United States Patent 7,655,785 (BIOINFORMATICALLY DETECTABLE GROUP OF NOVEL REGULATORY OLIGONUCLEOTIDES AND USES THEREOF) - sequence listing, part 2

SEQ ID NO: 36692 - RNA, 22 nt, Homo sapiens
caaaccuguaggggccaagagg

SEQ ID NO: 36693 - RNA, 22 nt, Homo sapiens
caacacagugaaacccgucucu

SEQ ID NO: 36694 - RNA, 22 nt, Homo sapiens
caacauccaccuccuggguuca

SEQ ID NO: 36695 - RNA, 22 nt, Homo sapiens
caccagcuggcauugaauaccu

SEQ ID NO: 36696 - RNA, 22 nt, Homo sapiens
caccuagacuggagugcagugg

SEQ ID NO: 36697 - RNA, 22 nt, Homo sapiens
caccuguacauggcaguguccu

SEQ ID NO: 36698 - RNA, 22 nt, Homo sapiens
cacucaguuugugguacuuugu

SEQ ID NO: 36699 - RNA, 22 nt, Homo sapiens
cacugcacuccagucccgucuc

SEQ ID NO: 36700 - RNA, 22 nt, Homo sapiens
cacugcacuccagucuggcgac

SEQ ID NO: 36701 - RNA, 22 nt, Homo sapiens
cacugcacucuucuucugggca

SEQ ID NO: 36702 - RNA, 21 nt, Homo sapiens
cacugcacuugccuucugggu

SEQ ID NO: 36703 - RNA, 22 nt, Homo sapiens
cacugcauuacucaugagcaug

SEQ ID NO: 36704 - RNA, 22 nt, Homo sapiens
cacuuugguucaccugaguuuc

SEQ ID NO: 36705 - RNA, 21 nt, Homo sapiens
caucaaauugucauggugggu

SEQ ID NO: 36706 - RNA, 22 nt, Homo sapiens
caucucauugaauugcugagca

SEQ ID NO: 36707 - RNA, 22 nt, Homo sapiens
caugcauuggucuauuauguga

SEQ ID NO: 36708 - RNA, 19 nt, Homo sapiens
cauugcacuccacccuggg

SEQ ID NO: 36709 - RNA, 22 nt, Homo sapiens
cauugcacuccagccuaggcaa

SEQ ID NO: 36710 - RNA, 22 nt, Homo sapiens
cauugcacuccagccugaggga

SEQ ID NO: 36711 - RNA, 20 nt, Homo sapiens
cauugcacuccagccugcug

SEQ ID NO: 36712 - RNA, 22 nt, Homo sapiens
cauugcacuccagccuggccaa

SEQ ID NO: 36713 - RNA, 22 nt, Homo sapiens
ccacagucuaugcaacaagguc

SEQ ID NO: 36714 - RNA, 22 nt, Homo sapiens
ccagaauucucauuggaaggaa

SEQ ID NO: 36715 - RNA, 22 nt, Homo sapiens
ccagauguuuucauucagcaag

SEQ ID NO: 36716 - RNA, 22 nt, Homo sapiens
ccaguucaaugauauggaaacu

SEQ ID NO: 36717 - RNA, 22 nt, Homo sapiens
ccaguuuuuggcaaugaugaau

SEQ ID NO: 36718 - RNA, 22 nt, Homo sapiens
ccaugaacuagaauagaacaug

SEQ ID NO: 36719 - RNA, 22 nt, Homo sapiens
ccauugcacuccauccugggca

SEQ ID NO: 36720 - RNA, 22 nt, Homo sapiens
cccagcguucggcauggcugag

SEQ ID NO: 36721 - RNA, 22 nt, Homo sapiens
ccuuuuuguaguggaaguagga

SEQ ID NO: 36722 - RNA, 16 nt, Homo sapiens
cuaaaaugucuacuug

SEQ ID NO: 36723 - RNA, 22 nt, Homo sapiens
cuaaucugugcauagaagaggc

SEQ ID NO: 36724 - RNA, 22 nt, Homo sapiens
cuagccuggagugcaguggugc

SEQ ID NO: 36725 - RNA, 22 nt, Homo sapiens
cucaaaugguccagcuaguggu

SEQ ID NO: 36726 - RNA, 22 nt, Homo sapiens
cucaaguagugguuuucauuga

SEQ ID NO: 36727 - RNA, 22 nt, Homo sapiens
cucacuaggaaguaaaguuugu

SEQ ID NO: 36728 - RNA, 22 nt, Homo sapiens
cucagcaguggauuuaccacca

SEQ ID NO: 36729 - RNA, 22 nt, Homo sapiens
cuccacugagcaggugggaggc

SEQ ID NO: 36730 - RNA, 23 nt, Homo sapiens
cucccugaacaugacacaccaga

SEQ ID NO: 36731 - RNA, 22 nt, Homo sapiens
cucugguuaaggcugaacuaua

SEQ ID NO: 36732 - RNA, 22 nt, Homo sapiens
cugagcaauauagugagaucuu

SEQ ID NO: 36733 - RNA, 22 nt, Homo sapiens
cugagcaucauggcagaaucuu

SEQ ID NO: 36734 - RNA, 22 nt, Homo sapiens
cugaggugggaggauuggcuug

SEQ ID NO: 36735 - RNA, 22 nt, Homo sapiens
cuggagaucuugacauugaagu

SEQ ID NO: 36736 - RNA, 22 nt, Homo sapiens
cuggcaagagugaaccagcugu

SEQ ID NO: 36737 - RNA, 22 nt, Homo sapiens
cuggcgagacagcuccaucacu

SEQ ID NO: 36738 - RNA, 22 nt, Homo sapiens
cuggcucuguuagaagaaccag

SEQ ID NO: 36739 - RNA, 22 nt, Homo sapiens
cugguuguuacaugcuugccag

SEQ ID NO: 36740 - RNA, 22 nt, Homo sapiens
cugguuguucuggaugggcagg

SEQ ID NO: 36741 - RNA, 22 nt, Homo sapiens
cuguaaaguucucauuguagcc

SEQ ID NO: 36742 - RNA, 22 nt, Homo sapiens
cugucuguuucaaaagugguua

SEQ ID NO: 36743 - RNA, 22 nt, Homo sapiens
cuuaacagugguauugaugacc

SEQ ID NO: 36744 - RNA, 22 nt, Homo sapiens
cuuagguuaugauaaauuuagu

SEQ ID NO: 36745 - RNA, 22 nt, Homo sapiens
cuucuugcuguguccucacaug

SEQ ID NO: 36746 - RNA, 22 nt, Homo sapiens
cuuucugaggagaauagagaac

SEQ ID NO: 36747 - RNA, 22 nt, Homo sapiens
cuuuggagaaaaguucuugggc

SEQ ID NO: 36748 - RNA, 22 nt, Homo sapiens
cuuugguuaauaggauauggca

SEQ ID NO: 36749 - RNA, 22 nt, Homo sapiens
gaaagauuuuaacugggagacu

SEQ ID NO: 36750 - RNA, 22 nt, Homo sapiens
gaaagugcugcaaggccaugca

SEQ ID NO: 36751 - RNA, 22 nt, Homo sapiens
gaagaacuaggugagaucuaga

SEQ ID NO: 36752 - RNA, 22 nt, Homo sapiens
gaagcagcauucugguuuuugg

SEQ ID NO: 36753 - RNA, 22 nt, Homo sapiens
gaauguuuacuuuguuuaauac

SEQ ID NO: 36754 - RNA, 22 nt, Homo sapiens
gaccugagagguacauguauuu

SEQ ID NO: 36755 - RNA, 22 nt, Homo sapiens
gagaucauugugggccaagcug

SEQ ID NO: 36756 - RNA, 22 nt, Homo sapiens
gagauuauuuaaaaggugauuu

SEQ ID NO: 36757 - RNA, 22 nt, Homo sapiens
gagcugaucuuuauguaaauuc

SEQ ID NO: 36758 - RNA, 22 nt, Homo sapiens
gagguagguacaauugccacca

SEQ ID NO: 36759 - RNA, 22 nt, Homo sapiens
gaguauguauaugagugugucu

SEQ ID NO: 36760 - RNA, 21 nt, Homo sapiens
gauaucuuuauucccaagagc

SEQ ID NO: 36761 - RNA, 23 nt, Homo sapiens
gcaaauaucguagagugucccug

SEQ ID NO: 36762 - RNA, 22 nt, Homo sapiens
gcacauggccacuaggaauaaa

SEQ ID NO: 36763 - RNA, 22 nt, Homo sapiens
gcacccugucaaaauggaccaa

SEQ ID NO: 36764 - RNA, 22 nt, Homo sapiens
gcacugagagaagccccaagua

SEQ ID NO: 36765 - RNA, 22 nt, Homo sapiens
gcagcaucaaaucacacaagau

SEQ ID NO: 36766 - RNA, 22 nt, Homo sapiens
gcagucaucugaaggcuuaacu

SEQ ID NO: 36767 - RNA, 22 nt, Homo sapiens
gccauugcacuccagccuaggu

SEQ ID NO: 36768 - RNA, 22 nt, Homo sapiens
gccauugcacuccagccugagc

SEQ ID NO: 36769 - RNA, 22 nt, Homo sapiens
gcugauggugcaguucuagccu

SEQ ID NO: 36770 - RNA, 22 nt, Homo sapiens
gcugauguuggccucugggcuu

SEQ ID NO: 36771 - RNA, 22 nt, Homo sapiens
ggaauguuaaggcgcuguuggu

SEQ ID NO: 36772 - RNA, 22 nt, Homo sapiens
ggacauguauauauaugugugu

SEQ ID NO: 36773 - RNA, 22 nt, Homo sapiens
ggaggcuaguaaaaagguagaa

SEQ ID NO: 36774 - RNA, 22 nt, Homo sapiens
ggcaaggugaugaaugucuaca

SEQ ID NO: 36775 - RNA, 22 nt, Homo sapiens
ggcacuguggcucaagccugua

SEQ ID NO: 36776 - RNA, 22 nt, Homo sapiens
ggcaguuuguuugugaggucca

SEQ ID NO: 36777 - RNA, 22 nt, Homo sapiens
ggccuguaggguauugguaggg

SEQ ID NO: 36778 - RNA, 19 nt, Homo sapiens
ggcucagucaacugacugu

SEQ ID NO: 36779 - RNA, 22 nt, Homo sapiens
ggcucaguuuccuccgucugcu

SEQ ID NO: 36780 - RNA, 22 nt, Homo sapiens
gggaagugugcagaguucucuu

SEQ ID NO: 36781 - RNA, 22 nt, Homo sapiens
gggcaugauggugcacacaugu

SEQ ID NO: 36782 - RNA, 23 nt, Homo sapiens
ucaugaggccauucaaauccauu

SEQ ID NO: 36783 - RNA, 22 nt, Homo sapiens
uccaugaguccauuagaaaaaa

SEQ ID NO: 36784 - RNA, 22 nt, Homo sapiens
ucccacugucuucucgugcucg

SEQ ID NO: 36785 - RNA, 22 nt, Homo sapiens
uccucugaacuccagacccaua

SEQ ID NO: 36786 - RNA, 22 nt, Homo sapiens
caacagucagcccauccacaga

SEQ ID NO: 36787 - RNA, 22 nt, Homo sapiens
caagugaauaguugcucucaga

SEQ ID NO: 36788 - RNA, 22 nt, Homo sapiens
caauacuguguugaauaagagu

SEQ ID NO: 36789 - RNA, 22 nt, Homo sapiens
cacagcacaggcaugaguguca

SEQ ID NO: 36790 - RNA, 22 nt, Homo sapiens
cacaggucauccuggaucaagg

SEQ ID NO: 36791 - RNA, 22 nt, Homo sapiens
caccacauuccauugaucaggc

SEQ ID NO: 36792 - RNA, 22 nt, Homo sapiens
cacuaggcuggagugcaguggc

SEQ ID NO: 36793 - RNA, 22 nt, Homo sapiens
cacugcaguggaagauuaagaa

SEQ ID NO: 36794 - RNA, 22 nt, Homo sapiens
cacugcaguguaauuaagguug

SEQ ID NO: 36795 - RNA, 22 nt, Homo sapiens
cacugcauggucuagcuggguu

SEQ ID NO: 36796 - RNA, 22 nt, Homo sapiens
cacuggucucauggcaugagag

SEQ ID NO: 36797 - RNA, 22 nt, Homo sapiens
cagagugcauguuuagaugagu

SEQ ID NO: 36798 - RNA, 22 nt, Homo sapiens
cagaucaucuugagcuuaggaa

SEQ ID NO: 36799 - RNA, 22 nt, Homo sapiens
cagcgaggucugcgucacauug

SEQ ID NO: 36800 - RNA, 22 nt, Homo sapiens
cagcugaugucgaaugcacucu

SEQ ID NO: 36801 - RNA, 22 nt, Homo sapiens
cagcuggugcugcaccaguggg

SEQ ID NO: 36802 - RNA, 22 nt, Homo sapiens
caguacaauguggaaaaggagu

SEQ ID NO: 36803 - RNA, 21 nt, Homo sapiens
gugugcuugagugaugggauu

SEQ ID NO: 36804 - RNA, 22 nt, Homo sapiens
guguuauugagaaauagggugu

SEQ ID NO: 36805 - RNA, 22 nt, Homo sapiens
guuaugcagcaauugauaaucu

SEQ ID NO: 36806 - RNA, 22 nt, Homo sapiens
guuaugcagcuuagaaaaugaa

SEQ ID NO: 36807 - RNA, 22 nt, Homo sapiens
guuauggaguauaugugaacug

SEQ ID NO: 36808 - RNA, 22 nt, Homo sapiens
guuauguuauguuauguuaugu

SEQ ID NO: 36809 - RNA, 22 nt, Homo sapiens
guuauuguccauuuauuuagca

SEQ ID NO: 36810 - RNA, 22 nt, Homo sapiens
guuuaggaaugagaauauuuag

SEQ ID NO: 36811 - RNA, 22 nt, Homo sapiens
uaaagcuacaguauaugguauu

SEQ ID NO: 36812 - RNA, 22 nt, Homo sapiens
uaaagcuagagcuggaguggca

SEQ ID NO: 36813 - RNA, 22 nt, Homo sapiens
uaaagugaggauggcaguaggu

SEQ ID NO: 36814 - RNA, 22 nt, Homo sapiens
uaacccugaggggcuuggggac

SEQ ID NO: 36815 - RNA, 22 nt, Homo sapiens
uaacgcuaguaucaccaggcua

SEQ ID NO: 36816 - RNA, 22 nt, Homo sapiens
uaacuagaaaggagacaguugc

SEQ ID NO: 36817 - RNA, 22 nt, Homo sapiens
uaacuauagagaauguugagua

SEQ ID NO: 36818 - RNA, 22 nt, Homo sapiens
uaaguagaggaaucauuuugug

SEQ ID NO: 36819 - RNA, 22 nt, Homo sapiens
uaagugaauguuggcuacugaa

SEQ ID NO: 36820 - RNA, 22 nt, Homo sapiens
uaagugcaacauaaguguuaaa

SEQ ID NO: 36821 - RNA, 22 nt, Homo sapiens
uaagugcaugauuacaugcaua

SEQ ID NO: 36822 - RNA, 22 nt, Homo sapiens
uaauaauguuaggcuuacucaa

SEQ ID NO: 36823 - RNA, 22 nt, Homo sapiens
uaauagagucauuauuauuguu

SEQ ID NO: 36824 - RNA, 22 nt, Homo sapiens
uaauauguuuugaaaucaggaa

SEQ ID NO: 36825 - RNA, 22 nt, Homo sapiens
uaaugcacauuuauuuuaccuu

SEQ ID NO: 36826 - RNA, 22 nt, Homo sapiens
uacaaguaauaagggaagaauu

SEQ ID NO: 36827 - RNA, 22 nt, Homo sapiens
uacaaguauuuuuauuagugcc

SEQ ID NO: 36828 - RNA, 22 nt, Homo sapiens
uacagaguauccauuugaguuc

SEQ ID NO: 36829 - RNA, 20 nt, Homo sapiens
uacaggacugagaaucugug

SEQ ID NO: 36830 - RNA, 22 nt, Homo sapiens
uacagguauagauguguguucu

SEQ ID NO: 36831 - RNA, 22 nt, Homo sapiens
uacaggugcucuacagacagga

SEQ ID NO: 36832 - RNA, 22 nt, Homo sapiens
uacaguaggauuuucagggucu

SEQ ID NO: 36833 - RNA, 22 nt, Homo sapiens
uaccacugccgagaaaacagau

SEQ ID NO: 36834 - RNA, 22 nt, Homo sapiens
uaccaguaaugguucuagagga

SEQ ID NO: 36835 - RNA, 19 nt, Homo sapiens
uacccagaagcagcauugu

SEQ ID NO: 36836 - RNA, 22 nt, Homo sapiens
uaccucagccaaugcccagaag

SEQ ID NO: 36837 - RNA, 22 nt, Homo sapiens
uacugcuuaaaagucaauuacu

SEQ ID NO: 36838 - RNA, 22 nt, Homo sapiens
uacuguguaguuagaccucaga

SEQ ID NO: 36839 - RNA, 18 nt, Homo sapiens
uagaauauaggucauucu

SEQ ID NO: 36840 - RNA, 22 nt, Homo sapiens
uagaaucuaacucgcaugaaaa

SEQ ID NO: 36841 - RNA, 22 nt, Homo sapiens
uagaggaaugaauuuggccaga

SEQ ID NO: 36842 - RNA, 21 nt, Homo sapiens
uagauacuguauuaaaccuag

SEQ ID NO: 36843 - RNA, 22 nt, Homo sapiens
uagaucauauacuugccaugac

SEQ ID NO: 36844 - RNA, 23 nt, Homo sapiens
uagaucaucaaguuuacugugcu

SEQ ID NO: 36845 - RNA, 20 nt, Homo sapiens
uagcacaucuggcuguagag

SEQ ID NO: 36846 - RNA, 23 nt, Homo sapiens
uagcacuuuuuacauauggacau

SEQ ID NO: 36847 - RNA, 22 nt, Homo sapiens
uagcagcaaagcaggaucugcu

SEQ ID NO: 36848 - RNA, 22 nt, Homo sapiens
uagcagcauaaauggacuaaga

SEQ ID NO: 36849 - RNA, 22 nt, Homo sapiens
aaaggauucuaauggaaaugcu

SEQ ID NO: 36850 - RNA, 22 nt, Homo sapiens
aaagugcaguacuucguauauu

SEQ ID NO: 36851 - RNA, 22 nt, Homo sapiens
cugagcuagaccacuuggcucc

SEQ ID NO: 36852 - RNA, 22 nt, Homo sapiens
cugagcuaugccuggaaaggca

SEQ ID NO: 36853 - RNA, 22 nt, Homo sapiens
cugccuagaucugaaccuggcu

SEQ ID NO: 36854 - RNA, 22 nt, Homo sapiens
cuggaaagaaacccuuaauucu

SEQ ID NO: 36855 - RNA, 22 nt, Homo sapiens
cuggagauuaaccaauugccau

SEQ ID NO: 36856 - RNA, 18 nt, Homo sapiens
cuggaugucgaguguguu

SEQ ID NO: 36857 - RNA, 22 nt, Homo sapiens
cuggcaaaaagagggcaauaau

SEQ ID NO: 36858 - RNA, 22 nt, Homo sapiens
cuggcaagagugaaccagcugu

SEQ ID NO: 36859 - RNA, 22 nt, Homo sapiens
cugguuuguaaaguuccugaga

SEQ ID NO: 36860 - RNA, 22 nt, Homo sapiens
cuguaugugagaaauaauaagu

SEQ ID NO: 36861 - RNA, 22 nt, Homo sapiens
cugugguugagcuuugccauga

SEQ ID NO: 36862 - RNA, 20 nt, Homo sapiens
cuugaagacuaugcugcuga

SEQ ID NO: 36863 - RNA, 22 nt, Homo sapiens
cuugaccuauggaucuguuuuu

SEQ ID NO: 36864 - RNA, 22 nt, Homo sapiens
cuuggauuauaauggaauauuu

SEQ ID NO: 36865 - RNA, 22 nt, Homo sapiens
cuuggcacgugauagguguuga

SEQ ID NO: 36866 - RNA, 22 nt, Homo sapiens
cuuuacaguuggacucacgagg

SEQ ID NO: 36867 - RNA, 22 nt, Homo sapiens
gaaaauccauccccagggagua

SEQ ID NO: 36868 - RNA, 22 nt, Homo sapiens
gaaacugcauuucuaacaagcu

SEQ ID NO: 36869 - RNA, 22 nt, Homo sapiens
gaaagacuuucugcuguggaua

SEQ ID NO: 36870 - RNA, 22 nt, Homo sapiens
gaaagcuaaugacuuuggguga

SEQ ID NO: 36871 - RNA, 22 nt, Homo sapiens
gaaaguaauuaacgauuguugc

SEQ ID NO: 36872 - RNA, 22 nt, Homo sapiens
gaaaucucuacuauuuugaucu

SEQ ID NO: 36873 - RNA, 22 nt, Homo sapiens
gaaauguuuuucaugugggcaa

SEQ ID NO: 36874 - RNA, 22 nt, Homo sapiens
gaacuguuucuggugaaagagu

SEQ ID NO: 36875 - RNA, 22 nt, Homo sapiens
gaauacuguccaagagugaugg

SEQ ID NO: 36876 - RNA, 22 nt, Homo sapiens
gaaucaauugaucuaugugucu

SEQ ID NO: 36877 - RNA, 22 nt, Homo sapiens
gacagugagaugucaugugaaa

SEQ ID NO: 36878 - RNA, 22 nt, Homo sapiens
gacccucuagauggaagcacug

SEQ ID NO: 36879 - RNA, 17 nt, Homo sapiens
gacgaucaucaggaggc

SEQ ID NO: 36880 - RNA, 22 nt, Homo sapiens
gacuagauauuguucuauguca

SEQ ID NO: 36881 - RNA, 22 nt, Homo sapiens
gacuauguuaccuuacacauca

SEQ ID NO: 36882 - RNA, 22 nt, Homo sapiens
gacucagaacuaaggguguuuc

SEQ ID NO: 36883 - RNA, 22 nt, Homo sapiens
gagauacacccagugcagaggc

SEQ ID NO: 36884 - RNA, 22 nt, Homo sapiens
gagaucauguacuagaacaccu

SEQ ID NO: 36885 - RNA, 22 nt, Homo sapiens
gagauucuucaauauuuauucu

SEQ ID NO: 36886 - RNA, 22 nt, Homo sapiens
gagcaacaguggcagugguggg

SEQ ID NO: 36887 - RNA, 22 nt, Homo sapiens
gagcucaccuuaccucuggagc

SEQ ID NO: 36888 - RNA, 22 nt, Homo sapiens
gagcugaucuuuauguaaauuc

SEQ ID NO: 36889 - RNA, 22 nt, Homo sapiens
gaggcauuauucccaucuuaca

SEQ ID NO: 36890 - RNA, 22 nt, Homo sapiens
gagguacgaaauacacuguacu

SEQ ID NO: 36891 - RNA, 22 nt, Homo sapiens
gaggugaaggucucaauaaaua

SEQ ID NO: 36892 - RNA, 22 nt, Homo sapiens
gagguggauacauuaaauaaug

SEQ ID NO: 36893 - RNA, 22 nt, Homo sapiens
gaggugguagguucacagcagc

SEQ ID NO: 36894 - RNA, 22 nt, Homo sapiens
gauauguaaaaauuauaucuga

SEQ ID NO: 36895 - RNA, 22 nt, Homo sapiens
gcaccaugguagaauaauggua

SEQ ID NO: 36896 - RNA, 22 nt, Homo sapiens
gcagugugaucacagcuuacug

SEQ ID NO: 36897 - RNA, 20 nt, Homo sapiens
gcaugagucuuuauaguaga

SEQ ID NO: 36898 - RNA, 22 nt, Homo sapiens
gcuaggagauccacugcucucu

SEQ ID NO: 36899 - RNA, 22 nt, Homo sapiens
gcugagguucaagaagguuaaa

SEQ ID NO: 36900 - RNA, 22 nt, Homo sapiens
uguuauuuuguguuagggcaca

SEQ ID NO: 36901 - RNA, 22 nt, Homo sapiens
uuaaagccauaccugagagagu

SEQ ID NO: 36902 - RNA, 22 nt, Homo sapiens
uuaagcaguaguuaaggagagg

SEQ ID NO: 36903 - RNA, 22 nt, Homo sapiens
uuaaguuaggcuucagcagucu

SEQ ID NO: 36904 - RNA, 22 nt, Homo sapiens
uuacaaccucagcagugcaaag

SEQ ID NO: 36905 - RNA, 22 nt, Homo sapiens
uuacaaguggcaucucucugga

SEQ ID NO: 36906 - RNA, 22 nt, Homo sapiens
uuacaguauugcaaggacuagg

SEQ ID NO: 36907 - RNA, 22 nt, Homo sapiens
uuacuagaaacagggcuucgcc

SEQ ID NO: 36908 - RNA, 22 nt, Homo sapiens
uuacugcauaauuccugggaag

SEQ ID NO: 36909 - RNA, 22 nt, Homo sapiens
uuagccccuuugagccucaacu

SEQ ID NO: 36910 - RNA, 18 nt, Homo sapiens
uuagguaggucuuugugu

SEQ ID NO: 36911 - RNA, 22 nt, Homo sapiens
uuaguugcauucaugugagagu

SEQ ID NO: 36912 - RNA, 22 nt, Homo sapiens
uuauagacacguuguaacaaac

SEQ ID NO: 36913 - RNA, 22 nt, Homo sapiens
uuauagcuaacaucugugaaaa

SEQ ID NO: 36914 - RNA, 22 nt, Homo sapiens
uuauauguuacucccucuagca

SEQ ID NO: 36915 - RNA, 22 nt, Homo sapiens
uuaucauagugcaguuuucuga

SEQ ID NO: 36916 - RNA, 23 nt, Homo sapiens
uuauggcuuuuauuauguugagg

SEQ ID NO: 36917 - RNA, 22 nt, Homo sapiens
uuauguguuuaauguuucugaa

SEQ ID NO: 36918 - RNA, 22 nt, Homo sapiens
uuauucauuaauugcuaagguu

SEQ ID NO: 36919 - RNA, 22 nt, Homo sapiens
uuauugcacuccagccugggua

SEQ ID NO: 36920 - RNA, 17 nt, Homo sapiens
uuauugcuauaagcuga

SEQ ID NO: 36921 - RNA, 22 nt, Homo sapiens
uucaaaaccucugcuuaagccc

SEQ ID NO: 36922 - RNA, 22 nt, Homo sapiens
uucaccaguuuugucacgaaug

SEQ ID NO: 36923 - RNA, 22 nt, Homo sapiens
uucacugcacuccagccugagc

SEQ ID NO: 36924 - RNA, 22 nt, Homo sapiens
uucacugugaacucauauucag

SEQ ID NO: 36925 - RNA, 22 nt, Homo sapiens
uucagcaguggccaguggaaau

SEQ ID NO: 36926 - RNA, 22 nt, Homo sapiens
uucaggcaccauggucauugau

SEQ ID NO: 36927 - RNA, 22 nt, Homo sapiens
aaagugcaguauuugggcagga

SEQ ID NO: 36928 - RNA, 22 nt, Homo sapiens
aaagugcugagacagacuggga

SEQ ID NO: 36929 - RNA, 22 nt, Homo sapiens
aaagugcugggauuuuaggcau

SEQ ID NO: 36930 - RNA, 22 nt, Homo sapiens
aaagugcuuacuaaguugccaa

SEQ ID NO: 36931 - RNA, 22 nt, Homo sapiens
aaagugcuucucuuuggugggu

SEQ ID NO: 36932 - RNA, 22 nt, Homo sapiens
aaauggcaccggcucuucccuc

SEQ ID NO: 36933 - RNA, 22 nt, Homo sapiens
aaaugucauggaguguuucccc

SEQ ID NO: 36934 - RNA, 22 nt, Homo sapiens
aacagugcuucauucacacauu

SEQ ID NO: 36935 - RNA, 22 nt, Homo sapiens
aaccuguaaccauaugaucagu

SEQ ID NO: 36936 - RNA, 22 nt, Homo sapiens
aacugcacauauuuguaugggu

SEQ ID NO: 36937 - RNA, 22 nt, Homo sapiens
aagagguuguaccuaaaguguu

SEQ ID NO: 36938 - RNA, 22 nt, Homo sapiens
aagaucauucagggaaggcuga

SEQ ID NO: 36939 - RNA, 22 nt, Homo sapiens
aagcuacauuuuauuuauguca

SEQ ID NO: 36940 - RNA, 22 nt, Homo sapiens
aaggcuuuuugcugacguccuu

SEQ ID NO: 36941 - RNA, 22 nt, Homo sapiens
aaguccccugacagaggggagg

SEQ ID NO: 36942 - RNA, 20 nt, Homo sapiens
aagugcaucguugugucugc

SEQ ID NO: 36943 - RNA, 22 nt, Homo sapiens
aagugcucuugugggaagagag

SEQ ID NO: 36944 - RNA, 22 nt, Homo sapiens
aaguuaauguuuaagacuccua

SEQ ID NO: 36945 - RNA, 21 nt, Homo sapiens
aauacucuagguuaagagagc

SEQ ID NO: 36946 - RNA, 22 nt, Homo sapiens
aauaugucuugaaauuggguaa

SEQ ID NO: 36947 - RNA, 22 nt, Homo sapiens
aaucaacauuguuuuaagucaa

SEQ ID NO: 36948 - RNA, 22 nt, Homo sapiens
aaucagagcccucugagcuuca

SEQ ID NO: 36949 - RNA, 17 nt, Homo sapiens
aaucagauuucugagga

SEQ ID NO: 36950 - RNA, 16 nt, Homo sapiens
aauccauuggcccugc

SEQ ID NO: 36951 - RNA, 22 nt, Homo sapiens
aaucugucuagacaaggagucu

SEQ ID NO: 36952 - RNA, 22 nt, Homo sapiens
aaugugcuguucagaggagucc

SEQ ID NO: 36953 - RNA, 22 nt, Homo sapiens
aauuaguuggcugccuaugauu

SEQ ID NO: 36954 - RNA, 22 nt, Homo sapiens
aauuguacucccauaauucccu

SEQ ID NO: 36955 - RNA, 22 nt, Homo sapiens
acaagcacaaaugcauagaugg

SEQ ID NO: 36956 - RNA, 22 nt, Homo sapiens
acaagcacaaauuuaauccugu

SEQ ID NO: 36957 - RNA, 22 nt, Homo sapiens
acacauuggcaauucuggagca

SEQ ID NO: 36958 - RNA, 22 nt, Homo sapiens
acagaaccauucacuccccugg

SEQ ID NO: 36959 - RNA, 22 nt, Homo sapiens
acagaccuauuucaaucauuua

SEQ ID NO: 36960 - RNA, 22 nt, Homo sapiens
acagauugcugggccccagccc

SEQ ID NO: 36961 - RNA, 22 nt, Homo sapiens
acagccauuccagccaaauacu

SEQ ID NO: 36962 - RNA, 22 nt, Homo sapiens
acaguacuuuuggauuugugaa

SEQ ID NO: 36963 - RNA, 21 nt, Homo sapiens
acaguaguaauaguguagcca

SEQ ID NO: 36964 - RNA, 22 nt, Homo sapiens
acaguaugcuuuaaacuuuguu

SEQ ID NO: 36965 - RNA, 18 nt, Homo sapiens
acagugcuggcaugagau

SEQ ID NO: 36966 - RNA, 19 nt, Homo sapiens
acagugcuuugucagaagc

SEQ ID NO: 36967 - RNA, 22 nt, Homo sapiens
acaucccuuucccacccuucac

SEQ ID NO: 36968 - RNA, 19 nt, Homo sapiens
acauugcauuuguaggcuu

SEQ ID NO: 36969 - RNA, 22 nt, Homo sapiens
accaccacucccgcauucuaaa

SEQ ID NO: 36970 - RNA, 19 nt, Homo sapiens
accagauugcauucuugga

SEQ ID NO: 36971 - RNA, 22 nt, Homo sapiens
acccaguguucaacauucacau

SEQ ID NO: 36972 - RNA, 22 nt, Homo sapiens
acccaguguucagacuaccugu

SEQ ID NO: 36973 - RNA, 22 nt, Homo sapiens
acccuacauaguagauccuaca

SEQ ID NO: 36974 - RNA, 22 nt, Homo sapiens
acccugucaaaauagaccaauc

SEQ ID NO: 36975 - RNA, 22 nt, Homo sapiens
acccugucagcuggccugggca

SEQ ID NO: 36976 - RNA, 19 nt, Homo sapiens
acccuguccccaccuuuac

SEQ ID NO: 36977 - RNA, 22 nt, Homo sapiens
acccuuuagguuggaugaggau

SEQ ID NO: 36978 - RNA, 22 nt, Homo sapiens
acuccauuuccagagcagcccc

SEQ ID NO: 36979 - RNA, 22 nt, Homo sapiens
acucuguauaaacauugcugua

SEQ ID NO: 36980 - RNA, 22 nt, Homo sapiens
auggagcuugacaguuguagag

SEQ ID NO: 36981 - RNA, 22 nt, Homo sapiens
auggcaaaauguuccuaguggu

SEQ ID NO: 36982 - RNA, 22 nt, Homo sapiens
auggcuagaaccuguauauuca

SEQ ID NO: 36983 - RNA, 22 nt, Homo sapiens
auggcuuuugcccuaaauggau

SEQ ID NO: 36984 - RNA, 20 nt, Homo sapiens
augguaguagcaccuuuaca

SEQ ID NO: 36985 - RNA, 22 nt, Homo sapiens
augugacugauggagaauaugu

SEQ ID NO: 36986 - RNA, 22 nt, Homo sapiens
augugcagauguuacaaauugu

SEQ ID NO: 36987 - RNA, 22 nt, Homo sapiens
augugcuugagggaaaucaguu

SEQ ID NO: 36988 - RNA, 18 nt, Homo sapiens
auguuauguuuguagaag

SEQ ID NO: 36989 - RNA, 22 nt, Homo sapiens
auguuugguaagaauauuguua

SEQ ID NO: 36990 - RNA, 22 nt, Homo sapiens
auuagaugguuauaggugugag

SEQ ID NO: 36991 - RNA, 22 nt, Homo sapiens
auucaagggauuucaggaggcu

SEQ ID NO: 36992 - RNA, 22 nt, Homo sapiens
auucacagggggagaaggguau

SEQ ID NO: 36993 - RNA, 23 nt, Homo sapiens
auuccaguggcaauuggagaaac

SEQ ID NO: 36994 - RNA, 18 nt, Homo sapiens
auucuacaggccuuuuga

SEQ ID NO: 36995 - RNA, 22 nt, Homo sapiens
auugcaaugggaaacuaugaaa

SEQ ID NO: 36996 - RNA, 22 nt, Homo sapiens
auugcaauuaguccauagaguu

SEQ ID NO: 36997 - RNA, 21 nt, Homo sapiens
auugcacaauauacccaugua

SEQ ID NO: 36998 - RNA, 22 nt, Homo sapiens
auugcacacagaaucaggguaa

SEQ ID NO: 36999 - RNA, 22 nt, Homo sapiens
auugcacuccagccuugugaca

SEQ ID NO: 37000 - RNA, 22 nt, Homo sapiens
auugcauaaacacauuucuuau

SEQ ID NO: 37001 - RNA, 22 nt, Homo sapiens
auugcuaacugaaauaagacca

SEQ ID NO: 37002 - RNA, 22 nt, Homo sapiens
auugcuuaagucccuguauuag

SEQ ID NO: 37003 - RNA, 22 nt, Homo sapiens
auuggcuuuauacauaagaaua

SEQ ID NO: 37004 - RNA, 22 nt, Homo sapiens
auuguacuccagccuaggcaac

SEQ ID NO: 37005 - RNA, 22 nt, Homo sapiens
auuguacuccagccugggcaaa

SEQ ID NO: 37006 - RNA, 22 nt, Homo sapiens
auuguacugccccccuguugcu

SEQ ID NO: 37007 - RNA, 20 nt, Homo sapiens
auuuggcauaguuuaagcaa

SEQ ID NO: 37008 - RNA, 22 nt, Homo sapiens
caaagcuauagcaccagaggga

SEQ ID NO: 37009 - RNA, 22 nt, Homo sapiens
caaaguaauuacgguuuuggcc

SEQ ID NO: 37010 - RNA, 22 nt, Homo sapiens
caaagucuucaguugauucuga

SEQ ID NO: 37011 - RNA, 22 nt, Homo sapiens
caaagugcugggacuggccggg

SEQ ID NO: 37012 - RNA, 22 nt, Homo sapiens
caaauugcuugucuguagugga

SEQ ID NO: 37013 - RNA, 19 nt, Homo sapiens
caacccugcagagaaagga

SEQ ID NO: 37014 - RNA, 23 nt, Homo sapiens
caauacugaccucacguuaauag

SEQ ID NO: 37015 - RNA, 22 nt, Homo sapiens
cacauugcaggaaaguucauua

SEQ ID NO: 37016 - RNA, 22 nt, Homo sapiens
caccacagccauuauugucccc

SEQ ID NO: 37017 - RNA, 22 nt, Homo sapiens
cacucaguuugugguacuuugu

SEQ ID NO: 37018 - RNA, 22 nt, Homo sapiens
cacugcacuccagccuaagagg

SEQ ID NO: 37019 - RNA, 20 nt, Homo sapiens
cagagcaaagcaguccuggc

SEQ ID NO: 37020 - RNA, 20 nt, Homo sapiens
cagggcaaugaggagguaaa

SEQ ID NO: 37021 - RNA, 22 nt, Homo sapiens
cagguaagaugcuuucucuuau

SEQ ID NO: 37022 - RNA, 22 nt, Homo sapiens
caguagcaugccucagaaugag

SEQ ID NO: 37023 - RNA, 22 nt, Homo sapiens
cauagcacugagcucuacccuc

SEQ ID NO: 37024 - RNA, 23 nt, Homo sapiens
caucacauagaggaaagaggaca

SEQ ID NO: 37025 - RNA, 22 nt, Homo sapiens
caucccugaaccccagaaaucu

SEQ ID NO: 37026 - RNA, 22 nt, Homo sapiens
caugaugcuagguauggaugaa

SEQ ID NO: 37027 - RNA, 22 nt, Homo sapiens
caugcauuggucuauuauguga

SEQ ID NO: 37028 - RNA, 20 nt, Homo sapiens
cauuccacuuuccugucagu

SEQ ID NO: 37029 - RNA, 22 nt, Homo sapiens
cauugcacacauuuaccuaugu

SEQ ID NO: 37030 - RNA, 22 nt, Homo sapiens
ccaaaucucauguugaaaugug

SEQ ID NO: 37031 - RNA, 22 nt, Homo sapiens
ccaaggcacugauucuguacuc

SEQ ID NO: 37032 - RNA, 19 nt, Homo sapiens
ccacaaugguugaacuaga

SEQ ID NO: 37033 - RNA, 22 nt, Homo sapiens
ccagaguuucugauucagcagg

SEQ ID NO: 37034 - RNA, 22 nt, Homo sapiens
ccauacugucaaauagauuucc

SEQ ID NO: 37035 - RNA, 22 nt, Homo sapiens
cccugagaugugaauuucagag

SEQ ID NO: 37036 - RNA, 22 nt, Homo sapiens
cccuguagcagcauucuuaaau

SEQ ID NO: 37037 - RNA, 21 nt, Homo sapiens
ccugaugaccucugagaguua

SEQ ID NO: 37038 - RNA, 22 nt, Homo sapiens
ccuggguuacaggugugagcca

SEQ ID NO: 37039 - RNA, 22 nt, Homo sapiens
ccugucuugaagagauccuccu

SEQ ID NO: 37040 - RNA, 22 nt, Homo sapiens
ccuuuguuuaguugaauuguau

SEQ ID NO: 37041 - RNA, 22 nt, Homo sapiens
cuaaagauagugacaugauuug

SEQ ID NO: 37042 - RNA, 22 nt, Homo sapiens
cuaacuaugucucaggaugucc

SEQ ID NO: 37043 - RNA, 18 nt, Homo sapiens
cuaagacacuuggcagag

SEQ ID NO: 37044 - RNA, 22 nt, Homo sapiens
cuaaugcagucaggagaaggaa

SEQ ID NO: 37045 - RNA, 22 nt, Homo sapiens
cuacagaguaucuaaagaggua

SEQ ID NO: 37046 - RNA, 20 nt, Homo sapiens
cucacagacagcuucuuucu

SEQ ID NO: 37047 - RNA, 22 nt, Homo sapiens
cucagucuaugauacuuugcua

SEQ ID NO: 37048 - RNA, 22 nt, Homo sapiens
cucaguguucccauucuaccuu

SEQ ID NO: 37049 - RNA, 21 nt, Homo sapiens
cucauauugcuuuuccauggu

SEQ ID NO: 37050 - RNA, 22 nt, Homo sapiens
cucccagugacccaggaacagg

SEQ ID NO: 37051 - RNA, 22 nt, Homo sapiens
cucccauugcaaacaacagaag

SEQ ID NO: 37052 - RNA, 23 nt, Homo sapiens
cucccugaacaugacacaccaga

SEQ ID NO: 37053 - RNA, 22 nt, Homo sapiens
cucuuggguagauuuugcagag

SEQ ID NO: 37054 - RNA, 22 nt, Homo sapiens
cugaagugugaaagucuuuuuu

SEQ ID NO: 37055 - RNA, 22 nt, Homo sapiens
cugagaagaaacagguaaggac

SEQ ID NO: 37056 - RNA, 22 nt, Homo sapiens
cugagaaugaugauuuccaguu

SEQ ID NO: 37057 - RNA, 22 nt, Homo sapiens
cugagcaauauagugagaucuu

SEQ ID NO: 37058 - RNA, 22 nt, Homo sapiens
ucuggguuuuguaccgugcucg

SEQ ID NO: 37059 - RNA, 22 nt, Homo sapiens
ucugguggugaugagagacagu

SEQ ID NO: 37060 - RNA, 22 nt, Homo sapiens
ucuguacugccaaguuucuuua

SEQ ID NO: 37061 - RNA, 22 nt, Homo sapiens
ucugucacugaaucccugucac

SEQ ID NO: 37062 - RNA, 22 nt, Homo sapiens
ucugugcauggcagaggaauga

SEQ ID NO: 37063 - RNA, 21 nt, Homo sapiens
ucuguguugaucucacuggga

SEQ ID NO: 37064 - RNA, 22 nt, Homo sapiens
ucuucaugcuugaaauaauagc

SEQ ID NO: 37065 - RNA, 22 nt, Homo sapiens
ucuuuaguuaagggacauuuua

SEQ ID NO: 37066 - RNA, 22 nt, Homo sapiens
ucuuugauguucugaaagaugg

SEQ ID NO: 37067 - RNA, 22 nt, Homo sapiens
ucuuuggucuacuuucauaugu

SEQ ID NO: 37068 - RNA, 22 nt, Homo sapiens
ugaaaagucuaagauuaagguu

SEQ ID NO: 37069 - RNA, 22 nt, Homo sapiens
ugaaacauacacucugaugggg

SEQ ID NO: 37070 - RNA, 22 nt, Homo sapiens
ugaaagguuuaauucugugaga

SEQ ID NO: 37071 - RNA, 22 nt, Homo sapiens
ugaaaucuuugaugguggcauu

SEQ ID NO: 37072 - RNA, 21 nt, Homo sapiens
ugaaccccugcucucaagaaa

SEQ ID NO: 37073 - RNA, 22 nt, Homo sapiens
ugaacucagcauccagggccaa

SEQ ID NO: 37074 - RNA, 22 nt, Homo sapiens
ugaagugaagacucacagaagg

SEQ ID NO: 37075 - RNA, 22 nt, Homo sapiens
ugaauacagcacacccaugggu

SEQ ID NO: 37076 - RNA, 22 nt, Homo sapiens
ugaauacugugcaaaggauuug

SEQ ID NO: 37077 - RNA, 22 nt, Homo sapiens
ugaauaggcaguuaaguuuaug

SEQ ID NO: 37078 - RNA, 22 nt, Homo sapiens
ugaaugcauggggccaagaagg

SEQ ID NO: 37079 - RNA, 17 nt, Homo sapiens
ugacagaaacuuguugu

SEQ ID NO: 37080 - RNA, 23 nt, Homo sapiens
ugacagucucccgauggcuaggc

SEQ ID NO: 37081 - RNA, 18 nt, Homo sapiens
ugacaguuucuuuauauu

SEQ ID NO: 37082 - RNA, 22 nt, Homo sapiens
ugacaugaagaaaaacagauuu

SEQ ID NO: 37083 - RNA, 22 nt, Homo sapiens
ugacaugaaggcaccucugucc

SEQ ID NO: 37084 - RNA, 22 nt, Homo sapiens
ugacauuacagucacuugcugu

SEQ ID NO: 37085 - RNA, 22 nt, Homo sapiens
ugacuagagacagaaacuaaaa

SEQ ID NO: 37086 - RNA, 22 nt, Homo sapiens
ugagaacucaugaaucuuucca

SEQ ID NO: 37087 - RNA, 22 nt, Homo sapiens
ugagaacuuugucuuuuacucu

SEQ ID NO: 37088 - RNA, 22 nt, Homo sapiens
ugagaagacaucagcuuucgga

SEQ ID NO: 37089 - RNA, 22 nt, Homo sapiens
ugagaagacaucuuugcuuugu

SEQ ID NO: 37090 - RNA, 22 nt, Homo sapiens
ugagacaucugagauuuuaagc

SEQ ID NO: 37091 - RNA, 22 nt, Homo sapiens
ugagagaugaacuauucuugaa

SEQ ID NO: 37092 - RNA, 22 nt, Homo sapiens
ugagagaugauaaaauguuugu

SEQ ID NO: 37093 - RNA, 22 nt, Homo sapiens
ugagauaacuaaaaacauuuug

SEQ ID NO: 37094 - RNA, 22 nt, Homo sapiens
ugagaucuuugcuguccucacc

SEQ ID NO: 37095 - RNA, 22 nt, Homo sapiens
ugagaugaagucucacucuguc

SEQ ID NO: 37096 - RNA, 22 nt, Homo sapiens
ugagaugacgacacaccucagu

SEQ ID NO: 37097 - RNA, 22 nt, Homo sapiens
ugagaugagggaagccuaggca

SEQ ID NO: 37098 - RNA, 22 nt, Homo sapiens
ugagaugaguugcuggcucuga

SEQ ID NO: 37099 - RNA, 22 nt, Homo sapiens
ugagaugaucaaaguauaggcu

SEQ ID NO: 37100 - RNA, 22 nt, Homo sapiens
ugagaugauuuaauggagccca

SEQ ID NO: 37101 - RNA, 22 nt, Homo sapiens
ugagauuaaucuuuaaguaaga

SEQ ID NO: 37102 - RNA, 23 nt, Homo sapiens
ugagauuacccagaaagaguaua

SEQ ID NO: 37103 - RNA, 19 nt, Homo sapiens
ugagauuguaugaggagau

SEQ ID NO: 37104 - RNA, 22 nt, Homo sapiens
aaaagagcugagagguauucuu

SEQ ID NO: 37105 - RNA, 15 nt, Homo sapiens
aaacccugucucaag

SEQ ID NO: 37106 - RNA, 22 nt, Homo sapiens
aaacugucuucugacaguuucc

SEQ ID NO: 37107 - RNA, 22 nt, Homo sapiens
aaacuugucuaauuauaagcau

SEQ ID NO: 37108 - RNA, 22 nt, Homo sapiens
aaagcacugaauaaauuugcuu

SEQ ID NO: 37109 - RNA, 22 nt, Homo sapiens
aaagcacuggagucaucaucua

SEQ ID NO: 37110 - RNA, 18 nt, Homo sapiens
aaagugaugucauucuuu

SEQ ID NO: 37111 - RNA, 22 nt, Homo sapiens
aaagugcugagaguucuaacuu

SEQ ID NO: 37112 - RNA, 22 nt, Homo sapiens
aaagugcugagauuguaggcau

SEQ ID NO: 37113 - RNA, 22 nt, Homo sapiens
aaagugcugagucuaggcgggg

SEQ ID NO: 37114 - RNA, 22 nt, Homo sapiens
aaagugcugggaucacacugaa

SEQ ID NO: 37115 - RNA, 22 nt, Homo sapiens
aaaugccucccauucuacugac

SEQ ID NO: 37116 - RNA, 22 nt, Homo sapiens
aaaugcugcuuuggccucuucu

SEQ ID NO: 37117 - RNA, 22 nt, Homo sapiens
aaauugcaguuaggaugauggu

SEQ ID NO: 37118 - RNA, 22 nt, Homo sapiens
aacacuguuuccagucaugauc

SEQ ID NO: 37119 - RNA, 22 nt, Homo sapiens
aacagagcuggugacuccaggu

SEQ ID NO: 37120 - RNA, 22 nt, Homo sapiens
aacaggcuccuaggggugcacc

SEQ ID NO: 37121 - RNA, 22 nt, Homo sapiens
auagcagacauuucaaggcagg

SEQ ID NO: 37122 - RNA, 22 nt, Homo sapiens
auaguauaguugaggauggcau

SEQ ID NO: 37123 - RNA, 22 nt, Homo sapiens
auauguauuuuaacguguaagg

SEQ ID NO: 37124 - RNA, 18 nt, Homo sapiens
auauugcauuggauggau

SEQ ID NO: 37125 - RNA, 22 nt, Homo sapiens
auauuguacugcuacugguucu

SEQ ID NO: 37126 - RNA, 22 nt, Homo sapiens
auauuugguuaccugugggucu

SEQ ID NO: 37127 - RNA, 20 nt, Homo sapiens
aucaaagacuuagaggggga

SEQ ID NO: 37128 - RNA, 22 nt, Homo sapiens
aucaaaguaggcauauguuuuu

SEQ ID NO: 37129 - RNA, 22 nt, Homo sapiens
aucaaagugaaauauuaguuau

SEQ ID NO: 37130 - RNA, 22 nt, Homo sapiens
aucaaagugaauuaaugagaau

SEQ ID NO: 37131 - RNA, 22 nt, Homo sapiens
aucaaguaaucugaguaagagu

SEQ ID NO: 37132 - RNA, 22 nt, Homo sapiens
aucacagagucacgggcaacuu

SEQ ID NO: 37133 - RNA, 22 nt, Homo sapiens
aucacauuuauaguggcacgca

SEQ ID NO: 37134 - RNA, 22 nt, Homo sapiens
aucagcaguguaaaaacggacu

SEQ ID NO: 37135 - RNA, 22 nt, Homo sapiens
aucagugaaagugaaaucuccg

SEQ ID NO: 37136 - RNA, 22 nt, Homo sapiens
aucagugagugguuagugaaug

SEQ ID NO: 37137 - RNA, 23 nt, Homo sapiens
auccacauucuaguccuuuaugc

SEQ ID NO: 37138 - RNA, 22 nt, Homo sapiens
aucccugagccugacucucaga

SEQ ID NO: 37139 - RNA, 22 nt, Homo sapiens
aucccugaggaauuucugcacu

SEQ ID NO: 37140 - RNA, 22 nt, Homo sapiens
auccugagacuuugcugaaguu

SEQ ID NO: 37141 - RNA, 22 nt, Homo sapiens
aucuacagccagucugguuugu

SEQ ID NO: 37142 - RNA, 22 nt, Homo sapiens
aucuagagaggcagucuggccg

SEQ ID NO: 37143 - RNA, 22 nt, Homo sapiens
aucucaguuaauuccaucuuuc

SEQ ID NO: 37144 - RNA, 22 nt, Homo sapiens
aucuccaggugccagcugcgcc

SEQ ID NO: 37145 - RNA, 22 nt, Homo sapiens
aucugcaaauaaugaagauugg

SEQ ID NO: 37146 - RNA, 22 nt, Homo sapiens
augaaaucuuuggcagaucuua

SEQ ID NO: 37147 - RNA, 22 nt, Homo sapiens
augaauccauuccugccacaga

SEQ ID NO: 37148 - RNA, 22 nt, Homo sapiens
augacagagauaugugaauuuu

SEQ ID NO: 37149 - RNA, 22 nt, Homo sapiens
augacauugaaaagcaagugga

SEQ ID NO: 37150 - RNA, 22 nt, Homo sapiens
augagcuguuuggaagacacuu

SEQ ID NO: 37151 - RNA, 22 nt, Homo sapiens
augaggacaucuuccuuaugga

SEQ ID NO: 37152 - RNA, 22 nt, Homo sapiens
augaguaguugcuaaauauuga

SEQ ID NO: 37153 - RNA, 18 nt, Homo sapiens
augagucauuguggaaau

SEQ ID NO: 37154 - RNA, 22 nt, Homo sapiens
augcaaacagcuaucuggcugg

SEQ ID NO: 37155 - RNA, 22 nt, Homo sapiens
augcacauggcuaacuuuuuuc

SEQ ID NO: 37156 - RNA, 22 nt, Homo sapiens
augccacagaaauaaccaaaau

SEQ ID NO: 37157 - RNA, 22 nt, Homo sapiens
augccacuguuuaugucacuua

SEQ ID NO: 37158 - RNA, 22 nt, Homo sapiens
augcuacuggauuuguauaaau

SEQ ID NO: 37159 - RNA, 22 nt, Homo sapiens
auggacucauugaauuaagucc

SEQ ID NO: 37160 - RNA, 22 nt, Homo sapiens
uaccucaguucaauaacagaua

SEQ ID NO: 37161 - RNA, 22 nt, Homo sapiens
uaccugagacaacuuugaggaa

SEQ ID NO: 37162 - RNA, 22 nt, Homo sapiens
uacguuaucagguaugcaagag

SEQ ID NO: 37163 - RNA, 22 nt, Homo sapiens
uacuagaggcgggguuucgcca

SEQ ID NO: 37164 - RNA, 22 nt, Homo sapiens
uacugcuuaagggcaugggccc

SEQ ID NO: 37165 - RNA, 22 nt, Homo sapiens
uagaacauuccaggugauguug

SEQ ID NO: 37166 - RNA, 22 nt, Homo sapiens
uagaagcuacucuucuuguggc

SEQ ID NO: 37167 - RNA, 22 nt, Homo sapiens
uagaaguaggcuacgugucugg

SEQ ID NO: 37168 - RNA, 22 nt, Homo sapiens
uagagcaugugccauacguaca

SEQ ID NO: 37169 - RNA, 22 nt, Homo sapiens
uagcacuauguuaucacauacu

SEQ ID NO: 37170 - RNA, 22 nt, Homo sapiens
uagcagccaggaagggcuggcu

SEQ ID NO: 37171 - RNA, 22 nt, Homo sapiens
uagcaguauugaaagaugaggg

SEQ ID NO: 37172 - RNA, 22 nt, Homo sapiens
uagcugaucuuuuaaagaauga

SEQ ID NO: 37173 - RNA, 20 nt, Homo sapiens
uagguuuucacagaauugcc

SEQ ID NO: 37174 - RNA, 22 nt, Homo sapiens
uaguugcauucaggauaugacg

SEQ ID NO: 37175 - RNA, 22 nt, Homo sapiens
uauaagacuagcagcugaauug

SEQ ID NO: 37176 - RNA, 22 nt, Homo sapiens
uauacuguuuucuauaguggcu

SEQ ID NO: 37177 - RNA, 22 nt, Homo sapiens
uauagcagugaguauugacuaa

SEQ ID NO: 37178 - RNA, 22 nt, Homo sapiens
uauaugcauugugggguacuga

SEQ ID NO: 37179 - RNA, 22 nt, Homo sapiens
uauaugcucugggauccugaaa

SEQ ID NO: 37180 - RNA, 22 nt, Homo sapiens
uauauguucugugucccuuucg

SEQ ID NO: 37181 - RNA, 22 nt, Homo sapiens
uaucacaguaaaucugggugca

SEQ ID NO: 37182 - RNA, 22 nt, Homo sapiens
uaucacccuuucauuguucuuc

SEQ ID NO: 37183 - RNA, 22 nt, Homo sapiens
uaucaguauggauucauggauu

SEQ ID NO: 37184 - RNA, 22 nt, Homo sapiens
uaucauaguuuggacuuucauu

SEQ ID NO: 37185 - RNA, 20 nt, Homo sapiens
uaugguuuuagguauagcau

SEQ ID NO: 37186 - RNA, 22 nt, Homo sapiens
uauuauagugauaggucuacug

SEQ ID NO: 37187 - RNA, 22 nt, Homo sapiens
uauugcaauuggggaaacuggg

SEQ ID NO: 37188 - RNA, 20 nt, Homo sapiens
uauugcacuccagucugggc

SEQ ID NO: 37189 - RNA, 22 nt, Homo sapiens
uauugcacuuuuccauaggagu

SEQ ID NO: 37190 - RNA, 22 nt, Homo sapiens
uauugcuuaugaugcugaauua

SEQ ID NO: 37191 - RNA, 22 nt, Homo sapiens
uauuguacauauccucccuuca

SEQ ID NO: 37192 - RNA, 22 nt, Homo sapiens
ucaaaugcacguagagaaaaua

SEQ ID NO: 37193 - RNA, 22 nt, Homo sapiens
ucaaaugcucuuugcagagagg

SEQ ID NO: 37194 - RNA, 22 nt, Homo sapiens
ucaaguacuuugcauagugccg

SEQ ID NO: 37195 - RNA, 22 nt, Homo sapiens
ucacauuguacaaacagguaag

SEQ ID NO: 37196 - RNA, 22 nt, Homo sapiens
ucacauuguuauguaaauguuu

SEQ ID NO: 37197 - RNA, 23 nt, Homo sapiens
ucacggagaccugcaagaccaau

SEQ ID NO: 37198 - RNA, 22 nt, Homo sapiens
ucacugcacuucaggcuuucuc

SEQ ID NO: 37199 - RNA, 22 nt, Homo sapiens
ucacugugagaguuuauccugu

SEQ ID NO: 37200 - RNA, 18 nt, Homo sapiens
ucagagugcagacuauac

SEQ ID NO: 37201 - RNA, 22 nt, Homo sapiens
ucagagugcagggaguagcagc

SEQ ID NO: 37202 - RNA, 22 nt, Homo sapiens
ucaggcacucagcuuagagucu

SEQ ID NO: 37203 - RNA, 20 nt, Homo sapiens
ucaguauauuguuuccacag

SEQ ID NO: 37204 - RNA, 22 nt, Homo sapiens
ucaguccccucgcugagucuac

SEQ ID NO: 37205 - RNA, 22 nt, Homo sapiens
ucagugauugguuauuuuaggc

SEQ ID NO: 37206 - RNA, 22 nt, Homo sapiens
ucaguggagcuacaauucuggg

SEQ ID NO: 37207 - RNA, 22 nt, Homo sapiens
ucaguguuuuauccuccagagc

SEQ ID NO: 37208 - RNA, 22 nt, Homo sapiens
ucauacaguaguccucacuugu

SEQ ID NO: 37209 - RNA, 22 nt, Homo sapiens
ucaucaguuuuuuauaugugau

SEQ ID NO: 37210 - RNA, 22 nt, Homo sapiens
ucauggggugcuuugcuagauu

SEQ ID NO: 37211 - RNA, 22 nt, Homo sapiens
ucauucauucauccagcuugag

SEQ ID NO: 37212 - RNA, 22 nt, Homo sapiens
ucauugcacuucuuuaguugca

SEQ ID NO: 37213 - RNA, 22 nt, Homo sapiens
ucauugcauguuaauuaaacag

SEQ ID NO: 37214 - RNA, 22 nt, Homo sapiens
ucauuggaugagaccccugucc

SEQ ID NO: 37215 - RNA, 22 nt, Homo sapiens
uccaaaucucuggcacugggau

SEQ ID NO: 37216 - RNA, 22 nt, Homo sapiens
uccaguggacagacauaccaug

SEQ ID NO: 37217 - RNA, 20 nt, Homo sapiens
uccaguuuuggagacauucu

SEQ ID NO: 37218 - RNA, 19 nt, Homo sapiens
ucccaagaugcucauacau

SEQ ID NO: 37219 - RNA, 22 nt, Homo sapiens
ucccaguguguagcuugucucu

SEQ ID NO: 37220 - RNA, 22 nt, Homo sapiens
ucccgaggacaucugggggcaa

SEQ ID NO: 37221 - RNA, 22 nt, Homo sapiens
ucccugagguccuggauuauug

SEQ ID NO: 37222 - RNA, 22 nt, Homo sapiens
ucuagaugaaguauaaaguagu

SEQ ID NO: 37223 - RNA, 22 nt, Homo sapiens
ucuauggaguuugaaugagaaa

SEQ ID NO: 37224 - RNA, 22 nt, Homo sapiens
ucucacaccccucucauauacc

SEQ ID NO: 37225 - RNA, 22 nt, Homo sapiens
ucuccauuuguaaggguuucuc

SEQ ID NO: 37226 - RNA, 22 nt, Homo sapiens
ucucccauccguacacggauug

SEQ ID NO: 37227 - RNA, 22 nt, Homo sapiens
ucucugagaaaaguuucuccca

SEQ ID NO: 37228 - RNA, 22 nt, Homo sapiens
ucucuggauaucuacuuauguu

SEQ ID NO: 37229 - RNA, 22 nt, Homo sapiens
ucucuuggugacuuaaaauguu

SEQ ID NO: 37230 - RNA, 22 nt, Homo sapiens
ucugaaucguucccaugcagga

SEQ ID NO: 37231 - RNA, 22 nt, Homo sapiens
ucugacucuggagucucagguu

SEQ ID NO: 37232 - RNA, 22 nt, Homo sapiens
ucugccacugucauugugugau

SEQ ID NO: 37233 - RNA, 22 nt, Homo sapiens
ucugccuacugguuggaggaac

SEQ ID NO: 37234 - RNA, 22 nt, Homo sapiens
ucuggcaagagccgagggcagu

SEQ ID NO: 37235 - RNA, 22 nt, Homo sapiens
ucuggcuuucuuuacuuaaugu

SEQ ID NO: 37236 - RNA, 22 nt, Homo sapiens
ucuggcuuugugaguugccaga

SEQ ID NO: 37237 - RNA, 20 nt, Homo sapiens
ucuggguuuuggccacgccc

SEQ ID NO: 37238 - RNA, 22 nt, Homo sapiens
ucuuuguucaggagccaacucc

SEQ ID NO: 37239 - RNA, 22 nt, Homo sapiens
ucuuuguuuucugauccugaag

SEQ ID NO: 37240 - RNA, 20 nt, Homo sapiens
ugaaaucuucacuaagucuc

SEQ ID NO: 37241 - RNA, 21 nt, Homo sapiens
ugaaaugcaugugcacauuaa

SEQ ID NO: 37242 - RNA, 22 nt, Homo sapiens
ugaaaugcugucuaggggaaau

SEQ ID NO: 37243 - RNA, 22 nt, Homo sapiens
ugaagacucaauuauuaugaac

SEQ ID NO: 37244 - RNA, 22 nt, Homo sapiens
ugaagugaagcaguaguguggg

SEQ ID NO: 37245 - RNA, 18 nt, Homo sapiens
ugaauacagcguugggaa

SEQ ID NO: 37246 - RNA, 22 nt, Homo sapiens
ugaauguuguugguugagauau

SEQ ID NO: 37247 - RNA, 22 nt, Homo sapiens
ugacaagaguagagagggugcc

SEQ ID NO: 37248 - RNA, 22 nt, Homo sapiens
ugacaggauggagaucgguauu

SEQ ID NO: 37249 - RNA, 22 nt, Homo sapiens
ugacagucaccaggacccacag

SEQ ID NO: 37250 - RNA, 22 nt, Homo sapiens
ugacaugauguuccuacacugu

SEQ ID NO: 37251 - RNA, 22 nt, Homo sapiens
ugacggaggacaccugcggaau

SEQ ID NO: 37252 - RNA, 22 nt, Homo sapiens
ugacggaggcauuggaagcuug

SEQ ID NO: 37253 - RNA, 22 nt, Homo sapiens
ugacuacaggucaggaagcugu

SEQ ID NO: 37254 - RNA, 22 nt, Homo sapiens
ugacucaguuucucagguagua

SEQ ID NO: 37255 - RNA, 22 nt, Homo sapiens
ugacuuuagaauuuuauccaga

SEQ ID NO: 37256 - RNA, 22 nt, Homo sapiens
ugagaaccucugugugcccacu

SEQ ID NO: 37257 - RNA, 22 nt, Homo sapiens
ugagaagaugaacuccuugguc

SEQ ID NO: 37258 - RNA, 22 nt, Homo sapiens
ugagaccuuucauuucucagug

SEQ ID NO: 37259 - RNA, 22 nt, Homo sapiens
ugagacugguuaauugauaaag

SEQ ID NO: 37260 - RNA, 21 nt, Homo sapiens
ugagaguaguguauuauucuc

SEQ ID NO: 37261 - RNA, 22 nt, Homo sapiens
ugagauaaagcauguacugugu

SEQ ID NO: 37262 - RNA, 22 nt, Homo sapiens
ugagauaaugcaugugaagauc

SEQ ID NO: 37263 - RNA, 23 nt, Homo sapiens
ugagaucuacagaucucagaucu

SEQ ID NO: 37264 - RNA, 22 nt, Homo sapiens
ugagaugaaagcagaaagacuu

SEQ ID NO: 37265 - RNA, 22 nt, Homo sapiens
ugagaugaacuugauuguuuua

SEQ ID NO: 37266 - RNA, 19 nt, Homo sapiens
ugagaugaagacagggguu

SEQ ID NO: 37267 - RNA, 22 nt, Homo sapiens
ugagaugagagaaugcuugccu

SEQ ID NO: 37268 - RNA, 22 nt, Homo sapiens
ugagaugaggucucacucuguu

SEQ ID NO: 37269 - RNA, 22 nt, Homo sapiens
ugagaugaggucucgcucuguc

SEQ ID NO: 37270 - RNA, 22 nt, Homo sapiens
ugagaugagucucgcucuguca

SEQ ID NO: 37271 - RNA, 22 nt, Homo sapiens
ugagaugaguucucgcucuguc

SEQ ID NO: 37272 - RNA, 22 nt, Homo sapiens
ugagaugaguugcgcucugucg

SEQ ID NO: 37273 - RNA, 22 nt, Homo sapiens
ugagaugauaucuuauuguaau

SEQ ID NO: 37274 - RNA, 22 nt, Homo sapiens
ugagcagugaguguggugcagg

SEQ ID NO: 37275 - RNA, 22 nt, Homo sapiens
ugagcuaggaucacaccugcau

SEQ ID NO: 37276 - RNA, 22 nt, Homo sapiens
ugagcuauguucuucuuguuuu

SEQ ID NO: 37277 - RNA, 22 nt, Homo sapiens
ugagcugagaucacacuacugu

SEQ ID NO: 37278 - RNA, 22 nt, Homo sapiens
ugagcugagaucuuaccacugc

SEQ ID NO: 37279 - RNA, 22 nt, Homo sapiens
ugaggagugagaaauugguuuc

SEQ ID NO: 37280 - RNA, 22 nt, Homo sapiens
ugaggcacucccuagcggggug

SEQ ID NO: 37281 - RNA, 22 nt, Homo sapiens
ugagguaacaaacuaugaguua

SEQ ID NO: 37282 - RNA, 22 nt, Homo sapiens
ugagguaauagauaauauuuuu

SEQ ID NO: 37283 - RNA, 22 nt, Homo sapiens
ugagguagaggugaacuugacc

SEQ ID NO: 37284 - RNA, 22 nt, Homo sapiens
ugaggugaaguaauauucuaag

SEQ ID NO: 37285 - RNA, 22 nt, Homo sapiens
ugaggugagggguuaggugcua

SEQ ID NO: 37286 - RNA, 20 nt, Homo sapiens
ugaguuccuuguucagaagc

SEQ ID NO: 37287 - RNA, 22 nt, Homo sapiens
ugaguuuaucuaaagaccuggg

SEQ ID NO: 37288 - RNA, 23 nt, Homo sapiens
ugauaacagcauaugaagauucu

SEQ ID NO: 37289 - RNA, 22 nt, Homo sapiens
ugcaaagucgaaacugcaguuu

SEQ ID NO: 37290 - RNA, 22 nt, Homo sapiens
ugcaagaaacauauuccacaag

SEQ ID NO: 37291 - RNA, 22 nt, Homo sapiens
ugcaagaggagacuguacucag

SEQ ID NO: 37292 - RNA, 22 nt, Homo sapiens
ugcaccauuacacuccaggcug

SEQ ID NO: 37293 - RNA, 22 nt, Homo sapiens
ugcagcacuguucacaauagcc

SEQ ID NO: 37294 - RNA, 22 nt, Homo sapiens
ugcagcucagcugcggaguuuu

SEQ ID NO: 37295 - RNA, 22 nt, Homo sapiens
ugcaguacauucagcauccucu

SEQ ID NO: 37296 - RNA, 22 nt, Homo sapiens
ugcagugugaaagagccugaca

SEQ ID NO: 37297 - RNA, 22 nt, Homo sapiens
ugcauaauuccuugcaccagaa

SEQ ID NO: 37298 - RNA, 22 nt, Homo sapiens
ugcauacugggagguugggugu

SEQ ID NO: 37299 - RNA, 22 nt, Homo sapiens
ugccuacuuugcaucugucagg

SEQ ID NO: 37300 - RNA, 22 nt, Homo sapiens
ugccuaggcuggaguguagugg

SEQ ID NO: 37301 - RNA, 22 nt, Homo sapiens
uggaaaguacugagguccaccu

SEQ ID NO: 37302 - RNA, 21 nt, Homo sapiens
uggaaguguacaauuauaccc

SEQ ID NO: 37303 - RNA, 22 nt, Homo sapiens
uggaaucuagagaaaugcaaac

SEQ ID NO: 37304 - RNA, 20 nt, Homo sapiens
uggaaucuaggcggagguuu

SEQ ID NO: 37305 - RNA, 21 nt, Homo sapiens
uggaaucuauagaggcaguag

SEQ ID NO: 37306 - RNA, 22 nt, Homo sapiens
uggacuguaaauuggggacucu

SEQ ID NO: 37307 - RNA, 22 nt, Homo sapiens
uggacuguaagugccuugagua

SEQ ID NO: 37308 - RNA, 22 nt, Homo sapiens
uggacuguaauuuuauaggcau

SEQ ID NO: 37309 - RNA, 22 nt, Homo sapiens
uggagauguuuaaaauccacug

SEQ ID NO: 37310 - RNA, 22 nt, Homo sapiens
uggauggagaggcuugugaugc

SEQ ID NO: 37311 - RNA, 22 nt, Homo sapiens
uggcaaaugugagaugagaacu

SEQ ID NO: 37312 - RNA, 22 nt, Homo sapiens
uugacauauuugugcuuaagaa

SEQ ID NO: 37313 - RNA, 22 nt, Homo sapiens
uugacauugcuguaguguccag

SEQ ID NO: 37314 - RNA, 22 nt, Homo sapiens
uugagauggaaucucgcuuugu

SEQ ID NO: 37315 - RNA, 22 nt, Homo sapiens
uugagauggagcuucacucuug

SEQ ID NO: 37316 - RNA, 22 nt, Homo sapiens
uugagauggagucucacucugc

SEQ ID NO: 37317 - RNA, 22 nt, Homo sapiens
uugagauggagucucacucuuu

SEQ ID NO: 37318 - RNA, 22 nt, Homo sapiens
uugagauggagucucacugugu

SEQ ID NO: 37319 - RNA, 22 nt, Homo sapiens
uugagcacaggaguuuugagac

SEQ ID NO: 37320 - RNA, 22 nt, Homo sapiens
ugcuuuguugaaaaucauuugg

SEQ ID NO: 37321 - RNA, 20 nt, Homo sapiens
uggaaaguaagucaugauau

SEQ ID NO: 37322 - RNA, 22 nt, Homo sapiens
uggaaaguaguucuaaucuaag

SEQ ID NO: 37323 - RNA, 22 nt, Homo sapiens
uggaaaguccaagccaaccggg

SEQ ID NO: 37324 - RNA, 22 nt, Homo sapiens
uggaagacaaguguuagcaugg

SEQ ID NO: 37325 - RNA, 20 nt, Homo sapiens
uggaagccuggugcuaucuu

SEQ ID NO: 37326 - RNA, 22 nt, Homo sapiens
uggaagugaacaaccaaggcag

SEQ ID NO: 37327 - RNA, 22 nt, Homo sapiens
uggaaguuaaaugacucuuucu

SEQ ID NO: 37328 - RNA, 22 nt, Homo sapiens
uggaaucuuaggugaaggcuuu

SEQ ID NO: 37329 - RNA, 22 nt, Homo sapiens
uggaauuuagguugauaguaua

SEQ ID NO: 37330 - RNA, 22 nt, Homo sapiens
uuaugugccuuuuugccauuca

SEQ ID NO: 37331 - RNA, 22 nt, Homo sapiens
uuauugcuccagaggcugauuu

SEQ ID NO: 37332 - RNA, 22 nt, Homo sapiens
uucaaaggauuuagauuagcua

SEQ ID NO: 37333 - RNA, 22 nt, Homo sapiens
uucaaguaagaaagacaucagg

SEQ ID NO: 37334 - RNA, 22 nt, Homo sapiens
uucacacugggccuacucugug

SEQ ID NO: 37335 - RNA, 20 nt, Homo sapiens
cagugcacuuucccacuggu

SEQ ID NO: 37336 - RNA, 22 nt, Homo sapiens
cagugcauagaugugccacauu

SEQ ID NO: 37337 - RNA, 22 nt, Homo sapiens
cagugucugcauuuggaacuca

SEQ ID NO: 37338 - RNA, 22 nt, Homo sapiens
caguguuuuuaacaggugcccg

SEQ ID NO: 37339 - RNA, 22 nt, Homo sapiens
cauaaugcuaagagcugccccu

SEQ ID NO: 37340 - RNA, 22 nt, Homo sapiens
caucccugucgucaagucucug

SEQ ID NO: 37341 - RNA, 22 nt, Homo sapiens
caugcacugaguccaccucugg

SEQ ID NO: 37342 - RNA, 22 nt, Homo sapiens
cauggcuacugcagauguaggg

SEQ ID NO: 37343 - RNA, 21 nt, Homo sapiens
caugucacugcacucuagccu

SEQ ID NO: 37344 - RNA, 20 nt, Homo sapiens
cauuacacuccaaccugggu

SEQ ID NO: 37345 - RNA, 22 nt, Homo sapiens
cauugcacuccaccuuggguaa

SEQ ID NO: 37346 - RNA, 22 nt, Homo sapiens
cauugcacuccagccuaggcaa

SEQ ID NO: 37347 - RNA, 22 nt, Homo sapiens
cauugcacuccagccugaguga

SEQ ID NO: 37348 - RNA, 22 nt, Homo sapiens
cauugcacuccagccuugguga

SEQ ID NO: 37349 - RNA, 22 nt, Homo sapiens
cauugguuccaguuuguccuua

SEQ ID NO: 37350 - RNA, 22 nt, Homo sapiens
ccacaguugaaauuuugacugu

SEQ ID NO: 37351 - RNA, 22 nt, Homo sapiens
ccagugauuguauggugaaggu

SEQ ID NO: 37352 - RNA, 22 nt, Homo sapiens
ccaguguuuuugaauuccagga

SEQ ID NO: 37353 - RNA, 22 nt, Homo sapiens
cccagugguuacauaaggagua

SEQ ID NO: 37354 - RNA, 22 nt, Homo sapiens
cccgugucuuggucuagggccu

SEQ ID NO: 37355 - RNA, 22 nt, Homo sapiens
ccggcuguguggagaggccccu

SEQ ID NO: 37356 - RNA, 22 nt, Homo sapiens
ccuguguuaugguuucuaaugu

SEQ ID NO: 37357 - RNA, 22 nt, Homo sapiens
ccuucuuuuguaaggcugaaua

SEQ ID NO: 37358 - RNA, 22 nt, Homo sapiens
ccuuuguuaguuugcugagaau

SEQ ID NO: 37359 - RNA, 22 nt, Homo sapiens
cgcuggugucuaagcgacagcu

SEQ ID NO: 37360 - RNA, 22 nt, Homo sapiens
cuaacacagagguuuauuucuc

SEQ ID NO: 37361 - RNA, 22 nt, Homo sapiens
cuaagggaggaagcugugcagg

SEQ ID NO: 37362 - RNA, 22 nt, Homo sapiens
cuaauacaguuguccaagcugg

SEQ ID NO: 37363 - RNA, 22 nt, Homo sapiens
cuagagagaagcugugugaccu

SEQ ID NO: 37364 - RNA, 22 nt, Homo sapiens
cuagcacauuuaucuuuauaca

SEQ ID NO: 37365 - RNA, 22 nt, Homo sapiens
cuagcaggcaagauaagauuca

SEQ ID NO: 37366 - RNA, 22 nt, Homo sapiens
cuaucucaggcccaggcccuug

SEQ ID NO: 37367 - RNA, 19 nt, Homo sapiens
cucaaagugguauuuggag

SEQ ID NO: 37368 - RNA, 22 nt, Homo sapiens
cucacaaccuuaugaagcauga

SEQ ID NO: 37369 - RNA, 22 nt, Homo sapiens
cucacugugguguccuuaggua

SEQ ID NO: 37370 - RNA, 22 nt, Homo sapiens
cuccacugagcaggugggaggc

SEQ ID NO: 37371 - RNA, 22 nt, Homo sapiens
cuccccuuuaguuucuuaauaa

SEQ ID NO: 37372 - RNA, 22 nt, Homo sapiens
cucccuuugcugaauguuuuuc

SEQ ID NO: 37373 - RNA, 22 nt, Homo sapiens
cucuuuaguaagcaguugauga

SEQ ID NO: 37374 - RNA, 22 nt, Homo sapiens
cugaagugcuugccacauaaaa

SEQ ID NO: 37375 - RNA, 22 nt, Homo sapiens
cugacagaugacugccacugua

SEQ ID NO: 37376 - RNA, 22 nt, Homo sapiens
cugaccucugucaaagacaccc

SEQ ID NO: 37377 - RNA, 22 nt, Homo sapiens
cugacuaguuuuaaugcagauu

SEQ ID NO: 37378 - RNA, 22 nt, Homo sapiens
cugagaucguggggcugcuguc

SEQ ID NO: 37379 - RNA, 22 nt, Homo sapiens
cugagcaaagaagugauaauga

SEQ ID NO: 37380 - RNA, 22 nt, Homo sapiens
cugagcaaaguucuauuuaugg

SEQ ID NO: 37381 - RNA, 22 nt, Homo sapiens
cugagcaagucauuuuguuaaa

SEQ ID NO: 37382 - RNA, 22 nt, Homo sapiens
cugagcucauuucuuuugcuac

SEQ ID NO: 37383 - RNA, 22 nt, Homo sapiens
cugaggacaucagggaagcauc

SEQ ID NO: 37384 - RNA, 22 nt, Homo sapiens
cuggaaaguagacaaucuaaaa

SEQ ID NO: 37385 - RNA, 22 nt, Homo sapiens
cuguaguuagcagaugaugaau

SEQ ID NO: 37386 - RNA, 22 nt, Homo sapiens
cugugcaugcgcggagcugaaa

SEQ ID NO: 37387 - RNA, 22 nt, Homo sapiens
cugugcauguuguccaauucuu

SEQ ID NO: 37388 - RNA, 22 nt, Homo sapiens
cugugcuugagagaugacacag

SEQ ID NO: 37389 - RNA, 22 nt, Homo sapiens
cuguuugaggguuugcuuucag

SEQ ID NO: 37390 - RNA, 22 nt, Homo sapiens
cuucaugggagaaccacaggua

SEQ ID NO: 37391 - RNA, 22 nt, Homo sapiens
cuugcauagaguuauugcccuu

SEQ ID NO: 37392 - RNA, 19 nt, Homo sapiens
cuugccccauucauccucu

SEQ ID NO: 37393 - RNA, 22 nt, Homo sapiens
cuugugcaugaccccagguggg

SEQ ID NO: 37394 - RNA, 22 nt, Homo sapiens
cuuucacacuguuggugggaau

SEQ ID NO: 37395 - RNA, 22 nt, Homo sapiens
cuuuccauuguuggagcauaaa

SEQ ID NO: 37396 - RNA, 22 nt, Homo sapiens
gaguauuuuacaucguguaauu

SEQ ID NO: 37397 - RNA, 22 nt, Homo sapiens
gagucuauucaauguaguuaga

SEQ ID NO: 37398 - RNA, 22 nt, Homo sapiens
gaucacauuguuucauacauau

SEQ ID NO: 37399 - RNA, 22 nt, Homo sapiens
gaugagguaguguaccuagucu

SEQ ID NO: 37400 - RNA, 22 nt, Homo sapiens
gauuagaacagaagucagauua

SEQ ID NO: 37401 - RNA, 22 nt, Homo sapiens
gauuagagaaauacugcugcua

SEQ ID NO: 37402 - RNA, 22 nt, Homo sapiens
gauuuuuggggaagccucuuau

SEQ ID NO: 37403 - RNA, 21 nt, Homo sapiens
gcaaguacuaucaucauuauc

SEQ ID NO: 37404 - RNA, 22 nt, Homo sapiens
gcacauggccccaucgugccga

SEQ ID NO: 37405 - RNA, 22 nt, Homo sapiens
gcacccguagugcuuucaauua

SEQ ID NO: 37406 - RNA, 22 nt, Homo sapiens
gcagcacaugacuguauguaua

SEQ ID NO: 37407 - RNA, 23 nt, Homo sapiens
gcagucauuuggaaaagguugaa

SEQ ID NO: 37408 - RNA, 22 nt, Homo sapiens
gcaguguggguagagggcaaga

SEQ ID NO: 37409 - RNA, 22 nt, Homo sapiens
gcaugcauuuuccuaacuagaa

SEQ ID NO: 37410 - RNA, 22 nt, Homo sapiens
gccauggaggauuuauagaggc

SEQ ID NO: 37411 - RNA, 22 nt, Homo sapiens
gccuguagaagaguagaugacc

SEQ ID NO: 37412 - RNA, 22 nt, Homo sapiens
gcucuuuugggguaauucugag

SEQ ID NO: 37413 - RNA, 22 nt, Homo sapiens
gcugguauuacaggcaugagcc

SEQ ID NO: 37414 - RNA, 22 nt, Homo sapiens
gcuguauugacuuuguaucaua

SEQ ID NO: 37415 - RNA, 22 nt, Homo sapiens
gcuguguucucgaggcggggga

SEQ ID NO: 37416 - RNA, 22 nt, Homo sapiens
gcuuuguuaaaacacagccaca

SEQ ID NO: 37417 - RNA, 22 nt, Homo sapiens
gcuuuguugauggugagucugu

SEQ ID NO: 37418 - RNA, 22 nt, Homo sapiens
gcuuuguuguugaugggaaauc

SEQ ID NO: 37419 - RNA, 22 nt, Homo sapiens
ggaagacuuagaguagcaucag

SEQ ID NO: 37420 - RNA, 22 nt, Homo sapiens
ggaauaguauaaauaccacaaa

SEQ ID NO: 37421 - RNA, 17 nt, Homo sapiens
ggaaugaauuccagccc

SEQ ID NO: 37422 - RNA, 22 nt, Homo sapiens
ggaaugggauuugaagucuggc

SEQ ID NO: 37423 - RNA, 22 nt, Homo sapiens
ggagaguaauuagacugaaaga

SEQ ID NO: 37424 - RNA, 22 nt, Homo sapiens
ggagggugagaucaauuuggga

SEQ ID NO: 37425 - RNA, 20 nt, Homo sapiens
ggagguguuggauuucuagu

SEQ ID NO: 37426 - RNA, 22 nt, Homo sapiens
ggaguaaaagaguaggaggaau

SEQ ID NO: 37427 - RNA, 22 nt, Homo sapiens
ggagucugauguucuaaggcag

SEQ ID NO: 37428 - RNA, 22 nt, Homo sapiens
ggcaaggugcuacagacaguga

SEQ ID NO: 37429 - RNA, 22 nt, Homo sapiens
ggcaguuuggcaguuucauaaa

SEQ ID NO: 37430 - RNA, 22 nt, Homo sapiens
ggcauguuuaguagaauguggu

SEQ ID NO: 37431 - RNA, 18 nt, Homo sapiens
ggcggguguuuuauucac

SEQ ID NO: 37432 - RNA, 22 nt, Homo sapiens
ggcuagagacaaguugcugaga

SEQ ID NO: 37433 - RNA, 22 nt, Homo sapiens
ggcucagugaucuguuucugua

SEQ ID NO: 37434 - RNA, 22 nt, Homo sapiens
ggcucagugggguccugguucu

SEQ ID NO: 37435 - RNA, 18 nt, Homo sapiens
ggcugguguuuuaguaua

SEQ ID NO: 37436 - RNA, 19 nt, Homo sapiens
gggaggaugcgucuucagg

SEQ ID NO: 37437 - RNA, 22 nt, Homo sapiens
gggguaggcuacacugaguucc

SEQ ID NO: 37438 - RNA, 22 nt, Homo sapiens
gguauugguugagauuaacuuu

SEQ ID NO: 37439 - RNA, 22 nt, Homo sapiens
ggucaaguaauccuggguguca

SEQ ID NO: 37440 - RNA, 22 nt, Homo sapiens
ggucauggauugucuuuucuug

SEQ ID NO: 37441 - RNA, 22 nt, Homo sapiens
ggugacugguuuaucuggcagu

SEQ ID NO: 37442 - RNA, 22 nt, Homo sapiens
ggugagaaaaacauagucucag

SEQ ID NO: 37443 - RNA, 23 nt, Homo sapiens
ggugaggaguacagagucuucau

SEQ ID NO: 37444 - RNA, 22 nt, Homo sapiens
ggugagguaggaaaaguuagga

SEQ ID NO: 37445 - RNA, 22 nt, Homo sapiens
guacaggugcaggaugggcagg

SEQ ID NO: 37446 - RNA, 22 nt, Homo sapiens
guacaguauaguaauaggauuu

SEQ ID NO: 37447 - RNA, 22 nt, Homo sapiens
guacugagagacaguuacuguu

SEQ ID NO: 37448 - RNA, 22 nt, Homo sapiens
guaguuuaucagaaagaauagg

SEQ ID NO: 37449 - RNA, 22 nt, Homo sapiens
guauacacccugugauauuauu

SEQ ID NO: 37450 - RNA, 22 nt, Homo sapiens
auagcaaugccccacuccuugg

SEQ ID NO: 37451 - RNA, 21 nt, Homo sapiens
auagcacuucacuugguuaga

SEQ ID NO: 37452 - RNA, 22 nt, Homo sapiens
auagcaggagaauggucauggg

SEQ ID NO: 37453 - RNA, 22 nt, Homo sapiens
auagugaacuuugugagaacaa

SEQ ID NO: 37454 - RNA, 22 nt, Homo sapiens
auauagcaaugaaagagaugaa

SEQ ID NO: 37455 - RNA, 22 nt, Homo sapiens
auauaugcuaagugcuaauaaa

SEQ ID NO: 37456 - RNA, 20 nt, Homo sapiens
auaugcagacacauacauac

SEQ ID NO: 37457 - RNA, 20 nt, Homo sapiens
auaugcauguguuuucacuu

SEQ ID NO: 37458 - RNA, 22 nt, Homo sapiens
auaugguuuuuggaagcauauc

SEQ ID NO: 37459 - RNA, 22 nt, Homo sapiens
auaugucuguuuagucuguaau

SEQ ID NO: 37460 - RNA, 18 nt, Homo sapiens
guaugcacaugccccugc

SEQ ID NO: 37461 - RNA, 22 nt, Homo sapiens
guauuguacuacaagcucuuua

SEQ ID NO: 37462 - RNA, 19 nt, Homo sapiens
guauuugacuuucuuguuu

SEQ ID NO: 37463 - RNA, 22 nt, Homo sapiens
gucaagugaagcagugggagua

SEQ ID NO: 37464 - RNA, 21 nt, Homo sapiens
guccaaaacaguguccaaugc

SEQ ID NO: 37465 - RNA, 22 nt, Homo sapiens
gucccugaggaacauccagggc

SEQ ID NO: 37466 - RNA, 22 nt, Homo sapiens
gucucauugcaguuagaccugu

SEQ ID NO: 37467 - RNA, 22 nt, Homo sapiens
gucuggcaauggcagacuggca

SEQ ID NO: 37468 - RNA, 22 nt, Homo sapiens
gucuggguuuguuuguacuugc

SEQ ID NO: 37469 - RNA, 22 nt, Homo sapiens
gucugguuuuuuauauccucac

SEQ ID NO: 37470 - RNA, 22 nt, Homo sapiens
gucugugguuccuaugucaccu

SEQ ID NO: 37471 - RNA, 22 nt, Homo sapiens
gucuuggcaugugcagcuggga

SEQ ID NO: 37472 - RNA, 22 nt, Homo sapiens
gucuuugaugucuaugugcuuc

SEQ ID NO: 37473 - RNA, 22 nt, Homo sapiens
gugagaggaggcagcuuuuaca

SEQ ID NO: 37474 - RNA, 22 nt, Homo sapiens
gugagcauaggaggcuucuguu

SEQ ID NO: 37475 - RNA, 22 nt, Homo sapiens
gugagcuccucuucugcugcag

SEQ ID NO: 37476 - RNA, 22 nt, Homo sapiens
gugagguguuaaccaaccugug

SEQ ID NO: 37477 - RNA, 22 nt, Homo sapiens
gugauugcauuaugaauauuau

SEQ ID NO: 37478 - RNA, 21 nt, Homo sapiens
gugcaaacaucauagaaugua

SEQ ID NO: 37479 - RNA, 22 nt, Homo sapiens
gugcacgucuuaggaggucacg

SEQ ID NO: 37480 - RNA, 22 nt, Homo sapiens
guggaaaacauaugcuuguuga

SEQ ID NO: 37481 - RNA, 22 nt, Homo sapiens
guggaauuauagagacaucuug

SEQ ID NO: 37482 - RNA, 22 nt, Homo sapiens
guggacggagguugcagugagc

SEQ ID NO: 37483 - RNA, 22 nt, Homo sapiens
guggcuagaaugaagguagcug

SEQ ID NO: 37484 - RNA, 22 nt, Homo sapiens
gugggauggagagaagguauga

SEQ ID NO: 37485 - RNA, 22 nt, Homo sapiens
guggggucaucucauuugugga

SEQ ID NO: 37486 - RNA, 22 nt, Homo sapiens
gugguguccugcaccuauaguc

SEQ ID NO: 37487 - RNA, 22 nt, Homo sapiens
guguaaaugagugcugaaggag

SEQ ID NO: 37488 - RNA, 22 nt, Homo sapiens
guguagagaaauagccugaagg

SEQ ID NO: 37489 - RNA, 22 nt, Homo sapiens
gugugcaaauguguaccuacau

SEQ ID NO: 37490 - RNA, 19 nt, Homo sapiens
gugugcauaucacagagca

SEQ ID NO: 37491 - RNA, 22 nt, Homo sapiens
gugugcauggagggggcaguga

SEQ ID NO: 37492 - RNA, 22 nt, Homo sapiens
aauagcacugcuaugguuugaa

SEQ ID NO: 37493 - RNA, 22 nt, Homo sapiens
aaucacaguuaguaagggagaa

SEQ ID NO: 37494 - RNA, 22 nt, Homo sapiens
aauccauuugccgucuauccau

SEQ ID NO: 37495 - RNA, 22 nt, Homo sapiens
aaucuguagaaggugcacauuc

SEQ ID NO: 37496 - RNA, 23 nt, Homo sapiens
aaucugucuuuguuauagggguc

SEQ ID NO: 37497 - RNA, 22 nt, Homo sapiens
aaugacagugcuaaagaacccu

SEQ ID NO: 37498 - RNA, 22 nt, Homo sapiens
aaugugcuuugaaaagagcuga

SEQ ID NO: 37499 - RNA, 22 nt, Homo sapiens
aauuaguuggcugggugcggug

SEQ ID NO: 37500 - RNA, 22 nt, Homo sapiens
aauuaguugucgugagaguggu

SEQ ID NO: 37501 - RNA, 22 nt, Homo sapiens
aauugcuuuuauuuagggccag

SEQ ID NO: 37502 - RNA, 22 nt, Homo sapiens
aauuguacucccaucauuccua

SEQ ID NO: 37503 - RNA, 22 nt, Homo sapiens
acacaaugguaaguguuugugu

SEQ ID NO: 37504 - RNA, 22 nt, Homo sapiens
acaccaguacuuuauacaagca

SEQ ID NO: 37505 - RNA, 22 nt, Homo sapiens
acaccaugucuguuucugguuu

SEQ ID NO: 37506 - RNA, 22 nt, Homo sapiens
acacugucugaugaaaguaguu

SEQ ID NO: 37507 - RNA, 22 nt, Homo sapiens
acagauagacauauauagcuca

SEQ ID NO: 37508 - RNA, 22 nt, Homo sapiens
acaggguuauuguaauaaugua

SEQ ID NO: 37509 - RNA, 21 nt, Homo sapiens
acaguacuugagaucuuuuga

SEQ ID NO: 37510 - RNA, 22 nt, Homo sapiens
acaguauaaugcuguagggaga

SEQ ID NO: 37511 - RNA, 22 nt, Homo sapiens
acagugcuuggcacacaguaau

SEQ ID NO: 37512 - RNA, 22 nt, Homo sapiens
acaguggaauguaggguuugag

SEQ ID NO: 37513 - RNA, 22 nt, Homo sapiens
acauaaagaagcaggacauugu

SEQ ID NO: 37514 - RNA, 22 nt, Homo sapiens
acaugcaucauuaggugguuua

SEQ ID NO: 37515 - RNA, 19 nt, Homo sapiens
acauggauuuugugcaaac

SEQ ID NO: 37516 - RNA, 22 nt, Homo sapiens
acauugcucuuaccaaguuugu

SEQ ID NO: 37517 - RNA, 22 nt, Homo sapiens
accaccauugcacugaacuuuc

SEQ ID NO: 37518 - RNA, 22 nt, Homo sapiens
accauugcacuccuuucugggc

SEQ ID NO: 37519 - RNA, 22 nt, Homo sapiens
acccugucaaaacggaccaauc

SEQ ID NO: 37520 - RNA, 19 nt, Homo sapiens
accuguagaaaguacaaca

SEQ ID NO: 37521 - RNA, 22 nt, Homo sapiens
accugugguuacagucugucuc

SEQ ID NO: 37522 - RNA, 22 nt, Homo sapiens
acuucauucucuggaucagaau

SEQ ID NO: 37523 - RNA, 21 nt, Homo sapiens
agaaaaucuuaugggaaacau

SEQ ID NO: 37524 - RNA, 22 nt, Homo sapiens
agaaacacagguggaauugcuu

SEQ ID NO: 37525 - RNA, 22 nt, Homo sapiens
agagaacugauucagggaaaau

SEQ ID NO: 37526 - RNA, 19 nt, Homo sapiens
agagacucauuguagcauu

SEQ ID NO: 37527 - RNA, 22 nt, Homo sapiens
agagauaauuagguuaaaugag

SEQ ID NO: 37528 - RNA, 22 nt, Homo sapiens
agauaugucugcuauuugcugu

SEQ ID NO: 37529 - RNA, 23 nt, Homo sapiens
agaugcaucuggcugcgaggcaa

SEQ ID NO: 37530 - RNA, 22 nt, Homo sapiens
agaugguguuuucucaccagau

SEQ ID NO: 37531 - RNA, 22 nt, Homo sapiens
agcaauaugacauugcuacauc

SEQ ID NO: 37532 - RNA, 22 nt, Homo sapiens
agcaccacaauuuccugccuaa

SEQ ID NO: 37533 - RNA, 23 nt, Homo sapiens
agcaccaccccaggucacaagug

SEQ ID NO: 37534 - RNA, 22 nt, Homo sapiens
agcagcaucgggaaguuggcca

SEQ ID NO: 37535 - RNA, 22 nt, Homo sapiens
agcagcaugcaaauggacuaau

SEQ ID NO: 37536 - RNA, 22 nt, Homo sapiens
agcagcauggguauaaaucucc

SEQ ID NO: 37537 - RNA, 16 nt, Homo sapiens
agcagguguuagguga

SEQ ID NO: 37538 - RNA, 23 nt, Homo sapiens
agccuguugccuaggcagcucau

SEQ ID NO: 37539 - RNA, 22 nt, Homo sapiens
agcgccauugcacuccagccuu

SEQ ID NO: 37540 - RNA, 22 nt, Homo sapiens
agcuggcuguggagaaaccccu

SEQ ID NO: 37541 - RNA, 22 nt, Homo sapiens
agcugguauuuugucaaggaua

SEQ ID NO: 37542 - RNA, 19 nt, Homo sapiens
aggacuaaagacuagaagu

SEQ ID NO: 37543 - RNA, 22 nt, Homo sapiens
aggaggauugcuuucaucuuuu

SEQ ID NO: 37544 - RNA, 22 nt, Homo sapiens
agggagcaaaguggucuuucuc

SEQ ID NO: 37545 - RNA, 22 nt, Homo sapiens
agguacuugagauucugaacug

SEQ ID NO: 37546 - RNA, 22 nt, Homo sapiens
agguagcauagcgggaauauca

SEQ ID NO: 37547 - RNA, 22 nt, Homo sapiens
aggugcugagcagagaauccug

SEQ ID NO: 37548 - RNA, 20 nt, Homo sapiens
agguuauuauaauuagaaga

SEQ ID NO: 37549 - RNA, 22 nt, Homo sapiens
agucaguguguauugauggcac

SEQ ID NO: 37550 - RNA, 22 nt, Homo sapiens
agugaaaucugaagaaggucau

SEQ ID NO: 37551 - RNA, 22 nt, Homo sapiens
agugcacucuuuccucucuuac

SEQ ID NO: 37552 - RNA, 22 nt, Homo sapiens
agugcaguugucacgugccuuc

SEQ ID NO: 37553 - RNA, 22 nt, Homo sapiens
agugcauugagacuugugaguu

SEQ ID NO: 37554 - RNA, 22 nt, Homo sapiens
aguggguguuccauuggauaaa

SEQ ID NO: 37555 - RNA, 22 nt, Homo sapiens
agugguuuuaaguagagcauac

SEQ ID NO: 37556 - RNA, 22 nt, Homo sapiens
aguguuuuuaacaagaaagggu

SEQ ID NO: 37557 - RNA, 22 nt, Homo sapiens
auaaaguagaggugaggugcau

SEQ ID NO: 37558 - RNA, 22 nt, Homo sapiens
auaaaugcauugagaacugcug

SEQ ID NO: 37559 - RNA, 22 nt, Homo sapiens
auaauagguugauugacauugc

SEQ ID NO: 37560 - RNA, 22 nt, Homo sapiens
auacagacacagucagaggggu

SEQ ID NO: 37561 - RNA, 22 nt, Homo sapiens
auacaguaaugucuuaggcugu

SEQ ID NO: 37562 - RNA, 22 nt, Homo sapiens
auacagugaauacuuacagugu

SEQ ID NO: 37563 - RNA, 22 nt, Homo sapiens
auacaguguucugggaagaagu

SEQ ID NO: 37564 - RNA, 20 nt, Homo sapiens
auaccacagacuggguaguu

SEQ ID NO: 37565 - RNA, 22 nt, Homo sapiens
gugaggaaggaaaccugcuagc

SEQ ID NO: 37566 - RNA, 22 nt, Homo sapiens
gugagguacgugucaagaacca

SEQ ID NO: 37567 - RNA, 22 nt, Homo sapiens
gugagguagagcaugugaaaga

SEQ ID NO: 37568 - RNA, 22 nt, Homo sapiens
gugaggugguacaauauuaacu

SEQ ID NO: 37569 - RNA, 22 nt, Homo sapiens
gugcacaacgugcaaguuuguu

SEQ ID NO: 37570 - RNA, 22 nt, Homo sapiens
gugcacaacgugcagguuuguu

SEQ ID NO: 37571 - RNA, 22 nt, Homo sapiens
gugcacaacguguagguuuguu

SEQ ID NO: 37572 - RNA, 22 nt, Homo sapiens
uggacaagugcccuccaccuca

SEQ ID NO: 37573 - RNA, 20 nt, Homo sapiens
uggaccagagagguggggac

SEQ ID NO: 37574 - RNA, 22 nt, Homo sapiens
uggagagugauaaguaaaugga

SEQ ID NO: 37575 - RNA, 18 nt, Homo sapiens
uggagauaagaagaacuu

SEQ ID NO: 37576 - RNA, 22 nt, Homo sapiens
uggagcccuaaacuucuaauau

SEQ ID NO: 37577 - RNA, 23 nt, Homo sapiens
uggaggacaagcauggauaguga

SEQ ID NO: 37578 - RNA, 22 nt, Homo sapiens
uggaggacugcagaacugaggc

SEQ ID NO: 37579 - RNA, 22 nt, Homo sapiens
uggagggcuagucauuucuuuu

SEQ ID NO: 37580 - RNA, 22 nt, Homo sapiens
uggaguuugacaugccuuuggg

SEQ ID NO: 37581 - RNA, 22 nt, Homo sapiens
uggcaaaauggaauauguuggg

SEQ ID NO: 37582 - RNA, 21 nt, Homo sapiens
uggcaaaaugggcaguggguu

SEQ ID NO: 37583 - RNA, 22 nt, Homo sapiens
uggcaagaacugcaauugcuuu

SEQ ID NO: 37584 - RNA, 22 nt, Homo sapiens
uggcaagagaacaacaucucuc

SEQ ID NO: 37585 - RNA, 22 nt, Homo sapiens
uggcaauaaaaugcaguuacuu

SEQ ID NO: 37586 - RNA, 22 nt, Homo sapiens
uggcaguuucacauggcucaac

SEQ ID NO: 37587 - RNA, 22 nt, Homo sapiens
uggcauguuggguguugacucc

SEQ ID NO: 37588 - RNA, 22 nt, Homo sapiens
uggcuguuuauuucacaugggu

SEQ ID NO: 37589 - RNA, 22 nt, Homo sapiens
uggcuguuuauuucaccugggc

SEQ ID NO: 37590 - RNA, 22 nt, Homo sapiens
uggcuguuuauuucaccugggu

SEQ ID NO: 37591 - RNA, 22 nt, Homo sapiens
ugggagcauugcauuagaagcc

SEQ ID NO: 37592 - RNA, 22 nt, Homo sapiens
ugggaugaaaauagcuucuucc

SEQ ID NO: 37593 - RNA, 22 nt, Homo sapiens
ugggaugugagucuucgcuuuc

SEQ ID NO: 37594 - RNA, 22 nt, Homo sapiens
ugggcggagacgugcagccgcc

SEQ ID NO: 37595 - RNA, 22 nt, Homo sapiens
ugguaagaucugugagccaggc

SEQ ID NO: 37596 - RNA, 22 nt, Homo sapiens
ugguccucugcuuccagaauuc

SEQ ID NO: 37597 - RNA, 22 nt, Homo sapiens
uguaaaccauauauguauguag

SEQ ID NO: 37598 - RNA, 22 nt, Homo sapiens
uguaaaucugguuaauuggaua

SEQ ID NO: 37599 - RNA, 22 nt, Homo sapiens
uguaguuugaaagcucccucug

SEQ ID NO: 37600 - RNA, 21 nt, Homo sapiens
uguauacauauguuaggugca

SEQ ID NO: 37601 - RNA, 22 nt, Homo sapiens
uguauauguuuguacauauguc

SEQ ID NO: 37602 - RNA, 22 nt, Homo sapiens
uguauuuguuguuaaauggaga

SEQ ID NO: 37603 - RNA, 20 nt, Homo sapiens
ugucaaggaauucccaaauc

SEQ ID NO: 37604 - RNA, 22 nt, Homo sapiens
ugucacauccaagaaggugcag

SEQ ID NO: 37605 - RNA, 20 nt, Homo sapiens
ugucauuaagcacugugcca

SEQ ID NO: 37606 - RNA, 20 nt, Homo sapiens
ugucuauggggguucucugc

SEQ ID NO: 37607 - RNA, 22 nt, Homo sapiens
ugugaaacacgaaagucuaaaa

SEQ ID NO: 37608 - RNA, 22 nt, Homo sapiens
ugugaacaugacagugggcuag

SEQ ID NO: 37609 - RNA, 21 nt, Homo sapiens
ugugaacauguuggguggcau

SEQ ID NO: 37610 - RNA, 22 nt, Homo sapiens
ugugaaugauggagugucgaau

SEQ ID NO: 37611 - RNA, 22 nt, Homo sapiens
ugugaauggugcugcaaugaac

SEQ ID NO: 37612 - RNA, 22 nt, Homo sapiens
ugugaauguaaccuuauuugga

SEQ ID NO: 37613 - RNA, 22 nt, Homo sapiens
ugugaauguaagaaaauccaac

SEQ ID NO: 37614 - RNA, 18 nt, Homo sapiens
ugugacauugagcauguc

SEQ ID NO: 37615 - RNA, 22 nt, Homo sapiens
ugugauaguuggcuaaagcagu

SEQ ID NO: 37616 - RNA, 22 nt, Homo sapiens
ugugaucaaccugcagggcugg

SEQ ID NO: 37617 - RNA, 22 nt, Homo sapiens
ugugcauagugugugcggggcg

SEQ ID NO: 37618 - RNA, 22 nt, Homo sapiens
ugugcauaugucuuuauaguag

SEQ ID NO: 37619 - RNA, 22 nt, Homo sapiens
ugugcucaucucagucaacugu

SEQ ID NO: 37620 - RNA, 22 nt, Homo sapiens
ugugcuugcuucuucuccuagu

SEQ ID NO: 37621 - RNA, 21 nt, Homo sapiens
uguggcaauggccucacagau

SEQ ID NO: 37622 - RNA, 22 nt, Homo sapiens
uguggccuuuguuucaguuggg

SEQ ID NO: 37623 - RNA, 22 nt, Homo sapiens
ugugguuuuaguaaaacuaugu

SEQ ID NO: 37624 - RNA, 22 nt, Homo sapiens
uguguuugauaaguccauaguu

SEQ ID NO: 37625 - RNA, 19 nt, Homo sapiens
uguugcacauaucaauaug

SEQ ID NO: 37626 - RNA, 19 nt, Homo sapiens
uguugcacuccagcuuggg

SEQ ID NO: 37627 - RNA, 22 nt, Homo sapiens
uguuggacuuacuuggcagauu

SEQ ID NO: 37628 - RNA, 22 nt, Homo sapiens
uguuuguuugauaugggauaaa

SEQ ID NO: 37629 - RNA, 22 nt, Homo sapiens
uguuuuggagguccucacuaga

SEQ ID NO: 37630 - RNA, 22 nt, Homo sapiens
uuaaaguguuugcagacaggug

SEQ ID NO: 37631 - RNA, 22 nt, Homo sapiens
uuaaaugcacauacuugagaaa

SEQ ID NO: 37632 - RNA, 22 nt, Homo sapiens
uuaacacugccauugauacugu

SEQ ID NO: 37633 - RNA, 22 nt, Homo sapiens
uuaagugcucaguuacucaguu

SEQ ID NO: 37634 - RNA, 22 nt, Homo sapiens
uuaaguuguagcuacaaauaca

SEQ ID NO: 37635 - RNA, 22 nt, Homo sapiens
uuaauuguaucuauagauguca

SEQ ID NO: 37636 - RNA, 22 nt, Homo sapiens
uuacacaguaggucccuaguaa

SEQ ID NO: 37637 - RNA, 22 nt, Homo sapiens
uuacaccuguaauccagcacuu

SEQ ID NO: 37638 - RNA, 22 nt, Homo sapiens
uuacaguagaugaggguauaau

SEQ ID NO: 37639 - RNA, 22 nt, Homo sapiens
uuacaguaugaguaagaguucu

SEQ ID NO: 37640 - RNA, 22 nt, Homo sapiens
uuacuagaacauuuagggaacu

SEQ ID NO: 37641 - RNA, 22 nt, Homo sapiens
uuauagcagugcccaacuccug

SEQ ID NO: 37642 - RNA, 20 nt, Homo sapiens
uuauagcuacaucuugacug

SEQ ID NO: 37643 - RNA, 22 nt, Homo sapiens
uuauauguuucuuagggacaga

SEQ ID NO: 37644 - RNA, 22 nt, Homo sapiens
uuaucccacuuucuguuccugu

SEQ ID NO: 37645 - RNA, 22 nt, Homo sapiens
gcuggguucagagugggcugcg

SEQ ID NO: 37646 - RNA, 22 nt, Homo sapiens
gcuggugacuuuaaguugaagc

SEQ ID NO: 37647 - RNA, 20 nt, Homo sapiens
gcugugcuuaauacacuuuc

SEQ ID NO: 37648 - RNA, 22 nt, Homo sapiens
gcuucauggaggcugggcgcag

SEQ ID NO: 37649 - RNA, 21 nt, Homo sapiens
gcuuuuucggaagucuuuggc

SEQ ID NO: 37650 - RNA, 22 nt, Homo sapiens
ggaaagacuauuguaaaggaug

SEQ ID NO: 37651 - RNA, 22 nt, Homo sapiens
ggaacaccauuuuuccugccuu

SEQ ID NO: 37652 - RNA, 17 nt, Homo sapiens
ggaagccuuugguuuaa

SEQ ID NO: 37653 - RNA, 22 nt, Homo sapiens
ggaaguuaauacagauagagua

SEQ ID NO: 37654 - RNA, 20 nt, Homo sapiens
ggaauagucuacacucugac

SEQ ID NO: 37655 - RNA, 22 nt, Homo sapiens
ggaaucugaaccaugggaaugg

SEQ ID NO: 37656 - RNA, 22 nt, Homo sapiens
ggacuagggacauggggagcug

SEQ ID NO: 37657 - RNA, 20 nt, Homo sapiens
ggagagugacauaauucugg

SEQ ID NO: 37658 - RNA, 22 nt, Homo sapiens
ggaggcuaguaaaaagguagaa

SEQ ID NO: 37659 - RNA, 22 nt, Homo sapiens
ggagguaauaaguuccagugua

SEQ ID NO: 37660 - RNA, 22 nt, Homo sapiens
ggagugcuguuguuacacaagg

SEQ ID NO: 37661 - RNA, 22 nt, Homo sapiens
ggcaagaaaaugcaauuacugu

SEQ ID NO: 37662 - RNA, 21 nt, Homo sapiens
ggcaagaaacacaaucaagua

SEQ ID NO: 37663 - RNA, 22 nt, Homo sapiens
ggcaagaagaacuauaacuuuu

SEQ ID NO: 37664 - RNA, 22 nt, Homo sapiens
ggcaagaagagaguuuaaacau

SEQ ID NO: 37665 - RNA, 21 nt, Homo sapiens
ggcaagagaauacaacauaaa

SEQ ID NO: 37666 - RNA, 22 nt, Homo sapiens
ggcaaggauuagauucuccccu

SEQ ID NO: 37667 - RNA, 22 nt, Homo sapiens
ggcaaggugaugaaugucuaca

SEQ ID NO: 37668 - RNA, 22 nt, Homo sapiens
ggcagcacaauuuucugaugga

SEQ ID NO: 37669 - RNA, 22 nt, Homo sapiens
ggcagcucaggccccgcgcuga

SEQ ID NO: 37670 - RNA, 22 nt, Homo sapiens
ggcaguuuguuugugaggucca

SEQ ID NO: 37671 - RNA, 22 nt, Homo sapiens
ggcuguguguuaaaauaggcuu

SEQ ID NO: 37672 - RNA, 22 nt, Homo sapiens
gggaagauauaggcugggcacc

SEQ ID NO: 37673 - RNA, 20 nt, Homo sapiens
gggaaugcaaauucucaucc

SEQ ID NO: 37674 - RNA, 22 nt, Homo sapiens
uggaagguaaguuuugagcauu

SEQ ID NO: 37675 - RNA, 22 nt, Homo sapiens
uggaagugucugugcccagcuc

SEQ ID NO: 37676 - RNA, 22 nt, Homo sapiens
uggaaucuacuaaagcaaaauc

SEQ ID NO: 37677 - RNA, 21 nt, Homo sapiens
uggaaucuauuauuccaguuu

SEQ ID NO: 37678 - RNA, 20 nt, Homo sapiens
uggaaucugaagaucucagu

SEQ ID NO: 37679 - RNA, 18 nt, Homo sapiens
uggaauguuuggguuaau

SEQ ID NO: 37680 - RNA, 22 nt, Homo sapiens
uggacaugaagggcacaggagg

SEQ ID NO: 37681 - RNA, 22 nt, Homo sapiens
uggacuagagggugggcgaggu

SEQ ID NO: 37682 - RNA, 19 nt, Homo sapiens
uggagucaucaugcugcua

SEQ ID NO: 37683 - RNA, 22 nt, Homo sapiens
uggcaaauauuuuguuuuguaa

SEQ ID NO: 37684 - RNA, 22 nt, Homo sapiens
uggcaacuugcaaccucauucu

SEQ ID NO: 37685 - RNA, 23 nt, Homo sapiens
uggcaagaauucuuaccgugugg

SEQ ID NO: 37686 - RNA, 22 nt, Homo sapiens
uggcaagagcaaaauguacagu

SEQ ID NO: 37687 - RNA, 22 nt, Homo sapiens
uggcaguuuuaugugguucaac

SEQ ID NO: 37688 - RNA, 22 nt, Homo sapiens
uggcaugucguuuuucauagga

SEQ ID NO: 37689 - RNA, 22 nt, Homo sapiens
uggcgggaaaguugggagaaga

SEQ ID NO: 37690 - RNA, 19 nt, Homo sapiens
uggcuagaggccaggcguu

SEQ ID NO: 37691 - RNA, 22 nt, Homo sapiens
uggcuccguuguacaggcugga

SEQ ID NO: 37692 - RNA, 22 nt, Homo sapiens
uggcuuuuguuauuuggaagcu

SEQ ID NO: 37693 - RNA, 22 nt, Homo sapiens
ugggaagaagguuuacuugcca

SEQ ID NO: 37694 - RNA, 22 nt, Homo sapiens
ugggaauaugauacaggucuuu

SEQ ID NO: 37695 - RNA, 22 nt, Homo sapiens
ugggaaugaaauuacauagcuu

SEQ ID NO: 37696 - RNA, 22 nt, Homo sapiens
ugggagugugcacaauuucagc

SEQ ID NO: 37697 - RNA, 22 nt, Homo sapiens
ugggaucgucaagugaggcucg

SEQ ID NO: 37698 - RNA, 22 nt, Homo sapiens
ugggcaguauggucauuuucgu

SEQ ID NO: 37699 - RNA, 22 nt, Homo sapiens
ugggucaguagcauguaugucu

SEQ ID NO: 37700 - RNA, 23 nt, Homo sapiens
ugggucaguuuuucugacaucau

SEQ ID NO: 37701 - RNA, 22 nt, Homo sapiens
ugguacuucaugcucacagaua

SEQ ID NO: 37702 - RNA, 22 nt, Homo sapiens
ugguauguugucucuuuguucu

SEQ ID NO: 37703 - RNA, 22 nt, Homo sapiens
uggucuggagagucccgcccag

SEQ ID NO: 37704 - RNA, 22 nt, Homo sapiens
ugguucaguugcacaggcuguu

SEQ ID NO: 37705 - RNA, 22 nt, Homo sapiens
uguaaacauguauguguuuaug

SEQ ID NO: 37706 - RNA, 22 nt, Homo sapiens
uguaagcauuauauaauuguug

SEQ ID NO: 37707 - RNA, 22 nt, Homo sapiens
uguacuagaaauuaaggcaggg

SEQ ID NO: 37708 - RNA, 22 nt, Homo sapiens
uguagauauucuuucaguuuuu

SEQ ID NO: 37709 - RNA, 22 nt, Homo sapiens
uguagggagagggaguugcacc

SEQ ID NO: 37710 - RNA, 22 nt, Homo sapiens
ugucauauagaauguucuauga

SEQ ID NO: 37711 - RNA, 20 nt, Homo sapiens
ugucccaaccccauggguuc

SEQ ID NO: 37712 - RNA, 21 nt, Homo sapiens
ugucugagagaggagaucuac

SEQ ID NO: 37713 - RNA, 22 nt, Homo sapiens
ugucuuugguucaggcaaggag

SEQ ID NO: 37714 - RNA, 22 nt, Homo sapiens
ugugaaugaagaaugcuaaccu

SEQ ID NO: 37715 - RNA, 22 nt, Homo sapiens
ugugacaaauuuaguggacugu

SEQ ID NO: 37716 - RNA, 22 nt, Homo sapiens
ugugacucuggcacauggugag

SEQ ID NO: 37717 - RNA, 19 nt, Homo sapiens
ugugagcauuagcauuuag

SEQ ID NO: 37718 - RNA, 22 nt, Homo sapiens
ugugauugauuaaugugugcua

SEQ ID NO: 37719 - RNA, 22 nt, Homo sapiens
ugugcauauaaguguguauaua

SEQ ID NO: 37720 - RNA, 22 nt, Homo sapiens
uguggaaauaaaagaaagguua

SEQ ID NO: 37721 - RNA, 22 nt, Homo sapiens
uguggaaauuguuguauuuaau

SEQ ID NO: 37722 - RNA, 22 nt, Homo sapiens
uguggcaaagucuugugaauau

SEQ ID NO: 37723 - RNA, 22 nt, Homo sapiens
ugugguuuuucacauuuagaga

SEQ ID NO: 37724 - RNA, 22 nt, Homo sapiens
uguuacacugugcacuaaauuu

SEQ ID NO: 37725 - RNA, 22 nt, Homo sapiens
ugagcaaaauuuuggacauaga

SEQ ID NO: 37726 - RNA, 22 nt, Homo sapiens
ugagcagaaagcugcaaggucg

SEQ ID NO: 37727 - RNA, 22 nt, Homo sapiens
ugagcauuguuuggacuuggau

SEQ ID NO: 37728 - RNA, 22 nt, Homo sapiens
ugagcuagggccuggaauaggg

SEQ ID NO: 37729 - RNA, 22 nt, Homo sapiens
ugagcucaguauuucauaaaca

SEQ ID NO: 37730 - RNA, 22 nt, Homo sapiens
ugagcugagaaaugcagcagcu

SEQ ID NO: 37731 - RNA, 22 nt, Homo sapiens
ugagcugagaucaugcuauugu

SEQ ID NO: 37732 - RNA, 22 nt, Homo sapiens
ugagcugagaucgugccauugu

SEQ ID NO: 37733 - RNA, 18 nt, Homo sapiens
ugaggaaaggguuugcua

SEQ ID NO: 37734 - RNA, 22 nt, Homo sapiens
ugaggugaggguaucaaaugcu

SEQ ID NO: 37735 - RNA, 22 nt, Homo sapiens
ugagugaaagaagcacuaagga

SEQ ID NO: 37736 - RNA, 17 nt, Homo sapiens
ugauauuuucccagaua

SEQ ID NO: 37737 - RNA, 22 nt, Homo sapiens
ugauuggagaacaaacugcaua

SEQ ID NO: 37738 - RNA, 22 nt, Homo sapiens
ugauuggagaugaauuucguuu

SEQ ID NO: 37739 - RNA, 19 nt, Homo sapiens
ugcaaagucagugaagggu

SEQ ID NO: 37740 - RNA, 22 nt, Homo sapiens
ugcaacauguguaccacucugu

SEQ ID NO: 37741 - RNA, 22 nt, Homo sapiens
ugcaaguaauuccagcuacuga

SEQ ID NO: 37742 - RNA, 22 nt, Homo sapiens
ugcaccauugcauacuuaauua

SEQ ID NO: 37743 - RNA, 22 nt, Homo sapiens
ugcagagucuguccugccugcc

SEQ ID NO: 37744 - RNA, 20 nt, Homo sapiens
ugcagcacgggcccuuucca

SEQ ID NO: 37745 - RNA, 22 nt, Homo sapiens
ugcagcauguaggcacguuauu

SEQ ID NO: 37746 - RNA, 22 nt, Homo sapiens
ugcaggguccauugucccaagu

SEQ ID NO: 37747 - RNA, 22 nt, Homo sapiens
ugcagugugauuuucuggcuga

SEQ ID NO: 37748 - RNA, 22 nt, Homo sapiens
ugcauacacaagcauacaugua

SEQ ID NO: 37749 - RNA, 22 nt, Homo sapiens
ugcauccauucuagacucaucu

SEQ ID NO: 37750 - RNA, 22 nt, Homo sapiens
ugccaaggagucagucccuaga

SEQ ID NO: 37751 - RNA, 22 nt, Homo sapiens
ugccaguguuuuguugaagauu

SEQ ID NO: 37752 - RNA, 22 nt, Homo sapiens
ugcccuuugucagaugaguagg

SEQ ID NO: 37753 - RNA, 22 nt, Homo sapiens
ugcuagagaaauauauuugggg

SEQ ID NO: 37754 - RNA, 22 nt, Homo sapiens
ugcuaucauugauuagugaugu

SEQ ID NO: 37755 - RNA, 22 nt, Homo sapiens
ugcuggugucaucaaggcuuug

SEQ ID NO: 37756 - RNA, 22 nt, Homo sapiens
ugcugguuuucaucaucagugg

SEQ ID NO: 37757 - RNA, 22 nt, Homo sapiens
uuugguaguuuguugggaccca

SEQ ID NO: 37758 - RNA, 22 nt, Homo sapiens
uuuguaauccuauuccaaagga

SEQ ID NO: 37759 - RNA, 22 nt, Homo sapiens
uuuguacacgugggugaauugu

SEQ ID NO: 37760 - RNA, 22 nt, Homo sapiens
uuuguacacuguuggugguuau

SEQ ID NO: 37761 - RNA, 22 nt, Homo sapiens
uuugugaggugauggauauguc

SEQ ID NO: 37762 - RNA, 22 nt, Homo sapiens
uuuuaacagccaggggacggcc

SEQ ID NO: 37763 - RNA, 22 nt, Homo sapiens
uuuuacagaggagguugcugau

SEQ ID NO: 37764 - RNA, 22 nt, Homo sapiens
uuuugcaauauguuccugaaua

SEQ ID NO: 37765 - RNA, 20 nt, Homo sapiens
uuuugcacuccuacuaaggu

SEQ ID NO: 37766 - RNA, 22 nt, Homo sapiens
uuuugcucuucggaagagcuug

SEQ ID NO: 37767 - RNA, 22 nt, Homo sapiens
uuuuggcacuuugucugauucu

SEQ ID NO: 37768 - RNA, 22 nt, Homo sapiens
uuuuggcucugucuguaucuuu

SEQ ID NO: 37769 - RNA, 22 nt, Homo sapiens
uuuugguguacaauucuaugga

SEQ ID NO: 37770 - RNA, 22 nt, Homo sapiens
uuuuguacaacagcucugggga

SEQ ID NO: 37771 - RNA, 21 nt, Homo sapiens
uuuuugggcuuucauaguguu

SEQ ID NO: 37772 - RNA, 22 nt, Homo sapiens
uggcaagaagagcaugagacca

SEQ ID NO: 37773 - RNA, 22 nt, Homo sapiens
uggcaguuuacagcuuuaggag

SEQ ID NO: 37774 - RNA, 22 nt, Homo sapiens
uggcaguuucauaugguucaac

SEQ ID NO: 37775 - RNA, 22 nt, Homo sapiens
uggcaguuuuugccuucaauac

SEQ ID NO: 37776 - RNA, 22 nt, Homo sapiens
uggcaugauccuagauucaaca

SEQ ID NO: 37777 - RNA, 22 nt, Homo sapiens
uggcauguaaugcagaaguugc

SEQ ID NO: 37778 - RNA, 22 nt, Homo sapiens
uaaguauuaugugcugcauuuu

SEQ ID NO: 37779 - RNA, 22 nt, Homo sapiens
uaagugaaggaaguguguuuac

SEQ ID NO: 37780 - RNA, 22 nt, Homo sapiens
uaaguuguagaacguuuucuua

SEQ ID NO: 37781 - RNA, 22 nt, Homo sapiens
uaauacuagugaauagcaggau

SEQ ID NO: 37782 - RNA, 22 nt, Homo sapiens
uaauacugcugugcuugaguug

SEQ ID NO: 37783 - RNA, 22 nt, Homo sapiens
uaauacuguaauggugguuccg

SEQ ID NO: 37784 - RNA, 22 nt, Homo sapiens
uaauugaaugcagacaccaggg

SEQ ID NO: 37785 - RNA, 22 nt, Homo sapiens
uacaauagugacaaaucagcau

SEQ ID NO: 37786 - RNA, 22 nt, Homo sapiens
uacaguaauguuaaucuuugug

SEQ ID NO: 37787 - RNA, 22 nt, Homo sapiens
uacaguauuaugagugauugaa

SEQ ID NO: 37788 - RNA, 22 nt, Homo sapiens
uacagucuagaggagaaucagg

SEQ ID NO: 37789 - RNA, 22 nt, Homo sapiens
uacagugggcacuggcgcccug

SEQ ID NO: 37790 - RNA, 22 nt, Homo sapiens
uacaugcaugggcaugugugca

SEQ ID NO: 37791 - RNA, 22 nt, Homo sapiens
uacauguauguguuuauggcug

SEQ ID NO: 37792 - RNA, 22 nt, Homo sapiens
uacauugcacuuuauuagauac

SEQ ID NO: 37793 - RNA, 22 nt, Homo sapiens
uaccacauuguagagggcauuc

SEQ ID NO: 37794 - RNA, 20 nt, Homo sapiens
uagagagauauggggguucc

SEQ ID NO: 37795 - RNA, 22 nt, Homo sapiens
uagagugcugucaaagacuugu

SEQ ID NO: 37796 - RNA, 22 nt, Homo sapiens
uagcaaaucaauggaauugaag

SEQ ID NO: 37797 - RNA, 22 nt, Homo sapiens
uagcagcaccccacucuacugg

SEQ ID NO: 37798 - RNA, 20 nt, Homo sapiens
uagcagcagacagagggagg

SEQ ID NO: 37799 - RNA, 22 nt, Homo sapiens
uagcagcagugguguauuuaga

SEQ ID NO: 37800 - RNA, 22 nt, Homo sapiens
uagcagcaucucuggcuucuac

SEQ ID NO: 37801 - RNA, 22 nt, Homo sapiens
uucaggcuccgugccagcuccg

SEQ ID NO: 37802 - RNA, 22 nt, Homo sapiens
uucaguacacguguucucauuu

SEQ ID NO: 37803 - RNA, 22 nt, Homo sapiens
uucaguggagaggcugaguggu

SEQ ID NO: 37804 - RNA, 18 nt, Homo sapiens
uucauaguagcaugauuu

SEQ ID NO: 37805 - RNA, 22 nt, Homo sapiens
uucauguaauuccauaagguaa

SEQ ID NO: 37806 - RNA, 22 nt, Homo sapiens
uucauuggacuuguguucuuga

SEQ ID NO: 37807 - RNA, 22 nt, Homo sapiens
uuccaauguuccguguugcagu

SEQ ID NO: 37808 - RNA, 22 nt, Homo sapiens
uuccagaugggaguucuauucu

SEQ ID NO: 37809 - RNA, 22 nt, Homo sapiens
uuccaguauuugggcaagcgca

SEQ ID NO: 37810 - RNA, 22 nt, Homo sapiens
uuccaguggacuacuucauccu

SEQ ID NO: 37811 - RNA, 22 nt, Homo sapiens
uuccauaggcuagaucaaccag

SEQ ID NO: 37812 - RNA, 22 nt, Homo sapiens
uuccauugugucaucuuggugg

SEQ ID NO: 37813 - RNA, 22 nt, Homo sapiens
uuccuaguccugagucucugcg

SEQ ID NO: 37814 - RNA, 20 nt, Homo sapiens
uucuacagucacaggaagau

SEQ ID NO: 37815 - RNA, 22 nt, Homo sapiens
uucuaguacucccuggagcugg

SEQ ID NO: 37816 - RNA, 22 nt, Homo sapiens
uucucagugaaguuuagaacau

SEQ ID NO: 37817 - RNA, 22 nt, Homo sapiens
uucuccugguggacccuaaacg

SEQ ID NO: 37818 - RNA, 22 nt, Homo sapiens
uucucugggacauaggucgggu

SEQ ID NO: 37819 - RNA, 22 nt, Homo sapiens
uucugaguggcuuucaacacug

SEQ ID NO: 37820 - RNA, 22 nt, Homo sapiens
uucugguuaauacuugcaaaaa

SEQ ID NO: 37821 - RNA, 22 nt, Homo sapiens
uucugugcuuguggaugaagug

SEQ ID NO: 37822 - RNA, 22 nt, Homo sapiens
uucuugcacuuaacugacauuc

SEQ ID NO: 37823 - RNA, 22 nt, Homo sapiens
uugaaagacaucaccuacugcu

SEQ ID NO: 37824 - RNA, 22 nt, Homo sapiens
uugaaagaugaacuggauugga

SEQ ID NO: 37825 - RNA, 22 nt, Homo sapiens
uugacagagaaaagugugacuu

SEQ ID NO: 37826 - RNA, 22 nt, Homo sapiens
uugacauaguuucugaaauaga

SEQ ID NO: 37827 - RNA, 22 nt, Homo sapiens
uugagauggagucucacucugu

SEQ ID NO: 37828 - RNA, 22 nt, Homo sapiens
uugagauggagucucacucuuc

SEQ ID NO: 37829 - RNA, 22 nt, Homo sapiens
uugagauggaguuucacucugu

SEQ ID NO: 37830 - RNA, 22 nt, Homo sapiens
uugagauggaguuucacucuug

SEQ ID NO: 37831 - RNA, 22 nt, Homo sapiens
uugagauguaguuucacuccug

SEQ ID NO: 37832 - RNA, 22 nt, Homo sapiens
uugagauguggcaguuuaugag

SEQ ID NO: 37833 - RNA, 22 nt, Homo sapiens
uugaggaggcagucuguccguu

SEQ ID NO: 37834 - RNA, 22 nt, Homo sapiens
uugagggagcauuuguuuugag

SEQ ID NO: 37835 - RNA, 22 nt, Homo sapiens
uugaggugggaggaucacuuga

SEQ ID NO: 37836 - RNA, 22 nt, Homo sapiens
uugauauguaguuggacuugau

SEQ ID NO: 37837 - RNA, 22 nt, Homo sapiens
uugaucugugucccugcccaau

SEQ ID NO: 37838 - RNA, 18 nt, Homo sapiens
uugcaaauucuucccugu

SEQ ID NO: 37839 - RNA, 22 nt, Homo sapiens
uugcacauugauuuuguauccu

SEQ ID NO: 37840 - RNA, 22 nt, Homo sapiens
uugcacuauaggaaaauguguc

SEQ ID NO: 37841 - RNA, 22 nt, Homo sapiens
uugcacuauuaguauagauguc

SEQ ID NO: 37842 - RNA, 22 nt, Homo sapiens
uugcacuccagccuuggggaga

SEQ ID NO: 37843 - RNA, 22 nt, Homo sapiens
uugcacuccggccuggguaaca

SEQ ID NO: 37844 - RNA, 22 nt, Homo sapiens
uugcagcaaagagggaggggca

SEQ ID NO: 37845 - RNA, 22 nt, Homo sapiens
uugcauagaccgaugucuugga

SEQ ID NO: 37846 - RNA, 22 nt, Homo sapiens
uugcuacauugauugccucuuu

SEQ ID NO: 37847 - RNA, 22 nt, Homo sapiens
uugcugagucuuucuagguugc

SEQ ID NO: 37848 - RNA, 22 nt, Homo sapiens
uugcuucauucaacauugaggg

SEQ ID NO: 37849 - RNA, 22 nt, Homo sapiens
uuggagugugagagcagccugg

SEQ ID NO: 37850 - RNA, 22 nt, Homo sapiens
uuggcaaagugucuggcauuua

SEQ ID NO: 37851 - RNA, 22 nt, Homo sapiens
uuggcaaauagguuuuauugca

SEQ ID NO: 37852 - RNA, 22 nt, Homo sapiens
uuggcacuugauaauauucugg

SEQ ID NO: 37853 - RNA, 22 nt, Homo sapiens
uuggcauagaggcucucaagcu

SEQ ID NO: 37854 - RNA, 22 nt, Homo sapiens
uuggccagugucuuuuuuuccu

SEQ ID NO: 37855 - RNA, 22 nt, Homo sapiens
uuggcuaagaucacgugagaau

SEQ ID NO: 37856 - RNA, 22 nt, Homo sapiens
uugggcaaguggcaugaccaug

SEQ ID NO: 37857 - RNA, 22 nt, Homo sapiens
uugggcaauaggaagcaggugg

SEQ ID NO: 37858 - RNA, 22 nt, Homo sapiens
gacuagaaauuauuuagugagc

SEQ ID NO: 37859 - RNA, 22 nt, Homo sapiens
gacuaggagagcagcugcccau

SEQ ID NO: 37860 - RNA, 22 nt, Homo sapiens
gacuaggagauauguuuucuuc

SEQ ID NO: 37861 - RNA, 18 nt, Homo sapiens
gacucaguuucuaaggca

SEQ ID NO: 37862 - RNA, 22 nt, Homo sapiens
gacugcagugcagcuguuaggc

SEQ ID NO: 37863 - RNA, 16 nt, Homo sapiens
gacugggcugaggaau

SEQ ID NO: 37864 - RNA, 22 nt, Homo sapiens
gagaaccuccagcaagguagua

SEQ ID NO: 37865 - RNA, 22 nt, Homo sapiens
gagaacuaaugauguacuaggc

SEQ ID NO: 37866 - RNA, 22 nt, Homo sapiens
gagacagugucagccauugaaa

SEQ ID NO: 37867 - RNA, 22 nt, Homo sapiens
gagagugaaguuugcuaccugu

SEQ ID NO: 37868 - RNA, 22 nt, Homo sapiens
gagaucaucuaaucuggccucu

SEQ ID NO: 37869 - RNA, 22 nt, Homo sapiens
gagaucaugcugguucucucau

SEQ ID NO: 37870 - RNA, 22 nt, Homo sapiens
ucucuagagagccugguguuca

SEQ ID NO: 37871 - RNA, 22 nt, Homo sapiens
ucucugguuuguggaaucuuag

SEQ ID NO: 37872 - RNA, 22 nt, Homo sapiens
ucugcauaucaugcagaacuau

SEQ ID NO: 37873 - RNA, 22 nt, Homo sapiens
ucuggcaagauauccauugcuu

SEQ ID NO: 37874 - RNA, 20 nt, Homo sapiens
ucuggccccuccaaaucuca

SEQ ID NO: 37875 - RNA, 22 nt, Homo sapiens
ucuggccccucccaaaucucau

SEQ ID NO: 37876 - RNA, 17 nt, Homo sapiens
ucuggcuuucacaccug

SEQ ID NO: 37877 - RNA, 22 nt, Homo sapiens
ucuggugugcucuggacuugca

SEQ ID NO: 37878 - RNA, 19 nt, Homo sapiens
ucugucacuggggguauuc

SEQ ID NO: 37879 - RNA, 22 nt, Homo sapiens
ucugugcauuacacuuuucuca

SEQ ID NO: 37880 - RNA, 22 nt, Homo sapiens
ucugugcauuguaacaacuaaa

SEQ ID NO: 37881 - RNA, 22 nt, Homo sapiens
ucuguguuugaucaagauugua

SEQ ID NO: 37882 - RNA, 22 nt, Homo sapiens
ucuguugguucuuugaggagga

SEQ ID NO: 37883 - RNA, 22 nt, Homo sapiens
ucuugaacuucugcacacucag

SEQ ID NO: 37884 - RNA, 22 nt, Homo sapiens
ucuuggccaugaauggcaaggc

SEQ ID NO: 37885 - RNA, 20 nt, Homo sapiens
ucuugggaauguagccuagg

SEQ ID NO: 37886 - RNA, 23 nt, Homo sapiens
ucuuguacuuugagugagcaugg

SEQ ID NO: 37887 - RNA, 22 nt, Homo sapiens
ucuuuggucagaaagauuacac

SEQ ID NO: 37888 - RNA, 22 nt, Homo sapiens
ucuuuguugcauaggcuuguuc

SEQ ID NO: 37889 - RNA, 22 nt, Homo sapiens
ugaaauuauucuuaccaaggug

SEQ ID NO: 37890 - RNA, 22 nt, Homo sapiens
ugaagugaaugguaaguaugcc

SEQ ID NO: 37891 - RNA, 22 nt, Homo sapiens
ugaagugcugugggccaggcgu

SEQ ID NO: 37892 - RNA, 22 nt, Homo sapiens
ugaauagugucacaauaaacau

SEQ ID NO: 37893 - RNA, 22 nt, Homo sapiens
ugaaucaugcugcuauaaagac

SEQ ID NO: 37894 - RNA, 22 nt, Homo sapiens
ugaauucaucucacagaguuaa

SEQ ID NO: 37895 - RNA, 21 nt, Homo sapiens
ugacagaaaauugaguuugcu

SEQ ID NO: 37896 - RNA, 22 nt, Homo sapiens
ugacaugaagucucccucuguu

SEQ ID NO: 37897 - RNA, 22 nt, Homo sapiens
ugacuacaccacacgguuaagg

SEQ ID NO: 37898 - RNA, 22 nt, Homo sapiens
ugacuagagcaauuggaaacaa

SEQ ID NO: 37899 - RNA, 22 nt, Homo sapiens
ugagaacugccuguauuuaucu

SEQ ID NO: 37900 - RNA, 22 nt, Homo sapiens
ugagaacuuauggugauuuuuu

SEQ ID NO: 37901 - RNA, 22 nt, Homo sapiens
ugagaagcauaccagugucugu

SEQ ID NO: 37902 - RNA, 22 nt, Homo sapiens
ugagaccugaucuugguacugc

SEQ ID NO: 37903 - RNA, 22 nt, Homo sapiens
ugagagaugaacucugauaugu

SEQ ID NO: 37904 - RNA, 22 nt, Homo sapiens
ugagaucaagguuaauauaauc

SEQ ID NO: 37905 - RNA, 22 nt, Homo sapiens
ugagaugagggcugcacucaaa

SEQ ID NO: 37906 - RNA, 22 nt, Homo sapiens
ugagaugaugggauaagagggc

SEQ ID NO: 37907 - RNA, 22 nt, Homo sapiens
ugagauuguaucugcaaugugu

SEQ ID NO: 37908 - RNA, 22 nt, Homo sapiens
ugagauuguuagaucaaauggu

SEQ ID NO: 37909 - RNA, 22 nt, Homo sapiens
ugagcaacauuucaaaacucca

SEQ ID NO: 37910 - RNA, 20 nt, Homo sapiens
ugagcucaugacauuuuucu

SEQ ID NO: 37911 - RNA, 22 nt, Homo sapiens
ugagcugagauuaagcugcugc

SEQ ID NO: 37912 - RNA, 22 nt, Homo sapiens
ugagcuguuugaagaagcauuu

SEQ ID NO: 37913 - RNA, 22 nt, Homo sapiens
ugaggagugaacuauuucugau

SEQ ID NO: 37914 - RNA, 22 nt, Homo sapiens
ugaggaguguauuucauucgcu

SEQ ID NO: 37915 - RNA, 22 nt, Homo sapiens
ugaggauaguguugaaggcagg

SEQ ID NO: 37916 - RNA, 22 nt, Homo sapiens
ugagguaugacuuauuauucuu

SEQ ID NO: 37917 - RNA, 22 nt, Homo sapiens
ugauauggcuuggcuaugucac

SEQ ID NO: 37918 - RNA, 22 nt, Homo sapiens
ugcaagucaucuguccuucaga

SEQ ID NO: 37919 - RNA, 22 nt, Homo sapiens
ugcaccauugcauuccagccug

SEQ ID NO: 37920 - RNA, 17 nt, Homo sapiens
ugcagcacacugauggg

SEQ ID NO: 37921 - RNA, 23 nt, Homo sapiens
ugcagcacacugaugggucuuga

SEQ ID NO: 37922 - RNA, 22 nt, Homo sapiens
ugcagcacugaacuucugggcu

SEQ ID NO: 37923 - RNA, 20 nt, Homo sapiens
ugcagcacugggaaugcagu

SEQ ID NO: 37924 - RNA, 22 nt, Homo sapiens
ugcaguagugugaucuuggcuc

SEQ ID NO: 37925 - RNA, 22 nt, Homo sapiens
ugcaguguggcucacgccugua

SEQ ID NO: 37926 - RNA, 22 nt, Homo sapiens
ugcaguuuaggaacugguaaca

SEQ ID NO: 37927 - RNA, 21 nt, Homo sapiens
ugcauacuucucagaugauua

SEQ ID NO: 37928 - RNA, 22 nt, Homo sapiens
ugcauuguuccgaauguguccu

SEQ ID NO: 37929 - RNA, 22 nt, Homo sapiens
ugccaguuuuuacauuuccugu

SEQ ID NO: 37930 - RNA, 22 nt, Homo sapiens
ugccauugcacuccagccuggg

SEQ ID NO: 37931 - RNA, 22 nt, Homo sapiens
ugcccuguaucccacuguuuca

SEQ ID NO: 37932 - RNA, 22 nt, Homo sapiens
ugccuaggcccaguccucagaa

SEQ ID NO: 37933 - RNA, 22 nt, Homo sapiens
ugccuaggcuggaaugcagugg

SEQ ID NO: 37934 - RNA, 22 nt, Homo sapiens
ugcuagaagaucacacacauca

SEQ ID NO: 37935 - RNA, 22 nt, Homo sapiens
ugcuggugauucagauucaaau

SEQ ID NO: 37936 - RNA, 18 nt, Homo sapiens
ugcuuagucauuuucaau

SEQ ID NO: 37937 - RNA, 21 nt, Homo sapiens
ugcuuuggucauacuucuucc

SEQ ID NO: 37938 - RNA, 22 nt, Homo sapiens
ggacaaaguauuuucaaaugua

SEQ ID NO: 37939 - RNA, 22 nt, Homo sapiens
ggagaugaaaugagcuacuuaa

SEQ ID NO: 37940 - RNA, 22 nt, Homo sapiens
ggaguaggcuguccggcaccca

SEQ ID NO: 37941 - RNA, 17 nt, Homo sapiens
ggcaagaaguggaacuc

SEQ ID NO: 37942 - RNA, 19 nt, Homo sapiens
ggcaauacuuucuuguugg

SEQ ID NO: 37943 - RNA, 22 nt, Homo sapiens
ggcaccauggaaggacgggagc

SEQ ID NO: 37944 - RNA, 23 nt, Homo sapiens
ggcacggaauucaaagaggcauu

SEQ ID NO: 37945 - RNA, 17 nt, Homo sapiens
ggcaggaauuaauguca

SEQ ID NO: 37946 - RNA, 22 nt, Homo sapiens
ggcaguuucucaggcaggggua

SEQ ID NO: 37947 - RNA, 22 nt, Homo sapiens
ggcaguuuguucuugcuccuuu

SEQ ID NO: 37948 - RNA, 22 nt, Homo sapiens
ggcauguugauagguagaugua

SEQ ID NO: 37949 - RNA, 22 nt, Homo sapiens
ggccggguggccauggcugccc

SEQ ID NO: 37950 - RNA, 22 nt, Homo sapiens
ggcucaguugcaaaucaguuca

SEQ ID NO: 37951 - RNA, 22 nt, Homo sapiens
gggagcacaagaaauguuucau

SEQ ID NO: 37952 - RNA, 22 nt, Homo sapiens
gggaguguguaggacccagugu

SEQ ID NO: 37953 - RNA, 23 nt, Homo sapiens
gggauuguaaaauaugagggcag

SEQ ID NO: 37954 - RNA, 22 nt, Homo sapiens
ggggcauugugacauaucucug

SEQ ID NO: 37955 - RNA, 17 nt, Homo sapiens
gggucaccuugcaggua

SEQ ID NO: 37956 - RNA, 22 nt, Homo sapiens
gguauuuaaaguaccugucugc

SEQ ID NO: 37957 - RNA, 22 nt, Homo sapiens
ggugcagcacaccaacauggca

SEQ ID NO: 37958 - RNA, 22 nt, Homo sapiens
guacaguaguaaaagugaauga

SEQ ID NO: 37959 - RNA, 22 nt, Homo sapiens
guaccacaguugcucacggguu

SEQ ID NO: 37960 - RNA, 22 nt, Homo sapiens
guagaaagcauuucagauuugc

SEQ ID NO: 37961 - RNA, 22 nt, Homo sapiens
guaucauugccuaaugcucuca

SEQ ID NO: 37962 - RNA, 22 nt, Homo sapiens
guaucauuggcauguaaccaga

SEQ ID NO: 37963 - RNA, 22 nt, Homo sapiens
guaugcacauauguguauguau

SEQ ID NO: 37964 - RNA, 18 nt, Homo sapiens
guauuccagccugaguga

SEQ ID NO: 37965 - RNA, 22 nt, Homo sapiens
gucaguggagaaaaggacaugu

SEQ ID NO: 37966 - RNA, 22 nt, Homo sapiens
gucauccaggcuggagugaagc

SEQ ID NO: 37967 - RNA, 22 nt, Homo sapiens
gucauucauucagcaagcacug

SEQ ID NO: 37968 - RNA, 22 nt, Homo sapiens
guccaguacucuuuccugaaaa

SEQ ID NO: 37969 - RNA, 22 nt, Homo sapiens
guccauuuguuuccagagcacu

SEQ ID NO: 37970 - RNA, 22 nt, Homo sapiens
guccugaagaccuuccucugga

SEQ ID NO: 37971 - RNA, 22 nt, Homo sapiens
gucguggagucucuggcuugua

SEQ ID NO: 37972 - RNA, 22 nt, Homo sapiens
gucugucuuuugucuuugaaau

SEQ ID NO: 37973 - RNA, 22 nt, Homo sapiens
aauggcuucuuauugugguuca

SEQ ID NO: 37974 - RNA, 22 nt, Homo sapiens
aauguguuuugaaaucaggaag

SEQ ID NO: 37975 - RNA, 22 nt, Homo sapiens
aauucacuucuuuuaggcaggg

SEQ ID NO: 37976 - RNA, 22 nt, Homo sapiens
aauucuguauuguuuagggacu

SEQ ID NO: 37977 - RNA, 22 nt, Homo sapiens
aauucugugagauggugcagau

SEQ ID NO: 37978 - RNA, 22 nt, Homo sapiens
aauugcaccaucuagaucaaga

SEQ ID NO: 37979 - RNA, 22 nt, Homo sapiens
aauugcuucuguauuuuggaca

SEQ ID NO: 37980 - RNA, 23 nt, Homo sapiens
aauugcuuuugaggacuuaguug

SEQ ID NO: 37981 - RNA, 20 nt, Homo sapiens
acagcauagccuuuuaaagc

SEQ ID NO: 37982 - RNA, 22 nt, Homo sapiens
acagguacaagggauuaggaug

SEQ ID NO: 37983 - RNA, 22 nt, Homo sapiens
acagugcuuucaauguucagua

SEQ ID NO: 37984 - RNA, 22 nt, Homo sapiens
acagugcuuuuguuccucuccu

SEQ ID NO: 37985 - RNA, 22 nt, Homo sapiens
acauagaguaguggugaggaug

SEQ ID NO: 37986 - RNA, 22 nt, Homo sapiens
acauaugaguacaugugccaug

SEQ ID NO: 37987 - RNA, 17 nt, Homo sapiens
acaugagacuggauucu

SEQ ID NO: 37988 - RNA, 22 nt, Homo sapiens
acaugcauauguuggaagaaag

SEQ ID NO: 37989 - RNA, 22 nt, Homo sapiens
acaugcauccaugugaagagac

SEQ ID NO: 37990 - RNA, 22 nt, Homo sapiens
acaugcauggcaugcauuguac

SEQ ID NO: 37991 - RNA, 22 nt, Homo sapiens
acauggcuuaugaauuuggaga

SEQ ID NO: 37992 - RNA, 18 nt, Homo sapiens
acauucagcuugaagaua

SEQ ID NO: 37993 - RNA, 22 nt, Homo sapiens
acccagaguuccuugucuuuca

SEQ ID NO: 37994 - RNA, 17 nt, Homo sapiens
acccagucuuuuugcac

SEQ ID NO: 37995 - RNA, 17 nt, Homo sapiens
accccuaccucagaagc

SEQ ID NO: 37996 - RNA, 22 nt, Homo sapiens
acccugucaaaauggaccaauc

SEQ ID NO: 37997 - RNA, 22 nt, Homo sapiens
accucagcccggggaaguugag

SEQ ID NO: 37998 - RNA, 22 nt, Homo sapiens
acuaugcuuuucuuagaauuaa

SEQ ID NO: 37999 - RNA, 22 nt, Homo sapiens
acuccacuuucaccacagcgga

SEQ ID NO: 38000 - RNA, 18 nt, Homo sapiens
acucuguauguggagugg

SEQ ID NO: 38001 - RNA, 22 nt, Homo sapiens
acugcaaugucgaauagagaug

SEQ ID NO: 38002 - RNA, 22 nt, Homo sapiens
acuggcuuaaggaugggccacu

SEQ ID NO: 38003 - RNA, 22 nt, Homo sapiens
acuuugcuuagagggcauuaaa

SEQ ID NO: 38004 - RNA, 22 nt, Homo sapiens
agaagaacauagggugacugaa

SEQ ID NO: 38005 - RNA, 22 nt, Homo sapiens
agacuagagggaaaugaguugg

SEQ ID NO: 38006 - RNA, 22 nt, Homo sapiens
agagaacugauuggaugugggc

SEQ ID NO: 38007 - RNA, 22 nt, Homo sapiens
agagaugauuaacauuuuggua

SEQ ID NO: 38008 - RNA, 22 nt, Homo sapiens
agagauuauccuggcuucucug

SEQ ID NO: 38009 - RNA, 22 nt, Homo sapiens
agagcacugcugcaggguucug

SEQ ID NO: 38010 - RNA, 21 nt, Homo sapiens
agagucaucucuaucuguacc

SEQ ID NO: 38011 - RNA, 22 nt, Homo sapiens
agagugaagcuuuuuauauucu

SEQ ID NO: 38012 - RNA, 23 nt, Homo sapiens
agagugcaauggugccaucucgg

SEQ ID NO: 38013 - RNA, 22 nt, Homo sapiens
agagugcuuuauuagauguagc

SEQ ID NO: 38014 - RNA, 22 nt, Homo sapiens
cugagauaauuucuagguguca

SEQ ID NO: 38015 - RNA, 22 nt, Homo sapiens
cugagaucugaaccaggagugu

SEQ ID NO: 38016 - RNA, 22 nt, Homo sapiens
cugagcaaaaugaagacacgau

SEQ ID NO: 38017 - RNA, 22 nt, Homo sapiens
cugagguacccacuucaucuca

SEQ ID NO: 38018 - RNA, 20 nt, Homo sapiens
cugagguugggguccuuccc

SEQ ID NO: 38019 - RNA, 22 nt, Homo sapiens
cugagguuguucuucucagugg

SEQ ID NO: 38020 - RNA, 22 nt, Homo sapiens
cuggaaagaaucaggcuaaacu

SEQ ID NO: 38021 - RNA, 22 nt, Homo sapiens
cuggaaagcaaguccauugcuc

SEQ ID NO: 38022 - RNA, 22 nt, Homo sapiens
cuggaagcacaacgcauuuauu

SEQ ID NO: 38023 - RNA, 20 nt, Homo sapiens
cuggaugucgaggcagaggu

SEQ ID NO: 38024 - RNA, 22 nt, Homo sapiens
cugguuguuacaaagagccugg

SEQ ID NO: 38025 - RNA, 22 nt, Homo sapiens
cuguauguuucuaugaauguga

SEQ ID NO: 38026 - RNA, 22 nt, Homo sapiens
cugucuaugagccaggaagcca

SEQ ID NO: 38027 - RNA, 22 nt, Homo sapiens
cugucuggaguccuucgugugc

SEQ ID NO: 38028 - RNA, 22 nt, Homo sapiens
cugugaucuuuuuucauguggu

SEQ ID NO: 38029 - RNA, 22 nt, Homo sapiens
cugugcauaucuuggacugugu

SEQ ID NO: 38030 - RNA, 22 nt, Homo sapiens
cugugcauggauuuuaagauug

SEQ ID NO: 38031 - RNA, 22 nt, Homo sapiens
cugugcuuggagucccccuagg

SEQ ID NO: 38032 - RNA, 22 nt, Homo sapiens
cuguucaaauuguuugugaagu

SEQ ID NO: 38033 - RNA, 21 nt, Homo sapiens
cuuaagccacuaaguuuugga

SEQ ID NO: 38034 - RNA, 22 nt, Homo sapiens
cuuccaaguggggcacgugcca

SEQ ID NO: 38035 - RNA, 22 nt, Homo sapiens
cuuccagcuggguucagucagu

SEQ ID NO: 38036 - RNA, 22 nt, Homo sapiens
cuuccauaguauuuuuacaaaa

SEQ ID NO: 38037 - RNA, 22 nt, Homo sapiens
cuugacaaugcuucaggcugaa

SEQ ID NO: 38038 - RNA, 22 nt, Homo sapiens
cuugcacauuacagaucugcau

SEQ ID NO: 38039 - RNA, 22 nt, Homo sapiens
cuuggcauuguguugauagaag

SEQ ID NO: 38040 - RNA, 22 nt, Homo sapiens
cuuguacacuguuggugggaau

SEQ ID NO: 38041 - RNA, 22 nt, Homo sapiens
cuuuggcaaugucauuuucaau

SEQ ID NO: 38042 - RNA, 22 nt, Homo sapiens
cuuugguucuguuuauaugcug

SEQ ID NO: 38043 - RNA, 22 nt, Homo sapiens
gaaagugcugcaaggccaugca

SEQ ID NO: 38044 - RNA, 22 nt, Homo sapiens
gaaagugcugcuugacugggau

SEQ ID NO: 38045 - RNA, 22 nt, Homo sapiens
aguaccacgugaugccauuuuc

SEQ ID NO: 38046 - RNA, 22 nt, Homo sapiens
agucaagaaucucagcaucuuu

SEQ ID NO: 38047 - RNA, 22 nt, Homo sapiens
agucaagauggcaagguaaggc

SEQ ID NO: 38048 - RNA, 20 nt, Homo sapiens
agucaguuuauuuucucucu

SEQ ID NO: 38049 - RNA, 22 nt, Homo sapiens
agugauuuuaacuuccagcaau

SEQ ID NO: 38050 - RNA, 22 nt, Homo sapiens
agugcaguggcacaaucuuggc

SEQ ID NO: 38051 - RNA, 22 nt, Homo sapiens
agugcauuugcaucucaauaua

SEQ ID NO: 38052 - RNA, 22 nt, Homo sapiens
aguuccuacuggcuguaaagaa

SEQ ID NO: 38053 - RNA, 22 nt, Homo sapiens
auaaagcuauuccucucuuuuu

SEQ ID NO: 38054 - RNA, 22 nt, Homo sapiens
auaaaugcaaugguauuuuuga

SEQ ID NO: 38055 - RNA, 22 nt, Homo sapiens
auaaaugccuguuguuuuaagc

SEQ ID NO: 38056 - RNA, 22 nt, Homo sapiens
auaaaugcuuccagucauuaaa

SEQ ID NO: 38057 - RNA, 22 nt, Homo sapiens
auaagaguaguacauaugagac

SEQ ID NO: 38058 - RNA, 22 nt, Homo sapiens
auaaggcagcugcuaaaaggca

SEQ ID NO: 38059 - RNA, 22 nt, Homo sapiens
auaauacugggaagaugagcau

SEQ ID NO: 38060 - RNA, 18 nt, Homo sapiens
auacaagcagcagagauu

SEQ ID NO: 38061 - RNA, 22 nt, Homo sapiens
auacaagcaguccaacuccaua

SEQ ID NO: 38062 - RNA, 22 nt, Homo sapiens
auacagguauacaaugcauaau

SEQ ID NO: 38063 - RNA, 16 nt, Homo sapiens
auaccacagugacaca

SEQ ID NO: 38064 - RNA, 20 nt, Homo sapiens
auagaagacuagugcagcag

SEQ ID NO: 38065 - RNA, 22 nt, Homo sapiens
auagagcuaccauagaauccag

SEQ ID NO: 38066 - RNA, 22 nt, Homo sapiens
auaguagagagggcaaaaugcu

SEQ ID NO: 38067 - RNA, 22 nt, Homo sapiens
auauguaguauggaaacauugu

SEQ ID NO: 38068 - RNA, 22 nt, Homo sapiens
auaugucuauuauuagggcagg

SEQ ID NO: 38069 - RNA, 22 nt, Homo sapiens
auauugcuuagugaugaagucu

SEQ ID NO: 38070 - RNA, 22 nt, Homo sapiens
aucaagcuggcauauguaguuc

SEQ ID NO: 38071 - RNA, 22 nt, Homo sapiens
aucaaguaguuauacguaaagg

SEQ ID NO: 38072 - RNA, 22 nt, Homo sapiens
aucacuuucuauuucugugcca

SEQ ID NO: 38073 - RNA, 22 nt, Homo sapiens
aucacuuugcucuccagugugg

SEQ ID NO: 38074 - RNA, 22 nt, Homo sapiens
aucagcagcaugaaaacaggcu

SEQ ID NO: 38075 - RNA, 22 nt, Homo sapiens
aucagcagcaugaaaacggacu

SEQ ID NO: 38076 - RNA, 22 nt, Homo sapiens
aucauguaguaagacacauuua

SEQ ID NO: 38077 - RNA, 22 nt, Homo sapiens
auccacaugcaguuggaaacag

SEQ ID NO: 38078 - RNA, 22 nt, Homo sapiens
auccucugagagaguuucauaa

SEQ ID NO: 38079 - RNA, 22 nt, Homo sapiens
auccucugagaucuaggcagag

SEQ ID NO: 38080 - RNA, 22 nt, Homo sapiens
aucucauuccuucugggcugau

SEQ ID NO: 38081 - RNA, 22 nt, Homo sapiens
aucugggguuggcaaaguuugg

SEQ ID NO: 38082 - RNA, 22 nt, Homo sapiens
aucuuuggcgggaauaucacag

SEQ ID NO: 38083 - RNA, 22 nt, Homo sapiens
aucuuuggucaucacagcuaga

SEQ ID NO: 38084 - RNA, 22 nt, Homo sapiens
augaaacuggcuaauuuuugua

SEQ ID NO: 38085 - RNA, 23 nt, Homo sapiens
augaaagcccuugcaaaugcugg

SEQ ID NO: 38086 - RNA, 22 nt, Homo sapiens
augaaagguauguuuucuguga

SEQ ID NO: 38087 - RNA, 22 nt, Homo sapiens
augaacacuccaauuguacucc

SEQ ID NO: 38088 - RNA, 22 nt, Homo sapiens
augaauuuucugauguugggua

SEQ ID NO: 38089 - RNA, 22 nt, Homo sapiens
augacuaaaggguuuauguuga

SEQ ID NO: 38090 - RNA, 22 nt, Homo sapiens
augacuuuucugaaaaccacca

SEQ ID NO: 38091 - RNA, 22 nt, Homo sapiens
augagacuagaagagaauaaua

SEQ ID NO: 38092 - RNA, 22 nt, Homo sapiens
augagcaaagagaugagacccu

SEQ ID NO: 38093 - RNA, 22 nt, Homo sapiens
augagguauccaagcccagaaa

SEQ ID NO: 38094 - RNA, 22 nt, Homo sapiens
augauggagguagauuguccau

SEQ ID NO: 38095 - RNA, 18 nt, Homo sapiens
augcauauuuuaaguugu

SEQ ID NO: 38096 - RNA, 22 nt, Homo sapiens
augcauauuuuaccuagaagag

SEQ ID NO: 38097 - RNA, 22 nt, Homo sapiens
augcauggagucuuucacaagu

SEQ ID NO: 38098 - RNA, 22 nt, Homo sapiens
augccagggagaauuguucaag

SEQ ID NO: 38099 - RNA, 19 nt, Homo sapiens
uagcagcaugauuuauaau

SEQ ID NO: 38100 - RNA, 22 nt, Homo sapiens
uagcagguguuccacaaauauu

SEQ ID NO: 38101 - RNA, 22 nt, Homo sapiens
uagcauaauuuguagaaaauca

SEQ ID NO: 38102 - RNA, 21 nt, Homo sapiens
uagcugaugauguaggggaug

SEQ ID NO: 38103 - RNA, 22 nt, Homo sapiens
uagcugcaaaauauagacuucu

SEQ ID NO: 38104 - RNA, 20 nt, Homo sapiens
uaggagcaaugagaguagaa

SEQ ID NO: 38105 - RNA, 22 nt, Homo sapiens
uaggagcacagcagcauguggg

SEQ ID NO: 38106 - RNA, 22 nt, Homo sapiens
uaggcagccagcuguggauuga

SEQ ID NO: 38107 - RNA, 22 nt, Homo sapiens
uaggcaguuuuccuuucacagu

SEQ ID NO: 38108 - RNA, 22 nt, Homo sapiens
uaggcuguguggccguggggcu

SEQ ID NO: 38109 - RNA, 22 nt, Homo sapiens
uaggcuuuucugggaugugggc

SEQ ID NO: 38110 - RNA, 22 nt, Homo sapiens
uaggugaauguaguaagguguu

SEQ ID NO: 38111 - RNA, 22 nt, Homo sapiens
uaggugcacaguaaauauaugu

SEQ ID NO: 38112 - RNA, 22 nt, Homo sapiens
uauacugucuuuguaugccuag

SEQ ID NO: 38113 - RNA, 22 nt, Homo sapiens
uauagagguagguuaauuggaa

SEQ ID NO: 38114 - RNA, 22 nt, Homo sapiens
uaucacaguaucuagcacagug

SEQ ID NO: 38115 - RNA, 20 nt, Homo sapiens
uaucacaguucaggaacucu

SEQ ID NO: 38116 - RNA, 22 nt, Homo sapiens
uaucagcacaguggguucaugg

SEQ ID NO: 38117 - RNA, 22 nt, Homo sapiens
uaucccuuagagcggggugguu

SEQ ID NO: 38118 - RNA, 22 nt, Homo sapiens
uaugaauuuuauccaggauaua

SEQ ID NO: 38119 - RNA, 20 nt, Homo sapiens
uaugacaaagccuagugagu

SEQ ID NO: 38120 - RNA, 22 nt, Homo sapiens
uaugcacaugcaugcuugaaua

SEQ ID NO: 38121 - RNA, 22 nt, Homo sapiens
uaugcagacauuguuccaacca

SEQ ID NO: 38122 - RNA, 22 nt, Homo sapiens
uauggauuuuuuugacaagagc

SEQ ID NO: 38123 - RNA, 22 nt, Homo sapiens
uauggcuaugggaacugggagu

SEQ ID NO: 38124 - RNA, 22 nt, Homo sapiens
uauggcucuauuuccuugucua

SEQ ID NO: 38125 - RNA, 22 nt, Homo sapiens
uauggcuuuguuaacauuuucu

SEQ ID NO: 38126 - RNA, 22 nt, Homo sapiens
uauggcuuuucacuuaaguccu

SEQ ID NO: 38127 - RNA, 22 nt, Homo sapiens
uauuccauuugugaaaggaagu

SEQ ID NO: 38128 - RNA, 22 nt, Homo sapiens
uauugcagauacccaggaaguu

SEQ ID NO: 38129 - RNA, 22 nt, Homo sapiens
ucuggcuuuagcaugugggaag

SEQ ID NO: 38130 - RNA, 22 nt, Homo sapiens
ucuggguuuuuacaauguuuac

SEQ ID NO: 38131 - RNA, 22 nt, Homo sapiens
ucuggguuuuuccauugccggu

SEQ ID NO: 38132 - RNA, 23 nt, Homo sapiens
ucugguguugucaaaugcugguu

SEQ ID NO: 38133 - RNA, 22 nt, Homo sapiens
ucugguuccugcauucauucaa

SEQ ID NO: 38134 - RNA, 22 nt, Homo sapiens
ucuguaguuaacagcuucagcu

SEQ ID NO: 38135 - RNA, 22 nt, Homo sapiens
ucuguguuugguuggcaauuuc

SEQ ID NO: 38136 - RNA, 22 nt, Homo sapiens
ucuucuagcggaacccucuugu

SEQ ID NO: 38137 - RNA, 22 nt, Homo sapiens
ucuuuagugacaguugugcaag

SEQ ID NO: 38138 - RNA, 22 nt, Homo sapiens
ucuuugggauauucugaaaggg

SEQ ID NO: 38139 - RNA, 22 nt, Homo sapiens
ucuuuggguagauauguagcug

SEQ ID NO: 38140 - RNA, 22 nt, Homo sapiens
ucuuuggguguauuucacagcc

SEQ ID NO: 38141 - RNA, 22 nt, Homo sapiens
ucuuugguucuguuuauguaau

SEQ ID NO: 38142 - RNA, 22 nt, Homo sapiens
ucuuuguuagaacccucuccuu

SEQ ID NO: 38143 - RNA, 22 nt, Homo sapiens
ugaaaguaauugcaguuuuuac

SEQ ID NO: 38144 - RNA, 22 nt, Homo sapiens
ugaaaugccuuuaaugaauuua

SEQ ID NO: 38145 - RNA, 22 nt, Homo sapiens
ugaaauguguuaucugggccug

SEQ ID NO: 38146 - RNA, 22 nt, Homo sapiens
ugaaggcaggagggagaaaagu

SEQ ID NO: 38147 - RNA, 22 nt, Homo sapiens
ugaagggcauuguuuugccaaa

SEQ ID NO: 38148 - RNA, 21 nt, Homo sapiens
ugaaguagcauaggaugucaa

SEQ ID NO: 38149 - RNA, 20 nt, Homo sapiens
ugacaagugagaauuauggg

SEQ ID NO: 38150 - RNA, 22 nt, Homo sapiens
ugacacauguagacaucuggug

SEQ ID NO: 38151 - RNA, 22 nt, Homo sapiens
ugacagaggucuuuuaauagcu

SEQ ID NO: 38152 - RNA, 18 nt, Homo sapiens
ugacagcacaugugggga

SEQ ID NO: 38153 - RNA, 22 nt, Homo sapiens
ugacaggagauuaugugauguu

SEQ ID NO: 38154 - RNA, 20 nt, Homo sapiens
ugacaguuaagggauagaag

SEQ ID NO: 38155 - RNA, 21 nt, Homo sapiens
ugacauuauuucaugucagua

SEQ ID NO: 38156 - RNA, 22 nt, Homo sapiens
ugacuaggaggcuggaggauga

SEQ ID NO: 38157 - RNA, 22 nt, Homo sapiens
ugagaacucaugggucugcugg

SEQ ID NO: 38158 - RNA, 22 nt, Homo sapiens
ugagaacugguagcacuuguga

SEQ ID NO: 38159 - RNA, 22 nt, Homo sapiens
ugagacauacuuacaggggaug

SEQ ID NO: 38160 - RNA, 21 nt, Homo sapiens
ugagauaauauguuucugaug

SEQ ID NO: 38161 - RNA, 22 nt, Homo sapiens
ugagauaaucaugugguuuuug

SEQ ID NO: 38162 - RNA, 22 nt, Homo sapiens
ugagauagggucucacucuguc

SEQ ID NO: 38163 - RNA, 19 nt, Homo sapiens
ugagauccacugaagauuc

SEQ ID NO: 38164 - RNA, 22 nt, Homo sapiens
uggcaaaaaaccgcaguugccu

SEQ ID NO: 38165 - RNA, 22 nt, Homo sapiens
uggcaaagugugacgugggggu

SEQ ID NO: 38166 - RNA, 22 nt, Homo sapiens
uggcaaauuccaaaguuaauuc

SEQ ID NO: 38167 - RNA, 22 nt, Homo sapiens
uggcaagaaccacaguuacuuu

SEQ ID NO: 38168 - RNA, 22 nt, Homo sapiens
uggcaagaaggauuuauuccuu

SEQ ID NO: 38169 - RNA, 22 nt, Homo sapiens
uggcaagagggaugcaagguuu

SEQ ID NO: 38170 - RNA, 22 nt, Homo sapiens
uggcaagaucacaauuacuuuu

SEQ ID NO: 38171 - RNA, 18 nt, Homo sapiens
uggcaauaugguucuacc

SEQ ID NO: 38172 - RNA, 22 nt, Homo sapiens
uggcaguuuacaaaugccauga

SEQ ID NO: 38173 - RNA, 19 nt, Homo sapiens
uggcaugaaugugaacuaa

SEQ ID NO: 38174 - RNA, 17 nt, Homo sapiens
uggcaugaggguguggg

SEQ ID NO: 38175 - RNA, 22 nt, Homo sapiens
uggcaugauguguucauugaaa

SEQ ID NO: 38176 - RNA, 22 nt, Homo sapiens
uggcccccucccaaaucucaua

SEQ ID NO: 38177 - RNA, 22 nt, Homo sapiens
uggccuguaacccucucauagg

SEQ ID NO: 38178 - RNA, 22 nt, Homo sapiens
uggccuguaacgcugucucagc

SEQ ID NO: 38179 - RNA, 22 nt, Homo sapiens
uggcggagacauggacuucaga

SEQ ID NO: 38180 - RNA, 22 nt, Homo sapiens
uggcuguuguuacuaacaguuc

SEQ ID NO: 38181 - RNA, 22 nt, Homo sapiens
uggcuguuuauuucaccuggau

SEQ ID NO: 38182 - RNA, 22 nt, Homo sapiens
uggcuguuuauuucacgugggu

SEQ ID NO: 38183 - RNA, 22 nt, Homo sapiens
ugggauguagccuucuauuuuc

SEQ ID NO: 38184 - RNA, 22 nt, Homo sapiens
uggggcuuuuucuuguauucuc

SEQ ID NO: 38185 - RNA, 22 nt, Homo sapiens
uggggugugagggagaaagaaa

SEQ ID NO: 38186 - RNA, 22 nt, Homo sapiens
uggguaggaccagaaaugcacu

SEQ ID NO: 38187 - RNA, 22 nt, Homo sapiens
uggguaggcccucauuggacag

SEQ ID NO: 38188 - RNA, 22 nt, Homo sapiens
ugguaagaaaaccauuauuagc

SEQ ID NO: 38189 - RNA, 22 nt, Homo sapiens
ugguauuuaauauaugagaguu

SEQ ID NO: 38190 - RNA, 22 nt, Homo sapiens
uggucaaaugccaaucuguagu

SEQ ID NO: 38191 - RNA, 22 nt, Homo sapiens
uggugcuuaaauaaggcuuuca

SEQ ID NO: 38192 - RNA, 20 nt, Homo sapiens
ugguguuugaacagugaaug

SEQ ID NO: 38193 - RNA, 22 nt, Homo sapiens
uguaaaaagcccagccgcugag

SEQ ID NO: 38194 - RNA, 22 nt, Homo sapiens
uguacaaauuucugugguggug

SEQ ID NO: 38195 - RNA, 22 nt, Homo sapiens
uguagacaccaaagacagcaua

SEQ ID NO: 38196 - RNA, 22 nt, Homo sapiens
uguaugagagugaaagcauuuc

SEQ ID NO: 38197 - RNA, 16 nt, Homo sapiens
uguauugcuaaaaaga

SEQ ID NO: 38198 - RNA, 22 nt, Homo sapiens
ugucagcacaacucagguuccu

SEQ ID NO: 38199 - RNA, 22 nt, Homo sapiens
uguccauuuuuaugcuuauggu

SEQ ID NO: 38200 - RNA, 22 nt, Homo sapiens
ugucccguuuucgaggcugcag

SEQ ID NO: 38201 - RNA, 22 nt, Homo sapiens
ugucuagaaaagccugccuucu

SEQ ID NO: 38202 - RNA, 22 nt, Homo sapiens
ugucucggagaucucucaaagu

SEQ ID NO: 38203 - RNA, 22 nt, Homo sapiens
ugucuggaaggguggccuccug

SEQ ID NO: 38204 - RNA, 22 nt, Homo sapiens
ugucuggaguccauagaagugu

SEQ ID NO: 38205 - RNA, 22 nt, Homo sapiens
ugucuuuguuaguuguccuagu

SEQ ID NO: 38206 - RNA, 22 nt, Homo sapiens
ugugaacugagcauuaacuaca

SEQ ID NO: 38207 - RNA, 22 nt, Homo sapiens
ugugaagauggacuaauauagu

SEQ ID NO: 38208 - RNA, 22 nt, Homo sapiens
ugugaauggugcugccgugaag

SEQ ID NO: 38209 - RNA, 22 nt, Homo sapiens
ugugccacugcacuccugccug

SEQ ID NO: 38210 - RNA, 22 nt, Homo sapiens
ugugccacugcacucugggcaa

SEQ ID NO: 38211 - RNA, 22 nt, Homo sapiens
ugugccuucuaagaaggagucu

SEQ ID NO: 38212 - RNA, 22 nt, Homo sapiens
uguggcaaauggucaggaagaa

SEQ ID NO: 38213 - RNA, 22 nt, Homo sapiens
uguggcuuuacagcaugguuca

SEQ ID NO: 38214 - RNA, 22 nt, Homo sapiens
ugugguuuuauaaacgugaccu

SEQ ID NO: 38215 - RNA, 22 nt, Homo sapiens
uguuacagcagaauugaaagag

SEQ ID NO: 38216 - RNA, 22 nt, Homo sapiens
uguuacagugacuaauguuuua

SEQ ID NO: 38217 - RNA, 22 nt, Homo sapiens
uguuauugagguuacuuauaag

SEQ ID NO: 38218 - RNA, 22 nt, Homo sapiens
uguucuggagccgguucaaaug

SEQ ID NO: 38219 - RNA, 22 nt, Homo sapiens
uguucuugagccuuuagaccua

SEQ ID NO: 38220 - RNA, 22 nt, Homo sapiens
uguuugcuguuuucuccaauga

SEQ ID NO: 38221 - RNA, 22 nt, Homo sapiens
uguuuguuugagauggagucuc

SEQ ID NO: 38222 - RNA, 22 nt, Homo sapiens
uuaaaaguauaggccuggcaua

SEQ ID NO: 38223 - RNA, 22 nt, Homo sapiens
uuaaagugaucauaaggauagu

SEQ ID NO: 38224 - RNA, 22 nt, Homo sapiens
uuaaaugcucacauaaagguag

SEQ ID NO: 38225 - RNA, 22 nt, Homo sapiens
uuaagaagugauuuuccucauu

SEQ ID NO: 38226 - RNA, 22 nt, Homo sapiens
uuaagagcauggugccagguug

SEQ ID NO: 38227 - RNA, 22 nt, Homo sapiens
uuaagucacacuagacaacuga

SEQ ID NO: 38228 - RNA, 22 nt, Homo sapiens
uuaauagcaaagaguuuagacu

SEQ ID NO: 38229 - RNA, 22 nt, Homo sapiens
uuaaucaggccguuuccuaaga

SEQ ID NO: 38230 - RNA, 22 nt, Homo sapiens
uuacagguggagaaguaaggcu

SEQ ID NO: 38231 - RNA, 22 nt, Homo sapiens
uuacagucuuaggcagugcuuu

SEQ ID NO: 38232 - RNA, 22 nt, Homo sapiens
uuaccacagugccugucuaaug

SEQ ID NO: 38233 - RNA, 22 nt, Homo sapiens
uuacuguagugucauaucguau

SEQ ID NO: 38234 - RNA, 22 nt, Homo sapiens
uuacuugagauggggugucacu

SEQ ID NO: 38235 - RNA, 22 nt, Homo sapiens
uuagagcacugaucugcucuuu

SEQ ID NO: 38236 - RNA, 22 nt, Homo sapiens
uuagcagcucuggugacaaggu

SEQ ID NO: 38237 - RNA, 22 nt, Homo sapiens
uuagggaggagucccucuuuuu

SEQ ID NO: 38238 - RNA, 22 nt, Homo sapiens
uuagggaguaaucuaaaaaugg

SEQ ID NO: 38239 - RNA, 22 nt, Homo sapiens
uuauaugcuaaacaaggggugg

SEQ ID NO: 38240 - RNA, 22 nt, Homo sapiens
uuaugcagcaaagugcuugaaa

SEQ ID NO: 38241 - RNA, 22 nt, Homo sapiens
uuaugcaucuuccacacucauu

SEQ ID NO: 38242 - RNA, 22 nt, Homo sapiens
aaagcaucacuuuuccuacuuu

SEQ ID NO: 38243 - RNA, 22 nt, Homo sapiens
aaagcuaccagauucuguugga

SEQ ID NO: 38244 - RNA, 22 nt, Homo sapiens
aaaguacugggauuggccgggu

SEQ ID NO: 38245 - RNA, 17 nt, Homo sapiens
aaaguccuuugcuaucu

SEQ ID NO: 38246 - RNA, 22 nt, Homo sapiens
aaagugaauguaucccguaagu

SEQ ID NO: 38247 - RNA, 22 nt, Homo sapiens
aaagugcacuuggaagagggcc

SEQ ID NO: 38248 - RNA, 22 nt, Homo sapiens
aaagugcuaggauuaccugggg

SEQ ID NO: 38249 - RNA, 22 nt, Homo sapiens
aaagugcugggauuggcugggc

SEQ ID NO: 38250 - RNA, 22 nt, Homo sapiens
aaagugcuguagacugggcgca

SEQ ID NO: 38251 - RNA, 22 nt, Homo sapiens
aaagugcuuccuuuuugagggu

SEQ ID NO: 38252 - RNA, 22 nt, Homo sapiens
aaaguggacuaagugaauauga

SEQ ID NO: 38253 - RNA, 22 nt, Homo sapiens
aaaugcagucuuuguucugggc

SEQ ID NO: 38254 - RNA, 22 nt, Homo sapiens
aaauugcuuuugaagacuuagu

SEQ ID NO: 38255 - RNA, 22 nt, Homo sapiens
aacagauugcugagccccaccc

SEQ ID NO: 38256 - RNA, 22 nt, Homo sapiens
aacagucaauugcugaugaccu

SEQ ID NO: 38257 - RNA, 22 nt, Homo sapiens
aaccuauaguauugaaaucaag

SEQ ID NO: 38258 - RNA, 22 nt, Homo sapiens
aacuaggccuagaaguugagua

SEQ ID NO: 38259 - RNA, 22 nt, Homo sapiens
aacuaugucaaauaaaaugagg

SEQ ID NO: 38260 - RNA, 22 nt, Homo sapiens
aacugccucugacauaggcagg

SEQ ID NO: 38261 - RNA, 22 nt, Homo sapiens
aagagcauuauuuaguaauuuc

SEQ ID NO: 38262 - RNA, 22 nt, Homo sapiens
aagagcucauccauaguuguca

SEQ ID NO: 38263 - RNA, 22 nt, Homo sapiens
aagauagcuaagcuucuucuaa

SEQ ID NO: 38264 - RNA, 22 nt, Homo sapiens
aagaugcagucauacuggagga

SEQ ID NO: 38265 - RNA, 22 nt, Homo sapiens
aagaugcagucauacuggagua

SEQ ID NO: 38266 - RNA, 22 nt, Homo sapiens
aagcacccuuugucuggacaug

SEQ ID NO: 38267 - RNA, 22 nt, Homo sapiens
aagcuggcuuucauugagugcu

SEQ ID NO: 38268 - RNA, 22 nt, Homo sapiens
aaggaguaucuguuuucucacc

SEQ ID NO: 38269 - RNA, 22 nt, Homo sapiens
aaggcuauuugagaaugugugu

SEQ ID NO: 38270 - RNA, 20 nt, Homo sapiens
aaggcuuucgaguuccaggg

SEQ ID NO: 38271 - RNA, 22 nt, Homo sapiens
aagguguagucucuggauaagc

SEQ ID NO: 38272 - RNA, 22 nt, Homo sapiens
aaguaguuaggaacauucucuc

SEQ ID NO: 38273 - RNA, 22 nt, Homo sapiens
aaguauagcuaugauaaacauu

SEQ ID NO: 38274 - RNA, 19 nt, Homo sapiens
aagugaaugcuuuguucac

SEQ ID NO: 38275 - RNA, 22 nt, Homo sapiens
aagugaauucauuguguuauau

SEQ ID NO: 38276 - RNA, 22 nt, Homo sapiens
aagugacuagacuaugaaaccu

SEQ ID NO: 38277 - RNA, 22 nt, Homo sapiens
auauucacagguaucagagauu

SEQ ID NO: 38278 - RNA, 22 nt, Homo sapiens
aucaaaguuucccagaaguugu

SEQ ID NO: 38279 - RNA, 22 nt, Homo sapiens
aucacaggucaaaucauuauuu

SEQ ID NO: 38280 - RNA, 19 nt, Homo sapiens
aucaccauuauuuggaaca

SEQ ID NO: 38281 - RNA, 21 nt, Homo sapiens
aucagagacccaggcuuccuc

SEQ ID NO: 38282 - RNA, 20 nt, Homo sapiens
aucagagacuaggauugcca

SEQ ID NO: 38283 - RNA, 20 nt, Homo sapiens
aucagagccggugaaagggc

SEQ ID NO: 38284 - RNA, 22 nt, Homo sapiens
aucagauggcuaaaacagaaga

SEQ ID NO: 38285 - RNA, 22 nt, Homo sapiens
aucagugauugauuuaaagacg

SEQ ID NO: 38286 - RNA, 22 nt, Homo sapiens
aucaucaugcacuacagccugg

SEQ ID NO: 38287 - RNA, 22 nt, Homo sapiens
auccugagacuuuucugaaguu

SEQ ID NO: 38288 - RNA, 22 nt, Homo sapiens
aucucauggagguagagaguaa

SEQ ID NO: 38289 - RNA, 22 nt, Homo sapiens
aucuggcuucuuuuaguccaca

SEQ ID NO: 38290 - RNA, 22 nt, Homo sapiens
aucugguguauuggugcugggu

SEQ ID NO: 38291 - RNA, 22 nt, Homo sapiens
aucuuguguugaauggugcaga

SEQ ID NO: 38292 - RNA, 22 nt, Homo sapiens
augaaagguugucuuaagccau

SEQ ID NO: 38293 - RNA, 22 nt, Homo sapiens
augagagcuaacuguggguaca

SEQ ID NO: 38294 - RNA, 22 nt, Homo sapiens
augagaugauaggcguucuaac

SEQ ID NO: 38295 - RNA, 19 nt, Homo sapiens
augagcaauaguuuuaauc

SEQ ID NO: 38296 - RNA, 22 nt, Homo sapiens
augauaaguuauuagaagaaga

SEQ ID NO: 38297 - RNA, 22 nt, Homo sapiens
augcaaacaucugaagagacau

SEQ ID NO: 38298 - RNA, 22 nt, Homo sapiens
augcagaucacauuuuucuguc

SEQ ID NO: 38299 - RNA, 22 nt, Homo sapiens
augcauaugucuuuauaguggc

SEQ ID NO: 38300 - RNA, 19 nt, Homo sapiens
augccacagugaggucaga

SEQ ID NO: 38301 - RNA, 22 nt, Homo sapiens
augcuacuggacaauggugacu

SEQ ID NO: 38302 - RNA, 22 nt, Homo sapiens
augcuguuuugaauucucuaga

SEQ ID NO: 38303 - RNA, 22 nt, Homo sapiens
auggaagcauaguauucuauug

SEQ ID NO: 38304 - RNA, 22 nt, Homo sapiens
auggaggccuacagaauuuugg

SEQ ID NO: 38305 - RNA, 22 nt, Homo sapiens
auggauuuuaggauacaguuga

SEQ ID NO: 38306 - RNA, 22 nt, Homo sapiens
auggcaaaaaaugcaauuacuu

SEQ ID NO: 38307 - RNA, 22 nt, Homo sapiens
auggcucuguuccaugugucuu

SEQ ID NO: 38308 - RNA, 22 nt, Homo sapiens
auggcucuuauuauuugaggua

SEQ ID NO: 38309 - RNA, 22 nt, Homo sapiens
auggcucuuauuauuuugaggu

SEQ ID NO: 38310 - RNA, 22 nt, Homo sapiens
auggcugugaaaugguaggugg

SEQ ID NO: 38311 - RNA, 22 nt, Homo sapiens
auggcugugagaucgacuuauu

SEQ ID NO: 38312 - RNA, 22 nt, Homo sapiens
auggcuguuuaagaguuucauu

SEQ ID NO: 38313 - RNA, 22 nt, Homo sapiens
auggcuuuguguucagagcuga

SEQ ID NO: 38314 - RNA, 22 nt, Homo sapiens
augggaaaaucagaaggccugg

SEQ ID NO: 38315 - RNA, 22 nt, Homo sapiens
augggcaaauguuggaaauucc

SEQ ID NO: 38316 - RNA, 22 nt, Homo sapiens
augguacucucuugucugcaaa

SEQ ID NO: 38317 - RNA, 22 nt, Homo sapiens
augguuuuacugcaaaauggga

SEQ ID NO: 38318 - RNA, 20 nt, Homo sapiens
augugcuaauauuaauaugu

SEQ ID NO: 38319 - RNA, 22 nt, Homo sapiens
augugcuuaaaaaugcagagaa

SEQ ID NO: 38320 - RNA, 22 nt, Homo sapiens
augugcuuauagguguauguuu

SEQ ID NO: 38321 - RNA, 22 nt, Homo sapiens
auguggcacuugacuuucucgc

SEQ ID NO: 38322 - RNA, 22 nt, Homo sapiens
auuaagugaaugaaguuguucc

SEQ ID NO: 38323 - RNA, 22 nt, Homo sapiens
auucacuuuuauagacaggucu

SEQ ID NO: 38324 - RNA, 22 nt, Homo sapiens
auuccacaguuaacacagaccg

SEQ ID NO: 38325 - RNA, 22 nt, Homo sapiens
auugaacacuucugugugccag

SEQ ID NO: 38326 - RNA, 22 nt, Homo sapiens
auugacacugauuuuucuuuaa

SEQ ID NO: 38327 - RNA, 18 nt, Homo sapiens
auugcacaccagccuggg

SEQ ID NO: 38328 - RNA, 22 nt, Homo sapiens
auugcacaccagucugggcaaa

SEQ ID NO: 38329 - RNA, 22 nt, Homo sapiens
auugcacucugaucugcacucc

SEQ ID NO: 38330 - RNA, 22 nt, Homo sapiens
auugcccaggcuggagugcagu

SEQ ID NO: 38331 - RNA, 22 nt, Homo sapiens
auugcucaaaucaguacuugag

SEQ ID NO: 38332 - RNA, 22 nt, Homo sapiens
auugcuuacccuguauuagauc

SEQ ID NO: 38333 - RNA, 22 nt, Homo sapiens
auuggacagcauuucuagacuu

SEQ ID NO: 38334 - RNA, 22 nt, Homo sapiens
auuggggaaugguggcuuuagu

SEQ ID NO: 38335 - RNA, 22 nt, Homo sapiens
auuguacuccagccuguggagc

SEQ ID NO: 38336 - RNA, 22 nt, Homo sapiens
auuguacucuagccucugggca

SEQ ID NO: 38337 - RNA, 19 nt, Homo sapiens
auuugaucaucaggcacag

SEQ ID NO: 38338 - RNA, 22 nt, Homo sapiens
auuuggcaauuuugaagaugcc

SEQ ID NO: 38339 - RNA, 22 nt, Homo sapiens
auuuuugguugguaggcuauua

SEQ ID NO: 38340 - RNA, 22 nt, Homo sapiens
caaaggugcuuuccagguccaa

SEQ ID NO: 38341 - RNA, 22 nt, Homo sapiens
caaagugcuggaauuggccggg

SEQ ID NO: 38342 - RNA, 22 nt, Homo sapiens
caaagugcugggaugggccagg

SEQ ID NO: 38343 - RNA, 22 nt, Homo sapiens
caacacuguuuauuggauagcc

SEQ ID NO: 38344 - RNA, 22 nt, Homo sapiens
caacaguaaagcauuuuuaagu

SEQ ID NO: 38345 - RNA, 22 nt, Homo sapiens
cuuugcaaauggccuuuccaag

SEQ ID NO: 38346 - RNA, 18 nt, Homo sapiens
gaagaaguaggcauggca

SEQ ID NO: 38347 - RNA, 22 nt, Homo sapiens
gaagguaguuuauagauguggu

SEQ ID NO: 38348 - RNA, 22 nt, Homo sapiens
gaauagugcugcaagaaacaua

SEQ ID NO: 38349 - RNA, 22 nt, Homo sapiens
gaaucacaguuauuagagcagc

SEQ ID NO: 38350 - RNA, 22 nt, Homo sapiens
gacugaggaagcgcucucuccu

SEQ ID NO: 38351 - RNA, 22 nt, Homo sapiens
gagagcaugugcuggcaucagu

SEQ ID NO: 38352 - RNA, 22 nt, Homo sapiens
gagauaaauaggucacaguucu

SEQ ID NO: 38353 - RNA, 22 nt, Homo sapiens
gagaucaaugggauggaauuga

SEQ ID NO: 38354 - RNA, 22 nt, Homo sapiens
gagaucauucugauccagaguc

SEQ ID NO: 38355 - RNA, 22 nt, Homo sapiens
gagaugaagugucaauaaggau

SEQ ID NO: 38356 - RNA, 22 nt, Homo sapiens
gagcacccuuuguugauugcaa

SEQ ID NO: 38357 - RNA, 22 nt, Homo sapiens
gagcaguugagagugcuggcca

SEQ ID NO: 38358 - RNA, 22 nt, Homo sapiens
gagccuguaggaggagaggugg

SEQ ID NO: 38359 - RNA, 22 nt, Homo sapiens
gagcugguccuuuaaggaugca

SEQ ID NO: 38360 - RNA, 22 nt, Homo sapiens
gaggcagucuguccauucucag

SEQ ID NO: 38361 - RNA, 22 nt, Homo sapiens
gaggcuagauggggaugugucc

SEQ ID NO: 38362 - RNA, 22 nt, Homo sapiens
gagggcacugcuuuccuuucaa

SEQ ID NO: 38363 - RNA, 22 nt, Homo sapiens
gagguaagaaagucaguccuuc

SEQ ID NO: 38364 - RNA, 22 nt, Homo sapiens
gagguaagaguuuuccauuucu

SEQ ID NO: 38365 - RNA, 22 nt, Homo sapiens
gagguaagaugauucguguccu

SEQ ID NO: 38366 - RNA, 22 nt, Homo sapiens
gagguagagacuauguauuaga

SEQ ID NO: 38367 - RNA, 22 nt, Homo sapiens
gaggugauaucucauugugguu

SEQ ID NO: 38368 - RNA, 22 nt, Homo sapiens
gagguguagucaugccaagauc

SEQ ID NO: 38369 - RNA, 20 nt, Homo sapiens
aagugaguguuaaacugaac

SEQ ID NO: 38370 - RNA, 22 nt, Homo sapiens
aagugcucuugaaacugccuua

SEQ ID NO: 38371 - RNA, 22 nt, Homo sapiens
aaguggaauguuuguggcacaa

SEQ ID NO: 38372 - RNA, 22 nt, Homo sapiens
aauaaagcagcuuuuugggacu

SEQ ID NO: 38373 - RNA, 22 nt, Homo sapiens
aauacugugauaucgagcgauu

SEQ ID NO: 38374 - RNA, 22 nt, Homo sapiens
agacuagaaaucauuuguugag

SEQ ID NO: 38375 - RNA, 21 nt, Homo sapiens
agagaacugaaacaugugacu

SEQ ID NO: 38376 - RNA, 22 nt, Homo sapiens
agagaccuguaaaguucaggca

SEQ ID NO: 38377 - RNA, 22 nt, Homo sapiens
agagaucaauaugaaggaaaug

SEQ ID NO: 38378 - RNA, 22 nt, Homo sapiens
agagguaagaauaguaguugga

SEQ ID NO: 38379 - RNA, 22 nt, Homo sapiens
agagguuuaauugauucacagu

SEQ ID NO: 38380 - RNA, 22 nt, Homo sapiens
agagguuuuggggcugagagcu

SEQ ID NO: 38381 - RNA, 22 nt, Homo sapiens
agaugccucauguucuagguuc

SEQ ID NO: 38382 - RNA, 17 nt, Homo sapiens
agcaccacacucucuug

SEQ ID NO: 38383 - RNA, 22 nt, Homo sapiens
agcaccauugcacuccagccug

SEQ ID NO: 38384 - RNA, 22 nt, Homo sapiens
agcagcucaugccuuugggagg

SEQ ID NO: 38385 - RNA, 22 nt, Homo sapiens
agcaugacauauuguagagaaa

SEQ ID NO: 38386 - RNA, 22 nt, Homo sapiens
agcucacagccuagcacuguga

SEQ ID NO: 38387 - RNA, 22 nt, Homo sapiens
agcuguuuuugugggcauguga

SEQ ID NO: 38388 - RNA, 22 nt, Homo sapiens
agcuuguuuucccauaacuaga

SEQ ID NO: 38389 - RNA, 22 nt, Homo sapiens
aggaagacugaaauugcuguuc

SEQ ID NO: 38390 - RNA, 22 nt, Homo sapiens
aggaaugucaaugguaguuuaa

SEQ ID NO: 38391 - RNA, 21 nt, Homo sapiens
aggagcauuguugugguggag

SEQ ID NO: 38392 - RNA, 21 nt, Homo sapiens
aggcaagacuuuuagguuugu

SEQ ID NO: 38393 - RNA, 19 nt, Homo sapiens
aggcauugugcucaucugu

SEQ ID NO: 38394 - RNA, 22 nt, Homo sapiens
agggcaagacuuguuaagaaca

SEQ ID NO: 38395 - RNA, 22 nt, Homo sapiens
agguacuuucccaaccauacug

SEQ ID NO: 38396 - RNA, 22 nt, Homo sapiens
aggugaauggauaaacuguggg

SEQ ID NO: 38397 - RNA, 18 nt, Homo sapiens
agguuauuucccaagacu

SEQ ID NO: 38398 - RNA, 22 nt, Homo sapiens
augcuacugaccccuacuuaca

SEQ ID NO: 38399 - RNA, 22 nt, Homo sapiens
auggaaacauaagaguauagau

SEQ ID NO: 38400 - RNA, 21 nt, Homo sapiens
auggaaagacugccucuucaa

SEQ ID NO: 38401 - RNA, 22 nt, Homo sapiens
auggaagcugauuagauaguac

SEQ ID NO: 38402 - RNA, 22 nt, Homo sapiens
auggagcaaaacagauuuggga

SEQ ID NO: 38403 - RNA, 22 nt, Homo sapiens
auggauuuguaguacaugguug

SEQ ID NO: 38404 - RNA, 22 nt, Homo sapiens
auggauuuugaacuugagaguu

SEQ ID NO: 38405 - RNA, 22 nt, Homo sapiens
auggcacuguguccugggguca

SEQ ID NO: 38406 - RNA, 22 nt, Homo sapiens
auggcaguuuauucuaaaucaa

SEQ ID NO: 38407 - RNA, 22 nt, Homo sapiens
auggcuagauuguaugguaguu

SEQ ID NO: 38408 - RNA, 22 nt, Homo sapiens
auggcucuguuuuuuaugcucu

SEQ ID NO: 38409 - RNA, 22 nt, Homo sapiens
auggcuguuucugcaaugucua

SEQ ID NO: 38410 - RNA, 22 nt, Homo sapiens
auggcuguuuuuuauguuacag

SEQ ID NO: 38411 - RNA, 22 nt, Homo sapiens
augugcuuuuggugagagauuu

SEQ ID NO: 38412 - RNA, 22 nt, Homo sapiens
auguggcuuuucaacuguguga

SEQ ID NO: 38413 - RNA, 22 nt, Homo sapiens
auucacuguggcuuucucugau

SEQ ID NO: 38414 - RNA, 22 nt, Homo sapiens
auucagaggggcagcugucuug

SEQ ID NO: 38415 - RNA, 22 nt, Homo sapiens
auuccaguuugugagaagcugu

SEQ ID NO: 38416 - RNA, 22 nt, Homo sapiens
auugagcuuuuuaaaauauagu

SEQ ID NO: 38417 - RNA, 22 nt, Homo sapiens
auugcacaucugcacuacagcc

SEQ ID NO: 38418 - RNA, 22 nt, Homo sapiens
auugcacuccagccuggcagca

SEQ ID NO: 38419 - RNA, 22 nt, Homo sapiens
auugcacuccagccuugggcaa

SEQ ID NO: 38420 - RNA, 22 nt, Homo sapiens
auugcacuggggguuagaauuu

SEQ ID NO: 38421 - RNA, 22 nt, Homo sapiens
auugcuauuauuugaccauugu

SEQ ID NO: 38422 - RNA, 22 nt, Homo sapiens
auugcuucugauuuuaaaugag

SEQ ID NO: 38423 - RNA, 22 nt, Homo sapiens
auuggguuaaaggauaugaaca

SEQ ID NO: 38424 - RNA, 22 nt, Homo sapiens
auuguacauacaccggugugua

SEQ ID NO: 38425 - RNA, 18 nt, Homo sapiens
ccagugcaaggaaagccc

SEQ ID NO: 38426 - RNA, 21 nt, Homo sapiens
ccaguguaaugauagcaggca

SEQ ID NO: 38427 - RNA, 17 nt, Homo sapiens
ccaguuuucccucagug

SEQ ID NO: 38428 - RNA, 22 nt, Homo sapiens
ccaucccuuucugagcaguucc

SEQ ID NO: 38429 - RNA, 22 nt, Homo sapiens
cccagagacagaaugauaaacu

SEQ ID NO: 38430 - RNA, 23 nt, Homo sapiens
cccaguuaauccuuaaucuccac

SEQ ID NO: 38431 - RNA, 22 nt, Homo sapiens
ccccauuguugugguuuuaucu

SEQ ID NO: 38432 - RNA, 17 nt, Homo sapiens
ccccugagcgaugcagu

SEQ ID NO: 38433 - RNA, 22 nt, Homo sapiens
cccucgagaaaccaucugcuga

SEQ ID NO: 38434 - RNA, 22 nt, Homo sapiens
cccuugcacuucagagcugcau

SEQ ID NO: 38435 - RNA, 22 nt, Homo sapiens
ccugagaucauacuguuaguaa

SEQ ID NO: 38436 - RNA, 22 nt, Homo sapiens
ccuggcacugggccccguggcu

SEQ ID NO: 38437 - RNA, 22 nt, Homo sapiens
ccuuggcacuacugacauugua

SEQ ID NO: 38438 - RNA, 22 nt, Homo sapiens
cgcccuguagcuagcuagaggu

SEQ ID NO: 38439 - RNA, 22 nt, Homo sapiens
cgccgggggaugggcaccagcg

SEQ ID NO: 38440 - RNA, 22 nt, Homo sapiens
cuacaguaugaaaccuuuacuc

SEQ ID NO: 38441 - RNA, 22 nt, Homo sapiens
cuagaagguaagagcuggaugc

SEQ ID NO: 38442 - RNA, 22 nt, Homo sapiens
cuagaggcacagccuaggcacu

SEQ ID NO: 38443 - RNA, 22 nt, Homo sapiens
cuagcagaacaauacaauucgg

SEQ ID NO: 38444 - RNA, 22 nt, Homo sapiens
cuauaacagugugguuuggaga

SEQ ID NO: 38445 - RNA, 22 nt, Homo sapiens
cuauggcucugguuauggcugu

SEQ ID NO: 38446 - RNA, 22 nt, Homo sapiens
cuauucacaauggugaagauau

SEQ ID NO: 38447 - RNA, 22 nt, Homo sapiens
cucaaagugcuaagauuaggcu

SEQ ID NO: 38448 - RNA, 22 nt, Homo sapiens
cucaggcacucugauuccagug

SEQ ID NO: 38449 - RNA, 20 nt, Homo sapiens
cucagguauuugaggcugca

SEQ ID NO: 38450 - RNA, 20 nt, Homo sapiens
cucccugacaaauguggaaa

SEQ ID NO: 38451 - RNA, 22 nt, Homo sapiens
cucccugagccagggcuuugac

SEQ ID NO: 38452 - RNA, 22 nt, Homo sapiens
cugacauuguugaucacagcca

SEQ ID NO: 38453 - RNA, 22 nt, Homo sapiens
cugacuuuagaacccaaaaagu

SEQ ID NO: 38454 - RNA, 22 nt, Homo sapiens
cugagaucaugggucagguggu

SEQ ID NO: 38455 - RNA, 22 nt, Homo sapiens
cugcauuugaugacguauggug

SEQ ID NO: 38456 - RNA, 22 nt, Homo sapiens
cugccuagauguuguagggggu

SEQ ID NO: 38457 - RNA, 22 nt, Homo sapiens
cuggaaagcaaagggugcauug

SEQ ID NO: 38458 - RNA, 22 nt, Homo sapiens
cuggaagaaaaucacgccaucu

SEQ ID NO: 38459 - RNA, 22 nt, Homo sapiens
cuggccagagacauucauuaaa

SEQ ID NO: 38460 - RNA, 22 nt, Homo sapiens
cuguaagcauuauaaagagaua

SEQ ID NO: 38461 - RNA, 22 nt, Homo sapiens
cugucuggaggccugcaaauaa

SEQ ID NO: 38462 - RNA, 22 nt, Homo sapiens
cugucuguuucaaaagugguua

SEQ ID NO: 38463 - RNA, 22 nt, Homo sapiens
cugugcauguaugcgugaguuc

SEQ ID NO: 38464 - RNA, 22 nt, Homo sapiens
cugugcauuggaugucucccug

SEQ ID NO: 38465 - RNA, 22 nt, Homo sapiens
cugugccaagcuugcgaugugc

SEQ ID NO: 38466 - RNA, 22 nt, Homo sapiens
cugugcuaggcaaugugguaga

SEQ ID NO: 38467 - RNA, 22 nt, Homo sapiens
cugugcuugauuauaugagugu

SEQ ID NO: 38468 - RNA, 22 nt, Homo sapiens
cuguucaggaggcauuuggugg

SEQ ID NO: 38469 - RNA, 22 nt, Homo sapiens
cuucugauugaaaauggaguag

SEQ ID NO: 38470 - RNA, 22 nt, Homo sapiens
cuugcauuuuggagaaugcuga

SEQ ID NO: 38471 - RNA, 22 nt, Homo sapiens
cuugggauauguguuacucugu

SEQ ID NO: 38472 - RNA, 22 nt, Homo sapiens
cuuucucagugagacccgagau

SEQ ID NO: 38473 - RNA, 22 nt, Homo sapiens
cuuugaugagaaaauacuuugu

SEQ ID NO: 38474 - RNA, 22 nt, Homo sapiens
cuuugggaccgcgguuuauacu

SEQ ID NO: 38475 - RNA, 22 nt, Homo sapiens
cuuugguugugcucuccacuuu

SEQ ID NO: 38476 - RNA, 22 nt, Homo sapiens
cuuuuggcuuaagauugucuug

SEQ ID NO: 38477 - RNA, 22 nt, Homo sapiens
cuuuuggcuuagaauugucuug

SEQ ID NO: 38478 - RNA, 22 nt, Homo sapiens
cuuuuugcaaauacaacucuga

SEQ ID NO: 38479 - RNA, 22 nt, Homo sapiens
cuuuuugcuagagucuaggguc

SEQ ID NO: 38480 - RNA, 22 nt, Homo sapiens
cuuuuugcugcagcaauacugg

SEQ ID NO: 38481 - RNA, 22 nt, Homo sapiens
cuuuuugguagagcaggugugc

SEQ ID NO: 38482 - RNA, 22 nt, Homo sapiens
gaaagguaggaacagggugcag

SEQ ID NO: 38483 - RNA, 18 nt, Homo sapiens
gaaaugccucuugcuuac

SEQ ID NO: 38484 - RNA, 22 nt, Homo sapiens
gaaauguugauagugggcauug

SEQ ID NO: 38485 - RNA, 22 nt, Homo sapiens
gaauacugacuauuucaucugg

SEQ ID NO: 38486 - RNA, 22 nt, Homo sapiens
gaaucauuggguugauucaaga

SEQ ID NO: 38487 - RNA, 22 nt, Homo sapiens
gaaucauuguuucuaaguuugu

SEQ ID NO: 38488 - RNA, 22 nt, Homo sapiens
gacaagagaacacugcuauauu

SEQ ID NO: 38489 - RNA, 22 nt, Homo sapiens
gacauagagccuugacuucauu

SEQ ID NO: 38490 - RNA, 22 nt, Homo sapiens
gaccacauuccacacaggcuuu

SEQ ID NO: 38491 - RNA, 16 nt, Homo sapiens
gugcuguguuguuagg

SEQ ID NO: 38492 - RNA, 22 nt, Homo sapiens
guggaaagaacacaaaauuagg

SEQ ID NO: 38493 - RNA, 22 nt, Homo sapiens
guggaauauaaagcaucgugua

SEQ ID NO: 38494 - RNA, 22 nt, Homo sapiens
guggagucaucacucagagugg

SEQ ID NO: 38495 - RNA, 22 nt, Homo sapiens
guggcaugaaagcaucugugau

SEQ ID NO: 38496 - RNA, 22 nt, Homo sapiens
guggguaaaucucuggggcucu

SEQ ID NO: 38497 - RNA, 22 nt, Homo sapiens
guguccucgaguacacaucagg

SEQ ID NO: 38498 - RNA, 22 nt, Homo sapiens
gugugcauaugucuuuauagua

SEQ ID NO: 38499 - RNA, 22 nt, Homo sapiens
guguggcaggugggggcucaga

SEQ ID NO: 38500 - RNA, 22 nt, Homo sapiens
guguucaaacccaggucugucu

SEQ ID NO: 38501 - RNA, 22 nt, Homo sapiens
guguucaaauucugacagagag

SEQ ID NO: 38502 - RNA, 22 nt, Homo sapiens
guuacugucuuccugauugcuu

SEQ ID NO: 38503 - RNA, 22 nt, Homo sapiens
guuauugcucucgaagacucuc

SEQ ID NO: 38504 - RNA, 21 nt, Homo sapiens
guucaagugauccuccugucu

SEQ ID NO: 38505 - RNA, 17 nt, Homo sapiens
guucccaguggcauuug

SEQ ID NO: 38506 - RNA, 20 nt, Homo sapiens
guucccuguaggugugcgga

SEQ ID NO: 38507 - RNA, 22 nt, Homo sapiens
guugcagcacacaggcugucag

SEQ ID NO: 38508 - RNA, 22 nt, Homo sapiens
guuugcacuccuaugagaaucu

SEQ ID NO: 38509 - RNA, 22 nt, Homo sapiens
guuuugguuauauggaucaguu

SEQ ID NO: 38510 - RNA, 22 nt, Homo sapiens
uaaagauaaggcucgcuuggau

SEQ ID NO: 38511 - RNA, 16 nt, Homo sapiens
uaaagcuaaucacuuu

SEQ ID NO: 38512 - RNA, 21 nt, Homo sapiens
uaaagcuagaaccuuagcuuu

SEQ ID NO: 38513 - RNA, 22 nt, Homo sapiens
uaaagcuaucacauuggugauu

SEQ ID NO: 38514 - RNA, 20 nt, Homo sapiens
uaaaugccucaugcuuuauu

SEQ ID NO: 38515 - RNA, 21 nt, Homo sapiens
uaacagcuccacuccauucuc

SEQ ID NO: 38516 - RNA, 22 nt, Homo sapiens
uaacccagugucugugaugggu

SEQ ID NO: 38517 - RNA, 21 nt, Homo sapiens
uaacccugaaggagcucugga

SEQ ID NO: 38518 - RNA, 22 nt, Homo sapiens
uaagcaguaaaugaagucuugc

SEQ ID NO: 38519 - RNA, 16 nt, Homo sapiens
uaagccccacgugcau

SEQ ID NO: 38520 - RNA, 22 nt, Homo sapiens
uaagcuauagugaauaaauugc

SEQ ID NO: 38521 - RNA, 22 nt, Homo sapiens
uaaggcacuacuuuaggcuuuc

SEQ ID NO: 38522 - RNA, 20 nt, Homo sapiens
uaaggcacugugcuuuuagg

SEQ ID NO: 38523 - RNA, 22 nt, Homo sapiens
uaaguacaugcuagauggaaug

SEQ ID NO: 38524 - RNA, 22 nt, Homo sapiens
uaaguauagguaacagaagcaa

SEQ ID NO: 38525 - RNA, 22 nt, Homo sapiens
uaaguauuaggccccaggcugg

SEQ ID NO: 38526 - RNA, 22 nt, Homo sapiens
uaaguauuuuaauuccuggcau

SEQ ID NO: 38527 - RNA, 22 nt, Homo sapiens
uaagugaauauggacaguuagc

SEQ ID NO: 38528 - RNA, 22 nt, Homo sapiens
uaagugaauuucacuacugagu

SEQ ID NO: 38529 - RNA, 22 nt, Homo sapiens
uaagugaauuugacagguaaug

SEQ ID NO: 38530 - RNA, 22 nt, Homo sapiens
uaaugcuguggucugguuuaaa

SEQ ID NO: 38531 - RNA, 22 nt, Homo sapiens
uacaguggugugaucucagcuc

SEQ ID NO: 38532 - RNA, 23 nt, Homo sapiens
uaccacauuccuucuuuccuguu

SEQ ID NO: 38533 - RNA, 22 nt, Homo sapiens
uaccagcauuucucuuuaagua

SEQ ID NO: 38534 - RNA, 22 nt, Homo sapiens
uacccuuuaguauaaaaucaga

SEQ ID NO: 38535 - RNA, 22 nt, Homo sapiens
uacuagaaccuuauucagagug

SEQ ID NO: 38536 - RNA, 22 nt, Homo sapiens
uacucacauucuguuucuugcu

SEQ ID NO: 38537 - RNA, 22 nt, Homo sapiens
uacucaguagacacucauaugu

SEQ ID NO: 38538 - RNA, 22 nt, Homo sapiens
uagaaagcaugaccuucagaua

SEQ ID NO: 38539 - RNA, 22 nt, Homo sapiens
uagagagcuguuugaaagcagg

SEQ ID NO: 38540 - RNA, 22 nt, Homo sapiens
uagagauaucaauuucauggug

SEQ ID NO: 38541 - RNA, 22 nt, Homo sapiens
uagaucauauucagugcuuacu

SEQ ID NO: 38542 - RNA, 20 nt, Homo sapiens
uagaugcauuuagauucauu

SEQ ID NO: 38543 - RNA, 23 nt, Homo sapiens
uagcaacaguuggaggugaggua

SEQ ID NO: 38544 - RNA, 22 nt, Homo sapiens
uagcacaucccuaaaaugcugu

SEQ ID NO: 38545 - RNA, 22 nt, Homo sapiens
uagcccagugagguugauuugg

SEQ ID NO: 38546 - RNA, 22 nt, Homo sapiens
uagccuguggugaauguuucug

SEQ ID NO: 38547 - RNA, 22 nt, Homo sapiens
uaggcuuuuggacccugucucu

SEQ ID NO: 38548 - RNA, 22 nt, Homo sapiens
uagggaguuuuggggugcagaa

SEQ ID NO: 38549 - RNA, 22 nt, Homo sapiens
uagggcaugugggaaguuauaa

SEQ ID NO: 38550 - RNA, 22 nt, Homo sapiens
uagggcauuuagaggcuauuaa

SEQ ID NO: 38551 - RNA, 22 nt, Homo sapiens
uagggcuuuccggccugucaga

SEQ ID NO: 38552 - RNA, 22 nt, Homo sapiens
uagguaagauguuaacagcuga

SEQ ID NO: 38553 - RNA, 22 nt, Homo sapiens
uagguaaguaauauacagauga

SEQ ID NO: 38554 - RNA, 18 nt, Homo sapiens
uagugcuguucucaugau

SEQ ID NO: 38555 - RNA, 20 nt, Homo sapiens
uaguggcaugcaccuguagc

SEQ ID NO: 38556 - RNA, 22 nt, Homo sapiens
uaguguuuuucauuggcagagg

SEQ ID NO: 38557 - RNA, 22 nt, Homo sapiens
uauaacacccacauauagucuu

SEQ ID NO: 38558 - RNA, 22 nt, Homo sapiens
uauacaguaggcacucaguggc

SEQ ID NO: 38559 - RNA, 22 nt, Homo sapiens
uauagcagccugaacaaaguaa

SEQ ID NO: 38560 - RNA, 22 nt, Homo sapiens
uauagcuugaaggaauggucau

SEQ ID NO: 38561 - RNA, 22 nt, Homo sapiens
uauaugcuaaacaagggguggg

SEQ ID NO: 38562 - RNA, 22 nt, Homo sapiens
uaucacaguagaacucuuucca

SEQ ID NO: 38563 - RNA, 22 nt, Homo sapiens
uaucacuauucauccuagcucc

SEQ ID NO: 38564 - RNA, 22 nt, Homo sapiens
uaucacuuugauaguuuaaaug

SEQ ID NO: 38565 - RNA, 22 nt, Homo sapiens
uaugcacuauagcauauguggu

SEQ ID NO: 38566 - RNA, 22 nt, Homo sapiens
uaugcuuauuaaaacagugugu

SEQ ID NO: 38567 - RNA, 22 nt, Homo sapiens
agcaccaugggcugaguaagug

SEQ ID NO: 38568 - RNA, 22 nt, Homo sapiens
agcaccauuguacuccagccug

SEQ ID NO: 38569 - RNA, 22 nt, Homo sapiens
agcaccauuucucuaaagcacu

SEQ ID NO: 38570 - RNA, 22 nt, Homo sapiens
agcagcaccaaacagacuaaga

SEQ ID NO: 38571 - RNA, 22 nt, Homo sapiens
agcagcauauuuuuauaaugua

SEQ ID NO: 38572 - RNA, 22 nt, Homo sapiens
agcagcucaagacuuaaauuug

SEQ ID NO: 38573 - RNA, 21 nt, Homo sapiens
agcagcuuugguugaagcaga

SEQ ID NO: 38574 - RNA, 22 nt, Homo sapiens
agcaggacaauaugggaucagg

SEQ ID NO: 38575 - RNA, 22 nt, Homo sapiens
agcagguguggcuuauccugaa

SEQ ID NO: 38576 - RNA, 22 nt, Homo sapiens
agcaucagugauuuuguugaag

SEQ ID NO: 38577 - RNA, 20 nt, Homo sapiens
agcaucauugcaauuuguca

SEQ ID NO: 38578 - RNA, 21 nt, Homo sapiens
agccaguguuccuuguggcuc

SEQ ID NO: 38579 - RNA, 22 nt, Homo sapiens
agcccagagacuguguaaauuu

SEQ ID NO: 38580 - RNA, 22 nt, Homo sapiens
agcgccacugcacuccagccug

SEQ ID NO: 38581 - RNA, 22 nt, Homo sapiens
agcucuauuagaagccgugggu

SEQ ID NO: 38582 - RNA, 20 nt, Homo sapiens
agcuggguguguuggugcau

SEQ ID NO: 38583 - RNA, 22 nt, Homo sapiens
aggagcacaauggucaugugga

SEQ ID NO: 38584 - RNA, 21 nt, Homo sapiens
aggcaagguguuauuauugaa

SEQ ID NO: 38585 - RNA, 22 nt, Homo sapiens
aggcaguuucagugagagguga

SEQ ID NO: 38586 - RNA, 22 nt, Homo sapiens
agguaauuuucccagagggaaa

SEQ ID NO: 38587 - RNA, 22 nt, Homo sapiens
aggugaaugcucacauucuaau

SEQ ID NO: 38588 - RNA, 22 nt, Homo sapiens
aggugcaauggugguuuugugg

SEQ ID NO: 38589 - RNA, 22 nt, Homo sapiens
aggugcugacaggauagguuuc

SEQ ID NO: 38590 - RNA, 22 nt, Homo sapiens
agguguuguugaggagauuuca

SEQ ID NO: 38591 - RNA, 22 nt, Homo sapiens
aguccagguuuuguaauggcaa

SEQ ID NO: 38592 - RNA, 22 nt, Homo sapiens
agugacuagaauaugaauuuua

SEQ ID NO: 38593 - RNA, 22 nt, Homo sapiens
agugagcugcagucuggggucc

SEQ ID NO: 38594 - RNA, 22 nt, Homo sapiens
aguggaaucuguuauacuaacu

SEQ ID NO: 38595 - RNA, 22 nt, Homo sapiens
aguggaauuaagaaacugaauu

SEQ ID NO: 38596 - RNA, 22 nt, Homo sapiens
aguggugucugaguggccaggg

SEQ ID NO: 38597 - RNA, 20 nt, Homo sapiens
agugguuuucaaauaugucu

SEQ ID NO: 38598 - RNA, 22 nt, Homo sapiens
agugguuuuggaauggaauuca

SEQ ID NO: 38599 - RNA, 19 nt, Homo sapiens
agugucauggucauuauuu

SEQ ID NO: 38600 - RNA, 22 nt, Homo sapiens
auaagagcaggcuucuggccag

SEQ ID NO: 38601 - RNA, 22 nt, Homo sapiens
auaaggcugguauagacauuca

SEQ ID NO: 38602 - RNA, 23 nt, Homo sapiens
auaaugcaaguggugguaaucug

SEQ ID NO: 38603 - RNA, 22 nt, Homo sapiens
auaauugcuaagugaagauggu

SEQ ID NO: 38604 - RNA, 22 nt, Homo sapiens
auacaguauggagggcccagcu

SEQ ID NO: 38605 - RNA, 22 nt, Homo sapiens
auacugucucuugcuccugccc

SEQ ID NO: 38606 - RNA, 22 nt, Homo sapiens
uuguaacaugcuuucacuucag

SEQ ID NO: 38607 - RNA, 22 nt, Homo sapiens
uuguacuagucauauuuugaaa

SEQ ID NO: 38608 - RNA, 22 nt, Homo sapiens
uuguagaucuucaguugcuaca

SEQ ID NO: 38609 - RNA, 22 nt, Homo sapiens
uugucuagugaauacauuaaug

SEQ ID NO: 38610 - RNA, 22 nt, Homo sapiens
uugugauugagugauccuuguu

SEQ ID NO: 38611 - RNA, 22 nt, Homo sapiens
uugugcauaucagagguuugcu

SEQ ID NO: 38612 - RNA, 22 nt, Homo sapiens
uugugcuuuugagcugagauga

SEQ ID NO: 38613 - RNA, 22 nt, Homo sapiens
uugugcuuuuuaaauagcuucc

SEQ ID NO: 38614 - RNA, 22 nt, Homo sapiens
uugugguuauagagucucccug

SEQ ID NO: 38615 - RNA, 22 nt, Homo sapiens
uugugguugacuaaauuuguaa

SEQ ID NO: 38616 - RNA, 22 nt, Homo sapiens
uugugguuuuaucuaccuuugg

SEQ ID NO: 38617 - RNA, 22 nt, Homo sapiens
uuguguuugaugcugacacgca

SEQ ID NO: 38618 - RNA, 22 nt, Homo sapiens
uuguuauguuggucaguaaugu

SEQ ID NO: 38619 - RNA, 22 nt, Homo sapiens
uuguuuagagacuggaauuaaa

SEQ ID NO: 38620 - RNA, 22 nt, Homo sapiens
uuuaauagcagggacuuccggg

SEQ ID NO: 38621 - RNA, 22 nt, Homo sapiens
uuuacugucuucagucccucug

SEQ ID NO: 38622 - RNA, 22 nt, Homo sapiens
uuuagcaaugcuguggggaagu

SEQ ID NO: 38623 - RNA, 22 nt, Homo sapiens
uuuauucggcuaggagcuucgg

SEQ ID NO: 38624 - RNA, 22 nt, Homo sapiens
uuucacagcugucuuccgucuc

SEQ ID NO: 38625 - RNA, 20 nt, Homo sapiens
uuucaguacuuucuacuggc

SEQ ID NO: 38626 - RNA, 22 nt, Homo sapiens
uuucauccggcuguguauuaug

SEQ ID NO: 38627 - RNA, 22 nt, Homo sapiens
agcuuguuuuccugcaacuaga

SEQ ID NO: 38628 - RNA, 22 nt, Homo sapiens
aggaaaucuuagcugaggggau

SEQ ID NO: 38629 - RNA, 22 nt, Homo sapiens
aggaaucuaagguaucagguua

SEQ ID NO: 38630 - RNA, 22 nt, Homo sapiens
aggagcacaggacuuugauuau

SEQ ID NO: 38631 - RNA, 22 nt, Homo sapiens
aggcaaaugccagcaaucacac

SEQ ID NO: 38632 - RNA, 22 nt, Homo sapiens
aggcaaguugcucaaaugcaaa

SEQ ID NO: 38633 - RNA, 22 nt, Homo sapiens
aggcuguguggauaauauuggg

SEQ ID NO: 38634 - RNA, 21 nt, Homo sapiens
aggcuguuguuuugggaugga

SEQ ID NO: 38635 - RNA, 22 nt, Homo sapiens
agggcuuaucuguguagaguuc

SEQ ID NO: 38636 - RNA, 22 nt, Homo sapiens
agguccauugguauuauagcau

SEQ ID NO: 38637 - RNA, 22 nt, Homo sapiens
aguaacaggauccaaagaaugu

SEQ ID NO: 38638 - RNA, 22 nt, Homo sapiens
aguauuuguuggaauaccuguu

SEQ ID NO: 38639 - RNA, 21 nt, Homo sapiens
agucauaggaguacauaaugc

SEQ ID NO: 38640 - RNA, 22 nt, Homo sapiens
agucauggcagaaggcaccucu

SEQ ID NO: 38641 - RNA, 22 nt, Homo sapiens
agucugguguucucacacuagu

SEQ ID NO: 38642 - RNA, 22 nt, Homo sapiens
agugacaugggaucaaaucuga

SEQ ID NO: 38643 - RNA, 17 nt, Homo sapiens
agugagaucauggcuua

SEQ ID NO: 38644 - RNA, 22 nt, Homo sapiens
agugcaguggcucaaaaugccu

SEQ ID NO: 38645 - RNA, 22 nt, Homo sapiens
agugcaguggugccaucauaac

SEQ ID NO: 38646 - RNA, 22 nt, Homo sapiens
aguggcaaugugauguccugaa

SEQ ID NO: 38647 - RNA, 23 nt, Homo sapiens
auaagccuuuucuuucugcccca

SEQ ID NO: 38648 - RNA, 22 nt, Homo sapiens
auaaguagaaugauggucaaaa

SEQ ID NO: 38649 - RNA, 22 nt, Homo sapiens
auaagugagugauucaguguua

SEQ ID NO: 38650 - RNA, 22 nt, Homo sapiens
auaauagcugaucauuuagaag

SEQ ID NO: 38651 - RNA, 22 nt, Homo sapiens
auaauagguaguaauggauuga

SEQ ID NO: 38652 - RNA, 22 nt, Homo sapiens
auacaguaucuucuggcaagca

SEQ ID NO: 38653 - RNA, 22 nt, Homo sapiens
auacaguguauguauaguacau

SEQ ID NO: 38654 - RNA, 22 nt, Homo sapiens
auacccugucgugagucagaga

SEQ ID NO: 38655 - RNA, 22 nt, Homo sapiens
auacuagucaagaauguaugag

SEQ ID NO: 38656 - RNA, 22 nt, Homo sapiens
auagaaucaucugugcacuagu

SEQ ID NO: 38657 - RNA, 22 nt, Homo sapiens
auagaucuauuuauguaucccu

SEQ ID NO: 38658 - RNA, 21 nt, Homo sapiens
auagcacaucagauuuuauua

SEQ ID NO: 38659 - RNA, 22 nt, Homo sapiens
auagcacugguuuuucuugguu

SEQ ID NO: 38660 - RNA, 22 nt, Homo sapiens
auagcagcucacuuauuuaugg

SEQ ID NO: 38661 - RNA, 22 nt, Homo sapiens
auaggcacauuaggaacuuuug

SEQ ID NO: 38662 - RNA, 22 nt, Homo sapiens
auagugcugcaauaaccauggg

SEQ ID NO: 38663 - RNA, 22 nt, Homo sapiens
auagugcugcagucaauguacg

SEQ ID NO: 38664 - RNA, 19 nt, Homo sapiens
auauaacauccaggagcag

SEQ ID NO: 38665 - RNA, 22 nt, Homo sapiens
auauagcucuggcuggaugacu

SEQ ID NO: 38666 - RNA, 22 nt, Homo sapiens
auaucaacaugguaggguuggu

SEQ ID NO: 38667 - RNA, 22 nt, Homo sapiens
auaucacaggaaaggaagauac

SEQ ID NO: 38668 - RNA, 22 nt, Homo sapiens
auaucccaguguguaaacacug

SEQ ID NO: 38669 - RNA, 22 nt, Homo sapiens
auaugcaaauccauagagacag

SEQ ID NO: 38670 - RNA, 22 nt, Homo sapiens
auaugcacgugcauacacacuu

SEQ ID NO: 38671 - RNA, 22 nt, Homo sapiens
auaugucuuaguuaccuugggc

SEQ ID NO: 38672 - RNA, 22 nt, Homo sapiens
aucacagaacuuugagcagaga

SEQ ID NO: 38673 - RNA, 22 nt, Homo sapiens
aucacagcuacuccucugucuu

SEQ ID NO: 38674 - RNA, 22 nt, Homo sapiens
aucagaguugucagggagcuuu

SEQ ID NO: 38675 - RNA, 22 nt, Homo sapiens
aucagcauucccaaaugaugug

SEQ ID NO: 38676 - RNA, 22 nt, Homo sapiens
aucauccagccccagaagggag

SEQ ID NO: 38677 - RNA, 22 nt, Homo sapiens
auccauugcucaagagaaguca

SEQ ID NO: 38678 - RNA, 22 nt, Homo sapiens
aucccugagaacuuuuaauguu

SEQ ID NO: 38679 - RNA, 21 nt, Homo sapiens
auccuucuuuuucaaccugug

SEQ ID NO: 38680 - RNA, 22 nt, Homo sapiens
aucuagagacauaguaaagaau

SEQ ID NO: 38681 - RNA, 22 nt, Homo sapiens
aucugcaaagcugggcugagac

SEQ ID NO: 38682 - RNA, 22 nt, Homo sapiens
aucuggcuccuuuugacaaugc

SEQ ID NO: 38683 - RNA, 22 nt, Homo sapiens
aucuggguccguucugcuucuc

SEQ ID NO: 38684 - RNA, 22 nt, Homo sapiens
aucugguguuuuucucccucgu

SEQ ID NO: 38685 - RNA, 22 nt, Homo sapiens
aucuuugauuguagguacaaug

SEQ ID NO: 38686 - RNA, 20 nt, Homo sapiens
cagucauagacaucagaguc

SEQ ID NO: 38687 - RNA, 22 nt, Homo sapiens
cagugcuuguuauuguucuauu

SEQ ID NO: 38688 - RNA, 22 nt, Homo sapiens
cagugguuuucucaguucagca

SEQ ID NO: 38689 - RNA, 21 nt, Homo sapiens
cauaaugcuacuuauuuuaug

SEQ ID NO: 38690 - RNA, 22 nt, Homo sapiens
caugucacuuccucucugaugg

SEQ ID NO: 38691 - RNA, 22 nt, Homo sapiens
cauugcacuccagccugcugac

SEQ ID NO: 38692 - RNA, 22 nt, Homo sapiens
cauugcacuccagcucugggcg

SEQ ID NO: 38693 - RNA, 20 nt, Homo sapiens
cauugcacuccagcuugggc

SEQ ID NO: 38694 - RNA, 22 nt, Homo sapiens
cauugcacucuagucuggguga

SEQ ID NO: 38695 - RNA, 22 nt, Homo sapiens
cauugcacucugcauuccaguc

SEQ ID NO: 38696 - RNA, 22 nt, Homo sapiens
cauugcacugcuucuugggugu

SEQ ID NO: 38697 - RNA, 22 nt, Homo sapiens
cauuguacauaaguauggagua

SEQ ID NO: 38698 - RNA, 22 nt, Homo sapiens
cauuugcacugagacucagcuu

SEQ ID NO: 38699 - RNA, 23 nt, Homo sapiens
ccacacuguuuagaauggcauca

SEQ ID NO: 38700 - RNA, 22 nt, Homo sapiens
ccacauuggaaaggaucccccc

SEQ ID NO: 38701 - RNA, 22 nt, Homo sapiens
ccacccuuccauucuuccucuu

SEQ ID NO: 38702 - RNA, 22 nt, Homo sapiens
ccagaguggagccuuugcgagg

SEQ ID NO: 38703 - RNA, 22 nt, Homo sapiens
uagcagcauuuuuguagaguau

SEQ ID NO: 38704 - RNA, 22 nt, Homo sapiens
uagcugauguuugucuaguagc

SEQ ID NO: 38705 - RNA, 22 nt, Homo sapiens
uaggaaugaacgauuuauuggu

SEQ ID NO: 38706 - RNA, 22 nt, Homo sapiens
uaggacauugcccuuguggaga

SEQ ID NO: 38707 - RNA, 22 nt, Homo sapiens
uaggagugugaacccuaugaac

SEQ ID NO: 38708 - RNA, 22 nt, Homo sapiens
uaggcaaaugcaagaguagaac

SEQ ID NO: 38709 - RNA, 22 nt, Homo sapiens
uaggcacacaucuacuacaaau

SEQ ID NO: 38710 - RNA, 22 nt, Homo sapiens
uaggcauuuuucugauaaacua

SEQ ID NO: 38711 - RNA, 22 nt, Homo sapiens
uagggaguguccuuucgggaaa

SEQ ID NO: 38712 - RNA, 22 nt, Homo sapiens
uagguaaguaugugugaugggg

SEQ ID NO: 38713 - RNA, 22 nt, Homo sapiens
uagguaguugugggcuugaaug

SEQ ID NO: 38714 - RNA, 22 nt, Homo sapiens
uaggugaaugcuggaagaaaug

SEQ ID NO: 38715 - RNA, 22 nt, Homo sapiens
uaguaucacaagguguacaccc

SEQ ID NO: 38716 - RNA, 22 nt, Homo sapiens
uauagcaguguaagaaucgagu

SEQ ID NO: 38717 - RNA, 22 nt, Homo sapiens
uauagcccuugguguggaaaug

SEQ ID NO: 38718 - RNA, 22 nt, Homo sapiens
uaucacagauucuccaggguuu

SEQ ID NO: 38719 - RNA, 22 nt, Homo sapiens
uaucacagugcuggaguauucc

SEQ ID NO: 38720 - RNA, 22 nt, Homo sapiens
uaugaaagcuacuucucacaau

SEQ ID NO: 38721 - RNA, 22 nt, Homo sapiens
uaugaccuuggacaaguuacuu

SEQ ID NO: 38722 - RNA, 22 nt, Homo sapiens
uaugagagcugguagguagaga

SEQ ID NO: 38723 - RNA, 22 nt, Homo sapiens
uaugcacuaggcacuguguuug

SEQ ID NO: 38724 - RNA, 23 nt, Homo sapiens
uaugccuguuucaaacaaacuuu

SEQ ID NO: 38725 - RNA, 22 nt, Homo sapiens
uaugcuguuucugauuuaggga

SEQ ID NO: 38726 - RNA, 22 nt, Homo sapiens
uauggcugugacuuaucuuguu

SEQ ID NO: 38727 - RNA, 22 nt, Homo sapiens
uauggcuuucuacuugaguucu

SEQ ID NO: 38728 - RNA, 22 nt, Homo sapiens
uaugugcuuuguuaaacagaug

SEQ ID NO: 38729 - RNA, 20 nt, Homo sapiens
uauuacagaguaauggugga

SEQ ID NO: 38730 - RNA, 22 nt, Homo sapiens
uauucacaggugugggacaaag

SEQ ID NO: 38731 - RNA, 22 nt, Homo sapiens
uauuccacuauuaguccagaug

SEQ ID NO: 38732 - RNA, 22 nt, Homo sapiens
uauuccacuggcacugcauuug

SEQ ID NO: 38733 - RNA, 22 nt, Homo sapiens
uauuccacuuacaugagguauc

SEQ ID NO: 38734 - RNA, 22 nt, Homo sapiens
uauugcacgccagccugagcaa

SEQ ID NO: 38735 - RNA, 22 nt, Homo sapiens
uauugcacuccagccuuggcaa

SEQ ID NO: 38736 - RNA, 22 nt, Homo sapiens
uauugcagaaugugaguuggca

SEQ ID NO: 38737 - RNA, 22 nt, Homo sapiens
uauugcuacuuugccuuccaaa

SEQ ID NO: 38738 - RNA, 22 nt, Homo sapiens
uauugcuuuugauucaaggcag

SEQ ID NO: 38739 - RNA, 22 nt, Homo sapiens
uauuguuaaagauguuaaugau

SEQ ID NO: 38740 - RNA, 22 nt, Homo sapiens
uauuugcacucccaucauggug

SEQ ID NO: 38741 - RNA, 22 nt, Homo sapiens
ucaaaaccucagagaguagagc

SEQ ID NO: 38742 - RNA, 22 nt, Homo sapiens
ucaaacugcuugaggccauuua

SEQ ID NO: 38743 - RNA, 22 nt, Homo sapiens
ucaaacugucagguugaccaga

SEQ ID NO: 38744 - RNA, 18 nt, Homo sapiens
ucaagcuauugucaugcc

SEQ ID NO: 38745 - RNA, 22 nt, Homo sapiens
ucaaguaguaacuaacugugac

SEQ ID NO: 38746 - RNA, 23 nt, Homo sapiens
ucaagugaugguggccacaaggg

SEQ ID NO: 38747 - RNA, 22 nt, Homo sapiens
ucaauguaucuccaagaauuga

SEQ ID NO: 38748 - RNA, 22 nt, Homo sapiens
ucacagacugagccaaauagag

SEQ ID NO: 38749 - RNA, 22 nt, Homo sapiens
ucacauuguguagccugcucac

SEQ ID NO: 38750 - RNA, 22 nt, Homo sapiens
ucacccugacaugcggccgaac

SEQ ID NO: 38751 - RNA, 22 nt, Homo sapiens
ucacugcacuagguaaugccac

SEQ ID NO: 38752 - RNA, 22 nt, Homo sapiens
ucagagugguuguaccauuuga

SEQ ID NO: 38753 - RNA, 22 nt, Homo sapiens
ucagauguuugagaaguauacu

SEQ ID NO: 38754 - RNA, 22 nt, Homo sapiens
ucagcacauucaaggccugccu

SEQ ID NO: 38755 - RNA, 22 nt, Homo sapiens
ucagcguguggacggccaucuu

SEQ ID NO: 38756 - RNA, 21 nt, Homo sapiens
ucagcucaucacugccuggag

SEQ ID NO: 38757 - RNA, 22 nt, Homo sapiens
ucaggcacuaguaagaaaaagg

SEQ ID NO: 38758 - RNA, 22 nt, Homo sapiens
ucaggcuuuucccagagugaug

SEQ ID NO: 38759 - RNA, 23 nt, Homo sapiens
ucaguagucauugggaaagugug

SEQ ID NO: 38760 - RNA, 22 nt, Homo sapiens
ucagucuuuuaccauuaaguau

SEQ ID NO: 38761 - RNA, 22 nt, Homo sapiens
ucagucuuuuuuuggcaagcau

SEQ ID NO: 38762 - RNA, 22 nt, Homo sapiens
ucaguggauuuaaccugaauca

SEQ ID NO: 38763 - RNA, 22 nt, Homo sapiens
ucaguguuuggaaucucaauuu

SEQ ID NO: 38764 - RNA, 22 nt, Homo sapiens
ucauauugcgguucauugacuu

SEQ ID NO: 38765 - RNA, 22 nt, Homo sapiens
ucaucagugcuugcaaauuauu

SEQ ID NO: 38766 - RNA, 22 nt, Homo sapiens
gugacagaguaagacccuguau

SEQ ID NO: 38767 - RNA, 22 nt, Homo sapiens
gugagacugaguuucgcucuug

SEQ ID NO: 38768 - RNA, 22 nt, Homo sapiens
gugagcaauugauacuugaagu

SEQ ID NO: 38769 - RNA, 22 nt, Homo sapiens
gugagcaguguccuugggggca

SEQ ID NO: 38770 - RNA, 22 nt, Homo sapiens
gugagcuagaccacuuggcucc

SEQ ID NO: 38771 - RNA, 17 nt, Homo sapiens
gugagguggguaguauc

SEQ ID NO: 38772 - RNA, 22 nt, Homo sapiens
gugaguuauuauuuauguaaac

SEQ ID NO: 38773 - RNA, 22 nt, Homo sapiens
gugauagguugucacugucacu

SEQ ID NO: 38774 - RNA, 22 nt, Homo sapiens
gugcaaugaguguggcaaagcc

SEQ ID NO: 38775 - RNA, 22 nt, Homo sapiens
gugcgggaggcgcgccuaggug

SEQ ID NO: 38776 - RNA, 22 nt, Homo sapiens
guggaaaaguaguugcgguuuu

SEQ ID NO: 38777 - RNA, 22 nt, Homo sapiens
guggaaaauuauugcuguuuuu

SEQ ID NO: 38778 - RNA, 22 nt, Homo sapiens
guggaaucuagagaggcaguag

SEQ ID NO: 38779 - RNA, 22 nt, Homo sapiens
guggagacaaaggcugagugag

SEQ ID NO: 38780 - RNA, 22 nt, Homo sapiens
guggcaaacucagcaugcccca

SEQ ID NO: 38781 - RNA, 22 nt, Homo sapiens
guggcaaguguuccaagaggcg

SEQ ID NO: 38782 - RNA, 22 nt, Homo sapiens
guggcagagucagagggaaaug

SEQ ID NO: 38783 - RNA, 22 nt, Homo sapiens
guggcagugugaggauccugcu

SEQ ID NO: 38784 - RNA, 18 nt, Homo sapiens
gugucugguuaugggagu

SEQ ID NO: 38785 - RNA, 20 nt, Homo sapiens
gugugcauuucagauuuugg

SEQ ID NO: 38786 - RNA, 21 nt, Homo sapiens
gugugcuugaauucagcuguc

SEQ ID NO: 38787 - RNA, 22 nt, Homo sapiens
guuauguuaaauuguuguaugc

SEQ ID NO: 38788 - RNA, 22 nt, Homo sapiens
guugaaaucaucacuuggcaug

SEQ ID NO: 38789 - RNA, 22 nt, Homo sapiens
guugcacagucuuuccuggacu

SEQ ID NO: 38790 - RNA, 22 nt, Homo sapiens
guugguuuccuguaacuggaca

SEQ ID NO: 38791 - RNA, 22 nt, Homo sapiens
guuuuuggggucacuauuaccg

SEQ ID NO: 38792 - RNA, 22 nt, Homo sapiens
uaaagcuagaauuguuccagca

SEQ ID NO: 38793 - RNA, 22 nt, Homo sapiens
uaaagcuaugagaacaccguag

SEQ ID NO: 38794 - RNA, 22 nt, Homo sapiens
uaaauggauauugccaucuccu

SEQ ID NO: 38795 - RNA, 22 nt, Homo sapiens
uaacaguguauuccuuuggaca

SEQ ID NO: 38796 - RNA, 23 nt, Homo sapiens
uaacauugcaugauuaccugcau

SEQ ID NO: 38797 - RNA, 22 nt, Homo sapiens
uaacauuguugauuauacuaag

SEQ ID NO: 38798 - RNA, 22 nt, Homo sapiens
uaagacucuggacucuaauguu

SEQ ID NO: 38799 - RNA, 22 nt, Homo sapiens
uaaugugaauagugcuguaaug

SEQ ID NO: 38800 - RNA, 22 nt, Homo sapiens
uaauucuguauguaucagaguu

SEQ ID NO: 38801 - RNA, 22 nt, Homo sapiens
uacaagcaggaaaugguauaug

SEQ ID NO: 38802 - RNA, 22 nt, Homo sapiens
uacaagcuaaaauggaagauca

SEQ ID NO: 38803 - RNA, 20 nt, Homo sapiens
uacacguaugagcacaugug

SEQ ID NO: 38804 - RNA, 22 nt, Homo sapiens
uacagaguagaagauuugcaga

SEQ ID NO: 38805 - RNA, 22 nt, Homo sapiens
uacaggauagacaauuuauuaa

SEQ ID NO: 38806 - RNA, 22 nt, Homo sapiens
uacaguggcaugucaggugcuu

SEQ ID NO: 38807 - RNA, 22 nt, Homo sapiens
uacaguguuuugguauuccaca

SEQ ID NO: 38808 - RNA, 22 nt, Homo sapiens
uaccaaguauuuucacaugaac

SEQ ID NO: 38809 - RNA, 20 nt, Homo sapiens
aaacucugucuucuuuauca

SEQ ID NO: 38810 - RNA, 22 nt, Homo sapiens
aaagaagucagccuguccuuug

SEQ ID NO: 38811 - RNA, 22 nt, Homo sapiens
aaagagaucuaugggcacuaug

SEQ ID NO: 38812 - RNA, 22 nt, Homo sapiens
aaaggcacugugacuuuauagg

SEQ ID NO: 38813 - RNA, 20 nt, Homo sapiens
aaaggcugugagaacgagau

SEQ ID NO: 38814 - RNA, 22 nt, Homo sapiens
aaagugcaguauuugggcagaa

SEQ ID NO: 38815 - RNA, 22 nt, Homo sapiens
aaagugcugggauuaggccagg

SEQ ID NO: 38816 - RNA, 22 nt, Homo sapiens
aaagugcugggauuggccgggc

SEQ ID NO: 38817 - RNA, 22 nt, Homo sapiens
aaaguguguuuccaaccugugg

SEQ ID NO: 38818 - RNA, 22 nt, Homo sapiens
aaaucccuugcucucucagacc

SEQ ID NO: 38819 - RNA, 22 nt, Homo sapiens
aaaugcagcacucaagugggaa

SEQ ID NO: 38820 - RNA, 22 nt, Homo sapiens
aaauuguccuauugguuuaagc

SEQ ID NO: 38821 - RNA, 22 nt, Homo sapiens
aacauugaacuuggcacaccca

SEQ ID NO: 38822 - RNA, 21 nt, Homo sapiens
aagaaagcuggacuugccgcu

SEQ ID NO: 38823 - RNA, 22 nt, Homo sapiens
aagagcauuggauggggagauu

SEQ ID NO: 38824 - RNA, 22 nt, Homo sapiens
aagagcucucuguagcauguga

SEQ ID NO: 38825 - RNA, 22 nt, Homo sapiens
aagagguaauaacaaagcuucu

SEQ ID NO: 38826 - RNA, 22 nt, Homo sapiens
aagauaguaaacauuuucugcu

SEQ ID NO: 38827 - RNA, 22 nt, Homo sapiens
aagcacccagccucacgccugc

SEQ ID NO: 38828 - RNA, 22 nt, Homo sapiens
aagcuuucaacuguuugccauu

SEQ ID NO: 38829 - RNA, 22 nt, Homo sapiens
aaggcaauuuguugugaggauu

SEQ ID NO: 38830 - RNA, 22 nt, Homo sapiens
aaggcauucucaaacuaguucu

SEQ ID NO: 38831 - RNA, 22 nt, Homo sapiens
aaggcuguuguguaauaggauu

SEQ ID NO: 38832 - RNA, 22 nt, Homo sapiens
aagggagcugcauaaucuugug

SEQ ID NO: 38833 - RNA, 22 nt, Homo sapiens
aagguauuucuaugggaauaga

SEQ ID NO: 38834 - RNA, 22 nt, Homo sapiens
aaguaaauauccgguaguccca

SEQ ID NO: 38835 - RNA, 22 nt, Homo sapiens
aaguacuguuuaaauugcagaa

SEQ ID NO: 38836 - RNA, 22 nt, Homo sapiens
aagucaaggagagaggcgucag

SEQ ID NO: 38837 - RNA, 21 nt, Homo sapiens
aagugcucugggacucuaaau

SEQ ID NO: 38838 - RNA, 22 nt, Homo sapiens
aagugcucuugaaacugucuua

SEQ ID NO: 38839 - RNA, 22 nt, Homo sapiens
aaguuguuggaguuccauuguu

SEQ ID NO: 38840 - RNA, 22 nt, Homo sapiens
aauacugcuuugauguaagcua

SEQ ID NO: 38841 - RNA, 22 nt, Homo sapiens
aauagcuguccuuagaagugug

SEQ ID NO: 38842 - RNA, 22 nt, Homo sapiens
aauauugucaaaauggauucca

SEQ ID NO: 38843 - RNA, 22 nt, Homo sapiens
aauccugucuugccauccaaua

SEQ ID NO: 38844 - RNA, 22 nt, Homo sapiens
aaugccaucagagaaaacucuu

SEQ ID NO: 38845 - RNA, 22 nt, Homo sapiens
aauggcacaagacaugaagaag

SEQ ID NO: 38846 - RNA, 22 nt, Homo sapiens
uggcaugucagguuucuggguu

SEQ ID NO: 38847 - RNA, 18 nt, Homo sapiens
uggccaauggcaaacaga

SEQ ID NO: 38848 - RNA, 21 nt, Homo sapiens
uggcuguuuucaugcuagaac

SEQ ID NO: 38849 - RNA, 22 nt, Homo sapiens
uggcuuuuauuauguugaggua

SEQ ID NO: 38850 - RNA, 22 nt, Homo sapiens
ugggagacuacauuuuuaacaa

SEQ ID NO: 38851 - RNA, 23 nt, Homo sapiens
ugggauguuuuuggaaacuucug

SEQ ID NO: 38852 - RNA, 22 nt, Homo sapiens
ugggcaaaacuaagagcugugg

SEQ ID NO: 38853 - RNA, 22 nt, Homo sapiens
ugggcuagaugcuuugggguca

SEQ ID NO: 38854 - RNA, 22 nt, Homo sapiens
uggugcccuguccuucuguggc

SEQ ID NO: 38855 - RNA, 22 nt, Homo sapiens
uguaauuuaaaugauccuugga

SEQ ID NO: 38856 - RNA, 22 nt, Homo sapiens
uguauaguugagucaaguuuca

SEQ ID NO: 38857 - RNA, 22 nt, Homo sapiens
uguaugucugcucuuuggaacu

SEQ ID NO: 38858 - RNA, 22 nt, Homo sapiens
uguauguugauguuauauucug

SEQ ID NO: 38859 - RNA, 22 nt, Homo sapiens
uguauguuguaagacuuagacc

SEQ ID NO: 38860 - RNA, 22 nt, Homo sapiens
ugucaucauuugagagaagaaa

SEQ ID NO: 38861 - RNA, 22 nt, Homo sapiens
ugucaucuagguauuaagcccc

SEQ ID NO: 38862 - RNA, 22 nt, Homo sapiens
ugucaucuagguuuuaagccuu

SEQ ID NO: 38863 - RNA, 22 nt, Homo sapiens
ugucauucaggaaauucuaagu

SEQ ID NO: 38864 - RNA, 22 nt, Homo sapiens
uguccuguaggaggcagaacaa

SEQ ID NO: 38865 - RNA, 21 nt, Homo sapiens
ugucuagaccucauccuacag

SEQ ID NO: 38866 - RNA, 22 nt, Homo sapiens
ugucucccuucccauuaggaag

SEQ ID NO: 38867 - RNA, 22 nt, Homo sapiens
ugugaaacauggauagaacugg

SEQ ID NO: 38868 - RNA, 22 nt, Homo sapiens
ugugaauggugcuuccuagaug

SEQ ID NO: 38869 - RNA, 22 nt, Homo sapiens
ugugccacugcacucuggccug

SEQ ID NO: 38870 - RNA, 22 nt, Homo sapiens
ugugcuuguaaaggccagagca

SEQ ID NO: 38871 - RNA, 22 nt, Homo sapiens
uguggaaauggugcuacgaaca

SEQ ID NO: 38872 - RNA, 22 nt, Homo sapiens
uguggcuuuuucuuggcugagg

SEQ ID NO: 38873 - RNA, 22 nt, Homo sapiens
uguguaaauaugauagaggaau

SEQ ID NO: 38874 - RNA, 22 nt, Homo sapiens
uguuuuggaggccagaagucca

SEQ ID NO: 38875 - RNA, 22 nt, Homo sapiens
uuaaaguaauugaaauggccuu

SEQ ID NO: 38876 - RNA, 20 nt, Homo sapiens
uuaaaucuagugcagacuca

SEQ ID NO: 38877 - RNA, 22 nt, Homo sapiens
uuaacaguugcaugagacugag

SEQ ID NO: 38878 - RNA, 22 nt, Homo sapiens
uuaagacaccaaucauuggauu

SEQ ID NO: 38879 - RNA, 18 nt, Homo sapiens
uuaaggcaggacuuuaag

SEQ ID NO: 38880 - RNA, 17 nt, Homo sapiens
uuacaggugcugagagu

SEQ ID NO: 38881 - RNA, 22 nt, Homo sapiens
uuagaaaguagaaaagcugguu

SEQ ID NO: 38882 - RNA, 22 nt, Homo sapiens
uuagaacuagaggaguuugagu

SEQ ID NO: 38883 - RNA, 22 nt, Homo sapiens
uuagcacauuuccagcacaugg

SEQ ID NO: 38884 - RNA, 22 nt, Homo sapiens
uuagcagcaucccuggccugua

SEQ ID NO: 38885 - RNA, 22 nt, Homo sapiens
uuagcucaguuggugagagcgu

SEQ ID NO: 38886 - RNA, 22 nt, Homo sapiens
uuaggcuaguugauauaguuug

SEQ ID NO: 38887 - RNA, 22 nt, Homo sapiens
uuagggaggacaguuacaacag

SEQ ID NO: 38888 - RNA, 22 nt, Homo sapiens
uuagggaggcucaggacaagag

SEQ ID NO: 38889 - RNA, 23 nt, Homo sapiens
uuaguaaacucaaugacaccaca

SEQ ID NO: 38890 - RNA, 22 nt, Homo sapiens
uuauaacagagacuccugugcu

SEQ ID NO: 38891 - RNA, 22 nt, Homo sapiens
uuauacuacuauaaagagguag

SEQ ID NO: 38892 - RNA, 18 nt, Homo sapiens
uuauaugcauguguagga

SEQ ID NO: 38893 - RNA, 22 nt, Homo sapiens
uuauauguuucuguuuggaggc

SEQ ID NO: 38894 - RNA, 22 nt, Homo sapiens
uuauauguuuguacuuaggccu

SEQ ID NO: 38895 - RNA, 22 nt, Homo sapiens
uuaugcuguuuucuggagauuu

SEQ ID NO: 38896 - RNA, 22 nt, Homo sapiens
uuauugcucauuugggcauucu

SEQ ID NO: 38897 - RNA, 22 nt, Homo sapiens
uuauugcuuuugugcaggugag

SEQ ID NO: 38898 - RNA, 23 nt, Homo sapiens
uucaaaggaugcuuuauggaauu

SEQ ID NO: 38899 - RNA, 22 nt, Homo sapiens
uucaauuaauauuauacucuca

SEQ ID NO: 38900 - RNA, 22 nt, Homo sapiens
uucaggcaccauugucauugau

SEQ ID NO: 38901 - RNA, 22 nt, Homo sapiens
uucaggcuccugugagaaucua

SEQ ID NO: 38902 - RNA, 22 nt, Homo sapiens
uucagugucauuaacacaguag

SEQ ID NO: 38903 - RNA, 22 nt, Homo sapiens
uucaucagcuguagaugucaug

SEQ ID NO: 38904 - RNA, 22 nt, Homo sapiens
uucauguaaucaaggcagcuaa

SEQ ID NO: 38905 - RNA, 22 nt, Homo sapiens
uuccacaggguugaacuaguuu

SEQ ID NO: 38906 - RNA, 22 nt, Homo sapiens
uuccaguguuugacucaccuuu

SEQ ID NO: 38907 - RNA, 22 nt, Homo sapiens
uuccaguugugagcuauccggg

SEQ ID NO: 38908 - RNA, 22 nt, Homo sapiens
uucccaguggaacauguaguca

SEQ ID NO: 38909 - RNA, 22 nt, Homo sapiens
uucccauuguuggccagcaugu

SEQ ID NO: 38910 - RNA, 22 nt, Homo sapiens
uucccugagcaucuguugagcc

SEQ ID NO: 38911 - RNA, 22 nt, Homo sapiens
uuccugagagggcugggugcag

SEQ ID NO: 38912 - RNA, 22 nt, Homo sapiens
uucugagguuauauucucucaa

SEQ ID NO: 38913 - RNA, 22 nt, Homo sapiens
uucuggcucgauucucugaccg

SEQ ID NO: 38914 - RNA, 22 nt, Homo sapiens
uucuggcuuauaaacgugacuu

SEQ ID NO: 38915 - RNA, 22 nt, Homo sapiens
uucuggcuuuuaaagaaauguu

SEQ ID NO: 38916 - RNA, 22 nt, Homo sapiens
uugaagacuauaugauucuuca

SEQ ID NO: 38917 - RNA, 18 nt, Homo sapiens
uugaaugcgucccagaga

SEQ ID NO: 38918 - RNA, 19 nt, Homo sapiens
ugagaucuuuacuggguuu

SEQ ID NO: 38919 - RNA, 22 nt, Homo sapiens
ugagaucuuuuguggcugagaa

SEQ ID NO: 38920 - RNA, 22 nt, Homo sapiens
ugagaugaagcuagaagaaugg

SEQ ID NO: 38921 - RNA, 22 nt, Homo sapiens
ugagaugaagucuugcucuguu

SEQ ID NO: 38922 - RNA, 22 nt, Homo sapiens
ugagaugaagugauguaaaaca

SEQ ID NO: 38923 - RNA, 22 nt, Homo sapiens
ugagaugagaaucaguucuaau

SEQ ID NO: 38924 - RNA, 22 nt, Homo sapiens
ugagaugauagauauguuaauu

SEQ ID NO: 38925 - RNA, 21 nt, Homo sapiens
ugagaugauccugcaugcaug

SEQ ID NO: 38926 - RNA, 21 nt, Homo sapiens
ugagcauuaguacaguaggga

SEQ ID NO: 38927 - RNA, 22 nt, Homo sapiens
ugagcuaggauccugucacugu

SEQ ID NO: 38928 - RNA, 22 nt, Homo sapiens
ugagcugagacaauaaguuuuu

SEQ ID NO: 38929 - RNA, 22 nt, Homo sapiens
ugagggaugccugguuuguuuu

SEQ ID NO: 38930 - RNA, 22 nt, Homo sapiens
ugagguaagauguucauuuuuc

SEQ ID NO: 38931 - RNA, 22 nt, Homo sapiens
ugaggugagauggcuaccccaa

SEQ ID NO: 38932 - RNA, 22 nt, Homo sapiens
ugauauauugaaugaugaaaca

SEQ ID NO: 38933 - RNA, 23 nt, Homo sapiens
ugauaugccuaggaguauauuuu

SEQ ID NO: 38934 - RNA, 22 nt, Homo sapiens
ugaugcuacuaccugggcugaa

SEQ ID NO: 38935 - RNA, 22 nt, Homo sapiens
ugcaaaugcugcuauuucucuu

SEQ ID NO: 38936 - RNA, 22 nt, Homo sapiens
ugcaagaaucagccuaucauua

SEQ ID NO: 38937 - RNA, 21 nt, Homo sapiens
ugcaagaaucaggaagcugcc

SEQ ID NO: 38938 - RNA, 22 nt, Homo sapiens
ugcacacucuguaugagaaucu

SEQ ID NO: 38939 - RNA, 22 nt, Homo sapiens
ugcaccauggcacuccaggcug

SEQ ID NO: 38940 - RNA, 22 nt, Homo sapiens
ugcaccauugcacuccagccug

SEQ ID NO: 38941 - RNA, 22 nt, Homo sapiens
ugcagagaaacauuuuguauuu

SEQ ID NO: 38942 - RNA, 22 nt, Homo sapiens
ugcagcacaguagguuugcaau

SEQ ID NO: 38943 - RNA, 22 nt, Homo sapiens
ugcagugucaauaauaauuagu

SEQ ID NO: 38944 - RNA, 22 nt, Homo sapiens
ugccuaggcuggaaugcaaugg

SEQ ID NO: 38945 - RNA, 22 nt, Homo sapiens
ugccuaggcuggagugcagugg

SEQ ID NO: 38946 - RNA, 22 nt, Homo sapiens
ugccuucuguuaaacgaggaug

SEQ ID NO: 38947 - RNA, 16 nt, Homo sapiens
ugccuucuucuguauu

SEQ ID NO: 38948 - RNA, 22 nt, Homo sapiens
uggaaaacaugcacauuggauu

SEQ ID NO: 38949 - RNA, 22 nt, Homo sapiens
uggaaaguacuugaguuuguau

SEQ ID NO: 38950 - RNA, 20 nt, Homo sapiens
uggaaggcaucugcauuauu

SEQ ID NO: 38951 - RNA, 22 nt, Homo sapiens
uggaagucuucauuauguauag

SEQ ID NO: 38952 - RNA, 22 nt, Homo sapiens
uggaauuuacuuauuuaggggc

SEQ ID NO: 38953 - RNA, 21 nt, Homo sapiens
uggaccccuacuucucaccau

SEQ ID NO: 38954 - RNA, 22 nt, Homo sapiens
uggacugagauuucagcugcca

SEQ ID NO: 38955 - RNA, 22 nt, Homo sapiens
uggagagucauuuauaguauuu

SEQ ID NO: 38956 - RNA, 22 nt, Homo sapiens
uggagcccuaguuccucauaac

SEQ ID NO: 38957 - RNA, 22 nt, Homo sapiens
uggagugagaacuucaaugaug

SEQ ID NO: 38958 - RNA, 22 nt, Homo sapiens
uggaguguuggggcaggaucuc

SEQ ID NO: 38959 - RNA, 22 nt, Homo sapiens
uggauggugauuggaucaugga

SEQ ID NO: 38960 - RNA, 18 nt, Homo sapiens
uggauuggaaaaguuccu

SEQ ID NO: 38961 - RNA, 22 nt, Homo sapiens
uugcagcauucugguuccuggu

SEQ ID NO: 38962 - RNA, 23 nt, Homo sapiens
uugcauagacauccucauagauu

SEQ ID NO: 38963 - RNA, 22 nt, Homo sapiens
uugcaugcacaguucucaauag

SEQ ID NO: 38964 - RNA, 22 nt, Homo sapiens
uugcuagagaugagggaugugu

SEQ ID NO: 38965 - RNA, 22 nt, Homo sapiens
uuggaaagagguguuuaugacu

SEQ ID NO: 38966 - RNA, 22 nt, Homo sapiens
uuggaaaguuguuguaguuauu

SEQ ID NO: 38967 - RNA, 22 nt, Homo sapiens
uuggaauacucaaaagguuggg

SEQ ID NO: 38968 - RNA, 22 nt, Homo sapiens
uuggaauguauggcaucuugcg

SEQ ID NO: 38969 - RNA, 22 nt, Homo sapiens
uuggauuuugguggcaacucau

SEQ ID NO: 38970 - RNA, 22 nt, Homo sapiens
uuggcacugagcaagaacaggg

SEQ ID NO: 38971 - RNA, 19 nt, Homo sapiens
uuggcccugguucucuucu

SEQ ID NO: 38972 - RNA, 22 nt, Homo sapiens
uuggcuguguuucccuacaaau

SEQ ID NO: 38973 - RNA, 22 nt, Homo sapiens
uuggcuucuggacuauugugca

SEQ ID NO: 38974 - RNA, 22 nt, Homo sapiens
uuguaaacaucuguacauugcu

SEQ ID NO: 38975 - RNA, 22 nt, Homo sapiens
uugucaguguucacucaaagcu

SEQ ID NO: 38976 - RNA, 22 nt, Homo sapiens
uugucauggucuugauccauua

SEQ ID NO: 38977 - RNA, 22 nt, Homo sapiens
uuguccacugcuagccucugca

SEQ ID NO: 38978 - RNA, 21 nt, Homo sapiens
uugucuagagaaauauaucuc

SEQ ID NO: 38979 - RNA, 22 nt, Homo sapiens
uugugaaaucuaggcagagguu

SEQ ID NO: 38980 - RNA, 22 nt, Homo sapiens
uugugcuuuacuuacuaccaga

SEQ ID NO: 38981 - RNA, 22 nt, Homo sapiens
uugugguuuucagcuuauauau

SEQ ID NO: 38982 - RNA, 22 nt, Homo sapiens
uugugucccuacccaaaucuca

SEQ ID NO: 38983 - RNA, 22 nt, Homo sapiens
uugugucccugcccaaaucuca

SEQ ID NO: 38984 - RNA, 22 nt, Homo sapiens
uuguuaugggguggcuugaaag

SEQ ID NO: 38985 - RNA, 21 nt, Homo sapiens
uuuacuguggacccauugcuu

SEQ ID NO: 38986 - RNA, 23 nt, Homo sapiens
uuuauacguugucauuuaucagg

SEQ ID NO: 38987 - RNA, 22 nt, Homo sapiens
uuuauagucaggaacuugagga

SEQ ID NO: 38988 - RNA, 22 nt, Homo sapiens
uuuauugcucuaaaguugccau

SEQ ID NO: 38989 - RNA, 22 nt, Homo sapiens
uuucacagagggcuucuuucua

SEQ ID NO: 38990 - RNA, 19 nt, Homo sapiens
uuuccaguaaucuuaugug

SEQ ID NO: 38991 - RNA, 22 nt, Homo sapiens
uuuccaguuguucuagaaagcu

SEQ ID NO: 38992 - RNA, 22 nt, Homo sapiens
uuucccugaaggcucugaaguc

SEQ ID NO: 38993 - RNA, 22 nt, Homo sapiens
uuucccuuacuuaaacuuacuc

SEQ ID NO: 38994 - RNA, 22 nt, Homo sapiens
uuucuacagggcuugccaggua

SEQ ID NO: 38995 - RNA, 21 nt, Homo sapiens
uuucugggggagcauggcagg

SEQ ID NO: 38996 - RNA, 22 nt, Homo sapiens
uuugaauggaaguuuugugaaa

SEQ ID NO: 38997 - RNA, 22 nt, Homo sapiens
uuugaauguaaugagcaggaag

SEQ ID NO: 38998 - RNA, 22 nt, Homo sapiens
uuugccaaucagaggcaucuug

SEQ ID NO: 38999 - RNA, 22 nt, Homo sapiens
uuuggcacuauagguaaauuug

SEQ ID NO: 39000 - RNA, 22 nt, Homo sapiens
uuuggcagaaaacuaaaaggua

SEQ ID NO: 39001 - RNA, 22 nt, Homo sapiens
uuuggcuuuugugauacguaau

SEQ ID NO: 39002 - RNA, 22 nt, Homo sapiens
uuugucuccuaagacucugugg

SEQ ID NO: 39003 - RNA, 21 nt, Homo sapiens
uuuguguccccacccaaaucu

SEQ ID NO: 39004 - RNA, 22 nt, Homo sapiens
uuugugugugauuauaaaaggu

SEQ ID NO: 39005 - RNA, 23 nt, Homo sapiens
uuuugcaauaagucacuggaaua

SEQ ID NO: 39006 - RNA, 22 nt, Homo sapiens
uuuugcucuugguaaugaaaga

SEQ ID NO: 39007 - RNA, 22 nt, Homo sapiens
ucuugcauuuuuaaauagugcu

SEQ ID NO: 39008 - RNA, 22 nt, Homo sapiens
ucuugguuuauugauggagagg

SEQ ID NO: 39009 - RNA, 22 nt, Homo sapiens
ucuuugccuaacccaaggucau

SEQ ID NO: 39010 - RNA, 22 nt, Homo sapiens
ucuuuggauggaaauuggaguc

SEQ ID NO: 39011 - RNA, 22 nt, Homo sapiens
acugagaucuuuaaauaaauaa

SEQ ID NO: 39012 - RNA, 22 nt, Homo sapiens
acuggcuuuugagaaaaacacu

SEQ ID NO: 39013 - RNA, 22 nt, Homo sapiens
acuggguuaauuugaagguuga

SEQ ID NO: 39014 - RNA, 22 nt, Homo sapiens
agaauguaacucuaugaaggca

SEQ ID NO: 39015 - RNA, 21 nt, Homo sapiens
agacacuuggaagguuuuaga

SEQ ID NO: 39016 - RNA, 22 nt, Homo sapiens
agagaacugauuggaguugggc

SEQ ID NO: 39017 - RNA, 22 nt, Homo sapiens
agagagcuuuugguugcccuaa

SEQ ID NO: 39018 - RNA, 22 nt, Homo sapiens
agagaucaacugaauuacugga

SEQ ID NO: 39019 - RNA, 22 nt, Homo sapiens
agagaugaagauggggcucccg

SEQ ID NO: 39020 - RNA, 22 nt, Homo sapiens
agagccacacucuccuaacuca

SEQ ID NO: 39021 - RNA, 22 nt, Homo sapiens
agagccacauuaaauaugggaa

SEQ ID NO: 39022 - RNA, 22 nt, Homo sapiens
agaggaguacuacuccaagucu

SEQ ID NO: 39023 - RNA, 22 nt, Homo sapiens
agagugcaauggcaccaucucg

SEQ ID NO: 39024 - RNA, 22 nt, Homo sapiens
agagugcuauagauuagauuuc

SEQ ID NO: 39025 - RNA, 20 nt, Homo sapiens
agagugcuggacugaggagc

SEQ ID NO: 39026 - RNA, 22 nt, Homo sapiens
agcaagaaugaacucucccaga

SEQ ID NO: 39027 - RNA, 22 nt, Homo sapiens
agcagcaauuuuguaugguuua

SEQ ID NO: 39028 - RNA, 22 nt, Homo sapiens
agcagcacaucccuuucuggcc

SEQ ID NO: 39029 - RNA, 22 nt, Homo sapiens
agcagcauuccaaaaaucugcu

SEQ ID NO: 39030 - RNA, 17 nt, Homo sapiens
agcauguguuugagauu

SEQ ID NO: 39031 - RNA, 22 nt, Homo sapiens
agcauuaguugugaagccuuua

SEQ ID NO: 39032 - RNA, 22 nt, Homo sapiens
agcucauugcaaccuccgccuc

SEQ ID NO: 39033 - RNA, 21 nt, Homo sapiens
agcuccacucguucccaaagc

SEQ ID NO: 39034 - RNA, 22 nt, Homo sapiens
agcuccuuugcuuuuuccagga

SEQ ID NO: 39035 - RNA, 22 nt, Homo sapiens
agcuguguugucugaagucaga

SEQ ID NO: 39036 - RNA, 20 nt, Homo sapiens
gggcaaguaugugggaaguc

SEQ ID NO: 39037 - RNA, 18 nt, Homo sapiens
gggcaaguugccuggcuu

SEQ ID NO: 39038 - RNA, 22 nt, Homo sapiens
gggcauguggacuuguauguuu

SEQ ID NO: 39039 - RNA, 22 nt, Homo sapiens
ggucaagcuagauuuuaaugau

SEQ ID NO: 39040 - RNA, 22 nt, Homo sapiens
ggucauggauguuuauaguaca

SEQ ID NO: 39041 - RNA, 22 nt, Homo sapiens
ggucuuggagaauuguccuggg

SEQ ID NO: 39042 - RNA, 22 nt, Homo sapiens
gguggugguauuucagaaaaug

SEQ ID NO: 39043 - RNA, 22 nt, Homo sapiens
guaaugaacuugaaagccuguu

SEQ ID NO: 39044 - RNA, 17 nt, Homo sapiens
guacacuucuucuguga

SEQ ID NO: 39045 - RNA, 22 nt, Homo sapiens
guacaguacugaaugaauguau

SEQ ID NO: 39046 - RNA, 22 nt, Homo sapiens
guacaguuuagugcuuugagaa

SEQ ID NO: 39047 - RNA, 22 nt, Homo sapiens
guacaugcauacaugcacaucu

SEQ ID NO: 39048 - RNA, 22 nt, Homo sapiens
guagaccauuuaucuggggagu

SEQ ID NO: 39049 - RNA, 22 nt, Homo sapiens
guagagagaaauacaaagcugu

SEQ ID NO: 39050 - RNA, 22 nt, Homo sapiens
guauuuuguuagggugugguau

SEQ ID NO: 39051 - RNA, 22 nt, Homo sapiens
gucaacauauuaauuauguucu

SEQ ID NO: 39052 - RNA, 22 nt, Homo sapiens
gucaccagcuguguuagccccu

SEQ ID NO: 39053 - RNA, 22 nt, Homo sapiens
gucagggagucucuaucagugg

SEQ ID NO: 39054 - RNA, 22 nt, Homo sapiens
gucaggugcuuacgcggagauc

SEQ ID NO: 39055 - RNA, 22 nt, Homo sapiens
gucauauaggguuuaccuguau

SEQ ID NO: 39056 - RNA, 22 nt, Homo sapiens
gucauggguuaaagguggauac

SEQ ID NO: 39057 - RNA, 22 nt, Homo sapiens
gucuggcacagggaaaguacaa

SEQ ID NO: 39058 - RNA, 22 nt, Homo sapiens
gucuggcuuaucucacuuacca

SEQ ID NO: 39059 - RNA, 22 nt, Homo sapiens
gucugguugacagcauguggcc

SEQ ID NO: 39060 - RNA, 22 nt, Homo sapiens
gugaaacuggguggugagagac

SEQ ID NO: 39061 - RNA, 22 nt, Homo sapiens
gugaaagauuaaaccagugugu

SEQ ID NO: 39062 - RNA, 22 nt, Homo sapiens
gugaaauacauaaucccaagug

SEQ ID NO: 39063 - RNA, 22 nt, Homo sapiens
gugagaugaggucucacucugu

SEQ ID NO: 39064 - RNA, 22 nt, Homo sapiens
gugagcauauuaguauugcacu

SEQ ID NO: 39065 - RNA, 22 nt, Homo sapiens
gugagcauucaaggaaggagcu

SEQ ID NO: 39066 - RNA, 22 nt, Homo sapiens
gugcacaacaugcagguuuguu

SEQ ID NO: 39067 - RNA, 22 nt, Homo sapiens
gugcacaaugugcagguuuguu

SEQ ID NO: 39068 - RNA, 23 nt, Homo sapiens
gugccuucugagccuagucucca

SEQ ID NO: 39069 - RNA, 22 nt, Homo sapiens
gugcuauguuauccagcaagau

SEQ ID NO: 39070 - RNA, 22 nt, Homo sapiens
guggcaaagaugccuucuccaa

SEQ ID NO: 39071 - RNA, 22 nt, Homo sapiens
guggcagaaaagagaagcaaug

SEQ ID NO: 39072 - RNA, 22 nt, Homo sapiens
gugguaaaauggcauagagcua

SEQ ID NO: 39073 - RNA, 22 nt, Homo sapiens
guggugucuuuuuugauuagga

SEQ ID NO: 39074 - RNA, 22 nt, Homo sapiens
gugguucuagaauugaguaucc

SEQ ID NO: 39075 - RNA, 22 nt, Homo sapiens
gugugcaauuuugugggaggca

SEQ ID NO: 39076 - RNA, 22 nt, Homo sapiens
gugugcaugucuuuuuaguagg

SEQ ID NO: 39077 - RNA, 22 nt, Homo sapiens
gugugucuugaccaggaucgga

SEQ ID NO: 39078 - RNA, 22 nt, Homo sapiens
guuauguuaguuacaaggcuag

SEQ ID NO: 39079 - RNA, 22 nt, Homo sapiens
guuuacagucgacuugggaaua

SEQ ID NO: 39080 - RNA, 22 nt, Homo sapiens
guuugguugcauggaaaauuua

SEQ ID NO: 39081 - RNA, 15 nt, Homo sapiens
guuuuuggauacaau

SEQ ID NO: 39082 - RNA, 22 nt, Homo sapiens
uaaagcauguaauuagguuaga

SEQ ID NO: 39083 - RNA, 22 nt, Homo sapiens
uaaagcuacagagcggaaaauu

SEQ ID NO: 39084 - RNA, 22 nt, Homo sapiens
uaaagcuauuauaguuauguuu

SEQ ID NO: 39085 - RNA, 22 nt, Homo sapiens
uaacagcucuacagcugcucuu

SEQ ID NO: 39086 - RNA, 22 nt, Homo sapiens
uaacaguauauuuaccaaaccu

SEQ ID NO: 39087 - RNA, 22 nt, Homo sapiens
uaacucugccuagugacauggu

SEQ ID NO: 39088 - RNA, 18 nt, Homo sapiens
uaacuggugugagauggu

SEQ ID NO: 39089 - RNA, 22 nt, Homo sapiens
uaacuucaucauaagucaagaa

SEQ ID NO: 39090 - RNA, 22 nt, Homo sapiens
uaaggaaggcugugugcuuuua

SEQ ID NO: 39091 - RNA, 20 nt, Homo sapiens
augaaggcaggugugaguuu

SEQ ID NO: 39092 - RNA, 22 nt, Homo sapiens
augaauucaucugguuuuggga

SEQ ID NO: 39093 - RNA, 22 nt, Homo sapiens
augacagugagugagcucucac

SEQ ID NO: 39094 - RNA, 22 nt, Homo sapiens
augacuggauaauggacacaca

SEQ ID NO: 39095 - RNA, 22 nt, Homo sapiens
augagaaugauucuguuauggu

SEQ ID NO: 39096 - RNA, 22 nt, Homo sapiens
augagaugcaagauuagauggg

SEQ ID NO: 39097 - RNA, 22 nt, Homo sapiens
augagcuccucaaggucagaga

SEQ ID NO: 39098 - RNA, 22 nt, Homo sapiens
augaggagauauuaaauaccau

SEQ ID NO: 39099 - RNA, 22 nt, Homo sapiens
augagggagggcaccugaccuu

SEQ ID NO: 39100 - RNA, 22 nt, Homo sapiens
augaggugaggucaguaaggua

SEQ ID NO: 39101 - RNA, 20 nt, Homo sapiens
augagguguaugacacugaa

SEQ ID NO: 39102 - RNA, 22 nt, Homo sapiens
augaguaugagaauacauuaag

SEQ ID NO: 39103 - RNA, 22 nt, Homo sapiens
augauccagugaguuucaguuc

SEQ ID NO: 39104 - RNA, 20 nt, Homo sapiens
augcaaacccugcuuugugg

SEQ ID NO: 39105 - RNA, 22 nt, Homo sapiens
augcaacugcacuccagccugg

SEQ ID NO: 39106 - RNA, 22 nt, Homo sapiens
augcaagacaccgauuagcuuu

SEQ ID NO: 39107 - RNA, 22 nt, Homo sapiens
augcauggcagagucaggguac

SEQ ID NO: 39108 - RNA, 22 nt, Homo sapiens
augcuacugauaagcaaucauu

SEQ ID NO: 39109 - RNA, 22 nt, Homo sapiens
auggaaagcuguuccuacacaa

SEQ ID NO: 39110 - RNA, 22 nt, Homo sapiens
auggaauggcacuuugaagauu

SEQ ID NO: 39111 - RNA, 22 nt, Homo sapiens
auggauuuuggggccagaggca

SEQ ID NO: 39112 - RNA, 22 nt, Homo sapiens
auggcuguuccugggaguucua

SEQ ID NO: 39113 - RNA, 22 nt, Homo sapiens
auggcuuaagacaaccuuucau

SEQ ID NO: 39114 - RNA, 22 nt, Homo sapiens
auggcuucuucuaaaagugggg

SEQ ID NO: 39115 - RNA, 22 nt, Homo sapiens
auggcuuuuauuguguugaggu

SEQ ID NO: 39116 - RNA, 22 nt, Homo sapiens
augguauuuaacagucuuucua

SEQ ID NO: 39117 - RNA, 22 nt, Homo sapiens
auggucuuuauuguguugagug

SEQ ID NO: 39118 - RNA, 22 nt, Homo sapiens
augucauagaagccugugaacc

SEQ ID NO: 39119 - RNA, 22 nt, Homo sapiens
augucuguuugcugagcccggc

SEQ ID NO: 39120 - RNA, 22 nt, Homo sapiens
augugaacugaauuaauucaca

SEQ ID NO: 39121 - RNA, 22 nt, Homo sapiens
augugcuuuuuaaacagaugcu

SEQ ID NO: 39122 - RNA, 22 nt, Homo sapiens
auguggcauuucucauucauuu

SEQ ID NO: 39123 - RNA, 22 nt, Homo sapiens
auguguaaagcuuuucuuuguu

SEQ ID NO: 39124 - RNA, 22 nt, Homo sapiens
auguuagcaucaauauucauca

SEQ ID NO: 39125 - RNA, 22 nt, Homo sapiens
auuaagagcacauguucugggu

SEQ ID NO: 39126 - RNA, 22 nt, Homo sapiens
auuacccuuagacuccagagug

SEQ ID NO: 39127 - RNA, 20 nt, Homo sapiens
auuagagcuacauggcuaca

SEQ ID NO: 39128 - RNA, 22 nt, Homo sapiens
auucaaagugcauguucccacu

SEQ ID NO: 39129 - RNA, 20 nt, Homo sapiens
auucaaguaugccuugagaa

SEQ ID NO: 39130 - RNA, 22 nt, Homo sapiens
auucacagcuuuaaaaggcgug

SEQ ID NO: 39131 - RNA, 22 nt, Homo sapiens
auuccagguggcgccauucaca

SEQ ID NO: 39132 - RNA, 22 nt, Homo sapiens
auugaguaacaauuuuguucaa

SEQ ID NO: 39133 - RNA, 22 nt, Homo sapiens
auugcacaaagagggaaacuga

SEQ ID NO: 39134 - RNA, 22 nt, Homo sapiens
auugcuuuuacugggagcuuug

SEQ ID NO: 39135 - RNA, 22 nt, Homo sapiens
auuggcaagauagcauaugagg

SEQ ID NO: 39136 - RNA, 22 nt, Homo sapiens
auuguacuagguccuagggcuu

SEQ ID NO: 39137 - RNA, 22 nt, Homo sapiens
auuguacuccagccugggcaag

SEQ ID NO: 39138 - RNA, 22 nt, Homo sapiens
auuguacuccagccugggcagc

SEQ ID NO: 39139 - RNA, 22 nt, Homo sapiens
auuguacuccagccugggcgac

SEQ ID NO: 39140 - RNA, 22 nt, Homo sapiens
auuguacuccagccugggcugc

SEQ ID NO: 39141 - RNA, 21 nt, Homo sapiens
auuguauguaaaccaaaugag

SEQ ID NO: 39142 - RNA, 22 nt, Homo sapiens
auugucacuuaaaagugcaugu

SEQ ID NO: 39143 - RNA, 22 nt, Homo sapiens
auuuaugguuaauauaggaagu

SEQ ID NO: 39144 - RNA, 22 nt, Homo sapiens
auuuggcagugaagggaucaca

SEQ ID NO: 39145 - RNA, 22 nt, Homo sapiens
auuugggaaugugcauuauacu

SEQ ID NO: 39146 - RNA, 22 nt, Homo sapiens
auuugguagaguucgauaccug

SEQ ID NO: 39147 - RNA, 22 nt, Homo sapiens
auuuugcauugcuguaaaggaa

SEQ ID NO: 39148 - RNA, 18 nt, Homo sapiens
auuuuugcaguccacaug

SEQ ID NO: 39149 - RNA, 22 nt, Homo sapiens
auuuuugguugucagcacuagg

SEQ ID NO: 39150 - RNA, 22 nt, Homo sapiens
auuuuugguuucaccugcacgc

SEQ ID NO: 39151 - RNA, 22 nt, Homo sapiens
caaggugcugagacaggagccc

SEQ ID NO: 39152 - RNA, 22 nt, Homo sapiens
caaguguuuccuuaaauacuug

SEQ ID NO: 39153 - RNA, 22 nt, Homo sapiens
cacagcgacuuccgccuaccgg

SEQ ID NO: 39154 - RNA, 22 nt, Homo sapiens
cacauguuugcuacauuuuucu

SEQ ID NO: 39155 - RNA, 22 nt, Homo sapiens
caccagguuggagugcaguggu

SEQ ID NO: 39156 - RNA, 22 nt, Homo sapiens
cacccuugcagggacagcuuug

SEQ ID NO: 39157 - RNA, 19 nt, Homo sapiens
caccgccugcccccugcug

SEQ ID NO: 39158 - RNA, 22 nt, Homo sapiens
cacugcacuccagcuuugguga

SEQ ID NO: 39159 - RNA, 22 nt, Homo sapiens
cagagaacugaguuauuuucuu

SEQ ID NO: 39160 - RNA, 20 nt, Homo sapiens
cagcacgcacaugagacugu

SEQ ID NO: 39161 - RNA, 22 nt, Homo sapiens
cagccggguggcuccuagggua

SEQ ID NO: 39162 - RNA, 22 nt, Homo sapiens
cagcucuuguuaaaacuaacua

SEQ ID NO: 39163 - RNA, 23 nt, Homo sapiens
cagcuggugauuuuaaguugaag

SEQ ID NO: 39164 - RNA, 22 nt, Homo sapiens
cagcuggugggagcuggguucc

SEQ ID NO: 39165 - RNA, 22 nt, Homo sapiens
cagcugguguuacaaaccagag

SEQ ID NO: 39166 - RNA, 22 nt, Homo sapiens
caggaccucuugccuggaagcc

SEQ ID NO: 39167 - RNA, 22 nt, Homo sapiens
caggcagugggagacaaaacug

SEQ ID NO: 39168 - RNA, 22 nt, Homo sapiens
caggcuuuuccacacauggguu

SEQ ID NO: 39169 - RNA, 22 nt, Homo sapiens
caggugaaugccucuccuucug

SEQ ID NO: 39170 - RNA, 22 nt, Homo sapiens
cagucacagugacaggaugugg

SEQ ID NO: 39171 - RNA, 22 nt, Homo sapiens
ucaucucaguuucuugccguac

SEQ ID NO: 39172 - RNA, 22 nt, Homo sapiens
ucauuagagacagggugucacu

SEQ ID NO: 39173 - RNA, 22 nt, Homo sapiens
ucauuagagaucuuggggaaaa

SEQ ID NO: 39174 - RNA, 22 nt, Homo sapiens
uccaagaugcuggcagcuacag

SEQ ID NO: 39175 - RNA, 22 nt, Homo sapiens
uccauagacauuuuaagguagu

SEQ ID NO: 39176 - RNA, 22 nt, Homo sapiens
ucccagugcuaugcaaaagccu

SEQ ID NO: 39177 - RNA, 22 nt, Homo sapiens
ucccugaguaucuaauguguuu

SEQ ID NO: 39178 - RNA, 22 nt, Homo sapiens
ucccuugagccuggcuucucac

SEQ ID NO: 39179 - RNA, 22 nt, Homo sapiens
uccugagagcagacccucuaua

SEQ ID NO: 39180 - RNA, 22 nt, Homo sapiens
uccuugagaggacagagccaua

SEQ ID NO: 39181 - RNA, 21 nt, Homo sapiens
uccuuggugaugcccugcagu

SEQ ID NO: 39182 - RNA, 22 nt, Homo sapiens
ucgguacuugagagagacacag

SEQ ID NO: 39183 - RNA, 22 nt, Homo sapiens
ucuaauguaaccugcaaauauu

SEQ ID NO: 39184 - RNA, 22 nt, Homo sapiens
ucucaguggcuuccucacuuuu

SEQ ID NO: 39185 - RNA, 22 nt, Homo sapiens
ucucaguguuaucuaucugccu

SEQ ID NO: 39186 - RNA, 22 nt, Homo sapiens
uuucauggcgaggcuucauggg

SEQ ID NO: 39187 - RNA, 22 nt, Homo sapiens
uuuccagguggccaacauuuua

SEQ ID NO: 39188 - RNA, 22 nt, Homo sapiens
uuuccaguuggaaagccuguuu

SEQ ID NO: 39189 - RNA, 23 nt, Homo sapiens
uuucuugggcaugcuaugucagu

SEQ ID NO: 39190 - RNA, 19 nt, Homo sapiens
uuugaauauaaugcagcua

SEQ ID NO: 39191 - RNA, 20 nt, Homo sapiens
uuugaauguaaagcauguca

SEQ ID NO: 39192 - RNA, 22 nt, Homo sapiens
uuugccaauauuuuacugagga

SEQ ID NO: 39193 - RNA, 22 nt, Homo sapiens
uuugccaauauuuuauugagga

SEQ ID NO: 39194 - RNA, 22 nt, Homo sapiens
uuugccaaugggaauuuuccua

SEQ ID NO: 39195 - RNA, 22 nt, Homo sapiens
uuugcuuaguaaauguagaaaa

SEQ ID NO: 39196 - RNA, 20 nt, Homo sapiens
uuuggcaauaggguuuuugu

SEQ ID NO: 39197 - RNA, 22 nt, Homo sapiens
uuuggcaugggcuauuugcuuu

SEQ ID NO: 39198 - RNA, 22 nt, Homo sapiens
uuugggaaugaguuuaucauuu

SEQ ID NO: 39199 - RNA, 22 nt, Homo sapiens
uuugguuauauauauacacucu

SEQ ID NO: 39200 - RNA, 22 nt, Homo sapiens
uuugugagguggauagauugca

SEQ ID NO: 39201 - RNA, 22 nt, Homo sapiens
uuuguucaccucaaggauggga

SEQ ID NO: 39202 - RNA, 19 nt, Homo sapiens
uuuuggaaaugugaacagc

SEQ ID NO: 39203 - RNA, 22 nt, Homo sapiens
uuuugggggugauucacacagu

SEQ ID NO: 39204 - RNA, 22 nt, Homo sapiens
uuuuugguugguaggcuauuaa

SEQ ID NO: 39205 - RNA, 22 nt, Homo sapiens
uuuuuugcuguaugcaaacauc

SEQ ID NO: 39206 - RNA, 21 nt, Homo sapiens
aacagugcugaacagacaccu

SEQ ID NO: 39207 - RNA, 22 nt, Homo sapiens
aaccacauggcucaguggacau

SEQ ID NO: 39208 - RNA, 22 nt, Homo sapiens
aagagagcuaugugcauaauua

SEQ ID NO: 39209 - RNA, 22 nt, Homo sapiens
aagaggcuguaggauaaugccu

SEQ ID NO: 39210 - RNA, 22 nt, Homo sapiens
aagaguuaguaaaauuuccucu

SEQ ID NO: 39211 - RNA, 22 nt, Homo sapiens
aagauauguuaguuauaaacuc

SEQ ID NO: 39212 - RNA, 22 nt, Homo sapiens
aagaucaucauagagggcauga

SEQ ID NO: 39213 - RNA, 22 nt, Homo sapiens
aagccacuguaccugucucuua

SEQ ID NO: 39214 - RNA, 22 nt, Homo sapiens
aagcucuuguugaaucuuguca

SEQ ID NO: 39215 - RNA, 22 nt, Homo sapiens
aagcuggcauucaugagauuac

SEQ ID NO: 39216 - RNA, 22 nt, Homo sapiens
aagcuggcauucauucguucuu

SEQ ID NO: 39217 - RNA, 22 nt, Homo sapiens
aaggaguagacaacauggcgcc

SEQ ID NO: 39218 - RNA, 23 nt, Homo sapiens
aagguaagcuagaaagauguaga

SEQ ID NO: 39219 - RNA, 22 nt, Homo sapiens
aagguauuuuugucuauaucuu

SEQ ID NO: 39220 - RNA, 22 nt, Homo sapiens
aagucaaggagagaagcuucag

SEQ ID NO: 39221 - RNA, 22 nt, Homo sapiens
aagugacauugugcccauuuga

SEQ ID NO: 39222 - RNA, 22 nt, Homo sapiens
aagugagugacaaaaacugggc

SEQ ID NO: 39223 - RNA, 22 nt, Homo sapiens
aagugcccuauuuggcccuuga

SEQ ID NO: 39224 - RNA, 22 nt, Homo sapiens
aauaaaguaggaggugaggaaa

SEQ ID NO: 39225 - RNA, 19 nt, Homo sapiens
aauaaugccagaugucugu

SEQ ID NO: 39226 - RNA, 22 nt, Homo sapiens
aauagcuguuuuuaauuccugc

SEQ ID NO: 39227 - RNA, 22 nt, Homo sapiens
aaucacagccagcuuccgcuau

SEQ ID NO: 39228 - RNA, 22 nt, Homo sapiens
aaucacaggucuuggcugcaug

SEQ ID NO: 39229 - RNA, 22 nt, Homo sapiens
aaucacauuaaugcucccucag

SEQ ID NO: 39230 - RNA, 22 nt, Homo sapiens
aaucccuggacuuucggaggcu

SEQ ID NO: 39231 - RNA, 22 nt, Homo sapiens
aaucucagagauaucugugucc

SEQ ID NO: 39232 - RNA, 22 nt, Homo sapiens
aaucucagcauuuugggcugag

SEQ ID NO: 39233 - RNA, 17 nt, Homo sapiens
aaugagacauuucugcu

SEQ ID NO: 39234 - RNA, 22 nt, Homo sapiens
aaugcuguucuuugcuuaaguu

SEQ ID NO: 39235 - RNA, 18 nt, Homo sapiens
aauggcucuggguucuaa

SEQ ID NO: 39236 - RNA, 22 nt, Homo sapiens
aaugugcuucuggcugugguca

SEQ ID NO: 39237 - RNA, 22 nt, Homo sapiens
aaugugcuuucuuucacacagu

SEQ ID NO: 39238 - RNA, 22 nt, Homo sapiens
aauuaguugaaagucugcuuuu

SEQ ID NO: 39239 - RNA, 22 nt, Homo sapiens
acacaguaagcacaguguagau

SEQ ID NO: 39240 - RNA, 22 nt, Homo sapiens
acacuacuggguauauguguuu

SEQ ID NO: 39241 - RNA, 23 nt, Homo sapiens
acacuugcugaguaaaucaaaua

SEQ ID NO: 39242 - RNA, 22 nt, Homo sapiens
acacuuucuagacaagggaaua

SEQ ID NO: 39243 - RNA, 22 nt, Homo sapiens
acaguacucugcucuuuugauu

SEQ ID NO: 39244 - RNA, 22 nt, Homo sapiens
acagugcuucugauaugaugcc

SEQ ID NO: 39245 - RNA, 22 nt, Homo sapiens
acaucccuugcucggggccccu

SEQ ID NO: 39246 - RNA, 22 nt, Homo sapiens
acauguauauaaugcauagcga

SEQ ID NO: 39247 - RNA, 22 nt, Homo sapiens
accaguuuuuuauacaucuucu

SEQ ID NO: 39248 - RNA, 22 nt, Homo sapiens
acccucagaccaguuucccugg

SEQ ID NO: 39249 - RNA, 22 nt, Homo sapiens
acccugcuaaacagcccccugc

SEQ ID NO: 39250 - RNA, 22 nt, Homo sapiens
acccuggaggucuacagugcag

SEQ ID NO: 39251 - RNA, 22 nt, Homo sapiens
acccugucauccacauggugcu

SEQ ID NO: 39252 - RNA, 22 nt, Homo sapiens
accuguagcagacuuaauauuu

SEQ ID NO: 39253 - RNA, 22 nt, Homo sapiens
acuacugucagacugccacuga

SEQ ID NO: 39254 - RNA, 22 nt, Homo sapiens
acucagagugggccccuagaua

SEQ ID NO: 39255 - RNA, 22 nt, Homo sapiens
acucuguaagcaagcuggggaa

SEQ ID NO: 39256 - RNA, 19 nt, Homo sapiens
acugagcuaccugggggca

SEQ ID NO: 39257 - RNA, 20 nt, Homo sapiens
acugauauguuccuguucuc

SEQ ID NO: 39258 - RNA, 18 nt, Homo sapiens
acugcacuccauccuagg

SEQ ID NO: 39259 - RNA, 22 nt, Homo sapiens
acuggcaauggcagaaauaguu

SEQ ID NO: 39260 - RNA, 22 nt, Homo sapiens
acuggcuguuaggaauuaccuc

SEQ ID NO: 39261 - RNA, 22 nt, Homo sapiens
acugugcuguuuuaauuauuga

SEQ ID NO: 39262 - RNA, 22 nt, Homo sapiens
agaaacauucucuugccuccuu

SEQ ID NO: 39263 - RNA, 22 nt, Homo sapiens
agaauguuuuagaccaauacaa

SEQ ID NO: 39264 - RNA, 22 nt, Homo sapiens
auuguacuccagccugggcuaa

SEQ ID NO: 39265 - RNA, 22 nt, Homo sapiens
auuguacuccagccugggugac

SEQ ID NO: 39266 - RNA, 22 nt, Homo sapiens
auuguacuuaagccugggugaa

SEQ ID NO: 39267 - RNA, 22 nt, Homo sapiens
auuuuuggauauagggaaggau

SEQ ID NO: 39268 - RNA, 22 nt, Homo sapiens
caaagcacuuggcuuggaagau

SEQ ID NO: 39269 - RNA, 22 nt, Homo sapiens
caaaggcuguuauaggccagga

SEQ ID NO: 39270 - RNA, 22 nt, Homo sapiens
caaaggcuuccacugcauccuu

SEQ ID NO: 39271 - RNA, 22 nt, Homo sapiens
caaagugcugaaagaggccagg

SEQ ID NO: 39272 - RNA, 22 nt, Homo sapiens
caauacuguuaccugaaauagg

SEQ ID NO: 39273 - RNA, 22 nt, Homo sapiens
cacaaaguagauuagucuucca

SEQ ID NO: 39274 - RNA, 22 nt, Homo sapiens
cacaggccugucucuuucuaac

SEQ ID NO: 39275 - RNA, 22 nt, Homo sapiens
cacauugaauuucugaugacaa

SEQ ID NO: 39276 - RNA, 16 nt, Homo sapiens
cacauugcugcauggc

SEQ ID NO: 39277 - RNA, 22 nt, Homo sapiens
caccagcuggcauugaauaccu

SEQ ID NO: 39278 - RNA, 22 nt, Homo sapiens
caguaguagccccuuagaugga

SEQ ID NO: 39279 - RNA, 22 nt, Homo sapiens
cagugcuuuaucaaguccucca

SEQ ID NO: 39280 - RNA, 22 nt, Homo sapiens
caguuacuugacacaaccaauu

SEQ ID NO: 39281 - RNA, 22 nt, Homo sapiens
caguugguguacauauauguau

SEQ ID NO: 39282 - RNA, 22 nt, Homo sapiens
cauacaguaggcacuauuugua

SEQ ID NO: 39283 - RNA, 22 nt, Homo sapiens
caucacagcaaguagggagugg

SEQ ID NO: 39284 - RNA, 21 nt, Homo sapiens
caucacauuacucaaaguccu

SEQ ID NO: 39285 - RNA, 22 nt, Homo sapiens
caucagagugagauauaagauc

SEQ ID NO: 39286 - RNA, 22 nt, Homo sapiens
cauccccugcaccaaccuuuac

SEQ ID NO: 39287 - RNA, 19 nt, Homo sapiens
cauggcuuauaauuuuaau

SEQ ID NO: 39288 - RNA, 22 nt, Homo sapiens
cauugcaguuuuugguguaucu

SEQ ID NO: 39289 - RNA, 22 nt, Homo sapiens
cauugcauuuucuuuguaccuu

SEQ ID NO: 39290 - RNA, 22 nt, Homo sapiens
cauugcuaaaagucauauauaa

SEQ ID NO: 39291 - RNA, 22 nt, Homo sapiens
cauugcuuuuggugguuuagac

SEQ ID NO: 39292 - RNA, 22 nt, Homo sapiens
cauugguuaguuaacuuuaaga

SEQ ID NO: 39293 - RNA, 22 nt, Homo sapiens
cauugguugaacagauuguguu

SEQ ID NO: 39294 - RNA, 23 nt, Homo sapiens
ccacaaugguugaacuagauuac

SEQ ID NO: 39295 - RNA, 22 nt, Homo sapiens
ccacccuuccacacccugggua

SEQ ID NO: 39296 - RNA, 22 nt, Homo sapiens
ccacugcacuccagcccggcaa

SEQ ID NO: 39297 - RNA, 22 nt, Homo sapiens
ccagucuuggugucuguagcac

SEQ ID NO: 39298 - RNA, 22 nt, Homo sapiens
ccauggcuauucuguaaggguu

SEQ ID NO: 39299 - RNA, 22 nt, Homo sapiens
cccugagagcagggucuuucuc

SEQ ID NO: 39300 - RNA, 22 nt, Homo sapiens
ccucauugcuaucccaggcuga

SEQ ID NO: 39301 - RNA, 22 nt, Homo sapiens
ccucccuuuguugcaagggaaa

SEQ ID NO: 39302 - RNA, 22 nt, Homo sapiens
ccucuguaguccugcaagagga

SEQ ID NO: 39303 - RNA, 22 nt, Homo sapiens
cuacagguaugaaagggaguau

SEQ ID NO: 39304 - RNA, 22 nt, Homo sapiens
cuacaguagagaggauguagaa

SEQ ID NO: 39305 - RNA, 22 nt, Homo sapiens
cucaaaguguggucuguggguu

SEQ ID NO: 39306 - RNA, 22 nt, Homo sapiens
cucacugggaccacucugaagu

SEQ ID NO: 39307 - RNA, 22 nt, Homo sapiens
cucaguggauuagauaaugcac

SEQ ID NO: 39308 - RNA, 22 nt, Homo sapiens
cuccuggugauuggagugugaa

SEQ ID NO: 39309 - RNA, 22 nt, Homo sapiens
cucucaagaugcugggauuaca

SEQ ID NO: 39310 - RNA, 17 nt, Homo sapiens
cucucugguuuaaagca

SEQ ID NO: 39311 - RNA, 22 nt, Homo sapiens
cucugagguuauucguaauauu

SEQ ID NO: 39312 - RNA, 22 nt, Homo sapiens
cucuuuuguuccuaguuugauc

SEQ ID NO: 39313 - RNA, 22 nt, Homo sapiens
cugacuuauguggacuauuuca

SEQ ID NO: 39314 - RNA, 22 nt, Homo sapiens
cugagacacucuuaucugcaua

SEQ ID NO: 39315 - RNA, 22 nt, Homo sapiens
gagaucauuaugucagggguca

SEQ ID NO: 39316 - RNA, 23 nt, Homo sapiens
gagaucauucuggaauuagagug

SEQ ID NO: 39317 - RNA, 22 nt, Homo sapiens
gagaucuuggccaaguuucuua

SEQ ID NO: 39318 - RNA, 22 nt, Homo sapiens
gagaugaaaucuugcucuguca

SEQ ID NO: 39319 - RNA, 21 nt, Homo sapiens
gagcacauuguccucuaacgc

SEQ ID NO: 39320 - RNA, 22 nt, Homo sapiens
gagcucauuguugcuaaagaga

SEQ ID NO: 39321 - RNA, 22 nt, Homo sapiens
gagcuguuuuucacuagaccaa

SEQ ID NO: 39322 - RNA, 22 nt, Homo sapiens
gagguaagagaauaaacaguuu

SEQ ID NO: 39323 - RNA, 21 nt, Homo sapiens
gagguaccucauguaagugga

SEQ ID NO: 39324 - RNA, 22 nt, Homo sapiens
gagguagaauguuuuucagcug

SEQ ID NO: 39325 - RNA, 22 nt, Homo sapiens
gagguaggggccuuaaagaugc

SEQ ID NO: 39326 - RNA, 22 nt, Homo sapiens
gagguguaaggacaacagagac

SEQ ID NO: 39327 - RNA, 23 nt, Homo sapiens
gaguggagacucauugauuuccu

SEQ ID NO: 39328 - RNA, 22 nt, Homo sapiens
gauacaguaugcaugugguauu

SEQ ID NO: 39329 - RNA, 22 nt, Homo sapiens
gauacuguauccuaaaagcuuu

SEQ ID NO: 39330 - RNA, 22 nt, Homo sapiens
gauggcaucugagaguguuaga

SEQ ID NO: 39331 - RNA, 22 nt, Homo sapiens
gauggugucccaggcucaggcu

SEQ ID NO: 39332 - RNA, 20 nt, Homo sapiens
gauuagagagaggcugugca

SEQ ID NO: 39333 - RNA, 22 nt, Homo sapiens
gcaaaguguuuuuaggaagucu

SEQ ID NO: 39334 - RNA, 22 nt, Homo sapiens
gcaaaucuuauguccucacauu

SEQ ID NO: 39335 - RNA, 22 nt, Homo sapiens
gcaauacugacagcauuaguuu

SEQ ID NO: 39336 - RNA, 22 nt, Homo sapiens
gcagagaaacaggucuaaggag

SEQ ID NO: 39337 - RNA, 22 nt, Homo sapiens
gcaguauuguugaaauguccau

SEQ ID NO: 39338 - RNA, 22 nt, Homo sapiens
gcagugcaguggcgcgaucucg

SEQ ID NO: 39339 - RNA, 22 nt, Homo sapiens
gcauguaguagauguugaauaa

SEQ ID NO: 39340 - RNA, 22 nt, Homo sapiens
gcauugcacuuggcauagacug

SEQ ID NO: 39341 - RNA, 18 nt, Homo sapiens
gccaacauguaaacaggu

SEQ ID NO: 39342 - RNA, 22 nt, Homo sapiens
gcccagcguucagggaggggcu

SEQ ID NO: 39343 - RNA, 22 nt, Homo sapiens
gcccugagauucuuggauucug

SEQ ID NO: 39344 - RNA, 22 nt, Homo sapiens
gcuaggagaucugcugcucucu

SEQ ID NO: 39345 - RNA, 22 nt, Homo sapiens
gcuggcuuucuccugaucucag

SEQ ID NO: 39346 - RNA, 22 nt, Homo sapiens
gcuggguugccagguuacuuaa

SEQ ID NO: 39347 - RNA, 22 nt, Homo sapiens
gcuguaguugaggauuuuaaga

SEQ ID NO: 39348 - RNA, 18 nt, Homo sapiens
gcuguugucagagcacau

SEQ ID NO: 39349 - RNA, 22 nt, Homo sapiens
ggacugagaggacuacagugua

SEQ ID NO: 39350 - RNA, 22 nt, Homo sapiens
ggagaugauuaugaaucacuua

SEQ ID NO: 39351 - RNA, 20 nt, Homo sapiens
ggagguguugauuuuucuuu

SEQ ID NO: 39352 - RNA, 22 nt, Homo sapiens
ggauaucauuauuucuagggcu

SEQ ID NO: 39353 - RNA, 22 nt, Homo sapiens
ggcaagaaagaaaucaucuguc

SEQ ID NO: 39354 - RNA, 22 nt, Homo sapiens
ggcaagaaccacaauuacuuuu

SEQ ID NO: 39355 - RNA, 22 nt, Homo sapiens
ggcaagaaccagggauuugcgu

SEQ ID NO: 39356 - RNA, 22 nt, Homo sapiens
ggcaagaaccucaauuaccuuu

SEQ ID NO: 39357 - RNA, 22 nt, Homo sapiens
ggcaagaacuucacucacuuuu

SEQ ID NO: 39358 - RNA, 22 nt, Homo sapiens
ggcaguguggcugcauauagca

SEQ ID NO: 39359 - RNA, 22 nt, Homo sapiens
ggcuagagaauagugccacuaa

SEQ ID NO: 39360 - RNA, 22 nt, Homo sapiens
gggaaauguaaagucauaagau

SEQ ID NO: 39361 - RNA, 22 nt, Homo sapiens
gggaagaaggagugguuuacuc

SEQ ID NO: 39362 - RNA, 22 nt, Homo sapiens
gggaagugugcagaguucucuu

SEQ ID NO: 39363 - RNA, 22 nt, Homo sapiens
gggagguuguauguaugcgggg

SEQ ID NO: 39364 - RNA, 22 nt, Homo sapiens
ggguaggcaagcggaugucaga

SEQ ID NO: 39365 - RNA, 22 nt, Homo sapiens
gggucauggaugugaagcuaga

SEQ ID NO: 39366 - RNA, 22 nt, Homo sapiens
ggucauggauaagauccagaag

SEQ ID NO: 39367 - RNA, 22 nt, Homo sapiens
ggucuagagagagggguggacu

SEQ ID NO: 39368 - RNA, 22 nt, Homo sapiens
gguggcaaaucugaguggcgcu

SEQ ID NO: 39369 - RNA, 22 nt, Homo sapiens
guacaguucucuuuguugucag

SEQ ID NO: 39370 - RNA, 22 nt, Homo sapiens
guagagugcugggcacuggcuc

SEQ ID NO: 39371 - RNA, 22 nt, Homo sapiens
guagcagucacauagcagauug

SEQ ID NO: 39372 - RNA, 22 nt, Homo sapiens
guaugacacaggaagcuuaacc

SEQ ID NO: 39373 - RNA, 22 nt, Homo sapiens
guauggaagucaguuuguuggc

SEQ ID NO: 39374 - RNA, 22 nt, Homo sapiens
guauugacuaucaaucaugugc

SEQ ID NO: 39375 - RNA, 22 nt, Homo sapiens
guauuugauuauagcaugcuua

SEQ ID NO: 39376 - RNA, 22 nt, Homo sapiens
guauuuguugcagcagcacuau

SEQ ID NO: 39377 - RNA, 22 nt, Homo sapiens
gucacauugaugcccauggugg

SEQ ID NO: 39378 - RNA, 22 nt, Homo sapiens
gucuggcuccugucuaaucacu

SEQ ID NO: 39379 - RNA, 22 nt, Homo sapiens
gucuggcuccuucuacuacaug

SEQ ID NO: 39380 - RNA, 21 nt, Homo sapiens
gucugguguuuuaaugaggac

SEQ ID NO: 39381 - RNA, 20 nt, Homo sapiens
gucugucuccgaguagaauu

SEQ ID NO: 39382 - RNA, 22 nt, Homo sapiens
gucuuugcauguauguucauga

SEQ ID NO: 39383 - RNA, 22 nt, Homo sapiens
gugaaauauuuaacguccaggu

SEQ ID NO: 39384 - RNA, 22 nt, Homo sapiens
gugaaucuguuuucuucuguuc

SEQ ID NO: 39385 - RNA, 22 nt, Homo sapiens
gugagcuaguuucuuugcugug

SEQ ID NO: 39386 - RNA, 22 nt, Homo sapiens
uauggauguuaagguucacagc

SEQ ID NO: 39387 - RNA, 22 nt, Homo sapiens
uaugggauuucauuaagugucu

SEQ ID NO: 39388 - RNA, 22 nt, Homo sapiens
uucaggcuuuuauuuacugaua

SEQ ID NO: 39389 - RNA, 22 nt, Homo sapiens
uucaggguggagaguaugaggu

SEQ ID NO: 39390 - RNA, 22 nt, Homo sapiens
uucauaguaacaguaacuaugg

SEQ ID NO: 39391 - RNA, 22 nt, Homo sapiens
uucauagugaaaaauucaaagu

SEQ ID NO: 39392 - RNA, 22 nt, Homo sapiens
uucauguaauauauuucaggcc

SEQ ID NO: 39393 - RNA, 22 nt, Homo sapiens
uucauguaauauuucacagcuu

SEQ ID NO: 39394 - RNA, 21 nt, Homo sapiens
uuccagugagccuagaugccu

SEQ ID NO: 39395 - RNA, 22 nt, Homo sapiens
uuccaugugggcuugucaagua

SEQ ID NO: 39396 - RNA, 22 nt, Homo sapiens
uuccauguugauacgugaaguu

SEQ ID NO: 39397 - RNA, 22 nt, Homo sapiens
uucccugaaauauucacuuuca

SEQ ID NO: 39398 - RNA, 22 nt, Homo sapiens
uucccugaaguguuacucuaga

SEQ ID NO: 39399 - RNA, 22 nt, Homo sapiens
uucccuuucugccuugaaucuu

SEQ ID NO: 39400 - RNA, 21 nt, Homo sapiens
uucuaaguaaauguuggacau

SEQ ID NO: 39401 - RNA, 22 nt, Homo sapiens
uucuacagugacugcagccaua

SEQ ID NO: 39402 - RNA, 17 nt, Homo sapiens
uucucaguucugaucuc

SEQ ID NO: 39403 - RNA, 22 nt, Homo sapiens
uucucuggucagaggggagguu

SEQ ID NO: 39404 - RNA, 22 nt, Homo sapiens
uucucuguggauugggugagag

SEQ ID NO: 39405 - RNA, 22 nt, Homo sapiens
uucuggcucaggucaacacuuc

SEQ ID NO: 39406 - RNA, 22 nt, Homo sapiens
uucuuccagccuugaggggccc

SEQ ID NO: 39407 - RNA, 22 nt, Homo sapiens
uucuugaggcaugccgcuggga

SEQ ID NO: 39408 - RNA, 20 nt, Homo sapiens
uucuugaguuaacaaguuac

SEQ ID NO: 39409 - RNA, 22 nt, Homo sapiens
uucuugcacuuggcccucauua

SEQ ID NO: 39410 - RNA, 22 nt, Homo sapiens
uucuuugguacaagggccgacc

SEQ ID NO: 39411 - RNA, 17 nt, Homo sapiens
uugaaugcauuacuugg

SEQ ID NO: 39412 - RNA, 22 nt, Homo sapiens
uugaauguacuuguucucacua

SEQ ID NO: 39413 - RNA, 22 nt, Homo sapiens
uugacuuuuaggaggaaaauga

SEQ ID NO: 39414 - RNA, 22 nt, Homo sapiens
uugagauggagucucacucuug

SEQ ID NO: 39415 - RNA, 22 nt, Homo sapiens
uugagauggagucuugcacugu

SEQ ID NO: 39416 - RNA, 22 nt, Homo sapiens
uugagauggaguuucacucucg

SEQ ID NO: 39417 - RNA, 22 nt, Homo sapiens
uugagauggauagacauagcau

SEQ ID NO: 39418 - RNA, 22 nt, Homo sapiens
uugaggccugauaacacacuga

SEQ ID NO: 39419 - RNA, 22 nt, Homo sapiens
uugagggagccuguuagucccg

SEQ ID NO: 39420 - RNA, 22 nt, Homo sapiens
uugaggguggcauauauugauu

SEQ ID NO: 39421 - RNA, 22 nt, Homo sapiens
uugaggucuucaggaucaggcu

SEQ ID NO: 39422 - RNA, 22 nt, Homo sapiens
uugauaugaauggcuguuugug

SEQ ID NO: 39423 - RNA, 22 nt, Homo sapiens
uugcagcaacauggaugaaacu

SEQ ID NO: 39424 - RNA, 22 nt, Homo sapiens
uugcauaagugcauucugugau

SEQ ID NO: 39425 - RNA, 22 nt, Homo sapiens
uugcaucagcaggcauaauugg

SEQ ID NO: 39426 - RNA, 22 nt, Homo sapiens
uugcaugucugcuucuccuccu

SEQ ID NO: 39427 - RNA, 22 nt, Homo sapiens
uugcauuagugugguacauuug

SEQ ID NO: 39428 - RNA, 22 nt, Homo sapiens
uugccaauauuuuacugagaag

SEQ ID NO: 39429 - RNA, 22 nt, Homo sapiens
uuggaagacauucugucugcua

SEQ ID NO: 39430 - RNA, 22 nt, Homo sapiens
uuggaagagaagggagauaaac

SEQ ID NO: 39431 - RNA, 22 nt, Homo sapiens
uuggaagauuacuuaguuuucu

SEQ ID NO: 39432 - RNA, 22 nt, Homo sapiens
uuggaauauuauuauugggcag

SEQ ID NO: 39433 - RNA, 22 nt, Homo sapiens
uuggcaaagaggaaugccacuu

SEQ ID NO: 39434 - RNA, 22 nt, Homo sapiens
uuggccauaugacuugcuuugg

SEQ ID NO: 39435 - RNA, 22 nt, Homo sapiens
uuggcuguguuccucaaggagu

SEQ ID NO: 39436 - RNA, 22 nt, Homo sapiens
uuggcuguguuuauaugcugga

SEQ ID NO: 39437 - RNA, 22 nt, Homo sapiens
uuggcuuuuaugcagcuuaggu

SEQ ID NO: 39438 - RNA, 17 nt, Homo sapiens
uugggcaagguagguga

SEQ ID NO: 39439 - RNA, 22 nt, Homo sapiens
uuguaguguuuauucugucaac

SEQ ID NO: 39440 - RNA, 22 nt, Homo sapiens
uuguccaagucccauuuguuga

SEQ ID NO: 39441 - RNA, 22 nt, Homo sapiens
uuguccuccacauuugaucagu

SEQ ID NO: 39442 - RNA, 22 nt, Homo sapiens
uuguccuugagauaguuugcag

SEQ ID NO: 39443 - RNA, 22 nt, Homo sapiens
uuguccuugagauaguuugcug

SEQ ID NO: 39444 - RNA, 22 nt, Homo sapiens
uugugaagaugugaagcaagca

SEQ ID NO: 39445 - RNA, 22 nt, Homo sapiens
uugugacacagcugggccuaua

SEQ ID NO: 39446 - RNA, 20 nt, Homo sapiens
uugugcauugggccauuggg

SEQ ID NO: 39447 - RNA, 22 nt, Homo sapiens
uugugcuuaauaaaaaguggua

SEQ ID NO: 39448 - RNA, 22 nt, Homo sapiens
uugugcuucaucaccuagcaga

SEQ ID NO: 39449 - RNA, 22 nt, Homo sapiens
uugugcuugauuugccuagcug

SEQ ID NO: 39450 - RNA, 22 nt, Homo sapiens
uugugcuugcuguguucuaugc

SEQ ID NO: 39451 - RNA, 22 nt, Homo sapiens
uuguuuuggagaugagcuaaaa

SEQ ID NO: 39452 - RNA, 20 nt, Homo sapiens
uuuaagacaugcugaauuga

SEQ ID NO: 39453 - RNA, 22 nt, Homo sapiens
uuuaauacugcaucuuuacucu

SEQ ID NO: 39454 - RNA, 22 nt, Homo sapiens
uuuaaugcugcccagucauggg

SEQ ID NO: 39455 - RNA, 22 nt, Homo sapiens
uuuacagucucauagguggaag

SEQ ID NO: 39456 - RNA, 22 nt, Homo sapiens
uuuaugagguagagugguuuau

SEQ ID NO: 39457 - RNA, 22 nt, Homo sapiens
uuuauguggagcacuugacaca

SEQ ID NO: 39458 - RNA, 22 nt, Homo sapiens
uuucacagcaauugccuauugu

SEQ ID NO: 39459 - RNA, 22 nt, Homo sapiens
uuucccauuguucugcucugug

SEQ ID NO: 39460 - RNA, 22 nt, Homo sapiens
uuucucaguguuucaggguagg

SEQ ID NO: 39461 - RNA, 22 nt, Homo sapiens
uuucugggggugcugauggaaa

SEQ ID NO: 39462 - RNA, 22 nt, Homo sapiens
uuucuuggagcucuuagggucg

SEQ ID NO: 39463 - RNA, 22 nt, Homo sapiens
uuugaagacuacugggagugaa

SEQ ID NO: 39464 - RNA, 22 nt, Homo sapiens
uuugaagcaauugugaauggga

SEQ ID NO: 39465 - RNA, 23 nt, Homo sapiens
uuugagugugauaaacacuguca

SEQ ID NO: 39466 - RNA, 22 nt, Homo sapiens
uauggguuucagagggugauag

SEQ ID NO: 39467 - RNA, 22 nt, Homo sapiens
uaugguuuuggaauccugcaga

SEQ ID NO: 39468 - RNA, 22 nt, Homo sapiens
uauguuaucaaaaagcuaagga

SEQ ID NO: 39469 - RNA, 22 nt, Homo sapiens
uauuacagaccauaucgccggg

SEQ ID NO: 39470 - RNA, 22 nt, Homo sapiens
uauuaguuuucuguggauuaca

SEQ ID NO: 39471 - RNA, 22 nt, Homo sapiens
uauugaacgugggauauugaag

SEQ ID NO: 39472 - RNA, 22 nt, Homo sapiens
uauugcacaugaggagacauug

SEQ ID NO: 39473 - RNA, 22 nt, Homo sapiens
uauugcuaacaucccuuaugua

SEQ ID NO: 39474 - RNA, 22 nt, Homo sapiens
uauugcuugaggaaaugguaau

SEQ ID NO: 39475 - RNA, 18 nt, Homo sapiens
uauugcuugguuuggaga

SEQ ID NO: 39476 - RNA, 22 nt, Homo sapiens
uauugcuuuacucucuuauccu

SEQ ID NO: 39477 - RNA, 22 nt, Homo sapiens
uauuggcucuguuucucugaag

SEQ ID NO: 39478 - RNA, 20 nt, Homo sapiens
ucaaauucuuggccuccagc

SEQ ID NO: 39479 - RNA, 22 nt, Homo sapiens
ucaagaccucacauagaggaga

SEQ ID NO: 39480 - RNA, 22 nt, Homo sapiens
ucaaggcacuagcugagcugca

SEQ ID NO: 39481 - RNA, 22 nt, Homo sapiens
ucaaguacuuauuugauaauua

SEQ ID NO: 39482 - RNA, 22 nt, Homo sapiens
ucacagacauugaggggaccuu

SEQ ID NO: 39483 - RNA, 21 nt, Homo sapiens
ucacagccuaggaccugaaga

SEQ ID NO: 39484 - RNA, 22 nt, Homo sapiens
ucacagccuaguuuuauacauu

SEQ ID NO: 39485 - RNA, 22 nt, Homo sapiens
ucacagugaguggaguggggug

SEQ ID NO: 39486 - RNA, 17 nt, Homo sapiens
ucacaguguuaggauga

SEQ ID NO: 39487 - RNA, 22 nt, Homo sapiens
ucacauucaauuguaauccccg

SEQ ID NO: 39488 - RNA, 20 nt, Homo sapiens
ucacuauggagcucuuucuu

SEQ ID NO: 39489 - RNA, 20 nt, Homo sapiens
ucacugugaacuucuugagg

SEQ ID NO: 39490 - RNA, 22 nt, Homo sapiens
ucacuuggccgcagccuucucu

SEQ ID NO: 39491 - RNA, 22 nt, Homo sapiens
ucagaguggagucugcagccuu

SEQ ID NO: 39492 - RNA, 22 nt, Homo sapiens
ucagaguguuuuccaacuuggu

SEQ ID NO: 39493 - RNA, 22 nt, Homo sapiens
ucagaucaguuccacaagaacu

SEQ ID NO: 39494 - RNA, 22 nt, Homo sapiens
ucagauuggugcaaaaguaauu

SEQ ID NO: 39495 - RNA, 22 nt, Homo sapiens
ucaggcaccuuccucuuaucug

SEQ ID NO: 39496 - RNA, 20 nt, Homo sapiens
ucagugauugguuuaguuau

SEQ ID NO: 39497 - RNA, 21 nt, Homo sapiens
ucagugcugugggcaaggugc

SEQ ID NO: 39498 - RNA, 22 nt, Homo sapiens
ucaguggacuuagucuuucccc

SEQ ID NO: 39499 - RNA, 22 nt, Homo sapiens
ucaguggagagcuuccaggauu

SEQ ID NO: 39500 - RNA, 22 nt, Homo sapiens
ucaguggagccucacucugugg

SEQ ID NO: 39501 - RNA, 22 nt, Homo sapiens
ucaguggauuauuaaagucacc

SEQ ID NO: 39502 - RNA, 21 nt, Homo sapiens
ucauaagcucaacaucuguag

SEQ ID NO: 39503 - RNA, 21 nt, Homo sapiens
ucaucaagcuguagacaugau

SEQ ID NO: 39504 - RNA, 22 nt, Homo sapiens
ucaucaguggggaugugguuga

SEQ ID NO: 39505 - RNA, 20 nt, Homo sapiens
ucaucaguuggugcucgcug

SEQ ID NO: 39506 - RNA, 22 nt, Homo sapiens
ucaucuggcgaaugugaagagu

SEQ ID NO: 39507 - RNA, 22 nt, Homo sapiens
ucauguauuaucauuagugggu

SEQ ID NO: 39508 - RNA, 22 nt, Homo sapiens
ucaugugaggauaacaauagug

SEQ ID NO: 39509 - RNA, 22 nt, Homo sapiens
ucauucauuugcucacuccaca

SEQ ID NO: 39510 - RNA, 22 nt, Homo sapiens
uccaguagaauuuuauucaaca

SEQ ID NO: 39511 - RNA, 22 nt, Homo sapiens
uccagugugcaggcaaguuuga

SEQ ID NO: 39512 - RNA, 22 nt, Homo sapiens
uccaguuuuguuaacauauggu

SEQ ID NO: 39513 - RNA, 22 nt, Homo sapiens
uccaugagaauaguuaggcucu

SEQ ID NO: 39514 - RNA, 19 nt, Homo sapiens
ucccaauguuuccaggcag

SEQ ID NO: 39515 - RNA, 22 nt, Homo sapiens
ucccaguauucauuuacagaag

SEQ ID NO: 39516 - RNA, 19 nt, Homo sapiens
ucccugagucuuagcuuga

SEQ ID NO: 39517 - RNA, 22 nt, Homo sapiens
ucccuguguccugggggcaccu

SEQ ID NO: 39518 - RNA, 22 nt, Homo sapiens
uccucaguggauuggauggugc

SEQ ID NO: 39519 - RNA, 22 nt, Homo sapiens
uccuugaaacaggaagaauuca

SEQ ID NO: 39520 - RNA, 22 nt, Homo sapiens
uccuugagccucccagacucag

SEQ ID NO: 39521 - RNA, 22 nt, Homo sapiens
uccuuugguucuugucacccca

SEQ ID NO: 39522 - RNA, 22 nt, Homo sapiens
ucgcaccauugcacuccagcca

SEQ ID NO: 39523 - RNA, 22 nt, Homo sapiens
ucgcagcacgagcaugcaaggu

SEQ ID NO: 39524 - RNA, 22 nt, Homo sapiens
ucucagagccuaggguuuuuca

SEQ ID NO: 39525 - RNA, 22 nt, Homo sapiens
ucucagugaauugguuuugucu

SEQ ID NO: 39526 - RNA, 17 nt, Homo sapiens
ucucccaucccuuucuc

SEQ ID NO: 39527 - RNA, 22 nt, Homo sapiens
ucugacaaugaacaaucuauag

SEQ ID NO: 39528 - RNA, 19 nt, Homo sapiens
ucugacagccccagucaac

SEQ ID NO: 39529 - RNA, 22 nt, Homo sapiens
ucugacuagacaagcaguguac

SEQ ID NO: 39530 - RNA, 22 nt, Homo sapiens
ucugcaagucuaaacuagccau

SEQ ID NO: 39531 - RNA, 23 nt, Homo sapiens
ucugcggguguggacccuagugc

SEQ ID NO: 39532 - RNA, 22 nt, Homo sapiens
ucuggaauguaaaguuuauggg

SEQ ID NO: 39533 - RNA, 22 nt, Homo sapiens
ucuggcauuuucucugcuugca

SEQ ID NO: 39534 - RNA, 21 nt, Homo sapiens
ucuggccccuccaaaucucau

SEQ ID NO: 39535 - RNA, 22 nt, Homo sapiens
ucuggccccucucaaaucucau

SEQ ID NO: 39536 - RNA, 22 nt, Homo sapiens
ucuggcuuuuaacaucuauaaa

SEQ ID NO: 39537 - RNA, 22 nt, Homo sapiens
ucugggguuagucaaagguaug

SEQ ID NO: 39538 - RNA, 22 nt, Homo sapiens
ucugucuuguccucacccuaga

SEQ ID NO: 39539 - RNA, 22 nt, Homo sapiens
ucugugcugagaguugaaaguu

SEQ ID NO: 39540 - RNA, 22 nt, Homo sapiens
ucugugcuugucauaugcuuug

SEQ ID NO: 39541 - RNA, 19 nt, Homo sapiens
ucugugcuugucccccugu

SEQ ID NO: 39542 - RNA, 22 nt, Homo sapiens
ucugugguucaggcuggagugc

SEQ ID NO: 39543 - RNA, 17 nt, Homo sapiens
ucuucuguuacuguggc

SEQ ID NO: 39544 - RNA, 22 nt, Homo sapiens
uuugcagagacuuguuaggaau

SEQ ID NO: 39545 - RNA, 22 nt, Homo sapiens
uuuggcacuguaaauuucucuu

SEQ ID NO: 39546 - RNA, 22 nt, Homo sapiens
uugagggaagccagaggucugc

SEQ ID NO: 39547 - RNA, 22 nt, Homo sapiens
uugagggaggcagggcuugucu

SEQ ID NO: 39548 - RNA, 22 nt, Homo sapiens
uugaggucagagguucgagacc

SEQ ID NO: 39549 - RNA, 22 nt, Homo sapiens
uugcaacauguauucuggugau

SEQ ID NO: 39550 - RNA, 22 nt, Homo sapiens
uugcaacauuguaaguuuauau

SEQ ID NO: 39551 - RNA, 20 nt, Homo sapiens
uugcacagagaaggaggcag

SEQ ID NO: 39552 - RNA, 22 nt, Homo sapiens
uugcacauguugaaccagcaaa

SEQ ID NO: 39553 - RNA, 22 nt, Homo sapiens
uugcacauuuuuucuggcagaa

SEQ ID NO: 39554 - RNA, 22 nt, Homo sapiens
uugcauagacaauauuaaucuu

SEQ ID NO: 39555 - RNA, 22 nt, Homo sapiens
uugcauuuucuaggagggcaaa

SEQ ID NO: 39556 - RNA, 22 nt, Homo sapiens
uugcuaagucaagagaaaugau

SEQ ID NO: 39557 - RNA, 22 nt, Homo sapiens
uugcuuagucaugaaucacuga

SEQ ID NO: 39558 - RNA, 22 nt, Homo sapiens
uuggaauacuuguuaaagucca

SEQ ID NO: 39559 - RNA, 22 nt, Homo sapiens
uuggaauauaaccuguuucuaa

SEQ ID NO: 39560 - RNA, 22 nt, Homo sapiens
uuggaauuuuaaaauaggcaac

SEQ ID NO: 39561 - RNA, 22 nt, Homo sapiens
uuggacucccuccccagcuuca

SEQ ID NO: 39562 - RNA, 22 nt, Homo sapiens
uuggagagucacuaguuagugc

SEQ ID NO: 39563 - RNA, 22 nt, Homo sapiens
uuggagagugauauucagaugc

SEQ ID NO: 39564 - RNA, 22 nt, Homo sapiens
uuggauuuuaacaaacuaggug

SEQ ID NO: 39565 - RNA, 22 nt, Homo sapiens
uugggauggaacuuuucaguga

SEQ ID NO: 39566 - RNA, 23 nt, Homo sapiens
uugggcaaaucacuaacgucucc

SEQ ID NO: 39567 - RNA, 21 nt, Homo sapiens
uuggggaauggagagguuuuc

SEQ ID NO: 39568 - RNA, 22 nt, Homo sapiens
uugguaguuucugucuuuagau

SEQ ID NO: 39569 - RNA, 22 nt, Homo sapiens
uugguauguaauuuauauugua

SEQ ID NO: 39570 - RNA, 22 nt, Homo sapiens
uuggucaaaucugaugggagaa

SEQ ID NO: 39571 - RNA, 22 nt, Homo sapiens
uuguacaggaguguaagcuuca

SEQ ID NO: 39572 - RNA, 22 nt, Homo sapiens
uuguacuuuuaguagagacggg

SEQ ID NO: 39573 - RNA, 22 nt, Homo sapiens
uuguauguuguuugucagagaa

SEQ ID NO: 39574 - RNA, 22 nt, Homo sapiens
uuguccucuccaaaucucaugu

SEQ ID NO: 39575 - RNA, 22 nt, Homo sapiens
uugugaagaaaccagaaaaguu

SEQ ID NO: 39576 - RNA, 22 nt, Homo sapiens
uugugcaugaugcauacauggu

SEQ ID NO: 39577 - RNA, 22 nt, Homo sapiens
uugugcuuaaugaguguaaggu

SEQ ID NO: 39578 - RNA, 22 nt, Homo sapiens
uugugcuuguaacuacauucag

SEQ ID NO: 39579 - RNA, 22 nt, Homo sapiens
uuguguccccacccaaaucuca

SEQ ID NO: 39580 - RNA, 22 nt, Homo sapiens
uuguguuuuuaguagggaaggg

SEQ ID NO: 39581 - RNA, 22 nt, Homo sapiens
uuguuauguuaaacuacugaaa

SEQ ID NO: 39582 - RNA, 22 nt, Homo sapiens
uuuaacauuggaugagaucguc

SEQ ID NO: 39583 - RNA, 22 nt, Homo sapiens
uuuaaugcaucccaaaauguag

SEQ ID NO: 39584 - RNA, 23 nt, Homo sapiens
uuucacaguagcuggaucagccu

SEQ ID NO: 39585 - RNA, 19 nt, Homo sapiens
uuucauguuuuuggugaga

SEQ ID NO: 39586 - RNA, 22 nt, Homo sapiens
uuuccaguuuggaggaugcauu

SEQ ID NO: 39587 - RNA, 22 nt, Homo sapiens
uuugaagugugaugccuugaug

SEQ ID NO: 39588 - RNA, 22 nt, Homo sapiens
uuugaaugcaacaaaugcggga

SEQ ID NO: 39589 - RNA, 22 nt, Homo sapiens
uuugcacauauuugggcaaaag

SEQ ID NO: 39590 - RNA, 22 nt, Homo sapiens
uuugcacuggagauucaauggg

SEQ ID NO: 39591 - RNA, 22 nt, Homo sapiens
uuuggaaugugcacucagauug

SEQ ID NO: 39592 - RNA, 22 nt, Homo sapiens
uuuggacuucuagccuccagag

SEQ ID NO: 39593 - RNA, 20 nt, Homo sapiens
uuuggcacugagugguauaa

SEQ ID NO: 39594 - RNA, 22 nt, Homo sapiens
uuuggcagaugacccucaaguu

SEQ ID NO: 39595 - RNA, 22 nt, Homo sapiens
uuuguacacuguugguaggauu

SEQ ID NO: 39596 - RNA, 23 nt, Homo sapiens
uuuguaguagcaugauuuauaau

SEQ ID NO: 39597 - RNA, 21 nt, Homo sapiens
uuuugcacacuaugcagcuuu

SEQ ID NO: 39598 - RNA, 22 nt, Homo sapiens
uuuugcucuucauagguccugu

SEQ ID NO: 39599 - RNA, 22 nt, Homo sapiens
uuuuugaguaaauauaaauugu

SEQ ID NO: 39600 - RNA, 22 nt, Homo sapiens
uuuuuugguaauugaacaauga

SEQ ID NO: 39601 - RNA, 22 nt, Homo sapiens
gaacccuggaggcggagguugc

SEQ ID NO: 39602 - RNA, 22 nt, Homo sapiens
gaagaaguacaagacaaauuuu

SEQ ID NO: 39603 - RNA, 22 nt, Homo sapiens
gaaggcacugugugccacccug

SEQ ID NO: 39604 - RNA, 22 nt, Homo sapiens
gaaggcaugcugcauggccaga

SEQ ID NO: 39605 - RNA, 22 nt, Homo sapiens
gaaggugcuuggugaaugcauu

SEQ ID NO: 39606 - RNA, 22 nt, Homo sapiens
gaauguuuacuuuguuuaauac

SEQ ID NO: 39607 - RNA, 22 nt, Homo sapiens
gaauucugucgcuuacuagaug

SEQ ID NO: 39608 - RNA, 22 nt, Homo sapiens
gacccucuagagggaagcgcuu

SEQ ID NO: 39609 - RNA, 22 nt, Homo sapiens
gacuggguuaguuugaaagacu

SEQ ID NO: 39610 - RNA, 22 nt, Homo sapiens
gacuuagagauguuguauuugg

SEQ ID NO: 39611 - RNA, 20 nt, Homo sapiens
gacuugagagugggagagua

SEQ ID NO: 39612 - RNA, 18 nt, Homo sapiens
gacuuggaguuuacagug

SEQ ID NO: 39613 - RNA, 22 nt, Homo sapiens
gagaagugcgucguuugaugau

SEQ ID NO: 39614 - RNA, 21 nt, Homo sapiens
gagaaucaucauggcugcaua

SEQ ID NO: 39615 - RNA, 22 nt, Homo sapiens
gagaaugagaggggaaggccac

SEQ ID NO: 39616 - RNA, 22 nt, Homo sapiens
gagagcauuaagccaucaucau

SEQ ID NO: 39617 - RNA, 22 nt, Homo sapiens
gagagugcuuuggguguaggcc

SEQ ID NO: 39618 - RNA, 22 nt, Homo sapiens
gagauauguuggcagcugguau

SEQ ID NO: 39619 - RNA, 22 nt, Homo sapiens
gagaucauugugggccaagcug

SEQ ID NO: 39620 - RNA, 22 nt, Homo sapiens
gagaugaaguuaaggaucuuua

SEQ ID NO: 39621 - RNA, 22 nt, Homo sapiens
gagcaaaaguauguauugguua

SEQ ID NO: 39622 - RNA, 22 nt, Homo sapiens
gagcugaucuuuucugauucca

SEQ ID NO: 39623 - RNA, 22 nt, Homo sapiens
gagguaaguaagaauggcaagc

SEQ ID NO: 39624 - RNA, 22 nt, Homo sapiens
gagguaaguggauuaugagguc

SEQ ID NO: 39625 - RNA, 21 nt, Homo sapiens
gagguagggauuaaagaccuc

SEQ ID NO: 39626 - RNA, 22 nt, Homo sapiens
gagugcaauggcgcgaucucgg

SEQ ID NO: 39627 - RNA, 22 nt, Homo sapiens
gagugguaguuucuagaggugu

SEQ ID NO: 39628 - RNA, 22 nt, Homo sapiens
gaguuuguaaacuauucacuaa

SEQ ID NO: 39629 - RNA, 22 nt, Homo sapiens
gaucaauuggcugaagacacgu

SEQ ID NO: 39630 - RNA, 22 nt, Homo sapiens
gaucuggagguuuuccucauga

SEQ ID NO: 39631 - RNA, 22 nt, Homo sapiens
gaucuggucuuugauuagacac

SEQ ID NO: 39632 - RNA, 22 nt, Homo sapiens
gaugacuaagaauuuuauaauu

SEQ ID NO: 39633 - RNA, 22 nt, Homo sapiens
gauggcagugcagccccuggcu

SEQ ID NO: 39634 - RNA, 22 nt, Homo sapiens
gcacauggccacuaggaauaaa

SEQ ID NO: 39635 - RNA, 22 nt, Homo sapiens
gcaccccuuaccgggcuggguu

SEQ ID NO: 39636 - RNA, 22 nt, Homo sapiens
gcagcacauggcagaacauauu

SEQ ID NO: 39637 - RNA, 22 nt, Homo sapiens
gcagcaguggcaguuaauauuu

SEQ ID NO: 39638 - RNA, 22 nt, Homo sapiens
gcaucacagggagacaggccuc

SEQ ID NO: 39639 - RNA, 22 nt, Homo sapiens
gcccacuguuaaauuuguuuua

SEQ ID NO: 39640 - RNA, 22 nt, Homo sapiens
gcccuguaguauaguuugaagu

SEQ ID NO: 39641 - RNA, 22 nt, Homo sapiens
gccuuuggugacaggcaugugu

SEQ ID NO: 39642 - RNA, 23 nt, Homo sapiens
gcuaggagagaugaaacacaggu

SEQ ID NO: 39643 - RNA, 22 nt, Homo sapiens
gcugacagugguuauacuuaga

SEQ ID NO: 39644 - RNA, 22 nt, Homo sapiens
gcuggucugccguaguaggugc

SEQ ID NO: 39645 - RNA, 22 nt, Homo sapiens
gcugguguagagugcagaaagg

SEQ ID NO: 39646 - RNA, 22 nt, Homo sapiens
gcuguguugugcccagcaucau

SEQ ID NO: 39647 - RNA, 22 nt, Homo sapiens
gcuguuugccgccaucgcagac

SEQ ID NO: 39648 - RNA, 22 nt, Homo sapiens
uuauggcuuugcgguguuagca

SEQ ID NO: 39649 - RNA, 22 nt, Homo sapiens
uuauucagcaccugcuguguuc

SEQ ID NO: 39650 - RNA, 16 nt, Homo sapiens
uuauugcauucuucuc

SEQ ID NO: 39651 - RNA, 22 nt, Homo sapiens
uuauugcuuaugauuagguguu

SEQ ID NO: 39652 - RNA, 22 nt, Homo sapiens
uucaaaggauagauuaagauca

SEQ ID NO: 39653 - RNA, 22 nt, Homo sapiens
uucaacagugauggccuuugua

SEQ ID NO: 39654 - RNA, 22 nt, Homo sapiens
uucaagaauuaaaguggcuuuu

SEQ ID NO: 39655 - RNA, 22 nt, Homo sapiens
uucagagagggagggauaccua

SEQ ID NO: 39656 - RNA, 22 nt, Homo sapiens
uucagaucaucccagcuccacu

SEQ ID NO: 39657 - RNA, 19 nt, Homo sapiens
uucagcagugucugcucuu

SEQ ID NO: 39658 - RNA, 22 nt, Homo sapiens
uucaguaguaaguuggaacucu

SEQ ID NO: 39659 - RNA, 22 nt, Homo sapiens
uucaguggacuuaguagugcuu

SEQ ID NO: 39660 - RNA, 22 nt, Homo sapiens
uucauagaggacauuacuggag

SEQ ID NO: 39661 - RNA, 22 nt, Homo sapiens
uucaucuggcaauucagagauu

SEQ ID NO: 39662 - RNA, 22 nt, Homo sapiens
uuccaguguguucauccucaga

SEQ ID NO: 39663 - RNA, 22 nt, Homo sapiens
uuccaguuauuauaccucuuaa

SEQ ID NO: 39664 - RNA, 22 nt, Homo sapiens
uucccuuugugcauaggauuug

SEQ ID NO: 39665 - RNA, 22 nt, Homo sapiens
uucuagagagaagacuuaagcu

SEQ ID NO: 39666 - RNA, 22 nt, Homo sapiens
uucuggaaaucagcagagggug

SEQ ID NO: 39667 - RNA, 22 nt, Homo sapiens
uucuggcuaugggauacuaaau

SEQ ID NO: 39668 - RNA, 22 nt, Homo sapiens
uucuugcuguauccucacaugg

SEQ ID NO: 39669 - RNA, 22 nt, Homo sapiens
uucuugguguaguaguugaaaa

SEQ ID NO: 39670 - RNA, 22 nt, Homo sapiens
uucuuuaguucacuugcuccag

SEQ ID NO: 39671 - RNA, 22 nt, Homo sapiens
uugaaaguguucacaaugguau

SEQ ID NO: 39672 - RNA, 22 nt, Homo sapiens
uugaacuagaaccugcaaauuu

SEQ ID NO: 39673 - RNA, 22 nt, Homo sapiens
uugaagacuaccuaccauacuu

SEQ ID NO: 39674 - RNA, 22 nt, Homo sapiens
uugaaguagaaagacgaaauuu

SEQ ID NO: 39675 - RNA, 22 nt, Homo sapiens
uugaaguagcauuucaugucua

SEQ ID NO: 39676 - RNA, 22 nt, Homo sapiens
uugacagaccuuggucauaucc

SEQ ID NO: 39677 - RNA, 20 nt, Homo sapiens
uugacagagggaaaguugcu

SEQ ID NO: 39678 - RNA, 22 nt, Homo sapiens
uugacuuuuauucacucugcua

SEQ ID NO: 39679 - RNA, 21 nt, Homo sapiens
uugagaagaauuagcucuucc

SEQ ID NO: 39680 - RNA, 22 nt, Homo sapiens
uugagauggagccucacucugc

SEQ ID NO: 39681 - RNA, 22 nt, Homo sapiens
uugagauggagucucacgcauu

SEQ ID NO: 39682 - RNA, 22 nt, Homo sapiens
uugagauggagucucacuccuu

SEQ ID NO: 39683 - RNA, 22 nt, Homo sapiens
uugagauggagucucgcacugu

SEQ ID NO: 39684 - RNA, 22 nt, Homo sapiens
uugagauggaguucauuuuugu

SEQ ID NO: 39685 - RNA, 22 nt, Homo sapiens
uugagauggaguuucaauauug

SEQ ID NO: 39686 - RNA, 22 nt, Homo sapiens
uugagcacaggaguuugagacc

SEQ ID NO: 39687 - RNA, 22 nt, Homo sapiens
uugagggaaacauucacaucau

SEQ ID NO: 39688 - RNA, 22 nt, Homo sapiens
uugaggugaagggcagagcagc

SEQ ID NO: 39689 - RNA, 22 nt, Homo sapiens
uugauguugaggacauaaaccu

SEQ ID NO: 39690 - RNA, 21 nt, Homo sapiens
uugcaaaugcugcugccugau

SEQ ID NO: 39691 - RNA, 22 nt, Homo sapiens
uugcacaauggaauuuaucuuu

SEQ ID NO: 39692 - RNA, 22 nt, Homo sapiens
uugcacagugguuuagagccug

SEQ ID NO: 39693 - RNA, 22 nt, Homo sapiens
uugcacauggcaggugcucaau

SEQ ID NO: 39694 - RNA, 22 nt, Homo sapiens
uugcacauugauuuuguaucuu

SEQ ID NO: 39695 - RNA, 22 nt, Homo sapiens
uugcacuccagccuggaugaca

SEQ ID NO: 39696 - RNA, 22 nt, Homo sapiens
uugcagcaaauaggaaugagga

SEQ ID NO: 39697 - RNA, 22 nt, Homo sapiens
uauugcagugagauccaucugg

SEQ ID NO: 39698 - RNA, 22 nt, Homo sapiens
uauugcuuuuaacccaaucucu

SEQ ID NO: 39699 - RNA, 22 nt, Homo sapiens
uauuguacauguuauagauuuu

SEQ ID NO: 39700 - RNA, 22 nt, Homo sapiens
uauuguccacuuugcacugugu

SEQ ID NO: 39701 - RNA, 22 nt, Homo sapiens
uauuuggauagucuggaaaaaa

SEQ ID NO: 39702 - RNA, 22 nt, Homo sapiens
ucaaaugauucagaagccaccu

SEQ ID NO: 39703 - RNA, 22 nt, Homo sapiens
ucaaaugcuguauuguaguaau

SEQ ID NO: 39704 - RNA, 22 nt, Homo sapiens
ucaaggcaguggccuuccuucu

SEQ ID NO: 39705 - RNA, 18 nt, Homo sapiens
ucacagguaaaguugaca

SEQ ID NO: 39706 - RNA, 22 nt, Homo sapiens
ucacauuaagcuguuauuucuu

SEQ ID NO: 39707 - RNA, 22 nt, Homo sapiens
ucacauuguauauguaccuauc

SEQ ID NO: 39708 - RNA, 22 nt, Homo sapiens
ucacuagggagaaacugaggcu

SEQ ID NO: 39709 - RNA, 22 nt, Homo sapiens
ucacugcacucuccgccuugcg

SEQ ID NO: 39710 - RNA, 22 nt, Homo sapiens
ucagagcaaagacacuuuauca

SEQ ID NO: 39711 - RNA, 22 nt, Homo sapiens
ucagaguggccucucuugaaga

SEQ ID NO: 39712 - RNA, 22 nt, Homo sapiens
ucagauugaugcauacuuaaau

SEQ ID NO: 39713 - RNA, 22 nt, Homo sapiens
ucaggcaugcagcaaugcagug

SEQ ID NO: 39714 - RNA, 22 nt, Homo sapiens
ucagguaaucuauuugucuuuu

SEQ ID NO: 39715 - RNA, 19 nt, Homo sapiens
ucaguagugcacauaagcc

SEQ ID NO: 39716 - RNA, 22 nt, Homo sapiens
ucaguauaugaaucuggggcag

SEQ ID NO: 39717 - RNA, 23 nt, Homo sapiens
ucagugaaggaacaacuaaauag

SEQ ID NO: 39718 - RNA, 22 nt, Homo sapiens
ucauacaggccaccagggaagu

SEQ ID NO: 39719 - RNA, 21 nt, Homo sapiens
ucaucagucaaagacaauggu

SEQ ID NO: 39720 - RNA, 22 nt, Homo sapiens
ucaugcaucuuguggaauuuga

SEQ ID NO: 39721 - RNA, 23 nt, Homo sapiens
ucauguauucccuguaaugggua

SEQ ID NO: 39722 - RNA, 22 nt, Homo sapiens
ucauucauucuucaguggguac

SEQ ID NO: 39723 - RNA, 22 nt, Homo sapiens
ucauugcuuauuuguuggugga

SEQ ID NO: 39724 - RNA, 22 nt, Homo sapiens
uccacguggucuaucuguccuu

SEQ ID NO: 39725 - RNA, 22 nt, Homo sapiens
uccaguuauccuguggggagga

SEQ ID NO: 39726 - RNA, 22 nt, Homo sapiens
uccauguagaugcuauguuguc

SEQ ID NO: 39727 - RNA, 22 nt, Homo sapiens
ucccacugucuucucgugcucg

SEQ ID NO: 39728 - RNA, 22 nt, Homo sapiens
uccccugagaccccucagcacu

SEQ ID NO: 39729 - RNA, 22 nt, Homo sapiens
ucccugagcaaaguuuucugua

SEQ ID NO: 39730 - RNA, 22 nt, Homo sapiens
ucccugagugauugaaaauaaa

SEQ ID NO: 39731 - RNA, 22 nt, Homo sapiens
ucccuuucuggaguuucccaag

SEQ ID NO: 39732 - RNA, 22 nt, Homo sapiens
uccugagacucacaggcucccc

SEQ ID NO: 39733 - RNA, 22 nt, Homo sapiens
uccuuuagacugaauccugaga

SEQ ID NO: 39734 - RNA, 22 nt, Homo sapiens
uccuuuggguagcuguucagau

SEQ ID NO: 39735 - RNA, 22 nt, Homo sapiens
ucuaaagcauccagauugcuuc

SEQ ID NO: 39736 - RNA, 23 nt, Homo sapiens
ucucauuccuugaaaauaaugac

SEQ ID NO: 39737 - RNA, 22 nt, Homo sapiens
ucucccauccaugaacuucugu

SEQ ID NO: 39738 - RNA, 22 nt, Homo sapiens
ucuccggguggcggcgaaggga

SEQ ID NO: 39739 - RNA, 19 nt, Homo sapiens
ucucugguguuggagggga

SEQ ID NO: 39740 - RNA, 22 nt, Homo sapiens
ucugagcaugcaucuugccugg

SEQ ID NO: 39741 - RNA, 22 nt, Homo sapiens
ucugaguggcagaaugagcuga

SEQ ID NO: 39742 - RNA, 21 nt, Homo sapiens
ucuggcccccucaaaucucau

SEQ ID NO: 39743 - RNA, 20 nt, Homo sapiens
ucuggccccucuaaaucuca

SEQ ID NO: 39744 - RNA, 22 nt, Homo sapiens
ucuggcuucugacuuaggggac

SEQ ID NO: 39745 - RNA, 22 nt, Homo sapiens
aaauugcuuuugaagacuuagu

SEQ ID NO: 39746 - RNA, 19 nt, Homo sapiens
acauugcauuuguaggcuu

SEQ ID NO: 39747 - RNA, 22 nt, Homo sapiens
accaccauugcacugaacuuuc

SEQ ID NO: 39748 - RNA, 19 nt, Homo sapiens
accagauugcauucuugga

SEQ ID NO: 39749 - RNA, 22 nt, Homo sapiens
acuuugcuuagagggcauuaaa

SEQ ID NO: 39750 - RNA, 22 nt, Homo sapiens
agagcacugcugcaggguucug

SEQ ID NO: 39751 - RNA, 22 nt, Homo sapiens
agaugccucauguucuagguuc

SEQ ID NO: 39752 - RNA, 16 nt, Homo sapiens
agcagguguuagguga

SEQ ID NO: 39753 - RNA, 23 nt, Homo sapiens
auccacauucuaguccuuuaugc

SEQ ID NO: 39754 - RNA, 22 nt, Homo sapiens
augagagcuaacuguggguaca

SEQ ID NO: 39755 - RNA, 22 nt, Homo sapiens
auggagcaaaacagauuuggga

SEQ ID NO: 39756 - RNA, 22 nt, Homo sapiens
auggcuagaaccuguauauuca

SEQ ID NO: 39757 - RNA, 22 nt, Homo sapiens
auggcuuuuauuguguugaggu

SEQ ID NO: 39758 - RNA, 22 nt, Homo sapiens
augugcuuaaaaaugcagagaa

SEQ ID NO: 39759 - RNA, 22 nt, Homo sapiens
augugcuuauagguguauguuu

SEQ ID NO: 39760 - RNA, 22 nt, Homo sapiens
auucagaggggcagcugucuug

SEQ ID NO: 39761 - RNA, 18 nt, Homo sapiens
auucuacaggccuuuuga

SEQ ID NO: 39762 - RNA, 18 nt, Homo sapiens
auugcacaccagccuggg

SEQ ID NO: 39763 - RNA, 22 nt, Homo sapiens
auugcacaccagucugggcaaa

SEQ ID NO: 39764 - RNA, 22 nt, Homo sapiens
aacaggcuccuaggggugcacc

SEQ ID NO: 39765 - RNA, 22 nt, Homo sapiens
aagggagcugcauaaucuugug

SEQ ID NO: 39766 - RNA, 22 nt, Homo sapiens
aauugcuuuuauuuagggccag

SEQ ID NO: 39767 - RNA, 22 nt, Homo sapiens
aauuguacucccauaauucccu

SEQ ID NO: 39768 - RNA, 22 nt, Homo sapiens
aauuguacucccaucauuccua

SEQ ID NO: 39769 - RNA, 18 nt, Homo sapiens
acagugcuggcaugagau

SEQ ID NO: 39770 - RNA, 22 nt, Homo sapiens
acagugcuucugauaugaugcc

SEQ ID NO: 39771 - RNA, 22 nt, Homo sapiens
agcaggacaauaugggaucagg

SEQ ID NO: 39772 - RNA, 22 nt, Homo sapiens
agggagcaaaguggucuuucuc

SEQ ID NO: 39773 - RNA, 22 nt, Homo sapiens
aguaccacgugaugccauuuuc

SEQ ID NO: 39774 - RNA, 20 nt, Homo sapiens
auaccacagacuggguaguu

SEQ ID NO: 39775 - RNA, 16 nt, Homo sapiens
auaccacagugacaca

SEQ ID NO: 39776 - RNA, 22 nt, Homo sapiens
auauuguacugcuacugguucu

SEQ ID NO: 39777 - RNA, 22 nt, Homo sapiens
auccucugagaucuaggcagag

SEQ ID NO: 39778 - RNA, 22 nt, Homo sapiens
aucuagagaggcagucuggccg

SEQ ID NO: 39779 - RNA, 22 nt, Homo sapiens
auuagaugguuauaggugugag

SEQ ID NO: 39780 - RNA, 22 nt, Homo sapiens
auuggcuuuauacauaagaaua

SEQ ID NO: 39781 - RNA, 22 nt, Homo sapiens
auuguacuagguccuagggcuu

SEQ ID NO: 39782 - RNA, 22 nt, Homo sapiens
auuguacuccagccugggcaaa

SEQ ID NO: 39783 - RNA, 22 nt, Homo sapiens
auuguacuccagccugggcuaa

SEQ ID NO: 39784 - RNA, 22 nt, Homo sapiens
auuguacuccagccuguggagc

SEQ ID NO: 39785 - RNA, 22 nt, Homo sapiens
auuguacucuagccucugggca

SEQ ID NO: 39786 - RNA, 22 nt, Homo sapiens
caccacauuccauugaucaggc

SEQ ID NO: 39787 - RNA, 22 nt, Homo sapiens
cauggcuacugcagauguaggg

SEQ ID NO: 39788 - RNA, 22 nt, Homo sapiens
cauugcuuuuggugguuuagac

SEQ ID NO: 39789 - RNA, 22 nt, Homo sapiens
cauugguuaguuaacuuuaaga

SEQ ID NO: 39790 - RNA, 22 nt, Homo sapiens
cauuguacauaaguauggagua

SEQ ID NO: 39791 - RNA, 22 nt, Homo sapiens
cugccuagauguuguagggggu

SEQ ID NO: 39792 - RNA, 22 nt, Homo sapiens
gacccucuagauggaagcacug

SEQ ID NO: 39793 - RNA, 22 nt, Homo sapiens
gagccuguaggaggagaggugg

SEQ ID NO: 39794 - RNA, 22 nt, Homo sapiens
gcuuuguugauggugagucugu

SEQ ID NO: 39795 - RNA, 22 nt, Homo sapiens
gugagcaguguccuugggggca

SEQ ID NO: 39796 - RNA, 22 nt, Homo sapiens
uaccagcauuucucuuuaagua

SEQ ID NO: 39797 - RNA, 20 nt, Homo sapiens
uagcacaucuggcuguagag

SEQ ID NO: 39798 - RNA, 22 nt, Homo sapiens
uagcagccaggaagggcuggcu

SEQ ID NO: 39799 - RNA, 22 nt, Homo sapiens
uauggcuaugggaacugggagu

SEQ ID NO: 39800 - RNA, 22 nt, Homo sapiens
uauugaacgugggauauugaag

SEQ ID NO: 39801 - RNA, 20 nt, Homo sapiens
uauugcacuccagucugggc

SEQ ID NO: 39802 - RNA, 22 nt, Homo sapiens
uauugcuaacaucccuuaugua

SEQ ID NO: 39803 - RNA, 22 nt, Homo sapiens
uauuguacauauccucccuuca

SEQ ID NO: 39804 - RNA, 22 nt, Homo sapiens
ucacauuguacaaacagguaag

SEQ ID NO: 39805 - RNA, 22 nt, Homo sapiens
ucacauuguauauguaccuauc

SEQ ID NO: 39806 - RNA, 22 nt, Homo sapiens
ucauugcuuauuuguuggugga

SEQ ID NO: 39807 - RNA, 22 nt, Homo sapiens
ucugacuagacaagcaguguac

SEQ ID NO: 39808 - RNA, 22 nt, Homo sapiens
ucugccuacugguuggaggaac

SEQ ID NO: 39809 - RNA, 22 nt, Homo sapiens
ugagcuagggccuggaauaggg

SEQ ID NO: 39810 - RNA, 22 nt, Homo sapiens
ugccuaggcuggaaugcagugg

SEQ ID NO: 39811 - RNA, 22 nt, Homo sapiens
uuaaagccauaccugagagagu

SEQ ID NO: 39812 - RNA, 22 nt, Homo sapiens
uuaccacagugccugucuaaug

SEQ ID NO: 39813 - RNA, 22 nt, Homo sapiens
uuagggaggacaguuacaacag

SEQ ID NO: 39814 - RNA, 22 nt, Homo sapiens
uuagggaggagucccucuuuuu

SEQ ID NO: 39815 - RNA, 22 nt, Homo sapiens
uuauauguuacucccucuagca

SEQ ID NO: 39816 - RNA, 22 nt, Homo sapiens
uuauauguuucuguuuggaggc

SEQ ID NO: 39817 - RNA, 22 nt, Homo sapiens
uuauguguuuaauguuucugaa

SEQ ID NO: 39818 - RNA, 22 nt, Homo sapiens
uuauugcacuccagccugggua

SEQ ID NO: 39819 - RNA, 22 nt, Homo sapiens
aauugcuucuguauuuuggaca

SEQ ID NO: 39820 - RNA, 22 nt, Homo sapiens
acacauuggcaauucuggagca

SEQ ID NO: 39821 - RNA, 22 nt, Homo sapiens
acagugcuuucaauguucagua

SEQ ID NO: 39822 - RNA, 17 nt, Homo sapiens
acaugagacuggauucu

SEQ ID NO: 39823 - RNA, 22 nt, Homo sapiens
accaccacucccgcauucuaaa

SEQ ID NO: 39824 - RNA, 22 nt, Homo sapiens
accauugcacuccuuucugggc

SEQ ID NO: 39825 - RNA, 22 nt, Homo sapiens
agagccacauuaaauaugggaa

SEQ ID NO: 39826 - RNA, 22 nt, Homo sapiens
agcauuaguugugaagccuuua

SEQ ID NO: 39827 - RNA, 22 nt, Homo sapiens
agcuggcuguggagaaaccccu

SEQ ID NO: 39828 - RNA, 22 nt, Homo sapiens
agguagcauagcgggaauauca

SEQ ID NO: 39829 - RNA, 22 nt, Homo sapiens
auaagagcaggcuucuggccag

SEQ ID NO: 39830 - RNA, 22 nt, Homo sapiens
aucuggcuccuuuugacaaugc

SEQ ID NO: 39831 - RNA, 22 nt, Homo sapiens
aucuggcuucuuuuaguccaca

SEQ ID NO: 39832 - RNA, 22 nt, Homo sapiens
auuaagagcacauguucugggu

SEQ ID NO: 39833 - RNA, 22 nt, Homo sapiens
auugcuuacccuguauuagauc

SEQ ID NO: 39834 - RNA, 22 nt, Homo sapiens
auugcuuuuacugggagcuuug

SEQ ID NO: 39835 - RNA, 22 nt, Homo sapiens
auuggacagcauuucuagacuu

SEQ ID NO: 39836 - RNA, 22 nt, Homo sapiens
auuguacauacaccggugugua

SEQ ID NO: 39837 - RNA, 22 nt, Homo sapiens
auuguacuccagccugggcaag

SEQ ID NO: 39838 - RNA, 16 nt, Homo sapiens
cacauugcugcauggc

SEQ ID NO: 39839 - RNA, 22 nt, Homo sapiens
cagugcuuguuauuguucuauu

SEQ ID NO: 39840 - RNA, 22 nt, Homo sapiens
ccccauuguugugguuuuaucu

SEQ ID NO: 39841 - RNA, 22 nt, Homo sapiens
cuagcacauuuaucuuuauaca

SEQ ID NO: 39842 - RNA, 22 nt, Homo sapiens
cugccuagaucugaaccuggcu

SEQ ID NO: 39843 - RNA, 22 nt, Homo sapiens
gacccucuagagggaagcgcuu

SEQ ID NO: 39844 - RNA, 22 nt, Homo sapiens
gauuagagaaauacugcugcua

SEQ ID NO: 39845 - RNA, 22 nt, Homo sapiens
gcuuuguuaaaacacagccaca

SEQ ID NO: 39846 - RNA, 17 nt, Homo sapiens
guacacuucuucuguga

SEQ ID NO: 39847 - RNA, 22 nt, Homo sapiens
guacaguuuagugcuuugagaa

SEQ ID NO: 39848 - RNA, 22 nt, Homo sapiens
gucuggcuccuucuacuacaug

SEQ ID NO: 39849 - RNA, 22 nt, Homo sapiens
guggcuagaaugaagguagcug

SEQ ID NO: 39850 - RNA, 23 nt, Homo sapiens
uaccacauuccuucuuuccuguu

SEQ ID NO: 39851 - RNA, 22 nt, Homo sapiens
uauugcacaugaggagacauug

SEQ ID NO: 39852 - RNA, 22 nt, Homo sapiens
uauugcacuccagccuuggcaa

SEQ ID NO: 39853 - RNA, 22 nt, Homo sapiens
uauugcuugaggaaaugguaau

SEQ ID NO: 39854 - RNA, 22 nt, Homo sapiens
uauugcuuuuaacccaaucucu

SEQ ID NO: 39855 - RNA, 22 nt, Homo sapiens
ugacuuuagaauuuuauccaga

SEQ ID NO: 39856 - RNA, 22 nt, Homo sapiens
ugccuaggcuggagugcagugg

SEQ ID NO: 39857 - RNA, 22 nt, Homo sapiens
ugggagcauugcauuagaagcc

SEQ ID NO: 39858 - RNA, 22 nt, Homo sapiens
ugggcuagaugcuuugggguca

SEQ ID NO: 39859 - RNA, 22 nt, Homo sapiens
uuaauuguaucuauagauguca

SEQ ID NO: 39860 - RNA, 22 nt, Homo sapiens
uuagagcacugaucugcucuuu

SEQ ID NO: 39861 - RNA, 22 nt, Homo sapiens
uuauugcuuaugauuagguguu

SEQ ID NO: 39862 - RNA, 22 nt, Homo sapiens
uuguacaggaguguaagcuuca

SEQ ID NO: 39863 - RNA, 20 nt, Homo sapiens
uugugcauugggccauuggg

SEQ ID NO: 39864 - RNA, 22 nt, Homo sapiens
uuuguacacuguuggugguuau

SEQ ID NO: 39865 - RNA, 22 nt, Homo sapiens
uucuggcuaugggauacuaaau

SEQ ID NO: 39866 - RNA, 22 nt, Homo sapiens
uucuggcucgauucucugaccg

SEQ ID NO: 39867 - RNA, 22 nt, Homo sapiens
uugacauugcuguaguguccag

SEQ ID NO: 39868 - RNA, 22 nt, Homo sapiens
uugcuucauucaacauugaggg

SEQ ID NO: 39869 - RNA, 22 nt, Homo sapiens
uuggcuuuuaugcagcuuaggu

SEQ ID NO: 39870 - RNA, 22 nt, Homo sapiens
uuguacuuuuaguagagacggg

SEQ ID NO: 39871 - RNA, 22 nt, Homo sapiens
uuuauagucaggaacuugagga

SEQ ID NO: 39872 - RNA, 22 nt, Homo sapiens
uuuauucggcuaggagcuucgg

SEQ ID NO: 39873 - RNA, 22 nt, Homo sapiens
uuuguacacuguugguaggauu

SEQ ID NO: 39874 - RNA, 19 nt, Homo sapiens
ccacaaugguugaacuaga

SEQ ID NO: 39875 - RNA, 22 nt, Homo sapiens
cuaacacagagguuuauuucuc

SEQ ID NO: 39876 - RNA, 22 nt, Homo sapiens
cuagagagaagcugugugaccu

SEQ ID NO: 39877 - RNA, 22 nt, Homo sapiens
cuauggcucugguuauggcugu

SEQ ID NO: 39878 - RNA, 22 nt, Homo sapiens
cugacuaguuuuaaugcagauu

SEQ ID NO: 39879 - RNA, 22 nt, Homo sapiens
cugagcuagaccacuuggcucc

SEQ ID NO: 39880 - RNA, 22 nt, Homo sapiens
gccuuuggugacaggcaugugu

SEQ ID NO: 39881 - RNA, 22 nt, Homo sapiens
gcuguauugacuuuguaucaua

SEQ ID NO: 39882 - RNA, 22 nt, Homo sapiens
guaccacaguugcucacggguu

SEQ ID NO: 39883 - RNA, 22 nt, Homo sapiens
gucuggcuccugucuaaucacu

SEQ ID NO: 39884 - RNA, 22 nt, Homo sapiens
gucuggcuuaucucacuuacca

SEQ ID NO: 39885 - RNA, 22 nt, Homo sapiens
guuauuguccauuuauuuagca

SEQ ID NO: 39886 - RNA, 22 nt, Homo sapiens
uacaguaggauuuucagggucu

SEQ ID NO: 39887 - RNA, 22 nt, Homo sapiens
uacauguauguguuuauggcug

SEQ ID NO: 39888 - RNA, 22 nt, Homo sapiens
uaccacauuguagagggcauuc

SEQ ID NO: 39889 - RNA, 22 nt, Homo sapiens
uacucacauucuguuucuugcu

SEQ ID NO: 39890 - RNA, 22 nt, Homo sapiens
uaggagcacagcagcauguggg

SEQ ID NO: 39891 - RNA, 22 nt, Homo sapiens
uaggcagccagcuguggauuga

SEQ ID NO: 39892 - RNA, 22 nt, Homo sapiens
uagggaguguccuuucgggaaa

SEQ ID NO: 39893 - RNA, 22 nt, Homo sapiens
uauugcacgccagccugagcaa

SEQ ID NO: 39894 - RNA, 22 nt, Homo sapiens
uauugcuuaugaugcugaauua

SEQ ID NO: 39895 - RNA, 22 nt, Homo sapiens
uauugcuuuugauucaaggcag

SEQ ID NO: 39896 - RNA, 22 nt, Homo sapiens
uauuguccacuuugcacugugu

SEQ ID NO: 39897 - RNA, 22 nt, Homo sapiens
ucacauuguuauguaaauguuu

SEQ ID NO: 39898 - RNA, 22 nt, Homo sapiens
ucauuagagaucuuggggaaaa

SEQ ID NO: 39899 - RNA, 22 nt, Homo sapiens
ucuggcuuuagcaugugggaag

SEQ ID NO: 39900 - RNA, 23 nt, Homo sapiens
ucuuguacuuugagugagcaugg

SEQ ID NO: 39901 - RNA, 22 nt, Homo sapiens
ugacuaggaggcuggaggauga

SEQ ID NO: 39902 - RNA, 22 nt, Homo sapiens
ugcuuuguugaaaaucauuugg

SEQ ID NO: 39903 - RNA, 22 nt, Homo sapiens
uggacuagagggugggcgaggu

SEQ ID NO: 39904 - RNA, 19 nt, Homo sapiens
uggcuagaggccaggcguu

SEQ ID NO: 39905 - RNA, 18 nt, Homo sapiens
ugugacauugagcauguc

SEQ ID NO: 39906 - RNA, 22 nt, Homo sapiens
uuaagagcauggugccagguug

SEQ ID NO: 39907 - RNA, 22 nt, Homo sapiens
uuagggaggcucaggacaagag

SEQ ID NO: 39908 - RNA, 22 nt, Homo sapiens
uucuggcucaggucaacacuuc

SEQ ID NO: 39909 - RNA, 22 nt, Homo sapiens
uucuggcuuauaaacgugacuu

SEQ ID NO: 39910 - RNA, 22 nt, Homo sapiens
uugcacauggcaggugcucaau

SEQ ID NO: 39911 - RNA, 22 nt, Homo sapiens
uugcauuagugugguacauuug

SEQ ID NO: 39912 - RNA, 22 nt, Homo sapiens
uugcuacauugauugccucuuu

SEQ ID NO: 39913 - RNA, 22 nt, Homo sapiens
uuguagaucuucaguugcuaca

SEQ ID NO: 39914 - RNA, 22 nt, Homo sapiens
uuuauugcucuaaaguugccau

SEQ ID NO: 39915 - RNA, 22 nt, Homo sapiens
auugcuauuauuugaccauugu

SEQ ID NO: 39916 - RNA, 22 nt, Homo sapiens
auugcuucugauuuuaaaugag

SEQ ID NO: 39917 - RNA, 22 nt, Homo sapiens
auuguacuccagccuaggcaac

SEQ ID NO: 39918 - RNA, 22 nt, Homo sapiens
auuguacuccagccugggcagc

SEQ ID NO: 39919 - RNA, 22 nt, Homo sapiens
auuguacuccagccugggugac

SEQ ID NO: 39920 - RNA, 22 nt, Homo sapiens
auuguacugccccccuguugcu

SEQ ID NO: 39921 - RNA, 22 nt, Homo sapiens
auuguacuuaagccugggugaa

SEQ ID NO: 39922 - RNA, 22 nt, Homo sapiens
auugucacuuaaaagugcaugu

SEQ ID NO: 39923 - RNA, 22 nt, Homo sapiens
caaauugcuugucuguagugga

SEQ ID NO: 39924 - RNA, 22 nt, Homo sapiens
cacauugcaggaaaguucauua

SEQ ID NO: 39925 - RNA, 22 nt, Homo sapiens
cauugcauuuucuuuguaccuu

SEQ ID NO: 39926 - RNA, 22 nt, Homo sapiens
cauugcuaaaagucauauauaa

SEQ ID NO: 39927 - RNA, 22 nt, Homo sapiens
cauugguugaacagauuguguu

SEQ ID NO: 39928 - RNA, 22 nt, Homo sapiens
aaccacauggcucaguggacau

SEQ ID NO: 39929 - RNA, 23 nt, Homo sapiens
aauugcuuuugaggacuuaguug

SEQ ID NO: 39930 - RNA, 22 nt, Homo sapiens
acagugcuuggcacacaguaau

SEQ ID NO: 39931 - RNA, 22 nt, Homo sapiens
acauggcuuaugaauuuggaga

SEQ ID NO: 39932 - RNA, 22 nt, Homo sapiens
acauugcucuuaccaaguuugu

SEQ ID NO: 39933 - RNA, 22 nt, Homo sapiens
agagaccuguaaaguucaggca

SEQ ID NO: 39934 - RNA, 19 nt, Homo sapiens
agagacucauuguagcauu

SEQ ID NO: 39935 - RNA, 22 nt, Homo sapiens
auggcuagauuguaugguaguu

SEQ ID NO: 39936 - RNA, 22 nt, Homo sapiens
auggcuuuguguucagagcuga

SEQ ID NO: 39937 - RNA, 22 nt, Homo sapiens
augugcuugagggaaaucaguu

SEQ ID NO: 39938 - RNA, 20 nt, Homo sapiens
auuagagcuacauggcuaca

SEQ ID NO: 39939 - RNA, 22 nt, Homo sapiens
auugcacacagaaucaggguaa

SEQ ID NO: 39940 - RNA, 22 nt, Homo sapiens
auuguacuccagccugggcgac

SEQ ID NO: 39941 - RNA, 22 nt, Homo sapiens
auuguacuccagccugggcugc

SEQ ID NO: 39942 - RNA, 22 nt, Homo sapiens
cacauugaauuucugaugacaa

SEQ ID NO: 39943 - RNA, 19 nt, Homo sapiens
cauggcuuauaauuuuaau

SEQ ID NO: 39944 - RNA, 22 nt, Homo sapiens
cauugguuccaguuuguccuua

SEQ ID NO: 39945 - RNA, 23 nt, Homo sapiens
ccacaaugguugaacuagauuac

SEQ ID NO: 39946 - RNA, 22 nt, Homo sapiens
ccacaguugaaauuuugacugu

SEQ ID NO: 39947 - RNA, 22 nt, Homo sapiens
ccacauuggaaaggaucccccc

SEQ ID NO: 39948 - RNA, 22 nt, Homo sapiens
cuaagggaggaagcugugcagg

SEQ ID NO: 39949 - RNA, 22 nt, Homo sapiens
cugagcuaugccuggaaaggca

SEQ ID NO: 39950 - RNA, 22 nt, Homo sapiens
cuggcaagagugaaccagcugu

SEQ ID NO: 39951 - RNA, 22 nt, Homo sapiens
cuuguacacuguuggugggaau

SEQ ID NO: 39952 - RNA, 22 nt, Homo sapiens
gaccacauuccacacaggcuuu

SEQ ID NO: 39953 - RNA, 20 nt, Homo sapiens
gauuagagagaggcugugca

SEQ ID NO: 39954 - RNA, 22 nt, Homo sapiens
ggacuagggacauggggagcug

SEQ ID NO: 39955 - RNA, 22 nt, Homo sapiens
guaucauugccuaaugcucuca

SEQ ID NO: 39956 - RNA, 22 nt, Homo sapiens
guauuguacuacaagcucuuua

SEQ ID NO: 39957 - RNA, 22 nt, Homo sapiens
uacauugcacuuuauuagauac

SEQ ID NO: 39958 - RNA, 20 nt, Homo sapiens
uaggagcaaugagaguagaa

SEQ ID NO: 39959 - RNA, 18 nt, Homo sapiens
uauugcuugguuuggaga

SEQ ID NO: 39960 - RNA, 22 nt, Homo sapiens
uauugcuuuacucucuuauccu

SEQ ID NO: 39961 - RNA, 22 nt, Homo sapiens
uauuguacauguuauagauuuu

SEQ ID NO: 39962 - RNA, 22 nt, Homo sapiens
ucacauuguguagccugcucac

SEQ ID NO: 39963 - RNA, 22 nt, Homo sapiens
ucauuagagacagggugucacu

SEQ ID NO: 39964 - RNA, 22 nt, Homo sapiens
ucuggcaagagccgagggcagu

SEQ ID NO: 39965 - RNA, 22 nt, Homo sapiens
ucuggcuucugacuuaggggac

SEQ ID NO: 39966 - RNA, 22 nt, Homo sapiens
ugacauuacagucacuugcugu

SEQ ID NO: 39967 - RNA, 20 nt, Homo sapiens
ugucauuaagcacugugcca

SEQ ID NO: 39968 - RNA, 22 nt, Homo sapiens
uguccauuuuuaugcuuauggu

SEQ ID NO: 39969 - RNA, 22 nt, Homo sapiens
uguuauugagguuacuuauaag

SEQ ID NO: 39970 - RNA, 22 nt, Homo sapiens
uuagcagcaucccuggccugua

SEQ ID NO: 39971 - RNA, 22 nt, Homo sapiens
uuagcagcucuggugacaaggu

SEQ ID NO: 39972 - RNA, 22 nt, Homo sapiens
uuagggaguaaucuaaaaaugg

SEQ ID NO: 39973 - RNA, 22 nt, Homo sapiens
uuauauguuuguacuuaggccu

SEQ ID NO: 39974 - RNA, 22 nt, Homo sapiens
uucuggcuuuuaaagaaauguu

SEQ ID NO: 39975 - RNA, 22 nt, Homo sapiens
uugcacauuuuuucuggcagaa

SEQ ID NO: 39976 - RNA, 22 nt, Homo sapiens
uugugacacagcugggccuaua

SEQ ID NO: 39977 - RNA, 22 nt, Homo sapiens
uuuacugucuucagucccucug

SEQ ID NO: 39978 - RNA, 22 nt, Homo sapiens
uuuguacacgugggugaauugu

SEQ ID NO: 39979 - RNA, 22 nt, Homo sapiens
uuuuguacaacagcucugggga

SEQ ID NO: 39980 - RNA, 18 nt, Homo sapiens
aaagugaugucauucuuu

SEQ ID NO: 39981 - RNA, 19 nt, Homo sapiens
aagaugauguuugggcuaa

SEQ ID NO: 39982 - RNA, 20 nt, Homo sapiens
aagcauggguuuuaggguca

SEQ ID NO: 39983 - RNA, 22 nt, Homo sapiens
aagcaugguuuccaggggucac

SEQ ID NO: 39984 - RNA, 21 nt, Homo sapiens
aaucacaguuguucugccuuc

SEQ ID NO: 39985 - RNA, 22 nt, Homo sapiens
acagucauagcagccuuuguua

SEQ ID NO: 39986 - RNA, 22 nt, Homo sapiens
agagugcuuuauuagauguagc

SEQ ID NO: 39987 - RNA, 22 nt, Homo sapiens
agaugguguuuucucaccagau

SEQ ID NO: 39988 - RNA, 22 nt, Homo sapiens
agcuuguauuuguagccuguug

SEQ ID NO: 39989 - RNA, 22 nt, Homo sapiens
aggucccauguccucccugacc

SEQ ID NO: 39990 - RNA, 22 nt, Homo sapiens
auaauacugggaagaugagcau

SEQ ID NO: 39991 - RNA, 22 nt, Homo sapiens
aucaaauugucauuuuaaggau

SEQ ID NO: 39992 - RNA, 22 nt, Homo sapiens
aucccugagaacuuuuaauguu

SEQ ID NO: 39993 - RNA, 22 nt, Homo sapiens
aucccugagccugacucucaga

SEQ ID NO: 39994 - RNA, 22 nt, Homo sapiens
aucccugaggaauuucugcacu

SEQ ID NO: 39995 - RNA, 22 nt, Homo sapiens
auccuuuagacuguccaguuga

SEQ ID NO: 39996 - RNA, 22 nt, Homo sapiens
aucgcgccauuguacuccagcc

SEQ ID NO: 39997 - RNA, 22 nt, Homo sapiens
augauguccacagggguguuca

SEQ ID NO: 39998 - RNA, 22 nt, Homo sapiens
augauuguucucacucaagaga

SEQ ID NO: 39999 - RNA, 22 nt, Homo sapiens
auggucccuguuccaugcuccu

SEQ ID NO: 40000 - RNA, 22 nt, Homo sapiens
augugguaggcccaugagucau

SEQ ID NO: 40001 - RNA, 20 nt, Homo sapiens
auuagacuugccuuauccuu

SEQ ID NO: 40002 - RNA, 20 nt, Homo sapiens
auucaaguaugccuugagaa

SEQ ID NO: 40003 - RNA, 22 nt, Homo sapiens
uuacaccuguaauccagcacuu

SEQ ID NO: 40004 - RNA, 22 nt, Homo sapiens
uuacagucucaagagugcugca

SEQ ID NO: 40005 - RNA, 22 nt, Homo sapiens
uucaaaaccucugcuuaagccc

SEQ ID NO: 40006 - RNA, 22 nt, Homo sapiens
uucagcuacuugggaggcugaa

SEQ ID NO: 40007 - RNA, 22 nt, Homo sapiens
uucauaguguuuccuuccagug

SEQ ID NO: 40008 - RNA, 22 nt, Homo sapiens
uuccacaaugguugaacuaauu

SEQ ID NO: 40009 - RNA, 22 nt, Homo sapiens
uuccacaaugguugaacuagcu

SEQ ID NO: 40010 - RNA, 22 nt, Homo sapiens
uuccacaaugguugaacuaguu

SEQ ID NO: 40011 - RNA, 22 nt, Homo sapiens
uuccaguugugagcuauccggg

SEQ ID NO: 40012 - RNA, 22 nt, Homo sapiens
uucccugaaguguuacucuaga

SEQ ID NO: 40013 - RNA, 22 nt, Homo sapiens
uuccuacuguucaucaggaacc

SEQ ID NO: 40014 - RNA, 22 nt, Homo sapiens
uuccugucuuccaagagagauu

SEQ ID NO: 40015 - RNA, 22 nt, Homo sapiens
uucgucccuuuuggaauccucu

SEQ ID NO: 40016 - RNA, 22 nt, Homo sapiens
uucuggcuuuuaaagaaauguu

SEQ ID NO: 40017 - RNA, 22 nt, Homo sapiens
uucugguuaauacuugcaaaaa

SEQ ID NO: 40018 - RNA, 22 nt, Homo sapiens
uugagaaucuuucgaauguucu

SEQ ID NO: 40019 - RNA, 22 nt, Homo sapiens
uugaggaagugguuccccagag

SEQ ID NO: 40020 - RNA, 22 nt, Homo sapiens
uugaggcaaugaggagaagcug

SEQ ID NO: 40021 - RNA, 16 nt, Homo sapiens
uugaggcaugucucag

SEQ ID NO: 40022 - RNA, 21 nt, Homo sapiens
uugcaaaugcugcugccugau

SEQ ID NO: 40023 - RNA, 22 nt, Homo sapiens
uuggccauggagcacuuuucua

SEQ ID NO: 40024 - RNA, 22 nt, Homo sapiens
uuggucacugacauguuugaaa

SEQ ID NO: 40025 - RNA, 23 nt, Homo sapiens
uuggucucccaaaguguugagau

SEQ ID NO: 40026 - RNA, 22 nt, Homo sapiens
uugugcaaaguugugguuucug

SEQ ID NO: 40027 - RNA, 22 nt, Homo sapiens
uuuaaagcuaaaauauguuuau

SEQ ID NO: 40028 - RNA, 19 nt, Homo sapiens
uuucccugcagaccuacua

SEQ ID NO: 40029 - RNA, 22 nt, Homo sapiens
uuucugggggugcugauggaaa

SEQ ID NO: 40030 - RNA, 22 nt, Homo sapiens
uuugcuugaggucuagcuaccc

SEQ ID NO: 40031 - RNA, 22 nt, Homo sapiens
uuugggaaugaguuuaucauuu

SEQ ID NO: 40032 - RNA, 22 nt, Homo sapiens
uuugguccaguguucagguccu

SEQ ID NO: 40033 - RNA, 22 nt, Homo sapiens
uuugguccuccuacagggcagg

SEQ ID NO: 40034 - RNA, 18 nt, Homo sapiens
uuugguccuuuauaaaca

SEQ ID NO: 40035 - RNA, 22 nt, Homo sapiens
uuuuggcuuaaagagaauguau

SEQ ID NO: 40036 - RNA, 22 nt, Homo sapiens
uuuugguguacaauucuaugga

SEQ ID NO: 40037 - RNA, 22 nt, Homo sapiens
uuuuuugcuguaugcaaacauc

SEQ ID NO: 40038 - RNA, 23 nt, Homo sapiens
caucacagagccuuccuugacuc

SEQ ID NO: 40039 - RNA, 19 nt, Homo sapiens
caucacagagucuuccauu

SEQ ID NO: 40040 - RNA, 22 nt, Homo sapiens
cauggauuuuuuugaauggcag

SEQ ID NO: 40041 - RNA, 22 nt, Homo sapiens
cauugcacacauuuaccuaugu

SEQ ID NO: 40042 - RNA, 22 nt, Homo sapiens
cauugcccuccagccugggcaa

SEQ ID NO: 40043 - RNA, 22 nt, Homo sapiens
ccacagucuaugcaacaagguc

SEQ ID NO: 40044 - RNA, 22 nt, Homo sapiens
ccacaguugaaauuuugacugu

SEQ ID NO: 40045 - RNA, 22 nt, Homo sapiens
ccuucuuuuguaaggcugaaua

SEQ ID NO: 40046 - RNA, 22 nt, Homo sapiens
cuaugcuucuuaaauuaguuau

SEQ ID NO: 40047 - RNA, 22 nt, Homo sapiens
cucagcuacuugagaggcuuag

SEQ ID NO: 40048 - RNA, 22 nt, Homo sapiens
cucauuggcuacugaggcuugu

SEQ ID NO: 40049 - RNA, 22 nt, Homo sapiens
cucccugagccagggcuuugac

SEQ ID NO: 40050 - RNA, 22 nt, Homo sapiens
cugcaagaugcauaggaauuuu

SEQ ID NO: 40051 - RNA, 17 nt, Homo sapiens
cuucaaauaauuucccc

SEQ ID NO: 40052 - RNA, 22 nt, Homo sapiens
cuucuguuaguucugauaacuu

SEQ ID NO: 40053 - RNA, 22 nt, Homo sapiens
cuuguacacuguuggugggaau

SEQ ID NO: 40054 - RNA, 22 nt, Homo sapiens
gaaaugcucagggguuuuccag

SEQ ID NO: 40055 - RNA, 23 nt, Homo sapiens
gaaaugucuuagugaaauugcuu

SEQ ID NO: 40056 - RNA, 22 nt, Homo sapiens
gaggcauugaagauauggaagu

SEQ ID NO: 40057 - RNA, 22 nt, Homo sapiens
gaguuccuuugagccugagagg

SEQ ID NO: 40058 - RNA, 22 nt, Homo sapiens
gcaauggaaucccuugaucaau

SEQ ID NO: 40059 - RNA, 22 nt, Homo sapiens
gccaagaugcugcccacagaca

SEQ ID NO: 40060 - RNA, 22 nt, Homo sapiens
gccuagagaaguaaauauuauc

SEQ ID NO: 40061 - RNA, 22 nt, Homo sapiens
ggaauguuaaggcgcuguuggu

SEQ ID NO: 40062 - RNA, 22 nt, Homo sapiens
ggagagcuaggcagagguuugu

SEQ ID NO: 40063 - RNA, 22 nt, Homo sapiens
ggcacgguggcucacgccugua

SEQ ID NO: 40064 - RNA, 17 nt, Homo sapiens
ggcaggaauuaauguca

SEQ ID NO: 40065 - RNA, 22 nt, Homo sapiens
guaaauaccaguuucuggaaca

SEQ ID NO: 40066 - RNA, 22 nt, Homo sapiens
guaacguaaugucaaaaucuau

SEQ ID NO: 40067 - RNA, 22 nt, Homo sapiens
gucagugucuuugcagcucaga

SEQ ID NO: 40068 - RNA, 22 nt, Homo sapiens
gucaguuugguuaaucauucca

SEQ ID NO: 40069 - RNA, 22 nt, Homo sapiens
gucccugaggaacauccagggc

SEQ ID NO: 40070 - RNA, 22 nt, Homo sapiens
gugaaagcaucugacugugcca

SEQ ID NO: 40071 - RNA, 22 nt, Homo sapiens
gugaaugaaugggugaauacau

SEQ ID NO: 40072 - RNA, 22 nt, Homo sapiens
gugaggaaggaaaccugcuagc

SEQ ID NO: 40073 - RNA, 22 nt, Homo sapiens
gugaggcacugcugcuuuccag

SEQ ID NO: 40074 - RNA, 22 nt, Homo sapiens
guggaucacuugaggucaagag

SEQ ID NO: 40075 - RNA, 22 nt, Homo sapiens
guuccuuguagaugcuggauau

SEQ ID NO: 40076 - RNA, 22 nt, Homo sapiens
uaaggaaggcugugugcuuuua

SEQ ID NO: 40077 - RNA, 22 nt, Homo sapiens
uacaugugccauguugguuugc

SEQ ID NO: 40078 - RNA, 22 nt, Homo sapiens
uagaaguaggcuacgugucugg

SEQ ID NO: 40079 - RNA, 22 nt, Homo sapiens
uagcagcauuuuuguagaguau

SEQ ID NO: 40080 - RNA, 22 nt, Homo sapiens
uagucccauaugauuuagugaa

SEQ ID NO: 40081 - RNA, 22 nt, Homo sapiens
uauagcuaugggauguauuugc

SEQ ID NO: 40082 - RNA, 22 nt, Homo sapiens
uaucacaggucaggaaucuugc

SEQ ID NO: 40083 - RNA, 22 nt, Homo sapiens
uaucucauccuccuugauccca

SEQ ID NO: 40084 - RNA, 22 nt, Homo sapiens
uauugcuaaauucuuuuccuag

SEQ ID NO: 40085 - RNA, 22 nt, Homo sapiens
ucaacugcuugagaucacaaau

SEQ ID NO: 40086 - RNA, 23 nt, Homo sapiens
ucaagugaugguggccacaaggg

SEQ ID NO: 40087 - RNA, 22 nt, Homo sapiens
ucacaguucagcauggcugagg

SEQ ID NO: 40088 - RNA, 22 nt, Homo sapiens
ucaguuuguauuucagguugca

SEQ ID NO: 40089 - RNA, 22 nt, Homo sapiens
ucauaguagucacuuaauaaau

SEQ ID NO: 40090 - RNA, 22 nt, Homo sapiens
ucaucaggcucauucaagcuga

SEQ ID NO: 40091 - RNA, 19 nt, Homo sapiens
ucccuguagaccacagugc

SEQ ID NO: 40092 - RNA, 22 nt, Homo sapiens
uccuugagccucccagacucag

SEQ ID NO: 40093 - RNA, 22 nt, Homo sapiens
ucguucuugucaguuuauaaag

SEQ ID NO: 40094 - RNA, 22 nt, Homo sapiens
ucuaaguaguagcuggucagaa

SEQ ID NO: 40095 - RNA, 22 nt, Homo sapiens
ucucaguuuucuggggaagaaa

SEQ ID NO: 40096 - RNA, 22 nt, Homo sapiens
ucugugcugagaguugaaaguu

SEQ ID NO: 40097 - RNA, 22 nt, Homo sapiens
ucugugcuugucauaugcuuug

SEQ ID NO: 40098 - RNA, 22 nt, Homo sapiens
ucuguguuugaucaagauugua

SEQ ID NO: 40099 - RNA, 22 nt, Homo sapiens
ucuugcuuguuguucccuucau

SEQ ID NO: 40100 - RNA, 22 nt, Homo sapiens
ucuugcuuuugcagagcuucuc

SEQ ID NO: 40101 - RNA, 18 nt, Homo sapiens
ugaaacacauuuuuuccu

SEQ ID NO: 40102 - RNA, 22 nt, Homo sapiens
ugaaaugccuugagauuuugac

SEQ ID NO: 40103 - RNA, 22 nt, Homo sapiens
ugagaaugcagaaucucgugca

SEQ ID NO: 40104 - RNA, 22 nt, Homo sapiens
ugaggcaaggcugaaugaaggc

SEQ ID NO: 40105 - RNA, 22 nt, Homo sapiens
ugagguaggugaagaaugcacg

SEQ ID NO: 40106 - RNA, 22 nt, Homo sapiens
ugaucacagcuugacuaaagga

SEQ ID NO: 40107 - RNA, 22 nt, Homo sapiens
ugcagcacugaacuucugggcu

SEQ ID NO: 40108 - RNA, 22 nt, Homo sapiens
ugcuauagcuauaucaucuccu

SEQ ID NO: 40109 - RNA, 21 nt, Homo sapiens
uggcuuauuugaaucuggcuu

SEQ ID NO: 40110 - RNA, 22 nt, Homo sapiens
ugguccccaauacuucuauaga

SEQ ID NO: 40111 - RNA, 22 nt, Homo sapiens
uuggccccuccaaaucucaugu

SEQ ID NO: 40112 - RNA, 21 nt, Homo sapiens
uugguccacaugucauaguua

SEQ ID NO: 40113 - RNA, 22 nt, Homo sapiens
uugguccccuucaaccagcugu

SEQ ID NO: 40114 - RNA, 19 nt, Homo sapiens
uuggucccuuuggguucuu

SEQ ID NO: 40115 - RNA, 22 nt, Homo sapiens
uuuauucggcuaggagcuucgg

SEQ ID NO: 40116 - RNA, 22 nt, Homo sapiens
uuuauugcucuaaaguugccau

SEQ ID NO: 40117 - RNA, 22 nt, Homo sapiens
uuugcuuaguaaauguagaaaa

SEQ ID NO: 40118 - RNA, 23 nt, Homo sapiens
uuuggcauuccagaaauuuucau

SEQ ID NO: 40119 - RNA, 22 nt, Homo sapiens
uuuggucccaaugugauaaggu

SEQ ID NO: 40120 - RNA, 22 nt, Homo sapiens
uuuguacuaugguuuuucacua

SEQ ID NO: 40121 - RNA, 22 nt, Homo sapiens
uuuguacuucauugguucuacu

SEQ ID NO: 40122 - RNA, 22 nt, Homo sapiens
uggaagacauuuuggaccuugg

SEQ ID NO: 40123 - RNA, 22 nt, Homo sapiens
uggccagugucggaggccagga

SEQ ID NO: 40124 - RNA, 22 nt, Homo sapiens
uggcuuuuaucuacucucaacu

SEQ ID NO: 40125 - RNA, 22 nt, Homo sapiens
ugggaaacauccagcacauacu

SEQ ID NO: 40126 - RNA, 22 nt, Homo sapiens
uggguccccuacucuuuccaca

SEQ ID NO: 40127 - RNA, 20 nt, Homo sapiens
ugguccccugagucuggcuu

SEQ ID NO: 40128 - RNA, 23 nt, Homo sapiens
uggucccguguucuggcuuuagg

SEQ ID NO: 40129 - RNA, 22 nt, Homo sapiens
uggugcccuguccuucuguggc

SEQ ID NO: 40130 - RNA, 22 nt, Homo sapiens
ugguuccauauuaauuuuagga

SEQ ID NO: 40131 - RNA, 22 nt, Homo sapiens
ugucaagaugguuugauguugu

SEQ ID NO: 40132 - RNA, 22 nt, Homo sapiens
uguggaaauaaaagaaagguua

SEQ ID NO: 40133 - RNA, 22 nt, Homo sapiens
uucccugaaauauucacuuuca

SEQ ID NO: 40134 - RNA, 22 nt, Homo sapiens
uuccuugguucagggaaggucc

SEQ ID NO: 40135 - RNA, 22 nt, Homo sapiens
uucuugguguaguaguugaaaa

SEQ ID NO: 40136 - RNA, 22 nt, Homo sapiens
uugaaugaauggaaagaagggu

SEQ ID NO: 40137 - RNA, 22 nt, Homo sapiens
uugaggaaugugauuucaaaua

SEQ ID NO: 40138 - RNA, 22 nt, Homo sapiens
uugagguaguacuuauuauugg

SEQ ID NO: 40139 - RNA, 22 nt, Homo sapiens
uugaguccauucgaugcugauu

SEQ ID NO: 40140 - RNA, 22 nt, Homo sapiens
uugcaccuugaagccaauagca

SEQ ID NO: 40141 - RNA, 22 nt, Homo sapiens
uugcuagaugaaaaugguaccu

SEQ ID NO: 40142 - RNA, 22 nt, Homo sapiens
uuggaacacauguuuuucuacc

SEQ ID NO: 40143 - RNA, 22 nt, Homo sapiens
uuggguccucugguccuugguu

SEQ ID NO: 40144 - RNA, 22 nt, Homo sapiens
uugguuccuuagccuaggacua

SEQ ID NO: 40145 - RNA, 22 nt, Homo sapiens
uuguucccuucuggcuuuuaug

SEQ ID NO: 40146 - RNA, 23 nt, Homo sapiens
uuuaagcuucauguccuaacauc

SEQ ID NO: 40147 - RNA, 22 nt, Homo sapiens
uuugauguccaccucagcccac

SEQ ID NO: 40148 - RNA, 22 nt, Homo sapiens
uuugauguugagacuauaaagc

SEQ ID NO: 40149 - RNA, 22 nt, Homo sapiens
uuuggcaugggcuauuugcuuu

SEQ ID NO: 40150 - RNA, 18 nt, Homo sapiens
uuuguacuuuuucuaaug

SEQ ID NO: 40151 - RNA, 22 nt, Homo sapiens
uuuuccagugggacucccauua

SEQ ID NO: 40152 - RNA, 22 nt, Homo sapiens
uuuugcaguuacagagagugag

SEQ ID NO: 40153 - RNA, 22 nt, Homo sapiens
uuuuugauuaauggguagacca

SEQ ID NO: 40154 - RNA, 22 nt, Homo sapiens
aaucacaguguucuugugaggg

SEQ ID NO: 40155 - RNA, 22 nt, Homo sapiens
aaucacaguuaguaagggagaa

SEQ ID NO: 40156 - RNA, 22 nt, Homo sapiens
aaugauauguuauguuuagguu

SEQ ID NO: 40157 - RNA, 22 nt, Homo sapiens
aaugugcuuucuuucacacagu

SEQ ID NO: 40158 - RNA, 22 nt, Homo sapiens
acaacaguuuuaucaccccaga

SEQ ID NO: 40159 - RNA, 22 nt, Homo sapiens
acagcagugccccacucuacug

SEQ ID NO: 40160 - RNA, 22 nt, Homo sapiens
acaggagugggauuugaguccu

SEQ ID NO: 40161 - RNA, 22 nt, Homo sapiens
acaugcauauguuggaagaaag

SEQ ID NO: 40162 - RNA, 22 nt, Homo sapiens
agagauacauucugagaagugc

SEQ ID NO: 40163 - RNA, 22 nt, Homo sapiens
agcuuguuuuauagaaagucaa

SEQ ID NO: 40164 - RNA, 22 nt, Homo sapiens
aggccaguuuuuggagggaaac

SEQ ID NO: 40165 - RNA, 22 nt, Homo sapiens
auagguauuuuuaaaugacugu

SEQ ID NO: 40166 - RNA, 21 nt, Homo sapiens
auagugcuagagaguagcagg

SEQ ID NO: 40167 - RNA, 22 nt, Homo sapiens
auagugcugcaauaaacacacg

SEQ ID NO: 40168 - RNA, 22 nt, Homo sapiens
auauuacagagaggaccuggga

SEQ ID NO: 40169 - RNA, 22 nt, Homo sapiens
augagaauguaaguuaaugaaa

SEQ ID NO: 40170 - RNA, 22 nt, Homo sapiens
augaggcaggaaaggcguaucu

SEQ ID NO: 40171 - RNA, 22 nt, Homo sapiens
auggcggugugaucuuggcuca

SEQ ID NO: 40172 - RNA, 22 nt, Homo sapiens
auuaaggaguggguucauggug

SEQ ID NO: 40173 - RNA, 22 nt, Homo sapiens
auugcuucugauuuuaaaugag

SEQ ID NO: 40174 - RNA, 22 nt, Homo sapiens
auuggaguuguacgcacgcuca

SEQ ID NO: 40175 - RNA, 21 nt, Homo sapiens
auuugguguuagaaauaaauu

SEQ ID NO: 40176 - RNA, 22 nt, Homo sapiens
cacaguugccuaucuccugaag

SEQ ID NO: 40177 - RNA, 22 nt, Homo sapiens
cagcaaaucauccuauuugagc

SEQ ID NO: 40178 - RNA, 22 nt, Homo sapiens
cagguacuucugggcugagcag

SEQ ID NO: 40179 - RNA, 22 nt, Homo sapiens
caugucacuuccucucugaugg

SEQ ID NO: 40180 - RNA, 20 nt, Homo sapiens
cauugcccuccagccugggc

SEQ ID NO: 40181 - RNA, 22 nt, Homo sapiens
cauuuuacuuuccagacgugga

SEQ ID NO: 40182 - RNA, 22 nt, Homo sapiens
ccauuucacucuuccugaagga

SEQ ID NO: 40183 - RNA, 17 nt, Homo sapiens
ccccugagcgaugcagu

SEQ ID NO: 40184 - RNA, 22 nt, Homo sapiens
cgccgggggaugggcaccagcg

SEQ ID NO: 40185 - RNA, 22 nt, Homo sapiens
cuggagcaaaggugacucuugu

SEQ ID NO: 40186 - RNA, 22 nt, Homo sapiens
cuguugguuaaauuccaugcag

SEQ ID NO: 40187 - RNA, 19 nt, Homo sapiens
cuugccccauucauccucu

SEQ ID NO: 40188 - RNA, 18 nt, Homo sapiens
cuugucaaaucuuuccuc

SEQ ID NO: 40189 - RNA, 22 nt, Homo sapiens
gagaaguaaauuuauuugcaaa

SEQ ID NO: 40190 - RNA, 22 nt, Homo sapiens
gaggacauuaugcuaaguggaa

SEQ ID NO: 40191 - RNA, 22 nt, Homo sapiens
gauacaccauuuucuagcuauu

SEQ ID NO: 40192 - RNA, 22 nt, Homo sapiens
gcaguagugugaucuuggcuca

SEQ ID NO: 40193 - RNA, 22 nt, Homo sapiens
gcauggauguugauggcugcug

SEQ ID NO: 40194 - RNA, 22 nt, Homo sapiens
gccccugagacuugccucgggc

SEQ ID NO: 40195 - RNA, 22 nt, Homo sapiens
gcccugagauucuuggauucug

SEQ ID NO: 40196 - RNA, 22 nt, Homo sapiens
gcugucaugagcaacacaugaa

SEQ ID NO: 40197 - RNA, 21 nt, Homo sapiens
gcuuuuucggaagucuuuggc

SEQ ID NO: 40198 - RNA, 22 nt, Homo sapiens
ggagaauguaauugguauuuug

SEQ ID NO: 40199 - RNA, 22 nt, Homo sapiens
ggcacgguggcucacaccugua

SEQ ID NO: 40200 - RNA, 22 nt, Homo sapiens
ggcauugaguggguaggaguca

SEQ ID NO: 40201 - RNA, 22 nt, Homo sapiens
ggcuauagauaugugaacacuu

SEQ ID NO: 40202 - RNA, 22 nt, Homo sapiens
ggcucaguuuccuccgucugcu

SEQ ID NO: 40203 - RNA, 22 nt, Homo sapiens
ggucacauuggacuaucaaguu

SEQ ID NO: 40204 - RNA, 22 nt, Homo sapiens
guaacacaugcugcucucuggu

SEQ ID NO: 40205 - RNA, 22 nt, Homo sapiens
guacccuauggauauagaugaa

SEQ ID NO: 40206 - RNA, 22 nt, Homo sapiens
gucaguuucacucagcuggaac

SEQ ID NO: 40207 - RNA, 22 nt, Homo sapiens
gugaacagcagaugagugagug

SEQ ID NO: 40208 - RNA, 22 nt, Homo sapiens
gugaguaaagguucauugaauu

SEQ ID NO: 40209 - RNA, 22 nt, Homo sapiens
uaacaccuuugauagcacuuuu

SEQ ID NO: 40210 - RNA, 19 nt, Homo sapiens
uacccuaguauauacagaa

SEQ ID NO: 40211 - RNA, 22 nt, Homo sapiens
uagcagaauaacuugccagccu

SEQ ID NO: 40212 - RNA, 22 nt, Homo sapiens
uagcagcauaaauggacuaaga

SEQ ID NO: 40213 - RNA, 18 nt, Homo sapiens
uagcucuuguugguccau

SEQ ID NO: 40214 - RNA, 21 nt, Homo sapiens
uaggccgggugcaggaugcuu

SEQ ID NO: 40215 - RNA, 22 nt, Homo sapiens
uaggucuccuuuuugccuaaau

SEQ ID NO: 40216 - RNA, 22 nt, Homo sapiens
uagugaaugucacuggcuguug

SEQ ID NO: 40217 - RNA, 22 nt, Homo sapiens
uagugcugagauugagaagccc

SEQ ID NO: 40218 - RNA, 22 nt, Homo sapiens
uaucacaggucaggaaccuugu

SEQ ID NO: 40219 - RNA, 22 nt, Homo sapiens
uaucacagguggacugcacacc

SEQ ID NO: 40220 - RNA, 22 nt, Homo sapiens
uaucucagagaaucagauuuac

SEQ ID NO: 40221 - RNA, 22 nt, Homo sapiens
uauuugguuauaugaguaaguu

SEQ ID NO: 40222 - RNA, 22 nt, Homo sapiens
ucaacauugcugucaggcaucu

SEQ ID NO: 40223 - RNA, 22 nt, Homo sapiens
ucacagucaaaguaaucauaga

SEQ ID NO: 40224 - RNA, 22 nt, Homo sapiens
ucacagucacugucacguugaa

SEQ ID NO: 40225 - RNA, 22 nt, Homo sapiens
ucacagucuccucuagggaggg

SEQ ID NO: 40226 - RNA, 22 nt, Homo sapiens
ucacaguugauugaaacacagc

SEQ ID NO: 40227 - RNA, 22 nt, Homo sapiens
ucacugcacuccagccuuuaug

SEQ ID NO: 40228 - RNA, 22 nt, Homo sapiens
ucacugcacucuccgccuugcg

SEQ ID NO: 40229 - RNA, 22 nt, Homo sapiens
ucaucagguaugucagcggagu

SEQ ID NO: 40230 - RNA, 22 nt, Homo sapiens
uccacagugguugaacuaguaa

SEQ ID NO: 40231 - RNA, 22 nt, Homo sapiens
ucccugagguccuggauuauug

SEQ ID NO: 40232 - RNA, 19 nt, Homo sapiens
ucccugagucuuagcuuga

SEQ ID NO: 40233 - RNA, 22 nt, Homo sapiens
uccuuggucaaaaagaaagugu

SEQ ID NO: 40234 - RNA, 21 nt, Homo sapiens
ucucucaaccaggaagugggc

SEQ ID NO: 40235 - RNA, 22 nt, Homo sapiens
ggguaggcaagcggaugucaga

SEQ ID NO: 40236 - RNA, 22 nt, Homo sapiens
gucugguuggaguaguuuucag

SEQ ID NO: 40237 - RNA, 22 nt, Homo sapiens
gucugguuuuuuauauccucac

SEQ ID NO: 40238 - RNA, 22 nt, Homo sapiens
gugggagugucccguuuuucca

SEQ ID NO: 40239 - RNA, 22 nt, Homo sapiens
guugcuuauuccuguaauccca

SEQ ID NO: 40240 - RNA, 22 nt, Homo sapiens
uaacuaaagagaagucaauguc

SEQ ID NO: 40241 - RNA, 22 nt, Homo sapiens
uacucaauugcagucaccuggc

SEQ ID NO: 40242 - RNA, 22 nt, Homo sapiens
uagcacaucccuaaaaugcugu

SEQ ID NO: 40243 - RNA, 20 nt, Homo sapiens
uagcagcagacagagggagg

SEQ ID NO: 40244 - RNA, 22 nt, Homo sapiens
uaucacagaggguauccuagag

SEQ ID NO: 40245 - RNA, 22 nt, Homo sapiens
uaucaccauguccguuuuaaaa

SEQ ID NO: 40246 - RNA, 22 nt, Homo sapiens
uaucuacauguagguauguaug

SEQ ID NO: 40247 - RNA, 22 nt, Homo sapiens
uaugaaacucuaagauucacau

SEQ ID NO: 40248 - RNA, 22 nt, Homo sapiens
uaugaaagcuacuucucacaau

SEQ ID NO: 40249 - RNA, 21 nt, Homo sapiens
uaugguuucuaauucugcagg

SEQ ID NO: 40250 - RNA, 22 nt, Homo sapiens
uauuacacuuuagugucuucca

SEQ ID NO: 40251 - RNA, 22 nt, Homo sapiens
uauuugcacucccaucauggug

SEQ ID NO: 40252 - RNA, 22 nt, Homo sapiens
ucaagugauucuugugccuuag

SEQ ID NO: 40253 - RNA, 22 nt, Homo sapiens
ucacagucugcgugaugagaca

SEQ ID NO: 40254 - RNA, 22 nt, Homo sapiens
ucacugaaaccuccaccucucg

SEQ ID NO: 40255 - RNA, 22 nt, Homo sapiens
ucacugagcacaggagaugugc

SEQ ID NO: 40256 - RNA, 22 nt, Homo sapiens
ucagcaaugaccuaagcaaaua

SEQ ID NO: 40257 - RNA, 22 nt, Homo sapiens
ucaucaggaaacuuaugcagug

SEQ ID NO: 40258 - RNA, 22 nt, Homo sapiens
uccacagugguugaacuaguuu

SEQ ID NO: 40259 - RNA, 18 nt, Homo sapiens
ucccugacucaaauucuu

SEQ ID NO: 40260 - RNA, 22 nt, Homo sapiens
ucccugagcaaaguuuucugua

SEQ ID NO: 40261 - RNA, 22 nt, Homo sapiens
ucccugaguaucuaauguguuu

SEQ ID NO: 40262 - RNA, 22 nt, Homo sapiens
ucccugagugauugaaaauaaa

SEQ ID NO: 40263 - RNA, 22 nt, Homo sapiens
uccuuggugacauuucuugucu

SEQ ID NO: 40264 - RNA, 22 nt, Homo sapiens
uccuugguugauccugugcaga

SEQ ID NO: 40265 - RNA, 22 nt, Homo sapiens
ucuguguugaugcucauuaauu

SEQ ID NO: 40266 - RNA, 22 nt, Homo sapiens
ucuuggcaaagaauuuuuggcu

SEQ ID NO: 40267 - RNA, 22 nt, Homo sapiens
ucuuuggguagauauguagcug

SEQ ID NO: 40268 - RNA, 22 nt, Homo sapiens
ucuuuugggccucuugucagac

SEQ ID NO: 40269 - RNA, 22 nt, Homo sapiens
ugaaaugcagaacuuuaggucu

SEQ ID NO: 40270 - RNA, 22 nt, Homo sapiens
ugaaaugccuuuaaugaauuua

SEQ ID NO: 40271 - RNA, 21 nt, Homo sapiens
ugaaugcuuuaaauauuagaa

SEQ ID NO: 40272 - RNA, 22 nt, Homo sapiens
ugacucuagagcugccuguggc

SEQ ID NO: 40273 - RNA, 22 nt, Homo sapiens
ugagaaugaugauugguaaacc

SEQ ID NO: 40274 - RNA, 22 nt, Homo sapiens
ugagaauguagggcucucccag

SEQ ID NO: 40275 - RNA, 19 nt, Homo sapiens
ugagaauguuaccaggucc

SEQ ID NO: 40276 - RNA, 22 nt, Homo sapiens
ugagacaucucuccugagacag

SEQ ID NO: 40277 - RNA, 22 nt, Homo sapiens
ugagcucaugcauucuugagga

SEQ ID NO: 40278 - RNA, 22 nt, Homo sapiens
ugaguagucagugggcaggaag

SEQ ID NO: 40279 - RNA, 22 nt, Homo sapiens
ugagucaugcuggagucauggc

SEQ ID NO: 40280 - RNA, 22 nt, Homo sapiens
ugaugucuugagauggagcuua

SEQ ID NO: 40281 - RNA, 21 nt, Homo sapiens
ugcauggagaacacugagggu

SEQ ID NO: 40282 - RNA, 22 nt, Homo sapiens
ugcccguaauuccagcacuuug

SEQ ID NO: 40283 - RNA, 22 nt, Homo sapiens
ugccuaggcuggaaugcaaugg

SEQ ID NO: 40284 - RNA, 22 nt, Homo sapiens
uggaauuuagguugauaguaua

SEQ ID NO: 40285 - RNA, 22 nt, Homo sapiens
uggaguuugacaugccuuuggg

SEQ ID NO: 40286 - RNA, 22 nt, Homo sapiens
uggcucauuucuaaacccagcu

SEQ ID NO: 40287 - RNA, 22 nt, Homo sapiens
ugguaaaaugucauuuaccaga

SEQ ID NO: 40288 - RNA, 22 nt, Homo sapiens
uguacaaaacaagaugggggua

SEQ ID NO: 40289 - RNA, 22 nt, Homo sapiens
uguccuagagggaugucacccc

SEQ ID NO: 40290 - RNA, 22 nt, Homo sapiens
ugucuuuguuaguuguccuagu

SEQ ID NO: 40291 - RNA, 22 nt, Homo sapiens
uguggaaauuguuguauuuaau

SEQ ID NO: 40292 - RNA, 22 nt, Homo sapiens
uguggcauuuucagaaaggaug

SEQ ID NO: 40293 - RNA, 22 nt, Homo sapiens
uguuacacugugcacuaaauuu

SEQ ID NO: 40294 - RNA, 22 nt, Homo sapiens
uuaggcuuuauugaaaacaaua

SEQ ID NO: 40295 - RNA, 22 nt, Homo sapiens
uuaggcuuuuuaaccaguuguu

SEQ ID NO: 40296 - RNA, 22 nt, Homo sapiens
uuagugaaugcaccacuucuga

SEQ ID NO: 40297 - RNA, 22 nt, Homo sapiens
uucagagugguaugaagugaug

SEQ ID NO: 40298 - RNA, 22 nt, Homo sapiens
uuccacaauggcugaacuaguu

SEQ ID NO: 40299 - RNA, 22 nt, Homo sapiens
uucuaaacaucuuacaaugcau

SEQ ID NO: 40300 - RNA, 22 nt, Homo sapiens
uucuucugguuaugaaauuuga

SEQ ID NO: 40301 - RNA, 18 nt, Homo sapiens
uucuuguguugauauuuu

SEQ ID NO: 40302 - RNA, 22 nt, Homo sapiens
uugaaugaaaugaugucauuug

SEQ ID NO: 40303 - RNA, 22 nt, Homo sapiens
uugaaugaaauuggugugggga

SEQ ID NO: 40304 - RNA, 22 nt, Homo sapiens
uugaggaaugucauuuguguuu

SEQ ID NO: 40305 - RNA, 23 nt, Homo sapiens
uugaggcauguaccaucaauauc

SEQ ID NO: 40306 - RNA, 22 nt, Homo sapiens
uugaggccugauaacacacuga

SEQ ID NO: 40307 - RNA, 22 nt, Homo sapiens
uugauguccaucucuagguaaa

SEQ ID NO: 40308 - RNA, 22 nt, Homo sapiens
uugcaaugugaugugauuugga

SEQ ID NO: 40309 - RNA, 22 nt, Homo sapiens
uugccacuucucuugccccauu

SEQ ID NO: 40310 - RNA, 22 nt, Homo sapiens
uuggaaacgucaccuuuuccuu

SEQ ID NO: 40311 - RNA, 22 nt, Homo sapiens
uuggcuuaguugaccacagucu

SEQ ID NO: 40312 - RNA, 22 nt, Homo sapiens
uugguccccacuccccugccaa

SEQ ID NO: 40313 - RNA, 22 nt, Homo sapiens
uguauaacucacauugaaguuu

SEQ ID NO: 40314 - RNA, 22 nt, Homo sapiens
uguauguugggucaaaguacau

SEQ ID NO: 40315 - RNA, 22 nt, Homo sapiens
ugucagaaucuagaggcugcua

SEQ ID NO: 40316 - RNA, 22 nt, Homo sapiens
ugucccugagccuggauuccug

SEQ ID NO: 40317 - RNA, 20 nt, Homo sapiens
ugugaacuguagauagucuu

SEQ ID NO: 40318 - RNA, 22 nt, Homo sapiens
ugugguagugcuuaccugcagu

SEQ ID NO: 40319 - RNA, 22 nt, Homo sapiens
ugugguccucugaaggcuuuuc

SEQ ID NO: 40320 - RNA, 22 nt, Homo sapiens
aagcuacuuuggugguuccuua

SEQ ID NO: 40321 - RNA, 22 nt, Homo sapiens
acaaaguauggaauguuggugu

SEQ ID NO: 40322 - RNA, 19 nt, Homo sapiens
acagauagaauguucuaca

SEQ ID NO: 40323 - RNA, 23 nt, Homo sapiens
accccuacaggcuuguguccugc

SEQ ID NO: 40324 - RNA, 17 nt, Homo sapiens
accccuaccucagaagc

SEQ ID NO: 40325 - RNA, 22 nt, Homo sapiens
agcucuuguuaguauuagcagu

SEQ ID NO: 40326 - RNA, 22 nt, Homo sapiens
aggaauuuaauguaugauaaua

SEQ ID NO: 40327 - RNA, 21 nt, Homo sapiens
aggcaagguguuauuauugaa

SEQ ID NO: 40328 - RNA, 22 nt, Homo sapiens
aggcuuauuaagauucccuuau

SEQ ID NO: 40329 - RNA, 22 nt, Homo sapiens
aguaagauggcaacucuccaca

SEQ ID NO: 40330 - RNA, 19 nt, Homo sapiens
agugucauggucauuauuu

SEQ ID NO: 40331 - RNA, 22 nt, Homo sapiens
auagcucuugcuuacccacugu

SEQ ID NO: 40332 - RNA, 22 nt, Homo sapiens
auagguauguaauacaaaugaa

SEQ ID NO: 40333 - RNA, 22 nt, Homo sapiens
auaucacaggaaaggaagauac

SEQ ID NO: 40334 - RNA, 22 nt, Homo sapiens
aucacuuugcucuccagugugg

SEQ ID NO: 40335 - RNA, 22 nt, Homo sapiens
aucccuuucugauacuuucccu

SEQ ID NO: 40336 - RNA, 22 nt, Homo sapiens
aucuacuugcugggucucugga

SEQ ID NO: 40337 - RNA, 23 nt, Homo sapiens
augaaagcccuugcaaaugcugg

SEQ ID NO: 40338 - RNA, 22 nt, Homo sapiens
augacagagauaugugaauuuu

SEQ ID NO: 40339 - RNA, 22 nt, Homo sapiens
augacugucagggcagucauug

SEQ ID NO: 40340 - RNA, 22 nt, Homo sapiens
augaggaagucaggcccagggg

SEQ ID NO: 40341 - RNA, 22 nt, Homo sapiens
augaggcacugcgcccuacuga

SEQ ID NO: 40342 - RNA, 22 nt, Homo sapiens
augauacuggcuucauagaaug

SEQ ID NO: 40343 - RNA, 22 nt, Homo sapiens
auggucccauucauucacguau

SEQ ID NO: 40344 - RNA, 22 nt, Homo sapiens
auugaacuuuugucacugacau

SEQ ID NO: 40345 - RNA, 22 nt, Homo sapiens
auuguacugccccccuguugcu

SEQ ID NO: 40346 - RNA, 22 nt, Homo sapiens
caacagucagcccauccacaga

SEQ ID NO: 40347 - RNA, 22 nt, Homo sapiens
caagagagcugaugguuuuaaa

SEQ ID NO: 40348 - RNA, 22 nt, Homo sapiens
cacaaaguagauuagucuucca

SEQ ID NO: 40349 - RNA, 21 nt, Homo sapiens
cacugcacuugccuucugggu

SEQ ID NO: 40350 - RNA, 22 nt, Homo sapiens
cacuuugguucaccugaguuuc

SEQ ID NO: 40351 - RNA, 22 nt, Homo sapiens
cagauacuggccuggagcugug

SEQ ID NO: 40352 - RNA, 22 nt, Homo sapiens
ccuuuguuuaguugaauuguau

SEQ ID NO: 40353 - RNA, 22 nt, Homo sapiens
cuagccuggagugcaguggugc

SEQ ID NO: 40354 - RNA, 22 nt, Homo sapiens
cucaaguagugguuuucauuga

SEQ ID NO: 40355 - RNA, 21 nt, Homo sapiens
cucauauugcuuuuccauggu

SEQ ID NO: 40356 - RNA, 23 nt, Homo sapiens
cucccugaacaugacacaccaga

SEQ ID NO: 40357 - RNA, 20 nt, Homo sapiens
cucccugacaaauguggaaa

SEQ ID NO: 40358 - RNA, 22 nt, Homo sapiens
cugaggaaguucuuuaacaguu

SEQ ID NO: 40359 - RNA, 22 nt, Homo sapiens
cugcaagaaucguaguauuuga

SEQ ID NO: 40360 - RNA, 22 nt, Homo sapiens
cuucucagugcucaucuuauuu

SEQ ID NO: 40361 - RNA, 22 nt, Homo sapiens
gaaugaauguuuauccuuagau

SEQ ID NO: 40362 - RNA, 20 nt, Homo sapiens
gagaccugagauucacucaa

SEQ ID NO: 40363 - RNA, 22 nt, Homo sapiens
gagcuuguagugugaaugguau

SEQ ID NO: 40364 - RNA, 22 nt, Homo sapiens
gagucagugucuugcucuguca

SEQ ID NO: 40365 - RNA, 22 nt, Homo sapiens
gauuuguuggccugugagcuag

SEQ ID NO: 40366 - RNA, 22 nt, Homo sapiens
gcaaaaaguagugcugguuagg

SEQ ID NO: 40367 - RNA, 22 nt, Homo sapiens
gcacaguuaaagggucauguga

SEQ ID NO: 40368 - RNA, 22 nt, Homo sapiens
gcaugaugaauaauaucacaag

SEQ ID NO: 40369 - RNA, 22 nt, Homo sapiens
gccaagauuuaauucaucaguu

SEQ ID NO: 40370 - RNA, 22 nt, Homo sapiens
gcucaaguaauggcaguuuugc

SEQ ID NO: 40371 - RNA, 22 nt, Homo sapiens
gcuguaguugaggauuuuaaga

SEQ ID NO: 40372 - RNA, 22 nt, Homo sapiens
ggcacaaugucagcucacugca

SEQ ID NO: 40373 - RNA, 22 nt, Homo sapiens
ggccagaugaucuaugaaggaa

SEQ ID NO: 40374 - RNA, 22 nt, Homo sapiens
aaagagaucuaugggcacuaug

SEQ ID NO: 40375 - RNA, 22 nt, Homo sapiens
aaagugauguccaggcuuucag

SEQ ID NO: 40376 - RNA, 22 nt, Homo sapiens
aaccuuuagucagcucuuagga

SEQ ID NO: 40377 - RNA, 22 nt, Homo sapiens
aagaugcagaagcccagauguu

SEQ ID NO: 40378 - RNA, 20 nt, Homo sapiens
aagcaagcauuugcaaucau

SEQ ID NO: 40379 - RNA, 22 nt, Homo sapiens
aagcacaauuucaccuucuugu

SEQ ID NO: 40380 - RNA, 21 nt, Homo sapiens
aagcaugguguaucuuuccau

SEQ ID NO: 40381 - RNA, 22 nt, Homo sapiens
aauagugcugugcagugagugg

SEQ ID NO: 40382 - RNA, 22 nt, Homo sapiens
aagcaucauuuggaauuugaga

SEQ ID NO: 40383 - RNA, 22 nt, Homo sapiens
aaggaauucaaauuuucucugg

SEQ ID NO: 40384 - RNA, 20 nt, Homo sapiens
aaggcuuucgaguuccaggg

SEQ ID NO: 40385 - RNA, 22 nt, Homo sapiens
aaucacauugaaucugcuaccu

SEQ ID NO: 40386 - RNA, 22 nt, Homo sapiens
aaucugauguuaucagcuuaag

SEQ ID NO: 40387 - RNA, 19 nt, Homo sapiens
aauggcuuuuccuguuccc

SEQ ID NO: 40388 - RNA, 21 nt, Homo sapiens
uggucccuucagaucggauuu

SEQ ID NO: 40389 - RNA, 22 nt, Homo sapiens
uguacaaauuucugugguggug

SEQ ID NO: 40390 - RNA, 22 nt, Homo sapiens
ugucaaguugugguucaauuuu

SEQ ID NO: 40391 - RNA, 22 nt, Homo sapiens
ugugaaacauggauagaacugg

SEQ ID NO: 40392 - RNA, 22 nt, Homo sapiens
uuaaggaguagugucugguauu

SEQ ID NO: 40393 - RNA, 22 nt, Homo sapiens
uuagccccuuugagccucaacu

SEQ ID NO: 40394 - RNA, 22 nt, Homo sapiens
uuauagcacuaagaagguaaua

SEQ ID NO: 40395 - RNA, 20 nt, Homo sapiens
uuaugucguuucuugcuuau

SEQ ID NO: 40396 - RNA, 22 nt, Homo sapiens
uucccugagcaucuguugagcc

SEQ ID NO: 40397 - RNA, 22 nt, Homo sapiens
uucccugaguaucuuaccaugg

SEQ ID NO: 40398 - RNA, 22 nt, Homo sapiens
uuccugugacccccaagcccac

SEQ ID NO: 40399 - RNA, 22 nt, Homo sapiens
uuccuuaguuauuugguccccu

SEQ ID NO: 40400 - RNA, 21 nt, Homo sapiens
uucucagaggcaggggauaaa

SEQ ID NO: 40401 - RNA, 22 nt, Homo sapiens
uugaccccuucuaauagccuca

SEQ ID NO: 40402 - RNA, 21 nt, Homo sapiens
uugagcuuuuaguacagacag

SEQ ID NO: 40403 - RNA, 22 nt, Homo sapiens
uugcacaauggaauuuaucuuu

SEQ ID NO: 40404 - RNA, 22 nt, Homo sapiens
uuggaaauauguuaagugucau

SEQ ID NO: 40405 - RNA, 22 nt, Homo sapiens
uuggccauaugacuugcuuugg

SEQ ID NO: 40406 - RNA, 22 nt, Homo sapiens
auugcucaaaucaguacuugag

SEQ ID NO: 40407 - RNA, 22 nt, Homo sapiens
caaggaauucucaauagaguua

SEQ ID NO: 40408 - RNA, 22 nt, Homo sapiens
caaguguuuccuuaaauacuug

SEQ ID NO: 40409 - RNA, 22 nt, Homo sapiens
uugucaaacucauucuccaucc

SEQ ID NO: 40410 - RNA, 22 nt, Homo sapiens
uugugucccugcggcugaggag

SEQ ID NO: 40411 - RNA, 22 nt, Homo sapiens
uuuaugcgucuguaauuucuuu

SEQ ID NO: 40412 - RNA, 22 nt, Homo sapiens
uuugacuacugaugguguacgc

SEQ ID NO: 40413 - RNA, 22 nt, Homo sapiens
uuugacuagaguguuuuacaac

SEQ ID NO: 40414 - RNA, 22 nt, Homo sapiens
uuugauguugauacuaccuuca

SEQ ID NO: 40415 - RNA, 22 nt, Homo sapiens
uuuggcauuagagagacuugca

SEQ ID NO: 40416 - RNA, 20 nt, Homo sapiens
uuuuagcuuuuauugaaagc

SEQ ID NO: 40417 - RNA, 17 nt, Homo sapiens
uuuuggauuagaaaucc

SEQ ID NO: 40418 - RNA, 22 nt, Homo sapiens
uuuugguguauuguauaaggua

SEQ ID NO: 40419 - RNA, 22 nt, Homo sapiens
cacugcacucuucuucugggca

SEQ ID NO: 40420 - RNA, 22 nt, Homo sapiens
cagagaaugucuuuuuuaacca

SEQ ID NO: 40421 - RNA, 21 nt, Homo sapiens
caugucacugcacucuagccu

SEQ ID NO: 40422 - RNA, 22 nt, Homo sapiens
ccacccuuccauucuuccucuu

SEQ ID NO: 40423 - RNA, 22 nt, Homo sapiens
ccaucccuuucugagcaguucc

SEQ ID NO: 40424 - RNA, 17 nt, Homo sapiens
cccuaguagcugggacu

SEQ ID NO: 40425 - RNA, 22 nt, Homo sapiens
cuagauuauccaacuuauuagc

SEQ ID NO: 40426 - RNA, 22 nt, Homo sapiens
cuagcccagugcuccuggauca

SEQ ID NO: 40427 - RNA, 22 nt, Homo sapiens
cucacugugguguccuuaggua

SEQ ID NO: 40428 - RNA, 22 nt, Homo sapiens
cucagcuacuugggaagcugag

SEQ ID NO: 40429 - RNA, 22 nt, Homo sapiens
cucaguuuugccuuguuuaagg

SEQ ID NO: 40430 - RNA, 22 nt, Homo sapiens
cugaaagagcauguaacacagu

SEQ ID NO: 40431 - RNA, 22 nt, Homo sapiens
cugaaggcagguagaauagaga

SEQ ID NO: 40432 - RNA, 22 nt, Homo sapiens
cugaggcacggcgaccuuaagu

SEQ ID NO: 40433 - RNA, 22 nt, Homo sapiens
cugcaguaaccacuguaggugu

SEQ ID NO: 40434 - RNA, 21 nt, Homo sapiens
cugguccccuuuauguaugug

SEQ ID NO: 40435 - RNA, 22 nt, Homo sapiens
cuguaauguaaugagacuacau

SEQ ID NO: 40436 - RNA, 22 nt, Homo sapiens
cuuuuggcuuaagauugucuug

SEQ ID NO: 40437 - RNA, 22 nt, Homo sapiens
cuuuuggcuuagaauugucuug

SEQ ID NO: 40438 - RNA, 22 nt, Homo sapiens
gagauacacccagugcagaggc

SEQ ID NO: 40439 - RNA, 22 nt, Homo sapiens
gagcuuguggucuucguguuau

SEQ ID NO: 40440 - RNA, 22 nt, Homo sapiens
gaggaaguagcuacugucuuuc

SEQ ID NO: 40441 - RNA, 22 nt, Homo sapiens
gauggaguugacuaagacaaca

SEQ ID NO: 40442 - RNA, 22 nt, Homo sapiens
gauuuuccaguggcccugauca

SEQ ID NO: 40443 - RNA, 22 nt, Homo sapiens
gcaaaugcuacaccauuuugua

SEQ ID NO: 40444 - RNA, 22 nt, Homo sapiens
gcacagucaacacuuauucacc

SEQ ID NO: 40445 - RNA, 22 nt, Homo sapiens
gcaugcacuguauuuaaguauc

SEQ ID NO: 40446 - RNA, 22 nt, Homo sapiens
gccauggaggauuuauagaggc

SEQ ID NO: 40447 - RNA, 22 nt, Homo sapiens
gcuugguccccacccaaaucgc

SEQ ID NO: 40448 - RNA, 22 nt, Homo sapiens
ggacauguauauauaugugugu

SEQ ID NO: 40449 - RNA, 22 nt, Homo sapiens
ggcaacaaagacauuucaacau

SEQ ID NO: 40450 - RNA, 22 nt, Homo sapiens
ggcaacaauuccuacuucuuuu

SEQ ID NO: 40451 - RNA, 22 nt, Homo sapiens
ggcaugguggugugugccuaua

SEQ ID NO: 40452 - RNA, 22 nt, Homo sapiens
gucaacauauuaauuauguucu

SEQ ID NO: 40453 - RNA, 22 nt, Homo sapiens
gucugcaugucauaugauagua

SEQ ID NO: 40454 - RNA, 22 nt, Homo sapiens
gucuuccagccuccaucuuucu

SEQ ID NO: 40455 - RNA, 22 nt, Homo sapiens
gugcuuauccccauucuggagg

SEQ ID NO: 40456 - RNA, 22 nt, Homo sapiens
uaaagcacaaguaaagaauacu

SEQ ID NO: 40457 - RNA, 22 nt, Homo sapiens
uaacaacauucuaacugacggc

SEQ ID NO: 40458 - RNA, 22 nt, Homo sapiens
uaagagagcuccaucuuuuccu

SEQ ID NO: 40459 - RNA, 22 nt, Homo sapiens
uaaggaguagaauaguaaggca

SEQ ID NO: 40460 - RNA, 22 nt, Homo sapiens
uaagguuacaaaggacuucaua

SEQ ID NO: 40461 - RNA, 22 nt, Homo sapiens
uacaacacugguucgacaugug

SEQ ID NO: 40462 - RNA, 16 nt, Homo sapiens
uacaacagugaguaug

SEQ ID NO: 40463 - RNA, 20 nt, Homo sapiens
uagagagauauggggguucc

SEQ ID NO: 40464 - RNA, 22 nt, Homo sapiens
uagagcuugacacuuuccaugg

SEQ ID NO: 40465 - RNA, 22 nt, Homo sapiens
uagauuguaauaugcagaaugg

SEQ ID NO: 40466 - RNA, 22 nt, Homo sapiens
uagcagcaccccacucuacugg

SEQ ID NO: 40467 - RNA, 22 nt, Homo sapiens
uaggcaaaugcaagaguagaac

SEQ ID NO: 40468 - RNA, 22 nt, Homo sapiens
uauaacacccacauauagucuu

SEQ ID NO: 40469 - RNA, 22 nt, Homo sapiens
uaucauaguuuggacuuucauu

SEQ ID NO: 40470 - RNA, 22 nt, Homo sapiens
ucaaagugagcuccuucucacu

SEQ ID NO: 40471 - RNA, 22 nt, Homo sapiens
ucaaauuccaagucuagguagg

SEQ ID NO: 40472 - RNA, 22 nt, Homo sapiens
ucacagauaaauaaagaugauu

SEQ ID NO: 40473 - RNA, 20 nt, Homo sapiens
ucacagucacacauaauccu

SEQ ID NO: 40474 - RNA, 22 nt, Homo sapiens
ucacaguccuguuuaggagagg

SEQ ID NO: 40475 - RNA, 22 nt, Homo sapiens
ucacagucggugacuucuugcu

SEQ ID NO: 40476 - RNA, 23 nt, Homo sapiens
ucacaguuacuuuugcaucaacc

SEQ ID NO: 40477 - RNA, 22 nt, Homo sapiens
ucacaguuggccuggccuuuua

SEQ ID NO: 40478 - RNA, 19 nt, Homo sapiens
ucauagucuaagaugagaa

SEQ ID NO: 40479 - RNA, 22 nt, Homo sapiens
uccuuggucauggaagagacag

SEQ ID NO: 40480 - RNA, 21 nt, Homo sapiens
uccuuggugaugcccugcagu

SEQ ID NO: 40481 - RNA, 23 nt, Homo sapiens
uccuugguuggcgcccuaugugu

SEQ ID NO: 40482 - RNA, 22 nt, Homo sapiens
uccuuuguuacaguuggcucug

SEQ ID NO: 40483 - RNA, 22 nt, Homo sapiens
ucuacccugugagggacacagu

SEQ ID NO: 40484 - RNA, 22 nt, Homo sapiens
ucuggucccugcacauauuuuc

SEQ ID NO: 40485 - RNA, 22 nt, Homo sapiens
ucugugaaugaacacuugaaaa

SEQ ID NO: 40486 - RNA, 22 nt, Homo sapiens
ucuuugggauauucugaaaggg

SEQ ID NO: 40487 - RNA, 22 nt, Homo sapiens
ucuuuggguguauuucacagcc

SEQ ID NO: 40488 - RNA, 22 nt, Homo sapiens
ucuuugucuacauccuguuaaa

SEQ ID NO: 40489 - RNA, 21 nt, Homo sapiens
ugaaaugcaugugcacauuaa

SEQ ID NO: 40490 - RNA, 22 nt, Homo sapiens
ugaaaugcuaauucguagcuaa

SEQ ID NO: 40491 - RNA, 22 nt, Homo sapiens
ugaaaugcugucuaggggaaau

SEQ ID NO: 40492 - RNA, 22 nt, Homo sapiens
ugagaaugacugggcaugcugc

SEQ ID NO: 40493 - RNA, 22 nt, Homo sapiens
ugagaaugaugauuuccaguuu

SEQ ID NO: 40494 - RNA, 20 nt, Homo sapiens
ugagcuuguaaacacuguuu

SEQ ID NO: 40495 - RNA, 22 nt, Homo sapiens
ugagguagaggugaacuugacc

SEQ ID NO: 40496 - RNA, 19 nt, Homo sapiens
ugcagcaauguaaaagaca

SEQ ID NO: 40497 - RNA, 22 nt, Homo sapiens
ugcauauucgaguuauuuuggg

SEQ ID NO: 40498 - RNA, 22 nt, Homo sapiens
ugccaucauuaauauuaggcau

SEQ ID NO: 40499 - RNA, 22 nt, Homo sapiens
ugcuagaagaucacacacauca

SEQ ID NO: 40500 - RNA, 22 nt, Homo sapiens
uggaauuuacuuauuuaggggc

SEQ ID NO: 40501 - RNA, 22 nt, Homo sapiens
uggcuuucuggggcuucuguuc

SEQ ID NO: 40502 - RNA, 21 nt, Homo sapiens
uggucccauaagauuacaaug

SEQ ID NO: 40503 - RNA, 21 nt, Homo sapiens
uggucccauaagauuauaaug

SEQ ID NO: 40504 - RNA, 22 nt, Homo sapiens
uggucccaugaacuuuagguca

SEQ ID NO: 40505 - RNA, 22 nt, Homo sapiens
uggucccucugaaaauugggug

SEQ ID NO: 40506 - RNA, 22 nt, Homo sapiens
uguagcaaauaaaagucuggau

SEQ ID NO: 40507 - RNA, 22 nt, Homo sapiens
acacagucaaauccacuuggcu

SEQ ID NO: 40508 - RNA, 23 nt, Homo sapiens
acaguggugugaucuuggcucag

SEQ ID NO: 40509 - RNA, 22 nt, Homo sapiens
acaucaggcuugugaugauuac

SEQ ID NO: 40510 - RNA, 22 nt, Homo sapiens
agaauguaaacagaauagagga

SEQ ID NO: 40511 - RNA, 22 nt, Homo sapiens
agagagguggguggagccccca

SEQ ID NO: 40512 - RNA, 22 nt, Homo sapiens
agaucacaguaccguaaggcug

SEQ ID NO: 40513 - RNA, 22 nt, Homo sapiens
agcagcaauuuuguaugguuua

SEQ ID NO: 40514 - RNA, 22 nt, Homo sapiens
agcuuguagugauuugugguaa

SEQ ID NO: 40515 - RNA, 22 nt, Homo sapiens
aggcaugaaauacaugcauuga

SEQ ID NO: 40516 - RNA, 20 nt, Homo sapiens
agucaguuuauuuucucucu

SEQ ID NO: 40517 - RNA, 22 nt, Homo sapiens
auaagugagugauucaguguua

SEQ ID NO: 40518 - RNA, 22 nt, Homo sapiens
auaccuuuuaggggaacguucu

SEQ ID NO: 40519 - RNA, 22 nt, Homo sapiens
auaucacaaacaagucuguacu

SEQ ID NO: 40520 - RNA, 22 nt, Homo sapiens
aucacagaguuaaaacuuucuu

SEQ ID NO: 40521 - RNA, 22 nt, Homo sapiens
auccuguacuaagguuuuccca

SEQ ID NO: 40522 - RNA, 22 nt, Homo sapiens
augagauaaaccaucucuuaag

SEQ ID NO: 40523 - RNA, 22 nt, Homo sapiens
augaggaaggagccuuugucug

SEQ ID NO: 40524 - RNA, 22 nt, Homo sapiens
augaggugaggucaguaaggua

SEQ ID NO: 40525 - RNA, 22 nt, Homo sapiens
auggccauuacuaagaauguuu

SEQ ID NO: 40526 - RNA, 22 nt, Homo sapiens
caaauccucaccucaucaugaa

SEQ ID NO: 40527 - RNA, 21 nt, Homo sapiens
caagugaugcuucugcuuuaa

SEQ ID NO: 40528 - RNA, 21 nt, Homo sapiens
caaugacacuguagcugugcu

SEQ ID NO: 40529 - RNA, 22 nt, Homo sapiens
ucuguuguuaucauaauauuga

SEQ ID NO: 40530 - RNA, 22 nt, Homo sapiens
ugaaucaugcugcuauaaagac

SEQ ID NO: 40531 - RNA, 22 nt, Homo sapiens
ugagaggugauaaagcaagggu

SEQ ID NO: 40532 - RNA, 22 nt, Homo sapiens
ugagguaacaaacuaugaguua

SEQ ID NO: 40533 - RNA, 22 nt, Homo sapiens
ugagguaugugaugucuuuuag

SEQ ID NO: 40534 - RNA, 22 nt, Homo sapiens
ugagguugaaggacauuuuuau

SEQ ID NO: 40535 - RNA, 19 nt, Homo sapiens
ugaguaucuuuacacaucu

SEQ ID NO: 40536 - RNA, 22 nt, Homo sapiens
ugaugucuugcaggcacgagau

SEQ ID NO: 40537 - RNA, 18 nt, Homo sapiens
ugauugacuuauuuaggu

SEQ ID NO: 40538 - RNA, 18 nt, Homo sapiens
ugcaauggagaugcagcc

SEQ ID NO: 40539 - RNA, 22 nt, Homo sapiens
uuuuuugguaauugaacaauga

SEQ ID NO: 40540 - RNA, 18 nt, Homo sapiens
aaacugcuuccuuggccu

SEQ ID NO: 40541 - RNA, 22 nt, Homo sapiens
aaagaagucagccuguccuuug

SEQ ID NO: 40542 - RNA, 22 nt, Homo sapiens
aaagucuguuuugucagagacu

SEQ ID NO: 40543 - RNA, 22 nt, Homo sapiens
aaagugcacuuggaagagggcc

SEQ ID NO: 40544 - RNA, 22 nt, Homo sapiens
ugaaagacugaagaauaggcau

SEQ ID NO: 40545 - RNA, 22 nt, Homo sapiens
ugaaaugaucaguuugguuacu

SEQ ID NO: 40546 - RNA, 22 nt, Homo sapiens
ugaacagagaaacacuggccau

SEQ ID NO: 40547 - RNA, 22 nt, Homo sapiens
ugaagggcauuguuuugccaaa

SEQ ID NO: 40548 - RNA, 21 nt, Homo sapiens
ugaaguagcauaggaugucaa

SEQ ID NO: 40549 - RNA, 22 nt, Homo sapiens
ugaaguaggcauaaguuaagcu

SEQ ID NO: 40550 - RNA, 22 nt, Homo sapiens
ugaaguagguucucguaucgcc

SEQ ID NO: 40551 - RNA, 22 nt, Homo sapiens
ugaagugaagcaguaguguggg

SEQ ID NO: 40552 - RNA, 22 nt, Homo sapiens
ugaauaguaauguguuuggucu

SEQ ID NO: 40553 - RNA, 22 nt, Homo sapiens
ugaauguauuuauuaccauuca

SEQ ID NO: 40554 - RNA, 19 nt, Homo sapiens
ugacacuguuggugggagg

SEQ ID NO: 40555 - RNA, 22 nt, Homo sapiens
ugacagcugaagauguugaacc

SEQ ID NO: 40556 - RNA, 22 nt, Homo sapiens
ugacaguaaacagucuugauua

SEQ ID NO: 40557 - RNA, 22 nt, Homo sapiens
ugacagugaauaagucucuuaa

SEQ ID NO: 40558 - RNA, 22 nt, Homo sapiens
ugacaugaaggcaccucugucc

SEQ ID NO: 40559 - RNA, 22 nt, Homo sapiens
ugacucaguuguuagucuucau

SEQ ID NO: 40560 - RNA, 22 nt, Homo sapiens
ugacuggagaccucaguagggu

SEQ ID NO: 40561 - RNA, 22 nt, Homo sapiens
ugacuugauacauguuuuugaa

SEQ ID NO: 40562 - RNA, 22 nt, Homo sapiens
ugagaacagauggcuuuauuau

SEQ ID NO: 40563 - RNA, 16 nt, Homo sapiens
ugagaacaugugacau

SEQ ID NO: 40564 - RNA, 22 nt, Homo sapiens
ugagaacaugugauauuuggug

SEQ ID NO: 40565 - RNA, 20 nt, Homo sapiens
ugagaacauguggcauuugg

SEQ ID NO: 40566 - RNA, 22 nt, Homo sapiens
ugagaacauuccucuuccuggc

SEQ ID NO: 40567 - RNA, 22 nt, Homo sapiens
ugagaacuagagaacaagguga

SEQ ID NO: 40568 - RNA, 22 nt, Homo sapiens
ugagaacugcagggagcugcau

SEQ ID NO: 40569 - RNA, 22 nt, Homo sapiens
ugagaacuuauggugauuuuuu

SEQ ID NO: 40570 - RNA, 22 nt, Homo sapiens
ugagaaugcagaaucucgugca

SEQ ID NO: 40571 - RNA, 22 nt, Homo sapiens
ugagacggagucuugcucuguc

SEQ ID NO: 40572 - RNA, 22 nt, Homo sapiens
ugagacugagucuugcucuauu

SEQ ID NO: 40573 - RNA, 22 nt, Homo sapiens
ugagacugaguuuccaucuugu

SEQ ID NO: 40574 - RNA, 22 nt, Homo sapiens
ugagacugaguuucgcucuugu

SEQ ID NO: 40575 - RNA, 22 nt, Homo sapiens
ugagacugaguuuugcucguug

SEQ ID NO: 40576 - RNA, 22 nt, Homo sapiens
ugagagucauacaaauaaaaau

SEQ ID NO: 40577 - RNA, 22 nt, Homo sapiens
ugagauaaagcauguacugugu

SEQ ID NO: 40578 - RNA, 22 nt, Homo sapiens
ugagauagaaaacauaggagaa

SEQ ID NO: 40579 - RNA, 22 nt, Homo sapiens
ugagaucagaaggauuucucug

SEQ ID NO: 40580 - RNA, 22 nt, Homo sapiens
ugagaucugucuuuauaguauu

SEQ ID NO: 40581 - RNA, 22 nt, Homo sapiens
ugagaugaaagcagaaagacuu

SEQ ID NO: 40582 - RNA, 22 nt, Homo sapiens
ugagaugaggucucacucuguu

SEQ ID NO: 40583 - RNA, 22 nt, Homo sapiens
ugagaugauaucuuauuguaau

SEQ ID NO: 40584 - RNA, 21 nt, Homo sapiens
ugagaugauccugcaugcaug

SEQ ID NO: 40585 - RNA, 22 nt, Homo sapiens
ugagaugcaaaaugagaauugu

SEQ ID NO: 40586 - RNA, 22 nt, Homo sapiens
ugagauuaucguaauguaucuc

SEQ ID NO: 40587 - RNA, 22 nt, Homo sapiens
ugagcaaaauuuuggacauaga

SEQ ID NO: 40588 - RNA, 22 nt, Homo sapiens
ugagcacagcgugugggagagc

SEQ ID NO: 40589 - RNA, 22 nt, Homo sapiens
ugagcaucucuaaaaggagcaa

SEQ ID NO: 40590 - RNA, 22 nt, Homo sapiens
ugagcauuguguuugacuguga

SEQ ID NO: 40591 - RNA, 20 nt, Homo sapiens
ugagcucaugacauuuuucu

SEQ ID NO: 40592 - RNA, 18 nt, Homo sapiens
ugaggaaaggguuugcua

SEQ ID NO: 40593 - RNA, 22 nt, Homo sapiens
ugaggcaaggcugaaugaaggc

SEQ ID NO: 40594 - RNA, 17 nt, Homo sapiens
ugagggaugccugguuc

SEQ ID NO: 40595 - RNA, 22 nt, Homo sapiens
ugagggaugcguacccuaugcc

SEQ ID NO: 40596 - RNA, 22 nt, Homo sapiens
ugagguagaggugaacuugacc

SEQ ID NO: 40597 - RNA, 22 nt, Homo sapiens
ugagguagguaccauuaucacu

SEQ ID NO: 40598 - RNA, 22 nt, Homo sapiens
ugaggucuuuauuuagugcuca

SEQ ID NO: 40599 - RNA, 22 nt, Homo sapiens
ugaggugaaguaauauucuaag

SEQ ID NO: 40600 - RNA, 22 nt, Homo sapiens
ugagguuauuuguucaagaagu

SEQ ID NO: 40601 - RNA, 22 nt, Homo sapiens
ugaguguccaaguaaggugaaa

SEQ ID NO: 40602 - RNA, 22 nt, Homo sapiens
ugaguucaauguuaaugaagca

SEQ ID NO: 40603 - RNA, 22 nt, Homo sapiens
ugaguucuuuuagggauauugc

SEQ ID NO: 40604 - RNA, 22 nt, Homo sapiens
ugauaagugagauagcaaguga

SEQ ID NO: 40605 - RNA, 17 nt, Homo sapiens
ugauaagugugagguga

SEQ ID NO: 40606 - RNA, 22 nt, Homo sapiens
ugauagaucugggcaaaguaaa

SEQ ID NO: 40607 - RNA, 18 nt, Homo sapiens
ugauaucaaugauagcca

SEQ ID NO: 40608 - RNA, 18 nt, Homo sapiens
ugauaucaucacaauuga

SEQ ID NO: 40609 - RNA, 22 nt, Homo sapiens
ugauccuguccuuaugauguua

SEQ ID NO: 40610 - RNA, 22 nt, Homo sapiens
ugauggcaauggcauucauuuu

SEQ ID NO: 40611 - RNA, 22 nt, Homo sapiens
ugauggcauuucauguuuguaa

SEQ ID NO: 40612 - RNA, 22 nt, Homo sapiens
ugaugguuuuauaagggagagu

SEQ ID NO: 40613 - RNA, 20 nt, Homo sapiens
ugauguccaggcagagguuu

SEQ ID NO: 40614 - RNA, 18 nt, Homo sapiens
ugauugacuuauuuaggu

SEQ ID NO: 40615 - RNA, 22 nt, Homo sapiens
ugauuggagaacaaacugcaua

SEQ ID NO: 40616 - RNA, 22 nt, Homo sapiens
ugauuggagaugaauuucguuu

SEQ ID NO: 40617 - RNA, 22 nt, Homo sapiens
ugcaaagucgaaacugcaguuu

SEQ ID NO: 40618 - RNA, 22 nt, Homo sapiens
ugcaaauguuaguaacaccacu

SEQ ID NO: 40619 - RNA, 22 nt, Homo sapiens
ugcaacacauugccccugcucu

SEQ ID NO: 40620 - RNA, 22 nt, Homo sapiens
ugcagaaucccuucagauccga

SEQ ID NO: 40621 - RNA, 22 nt, Homo sapiens
ugcagcucagcugcggaguuuu

SEQ ID NO: 40622 - RNA, 22 nt, Homo sapiens
ugcauacacaagcauacaugua

SEQ ID NO: 40623 - RNA, 19 nt, Homo sapiens
ugcauaggguuacauacuc

SEQ ID NO: 40624 - RNA, 22 nt, Homo sapiens
ugcauuguaggauguuuagcag

SEQ ID NO: 40625 - RNA, 22 nt, Homo sapiens
ugcauuguuuuugguucccagg

SEQ ID NO: 40626 - RNA, 22 nt, Homo sapiens
ugccaacaugccuggcuguuuu

SEQ ID NO: 40627 - RNA, 22 nt, Homo sapiens
ugccagaugugcccucuccacc

SEQ ID NO: 40628 - RNA, 22 nt, Homo sapiens
ugccuacagaaggggcucagca

SEQ ID NO: 40629 - RNA, 22 nt, Homo sapiens
ugccuaggcuggagugcagugg

SEQ ID NO: 40630 - RNA, 18 nt, Homo sapiens
ugcuaugagauuauuuua

SEQ ID NO: 40631 - RNA, 21 nt, Homo sapiens
ugcuauguuguccaggcuggc

SEQ ID NO: 40632 - RNA, 22 nt, Homo sapiens
ugcuggugauuaaauccugaag

SEQ ID NO: 40633 - RNA, 22 nt, Homo sapiens
ggacuagggacauggggagcug

SEQ ID NO: 40634 - RNA, 22 nt, Homo sapiens
ggagaucuuugaaguguugugc

SEQ ID NO: 40635 - RNA, 22 nt, Homo sapiens
ggaggcuaguaaaaagguagaa

SEQ ID NO: 40636 - RNA, 22 nt, Homo sapiens
ggagugucagaaacaguguccu

SEQ ID NO: 40637 - RNA, 22 nt, Homo sapiens
ggaugcauuuuugguugucaca

SEQ ID NO: 40638 - RNA, 22 nt, Homo sapiens
ggcaaaucugcaauuacuuuug

SEQ ID NO: 40639 - RNA, 17 nt, Homo sapiens
ggcaagaaguggaacuc

SEQ ID NO: 40640 - RNA, 22 nt, Homo sapiens
ggcacuguggcucaagccugua

SEQ ID NO: 40641 - RNA, 21 nt, Homo sapiens
ggcucuguggucucagguuuc

SEQ ID NO: 40642 - RNA, 22 nt, Homo sapiens
gggaauggaagacauuaugaug

SEQ ID NO: 40643 - RNA, 22 nt, Homo sapiens
gggaguagagaguuucucugac

SEQ ID NO: 40644 - RNA, 22 nt, Homo sapiens
gggagugugcacacaugguaua

SEQ ID NO: 40645 - RNA, 22 nt, Homo sapiens
gggaucaacuuauacuaaaauu

SEQ ID NO: 40646 - RNA, 22 nt, Homo sapiens
gggaugaaguugauguagaaag

SEQ ID NO: 40647 - RNA, 22 nt, Homo sapiens
ggucaaguaauccuggguguca

SEQ ID NO: 40648 - RNA, 22 nt, Homo sapiens
ggucaguguuaucaccgaagga

SEQ ID NO: 40649 - RNA, 22 nt, Homo sapiens
uggacuguaauuuuauaggcau

SEQ ID NO: 40650 - RNA, 22 nt, Homo sapiens
uggagguagacauugggaagag

SEQ ID NO: 40651 - RNA, 20 nt, Homo sapiens
uggagugaagguucuggacc

SEQ ID NO: 40652 - RNA, 22 nt, Homo sapiens
uggagugauaugguuauauggg

SEQ ID NO: 40653 - RNA, 20 nt, Homo sapiens
uggaguuguggcaguuugga

SEQ ID NO: 40654 - RNA, 22 nt, Homo sapiens
uggauagaaauguacuguuuuc

SEQ ID NO: 40655 - RNA, 22 nt, Homo sapiens
uggauaguaauaaacauauagg

SEQ ID NO: 40656 - RNA, 22 nt, Homo sapiens
uggcaaagugugacgugggggu

SEQ ID NO: 40657 - RNA, 22 nt, Homo sapiens
uggcaaauuccaaaguuaauuc

SEQ ID NO: 40658 - RNA, 22 nt, Homo sapiens
uggcaagaaccacaguuacuuu

SEQ ID NO: 40659 - RNA, 22 nt, Homo sapiens
uggcaagaacugcaauugcuuu

SEQ ID NO: 40660 - RNA, 23 nt, Homo sapiens
uggcaagaauucuuaccgugugg

SEQ ID NO: 40661 - RNA, 22 nt, Homo sapiens
uggcaagagaacaacaucucuc

SEQ ID NO: 40662 - RNA, 22 nt, Homo sapiens
uggcaagagggaugcaagguuu

SEQ ID NO: 40663 - RNA, 22 nt, Homo sapiens
uggcagugggagauauuuuauu

SEQ ID NO: 40664 - RNA, 22 nt, Homo sapiens
uggcaguuuuugccuucaauac

SEQ ID NO: 40665 - RNA, 17 nt, Homo sapiens
uggcaugaggguguggg

SEQ ID NO: 40666 - RNA, 22 nt, Homo sapiens
uggcaugauccuagauucaaca

SEQ ID NO: 40667 - RNA, 22 nt, Homo sapiens
uggcaugggguaguagcgcugg

SEQ ID NO: 40668 - RNA, 22 nt, Homo sapiens
uggcggagacauggacuucaga

SEQ ID NO: 40669 - RNA, 22 nt, Homo sapiens
uggcuccguuguacaggcugga

SEQ ID NO: 40670 - RNA, 22 nt, Homo sapiens
uggcuguuuauuucacaugggu

SEQ ID NO: 40671 - RNA, 22 nt, Homo sapiens
ugggaagagggagcgauuuugg

SEQ ID NO: 40672 - RNA, 22 nt, Homo sapiens
ugggaagaugcugcuucuuccu

SEQ ID NO: 40673 - RNA, 22 nt, Homo sapiens
ugggagcauugcauuagaagcc

SEQ ID NO: 40674 - RNA, 22 nt, Homo sapiens
ugggaugaugcuugagaauauc

SEQ ID NO: 40675 - RNA, 22 nt, Homo sapiens
ugggaugauguuaaacguacuc

SEQ ID NO: 40676 - RNA, 22 nt, Homo sapiens
ugggcaagugacuuggcuucuc

SEQ ID NO: 40677 - RNA, 22 nt, Homo sapiens
uggggcuuuuucuuguauucuc

SEQ ID NO: 40678 - RNA, 20 nt, Homo sapiens
uggucaccuucaggagguuc

SEQ ID NO: 40679 - RNA, 22 nt, Homo sapiens
ugguccuuuccauuggagacac

SEQ ID NO: 40680 - RNA, 22 nt, Homo sapiens
uggucuggagagucccgcccag

SEQ ID NO: 40681 - RNA, 19 nt, Homo sapiens
uggugccuuguucuuggau

SEQ ID NO: 40682 - RNA, 22 nt, Homo sapiens
uguaaugaucaaaucagaguaa

SEQ ID NO: 40683 - RNA, 22 nt, Homo sapiens
uguagcagccauaaacacagug

SEQ ID NO: 40684 - RNA, 21 nt, Homo sapiens
uguauacauauguuaggugca

SEQ ID NO: 40685 - RNA, 22 nt, Homo sapiens
uguauguaauugaaguuaaguu

SEQ ID NO: 40686 - RNA, 22 nt, Homo sapiens
ugucagcacaacucagguuccu

SEQ ID NO: 40687 - RNA, 22 nt, Homo sapiens
ugucauggggaaaauaacagac

SEQ ID NO: 40688 - RNA, 22 nt, Homo sapiens
ugucaugucuuuguguaucaau

SEQ ID NO: 40689 - RNA, 22 nt, Homo sapiens
ugucuagaaaagccugccuucu

SEQ ID NO: 40690 - RNA, 22 nt, Homo sapiens
ugucucaguucccuucucugga

SEQ ID NO: 40691 - RNA, 22 nt, Homo sapiens
ugugaacagaauuagucaccua

SEQ ID NO: 40692 - RNA, 22 nt, Homo sapiens
ugugacaguuaguuugguguua

SEQ ID NO: 40693 - RNA, 22 nt, Homo sapiens
ugugaccaaaaucaacauaccu

SEQ ID NO: 40694 - RNA, 22 nt, Homo sapiens
ugugagaaaugcagaaucucag

SEQ ID NO: 40695 - RNA, 22 nt, Homo sapiens
ugugagcuauggaguuguagag

SEQ ID NO: 40696 - RNA, 22 nt, Homo sapiens
ugugaugguuuagcauuuucuu

SEQ ID NO: 40697 - RNA, 20 nt, Homo sapiens
ugugauuauuuaguugcaug

SEQ ID NO: 40698 - RNA, 22 nt, Homo sapiens
ugugauugauauauuuacagaa

SEQ ID NO: 40699 - RNA, 22 nt, Homo sapiens
ugugcaaaaguaauugcgguuu

SEQ ID NO: 40700 - RNA, 22 nt, Homo sapiens
ugugccacugcacuccugccug

SEQ ID NO: 40701 - RNA, 22 nt, Homo sapiens
ugugccuucuaagaaggagucu

SEQ ID NO: 40702 - RNA, 22 nt, Homo sapiens
uguggaaauuguuguauuuaau

SEQ ID NO: 40703 - RNA, 22 nt, Homo sapiens
ugugggugguaaaauacaauga

SEQ ID NO: 40704 - RNA, 22 nt, Homo sapiens
ugugucuuuuaucacacaaugu

SEQ ID NO: 40705 - RNA, 22 nt, Homo sapiens
uguucaugaguucucauuuuua

SEQ ID NO: 40706 - RNA, 22 nt, Homo sapiens
uguucuggagaggcaggccaca

SEQ ID NO: 40707 - RNA, 22 nt, Homo sapiens
uguuugcuguuuucuccaauga

SEQ ID NO: 40708 - RNA, 22 nt, Homo sapiens
uuaaaguguuugcagacaggug

SEQ ID NO: 40709 - RNA, 22 nt, Homo sapiens
uuaauguaauugauugauugac

SEQ ID NO: 40710 - RNA, 22 nt, Homo sapiens
uuaauucugucugcccucaucc

SEQ ID NO: 40711 - RNA, 22 nt, Homo sapiens
uuaauuguccauuauucuguuc

SEQ ID NO: 40712 - RNA, 22 nt, Homo sapiens
uuacagucucaagagugcugca

SEQ ID NO: 40713 - RNA, 23 nt, Homo sapiens
uuacaguggcaugaucucugcuc

SEQ ID NO: 40714 - RNA, 22 nt, Homo sapiens
uuacaguggugaccuuguauug

SEQ ID NO: 40715 - RNA, 22 nt, Homo sapiens
uuaccagucugauuccuguuag

SEQ ID NO: 40716 - RNA, 22 nt, Homo sapiens
uuagaacagugcucaccacaaa

SEQ ID NO: 40717 - RNA, 22 nt, Homo sapiens
uuagaguguagcaggaagaggc

SEQ ID NO: 40718 - RNA, 22 nt, Homo sapiens
uuagauguuugacugggccuua

SEQ ID NO: 40719 - RNA, 22 nt, Homo sapiens
uuagcagcucuaauaacugcua

SEQ ID NO: 40720 - RNA, 22 nt, Homo sapiens
uuagcagcucuggugacaaggu

SEQ ID NO: 40721 - RNA, 22 nt, Homo sapiens
uuagguaauauauugcugcuuu

SEQ ID NO: 40722 - RNA, 22 nt, Homo sapiens
uuagucaaguguacugugaaug

SEQ ID NO: 40723 - RNA, 22 nt, Homo sapiens
uuaucagcagcaugaaaauaga

SEQ ID NO: 40724 - RNA, 22 nt, Homo sapiens
uuaucauagugcaguuuucuga

SEQ ID NO: 40725 - RNA, 22 nt, Homo sapiens
uuaugcuguuuucuggagauuu

SEQ ID NO: 40726 - RNA, 22 nt, Homo sapiens
uuaugguuuuuagcagaguaau

SEQ ID NO: 40727 - RNA, 22 nt, Homo sapiens
uuauguaaaucaaucuggaauc

SEQ ID NO: 40728 - RNA, 22 nt, Homo sapiens
uuaugucuuuuguguucagcua

SEQ ID NO: 40729 - RNA, 22 nt, Homo sapiens
uuauuagagauauuugguuagg

SEQ ID NO: 40730 - RNA, 22 nt, Homo sapiens
uuauucauuaauugcuaagguu

SEQ ID NO: 40731 - RNA, 16 nt, Homo sapiens
uuauugcauucuucuc

SEQ ID NO: 40732 - RNA, 22 nt, Homo sapiens
uucaacagugauggccuuugua

SEQ ID NO: 40733 - RNA, 22 nt, Homo sapiens
uucaacugcuucagccucccaa

SEQ ID NO: 40734 - RNA, 22 nt, Homo sapiens
uucaagcuauggugaucuuuuc

SEQ ID NO: 40735 - RNA, 22 nt, Homo sapiens
uucaaggacuaaggauuuuugg

SEQ ID NO: 40736 - RNA, 22 nt, Homo sapiens
uucaagugaacaaaaugaggag

SEQ ID NO: 40737 - RNA, 22 nt, Homo sapiens
uucacaaugccuuguugauggu

SEQ ID NO: 40738 - RNA, 22 nt, Homo sapiens
uacuagaaccuuauucagagug

SEQ ID NO: 40739 - RNA, 22 nt, Homo sapiens
uacugagagaggaauauugaaa

SEQ ID NO: 40740 - RNA, 23 nt, Homo sapiens
uacugcauccuccgccucuaggg

SEQ ID NO: 40741 - RNA, 22 nt, Homo sapiens
uacugcauuccaaucugggcga

SEQ ID NO: 40742 - RNA, 22 nt, Homo sapiens
uacugcauuucacuguuaaaga

SEQ ID NO: 40743 - RNA, 21 nt, Homo sapiens
uacuggagauacagucugcaa

SEQ ID NO: 40744 - RNA, 22 nt, Homo sapiens
uacuuagagacaugcagcacug

SEQ ID NO: 40745 - RNA, 22 nt, Homo sapiens
uagaagcuacucuucuuguggc

SEQ ID NO: 40746 - RNA, 22 nt, Homo sapiens
uagacacugcauauuuuuuuaa

SEQ ID NO: 40747 - RNA, 21 nt, Homo sapiens
uagcaaauugcuauuaaggca

SEQ ID NO: 40748 - RNA, 22 nt, Homo sapiens
uagcaccugugcacaccaggca

SEQ ID NO: 40749 - RNA, 22 nt, Homo sapiens
uagcaucagauuccauauucua

SEQ ID NO: 40750 - RNA, 22 nt, Homo sapiens
uagcaugacacuuguugaaugc

SEQ ID NO: 40751 - RNA, 22 nt, Homo sapiens
uagcccagugagguugauuugg

SEQ ID NO: 40752 - RNA, 22 nt, Homo sapiens
uagccucacaaagugcuuaaga

SEQ ID NO: 40753 - RNA, 22 nt, Homo sapiens
uaggcaaaugcaagaguagaac

SEQ ID NO: 40754 - RNA, 22 nt, Homo sapiens
uuguccucuccaaaucucaugu

SEQ ID NO: 40755 - RNA, 22 nt, Homo sapiens
uugugaauggugccacaauaaa

SEQ ID NO: 40756 - RNA, 22 nt, Homo sapiens
uugugagggagcuaagaugagu

SEQ ID NO: 40757 - RNA, 22 nt, Homo sapiens
uugugcuucaucaccuagcaga

SEQ ID NO: 40758 - RNA, 22 nt, Homo sapiens
uugugcuugcuguguucuaugc

SEQ ID NO: 40759 - RNA, 22 nt, Homo sapiens
uugugcuuuuuaaauagcuucc

SEQ ID NO: 40760 - RNA, 22 nt, Homo sapiens
uugugguaggaugaagagauga

SEQ ID NO: 40761 - RNA, 22 nt, Homo sapiens
uugugguuauagagucucccug

SEQ ID NO: 40762 - RNA, 22 nt, Homo sapiens
uugugguuuuuaaaacuaggug

SEQ ID NO: 40763 - RNA, 22 nt, Homo sapiens
uugugucaaauggcaauuagca

SEQ ID NO: 40764 - RNA, 17 nt, Homo sapiens
uuuaaugcuaggacucu

SEQ ID NO: 40765 - RNA, 23 nt, Homo sapiens
uuuauacguugucauuuaucagg

SEQ ID NO: 40766 - RNA, 22 nt, Homo sapiens
uuucacuagccagcccuuuauu

SEQ ID NO: 40767 - RNA, 23 nt, Homo sapiens
uuucaguaguuguauccuguugc

SEQ ID NO: 40768 - RNA, 22 nt, Homo sapiens
uuucauagaucaugcuuuugga

SEQ ID NO: 40769 - RNA, 18 nt, Homo sapiens
uuucauugagugugauau

SEQ ID NO: 40770 - RNA, 22 nt, Homo sapiens
uuuccauguuggugaaaugagg

SEQ ID NO: 40771 - RNA, 22 nt, Homo sapiens
uuucccuuacuuaaacuuacuc

SEQ ID NO: 40772 - RNA, 22 nt, Homo sapiens
uuucuacagugaacgauuucua

SEQ ID NO: 40773 - RNA, 22 nt, Homo sapiens
uuucugugguccucuugaaggu

SEQ ID NO: 40774 - RNA, 22 nt, Homo sapiens
uuugacuaccaggaauguucuu

SEQ ID NO: 40775 - RNA, 22 nt, Homo sapiens
uuugacuagaguguuuuacaac

SEQ ID NO: 40776 - RNA, 22 nt, Homo sapiens
uuugagaucuuuagaaucaggc

SEQ ID NO: 40777 - RNA, 22 nt, Homo sapiens
uuugagcaagaggugacauuau

SEQ ID NO: 40778 - RNA, 22 nt, Homo sapiens
uuugagcauuagggcaaaggca

SEQ ID NO: 40779 - RNA, 22 nt, Homo sapiens
uuugauguugauacuaccuuca

SEQ ID NO: 40780 - RNA, 23 nt, Homo sapiens
uuugcacuugcuccuucuauggc

SEQ ID NO: 40781 - RNA, 22 nt, Homo sapiens
uuugcaugcuccuuaugagaau

SEQ ID NO: 40782 - RNA, 22 nt, Homo sapiens
uuuggcauuuuacuacucaaau

SEQ ID NO: 40783 - RNA, 22 nt, Homo sapiens
uuuggccauguuggucaggcug

SEQ ID NO: 40784 - RNA, 22 nt, Homo sapiens
uuuggcuuuuguaauaacugcc

SEQ ID NO: 40785 - RNA, 22 nt, Homo sapiens
uuuggguuaguuuuccaaucuu

SEQ ID NO: 40786 - RNA, 19 nt, Homo sapiens
uuuguccugcccuuucuca

SEQ ID NO: 40787 - RNA, 22 nt, Homo sapiens
uuugugcuauguuauauauucu

SEQ ID NO: 40788 - RNA, 22 nt, Homo sapiens
uuugugcuccucucaguaugug

SEQ ID NO: 40789 - RNA, 22 nt, Homo sapiens
uuuucaguggccauaguggaga

SEQ ID NO: 40790 - RNA, 20 nt, Homo sapiens
uuuugaacuuggcaaccugu

SEQ ID NO: 40791 - RNA, 22 nt, Homo sapiens
uuuugcacuagaaccagagguu

SEQ ID NO: 40792 - RNA, 22 nt, Homo sapiens
uuuugcaguuacagagagugag

SEQ ID NO: 40793 - RNA, 19 nt, Homo sapiens
uuuugcucuuuauaccuau

SEQ ID NO: 40794 - RNA, 22 nt, Homo sapiens
uuuuugaguaaauauaaauugu

SEQ ID NO: 40795 - RNA, 22 nt, Homo sapiens
auagcagcaccucacucuacug

SEQ ID NO: 40796 - RNA, 22 nt, Homo sapiens
auagcagcuugucagggcagac

SEQ ID NO: 40797 - RNA, 22 nt, Homo sapiens
auagcauaucccacaugucaga

SEQ ID NO: 40798 - RNA, 22 nt, Homo sapiens
auagcaucauuucuugaaaaga

SEQ ID NO: 40799 - RNA, 22 nt, Homo sapiens
auaucacagguguuuaccugau

SEQ ID NO: 40800 - RNA, 22 nt, Homo sapiens
auaugcacuauacacacguaua

SEQ ID NO: 40801 - RNA, 22 nt, Homo sapiens
auaugcauguacccacacaggc

SEQ ID NO: 40802 - RNA, 22 nt, Homo sapiens
auaugguguuugcuauucagcu

SEQ ID NO: 40803 - RNA, 17 nt, Homo sapiens
auaugucugcuggggga

SEQ ID NO: 40804 - RNA, 22 nt, Homo sapiens
auaugucuguuuagucuguaau

SEQ ID NO: 40805 - RNA, 18 nt, Homo sapiens
auauugcauuggauggau

SEQ ID NO: 40806 - RNA, 22 nt, Homo sapiens
aucaaagccaugcucaguuuuc

SEQ ID NO: 40807 - RNA, 22 nt, Homo sapiens
aucaccuuucccuuucugaauc

SEQ ID NO: 40808 - RNA, 22 nt, Homo sapiens
gucagugucuuugcagcucaga

SEQ ID NO: 40809 - RNA, 22 nt, Homo sapiens
gucaugggguacuacacauggg

SEQ ID NO: 40810 - RNA, 22 nt, Homo sapiens
gucauugagucagggaguaucu

SEQ ID NO: 40811 - RNA, 22 nt, Homo sapiens
guccaaagugggagaggugggg

SEQ ID NO: 40812 - RNA, 22 nt, Homo sapiens
gucccagagauauugugucuuu

SEQ ID NO: 40813 - RNA, 22 nt, Homo sapiens
gucccugcgauugugggauccu

SEQ ID NO: 40814 - RNA, 22 nt, Homo sapiens
gucucccagccuacaucuuucu

SEQ ID NO: 40815 - RNA, 21 nt, Homo sapiens
gucugguguuuuaaugaggac

SEQ ID NO: 40816 - RNA, 20 nt, Homo sapiens
gucuugcuccguugcccagg

SEQ ID NO: 40817 - RNA, 22 nt, Homo sapiens
gugaaagacagcauuaauggcu

SEQ ID NO: 40818 - RNA, 22 nt, Homo sapiens
gugaacaagcaaaggcaggagg

SEQ ID NO: 40819 - RNA, 22 nt, Homo sapiens
gugaaguuuuuugcugagaguc

SEQ ID NO: 40820 - RNA, 22 nt, Homo sapiens
gugacacagcaagacuccgucu

SEQ ID NO: 40821 - RNA, 22 nt, Homo sapiens
gugagaaucaaacuacauaaau

SEQ ID NO: 40822 - RNA, 22 nt, Homo sapiens
gugagacugaguuucgcucuug

SEQ ID NO: 40823 - RNA, 19 nt, Homo sapiens
gugagcacagacaauacaa

SEQ ID NO: 40824 - RNA, 22 nt, Homo sapiens
gugagcaguguccuugggggca

SEQ ID NO: 40825 - RNA, 21 nt, Homo sapiens
gugaggucauugggcuuucug

SEQ ID NO: 40826 - RNA, 22 nt, Homo sapiens
gugaguggacgugaccaauaaa

SEQ ID NO: 40827 - RNA, 22 nt, Homo sapiens
gugaucucagcucacuggaacc

SEQ ID NO: 40828 - RNA, 22 nt, Homo sapiens
gugcaaugagaaggggcucugg

SEQ ID NO: 40829 - RNA, 22 nt, Homo sapiens
gugcacaaaucuuaaauguaca

SEQ ID NO: 40830 - RNA, 23 nt, Homo sapiens
gugcaguggcgagauuucggcuc

SEQ ID NO: 40831 - RNA, 22 nt, Homo sapiens
gugcaguuugaaaguagaaaca

SEQ ID NO: 40832 - RNA, 21 nt, Homo sapiens
gugcuuguagccucacuucug

SEQ ID NO: 40833 - RNA, 20 nt, Homo sapiens
guggaagauaaguagccuga

SEQ ID NO: 40834 - RNA, 22 nt, Homo sapiens
guggaaugauaucucauugugg

SEQ ID NO: 40835 - RNA, 22 nt, Homo sapiens
guggacagagacuaaauguugu

SEQ ID NO: 40836 - RNA, 22 nt, Homo sapiens
guggagucaucacucagagugg

SEQ ID NO: 40837 - RNA, 17 nt, Homo sapiens
guggauagaacaaugaa

SEQ ID NO: 40838 - RNA, 22 nt, Homo sapiens
guggcaaacucagcaugcccca

SEQ ID NO: 40839 - RNA, 22 nt, Homo sapiens
guggcaagaugacuacucacug

SEQ ID NO: 40840 - RNA, 22 nt, Homo sapiens
guggcaaggaaaugcugcucac

SEQ ID NO: 40841 - RNA, 22 nt, Homo sapiens
guggcagcacauauagguuguu

SEQ ID NO: 40842 - RNA, 22 nt, Homo sapiens
guggcauuucccaaaguauucu

SEQ ID NO: 40843 - RNA, 22 nt, Homo sapiens
guggcgagaucauagcucauug

SEQ ID NO: 40844 - RNA, 22 nt, Homo sapiens
guggcuuuauuuagaagcaggg

SEQ ID NO: 40845 - RNA, 22 nt, Homo sapiens
gugggaagcuggaacucccucc

SEQ ID NO: 40846 - RNA, 22 nt, Homo sapiens
gugggguaggaggaguacuucc

SEQ ID NO: 40847 - RNA, 22 nt, Homo sapiens
gugguagaaaguaccaaacuag

SEQ ID NO: 40848 - RNA, 22 nt, Homo sapiens
gugucaguggggagugaucuuc

SEQ ID NO: 40849 - RNA, 22 nt, Homo sapiens
gugucaugagggggacaggaag

SEQ ID NO: 40850 - RNA, 21 nt, Homo sapiens
gugugcuugaauucagcuguc

SEQ ID NO: 40851 - RNA, 22 nt, Homo sapiens
guguucaaauucugacagagag

SEQ ID NO: 40852 - RNA, 22 nt, Homo sapiens
guuaugcagcaauugauaaucu

SEQ ID NO: 40853 - RNA, 22 nt, Homo sapiens
guuauugcucucgaagacucuc

SEQ ID NO: 40854 - RNA, 20 nt, Homo sapiens
guucauguaauuaguucagg

SEQ ID NO: 40855 - RNA, 22 nt, Homo sapiens
guugcucaggcuggagugcagu

SEQ ID NO: 40856 - RNA, 22 nt, Homo sapiens
guuguggagucuucuguucugg

SEQ ID NO: 40857 - RNA, 22 nt, Homo sapiens
uaaagcacaaguaaagaauacu

SEQ ID NO: 40858 - RNA, 21 nt, Homo sapiens
uaaagcuagaaccuuagcuuu

SEQ ID NO: 40859 - RNA, 22 nt, Homo sapiens
uaaagcuagagcuggaguggca

SEQ ID NO: 40860 - RNA, 22 nt, Homo sapiens
uaaagcuuagauccaugguggc

SEQ ID NO: 40861 - RNA, 21 nt, Homo sapiens
uaacagcuccacuccauucuc

SEQ ID NO: 40862 - RNA, 22 nt, Homo sapiens
uaacccugaggggcuuggggac

SEQ ID NO: 40863 - RNA, 22 nt, Homo sapiens
uaagacuuuuugggaauauaga

SEQ ID NO: 40864 - RNA, 22 nt, Homo sapiens
uaaggcauuuuuuugaguugca

SEQ ID NO: 40865 - RNA, 20 nt, Homo sapiens
uaagugcauaggauauuucu

SEQ ID NO: 40866 - RNA, 22 nt, Homo sapiens
uaagugcaugauuacaugcaua

SEQ ID NO: 40867 - RNA, 22 nt, Homo sapiens
uaauauguuuugaaaucaggaa

SEQ ID NO: 40868 - RNA, 22 nt, Homo sapiens
uaaucucagcuacucaggaggc

SEQ ID NO: 40869 - RNA, 22 nt, Homo sapiens
uaauugaaugcagacaccaggg

SEQ ID NO: 40870 - RNA, 22 nt, Homo sapiens
uacagccacauaauguaugauu

SEQ ID NO: 40871 - RNA, 22 nt, Homo sapiens
uacagcuaugugcaugcaugcu

SEQ ID NO: 40872 - RNA, 22 nt, Homo sapiens
uacauguauguguuuauggcug

SEQ ID NO: 40873 - RNA, 22 nt, Homo sapiens
uacauugcacuuuauuagauac

SEQ ID NO: 40874 - RNA, 22 nt, Homo sapiens
uaccauguaucugggaugcuuu

SEQ ID NO: 40875 - RNA, 22 nt, Homo sapiens
uacuacuuucugacaucuuuaa

SEQ ID NO: 40876 - RNA, 22 nt, Homo sapiens
uacucacauucuguuucuugcu

SEQ ID NO: 40877 - RNA, 22 nt, Homo sapiens
uacucaguagacacucauaugu

SEQ ID NO: 40878 - RNA, 22 nt, Homo sapiens
uacucugcagccauaaaacaga

SEQ ID NO: 40879 - RNA, 22 nt, Homo sapiens
uacugcacucuagccuggguga

SEQ ID NO: 40880 - RNA, 22 nt, Homo sapiens
uacuguacugcaguucugcaaa

SEQ ID NO: 40881 - RNA, 22 nt, Homo sapiens
uagaucauauucagugcuuacu

SEQ ID NO: 40882 - RNA, 23 nt, Homo sapiens
uagcaacaguuggaggugaggua

SEQ ID NO: 40883 - RNA, 22 nt, Homo sapiens
uagcacaucuucuuggccugca

SEQ ID NO: 40884 - RNA, 22 nt, Homo sapiens
uagcaccucuuuggccuuucgu

SEQ ID NO: 40885 - RNA, 22 nt, Homo sapiens
uagcacuauguuaucacauacu

SEQ ID NO: 40886 - RNA, 22 nt, Homo sapiens
uagcagaauaacuugccagccu

SEQ ID NO: 40887 - RNA, 22 nt, Homo sapiens
uagcuccagugggguuacugcu

SEQ ID NO: 40888 - RNA, 22 nt, Homo sapiens
uagcugagacuacaguaggugc

SEQ ID NO: 40889 - RNA, 22 nt, Homo sapiens
uaggcacacaucuacuacaaau

SEQ ID NO: 40890 - RNA, 22 nt, Homo sapiens
uaggcagccagcuguggauuga

SEQ ID NO: 40891 - RNA, 22 nt, Homo sapiens
uaguaucacauggucuuaauua

SEQ ID NO: 40892 - RNA, 22 nt, Homo sapiens
uaguugcaucuuaggucuguga

SEQ ID NO: 40893 - RNA, 22 nt, Homo sapiens
uauacacgugugcauauauaca

SEQ ID NO: 40894 - RNA, 22 nt, Homo sapiens
uauagcaaugccccacuccuga

SEQ ID NO: 40895 - RNA, 22 nt, Homo sapiens
uauagcauuuugauccuguaga

SEQ ID NO: 40896 - RNA, 22 nt, Homo sapiens
uauagcuaugggauguauuugc

SEQ ID NO: 40897 - RNA, 22 nt, Homo sapiens
uauaucacaugcacucauuuuc

SEQ ID NO: 40898 - RNA, 22 nt, Homo sapiens
auugagcaauuccuaugugcuu

SEQ ID NO: 40899 - RNA, 22 nt, Homo sapiens
auugauaguuuaauaggaauug

SEQ ID NO: 40900 - RNA, 22 nt, Homo sapiens
auugcaacuuccgccuccuggg

SEQ ID NO: 40901 - RNA, 22 nt, Homo sapiens
auugcacaccagucugggcaaa

SEQ ID NO: 40902 - RNA, 22 nt, Homo sapiens
auugcacaucugcacuacagcc

SEQ ID NO: 40903 - RNA, 22 nt, Homo sapiens
auugcacuccagccugggugag

SEQ ID NO: 40904 - RNA, 22 nt, Homo sapiens
auugcacucuagccuuggcgac

SEQ ID NO: 40905 - RNA, 18 nt, Homo sapiens
auugcccucauggggcuu

SEQ ID NO: 40906 - RNA, 22 nt, Homo sapiens
auuggcaaucgucuccauuuuu

SEQ ID NO: 40907 - RNA, 20 nt, Homo sapiens
auuguccuugauuacacaga

SEQ ID NO: 40908 - RNA, 22 nt, Homo sapiens
auuugacacugagagccucagu

SEQ ID NO: 40909 - RNA, 22 nt, Homo sapiens
auuuggcaauuuugaagaugcc

SEQ ID NO: 40910 - RNA, 22 nt, Homo sapiens
auuuggccuuuguaugcaguau

SEQ ID NO: 40911 - RNA, 22 nt, Homo sapiens
caaagcuauagcaccagaggga

SEQ ID NO: 40912 - RNA, 22 nt, Homo sapiens
caacaguaaagcauuuuuaagu

SEQ ID NO: 40913 - RNA, 22 nt, Homo sapiens
cuggagaucuugacauugaagu

SEQ ID NO: 40914 - RNA, 22 nt, Homo sapiens
cuggaguaugauguuagcguug

SEQ ID NO: 40915 - RNA, 22 nt, Homo sapiens
cuggcaaaaagagggcaauaau

SEQ ID NO: 40916 - RNA, 22 nt, Homo sapiens
cuggcaagaggauaaaguccua

SEQ ID NO: 40917 - RNA, 22 nt, Homo sapiens
cuggcaagagugaaccagcugu

SEQ ID NO: 40918 - RNA, 22 nt, Homo sapiens
cugggaucaguucuagucagaa

SEQ ID NO: 40919 - RNA, 22 nt, Homo sapiens
cugggaugugacuguugccccc

SEQ ID NO: 40920 - RNA, 22 nt, Homo sapiens
cugggucaguuucugauuauug

SEQ ID NO: 40921 - RNA, 22 nt, Homo sapiens
cuggucguuauuuaucuucuca

SEQ ID NO: 40922 - RNA, 22 nt, Homo sapiens
cuggugagaugucuuuccucuu

SEQ ID NO: 40923 - RNA, 21 nt, Homo sapiens
cugguguuagcacuucuuccc

SEQ ID NO: 40924 - RNA, 22 nt, Homo sapiens
cuguauguuucuaugaauguga

SEQ ID NO: 40925 - RNA, 22 nt, Homo sapiens
cugucaucauuucuaugugcca

SEQ ID NO: 40926 - RNA, 22 nt, Homo sapiens
cuguuauguucuagagggugca

SEQ ID NO: 40927 - RNA, 22 nt, Homo sapiens
cuguugguguuuaaucacugca

SEQ ID NO: 40928 - RNA, 22 nt, Homo sapiens
cuuaggguacuuuggugcauca

SEQ ID NO: 40929 - RNA, 20 nt, Homo sapiens
cuucacagaaguggaaucau

SEQ ID NO: 40930 - RNA, 22 nt, Homo sapiens
cuucaguucuguaaggacagca

SEQ ID NO: 40931 - RNA, 22 nt, Homo sapiens
cuuccagcuggguucagucagu

SEQ ID NO: 40932 - RNA, 22 nt, Homo sapiens
cuucucagugcucaucuuauuu

SEQ ID NO: 40933 - RNA, 20 nt, Homo sapiens
cuugaagacuaugcugcuga

SEQ ID NO: 40934 - RNA, 22 nt, Homo sapiens
cuugugcaugaccccagguggg

SEQ ID NO: 40935 - RNA, 22 nt, Homo sapiens
cuuuaugagguuggauggaucu

SEQ ID NO: 40936 - RNA, 22 nt, Homo sapiens
cuuugcaaauggccuuuccaag

SEQ ID NO: 40937 - RNA, 20 nt, Homo sapiens
cuuuggcaaugagaacaggg

SEQ ID NO: 40938 - RNA, 22 nt, Homo sapiens
cuuuggucaauugcugcgggga

SEQ ID NO: 40939 - RNA, 22 nt, Homo sapiens
cuuuuacacugguggugggaau

SEQ ID NO: 40940 - RNA, 22 nt, Homo sapiens
gaagacauuuacaugggagacc

SEQ ID NO: 40941 - RNA, 22 nt, Homo sapiens
gaagcagcauucugguuuuugg

SEQ ID NO: 40942 - RNA, 22 nt, Homo sapiens
gaaucacagauuaugaguaucu

SEQ ID NO: 40943 - RNA, 22 nt, Homo sapiens
gaaugauacuguuaacgaaaga

SEQ ID NO: 40944 - RNA, 22 nt, Homo sapiens
gacaucauuaugagauuuaaac

SEQ ID NO: 40945 - RNA, 22 nt, Homo sapiens
gacauguuucucucuguuuacu

SEQ ID NO: 40946 - RNA, 22 nt, Homo sapiens
gacauguuuucaagauuuauaa

SEQ ID NO: 40947 - RNA, 22 nt, Homo sapiens
gacccuguugggguuuagggcu

SEQ ID NO: 40948 - RNA, 22 nt, Homo sapiens
gacuaggagauauguuuucuuc

SEQ ID NO: 40949 - RNA, 22 nt, Homo sapiens
gacucuguagacaaucacaucu

SEQ ID NO: 40950 - RNA, 22 nt, Homo sapiens
gacuucaucauacuaugugugg

SEQ ID NO: 40951 - RNA, 22 nt, Homo sapiens
gagaacugacauuaucguguau

SEQ ID NO: 40952 - RNA, 21 nt, Homo sapiens
gagaaucaucauggcugcaua

SEQ ID NO: 40953 - RNA, 22 nt, Homo sapiens
gagacggagucucgcucuguca

SEQ ID NO: 40954 - RNA, 22 nt, Homo sapiens
gagacucuuagauuggaaaucu

SEQ ID NO: 40955 - RNA, 22 nt, Homo sapiens
gagacugagucuugcucugucg

SEQ ID NO: 40956 - RNA, 22 nt, Homo sapiens
gagauggagucuuuuucuguca

SEQ ID NO: 40957 - RNA, 22 nt, Homo sapiens
gagaugguguuccacugccagu

SEQ ID NO: 40958 - RNA, 22 nt, Homo sapiens
gagauugucaugauuacauugu

SEQ ID NO: 40959 - RNA, 22 nt, Homo sapiens
gagcaguugagagugcuggcca

SEQ ID NO: 40960 - RNA, 22 nt, Homo sapiens
gagcaucaguggccucaucuca

SEQ ID NO: 40961 - RNA, 22 nt, Homo sapiens
gagcucguuuuugcugacucuu

SEQ ID NO: 40962 - RNA, 22 nt, Homo sapiens
gagguggauacauuaaauaaug

SEQ ID NO: 40963 - RNA, 22 nt, Homo sapiens
gagguggugguggaggcauagc

SEQ ID NO: 40964 - RNA, 22 nt, Homo sapiens
gagguguagagauauaccugaa

SEQ ID NO: 40965 - RNA, 23 nt, Homo sapiens
gagugcaaugacaugaucucgga

SEQ ID NO: 40966 - RNA, 22 nt, Homo sapiens
gagugcaauggcaugaucuugg

SEQ ID NO: 40967 - RNA, 22 nt, Homo sapiens
gagugcauaugggccuguguca

SEQ ID NO: 40968 - RNA, 22 nt, Homo sapiens
gagugcugagcccacuuccuug

SEQ ID NO: 40969 - RNA, 22 nt, Homo sapiens
gaguucauaucuaugagugugc

SEQ ID NO: 40970 - RNA, 22 nt, Homo sapiens
gauaugaguagucgcauugaug

SEQ ID NO: 40971 - RNA, 22 nt, Homo sapiens
gauauguguaucuauguacaug

SEQ ID NO: 40972 - RNA, 22 nt, Homo sapiens
gaucacuuugaugccaggaacu

SEQ ID NO: 40973 - RNA, 22 nt, Homo sapiens
gaucuguuucaauugucuuagu

SEQ ID NO: 40974 - RNA, 22 nt, Homo sapiens
gaugcaguaagaaugcauagcg

SEQ ID NO: 40975 - RNA, 22 nt, Homo sapiens
gauguagaaagagugggcugga

SEQ ID NO: 40976 - RNA, 22 nt, Homo sapiens
gauguguugggaagauuucaag

SEQ ID NO: 40977 - RNA, 22 nt, Homo sapiens
gauuccauuuguggcuauuuac

SEQ ID NO: 40978 - RNA, 22 nt, Homo sapiens
gauuuuccaguggcccugauca

SEQ ID NO: 40979 - RNA, 20 nt, Homo sapiens
gcaaauggaucccacaagcc

SEQ ID NO: 40980 - RNA, 22 nt, Homo sapiens
gcaagaaucugggaguaaaauu

SEQ ID NO: 40981 - RNA, 22 nt, Homo sapiens
gcacaguggcucccgucuauaa

SEQ ID NO: 40982 - RNA, 22 nt, Homo sapiens
gcacauuacaaguauuagcuca

SEQ ID NO: 40983 - RNA, 19 nt, Homo sapiens
gcagagaugugguagcuug

SEQ ID NO: 40984 - RNA, 22 nt, Homo sapiens
gcaguguggguagagggcaaga

SEQ ID NO: 40985 - RNA, 20 nt, Homo sapiens
gcaguguucacuguauuccu

SEQ ID NO: 40986 - RNA, 22 nt, Homo sapiens
gcccuguugcccaggcuggagu

SEQ ID NO: 40987 - RNA, 22 nt, Homo sapiens
gcucaaguaauggcaguuuugc

SEQ ID NO: 40988 - RNA, 22 nt, Homo sapiens
gcuccauuuuccauuucucuaa

SEQ ID NO: 40989 - RNA, 22 nt, Homo sapiens
gcucguuuuugccucugguugc

SEQ ID NO: 40990 - RNA, 22 nt, Homo sapiens
gcugagaucucuugccugaacu

SEQ ID NO: 40991 - RNA, 22 nt, Homo sapiens
gcugcuguaccagaugugguua

SEQ ID NO: 40992 - RNA, 22 nt, Homo sapiens
gcuggguucagagugggcugcg

SEQ ID NO: 40993 - RNA, 22 nt, Homo sapiens
gcuguaguugaggauuuuaaga

SEQ ID NO: 40994 - RNA, 22 nt, Homo sapiens
gcugucuggagucuguucaaug

SEQ ID NO: 40995 - RNA, 22 nt, Homo sapiens
gcuuggugugcaagugguacua

SEQ ID NO: 40996 - RNA, 22 nt, Homo sapiens
gcuuguguuuacuguaguuacu

SEQ ID NO: 40997 - RNA, 22 nt, Homo sapiens
gcuuuguugauggugagucugu

SEQ ID NO: 40998 - RNA, 22 nt, Homo sapiens
ggaagaauaaugggccuuagag

SEQ ID NO: 40999 - RNA, 22 nt, Homo sapiens
ggaagaauauuaggggauuucg

SEQ ID NO: 41000 - RNA, 22 nt, Homo sapiens
ggaaguuaauacagauagagua

SEQ ID NO: 41001 - RNA, 22 nt, Homo sapiens
ggacagugaaugccacuccucc

SEQ ID NO: 41002 - RNA, 22 nt, Homo sapiens
cacauugaauuucugaugacaa

SEQ ID NO: 41003 - RNA, 22 nt, Homo sapiens
caccaaccucaguagcaucugu

SEQ ID NO: 41004 - RNA, 22 nt, Homo sapiens
caccagguuggagugcaguggu

SEQ ID NO: 41005 - RNA, 22 nt, Homo sapiens
cacugcacuccagucugacgac

SEQ ID NO: 41006 - RNA, 22 nt, Homo sapiens
cacugcauccuccauauccugg

SEQ ID NO: 41007 - RNA, 22 nt, Homo sapiens
cacugcauucuccaccucccag

SEQ ID NO: 41008 - RNA, 22 nt, Homo sapiens
cacugcgaccuccaccucccgg

SEQ ID NO: 41009 - RNA, 22 nt, Homo sapiens
cacugcgacguccgccucccgg

SEQ ID NO: 41010 - RNA, 17 nt, Homo sapiens
cacugggugcaagagga

SEQ ID NO: 41011 - RNA, 22 nt, Homo sapiens
cacugggugccauauguuugcu

SEQ ID NO: 41012 - RNA, 22 nt, Homo sapiens
cacuuugguucaccugaguuuc

SEQ ID NO: 41013 - RNA, 22 nt, Homo sapiens
cagagagcuugcccuuguauau

SEQ ID NO: 41014 - RNA, 22 nt, Homo sapiens
cagccgggugagguggcuuguu

SEQ ID NO: 41015 - RNA, 22 nt, Homo sapiens
cagcuaaauuguuaaauccaag

SEQ ID NO: 41016 - RNA, 22 nt, Homo sapiens
cagcuaguaauuuauugaagau

SEQ ID NO: 41017 - RNA, 22 nt, Homo sapiens
cagcuguguuauaaacuaccau

SEQ ID NO: 41018 - RNA, 22 nt, Homo sapiens
cagcuugugguauugcugguug

SEQ ID NO: 41019 - RNA, 22 nt, Homo sapiens
caggcaaggugaaguguacugg

SEQ ID NO: 41020 - RNA, 22 nt, Homo sapiens
caggcagucuggcucccaagug

SEQ ID NO: 41021 - RNA, 22 nt, Homo sapiens
caggcagucuggggguguaucc

SEQ ID NO: 41022 - RNA, 22 nt, Homo sapiens
caggcauuguccaugcugaagg

SEQ ID NO: 41023 - RNA, 22 nt, Homo sapiens
caggugguauuugguuuucugu

SEQ ID NO: 41024 - RNA, 22 nt, Homo sapiens
caguagcaugccucagaaugag

SEQ ID NO: 41025 - RNA, 19 nt, Homo sapiens
caguaucauugcacauagu

SEQ ID NO: 41026 - RNA, 22 nt, Homo sapiens
cagugcaaagccucugcccaga

SEQ ID NO: 41027 - RNA, 22 nt, Homo sapiens
cagugcauaggaucuaaaauuu

SEQ ID NO: 41028 - RNA, 22 nt, Homo sapiens
cagugcuuguuauuguucuauu

SEQ ID NO: 41029 - RNA, 22 nt, Homo sapiens
cauacagcuaguaaguguaaga

SEQ ID NO: 41030 - RNA, 22 nt, Homo sapiens
caucccugaaccccagaaaucu

SEQ ID NO: 41031 - RNA, 22 nt, Homo sapiens
caugacacuggcauguuucuuu

SEQ ID NO: 41032 - RNA, 22 nt, Homo sapiens
caugcacugaguccaccucugg

SEQ ID NO: 41033 - RNA, 22 nt, Homo sapiens
caugccacugcacgccauccug

SEQ ID NO: 41034 - RNA, 22 nt, Homo sapiens
caugucacuuccucucugaugg

SEQ ID NO: 41035 - RNA, 22 nt, Homo sapiens
caugucuuuuaaacauucaacu

SEQ ID NO: 41036 - RNA, 22 nt, Homo sapiens
cauugcacuccacuccugaaca

SEQ ID NO: 41037 - RNA, 22 nt, Homo sapiens
cauugcacuccagcccagguga

SEQ ID NO: 41038 - RNA, 22 nt, Homo sapiens
cauugcacuccagccugccugg

SEQ ID NO: 41039 - RNA, 22 nt, Homo sapiens
cauugcacuccagucugggcaa

SEQ ID NO: 41040 - RNA, 22 nt, Homo sapiens
cauugcacucuagccucggcaa

SEQ ID NO: 41041 - RNA, 22 nt, Homo sapiens
cauugcaguggaguggggaaga

SEQ ID NO: 41042 - RNA, 22 nt, Homo sapiens
cauugcauuuucuuuguaccuu

SEQ ID NO: 41043 - RNA, 22 nt, Homo sapiens
ccaaguguuuucauuguuccau

SEQ ID NO: 41044 - RNA, 22 nt, Homo sapiens
ccacauuggaaaggaucccccc

SEQ ID NO: 41045 - RNA, 22 nt, Homo sapiens
ccauggcuucugcauucuguca

SEQ ID NO: 41046 - RNA, 22 nt, Homo sapiens
cccagagacagaaugauaaacu

SEQ ID NO: 41047 - RNA, 18 nt, Homo sapiens
cccagugacuuauggccu

SEQ ID NO: 41048 - RNA, 22 nt, Homo sapiens
cccagugugcugggugacagcu

SEQ ID NO: 41049 - RNA, 17 nt, Homo sapiens
ccccugagcgaugcagu

SEQ ID NO: 41050 - RNA, 22 nt, Homo sapiens
cccucauucauucauccuaugu

SEQ ID NO: 41051 - RNA, 21 nt, Homo sapiens
ccugauguucacuuggccuuc

SEQ ID NO: 41052 - RNA, 22 nt, Homo sapiens
ccuggcaagagacugaagauag

SEQ ID NO: 41053 - RNA, 18 nt, Homo sapiens
ccuuaguuauagagaguc

SEQ ID NO: 41054 - RNA, 22 nt, Homo sapiens
cggcaguggguaagccaagcuu

SEQ ID NO: 41055 - RNA, 22 nt, Homo sapiens
cuaaaacuuucugagugcagca

SEQ ID NO: 41056 - RNA, 16 nt, Homo sapiens
cuaaaaugucuacuug

SEQ ID NO: 41057 - RNA, 17 nt, Homo sapiens
cuaaggcaagagucugc

SEQ ID NO: 41058 - RNA, 22 nt, Homo sapiens
cuagcagacacuuccagagagu

SEQ ID NO: 41059 - RNA, 22 nt, Homo sapiens
cuagcagcaugagaauggacca

SEQ ID NO: 41060 - RNA, 22 nt, Homo sapiens
cuaugucuuucauauuuugggg

SEQ ID NO: 41061 - RNA, 22 nt, Homo sapiens
cucaaagucaagggaaagcagg

SEQ ID NO: 41062 - RNA, 22 nt, Homo sapiens
cucaaguacaugggauuacagg

SEQ ID NO: 41063 - RNA, 22 nt, Homo sapiens
cucacagucagaagggacuugc

SEQ ID NO: 41064 - RNA, 22 nt, Homo sapiens
cucacagugacacgaaccccca

SEQ ID NO: 41065 - RNA, 22 nt, Homo sapiens
cucacuaggaaguaaaguuugu

SEQ ID NO: 41066 - RNA, 22 nt, Homo sapiens
cucacugucaacauguauuugg

SEQ ID NO: 41067 - RNA, 22 nt, Homo sapiens
cucagugucuggcacacagaaa

SEQ ID NO: 41068 - RNA, 22 nt, Homo sapiens
cuccaggugucauccaccuccu

SEQ ID NO: 41069 - RNA, 22 nt, Homo sapiens
cucccugagccagggcuuugac

SEQ ID NO: 41070 - RNA, 22 nt, Homo sapiens
cucucuguuugucuguuauugg

SEQ ID NO: 41071 - RNA, 22 nt, Homo sapiens
cucugguuaaggcugaacuaua

SEQ ID NO: 41072 - RNA, 22 nt, Homo sapiens
cucuuuuguuuagcugagaggg

SEQ ID NO: 41073 - RNA, 22 nt, Homo sapiens
cugaaaguuauucaggggcaag

SEQ ID NO: 41074 - RNA, 22 nt, Homo sapiens
cugaauagucaacgauggacug

SEQ ID NO: 41075 - RNA, 22 nt, Homo sapiens
cugagagugguauguuuaagug

SEQ ID NO: 41076 - RNA, 22 nt, Homo sapiens
cugaggguagaaggaucacuug

SEQ ID NO: 41077 - RNA, 22 nt, Homo sapiens
cugagguaggcccugagaauau

SEQ ID NO: 41078 - RNA, 22 nt, Homo sapiens
cugaggucugaauccagguauc

SEQ ID NO: 41079 - RNA, 22 nt, Homo sapiens
cugcauuagucuguuuaguguu

SEQ ID NO: 41080 - RNA, 22 nt, Homo sapiens
cugcauuugaugacguauggug

SEQ ID NO: 41081 - RNA, 22 nt, Homo sapiens
cugccuaaagaaaaagacguug

SEQ ID NO: 41082 - RNA, 22 nt, Homo sapiens
cugccuagauguuguagggggu

SEQ ID NO: 41083 - RNA, 22 nt, Homo sapiens
cuggaaugcagcuuuaggggcu

SEQ ID NO: 41084 - RNA, 22 nt, Homo sapiens
cuggagcauugguggauuuguu

SEQ ID NO: 41085 - RNA, 19 nt, Homo sapiens
cuggcaaaugcuuuggcca

SEQ ID NO: 41086 - RNA, 22 nt, Homo sapiens
cuggcagugcuuguuauccugg

SEQ ID NO: 41087 - RNA, 22 nt, Homo sapiens
cuggcccaguucugcguuuugc

SEQ ID NO: 41088 - RNA, 22 nt, Homo sapiens
cuguacucaucccauaugcacu

SEQ ID NO: 41089 - RNA, 22 nt, Homo sapiens
cugucacuggggcacauguccc

SEQ ID NO: 41090 - RNA, 22 nt, Homo sapiens
cugucucagugaauugguuuua

SEQ ID NO: 41091 - RNA, 22 nt, Homo sapiens
cugugcaaagcgcucucggggu

SEQ ID NO: 41092 - RNA, 22 nt, Homo sapiens
cugugccaagcuugcgaugugc

SEQ ID NO: 41093 - RNA, 22 nt, Homo sapiens
cugugcuugauuauaugagugu

SEQ ID NO: 41094 - RNA, 22 nt, Homo sapiens
cugugguuacguucuuugugcu

SEQ ID NO: 41095 - RNA, 22 nt, Homo sapiens
cuguugcaguuauggcugcagg

SEQ ID NO: 41096 - RNA, 22 nt, Homo sapiens
cuguuugauuaagugguggaaa

SEQ ID NO: 41097 - RNA, 22 nt, Homo sapiens
acaucacuguuugauugauuga

SEQ ID NO: 41098 - RNA, 22 nt, Homo sapiens
acaucauugggggcuacaggug

SEQ ID NO: 41099 - RNA, 21 nt, Homo sapiens
acauguacacauguaugcaca

SEQ ID NO: 41100 - RNA, 22 nt, Homo sapiens
accacagugcuuccugcucacg

SEQ ID NO: 41101 - RNA, 22 nt, Homo sapiens
acccaguguucaacauucacau

SEQ ID NO: 41102 - RNA, 21 nt, Homo sapiens
acccucuaguuuucaacaggc

SEQ ID NO: 41103 - RNA, 19 nt, Homo sapiens
acccuguccccaccuuuac

SEQ ID NO: 41104 - RNA, 22 nt, Homo sapiens
accgaguguucucccgcagcgg

SEQ ID NO: 41105 - RNA, 22 nt, Homo sapiens
acuacaugugaugucaguauau

SEQ ID NO: 41106 - RNA, 22 nt, Homo sapiens
acucagagugggccccuagaua

SEQ ID NO: 41107 - RNA, 22 nt, Homo sapiens
uaaauggauauugccaucuccu

SEQ ID NO: 41108 - RNA, 22 nt, Homo sapiens
uaacaccuugcucugucaauaa

SEQ ID NO: 41109 - RNA, 22 nt, Homo sapiens
uaacaccuuugauagcacuuuu

SEQ ID NO: 41110 - RNA, 22 nt, Homo sapiens
uaacaguguauuccuuuggaca

SEQ ID NO: 41111 - RNA, 22 nt, Homo sapiens
uaacccuuacaacuacacucgu

SEQ ID NO: 41112 - RNA, 22 nt, Homo sapiens
uaacucugccuagugacauggu

SEQ ID NO: 41113 - RNA, 22 nt, Homo sapiens
uaacugcaaccucugccugcug

SEQ ID NO: 41114 - RNA, 22 nt, Homo sapiens
uaaguugcagguugugauucca

SEQ ID NO: 41115 - RNA, 22 nt, Homo sapiens
uaauagcaguguuacuaggacu

SEQ ID NO: 41116 - RNA, 22 nt, Homo sapiens
uaaugcaucaugguuggcaaac

SEQ ID NO: 41117 - RNA, 22 nt, Homo sapiens
uacaacacugguucgacaugug

SEQ ID NO: 41118 - RNA, 23 nt, Homo sapiens
uacagcugcagaaucaggcuaag

SEQ ID NO: 41119 - RNA, 22 nt, Homo sapiens
uacagucuggaggccuguguug

SEQ ID NO: 41120 - RNA, 22 nt, Homo sapiens
uacaguguuuugguauuccaca

SEQ ID NO: 41121 - RNA, 19 nt, Homo sapiens
uacaugcagcaggcacgca

SEQ ID NO: 41122 - RNA, 22 nt, Homo sapiens
uaccacaggcuggguaaucuau

SEQ ID NO: 41123 - RNA, 22 nt, Homo sapiens
uacccuguaaucugaaacauga

SEQ ID NO: 41124 - RNA, 22 nt, Homo sapiens
uacucugcaguaauuccagccc

SEQ ID NO: 41125 - RNA, 22 nt, Homo sapiens
uacugcacuccacccuggguga

SEQ ID NO: 41126 - RNA, 22 nt, Homo sapiens
uacugcacuccagccuggguga

SEQ ID NO: 41127 - RNA, 21 nt, Homo sapiens
ugcauacuucucagaugauua

SEQ ID NO: 41128 - RNA, 22 nt, Homo sapiens
ugcauaggcuaaaauccuggcc

SEQ ID NO: 41129 - RNA, 22 nt, Homo sapiens
ugcauaugucuuuauagcagca

SEQ ID NO: 41130 - RNA, 21 nt, Homo sapiens
ugcauauuggaacuuucucuc

SEQ ID NO: 41131 - RNA, 20 nt, Homo sapiens
ugcauguccucacuuacuug

SEQ ID NO: 41132 - RNA, 21 nt, Homo sapiens
ugcauuggagaauguuucuca

SEQ ID NO: 41133 - RNA, 19 nt, Homo sapiens
ugcauugucugggaaaugg

SEQ ID NO: 41134 - RNA, 21 nt, Homo sapiens
ugcauuguugcugagagcagg

SEQ ID NO: 41135 - RNA, 22 nt, Homo sapiens
ugccaggaugaggucaauguuu

SEQ ID NO: 41136 - RNA, 23 nt, Homo sapiens
ugccuagaugcugcccugggaca

SEQ ID NO: 41137 - RNA, 22 nt, Homo sapiens
ugccuaggcuggaguguagugg

SEQ ID NO: 41138 - RNA, 22 nt, Homo sapiens
ugccuaguggaaggagagcaaa

SEQ ID NO: 41139 - RNA, 22 nt, Homo sapiens
ugccugagccagguuuuaggag

SEQ ID NO: 41140 - RNA, 22 nt, Homo sapiens
ugcucaccugcugcucaccucc

SEQ ID NO: 41141 - RNA, 22 nt, Homo sapiens
ugcuugagacacauaugaauuu

SEQ ID NO: 41142 - RNA, 22 nt, Homo sapiens
ugcuuugguagaaaucuuuggu

SEQ ID NO: 41143 - RNA, 21 nt, Homo sapiens
ugcuuuggucauacuucuucc

SEQ ID NO: 41144 - RNA, 22 nt, Homo sapiens
uggaaacuuauguucuucugug

SEQ ID NO: 41145 - RNA, 20 nt, Homo sapiens
uggaaaguaagucaugauau

SEQ ID NO: 41146 - RNA, 22 nt, Homo sapiens
uggaaguaaccaugaauggaau

SEQ ID NO: 41147 - RNA, 22 nt, Homo sapiens
uggaagucuucauuauguauag

SEQ ID NO: 41148 - RNA, 20 nt, Homo sapiens
uggaaucugaagaucucagu

SEQ ID NO: 41149 - RNA, 22 nt, Homo sapiens
uggaauguggacucuuaugggg

SEQ ID NO: 41150 - RNA, 22 nt, Homo sapiens
uggaauguuauggcuuuaaucu

SEQ ID NO: 41151 - RNA, 18 nt, Homo sapiens
uggaauguuuggguuaau

SEQ ID NO: 41152 - RNA, 22 nt, Homo sapiens
uggacaugaagggcacaggagg

SEQ ID NO: 41153 - RNA, 21 nt, Homo sapiens
uggaccccuacuucucaccau

SEQ ID NO: 41154 - RNA, 21 nt, Homo sapiens
uggaccccuuccagucaucau

SEQ ID NO: 41155 - RNA, 22 nt, Homo sapiens
uggagagucauuuauaguauuu

SEQ ID NO: 41156 - RNA, 22 nt, Homo sapiens
uggagguaggacgaagaacucu

SEQ ID NO: 41157 - RNA, 22 nt, Homo sapiens
uggagucuugaugauuuucaaa

SEQ ID NO: 41158 - RNA, 22 nt, Homo sapiens
uggagucuugcucuguugccca

SEQ ID NO: 41159 - RNA, 22 nt, Homo sapiens
uggagugcaauggcaccaucuu

SEQ ID NO: 41160 - RNA, 22 nt, Homo sapiens
uggaguguaauuagccaucagu

SEQ ID NO: 41161 - RNA, 22 nt, Homo sapiens
uggaucauucuuucuugcaggg

SEQ ID NO: 41162 - RNA, 19 nt, Homo sapiens
uggaugacugucugggucu

SEQ ID NO: 41163 - RNA, 22 nt, Homo sapiens
uggauggagaggcuugugaugc

SEQ ID NO: 41164 - RNA, 22 nt, Homo sapiens
uggcaaaaaaccgcaguugccu

SEQ ID NO: 41165 - RNA, 22 nt, Homo sapiens
uggcaaaauauuuugguuucug

SEQ ID NO: 41166 - RNA, 22 nt, Homo sapiens
uggcaaaugaaagaaagccagu

SEQ ID NO: 41167 - RNA, 22 nt, Homo sapiens
uggcaaaugugagaugagaacu

SEQ ID NO: 41168 - RNA, 22 nt, Homo sapiens
uggcaagaagagcaugagacca

SEQ ID NO: 41169 - RNA, 22 nt, Homo sapiens
uggcaagagcaaaauguacagu

SEQ ID NO: 41170 - RNA, 22 nt, Homo sapiens
uggcaccauccaggugucucua

SEQ ID NO: 41171 - RNA, 22 nt, Homo sapiens
uggcagcgugaauguggcugaa

SEQ ID NO: 41172 - RNA, 22 nt, Homo sapiens
uggcagcugcuucaugggaugc

SEQ ID NO: 41173 - RNA, 22 nt, Homo sapiens
uggcaggugcacuggcuuugaa

SEQ ID NO: 41174 - RNA, 22 nt, Homo sapiens
uggcaugcauuguggguaauua

SEQ ID NO: 41175 - RNA, 22 nt, Homo sapiens
uggcauggucugcccaaguuuc

SEQ ID NO: 41176 - RNA, 22 nt, Homo sapiens
uggcuacagaaaguacuaguga

SEQ ID NO: 41177 - RNA, 22 nt, Homo sapiens
uggcucuuucuagacuuaauua

SEQ ID NO: 41178 - RNA, 20 nt, Homo sapiens
uggcucuuugcugcuaaagu

SEQ ID NO: 41179 - RNA, 21 nt, Homo sapiens
uggcuguuuucaugcuagaac

SEQ ID NO: 41180 - RNA, 20 nt, Homo sapiens
ugggaaauguccaggacaua

SEQ ID NO: 41181 - RNA, 22 nt, Homo sapiens
ugggaagaagguuuacuugcca

SEQ ID NO: 41182 - RNA, 22 nt, Homo sapiens
ugggaauaugauacaggucuuu

SEQ ID NO: 41183 - RNA, 22 nt, Homo sapiens
ugggagugugcacaauuucagc

SEQ ID NO: 41184 - RNA, 22 nt, Homo sapiens
ugggaugaaaauagcuucuucc

SEQ ID NO: 41185 - RNA, 22 nt, Homo sapiens
uggguagagaaucaggaucuua

SEQ ID NO: 41186 - RNA, 23 nt, Homo sapiens
uggguucccuaagcgcaugcugc

SEQ ID NO: 41187 - RNA, 22 nt, Homo sapiens
ugguaaaaugucauuuaccaga

SEQ ID NO: 41188 - RNA, 18 nt, Homo sapiens
uguaaacuaccucaaccu

SEQ ID NO: 41189 - RNA, 22 nt, Homo sapiens
uguaaaucuuucacaguugaug

SEQ ID NO: 41190 - RNA, 22 nt, Homo sapiens
ugucaaacauuaugaugcucua

SEQ ID NO: 41191 - RNA, 22 nt, Homo sapiens
ugucacaguuuguacuuuauag

SEQ ID NO: 41192 - RNA, 22 nt, Homo sapiens
ugucacuuugccuucuggacuu

SEQ ID NO: 41193 - RNA, 22 nt, Homo sapiens
ugucaguggucuggaugcagcc

SEQ ID NO: 41194 - RNA, 22 nt, Homo sapiens
ugucaugguagcaaggacgagg

SEQ ID NO: 41195 - RNA, 22 nt, Homo sapiens
ugucauguaaagaguaaauggu

SEQ ID NO: 41196 - RNA, 22 nt, Homo sapiens
ugucauguggcuaacgauucau

SEQ ID NO: 41197 - RNA, 22 nt, Homo sapiens
uguccugcagagguguuugccu

SEQ ID NO: 41198 - RNA, 22 nt, Homo sapiens
ugucugagacuguuuuacuuuc

SEQ ID NO: 41199 - RNA, 22 nt, Homo sapiens
ugucuugagagaggacaugacu

SEQ ID NO: 41200 - RNA, 22 nt, Homo sapiens
ugugaagaugagaugacgcccu

SEQ ID NO: 41201 - RNA, 22 nt, Homo sapiens
ugugacagcacagcaucucuuu

SEQ ID NO: 41202 - RNA, 22 nt, Homo sapiens
ugugacuaguggugaaugacgc

SEQ ID NO: 41203 - RNA, 22 nt, Homo sapiens
ugugaucaauuagugaugucug

SEQ ID NO: 41204 - RNA, 22 nt, Homo sapiens
ugugaugugaugagaaguuccu

SEQ ID NO: 41205 - RNA, 22 nt, Homo sapiens
ugugauuauuuauagacaguca

SEQ ID NO: 41206 - RNA, 22 nt, Homo sapiens
ugugcaaggcucucaaccugug

SEQ ID NO: 41207 - RNA, 22 nt, Homo sapiens
ugugcaaucagcuucauuacau

SEQ ID NO: 41208 - RNA, 23 nt, Homo sapiens
ugugcacauuuacauauauacac

SEQ ID NO: 41209 - RNA, 22 nt, Homo sapiens
ugugcaugacagcauacaaacg

SEQ ID NO: 41210 - RNA, 21 nt, Homo sapiens
uguggcaauggccucacagau

SEQ ID NO: 41211 - RNA, 22 nt, Homo sapiens
uguggucaucacuugaagguaa

SEQ ID NO: 41212 - RNA, 22 nt, Homo sapiens
ugugguuuuaguaaaacuaugu

SEQ ID NO: 41213 - RNA, 22 nt, Homo sapiens
ugugucuuguuuuuucccaggc

SEQ ID NO: 41214 - RNA, 22 nt, Homo sapiens
uguucuggagaguuuagucugg

SEQ ID NO: 41215 - RNA, 22 nt, Homo sapiens
uguugccacuguuauuaaccua

SEQ ID NO: 41216 - RNA, 22 nt, Homo sapiens
uguuugguggucucuucacaug

SEQ ID NO: 41217 - RNA, 22 nt, Homo sapiens
uuaaucacagcugaacucaaac

SEQ ID NO: 41218 - RNA, 22 nt, Homo sapiens
uuaauuguccaaguucaucucu

SEQ ID NO: 41219 - RNA, 21 nt, Homo sapiens
uuacaauggcuccuugaaggu

SEQ ID NO: 41220 - RNA, 22 nt, Homo sapiens
uuacagcugcuccccaucacuc

SEQ ID NO: 41221 - RNA, 22 nt, Homo sapiens
uuacagguggagaaguaaggcu

SEQ ID NO: 41222 - RNA, 22 nt, Homo sapiens
uuacagucuuaggcagugcuuu

SEQ ID NO: 41223 - RNA, 22 nt, Homo sapiens
uuacuugagaugaguuggacaa

SEQ ID NO: 41224 - RNA, 22 nt, Homo sapiens
uuagaacuagaggaguuugagu

SEQ ID NO: 41225 - RNA, 22 nt, Homo sapiens
uuagagcacugaucugcucuuu

SEQ ID NO: 41226 - RNA, 22 nt, Homo sapiens
uuagauuauugagcauccacug

SEQ ID NO: 41227 - RNA, 22 nt, Homo sapiens
uuagcaauugauucucauaagc

SEQ ID NO: 41228 - RNA, 22 nt, Homo sapiens
uuagcacaguucauucauguua

SEQ ID NO: 41229 - RNA, 22 nt, Homo sapiens
uuagcacaucuuucuauguaag

SEQ ID NO: 41230 - RNA, 22 nt, Homo sapiens
uuagcagcaucccuggccugua

SEQ ID NO: 41231 - RNA, 22 nt, Homo sapiens
uuagcagcaugaaaauggacug

SEQ ID NO: 41232 - RNA, 22 nt, Homo sapiens
uuaggcuuuauugaaaacaaua

SEQ ID NO: 41233 - RNA, 22 nt, Homo sapiens
uuaguaguugugauagguaccu

SEQ ID NO: 41234 - RNA, 22 nt, Homo sapiens
uuaguaguuugauaggaauagc

SEQ ID NO: 41235 - RNA, 22 nt, Homo sapiens
uuagugcuuacgaugagcuaag

SEQ ID NO: 41236 - RNA, 22 nt, Homo sapiens
uuauacacugugggaguguaaa

SEQ ID NO: 41237 - RNA, 22 nt, Homo sapiens
uuauccugucaguaaauauuuu

SEQ ID NO: 41238 - RNA, 22 nt, Homo sapiens
uuauucauuaacagggaccaaa

SEQ ID NO: 41239 - RNA, 22 nt, Homo sapiens
uuauugaguaaaaagaaugguu

SEQ ID NO: 41240 - RNA, 22 nt, Homo sapiens
uuauugcacuccagccugggua

SEQ ID NO: 41241 - RNA, 22 nt, Homo sapiens
uuauugcuuuugugcaggugag

SEQ ID NO: 41242 - RNA, 20 nt, Homo sapiens
uucaagugauucucaugccu

SEQ ID NO: 41243 - RNA, 22 nt, Homo sapiens
uucaccuugcccacagcagucu

SEQ ID NO: 41244 - RNA, 22 nt, Homo sapiens
uucaccuugggucccacuugcu

SEQ ID NO: 41245 - RNA, 22 nt, Homo sapiens
uucacugugcuuaaauucugcu

SEQ ID NO: 41246 - RNA, 19 nt, Homo sapiens
uucagcagugucugcucuu

SEQ ID NO: 41247 - RNA, 22 nt, Homo sapiens
uucaguaaauguucuuacuaua

SEQ ID NO: 41248 - RNA, 23 nt, Homo sapiens
uucaguauugaaugauggcgcug

SEQ ID NO: 41249 - RNA, 22 nt, Homo sapiens
uucaguauugcaccuggagucc

SEQ ID NO: 41250 - RNA, 18 nt, Homo sapiens
uucauaguagcaugauuu

SEQ ID NO: 41251 - RNA, 22 nt, Homo sapiens
uucauaguauuuuucuccaaau

SEQ ID NO: 41252 - RNA, 22 nt, Homo sapiens
uucauagugaaaaauucaaagu

SEQ ID NO: 41253 - RNA, 20 nt, Homo sapiens
uucaucaggauauuggucua

SEQ ID NO: 41254 - RNA, 23 nt, Homo sapiens
uucaucagggauauuggccugaa

SEQ ID NO: 41255 - RNA, 18 nt, Homo sapiens
uucaucaguccucagcug

SEQ ID NO: 41256 - RNA, 22 nt, Homo sapiens
uucaucaguugagcugguugcu

SEQ ID NO: 41257 - RNA, 22 nt, Homo sapiens
uucauguaauauuucacagcuu

SEQ ID NO: 41258 - RNA, 22 nt, Homo sapiens
uuccaauguuccguguugcagu

SEQ ID NO: 41259 - RNA, 22 nt, Homo sapiens
uuccacagggauuugcauugau

SEQ ID NO: 41260 - RNA, 20 nt, Homo sapiens
uuccagcacauuagggaagc

SEQ ID NO: 41261 - RNA, 22 nt, Homo sapiens
uuccaguggacuacuucauccu

SEQ ID NO: 41262 - RNA, 22 nt, Homo sapiens
uuccaugagaugcaucaaagcu

SEQ ID NO: 41263 - RNA, 22 nt, Homo sapiens
uuccaugugggcuugucaagua

SEQ ID NO: 41264 - RNA, 22 nt, Homo sapiens
uuccauguugauacgugaaguu

SEQ ID NO: 41265 - RNA, 22 nt, Homo sapiens
uucccucagaaacacacagccc

SEQ ID NO: 41266 - RNA, 22 nt, Homo sapiens
uucccugaguaucuuaccaugg

SEQ ID NO: 41267 - RNA, 22 nt, Homo sapiens
uucccugugguauagaagccgu

SEQ ID NO: 41268 - RNA, 22 nt, Homo sapiens
uucccugugugcagaugggugu

SEQ ID NO: 41269 - RNA, 22 nt, Homo sapiens
uuccugagccuuguaucuagua

SEQ ID NO: 41270 - RNA, 22 nt, Homo sapiens
uuccuugagaaaguacaaggcu

SEQ ID NO: 41271 - RNA, 22 nt, Homo sapiens
uuccuugagagcuugauaucac

SEQ ID NO: 41272 - RNA, 22 nt, Homo sapiens
uucuacaggcuguucaagaagc

SEQ ID NO: 41273 - RNA, 22 nt, Homo sapiens
uucuauggucacagaugcuuga

SEQ ID NO: 41274 - RNA, 22 nt, Homo sapiens
uucucacaguacagggagcucu

SEQ ID NO: 41275 - RNA, 17 nt, Homo sapiens
uucucaguucugaucuc

SEQ ID NO: 41276 - RNA, 22 nt, Homo sapiens
uucucgcuuuuuccaccuguau

SEQ ID NO: 41277 - RNA, 22 nt, Homo sapiens
uucugacuggugugagauggua

SEQ ID NO: 41278 - RNA, 22 nt, Homo sapiens
uucugaguggcuuucaacacug

SEQ ID NO: 41279 - RNA, 22 nt, Homo sapiens
uucuguguuuaggucacggcua

SEQ ID NO: 41280 - RNA, 22 nt, Homo sapiens
uucuucaguuacaacaaggggg

SEQ ID NO: 41281 - RNA, 20 nt, Homo sapiens
uucuugaguuaacaaguuac

SEQ ID NO: 41282 - RNA, 22 nt, Homo sapiens
uucuuugcaugaucucaaaguc

SEQ ID NO: 41283 - RNA, 22 nt, Homo sapiens
uugaaagcuaucagagauucca

SEQ ID NO: 41284 - RNA, 22 nt, Homo sapiens
uugaaagucuaggcuuacagua

SEQ ID NO: 41285 - RNA, 22 nt, Homo sapiens
uugaacuguaagggucugugug

SEQ ID NO: 41286 - RNA, 22 nt, Homo sapiens
uugaagacuaaguuaucaggau

SEQ ID NO: 41287 - RNA, 22 nt, Homo sapiens
uugaaguagcauuucaugucua

SEQ ID NO: 41288 - RNA, 22 nt, Homo sapiens
uugaaguaggaaaggaggaggu

SEQ ID NO: 41289 - RNA, 22 nt, Homo sapiens
uugaaguaguacuuuauuauag

SEQ ID NO: 41290 - RNA, 22 nt, Homo sapiens
uugaauagacagccagcuuuaa

SEQ ID NO: 41291 - RNA, 18 nt, Homo sapiens
uugaauagagccaagcac

SEQ ID NO: 41292 - RNA, 22 nt, Homo sapiens
uugacaaggagccauugcaucu

SEQ ID NO: 41293 - RNA, 22 nt, Homo sapiens
uugacaaggagugggguugaga

SEQ ID NO: 41294 - RNA, 20 nt, Homo sapiens
uugacaguggguuguuaaag

SEQ ID NO: 41295 - RNA, 22 nt, Homo sapiens
uugacauauguguguccacaua

SEQ ID NO: 41296 - RNA, 22 nt, Homo sapiens
uugacauguaaguacucuauag

SEQ ID NO: 41297 - RNA, 22 nt, Homo sapiens
uugacuacaccaugccaggaac

SEQ ID NO: 41298 - RNA, 22 nt, Homo sapiens
uugacuucagagcugauucaag

SEQ ID NO: 41299 - RNA, 22 nt, Homo sapiens
uugacuuuuaggaggaaaauga

SEQ ID NO: 41300 - RNA, 22 nt, Homo sapiens
uugagauacauaauuaugaaug

SEQ ID NO: 41301 - RNA, 22 nt, Homo sapiens
uugagauggagucucguucugu

SEQ ID NO: 41302 - RNA, 22 nt, Homo sapiens
uugagauggagucuuguucucu

SEQ ID NO: 41303 - RNA, 22 nt, Homo sapiens
uugagauggagucuuguucuuu

SEQ ID NO: 41304 - RNA, 22 nt, Homo sapiens
uugagauguaagauguuaauau

SEQ ID NO: 41305 - RNA, 22 nt, Homo sapiens
uugagcaauccuccugccaugu

SEQ ID NO: 41306 - RNA, 22 nt, Homo sapiens
uugagcacauguguuaaggggu

SEQ ID NO: 41307 - RNA, 22 nt, Homo sapiens
uugagcauugguauagguuuua

SEQ ID NO: 41308 - RNA, 22 nt, Homo sapiens
uugagcucuuccagccuggagc

SEQ ID NO: 41309 - RNA, 22 nt, Homo sapiens
uugaggaggcagucucuccauu

SEQ ID NO: 41310 - RNA, 22 nt, Homo sapiens
uugagggaggcagggcuugucu

SEQ ID NO: 41311 - RNA, 22 nt, Homo sapiens
uugagguauugauaaaacauuu

SEQ ID NO: 41312 - RNA, 22 nt, Homo sapiens
uugaguaguaagugguucaccg

SEQ ID NO: 41313 - RNA, 22 nt, Homo sapiens
uugauacuagagucuuucugac

SEQ ID NO: 41314 - RNA, 22 nt, Homo sapiens
uugauagacacauauccaugug

SEQ ID NO: 41315 - RNA, 22 nt, Homo sapiens
uugauaguuuuaaaauuaaucu

SEQ ID NO: 41316 - RNA, 22 nt, Homo sapiens
uugauauuacucaguaacagau

SEQ ID NO: 41317 - RNA, 22 nt, Homo sapiens
uugauauucugagaagcugaag

SEQ ID NO: 41318 - RNA, 22 nt, Homo sapiens
uugaugauguuucugccuugcc

SEQ ID NO: 41319 - RNA, 22 nt, Homo sapiens
uugauguugaggacauaaaccu

SEQ ID NO: 41320 - RNA, 22 nt, Homo sapiens
uugcaaaguugccaaggaagga

SEQ ID NO: 41321 - RNA, 22 nt, Homo sapiens
uugcacauugauuuuguaucuu

SEQ ID NO: 41322 - RNA, 22 nt, Homo sapiens
uugcacuccagccugggugaca

SEQ ID NO: 41323 - RNA, 22 nt, Homo sapiens
uugcagcaaauaggaaugagga

SEQ ID NO: 41324 - RNA, 22 nt, Homo sapiens
uugcaucagcuccugauguacu

SEQ ID NO: 41325 - RNA, 22 nt, Homo sapiens
uugcaugcacaguucucaauag

SEQ ID NO: 41326 - RNA, 22 nt, Homo sapiens
uugcaugucugcuucuccuccu

SEQ ID NO: 41327 - RNA, 22 nt, Homo sapiens
uugccuaggcuggagugcagua

SEQ ID NO: 41328 - RNA, 23 nt, Homo sapiens
uuggaaugagaccuaagaguuuu

SEQ ID NO: 41329 - RNA, 22 nt, Homo sapiens
uuggaauguauggcaucuugcg

SEQ ID NO: 41330 - RNA, 22 nt, Homo sapiens
uuggagugugagagcagccugg

SEQ ID NO: 41331 - RNA, 22 nt, Homo sapiens
uuggauauucaguuuuuccauc

SEQ ID NO: 41332 - RNA, 22 nt, Homo sapiens
uuggcaagaauguaugccgauc

SEQ ID NO: 41333 - RNA, 22 nt, Homo sapiens
uuggcaagcuguuaauuauaaa

SEQ ID NO: 41334 - RNA, 22 nt, Homo sapiens
uuggcagcacgcaguccagagg

SEQ ID NO: 41335 - RNA, 22 nt, Homo sapiens
uuggcagcuguggaaucugggc

SEQ ID NO: 41336 - RNA, 22 nt, Homo sapiens
uuggcauagaggcucucaagcu

SEQ ID NO: 41337 - RNA, 22 nt, Homo sapiens
uuggcauuguggauggaaucau

SEQ ID NO: 41338 - RNA, 22 nt, Homo sapiens
uuggcuucuggacuauugugca

SEQ ID NO: 41339 - RNA, 22 nt, Homo sapiens
uugggcaauaggaagcaggugg

SEQ ID NO: 41340 - RNA, 22 nt, Homo sapiens
uuggguccucugguccuugguu

SEQ ID NO: 41341 - RNA, 22 nt, Homo sapiens
uugguccucccaugcucaagag

SEQ ID NO: 41342 - RNA, 21 nt, Homo sapiens
uuguagcagcauaaucccaga

SEQ ID NO: 41343 - RNA, 22 nt, Homo sapiens
uuguccacugcuagccucugca

SEQ ID NO: 41344 - RNA, 19 nt, Homo sapiens
uugucuuagaguugucauu

SEQ ID NO: 41345 - RNA, 22 nt, Homo sapiens
uugugaaugaugccgcaauaaa

SEQ ID NO: 41346 - RNA, 22 nt, Homo sapiens
uugugguugaugaagacugucu

SEQ ID NO: 41347 - RNA, 22 nt, Homo sapiens
uuguuauguuggucaguaaugu

SEQ ID NO: 41348 - RNA, 22 nt, Homo sapiens
uuuauugcucuaaaguugccau

SEQ ID NO: 41349 - RNA, 22 nt, Homo sapiens
uuucaguagagacacgguuuug

SEQ ID NO: 41350 - RNA, 16 nt, Homo sapiens
uuucaucaguuuuaau

SEQ ID NO: 41351 - RNA, 22 nt, Homo sapiens
uuucauggacgcaaugccuuuu

SEQ ID NO: 41352 - RNA, 22 nt, Homo sapiens
uuucuacagggcuugccaggua

SEQ ID NO: 41353 - RNA, 22 nt, Homo sapiens
uuucuuggagcucuuagggucg

SEQ ID NO: 41354 - RNA, 19 nt, Homo sapiens
uuugaauauaaugcagcua

SEQ ID NO: 41355 - RNA, 22 nt, Homo sapiens
uuugagcauggaaauggcauga

SEQ ID NO: 41356 - RNA, 22 nt, Homo sapiens
uuugagcuagagucucacucug

SEQ ID NO: 41357 - RNA, 21 nt, Homo sapiens
uuugaucauuaaaagugaauc

SEQ ID NO: 41358 - RNA, 22 nt, Homo sapiens
uuugcagugucagcuucugugu

SEQ ID NO: 41359 - RNA, 22 nt, Homo sapiens
uuugcaguuuauuccuggggcu

SEQ ID NO: 41360 - RNA, 23 nt, Homo sapiens
uuugccacuuauuagcugggagg

SEQ ID NO: 41361 - RNA, 22 nt, Homo sapiens
uuuggcagaaaacuaaaaggua

SEQ ID NO: 41362 - RNA, 22 nt, Homo sapiens
uuuggcauauuuuaagcugguu

SEQ ID NO: 41363 - RNA, 22 nt, Homo sapiens
uuuggcauuaagaugcuguauc

SEQ ID NO: 41364 - RNA, 22 nt, Homo sapiens
uuuggccauaauuuuaauuggc

SEQ ID NO: 41365 - RNA, 22 nt, Homo sapiens
uuugguguauauguaaacuaug

SEQ ID NO: 41366 - RNA, 22 nt, Homo sapiens
uuugucuccuaagacucugugg

SEQ ID NO: 41367 - RNA, 22 nt, Homo sapiens
uuuuaacagccaggggacggcc

SEQ ID NO: 41368 - RNA, 20 nt, Homo sapiens
uuuuagcacuuguuauggug

SEQ ID NO: 41369 - RNA, 20 nt, Homo sapiens
uuuugcacuccuacuaaggu

SEQ ID NO: 41370 - RNA, 22 nt, Homo sapiens
uuuugcacuguuuuaucugaca

SEQ ID NO: 41371 - RNA, 22 nt, Homo sapiens
uuuuggcuagaaauauaccucc

SEQ ID NO: 41372 - RNA, 22 nt, Homo sapiens
uuuugguauaugcaggggucuu

SEQ ID NO: 41373 - RNA, 22 nt, Homo sapiens
uuuuucacuuaaguuaggcuca

SEQ ID NO: 41374 - RNA, 21 nt, Homo sapiens
uuuuugggcuuucauaguguu

SEQ ID NO: 41375 - RNA, 22 nt, Homo sapiens
uacaaagugggaaacgaagguu

SEQ ID NO: 41376 - RNA, 20 nt, Homo sapiens
uacacguaugagcacaugug

SEQ ID NO: 41377 - RNA, 22 nt, Homo sapiens
uacagaauucugucccuugagu

SEQ ID NO: 41378 - RNA, 22 nt, Homo sapiens
uacaggugcuuauguggacaua

SEQ ID NO: 41379 - RNA, 22 nt, Homo sapiens
uacauccauccugcugggcagu

SEQ ID NO: 41380 - RNA, 22 nt, Homo sapiens
uaccauguauguuucuccauug

SEQ ID NO: 41381 - RNA, 22 nt, Homo sapiens
uacucugcagagaugcauaaca

SEQ ID NO: 41382 - RNA, 22 nt, Homo sapiens
uacugcaucgaaaugcuuuuau

SEQ ID NO: 41383 - RNA, 22 nt, Homo sapiens
uacugcaucuacuuagagccag

SEQ ID NO: 41384 - RNA, 22 nt, Homo sapiens
caaagucuucucauuaugucuu

SEQ ID NO: 41385 - RNA, 22 nt, Homo sapiens
caaaugcuucuauggacugucu

SEQ ID NO: 41386 - RNA, 22 nt, Homo sapiens
caaauugcuugucuguagugga

SEQ ID NO: 41387 - RNA, 22 nt, Homo sapiens
caagaucauuuaugcuaaaauu

SEQ ID NO: 41388 - RNA, 22 nt, Homo sapiens
caagggguggaaaugguagugu

SEQ ID NO: 41389 - RNA, 22 nt, Homo sapiens
caaugguuuuuuaguauaagua

SEQ ID NO: 41390 - RNA, 22 nt, Homo sapiens
cacaccuaccucauuauggaca

SEQ ID NO: 41391 - RNA, 22 nt, Homo sapiens
cacacugucuucauuacuguag

SEQ ID NO: 41392 - RNA, 22 nt, Homo sapiens
cacagcgacuuccgccuaccgg

SEQ ID NO: 41393 - RNA, 22 nt, Homo sapiens
cacaggccugucucuuucuaac

SEQ ID NO: 41394 - RNA, 22 nt, Homo sapiens
uucauaguguuuccuuccagug

SEQ ID NO: 41395 - RNA, 22 nt, Homo sapiens
uucauaguuuauacugauauuu

SEQ ID NO: 41396 - RNA, 21 nt, Homo sapiens
uucaucagccagaaaucaagc

SEQ ID NO: 41397 - RNA, 22 nt, Homo sapiens
uucaucaggaauauugaccugu

SEQ ID NO: 41398 - RNA, 22 nt, Homo sapiens
uucaucagggagaaauaauuuc

SEQ ID NO: 41399 - RNA, 22 nt, Homo sapiens
uucaucagggguauuggccaau

SEQ ID NO: 41400 - RNA, 22 nt, Homo sapiens
uucauccccuccaaaucucaug

SEQ ID NO: 41401 - RNA, 21 nt, Homo sapiens
uucaucuggccguauuccagg

SEQ ID NO: 41402 - RNA, 22 nt, Homo sapiens
uucaugcaucuguagugguuaa

SEQ ID NO: 41403 - RNA, 22 nt, Homo sapiens
uucauggaauauugaccauuuu

SEQ ID NO: 41404 - RNA, 22 nt, Homo sapiens
uucauggacucaauaguuucgc

SEQ ID NO: 41405 - RNA, 22 nt, Homo sapiens
uucauggaguugagaaggcuaa

SEQ ID NO: 41406 - RNA, 22 nt, Homo sapiens
uuccagcugggggcaacucugc

SEQ ID NO: 41407 - RNA, 22 nt, Homo sapiens
uuccaggugggcgugggccugg

SEQ ID NO: 41408 - RNA, 22 nt, Homo sapiens
uuccaguguguucauccucaga

SEQ ID NO: 41409 - RNA, 22 nt, Homo sapiens
uucccuagaacacauggaggga

SEQ ID NO: 41410 - RNA, 22 nt, Homo sapiens
uucccugaaauauucacuuuca

SEQ ID NO: 41411 - RNA, 22 nt, Homo sapiens
uucccugaaguguuacucuaga

SEQ ID NO: 41412 - RNA, 22 nt, Homo sapiens
uucccugagcaucuguugagcc

SEQ ID NO: 41413 - RNA, 22 nt, Homo sapiens
uucccuuucugaaaaucucauu

SEQ ID NO: 41414 - RNA, 22 nt, Homo sapiens
uucccuuugaaacuaaacuugc

SEQ ID NO: 41415 - RNA, 22 nt, Homo sapiens
uucccuuuguuaaauuggaaga

SEQ ID NO: 41416 - RNA, 22 nt, Homo sapiens
uuccuggaggggaaguguccaa

SEQ ID NO: 41417 - RNA, 22 nt, Homo sapiens
uuccuuguagcaaaugcgauga

SEQ ID NO: 41418 - RNA, 22 nt, Homo sapiens
uucuagcacuuugggagacuga

SEQ ID NO: 41419 - RNA, 19 nt, Homo sapiens
uucucugguuguacuaccc

SEQ ID NO: 41420 - RNA, 22 nt, Homo sapiens
uucugccaaucaacccacaucc

SEQ ID NO: 41421 - RNA, 22 nt, Homo sapiens
uucuuagucauguaauagucca

SEQ ID NO: 41422 - RNA, 22 nt, Homo sapiens
uucuuaguggcaccacuuuuuu

SEQ ID NO: 41423 - RNA, 21 nt, Homo sapiens
uucuucaggcagaaggauuau

SEQ ID NO: 41424 - RNA, 22 nt, Homo sapiens
uucuucaggccacaaaaauggu

SEQ ID NO: 41425 - RNA, 22 nt, Homo sapiens
uugaaaguaaacaucacaaaga

SEQ ID NO: 41426 - RNA, 22 nt, Homo sapiens
uugaauagaagguuuuuuguuc

SEQ ID NO: 41427 - RNA, 22 nt, Homo sapiens
uugaauagcauguuuagugcau

SEQ ID NO: 41428 - RNA, 22 nt, Homo sapiens
uugaauaggcucaugcuuauca

SEQ ID NO: 41429 - RNA, 22 nt, Homo sapiens
uugaaugaaaugaugucauuug

SEQ ID NO: 41430 - RNA, 22 nt, Homo sapiens
uugagauagaauaggaauggga

SEQ ID NO: 41431 - RNA, 22 nt, Homo sapiens
uugagaucaugcuacugcacuc

SEQ ID NO: 41432 - RNA, 22 nt, Homo sapiens
uugagaucuacuacuguaggag

SEQ ID NO: 41433 - RNA, 22 nt, Homo sapiens
uugagaucuugauauguuugaa

SEQ ID NO: 41434 - RNA, 22 nt, Homo sapiens
uugagaugaagucuugcucucu

SEQ ID NO: 41435 - RNA, 22 nt, Homo sapiens
uugagaugaaguuuugcucuuu

SEQ ID NO: 41436 - RNA, 22 nt, Homo sapiens
uugagaugauggauaugcuaau

SEQ ID NO: 41437 - RNA, 22 nt, Homo sapiens
uugagauggagucuugcacugu

SEQ ID NO: 41438 - RNA, 22 nt, Homo sapiens
uugagauggagucuugcgcugu

SEQ ID NO: 41439 - RNA, 22 nt, Homo sapiens
uugagauguauguauauaaugu

SEQ ID NO: 41440 - RNA, 22 nt, Homo sapiens
uugagcaacauagugagacugu

SEQ ID NO: 41441 - RNA, 22 nt, Homo sapiens
uugagcaaugaacgauucaggg

SEQ ID NO: 41442 - RNA, 22 nt, Homo sapiens
uugagcacugucugugugcagu

SEQ ID NO: 41443 - RNA, 22 nt, Homo sapiens
uugaggaaugugauuucaaaua

SEQ ID NO: 41444 - RNA, 22 nt, Homo sapiens
uugaggaggcagucuucccauu

SEQ ID NO: 41445 - RNA, 22 nt, Homo sapiens
uugagggagcauuuguuuugag

SEQ ID NO: 41446 - RNA, 22 nt, Homo sapiens
uugaggguggcauauauugauu

SEQ ID NO: 41447 - RNA, 22 nt, Homo sapiens
uugaggucuuugagcaaacgca

SEQ ID NO: 41448 - RNA, 22 nt, Homo sapiens
uugaguuugaguauucuaaagc

SEQ ID NO: 41449 - RNA, 22 nt, Homo sapiens
uugauagaucagggauuugauu

SEQ ID NO: 41450 - RNA, 22 nt, Homo sapiens
uugaucaauagaauacaacaga

SEQ ID NO: 41451 - RNA, 22 nt, Homo sapiens
uugaucuguguuagaagcuaag

SEQ ID NO: 41452 - RNA, 23 nt, Homo sapiens
uugcaaagccugaaacucuucag

SEQ ID NO: 41453 - RNA, 22 nt, Homo sapiens
uugcaaaguuugccuccuguag

SEQ ID NO: 41454 - RNA, 22 nt, Homo sapiens
uugcaagauguuaacauuggag

SEQ ID NO: 41455 - RNA, 22 nt, Homo sapiens
uugcacauggcaggugcucaau

SEQ ID NO: 41456 - RNA, 22 nt, Homo sapiens
uugcacuauuaguauagauguc

SEQ ID NO: 41457 - RNA, 22 nt, Homo sapiens
uugcacuccagcucuaggugac

SEQ ID NO: 41458 - RNA, 23 nt, Homo sapiens
uugcauagacauccucauagauu

SEQ ID NO: 41459 - RNA, 22 nt, Homo sapiens
uugcauagaccgaugucuugga

SEQ ID NO: 41460 - RNA, 22 nt, Homo sapiens
uugccauagugcugccagauau

SEQ ID NO: 41461 - RNA, 22 nt, Homo sapiens
uugccuaguuuaggucugugcu

SEQ ID NO: 41462 - RNA, 22 nt, Homo sapiens
uugcugagucuuucuagguugc

SEQ ID NO: 41463 - RNA, 20 nt, Homo sapiens
uugcugguguuagaggaggc

SEQ ID NO: 41464 - RNA, 22 nt, Homo sapiens
uugcugguuuucauaugagcag

SEQ ID NO: 41465 - RNA, 22 nt, Homo sapiens
uuggaagacaaugcugauucuc

SEQ ID NO: 41466 - RNA, 22 nt, Homo sapiens
uuggaagauuacuuaguuuucu

SEQ ID NO: 41467 - RNA, 22 nt, Homo sapiens
uuggaaugcaacagaaggauaa

SEQ ID NO: 41468 - RNA, 22 nt, Homo sapiens
uuggaauguacucuagccuaug

SEQ ID NO: 41469 - RNA, 22 nt, Homo sapiens
uuggaaugugacugauaauauu

SEQ ID NO: 41470 - RNA, 22 nt, Homo sapiens
uuggagagugauauucagaugc

SEQ ID NO: 41471 - RNA, 22 nt, Homo sapiens
uuggagcccuaacucucaguac

SEQ ID NO: 41472 - RNA, 22 nt, Homo sapiens
uuggaguguucugguccgggcu

SEQ ID NO: 41473 - RNA, 22 nt, Homo sapiens
uuggcaaauagguuuuauugca

SEQ ID NO: 41474 - RNA, 22 nt, Homo sapiens
uuggcaagaaccuucuuccaag

SEQ ID NO: 41475 - RNA, 22 nt, Homo sapiens
uuggccauaugacuugcuuugg

SEQ ID NO: 41476 - RNA, 22 nt, Homo sapiens
uugggacuggaaggaguaaggg

SEQ ID NO: 41477 - RNA, 22 nt, Homo sapiens
uugggauggaacuuuucaguga

SEQ ID NO: 41478 - RNA, 22 nt, Homo sapiens
uugggcauugcuauaaauucuu

SEQ ID NO: 41479 - RNA, 22 nt, Homo sapiens
uugguauguaauuuauauugua

SEQ ID NO: 41480 - RNA, 21 nt, Homo sapiens
uuggucuucucugugauucuu

SEQ ID NO: 41481 - RNA, 22 nt, Homo sapiens
uuguaacaguucugcgagcagc

SEQ ID NO: 41482 - RNA, 22 nt, Homo sapiens
ucccaguggucuugaaacaggg

SEQ ID NO: 41483 - RNA, 22 nt, Homo sapiens
uccccaguaggcaauuaacacc

SEQ ID NO: 41484 - RNA, 19 nt, Homo sapiens
uccccaguuuuccguucag

SEQ ID NO: 41485 - RNA, 19 nt, Homo sapiens
uccccgggucuagugcagc

SEQ ID NO: 41486 - RNA, 22 nt, Homo sapiens
ucccuugagccuggcuucucac

SEQ ID NO: 41487 - RNA, 22 nt, Homo sapiens
uccugagagcagacccucuaua

SEQ ID NO: 41488 - RNA, 22 nt, Homo sapiens
uccuggcuccacuguuuauucc

SEQ ID NO: 41489 - RNA, 22 nt, Homo sapiens
uccuucacucuacaucuuuguu

SEQ ID NO: 41490 - RNA, 22 nt, Homo sapiens
uccuugagaggacagagccaua

SEQ ID NO: 41491 - RNA, 22 nt, Homo sapiens
ucgugccacugcacuccagccu

SEQ ID NO: 41492 - RNA, 22 nt, Homo sapiens
ucuaugguuuauuuccaagugu

SEQ ID NO: 41493 - RNA, 22 nt, Homo sapiens
ucucagcacagucagggcgccu

SEQ ID NO: 41494 - RNA, 21 nt, Homo sapiens
ucucauuacugaugagccaga

SEQ ID NO: 41495 - RNA, 23 nt, Homo sapiens
ucucauuccuugaaaauaaugac

SEQ ID NO: 41496 - RNA, 22 nt, Homo sapiens
ucucccauccaugaacuucugu

SEQ ID NO: 41497 - RNA, 22 nt, Homo sapiens
ucucuggauaucuacuuauguu

SEQ ID NO: 41498 - RNA, 22 nt, Homo sapiens
ucucuguuuagagccagcaauu

SEQ ID NO: 41499 - RNA, 22 nt, Homo sapiens
cauggucaccuuccaaguuauu

SEQ ID NO: 41500 - RNA, 22 nt, Homo sapiens
caugucuuuuauucugugugau

SEQ ID NO: 41501 - RNA, 19 nt, Homo sapiens
caugugcacuacuggcuuc

SEQ ID NO: 41502 - RNA, 22 nt, Homo sapiens
caugugcaugcuuucuuaugug

SEQ ID NO: 41503 - RNA, 22 nt, Homo sapiens
cauugcacuccaccuuggguaa

SEQ ID NO: 41504 - RNA, 22 nt, Homo sapiens
cauugcacuccagccugcugac

SEQ ID NO: 41505 - RNA, 22 nt, Homo sapiens
cauugcacuccagccuugguga

SEQ ID NO: 41506 - RNA, 20 nt, Homo sapiens
cauugcacuccagcuugggc

SEQ ID NO: 41507 - RNA, 22 nt, Homo sapiens
cauugcacuccaucccgggaaa

SEQ ID NO: 41508 - RNA, 16 nt, Homo sapiens
cauugcacucuagccu

SEQ ID NO: 41509 - RNA, 22 nt, Homo sapiens
cauugcacucuagucuggguga

SEQ ID NO: 41510 - RNA, 22 nt, Homo sapiens
cauugcacucuaucccgguggg

SEQ ID NO: 41511 - RNA, 22 nt, Homo sapiens
cauugcacugcagcccgggcaa

SEQ ID NO: 41512 - RNA, 22 nt, Homo sapiens
cauugcacugcuucuugggugu

SEQ ID NO: 41513 - RNA, 22 nt, Homo sapiens
cauugcaguaagagugggcucu

SEQ ID NO: 41514 - RNA, 22 nt, Homo sapiens
cauugcaguuuuugguguaucu

SEQ ID NO: 41515 - RNA, 22 nt, Homo sapiens
cauugcccuccagccugggcaa

SEQ ID NO: 41516 - RNA, 22 nt, Homo sapiens
cauugguuccaguuuguccuua

SEQ ID NO: 41517 - RNA, 22 nt, Homo sapiens
cauuugcacugagacucagcuu

SEQ ID NO: 41518 - RNA, 22 nt, Homo sapiens
ccaaauccauccaaaucauaga

SEQ ID NO: 41519 - RNA, 22 nt, Homo sapiens
ccaaaucucauguugaaaugug

SEQ ID NO: 41520 - RNA, 22 nt, Homo sapiens
ccaagccucaguuucccucugu

SEQ ID NO: 41521 - RNA, 22 nt, Homo sapiens
ccacauuaccuugcuugcucca

SEQ ID NO: 41522 - RNA, 22 nt, Homo sapiens
ccaccuguacuuaagucacuuu

SEQ ID NO: 41523 - RNA, 22 nt, Homo sapiens
ccacugcacuccagcccggcaa

SEQ ID NO: 41524 - RNA, 22 nt, Homo sapiens
ccagaguggagccuuugcgagg

SEQ ID NO: 41525 - RNA, 22 nt, Homo sapiens
ccagaguuucugauucagcagg

SEQ ID NO: 41526 - RNA, 23 nt, Homo sapiens
ccaguauuuauguaaggaagugu

SEQ ID NO: 41527 - RNA, 22 nt, Homo sapiens
ccagugcugugcaguguaugag

SEQ ID NO: 41528 - RNA, 20 nt, Homo sapiens
ccaucaguccucucuuguuc

SEQ ID NO: 41529 - RNA, 22 nt, Homo sapiens
ccauugaacaugaaggaaugug

SEQ ID NO: 41530 - RNA, 22 nt, Homo sapiens
ccccaguguguaaaggccuugc

SEQ ID NO: 41531 - RNA, 22 nt, Homo sapiens
cccuaagacagugaggggugca

SEQ ID NO: 41532 - RNA, 17 nt, Homo sapiens
cccuaguagcugggacu

SEQ ID NO: 41533 - RNA, 22 nt, Homo sapiens
cccuugcacuucagagcugcau

SEQ ID NO: 41534 - RNA, 22 nt, Homo sapiens
ccugucuugauuaaauuacuua

SEQ ID NO: 41535 - RNA, 22 nt, Homo sapiens
ccuguguuaugguuucuaaugu

SEQ ID NO: 41536 - RNA, 22 nt, Homo sapiens
ccuucuuuuguaaggcugaaua

SEQ ID NO: 41537 - RNA, 22 nt, Homo sapiens
ccuuuuugaguugccagaguuc

SEQ ID NO: 41538 - RNA, 22 nt, Homo sapiens
cggaaugaaaauguccuucagu

SEQ ID NO: 41539 - RNA, 23 nt, Homo sapiens
cuaaagucugucacugaggacuu

SEQ ID NO: 41540 - RNA, 22 nt, Homo sapiens
cuaagugaguauaauuuuaaga

SEQ ID NO: 41541 - RNA, 20 nt, Homo sapiens
cuaaucaucccagaagaaau

SEQ ID NO: 41542 - RNA, 22 nt, Homo sapiens
cuacagcagcccaguccccgaa

SEQ ID NO: 41543 - RNA, 22 nt, Homo sapiens
cuagcagaacaauacaauucgg

SEQ ID NO: 41544 - RNA, 22 nt, Homo sapiens
cuagcagacaggcugggagcag

SEQ ID NO: 41545 - RNA, 22 nt, Homo sapiens
cuagcagacaugggcugaacca

SEQ ID NO: 41546 - RNA, 22 nt, Homo sapiens
cuagcagcauaagaaucaccaa

SEQ ID NO: 41547 - RNA, 22 nt, Homo sapiens
cuagccuggagugcaguggugc

SEQ ID NO: 41548 - RNA, 22 nt, Homo sapiens
cuaggcuguagagaaguucagu

SEQ ID NO: 41549 - RNA, 22 nt, Homo sapiens
cuagguucucaaaccagcguca

SEQ ID NO: 41550 - RNA, 22 nt, Homo sapiens
cuaugagucugcagaucuauua

SEQ ID NO: 41551 - RNA, 22 nt, Homo sapiens
cuauggugauagaaaucagaau

SEQ ID NO: 41552 - RNA, 18 nt, Homo sapiens
cucacaguaacuuuuaag

SEQ ID NO: 41553 - RNA, 22 nt, Homo sapiens
cucacuggguguaaaacaugua

SEQ ID NO: 41554 - RNA, 22 nt, Homo sapiens
cucaggguacuucuccuuugcu

SEQ ID NO: 41555 - RNA, 22 nt, Homo sapiens
cucaguguuaaggccaccucug

SEQ ID NO: 41556 - RNA, 21 nt, Homo sapiens
cucauauugcuuuuccauggu

SEQ ID NO: 41557 - RNA, 22 nt, Homo sapiens
cucauggaauacuucacagcca

SEQ ID NO: 41558 - RNA, 22 nt, Homo sapiens
cuccaggugagguuaagggacu

SEQ ID NO: 41559 - RNA, 23 nt, Homo sapiens
cucccugaacaugacacaccaga

SEQ ID NO: 41560 - RNA, 20 nt, Homo sapiens
cucccugacaaauguggaaa

SEQ ID NO: 41561 - RNA, 22 nt, Homo sapiens
cucucaagaugcugggauuaca

SEQ ID NO: 41562 - RNA, 22 nt, Homo sapiens
cugaagugcuugccacauaaaa

SEQ ID NO: 41563 - RNA, 22 nt, Homo sapiens
cugagacacucuuaucugcaua

SEQ ID NO: 41564 - RNA, 22 nt, Homo sapiens
cugagauggagucucgcauugu

SEQ ID NO: 41565 - RNA, 22 nt, Homo sapiens
cugagauuuuuagauccuggcg

SEQ ID NO: 41566 - RNA, 22 nt, Homo sapiens
cugagcacugagauccucuagc

SEQ ID NO: 41567 - RNA, 18 nt, Homo sapiens
cugagcacugcuuuauga

SEQ ID NO: 41568 - RNA, 22 nt, Homo sapiens
cugagguaauuuguugccagua

SEQ ID NO: 41569 - RNA, 22 nt, Homo sapiens
cugagguacugggggccaggau

SEQ ID NO: 41570 - RNA, 22 nt, Homo sapiens
cugagguagcucaggguauugc

SEQ ID NO: 41571 - RNA, 22 nt, Homo sapiens
cugagguaggugaucagugcuu

SEQ ID NO: 41572 - RNA, 22 nt, Homo sapiens
cugauuguuugccucuaaaauc

SEQ ID NO: 41573 - RNA, 22 nt, Homo sapiens
cuggaaagcaaguccauugcuc

SEQ ID NO: 41574 - RNA, 22 nt, Homo sapiens
cuggaauguuccuaaagauuca

SEQ ID NO: 41575 - RNA, 22 nt, Homo sapiens
cuggagcaaaggugacucuugu

SEQ ID NO: 41576 - RNA, 20 nt, Homo sapiens
cuggaugucgaggcagaggu

SEQ ID NO: 41577 - RNA, 22 nt, Homo sapiens
cuggcacagugucagaaacaca

SEQ ID NO: 41578 - RNA, 22 nt, Homo sapiens
cuggcucauuucauuuagcaua

SEQ ID NO: 41579 - RNA, 23 nt, Homo sapiens
cuguacacauauacaucuaagua

SEQ ID NO: 41580 - RNA, 22 nt, Homo sapiens
cuguaugugagaaauaauaagu

SEQ ID NO: 41581 - RNA, 22 nt, Homo sapiens
cuguccugcagagucagaauga

SEQ ID NO: 41582 - RNA, 22 nt, Homo sapiens
cugucuggaguccuucgugugc

SEQ ID NO: 41583 - RNA, 22 nt, Homo sapiens
cugugacugcagggcauauuug

SEQ ID NO: 41584 - RNA, 17 nt, Homo sapiens
cugugaugaucuugucu

SEQ ID NO: 41585 - RNA, 22 nt, Homo sapiens
cugugauuauauaguuaaggua

SEQ ID NO: 41586 - RNA, 22 nt, Homo sapiens
cugugcauuggaugucucccug

SEQ ID NO: 41587 - RNA, 23 nt, Homo sapiens
uuguaacuggagaguaacauucc

SEQ ID NO: 41588 - RNA, 20 nt, Homo sapiens
uuguacuccugggcucaagc

SEQ ID NO: 41589 - RNA, 22 nt, Homo sapiens
uuguacucucaccguaucccag

SEQ ID NO: 41590 - RNA, 22 nt, Homo sapiens
uuguacuggguuuucuggaauu

SEQ ID NO: 41591 - RNA, 22 nt, Homo sapiens
uuguauguuucugugcacauga

SEQ ID NO: 41592 - RNA, 22 nt, Homo sapiens
uugucaaacucauucuccaucc

SEQ ID NO: 41593 - RNA, 22 nt, Homo sapiens
uuguccauggacagcaccacag

SEQ ID NO: 41594 - RNA, 22 nt, Homo sapiens
uugucucacuggaguuuaguaa

SEQ ID NO: 41595 - RNA, 22 nt, Homo sapiens
uugugaaugaugucgcaauaaa

SEQ ID NO: 41596 - RNA, 22 nt, Homo sapiens
uugugaauggugccgcaauaaa

SEQ ID NO: 41597 - RNA, 22 nt, Homo sapiens
uugugcacauguacccuagaac

SEQ ID NO: 41598 - RNA, 18 nt, Homo sapiens
uugugccugagaaggugg

SEQ ID NO: 41599 - RNA, 22 nt, Homo sapiens
uugugguuuucagcuuauauau

SEQ ID NO: 41600 - RNA, 22 nt, Homo sapiens
uuguugcacugcuuuccuggcc

SEQ ID NO: 41601 - RNA, 22 nt, Homo sapiens
uuuaauguuacaguauugguau

SEQ ID NO: 41602 - RNA, 22 nt, Homo sapiens
uuuagguauuugguauagcagu

SEQ ID NO: 41603 - RNA, 22 nt, Homo sapiens
uuuauccagccucuagcaaggu

SEQ ID NO: 41604 - RNA, 22 nt, Homo sapiens
uggaaaucuaaguuuggauuga

SEQ ID NO: 41605 - RNA, 20 nt, Homo sapiens
uggaacuuaauugauggaca

SEQ ID NO: 41606 - RNA, 22 nt, Homo sapiens
uggaaguaaucaugagguagca

SEQ ID NO: 41607 - RNA, 23 nt, Homo sapiens
uggaaguauggaggaggcagaau

SEQ ID NO: 41608 - RNA, 22 nt, Homo sapiens
uggaagucauugagguguguua

SEQ ID NO: 41609 - RNA, 22 nt, Homo sapiens
uggaagugucugugcccagcuc

SEQ ID NO: 41610 - RNA, 22 nt, Homo sapiens
uggaaguuaaaugacucuuucu

SEQ ID NO: 41611 - RNA, 22 nt, Homo sapiens
uggaauaucaugagaguuuguu

SEQ ID NO: 41612 - RNA, 22 nt, Homo sapiens
uggaauguauaucguuuuuugu

SEQ ID NO: 41613 - RNA, 22 nt, Homo sapiens
uggaaugucuauguuuuugauu

SEQ ID NO: 41614 - RNA, 22 nt, Homo sapiens
uggaauuaauuaaaauauacug

SEQ ID NO: 41615 - RNA, 22 nt, Homo sapiens
uggacuguaagugccuugagua

SEQ ID NO: 41616 - RNA, 22 nt, Homo sapiens
uggagugagaacuucaaugaug

SEQ ID NO: 41617 - RNA, 22 nt, Homo sapiens
uggaguguguuaacuuuacaag

SEQ ID NO: 41618 - RNA, 22 nt, Homo sapiens
uggauagugauaagguagauga

SEQ ID NO: 41619 - RNA, 18 nt, Homo sapiens
uggauuggaaaaguuccu

SEQ ID NO: 41620 - RNA, 22 nt, Homo sapiens
uggcaaaaaucacaaguaccuu

SEQ ID NO: 41621 - RNA, 22 nt, Homo sapiens
uggcaaaucagaggcauggaca

SEQ ID NO: 41622 - RNA, 22 nt, Homo sapiens
uggcaaaugaagucagcuguac

SEQ ID NO: 41623 - RNA, 22 nt, Homo sapiens
uggcaacuugcaaccucauucu

SEQ ID NO: 41624 - RNA, 22 nt, Homo sapiens
uggcaagaaggauuuauuccuu

SEQ ID NO: 41625 - RNA, 22 nt, Homo sapiens
uggcaagaucacaauuacuuuu

SEQ ID NO: 41626 - RNA, 22 nt, Homo sapiens
uggcaagcaggacuaaagcacc

SEQ ID NO: 41627 - RNA, 19 nt, Homo sapiens
uggcacauguauacauaug

SEQ ID NO: 41628 - RNA, 19 nt, Homo sapiens
uggcacuugacguccggau

SEQ ID NO: 41629 - RNA, 22 nt, Homo sapiens
uggcagcgcaguugaaaaagaa

SEQ ID NO: 41630 - RNA, 22 nt, Homo sapiens
uggcaugauguguucauugaaa

SEQ ID NO: 41631 - RNA, 22 nt, Homo sapiens
uggcauggaaagcuuuucauac

SEQ ID NO: 41632 - RNA, 22 nt, Homo sapiens
uggcauggaacuacuuugaaac

SEQ ID NO: 41633 - RNA, 22 nt, Homo sapiens
uggcuaaguuaaucaaggagau

SEQ ID NO: 41634 - RNA, 22 nt, Homo sapiens
ugggaugaugaaaaggcuuucu

SEQ ID NO: 41635 - RNA, 22 nt, Homo sapiens
uggggugugagggagaaagaaa

SEQ ID NO: 41636 - RNA, 22 nt, Homo sapiens
ugguccaguucugugauauugc

SEQ ID NO: 41637 - RNA, 22 nt, Homo sapiens
uggugagaaaugagaugcuuuu

SEQ ID NO: 41638 - RNA, 22 nt, Homo sapiens
ugguggcuuuucguagguucac

SEQ ID NO: 41639 - RNA, 22 nt, Homo sapiens
ugguucaguugcacaggcuguu

SEQ ID NO: 41640 - RNA, 22 nt, Homo sapiens
uguagauaucauuagugcugug

SEQ ID NO: 41641 - RNA, 22 nt, Homo sapiens
uguagggagagggaguugcacc

SEQ ID NO: 41642 - RNA, 22 nt, Homo sapiens
uguauguugggucaaaguacau

SEQ ID NO: 41643 - RNA, 22 nt, Homo sapiens
uguauguuguaagacuuagacc

SEQ ID NO: 41644 - RNA, 22 nt, Homo sapiens
ugucaguuuuaacuagggaaua

SEQ ID NO: 41645 - RNA, 22 nt, Homo sapiens
ugucauacaguaacaugguugg

SEQ ID NO: 41646 - RNA, 19 nt, Homo sapiens
ugucaucaucuuuucuugc

SEQ ID NO: 41647 - RNA, 22 nt, Homo sapiens
ugucaucauuggaaucugccuc

SEQ ID NO: 41648 - RNA, 22 nt, Homo sapiens
ugucaucauuugagagaagaaa

SEQ ID NO: 41649 - RNA, 22 nt, Homo sapiens
ugucauucaggaaauucuaagu

SEQ ID NO: 41650 - RNA, 22 nt, Homo sapiens
ugugaagauggacuaauauagu

SEQ ID NO: 41651 - RNA, 22 nt, Homo sapiens
ugugacaguguuacauuucaug

SEQ ID NO: 41652 - RNA, 22 nt, Homo sapiens
ugugaguguguacuaguuauca

SEQ ID NO: 41653 - RNA, 22 nt, Homo sapiens
ugugauggaguuucauggacug

SEQ ID NO: 41654 - RNA, 22 nt, Homo sapiens
ugugauguggagggcagaucca

SEQ ID NO: 41655 - RNA, 22 nt, Homo sapiens
ugugcaaaaacaauugcgguuu

SEQ ID NO: 41656 - RNA, 22 nt, Homo sapiens
ugugcaaauuagcacaacccga

SEQ ID NO: 41657 - RNA, 22 nt, Homo sapiens
ugugccaaaucccauaauaaau

SEQ ID NO: 41658 - RNA, 22 nt, Homo sapiens
ugugccaaucauagggcuuggu

SEQ ID NO: 41659 - RNA, 22 nt, Homo sapiens
ugugccacugcacucccgccug

SEQ ID NO: 41660 - RNA, 22 nt, Homo sapiens
ugugccacugcacuucagccug

SEQ ID NO: 41661 - RNA, 22 nt, Homo sapiens
ugugcucaucucagucaacugu

SEQ ID NO: 41662 - RNA, 22 nt, Homo sapiens
ugugcuugcuucuucuccuagu

SEQ ID NO: 41663 - RNA, 22 nt, Homo sapiens
uguggcuuuuucuuggcugagg

SEQ ID NO: 41664 - RNA, 22 nt, Homo sapiens
ugugguuuuuuucuccaauagg

SEQ ID NO: 41665 - RNA, 22 nt, Homo sapiens
uguguaauaccuuugacuauau

SEQ ID NO: 41666 - RNA, 22 nt, Homo sapiens
uguguacugcagaguauucugu

SEQ ID NO: 41667 - RNA, 22 nt, Homo sapiens
ugugucuuguuuauagcuuucu

SEQ ID NO: 41668 - RNA, 22 nt, Homo sapiens
uguuacagcagaauugaaagag

SEQ ID NO: 41669 - RNA, 22 nt, Homo sapiens
uguucaauucccaccuaugagu

SEQ ID NO: 41670 - RNA, 22 nt, Homo sapiens
uguucuggagccgguucaaaug

SEQ ID NO: 41671 - RNA, 22 nt, Homo sapiens
uguuuuggaguggacuuugcau

SEQ ID NO: 41672 - RNA, 22 nt, Homo sapiens
uguuuuguuagcacucugggaa

SEQ ID NO: 41673 - RNA, 20 nt, Homo sapiens
uuaaaucuagugcagacuca

SEQ ID NO: 41674 - RNA, 22 nt, Homo sapiens
uuaagagcauggugccagguug

SEQ ID NO: 41675 - RNA, 22 nt, Homo sapiens
uuaaucucaggaguuugggacc

SEQ ID NO: 41676 - RNA, 22 nt, Homo sapiens
uuaauguaucuaucacaucaca

SEQ ID NO: 41677 - RNA, 22 nt, Homo sapiens
uuacacguaauaguaagccugg

SEQ ID NO: 41678 - RNA, 22 nt, Homo sapiens
uuacacguaauaucacggugug

SEQ ID NO: 41679 - RNA, 22 nt, Homo sapiens
uuacagauggcacacucaaggg

SEQ ID NO: 41680 - RNA, 21 nt, Homo sapiens
uuacaguugguugugaggugg

SEQ ID NO: 41681 - RNA, 22 nt, Homo sapiens
uuacaugcaugacaaggugcca

SEQ ID NO: 41682 - RNA, 22 nt, Homo sapiens
uuaccaguggugcuguaaacuu

SEQ ID NO: 41683 - RNA, 22 nt, Homo sapiens
uuacccauuagagaauuuaaga

SEQ ID NO: 41684 - RNA, 22 nt, Homo sapiens
uuacuacucucuaugaccaguu

SEQ ID NO: 41685 - RNA, 20 nt, Homo sapiens
uuacuauguaguauuggcuc

SEQ ID NO: 41686 - RNA, 22 nt, Homo sapiens
uuagaaaguagaaaagcugguu

SEQ ID NO: 41687 - RNA, 22 nt, Homo sapiens
uuagaguacaggggaaucaagg

SEQ ID NO: 41688 - RNA, 22 nt, Homo sapiens
uuagcaauagccugcaucugca

SEQ ID NO: 41689 - RNA, 22 nt, Homo sapiens
uuagcacauuuccagcacaugg

SEQ ID NO: 41690 - RNA, 22 nt, Homo sapiens
uuagcaccacacacuuuagagg

SEQ ID NO: 41691 - RNA, 22 nt, Homo sapiens
cuguguaguacuagauugagca

SEQ ID NO: 41692 - RNA, 22 nt, Homo sapiens
cuguucaaauuguuugugaagu

SEQ ID NO: 41693 - RNA, 22 nt, Homo sapiens
cuguugguuaaauuccaugcag

SEQ ID NO: 41694 - RNA, 17 nt, Homo sapiens
cuucaaauaauuucccc

SEQ ID NO: 41695 - RNA, 22 nt, Homo sapiens
cuucacuggagucccuggauuc

SEQ ID NO: 41696 - RNA, 22 nt, Homo sapiens
cuuccauaguauuuuuacaaaa

SEQ ID NO: 41697 - RNA, 22 nt, Homo sapiens
cuugaauguaaauaauguacag

SEQ ID NO: 41698 - RNA, 22 nt, Homo sapiens
cuugacaucugucaguuccuca

SEQ ID NO: 41699 - RNA, 22 nt, Homo sapiens
cuugcagagcccauggauguca

SEQ ID NO: 41700 - RNA, 22 nt, Homo sapiens
cuuggcauuguguugauagaag

SEQ ID NO: 41701 - RNA, 18 nt, Homo sapiens
cuugucaaaucuuuccuc

SEQ ID NO: 41702 - RNA, 22 nt, Homo sapiens
cuuguucuccuaagaugaaugc

SEQ ID NO: 41703 - RNA, 22 nt, Homo sapiens
cuuguuguggaggggagugcag

SEQ ID NO: 41704 - RNA, 17 nt, Homo sapiens
cuuguugugguaguuug

SEQ ID NO: 41705 - RNA, 21 nt, Homo sapiens
cuuuaugcuguguuagaaaag

SEQ ID NO: 41706 - RNA, 22 nt, Homo sapiens
cuuugauuauaaaaggguguuu

SEQ ID NO: 41707 - RNA, 22 nt, Homo sapiens
cuuuggcaaugucauuuucaau

SEQ ID NO: 41708 - RNA, 22 nt, Homo sapiens
cuuuggccauagcuaaaugauu

SEQ ID NO: 41709 - RNA, 22 nt, Homo sapiens
uucacugcauuucagccugggc

SEQ ID NO: 41710 - RNA, 22 nt, Homo sapiens
uucagagugguaugaagugaug

SEQ ID NO: 41711 - RNA, 22 nt, Homo sapiens
uucagcuaccugggaugcugaa

SEQ ID NO: 41712 - RNA, 22 nt, Homo sapiens
uucaggcaccauggucauugau

SEQ ID NO: 41713 - RNA, 20 nt, Homo sapiens
uucagugcagguaacaaucc

SEQ ID NO: 41714 - RNA, 22 nt, Homo sapiens
uucagugucauuaacacaguag

SEQ ID NO: 41715 - RNA, 22 nt, Homo sapiens
uucauagucuaauuuuuuccac

SEQ ID NO: 41716 - RNA, 22 nt, Homo sapiens
uucauugaaugauuuuuagaag

SEQ ID NO: 41717 - RNA, 22 nt, Homo sapiens
uuccacaauggcugaacuaguu

SEQ ID NO: 41718 - RNA, 22 nt, Homo sapiens
uuccacaaugguugaacuaguu

SEQ ID NO: 41719 - RNA, 22 nt, Homo sapiens
uuccacaggguugaacuaguuu

SEQ ID NO: 41720 - RNA, 22 nt, Homo sapiens
uuccagaugggaguucuauucu

SEQ ID NO: 41721 - RNA, 22 nt, Homo sapiens
uucccagagccugggagugagg

SEQ ID NO: 41722 - RNA, 22 nt, Homo sapiens
uucccugugggaguaggaaagu

SEQ ID NO: 41723 - RNA, 22 nt, Homo sapiens
uucccugugggcuggugcucca

SEQ ID NO: 41724 - RNA, 22 nt, Homo sapiens
uucccuuucugccuugaaucuu

SEQ ID NO: 41725 - RNA, 22 nt, Homo sapiens
uuccugugacccccaagcccac

SEQ ID NO: 41726 - RNA, 20 nt, Homo sapiens
uuccuuaggcauuggaagaa

SEQ ID NO: 41727 - RNA, 22 nt, Homo sapiens
uuccuugagaaaggcacaaguu

SEQ ID NO: 41728 - RNA, 22 nt, Homo sapiens
uucucagcccccugacagucag

SEQ ID NO: 41729 - RNA, 22 nt, Homo sapiens
uucucaguuccuacuuugguga

SEQ ID NO: 41730 - RNA, 22 nt, Homo sapiens
uucuccugguggacccuaaacg

SEQ ID NO: 41731 - RNA, 22 nt, Homo sapiens
uucucuggucagaggggagguu

SEQ ID NO: 41732 - RNA, 22 nt, Homo sapiens
uucugagguuauauucucucaa

SEQ ID NO: 41733 - RNA, 22 nt, Homo sapiens
uucugugcuuguggaugaagug

SEQ ID NO: 41734 - RNA, 21 nt, Homo sapiens
uucuuugcucaguguuagagu

SEQ ID NO: 41735 - RNA, 22 nt, Homo sapiens
uugaaagaugaacuggauugga

SEQ ID NO: 41736 - RNA, 22 nt, Homo sapiens
uugaaagcuaucucaaaucgcu

SEQ ID NO: 41737 - RNA, 22 nt, Homo sapiens
uugaaagucauuucuucuaagu

SEQ ID NO: 41738 - RNA, 22 nt, Homo sapiens
uugaaaguguucacaaugguau

SEQ ID NO: 41739 - RNA, 22 nt, Homo sapiens
uugaaauguuuagaaguuugga

SEQ ID NO: 41740 - RNA, 22 nt, Homo sapiens
uugaacugguaguuggaaaucu

SEQ ID NO: 41741 - RNA, 22 nt, Homo sapiens
uugaaguagaaagacgaaauuu

SEQ ID NO: 41742 - RNA, 22 nt, Homo sapiens
uugaaguauagaguuuaagaac

SEQ ID NO: 41743 - RNA, 22 nt, Homo sapiens
uugaaguaugaccgcugagaau

SEQ ID NO: 41744 - RNA, 22 nt, Homo sapiens
uugaaguguguauacauugugg

SEQ ID NO: 41745 - RNA, 22 nt, Homo sapiens
uugacaaguuguccaguaugag

SEQ ID NO: 41746 - RNA, 22 nt, Homo sapiens
uugacauaguuucugaaauaga

SEQ ID NO: 41747 - RNA, 22 nt, Homo sapiens
uugagaaucuuucgaauguucu

SEQ ID NO: 41748 - RNA, 22 nt, Homo sapiens
uugagacggagucuugcucuuu

SEQ ID NO: 41749 - RNA, 22 nt, Homo sapiens
uugagacggaguuuugcucuug

SEQ ID NO: 41750 - RNA, 22 nt, Homo sapiens
uugagauaggaacucacuaugc

SEQ ID NO: 41751 - RNA, 22 nt, Homo sapiens
uugagauaggagcuguuguucu

SEQ ID NO: 41752 - RNA, 22 nt, Homo sapiens
uugagauagggucuaccucugu

SEQ ID NO: 41753 - RNA, 22 nt, Homo sapiens
uugagauggagucucacgcauu

SEQ ID NO: 41754 - RNA, 22 nt, Homo sapiens
uugagauggagucucgcacugu

SEQ ID NO: 41755 - RNA, 22 nt, Homo sapiens
uugagauggagucucgcucugu

SEQ ID NO: 41756 - RNA, 22 nt, Homo sapiens
uugagauggagucucgcucuuu

SEQ ID NO: 41757 - RNA, 22 nt, Homo sapiens
uugagauggagucuugcucucu

SEQ ID NO: 41758 - RNA, 22 nt, Homo sapiens
uugagauggagucuugcucugu

SEQ ID NO: 41759 - RNA, 22 nt, Homo sapiens
uugagauggaguguugcucugu

SEQ ID NO: 41760 - RNA, 22 nt, Homo sapiens
uugagauggaguucauuuuugu

SEQ ID NO: 41761 - RNA, 22 nt, Homo sapiens
uugagauggaguuucaauauug

SEQ ID NO: 41762 - RNA, 22 nt, Homo sapiens
uugagauggaguuucgcucuug

SEQ ID NO: 41763 - RNA, 22 nt, Homo sapiens
uugagauggaguuucgcucuuu

SEQ ID NO: 41764 - RNA, 22 nt, Homo sapiens
uugagauggauagacauagcau

SEQ ID NO: 41765 - RNA, 22 nt, Homo sapiens
uugagauggugccacuguacuc

SEQ ID NO: 41766 - RNA, 22 nt, Homo sapiens
uugagauguggcaguuuaugag

SEQ ID NO: 41767 - RNA, 22 nt, Homo sapiens
uugagcacaggaguuuugagac

SEQ ID NO: 41768 - RNA, 22 nt, Homo sapiens
uugaggcaaugaggagaagcug

SEQ ID NO: 41769 - RNA, 23 nt, Homo sapiens
uugaggcauguaccaucaauauc

SEQ ID NO: 41770 - RNA, 22 nt, Homo sapiens
uugagggaaacauucacaucau

SEQ ID NO: 41771 - RNA, 22 nt, Homo sapiens
uugagggaagccagaggucugc

SEQ ID NO: 41772 - RNA, 22 nt, Homo sapiens
uugaggucagagguucgagacc

SEQ ID NO: 41773 - RNA, 22 nt, Homo sapiens
uugaggugaauuugcaggaugc

SEQ ID NO: 41774 - RNA, 22 nt, Homo sapiens
uugaguaguaagaagaugauag

SEQ ID NO: 41775 - RNA, 22 nt, Homo sapiens
uugauagacaucugaguuguug

SEQ ID NO: 41776 - RNA, 22 nt, Homo sapiens
uugaucaaaucugagugagaau

SEQ ID NO: 41777 - RNA, 22 nt, Homo sapiens
uugauccucugagaaucuaucg

SEQ ID NO: 41778 - RNA, 22 nt, Homo sapiens
uugcaaagaccucuucacuucc

SEQ ID NO: 41779 - RNA, 18 nt, Homo sapiens
uugcaaauucuucccugu

SEQ ID NO: 41780 - RNA, 22 nt, Homo sapiens
uugcaaugugaugugauuugga

SEQ ID NO: 41781 - RNA, 22 nt, Homo sapiens
uugcacauguugaaccagcaaa

SEQ ID NO: 41782 - RNA, 22 nt, Homo sapiens
uugcacauugcaccuuuuguau

SEQ ID NO: 41783 - RNA, 22 nt, Homo sapiens
uugcacauuuuuucuggcagaa

SEQ ID NO: 41784 - RNA, 22 nt, Homo sapiens
uugcaccacugcguuccagccu

SEQ ID NO: 41785 - RNA, 22 nt, Homo sapiens
uugcacuccagccuuggggaga

SEQ ID NO: 41786 - RNA, 22 nt, Homo sapiens
uugcacucuagccugggugaca

SEQ ID NO: 41787 - RNA, 22 nt, Homo sapiens
uugcacucugaagaccuacugu

SEQ ID NO: 41788 - RNA, 22 nt, Homo sapiens
uugcagagccccugcaaggguc

SEQ ID NO: 41789 - RNA, 22 nt, Homo sapiens
uugcaugcuccuuaugagaauc

SEQ ID NO: 41790 - RNA, 22 nt, Homo sapiens
uugccuaggcuggagugcagug

SEQ ID NO: 41791 - RNA, 22 nt, Homo sapiens
uugcuacauugauugccucuuu

SEQ ID NO: 41792 - RNA, 22 nt, Homo sapiens
uugcuccccaggaaaggaagca

SEQ ID NO: 41793 - RNA, 22 nt, Homo sapiens
uugcuggugguucgagcaacac

SEQ ID NO: 41794 - RNA, 22 nt, Homo sapiens
uuggaaauguguuugcauucag

SEQ ID NO: 41795 - RNA, 22 nt, Homo sapiens
aucagcagcaugaaaacaggcu

SEQ ID NO: 41796 - RNA, 22 nt, Homo sapiens
aucaggcacacauuggaguuug

SEQ ID NO: 41797 - RNA, 22 nt, Homo sapiens
aucccugagaacuuuuaauguu

SEQ ID NO: 41798 - RNA, 22 nt, Homo sapiens
aucccugugacgagcaucccua

SEQ ID NO: 41799 - RNA, 22 nt, Homo sapiens
aucccugugauccaaucacuuc

SEQ ID NO: 41800 - RNA, 22 nt, Homo sapiens
aucuagagaggcagucuggccg

SEQ ID NO: 41801 - RNA, 22 nt, Homo sapiens
aucuuggauuaccugggugggu

SEQ ID NO: 41802 - RNA, 22 nt, Homo sapiens
augaaaagcauaaacgcugaag

SEQ ID NO: 41803 - RNA, 22 nt, Homo sapiens
augaaaguguguggaaacuuga

SEQ ID NO: 41804 - RNA, 22 nt, Homo sapiens
augaaaugcauguuaaguccgu

SEQ ID NO: 41805 - RNA, 22 nt, Homo sapiens
augaacagagccuugagaaccu

SEQ ID NO: 41806 - RNA, 22 nt, Homo sapiens
augaacucaucauuuuuauggc

SEQ ID NO: 41807 - RNA, 22 nt, Homo sapiens
augaacucaucauuuuuuaugg

SEQ ID NO: 41808 - RNA, 22 nt, Homo sapiens
augacaguguggauuauuguaa

SEQ ID NO: 41809 - RNA, 22 nt, Homo sapiens
augaccauuucaauugauaugg

SEQ ID NO: 41810 - RNA, 22 nt, Homo sapiens
augaccuuguccucagugucau

SEQ ID NO: 41811 - RNA, 18 nt, Homo sapiens
augacucuggguguuccu

SEQ ID NO: 41812 - RNA, 22 nt, Homo sapiens
augacuggaacggcacuuuaca

SEQ ID NO: 41813 - RNA, 22 nt, Homo sapiens
augagaacauaucaagugauug

SEQ ID NO: 41814 - RNA, 22 nt, Homo sapiens
augagauacuacaaaugaguuu

SEQ ID NO: 41815 - RNA, 22 nt, Homo sapiens
augagaugcaagauuagauggg

SEQ ID NO: 41816 - RNA, 22 nt, Homo sapiens
augagcacuuguuuugggcaca

SEQ ID NO: 41817 - RNA, 22 nt, Homo sapiens
augaggauagguuucuauuagg

SEQ ID NO: 41818 - RNA, 22 nt, Homo sapiens
augaggcuauaauuuuuaugua

SEQ ID NO: 41819 - RNA, 22 nt, Homo sapiens
augagucacuuauuauuggggu

SEQ ID NO: 41820 - RNA, 22 nt, Homo sapiens
augauguguucuguguucccau

SEQ ID NO: 41821 - RNA, 22 nt, Homo sapiens
augauucugaucuagagcuugg

SEQ ID NO: 41822 - RNA, 19 nt, Homo sapiens
augauugucuauggaggaa

SEQ ID NO: 41823 - RNA, 22 nt, Homo sapiens
augcaacugcacuccagccugg

SEQ ID NO: 41824 - RNA, 22 nt, Homo sapiens
augcacuguuuucuugaugaga

SEQ ID NO: 41825 - RNA, 22 nt, Homo sapiens
augccacugcacuucagccugc

SEQ ID NO: 41826 - RNA, 22 nt, Homo sapiens
augccacuguuuaugucacuua

SEQ ID NO: 41827 - RNA, 22 nt, Homo sapiens
augcuacauucuacaauuaggc

SEQ ID NO: 41828 - RNA, 22 nt, Homo sapiens
augcuguuuugaauucucuaga

SEQ ID NO: 41829 - RNA, 22 nt, Homo sapiens
augcuuguguuggggcagugga

SEQ ID NO: 41830 - RNA, 22 nt, Homo sapiens
auggaaagcuguuccuacacaa

SEQ ID NO: 41831 - RNA, 22 nt, Homo sapiens
auggaaaugaagggcuggcccu

SEQ ID NO: 41832 - RNA, 22 nt, Homo sapiens
auggaagaaacgauuuucugga

SEQ ID NO: 41833 - RNA, 22 nt, Homo sapiens
auggaaugccauuuauaaugga

SEQ ID NO: 41834 - RNA, 22 nt, Homo sapiens
auggacagaaaaaaauagaugu

SEQ ID NO: 41835 - RNA, 22 nt, Homo sapiens
auggagagaauuauucucucag

SEQ ID NO: 41836 - RNA, 22 nt, Homo sapiens
auggaggccuacagaauuuugg

SEQ ID NO: 41837 - RNA, 22 nt, Homo sapiens
auggagguguggggagugaguu

SEQ ID NO: 41838 - RNA, 22 nt, Homo sapiens
auggaguguucugaauccuuug

SEQ ID NO: 41839 - RNA, 22 nt, Homo sapiens
auggauguucuagggaugugau

SEQ ID NO: 41840 - RNA, 22 nt, Homo sapiens
auggcaucgucaccuuuucagu

SEQ ID NO: 41841 - RNA, 22 nt, Homo sapiens
auggcccaguuugcuaucccua

SEQ ID NO: 41842 - RNA, 23 nt, Homo sapiens
auggcccuggugggagugucuuu

SEQ ID NO: 41843 - RNA, 22 nt, Homo sapiens
auggcucuguuccaugugucuu

SEQ ID NO: 41844 - RNA, 22 nt, Homo sapiens
auggcuguuuaagaguuucauu

SEQ ID NO: 41845 - RNA, 22 nt, Homo sapiens
auggcuuuaagagugucugaau

SEQ ID NO: 41846 - RNA, 22 nt, Homo sapiens
augggagugugguuagagaccu

SEQ ID NO: 41847 - RNA, 18 nt, Homo sapiens
auggguguuggaaaauga

SEQ ID NO: 41848 - RNA, 22 nt, Homo sapiens
auguaauguuaaauugcuaauu

SEQ ID NO: 41849 - RNA, 22 nt, Homo sapiens
auguaauugagguuuuugccau

SEQ ID NO: 41850 - RNA, 22 nt, Homo sapiens
auguagugugauuuucacuaga

SEQ ID NO: 41851 - RNA, 20 nt, Homo sapiens
augucagaguguggguacgg

SEQ ID NO: 41852 - RNA, 22 nt, Homo sapiens
augucuuucauagagacccaga

SEQ ID NO: 41853 - RNA, 22 nt, Homo sapiens
augugcacauucugguaaauau

SEQ ID NO: 41854 - RNA, 22 nt, Homo sapiens
augugcuugagggaaaucaguu

SEQ ID NO: 41855 - RNA, 22 nt, Homo sapiens
auguggcacuugacuuucucgc

SEQ ID NO: 41856 - RNA, 19 nt, Homo sapiens
augugguuagcaugacugc

SEQ ID NO: 41857 - RNA, 22 nt, Homo sapiens
augugugaaucccagaaccugu

SEQ ID NO: 41858 - RNA, 22 nt, Homo sapiens
augugugcuugauguaaaaagu

SEQ ID NO: 41859 - RNA, 22 nt, Homo sapiens
auguguucaucacagcacaauu

SEQ ID NO: 41860 - RNA, 22 nt, Homo sapiens
auguuagcaucuggcacuaugg

SEQ ID NO: 41861 - RNA, 20 nt, Homo sapiens
auguucuggaggacagaagc

SEQ ID NO: 41862 - RNA, 22 nt, Homo sapiens
auuaagagcacauguucugggu

SEQ ID NO: 41863 - RNA, 22 nt, Homo sapiens
auuaauguaauuaguaaaguug

SEQ ID NO: 41864 - RNA, 22 nt, Homo sapiens
auuacauagucaaggugucuca

SEQ ID NO: 41865 - RNA, 22 nt, Homo sapiens
auuagguuagugcaaaaguaau

SEQ ID NO: 41866 - RNA, 22 nt, Homo sapiens
auuagguuggugcaaaaguaau

SEQ ID NO: 41867 - RNA, 22 nt, Homo sapiens
auuagguuguugcaaaaguaau

SEQ ID NO: 41868 - RNA, 22 nt, Homo sapiens
auucaagugaugugauucuucu

SEQ ID NO: 41869 - RNA, 22 nt, Homo sapiens
auucaccauggcuaccaagggu

SEQ ID NO: 41870 - RNA, 22 nt, Homo sapiens
auucaucagggauauuggucug

SEQ ID NO: 41871 - RNA, 22 nt, Homo sapiens
auuccacaguuaacacagaccg

SEQ ID NO: 41872 - RNA, 22 nt, Homo sapiens
auuccacuuagugacucauuug

SEQ ID NO: 41873 - RNA, 22 nt, Homo sapiens
auuccagauggaguugaggguu

SEQ ID NO: 41874 - RNA, 22 nt, Homo sapiens
auuccagguggcgccauucaca

SEQ ID NO: 41875 - RNA, 22 nt, Homo sapiens
auuccuuaggcccuuugguuag

SEQ ID NO: 41876 - RNA, 23 nt, Homo sapiens
auugaacacuuucauaugugagg

SEQ ID NO: 41877 - RNA, 20 nt, Homo sapiens
auugaacucaguauucugaa

SEQ ID NO: 41878 - RNA, 20 nt, Homo sapiens
auugaagacuccggggcaga

SEQ ID NO: 41879 - RNA, 22 nt, Homo sapiens
auugagcaaggucuccuaguau

SEQ ID NO: 41880 - RNA, 18 nt, Homo sapiens
auugagcaugacagaccu

SEQ ID NO: 41881 - RNA, 22 nt, Homo sapiens
auugcacuccagccugggugac

SEQ ID NO: 41882 - RNA, 22 nt, Homo sapiens
auugcacucuagccugggugac

SEQ ID NO: 41883 - RNA, 20 nt, Homo sapiens
auugcagcaugauuuauaau

SEQ ID NO: 41884 - RNA, 22 nt, Homo sapiens
auugcauugugaucuucccaga

SEQ ID NO: 41885 - RNA, 22 nt, Homo sapiens
auugcuuuuacugggagcuuug

SEQ ID NO: 41886 - RNA, 22 nt, Homo sapiens
auuggcaauccauauauuuucu

SEQ ID NO: 41887 - RNA, 22 nt, Homo sapiens
auuggggaaugguggcuuuagu

SEQ ID NO: 41888 - RNA, 22 nt, Homo sapiens
auuuaugguuaauauaggaagu

SEQ ID NO: 41889 - RNA, 22 nt, Homo sapiens
auuucacugagacaugugccca

SEQ ID NO: 41890 - RNA, 21 nt, Homo sapiens
auuugcacugagcuccugugc

SEQ ID NO: 41891 - RNA, 20 nt, Homo sapiens
auuuggcauaguuuaagcaa

SEQ ID NO: 41892 - RNA, 22 nt, Homo sapiens
auuugggaaugugcauuauacu

SEQ ID NO: 41893 - RNA, 22 nt, Homo sapiens
auuuguccugccuuuuccuccu

SEQ ID NO: 41894 - RNA, 22 nt, Homo sapiens
auuuuugguuucaccugcacgc

SEQ ID NO: 41895 - RNA, 22 nt, Homo sapiens
caaaggugcuuuccagguccaa

SEQ ID NO: 41896 - RNA, 22 nt, Homo sapiens
agcagcauauuuuuauaaugua

SEQ ID NO: 41897 - RNA, 22 nt, Homo sapiens
agcagcauggguauaaaucucc

SEQ ID NO: 41898 - RNA, 22 nt, Homo sapiens
agcaggacaauaugggaucagg

SEQ ID NO: 41899 - RNA, 22 nt, Homo sapiens
agcagguguccacaauguuugc

SEQ ID NO: 41900 - RNA, 22 nt, Homo sapiens
agccucauucuacauguuaaug

SEQ ID NO: 41901 - RNA, 22 nt, Homo sapiens
agcuccaugauaguaugucugu

SEQ ID NO: 41902 - RNA, 22 nt, Homo sapiens
agcucuuguuaguauuagcagu

SEQ ID NO: 41903 - RNA, 22 nt, Homo sapiens
agcugaguguuccaagagcgag

SEQ ID NO: 41904 - RNA, 22 nt, Homo sapiens
agcugcaauguuuaguauaaua

SEQ ID NO: 41905 - RNA, 22 nt, Homo sapiens
agcuggauguauguuaagugaa

SEQ ID NO: 41906 - RNA, 20 nt, Homo sapiens
agcuguuguuaaaaaggagg

SEQ ID NO: 41907 - RNA, 22 nt, Homo sapiens
agcuguuguucucagaggcuuu

SEQ ID NO: 41908 - RNA, 22 nt, Homo sapiens
agcuguuguuuuaagauacuaa

SEQ ID NO: 41909 - RNA, 22 nt, Homo sapiens
agcuugugcuguaugaagggcc

SEQ ID NO: 41910 - RNA, 22 nt, Homo sapiens
agcuuguuuuccugcaacuaga

SEQ ID NO: 41911 - RNA, 22 nt, Homo sapiens
aggaaaucuuagcugaggggau

SEQ ID NO: 41912 - RNA, 22 nt, Homo sapiens
aggacacugagcaugggagguu

SEQ ID NO: 41913 - RNA, 22 nt, Homo sapiens
aggacacugauguaugcugugg

SEQ ID NO: 41914 - RNA, 18 nt, Homo sapiens
aggagcauagugcuauga

SEQ ID NO: 41915 - RNA, 21 nt, Homo sapiens
aggagcauucucuugcuuugu

SEQ ID NO: 41916 - RNA, 21 nt, Homo sapiens
aggagcauuguugugguggag

SEQ ID NO: 41917 - RNA, 22 nt, Homo sapiens
aggaggauugcuuucaucuuuu

SEQ ID NO: 41918 - RNA, 22 nt, Homo sapiens
aggcaacaugguaaaacccugu

SEQ ID NO: 41919 - RNA, 21 nt, Homo sapiens
aggcaagguguuauuauugaa

SEQ ID NO: 41920 - RNA, 22 nt, Homo sapiens
aggcacgguggcucacaccugu

SEQ ID NO: 41921 - RNA, 22 nt, Homo sapiens
aggcagucucugccggcugagg

SEQ ID NO: 41922 - RNA, 22 nt, Homo sapiens
aggcauggagacuaaaauuaua

SEQ ID NO: 41923 - RNA, 22 nt, Homo sapiens
aggcaugguggcacauacaugu

SEQ ID NO: 41924 - RNA, 19 nt, Homo sapiens
aggcauugugcucaucugu

SEQ ID NO: 41925 - RNA, 22 nt, Homo sapiens
agguccauugguauuauagcau

SEQ ID NO: 41926 - RNA, 22 nt, Homo sapiens
aggugcugagcagagaauccug

SEQ ID NO: 41927 - RNA, 22 nt, Homo sapiens
aggugguuuuucaacacacacu

SEQ ID NO: 41928 - RNA, 22 nt, Homo sapiens
agguuguguuugugauuagaua

SEQ ID NO: 41929 - RNA, 22 nt, Homo sapiens
aguauugcuaauaagagauuug

SEQ ID NO: 41930 - RNA, 22 nt, Homo sapiens
agucagugucuguaaggagaac

SEQ ID NO: 41931 - RNA, 23 nt, Homo sapiens
agucuguguuuacaggcucucug

SEQ ID NO: 41932 - RNA, 22 nt, Homo sapiens
agugcacucuuuccucucuuac

SEQ ID NO: 41933 - RNA, 22 nt, Homo sapiens
agugcaguggcucaaaaugccu

SEQ ID NO: 41934 - RNA, 22 nt, Homo sapiens
agugcaguggugccaucauaac

SEQ ID NO: 41935 - RNA, 22 nt, Homo sapiens
agugguguugccuguugaccua

SEQ ID NO: 41936 - RNA, 21 nt, Homo sapiens
aguucacauggcuccuguguu

SEQ ID NO: 41937 - RNA, 22 nt, Homo sapiens
auaaaagcaggucuaggucagg

SEQ ID NO: 41938 - RNA, 22 nt, Homo sapiens
auaaagacacuuggcaugauuu

SEQ ID NO: 41939 - RNA, 22 nt, Homo sapiens
auaaaugcaaugguauuuuuga

SEQ ID NO: 41940 - RNA, 22 nt, Homo sapiens
auaaaugcauugagaacugcug

SEQ ID NO: 41941 - RNA, 22 nt, Homo sapiens
auaaaugcuuccagucauuaaa

SEQ ID NO: 41942 - RNA, 22 nt, Homo sapiens
auacacguguauauguguaucu

SEQ ID NO: 41943 - RNA, 22 nt, Homo sapiens
auacagguauacaaugcauaau

SEQ ID NO: 41944 - RNA, 22 nt, Homo sapiens
auacaguguauguauaguacau

SEQ ID NO: 41945 - RNA, 22 nt, Homo sapiens
auacaguugccauuucuugugc

SEQ ID NO: 41946 - RNA, 22 nt, Homo sapiens
auacaugugccauguugguaug

SEQ ID NO: 41947 - RNA, 22 nt, Homo sapiens
auacaugugucauguugguuug

SEQ ID NO: 41948 - RNA, 22 nt, Homo sapiens
auagaagcugccaacguuucag

SEQ ID NO: 41949 - RNA, 22 nt, Homo sapiens
auagcacaguguguguacacca

SEQ ID NO: 41950 - RNA, 22 nt, Homo sapiens
auagcagaauuuggucaagucu

SEQ ID NO: 41951 - RNA, 22 nt, Homo sapiens
auagcagacauuucaaggcagg

SEQ ID NO: 41952 - RNA, 22 nt, Homo sapiens
auagcagcauauguaauguuga

SEQ ID NO: 41953 - RNA, 20 nt, Homo sapiens
auagcagcaugauuuauaau

SEQ ID NO: 41954 - RNA, 20 nt, Homo sapiens
auagcagcaugauuuauagu

SEQ ID NO: 41955 - RNA, 22 nt, Homo sapiens
auagcagcucacuuauuuaugg

SEQ ID NO: 41956 - RNA, 20 nt, Homo sapiens
auagcauugauggacucaaa

SEQ ID NO: 41957 - RNA, 22 nt, Homo sapiens
auagcccuuuucuaacuaugug

SEQ ID NO: 41958 - RNA, 22 nt, Homo sapiens
auagggcacgagaugugagccu

SEQ ID NO: 41959 - RNA, 22 nt, Homo sapiens
auaguacuauugcaguguuaua

SEQ ID NO: 41960 - RNA, 22 nt, Homo sapiens
auagugaacuuugugagaacaa

SEQ ID NO: 41961 - RNA, 22 nt, Homo sapiens
auagugcugcaauaaacacacg

SEQ ID NO: 41962 - RNA, 22 nt, Homo sapiens
auauaugcacacgugugcauau

SEQ ID NO: 41963 - RNA, 21 nt, Homo sapiens
auauggaacuggugacguguu

SEQ ID NO: 41964 - RNA, 22 nt, Homo sapiens
auaugucuauuauuagggcagg

SEQ ID NO: 41965 - RNA, 21 nt, Homo sapiens
auaugugcuguggaagucagc

SEQ ID NO: 41966 - RNA, 19 nt, Homo sapiens
aucaaacugcucuuugagg

SEQ ID NO: 41967 - RNA, 22 nt, Homo sapiens
aucaaagcagcauggcccaguc

SEQ ID NO: 41968 - RNA, 22 nt, Homo sapiens
aucaaaugcuggcagagugccu

SEQ ID NO: 41969 - RNA, 22 nt, Homo sapiens
aucacagagucacgggcaacuu

SEQ ID NO: 41970 - RNA, 22 nt, Homo sapiens
aucacaguuauaacauccuuuu

SEQ ID NO: 41971 - RNA, 22 nt, Homo sapiens
aucaccauguguacauuagacc

SEQ ID NO: 41972 - RNA, 22 nt, Homo sapiens
aucaccuggaguagcccguccc

SEQ ID NO: 41973 - RNA, 22 nt, Homo sapiens
aucacuagaucauagguaaaca

SEQ ID NO: 41974 - RNA, 22 nt, Homo sapiens
aucacugggagcagccauuaau

SEQ ID NO: 41975 - RNA, 22 nt, Homo sapiens
aucacuggucaugagagaagua

SEQ ID NO: 41976 - RNA, 22 nt, Homo sapiens
aucacuguaaguuuacacuuug

SEQ ID NO: 41977 - RNA, 22 nt, Homo sapiens
aucacugugauuucuacugugc

SEQ ID NO: 41978 - RNA, 22 nt, Homo sapiens
aucacuguuuugaugcucggac

SEQ ID NO: 41979 - RNA, 22 nt, Homo sapiens
aucagaaucucuagugggacca

SEQ ID NO: 41980 - RNA, 21 nt, Homo sapiens
aucagagacccaggcuuccuc

SEQ ID NO: 41981 - RNA, 20 nt, Homo sapiens
aucagagacuaggauugcca

SEQ ID NO: 41982 - RNA, 22 nt, Homo sapiens
aucagucuguuggaauaucgcu

SEQ ID NO: 41983 - RNA, 22 nt, Homo sapiens
aucagugcagugggaacuagaa

SEQ ID NO: 41984 - RNA, 22 nt, Homo sapiens
auccagaugggcuuaauguaau

SEQ ID NO: 41985 - RNA, 22 nt, Homo sapiens
ugcugguguuuaggaauaagaa

SEQ ID NO: 41986 - RNA, 22 nt, Homo sapiens
ugcuguguugcuggcuuaaaga

SEQ ID NO: 41987 - RNA, 22 nt, Homo sapiens
ugcuuaguuguauguuccacau

SEQ ID NO: 41988 - RNA, 22 nt, Homo sapiens
uggaaaacaugcacauuggauu

SEQ ID NO: 41989 - RNA, 22 nt, Homo sapiens
uggaaaguacugagguccaccu

SEQ ID NO: 41990 - RNA, 22 nt, Homo sapiens
uggaaauaaaauagaguuugcc

SEQ ID NO: 41991 - RNA, 22 nt, Homo sapiens
uggaaauuaagucuuuccugag

SEQ ID NO: 41992 - RNA, 20 nt, Homo sapiens
uggaaguaagaauauaggug

SEQ ID NO: 41993 - RNA, 22 nt, Homo sapiens
uggaaguagauagauuguguca

SEQ ID NO: 41994 - RNA, 22 nt, Homo sapiens
uggaaguauagauaauugaaag

SEQ ID NO: 41995 - RNA, 22 nt, Homo sapiens
uggaaucuagagaaaugcaaac

SEQ ID NO: 41996 - RNA, 21 nt, Homo sapiens
uggaaucuauuauuccaguuu

SEQ ID NO: 41997 - RNA, 21 nt, Homo sapiens
uggaaugaauggccaacaugg

SEQ ID NO: 41998 - RNA, 17 nt, Homo sapiens
uggaaugucuaagccug

SEQ ID NO: 41999 - RNA, 22 nt, Homo sapiens
uggacaagugcccuccaccuca

SEQ ID NO: 42000 - RNA, 20 nt, Homo sapiens
uggaccagagagguggggac

SEQ ID NO: 42001 - RNA, 22 nt, Homo sapiens
uaggcaauggagauagaggaug

SEQ ID NO: 42002 - RNA, 22 nt, Homo sapiens
uaggcaauguggcgaaacucug

SEQ ID NO: 42003 - RNA, 22 nt, Homo sapiens
uagggcaaggaacaguuaaaaa

SEQ ID NO: 42004 - RNA, 22 nt, Homo sapiens
uagguagguggaaaaguaauug

SEQ ID NO: 42005 - RNA, 22 nt, Homo sapiens
uaggugguuugaaauacucaag

SEQ ID NO: 42006 - RNA, 19 nt, Homo sapiens
uaggugguuuuccccucac

SEQ ID NO: 42007 - RNA, 22 nt, Homo sapiens
uagguucucaggaaugagcuuc

SEQ ID NO: 42008 - RNA, 22 nt, Homo sapiens
uagguucuccacagguucucca

SEQ ID NO: 42009 - RNA, 22 nt, Homo sapiens
uagguugucuucccagaguuuu

SEQ ID NO: 42010 - RNA, 22 nt, Homo sapiens
uagucaaaucugaaggaaauuu

SEQ ID NO: 42011 - RNA, 22 nt, Homo sapiens
uaguugcauuggcugcuaugcu

SEQ ID NO: 42012 - RNA, 22 nt, Homo sapiens
uauaaccauuucuucucucuuc

SEQ ID NO: 42013 - RNA, 22 nt, Homo sapiens
uauacagcaaguuacugugcug

SEQ ID NO: 42014 - RNA, 22 nt, Homo sapiens
uauacuguuuucuauaguggcu

SEQ ID NO: 42015 - RNA, 20 nt, Homo sapiens
uauagcaauuuuuuucuccu

SEQ ID NO: 42016 - RNA, 23 nt, Homo sapiens
uaucacacuuucucugugccaca

SEQ ID NO: 42017 - RNA, 22 nt, Homo sapiens
uaucacagauauuaugggccaa

SEQ ID NO: 42018 - RNA, 20 nt, Homo sapiens
uaucacaguucaggaacucu

SEQ ID NO: 42019 - RNA, 22 nt, Homo sapiens
uaucccuuagagcggggugguu

SEQ ID NO: 42020 - RNA, 22 nt, Homo sapiens
uaucucauccuccuugauccca

SEQ ID NO: 42021 - RNA, 20 nt, Homo sapiens
uaugacaaagccuagugagu

SEQ ID NO: 42022 - RNA, 22 nt, Homo sapiens
uaugacuguuugcucauucagg

SEQ ID NO: 42023 - RNA, 22 nt, Homo sapiens
uaugcacaugcaugcuugaaua

SEQ ID NO: 42024 - RNA, 22 nt, Homo sapiens
uauggauguuaagguucacagc

SEQ ID NO: 42025 - RNA, 22 nt, Homo sapiens
uauggcaaugcauaggaaggaa

SEQ ID NO: 42026 - RNA, 22 nt, Homo sapiens
uaugggauuucauuaagugucu

SEQ ID NO: 42027 - RNA, 17 nt, Homo sapiens
uauguaguacuuauaaa

SEQ ID NO: 42028 - RNA, 22 nt, Homo sapiens
uauuccauuugggucaggauga

SEQ ID NO: 42029 - RNA, 22 nt, Homo sapiens
uauugaacuggaucagaaggcc

SEQ ID NO: 42030 - RNA, 22 nt, Homo sapiens
uauugcacgccagccugagcaa

SEQ ID NO: 42031 - RNA, 22 nt, Homo sapiens
uauugcacuccagccuuggcaa

SEQ ID NO: 42032 - RNA, 22 nt, Homo sapiens
uauugcagugagauccaucugg

SEQ ID NO: 42033 - RNA, 22 nt, Homo sapiens
uauugcauauuauucuaguggc

SEQ ID NO: 42034 - RNA, 22 nt, Homo sapiens
uauuguacauguuauagauuuu

SEQ ID NO: 42035 - RNA, 22 nt, Homo sapiens
uauuucccuuaacuuuccugca

SEQ ID NO: 42036 - RNA, 22 nt, Homo sapiens
ucaaacauccccaccagggacu

SEQ ID NO: 42037 - RNA, 22 nt, Homo sapiens
ucaaagucuucucaaguaacau

SEQ ID NO: 42038 - RNA, 22 nt, Homo sapiens
ucaaaugauucacccaccuuug

SEQ ID NO: 42039 - RNA, 22 nt, Homo sapiens
ucaaaugauucuccugccucag

SEQ ID NO: 42040 - RNA, 22 nt, Homo sapiens
ucaaaugcucuuugcagagagg

SEQ ID NO: 42041 - RNA, 22 nt, Homo sapiens
ucaacguauuuauauagcagag

SEQ ID NO: 42042 - RNA, 22 nt, Homo sapiens
ucaagcaauucgccugucucag

SEQ ID NO: 42043 - RNA, 22 nt, Homo sapiens
ucaaggacucagagagggauua

SEQ ID NO: 42044 - RNA, 22 nt, Homo sapiens
ucaaguacugccuugcucuggc

SEQ ID NO: 42045 - RNA, 18 nt, Homo sapiens
ucaauguggauguucuuu

SEQ ID NO: 42046 - RNA, 18 nt, Homo sapiens
ucacagguaauuaggauu

SEQ ID NO: 42047 - RNA, 22 nt, Homo sapiens
ucacagucacugucacguugaa

SEQ ID NO: 42048 - RNA, 22 nt, Homo sapiens
ucacagucggugacuucuugcu

SEQ ID NO: 42049 - RNA, 22 nt, Homo sapiens
ucacagugcaggaucaguuaau

SEQ ID NO: 42050 - RNA, 22 nt, Homo sapiens
ucacaguguuaaaccuuucuuu

SEQ ID NO: 42051 - RNA, 22 nt, Homo sapiens
ucacaguucagcauggcugagg

SEQ ID NO: 42052 - RNA, 20 nt, Homo sapiens
ucacauccucucccaacaug

SEQ ID NO: 42053 - RNA, 22 nt, Homo sapiens
ucacaugaauugucuuguucca

SEQ ID NO: 42054 - RNA, 19 nt, Homo sapiens
ucaccaguacacaauacaa

SEQ ID NO: 42055 - RNA, 20 nt, Homo sapiens
ucacuauggagcucuuucuu

SEQ ID NO: 42056 - RNA, 22 nt, Homo sapiens
ucacugagcacaggagaugugc

SEQ ID NO: 42057 - RNA, 22 nt, Homo sapiens
ucacugaggucugagcuuuaug

SEQ ID NO: 42058 - RNA, 22 nt, Homo sapiens
ucacuggccaaauucuggguga

SEQ ID NO: 42059 - RNA, 20 nt, Homo sapiens
ucacugugaacuucuugagg

SEQ ID NO: 42060 - RNA, 22 nt, Homo sapiens
ucacuguguauguauaugcagg

SEQ ID NO: 42061 - RNA, 22 nt, Homo sapiens
ucacuuggccgcagccuucucu

SEQ ID NO: 42062 - RNA, 18 nt, Homo sapiens
ucagagugcagacuauac

SEQ ID NO: 42063 - RNA, 22 nt, Homo sapiens
ucagaucacuggcgcuggcgga

SEQ ID NO: 42064 - RNA, 22 nt, Homo sapiens
ucagaucaguuccacaagaacu

SEQ ID NO: 42065 - RNA, 22 nt, Homo sapiens
ucagaucaugcuuaugauggga

SEQ ID NO: 42066 - RNA, 22 nt, Homo sapiens
ucagcaaugcugcacucuacug

SEQ ID NO: 42067 - RNA, 22 nt, Homo sapiens
ucagguaaucuauuugucuuuu

SEQ ID NO: 42068 - RNA, 23 nt, Homo sapiens
ucagguaguuucagaggaccuug

SEQ ID NO: 42069 - RNA, 23 nt, Homo sapiens
ucaguacuccacuuucaauagug

SEQ ID NO: 42070 - RNA, 22 nt, Homo sapiens
ucaguaguaaauggauuuggaa

SEQ ID NO: 42071 - RNA, 22 nt, Homo sapiens
ucagucuuuuuuuggcaagcau

SEQ ID NO: 42072 - RNA, 20 nt, Homo sapiens
ucagugcagauuguccaagu

SEQ ID NO: 42073 - RNA, 22 nt, Homo sapiens
ucagugccauugccauaugagu

SEQ ID NO: 42074 - RNA, 22 nt, Homo sapiens
ucagugguuaaaagauucuaga

SEQ ID NO: 42075 - RNA, 22 nt, Homo sapiens
ucagugucugcauucuuauugu

SEQ ID NO: 42076 - RNA, 22 nt, Homo sapiens
ucaguguugauggcugcugacu

SEQ ID NO: 42077 - RNA, 22 nt, Homo sapiens
ucaguguuuggaaucucaauuu

SEQ ID NO: 42078 - RNA, 22 nt, Homo sapiens
ucauagucuaagguucuuuugc

SEQ ID NO: 42079 - RNA, 22 nt, Homo sapiens
ucauauugcgguucauugacuu

SEQ ID NO: 42080 - RNA, 22 nt, Homo sapiens
ucaucaguuuuuuauaugugau

SEQ ID NO: 42081 - RNA, 22 nt, Homo sapiens
ucaugcaaugagucaggaggca

SEQ ID NO: 42082 - RNA, 22 nt, Homo sapiens
ucaugucuuguuguauuuauuu

SEQ ID NO: 42083 - RNA, 22 nt, Homo sapiens
uccacaauggagaagaguauga

SEQ ID NO: 42084 - RNA, 22 nt, Homo sapiens
uccacagugguggaauuguuca

SEQ ID NO: 42085 - RNA, 22 nt, Homo sapiens
uccacagugguugaacuaguaa

SEQ ID NO: 42086 - RNA, 21 nt, Homo sapiens
uccagcuuugagaguuguggu

SEQ ID NO: 42087 - RNA, 22 nt, Homo sapiens
uccagguuuggcuuuauaacuu

SEQ ID NO: 42088 - RNA, 22 nt, Homo sapiens
uccauaguacuagaaacugacc

SEQ ID NO: 42089 - RNA, 22 nt, Homo sapiens
ucccagugaaaccccaccuuca

SEQ ID NO: 42090 - RNA, 22 nt, Homo sapiens
auccaucagacggcaggcguug

SEQ ID NO: 42091 - RNA, 22 nt, Homo sapiens
aucccaguucagccucugacac

SEQ ID NO: 42092 - RNA, 22 nt, Homo sapiens
aucccuagaaaaaucagcacau

SEQ ID NO: 42093 - RNA, 22 nt, Homo sapiens
aucccugagccugacucucaga

SEQ ID NO: 42094 - RNA, 22 nt, Homo sapiens
aucccugaggaauuucugcacu

SEQ ID NO: 42095 - RNA, 22 nt, Homo sapiens
aucccuguaacuagcagccccu

SEQ ID NO: 42096 - RNA, 22 nt, Homo sapiens
auccucaguggcuuaaguauag

SEQ ID NO: 42097 - RNA, 22 nt, Homo sapiens
aucgcgccauuguacuccagcc

SEQ ID NO: 42098 - RNA, 22 nt, Homo sapiens
aucuacuugcugggucucugga

SEQ ID NO: 42099 - RNA, 21 nt, Homo sapiens
aucucacuugaauguaaaagc

SEQ ID NO: 42100 - RNA, 22 nt, Homo sapiens
aucugcaaagcugggcugagac

SEQ ID NO: 42101 - RNA, 22 nt, Homo sapiens
aucugcaaauaaugaagauugg

SEQ ID NO: 42102 - RNA, 22 nt, Homo sapiens
aucugcacaucuguguuuuugu

SEQ ID NO: 42103 - RNA, 19 nt, Homo sapiens
aucuggaguuccuggggcu

SEQ ID NO: 42104 - RNA, 22 nt, Homo sapiens
aucugguguccucgugggaguc

SEQ ID NO: 42105 - RNA, 22 nt, Homo sapiens
aucugugaaugaaguuauuuug

SEQ ID NO: 42106 - RNA, 22 nt, Homo sapiens
uacugcagucagacuccugggc

SEQ ID NO: 42107 - RNA, 22 nt, Homo sapiens
uagaauggaagguugagaagaa

SEQ ID NO: 42108 - RNA, 20 nt, Homo sapiens
uagacagcuagauuagauag

SEQ ID NO: 42109 - RNA, 22 nt, Homo sapiens
uagaccaauuggcauauaguaa

SEQ ID NO: 42110 - RNA, 22 nt, Homo sapiens
uagauaguaaagccauuagcuu

SEQ ID NO: 42111 - RNA, 22 nt, Homo sapiens
uagaucacucaggcaauaaaag

SEQ ID NO: 42112 - RNA, 22 nt, Homo sapiens
uagauuaucccugauuugucca

SEQ ID NO: 42113 - RNA, 22 nt, Homo sapiens
uagauucaucuguuccuuuuga

SEQ ID NO: 42114 - RNA, 22 nt, Homo sapiens
uagcaacauucagcucagguac

SEQ ID NO: 42115 - RNA, 22 nt, Homo sapiens
uagcaccuuagcauuucuagug

SEQ ID NO: 42116 - RNA, 22 nt, Homo sapiens
uagcagcaccccacucuacugg

SEQ ID NO: 42117 - RNA, 18 nt, Homo sapiens
uagcaugaugcugagugc

SEQ ID NO: 42118 - RNA, 22 nt, Homo sapiens
uagcauggaggcggccauagug

SEQ ID NO: 42119 - RNA, 22 nt, Homo sapiens
uagcaugucagucgccacacgu

SEQ ID NO: 42120 - RNA, 22 nt, Homo sapiens
uagcuccacagcuauauauaau

SEQ ID NO: 42121 - RNA, 22 nt, Homo sapiens
uaggaaguuucuugauuacuua

SEQ ID NO: 42122 - RNA, 22 nt, Homo sapiens
uaggcaguguucucacuuguaa

SEQ ID NO: 42123 - RNA, 22 nt, Homo sapiens
uaggcaguuuuccuuucacagu

SEQ ID NO: 42124 - RNA, 22 nt, Homo sapiens
uaguaucacaagguguacaccc

SEQ ID NO: 42125 - RNA, 20 nt, Homo sapiens
uaguggaaaucagguccucu

SEQ ID NO: 42126 - RNA, 22 nt, Homo sapiens
uauacugucuuuguaugccuag

SEQ ID NO: 42127 - RNA, 22 nt, Homo sapiens
uauagcagccugaacaaaguaa

SEQ ID NO: 42128 - RNA, 22 nt, Homo sapiens
uaucaacaggguggccagugua

SEQ ID NO: 42129 - RNA, 22 nt, Homo sapiens
uaucacacuggaagaaguuaag

SEQ ID NO: 42130 - RNA, 22 nt, Homo sapiens
uaucaccauguccguuuuaaaa

SEQ ID NO: 42131 - RNA, 22 nt, Homo sapiens
uaucauaguuuggacuuucauu

SEQ ID NO: 42132 - RNA, 22 nt, Homo sapiens
uauccuguagcucauccaccgc

SEQ ID NO: 42133 - RNA, 22 nt, Homo sapiens
uaucugcacauacacuuauagc

SEQ ID NO: 42134 - RNA, 22 nt, Homo sapiens
uaugaaagcuacuucucacaau

SEQ ID NO: 42135 - RNA, 22 nt, Homo sapiens
uaugagcacauauguaucuaug

SEQ ID NO: 42136 - RNA, 19 nt, Homo sapiens
uaugagcuaugacaugcau

SEQ ID NO: 42137 - RNA, 22 nt, Homo sapiens
uaugcacacacguguuuaugug

SEQ ID NO: 42138 - RNA, 22 nt, Homo sapiens
uaugcacacguguccaugugca

SEQ ID NO: 42139 - RNA, 22 nt, Homo sapiens
uaugcuuguuuauuuaagaaac

SEQ ID NO: 42140 - RNA, 22 nt, Homo sapiens
uauggauuuuuuugacaagagc

SEQ ID NO: 42141 - RNA, 22 nt, Homo sapiens
uauggcauuauuuugauagaca

SEQ ID NO: 42142 - RNA, 20 nt, Homo sapiens
uaugguuuuagguauagcau

SEQ ID NO: 42143 - RNA, 22 nt, Homo sapiens
uaugucuucuuuagagaaaugu

SEQ ID NO: 42144 - RNA, 22 nt, Homo sapiens
uaugucuuuugcuugcaaauag

SEQ ID NO: 42145 - RNA, 22 nt, Homo sapiens
uaugugcaaauuaauugcuaga

SEQ ID NO: 42146 - RNA, 22 nt, Homo sapiens
uauuacauccauaggcucugcu

SEQ ID NO: 42147 - RNA, 22 nt, Homo sapiens
uauuccauuugugaaaggaagu

SEQ ID NO: 42148 - RNA, 22 nt, Homo sapiens
uauuccuuuugcauuuccacau

SEQ ID NO: 42149 - RNA, 22 nt, Homo sapiens
uauugaacgugggauauugaag

SEQ ID NO: 42150 - RNA, 22 nt, Homo sapiens
uauugauuaauugugauuaggc

SEQ ID NO: 42151 - RNA, 22 nt, Homo sapiens
uauugcacuuuuccauaggagu

SEQ ID NO: 42152 - RNA, 22 nt, Homo sapiens
uauugcuggcucugucuucauu

SEQ ID NO: 42153 - RNA, 22 nt, Homo sapiens
uauuugguuauaugaguaaguu

SEQ ID NO: 42154 - RNA, 20 nt, Homo sapiens
uauuugguuauuuccauggu

SEQ ID NO: 42155 - RNA, 22 nt, Homo sapiens
ucaaaaccucagagaguagagc

SEQ ID NO: 42156 - RNA, 22 nt, Homo sapiens
ucaaaugaucugcccgccuugg

SEQ ID NO: 42157 - RNA, 22 nt, Homo sapiens
ucaaaugauucagaagccaccu

SEQ ID NO: 42158 - RNA, 22 nt, Homo sapiens
ucaaaugguccacgugaacauu

SEQ ID NO: 42159 - RNA, 22 nt, Homo sapiens
ucaacagugggcacuguaaaug

SEQ ID NO: 42160 - RNA, 22 nt, Homo sapiens
ucaagcaauucuccucucagcc

SEQ ID NO: 42161 - RNA, 22 nt, Homo sapiens
ucaagcaauucuccugccucag

SEQ ID NO: 42162 - RNA, 22 nt, Homo sapiens
ucaagcaauucugcugccucag

SEQ ID NO: 42163 - RNA, 20 nt, Homo sapiens
ucaaggcacgaauaaaaguu

SEQ ID NO: 42164 - RNA, 22 nt, Homo sapiens
ucacaaagcuuggccugcuucu

SEQ ID NO: 42165 - RNA, 22 nt, Homo sapiens
ucacacugaaacuaggguguga

SEQ ID NO: 42166 - RNA, 22 nt, Homo sapiens
ucacacugaauuugaagcaaug

SEQ ID NO: 42167 - RNA, 22 nt, Homo sapiens
ucacacugcaucuguuggaauu

SEQ ID NO: 42168 - RNA, 22 nt, Homo sapiens
ucacaggguguuauuagaauua

SEQ ID NO: 42169 - RNA, 22 nt, Homo sapiens
ucacaguccuguuuaggagagg

SEQ ID NO: 42170 - RNA, 17 nt, Homo sapiens
ucacaguguuaggauga

SEQ ID NO: 42171 - RNA, 23 nt, Homo sapiens
ucacaguuacuuuugcaucaacc

SEQ ID NO: 42172 - RNA, 22 nt, Homo sapiens
ucacauuaagcuguuauuucuu

SEQ ID NO: 42173 - RNA, 22 nt, Homo sapiens
ucacauuguguagccugcucac

SEQ ID NO: 42174 - RNA, 21 nt, Homo sapiens
ucaccuguagcugcauguucu

SEQ ID NO: 42175 - RNA, 19 nt, Homo sapiens
ucaccuugcccugcacaca

SEQ ID NO: 42176 - RNA, 22 nt, Homo sapiens
ucacuauagaaaacagugugga

SEQ ID NO: 42177 - RNA, 22 nt, Homo sapiens
ucacugcacuagguaaugccac

SEQ ID NO: 42178 - RNA, 22 nt, Homo sapiens
ucacugcacuccagccuuuaug

SEQ ID NO: 42179 - RNA, 22 nt, Homo sapiens
ucacugcacuucaggcuuucuc

SEQ ID NO: 42180 - RNA, 22 nt, Homo sapiens
ucacugcgaccuccaccucccg

SEQ ID NO: 42181 - RNA, 22 nt, Homo sapiens
ucacugcgaccuccaccuccug

SEQ ID NO: 42182 - RNA, 22 nt, Homo sapiens
ucacugcgaccuccgccucccg

SEQ ID NO: 42183 - RNA, 22 nt, Homo sapiens
ucacugcgaccucugccucccg

SEQ ID NO: 42184 - RNA, 22 nt, Homo sapiens
ucagagugcagggaguagcagc

SEQ ID NO: 42185 - RNA, 22 nt, Homo sapiens
ucagaucauauucuucgcugcu

SEQ ID NO: 42186 - RNA, 22 nt, Homo sapiens
ucagaugauucuguuguugugu

SEQ ID NO: 42187 - RNA, 22 nt, Homo sapiens
ucagcagugugaaaacaaacua

SEQ ID NO: 42188 - RNA, 22 nt, Homo sapiens
ucagcagugugaaaauggacua

SEQ ID NO: 42189 - RNA, 22 nt, Homo sapiens
ucaggugcaguggcucugaccu

SEQ ID NO: 42190 - RNA, 22 nt, Homo sapiens
ucagugccucaguuuuuaaaga

SEQ ID NO: 42191 - RNA, 22 nt, Homo sapiens
guaaucucagcuacuugggagg

SEQ ID NO: 42192 - RNA, 22 nt, Homo sapiens
guacacguggcuguguaggagu

SEQ ID NO: 42193 - RNA, 22 nt, Homo sapiens
guacaggcagcaaacaccauaa

SEQ ID NO: 42194 - RNA, 22 nt, Homo sapiens
guagcaccagugcucuucucaa

SEQ ID NO: 42195 - RNA, 22 nt, Homo sapiens
guagcagcuacuaaguugcugu

SEQ ID NO: 42196 - RNA, 22 nt, Homo sapiens
guagcaugcaauauuauagaga

SEQ ID NO: 42197 - RNA, 22 nt, Homo sapiens
guauacaugucaaaacucacau

SEQ ID NO: 42198 - RNA, 22 nt, Homo sapiens
guaugacacaggaagcuuaacc

SEQ ID NO: 42199 - RNA, 22 nt, Homo sapiens
guauggaagucaguuuguuggc

SEQ ID NO: 42200 - RNA, 22 nt, Homo sapiens
gucacaguguuuguucauccca

SEQ ID NO: 42201 - RNA, 22 nt, Homo sapiens
gucaccauugagucauuuccuc

SEQ ID NO: 42202 - RNA, 22 nt, Homo sapiens
gucagcaaagaggaauaguuug

SEQ ID NO: 42203 - RNA, 22 nt, Homo sapiens
gucagcaaaguucuccugcaga

SEQ ID NO: 42204 - RNA, 22 nt, Homo sapiens
gucagugcauguaaacauaaaa

SEQ ID NO: 42205 - RNA, 22 nt, Homo sapiens
caagugcuacagagaaaucuuu

SEQ ID NO: 42206 - RNA, 22 nt, Homo sapiens
caaguguuuccuuaaauacuug

SEQ ID NO: 42207 - RNA, 22 nt, Homo sapiens
cacaggaagaggcacggucccu

SEQ ID NO: 42208 - RNA, 22 nt, Homo sapiens
cacagucugggcuuguuuguac

SEQ ID NO: 42209 - RNA, 22 nt, Homo sapiens
cacauagucccugcuaaucuuc

SEQ ID NO: 42210 - RNA, 22 nt, Homo sapiens
cacauguuugcuacauuuuucu

SEQ ID NO: 42211 - RNA, 22 nt, Homo sapiens
caccagcuggcauugaauaccu

SEQ ID NO: 42212 - RNA, 22 nt, Homo sapiens
caccagguggcugaggccauga

SEQ ID NO: 42213 - RNA, 22 nt, Homo sapiens
cacugcacuccagucccgucuc

SEQ ID NO: 42214 - RNA, 22 nt, Homo sapiens
cacugcauccuccaccuccugg

SEQ ID NO: 42215 - RNA, 22 nt, Homo sapiens
cacugcauggucuagcuggguu

SEQ ID NO: 42216 - RNA, 22 nt, Homo sapiens
cacugggugagauccauguuua

SEQ ID NO: 42217 - RNA, 22 nt, Homo sapiens
cagagguaagcaagucagcauu

SEQ ID NO: 42218 - RNA, 22 nt, Homo sapiens
cagaugcaugaccugggcuugg

SEQ ID NO: 42219 - RNA, 22 nt, Homo sapiens
cagcuguuguuaugucugcagg

SEQ ID NO: 42220 - RNA, 22 nt, Homo sapiens
caggaaugugaggguucccugc

SEQ ID NO: 42221 - RNA, 20 nt, Homo sapiens
cagucauagacaucagaguc

SEQ ID NO: 42222 - RNA, 20 nt, Homo sapiens
cagucaugaagaacugugag

SEQ ID NO: 42223 - RNA, 22 nt, Homo sapiens
cagugauaggugguuguuggca

SEQ ID NO: 42224 - RNA, 22 nt, Homo sapiens
cagugguuuuuagcuugcuggg

SEQ ID NO: 42225 - RNA, 22 nt, Homo sapiens
caguucaugguaggcaccauag

SEQ ID NO: 42226 - RNA, 22 nt, Homo sapiens
cauaaagauggaggaggccagg

SEQ ID NO: 42227 - RNA, 22 nt, Homo sapiens
cauacaugugcuugucuuaugc

SEQ ID NO: 42228 - RNA, 22 nt, Homo sapiens
cauauucacuuuacagagcugu

SEQ ID NO: 42229 - RNA, 22 nt, Homo sapiens
caucacacuuggauguaagaca

SEQ ID NO: 42230 - RNA, 22 nt, Homo sapiens
cauggcucuuguuuacucccag

SEQ ID NO: 42231 - RNA, 21 nt, Homo sapiens
caugucacugcacucuagccu

SEQ ID NO: 42232 - RNA, 22 nt, Homo sapiens
cauugcaaugaggucuugcagu

SEQ ID NO: 42233 - RNA, 22 nt, Homo sapiens
cauugcacacauuuaccuaugu

SEQ ID NO: 42234 - RNA, 19 nt, Homo sapiens
cauugcacuccacccuggg

SEQ ID NO: 42235 - RNA, 22 nt, Homo sapiens
cauugcacuccagcccuggcaa

SEQ ID NO: 42236 - RNA, 22 nt, Homo sapiens
cauugcacuccagccuagccaa

SEQ ID NO: 42237 - RNA, 22 nt, Homo sapiens
cauugcacuccagccucggcaa

SEQ ID NO: 42238 - RNA, 22 nt, Homo sapiens
cauugcacuccagccugaccaa

SEQ ID NO: 42239 - RNA, 22 nt, Homo sapiens
cauugcacuccagccugaggga

SEQ ID NO: 42240 - RNA, 22 nt, Homo sapiens
cauugcacuccagccugaguga

SEQ ID NO: 42241 - RNA, 22 nt, Homo sapiens
cauugcacuccagccugcacga

SEQ ID NO: 42242 - RNA, 22 nt, Homo sapiens
cauugcacuccagccuggcaac

SEQ ID NO: 42243 - RNA, 22 nt, Homo sapiens
cauugcacuccagccuggccaa

SEQ ID NO: 42244 - RNA, 22 nt, Homo sapiens
cauugcacuccagccuuggcaa

SEQ ID NO: 42245 - RNA, 22 nt, Homo sapiens
cauugcacuccagcucugggcg

SEQ ID NO: 42246 - RNA, 22 nt, Homo sapiens
cauugcacuccagcuugggcga

SEQ ID NO: 42247 - RNA, 22 nt, Homo sapiens
cauugcacugcauucugggcaa

SEQ ID NO: 42248 - RNA, 22 nt, Homo sapiens
ccaaaguauuuucacugauauc

SEQ ID NO: 42249 - RNA, 22 nt, Homo sapiens
ccaaguguucucauuguucaau

SEQ ID NO: 42250 - RNA, 22 nt, Homo sapiens
ccacaguggauuaaaguuacug

SEQ ID NO: 42251 - RNA, 22 nt, Homo sapiens
ccaccgggucccagcucugcuc

SEQ ID NO: 42252 - RNA, 22 nt, Homo sapiens
ccacugugguaucugauacugg

SEQ ID NO: 42253 - RNA, 22 nt, Homo sapiens
ccagcaccauuuauuaaauagg

SEQ ID NO: 42254 - RNA, 22 nt, Homo sapiens
ccagcaccauuuguugaauagg

SEQ ID NO: 42255 - RNA, 22 nt, Homo sapiens
ccagucuuggugucuguagcac

SEQ ID NO: 42256 - RNA, 18 nt, Homo sapiens
ccagugcaaggaaagccc

SEQ ID NO: 42257 - RNA, 22 nt, Homo sapiens
ccaguguucuggaaggcugagu

SEQ ID NO: 42258 - RNA, 19 nt, Homo sapiens
ccaguguugccagagcuga

SEQ ID NO: 42259 - RNA, 22 nt, Homo sapiens
cccacaguggccucauauccuu

SEQ ID NO: 42260 - RNA, 22 nt, Homo sapiens
cccaguguuacgugacagccug

SEQ ID NO: 42261 - RNA, 22 nt, Homo sapiens
ccccagguuucaauaaagccca

SEQ ID NO: 42262 - RNA, 22 nt, Homo sapiens
ccccggguggauguacauguga

SEQ ID NO: 42263 - RNA, 22 nt, Homo sapiens
ccccugaaacucacucauuauc

SEQ ID NO: 42264 - RNA, 22 nt, Homo sapiens
cccugagaugugaauuucagag

SEQ ID NO: 42265 - RNA, 22 nt, Homo sapiens
cccuguguuuagcugaagguuu

SEQ ID NO: 42266 - RNA, 22 nt, Homo sapiens
cccuucauucaaggguugugag

SEQ ID NO: 42267 - RNA, 19 nt, Homo sapiens
ccucaaguacuaauauguu

SEQ ID NO: 42268 - RNA, 22 nt, Homo sapiens
ccugagguagaguuuauauuga

SEQ ID NO: 42269 - RNA, 22 nt, Homo sapiens
ccugcauaguucaccgcugaua

SEQ ID NO: 42270 - RNA, 22 nt, Homo sapiens
ccuggcacugagcaguguucua

SEQ ID NO: 42271 - RNA, 22 nt, Homo sapiens
ccugugguuaaccagcuagaug

SEQ ID NO: 42272 - RNA, 22 nt, Homo sapiens
ccuucacaggcacugguucaga

SEQ ID NO: 42273 - RNA, 22 nt, Homo sapiens
ccuuggcacuacugacauugua

SEQ ID NO: 42274 - RNA, 22 nt, Homo sapiens
ccuuuguuuaguugaauuguau

SEQ ID NO: 42275 - RNA, 22 nt, Homo sapiens
cuaaagauagugacaugauuug

SEQ ID NO: 42276 - RNA, 18 nt, Homo sapiens
cuaauacuauucaacaag

SEQ ID NO: 42277 - RNA, 22 nt, Homo sapiens
cuacucuggagagugacaauca

SEQ ID NO: 42278 - RNA, 22 nt, Homo sapiens
cuacugacacuacugcaaucau

SEQ ID NO: 42279 - RNA, 22 nt, Homo sapiens
cuagacacugacguuccuccga

SEQ ID NO: 42280 - RNA, 22 nt, Homo sapiens
cuagagagaagcugugugaccu

SEQ ID NO: 42281 - RNA, 22 nt, Homo sapiens
cuagcacauaguuauucacuca

SEQ ID NO: 42282 - RNA, 22 nt, Homo sapiens
cuaggugauccacugcucucuu

SEQ ID NO: 42283 - RNA, 22 nt, Homo sapiens
cuaggugcaugagccguacagu

SEQ ID NO: 42284 - RNA, 22 nt, Homo sapiens
cucacaugcucaccugguguuc

SEQ ID NO: 42285 - RNA, 22 nt, Homo sapiens
cucacugcauuucaguuuuguu

SEQ ID NO: 42286 - RNA, 22 nt, Homo sapiens
cucaguguucccauucuaccuu

SEQ ID NO: 42287 - RNA, 22 nt, Homo sapiens
cucaguguuucagcugcucaga

SEQ ID NO: 42288 - RNA, 22 nt, Homo sapiens
cucauugcaaucucugccuccc

SEQ ID NO: 42289 - RNA, 22 nt, Homo sapiens
cuccacugagcaggugggaggc

SEQ ID NO: 42290 - RNA, 22 nt, Homo sapiens
cuccaugagauuguugaaguag

SEQ ID NO: 42291 - RNA, 23 nt, Homo sapiens
cuccaugagccguccagggccug

SEQ ID NO: 42292 - RNA, 20 nt, Homo sapiens
cucuaguaauaaaguuuccc

SEQ ID NO: 42293 - RNA, 22 nt, Homo sapiens
cugaccucugucaaagacaccc

SEQ ID NO: 42294 - RNA, 22 nt, Homo sapiens
cugacugaggaucaguucauca

SEQ ID NO: 42295 - RNA, 23 nt, Homo sapiens
aauugcuuuugaggacuuaguug

SEQ ID NO: 42296 - RNA, 22 nt, Homo sapiens
aauuguacucccauaauucccu

SEQ ID NO: 42297 - RNA, 22 nt, Homo sapiens
aauugugcuuguaggccaggca

SEQ ID NO: 42298 - RNA, 22 nt, Homo sapiens
acacauuagcaagugcuguuau

SEQ ID NO: 42299 - RNA, 22 nt, Homo sapiens
acacuguuuuaguuauuauagc

SEQ ID NO: 42300 - RNA, 22 nt, Homo sapiens
acacuuucuggagcugcacaua

SEQ ID NO: 42301 - RNA, 22 nt, Homo sapiens
ugaguucaauuguauuuuauua

SEQ ID NO: 42302 - RNA, 22 nt, Homo sapiens
ugaguucaugcuuguaguucua

SEQ ID NO: 42303 - RNA, 22 nt, Homo sapiens
ugauagucuuugcuggugaccu

SEQ ID NO: 42304 - RNA, 22 nt, Homo sapiens
ugauauauugaaugaugaaaca

SEQ ID NO: 42305 - RNA, 20 nt, Homo sapiens
ugauauuucuggaaguggag

SEQ ID NO: 42306 - RNA, 21 nt, Homo sapiens
ugaugcaauccgcuaggucgc

SEQ ID NO: 42307 - RNA, 22 nt, Homo sapiens
ugaugcuacuaccugggcugaa

SEQ ID NO: 42308 - RNA, 22 nt, Homo sapiens
ugaugcugaugccugccagaag

SEQ ID NO: 42309 - RNA, 22 nt, Homo sapiens
ugauggcacagugaguuccagg

SEQ ID NO: 42310 - RNA, 22 nt, Homo sapiens
ugaugguuuuaaaaagaggagu

SEQ ID NO: 42311 - RNA, 22 nt, Homo sapiens
ugcaaagaaauuuuggugacca

SEQ ID NO: 42312 - RNA, 22 nt, Homo sapiens
ugcaaauguuaggugucauuau

SEQ ID NO: 42313 - RNA, 22 nt, Homo sapiens
ugcaagucaucuguccuucaga

SEQ ID NO: 42314 - RNA, 22 nt, Homo sapiens
ugcaauauccucuacuauaggu

SEQ ID NO: 42315 - RNA, 22 nt, Homo sapiens
ugcacaguccagugcccacuga

SEQ ID NO: 42316 - RNA, 22 nt, Homo sapiens
ugcagcucaaauuccuaacaag

SEQ ID NO: 42317 - RNA, 22 nt, Homo sapiens
ugcaguagugugaucuuggcuc

SEQ ID NO: 42318 - RNA, 22 nt, Homo sapiens
ugcagugugaaagagccugaca

SEQ ID NO: 42319 - RNA, 21 nt, Homo sapiens
ugcagugugguugcccugcug

SEQ ID NO: 42320 - RNA, 22 nt, Homo sapiens
ugcauagaauguucuguaaaua

SEQ ID NO: 42321 - RNA, 22 nt, Homo sapiens
acucugucuaguuguaaaauuu

SEQ ID NO: 42322 - RNA, 22 nt, Homo sapiens
acugagccuuuaaaugacuuca

SEQ ID NO: 42323 - RNA, 22 nt, Homo sapiens
acugcacuccagccuggacgac

SEQ ID NO: 42324 - RNA, 22 nt, Homo sapiens
acugcacuccagccugugcgua

SEQ ID NO: 42325 - RNA, 22 nt, Homo sapiens
acugcacuccagccuucgugac

SEQ ID NO: 42326 - RNA, 22 nt, Homo sapiens
acugcacuccagccuugcgaca

SEQ ID NO: 42327 - RNA, 22 nt, Homo sapiens
acugcacuccagccuuggcggc

SEQ ID NO: 42328 - RNA, 22 nt, Homo sapiens
acugcacuccagccuuugcgau

SEQ ID NO: 42329 - RNA, 19 nt, Homo sapiens
acugcacuccuccuugggu

SEQ ID NO: 42330 - RNA, 20 nt, Homo sapiens
acugcauuuaguccucagga

SEQ ID NO: 42331 - RNA, 22 nt, Homo sapiens
acugcauuugguaaagucaaga

SEQ ID NO: 42332 - RNA, 20 nt, Homo sapiens
acuggcacugguaggugugg

SEQ ID NO: 42333 - RNA, 22 nt, Homo sapiens
acugggauauuauugguaauau

SEQ ID NO: 42334 - RNA, 20 nt, Homo sapiens
acugggcuaccgaaguaagg

SEQ ID NO: 42335 - RNA, 22 nt, Homo sapiens
acuucauucucuggaucagaau

SEQ ID NO: 42336 - RNA, 22 nt, Homo sapiens
agaaacacagguggaauugcuu

SEQ ID NO: 42337 - RNA, 20 nt, Homo sapiens
agaagcauugcucucuucag

SEQ ID NO: 42338 - RNA, 22 nt, Homo sapiens
agacagcuggaguaucauagcu

SEQ ID NO: 42339 - RNA, 20 nt, Homo sapiens
agacuagggagcagaaagcc

SEQ ID NO: 42340 - RNA, 22 nt, Homo sapiens
agacucauuuccauagucagcu

SEQ ID NO: 42341 - RNA, 22 nt, Homo sapiens
agagaugauuaacauuuuggua

SEQ ID NO: 42342 - RNA, 22 nt, Homo sapiens
agaggucuuaucaaacaugcuu

SEQ ID NO: 42343 - RNA, 22 nt, Homo sapiens
agagugcuuuauuagauguagc

SEQ ID NO: 42344 - RNA, 22 nt, Homo sapiens
agaugauguuucuggcacauga

SEQ ID NO: 42345 - RNA, 23 nt, Homo sapiens
agauggcauuucaguucuuuagg

SEQ ID NO: 42346 - RNA, 22 nt, Homo sapiens
agauggguuuucacauguuggc

SEQ ID NO: 42347 - RNA, 22 nt, Homo sapiens
agaugguguuggcugaguguau

SEQ ID NO: 42348 - RNA, 23 nt, Homo sapiens
agcaaaugcucuagcacuccaac

SEQ ID NO: 42349 - RNA, 22 nt, Homo sapiens
agcaagauccagucgcacagga

SEQ ID NO: 42350 - RNA, 23 nt, Homo sapiens
agcaccuuuccuccacuaucugc

SEQ ID NO: 42351 - RNA, 22 nt, Homo sapiens
agcagcauuaugauauaucuua

SEQ ID NO: 42352 - RNA, 22 nt, Homo sapiens
agcagcauuccaaaaaucugcu

SEQ ID NO: 42353 - RNA, 22 nt, Homo sapiens
agcagcucaagacuuaaauuug

SEQ ID NO: 42354 - RNA, 22 nt, Homo sapiens
agcagugugagaauggacuaau

SEQ ID NO: 42355 - RNA, 22 nt, Homo sapiens
agccuguguugaauuauagaaa

SEQ ID NO: 42356 - RNA, 22 nt, Homo sapiens
agcggcuguuccccuggucuau

SEQ ID NO: 42357 - RNA, 21 nt, Homo sapiens
agcuaaauuggaaauuucugu

SEQ ID NO: 42358 - RNA, 22 nt, Homo sapiens
agcuggcuguagcugcaagucu

SEQ ID NO: 42359 - RNA, 22 nt, Homo sapiens
agcugguauuuugucaaggaua

SEQ ID NO: 42360 - RNA, 22 nt, Homo sapiens
agcuggucuacguguguaugag

SEQ ID NO: 42361 - RNA, 22 nt, Homo sapiens
agcuuguggugaauacugcuag

SEQ ID NO: 42362 - RNA, 22 nt, Homo sapiens
agcuuuuugggaggccuuagga

SEQ ID NO: 42363 - RNA, 22 nt, Homo sapiens
aggaagacauauagaacuaaaa

SEQ ID NO: 42364 - RNA, 23 nt, Homo sapiens
aggaaguaacuaucuuuucuguc

SEQ ID NO: 42365 - RNA, 23 nt, Homo sapiens
aggaauggaaaaccaaguaucau

SEQ ID NO: 42366 - RNA, 22 nt, Homo sapiens
aggaaugucaaugguaguuuaa

SEQ ID NO: 42367 - RNA, 22 nt, Homo sapiens
aggaauguuaguacuucuuagu

SEQ ID NO: 42368 - RNA, 22 nt, Homo sapiens
aggagaugaagcuuuaucuaaa

SEQ ID NO: 42369 - RNA, 23 nt, Homo sapiens
aggagcuuagaaguugccauugc

SEQ ID NO: 42370 - RNA, 22 nt, Homo sapiens
aggcaagugggagacagcauuu

SEQ ID NO: 42371 - RNA, 22 nt, Homo sapiens
aggcagaugagguccucagcug

SEQ ID NO: 42372 - RNA, 22 nt, Homo sapiens
aggcagcuguuauauacugagu

SEQ ID NO: 42373 - RNA, 22 nt, Homo sapiens
aggcaggugaaagauaguuuua

SEQ ID NO: 42374 - RNA, 22 nt, Homo sapiens
aggcaguuucagugagagguga

SEQ ID NO: 42375 - RNA, 22 nt, Homo sapiens
aggcauugugcaucgaugauuu

SEQ ID NO: 42376 - RNA, 22 nt, Homo sapiens
agggaagugugcuaugcauuua

SEQ ID NO: 42377 - RNA, 22 nt, Homo sapiens
agggaauguaaguuuuaugaga

SEQ ID NO: 42378 - RNA, 22 nt, Homo sapiens
aggguuuuuauuuauguggcau

SEQ ID NO: 42379 - RNA, 22 nt, Homo sapiens
agguagguugagaugggcauca

SEQ ID NO: 42380 - RNA, 22 nt, Homo sapiens
agguauauuggacagauguaaa

SEQ ID NO: 42381 - RNA, 21 nt, Homo sapiens
aggucaugaagauguucuaau

SEQ ID NO: 42382 - RNA, 22 nt, Homo sapiens
aggugcugacaggauagguuuc

SEQ ID NO: 42383 - RNA, 21 nt, Homo sapiens
aguagcacugugucuuacaaa

SEQ ID NO: 42384 - RNA, 22 nt, Homo sapiens
agucacagccuuuuacuuuaga

SEQ ID NO: 42385 - RNA, 22 nt, Homo sapiens
agucagucuguccugugcugag

SEQ ID NO: 42386 - RNA, 22 nt, Homo sapiens
agucauuguugagaugguguca

SEQ ID NO: 42387 - RNA, 22 nt, Homo sapiens
aguccaguguuaugaucaguag

SEQ ID NO: 42388 - RNA, 22 nt, Homo sapiens
agugacaugggaucaaaucuga

SEQ ID NO: 42389 - RNA, 21 nt, Homo sapiens
agugagucauuuggaaagcaa

SEQ ID NO: 42390 - RNA, 22 nt, Homo sapiens
agugauggagccaggauuuaau

SEQ ID NO: 42391 - RNA, 22 nt, Homo sapiens
agugcacuccagccugggcaac

SEQ ID NO: 42392 - RNA, 22 nt, Homo sapiens
agugcaguggcauggucauaac

SEQ ID NO: 42393 - RNA, 22 nt, Homo sapiens
agugcauuugcaucucaauaua

SEQ ID NO: 42394 - RNA, 22 nt, Homo sapiens
agugcauuuguucugugucagg

SEQ ID NO: 42395 - RNA, 22 nt, Homo sapiens
aguggcacaauuuugacucccc

SEQ ID NO: 42396 - RNA, 22 nt, Homo sapiens
agugucaggagacagguagcug

SEQ ID NO: 42397 - RNA, 22 nt, Homo sapiens
aguucaaaucgagccuggccau

SEQ ID NO: 42398 - RNA, 22 nt, Homo sapiens
aguucaaugcucuuucuacuau

SEQ ID NO: 42399 - RNA, 19 nt, Homo sapiens
auaaaugccuacaagggug

SEQ ID NO: 42400 - RNA, 22 nt, Homo sapiens
auaaguauuuggacuuuacugu

SEQ ID NO: 42401 - RNA, 22 nt, Homo sapiens
auaauaccugccacauuugaau

SEQ ID NO: 42402 - RNA, 22 nt, Homo sapiens
auaaucaugucugaaaccuuug

SEQ ID NO: 42403 - RNA, 22 nt, Homo sapiens
auacacgugcagaacaugcagg

SEQ ID NO: 42404 - RNA, 22 nt, Homo sapiens
auacacgugccauguuggugug

SEQ ID NO: 42405 - RNA, 22 nt, Homo sapiens
auacacuagggcuccugcagaa

SEQ ID NO: 42406 - RNA, 22 nt, Homo sapiens
auacagugaauacuuacagugu

SEQ ID NO: 42407 - RNA, 22 nt, Homo sapiens
auacuaugagauaauaaagacu

SEQ ID NO: 42408 - RNA, 21 nt, Homo sapiens
auacuugcauccuuggagaga

SEQ ID NO: 42409 - RNA, 22 nt, Homo sapiens
auagaagcuauguauaggggcc

SEQ ID NO: 42410 - RNA, 22 nt, Homo sapiens
auagaauguauuaguaaauuug

SEQ ID NO: 42411 - RNA, 22 nt, Homo sapiens
auagagugcuucaucaguagua

SEQ ID NO: 42412 - RNA, 22 nt, Homo sapiens
auagaucuauuuauguaucccu

SEQ ID NO: 42413 - RNA, 22 nt, Homo sapiens
auagcaaugccccacuccuugg

SEQ ID NO: 42414 - RNA, 22 nt, Homo sapiens
auagcaaugccccauucccagu

SEQ ID NO: 42415 - RNA, 22 nt, Homo sapiens
cuucaucugguuugugaacuuu

SEQ ID NO: 42416 - RNA, 22 nt, Homo sapiens
cuucaugggagaaccacaggua

SEQ ID NO: 42417 - RNA, 18 nt, Homo sapiens
cuucauugcuguuuugcu

SEQ ID NO: 42418 - RNA, 22 nt, Homo sapiens
cuucuugagacuuaggcuuugg

SEQ ID NO: 42419 - RNA, 22 nt, Homo sapiens
cuucuugagggccugcugggaa

SEQ ID NO: 42420 - RNA, 22 nt, Homo sapiens
cuugacaaugcuucaggcugaa

SEQ ID NO: 42421 - RNA, 22 nt, Homo sapiens
cuugugauugcacggcugccug

SEQ ID NO: 42422 - RNA, 22 nt, Homo sapiens
cuuguggugcuuuuacgugggc

SEQ ID NO: 42423 - RNA, 22 nt, Homo sapiens
cuuguguuacauauuuaagaga

SEQ ID NO: 42424 - RNA, 22 nt, Homo sapiens
cuuucugaggagaauagagaac

SEQ ID NO: 42425 - RNA, 22 nt, Homo sapiens
cuuuggcacuuccuaagugcca

SEQ ID NO: 42426 - RNA, 22 nt, Homo sapiens
ucucuguuuauuuuugguguau

SEQ ID NO: 42427 - RNA, 22 nt, Homo sapiens
ucucuuggcggaaguugcagug

SEQ ID NO: 42428 - RNA, 22 nt, Homo sapiens
ucucuugguugaacaguuugga

SEQ ID NO: 42429 - RNA, 20 nt, Homo sapiens
ucugauugcaacugcaugag

SEQ ID NO: 42430 - RNA, 22 nt, Homo sapiens
ucuggccuacaaguaauuuuau

SEQ ID NO: 42431 - RNA, 22 nt, Homo sapiens
ucuggccuacaucauuuuuccg

SEQ ID NO: 42432 - RNA, 22 nt, Homo sapiens
ucuggccuagaacaauuaauua

SEQ ID NO: 42433 - RNA, 22 nt, Homo sapiens
ucuguacugccaaguuucuuua

SEQ ID NO: 42434 - RNA, 22 nt, Homo sapiens
ucugucuuugccuaaguuuguc

SEQ ID NO: 42435 - RNA, 22 nt, Homo sapiens
ucugugcauuuucuuuuagacu

SEQ ID NO: 42436 - RNA, 19 nt, Homo sapiens
ucugugcuugucccccugu

SEQ ID NO: 42437 - RNA, 22 nt, Homo sapiens
ucugugguucuagcuacuuugg

SEQ ID NO: 42438 - RNA, 22 nt, Homo sapiens
ucuguguugaugcucauuaauu

SEQ ID NO: 42439 - RNA, 22 nt, Homo sapiens
ucuguugguucuuugaggagga

SEQ ID NO: 42440 - RNA, 17 nt, Homo sapiens
ucuucuguuacuguggc

SEQ ID NO: 42441 - RNA, 17 nt, Homo sapiens
ucuugugguucuugaau

SEQ ID NO: 42442 - RNA, 22 nt, Homo sapiens
ucuuucacuuagcaugauguuu

SEQ ID NO: 42443 - RNA, 22 nt, Homo sapiens
ucuuugggauauucugaaaggg

SEQ ID NO: 42444 - RNA, 22 nt, Homo sapiens
ugaaaaguuguugaaggcuuca

SEQ ID NO: 42445 - RNA, 22 nt, Homo sapiens
ugaaacacacauugcccuuuau

SEQ ID NO: 42446 - RNA, 20 nt, Homo sapiens
ugaaacacauggacuggggu

SEQ ID NO: 42447 - RNA, 22 nt, Homo sapiens
ugaacacagccugccucugcca

SEQ ID NO: 42448 - RNA, 21 nt, Homo sapiens
ugaaccccugcucucaagaaa

SEQ ID NO: 42449 - RNA, 20 nt, Homo sapiens
ugaacugguuacuuucuguc

SEQ ID NO: 42450 - RNA, 22 nt, Homo sapiens
ugaaggacauaaggcagaguga

SEQ ID NO: 42451 - RNA, 22 nt, Homo sapiens
ugaaggaguauggauaagucgu

SEQ ID NO: 42452 - RNA, 22 nt, Homo sapiens
ugaagugaagacucacagaagg

SEQ ID NO: 42453 - RNA, 22 nt, Homo sapiens
ugaauagacacuaaagacugua

SEQ ID NO: 42454 - RNA, 22 nt, Homo sapiens
ugaaugugauggguuucaugug

SEQ ID NO: 42455 - RNA, 22 nt, Homo sapiens
ugacacauguagacaucuggug

SEQ ID NO: 42456 - RNA, 22 nt, Homo sapiens
ugacaucaccaccuccgucauc

SEQ ID NO: 42457 - RNA, 18 nt, Homo sapiens
ugacaucauuuagaaagg

SEQ ID NO: 42458 - RNA, 21 nt, Homo sapiens
ugacauuauuucaugucagua

SEQ ID NO: 42459 - RNA, 21 nt, Homo sapiens
ugacuagauuccagauuggcc

SEQ ID NO: 42460 - RNA, 22 nt, Homo sapiens
ugacuaggaggcuggaggauga

SEQ ID NO: 42461 - RNA, 22 nt, Homo sapiens
ugacuagggacauucuuccacg

SEQ ID NO: 42462 - RNA, 22 nt, Homo sapiens
ugacuagggcucuaaacagcuc

SEQ ID NO: 42463 - RNA, 22 nt, Homo sapiens
ugacuauugauuuagacgugcu

SEQ ID NO: 42464 - RNA, 22 nt, Homo sapiens
ugacuggaacuuuagugagucu

SEQ ID NO: 42465 - RNA, 23 nt, Homo sapiens
ugacuggagacuguugauccuuu

SEQ ID NO: 42466 - RNA, 22 nt, Homo sapiens
ugacuggagucuugcucugucg

SEQ ID NO: 42467 - RNA, 20 nt, Homo sapiens
ugacuggauacccuuuggcu

SEQ ID NO: 42468 - RNA, 19 nt, Homo sapiens
ugagaacaugugguauuug

SEQ ID NO: 42469 - RNA, 20 nt, Homo sapiens
ugagaacaugugguauuugg

SEQ ID NO: 42470 - RNA, 22 nt, Homo sapiens
ugagaacucaugaaucuuucca

SEQ ID NO: 42471 - RNA, 22 nt, Homo sapiens
ugagaacuuugucuuuuacucu

SEQ ID NO: 42472 - RNA, 22 nt, Homo sapiens
ugagaagacaucuuugcuuugu

SEQ ID NO: 42473 - RNA, 22 nt, Homo sapiens
ugagaauauuugaagauguuag

SEQ ID NO: 42474 - RNA, 22 nt, Homo sapiens
ugagaauguagggcucucccag

SEQ ID NO: 42475 - RNA, 22 nt, Homo sapiens
ugagacugagucuugcucuugu

SEQ ID NO: 42476 - RNA, 22 nt, Homo sapiens
ugagaguauaaauugaugcagc

SEQ ID NO: 42477 - RNA, 22 nt, Homo sapiens
ugagauaacuaaaaacauuuug

SEQ ID NO: 42478 - RNA, 22 nt, Homo sapiens
ugagauaggaucuugcucuguu

SEQ ID NO: 42479 - RNA, 22 nt, Homo sapiens
ugagauaguuguagauguacau

SEQ ID NO: 42480 - RNA, 22 nt, Homo sapiens
ugagauccugugacuacacuga

SEQ ID NO: 42481 - RNA, 22 nt, Homo sapiens
ugagaugaagugauguaaaaca

SEQ ID NO: 42482 - RNA, 22 nt, Homo sapiens
ugagaugagaaucaguucuaau

SEQ ID NO: 42483 - RNA, 22 nt, Homo sapiens
ugagaugagggaagccuaggca

SEQ ID NO: 42484 - RNA, 22 nt, Homo sapiens
ugagaugaguugcgcucugucg

SEQ ID NO: 42485 - RNA, 22 nt, Homo sapiens
ugagaugaguugcuggcucuga

SEQ ID NO: 42486 - RNA, 22 nt, Homo sapiens
ugagaugaugggauaagagggc

SEQ ID NO: 42487 - RNA, 22 nt, Homo sapiens
ugagcagaaagcugcaaggucg

SEQ ID NO: 42488 - RNA, 22 nt, Homo sapiens
ugagccaugguuagcuucucau

SEQ ID NO: 42489 - RNA, 22 nt, Homo sapiens
ugagcucaugcauucuugagga

SEQ ID NO: 42490 - RNA, 22 nt, Homo sapiens
ugagcugagacaauaaguuuuu

SEQ ID NO: 42491 - RNA, 22 nt, Homo sapiens
ugagcugagaucacacuacugu

SEQ ID NO: 42492 - RNA, 22 nt, Homo sapiens
ugagcugagaucuuaccacugc

SEQ ID NO: 42493 - RNA, 22 nt, Homo sapiens
ugagguagaaugauucuaauau

SEQ ID NO: 42494 - RNA, 22 nt, Homo sapiens
ugagguaugugaugucuuuuag

SEQ ID NO: 42495 - RNA, 20 nt, Homo sapiens
ugaguagaggaguucuauca

SEQ ID NO: 42496 - RNA, 22 nt, Homo sapiens
ugaguagcuaagacgauaggca

SEQ ID NO: 42497 - RNA, 22 nt, Homo sapiens
ugaguauguaggaugugucuua

SEQ ID NO: 42498 - RNA, 22 nt, Homo sapiens
ugagucgagauugcgccacugu

SEQ ID NO: 42499 - RNA, 22 nt, Homo sapiens
ugagugugacuuagcagaagga

SEQ ID NO: 42500 - RNA, 22 nt, Homo sapiens
ugaguuaauuuuuguaucaugu

SEQ ID NO: 42501 - RNA, 22 nt, Homo sapiens
ugaguucuuuuacauuuugaau

SEQ ID NO: 42502 - RNA, 22 nt, Homo sapiens
ugauauguuagaaucuugcaag

SEQ ID NO: 42503 - RNA, 22 nt, Homo sapiens
ugaucucauuagcaccuuuagc

SEQ ID NO: 42504 - RNA, 22 nt, Homo sapiens
ugaucuguguaacauaggaguc

SEQ ID NO: 42505 - RNA, 22 nt, Homo sapiens
ugaugucuugcaggcacgagau

SEQ ID NO: 42506 - RNA, 19 nt, Homo sapiens
ugcaaagucagugaagggu

SEQ ID NO: 42507 - RNA, 22 nt, Homo sapiens
ugcaaaucuuguguaguuguga

SEQ ID NO: 42508 - RNA, 19 nt, Homo sapiens
ugcaaauucuaaaaacuga

SEQ ID NO: 42509 - RNA, 22 nt, Homo sapiens
ugcaagaugauuucaauugaua

SEQ ID NO: 42510 - RNA, 22 nt, Homo sapiens
ugcaagcacacccagggauugu

SEQ ID NO: 42511 - RNA, 22 nt, Homo sapiens
ugcagcacugaacuucugggcu

SEQ ID NO: 42512 - RNA, 18 nt, Homo sapiens
ugcagcaucaguacccag

SEQ ID NO: 42513 - RNA, 21 nt, Homo sapiens
ugcagccauucagcccuaugc

SEQ ID NO: 42514 - RNA, 22 nt, Homo sapiens
cagccggguggcuccuagggua

SEQ ID NO: 42515 - RNA, 22 nt, Homo sapiens
cagcuguuguuccagucuuuua

SEQ ID NO: 42516 - RNA, 20 nt, Homo sapiens
cagggcaaugaggagguaaa

SEQ ID NO: 42517 - RNA, 22 nt, Homo sapiens
cagugcaugacuguauauuauc

SEQ ID NO: 42518 - RNA, 22 nt, Homo sapiens
cagugcauguggcacucuccag

SEQ ID NO: 42519 - RNA, 22 nt, Homo sapiens
cagugcuuuaucaaguccucca

SEQ ID NO: 42520 - RNA, 23 nt, Homo sapiens
cagugguguuagagaaaucuuuu

SEQ ID NO: 42521 - RNA, 21 nt, Homo sapiens
cauaaugcuacuuauuuuaug

SEQ ID NO: 42522 - RNA, 18 nt, Homo sapiens
cauagcacuucagcacau

SEQ ID NO: 42523 - RNA, 22 nt, Homo sapiens
caucacaugcuuauuuuccuca

SEQ ID NO: 42524 - RNA, 21 nt, Homo sapiens
caucacauuacucaaaguccu

SEQ ID NO: 42525 - RNA, 22 nt, Homo sapiens
caucagcaauguaugaggguuc

SEQ ID NO: 42526 - RNA, 22 nt, Homo sapiens
cauccccugcaccaaccuuuac

SEQ ID NO: 42527 - RNA, 22 nt, Homo sapiens
caugaaagacugaggaauugga

SEQ ID NO: 42528 - RNA, 22 nt, Homo sapiens
cauggccuuuggaaugugucua

SEQ ID NO: 42529 - RNA, 22 nt, Homo sapiens
cauggcuuuauuuucagcuucu

SEQ ID NO: 42530 - RNA, 22 nt, Homo sapiens
cauggcuuuuauaacaagaaau

SEQ ID NO: 42531 - RNA, 19 nt, Homo sapiens
uuucaauguaaggauggag

SEQ ID NO: 42532 - RNA, 22 nt, Homo sapiens
uuucacguuggggaguugagug

SEQ ID NO: 42533 - RNA, 22 nt, Homo sapiens
uuucaguguggcaggcauagcu

SEQ ID NO: 42534 - RNA, 22 nt, Homo sapiens
uuucauagccuuugucgucuga

SEQ ID NO: 42535 - RNA, 22 nt, Homo sapiens
uuucauggaauauagucauuuu

SEQ ID NO: 42536 - RNA, 22 nt, Homo sapiens
uuucauggcgaggcuucauggg

SEQ ID NO: 42537 - RNA, 22 nt, Homo sapiens
uuucauguuuuucugugaggca

SEQ ID NO: 42538 - RNA, 22 nt, Homo sapiens
uuuccacauggacuuaccuucg

SEQ ID NO: 42539 - RNA, 22 nt, Homo sapiens
uuuccagguggccaacauuuua

SEQ ID NO: 42540 - RNA, 22 nt, Homo sapiens
uuuccuggagaaucuuaacaaa

SEQ ID NO: 42541 - RNA, 22 nt, Homo sapiens
uuucugagaccaaaacuuguaa

SEQ ID NO: 42542 - RNA, 22 nt, Homo sapiens
uuugagauaucuuccaucagua

SEQ ID NO: 42543 - RNA, 22 nt, Homo sapiens
uuugcaauagguuguggggagg

SEQ ID NO: 42544 - RNA, 22 nt, Homo sapiens
uuugcuugaggucuagcuaccc

SEQ ID NO: 42545 - RNA, 22 nt, Homo sapiens
uuuggcaacguuggaucccuca

SEQ ID NO: 42546 - RNA, 21 nt, Homo sapiens
uuuggcauuaugucaccagag

SEQ ID NO: 42547 - RNA, 22 nt, Homo sapiens
uuuggcuauguuguaucuuucc

SEQ ID NO: 42548 - RNA, 22 nt, Homo sapiens
uuugguguauaaaaaugcuagu

SEQ ID NO: 42549 - RNA, 22 nt, Homo sapiens
uuuguccccgcccagaucucau

SEQ ID NO: 42550 - RNA, 22 nt, Homo sapiens
uuugugcugcaauuaauuuccc

SEQ ID NO: 42551 - RNA, 22 nt, Homo sapiens
uuuuaagcuacaagagacauau

SEQ ID NO: 42552 - RNA, 22 nt, Homo sapiens
uuuuaguugcucagguauucuc

SEQ ID NO: 42553 - RNA, 22 nt, Homo sapiens
uuuuauguuuguucccugccaa

SEQ ID NO: 42554 - RNA, 22 nt, Homo sapiens
uuuugcaaauuccaguggccau

SEQ ID NO: 42555 - RNA, 23 nt, Homo sapiens
uuuugcaauaagucacuggaaua

SEQ ID NO: 42556 - RNA, 22 nt, Homo sapiens
uuuugcaauauguuccugaaua

SEQ ID NO: 42557 - RNA, 22 nt, Homo sapiens
uuuugggggugauucacacagu

SEQ ID NO: 42558 - RNA, 22 nt, Homo sapiens
uuuugguuguuggguaagagua

SEQ ID NO: 42559 - RNA, 22 nt, Homo sapiens
uuuuugagaauuggugaaacac

SEQ ID NO: 42560 - RNA, 18 nt, Homo sapiens
uuuuugaggcacagggga

SEQ ID NO: 42561 - RNA, 16 nt, Homo sapiens
uuuuugcagaaaugac

SEQ ID NO: 42562 - RNA, 22 nt, Homo sapiens
uuuuuuaguuagcugggcauga

SEQ ID NO: 42563 - RNA, 22 nt, Homo sapiens
ugcauauguucaaaguauucug

SEQ ID NO: 42564 - RNA, 22 nt, Homo sapiens
ugcauccauucuagacucaucu

SEQ ID NO: 42565 - RNA, 22 nt, Homo sapiens
ugcauguucuuacucauacaug

SEQ ID NO: 42566 - RNA, 22 nt, Homo sapiens
ugcauugcacuugcaugagaua

SEQ ID NO: 42567 - RNA, 22 nt, Homo sapiens
ugccaugaaguaauggcaaaaa

SEQ ID NO: 42568 - RNA, 22 nt, Homo sapiens
ugcccuuugucagaugaguagg

SEQ ID NO: 42569 - RNA, 21 nt, Homo sapiens
ugccuuuguaguaggugucuu

SEQ ID NO: 42570 - RNA, 22 nt, Homo sapiens
ugccuuuguucuggaaugggaa

SEQ ID NO: 42571 - RNA, 22 nt, Homo sapiens
ugcugcauuggggauuaaguuu

SEQ ID NO: 42572 - RNA, 22 nt, Homo sapiens
ugcugcuguuaucauuuuacca

SEQ ID NO: 42573 - RNA, 22 nt, Homo sapiens
ugcugcuguuguuguuacuagc

SEQ ID NO: 42574 - RNA, 22 nt, Homo sapiens
ugcugguggucccauaugauua

SEQ ID NO: 42575 - RNA, 22 nt, Homo sapiens
ugcuguuguuugaugaaguaau

SEQ ID NO: 42576 - RNA, 22 nt, Homo sapiens
ugcuuguguucagguaaccuuu

SEQ ID NO: 42577 - RNA, 22 nt, Homo sapiens
uggaaaauuaggggagguuaua

SEQ ID NO: 42578 - RNA, 21 nt, Homo sapiens
uggaaacuucuagcuuacgua

SEQ ID NO: 42579 - RNA, 22 nt, Homo sapiens
uggaaaguacuugaguuuguau

SEQ ID NO: 42580 - RNA, 22 nt, Homo sapiens
uggaaaguccaagccaaccggg

SEQ ID NO: 42581 - RNA, 22 nt, Homo sapiens
cuuuuacacugcuggugggaau

SEQ ID NO: 42582 - RNA, 21 nt, Homo sapiens
cuuuugcacuccagccugggu

SEQ ID NO: 42583 - RNA, 22 nt, Homo sapiens
cuuuuugcugcagcaauacugg

SEQ ID NO: 42584 - RNA, 22 nt, Homo sapiens
cuuuuugguagagcaggugugc

SEQ ID NO: 42585 - RNA, 20 nt, Homo sapiens
gaaacaucuauccucuccuu

SEQ ID NO: 42586 - RNA, 22 nt, Homo sapiens
gaacccuggaggcggagguugc

SEQ ID NO: 42587 - RNA, 22 nt, Homo sapiens
gaacuguuucuggugaaagagu

SEQ ID NO: 42588 - RNA, 22 nt, Homo sapiens
gaagauguugcuuaccuuggag

SEQ ID NO: 42589 - RNA, 22 nt, Homo sapiens
gaagcgaggugauuagcagaca

SEQ ID NO: 42590 - RNA, 22 nt, Homo sapiens
gaagguaguuuauagauguggu

SEQ ID NO: 42591 - RNA, 22 nt, Homo sapiens
gaaugcaugaggggaucagaug

SEQ ID NO: 42592 - RNA, 22 nt, Homo sapiens
gaauguuuacuuuguuuaauac

SEQ ID NO: 42593 - RNA, 22 nt, Homo sapiens
gacaguguggcgauuccucaag

SEQ ID NO: 42594 - RNA, 22 nt, Homo sapiens
gacauagagccuugacuucauu

SEQ ID NO: 42595 - RNA, 22 nt, Homo sapiens
gaccacauuccacacaggcuuu

SEQ ID NO: 42596 - RNA, 22 nt, Homo sapiens
gacugcauuugccccaucgaau

SEQ ID NO: 42597 - RNA, 22 nt, Homo sapiens
gagaacagaagcauuccuaauu

SEQ ID NO: 42598 - RNA, 22 nt, Homo sapiens
gagaacagagauaauuuuacuu

SEQ ID NO: 42599 - RNA, 22 nt, Homo sapiens
gagaacugagugugcuggcgga

SEQ ID NO: 42600 - RNA, 22 nt, Homo sapiens
gagacauugacuuuguuccaga

SEQ ID NO: 42601 - RNA, 22 nt, Homo sapiens
gagacggagucucgcucugucg

SEQ ID NO: 42602 - RNA, 22 nt, Homo sapiens
gagacggagucuugcucuguug

SEQ ID NO: 42603 - RNA, 22 nt, Homo sapiens
gagauaaauaggucacaguucu

SEQ ID NO: 42604 - RNA, 22 nt, Homo sapiens
gagauacacccagugcagaggc

SEQ ID NO: 42605 - RNA, 22 nt, Homo sapiens
gagaucaguuaaugaagugagc

SEQ ID NO: 42606 - RNA, 22 nt, Homo sapiens
gagaucuuggccaaguuucuua

SEQ ID NO: 42607 - RNA, 22 nt, Homo sapiens
gagauggugugcuguuggaagu

SEQ ID NO: 42608 - RNA, 22 nt, Homo sapiens
gagauuaauacacaucaaaugc

SEQ ID NO: 42609 - RNA, 22 nt, Homo sapiens
gagauucaucuagguccagaga

SEQ ID NO: 42610 - RNA, 22 nt, Homo sapiens
gagcaccagucccugucagugc

SEQ ID NO: 42611 - RNA, 22 nt, Homo sapiens
gagcaucauucaacaaaagucu

SEQ ID NO: 42612 - RNA, 22 nt, Homo sapiens
gagcuagguuuugaauccagac

SEQ ID NO: 42613 - RNA, 22 nt, Homo sapiens
gagcugaaguuuccauuuguac

SEQ ID NO: 42614 - RNA, 22 nt, Homo sapiens
gagcuggacuucuuaccuuuuc

SEQ ID NO: 42615 - RNA, 21 nt, Homo sapiens
gaggauauuuuuauguuugga

SEQ ID NO: 42616 - RNA, 22 nt, Homo sapiens
gagggcacugcuuuccuuucaa

SEQ ID NO: 42617 - RNA, 22 nt, Homo sapiens
gagguugggaugagggauacag

SEQ ID NO: 42618 - RNA, 22 nt, Homo sapiens
gaguauauuugcacuguuaugu

SEQ ID NO: 42619 - RNA, 22 nt, Homo sapiens
gagugcaaagguccugaggugg

SEQ ID NO: 42620 - RNA, 22 nt, Homo sapiens
gagugcuguuagcccuggguuu

SEQ ID NO: 42621 - RNA, 22 nt, Homo sapiens
gaguucaaaucucagcucuguu

SEQ ID NO: 42622 - RNA, 22 nt, Homo sapiens
gauaaaucuuggcuagucuaag

SEQ ID NO: 42623 - RNA, 22 nt, Homo sapiens
gauacuguauccuaaaagcuuu

SEQ ID NO: 42624 - RNA, 22 nt, Homo sapiens
gauauugacuuauucuauguuu

SEQ ID NO: 42625 - RNA, 22 nt, Homo sapiens
gaugaaacaucuuuggaaacug

SEQ ID NO: 42626 - RNA, 22 nt, Homo sapiens
gaugaggcuagagacaugugua

SEQ ID NO: 42627 - RNA, 22 nt, Homo sapiens
gaugaucaugaccuacagaugg

SEQ ID NO: 42628 - RNA, 22 nt, Homo sapiens
gaugccuuuuuguccucaguua

SEQ ID NO: 42629 - RNA, 22 nt, Homo sapiens
gauggaauuaaaaucagaauca

SEQ ID NO: 42630 - RNA, 22 nt, Homo sapiens
gaugguuuuuuaagaagagccu

SEQ ID NO: 42631 - RNA, 22 nt, Homo sapiens
gauuagaacagaagucagauua

SEQ ID NO: 42632 - RNA, 22 nt, Homo sapiens
gauuagcacuucaguuacagua

SEQ ID NO: 42633 - RNA, 22 nt, Homo sapiens
gauuccacuuacuuagcauucc

SEQ ID NO: 42634 - RNA, 22 nt, Homo sapiens
gauuggcauugcugcaccugag

SEQ ID NO: 42635 - RNA, 20 nt, Homo sapiens
gcaacauggccagagugaau

SEQ ID NO: 42636 - RNA, 22 nt, Homo sapiens
gcaagaaugagaaggauuaauu

SEQ ID NO: 42637 - RNA, 22 nt, Homo sapiens
gcacaguguuacuugauauauu

SEQ ID NO: 42638 - RNA, 22 nt, Homo sapiens
gcacauggccacuaggaauaaa

SEQ ID NO: 42639 - RNA, 22 nt, Homo sapiens
gcaccccuuaccgggcuggguu

SEQ ID NO: 42640 - RNA, 22 nt, Homo sapiens
gcacugggccacauuuauuuuc

SEQ ID NO: 42641 - RNA, 22 nt, Homo sapiens
gcagaauugguuucuucuaagg

SEQ ID NO: 42642 - RNA, 22 nt, Homo sapiens
gcagcaguggcaguuaauauuu

SEQ ID NO: 42643 - RNA, 22 nt, Homo sapiens
gcagcauuaccaagacauggca

SEQ ID NO: 42644 - RNA, 22 nt, Homo sapiens
gcaggaauuucucugcagaccc

SEQ ID NO: 42645 - RNA, 22 nt, Homo sapiens
gcaguggugugugccagccuag

SEQ ID NO: 42646 - RNA, 22 nt, Homo sapiens
gcaguguugugauccaggucuu

SEQ ID NO: 42647 - RNA, 22 nt, Homo sapiens
gcauaaagcuaauaagacgaag

SEQ ID NO: 42648 - RNA, 22 nt, Homo sapiens
gcaugacaaugauugcucuuca

SEQ ID NO: 42649 - RNA, 22 nt, Homo sapiens
gcaugcacaugugaaaaaauga

SEQ ID NO: 42650 - RNA, 22 nt, Homo sapiens
gccaagaugcugcccacagaca

SEQ ID NO: 42651 - RNA, 22 nt, Homo sapiens
gccauggugucuuauuuuugug

SEQ ID NO: 42652 - RNA, 22 nt, Homo sapiens
gccccgggugaugcagccguca

SEQ ID NO: 42653 - RNA, 22 nt, Homo sapiens
gccuguagaagaguagaugacc

SEQ ID NO: 42654 - RNA, 22 nt, Homo sapiens
gccuuuggugacaggcaugugu

SEQ ID NO: 42655 - RNA, 22 nt, Homo sapiens
gcgugguguuagaaugagaagu

SEQ ID NO: 42656 - RNA, 17 nt, Homo sapiens
gcugcauucauguagaa

SEQ ID NO: 42657 - RNA, 22 nt, Homo sapiens
gcuggcuuucuccugaucucag

SEQ ID NO: 42658 - RNA, 22 nt, Homo sapiens
gcugguguugugaaucaggccg

SEQ ID NO: 42659 - RNA, 22 nt, Homo sapiens
gcugugauucuguguagauagu

SEQ ID NO: 42660 - RNA, 22 nt, Homo sapiens
gcuucauggaggcugggcgcag

SEQ ID NO: 42661 - RNA, 22 nt, Homo sapiens
ggaagguaauuggcuaaugaga

SEQ ID NO: 42662 - RNA, 22 nt, Homo sapiens
ggaagguaauugucagcucaua

SEQ ID NO: 42663 - RNA, 22 nt, Homo sapiens
ggaauaguauaaauaccacaaa

SEQ ID NO: 42664 - RNA, 20 nt, Homo sapiens
ggaauagucuacacucugac

SEQ ID NO: 42665 - RNA, 22 nt, Homo sapiens
ggaaugagaaauauuacacaau

SEQ ID NO: 42666 - RNA, 22 nt, Homo sapiens
ggaaugggauuugaagucuggc

SEQ ID NO: 42667 - RNA, 22 nt, Homo sapiens
ggacuaggagcuaggaagaucu

SEQ ID NO: 42668 - RNA, 22 nt, Homo sapiens
uuagcagcaugagaauggacua

SEQ ID NO: 42669 - RNA, 22 nt, Homo sapiens
uuagggaggacaguuacaacag

SEQ ID NO: 42670 - RNA, 22 nt, Homo sapiens
uuagggaggcucaggacaagag

SEQ ID NO: 42671 - RNA, 22 nt, Homo sapiens
uuauaaacaugaagauuugggg

SEQ ID NO: 42672 - RNA, 22 nt, Homo sapiens
uuauagacacguuguaacaaac

SEQ ID NO: 42673 - RNA, 22 nt, Homo sapiens
uuauagcagugcccaacuccug

SEQ ID NO: 42674 - RNA, 22 nt, Homo sapiens
uuauggcuuugcgguguuagca

SEQ ID NO: 42675 - RNA, 22 nt, Homo sapiens
uuaugguuuuucugugagaugg

SEQ ID NO: 42676 - RNA, 22 nt, Homo sapiens
uuauugcucauuugggcauucu

SEQ ID NO: 42677 - RNA, 22 nt, Homo sapiens
uucaaaaccucugcuuaagccc

SEQ ID NO: 42678 - RNA, 22 nt, Homo sapiens
uucaagaauuaaaguggcuuuu

SEQ ID NO: 42679 - RNA, 22 nt, Homo sapiens
uucaagugguucagaagucuga

SEQ ID NO: 42680 - RNA, 22 nt, Homo sapiens
uucacacugggccuacucugug

SEQ ID NO: 42681 - RNA, 22 nt, Homo sapiens
uucacaguacucccuggaauua

SEQ ID NO: 42682 - RNA, 22 nt, Homo sapiens
uucacaugguugccuuuugauc

SEQ ID NO: 42683 - RNA, 22 nt, Homo sapiens
uucaccuggaguucaggauaag

SEQ ID NO: 42684 - RNA, 22 nt, Homo sapiens
uucaccuguagcaugcccuugg

SEQ ID NO: 42685 - RNA, 22 nt, Homo sapiens
uucacugcacuccagccugggu

SEQ ID NO: 42686 - RNA, 22 nt, Homo sapiens
uaucacacaucaugguaaaucu

SEQ ID NO: 42687 - RNA, 22 nt, Homo sapiens
uaucacacgccuugcuucauuu

SEQ ID NO: 42688 - RNA, 22 nt, Homo sapiens
uaucacagcgggguguacaccc

SEQ ID NO: 42689 - RNA, 20 nt, Homo sapiens
uaucacaggucagaaacccu

SEQ ID NO: 42690 - RNA, 22 nt, Homo sapiens
uaucacaguaaaucugggugca

SEQ ID NO: 42691 - RNA, 21 nt, Homo sapiens
uaucacaguagaauaggaucu

SEQ ID NO: 42692 - RNA, 20 nt, Homo sapiens
uaucacauggggagaaaccu

SEQ ID NO: 42693 - RNA, 21 nt, Homo sapiens
uaucacauuggugauuaaguu

SEQ ID NO: 42694 - RNA, 22 nt, Homo sapiens
uaucagugaaucuuauuuugcc

SEQ ID NO: 42695 - RNA, 22 nt, Homo sapiens
uaucauugccucaaucuguauu

SEQ ID NO: 42696 - RNA, 22 nt, Homo sapiens
uaucccaauguaauaucacaaa

SEQ ID NO: 42697 - RNA, 22 nt, Homo sapiens
uaucccuguggacuucccaaca

SEQ ID NO: 42698 - RNA, 22 nt, Homo sapiens
uaucucuuuucauguguaaaug

SEQ ID NO: 42699 - RNA, 22 nt, Homo sapiens
uaucugcacuucugucuagguc

SEQ ID NO: 42700 - RNA, 22 nt, Homo sapiens
uaugaccuuggacaaguuacuu

SEQ ID NO: 42701 - RNA, 22 nt, Homo sapiens
uauggauuugccuauucuguau

SEQ ID NO: 42702 - RNA, 22 nt, Homo sapiens
augaaacuggcuaauuuuugua

SEQ ID NO: 42703 - RNA, 22 nt, Homo sapiens
augacaagagccuucuuuccuu

SEQ ID NO: 42704 - RNA, 22 nt, Homo sapiens
augacauguauuuccaggauuu

SEQ ID NO: 42705 - RNA, 22 nt, Homo sapiens
augacauugaaaagcaagugga

SEQ ID NO: 42706 - RNA, 22 nt, Homo sapiens
augacugucagggcagucauug

SEQ ID NO: 42707 - RNA, 19 nt, Homo sapiens
augagaacagacuccauuu

SEQ ID NO: 42708 - RNA, 22 nt, Homo sapiens
augagaaucauuucagcuugua

SEQ ID NO: 42709 - RNA, 22 nt, Homo sapiens
augagaucugugaacaccuguc

SEQ ID NO: 42710 - RNA, 22 nt, Homo sapiens
augagauuguuugugugaaaua

SEQ ID NO: 42711 - RNA, 17 nt, Homo sapiens
augagcucaucauuuuu

SEQ ID NO: 42712 - RNA, 22 nt, Homo sapiens
augaggagguaugauuuucuga

SEQ ID NO: 42713 - RNA, 22 nt, Homo sapiens
augaggugggagaaucacuuga

SEQ ID NO: 42714 - RNA, 22 nt, Homo sapiens
augaucaucugaaagcuuuuac

SEQ ID NO: 42715 - RNA, 22 nt, Homo sapiens
augaucauggaaguuuuccugu

SEQ ID NO: 42716 - RNA, 22 nt, Homo sapiens
augcacauggcuaacuuuuuuc

SEQ ID NO: 42717 - RNA, 22 nt, Homo sapiens
augcuacuggauuuguauaaau

SEQ ID NO: 42718 - RNA, 22 nt, Homo sapiens
auggaauggcacuuugaagauu

SEQ ID NO: 42719 - RNA, 22 nt, Homo sapiens
auggacagacacuggccuucug

SEQ ID NO: 42720 - RNA, 22 nt, Homo sapiens
auggagaugugcgaacugagua

SEQ ID NO: 42721 - RNA, 22 nt, Homo sapiens
auggagcaaaacagauuuggga

SEQ ID NO: 42722 - RNA, 22 nt, Homo sapiens
auggagcuugacaguuguagag

SEQ ID NO: 42723 - RNA, 22 nt, Homo sapiens
auggaguuuacuuaguguaaua

SEQ ID NO: 42724 - RNA, 22 nt, Homo sapiens
auggaucuuucugcuuuugaau

SEQ ID NO: 42725 - RNA, 22 nt, Homo sapiens
auggcaaaaaaugcaauuacuu

SEQ ID NO: 42726 - RNA, 22 nt, Homo sapiens
auggcaagaagagcaauuauuu

SEQ ID NO: 42727 - RNA, 22 nt, Homo sapiens
auggcacuccagccugggcaac

SEQ ID NO: 42728 - RNA, 22 nt, Homo sapiens
auggcacugaagcguauugaca

SEQ ID NO: 42729 - RNA, 22 nt, Homo sapiens
auggcagcugacacuuccgucu

SEQ ID NO: 42730 - RNA, 22 nt, Homo sapiens
auggcggugugaucuuggcuca

SEQ ID NO: 42731 - RNA, 22 nt, Homo sapiens
auggcuuuuauuguguugaggu

SEQ ID NO: 42732 - RNA, 22 nt, Homo sapiens
auggcuuuuuaaaucauguugu

SEQ ID NO: 42733 - RNA, 22 nt, Homo sapiens
augggauaguaucaguggaaua

SEQ ID NO: 42734 - RNA, 22 nt, Homo sapiens
auggucuuuucccuggauuaua

SEQ ID NO: 42735 - RNA, 22 nt, Homo sapiens
auguaacuaucugagccauggg

SEQ ID NO: 42736 - RNA, 21 nt, Homo sapiens
auguaaugaagaagccacugg

SEQ ID NO: 42737 - RNA, 22 nt, Homo sapiens
auguagauaucaagaggcauau

SEQ ID NO: 42738 - RNA, 22 nt, Homo sapiens
auguaguagcagaaaauauuuu

SEQ ID NO: 42739 - RNA, 22 nt, Homo sapiens
auguccuaaucuccuguucuua

SEQ ID NO: 42740 - RNA, 22 nt, Homo sapiens
augugacagcaacccccagccc

SEQ ID NO: 42741 - RNA, 22 nt, Homo sapiens
augugacugauggagaauaugu

SEQ ID NO: 42742 - RNA, 22 nt, Homo sapiens
augugcaaauuuccaaacucuu

SEQ ID NO: 42743 - RNA, 21 nt, Homo sapiens
augugcacuaugucauuuaau

SEQ ID NO: 42744 - RNA, 20 nt, Homo sapiens
augugcaguguggcaaccaa

SEQ ID NO: 42745 - RNA, 22 nt, Homo sapiens
augugcuuauagguguauguuu

SEQ ID NO: 42746 - RNA, 22 nt, Homo sapiens
augugcuuuuuaaacagaugcu

SEQ ID NO: 42747 - RNA, 22 nt, Homo sapiens
auguggcauuucucauucauuu

SEQ ID NO: 42748 - RNA, 22 nt, Homo sapiens
auguggugguagccaggacagg

SEQ ID NO: 42749 - RNA, 22 nt, Homo sapiens
auguugcuugaaggcauuuugu

SEQ ID NO: 42750 - RNA, 22 nt, Homo sapiens
auuauaugucaucacagacacc

SEQ ID NO: 42751 - RNA, 22 nt, Homo sapiens
auuaucacaguuuugcauaugg

SEQ ID NO: 42752 - RNA, 22 nt, Homo sapiens
auucaagugaugcagcuguuuu

SEQ ID NO: 42753 - RNA, 22 nt, Homo sapiens
auucaucagggauauugguuga

SEQ ID NO: 42754 - RNA, 22 nt, Homo sapiens
auugaacacagaguagcuuucc

SEQ ID NO: 42755 - RNA, 22 nt, Homo sapiens
auugacaguuggccaguaagug

SEQ ID NO: 42756 - RNA, 22 nt, Homo sapiens
auugcaaagcguagacucuaaa

SEQ ID NO: 42757 - RNA, 21 nt, Homo sapiens
auugcacaauauacccaugua

SEQ ID NO: 42758 - RNA, 18 nt, Homo sapiens
auugcacaccagccuggg

SEQ ID NO: 42759 - RNA, 22 nt, Homo sapiens
auugcacuccggccugggugac

SEQ ID NO: 42760 - RNA, 23 nt, Homo sapiens
auugcagaaucacagagguagug

SEQ ID NO: 42761 - RNA, 22 nt, Homo sapiens
auugcaguuagaacagaagucu

SEQ ID NO: 42762 - RNA, 22 nt, Homo sapiens
auugcuuacccuguauuagauc

SEQ ID NO: 42763 - RNA, 22 nt, Homo sapiens
auugucauuuucugagaaguaa

SEQ ID NO: 42764 - RNA, 22 nt, Homo sapiens
auuguguuugaaugaggcucca

SEQ ID NO: 42765 - RNA, 22 nt, Homo sapiens
auuucacuucgcaugguguccg

SEQ ID NO: 42766 - RNA, 21 nt, Homo sapiens
auuugguggcugugugacacu

SEQ ID NO: 42767 - RNA, 22 nt, Homo sapiens
caaagucuauucuacccuuacc

SEQ ID NO: 42768 - RNA, 22 nt, Homo sapiens
caaaugacaucauuucauucaa

SEQ ID NO: 42769 - RNA, 22 nt, Homo sapiens
caacacagugaaacccgucucu

SEQ ID NO: 42770 - RNA, 22 nt, Homo sapiens
caaggaauucucaauagaguua

SEQ ID NO: 42771 - RNA, 22 nt, Homo sapiens
caagugaauaguugcucucaga

SEQ ID NO: 42772 - RNA, 21 nt, Homo sapiens
caagugaugcuucugcuuuaa

SEQ ID NO: 42773 - RNA, 22 nt, Homo sapiens
caauacuguuaccugaaauagg

SEQ ID NO: 42774 - RNA, 21 nt, Homo sapiens
caauggcacgaucuuggcuca

SEQ ID NO: 42775 - RNA, 22 nt, Homo sapiens
cacaaaguagauuagucuucca

SEQ ID NO: 42776 - RNA, 22 nt, Homo sapiens
cacacugucuucaauggguggu

SEQ ID NO: 42777 - RNA, 22 nt, Homo sapiens
cacagugaacaauauccucugu

SEQ ID NO: 42778 - RNA, 22 nt, Homo sapiens
cacaguguucauagccaucagg

SEQ ID NO: 42779 - RNA, 22 nt, Homo sapiens
cacauguucaggagcacuuaga

SEQ ID NO: 42780 - RNA, 22 nt, Homo sapiens
cacccaguaagcaugaggcccu

SEQ ID NO: 42781 - RNA, 19 nt, Homo sapiens
caccgccugcccccugcug

SEQ ID NO: 42782 - RNA, 22 nt, Homo sapiens
caccuguagucccagcugaggc

SEQ ID NO: 42783 - RNA, 21 nt, Homo sapiens
cacugcacuugccuucugggu

SEQ ID NO: 42784 - RNA, 22 nt, Homo sapiens
cacugcauccucugccuggcgg

SEQ ID NO: 42785 - RNA, 22 nt, Homo sapiens
cacugcauccuugaccuucugg

SEQ ID NO: 42786 - RNA, 22 nt, Homo sapiens
cacugcauuggaugguuccucc

SEQ ID NO: 42787 - RNA, 22 nt, Homo sapiens
cagauacuggaguccugaaguu

SEQ ID NO: 42788 - RNA, 22 nt, Homo sapiens
cagauguaguauuuuagugaaa

SEQ ID NO: 42789 - RNA, 20 nt, Homo sapiens
cagcaaccugcucucuuccu

SEQ ID NO: 42790 - RNA, 22 nt, Homo sapiens
cagcacauagcaguugcucagu

SEQ ID NO: 42791 - RNA, 22 nt, Homo sapiens
uucacaauuaaaugugguuauu

SEQ ID NO: 42792 - RNA, 21 nt, Homo sapiens
uucaccauggcuccacacucu

SEQ ID NO: 42793 - RNA, 22 nt, Homo sapiens
uucacugugaacucauauucag

SEQ ID NO: 42794 - RNA, 22 nt, Homo sapiens
uucacugugugacccugggcca

SEQ ID NO: 42795 - RNA, 22 nt, Homo sapiens
uucagacugggugaagagggua

SEQ ID NO: 42796 - RNA, 22 nt, Homo sapiens
uucagcuacuugggaggcugaa

SEQ ID NO: 42797 - RNA, 22 nt, Homo sapiens
uucaggcaccauugucauugau

SEQ ID NO: 42798 - RNA, 22 nt, Homo sapiens
uucagggacuuuagacaagaga

SEQ ID NO: 42799 - RNA, 22 nt, Homo sapiens
uucaguccauuuccuuggucac

SEQ ID NO: 42800 - RNA, 22 nt, Homo sapiens
uucagugccuggaagucgugcu

SEQ ID NO: 42801 - RNA, 22 nt, Homo sapiens
uucaguggagaggcugaguggu

SEQ ID NO: 42802 - RNA, 22 nt, Homo sapiens
uucaguucugcucugaucuuag

SEQ ID NO: 42803 - RNA, 18 nt, Homo sapiens
uucaguuuguaucugggg

SEQ ID NO: 42804 - RNA, 19 nt, Homo sapiens
uucauacagugagagcagc

SEQ ID NO: 42805 - RNA, 22 nt, Homo sapiens
uucauacaguggcugcacucca

SEQ ID NO: 42806 - RNA, 22 nt, Homo sapiens
uucauagucacauucgaugucu

SEQ ID NO: 42807 - RNA, 22 nt, Homo sapiens
ggacugagaggacuacagugua

SEQ ID NO: 42808 - RNA, 22 nt, Homo sapiens
ggagaauguaauugguauuuug

SEQ ID NO: 42809 - RNA, 22 nt, Homo sapiens
ggagaucuuguuaaaguacaga

SEQ ID NO: 42810 - RNA, 22 nt, Homo sapiens
ggagauguuuaaccuuuuaucu

SEQ ID NO: 42811 - RNA, 22 nt, Homo sapiens
ggaguaggcuguccggcaccca

SEQ ID NO: 42812 - RNA, 22 nt, Homo sapiens
ggagucuugcuauguugccaag

SEQ ID NO: 42813 - RNA, 23 nt, Homo sapiens
ggaguguaaugacucgaucucgg

SEQ ID NO: 42814 - RNA, 23 nt, Homo sapiens
ggaguguauuggcacgaucucag

SEQ ID NO: 42815 - RNA, 22 nt, Homo sapiens
ggaucacuugagaccaggaguu

SEQ ID NO: 42816 - RNA, 22 nt, Homo sapiens
ggaugcauucaacuuccaguuc

SEQ ID NO: 42817 - RNA, 22 nt, Homo sapiens
ggcaaagaugaccauuacuuuu

SEQ ID NO: 42818 - RNA, 22 nt, Homo sapiens
ggcaaaugaagauggagaggcu

SEQ ID NO: 42819 - RNA, 22 nt, Homo sapiens
ggcaagaaagaaaucaucuguc

SEQ ID NO: 42820 - RNA, 22 nt, Homo sapiens
ggcaagaggagauucugcuccc

SEQ ID NO: 42821 - RNA, 22 nt, Homo sapiens
ggcaagauagauaucaguguca

SEQ ID NO: 42822 - RNA, 23 nt, Homo sapiens
ggcaagaucucagcucacugcaa

SEQ ID NO: 42823 - RNA, 19 nt, Homo sapiens
ggcaauacuuucuuguugg

SEQ ID NO: 42824 - RNA, 22 nt, Homo sapiens
ggcaaugaggcggaccagcagg

SEQ ID NO: 42825 - RNA, 22 nt, Homo sapiens
ggcacaauugcagcaauaaaca

SEQ ID NO: 42826 - RNA, 22 nt, Homo sapiens
ggcacgguggcucacaccugua

SEQ ID NO: 42827 - RNA, 22 nt, Homo sapiens
aaaagucuguagugaaagguga

SEQ ID NO: 42828 - RNA, 22 nt, Homo sapiens
aaacccauauaccagcugugcu

SEQ ID NO: 42829 - RNA, 22 nt, Homo sapiens
aaacugcuuuccaugguggcug

SEQ ID NO: 42830 - RNA, 22 nt, Homo sapiens
aaagagaucuaugggcacuaug

SEQ ID NO: 42831 - RNA, 22 nt, Homo sapiens
aaagcacuggagucaucaucua

SEQ ID NO: 42832 - RNA, 22 nt, Homo sapiens
aaagcugucaaggcaggaggcu

SEQ ID NO: 42833 - RNA, 22 nt, Homo sapiens
aaaggcuucggaucagaaggua

SEQ ID NO: 42834 - RNA, 22 nt, Homo sapiens
aaagugauguccaggcuuucag

SEQ ID NO: 42835 - RNA, 22 nt, Homo sapiens
aaagugcuuacuaaguugccaa

SEQ ID NO: 42836 - RNA, 22 nt, Homo sapiens
aaaguucuguugauagugcuga

SEQ ID NO: 42837 - RNA, 22 nt, Homo sapiens
aaaugucauggaguguuucccc

SEQ ID NO: 42838 - RNA, 22 nt, Homo sapiens
aaauucauuucagcucugggua

SEQ ID NO: 42839 - RNA, 22 nt, Homo sapiens
aacaucaaccaugaggguugga

SEQ ID NO: 42840 - RNA, 22 nt, Homo sapiens
aacucacauucuuucuugguac

SEQ ID NO: 42841 - RNA, 22 nt, Homo sapiens
aacuggcauagccagacuucuc

SEQ ID NO: 42842 - RNA, 19 nt, Homo sapiens
aacuggugugagaugauau

SEQ ID NO: 42843 - RNA, 22 nt, Homo sapiens
aagagaacugacaguaccuggg

SEQ ID NO: 42844 - RNA, 22 nt, Homo sapiens
aagagagccagcugguauauuu

SEQ ID NO: 42845 - RNA, 22 nt, Homo sapiens
aagagaugaagguccugacugu

SEQ ID NO: 42846 - RNA, 22 nt, Homo sapiens
aagagcauuauuuaguaauuuc

SEQ ID NO: 42847 - RNA, 22 nt, Homo sapiens
aagagguagcagucacaaaaga

SEQ ID NO: 42848 - RNA, 23 nt, Homo sapiens
aagagguaugacuaugaagugga

SEQ ID NO: 42849 - RNA, 22 nt, Homo sapiens
aagaguuaguaaaauuuccucu

SEQ ID NO: 42850 - RNA, 22 nt, Homo sapiens
aagauaguaaacauuuucugcu

SEQ ID NO: 42851 - RNA, 22 nt, Homo sapiens
aagaugauguucuuuuucuuag

SEQ ID NO: 42852 - RNA, 22 nt, Homo sapiens
aagcaucacauaauggaucaug

SEQ ID NO: 42853 - RNA, 22 nt, Homo sapiens
aagcaucacuggaggcagccau

SEQ ID NO: 42854 - RNA, 22 nt, Homo sapiens
aagcuggagugcaguggugcaa

SEQ ID NO: 42855 - RNA, 22 nt, Homo sapiens
aagcugugucuugucagcuacc

SEQ ID NO: 42856 - RNA, 22 nt, Homo sapiens
aaggcauucucaaacuaguucu

SEQ ID NO: 42857 - RNA, 22 nt, Homo sapiens
aagggaaugcgcugccuguguu

SEQ ID NO: 42858 - RNA, 22 nt, Homo sapiens
aagggaauguuguggcugguug

SEQ ID NO: 42859 - RNA, 22 nt, Homo sapiens
aaggugcucucuuauguagaaa

SEQ ID NO: 42860 - RNA, 22 nt, Homo sapiens
aagguggugucagagagcuuau

SEQ ID NO: 42861 - RNA, 22 nt, Homo sapiens
aaguaaauauccgguaguccca

SEQ ID NO: 42862 - RNA, 22 nt, Homo sapiens
aaguacuguuuaaauugcagaa

SEQ ID NO: 42863 - RNA, 22 nt, Homo sapiens
aaguagcuggaugcaguggcac

SEQ ID NO: 42864 - RNA, 22 nt, Homo sapiens
aaguauguaucaagucauacuu

SEQ ID NO: 42865 - RNA, 22 nt, Homo sapiens
aagucaaggagagaagcuucag

SEQ ID NO: 42866 - RNA, 22 nt, Homo sapiens
aagugaguaauacgucaguugu

SEQ ID NO: 42867 - RNA, 22 nt, Homo sapiens
aagugcccuauuuggcccuuga

SEQ ID NO: 42868 - RNA, 22 nt, Homo sapiens
aagugcuggccuacucaaucga

SEQ ID NO: 42869 - RNA, 22 nt, Homo sapiens
aagugcuuuguacagggguuga

SEQ ID NO: 42870 - RNA, 22 nt, Homo sapiens
aagugguagggucaggauugga

SEQ ID NO: 42871 - RNA, 21 nt, Homo sapiens
aauaaagcaaccuuaugccau

SEQ ID NO: 42872 - RNA, 22 nt, Homo sapiens
aauaaagcauggcuacuccaua

SEQ ID NO: 42873 - RNA, 22 nt, Homo sapiens
aauaaagucugaagugugcuua

SEQ ID NO: 42874 - RNA, 22 nt, Homo sapiens
aauacugaaaguauuuucaaau

SEQ ID NO: 42875 - RNA, 22 nt, Homo sapiens
aauaugucugcuaauuguuucu

SEQ ID NO: 42876 - RNA, 22 nt, Homo sapiens
aaucacaguguucuugugaggg

SEQ ID NO: 42877 - RNA, 21 nt, Homo sapiens
aaucacugucuguuuccccuu

SEQ ID NO: 42878 - RNA, 22 nt, Homo sapiens
aaucagcacacugugcuuucca

SEQ ID NO: 42879 - RNA, 16 nt, Homo sapiens
aauccauuggcccugc

SEQ ID NO: 42880 - RNA, 22 nt, Homo sapiens
aaucccugagcuagacacaaag

SEQ ID NO: 42881 - RNA, 22 nt, Homo sapiens
aaucccuuuguccagucucuuu

SEQ ID NO: 42882 - RNA, 22 nt, Homo sapiens
aaucuguagaaggugcacauuc

SEQ ID NO: 42883 - RNA, 22 nt, Homo sapiens
aaugcuaucuggaacauuguug

SEQ ID NO: 42884 - RNA, 22 nt, Homo sapiens
aauggcaaauguuuucuguuga

SEQ ID NO: 42885 - RNA, 19 nt, Homo sapiens
aauggcuuuuccuguuccc

SEQ ID NO: 42886 - RNA, 22 nt, Homo sapiens
aauuaguaaccuaauuccaucu

SEQ ID NO: 42887 - RNA, 23 nt, Homo sapiens
aauugcacauuccuugcuggcag

SEQ ID NO: 42888 - RNA, 22 nt, Homo sapiens
aauugcacuggaaguaacugag

SEQ ID NO: 42889 - RNA, 21 nt, Homo sapiens
cuuugguuucugacuugcaua

SEQ ID NO: 42890 - RNA, 22 nt, Homo sapiens
cuuuuacacuguuagugggaau

SEQ ID NO: 42891 - RNA, 22 nt, Homo sapiens
cuuuuacacuguuggcaggauu

SEQ ID NO: 42892 - RNA, 22 nt, Homo sapiens
cuuuuggucuaucagagaagca

SEQ ID NO: 42893 - RNA, 22 nt, Homo sapiens
gaaagcuaaugacuuuggguga

SEQ ID NO: 42894 - RNA, 22 nt, Homo sapiens
gaaauguugauagugggcauug

SEQ ID NO: 42895 - RNA, 22 nt, Homo sapiens
gaacuguaaagaaauucuaagg

SEQ ID NO: 42896 - RNA, 22 nt, Homo sapiens
gaauagugcugcaagaaacaua

SEQ ID NO: 42897 - RNA, 22 nt, Homo sapiens
gaaucaauugaucuaugugucu

SEQ ID NO: 42898 - RNA, 22 nt, Homo sapiens
gaauggaacugacuauagcuga

SEQ ID NO: 42899 - RNA, 22 nt, Homo sapiens
gacacagugaagucucuacuug

SEQ ID NO: 42900 - RNA, 22 nt, Homo sapiens
gacagugugauacuuagucuca

SEQ ID NO: 42901 - RNA, 18 nt, Homo sapiens
gacaguguggcaauuccu

SEQ ID NO: 42902 - RNA, 18 nt, Homo sapiens
gacaguguggcgauuccu

SEQ ID NO: 42903 - RNA, 22 nt, Homo sapiens
gacauguuuucauguauuugga

SEQ ID NO: 42904 - RNA, 21 nt, Homo sapiens
gaccacagcagggaaugucag

SEQ ID NO: 42905 - RNA, 22 nt, Homo sapiens
gacuagaaauuauuuagugagc

SEQ ID NO: 42906 - RNA, 18 nt, Homo sapiens
gacuccauuucagccaga

SEQ ID NO: 42907 - RNA, 22 nt, Homo sapiens
gagacggagucacgcccuguca

SEQ ID NO: 42908 - RNA, 22 nt, Homo sapiens
gagacugagucuugcccuguca

SEQ ID NO: 42909 - RNA, 22 nt, Homo sapiens
gagagguaguuuuuuggucguc

SEQ ID NO: 42910 - RNA, 22 nt, Homo sapiens
gagagugaaguuugcuaccugu

SEQ ID NO: 42911 - RNA, 22 nt, Homo sapiens
gagagugcuuggcaucugcuga

SEQ ID NO: 42912 - RNA, 22 nt, Homo sapiens
gagagugcuuuggguguaggcc

SEQ ID NO: 42913 - RNA, 22 nt, Homo sapiens
gagaugaugagauguucacagu

SEQ ID NO: 42914 - RNA, 22 nt, Homo sapiens
gagauuaacauuugaggagcug

SEQ ID NO: 42915 - RNA, 22 nt, Homo sapiens
gagauucuucaauauuuauucu

SEQ ID NO: 42916 - RNA, 18 nt, Homo sapiens
gagcaccuuuuuugcaga

SEQ ID NO: 42917 - RNA, 22 nt, Homo sapiens
gagcucauuaaaaauguagaau

SEQ ID NO: 42918 - RNA, 22 nt, Homo sapiens
gagcucauuguugcuaaagaga

SEQ ID NO: 42919 - RNA, 22 nt, Homo sapiens
gaggaaguuuacaaagcaucug

SEQ ID NO: 42920 - RNA, 22 nt, Homo sapiens
gagugcaauggcaagaucuugg

SEQ ID NO: 42921 - RNA, 22 nt, Homo sapiens
gagugcaauggcaugaucuggg

SEQ ID NO: 42922 - RNA, 22 nt, Homo sapiens
gauagcagccauucuuuuuauu

SEQ ID NO: 42923 - RNA, 22 nt, Homo sapiens
gauagcauucaauuaucuguug

SEQ ID NO: 42924 - RNA, 22 nt, Homo sapiens
gaucacauuguuucauacauau

SEQ ID NO: 42925 - RNA, 22 nt, Homo sapiens
gaucuguuuuccuauuguuugu

SEQ ID NO: 42926 - RNA, 22 nt, Homo sapiens
gauggcagugcagccccuggcu

SEQ ID NO: 42927 - RNA, 22 nt, Homo sapiens
gauuccacuuucugucucuaug

SEQ ID NO: 42928 - RNA, 22 nt, Homo sapiens
gcaaaauugagaagggaauaua

SEQ ID NO: 42929 - RNA, 22 nt, Homo sapiens
gcaagauguuaccauuagggaa

SEQ ID NO: 42930 - RNA, 22 nt, Homo sapiens
gcaaggacucccugggucauuc

SEQ ID NO: 42931 - RNA, 22 nt, Homo sapiens
gcacaguuaaagggucauguga

SEQ ID NO: 42932 - RNA, 17 nt, Homo sapiens
gcacuggcguaucccac

SEQ ID NO: 42933 - RNA, 22 nt, Homo sapiens
gcagcaucaaaucacacaagau

SEQ ID NO: 42934 - RNA, 22 nt, Homo sapiens
gcaggaaucuugagaaggauuc

SEQ ID NO: 42935 - RNA, 22 nt, Homo sapiens
gcaggcaugacauuucacucuu

SEQ ID NO: 42936 - RNA, 22 nt, Homo sapiens
gcagugcaguggcgcgaucucg

SEQ ID NO: 42937 - RNA, 22 nt, Homo sapiens
gcagugugaucacagcuuacug

SEQ ID NO: 42938 - RNA, 22 nt, Homo sapiens
gcaucacagcuccugugcuggc

SEQ ID NO: 42939 - RNA, 22 nt, Homo sapiens
gcauggagaaggggacugauuc

SEQ ID NO: 42940 - RNA, 22 nt, Homo sapiens
gcauggagcauacauuucuguu

SEQ ID NO: 42941 - RNA, 22 nt, Homo sapiens
gccaacauggcgcuccauucuu

SEQ ID NO: 42942 - RNA, 22 nt, Homo sapiens
gccagugugaugugaucauggc

SEQ ID NO: 42943 - RNA, 22 nt, Homo sapiens
gccaguguuuuauugagaauuu

SEQ ID NO: 42944 - RNA, 22 nt, Homo sapiens
gcccugagauucuuggauucug

SEQ ID NO: 42945 - RNA, 22 nt, Homo sapiens
gccugagaggauaugauccccu

SEQ ID NO: 42946 - RNA, 22 nt, Homo sapiens
gcgguagcauagacugcaggac

SEQ ID NO: 42947 - RNA, 22 nt, Homo sapiens
gcuacugucuaucugugcuucu

SEQ ID NO: 42948 - RNA, 22 nt, Homo sapiens
gcuagcauucaaaugugcagcc

SEQ ID NO: 42949 - RNA, 22 nt, Homo sapiens
gcuaggagaucugcugcucucu

SEQ ID NO: 42950 - RNA, 22 nt, Homo sapiens
gcucugguuacaaaggcaaauu

SEQ ID NO: 42951 - RNA, 22 nt, Homo sapiens
gcugcuguuuaguuucuccugg

SEQ ID NO: 42952 - RNA, 22 nt, Homo sapiens
gcugcuguuucucuuucagcau

SEQ ID NO: 42953 - RNA, 22 nt, Homo sapiens
gcugguauuacaggcaugagcc

SEQ ID NO: 42954 - RNA, 22 nt, Homo sapiens
gcuggucugccguaguaggugc

SEQ ID NO: 42955 - RNA, 22 nt, Homo sapiens
gcugguguagagugcagaaagg

SEQ ID NO: 42956 - RNA, 22 nt, Homo sapiens
gcuuguguauuaaaccuugcag

SEQ ID NO: 42957 - RNA, 22 nt, Homo sapiens
gcuuguguucaaggaacaccua

SEQ ID NO: 42958 - RNA, 22 nt, Homo sapiens
gcuuguguuugcuccccagaau

SEQ ID NO: 42959 - RNA, 22 nt, Homo sapiens
ggaauggaacaaagucuugaaa

SEQ ID NO: 42960 - RNA, 22 nt, Homo sapiens
ggagauccucugcgggcaaaga

SEQ ID NO: 42961 - RNA, 22 nt, Homo sapiens
ggagaucuuuaggaguuggacu

SEQ ID NO: 42962 - RNA, 22 nt, Homo sapiens
ggagaucuuuguuaucuuuuga

SEQ ID NO: 42963 - RNA, 22 nt, Homo sapiens
ggaguaaaagaguaggaggaau

SEQ ID NO: 42964 - RNA, 22 nt, Homo sapiens
ggaguguaauggcgccaucuca

SEQ ID NO: 42965 - RNA, 22 nt, Homo sapiens
ggaguguaguggcuccaucucg

SEQ ID NO: 42966 - RNA, 22 nt, Homo sapiens
ggagugugauuguucucuguua

SEQ ID NO: 42967 - RNA, 22 nt, Homo sapiens
ggauaucauuauuucuagggcu

SEQ ID NO: 42968 - RNA, 22 nt, Homo sapiens
ggcaagaacuucacucacuuuu

SEQ ID NO: 42969 - RNA, 22 nt, Homo sapiens
ggcaagaucuuggcucacugaa

SEQ ID NO: 42970 - RNA, 22 nt, Homo sapiens
ggcacgguggcucacgccugua

SEQ ID NO: 42971 - RNA, 22 nt, Homo sapiens
ggcagacuguggaguucuuucu

SEQ ID NO: 42972 - RNA, 22 nt, Homo sapiens
ggcccugagacaggaaaaagcu

SEQ ID NO: 42973 - RNA, 22 nt, Homo sapiens
ggccggguggccauggcugccc

SEQ ID NO: 42974 - RNA, 22 nt, Homo sapiens
gggaagugugcagaguucucuu

SEQ ID NO: 42975 - RNA, 22 nt, Homo sapiens
gggaugaauuagguauguuuau

SEQ ID NO: 42976 - RNA, 22 nt, Homo sapiens
gggcgagaaucggcugcucagc

SEQ ID NO: 42977 - RNA, 22 nt, Homo sapiens
gggguauguaagugagugagug

SEQ ID NO: 42978 - RNA, 22 nt, Homo sapiens
gguaggcacuggugggaagaga

SEQ ID NO: 42979 - RNA, 19 nt, Homo sapiens
ggucagcaaagucuagcug

SEQ ID NO: 42980 - RNA, 19 nt, Homo sapiens
ggucauggagguuguguga

SEQ ID NO: 42981 - RNA, 22 nt, Homo sapiens
ggugagaaaaacauagucucag

SEQ ID NO: 42982 - RNA, 22 nt, Homo sapiens
guaaucucagcuacucaggagg

SEQ ID NO: 42983 - RNA, 22 nt, Homo sapiens
ucaguggauuauuaaagucacc

SEQ ID NO: 42984 - RNA, 22 nt, Homo sapiens
ucaguucauggaggugucugcu

SEQ ID NO: 42985 - RNA, 18 nt, Homo sapiens
ucauagaucaugacagug

SEQ ID NO: 42986 - RNA, 22 nt, Homo sapiens
ucauaguagucacuuaauaaau

SEQ ID NO: 42987 - RNA, 19 nt, Homo sapiens
ucauagucuaagaugagaa

SEQ ID NO: 42988 - RNA, 22 nt, Homo sapiens
ucauaucauuagaucuacugua

SEQ ID NO: 42989 - RNA, 21 nt, Homo sapiens
ucaucagucaaagacaauggu

SEQ ID NO: 42990 - RNA, 22 nt, Homo sapiens
ucaucuggcgaaugugaagagu

SEQ ID NO: 42991 - RNA, 22 nt, Homo sapiens
ucaugacacuggcaggagcuaa

SEQ ID NO: 42992 - RNA, 22 nt, Homo sapiens
ucauugcacuucuuuaguugca

SEQ ID NO: 42993 - RNA, 22 nt, Homo sapiens
uccaagaugcuggcagcuacag

SEQ ID NO: 42994 - RNA, 22 nt, Homo sapiens
uccaauguaaucaucauugaau

SEQ ID NO: 42995 - RNA, 22 nt, Homo sapiens
uccacagugguugaacuaguuu

SEQ ID NO: 42996 - RNA, 22 nt, Homo sapiens
uccagguuuugugaguuuaaau

SEQ ID NO: 42997 - RNA, 22 nt, Homo sapiens
uccaguggacagacauaccaug

SEQ ID NO: 42998 - RNA, 22 nt, Homo sapiens
uccaugaguccauuagaaaaaa

SEQ ID NO: 42999 - RNA, 22 nt, Homo sapiens
uccauggagacacauuuuauau

SEQ ID NO: 43000 - RNA, 22 nt, Homo sapiens
uccccugagaccccucagcacu

SEQ ID NO: 43001 - RNA, 22 nt, Homo sapiens
ucccugacagggucugagcuuu

SEQ ID NO: 43002 - RNA, 18 nt, Homo sapiens
ucccugacucaaauucuu

SEQ ID NO: 43003 - RNA, 19 nt, Homo sapiens
ucccugagucuuagcuuga

SEQ ID NO: 43004 - RNA, 19 nt, Homo sapiens
ucccuguagaccacagugc

SEQ ID NO: 43005 - RNA, 22 nt, Homo sapiens
uccuucaugcaucaauguaucc

SEQ ID NO: 43006 - RNA, 22 nt, Homo sapiens
acugcacuccagcccaggugac

SEQ ID NO: 43007 - RNA, 22 nt, Homo sapiens
acugcacuccagccuaggcgac

SEQ ID NO: 43008 - RNA, 22 nt, Homo sapiens
acugcacuccagccucgugaca

SEQ ID NO: 43009 - RNA, 22 nt, Homo sapiens
acugcacuccagccuuggcaac

SEQ ID NO: 43010 - RNA, 22 nt, Homo sapiens
acugcacuccagccuuggccac

SEQ ID NO: 43011 - RNA, 22 nt, Homo sapiens
acugcacuccagcuugggugac

SEQ ID NO: 43012 - RNA, 22 nt, Homo sapiens
acugcacuccuccuugggugac

SEQ ID NO: 43013 - RNA, 22 nt, Homo sapiens
acugcacuucaaccucauugac

SEQ ID NO: 43014 - RNA, 22 nt, Homo sapiens
acugcacuucagccuuggcuac

SEQ ID NO: 43015 - RNA, 22 nt, Homo sapiens
acugcacuucagccuugggaaa

SEQ ID NO: 43016 - RNA, 22 nt, Homo sapiens
acuggauguuagggauuuuauu

SEQ ID NO: 43017 - RNA, 22 nt, Homo sapiens
acuguguguuugucuagcacag

SEQ ID NO: 43018 - RNA, 22 nt, Homo sapiens
acuuuguguuacccagcaagga

SEQ ID NO: 43019 - RNA, 22 nt, Homo sapiens
acuuuuugauggggagaacauu

SEQ ID NO: 43020 - RNA, 22 nt, Homo sapiens
acuuuuugcaaccauuuggacc

SEQ ID NO: 43021 - RNA, 22 nt, Homo sapiens
agaagaacauagggugacugaa

SEQ ID NO: 43022 - RNA, 19 nt, Homo sapiens
agaaucuaaauuauuucug

SEQ ID NO: 43023 - RNA, 22 nt, Homo sapiens
agaaugugaacaucuugaaagu

SEQ ID NO: 43024 - RNA, 22 nt, Homo sapiens
agaauucugucauguuuauauu

SEQ ID NO: 43025 - RNA, 22 nt, Homo sapiens
agaguacugacguuugcaaauu

SEQ ID NO: 43026 - RNA, 18 nt, Homo sapiens
agaugguguugcuucugu

SEQ ID NO: 43027 - RNA, 22 nt, Homo sapiens
agcaacauuguucauaauagcu

SEQ ID NO: 43028 - RNA, 22 nt, Homo sapiens
agcaagacauggcuuccaaaug

SEQ ID NO: 43029 - RNA, 22 nt, Homo sapiens
agcacagugguuaaguuucuua

SEQ ID NO: 43030 - RNA, 22 nt, Homo sapiens
agcagcaucgggaaguuggcca

SEQ ID NO: 43031 - RNA, 22 nt, Homo sapiens
agcagcaugaggggacuucugc

SEQ ID NO: 43032 - RNA, 22 nt, Homo sapiens
agcagguauucgggucaugggg

SEQ ID NO: 43033 - RNA, 22 nt, Homo sapiens
agcagugucauuuucuggugag

SEQ ID NO: 43034 - RNA, 22 nt, Homo sapiens
agcagugugaaaauggacuaau

SEQ ID NO: 43035 - RNA, 19 nt, Homo sapiens
agcaucauuauuguuuugg

SEQ ID NO: 43036 - RNA, 17 nt, Homo sapiens
agcauguguuugagauu

SEQ ID NO: 43037 - RNA, 22 nt, Homo sapiens
agcuacuguuagucuaguuagg

SEQ ID NO: 43038 - RNA, 22 nt, Homo sapiens
agcugcacugguauaggagaaa

SEQ ID NO: 43039 - RNA, 22 nt, Homo sapiens
agcugccagucuuguaaggccu

SEQ ID NO: 43040 - RNA, 20 nt, Homo sapiens
agcuggguguguuggugcau

SEQ ID NO: 43041 - RNA, 22 nt, Homo sapiens
agcuguaguuugguggauguaa

SEQ ID NO: 43042 - RNA, 22 nt, Homo sapiens
agcugugucuucuuaaagauuu

SEQ ID NO: 43043 - RNA, 19 nt, Homo sapiens
agcuguguugccugugaga

SEQ ID NO: 43044 - RNA, 22 nt, Homo sapiens
agcuguuguuaauuaacucauu

SEQ ID NO: 43045 - RNA, 20 nt, Homo sapiens
agcuguuguuaugagguuua

SEQ ID NO: 43046 - RNA, 22 nt, Homo sapiens
agcuucauuccaacuuccuucu

SEQ ID NO: 43047 - RNA, 22 nt, Homo sapiens
agcuugugauuuagagugagag

SEQ ID NO: 43048 - RNA, 22 nt, Homo sapiens
agcuuguuuucccauaacuaga

SEQ ID NO: 43049 - RNA, 22 nt, Homo sapiens
agcuuuuugggcagcuauugac

SEQ ID NO: 43050 - RNA, 22 nt, Homo sapiens
aggaagguaaacuaacuugccu

SEQ ID NO: 43051 - RNA, 22 nt, Homo sapiens
aggagcuuuggggaaaacagau

SEQ ID NO: 43052 - RNA, 22 nt, Homo sapiens
aggcaagcaucuugcucccuuc

SEQ ID NO: 43053 - RNA, 22 nt, Homo sapiens
aggcuguguggauaauauuggg

SEQ ID NO: 43054 - RNA, 22 nt, Homo sapiens
aggucccauguccucccugacc

SEQ ID NO: 43055 - RNA, 22 nt, Homo sapiens
aggugguguuggguuccagccc

SEQ ID NO: 43056 - RNA, 18 nt, Homo sapiens
agguuauuucccaagacu

SEQ ID NO: 43057 - RNA, 22 nt, Homo sapiens
aguaacaggauccaaagaaugu

SEQ ID NO: 43058 - RNA, 22 nt, Homo sapiens
aguaucaagccacacaugguca

SEQ ID NO: 43059 - RNA, 20 nt, Homo sapiens
aguauucacuuuuuucaugg

SEQ ID NO: 43060 - RNA, 22 nt, Homo sapiens
agucacaugcauuuucuucaau

SEQ ID NO: 43061 - RNA, 22 nt, Homo sapiens
aguccauuugaugaugauucca

SEQ ID NO: 43062 - RNA, 22 nt, Homo sapiens
agucgguguuacugacagaaug

SEQ ID NO: 43063 - RNA, 22 nt, Homo sapiens
agugauuuuaacuuccagcaau

SEQ ID NO: 43064 - RNA, 22 nt, Homo sapiens
agugcaauaaggauguagaacu

SEQ ID NO: 43065 - RNA, 22 nt, Homo sapiens
agugcaauggcgugaucuuggc

SEQ ID NO: 43066 - RNA, 22 nt, Homo sapiens
agugcaguggcacaaucuuggc

SEQ ID NO: 43067 - RNA, 22 nt, Homo sapiens
agugcaguugucacgugccuuc

SEQ ID NO: 43068 - RNA, 22 nt, Homo sapiens
agugcauugcaucucugcuuca

SEQ ID NO: 43069 - RNA, 22 nt, Homo sapiens
aguggguguuccauuggauaaa

SEQ ID NO: 43070 - RNA, 19 nt, Homo sapiens
aguggguguuuucuguuug

SEQ ID NO: 43071 - RNA, 22 nt, Homo sapiens
auaaagccaugagcuugagaug

SEQ ID NO: 43072 - RNA, 22 nt, Homo sapiens
auaagaugaaggaagccauauc

SEQ ID NO: 43073 - RNA, 22 nt, Homo sapiens
auaaggcugguauagacauuca

SEQ ID NO: 43074 - RNA, 19 nt, Homo sapiens
auaagugaaucacgggggc

SEQ ID NO: 43075 - RNA, 22 nt, Homo sapiens
auacacauuccugggccucacc

SEQ ID NO: 43076 - RNA, 22 nt, Homo sapiens
auacacgugccuuguuggugua

SEQ ID NO: 43077 - RNA, 19 nt, Homo sapiens
auacacguguauacauaca

SEQ ID NO: 43078 - RNA, 22 nt, Homo sapiens
auacaucugccauguuggugug

SEQ ID NO: 43079 - RNA, 22 nt, Homo sapiens
auacaugugccaugcuggugug

SEQ ID NO: 43080 - RNA, 22 nt, Homo sapiens
auacaugugccauguugguuug

SEQ ID NO: 43081 - RNA, 15 nt, Homo sapiens
auagaaugaaaggga

SEQ ID NO: 43082 - RNA, 22 nt, Homo sapiens
auagaauguuugcgccagguga

SEQ ID NO: 43083 - RNA, 23 nt, Homo sapiens
auagagcuaggaugcagacagau

SEQ ID NO: 43084 - RNA, 22 nt, Homo sapiens
auagaguuagaaagaaauguuu

SEQ ID NO: 43085 - RNA, 22 nt, Homo sapiens
auagcaauuugggaaucagacu

SEQ ID NO: 43086 - RNA, 22 nt, Homo sapiens
auagcacaugugcaaauggcug

SEQ ID NO: 43087 - RNA, 22 nt, Homo sapiens
auagcagcaccccacuaccuca

SEQ ID NO: 43088 - RNA, 22 nt, Homo sapiens
auagcagcagcuaguagugaua

SEQ ID NO: 43089 - RNA, 22 nt, Homo sapiens
auagcucuugcuuacccacugu

SEQ ID NO: 43090 - RNA, 22 nt, Homo sapiens
auaguagagagggcaaaaugcu

SEQ ID NO: 43091 - RNA, 21 nt, Homo sapiens
auagugcuagagaguagcagg

SEQ ID NO: 43092 - RNA, 22 nt, Homo sapiens
auaucaacaucgugucauuagu

SEQ ID NO: 43093 - RNA, 22 nt, Homo sapiens
auaucacaggaaaggaagauac

SEQ ID NO: 43094 - RNA, 22 nt, Homo sapiens
auaucagugucuuacuguuuuu

SEQ ID NO: 43095 - RNA, 22 nt, Homo sapiens
auaugcauacauguaugcagga

SEQ ID NO: 43096 - RNA, 22 nt, Homo sapiens
auaugucuuaguuaccuugggc

SEQ ID NO: 43097 - RNA, 22 nt, Homo sapiens
auauguucucauucauaugugg

SEQ ID NO: 43098 - RNA, 22 nt, Homo sapiens
auauucaagugaggauggcuaa

SEQ ID NO: 43099 - RNA, 22 nt, Homo sapiens
aucaaaguaucucaauauggua

SEQ ID NO: 43100 - RNA, 22 nt, Homo sapiens
aucaaaguuucccagaaguugu

SEQ ID NO: 43101 - RNA, 22 nt, Homo sapiens
aucacaguuaagaggugaugaa

SEQ ID NO: 43102 - RNA, 22 nt, Homo sapiens
aucauugugcaucuucauucca

SEQ ID NO: 43103 - RNA, 22 nt, Homo sapiens
aucccagaaacucggguuucuc

SEQ ID NO: 43104 - RNA, 22 nt, Homo sapiens
aucccuguaguaauauucuagc

SEQ ID NO: 43105 - RNA, 22 nt, Homo sapiens
aucccuugacguggagucucug

SEQ ID NO: 43106 - RNA, 22 nt, Homo sapiens
aucccuuucugauacuuucccu

SEQ ID NO: 43107 - RNA, 22 nt, Homo sapiens
aucucugagauguucugauuuu

SEQ ID NO: 43108 - RNA, 21 nt, Homo sapiens
aucugugagaccuuggggguu

SEQ ID NO: 43109 - RNA, 22 nt, Homo sapiens
augaaagguugucuuaagccau

SEQ ID NO: 43110 - RNA, 22 nt, Homo sapiens
augaaagucaauccccaagugu

SEQ ID NO: 43111 - RNA, 22 nt, Homo sapiens
augaaauguaugagucuggguu

SEQ ID NO: 43112 - RNA, 22 nt, Homo sapiens
augaaguuagcucauuucuuuu

SEQ ID NO: 43113 - RNA, 22 nt, Homo sapiens
augacaaugaaucccuguuuca

SEQ ID NO: 43114 - RNA, 22 nt, Homo sapiens
augacacugcagagauguccca

SEQ ID NO: 43115 - RNA, 19 nt, Homo sapiens
augaccauuuccauaguau

SEQ ID NO: 43116 - RNA, 22 nt, Homo sapiens
augacuuuucugaaaaccacca

SEQ ID NO: 43117 - RNA, 22 nt, Homo sapiens
augagaacugucaaugagagcu

SEQ ID NO: 43118 - RNA, 22 nt, Homo sapiens
augagaauguaaguuaaugaaa

SEQ ID NO: 43119 - RNA, 22 nt, Homo sapiens
augagacauuaaaguguguuug

SEQ ID NO: 43120 - RNA, 22 nt, Homo sapiens
augagagugagagcagccccuu

SEQ ID NO: 43121 - RNA, 22 nt, Homo sapiens
augagauauguuaaaaguuaaa

SEQ ID NO: 43122 - RNA, 22 nt, Homo sapiens
augagauuauguaaagagacca

SEQ ID NO: 43123 - RNA, 22 nt, Homo sapiens
augagcucauaaagagugauuu

SEQ ID NO: 43124 - RNA, 22 nt, Homo sapiens
augaggaaggagccuuugucug

SEQ ID NO: 43125 - RNA, 22 nt, Homo sapiens
augaggcaggaaaggcguaucu

SEQ ID NO: 43126 - RNA, 22 nt, Homo sapiens
augagguccuagccaacuuuuu

SEQ ID NO: 43127 - RNA, 18 nt, Homo sapiens
augagucauuguggaaau

SEQ ID NO: 43128 - RNA, 22 nt, Homo sapiens
augauagucuugagaagcauuu

SEQ ID NO: 43129 - RNA, 22 nt, Homo sapiens
augcaaaucuuaaguaugugug

SEQ ID NO: 43130 - RNA, 22 nt, Homo sapiens
augcaagcacacaagaggaaau

SEQ ID NO: 43131 - RNA, 22 nt, Homo sapiens
augcaauucuagauugauagua

SEQ ID NO: 43132 - RNA, 22 nt, Homo sapiens
augccaagaugagcacgcgucu

SEQ ID NO: 43133 - RNA, 22 nt, Homo sapiens
augccacagaaauaaccaaaau

SEQ ID NO: 43134 - RNA, 22 nt, Homo sapiens
augccagggagaauuguucaag

SEQ ID NO: 43135 - RNA, 19 nt, Homo sapiens
augccucaguuuuguacuu

SEQ ID NO: 43136 - RNA, 19 nt, Homo sapiens
augccuggagaugguuaua

SEQ ID NO: 43137 - RNA, 22 nt, Homo sapiens
augcuuguugcagccugagccu

SEQ ID NO: 43138 - RNA, 20 nt, Homo sapiens
auggaacugugagccaauua

SEQ ID NO: 43139 - RNA, 22 nt, Homo sapiens
auggaagacuccucuuugggua

SEQ ID NO: 43140 - RNA, 22 nt, Homo sapiens
auggaaggagaggaaugaauga

SEQ ID NO: 43141 - RNA, 22 nt, Homo sapiens
auggaauguauagucauguagg

SEQ ID NO: 43142 - RNA, 22 nt, Homo sapiens
auggaauguggaaugguaagua

SEQ ID NO: 43143 - RNA, 22 nt, Homo sapiens
auggagugagaauggagguucc

SEQ ID NO: 43144 - RNA, 22 nt, Homo sapiens
auggaguguaauauugagagcu

SEQ ID NO: 43145 - RNA, 22 nt, Homo sapiens
auggauugucuccuugugccau

SEQ ID NO: 43146 - RNA, 22 nt, Homo sapiens
auggcagcugguuuuacccuag

SEQ ID NO: 43147 - RNA, 22 nt, Homo sapiens
auggcccccuguuugugaacau

SEQ ID NO: 43148 - RNA, 22 nt, Homo sapiens
auggcguguggcuuggaggcug

SEQ ID NO: 43149 - RNA, 22 nt, Homo sapiens
auggcucaauucuuucccugaa

SEQ ID NO: 43150 - RNA, 22 nt, Homo sapiens
auggcuuugggcugcucugccc

SEQ ID NO: 43151 - RNA, 22 nt, Homo sapiens
auggcuuuggucucccagugau

SEQ ID NO: 43152 - RNA, 22 nt, Homo sapiens
auggcuuuguguucagagcuga

SEQ ID NO: 43153 - RNA, 22 nt, Homo sapiens
augggguaggcuugcuguagua

SEQ ID NO: 43154 - RNA, 21 nt, Homo sapiens
augguacugucucuggagaua

SEQ ID NO: 43155 - RNA, 22 nt, Homo sapiens
augguugguuaaaucuguguau

SEQ ID NO: 43156 - RNA, 21 nt, Homo sapiens
auguaacugggaaugugagag

SEQ ID NO: 43157 - RNA, 20 nt, Homo sapiens
auguaauguaugauauguac

SEQ ID NO: 43158 - RNA, 22 nt, Homo sapiens
auguaguagauauuuauggaaa

SEQ ID NO: 43159 - RNA, 22 nt, Homo sapiens
augucaacauagacaguagagu

SEQ ID NO: 43160 - RNA, 22 nt, Homo sapiens
augucugguagccaccuggagg

SEQ ID NO: 43161 - RNA, 22 nt, Homo sapiens
augugcaauggugucaccacau

SEQ ID NO: 43162 - RNA, 22 nt, Homo sapiens
auguggcuuuucaacuguguga

SEQ ID NO: 43163 - RNA, 22 nt, Homo sapiens
auuaagugcuugccagugcugg

SEQ ID NO: 43164 - RNA, 20 nt, Homo sapiens
auuagagcuacauggcuaca

SEQ ID NO: 43165 - RNA, 22 nt, Homo sapiens
auuauauguguaugugcauacc

SEQ ID NO: 43166 - RNA, 22 nt, Homo sapiens
auuauguuguauuuccuugcag

SEQ ID NO: 43167 - RNA, 22 nt, Homo sapiens
auuauugacucauagaaaggau

SEQ ID NO: 43168 - RNA, 22 nt, Homo sapiens
auucaagggauuucaggaggcu

SEQ ID NO: 43169 - RNA, 20 nt, Homo sapiens
auucaaguaugccuugagaa

SEQ ID NO: 43170 - RNA, 22 nt, Homo sapiens
auucaccauggaccaggggccu

SEQ ID NO: 43171 - RNA, 22 nt, Homo sapiens
auuccacuuacaugaaguaccu

SEQ ID NO: 43172 - RNA, 22 nt, Homo sapiens
auucccuuagcugccucagccu

SEQ ID NO: 43173 - RNA, 22 nt, Homo sapiens
auucccuuggucaacggaugca

SEQ ID NO: 43174 - RNA, 22 nt, Homo sapiens
auugaacacuucugugugccag

SEQ ID NO: 43175 - RNA, 22 nt, Homo sapiens
auugaaucuaaaaugagucucu

SEQ ID NO: 43176 - RNA, 19 nt, Homo sapiens
auugacauugggguguuca

SEQ ID NO: 43177 - RNA, 22 nt, Homo sapiens
auugagacaaauuuguaugcag

SEQ ID NO: 43178 - RNA, 22 nt, Homo sapiens
auugcaaugggaaacuaugaaa

SEQ ID NO: 43179 - RNA, 22 nt, Homo sapiens
auugcacaaagagggaaacuga

SEQ ID NO: 43180 - RNA, 22 nt, Homo sapiens
auugcacacagaaucaggguaa

SEQ ID NO: 43181 - RNA, 22 nt, Homo sapiens
auugcccaggcuggagugcagu

SEQ ID NO: 43182 - RNA, 22 nt, Homo sapiens
auugcccauaaggauauuguca

SEQ ID NO: 43183 - RNA, 22 nt, Homo sapiens
auugcugagacauugcuaaucu

SEQ ID NO: 43184 - RNA, 22 nt, Homo sapiens
auuggcaauagcuuucuuacua

SEQ ID NO: 43185 - RNA, 22 nt, Homo sapiens
auuguacuccagccuaggcaac

SEQ ID NO: 43186 - RNA, 22 nt, Homo sapiens
auugucacuuaaaagugcaugu

SEQ ID NO: 43187 - RNA, 22 nt, Homo sapiens
auuuagcaauggagguagugua

SEQ ID NO: 43188 - RNA, 19 nt, Homo sapiens
auuugaucaucaggcacag

SEQ ID NO: 43189 - RNA, 22 nt, Homo sapiens
auuuggguaaugagugcaaggg

SEQ ID NO: 43190 - RNA, 22 nt, Homo sapiens
auuuugcauugcuguaaaggaa

SEQ ID NO: 43191 - RNA, 22 nt, Homo sapiens
caaaagugauugcgguuuuugc

SEQ ID NO: 43192 - RNA, 22 nt, Homo sapiens
caaagucuucaguugauucuga

SEQ ID NO: 43193 - RNA, 19 nt, Homo sapiens
caacccugcagagaaagga

SEQ ID NO: 43194 - RNA, 22 nt, Homo sapiens
caacucuguaggauccaggugg

SEQ ID NO: 43195 - RNA, 22 nt, Homo sapiens
caacugcucacuccuggguuca

SEQ ID NO: 43196 - RNA, 22 nt, Homo sapiens
caaguguuggcuuguauacaaa

SEQ ID NO: 43197 - RNA, 22 nt, Homo sapiens
caaugcauuauucucccacuuc

SEQ ID NO: 43198 - RNA, 22 nt, Homo sapiens
cacaaugucuaagauguuucua

SEQ ID NO: 43199 - RNA, 22 nt, Homo sapiens
cacagucuugcaauauugagau

SEQ ID NO: 43200 - RNA, 22 nt, Homo sapiens
cacaguguuacugguaugaagu

SEQ ID NO: 43201 - RNA, 22 nt, Homo sapiens
cacaguguuccagcuauuugaa

SEQ ID NO: 43202 - RNA, 22 nt, Homo sapiens
cacaguugccuaucuccugaag

SEQ ID NO: 43203 - RNA, 22 nt, Homo sapiens
cacugcacuccagcuugugggc

SEQ ID NO: 43204 - RNA, 22 nt, Homo sapiens
cacugcacuccagucuggcgac

SEQ ID NO: 43205 - RNA, 22 nt, Homo sapiens
cacugcacuccaguuucgguaa

SEQ ID NO: 43206 - RNA, 22 nt, Homo sapiens
cacugcacucuucuucugggca

SEQ ID NO: 43207 - RNA, 22 nt, Homo sapiens
cacugcaguaaauugcgucggu

SEQ ID NO: 43208 - RNA, 22 nt, Homo sapiens
cacugcaguggaagauuaagaa

SEQ ID NO: 43209 - RNA, 21 nt, Homo sapiens
cacugcaucacaggacagcau

SEQ ID NO: 43210 - RNA, 22 nt, Homo sapiens
cacugcauccuccaccugccag

SEQ ID NO: 43211 - RNA, 22 nt, Homo sapiens
cacugcauggccacccauguua

SEQ ID NO: 43212 - RNA, 22 nt, Homo sapiens
cacugcauuacucaugagcaug

SEQ ID NO: 43213 - RNA, 21 nt, Homo sapiens
cacuggguucaggcuugugga

SEQ ID NO: 43214 - RNA, 22 nt, Homo sapiens
cacuggucucauggcaugagag

SEQ ID NO: 43215 - RNA, 22 nt, Homo sapiens
cagagaacauucagagcuguag

SEQ ID NO: 43216 - RNA, 22 nt, Homo sapiens
cagagaucaugcaacugcucgc

SEQ ID NO: 43217 - RNA, 20 nt, Homo sapiens
cagcuagugguaggagucgg

SEQ ID NO: 43218 - RNA, 22 nt, Homo sapiens
cagggaauguuauuuaauagca

SEQ ID NO: 43219 - RNA, 22 nt, Homo sapiens
caguacaauguugauuagaagu

SEQ ID NO: 43220 - RNA, 22 nt, Homo sapiens
cagucacagugacaggaugugg

SEQ ID NO: 43221 - RNA, 22 nt, Homo sapiens
cauacaagcuacaaucacaaag

SEQ ID NO: 43222 - RNA, 22 nt, Homo sapiens
caucacuuuuccuuuuacagau

SEQ ID NO: 43223 - RNA, 22 nt, Homo sapiens
caucauugcacccuauagagaa

SEQ ID NO: 43224 - RNA, 19 nt, Homo sapiens
caucccugagcugaagugg

SEQ ID NO: 43225 - RNA, 22 nt, Homo sapiens
caucccugucgucaagucucug

SEQ ID NO: 43226 - RNA, 22 nt, Homo sapiens
cauggcccugggcugggcgaac

SEQ ID NO: 43227 - RNA, 22 nt, Homo sapiens
cauggcuuuaagcaacaccaag

SEQ ID NO: 43228 - RNA, 22 nt, Homo sapiens
caugguguuaggcacugggaau

SEQ ID NO: 43229 - RNA, 22 nt, Homo sapiens
cauugcaacuucugccucccag

SEQ ID NO: 43230 - RNA, 22 nt, Homo sapiens
cauugcacuccagccuaggcaa

SEQ ID NO: 43231 - RNA, 20 nt, Homo sapiens
cauugcacuccagccugcug

SEQ ID NO: 43232 - RNA, 22 nt, Homo sapiens
cauugcacuccagcuugggcaa

SEQ ID NO: 43233 - RNA, 22 nt, Homo sapiens
cauugcacuccauccuuggcaa

SEQ ID NO: 43234 - RNA, 22 nt, Homo sapiens
cauugcacuccaucuugggcaa

SEQ ID NO: 43235 - RNA, 22 nt, Homo sapiens
cauugcacucugcauuccaguc

SEQ ID NO: 43236 - RNA, 22 nt, Homo sapiens
cauugcacuuagacaacuuuug

SEQ ID NO: 43237 - RNA, 22 nt, Homo sapiens
cauugcagauccuucaaaugac

SEQ ID NO: 43238 - RNA, 22 nt, Homo sapiens
ccaagugcuuaaaauuucauuu

SEQ ID NO: 43239 - RNA, 22 nt, Homo sapiens
ccacacugucuuggugggaaac

SEQ ID NO: 43240 - RNA, 23 nt, Homo sapiens
ccacacuguuuagaauggcauca

SEQ ID NO: 43241 - RNA, 22 nt, Homo sapiens
ccagauguuuucauucagcaag

SEQ ID NO: 43242 - RNA, 20 nt, Homo sapiens
ccaguguuauuuauguucua

SEQ ID NO: 43243 - RNA, 19 nt, Homo sapiens
ccaguguucugauugcacu

SEQ ID NO: 43244 - RNA, 22 nt, Homo sapiens
ccaguuuucucacuguugcagu

SEQ ID NO: 43245 - RNA, 22 nt, Homo sapiens
ccaucccuuucugagcaguucc

SEQ ID NO: 43246 - RNA, 21 nt, Homo sapiens
ccaugggacggaaugaauaca

SEQ ID NO: 43247 - RNA, 21 nt, Homo sapiens
cccagguucucugaggguaga

SEQ ID NO: 43248 - RNA, 22 nt, Homo sapiens
cccaguguuuauuuugagccaa

SEQ ID NO: 43249 - RNA, 23 nt, Homo sapiens
cccaguuaauccuuaaucuccac

SEQ ID NO: 43250 - RNA, 22 nt, Homo sapiens
ccccagugguugcaacagcaga

SEQ ID NO: 43251 - RNA, 22 nt, Homo sapiens
ccccauuugaacuccuucaacu

SEQ ID NO: 43252 - RNA, 22 nt, Homo sapiens
ccccggguucugucugcccuug

SEQ ID NO: 43253 - RNA, 22 nt, Homo sapiens
ccucauugcuaucccaggcuga

SEQ ID NO: 43254 - RNA, 21 nt, Homo sapiens
ccuccauuuguauucuugccc

SEQ ID NO: 43255 - RNA, 19 nt, Homo sapiens
ccugcuguucuuuugcacc

SEQ ID NO: 43256 - RNA, 22 nt, Homo sapiens
ccuucauccuccagcaggcuag

SEQ ID NO: 43257 - RNA, 22 nt, Homo sapiens
ccuugguggccacaagacauug

SEQ ID NO: 43258 - RNA, 22 nt, Homo sapiens
cgcccuguagcuagcuagaggu

SEQ ID NO: 43259 - RNA, 22 nt, Homo sapiens
cuaaaguagccaggacugcagg

SEQ ID NO: 43260 - RNA, 22 nt, Homo sapiens
cuaaagucacgauuugugggua

SEQ ID NO: 43261 - RNA, 22 nt, Homo sapiens
cuaagugaacugucacugagaa

SEQ ID NO: 43262 - RNA, 22 nt, Homo sapiens
cuacauuguagguauucaaacu

SEQ ID NO: 43263 - RNA, 22 nt, Homo sapiens
cuagaacuagaacugcuggggu

SEQ ID NO: 43264 - RNA, 22 nt, Homo sapiens
cuagaagcauauucagaacaga

SEQ ID NO: 43265 - RNA, 22 nt, Homo sapiens
cuagaggcacagccuaggcacu

SEQ ID NO: 43266 - RNA, 22 nt, Homo sapiens
cuagcccugagauaaaugucau

SEQ ID NO: 43267 - RNA, 22 nt, Homo sapiens
cuagugcaguuccccugucuua

SEQ ID NO: 43268 - RNA, 22 nt, Homo sapiens
cuaucacuguuuugaugcccgg

SEQ ID NO: 43269 - RNA, 22 nt, Homo sapiens
cuauggcagccacggccuggag

SEQ ID NO: 43270 - RNA, 19 nt, Homo sapiens
cuauugcacauagcugaag

SEQ ID NO: 43271 - RNA, 21 nt, Homo sapiens
cucaaaguacugauauuacag

SEQ ID NO: 43272 - RNA, 20 nt, Homo sapiens
cucacagacagcuucuuucu

SEQ ID NO: 43273 - RNA, 22 nt, Homo sapiens
cucacagucucucccuaauuuu

SEQ ID NO: 43274 - RNA, 22 nt, Homo sapiens
cucacuaguaaggcuguuuagu

SEQ ID NO: 43275 - RNA, 22 nt, Homo sapiens
cucagcuacuugagaggcuuag

SEQ ID NO: 43276 - RNA, 22 nt, Homo sapiens
cucaggcacucugauuccagug

SEQ ID NO: 43277 - RNA, 22 nt, Homo sapiens
cucagggugguggacucuaaua

SEQ ID NO: 43278 - RNA, 22 nt, Homo sapiens
cuccauuuaucugaaauuuuau

SEQ ID NO: 43279 - RNA, 22 nt, Homo sapiens
cucccagugacccaggaacagg

SEQ ID NO: 43280 - RNA, 22 nt, Homo sapiens
cucccauugcaaacaacagaag

SEQ ID NO: 43281 - RNA, 22 nt, Homo sapiens
cuccuugauuagaguauagagu

SEQ ID NO: 43282 - RNA, 22 nt, Homo sapiens
cucucugagccauggcugcccu

SEQ ID NO: 43283 - RNA, 22 nt, Homo sapiens
cucugacagugguuagcacugu

SEQ ID NO: 43284 - RNA, 22 nt, Homo sapiens
cucuuuaguaagcaguugauga

SEQ ID NO: 43285 - RNA, 22 nt, Homo sapiens
cugacauggggauccaccuuag

SEQ ID NO: 43286 - RNA, 22 nt, Homo sapiens
cugagaucguggggcugcuguc

SEQ ID NO: 43287 - RNA, 22 nt, Homo sapiens
cugagcaaaaugaagacacgau

SEQ ID NO: 43288 - RNA, 22 nt, Homo sapiens
cugagcccauucuggggagaag

SEQ ID NO: 43289 - RNA, 22 nt, Homo sapiens
cugaggcacggcgaccuuaagu

SEQ ID NO: 43290 - RNA, 22 nt, Homo sapiens
cugaucuguagcagccaccaca

SEQ ID NO: 43291 - RNA, 22 nt, Homo sapiens
cugaugaaguauuuguucugga

SEQ ID NO: 43292 - RNA, 22 nt, Homo sapiens
cugccuagaucugaaccuggcu

SEQ ID NO: 43293 - RNA, 22 nt, Homo sapiens
cuggagauuaaccaauugccau

SEQ ID NO: 43294 - RNA, 22 nt, Homo sapiens
cuggaggccugaacauaaaugg

SEQ ID NO: 43295 - RNA, 22 nt, Homo sapiens
cuggaguaugaaccauguauca

SEQ ID NO: 43296 - RNA, 22 nt, Homo sapiens
cuggaguuugaggcugcaguga

SEQ ID NO: 43297 - RNA, 22 nt, Homo sapiens
cuggauagagauugaugaugcu

SEQ ID NO: 43298 - RNA, 22 nt, Homo sapiens
cugggaugauguaaauaggcua

SEQ ID NO: 43299 - RNA, 22 nt, Homo sapiens
cugggauggaggagaauuagag

SEQ ID NO: 43300 - RNA, 22 nt, Homo sapiens
cugggcaaugcggcuggauaga

SEQ ID NO: 43301 - RNA, 22 nt, Homo sapiens
cuguaauguaaugagacuacau

SEQ ID NO: 43302 - RNA, 22 nt, Homo sapiens
cugucacugggaggggcagcag

SEQ ID NO: 43303 - RNA, 22 nt, Homo sapiens
cugucucagccucuccaguagc

SEQ ID NO: 43304 - RNA, 22 nt, Homo sapiens
cugugcauaugacuuuauugga

SEQ ID NO: 43305 - RNA, 23 nt, Homo sapiens
cuguggugaggcccuagaaucug

SEQ ID NO: 43306 - RNA, 22 nt, Homo sapiens
cuguuugaggguuugcuuucag

SEQ ID NO: 43307 - RNA, 22 nt, Homo sapiens
cuguuugguaaggaugccucag

SEQ ID NO: 43308 - RNA, 22 nt, Homo sapiens
gggugguuuuaucucuucccuu

SEQ ID NO: 43309 - RNA, 22 nt, Homo sapiens
gguaacaguggggcuaugcuua

SEQ ID NO: 43310 - RNA, 22 nt, Homo sapiens
ggucauagagaauucaccagga

SEQ ID NO: 43311 - RNA, 22 nt, Homo sapiens
ggucuuggagaauuguccuggg

SEQ ID NO: 43312 - RNA, 22 nt, Homo sapiens
ggugagauguucagacgaacug

SEQ ID NO: 43313 - RNA, 22 nt, Homo sapiens
ggugaucauugucucuaguaug

SEQ ID NO: 43314 - RNA, 22 nt, Homo sapiens
gguggugguauuucagaaaaug

SEQ ID NO: 43315 - RNA, 22 nt, Homo sapiens
uacugcauucuccgccuccggg

SEQ ID NO: 43316 - RNA, 19 nt, Homo sapiens
uacuggcucgggaauuuuc

SEQ ID NO: 43317 - RNA, 22 nt, Homo sapiens
uacuucauucuugaccuugcau

SEQ ID NO: 43318 - RNA, 22 nt, Homo sapiens
uacuuuguuauagcagcaggaa

SEQ ID NO: 43319 - RNA, 22 nt, Homo sapiens
uagaaagcaugaccuucagaua

SEQ ID NO: 43320 - RNA, 22 nt, Homo sapiens
uagaaugucagcuucuugaggg

SEQ ID NO: 43321 - RNA, 22 nt, Homo sapiens
uagacaacugaaacacugugca

SEQ ID NO: 43322 - RNA, 22 nt, Homo sapiens
uagacuguaagauccaggagag

SEQ ID NO: 43323 - RNA, 22 nt, Homo sapiens
uagaguguaaaccacauaguga

SEQ ID NO: 43324 - RNA, 22 nt, Homo sapiens
uagcaaaucaauggaauugaag

SEQ ID NO: 43325 - RNA, 22 nt, Homo sapiens
uagcacaugucagguaauuugc

SEQ ID NO: 43326 - RNA, 22 nt, Homo sapiens
uagcagcaucucuggcuucuac

SEQ ID NO: 43327 - RNA, 22 nt, Homo sapiens
uagcagccaggaagggcuggcu

SEQ ID NO: 43328 - RNA, 22 nt, Homo sapiens
uagcagcuuuauugagguaaau

SEQ ID NO: 43329 - RNA, 22 nt, Homo sapiens
uagcaucaauucauguuaugau

SEQ ID NO: 43330 - RNA, 21 nt, Homo sapiens
uagcuacacugugauucaugg

SEQ ID NO: 43331 - RNA, 17 nt, Homo sapiens
uagcucuauuucuagcc

SEQ ID NO: 43332 - RNA, 22 nt, Homo sapiens
uagcugcccagcacgaaguugg

SEQ ID NO: 43333 - RNA, 22 nt, Homo sapiens
uagcuggaauuacuugcaccug

SEQ ID NO: 43334 - RNA, 22 nt, Homo sapiens
uagcuggaguuuuuguuauagg

SEQ ID NO: 43335 - RNA, 17 nt, Homo sapiens
uagcuucacauuaggaa

SEQ ID NO: 43336 - RNA, 22 nt, Homo sapiens
uagcuucuccauagcuccaugu

SEQ ID NO: 43337 - RNA, 19 nt, Homo sapiens
uagggcacgaggcagaguc

SEQ ID NO: 43338 - RNA, 22 nt, Homo sapiens
uaggugauccauuuguauuuua

SEQ ID NO: 43339 - RNA, 22 nt, Homo sapiens
uagugcccuuauaagagcagga

SEQ ID NO: 43340 - RNA, 22 nt, Homo sapiens
uaucaaggccacucauuuuaug

SEQ ID NO: 43341 - RNA, 22 nt, Homo sapiens
uaucacacuguuggauuugauu

SEQ ID NO: 43342 - RNA, 22 nt, Homo sapiens
uaucaccuugguagucuugggg

SEQ ID NO: 43343 - RNA, 22 nt, Homo sapiens
uaucaguauggauucauggauu

SEQ ID NO: 43344 - RNA, 22 nt, Homo sapiens
uaucaucauuggcaggugagaa

SEQ ID NO: 43345 - RNA, 21 nt, Homo sapiens
uaucccagucacaucuaccca

SEQ ID NO: 43346 - RNA, 23 nt, Homo sapiens
uaucccuugccuuaugaugugag

SEQ ID NO: 43347 - RNA, 22 nt, Homo sapiens
uaucugguuauugcugcugauu

SEQ ID NO: 43348 - RNA, 22 nt, Homo sapiens
uaugacauaguccuuaacccuc

SEQ ID NO: 43349 - RNA, 20 nt, Homo sapiens
uaugaccugucuuuucucuc

SEQ ID NO: 43350 - RNA, 22 nt, Homo sapiens
uaugaccuuguccccucucgcc

SEQ ID NO: 43351 - RNA, 22 nt, Homo sapiens
uaugacuuuugaauacagaugg

SEQ ID NO: 43352 - RNA, 22 nt, Homo sapiens
uauggaaaucuuaccuuauggu

SEQ ID NO: 43353 - RNA, 22 nt, Homo sapiens
uauggcuuuguuaacauuuucu

SEQ ID NO: 43354 - RNA, 22 nt, Homo sapiens
uauggguuucagagggugauag

SEQ ID NO: 43355 - RNA, 22 nt, Homo sapiens
uaugucauggguaaagugcccu

SEQ ID NO: 43356 - RNA, 20 nt, Homo sapiens
uauucacucuccagucuugc

SEQ ID NO: 43357 - RNA, 22 nt, Homo sapiens
uauugcacuccucaugcauuug

SEQ ID NO: 43358 - RNA, 22 nt, Homo sapiens
uauuugguagcuauuuugcagu

SEQ ID NO: 43359 - RNA, 18 nt, Homo sapiens
ucaagcaauugucaugcc

SEQ ID NO: 43360 - RNA, 19 nt, Homo sapiens
ucaagcuauucuccugccu

SEQ ID NO: 43361 - RNA, 22 nt, Homo sapiens
ucaaggcacuagcugagcugca

SEQ ID NO: 43362 - RNA, 23 nt, Homo sapiens
ucaagugaugguggccacaaggg

SEQ ID NO: 43363 - RNA, 22 nt, Homo sapiens
ucacaagugagaggaauuagau

SEQ ID NO: 43364 - RNA, 22 nt, Homo sapiens
ucacaauucacuacaggcuuga

SEQ ID NO: 43365 - RNA, 22 nt, Homo sapiens
ucacacucucaccaacauuugg

SEQ ID NO: 43366 - RNA, 19 nt, Homo sapiens
ucacacuguggcuucuuua

SEQ ID NO: 43367 - RNA, 22 nt, Homo sapiens
ucacacuguuuugauuauuaua

SEQ ID NO: 43368 - RNA, 22 nt, Homo sapiens
ucacaguagcaaauguuagaaa

SEQ ID NO: 43369 - RNA, 23 nt, Homo sapiens
ucacaguggcugcuuaauuguga

SEQ ID NO: 43370 - RNA, 22 nt, Homo sapiens
ucacaguugauugaaacacagc

SEQ ID NO: 43371 - RNA, 22 nt, Homo sapiens
ucacaucucagguuucuugaca

SEQ ID NO: 43372 - RNA, 22 nt, Homo sapiens
ucaccaccugcugaucauagag

SEQ ID NO: 43373 - RNA, 16 nt, Homo sapiens
ucaccccuagagaucc

SEQ ID NO: 43374 - RNA, 22 nt, Homo sapiens
ucaccuggagacaugaagacug

SEQ ID NO: 43375 - RNA, 21 nt, Homo sapiens
ucaccuguugcgaugaagcug

SEQ ID NO: 43376 - RNA, 18 nt, Homo sapiens
ucaccuugugagagagag

SEQ ID NO: 43377 - RNA, 22 nt, Homo sapiens
ucacuagaucaagggagagaaa

SEQ ID NO: 43378 - RNA, 22 nt, Homo sapiens
ucacuagggagaaacugaggcu

SEQ ID NO: 43379 - RNA, 22 nt, Homo sapiens
ucacucagaccuggugauaugc

SEQ ID NO: 43380 - RNA, 22 nt, Homo sapiens
ucacuggacucuagccugggug

SEQ ID NO: 43381 - RNA, 20 nt, Homo sapiens
ucacuggguucuugaagucu

SEQ ID NO: 43382 - RNA, 22 nt, Homo sapiens
ucagaacugauacuagaacuuu

SEQ ID NO: 43383 - RNA, 22 nt, Homo sapiens
ucagacacugcccuccaccugu

SEQ ID NO: 43384 - RNA, 22 nt, Homo sapiens
ucagaguagaaacacuuccaua

SEQ ID NO: 43385 - RNA, 22 nt, Homo sapiens
ucagaguagagcgacuucuccu

SEQ ID NO: 43386 - RNA, 22 nt, Homo sapiens
ucagaucauuaagguagguuua

SEQ ID NO: 43387 - RNA, 22 nt, Homo sapiens
ucagcagucacuccuaugacaa

SEQ ID NO: 43388 - RNA, 22 nt, Homo sapiens
ucaggcaugcagcaaugcagug

SEQ ID NO: 43389 - RNA, 20 nt, Homo sapiens
ucaggcuccgcauuaacuua

SEQ ID NO: 43390 - RNA, 20 nt, Homo sapiens
ucagguagaucuuugagguc

SEQ ID NO: 43391 - RNA, 22 nt, Homo sapiens
ucagguagugccaugauugauu

SEQ ID NO: 43392 - RNA, 22 nt, Homo sapiens
ucaggugcagagaagaaauggg

SEQ ID NO: 43393 - RNA, 22 nt, Homo sapiens
ucaguaccugagagugggcaga

SEQ ID NO: 43394 - RNA, 22 nt, Homo sapiens
ucagucauucaauuguugaaug

SEQ ID NO: 43395 - RNA, 22 nt, Homo sapiens
ucagucauugauggaguagguc

SEQ ID NO: 43396 - RNA, 22 nt, Homo sapiens
ucaguccccucgcugagucuac

SEQ ID NO: 43397 - RNA, 22 nt, Homo sapiens
ucagugcaggaaucucuagcca

SEQ ID NO: 43398 - RNA, 22 nt, Homo sapiens
ucagugucaucuggguuguuug

SEQ ID NO: 43399 - RNA, 22 nt, Homo sapiens
ucagugucugugauggagaggu

SEQ ID NO: 43400 - RNA, 22 nt, Homo sapiens
ucaguuuagguguaacggccac

SEQ ID NO: 43401 - RNA, 22 nt, Homo sapiens
ucauacuguugugaaacaaaac

SEQ ID NO: 43402 - RNA, 22 nt, Homo sapiens
ucauaguacuuuguuuugaaaa

SEQ ID NO: 43403 - RNA, 16 nt, Homo sapiens
ucauaguaucucuucu

SEQ ID NO: 43404 - RNA, 22 nt, Homo sapiens
ucauauugguuaaaauaguggg

SEQ ID NO: 43405 - RNA, 22 nt, Homo sapiens
ucaucagguaugucagcggagu

SEQ ID NO: 43406 - RNA, 20 nt, Homo sapiens
ucaucaguuggugcucgcug

SEQ ID NO: 43407 - RNA, 23 nt, Homo sapiens
ucaugaggccauucaaauccauu

SEQ ID NO: 43408 - RNA, 22 nt, Homo sapiens
ucauggcacugaugagaguuuc

SEQ ID NO: 43409 - RNA, 19 nt, Homo sapiens
ucauggcuuuuucagcugu

SEQ ID NO: 43410 - RNA, 22 nt, Homo sapiens
ucauuagagaucuuggggaaaa

SEQ ID NO: 43411 - RNA, 22 nt, Homo sapiens
ucauugcauuccagcccaagca

SEQ ID NO: 43412 - RNA, 22 nt, Homo sapiens
ucauuggaugagaccccugucc

SEQ ID NO: 43413 - RNA, 21 nt, Homo sapiens
ucauugggugcagcccacccu

SEQ ID NO: 43414 - RNA, 22 nt, Homo sapiens
ucauugguucuggguguuguug

SEQ ID NO: 43415 - RNA, 22 nt, Homo sapiens
uccacaauggcugaacuagauu

SEQ ID NO: 43416 - RNA, 22 nt, Homo sapiens
uccagguuucaugcucuuuauu

SEQ ID NO: 43417 - RNA, 18 nt, Homo sapiens
uccaguuuucccagcauc

SEQ ID NO: 43418 - RNA, 22 nt, Homo sapiens
uccauagacauuuuaagguagu

SEQ ID NO: 43419 - RNA, 22 nt, Homo sapiens
uccauaguugcacucuggagcc

SEQ ID NO: 43420 - RNA, 22 nt, Homo sapiens
uccauguagaagacaggggaga

SEQ ID NO: 43421 - RNA, 22 nt, Homo sapiens
ucccaguguguagcuugucucu

SEQ ID NO: 43422 - RNA, 22 nt, Homo sapiens
ucccauguagcuaggauuacag

SEQ ID NO: 43423 - RNA, 23 nt, Homo sapiens
uccccgggagcaccagcuuguug

SEQ ID NO: 43424 - RNA, 22 nt, Homo sapiens
cuucaccaguuuggcagucuca

SEQ ID NO: 43425 - RNA, 22 nt, Homo sapiens
cuucuguuaguucugauaacuu

SEQ ID NO: 43426 - RNA, 22 nt, Homo sapiens
cuugaacaaagagauuccauua

SEQ ID NO: 43427 - RNA, 19 nt, Homo sapiens
cuugccccauucauccucu

SEQ ID NO: 43428 - RNA, 22 nt, Homo sapiens
cuuggcauugccccuggaauuu

SEQ ID NO: 43429 - RNA, 22 nt, Homo sapiens
ugagguaggugaagaaugcacg

SEQ ID NO: 43430 - RNA, 22 nt, Homo sapiens
ugagguugguauuacugucucu

SEQ ID NO: 43431 - RNA, 22 nt, Homo sapiens
ugaguaauguugaucuuugaua

SEQ ID NO: 43432 - RNA, 22 nt, Homo sapiens
ugaguagaacaucaagucauac

SEQ ID NO: 43433 - RNA, 22 nt, Homo sapiens
ugaguagaacuccuggagaugu

SEQ ID NO: 43434 - RNA, 22 nt, Homo sapiens
ugaguaugaguucaggaaaggc

SEQ ID NO: 43435 - RNA, 22 nt, Homo sapiens
ugaguauguuuagaaguaaagg

SEQ ID NO: 43436 - RNA, 22 nt, Homo sapiens
ugagucaauggaggcucagagc

SEQ ID NO: 43437 - RNA, 22 nt, Homo sapiens
ugagucagucucacucugcugc

SEQ ID NO: 43438 - RNA, 22 nt, Homo sapiens
ugagucaugcuggagucauggc

SEQ ID NO: 43439 - RNA, 22 nt, Homo sapiens
ugagucuguucucacauugcua

SEQ ID NO: 43440 - RNA, 22 nt, Homo sapiens
ugagugaaagaagcacuaagga

SEQ ID NO: 43441 - RNA, 22 nt, Homo sapiens
ugagugagguucuacucuguga

SEQ ID NO: 43442 - RNA, 22 nt, Homo sapiens
ugaguucuuuguagauucugug

SEQ ID NO: 43443 - RNA, 22 nt, Homo sapiens
ugauaagaaauuguucauguag

SEQ ID NO: 43444 - RNA, 20 nt, Homo sapiens
ugauauuuucugagcaggaa

SEQ ID NO: 43445 - RNA, 22 nt, Homo sapiens
ugaugacacugauuucuucaau

SEQ ID NO: 43446 - RNA, 22 nt, Homo sapiens
ugaugacauugucacagucuga

SEQ ID NO: 43447 - RNA, 22 nt, Homo sapiens
ugauggcauuuggaguugggac

SEQ ID NO: 43448 - RNA, 22 nt, Homo sapiens
ugauguauuauuaagaccuggc

SEQ ID NO: 43449 - RNA, 22 nt, Homo sapiens
ugcacacucuguaugagaaucu

SEQ ID NO: 43450 - RNA, 22 nt, Homo sapiens
ugcaccauugucaccuggguga

SEQ ID NO: 43451 - RNA, 19 nt, Homo sapiens
ugcagcaauguaaaagaca

SEQ ID NO: 43452 - RNA, 22 nt, Homo sapiens
ugcagugcaugacuguguuaug

SEQ ID NO: 43453 - RNA, 20 nt, Homo sapiens
ugcaguguccucacuuguca

SEQ ID NO: 43454 - RNA, 22 nt, Homo sapiens
ugcauaauuccuugcaccagaa

SEQ ID NO: 43455 - RNA, 22 nt, Homo sapiens
aaaacgcauccucacaggucug

SEQ ID NO: 43456 - RNA, 22 nt, Homo sapiens
aaacugaucugaaggccaggcu

SEQ ID NO: 43457 - RNA, 22 nt, Homo sapiens
aaagaguucagguagauuucaa

SEQ ID NO: 43458 - RNA, 22 nt, Homo sapiens
aaagcuagagaagcugcuguca

SEQ ID NO: 43459 - RNA, 22 nt, Homo sapiens
aaaggauucuaauggaaaugcu

SEQ ID NO: 43460 - RNA, 19 nt, Homo sapiens
aaagguaguaaccucugau

SEQ ID NO: 43461 - RNA, 22 nt, Homo sapiens
aaaguacucaguucaguuccgu

SEQ ID NO: 43462 - RNA, 22 nt, Homo sapiens
aaagucacuggagaaggaauau

SEQ ID NO: 43463 - RNA, 22 nt, Homo sapiens
aaagucuagaggaucaugugug

SEQ ID NO: 43464 - RNA, 22 nt, Homo sapiens
aaaguguuucugcaguagguuu

SEQ ID NO: 43465 - RNA, 19 nt, Homo sapiens
aaaguguuuuaaagaggau

SEQ ID NO: 43466 - RNA, 22 nt, Homo sapiens
aaaguucuugcugaaggauuau

SEQ ID NO: 43467 - RNA, 22 nt, Homo sapiens
aaauccauuuguucagcuaugc

SEQ ID NO: 43468 - RNA, 22 nt, Homo sapiens
aaaugcacaaagauuuugcacu

SEQ ID NO: 43469 - RNA, 22 nt, Homo sapiens
aaaugcauugagggaaaaggca

SEQ ID NO: 43470 - RNA, 22 nt, Homo sapiens
aaauucaucaaaugguuuguau

SEQ ID NO: 43471 - RNA, 22 nt, Homo sapiens
aacaccauucucuguaacaaga

SEQ ID NO: 43472 - RNA, 22 nt, Homo sapiens
aacaggcuccuaggggugcacc

SEQ ID NO: 43473 - RNA, 22 nt, Homo sapiens
aacugcauuuucugauugugug

SEQ ID NO: 43474 - RNA, 22 nt, Homo sapiens
aacuggcacuacaucaagagcu

SEQ ID NO: 43475 - RNA, 22 nt, Homo sapiens
aacuggcauguuuuaaggcuua

SEQ ID NO: 43476 - RNA, 19 nt, Homo sapiens
aacuggugugagaugguau

SEQ ID NO: 43477 - RNA, 21 nt, Homo sapiens
aagaaagcuggacuugccgcu

SEQ ID NO: 43478 - RNA, 20 nt, Homo sapiens
aagacacuguccccacugga

SEQ ID NO: 43479 - RNA, 22 nt, Homo sapiens
aagaguaguaguggcacucucu

SEQ ID NO: 43480 - RNA, 21 nt, Homo sapiens
aagcacauugaguguguguga

SEQ ID NO: 43481 - RNA, 20 nt, Homo sapiens
aagcauggguuuuaggguca

SEQ ID NO: 43482 - RNA, 21 nt, Homo sapiens
aagcaugguguaucuuuccau

SEQ ID NO: 43483 - RNA, 22 nt, Homo sapiens
aagcaugguuuccaggggucac

SEQ ID NO: 43484 - RNA, 22 nt, Homo sapiens
aagccacuguaccugucucuua

SEQ ID NO: 43485 - RNA, 22 nt, Homo sapiens
aagcugccaggcaugguggcug

SEQ ID NO: 43486 - RNA, 22 nt, Homo sapiens
aagcugccuugcugaggagaaa

SEQ ID NO: 43487 - RNA, 22 nt, Homo sapiens
aagcuggauuuaguguggagca

SEQ ID NO: 43488 - RNA, 22 nt, Homo sapiens
aagcuguguguaagcucucaca

SEQ ID NO: 43489 - RNA, 22 nt, Homo sapiens
aaggaacuggaauauuuugaac

SEQ ID NO: 43490 - RNA, 22 nt, Homo sapiens
aaggcaguggcagaagauguca

SEQ ID NO: 43491 - RNA, 22 nt, Homo sapiens
aaggcuauuugagaaugugugu

SEQ ID NO: 43492 - RNA, 22 nt, Homo sapiens
aagggaaugcuuccaguuugug

SEQ ID NO: 43493 - RNA, 21 nt, Homo sapiens
aaggugguggugauugagaug

SEQ ID NO: 43494 - RNA, 22 nt, Homo sapiens
aaggugguuuucucuuggaguc

SEQ ID NO: 43495 - RNA, 22 nt, Homo sapiens
aagguucuugcuugcaugacug

SEQ ID NO: 43496 - RNA, 22 nt, Homo sapiens
aagugauguuauugggugacuc

SEQ ID NO: 43497 - RNA, 22 nt, Homo sapiens
aagugcaaaucuguggcugaaa

SEQ ID NO: 43498 - RNA, 22 nt, Homo sapiens
aagugcucuugaaacugccuua

SEQ ID NO: 43499 - RNA, 22 nt, Homo sapiens
aagugcuuuacacaugcaugau

SEQ ID NO: 43500 - RNA, 22 nt, Homo sapiens
aauacagcacacagaugggucu

SEQ ID NO: 43501 - RNA, 22 nt, Homo sapiens
aauagcacuguagauggaggaa

SEQ ID NO: 43502 - RNA, 22 nt, Homo sapiens
aauagcauugaaucuaccaauu

SEQ ID NO: 43503 - RNA, 22 nt, Homo sapiens
aaucaacauuguuuuaagucaa

SEQ ID NO: 43504 - RNA, 22 nt, Homo sapiens
aaucacauugaaucugcuaccu

SEQ ID NO: 43505 - RNA, 22 nt, Homo sapiens
aauccauuugccgucuauccau

SEQ ID NO: 43506 - RNA, 22 nt, Homo sapiens
aaucucaacacuuugggaggcu

SEQ ID NO: 43507 - RNA, 22 nt, Homo sapiens
aauggcaagagccacagaggcg

SEQ ID NO: 43508 - RNA, 22 nt, Homo sapiens
aauggcaguagauggaugggua

SEQ ID NO: 43509 - RNA, 22 nt, Homo sapiens
aauggcucuguuggcccaagac

SEQ ID NO: 43510 - RNA, 22 nt, Homo sapiens
aauggguaguacugugguaaca

SEQ ID NO: 43511 - RNA, 22 nt, Homo sapiens
aaugucaucuucaguuguacag

SEQ ID NO: 43512 - RNA, 22 nt, Homo sapiens
aaugugcacuauuagggugaua

SEQ ID NO: 43513 - RNA, 22 nt, Homo sapiens
aauguguuuugaaaucaggaag

SEQ ID NO: 43514 - RNA, 22 nt, Homo sapiens
aauugcaccaucuagaucaaga

SEQ ID NO: 43515 - RNA, 22 nt, Homo sapiens
aauugcacuaagcauaguccag

SEQ ID NO: 43516 - RNA, 22 nt, Homo sapiens
acaagacuucuuguauucuagu

SEQ ID NO: 43517 - RNA, 22 nt, Homo sapiens
acacagugucuguguauuuaaa

SEQ ID NO: 43518 - RNA, 22 nt, Homo sapiens
acacaugugcguagacucuuua

SEQ ID NO: 43519 - RNA, 22 nt, Homo sapiens
acaccuguggucccaguaacuu

SEQ ID NO: 43520 - RNA, 22 nt, Homo sapiens
acacuggguaacauaucuguua

SEQ ID NO: 43521 - RNA, 22 nt, Homo sapiens
acacugucaugucucacaggca

SEQ ID NO: 43522 - RNA, 22 nt, Homo sapiens
acacuguugacauuuuguagug

SEQ ID NO: 43523 - RNA, 22 nt, Homo sapiens
acagaucagagauauuuagguu

SEQ ID NO: 43524 - RNA, 19 nt, Homo sapiens
acagcugguuuugguuucu

SEQ ID NO: 43525 - RNA, 22 nt, Homo sapiens
acaguagcgcaaucucggcuca

SEQ ID NO: 43526 - RNA, 22 nt, Homo sapiens
acagucacaauuuguaccuuuu

SEQ ID NO: 43527 - RNA, 22 nt, Homo sapiens
acagugcuuucaauguucagua

SEQ ID NO: 43528 - RNA, 22 nt, Homo sapiens
acauccauuugcuuuauuugcu

SEQ ID NO: 43529 - RNA, 22 nt, Homo sapiens
acaugcaucauuaggugguuua

SEQ ID NO: 43530 - RNA, 22 nt, Homo sapiens
acauugcucuuaccaaguuugu

SEQ ID NO: 43531 - RNA, 22 nt, Homo sapiens
acccacuagaugccaguggcac

SEQ ID NO: 43532 - RNA, 22 nt, Homo sapiens
acccugcuaaacagcccccugc

SEQ ID NO: 43533 - RNA, 22 nt, Homo sapiens
acccuggaggucuacagugcag

SEQ ID NO: 43534 - RNA, 22 nt, Homo sapiens
acccugucauccacauggugcu

SEQ ID NO: 43535 - RNA, 22 nt, Homo sapiens
acccuuaagcacuaguucagcu

SEQ ID NO: 43536 - RNA, 22 nt, Homo sapiens
acccuugaguguguuucaggca

SEQ ID NO: 43537 - RNA, 22 nt, Homo sapiens
accucagcccggggaaguugag

SEQ ID NO: 43538 - RNA, 22 nt, Homo sapiens
accugguuuucucacaguggcu

SEQ ID NO: 43539 - RNA, 22 nt, Homo sapiens
accuguagcagacuuaauauuu

SEQ ID NO: 43540 - RNA, 23 nt, Homo sapiens
accugugguuauuuuacucuucc

SEQ ID NO: 43541 - RNA, 22 nt, Homo sapiens
accuucauuguugccaugucca

SEQ ID NO: 43542 - RNA, 22 nt, Homo sapiens
accuuguagcaaaccuaacaua

SEQ ID NO: 43543 - RNA, 22 nt, Homo sapiens
acuauacuguaacuguauucag

SEQ ID NO: 43544 - RNA, 22 nt, Homo sapiens
acucagagaacauucccagucu

SEQ ID NO: 43545 - RNA, 22 nt, Homo sapiens
acuccauuucauuuuagcucuu

SEQ ID NO: 43546 - RNA, 22 nt, Homo sapiens
acugaucaauguuaaggcuuau

SEQ ID NO: 43547 - RNA, 22 nt, Homo sapiens
uccccugagucaccugcuucuc

SEQ ID NO: 43548 - RNA, 18 nt, Homo sapiens
ucccucagaauuauagaa

SEQ ID NO: 43549 - RNA, 22 nt, Homo sapiens
ucccugaagcugcagcaacaca

SEQ ID NO: 43550 - RNA, 22 nt, Homo sapiens
ucccugagcaaaguuuucugua

SEQ ID NO: 43551 - RNA, 22 nt, Homo sapiens
ucccugagugauugaaaauaaa

SEQ ID NO: 43552 - RNA, 22 nt, Homo sapiens
ucccuugguaauucuguuccuu

SEQ ID NO: 43553 - RNA, 22 nt, Homo sapiens
uccuacaugcaguacauucaaa

SEQ ID NO: 43554 - RNA, 22 nt, Homo sapiens
uccugagacucacaggcucccc

SEQ ID NO: 43555 - RNA, 22 nt, Homo sapiens
uccuugaaacaggaagaauuca

SEQ ID NO: 43556 - RNA, 22 nt, Homo sapiens
uccuuugguggagucuuuaggg

SEQ ID NO: 43557 - RNA, 22 nt, Homo sapiens
uccuuugguucuugucacccca

SEQ ID NO: 43558 - RNA, 22 nt, Homo sapiens
ucgcugggaagacugaaguguc

SEQ ID NO: 43559 - RNA, 17 nt, Homo sapiens
ucuaauaauaugcauuu

SEQ ID NO: 43560 - RNA, 22 nt, Homo sapiens
ucucaaguaacugggacaauaa

SEQ ID NO: 43561 - RNA, 22 nt, Homo sapiens
ucucaaguggucgcaguuagau

SEQ ID NO: 43562 - RNA, 22 nt, Homo sapiens
ucucacaccccucucauauacc

SEQ ID NO: 43563 - RNA, 22 nt, Homo sapiens
ucucagcacaaacaaaauugcu

SEQ ID NO: 43564 - RNA, 22 nt, Homo sapiens
ucucagugaauugguuuugucu

SEQ ID NO: 43565 - RNA, 22 nt, Homo sapiens
ucucaguguuaucuaucugccu

SEQ ID NO: 43566 - RNA, 20 nt, Homo sapiens
ucucccaaacagcaggcccu

SEQ ID NO: 43567 - RNA, 17 nt, Homo sapiens
ucucccaucccuuucuc

SEQ ID NO: 43568 - RNA, 22 nt, Homo sapiens
ucucugagaccacuccaaacuc

SEQ ID NO: 43569 - RNA, 22 nt, Homo sapiens
ucugagguuacugcuuuguaga

SEQ ID NO: 43570 - RNA, 22 nt, Homo sapiens
ucuggagugugaaguggauaug

SEQ ID NO: 43571 - RNA, 22 nt, Homo sapiens
ucugguguuacugagccuccca

SEQ ID NO: 43572 - RNA, 23 nt, Homo sapiens
ucugguguugucaaaugcugguu

SEQ ID NO: 43573 - RNA, 22 nt, Homo sapiens
ucuguacuuccguaccuaaagu

SEQ ID NO: 43574 - RNA, 22 nt, Homo sapiens
ucugugcauggcagaggaauga

SEQ ID NO: 43575 - RNA, 22 nt, Homo sapiens
ucugugcauuguaacaacuaaa

SEQ ID NO: 43576 - RNA, 22 nt, Homo sapiens
ucugugcauuguaggauguuua

SEQ ID NO: 43577 - RNA, 22 nt, Homo sapiens
ucuucaugcuugaaauaauagc

SEQ ID NO: 43578 - RNA, 22 nt, Homo sapiens
ucuugcaauuuccuuaguggug

SEQ ID NO: 43579 - RNA, 22 nt, Homo sapiens
ucuugcacaaauuauuuuaacu

SEQ ID NO: 43580 - RNA, 22 nt, Homo sapiens
ucuugcuuuugcagagcuucuc

SEQ ID NO: 43581 - RNA, 22 nt, Homo sapiens
ucuuuggguagauauguagcug

SEQ ID NO: 43582 - RNA, 22 nt, Homo sapiens
ucuuuggguguauuucacagcc

SEQ ID NO: 43583 - RNA, 20 nt, Homo sapiens
ucuuuuuguggccccagagu

SEQ ID NO: 43584 - RNA, 18 nt, Homo sapiens
ugaaacacauuuuuuccu

SEQ ID NO: 43585 - RNA, 22 nt, Homo sapiens
ugaaagcuacaggaaaguauuu

SEQ ID NO: 43586 - RNA, 22 nt, Homo sapiens
ugaaaucuaaaauguuccaaga

SEQ ID NO: 43587 - RNA, 22 nt, Homo sapiens
ugaaaucuuugaugguggcauu

SEQ ID NO: 43588 - RNA, 22 nt, Homo sapiens
ugaaaugauuauaugguguuug

SEQ ID NO: 43589 - RNA, 21 nt, Homo sapiens
ugaaaugcaugugcacauuaa

SEQ ID NO: 43590 - RNA, 22 nt, Homo sapiens
ugaaaugccuuuaaugaauuua

SEQ ID NO: 43591 - RNA, 20 nt, Homo sapiens
ugaaggaggucauuuauacc

SEQ ID NO: 43592 - RNA, 22 nt, Homo sapiens
ugaauagagcugcaguggacau

SEQ ID NO: 43593 - RNA, 21 nt, Homo sapiens
ugaauauuuggguugugucca

SEQ ID NO: 43594 - RNA, 22 nt, Homo sapiens
ugaaugcauggggccaagaagg

SEQ ID NO: 43595 - RNA, 23 nt, Homo sapiens
ugaauguaucgaaugugggaaag

SEQ ID NO: 43596 - RNA, 22 nt, Homo sapiens
ugacaaguaaacagucagcacc

SEQ ID NO: 43597 - RNA, 21 nt, Homo sapiens
ugacagaaaauugaguuugcu

SEQ ID NO: 43598 - RNA, 22 nt, Homo sapiens
ugacagaggucuuuuaauagcu

SEQ ID NO: 43599 - RNA, 22 nt, Homo sapiens
ugacagcaucaggauuggagag

SEQ ID NO: 43600 - RNA, 22 nt, Homo sapiens
ugacaggucuaauuuacugaca

SEQ ID NO: 43601 - RNA, 22 nt, Homo sapiens
ugacaguguccuccuccugaga

SEQ ID NO: 43602 - RNA, 22 nt, Homo sapiens
ugacagugugagauccugucuc

SEQ ID NO: 43603 - RNA, 18 nt, Homo sapiens
ugacauugagcugagaaa

SEQ ID NO: 43604 - RNA, 21 nt, Homo sapiens
ugacuagggauaugugccacu

SEQ ID NO: 43605 - RNA, 22 nt, Homo sapiens
ugacuaggggcccuggcuucuu

SEQ ID NO: 43606 - RNA, 22 nt, Homo sapiens
ugacuagugugauguaguaaau

SEQ ID NO: 43607 - RNA, 22 nt, Homo sapiens
ugacucagauagguguguauuc

SEQ ID NO: 43608 - RNA, 22 nt, Homo sapiens
ugacuccagagacugugcuguc

SEQ ID NO: 43609 - RNA, 22 nt, Homo sapiens
ugacuggaaacaguguuauuug

SEQ ID NO: 43610 - RNA, 22 nt, Homo sapiens
ugacuucagacugaaaugauuc

SEQ ID NO: 43611 - RNA, 22 nt, Homo sapiens
ugacuucauuugguaauugggu

SEQ ID NO: 43612 - RNA, 22 nt, Homo sapiens
ugacuuuagaauuuuauccaga

SEQ ID NO: 43613 - RNA, 22 nt, Homo sapiens
ugagaacagcagcuugggacac

SEQ ID NO: 43614 - RNA, 16 nt, Homo sapiens
ugagaacaugggguau

SEQ ID NO: 43615 - RNA, 22 nt, Homo sapiens
ugagaagacaucagcuuucgga

SEQ ID NO: 43616 - RNA, 22 nt, Homo sapiens
ugagacugagucucgcucuugu

SEQ ID NO: 43617 - RNA, 22 nt, Homo sapiens
ugagacugaguuucacuuuugu

SEQ ID NO: 43618 - RNA, 22 nt, Homo sapiens
ugagaugaagcuagaagaaugg

SEQ ID NO: 43619 - RNA, 22 nt, Homo sapiens
ugagaugagggcugcacucaaa

SEQ ID NO: 43620 - RNA, 22 nt, Homo sapiens
ugagaugagucucgcucuguca

SEQ ID NO: 43621 - RNA, 22 nt, Homo sapiens
ugagaugauagauauguuaauu

SEQ ID NO: 43622 - RNA, 22 nt, Homo sapiens
ugagaugcauauucuggcuccu

SEQ ID NO: 43623 - RNA, 22 nt, Homo sapiens
ugagauuaaucuuuaaguaaga

SEQ ID NO: 43624 - RNA, 23 nt, Homo sapiens
ugagauuacccagaaagaguaua

SEQ ID NO: 43625 - RNA, 20 nt, Homo sapiens
ugagauuggugugguauaag

SEQ ID NO: 43626 - RNA, 19 nt, Homo sapiens
ugagauuguaugaggagau

SEQ ID NO: 43627 - RNA, 22 nt, Homo sapiens
ugagccauggcaccuugucuaa

SEQ ID NO: 43628 - RNA, 22 nt, Homo sapiens
ugagcuccuucauaaaaaggca

SEQ ID NO: 43629 - RNA, 22 nt, Homo sapiens
ugagcugagaaaugcagcagcu

SEQ ID NO: 43630 - RNA, 22 nt, Homo sapiens
ugagcugagaucaugcuauugu

SEQ ID NO: 43631 - RNA, 22 nt, Homo sapiens
ugagggaugccugguuuguuuu

SEQ ID NO: 43632 - RNA, 22 nt, Homo sapiens
ugagguaagauguucauuuuuc

SEQ ID NO: 43633 - RNA, 20 nt, Homo sapiens
ugaggucugagaaagaauga

SEQ ID NO: 43634 - RNA, 22 nt, Homo sapiens
ugaggugaggguaucaaaugcu

SEQ ID NO: 43635 - RNA, 22 nt, Homo sapiens
ugaguagaaauaaacgcaaacu

SEQ ID NO: 43636 - RNA, 22 nt, Homo sapiens
ugaguagcuaauguuuacugag

SEQ ID NO: 43637 - RNA, 22 nt, Homo sapiens
ugagucaauucuaacaauggca

SEQ ID NO: 43638 - RNA, 22 nt, Homo sapiens
ugagugaacgcugagaccaaau

SEQ ID NO: 43639 - RNA, 22 nt, Homo sapiens
guaaucucaccuacuugggagg

SEQ ID NO: 43640 - RNA, 22 nt, Homo sapiens
guaaucucagcuacucgggaga

SEQ ID NO: 43641 - RNA, 22 nt, Homo sapiens
guaaucucagcuacuugggagu

SEQ ID NO: 43642 - RNA, 19 nt, Homo sapiens
guaaucucaguacuuuggu

SEQ ID NO: 43643 - RNA, 22 nt, Homo sapiens
guacaugcauacaugcacaucu

SEQ ID NO: 43644 - RNA, 22 nt, Homo sapiens
guagcagccacacuugauaacu

SEQ ID NO: 43645 - RNA, 22 nt, Homo sapiens
guaguggcaugaucuuggcuca

SEQ ID NO: 43646 - RNA, 22 nt, Homo sapiens
guaugucuugucuauggcugcu

SEQ ID NO: 43647 - RNA, 22 nt, Homo sapiens
guaugucuuuauagcagugugg

SEQ ID NO: 43648 - RNA, 22 nt, Homo sapiens
guauuugauuauagcaugcuua

SEQ ID NO: 43649 - RNA, 18 nt, Homo sapiens
gucauagaaugaugguuc

SEQ ID NO: 43650 - RNA, 20 nt, Homo sapiens
guccauuugcugccauugcu

SEQ ID NO: 43651 - RNA, 22 nt, Homo sapiens
gucucuugguuuagagcauuua

SEQ ID NO: 43652 - RNA, 22 nt, Homo sapiens
gucuggagacuugggucaucaa

SEQ ID NO: 43653 - RNA, 22 nt, Homo sapiens
gucugguacuuguuuguaaggg

SEQ ID NO: 43654 - RNA, 20 nt, Homo sapiens
gucugucuccgaguagaauu

SEQ ID NO: 43655 - RNA, 22 nt, Homo sapiens
gucugugguuccuaugucaccu

SEQ ID NO: 43656 - RNA, 22 nt, Homo sapiens
gucuuccagccuccaucuuucu

SEQ ID NO: 43657 - RNA, 22 nt, Homo sapiens
gucuuuguuauuaugaaucaac

SEQ ID NO: 43658 - RNA, 22 nt, Homo sapiens
gucuuuguuuggucuguaucag

SEQ ID NO: 43659 - RNA, 22 nt, Homo sapiens
gugaacuguuugaggaagagaa

SEQ ID NO: 43660 - RNA, 22 nt, Homo sapiens
gugaaguuuuugugaggccuaa

SEQ ID NO: 43661 - RNA, 22 nt, Homo sapiens
gugacagaguaagacccuguau

SEQ ID NO: 43662 - RNA, 22 nt, Homo sapiens
gugaccaaagauagcucaaguu

SEQ ID NO: 43663 - RNA, 22 nt, Homo sapiens
gugagaagaaaaauauggcugu

SEQ ID NO: 43664 - RNA, 22 nt, Homo sapiens
gugagaggaggcagcuuuuaca

SEQ ID NO: 43665 - RNA, 22 nt, Homo sapiens
gugagcauuacucaugggauca

SEQ ID NO: 43666 - RNA, 22 nt, Homo sapiens
gugagcauucaaggaaggagcu

SEQ ID NO: 43667 - RNA, 22 nt, Homo sapiens
gugagcuaagcaaauaugagcc

SEQ ID NO: 43668 - RNA, 22 nt, Homo sapiens
gugaggucagggcuguggacag

SEQ ID NO: 43669 - RNA, 21 nt, Homo sapiens
gugaucaugucacugcacucc

SEQ ID NO: 43670 - RNA, 22 nt, Homo sapiens
gugauguguuucaacagcuccu

SEQ ID NO: 43671 - RNA, 22 nt, Homo sapiens
gugauugcauuaugaauauuau

SEQ ID NO: 43672 - RNA, 22 nt, Homo sapiens
gugauuuaguagaugcuaguua

SEQ ID NO: 43673 - RNA, 22 nt, Homo sapiens
gugcaaacuccaggucucuuca

SEQ ID NO: 43674 - RNA, 22 nt, Homo sapiens
gugcaaaucucugaguaucuuu

SEQ ID NO: 43675 - RNA, 22 nt, Homo sapiens
gugcaaauuccagcucaacucc

SEQ ID NO: 43676 - RNA, 22 nt, Homo sapiens
gugcaaugaguguggcaaagcc

SEQ ID NO: 43677 - RNA, 22 nt, Homo sapiens
gugcacauauggugcauaagug

SEQ ID NO: 43678 - RNA, 22 nt, Homo sapiens
gugcacaucuguguuccagcua

SEQ ID NO: 43679 - RNA, 22 nt, Homo sapiens
gugcacaugguagguauugagu

SEQ ID NO: 43680 - RNA, 22 nt, Homo sapiens
gugcacauuguuuaugucuguu

SEQ ID NO: 43681 - RNA, 23 nt, Homo sapiens
gugcaugagucuuuauaguagca

SEQ ID NO: 43682 - RNA, 22 nt, Homo sapiens
gugcaugucuaugcgagucuaa

SEQ ID NO: 43683 - RNA, 22 nt, Homo sapiens
gugccacaguguuaagggauuc

SEQ ID NO: 43684 - RNA, 22 nt, Homo sapiens
gugccacugcacuccggccugg

SEQ ID NO: 43685 - RNA, 23 nt, Homo sapiens
gugccuucugagccuagucucca

SEQ ID NO: 43686 - RNA, 22 nt, Homo sapiens
gugcuuuguuguggcaguggca

SEQ ID NO: 43687 - RNA, 22 nt, Homo sapiens
guggaaaacauaugcuuguuga

SEQ ID NO: 43688 - RNA, 22 nt, Homo sapiens
guggaaagaacacaaaauuagg

SEQ ID NO: 43689 - RNA, 22 nt, Homo sapiens
guggaagaaaucagguuauuug

SEQ ID NO: 43690 - RNA, 22 nt, Homo sapiens
guggaagauaguguguuaaugu

SEQ ID NO: 43691 - RNA, 22 nt, Homo sapiens
guggaagucuuugguauuggua

SEQ ID NO: 43692 - RNA, 18 nt, Homo sapiens
guggagugucuuccugga

SEQ ID NO: 43693 - RNA, 22 nt, Homo sapiens
guggcaugaaagcaucugugau

SEQ ID NO: 43694 - RNA, 22 nt, Homo sapiens
guggcgaagauggauugaguca

SEQ ID NO: 43695 - RNA, 22 nt, Homo sapiens
gugugauuguuaauuuuaggug

SEQ ID NO: 43696 - RNA, 22 nt, Homo sapiens
gugugcaugucuuuuuaguagg

SEQ ID NO: 43697 - RNA, 23 nt, Homo sapiens
gugugguaggcuauaccaucuag

SEQ ID NO: 43698 - RNA, 22 nt, Homo sapiens
guguucaaacccaggucugucu

SEQ ID NO: 43699 - RNA, 22 nt, Homo sapiens
guguucaaagcugauugagauu

SEQ ID NO: 43700 - RNA, 22 nt, Homo sapiens
guuacugucuuccugauugcuu

SEQ ID NO: 43701 - RNA, 22 nt, Homo sapiens
guuauguguuuccuuaauugcu

SEQ ID NO: 43702 - RNA, 22 nt, Homo sapiens
guucacaguuaggacaacugcu

SEQ ID NO: 43703 - RNA, 22 nt, Homo sapiens
guucacaguucagccuguaaca

SEQ ID NO: 43704 - RNA, 22 nt, Homo sapiens
guucccaguugaaaugauuagu

SEQ ID NO: 43705 - RNA, 22 nt, Homo sapiens
guuccuuguagaugcuggauau

SEQ ID NO: 43706 - RNA, 22 nt, Homo sapiens
guucuggagauaaagccaaggu

SEQ ID NO: 43707 - RNA, 22 nt, Homo sapiens
uaaacugucuugcaguuacaug

SEQ ID NO: 43708 - RNA, 22 nt, Homo sapiens
uaaagcacuuuuuucugcaugg

SEQ ID NO: 43709 - RNA, 16 nt, Homo sapiens
uaaagcuaaucacuuu

SEQ ID NO: 43710 - RNA, 22 nt, Homo sapiens
uaaagcuacagagcggaaaauu

SEQ ID NO: 43711 - RNA, 22 nt, Homo sapiens
uaaagcuacaguauaugguauu

SEQ ID NO: 43712 - RNA, 22 nt, Homo sapiens
uaaagcuaugagaacaccguag

SEQ ID NO: 43713 - RNA, 22 nt, Homo sapiens
uaaagcuauuauaguuauguuu

SEQ ID NO: 43714 - RNA, 22 nt, Homo sapiens
uaaauggauaaaugaauaccua

SEQ ID NO: 43715 - RNA, 22 nt, Homo sapiens
uaacagucaagguuugaccagg

SEQ ID NO: 43716 - RNA, 21 nt, Homo sapiens
uaacccugaaggagcucugga

SEQ ID NO: 43717 - RNA, 22 nt, Homo sapiens
uaacccuuaguaucuguggguu

SEQ ID NO: 43718 - RNA, 22 nt, Homo sapiens
uaacuccauuuggacucaguau

SEQ ID NO: 43719 - RNA, 22 nt, Homo sapiens
uaacugcaaccuccgccucccg

SEQ ID NO: 43720 - RNA, 18 nt, Homo sapiens
uaacuggugugagauggu

SEQ ID NO: 43721 - RNA, 22 nt, Homo sapiens
uaagacuguguaauuuaugaag

SEQ ID NO: 43722 - RNA, 20 nt, Homo sapiens
uaagccacacagucuaaggu

SEQ ID NO: 43723 - RNA, 22 nt, Homo sapiens
uaagcuaauguguuuucucuua

SEQ ID NO: 43724 - RNA, 22 nt, Homo sapiens
uaagggcaugcugcaugagagu

SEQ ID NO: 43725 - RNA, 22 nt, Homo sapiens
uaaguaaaugaaagguugauuu

SEQ ID NO: 43726 - RNA, 22 nt, Homo sapiens
uaaguauuaugugcugcauuuu

SEQ ID NO: 43727 - RNA, 22 nt, Homo sapiens
uaagugaauuucacuacugagu

SEQ ID NO: 43728 - RNA, 22 nt, Homo sapiens
uaagugaauuugacagguaaug

SEQ ID NO: 43729 - RNA, 20 nt, Homo sapiens
uaagugcuugagacuucuga

SEQ ID NO: 43730 - RNA, 23 nt, Homo sapiens
uaaguucaucucuaauaggugga

SEQ ID NO: 43731 - RNA, 18 nt, Homo sapiens
uaauaacugugaccuuga

SEQ ID NO: 43732 - RNA, 21 nt, Homo sapiens
uaauaaugucucagacaccua

SEQ ID NO: 43733 - RNA, 22 nt, Homo sapiens
uaaucucagcugagcugagauu

SEQ ID NO: 43734 - RNA, 22 nt, Homo sapiens
uaaugcauacagaagguguuuu

SEQ ID NO: 43735 - RNA, 22 nt, Homo sapiens
uaaugcauguaaugggcugaua

SEQ ID NO: 43736 - RNA, 22 nt, Homo sapiens
uaaugcuguggucugguuuaaa

SEQ ID NO: 43737 - RNA, 22 nt, Homo sapiens
uuauagcagugcaggaacagac

SEQ ID NO: 43738 - RNA, 22 nt, Homo sapiens
uuauauguuucuuagggacaga

SEQ ID NO: 43739 - RNA, 21 nt, Homo sapiens
uuaucccagugucucugcagg

SEQ ID NO: 43740 - RNA, 22 nt, Homo sapiens
uuaugucuuugagcaaugcugu

SEQ ID NO: 43741 - RNA, 22 nt, Homo sapiens
uuaugugccuuuuugccauuca

SEQ ID NO: 43742 - RNA, 22 nt, Homo sapiens
uuauugcuccagaggcugauuu

SEQ ID NO: 43743 - RNA, 22 nt, Homo sapiens
uucaagcuacaguggcaggguu

SEQ ID NO: 43744 - RNA, 19 nt, Homo sapiens
uucaaugcagcauugccac

SEQ ID NO: 43745 - RNA, 22 nt, Homo sapiens
uucacagcuuaauaaggcucag

SEQ ID NO: 43746 - RNA, 22 nt, Homo sapiens
uucacccugguuguagauggac

SEQ ID NO: 43747 - RNA, 22 nt, Homo sapiens
uucaccuggguuggccaucauu

SEQ ID NO: 43748 - RNA, 22 nt, Homo sapiens
uucacuggagcccaggaguugg

SEQ ID NO: 43749 - RNA, 22 nt, Homo sapiens
uucacuguagccucagccucuu

SEQ ID NO: 43750 - RNA, 22 nt, Homo sapiens
uucagaguggacagaaauuaag

SEQ ID NO: 43751 - RNA, 20 nt, Homo sapiens
uucagcaaaggaaugggagu

SEQ ID NO: 43752 - RNA, 22 nt, Homo sapiens
uucagcaaugacagccuauaua

SEQ ID NO: 43753 - RNA, 22 nt, Homo sapiens
uucaggguggagaguaugaggu

SEQ ID NO: 43754 - RNA, 22 nt, Homo sapiens
uucaguucugcacugaucuuag

SEQ ID NO: 43755 - RNA, 22 nt, Homo sapiens
uucauagaggacauuacuggag

SEQ ID NO: 43756 - RNA, 22 nt, Homo sapiens
uucaucagcuguagaugucaug

SEQ ID NO: 43757 - RNA, 22 nt, Homo sapiens
uucaucuggcaauucagagauu

SEQ ID NO: 43758 - RNA, 22 nt, Homo sapiens
uucauuggacuuguguucuuga

SEQ ID NO: 43759 - RNA, 22 nt, Homo sapiens
uuccacaaugguugaacuaauu

SEQ ID NO: 43760 - RNA, 22 nt, Homo sapiens
uuccacaaugguugaacuagcu

SEQ ID NO: 43761 - RNA, 21 nt, Homo sapiens
uuccagugagccuagaugccu

SEQ ID NO: 43762 - RNA, 22 nt, Homo sapiens
uuccaguguuugacucaccuuu

SEQ ID NO: 43763 - RNA, 22 nt, Homo sapiens
uucccagagaaaaggguuucuu

SEQ ID NO: 43764 - RNA, 22 nt, Homo sapiens
uucccuguaucuucugccaugu

SEQ ID NO: 43765 - RNA, 22 nt, Homo sapiens
uucccuugcaggaugaucugga

SEQ ID NO: 43766 - RNA, 22 nt, Homo sapiens
uuccguguaguugagcaguuuu

SEQ ID NO: 43767 - RNA, 22 nt, Homo sapiens
uuccugugacuguguggcaccc

SEQ ID NO: 43768 - RNA, 22 nt, Homo sapiens
uuccuugaaacagucaagagaa

SEQ ID NO: 43769 - RNA, 22 nt, Homo sapiens
uuccuugugacuaguagugacc

SEQ ID NO: 43770 - RNA, 22 nt, Homo sapiens
uuccuuguuuauuuacaggagg

SEQ ID NO: 43771 - RNA, 20 nt, Homo sapiens
uucuauggugaugaguccug

SEQ ID NO: 43772 - RNA, 22 nt, Homo sapiens
uucucagugaaguuuagaacau

SEQ ID NO: 43773 - RNA, 22 nt, Homo sapiens
uucuggccccucccaaucucau

SEQ ID NO: 43774 - RNA, 22 nt, Homo sapiens
uucugguuaauacuugcaaaaa

SEQ ID NO: 43775 - RNA, 22 nt, Homo sapiens
uucuucaggcauucccagaagc

SEQ ID NO: 43776 - RNA, 22 nt, Homo sapiens
uucuugaggcaugccgcuggga

SEQ ID NO: 43777 - RNA, 18 nt, Homo sapiens
uucuuguguugauauuuu

SEQ ID NO: 43778 - RNA, 22 nt, Homo sapiens
uugaaagucauggcacaggcaa

SEQ ID NO: 43779 - RNA, 22 nt, Homo sapiens
uugaagagaaccgcggcuuauu

SEQ ID NO: 43780 - RNA, 22 nt, Homo sapiens
uugaaguagguaccguucaauu

SEQ ID NO: 43781 - RNA, 22 nt, Homo sapiens
uugaauagugacuuugauucug

SEQ ID NO: 43782 - RNA, 22 nt, Homo sapiens
uugacaaugcacugugcuaagu

SEQ ID NO: 43783 - RNA, 22 nt, Homo sapiens
uugacauaaucauuucacagug

SEQ ID NO: 43784 - RNA, 22 nt, Homo sapiens
uugacauauuugugcuuaagaa

SEQ ID NO: 43785 - RNA, 22 nt, Homo sapiens
uugacauugcuguaguguccag

SEQ ID NO: 43786 - RNA, 21 nt, Homo sapiens
uugagaagaauuagcucuucc

SEQ ID NO: 43787 - RNA, 22 nt, Homo sapiens
uugagacugaacauuuguguac

SEQ ID NO: 43788 - RNA, 22 nt, Homo sapiens
uugagacugagucucgcccugu

SEQ ID NO: 43789 - RNA, 22 nt, Homo sapiens
uugagaguggcagagguggaac

SEQ ID NO: 43790 - RNA, 22 nt, Homo sapiens
uugagauggagucuugcucuug

SEQ ID NO: 43791 - RNA, 22 nt, Homo sapiens
uugagauggaguuuugcucuug

SEQ ID NO: 43792 - RNA, 19 nt, Homo sapiens
uugagaugugaacucacac

SEQ ID NO: 43793 - RNA, 22 nt, Homo sapiens
uugagcacaguagguuguggcu

SEQ ID NO: 43794 - RNA, 22 nt, Homo sapiens
uugagcaucauguuagcacuca

SEQ ID NO: 43795 - RNA, 22 nt, Homo sapiens
uugagcucaucaagauagagaa

SEQ ID NO: 43796 - RNA, 22 nt, Homo sapiens
uugagcucuucuagcaauucua

SEQ ID NO: 43797 - RNA, 22 nt, Homo sapiens
uugagggagccuguuagucccg

SEQ ID NO: 43798 - RNA, 20 nt, Homo sapiens
uugaggucaggaguuuggga

SEQ ID NO: 43799 - RNA, 22 nt, Homo sapiens
uugaggucuucaggaucaggcu

SEQ ID NO: 43800 - RNA, 22 nt, Homo sapiens
uugagugaaugaaugauuaaau

SEQ ID NO: 43801 - RNA, 22 nt, Homo sapiens
uugauuagauccaguugauuga

SEQ ID NO: 43802 - RNA, 22 nt, Homo sapiens
uugcaaggugcagcuuaugcaa

SEQ ID NO: 43803 - RNA, 22 nt, Homo sapiens
uugcacauggcuggggaggccu

SEQ ID NO: 43804 - RNA, 22 nt, Homo sapiens
uugcacauugauuuuguauccu

SEQ ID NO: 43805 - RNA, 22 nt, Homo sapiens
uugcagcaaagagggaggggca

SEQ ID NO: 43806 - RNA, 22 nt, Homo sapiens
uugcauauucucugaggcagga

SEQ ID NO: 43807 - RNA, 22 nt, Homo sapiens
uugcaucagcaggcauaauugg

SEQ ID NO: 43808 - RNA, 22 nt, Homo sapiens
uugcauugacacaugaagcuca

SEQ ID NO: 43809 - RNA, 22 nt, Homo sapiens
uugccaacauggugaacuccca

SEQ ID NO: 43810 - RNA, 22 nt, Homo sapiens
uugcucaggcuggaguacaaug

SEQ ID NO: 43811 - RNA, 22 nt, Homo sapiens
uugcuuaggcuggagugcagug

SEQ ID NO: 43812 - RNA, 22 nt, Homo sapiens
uuggaagacauucugucugcua

SEQ ID NO: 43813 - RNA, 22 nt, Homo sapiens
uuggaagagaagggagauaaac

SEQ ID NO: 43814 - RNA, 22 nt, Homo sapiens
uuggagagagaggacucccggc

SEQ ID NO: 43815 - RNA, 22 nt, Homo sapiens
uuggagagucacuaguuagugc

SEQ ID NO: 43816 - RNA, 22 nt, Homo sapiens
uuggauugugaaaguauucucu

SEQ ID NO: 43817 - RNA, 22 nt, Homo sapiens
uuggauuguuucuagauugggg

SEQ ID NO: 43818 - RNA, 22 nt, Homo sapiens
uuggauuuuaacaaacuaggug

SEQ ID NO: 43819 - RNA, 20 nt, Homo sapiens
uuggcauuuagacaagaguu

SEQ ID NO: 43820 - RNA, 22 nt, Homo sapiens
uuggcuuuuaugcagcuuaggu

SEQ ID NO: 43821 - RNA, 22 nt, Homo sapiens
uugggccacuuuaguuuccuua

SEQ ID NO: 43822 - RNA, 22 nt, Homo sapiens
uugguauguguuucauacucaa

SEQ ID NO: 43823 - RNA, 22 nt, Homo sapiens
uuggucucaucaagagcagcuu

SEQ ID NO: 43824 - RNA, 23 nt, Homo sapiens
uuguacacuaagaaucgcagaug

SEQ ID NO: 43825 - RNA, 22 nt, Homo sapiens
uuguaguagcauuauuuauaau

SEQ ID NO: 43826 - RNA, 22 nt, Homo sapiens
uuguauguuguuugucagagaa

SEQ ID NO: 43827 - RNA, 22 nt, Homo sapiens
uuguauugucuugaugaguuga

SEQ ID NO: 43828 - RNA, 22 nt, Homo sapiens
uugucacuauaaauaagcauuu

SEQ ID NO: 43829 - RNA, 22 nt, Homo sapiens
uuguccuccacauuugaucagu

SEQ ID NO: 43830 - RNA, 22 nt, Homo sapiens
uuguccuggagguucuugcaag

SEQ ID NO: 43831 - RNA, 22 nt, Homo sapiens
uugugauugagugauccuuguu

SEQ ID NO: 43832 - RNA, 22 nt, Homo sapiens
uugugcaugaugcauacauggu

SEQ ID NO: 43833 - RNA, 22 nt, Homo sapiens
uugugcauguauauuaguucac

SEQ ID NO: 43834 - RNA, 22 nt, Homo sapiens
uugugguaggcauguaagauga

SEQ ID NO: 43835 - RNA, 22 nt, Homo sapiens
uugugguugacuaaauuuguaa

SEQ ID NO: 43836 - RNA, 22 nt, Homo sapiens
uugugguugauacacguaggaa

SEQ ID NO: 43837 - RNA, 22 nt, Homo sapiens
uugugguuuuagcacuguggau

SEQ ID NO: 43838 - RNA, 22 nt, Homo sapiens
uugugguuuuaucuaccuuugg

SEQ ID NO: 43839 - RNA, 22 nt, Homo sapiens
uuuaaagcaugacgagaagaag

SEQ ID NO: 43840 - RNA, 22 nt, Homo sapiens
uuuaaagcuccaagcaugucug

SEQ ID NO: 43841 - RNA, 22 nt, Homo sapiens
cuuugcaaaacauugagaccuc

SEQ ID NO: 43842 - RNA, 22 nt, Homo sapiens
cuuuggcauuagccuguauaga

SEQ ID NO: 43843 - RNA, 22 nt, Homo sapiens
cuuuggucaauugcugugggga

SEQ ID NO: 43844 - RNA, 22 nt, Homo sapiens
cuuugugugggccaagggcugg

SEQ ID NO: 43845 - RNA, 22 nt, Homo sapiens
cuuuuacacuguuggugggaau

SEQ ID NO: 43846 - RNA, 22 nt, Homo sapiens
cuuuuguggaucuucuguugcu

SEQ ID NO: 43847 - RNA, 22 nt, Homo sapiens
gaaagauuuccugagcuagaaa

SEQ ID NO: 43848 - RNA, 22 nt, Homo sapiens
gaaagauuuuaacugggagacu

SEQ ID NO: 43849 - RNA, 22 nt, Homo sapiens
gaaagguaggaacagggugcag

SEQ ID NO: 43850 - RNA, 22 nt, Homo sapiens
gaaauggaucagagcaagcuuu

SEQ ID NO: 43851 - RNA, 23 nt, Homo sapiens
gaaaugucuuagugaaauugcuu

SEQ ID NO: 43852 - RNA, 22 nt, Homo sapiens
gaacugggguuggguugcgaua

SEQ ID NO: 43853 - RNA, 22 nt, Homo sapiens
gaagcauugauccacaggcgug

SEQ ID NO: 43854 - RNA, 22 nt, Homo sapiens
gacagugagaugucaugugaaa

SEQ ID NO: 43855 - RNA, 20 nt, Homo sapiens
gacauggaggaggauuauua

SEQ ID NO: 43856 - RNA, 22 nt, Homo sapiens
gacauguuuacaguguugagag

SEQ ID NO: 43857 - RNA, 22 nt, Homo sapiens
gacauuaucagguuuguuuucu

SEQ ID NO: 43858 - RNA, 22 nt, Homo sapiens
gaccacagacuggaaagagggc

SEQ ID NO: 43859 - RNA, 22 nt, Homo sapiens
gacuaggagagcagcugcccau

SEQ ID NO: 43860 - RNA, 22 nt, Homo sapiens
gacucagucuuggauuuuuaau

SEQ ID NO: 43861 - RNA, 19 nt, Homo sapiens
gacuccagaguugugugcu

SEQ ID NO: 43862 - RNA, 22 nt, Homo sapiens
gacugaggaagcgcucucuccu

SEQ ID NO: 43863 - RNA, 22 nt, Homo sapiens
gacuggauagauaaaguuaguu

SEQ ID NO: 43864 - RNA, 22 nt, Homo sapiens
gacuggccauugauacagaggu

SEQ ID NO: 43865 - RNA, 22 nt, Homo sapiens
gacuggccuauaauggcgaauu

SEQ ID NO: 43866 - RNA, 22 nt, Homo sapiens
gacuuagagauguuguauuugg

SEQ ID NO: 43867 - RNA, 20 nt, Homo sapiens
gacuucagaagcuucagagu

SEQ ID NO: 43868 - RNA, 22 nt, Homo sapiens
gagaacaguguuguauuuuuuc

SEQ ID NO: 43869 - RNA, 22 nt, Homo sapiens
gagacugagucuugcucuguca

SEQ ID NO: 43870 - RNA, 22 nt, Homo sapiens
gagaucuuuaagaacuacugcu

SEQ ID NO: 43871 - RNA, 22 nt, Homo sapiens
gagaugaaaucuugcucuguca

SEQ ID NO: 43872 - RNA, 22 nt, Homo sapiens
gagaugaaguuaaggaucuuua

SEQ ID NO: 43873 - RNA, 22 nt, Homo sapiens
gagauggaguuucacuucgcuc

SEQ ID NO: 43874 - RNA, 22 nt, Homo sapiens
gagaugguacacauacgauucu

SEQ ID NO: 43875 - RNA, 22 nt, Homo sapiens
gagaugugguucaaggguguuu

SEQ ID NO: 43876 - RNA, 22 nt, Homo sapiens
gagcaacaguggcagugguggg

SEQ ID NO: 43877 - RNA, 20 nt, Homo sapiens
gagcucaucuucuuuaccac

SEQ ID NO: 43878 - RNA, 22 nt, Homo sapiens
gagcugaauugcugccauuugc

SEQ ID NO: 43879 - RNA, 22 nt, Homo sapiens
gagcugccuugccuaugcaaga

SEQ ID NO: 43880 - RNA, 22 nt, Homo sapiens
gaggaaguagcuacugucuuuc

SEQ ID NO: 43881 - RNA, 22 nt, Homo sapiens
gaggagauauucugcuggaugg

SEQ ID NO: 43882 - RNA, 22 nt, Homo sapiens
gaggaguagggcacaaagccuu

SEQ ID NO: 43883 - RNA, 22 nt, Homo sapiens
gaggaucucuugagcccagaag

SEQ ID NO: 43884 - RNA, 22 nt, Homo sapiens
gaggcauugaaauauugcuuau

SEQ ID NO: 43885 - RNA, 22 nt, Homo sapiens
gagguauagaacaccuuucaag

SEQ ID NO: 43886 - RNA, 22 nt, Homo sapiens
gaggugguagguucacagcagc

SEQ ID NO: 43887 - RNA, 22 nt, Homo sapiens
gaguaacauugacaacuucaug

SEQ ID NO: 43888 - RNA, 19 nt, Homo sapiens
gaguugggguuuacuguaa

SEQ ID NO: 43889 - RNA, 22 nt, Homo sapiens
gauaaagauagcaauagggaca

SEQ ID NO: 43890 - RNA, 22 nt, Homo sapiens
gauaguugugagaacucuuacu

SEQ ID NO: 43891 - RNA, 22 nt, Homo sapiens
gaucuggagguuuuccucauga

SEQ ID NO: 43892 - RNA, 22 nt, Homo sapiens
gaugacagcugacucccuugcu

SEQ ID NO: 43893 - RNA, 22 nt, Homo sapiens
gaugacagugaguaaccccaac

SEQ ID NO: 43894 - RNA, 22 nt, Homo sapiens
gauuccauugcgaauuuucaga

SEQ ID NO: 43895 - RNA, 22 nt, Homo sapiens
gcaauacugacagcauuaguuu

SEQ ID NO: 43896 - RNA, 22 nt, Homo sapiens
gcaauguuacugaauguguuuu

SEQ ID NO: 43897 - RNA, 22 nt, Homo sapiens
gcacauauguaaauagcugccu

SEQ ID NO: 43898 - RNA, 22 nt, Homo sapiens
gcauauuuuaaaguguaaccug

SEQ ID NO: 43899 - RNA, 19 nt, Homo sapiens
gcaucauuaguugcuuuuc

SEQ ID NO: 43900 - RNA, 20 nt, Homo sapiens
gcaugagucuuuauaguaga

SEQ ID NO: 43901 - RNA, 22 nt, Homo sapiens
gcauggauguugauggcugcug

SEQ ID NO: 43902 - RNA, 22 nt, Homo sapiens
gcauggccuuuaaaugucacag

SEQ ID NO: 43903 - RNA, 22 nt, Homo sapiens
gcauugcacuuggcauagacug

SEQ ID NO: 43904 - RNA, 20 nt, Homo sapiens
gccacaguuaagcuucugcc

SEQ ID NO: 43905 - RNA, 21 nt, Homo sapiens
gccaguguggcaauuuuucaa

SEQ ID NO: 43906 - RNA, 22 nt, Homo sapiens
gcccacuguuaaauuuguuuua

SEQ ID NO: 43907 - RNA, 22 nt, Homo sapiens
gccccaguacaggcuccuuaga

SEQ ID NO: 43908 - RNA, 22 nt, Homo sapiens
gccccugagacuugccucgggc

SEQ ID NO: 43909 - RNA, 22 nt, Homo sapiens
gcuaggagauccacugcucucu

SEQ ID NO: 43910 - RNA, 22 nt, Homo sapiens
gcugagguucaagaagguuaaa

SEQ ID NO: 43911 - RNA, 22 nt, Homo sapiens
gcugcacuuuaaggcauccccu

SEQ ID NO: 43912 - RNA, 22 nt, Homo sapiens
gcugguguucaggcccucaguc

SEQ ID NO: 43913 - RNA, 19 nt, Homo sapiens
gcugguuguccacucucuc

SEQ ID NO: 43914 - RNA, 22 nt, Homo sapiens
gcuguguguuaucagaaauugc

SEQ ID NO: 43915 - RNA, 22 nt, Homo sapiens
gcuguguugugcccagcaucau

SEQ ID NO: 43916 - RNA, 22 nt, Homo sapiens
gcuguugguaaaaaggacauga

SEQ ID NO: 43917 - RNA, 22 nt, Homo sapiens
gcuguugugaacuauacaucua

SEQ ID NO: 43918 - RNA, 19 nt, Homo sapiens
gcuuguccacgugagauaa

SEQ ID NO: 43919 - RNA, 22 nt, Homo sapiens
gcuuguguucaagucacccuua

SEQ ID NO: 43920 - RNA, 19 nt, Homo sapiens
gcuuuguggggaaggagcc

SEQ ID NO: 43921 - RNA, 22 nt, Homo sapiens
ggaaagcuagguguggguguac

SEQ ID NO: 43922 - RNA, 22 nt, Homo sapiens
ggaaauguuuagcauccacuuu

SEQ ID NO: 43923 - RNA, 23 nt, Homo sapiens
ggaaugaaaccugguuaugauau

SEQ ID NO: 43924 - RNA, 20 nt, Homo sapiens
ggaauguuaaucuccaugau

SEQ ID NO: 43925 - RNA, 22 nt, Homo sapiens
ggagaugauuaugaaucacuua

SEQ ID NO: 43926 - RNA, 22 nt, Homo sapiens
ggagggugagaucaauuuggga

SEQ ID NO: 43927 - RNA, 22 nt, Homo sapiens
ggaucgauuccaaauguagauc

SEQ ID NO: 43928 - RNA, 23 nt, Homo sapiens
ggauggaaaguuuugagggccac

SEQ ID NO: 43929 - RNA, 22 nt, Homo sapiens
ggauggcauuucuuuagcuuuu

SEQ ID NO: 43930 - RNA, 22 nt, Homo sapiens
ggcaaggaggggcacuuucacu

SEQ ID NO: 43931 - RNA, 22 nt, Homo sapiens
ggcagcucaggccccgcgcuga

SEQ ID NO: 43932 - RNA, 22 nt, Homo sapiens
ggcagcuguguccuucguaagg

SEQ ID NO: 43933 - RNA, 22 nt, Homo sapiens
ggcagguaaggagugggagccu

SEQ ID NO: 43934 - RNA, 22 nt, Homo sapiens
ggcucagugaucuguuucugua

SEQ ID NO: 43935 - RNA, 22 nt, Homo sapiens
ggcucagugggguccugguucu

SEQ ID NO: 43936 - RNA, 22 nt, Homo sapiens
ggcucaguugcaaaucaguuca

SEQ ID NO: 43937 - RNA, 18 nt, Homo sapiens
ggcugguguuuuaguaua

SEQ ID NO: 43938 - RNA, 22 nt, Homo sapiens
gggaaaaugucuauugaaugaa

SEQ ID NO: 43939 - RNA, 22 nt, Homo sapiens
gggaagauauaggcugggcacc

SEQ ID NO: 43940 - RNA, 22 nt, Homo sapiens
gggucauggaugugaagcuaga

SEQ ID NO: 43941 - RNA, 22 nt, Homo sapiens
uuuaaguguuuguuccugaaaa

SEQ ID NO: 43942 - RNA, 22 nt, Homo sapiens
uuuaaugcgucucugaguuuug

SEQ ID NO: 43943 - RNA, 19 nt, Homo sapiens
uuuagaucuuuuaugcagc

SEQ ID NO: 43944 - RNA, 22 nt, Homo sapiens
uuuauggagagauauuuauggu

SEQ ID NO: 43945 - RNA, 22 nt, Homo sapiens
uuucaucaagcacagaguagau

SEQ ID NO: 43946 - RNA, 19 nt, Homo sapiens
uuuccaguaaucuuaugug

SEQ ID NO: 43947 - RNA, 22 nt, Homo sapiens
uuucccauuguucugcucugug

SEQ ID NO: 43948 - RNA, 22 nt, Homo sapiens
uuucgugucuggucugugaugg

SEQ ID NO: 43949 - RNA, 22 nt, Homo sapiens
uuucugaggccucaccagaagc

SEQ ID NO: 43950 - RNA, 22 nt, Homo sapiens
uuucugguuaauuucuaagagc

SEQ ID NO: 43951 - RNA, 23 nt, Homo sapiens
uuucuugggcaugcuaugucagu

SEQ ID NO: 43952 - RNA, 22 nt, Homo sapiens
uuugaauggaaguuuugugaaa

SEQ ID NO: 43953 - RNA, 22 nt, Homo sapiens
uuugacaaugugugcuuguauu

SEQ ID NO: 43954 - RNA, 22 nt, Homo sapiens
uuugacuuuuagaauaugaguu

SEQ ID NO: 43955 - RNA, 22 nt, Homo sapiens
uuugagaaugcuaccagagaag

SEQ ID NO: 43956 - RNA, 22 nt, Homo sapiens
uuugagcaggcuaaucaauaua

SEQ ID NO: 43957 - RNA, 22 nt, Homo sapiens
uuugauguugagacuauaaagc

SEQ ID NO: 43958 - RNA, 22 nt, Homo sapiens
uuugccuuugugauauggucua

SEQ ID NO: 43959 - RNA, 22 nt, Homo sapiens
uuuggaagaugccacuguauca

SEQ ID NO: 43960 - RNA, 18 nt, Homo sapiens
uuugguccuuuauaaaca

SEQ ID NO: 43961 - RNA, 22 nt, Homo sapiens
uuuguaauaccugaggcugggu

SEQ ID NO: 43962 - RNA, 21 nt, Homo sapiens
uuuguaguagcaugauuuaua

SEQ ID NO: 43963 - RNA, 23 nt, Homo sapiens
uuuguaguagcaugauuuauaau

SEQ ID NO: 43964 - RNA, 22 nt, Homo sapiens
uuugugauugcacacucaagau

SEQ ID NO: 43965 - RNA, 22 nt, Homo sapiens
uuuuaguggacaaagguauuua

SEQ ID NO: 43966 - RNA, 22 nt, Homo sapiens
uuuuccagugggacucccauua

SEQ ID NO: 43967 - RNA, 22 nt, Homo sapiens
uuuugcaccauccuaauaguau

SEQ ID NO: 43968 - RNA, 22 nt, Homo sapiens
uuuugcucuucggaagagcuug

SEQ ID NO: 43969 - RNA, 22 nt, Homo sapiens
uuuugcucuugguaaugaaaga

SEQ ID NO: 43970 - RNA, 22 nt, Homo sapiens
uuuuggugguuaugugucaaug

SEQ ID NO: 43971 - RNA, 22 nt, Homo sapiens
uuuuugagguauaguguggcua

SEQ ID NO: 43972 - RNA, 22 nt, Homo sapiens
uuuuugaguagcuggagagcag

SEQ ID NO: 43973 - RNA, 22 nt, Homo sapiens
uuuuuugcuguaugcaaacauc

SEQ ID NO: 43974 - RNA, 15 nt, Homo sapiens
aaacccugucucaag

SEQ ID NO: 43975 - RNA, 22 nt, Homo sapiens
aaagcuaagguagcauuggaga

SEQ ID NO: 43976 - RNA, 22 nt, Homo sapiens
aaaggaccacauauaugguggc

SEQ ID NO: 43977 - RNA, 20 nt, Homo sapiens
aaaggcugugagaacgagau

SEQ ID NO: 43978 - RNA, 19 nt, Homo sapiens
aaaguacucugaugccucu

SEQ ID NO: 43979 - RNA, 22 nt, Homo sapiens
aaagugcugggauuaggccagg

SEQ ID NO: 43980 - RNA, 22 nt, Homo sapiens
aaagugcugggauuuuaggcau

SEQ ID NO: 43981 - RNA, 22 nt, Homo sapiens
aaaugcugucugugagccucau

SEQ ID NO: 43982 - RNA, 22 nt, Homo sapiens
aaauucaugucaccucuaggua

SEQ ID NO: 43983 - RNA, 22 nt, Homo sapiens
aaauugcauugagcugcuuauu

SEQ ID NO: 43984 - RNA, 22 nt, Homo sapiens
aacaccaucccuuugaugcuuu

SEQ ID NO: 43985 - RNA, 22 nt, Homo sapiens
aacaccauuuuucugcagccuu

SEQ ID NO: 43986 - RNA, 22 nt, Homo sapiens
aacacuaucugccuuacaggga

SEQ ID NO: 43987 - RNA, 22 nt, Homo sapiens
aacagugcuguuauaaauguac

SEQ ID NO: 43988 - RNA, 22 nt, Homo sapiens
aaccuguaaccauaugaucagu

SEQ ID NO: 43989 - RNA, 22 nt, Homo sapiens
aacuccauuuuagacccuagau

SEQ ID NO: 43990 - RNA, 22 nt, Homo sapiens
aacucugucuccuucaaguuca

SEQ ID NO: 43991 - RNA, 22 nt, Homo sapiens
aacuggcauauucugguugcgg

SEQ ID NO: 43992 - RNA, 22 nt, Homo sapiens
aagagugcucgugggacucagc

SEQ ID NO: 43993 - RNA, 22 nt, Homo sapiens
aagaugcagaagcccagauguu

SEQ ID NO: 43994 - RNA, 22 nt, Homo sapiens
aagcaucauuuggaauuugaga

SEQ ID NO: 43995 - RNA, 22 nt, Homo sapiens
aagcuccauuucugccaugaga

SEQ ID NO: 43996 - RNA, 22 nt, Homo sapiens
aagggaauguuguggcugguuu

SEQ ID NO: 43997 - RNA, 23 nt, Homo sapiens
aagguaagcuagaaagauguaga

SEQ ID NO: 43998 - RNA, 22 nt, Homo sapiens
aaggucauugugguuuuugcca

SEQ ID NO: 43999 - RNA, 18 nt, Homo sapiens
aaggugcuucuguucuga

SEQ ID NO: 44000 - RNA, 22 nt, Homo sapiens
aagucaaggagagaggcgucag

SEQ ID NO: 44001 - RNA, 22 nt, Homo sapiens
aagucaugaagaggaaaggaca

SEQ ID NO: 44002 - RNA, 22 nt, Homo sapiens
aagugcuuaggauagugugugg

SEQ ID NO: 44003 - RNA, 22 nt, Homo sapiens
aagugcuuccuuucagaggguu

SEQ ID NO: 44004 - RNA, 22 nt, Homo sapiens
aagugcuuuuuagauaugguuu

SEQ ID NO: 44005 - RNA, 22 nt, Homo sapiens
aaguguaaguuaauguuuaggu

SEQ ID NO: 44006 - RNA, 23 nt, Homo sapiens
aaguucaugcucaucuguuacac

SEQ ID NO: 44007 - RNA, 22 nt, Homo sapiens
aauaaagcagcuuuuugggacu

SEQ ID NO: 44008 - RNA, 22 nt, Homo sapiens
aauaaagcaggguccuugcacu

SEQ ID NO: 44009 - RNA, 22 nt, Homo sapiens
aauaaagcuuugagcuuugcug

SEQ ID NO: 44010 - RNA, 22 nt, Homo sapiens
aauacugagaugugagguacua

SEQ ID NO: 44011 - RNA, 22 nt, Homo sapiens
aauacugugauaucgagcgauu

SEQ ID NO: 44012 - RNA, 22 nt, Homo sapiens
aaucacacuugauguugagcaa

SEQ ID NO: 44013 - RNA, 22 nt, Homo sapiens
aaucacguagcaguagggagaa

SEQ ID NO: 44014 - RNA, 22 nt, Homo sapiens
aaucacuuugcuacaaggcagu

SEQ ID NO: 44015 - RNA, 22 nt, Homo sapiens
aaugacagugcuaaagaacccu

SEQ ID NO: 44016 - RNA, 22 nt, Homo sapiens
aaugacucugccuaaauuucac

SEQ ID NO: 44017 - RNA, 22 nt, Homo sapiens
aaugcaucuagaaaggugaauu

SEQ ID NO: 44018 - RNA, 22 nt, Homo sapiens
aauggcauugguccuuuuggau

SEQ ID NO: 44019 - RNA, 22 nt, Homo sapiens
aauggcuucuuauugugguuca

SEQ ID NO: 44020 - RNA, 22 nt, Homo sapiens
aaugugccuacuggagcuugca

SEQ ID NO: 44021 - RNA, 22 nt, Homo sapiens
aauugcaauggacaaugcagca

SEQ ID NO: 44022 - RNA, 22 nt, Homo sapiens
acacaugcuccacuguggccuc

SEQ ID NO: 44023 - RNA, 22 nt, Homo sapiens
acaccaugucuguuucugguuu

SEQ ID NO: 44024 - RNA, 22 nt, Homo sapiens
acagcacugccaagugacccau

SEQ ID NO: 44025 - RNA, 22 nt, Homo sapiens
acaggagugggauuugaguccu

SEQ ID NO: 44026 - RNA, 18 nt, Homo sapiens
acagugcugucacugcuu

SEQ ID NO: 44027 - RNA, 22 nt, Homo sapiens
acagugcuguuguguuuucacg

SEQ ID NO: 44028 - RNA, 22 nt, Homo sapiens
acagugcuuuuguuccucuccu

SEQ ID NO: 44029 - RNA, 22 nt, Homo sapiens
acaguguagugacugccaacuu

SEQ ID NO: 44030 - RNA, 22 nt, Homo sapiens
acaguguguguguucaccuaga

SEQ ID NO: 44031 - RNA, 22 nt, Homo sapiens
uauggauuuucagauucuuauc

SEQ ID NO: 44032 - RNA, 22 nt, Homo sapiens
uauggcucuauuuccuugucua

SEQ ID NO: 44033 - RNA, 22 nt, Homo sapiens
uauggcuucuauaaggaagcuu

SEQ ID NO: 44034 - RNA, 22 nt, Homo sapiens
uauggcuuuuauuauguuguag

SEQ ID NO: 44035 - RNA, 22 nt, Homo sapiens
uauuagugccuaagucuuaggg

SEQ ID NO: 44036 - RNA, 22 nt, Homo sapiens
uauuccacaauaugauuuuuaa

SEQ ID NO: 44037 - RNA, 22 nt, Homo sapiens
uauugcaaauggugaucccagg

SEQ ID NO: 44038 - RNA, 22 nt, Homo sapiens
uauugcacaugaggagacauug

SEQ ID NO: 44039 - RNA, 23 nt, Homo sapiens
uauugcacuaugguaacccuuuu

SEQ ID NO: 44040 - RNA, 20 nt, Homo sapiens
uauugcacuccagucugggc

SEQ ID NO: 44041 - RNA, 22 nt, Homo sapiens
uauugcagaaugugaguuggca

SEQ ID NO: 44042 - RNA, 22 nt, Homo sapiens
uauugcagauacccaggaaguu

SEQ ID NO: 44043 - RNA, 22 nt, Homo sapiens
uauugccugucuccaaaaauca

SEQ ID NO: 44044 - RNA, 22 nt, Homo sapiens
uauugcucaugcauuuaauuuc

SEQ ID NO: 44045 - RNA, 22 nt, Homo sapiens
uauugcugaugcugaagggaag

SEQ ID NO: 44046 - RNA, 22 nt, Homo sapiens
uauugcuuaugaugcugaauua

SEQ ID NO: 44047 - RNA, 22 nt, Homo sapiens
uauuugauugacuuuagcagga

SEQ ID NO: 44048 - RNA, 22 nt, Homo sapiens
ucaaauguucccuguacuggcc

SEQ ID NO: 44049 - RNA, 22 nt, Homo sapiens
ucaaauguuuguuuaaggcuua

SEQ ID NO: 44050 - RNA, 20 nt, Homo sapiens
ucaaauucuuggccuccagc

SEQ ID NO: 44051 - RNA, 22 nt, Homo sapiens
ucaacauugcugucaggcaucu

SEQ ID NO: 44052 - RNA, 18 nt, Homo sapiens
ucaagcuauugucaugcc

SEQ ID NO: 44053 - RNA, 22 nt, Homo sapiens
ucaagugauucuugugccuuag

SEQ ID NO: 44054 - RNA, 22 nt, Homo sapiens
ucacaaguguauagacaugucc

SEQ ID NO: 44055 - RNA, 22 nt, Homo sapiens
ucacacgugaacucaucacaga

SEQ ID NO: 44056 - RNA, 22 nt, Homo sapiens
ucacacugucuugguuacucuu

SEQ ID NO: 44057 - RNA, 23 nt, Homo sapiens
ucacacuuaagagaaaugcagcu

SEQ ID NO: 44058 - RNA, 22 nt, Homo sapiens
ucacagauaaauaaagaugauu

SEQ ID NO: 44059 - RNA, 22 nt, Homo sapiens
ucacagaugaggcgagaggcag

SEQ ID NO: 44060 - RNA, 22 nt, Homo sapiens
ucacagcuaaaaugaaaguagu

SEQ ID NO: 44061 - RNA, 18 nt, Homo sapiens
ucacagguaaaguugaca

SEQ ID NO: 44062 - RNA, 22 nt, Homo sapiens
ucacauagcauaaugucugcaa

SEQ ID NO: 44063 - RNA, 22 nt, Homo sapiens
ucacaugugacauauauauuug

SEQ ID NO: 44064 - RNA, 22 nt, Homo sapiens
ucacaugugcguuuuggcaugu

SEQ ID NO: 44065 - RNA, 22 nt, Homo sapiens
ucaccagugucagggaacugcu

SEQ ID NO: 44066 - RNA, 22 nt, Homo sapiens
ucaccucgugaucugcccacuu

SEQ ID NO: 44067 - RNA, 22 nt, Homo sapiens
ucaccuguagcuaagaccuaau

SEQ ID NO: 44068 - RNA, 23 nt, Homo sapiens
ucacuagaguccuggaguuugag

SEQ ID NO: 44069 - RNA, 22 nt, Homo sapiens
ucacugaaaccacugccuccug

SEQ ID NO: 44070 - RNA, 22 nt, Homo sapiens
ucacugaaaccuccgccuucug

SEQ ID NO: 44071 - RNA, 22 nt, Homo sapiens
ucacugaaacuguccuggguua

SEQ ID NO: 44072 - RNA, 22 nt, Homo sapiens
ucacugcacucuccgccuugcg

SEQ ID NO: 44073 - RNA, 22 nt, Homo sapiens
ucagaccauuucauuacagacu

SEQ ID NO: 44074 - RNA, 22 nt, Homo sapiens
ucagauacuggugacaugaaug

SEQ ID NO: 44075 - RNA, 19 nt, Homo sapiens
ucagaucagcccaagggau

SEQ ID NO: 44076 - RNA, 22 nt, Homo sapiens
ucagaugauuccguugacgaga

SEQ ID NO: 44077 - RNA, 19 nt, Homo sapiens
ucagcaguaaucaacuuca

SEQ ID NO: 44078 - RNA, 22 nt, Homo sapiens
ucagcagugagagaccucaccc

SEQ ID NO: 44079 - RNA, 22 nt, Homo sapiens
ucagcagugccccacucuacug

SEQ ID NO: 44080 - RNA, 22 nt, Homo sapiens
ucagguaucuuuauagcgaugc

SEQ ID NO: 44081 - RNA, 22 nt, Homo sapiens
ucaggucauuccaggagggcca

SEQ ID NO: 44082 - RNA, 23 nt, Homo sapiens
ucaguacucuauaagugccagcu

SEQ ID NO: 44083 - RNA, 22 nt, Homo sapiens
ucaguagagacaggauuucacc

SEQ ID NO: 44084 - RNA, 23 nt, Homo sapiens
ucagugucuggauccugcucagu

SEQ ID NO: 44085 - RNA, 22 nt, Homo sapiens
ucauacaggccaccagggaagu

SEQ ID NO: 44086 - RNA, 22 nt, Homo sapiens
ucauacgucuccuugugccacc

SEQ ID NO: 44087 - RNA, 22 nt, Homo sapiens
ucauagaucaaguaauaagaca

SEQ ID NO: 44088 - RNA, 22 nt, Homo sapiens
ucaucagugcuugcaaauuauu

SEQ ID NO: 44089 - RNA, 22 nt, Homo sapiens
ucauggggugagcuacaggcac

SEQ ID NO: 44090 - RNA, 22 nt, Homo sapiens
ucauucacucccuugaaguuag

SEQ ID NO: 44091 - RNA, 22 nt, Homo sapiens
ucauucuuucuguggaggggcu

SEQ ID NO: 44092 - RNA, 22 nt, Homo sapiens
ucauugcaaucucugccucccg

SEQ ID NO: 44093 - RNA, 22 nt, Homo sapiens
ucauugcauguuaauuaaacag

SEQ ID NO: 44094 - RNA, 17 nt, Homo sapiens
uccagauuucaauugaa

SEQ ID NO: 44095 - RNA, 22 nt, Homo sapiens
uccagcuuuuucuaauucugug

SEQ ID NO: 44096 - RNA, 22 nt, Homo sapiens
uccaguuuucuuuccuagggcu

SEQ ID NO: 44097 - RNA, 22 nt, Homo sapiens
uccaugagaauaguuaggcucu

SEQ ID NO: 44098 - RNA, 19 nt, Homo sapiens
uccaugagcccacagugau

SEQ ID NO: 44099 - RNA, 22 nt, Homo sapiens
uccaugaggcuacaguaaucuc

SEQ ID NO: 44100 - RNA, 18 nt, Homo sapiens
uccauuuguaugggaugg

SEQ ID NO: 44101 - RNA, 22 nt, Homo sapiens
uccauuuguucagcuucaggaa

SEQ ID NO: 44102 - RNA, 16 nt, Homo sapiens
ucccaccauugcuugu

SEQ ID NO: 44103 - RNA, 22 nt, Homo sapiens
ucccacugucuucucgugcucg

SEQ ID NO: 44104 - RNA, 22 nt, Homo sapiens
ucccagugcuaugcaaaagccu

SEQ ID NO: 44105 - RNA, 22 nt, Homo sapiens
uccccgagcccaggcugugacu

SEQ ID NO: 44106 - RNA, 19 nt, Homo sapiens
uccccuguggauaccaaga

SEQ ID NO: 44107 - RNA, 20 nt, Homo sapiens
ucccuaagagccuuuccuuc

SEQ ID NO: 44108 - RNA, 20 nt, Homo sapiens
ucccucaaacuuuuccacug

SEQ ID NO: 44109 - RNA, 22 nt, Homo sapiens
ucccugacagucacagagcuac

SEQ ID NO: 44110 - RNA, 22 nt, Homo sapiens
ucccugagguccuggauuauug

SEQ ID NO: 44111 - RNA, 22 nt, Homo sapiens
ucccugaguaucuaauguguuu

SEQ ID NO: 44112 - RNA, 22 nt, Homo sapiens
ucccuuucuggaguuucccaag

SEQ ID NO: 44113 - RNA, 22 nt, Homo sapiens
uccugagucagcauccguuugu

SEQ ID NO: 44114 - RNA, 22 nt, Homo sapiens
uccuugagccuuaaauuauaaa

SEQ ID NO: 44115 - RNA, 23 nt, Homo sapiens
ucgguccccuuggcugcccucgg

SEQ ID NO: 44116 - RNA, 22 nt, Homo sapiens
ucuacagccaguucaggaagaa

SEQ ID NO: 44117 - RNA, 22 nt, Homo sapiens
ucucacagccauuucucccucu

SEQ ID NO: 44118 - RNA, 19 nt, Homo sapiens
ucucacagcucuacuaugu

SEQ ID NO: 44119 - RNA, 22 nt, Homo sapiens
ucucaguggcuuccucacuuuu

SEQ ID NO: 44120 - RNA, 22 nt, Homo sapiens
cugagaauguaaaugaagcuuu

SEQ ID NO: 44121 - RNA, 22 nt, Homo sapiens
cugagguuaggaguuugagacc

SEQ ID NO: 44122 - RNA, 20 nt, Homo sapiens
cugagguugggguccuuccc

SEQ ID NO: 44123 - RNA, 22 nt, Homo sapiens
cugagguuguucuucucagugg

SEQ ID NO: 44124 - RNA, 18 nt, Homo sapiens
cugagucauuccuggguc

SEQ ID NO: 44125 - RNA, 22 nt, Homo sapiens
cugauacucuccuuuuagagag

SEQ ID NO: 44126 - RNA, 22 nt, Homo sapiens
cugaucuggaggugucugggga

SEQ ID NO: 44127 - RNA, 20 nt, Homo sapiens
cugcacauccacucuacuuc

SEQ ID NO: 44128 - RNA, 22 nt, Homo sapiens
cugcacugagacccucuuugcu

SEQ ID NO: 44129 - RNA, 22 nt, Homo sapiens
cugcuguuguuaacuuuuggag

SEQ ID NO: 44130 - RNA, 22 nt, Homo sapiens
cuggaaacaucuuaggaaugca

SEQ ID NO: 44131 - RNA, 22 nt, Homo sapiens
cuggaaagcaaagggugcauug

SEQ ID NO: 44132 - RNA, 22 nt, Homo sapiens
cuggaagaaaaucacgccaucu

SEQ ID NO: 44133 - RNA, 22 nt, Homo sapiens
cuggaaugugagccccaaaaag

SEQ ID NO: 44134 - RNA, 22 nt, Homo sapiens
cuggaauuacaggguugagcua

SEQ ID NO: 44135 - RNA, 22 nt, Homo sapiens
cuggaauucaaaaucugaauuu

SEQ ID NO: 44136 - RNA, 22 nt, Homo sapiens
aaaucccuugcucucucagacc

SEQ ID NO: 44137 - RNA, 22 nt, Homo sapiens
aaaugcagucuuuguucugggc

SEQ ID NO: 44138 - RNA, 22 nt, Homo sapiens
aaaugcauaucaagauugcccu

SEQ ID NO: 44139 - RNA, 22 nt, Homo sapiens
aaaugcaugaggugggaagaaa

SEQ ID NO: 44140 - RNA, 22 nt, Homo sapiens
aaaugcugcuuuggccucuucu

SEQ ID NO: 44141 - RNA, 22 nt, Homo sapiens
aaaugguguuaguagaucuuua

SEQ ID NO: 44142 - RNA, 22 nt, Homo sapiens
aaauugcacaaguggugauuug

SEQ ID NO: 44143 - RNA, 22 nt, Homo sapiens
aacagagcuggugacuccaggu

SEQ ID NO: 44144 - RNA, 22 nt, Homo sapiens
aacagugcauuccuguccauau

SEQ ID NO: 44145 - RNA, 21 nt, Homo sapiens
aacagugcuuaguagauguuc

SEQ ID NO: 44146 - RNA, 22 nt, Homo sapiens
aacuaugucaaauaaaaugagg

SEQ ID NO: 44147 - RNA, 22 nt, Homo sapiens
aacugccucugacauaggcagg

SEQ ID NO: 44148 - RNA, 22 nt, Homo sapiens
aacuggcauaugaacuuguucu

SEQ ID NO: 44149 - RNA, 22 nt, Homo sapiens
aacuggccuggcgugcagaggg

SEQ ID NO: 44150 - RNA, 22 nt, Homo sapiens
aagagagcuaugugcauaauua

SEQ ID NO: 44151 - RNA, 22 nt, Homo sapiens
aagagcucauccauaguuguca

SEQ ID NO: 44152 - RNA, 22 nt, Homo sapiens
aagagguaggaaauggucauuu

SEQ ID NO: 44153 - RNA, 22 nt, Homo sapiens
aagcaacacaucugccccgguu

SEQ ID NO: 44154 - RNA, 22 nt, Homo sapiens
aagcugccuugugaaggcauuc

SEQ ID NO: 44155 - RNA, 22 nt, Homo sapiens
aagcuggagugcaguggugcga

SEQ ID NO: 44156 - RNA, 22 nt, Homo sapiens
aagcuggauuucgcauccuguu

SEQ ID NO: 44157 - RNA, 22 nt, Homo sapiens
aaggaguagaauagaugcaccu

SEQ ID NO: 44158 - RNA, 22 nt, Homo sapiens
aaggagugugauucuucaguuu

SEQ ID NO: 44159 - RNA, 22 nt, Homo sapiens
aagguacuggaaagaggaaugg

SEQ ID NO: 44160 - RNA, 22 nt, Homo sapiens
aagguauuucuaugggaauaga

SEQ ID NO: 44161 - RNA, 22 nt, Homo sapiens
aagguggaguugacaauuuuca

SEQ ID NO: 44162 - RNA, 22 nt, Homo sapiens
aagugacauugugcccauuuga

SEQ ID NO: 44163 - RNA, 22 nt, Homo sapiens
aagugcauguauuaguguaguc

SEQ ID NO: 44164 - RNA, 22 nt, Homo sapiens
aagugcuguaugggagccuagg

SEQ ID NO: 44165 - RNA, 22 nt, Homo sapiens
aagugcuuacagggaacaugau

SEQ ID NO: 44166 - RNA, 22 nt, Homo sapiens
aauaaagccugucucuuuagag

SEQ ID NO: 44167 - RNA, 22 nt, Homo sapiens
aauaaagcugaauccuuccuga

SEQ ID NO: 44168 - RNA, 22 nt, Homo sapiens
aauaugucuugaaauuggguaa

SEQ ID NO: 44169 - RNA, 19 nt, Homo sapiens
aauauugacaguggugucu

SEQ ID NO: 44170 - RNA, 22 nt, Homo sapiens
aauccaugugcuuuaccauuuu

SEQ ID NO: 44171 - RNA, 22 nt, Homo sapiens
aaucccuggacuuucggaggcu

SEQ ID NO: 44172 - RNA, 17 nt, Homo sapiens
aaugagacauuucugcu

SEQ ID NO: 44173 - RNA, 22 nt, Homo sapiens
aaugcacauauauuuccuuauu

SEQ ID NO: 44174 - RNA, 22 nt, Homo sapiens
aaugcuguguuauuucaugacc

SEQ ID NO: 44175 - RNA, 22 nt, Homo sapiens
aaugugcuuucuuucacacagu

SEQ ID NO: 44176 - RNA, 22 nt, Homo sapiens
aauuaggcuagaauguuauuaa

SEQ ID NO: 44177 - RNA, 22 nt, Homo sapiens
aauucacuucuuuuaggcaggg

SEQ ID NO: 44178 - RNA, 22 nt, Homo sapiens
aauugcacuacugcacucccac

SEQ ID NO: 44179 - RNA, 22 nt, Homo sapiens
acaaaguauggaauguuggugu

SEQ ID NO: 44180 - RNA, 22 nt, Homo sapiens
acaauguauauuuuacuguagg

SEQ ID NO: 44181 - RNA, 22 nt, Homo sapiens
acacaguaaauauguauugaau

SEQ ID NO: 44182 - RNA, 22 nt, Homo sapiens
acacagucaaauccacuuggcu

SEQ ID NO: 44183 - RNA, 22 nt, Homo sapiens
acacuguacuuauguuuugcag

SEQ ID NO: 44184 - RNA, 20 nt, Homo sapiens
acacugugcuaaggauuuuc

SEQ ID NO: 44185 - RNA, 19 nt, Homo sapiens
acagauagaauguucuaca

SEQ ID NO: 44186 - RNA, 22 nt, Homo sapiens
acagauagcacuaagggaucug

SEQ ID NO: 44187 - RNA, 22 nt, Homo sapiens
acagcagugccccacucuacug

SEQ ID NO: 44188 - RNA, 22 nt, Homo sapiens
acagugcuuggcacacaguaau

SEQ ID NO: 44189 - RNA, 18 nt, Homo sapiens
acagugucauggcucaau

SEQ ID NO: 44190 - RNA, 18 nt, Homo sapiens
acagugucuuacaccugu

SEQ ID NO: 44191 - RNA, 22 nt, Homo sapiens
acaguguuacuugauaguguau

SEQ ID NO: 44192 - RNA, 22 nt, Homo sapiens
acaguguuccuuuguugugacu

SEQ ID NO: 44193 - RNA, 22 nt, Homo sapiens
acauaaagaagcaggacauugu

SEQ ID NO: 44194 - RNA, 22 nt, Homo sapiens
acaugcauauguuggaagaaag

SEQ ID NO: 44195 - RNA, 22 nt, Homo sapiens
acauucagcuguuguuucaaug

SEQ ID NO: 44196 - RNA, 22 nt, Homo sapiens
accaugcaguccaauaugcaca

SEQ ID NO: 44197 - RNA, 22 nt, Homo sapiens
accauugcacuccagccugggc

SEQ ID NO: 44198 - RNA, 22 nt, Homo sapiens
acccaguguucagacuaccugu

SEQ ID NO: 44199 - RNA, 22 nt, Homo sapiens
acccaguguugggcagaacugu

SEQ ID NO: 44200 - RNA, 22 nt, Homo sapiens
acccugacacgauucuucacuu

SEQ ID NO: 44201 - RNA, 22 nt, Homo sapiens
acccugucaaaacggaccaauc

SEQ ID NO: 44202 - RNA, 22 nt, Homo sapiens
acccugucaaaauagaccaauc

SEQ ID NO: 44203 - RNA, 22 nt, Homo sapiens
acccugucagcuggccugggca

SEQ ID NO: 44204 - RNA, 22 nt, Homo sapiens
accgggcugagcgcaggccccg

SEQ ID NO: 44205 - RNA, 22 nt, Homo sapiens
acucagagagaacugucauuug

SEQ ID NO: 44206 - RNA, 22 nt, Homo sapiens
acucagagauuagcacauguuu

SEQ ID NO: 44207 - RNA, 22 nt, Homo sapiens
acuccacuuucaccacagcgga

SEQ ID NO: 44208 - RNA, 22 nt, Homo sapiens
acucuguugucuggccuuccug

SEQ ID NO: 44209 - RNA, 23 nt, Homo sapiens
acugagcaauguuuacauacuug

SEQ ID NO: 44210 - RNA, 22 nt, Homo sapiens
acugcacuccacccuuggcagc

SEQ ID NO: 44211 - RNA, 18 nt, Homo sapiens
acugcacuccaccuuggg

SEQ ID NO: 44212 - RNA, 22 nt, Homo sapiens
acugcacuccagacucugucuc

SEQ ID NO: 44213 - RNA, 22 nt, Homo sapiens
acugcacuccagcccgggugac

SEQ ID NO: 44214 - RNA, 22 nt, Homo sapiens
acugcacuccagccucaugaca

SEQ ID NO: 44215 - RNA, 22 nt, Homo sapiens
acugcacuccagccucccgucu

SEQ ID NO: 44216 - RNA, 22 nt, Homo sapiens
acugcacuccagccucguggac

SEQ ID NO: 44217 - RNA, 22 nt, Homo sapiens
acugcacuccagccuggacgaa

SEQ ID NO: 44218 - RNA, 22 nt, Homo sapiens
acugcacuccagccuuggagac

SEQ ID NO: 44219 - RNA, 22 nt, Homo sapiens
acugcacuccaguuccgggcaa

SEQ ID NO: 44220 - RNA, 22 nt, Homo sapiens
acugcacucccgcccgggugac

SEQ ID NO: 44221 - RNA, 22 nt, Homo sapiens
acugcacucuagccuuggcaac

SEQ ID NO: 44222 - RNA, 22 nt, Homo sapiens
acugcacucuagcuugggugac

SEQ ID NO: 44223 - RNA, 22 nt, Homo sapiens
acugcacuuauccuccaauguu

SEQ ID NO: 44224 - RNA, 20 nt, Homo sapiens
acugcacuucagccugcugg

SEQ ID NO: 44225 - RNA, 22 nt, Homo sapiens
ucucagugugguaaaaguuuuu

SEQ ID NO: 44226 - RNA, 22 nt, Homo sapiens
ucuccggguggcggcgaaggga

SEQ ID NO: 44227 - RNA, 22 nt, Homo sapiens
ucucuguuugucuguuacuggu

SEQ ID NO: 44228 - RNA, 22 nt, Homo sapiens
ucugaaucguucccaugcagga

SEQ ID NO: 44229 - RNA, 22 nt, Homo sapiens
ucugcaagucuaaacuagccau

SEQ ID NO: 44230 - RNA, 22 nt, Homo sapiens
ucuggccuccuaugagaaucga

SEQ ID NO: 44231 - RNA, 22 nt, Homo sapiens
ucuguacuccuugaguagugcu

SEQ ID NO: 44232 - RNA, 22 nt, Homo sapiens
ucugucaaaucuuauguuguag

SEQ ID NO: 44233 - RNA, 22 nt, Homo sapiens
ucugucacugaaucccugucac

SEQ ID NO: 44234 - RNA, 22 nt, Homo sapiens
ucugugaaaucauuuccuguaa

SEQ ID NO: 44235 - RNA, 22 nt, Homo sapiens
ucugugaaugaacacuugaaaa

SEQ ID NO: 44236 - RNA, 22 nt, Homo sapiens
ucugugaaugugaccuuauuug

SEQ ID NO: 44237 - RNA, 22 nt, Homo sapiens
ucuguguuugaucaagauugua

SEQ ID NO: 44238 - RNA, 22 nt, Homo sapiens
ucuucuagcggaacccucuugu

SEQ ID NO: 44239 - RNA, 22 nt, Homo sapiens
ugaaacacacagagaagggaga

SEQ ID NO: 44240 - RNA, 22 nt, Homo sapiens
ugaaacacaccuccucuccauc

SEQ ID NO: 44241 - RNA, 22 nt, Homo sapiens
ggugacugguuuaucuggcagu

SEQ ID NO: 44242 - RNA, 22 nt, Homo sapiens
ggugagaaagggauuccuguuc

SEQ ID NO: 44243 - RNA, 22 nt, Homo sapiens
ggugaguggugcuuaaguucag

SEQ ID NO: 44244 - RNA, 22 nt, Homo sapiens
gguguguaaauuacuuaucucu

SEQ ID NO: 44245 - RNA, 22 nt, Homo sapiens
guaaacuuccccucaugaauga

SEQ ID NO: 44246 - RNA, 22 nt, Homo sapiens
guaagugauagaauuaggauuc

SEQ ID NO: 44247 - RNA, 22 nt, Homo sapiens
guaauaacuguggaaaaagguu

SEQ ID NO: 44248 - RNA, 22 nt, Homo sapiens
guaaucucagcuucuugggagg

SEQ ID NO: 44249 - RNA, 17 nt, Homo sapiens
guacacuucuucuguga

SEQ ID NO: 44250 - RNA, 22 nt, Homo sapiens
guagaagcacagggccuguauu

SEQ ID NO: 44251 - RNA, 22 nt, Homo sapiens
guagaugcauggauuuacuucu

SEQ ID NO: 44252 - RNA, 22 nt, Homo sapiens
guagcagcaauuuacuccauac

SEQ ID NO: 44253 - RNA, 22 nt, Homo sapiens
guaggcacuggcucagcuuauc

SEQ ID NO: 44254 - RNA, 21 nt, Homo sapiens
guaugguugaagugacaagcc

SEQ ID NO: 44255 - RNA, 22 nt, Homo sapiens
guaugugcauuguaaauuuuga

SEQ ID NO: 44256 - RNA, 18 nt, Homo sapiens
guauuccagccugaguga

SEQ ID NO: 44257 - RNA, 22 nt, Homo sapiens
gucacuguuuccuauuauauuu

SEQ ID NO: 44258 - RNA, 22 nt, Homo sapiens
gucagauaauuugcauccaucu

SEQ ID NO: 44259 - RNA, 22 nt, Homo sapiens
gucaggcaccgauacaguuuuu

SEQ ID NO: 44260 - RNA, 22 nt, Homo sapiens
gucaugucugcacauaguaaaa

SEQ ID NO: 44261 - RNA, 22 nt, Homo sapiens
gucauugaaguggaaucaucca

SEQ ID NO: 44262 - RNA, 22 nt, Homo sapiens
gucauugucaauugacaauugu

SEQ ID NO: 44263 - RNA, 22 nt, Homo sapiens
guccagagaagucauuacuuca

SEQ ID NO: 44264 - RNA, 22 nt, Homo sapiens
guccuggagaagcguggaccgg

SEQ ID NO: 44265 - RNA, 22 nt, Homo sapiens
gucguggagucucuggcuugua

SEQ ID NO: 44266 - RNA, 22 nt, Homo sapiens
gucuagaacuucugaccuuagg

SEQ ID NO: 44267 - RNA, 22 nt, Homo sapiens
gucugagcauggggccggcagg

SEQ ID NO: 44268 - RNA, 22 nt, Homo sapiens
gucugucuuuugucuuugaaau

SEQ ID NO: 44269 - RNA, 22 nt, Homo sapiens
gucuuugagauaggguuauuuu

SEQ ID NO: 44270 - RNA, 22 nt, Homo sapiens
gugaaagacauauaugguuuga

SEQ ID NO: 44271 - RNA, 22 nt, Homo sapiens
gugagaacugugucuuauaaac

SEQ ID NO: 44272 - RNA, 22 nt, Homo sapiens
gugagaauauuuuaaauacuaa

SEQ ID NO: 44273 - RNA, 19 nt, Homo sapiens
gugagcaaugcauugcacu

SEQ ID NO: 44274 - RNA, 22 nt, Homo sapiens
gugagcaauugauacuugaagu

SEQ ID NO: 44275 - RNA, 22 nt, Homo sapiens
gugagcauaacaacagaguuua

SEQ ID NO: 44276 - RNA, 22 nt, Homo sapiens
gugagguagagcaugugaaaga

SEQ ID NO: 44277 - RNA, 22 nt, Homo sapiens
gugaucuguccuucauagccug

SEQ ID NO: 44278 - RNA, 22 nt, Homo sapiens
gugaugguccagggaaucucuu

SEQ ID NO: 44279 - RNA, 22 nt, Homo sapiens
gugcacaacaugcaguuuuguu

SEQ ID NO: 44280 - RNA, 22 nt, Homo sapiens
gugcacaaucgugcauuccuug

SEQ ID NO: 44281 - RNA, 22 nt, Homo sapiens
gugcaugcaucuuuauaguagc

SEQ ID NO: 44282 - RNA, 22 nt, Homo sapiens
gugcccacugucuguccuguag

SEQ ID NO: 44283 - RNA, 22 nt, Homo sapiens
guggaagcacaggccuccugga

SEQ ID NO: 44284 - RNA, 22 nt, Homo sapiens
guggaagguaaugcagcuuacu

SEQ ID NO: 44285 - RNA, 22 nt, Homo sapiens
guggaauacuaugaugguggau

SEQ ID NO: 44286 - RNA, 22 nt, Homo sapiens
guggaaugaaaacucucucaca

SEQ ID NO: 44287 - RNA, 22 nt, Homo sapiens
guggaaugcaguguugauucaa

SEQ ID NO: 44288 - RNA, 22 nt, Homo sapiens
guggcaaagaugccuucuccaa

SEQ ID NO: 44289 - RNA, 22 nt, Homo sapiens
guggcaaguguuccaagaggcg

SEQ ID NO: 44290 - RNA, 22 nt, Homo sapiens
gugggaugaucacaguucacug

SEQ ID NO: 44291 - RNA, 22 nt, Homo sapiens
gugguucuagaauugaguaucc

SEQ ID NO: 44292 - RNA, 21 nt, Homo sapiens
gugguucuagagaaacagaau

SEQ ID NO: 44293 - RNA, 22 nt, Homo sapiens
gugguuuuacaaagagaaagau

SEQ ID NO: 44294 - RNA, 22 nt, Homo sapiens
guguagagaaauagccugaagg

SEQ ID NO: 44295 - RNA, 22 nt, Homo sapiens
gugucaugaagguuuuaugcag

SEQ ID NO: 44296 - RNA, 22 nt, Homo sapiens
gugucucagcccagaccuauuu

SEQ ID NO: 44297 - RNA, 22 nt, Homo sapiens
gugugacugcucuauuagggcg

SEQ ID NO: 44298 - RNA, 22 nt, Homo sapiens
gugugauuauuucaauugaugc

SEQ ID NO: 44299 - RNA, 22 nt, Homo sapiens
gugugcacaaucuggcaugugc

SEQ ID NO: 44300 - RNA, 22 nt, Homo sapiens
gugugucuugaccaggaucgga

SEQ ID NO: 44301 - RNA, 22 nt, Homo sapiens
guguuugauugcaaauaaucua

SEQ ID NO: 44302 - RNA, 22 nt, Homo sapiens
guuaagaaguguaacuuaaguu

SEQ ID NO: 44303 - RNA, 22 nt, Homo sapiens
guucaaggaauguuggcuucuc

SEQ ID NO: 44304 - RNA, 22 nt, Homo sapiens
guucaagugauucuacugccuc

SEQ ID NO: 44305 - RNA, 22 nt, Homo sapiens
guucacacuugcaaccccagca

SEQ ID NO: 44306 - RNA, 22 nt, Homo sapiens
guucacagugguugccuuccag

SEQ ID NO: 44307 - RNA, 22 nt, Homo sapiens
guucagguauucuggaacagag

SEQ ID NO: 44308 - RNA, 22 nt, Homo sapiens
guugccuaggcuggagugcagu

SEQ ID NO: 44309 - RNA, 22 nt, Homo sapiens
guugcucaggccggagugcagu

SEQ ID NO: 44310 - RNA, 17 nt, Homo sapiens
guuuggguacuggguaa

SEQ ID NO: 44311 - RNA, 22 nt, Homo sapiens
uaaagcuaucacauuggugauu

SEQ ID NO: 44312 - RNA, 22 nt, Homo sapiens
uaacaggcuacucuugcauugc

SEQ ID NO: 44313 - RNA, 22 nt, Homo sapiens
uaagacuguuggcaauuuuugc

SEQ ID NO: 44314 - RNA, 22 nt, Homo sapiens
uaaggcuuaugguaaaguccug

SEQ ID NO: 44315 - RNA, 22 nt, Homo sapiens
uaaguagaggaaucauuuugug

SEQ ID NO: 44316 - RNA, 22 nt, Homo sapiens
uaagugcuugacuuugauguuu

SEQ ID NO: 44317 - RNA, 22 nt, Homo sapiens
uaaguguaaugucugaaguuug

SEQ ID NO: 44318 - RNA, 22 nt, Homo sapiens
uaaguuguagaacguuuucuua

SEQ ID NO: 44319 - RNA, 22 nt, Homo sapiens
uaauccuagcacuuuggaagac

SEQ ID NO: 44320 - RNA, 22 nt, Homo sapiens
uaaugcuugguuguuuggaaaa

SEQ ID NO: 44321 - RNA, 22 nt, Homo sapiens
uacacagucaaaaauuuccagg

SEQ ID NO: 44322 - RNA, 22 nt, Homo sapiens
uacaccauuugauucuuuaagc

SEQ ID NO: 44323 - RNA, 22 nt, Homo sapiens
uacaggaaugucagguugcugu

SEQ ID NO: 44324 - RNA, 22 nt, Homo sapiens
uacaggcaccuggcuaauuuuu

SEQ ID NO: 44325 - RNA, 22 nt, Homo sapiens
uacaggcagguguucccugguu

SEQ ID NO: 44326 - RNA, 22 nt, Homo sapiens
uacauacuucacagacuuuaaa

SEQ ID NO: 44327 - RNA, 19 nt, Homo sapiens
uacauaguauuuaguggca

SEQ ID NO: 44328 - RNA, 22 nt, Homo sapiens
uacauguauccauuguuuuugg

SEQ ID NO: 44329 - RNA, 22 nt, Homo sapiens
uaccaugcagguguauguuugu

SEQ ID NO: 44330 - RNA, 22 nt, Homo sapiens
acugcacuucagccuuggggac

SEQ ID NO: 44331 - RNA, 22 nt, Homo sapiens
acugcauuugucugucucaauu

SEQ ID NO: 44332 - RNA, 22 nt, Homo sapiens
acuggaguuuguucaagaaaua

SEQ ID NO: 44333 - RNA, 22 nt, Homo sapiens
acugguguaugggaggucccaa

SEQ ID NO: 44334 - RNA, 22 nt, Homo sapiens
acuguacuccauccugggugac

SEQ ID NO: 44335 - RNA, 22 nt, Homo sapiens
acuugacacuuauauuacucac

SEQ ID NO: 44336 - RNA, 22 nt, Homo sapiens
agaaccauuagagggagauauu

SEQ ID NO: 44337 - RNA, 22 nt, Homo sapiens
agacaguguguguauauauggu

SEQ ID NO: 44338 - RNA, 22 nt, Homo sapiens
agacucauuuuuaucgagcaug

SEQ ID NO: 44339 - RNA, 22 nt, Homo sapiens
agacuguaaugcauaauuuacu

SEQ ID NO: 44340 - RNA, 22 nt, Homo sapiens
agagcaauguuaucagucucug

SEQ ID NO: 44341 - RNA, 22 nt, Homo sapiens
agagguaagaauaguaguugga

SEQ ID NO: 44342 - RNA, 22 nt, Homo sapiens
agaugauguuuacugagcauca

SEQ ID NO: 44343 - RNA, 20 nt, Homo sapiens
agaugcaugcacauaaacac

SEQ ID NO: 44344 - RNA, 22 nt, Homo sapiens
agcaacauuuuugaccuuucuu

SEQ ID NO: 44345 - RNA, 22 nt, Homo sapiens
agcaagaugaaguugagcuagg

SEQ ID NO: 44346 - RNA, 17 nt, Homo sapiens
ggcaggaauuaauguca

SEQ ID NO: 44347 - RNA, 17 nt, Homo sapiens
ggcaggauccaggaucc

SEQ ID NO: 44348 - RNA, 22 nt, Homo sapiens
ggcccugauacaaguaaggucu

SEQ ID NO: 44349 - RNA, 22 nt, Homo sapiens
ggcuagagagcucagggauaug

SEQ ID NO: 44350 - RNA, 20 nt, Homo sapiens
gggaaugcaaauucucaucc

SEQ ID NO: 44351 - RNA, 22 nt, Homo sapiens
gggaauguagcaaaucugcaau

SEQ ID NO: 44352 - RNA, 22 nt, Homo sapiens
gggaugaagcccuaggguuggu

SEQ ID NO: 44353 - RNA, 22 nt, Homo sapiens
gggcaugaugucuuaugccuau

SEQ ID NO: 44354 - RNA, 19 nt, Homo sapiens
ggugcuugaauauuccucc

SEQ ID NO: 44355 - RNA, 22 nt, Homo sapiens
gguggcaaaucugaguggcgcu

SEQ ID NO: 44356 - RNA, 22 nt, Homo sapiens
guaacucugucacuuacuaguu

SEQ ID NO: 44357 - RNA, 22 nt, Homo sapiens
guaaucucagcuacgcgggagg

SEQ ID NO: 44358 - RNA, 22 nt, Homo sapiens
guaaucucagcuacucgggagg

SEQ ID NO: 44359 - RNA, 22 nt, Homo sapiens
guaaucucagcuacuugggagc

SEQ ID NO: 44360 - RNA, 22 nt, Homo sapiens
guacacaacaugcagguuuguu

SEQ ID NO: 44361 - RNA, 22 nt, Homo sapiens
guagaaaguuugcugucacaug

SEQ ID NO: 44362 - RNA, 22 nt, Homo sapiens
guagaagcacaggugaguuggu

SEQ ID NO: 44363 - RNA, 22 nt, Homo sapiens
guagagagaaauacaaagcugu

SEQ ID NO: 44364 - RNA, 22 nt, Homo sapiens
guagaggaauggcuccaccaua

SEQ ID NO: 44365 - RNA, 22 nt, Homo sapiens
guagcaucauuugcaauuucau

SEQ ID NO: 44366 - RNA, 22 nt, Homo sapiens
guaguagcacgagcucugucuc

SEQ ID NO: 44367 - RNA, 22 nt, Homo sapiens
guagugcaguuugagaaucagu

SEQ ID NO: 44368 - RNA, 22 nt, Homo sapiens
guaucaucauguuggccaggcu

SEQ ID NO: 44369 - RNA, 22 nt, Homo sapiens
gucagagcacugaguugugggc

SEQ ID NO: 44370 - RNA, 22 nt, Homo sapiens
gucagcaucaccaugucuauga

SEQ ID NO: 44371 - RNA, 22 nt, Homo sapiens
gucagugugauaucugcagggg

SEQ ID NO: 44372 - RNA, 22 nt, Homo sapiens
gucaugcaggguucgccagccc

SEQ ID NO: 44373 - RNA, 22 nt, Homo sapiens
gucauggacaaggugugagcca

SEQ ID NO: 44374 - RNA, 22 nt, Homo sapiens
gucaugucuugaaauucaguuu

SEQ ID NO: 44375 - RNA, 22 nt, Homo sapiens
gucauguuuaacuucuugagga

SEQ ID NO: 44376 - RNA, 22 nt, Homo sapiens
guccaguguuggagguuuuacc

SEQ ID NO: 44377 - RNA, 22 nt, Homo sapiens
guccaugagaugaauccacaca

SEQ ID NO: 44378 - RNA, 22 nt, Homo sapiens
gucccugaggaacauccagggc

SEQ ID NO: 44379 - RNA, 22 nt, Homo sapiens
gucguggagcucacagugugcc

SEQ ID NO: 44380 - RNA, 22 nt, Homo sapiens
gucucuuguuaucauuucugag

SEQ ID NO: 44381 - RNA, 22 nt, Homo sapiens
gucuggcuuaucucacuuacca

SEQ ID NO: 44382 - RNA, 22 nt, Homo sapiens
gucugguugacagcauguggcc

SEQ ID NO: 44383 - RNA, 22 nt, Homo sapiens
gucuguuuggggaccuguggcc

SEQ ID NO: 44384 - RNA, 22 nt, Homo sapiens
gucuugaaggcugaguaccugu

SEQ ID NO: 44385 - RNA, 22 nt, Homo sapiens
gucuuuaguugaaacauguggu

SEQ ID NO: 44386 - RNA, 22 nt, Homo sapiens
gugaaaagaugagcaccauaca

SEQ ID NO: 44387 - RNA, 22 nt, Homo sapiens
gugaaagcaucugacugugcca

SEQ ID NO: 44388 - RNA, 17 nt, Homo sapiens
gugaaaucaucauuuuu

SEQ ID NO: 44389 - RNA, 22 nt, Homo sapiens
gugaacaauguuuuauccuggg

SEQ ID NO: 44390 - RNA, 22 nt, Homo sapiens
gugaacagaaccugggaucgaa

SEQ ID NO: 44391 - RNA, 22 nt, Homo sapiens
gugaaucauaugccagucaugc

SEQ ID NO: 44392 - RNA, 22 nt, Homo sapiens
gugaauugagagaacuguguua

SEQ ID NO: 44393 - RNA, 22 nt, Homo sapiens
gugaccauuugacauauccuug

SEQ ID NO: 44394 - RNA, 22 nt, Homo sapiens
gugagcacugaaagaaggcaag

SEQ ID NO: 44395 - RNA, 22 nt, Homo sapiens
gugagcuccucucuauguguca

SEQ ID NO: 44396 - RNA, 22 nt, Homo sapiens
gugaggucguagucauaggcaa

SEQ ID NO: 44397 - RNA, 22 nt, Homo sapiens
gugaguuauuauuuauguaaac

SEQ ID NO: 44398 - RNA, 22 nt, Homo sapiens
gugauagaucugggauucagaa

SEQ ID NO: 44399 - RNA, 22 nt, Homo sapiens
gugcacaacgugcaggcuuguu

SEQ ID NO: 44400 - RNA, 22 nt, Homo sapiens
gugcauauaaguuguuucuagu

SEQ ID NO: 44401 - RNA, 22 nt, Homo sapiens
gugcauaucugugguuggcuga

SEQ ID NO: 44402 - RNA, 22 nt, Homo sapiens
gugcuuguguuaauauguagcu

SEQ ID NO: 44403 - RNA, 22 nt, Homo sapiens
guggaaaauuauugcuguuuuu

SEQ ID NO: 44404 - RNA, 22 nt, Homo sapiens
guggaagaccagacuuuccaac

SEQ ID NO: 44405 - RNA, 22 nt, Homo sapiens
guggaagugucuggggccaggg

SEQ ID NO: 44406 - RNA, 22 nt, Homo sapiens
guggaauggaaugauuguguau

SEQ ID NO: 44407 - RNA, 17 nt, Homo sapiens
guggaaugucaugucaa

SEQ ID NO: 44408 - RNA, 22 nt, Homo sapiens
guggaucacuugaggucaagag

SEQ ID NO: 44409 - RNA, 22 nt, Homo sapiens
guggcaagaauguacaaaaggu

SEQ ID NO: 44410 - RNA, 22 nt, Homo sapiens
guggcagagucagagggaaaug

SEQ ID NO: 44411 - RNA, 22 nt, Homo sapiens
guggcagugugaggauccugcu

SEQ ID NO: 44412 - RNA, 22 nt, Homo sapiens
gugguagaaauguagaugcuag

SEQ ID NO: 44413 - RNA, 22 nt, Homo sapiens
guguaaaugagugcugaaggag

SEQ ID NO: 44414 - RNA, 22 nt, Homo sapiens
guguauucaucuggcugaggua

SEQ ID NO: 44415 - RNA, 22 nt, Homo sapiens
gugucaugggcauguccuuaac

SEQ ID NO: 44416 - RNA, 22 nt, Homo sapiens
gugucccagugugcauacaggu

SEQ ID NO: 44417 - RNA, 22 nt, Homo sapiens
gugugacagcuauagacaugau

SEQ ID NO: 44418 - RNA, 22 nt, Homo sapiens
gugugcaacuuucauuaauauu

SEQ ID NO: 44419 - RNA, 22 nt, Homo sapiens
gugugcaauuuugugggaggca

SEQ ID NO: 44420 - RNA, 22 nt, Homo sapiens
gugugguaggauugguuacuca

SEQ ID NO: 44421 - RNA, 22 nt, Homo sapiens
guuaaagacauccacauaggag

SEQ ID NO: 44422 - RNA, 22 nt, Homo sapiens
guucaagcaauucugcugccuc

SEQ ID NO: 44423 - RNA, 22 nt, Homo sapiens
guucaagugauagcugggauua

SEQ ID NO: 44424 - RNA, 21 nt, Homo sapiens
guucaagugauccuccugucu

SEQ ID NO: 44425 - RNA, 20 nt, Homo sapiens
guucacagagguuaugauua

SEQ ID NO: 44426 - RNA, 22 nt, Homo sapiens
guugaguuugaccugaacucug

SEQ ID NO: 44427 - RNA, 22 nt, Homo sapiens
guugcagcacacaggcugucag

SEQ ID NO: 44428 - RNA, 22 nt, Homo sapiens
uaaagaugcugggaaggcuagg

SEQ ID NO: 44429 - RNA, 22 nt, Homo sapiens
uaaagcuagaauuguuccagca

SEQ ID NO: 44430 - RNA, 22 nt, Homo sapiens
uaaagcuuggauuuaggcuaau

SEQ ID NO: 44431 - RNA, 22 nt, Homo sapiens
uuggaaugcacacugagccugc

SEQ ID NO: 44432 - RNA, 22 nt, Homo sapiens
uuggagagaaaggcaguuccug

SEQ ID NO: 44433 - RNA, 22 nt, Homo sapiens
uuggagugugcucauaacugcu

SEQ ID NO: 44434 - RNA, 22 nt, Homo sapiens
uuggagugugucuuauuccauu

SEQ ID NO: 44435 - RNA, 22 nt, Homo sapiens
uuggcaaagaggaaugccacuu

SEQ ID NO: 44436 - RNA, 22 nt, Homo sapiens
uuggcaacauagugagaccccc

SEQ ID NO: 44437 - RNA, 22 nt, Homo sapiens
uuggcaaguccccaccucucuc

SEQ ID NO: 44438 - RNA, 22 nt, Homo sapiens
uuggcaaguuucugucagcaaa

SEQ ID NO: 44439 - RNA, 22 nt, Homo sapiens
uuggcauugaguuucaaaucau

SEQ ID NO: 44440 - RNA, 22 nt, Homo sapiens
uuggccauggagcacuuuucua

SEQ ID NO: 44441 - RNA, 22 nt, Homo sapiens
uugggauaaucacaaaguaaaa

SEQ ID NO: 44442 - RNA, 22 nt, Homo sapiens
uuguacuagaaaauuauucuuu

SEQ ID NO: 44443 - RNA, 22 nt, Homo sapiens
uuguacuauuuuuaucagugau

SEQ ID NO: 44444 - RNA, 22 nt, Homo sapiens
uuguacuccagccugggugaca

SEQ ID NO: 44445 - RNA, 22 nt, Homo sapiens
uuguaguagucucguucuuuua

SEQ ID NO: 44446 - RNA, 22 nt, Homo sapiens
uuguauaggcucaguaagaauc

SEQ ID NO: 44447 - RNA, 22 nt, Homo sapiens
uuguaugucuucauuugaaaaa

SEQ ID NO: 44448 - RNA, 22 nt, Homo sapiens
uugucacauggggcggcugccc

SEQ ID NO: 44449 - RNA, 22 nt, Homo sapiens
uugucauuuucagaguguuacg

SEQ ID NO: 44450 - RNA, 22 nt, Homo sapiens
uugucccauggggucuuccuuu

SEQ ID NO: 44451 - RNA, 22 nt, Homo sapiens
uccuucauuugucaacucuagu

SEQ ID NO: 44452 - RNA, 19 nt, Homo sapiens
uccuugauugcaccacugc

SEQ ID NO: 44453 - RNA, 21 nt, Homo sapiens
uccuuggugaugcccugcagu

SEQ ID NO: 44454 - RNA, 22 nt, Homo sapiens
uccuuuaguuaauaaagacaag

SEQ ID NO: 44455 - RNA, 22 nt, Homo sapiens
uccuuuggguagcuguucagau

SEQ ID NO: 44456 - RNA, 22 nt, Homo sapiens
ucgcugcgaccuccaccucccg

SEQ ID NO: 44457 - RNA, 22 nt, Homo sapiens
ucggcucagugcaagcucugcc

SEQ ID NO: 44458 - RNA, 22 nt, Homo sapiens
ucuaaggcaccuagagucauca

SEQ ID NO: 44459 - RNA, 22 nt, Homo sapiens
ucuaauguaaccugcaaauauu

SEQ ID NO: 44460 - RNA, 22 nt, Homo sapiens
ucucaagaugguagaugggaau

SEQ ID NO: 44461 - RNA, 22 nt, Homo sapiens
ucucacacugaauguguguggg

SEQ ID NO: 44462 - RNA, 22 nt, Homo sapiens
ucucagagccuaggguuuuuca

SEQ ID NO: 44463 - RNA, 22 nt, Homo sapiens
ucucugaaacucuugacauccu

SEQ ID NO: 44464 - RNA, 22 nt, Homo sapiens
ucucugagaaaaguuucuccca

SEQ ID NO: 44465 - RNA, 22 nt, Homo sapiens
ucugagaucaugucugugcugu

SEQ ID NO: 44466 - RNA, 22 nt, Homo sapiens
ucugagcaauagauguggauau

SEQ ID NO: 44467 - RNA, 22 nt, Homo sapiens
ucugagguaggugcauggauac

SEQ ID NO: 44468 - RNA, 22 nt, Homo sapiens
ucugagguuaaauuuuauaguu

SEQ ID NO: 44469 - RNA, 22 nt, Homo sapiens
ucugccacugucauugugugau

SEQ ID NO: 44470 - RNA, 22 nt, Homo sapiens
ucuggcaagagccgagggcagu

SEQ ID NO: 44471 - RNA, 20 nt, Homo sapiens
ucuggccccucuaaaucuca

SEQ ID NO: 44472 - RNA, 20 nt, Homo sapiens
ucuggguuuuggccacgccc

SEQ ID NO: 44473 - RNA, 22 nt, Homo sapiens
ucugguggugaugagagacagu

SEQ ID NO: 44474 - RNA, 22 nt, Homo sapiens
ucugugcauuacacuuuucuca

SEQ ID NO: 44475 - RNA, 22 nt, Homo sapiens
ucuuggguuugccuugcugcug

SEQ ID NO: 44476 - RNA, 22 nt, Homo sapiens
ucuuugauuuuguuacuaagac

SEQ ID NO: 44477 - RNA, 19 nt, Homo sapiens
ucuuugcuuuucuaagagg

SEQ ID NO: 44478 - RNA, 22 nt, Homo sapiens
ucuuuuguaaaaugaggaggug

SEQ ID NO: 44479 - RNA, 22 nt, Homo sapiens
ugaaacugcagugggcuuggca

SEQ ID NO: 44480 - RNA, 22 nt, Homo sapiens
ugaaagcuacagucuccuagga

SEQ ID NO: 44481 - RNA, 22 nt, Homo sapiens
ugaaauguaaguugucuagucu

SEQ ID NO: 44482 - RNA, 22 nt, Homo sapiens
ugaagaucuuaggagcugaggg

SEQ ID NO: 44483 - RNA, 22 nt, Homo sapiens
ugaagugggaaaugaguauuaa

SEQ ID NO: 44484 - RNA, 22 nt, Homo sapiens
ugaaucaugcugcuauaaagac

SEQ ID NO: 44485 - RNA, 22 nt, Homo sapiens
ugaaugguuuuuagagaacaau

SEQ ID NO: 44486 - RNA, 22 nt, Homo sapiens
ugacaagaaagcgucuucuuuu

SEQ ID NO: 44487 - RNA, 22 nt, Homo sapiens
ugacagagaagcauugaguuca

SEQ ID NO: 44488 - RNA, 18 nt, Homo sapiens
ugacagcacaugugggga

SEQ ID NO: 44489 - RNA, 22 nt, Homo sapiens
ugacagcuguugaggcauuuau

SEQ ID NO: 44490 - RNA, 22 nt, Homo sapiens
ugacaguaucuacagcuucuua

SEQ ID NO: 44491 - RNA, 23 nt, Homo sapiens
ugacagucucccgauggcuaggc

SEQ ID NO: 44492 - RNA, 20 nt, Homo sapiens
ugacaucagcaauguaauaa

SEQ ID NO: 44493 - RNA, 19 nt, Homo sapiens
ugacaugaaacccaagauc

SEQ ID NO: 44494 - RNA, 22 nt, Homo sapiens
ugacaugauuguauauuuagaa

SEQ ID NO: 44495 - RNA, 22 nt, Homo sapiens
ugacauuacagucacuugcugu

SEQ ID NO: 44496 - RNA, 22 nt, Homo sapiens
ugacuacauaaguaaucucaaa

SEQ ID NO: 44497 - RNA, 22 nt, Homo sapiens
ugacuagacuugcaagguugca

SEQ ID NO: 44498 - RNA, 22 nt, Homo sapiens
ugacuagagggcuuuuguguag

SEQ ID NO: 44499 - RNA, 22 nt, Homo sapiens
ugacuaggaaauuagaacuuuu

SEQ ID NO: 44500 - RNA, 22 nt, Homo sapiens
ugacuauaggauaacaugcauu

SEQ ID NO: 44501 - RNA, 22 nt, Homo sapiens
ugacucaagagccugacucauc

SEQ ID NO: 44502 - RNA, 22 nt, Homo sapiens
ugacucaguuucucagguagua

SEQ ID NO: 44503 - RNA, 21 nt, Homo sapiens
ugagaacaacaggucaagcag

SEQ ID NO: 44504 - RNA, 22 nt, Homo sapiens
ugagaacaugcacuugagguug

SEQ ID NO: 44505 - RNA, 16 nt, Homo sapiens
ugagaacaugcagcau

SEQ ID NO: 44506 - RNA, 22 nt, Homo sapiens
ugagaacauggagaacccccca

SEQ ID NO: 44507 - RNA, 16 nt, Homo sapiens
ugagaacaugugauau

SEQ ID NO: 44508 - RNA, 17 nt, Homo sapiens
ugagaacaugugguauu

SEQ ID NO: 44509 - RNA, 18 nt, Homo sapiens
ugagaacauguguacaca

SEQ ID NO: 44510 - RNA, 22 nt, Homo sapiens
ugagaacugccuguauuuaucu

SEQ ID NO: 44511 - RNA, 22 nt, Homo sapiens
ugagaauauuuuccaugucuca

SEQ ID NO: 44512 - RNA, 22 nt, Homo sapiens
ugagaaugaugauugguaaacc

SEQ ID NO: 44513 - RNA, 22 nt, Homo sapiens
ugagacaugugaacuguaguuc

SEQ ID NO: 44514 - RNA, 22 nt, Homo sapiens
ugagacgaagucuugcucuguu

SEQ ID NO: 44515 - RNA, 22 nt, Homo sapiens
ugagacugaguuucucucuugu

SEQ ID NO: 44516 - RNA, 22 nt, Homo sapiens
ugagacugaguuuugcucuugu

SEQ ID NO: 44517 - RNA, 18 nt, Homo sapiens
ugagauacuagaauaggu

SEQ ID NO: 44518 - RNA, 22 nt, Homo sapiens
ugagauagcauaagggacagaa

SEQ ID NO: 44519 - RNA, 22 nt, Homo sapiens
ugagaugaacuugauuguuuua

SEQ ID NO: 44520 - RNA, 22 nt, Homo sapiens
ugagaugaagucucacucuguc

SEQ ID NO: 44521 - RNA, 22 nt, Homo sapiens
ugagaugaagucuugcucuguu

SEQ ID NO: 44522 - RNA, 22 nt, Homo sapiens
ugagaugacgacacaccucagu

SEQ ID NO: 44523 - RNA, 22 nt, Homo sapiens
ugagaugauuuaauggagccca

SEQ ID NO: 44524 - RNA, 22 nt, Homo sapiens
ugagauuguucuaugucugguu

SEQ ID NO: 44525 - RNA, 22 nt, Homo sapiens
ugagcagugagugugcugcagg

SEQ ID NO: 44526 - RNA, 22 nt, Homo sapiens
ugagcagugaguguggugcagg

SEQ ID NO: 44527 - RNA, 22 nt, Homo sapiens
ugagccaaguucacaccauugc

SEQ ID NO: 44528 - RNA, 22 nt, Homo sapiens
ugagcugagaucgugccauugu

SEQ ID NO: 44529 - RNA, 22 nt, Homo sapiens
ugagcugagauuaagcugcugc

SEQ ID NO: 44530 - RNA, 22 nt, Homo sapiens
ugaggacugagaggcacugugg

SEQ ID NO: 44531 - RNA, 22 nt, Homo sapiens
ugaggauaguguugaaggcagg

SEQ ID NO: 44532 - RNA, 22 nt, Homo sapiens
ugagguaacaaacuaugaguua

SEQ ID NO: 44533 - RNA, 22 nt, Homo sapiens
auauuggccuaaaauucucuuu

SEQ ID NO: 44534 - RNA, 22 nt, Homo sapiens
aucacaauuguacguaggagcc

SEQ ID NO: 44535 - RNA, 22 nt, Homo sapiens
aucacagugagcauaugucuau

SEQ ID NO: 44536 - RNA, 22 nt, Homo sapiens
aucacuaugcaggugucucggg

SEQ ID NO: 44537 - RNA, 22 nt, Homo sapiens
acagagcaaugagcuacggucu

SEQ ID NO: 44538 - RNA, 22 nt, Homo sapiens
acagucuggagaaugggugcuc

SEQ ID NO: 44539 - RNA, 22 nt, Homo sapiens
acauacacuagggauguggugu

SEQ ID NO: 44540 - RNA, 22 nt, Homo sapiens
acaucccuugcucggggccccu

SEQ ID NO: 44541 - RNA, 22 nt, Homo sapiens
acaucccuuucccacccuucac

SEQ ID NO: 44542 - RNA, 18 nt, Homo sapiens
acauucagcuugaagaua

SEQ ID NO: 44543 - RNA, 22 nt, Homo sapiens
accacaggguaaaguuagauau

SEQ ID NO: 44544 - RNA, 22 nt, Homo sapiens
accacuguuucaagaagcuugu

SEQ ID NO: 44545 - RNA, 22 nt, Homo sapiens
acccuggauucguggccuugaa

SEQ ID NO: 44546 - RNA, 22 nt, Homo sapiens
acccugucaaaauggaccaauc

SEQ ID NO: 44547 - RNA, 22 nt, Homo sapiens
acccugucacucccaucaauuu

SEQ ID NO: 44548 - RNA, 22 nt, Homo sapiens
accuggacacuuugggcuccuc

SEQ ID NO: 44549 - RNA, 22 nt, Homo sapiens
accugugguuacagucugucuc

SEQ ID NO: 44550 - RNA, 22 nt, Homo sapiens
acuagguaguaaucugcagaga

SEQ ID NO: 44551 - RNA, 22 nt, Homo sapiens
acuauacugaagcaaauuaaca

SEQ ID NO: 44552 - RNA, 21 nt, Homo sapiens
acugauguuugaaauucgcug

SEQ ID NO: 44553 - RNA, 23 nt, Homo sapiens
acugcaauuacguuugcaccaac

SEQ ID NO: 44554 - RNA, 22 nt, Homo sapiens
acugcacuccaaccuuggugac

SEQ ID NO: 44555 - RNA, 22 nt, Homo sapiens
acugcacuccagccucggcaau

SEQ ID NO: 44556 - RNA, 22 nt, Homo sapiens
acugcacuccagccucggggac

SEQ ID NO: 44557 - RNA, 22 nt, Homo sapiens
acugcacuccagccucggugac

SEQ ID NO: 44558 - RNA, 22 nt, Homo sapiens
acugcacuccagccuuagugac

SEQ ID NO: 44559 - RNA, 22 nt, Homo sapiens
acugcacuccagccuucaggac

SEQ ID NO: 44560 - RNA, 22 nt, Homo sapiens
acugcacuccagcuccagggug

SEQ ID NO: 44561 - RNA, 22 nt, Homo sapiens
acugcacuccaucuuagguggc

SEQ ID NO: 44562 - RNA, 22 nt, Homo sapiens
acugcacuccggccucgugaca

SEQ ID NO: 44563 - RNA, 22 nt, Homo sapiens
acuggacuuaaugaugaauugu

SEQ ID NO: 44564 - RNA, 22 nt, Homo sapiens
acuguacuacagccugggugac

SEQ ID NO: 44565 - RNA, 22 nt, Homo sapiens
acuguacuccagccugggugac

SEQ ID NO: 44566 - RNA, 17 nt, Homo sapiens
acuuuuugaggaggcau

SEQ ID NO: 44567 - RNA, 20 nt, Homo sapiens
acuuuuugaugaggucguuu

SEQ ID NO: 44568 - RNA, 22 nt, Homo sapiens
agaaacauucucuugccuccuu

SEQ ID NO: 44569 - RNA, 22 nt, Homo sapiens
agaauguauauucuguaguugu

SEQ ID NO: 44570 - RNA, 22 nt, Homo sapiens
agacagcugguagcacuuccug

SEQ ID NO: 44571 - RNA, 22 nt, Homo sapiens
agagaacugauuggaugugggc

SEQ ID NO: 44572 - RNA, 22 nt, Homo sapiens
agagacauugcuccaacucacc

SEQ ID NO: 44573 - RNA, 22 nt, Homo sapiens
agagguagaagauaggcuacag

SEQ ID NO: 44574 - RNA, 22 nt, Homo sapiens
agagguuuuggggcugagagcu

SEQ ID NO: 44575 - RNA, 20 nt, Homo sapiens
agagugcugucuguccugag

SEQ ID NO: 44576 - RNA, 22 nt, Homo sapiens
agaucauaugcaguaaugaacu

SEQ ID NO: 44577 - RNA, 22 nt, Homo sapiens
agaugccuaugaagagaaauua

SEQ ID NO: 44578 - RNA, 22 nt, Homo sapiens
agauggugauaaaugugguacc

SEQ ID NO: 44579 - RNA, 22 nt, Homo sapiens
agauggugugcuaggaaaugua

SEQ ID NO: 44580 - RNA, 22 nt, Homo sapiens
agcacagugaaugguuuacuca

SEQ ID NO: 44581 - RNA, 22 nt, Homo sapiens
agcaccauuucucuaaagcacu

SEQ ID NO: 44582 - RNA, 21 nt, Homo sapiens
agcagaguggcagcucuuuug

SEQ ID NO: 44583 - RNA, 22 nt, Homo sapiens
agcagcaugcaaauggacuaau

SEQ ID NO: 44584 - RNA, 22 nt, Homo sapiens
agcagcucaugccuuugggagg

SEQ ID NO: 44585 - RNA, 21 nt, Homo sapiens
agcagcuuugguugaagcaga

SEQ ID NO: 44586 - RNA, 20 nt, Homo sapiens
agcaucagugguaguguugc

SEQ ID NO: 44587 - RNA, 22 nt, Homo sapiens
agcaucauuugauguucccgag

SEQ ID NO: 44588 - RNA, 20 nt, Homo sapiens
agccccauguaaaccacaug

SEQ ID NO: 44589 - RNA, 17 nt, Homo sapiens
agccccauuagcuaguu

SEQ ID NO: 44590 - RNA, 22 nt, Homo sapiens
agccccauuuguugaaaagacg

SEQ ID NO: 44591 - RNA, 22 nt, Homo sapiens
agcccuuagauggcuccuucca

SEQ ID NO: 44592 - RNA, 23 nt, Homo sapiens
agccugguuucccugcuucuccc

SEQ ID NO: 44593 - RNA, 22 nt, Homo sapiens
agcgccacugcacuccagccug

SEQ ID NO: 44594 - RNA, 22 nt, Homo sapiens
agcuguguugucugaagucaga

SEQ ID NO: 44595 - RNA, 22 nt, Homo sapiens
agcuguuguacacuuuaccuuu

SEQ ID NO: 44596 - RNA, 22 nt, Homo sapiens
agcuucauuguuaugaauguca

SEQ ID NO: 44597 - RNA, 22 nt, Homo sapiens
agcuuguuuuauagaaagucaa

SEQ ID NO: 44598 - RNA, 22 nt, Homo sapiens
aggaaguaauaaguuugguucu

SEQ ID NO: 44599 - RNA, 22 nt, Homo sapiens
aggagaucagccucccugcaac

SEQ ID NO: 44600 - RNA, 20 nt, Homo sapiens
aggagcauuuacauuggcuc

SEQ ID NO: 44601 - RNA, 22 nt, Homo sapiens
aggcacggugucucaugccugu

SEQ ID NO: 44602 - RNA, 22 nt, Homo sapiens
aggcaugugugcagacugucug

SEQ ID NO: 44603 - RNA, 23 nt, Homo sapiens
aggccaguuuuuccugcuugcug

SEQ ID NO: 44604 - RNA, 22 nt, Homo sapiens
aggcugguauuuacaaaagcuc

SEQ ID NO: 44605 - RNA, 22 nt, Homo sapiens
agggagcaaaguggucuuucuc

SEQ ID NO: 44606 - RNA, 22 nt, Homo sapiens
agguccacuuacuacuccuguu

SEQ ID NO: 44607 - RNA, 22 nt, Homo sapiens
aggugaauggauaaacuguggg

SEQ ID NO: 44608 - RNA, 22 nt, Homo sapiens
aggugguuuuaggcagagacau

SEQ ID NO: 44609 - RNA, 22 nt, Homo sapiens
agguuaacaucuauuuuggaug

SEQ ID NO: 44610 - RNA, 22 nt, Homo sapiens
agucacagguucuugggauuag

SEQ ID NO: 44611 - RNA, 22 nt, Homo sapiens
agucaugggagagaugugaucg

SEQ ID NO: 44612 - RNA, 17 nt, Homo sapiens
agugagaucauggcuua

SEQ ID NO: 44613 - RNA, 22 nt, Homo sapiens
agugagcuggagaaaagaaacu

SEQ ID NO: 44614 - RNA, 22 nt, Homo sapiens
agugcaaagccgagguuucuug

SEQ ID NO: 44615 - RNA, 22 nt, Homo sapiens
agugccaaaucgagggcucuga

SEQ ID NO: 44616 - RNA, 22 nt, Homo sapiens
aguggcaaugugauguccugaa

SEQ ID NO: 44617 - RNA, 22 nt, Homo sapiens
agugguuuuaaguagagcauac

SEQ ID NO: 44618 - RNA, 22 nt, Homo sapiens
auaaaguguuuaguauaggcaa

SEQ ID NO: 44619 - RNA, 22 nt, Homo sapiens
auaaaugccuguuguuuuaagc

SEQ ID NO: 44620 - RNA, 22 nt, Homo sapiens
auaaaugcuuagaucuguauau

SEQ ID NO: 44621 - RNA, 22 nt, Homo sapiens
auaacagcugcaaggcaaaagc

SEQ ID NO: 44622 - RNA, 22 nt, Homo sapiens
auaagugagugauucaguguua

SEQ ID NO: 44623 - RNA, 22 nt, Homo sapiens
auaagugcuuguugaauaauag

SEQ ID NO: 44624 - RNA, 22 nt, Homo sapiens
auacacgugccauguugguaug

SEQ ID NO: 44625 - RNA, 22 nt, Homo sapiens
auacaugugccauggugguuug

SEQ ID NO: 44626 - RNA, 22 nt, Homo sapiens
auacauguucaagggcauauau

SEQ ID NO: 44627 - RNA, 22 nt, Homo sapiens
auacuguuuuacaucauugccu

SEQ ID NO: 44628 - RNA, 22 nt, Homo sapiens
auagcacauggcauccucucuu

SEQ ID NO: 44629 - RNA, 22 nt, Homo sapiens
auagcagaacagugucucacug

SEQ ID NO: 44630 - RNA, 22 nt, Homo sapiens
auagugcagugaugaaccuagg

SEQ ID NO: 44631 - RNA, 22 nt, Homo sapiens
auagugcuauggcagaccuuga

SEQ ID NO: 44632 - RNA, 22 nt, Homo sapiens
auaucaacaugguaggguuggu

SEQ ID NO: 44633 - RNA, 22 nt, Homo sapiens
auaucaagugacuggaguucca

SEQ ID NO: 44634 - RNA, 22 nt, Homo sapiens
auaucacaaacaagucuguacu

SEQ ID NO: 44635 - RNA, 22 nt, Homo sapiens
auaucccagugaugauugauag

SEQ ID NO: 44636 - RNA, 22 nt, Homo sapiens
auaugcacgugcauacacacuu

SEQ ID NO: 44637 - RNA, 20 nt, Homo sapiens
auaugcauguguuuucacuu

SEQ ID NO: 44638 - RNA, 22 nt, Homo sapiens
auaugcuaauuuuuagucgagc

SEQ ID NO: 44639 - RNA, 22 nt, Homo sapiens
auaugcuuauuagcaagaaaua

SEQ ID NO: 44640 - RNA, 22 nt, Homo sapiens
auauguauuuuaacguguaagg

SEQ ID NO: 44641 - RNA, 22 nt, Homo sapiens
auauugacuuucucuuagauca

SEQ ID NO: 44642 - RNA, 22 nt, Homo sapiens
aucacugggauggaacugcuga

SEQ ID NO: 44643 - RNA, 22 nt, Homo sapiens
aucagaaucucuagaggacugu

SEQ ID NO: 44644 - RNA, 22 nt, Homo sapiens
aucagugagugguuagugaaug

SEQ ID NO: 44645 - RNA, 22 nt, Homo sapiens
aucaucacaguuguguguaaug

SEQ ID NO: 44646 - RNA, 22 nt, Homo sapiens
aucaugucuucccagugauucu

SEQ ID NO: 44647 - RNA, 22 nt, Homo sapiens
auccacagugucaauguuguga

SEQ ID NO: 44648 - RNA, 22 nt, Homo sapiens
auccauugcucaagagaaguca

SEQ ID NO: 44649 - RNA, 22 nt, Homo sapiens
aucccaguaaaaauggcuucua

SEQ ID NO: 44650 - RNA, 22 nt, Homo sapiens
auccccuugcagugaccggggc

SEQ ID NO: 44651 - RNA, 22 nt, Homo sapiens
aucccuguguccagcaccugug

SEQ ID NO: 44652 - RNA, 22 nt, Homo sapiens
auccuugagaaaauaaaugacc

SEQ ID NO: 44653 - RNA, 22 nt, Homo sapiens
aucucauggagguagagaguaa

SEQ ID NO: 44654 - RNA, 22 nt, Homo sapiens
aucuccaggugccagcugcgcc

SEQ ID NO: 44655 - RNA, 22 nt, Homo sapiens
aucugguguauuggugcugggu

SEQ ID NO: 44656 - RNA, 22 nt, Homo sapiens
aucuguguuuaaggucccagaa

SEQ ID NO: 44657 - RNA, 22 nt, Homo sapiens
aucuugcauuugcuaaaaugca

SEQ ID NO: 44658 - RNA, 22 nt, Homo sapiens
aucuuguguugaauggugcaga

SEQ ID NO: 44659 - RNA, 23 nt, Homo sapiens
augaaagcccuugcaaaugcugg

SEQ ID NO: 44660 - RNA, 22 nt, Homo sapiens
augaaagguauguuuucuguga

SEQ ID NO: 44661 - RNA, 22 nt, Homo sapiens
augaaagugauaaaugucucua

SEQ ID NO: 44662 - RNA, 23 nt, Homo sapiens
augaacucaucauuuuuuauggc

SEQ ID NO: 44663 - RNA, 22 nt, Homo sapiens
augaaguauuaggacacauuua

SEQ ID NO: 44664 - RNA, 22 nt, Homo sapiens
augacaguaugacuccaaaagu

SEQ ID NO: 44665 - RNA, 22 nt, Homo sapiens
augacagugagugagcucucac

SEQ ID NO: 44666 - RNA, 22 nt, Homo sapiens
augaccuuggggaaccaugucu

SEQ ID NO: 44667 - RNA, 22 nt, Homo sapiens
augacuagaggagggauggcca

SEQ ID NO: 44668 - RNA, 22 nt, Homo sapiens
augacuauugcacuuuccuggu

SEQ ID NO: 44669 - RNA, 22 nt, Homo sapiens
augacuggaacagcaauuuaca

SEQ ID NO: 44670 - RNA, 22 nt, Homo sapiens
augacuggauaauggacacaca

SEQ ID NO: 44671 - RNA, 22 nt, Homo sapiens
augagacuagaagagaauaaua

SEQ ID NO: 44672 - RNA, 22 nt, Homo sapiens
augagacuguucuuccucauug

SEQ ID NO: 44673 - RNA, 22 nt, Homo sapiens
augagagcugacuuuaaggcaa

SEQ ID NO: 44674 - RNA, 22 nt, Homo sapiens
augagauucuuagagaagucug

SEQ ID NO: 44675 - RNA, 19 nt, Homo sapiens
augagcaauaguuuuaauc

SEQ ID NO: 44676 - RNA, 22 nt, Homo sapiens
augaguauguucuguauuuuca

SEQ ID NO: 44677 - RNA, 22 nt, Homo sapiens
augauacugaguugaguucuca

SEQ ID NO: 44678 - RNA, 22 nt, Homo sapiens
augaucuguuuggugaucuugu

SEQ ID NO: 44679 - RNA, 19 nt, Homo sapiens
augcaaugucacaggcugc

SEQ ID NO: 44680 - RNA, 22 nt, Homo sapiens
augcacuuggcaggaugauucc

SEQ ID NO: 44681 - RNA, 22 nt, Homo sapiens
augcagaucacauuuuucuguc

SEQ ID NO: 44682 - RNA, 22 nt, Homo sapiens
augcagcugaggguaguggagc

SEQ ID NO: 44683 - RNA, 22 nt, Homo sapiens
augcagugugcaacagauuaag

SEQ ID NO: 44684 - RNA, 19 nt, Homo sapiens
augccacagugaggucaga

SEQ ID NO: 44685 - RNA, 22 nt, Homo sapiens
augccacugcacuccaaccugg

SEQ ID NO: 44686 - RNA, 22 nt, Homo sapiens
augccacugcacuucagccugg

SEQ ID NO: 44687 - RNA, 22 nt, Homo sapiens
augccuaagacccuguggggga

SEQ ID NO: 44688 - RNA, 22 nt, Homo sapiens
augccucugacaauuggauucu

SEQ ID NO: 44689 - RNA, 22 nt, Homo sapiens
augcuacugauaagcaaucauu

SEQ ID NO: 44690 - RNA, 22 nt, Homo sapiens
augcuguuuuguagcucccucu

SEQ ID NO: 44691 - RNA, 22 nt, Homo sapiens
auggaacuggagaugguuauau

SEQ ID NO: 44692 - RNA, 22 nt, Homo sapiens
auggaagaaaguuggguucuug

SEQ ID NO: 44693 - RNA, 22 nt, Homo sapiens
auggaagaauugucggggaugu

SEQ ID NO: 44694 - RNA, 22 nt, Homo sapiens
auggaaugguugggucauaagg

SEQ ID NO: 44695 - RNA, 22 nt, Homo sapiens
auggaauguaaguuauguuugc

SEQ ID NO: 44696 - RNA, 22 nt, Homo sapiens
auggaguguggaacugggaauc

SEQ ID NO: 44697 - RNA, 22 nt, Homo sapiens
auggauuuguaguacaugguug

SEQ ID NO: 44698 - RNA, 22 nt, Homo sapiens
auggauuuuaggauacaguuga

SEQ ID NO: 44699 - RNA, 22 nt, Homo sapiens
auggcaaaauguuccuaguggu

SEQ ID NO: 44700 - RNA, 22 nt, Homo sapiens
auggcagcaccccacucuacug

SEQ ID NO: 44701 - RNA, 22 nt, Homo sapiens
auggcagcccucuuuauccaug

SEQ ID NO: 44702 - RNA, 20 nt, Homo sapiens
auggcccugcugggaguguc

SEQ ID NO: 44703 - RNA, 22 nt, Homo sapiens
auggcccugggaaaggaggcau

SEQ ID NO: 44704 - RNA, 22 nt, Homo sapiens
auggcccuguguggagcugcug

SEQ ID NO: 44705 - RNA, 22 nt, Homo sapiens
auggcuauuccauaggcagagc

SEQ ID NO: 44706 - RNA, 22 nt, Homo sapiens
auggcucaguguguaucuauca

SEQ ID NO: 44707 - RNA, 22 nt, Homo sapiens
auggcucuuauuauuuugaggu

SEQ ID NO: 44708 - RNA, 22 nt, Homo sapiens
auggcuuuuccugucuugcaug

SEQ ID NO: 44709 - RNA, 22 nt, Homo sapiens
auggcuuuugaccugguaggau

SEQ ID NO: 44710 - RNA, 21 nt, Homo sapiens
augggguagaagagaaggcuu

SEQ ID NO: 44711 - RNA, 22 nt, Homo sapiens
auggucccuguuccaugcuccu

SEQ ID NO: 44712 - RNA, 22 nt, Homo sapiens
augguuuauuuguaagcagagu

SEQ ID NO: 44713 - RNA, 22 nt, Homo sapiens
augugacagugguuuuaagcgu

SEQ ID NO: 44714 - RNA, 22 nt, Homo sapiens
augugacugauguaaucagaca

SEQ ID NO: 44715 - RNA, 22 nt, Homo sapiens
augugaugguuaauuuuaugug

SEQ ID NO: 44716 - RNA, 22 nt, Homo sapiens
augugcaacugcuggaacaguc

SEQ ID NO: 44717 - RNA, 22 nt, Homo sapiens
augugcaagaucauuaaagcuc

SEQ ID NO: 44718 - RNA, 22 nt, Homo sapiens
augugcacaugcuuacauguga

SEQ ID NO: 44719 - RNA, 22 nt, Homo sapiens
augugcauaugaagcacagaca

SEQ ID NO: 44720 - RNA, 22 nt, Homo sapiens
augugcaugcuguucugccaga

SEQ ID NO: 44721 - RNA, 23 nt, Homo sapiens
augugguuuuagguguugaacug

SEQ ID NO: 44722 - RNA, 22 nt, Homo sapiens
auguuagcaucaauauucauca

SEQ ID NO: 44723 - RNA, 22 nt, Homo sapiens
auguuuagagagggugucaaau

SEQ ID NO: 44724 - RNA, 22 nt, Homo sapiens
auuaacaucuagaguuuuggug

SEQ ID NO: 44725 - RNA, 22 nt, Homo sapiens
auuaagugcuugcagaagucca

SEQ ID NO: 44726 - RNA, 22 nt, Homo sapiens
auuacaugucuauccaugaaca

SEQ ID NO: 44727 - RNA, 22 nt, Homo sapiens
auucaaagugcauguucccacu

SEQ ID NO: 44728 - RNA, 23 nt, Homo sapiens
auucaaguagugagagugguuau

SEQ ID NO: 44729 - RNA, 22 nt, Homo sapiens
auucacuguggcuuucucugau

SEQ ID NO: 44730 - RNA, 22 nt, Homo sapiens
auuccacagccgauaccaugac

SEQ ID NO: 44731 - RNA, 22 nt, Homo sapiens
auuccauagugucuguggcaga

SEQ ID NO: 44732 - RNA, 22 nt, Homo sapiens
auugaacaugccauauguacca

SEQ ID NO: 44733 - RNA, 22 nt, Homo sapiens
cacauguuuuagcauggcuguu

SEQ ID NO: 44734 - RNA, 19 nt, Homo sapiens
caccagugcaugcuacuau

SEQ ID NO: 44735 - RNA, 22 nt, Homo sapiens
caccgagguuggagugcagugg

SEQ ID NO: 44736 - RNA, 22 nt, Homo sapiens
caccuagacuggagugcagugg

SEQ ID NO: 44737 - RNA, 22 nt, Homo sapiens
aucacauuuauaguggcacgca

SEQ ID NO: 44738 - RNA, 19 nt, Homo sapiens
aucaccauuauuuggaaca

SEQ ID NO: 44739 - RNA, 22 nt, Homo sapiens
aucaccuggaggugaucacuug

SEQ ID NO: 44740 - RNA, 22 nt, Homo sapiens
aucacuguccacucaucuuucu

SEQ ID NO: 44741 - RNA, 22 nt, Homo sapiens
aucacuuugcucuccagugugg

SEQ ID NO: 44742 - RNA, 22 nt, Homo sapiens
aucagauuccagaggcagcacc

SEQ ID NO: 44743 - RNA, 22 nt, Homo sapiens
aucagcagcaugaaaagcaacu

SEQ ID NO: 44744 - RNA, 22 nt, Homo sapiens
aucauacuguuuugauuacugu

SEQ ID NO: 44745 - RNA, 22 nt, Homo sapiens
aucauggaguauuugcaagucu

SEQ ID NO: 44746 - RNA, 22 nt, Homo sapiens
ugcauuguggaucuaaaugcau

SEQ ID NO: 44747 - RNA, 22 nt, Homo sapiens
ugccaucauuaauauuaggcau

SEQ ID NO: 44748 - RNA, 23 nt, Homo sapiens
ugcuauguaagcauuuauuaaau

SEQ ID NO: 44749 - RNA, 22 nt, Homo sapiens
ugcuaugucagccaggcugguc

SEQ ID NO: 44750 - RNA, 22 nt, Homo sapiens
ugcuggcguuacucuccaucag

SEQ ID NO: 44751 - RNA, 22 nt, Homo sapiens
ugcuggugauucagauucaaau

SEQ ID NO: 44752 - RNA, 22 nt, Homo sapiens
uggaagugaacaaccaaggcag

SEQ ID NO: 44753 - RNA, 22 nt, Homo sapiens
uggaaguuaaauuaguugauga

SEQ ID NO: 44754 - RNA, 22 nt, Homo sapiens
uggaauguaacuugaaacuuuu

SEQ ID NO: 44755 - RNA, 22 nt, Homo sapiens
uggacagagagaccggcauuuu

SEQ ID NO: 44756 - RNA, 22 nt, Homo sapiens
uggacugagauuucagcugcca

SEQ ID NO: 44757 - RNA, 22 nt, Homo sapiens
uggagacugaucccucuuuccu

SEQ ID NO: 44758 - RNA, 22 nt, Homo sapiens
uggagagcaaagaauuuguuag

SEQ ID NO: 44759 - RNA, 19 nt, Homo sapiens
uggagucaucaugcugcua

SEQ ID NO: 44760 - RNA, 22 nt, Homo sapiens
uggagugucaguuuccagaguu

SEQ ID NO: 44761 - RNA, 22 nt, Homo sapiens
uggaugacuguuauaugcauau

SEQ ID NO: 44762 - RNA, 22 nt, Homo sapiens
uggcaagcuuuaauugacucuu

SEQ ID NO: 44763 - RNA, 22 nt, Homo sapiens
uggcaauauccacaauuacuuu

SEQ ID NO: 44764 - RNA, 22 nt, Homo sapiens
uggcagauaggauacaggacua

SEQ ID NO: 44765 - RNA, 22 nt, Homo sapiens
uggcagcgugaaagacuuuuuc

SEQ ID NO: 44766 - RNA, 22 nt, Homo sapiens
uggcauauaaagauguguucaa

SEQ ID NO: 44767 - RNA, 19 nt, Homo sapiens
uggcaugaaugugaacuaa

SEQ ID NO: 44768 - RNA, 22 nt, Homo sapiens
uggcauggaguggauggcccca

SEQ ID NO: 44769 - RNA, 22 nt, Homo sapiens
uggcauggggcagaacauuaca

SEQ ID NO: 44770 - RNA, 22 nt, Homo sapiens
uggccaagagcacagauauugg

SEQ ID NO: 44771 - RNA, 23 nt, Homo sapiens
uggccaagauaaucucaguuuuc

SEQ ID NO: 44772 - RNA, 22 nt, Homo sapiens
uggccuuuuccaagaacuacua

SEQ ID NO: 44773 - RNA, 22 nt, Homo sapiens
uggcucauuucuaaacccagcu

SEQ ID NO: 44774 - RNA, 22 nt, Homo sapiens
uggcuugauggcacaagguuuc

SEQ ID NO: 44775 - RNA, 22 nt, Homo sapiens
ugggcaaaacuaagagcugugg

SEQ ID NO: 44776 - RNA, 22 nt, Homo sapiens
ugggcggagacgugcagccgcc

SEQ ID NO: 44777 - RNA, 22 nt, Homo sapiens
ugggguaggcuguauacucugu

SEQ ID NO: 44778 - RNA, 22 nt, Homo sapiens
uggguaggaccagaaaugcacu

SEQ ID NO: 44779 - RNA, 22 nt, Homo sapiens
ugguaagaucagaacuggaguc

SEQ ID NO: 44780 - RNA, 22 nt, Homo sapiens
uggucguggagucccuggcuuc

SEQ ID NO: 44781 - RNA, 22 nt, Homo sapiens
uggucuucuggccuccagaacc

SEQ ID NO: 44782 - RNA, 22 nt, Homo sapiens
uggugagaaaagaugucuuugu

SEQ ID NO: 44783 - RNA, 22 nt, Homo sapiens
uggugcaaugaagugaucucaa

SEQ ID NO: 44784 - RNA, 22 nt, Homo sapiens
uggugcccuguccuucuguggc

SEQ ID NO: 44785 - RNA, 20 nt, Homo sapiens
uggugguuuuaugugguuua

SEQ ID NO: 44786 - RNA, 22 nt, Homo sapiens
uguagauaucuaucaggucaau

SEQ ID NO: 44787 - RNA, 21 nt, Homo sapiens
uguagcagcauaauuuauaau

SEQ ID NO: 44788 - RNA, 21 nt, Homo sapiens
uguagcagcaugauucauagu

SEQ ID NO: 44789 - RNA, 21 nt, Homo sapiens
uguagcagcaugauuuauaau

SEQ ID NO: 44790 - RNA, 22 nt, Homo sapiens
uguauaguugagucaaguuuca

SEQ ID NO: 44791 - RNA, 22 nt, Homo sapiens
uguauguuuaaggccaguggaa

SEQ ID NO: 44792 - RNA, 16 nt, Homo sapiens
uguauugcuaaaaaga

SEQ ID NO: 44793 - RNA, 22 nt, Homo sapiens
ugucaaagagacaucugcacuc

SEQ ID NO: 44794 - RNA, 22 nt, Homo sapiens
ugucaagaugguuugauguugu

SEQ ID NO: 44795 - RNA, 22 nt, Homo sapiens
ugucacccuuuauccauuuccu

SEQ ID NO: 44796 - RNA, 22 nt, Homo sapiens
ugucauagauugcuuggaaaaa

SEQ ID NO: 44797 - RNA, 22 nt, Homo sapiens
ugucauguugguguacugcacc

SEQ ID NO: 44798 - RNA, 22 nt, Homo sapiens
ugucuguuugcgaaauugcuuc

SEQ ID NO: 44799 - RNA, 22 nt, Homo sapiens
ugugacucuggcacauggugag

SEQ ID NO: 44800 - RNA, 19 nt, Homo sapiens
ugugacugguugucucgcu

SEQ ID NO: 44801 - RNA, 19 nt, Homo sapiens
ugugauaguugaaccugcc

SEQ ID NO: 44802 - RNA, 17 nt, Homo sapiens
ugugauugaagucaucc

SEQ ID NO: 44803 - RNA, 22 nt, Homo sapiens
ugugcaaauguuaaacuaacuu

SEQ ID NO: 44804 - RNA, 22 nt, Homo sapiens
ugugcaguuuuagcguauuuua

SEQ ID NO: 44805 - RNA, 22 nt, Homo sapiens
ugugcaguuuugagugaauuuc

SEQ ID NO: 44806 - RNA, 22 nt, Homo sapiens
ugugcuugaauuuaguagcuua

SEQ ID NO: 44807 - RNA, 22 nt, Homo sapiens
uguggcaaagucuugugaauau

SEQ ID NO: 44808 - RNA, 22 nt, Homo sapiens
uguggcaaauggucaggaagaa

SEQ ID NO: 44809 - RNA, 22 nt, Homo sapiens
ugugguuuuauaaacgugaccu

SEQ ID NO: 44810 - RNA, 22 nt, Homo sapiens
ugugguuuuucacauuuagaga

SEQ ID NO: 44811 - RNA, 22 nt, Homo sapiens
ugugucuugcuggugccugcau

SEQ ID NO: 44812 - RNA, 22 nt, Homo sapiens
uguguuuuuauguaaaauggaa

SEQ ID NO: 44813 - RNA, 22 nt, Homo sapiens
uguuacacugugcacuaaauuu

SEQ ID NO: 44814 - RNA, 22 nt, Homo sapiens
uguuauguauggagugauccca

SEQ ID NO: 44815 - RNA, 19 nt, Homo sapiens
uguugcacauaucaauaug

SEQ ID NO: 44816 - RNA, 18 nt, Homo sapiens
uguugguguucacucacu

SEQ ID NO: 44817 - RNA, 22 nt, Homo sapiens
uuaaaugcuagaauuuucuuug

SEQ ID NO: 44818 - RNA, 22 nt, Homo sapiens
uuaagugaauuaucuaacaugu

SEQ ID NO: 44819 - RNA, 22 nt, Homo sapiens
uuaaugaacuuuauuuuguaga

SEQ ID NO: 44820 - RNA, 22 nt, Homo sapiens
uuaauggagaguuucauuggug

SEQ ID NO: 44821 - RNA, 22 nt, Homo sapiens
uuacccuuuaacccuuuaaagu

SEQ ID NO: 44822 - RNA, 19 nt, Homo sapiens
uuagagaucaucugcuuca

SEQ ID NO: 44823 - RNA, 22 nt, Homo sapiens
uuagaugguucaccaugaguag

SEQ ID NO: 44824 - RNA, 22 nt, Homo sapiens
uuagcagcacaaaagcagacua

SEQ ID NO: 44825 - RNA, 22 nt, Homo sapiens
uuagcagcaccccacucuacug

SEQ ID NO: 44826 - RNA, 20 nt, Homo sapiens
uuagcagcaugauuuauaau

SEQ ID NO: 44827 - RNA, 22 nt, Homo sapiens
uuagcagccuucaagcuccaag

SEQ ID NO: 44828 - RNA, 22 nt, Homo sapiens
uuagggaguaaucuaaaaaugg

SEQ ID NO: 44829 - RNA, 22 nt, Homo sapiens
uuaguagcacagaguaucagca

SEQ ID NO: 44830 - RNA, 20 nt, Homo sapiens
uuaguucauuuagaagguuu

SEQ ID NO: 44831 - RNA, 20 nt, Homo sapiens
guucauguaauuaguucagg

SEQ ID NO: 44832 - RNA, 17 nt, Homo sapiens
guuuggguacuggguaa

SEQ ID NO: 44833 - RNA, 21 nt, Homo sapiens
uaaagcuagaaccuuagcuuu

SEQ ID NO: 44834 - RNA, 22 nt, Homo sapiens
uaaaguguuuguuauuaaaggu

SEQ ID NO: 44835 - RNA, 22 nt, Homo sapiens
uaacagcauuugugucuaguag

SEQ ID NO: 44836 - RNA, 22 nt, Homo sapiens
uaagacugccccagacagcaag

SEQ ID NO: 44837 - RNA, 22 nt, Homo sapiens
uaagguuacaaaggacuucaua

SEQ ID NO: 44838 - RNA, 22 nt, Homo sapiens
uaauauguuuugaaaucaggaa

SEQ ID NO: 44839 - RNA, 22 nt, Homo sapiens
uaaucucagcuacucaggaggc

SEQ ID NO: 44840 - RNA, 22 nt, Homo sapiens
uacaggcaccuggcuaauuuuu

SEQ ID NO: 44841 - RNA, 22 nt, Homo sapiens
uacauguauguguuuauggcug

SEQ ID NO: 44842 - RNA, 22 nt, Homo sapiens
uaccuguagacuacagcuucag

SEQ ID NO: 44843 - RNA, 22 nt, Homo sapiens
uacucugcagagaugcauaaca

SEQ ID NO: 44844 - RNA, 22 nt, Homo sapiens
uacucugcagccauaaaacaga

SEQ ID NO: 44845 - RNA, 21 nt, Homo sapiens
uacuggagauacagucugcaa

SEQ ID NO: 44846 - RNA, 22 nt, Homo sapiens
uacuucauucuugaccuugcau

SEQ ID NO: 44847 - RNA, 22 nt, Homo sapiens
uacuuuguuauagcagcaggaa

SEQ ID NO: 44848 - RNA, 22 nt, Homo sapiens
uagaucuuuaaaaggugcuaga

SEQ ID NO: 44849 - RNA, 22 nt, Homo sapiens
uagaugauucacuuuacuucca

SEQ ID NO: 44850 - RNA, 22 nt, Homo sapiens
uagauuaucccugauuugucca

SEQ ID NO: 44851 - RNA, 22 nt, Homo sapiens
uagcaguuguuguuacuuguau

SEQ ID NO: 44852 - RNA, 17 nt, Homo sapiens
uagcuucacauuaggaa

SEQ ID NO: 44853 - RNA, 22 nt, Homo sapiens
uaggcaauggagauagaggaug

SEQ ID NO: 44854 - RNA, 22 nt, Homo sapiens
uaggcaauguggcgaaacucug

SEQ ID NO: 44855 - RNA, 22 nt, Homo sapiens
uagugcccuuauaagagcagga

SEQ ID NO: 44856 - RNA, 20 nt, Homo sapiens
uaguggaaaucagguccucu

SEQ ID NO: 44857 - RNA, 22 nt, Homo sapiens
uauaguguuuucaaaaguaugu

SEQ ID NO: 44858 - RNA, 22 nt, Homo sapiens
uaucacuuugauaguuuaaaug

SEQ ID NO: 44859 - RNA, 22 nt, Homo sapiens
uaugcacaugcaugcuugaaua

SEQ ID NO: 44860 - RNA, 22 nt, Homo sapiens
uauugcuugaggaaaugguaau

SEQ ID NO: 44861 - RNA, 23 nt, Homo sapiens
ucacaguggcugcuuaauuguga

SEQ ID NO: 44862 - RNA, 22 nt, Homo sapiens
ucacaguugauugaaacacagc

SEQ ID NO: 44863 - RNA, 22 nt, Homo sapiens
ucacuggccaaauucuggguga

SEQ ID NO: 44864 - RNA, 22 nt, Homo sapiens
ucagcacauucaaggccugccu

SEQ ID NO: 44865 - RNA, 22 nt, Homo sapiens
ucagcagucacuccuaugacaa

SEQ ID NO: 44866 - RNA, 22 nt, Homo sapiens
ucagguaaucuauuugucuuuu

SEQ ID NO: 44867 - RNA, 22 nt, Homo sapiens
ucagugucaucuggguuguuug

SEQ ID NO: 44868 - RNA, 22 nt, Homo sapiens
ucaguguuuggaaucucaauuu

SEQ ID NO: 44869 - RNA, 19 nt, Homo sapiens
ucauagucuaagaugagaa

SEQ ID NO: 44870 - RNA, 20 nt, Homo sapiens
ucaucaguuggugcucgcug

SEQ ID NO: 44871 - RNA, 22 nt, Homo sapiens
ucaucuggcgaaugugaagagu

SEQ ID NO: 44872 - RNA, 22 nt, Homo sapiens
ucauucacucccuugaaguuag

SEQ ID NO: 44873 - RNA, 22 nt, Homo sapiens
uccacagugguugaacuaguuu

SEQ ID NO: 44874 - RNA, 22 nt, Homo sapiens
uccaguggacagacauaccaug

SEQ ID NO: 44875 - RNA, 22 nt, Homo sapiens
uccauagacauuuuaagguagu

SEQ ID NO: 44876 - RNA, 22 nt, Homo sapiens
uccaugaguccauuagaaaaaa

SEQ ID NO: 44877 - RNA, 22 nt, Homo sapiens
ucccugacagucacagagcuac

SEQ ID NO: 44878 - RNA, 22 nt, Homo sapiens
uccucauggagaaccucugcua

SEQ ID NO: 44879 - RNA, 17 nt, Homo sapiens
ucuaauaauaugcauuu

SEQ ID NO: 44880 - RNA, 22 nt, Homo sapiens
ucucagugaaauaaauuauuuu

SEQ ID NO: 44881 - RNA, 22 nt, Homo sapiens
ucucagugacugcugggucccc

SEQ ID NO: 44882 - RNA, 22 nt, Homo sapiens
ucucaguggcacccccaacacc

SEQ ID NO: 44883 - RNA, 21 nt, Homo sapiens
cugcauccauuucugagugau

SEQ ID NO: 44884 - RNA, 22 nt, Homo sapiens
cugcauuugaugacguauggug

SEQ ID NO: 44885 - RNA, 22 nt, Homo sapiens
cuggaauucaaaaucugaauuu

SEQ ID NO: 44886 - RNA, 20 nt, Homo sapiens
cuggaugucgaggcagaggu

SEQ ID NO: 44887 - RNA, 22 nt, Homo sapiens
cuggcuaagugcuugagugugc

SEQ ID NO: 44888 - RNA, 22 nt, Homo sapiens
cuggcucugggcuaaagaaaua

SEQ ID NO: 44889 - RNA, 22 nt, Homo sapiens
cuguacucaucccauaugcacu

SEQ ID NO: 44890 - RNA, 22 nt, Homo sapiens
cugucucagugaauugguuuua

SEQ ID NO: 44891 - RNA, 22 nt, Homo sapiens
cuguugguuaaauuccaugcag

SEQ ID NO: 44892 - RNA, 22 nt, Homo sapiens
cuguuugguuaucuuuuccugu

SEQ ID NO: 44893 - RNA, 18 nt, Homo sapiens
cuuaacauugggaugaua

SEQ ID NO: 44894 - RNA, 22 nt, Homo sapiens
cuucaaguaauucugauggcua

SEQ ID NO: 44895 - RNA, 22 nt, Homo sapiens
cuucacuuuguuaaacuccaau

SEQ ID NO: 44896 - RNA, 22 nt, Homo sapiens
cuugauagugguaaucauuuuu

SEQ ID NO: 44897 - RNA, 22 nt, Homo sapiens
cuugggcagugugcauguguau

SEQ ID NO: 44898 - RNA, 22 nt, Homo sapiens
cuuuggcauuagccuguauaga

SEQ ID NO: 44899 - RNA, 22 nt, Homo sapiens
cuuuguggggucuuuccucaaa

SEQ ID NO: 44900 - RNA, 22 nt, Homo sapiens
cuuuuggugguucugaugcagg

SEQ ID NO: 44901 - RNA, 22 nt, Homo sapiens
cuuuuguggaucuucuguugcu

SEQ ID NO: 44902 - RNA, 20 nt, Homo sapiens
cuuuuugcugugcugggagc

SEQ ID NO: 44903 - RNA, 22 nt, Homo sapiens
agguagaguguuuuguucuucu

SEQ ID NO: 44904 - RNA, 22 nt, Homo sapiens
aggugcacucagaaaacagaua

SEQ ID NO: 44905 - RNA, 22 nt, Homo sapiens
agugaacaaagaagugcagaua

SEQ ID NO: 44906 - RNA, 22 nt, Homo sapiens
agugacaugggaucaaaucuga

SEQ ID NO: 44907 - RNA, 19 nt, Homo sapiens
aguggguguuuucuguuug

SEQ ID NO: 44908 - RNA, 22 nt, Homo sapiens
auaagugagugauucaguguua

SEQ ID NO: 44909 - RNA, 22 nt, Homo sapiens
auacaagcaguccaacuccaua

SEQ ID NO: 44910 - RNA, 22 nt, Homo sapiens
auagcaaugccccauucccagu

SEQ ID NO: 44911 - RNA, 22 nt, Homo sapiens
auagcagaauuuggucaagucu

SEQ ID NO: 44912 - RNA, 22 nt, Homo sapiens
auagcagacauuucaaggcagg

SEQ ID NO: 44913 - RNA, 23 nt, Homo sapiens
auauaguagaugugcaguaacau

SEQ ID NO: 44914 - RNA, 22 nt, Homo sapiens
auaugcauguacccacacaggc

SEQ ID NO: 44915 - RNA, 22 nt, Homo sapiens
auaugcuuauuagcaagaaaua

SEQ ID NO: 44916 - RNA, 22 nt, Homo sapiens
aucacaauuguacguaggagcc

SEQ ID NO: 44917 - RNA, 22 nt, Homo sapiens
aucacagugaaaacagucaauu

SEQ ID NO: 44918 - RNA, 22 nt, Homo sapiens
aucacuuugcucuccagugugg

SEQ ID NO: 44919 - RNA, 22 nt, Homo sapiens
aucagaaucucuagugggacca

SEQ ID NO: 44920 - RNA, 22 nt, Homo sapiens
aucagagugaauaaugacaaaa

SEQ ID NO: 44921 - RNA, 22 nt, Homo sapiens
aucgcaccauugcacuccagca

SEQ ID NO: 44922 - RNA, 19 nt, Homo sapiens
aucuggaguuccuggggcu

SEQ ID NO: 44923 - RNA, 22 nt, Homo sapiens
aucugguguauuggugcugggu

SEQ ID NO: 44924 - RNA, 22 nt, Homo sapiens
aucugguguccucgugggaguc

SEQ ID NO: 44925 - RNA, 22 nt, Homo sapiens
augacaagagccuucuuuccuu

SEQ ID NO: 44926 - RNA, 22 nt, Homo sapiens
augacauugaaaagcaagugga

SEQ ID NO: 44927 - RNA, 22 nt, Homo sapiens
augacugagacuaacuuacuuu

SEQ ID NO: 44928 - RNA, 22 nt, Homo sapiens
augagagugagagcagccccuu

SEQ ID NO: 44929 - RNA, 22 nt, Homo sapiens
augcacuuggcaggaugauucc

SEQ ID NO: 44930 - RNA, 22 nt, Homo sapiens
auggaagcauaguauucuauug

SEQ ID NO: 44931 - RNA, 22 nt, Homo sapiens
auggagagaauuauucucucag

SEQ ID NO: 44932 - RNA, 22 nt, Homo sapiens
augugcuuuuuaaacagaugcu

SEQ ID NO: 44933 - RNA, 22 nt, Homo sapiens
auuaaguaaugguuccaauaau

SEQ ID NO: 44934 - RNA, 22 nt, Homo sapiens
auuauguuguauuuccuugcag

SEQ ID NO: 44935 - RNA, 22 nt, Homo sapiens
auuccacuuacaugaaguaccu

SEQ ID NO: 44936 - RNA, 22 nt, Homo sapiens
ucucaguggcuuccucacuuuu

SEQ ID NO: 44937 - RNA, 19 nt, Homo sapiens
ucucaguguuggucaggug

SEQ ID NO: 44938 - RNA, 20 nt, Homo sapiens
ucuugaacuuagucaacagg

SEQ ID NO: 44939 - RNA, 22 nt, Homo sapiens
ucuugaacuucauaggucuaga

SEQ ID NO: 44940 - RNA, 22 nt, Homo sapiens
ucuuuaguuaagggacauuuua

SEQ ID NO: 44941 - RNA, 22 nt, Homo sapiens
ucuuuggaggcgaucuguuuga

SEQ ID NO: 44942 - RNA, 22 nt, Homo sapiens
ucuuuggucagaaagauuacac

SEQ ID NO: 44943 - RNA, 21 nt, Homo sapiens
ugaauauuuggguugugucca

SEQ ID NO: 44944 - RNA, 22 nt, Homo sapiens
ugaauguccauugauguuuuga

SEQ ID NO: 44945 - RNA, 22 nt, Homo sapiens
ugaauucaucucacagaguuaa

SEQ ID NO: 44946 - RNA, 22 nt, Homo sapiens
ugagaaugacugggcaugcugc

SEQ ID NO: 44947 - RNA, 22 nt, Homo sapiens
ugagacugagucuugcucuauu

SEQ ID NO: 44948 - RNA, 22 nt, Homo sapiens
ugagacugagucuugcucuugu

SEQ ID NO: 44949 - RNA, 22 nt, Homo sapiens
ugagacugaguuuugcucguug

SEQ ID NO: 44950 - RNA, 22 nt, Homo sapiens
ugagauagaaaacauaggagaa

SEQ ID NO: 44951 - RNA, 22 nt, Homo sapiens
ugagauagcauaagggacagaa

SEQ ID NO: 44952 - RNA, 20 nt, Homo sapiens
ugagccccuggacucaagcg

SEQ ID NO: 44953 - RNA, 22 nt, Homo sapiens
ugagguaacagaagcgagcauu

SEQ ID NO: 44954 - RNA, 22 nt, Homo sapiens
ugagugagguucuacucuguga

SEQ ID NO: 44955 - RNA, 22 nt, Homo sapiens
ugaguuaauuuuuguaucaugu

SEQ ID NO: 44956 - RNA, 22 nt, Homo sapiens
ugaguucauggucauuugucac

SEQ ID NO: 44957 - RNA, 22 nt, Homo sapiens
ugauaggucuguuuugaaaagg

SEQ ID NO: 44958 - RNA, 22 nt, Homo sapiens
ugauauauugaaugaugaaaca

SEQ ID NO: 44959 - RNA, 22 nt, Homo sapiens
ugcaaaucuuguguaguuguga

SEQ ID NO: 44960 - RNA, 22 nt, Homo sapiens
ugcaccacugcacuccagcuug

SEQ ID NO: 44961 - RNA, 22 nt, Homo sapiens
ugcauuguaggauguuuagcag

SEQ ID NO: 44962 - RNA, 21 nt, Homo sapiens
ugcccaguggcuuggggucag

SEQ ID NO: 44963 - RNA, 22 nt, Homo sapiens
ugccuaggcuggagugcagugg

SEQ ID NO: 44964 - RNA, 22 nt, Homo sapiens
ugcuggugucaucaaggcuuug

SEQ ID NO: 44965 - RNA, 21 nt, Homo sapiens
ugcuuacugaauguuaauuuc

SEQ ID NO: 44966 - RNA, 22 nt, Homo sapiens
uggaaguuaaaugacucuuucu

SEQ ID NO: 44967 - RNA, 22 nt, Homo sapiens
uggacagagagaccggcauuuu

SEQ ID NO: 44968 - RNA, 22 nt, Homo sapiens
uggacuguaagugccuugagua

SEQ ID NO: 44969 - RNA, 19 nt, Homo sapiens
uggagucaucaugcugcua

SEQ ID NO: 44970 - RNA, 22 nt, Homo sapiens
uggaguguguugcagaugaagg

SEQ ID NO: 44971 - RNA, 22 nt, Homo sapiens
uggcaagugggaccuaguuaaa

SEQ ID NO: 44972 - RNA, 22 nt, Homo sapiens
ugggaagaugcugcuucuuccu

SEQ ID NO: 44973 - RNA, 22 nt, Homo sapiens
ugggaaugaaauuacauagcuu

SEQ ID NO: 44974 - RNA, 22 nt, Homo sapiens
ugggaucagcugggcucucugu

SEQ ID NO: 44975 - RNA, 22 nt, Homo sapiens
ugggaugaaaauagcuucuucc

SEQ ID NO: 44976 - RNA, 22 nt, Homo sapiens
uggguagagaaucaggaucuua

SEQ ID NO: 44977 - RNA, 22 nt, Homo sapiens
uggguagaugaauccauuccaa

SEQ ID NO: 44978 - RNA, 22 nt, Homo sapiens
ugguacuucaugcucacagaua

SEQ ID NO: 44979 - RNA, 22 nt, Homo sapiens
uggugagaaaugagaugcuuuu

SEQ ID NO: 44980 - RNA, 22 nt, Homo sapiens
uguaagugugcaauucagugau

SEQ ID NO: 44981 - RNA, 22 nt, Homo sapiens
ugucaauauguaauaacugaau

SEQ ID NO: 44982 - RNA, 22 nt, Homo sapiens
ugacccuguggcagcgucuaag

SEQ ID NO: 44983 - RNA, 22 nt, Homo sapiens
ugacuauaggauaacaugcauu

SEQ ID NO: 44984 - RNA, 22 nt, Homo sapiens
ugagacugaguuuugcucuugu

SEQ ID NO: 44985 - RNA, 22 nt, Homo sapiens
ugagaucaugccacugcacuuc

SEQ ID NO: 44986 - RNA, 22 nt, Homo sapiens
ugagaugcaaaaugagaauugu

SEQ ID NO: 44987 - RNA, 21 nt, Homo sapiens
ugagaugcaaucaccagggag

SEQ ID NO: 44988 - RNA, 22 nt, Homo sapiens
ugagauuaucguaauguaucuc

SEQ ID NO: 44989 - RNA, 22 nt, Homo sapiens
ugagcagugagugugcugcagg

SEQ ID NO: 44990 - RNA, 22 nt, Homo sapiens
ugaggcuagucagaucagauga

SEQ ID NO: 44991 - RNA, 22 nt, Homo sapiens
ugagguaggugaagaaugcacg

SEQ ID NO: 44992 - RNA, 17 nt, Homo sapiens
ugaguuaaucuuugugc

SEQ ID NO: 44993 - RNA, 22 nt, Homo sapiens
ugaguucuuuuacauuuugaau

SEQ ID NO: 44994 - RNA, 22 nt, Homo sapiens
ugaguucuuuuagggauauugc

SEQ ID NO: 44995 - RNA, 22 nt, Homo sapiens
ugaucuguguaacauaggaguc

SEQ ID NO: 44996 - RNA, 22 nt, Homo sapiens
ugaugguguuaccaucuuuacu

SEQ ID NO: 44997 - RNA, 19 nt, Homo sapiens
ugcaaagucuuuuccuauu

SEQ ID NO: 44998 - RNA, 19 nt, Homo sapiens
ugcaaauucuaaaaacuga

SEQ ID NO: 44999 - RNA, 22 nt, Homo sapiens
ugcagugugaaagagccugaca

SEQ ID NO: 45000 - RNA, 19 nt, Homo sapiens
ugcauugucugggaaaugg

SEQ ID NO: 45001 - RNA, 22 nt, Homo sapiens
ugcauuguggaucuaaaugcau

SEQ ID NO: 45002 - RNA, 22 nt, Homo sapiens
ugccuaggcuggaaugcagugg

SEQ ID NO: 45003 - RNA, 18 nt, Homo sapiens
ugcuaugagauuauuuua

SEQ ID NO: 45004 - RNA, 21 nt, Homo sapiens
ugcuuuggucauacuucuucc

SEQ ID NO: 45005 - RNA, 20 nt, Homo sapiens
uggaaauuaaccuuucaggu

SEQ ID NO: 45006 - RNA, 22 nt, Homo sapiens
uggaacacauaaauagcauagu

SEQ ID NO: 45007 - RNA, 22 nt, Homo sapiens
uggaacaccaggcuggcguggc

SEQ ID NO: 45008 - RNA, 22 nt, Homo sapiens
uggagugauaugguuauauggg

SEQ ID NO: 45009 - RNA, 22 nt, Homo sapiens
uggaguguaaauuaguucagcc

SEQ ID NO: 45010 - RNA, 22 nt, Homo sapiens
uggaguguagcggcaccuauua

SEQ ID NO: 45011 - RNA, 22 nt, Homo sapiens
uggagugucaguuuccagaguu

SEQ ID NO: 45012 - RNA, 20 nt, Homo sapiens
uggcaagauggcagaauaga

SEQ ID NO: 45013 - RNA, 22 nt, Homo sapiens
uggcagauaggauacaggacua

SEQ ID NO: 45014 - RNA, 22 nt, Homo sapiens
uggcuuuuguuauuuggaagcu

SEQ ID NO: 45015 - RNA, 22 nt, Homo sapiens
ugggaagcugcauuuuaacaag

SEQ ID NO: 45016 - RNA, 22 nt, Homo sapiens
ugggagacuacauuuuuaacaa

SEQ ID NO: 45017 - RNA, 22 nt, Homo sapiens
ugggaucauuaugcauagugua

SEQ ID NO: 45018 - RNA, 22 nt, Homo sapiens
ugggaugaugaaaaggcuuucu

SEQ ID NO: 45019 - RNA, 22 nt, Homo sapiens
ugggcaagagagcaugacccug

SEQ ID NO: 45020 - RNA, 22 nt, Homo sapiens
ugggguaggcuguauacucugu

SEQ ID NO: 45021 - RNA, 22 nt, Homo sapiens
uggucagaaaauuacuugauau

SEQ ID NO: 45022 - RNA, 22 nt, Homo sapiens
uggugagaaaagaugucuuugu

SEQ ID NO: 45023 - RNA, 22 nt, Homo sapiens
uggugcaaugaagugaucucaa

SEQ ID NO: 45024 - RNA, 17 nt, Homo sapiens
uggugcuugaaaguugc

SEQ ID NO: 45025 - RNA, 22 nt, Homo sapiens
uguaaugaucaaaucagaguaa

SEQ ID NO: 45026 - RNA, 21 nt, Homo sapiens
uguauacauauguuaggugca

SEQ ID NO: 45027 - RNA, 22 nt, Homo sapiens
uguauguugauguuauauucug

SEQ ID NO: 45028 - RNA, 22 nt, Homo sapiens
ugucuuguagacaauguauagu

SEQ ID NO: 45029 - RNA, 22 nt, Homo sapiens
ugucuuugguucaggcaaggag

SEQ ID NO: 45030 - RNA, 22 nt, Homo sapiens
ugugaagauggacuaauauagu

SEQ ID NO: 45031 - RNA, 22 nt, Homo sapiens
ugugaugcagggccugggccuc

SEQ ID NO: 45032 - RNA, 22 nt, Homo sapiens
ugugaugguuuggaagcuucuu

SEQ ID NO: 45033 - RNA, 22 nt, Homo sapiens
uguggucaucacuugaagguaa

SEQ ID NO: 45034 - RNA, 22 nt, Homo sapiens
uuaauuguccaaguucaucucu

SEQ ID NO: 45035 - RNA, 22 nt, Homo sapiens
uuagaacuagaggaguuugagu

SEQ ID NO: 45036 - RNA, 22 nt, Homo sapiens
uuagacaguggugcacugcacu

SEQ ID NO: 45037 - RNA, 22 nt, Homo sapiens
uuagcaauagccugcaucugca

SEQ ID NO: 45038 - RNA, 22 nt, Homo sapiens
uuagguaauauauugcugcuuu

SEQ ID NO: 45039 - RNA, 22 nt, Homo sapiens
uuaugcuugugugaauuuuccc

SEQ ID NO: 45040 - RNA, 22 nt, Homo sapiens
uucaacugcuucagccucccaa

SEQ ID NO: 45041 - RNA, 22 nt, Homo sapiens
uucacacugggccuacucugug

SEQ ID NO: 45042 - RNA, 22 nt, Homo sapiens
uucacaugacagggugaagcau

SEQ ID NO: 45043 - RNA, 22 nt, Homo sapiens
uucacuguagccucagccucuu

SEQ ID NO: 45044 - RNA, 22 nt, Homo sapiens
uucacuguagcuuggauguuua

SEQ ID NO: 45045 - RNA, 22 nt, Homo sapiens
uucacuguuaagcaguuaaacu

SEQ ID NO: 45046 - RNA, 22 nt, Homo sapiens
uucagagugguaugaagugaug

SEQ ID NO: 45047 - RNA, 22 nt, Homo sapiens
uuccacaaugguugaacuagcu

SEQ ID NO: 45048 - RNA, 22 nt, Homo sapiens
uuccacaaugguugaacuaguu

SEQ ID NO: 45049 - RNA, 22 nt, Homo sapiens
uuccaguggacuacuucauccu

SEQ ID NO: 45050 - RNA, 22 nt, Homo sapiens
uuccauguaguugagcaguuuu

SEQ ID NO: 45051 - RNA, 22 nt, Homo sapiens
aucaaagccaugcucaguuuuc

SEQ ID NO: 45052 - RNA, 22 nt, Homo sapiens
aucaaauugucauuuuaaggau

SEQ ID NO: 45053 - RNA, 22 nt, Homo sapiens
aucaccuggaggugaucacuug

SEQ ID NO: 45054 - RNA, 22 nt, Homo sapiens
aucauacuguuuugauuacugu

SEQ ID NO: 45055 - RNA, 22 nt, Homo sapiens
aucuacuugcugggucucugga

SEQ ID NO: 45056 - RNA, 22 nt, Homo sapiens
augaaugucuuauuuugagaaa

SEQ ID NO: 45057 - RNA, 22 nt, Homo sapiens
augacuauugcacuuuccuggu

SEQ ID NO: 45058 - RNA, 22 nt, Homo sapiens
augacucagaucuguuccuggu

SEQ ID NO: 45059 - RNA, 22 nt, Homo sapiens
augaggcaggaaaggcguaucu

SEQ ID NO: 45060 - RNA, 22 nt, Homo sapiens
augauggagguagauuguccau

SEQ ID NO: 45061 - RNA, 22 nt, Homo sapiens
augcacauggcuaacuuuuuuc

SEQ ID NO: 45062 - RNA, 22 nt, Homo sapiens
augcacuguuuucuugaugaga

SEQ ID NO: 45063 - RNA, 22 nt, Homo sapiens
augccacagaaauaaccaaaau

SEQ ID NO: 45064 - RNA, 22 nt, Homo sapiens
augcuguuuugaauucucuaga

SEQ ID NO: 45065 - RNA, 22 nt, Homo sapiens
augcuguuuuguagcucccucu

SEQ ID NO: 45066 - RNA, 22 nt, Homo sapiens
auggaagcugauuagauaguac

SEQ ID NO: 45067 - RNA, 22 nt, Homo sapiens
auggacagaaaaaaauagaugu

SEQ ID NO: 45068 - RNA, 22 nt, Homo sapiens
auggcuuuuccugucuugcaug

SEQ ID NO: 45069 - RNA, 22 nt, Homo sapiens
augggguaggcuugcuguagua

SEQ ID NO: 45070 - RNA, 21 nt, Homo sapiens
auguaacugggaaugugagag

SEQ ID NO: 45071 - RNA, 22 nt, Homo sapiens
augucuguuugcugagcccggc

SEQ ID NO: 45072 - RNA, 22 nt, Homo sapiens
auuacaugucuauccaugaaca

SEQ ID NO: 45073 - RNA, 22 nt, Homo sapiens
auuauaugucaucacagacacc

SEQ ID NO: 45074 - RNA, 22 nt, Homo sapiens
auugacuugauauauagcugau

SEQ ID NO: 45075 - RNA, 22 nt, Homo sapiens
auugcacacagaaucaggguaa

SEQ ID NO: 45076 - RNA, 22 nt, Homo sapiens
auugcacuccagccccggggac

SEQ ID NO: 45077 - RNA, 23 nt, Homo sapiens
auugcacuccagccuaccugggc

SEQ ID NO: 45078 - RNA, 22 nt, Homo sapiens
auugcacuccagccuagguaac

SEQ ID NO: 45079 - RNA, 22 nt, Homo sapiens
auugcacuccagccuggcaaua

SEQ ID NO: 45080 - RNA, 22 nt, Homo sapiens
auugcacuccagccugggcagc

SEQ ID NO: 45081 - RNA, 22 nt, Homo sapiens
auugcacuccagccugggggac

SEQ ID NO: 45082 - RNA, 22 nt, Homo sapiens
auugcacuccagccuuggggau

SEQ ID NO: 45083 - RNA, 22 nt, Homo sapiens
auugcacuccggccugggugac

SEQ ID NO: 45084 - RNA, 22 nt, Homo sapiens
auugcacucuagccugggugac

SEQ ID NO: 45085 - RNA, 22 nt, Homo sapiens
auuuggguaaugagugcaaggg

SEQ ID NO: 45086 - RNA, 21 nt, Homo sapiens
auuugguggcugugugacacu

SEQ ID NO: 45087 - RNA, 22 nt, Homo sapiens
caaagucuucaguugauucuga

SEQ ID NO: 45088 - RNA, 19 nt, Homo sapiens
caaaguguucuucuuugcc

SEQ ID NO: 45089 - RNA, 22 nt, Homo sapiens
caacacagugaaacccgucucu

SEQ ID NO: 45090 - RNA, 22 nt, Homo sapiens
caaggcacagccccuacuuccu

SEQ ID NO: 45091 - RNA, 22 nt, Homo sapiens
caaugcauuauucucccacuuc

SEQ ID NO: 45092 - RNA, 22 nt, Homo sapiens
cacagaauucauuggauuaccu

SEQ ID NO: 45093 - RNA, 22 nt, Homo sapiens
cagagaucaugcaacugcucgc

SEQ ID NO: 45094 - RNA, 22 nt, Homo sapiens
cagagguaagcaagucagcauu

SEQ ID NO: 45095 - RNA, 22 nt, Homo sapiens
cagagguauugcaaaagccuag

SEQ ID NO: 45096 - RNA, 22 nt, Homo sapiens
cagggaauguuauuuaauagca

SEQ ID NO: 45097 - RNA, 22 nt, Homo sapiens
cagguacuucugggcugagcag

SEQ ID NO: 45098 - RNA, 22 nt, Homo sapiens
caggugcauuggcugacaccug

SEQ ID NO: 45099 - RNA, 22 nt, Homo sapiens
cagugcuuuaucaaguccucca

SEQ ID NO: 45100 - RNA, 22 nt, Homo sapiens
caucacuguugguacaaguaau

SEQ ID NO: 45101 - RNA, 22 nt, Homo sapiens
cauggcuuuaagcaacaccaag

SEQ ID NO: 45102 - RNA, 22 nt, Homo sapiens
cauguauagauuccauaguggu

SEQ ID NO: 45103 - RNA, 19 nt, Homo sapiens
cauugcacuccacccuggg

SEQ ID NO: 45104 - RNA, 22 nt, Homo sapiens
cauugcacuuagacaacuuuug

SEQ ID NO: 45105 - RNA, 22 nt, Homo sapiens
ccaguuuucccagcaccauuaa

SEQ ID NO: 45106 - RNA, 21 nt, Homo sapiens
ccaugggacggaaugaauaca

SEQ ID NO: 45107 - RNA, 18 nt, Homo sapiens
cccgggugggcuguuccc

SEQ ID NO: 45108 - RNA, 22 nt, Homo sapiens
cccucgagaaaccaucugcuga

SEQ ID NO: 45109 - RNA, 21 nt, Homo sapiens
ccugaagaagugaccucugag

SEQ ID NO: 45110 - RNA, 22 nt, Homo sapiens
ccugagacugauugacucacaa

SEQ ID NO: 45111 - RNA, 22 nt, Homo sapiens
cuagagagaagcugugugaccu

SEQ ID NO: 45112 - RNA, 22 nt, Homo sapiens
cucacuggguguaaaacaugua

SEQ ID NO: 45113 - RNA, 22 nt, Homo sapiens
cucagugucuggcacacagaaa

SEQ ID NO: 45114 - RNA, 22 nt, Homo sapiens
cucaguguuaaggccaccucug

SEQ ID NO: 45115 - RNA, 22 nt, Homo sapiens
cucaguguucccauucuaccuu

SEQ ID NO: 45116 - RNA, 22 nt, Homo sapiens
cuccacugagcaggugggaggc

SEQ ID NO: 45117 - RNA, 22 nt, Homo sapiens
cuccagugcaaagucaugauca

SEQ ID NO: 45118 - RNA, 20 nt, Homo sapiens
cuccuucauuccuuuggacc

SEQ ID NO: 45119 - RNA, 22 nt, Homo sapiens
cucgaagacuaagcaucucuga

SEQ ID NO: 45120 - RNA, 22 nt, Homo sapiens
cugaaagagcauguaacacagu

SEQ ID NO: 45121 - RNA, 22 nt, Homo sapiens
cugauuguuugccucuaaaauc

SEQ ID NO: 45122 - RNA, 22 nt, Homo sapiens
uugagauggagucuugcacugu

SEQ ID NO: 45123 - RNA, 22 nt, Homo sapiens
uugagauggagucuugcucucu

SEQ ID NO: 45124 - RNA, 22 nt, Homo sapiens
uugagauggaguguugcucugu

SEQ ID NO: 45125 - RNA, 22 nt, Homo sapiens
uugagauggaguuuugcucuug

SEQ ID NO: 45126 - RNA, 22 nt, Homo sapiens
uugagcauugguauagguuuua

SEQ ID NO: 45127 - RNA, 22 nt, Homo sapiens
uugaguagugugaugcaugucu

SEQ ID NO: 45128 - RNA, 22 nt, Homo sapiens
uugauauguggaauauuuaucu

SEQ ID NO: 45129 - RNA, 22 nt, Homo sapiens
uugcaaggugcagcuuaugcaa

SEQ ID NO: 45130 - RNA, 22 nt, Homo sapiens
uugcacaguguguacagcacca

SEQ ID NO: 45131 - RNA, 22 nt, Homo sapiens
uugcaucagcuccugauguacu

SEQ ID NO: 45132 - RNA, 22 nt, Homo sapiens
uugccuaggcuggagugcagug

SEQ ID NO: 45133 - RNA, 22 nt, Homo sapiens
uugcgaugaagacaaaacaugc

SEQ ID NO: 45134 - RNA, 22 nt, Homo sapiens
uugcucaggcuggaguacaaug

SEQ ID NO: 45135 - RNA, 22 nt, Homo sapiens
uugcuuagucaugaaucacuga

SEQ ID NO: 45136 - RNA, 22 nt, Homo sapiens
uuggagcacuggggcacugaca

SEQ ID NO: 45137 - RNA, 22 nt, Homo sapiens
uuggcuaagaucacgugagaau

SEQ ID NO: 45138 - RNA, 22 nt, Homo sapiens
uuguauugucuugaugaguuga

SEQ ID NO: 45139 - RNA, 22 nt, Homo sapiens
uugugaaaaaccucucguggaa

SEQ ID NO: 45140 - RNA, 22 nt, Homo sapiens
uuuaaagcuccaagcaugucug

SEQ ID NO: 45141 - RNA, 22 nt, Homo sapiens
uuuaaaguuagaaggaaagggc

SEQ ID NO: 45142 - RNA, 22 nt, Homo sapiens
uuuacagucuuuugugugaguc

SEQ ID NO: 45143 - RNA, 22 nt, Homo sapiens
uuucacuagccagcccuuuauu

SEQ ID NO: 45144 - RNA, 22 nt, Homo sapiens
uuuccagguggccaacauuuua

SEQ ID NO: 45145 - RNA, 22 nt, Homo sapiens
uuugguguauaaaaaugcuagu

SEQ ID NO: 45146 - RNA, 18 nt, Homo sapiens
uuuguacuuuuucuaaug

SEQ ID NO: 45147 - RNA, 22 nt, Homo sapiens
uuugugcuauguuauauauucu

SEQ ID NO: 45148 - RNA, 19 nt, Homo sapiens
uuuuccccuuucuuaagac

SEQ ID NO: 45149 - RNA, 22 nt, Homo sapiens
uuuugcuugugaauagccacau

SEQ ID NO: 45150 - RNA, 17 nt, Homo sapiens
uuuuggauuagaaaucc

SEQ ID NO: 45151 - RNA, 22 nt, Homo sapiens
uuuuuuaguuagcugggcauga

SEQ ID NO: 45152 - RNA, 21 nt, Homo sapiens
auagugcuagagaguagcagg

SEQ ID NO: 45153 - RNA, 22 nt, Homo sapiens
auaugcauacauguaugcagga

SEQ ID NO: 45154 - RNA, 22 nt, Homo sapiens
auauguucucauucauaugugg

SEQ ID NO: 45155 - RNA, 22 nt, Homo sapiens
auauuguacugcuacugguucu

SEQ ID NO: 45156 - RNA, 22 nt, Homo sapiens
aucaaagugaauuaaugagaau

SEQ ID NO: 45157 - RNA, 22 nt, Homo sapiens
aucagaaucucuagaggacugu

SEQ ID NO: 45158 - RNA, 22 nt, Homo sapiens
aucagaguggguuuuaaaagug

SEQ ID NO: 45159 - RNA, 22 nt, Homo sapiens
aucccugugauccaaucacuuc

SEQ ID NO: 45160 - RNA, 22 nt, Homo sapiens
aucuuggauuaccugggugggu

SEQ ID NO: 45161 - RNA, 22 nt, Homo sapiens
augaaguuagcucauuucuuuu

SEQ ID NO: 45162 - RNA, 22 nt, Homo sapiens
augacaguguggauuauuguaa

SEQ ID NO: 45163 - RNA, 22 nt, Homo sapiens
augacugucuugcagaggcuau

SEQ ID NO: 45164 - RNA, 22 nt, Homo sapiens
augaggaaggagccuuugucug

SEQ ID NO: 45165 - RNA, 22 nt, Homo sapiens
augagucacuuauuauuggggu

SEQ ID NO: 45166 - RNA, 22 nt, Homo sapiens
augcaauucuagauugauagua

SEQ ID NO: 45167 - RNA, 22 nt, Homo sapiens
augcagauauuuuugugguugc

SEQ ID NO: 45168 - RNA, 22 nt, Homo sapiens
augcagaucacauuuuucuguc

SEQ ID NO: 45169 - RNA, 18 nt, Homo sapiens
augcauauuuuaaguugu

SEQ ID NO: 45170 - RNA, 19 nt, Homo sapiens
augccacagugaggucaga

SEQ ID NO: 45171 - RNA, 22 nt, Homo sapiens
auggcuuuguguucagagcuga

SEQ ID NO: 45172 - RNA, 22 nt, Homo sapiens
auggcuuuuuaaaucauguugu

SEQ ID NO: 45173 - RNA, 22 nt, Homo sapiens
augugcaauggugucaccacau

SEQ ID NO: 45174 - RNA, 22 nt, Homo sapiens
augugcuugagggaaaucaguu

SEQ ID NO: 45175 - RNA, 22 nt, Homo sapiens
auguguaaagcuuuucuuuguu

SEQ ID NO: 45176 - RNA, 22 nt, Homo sapiens
auuaauguaauuaguaaaguug

SEQ ID NO: 45177 - RNA, 22 nt, Homo sapiens
auuauugacucauagaaaggau

SEQ ID NO: 45178 - RNA, 22 nt, Homo sapiens
auucaccauggcuaccaagggu

SEQ ID NO: 45179 - RNA, 22 nt, Homo sapiens
auuccacagccgauaccaugac

SEQ ID NO: 45180 - RNA, 22 nt, Homo sapiens
auuccacuuagugacucauuug

SEQ ID NO: 45181 - RNA, 22 nt, Homo sapiens
auugcacuccagcccgggugac

SEQ ID NO: 45182 - RNA, 22 nt, Homo sapiens
auugcacuccagcccugcugac

SEQ ID NO: 45183 - RNA, 22 nt, Homo sapiens
auugcacuccagccucggugac

SEQ ID NO: 45184 - RNA, 22 nt, Homo sapiens
auugcacuccagccugagcaaa

SEQ ID NO: 45185 - RNA, 22 nt, Homo sapiens
auugcacuccagccuggcagca

SEQ ID NO: 45186 - RNA, 22 nt, Homo sapiens
auugcacuccagccuggccaac

SEQ ID NO: 45187 - RNA, 22 nt, Homo sapiens
auugcacuccagccuggggaac

SEQ ID NO: 45188 - RNA, 22 nt, Homo sapiens
auugcacuccagccugggugac

SEQ ID NO: 45189 - RNA, 22 nt, Homo sapiens
auugcacuccagccugggugag

SEQ ID NO: 45190 - RNA, 22 nt, Homo sapiens
auugcacuccagccuggugaca

SEQ ID NO: 45191 - RNA, 22 nt, Homo sapiens
auugcacuccagccuugggcaa

SEQ ID NO: 45192 - RNA, 18 nt, Homo sapiens
auugcacuccugccuggg

SEQ ID NO: 45193 - RNA, 22 nt, Homo sapiens
caaagugcugaaagaggccagg

SEQ ID NO: 45194 - RNA, 22 nt, Homo sapiens
caaauugcuugucuguagugga

SEQ ID NO: 45195 - RNA, 22 nt, Homo sapiens
cacugcacuccagucugacgac

SEQ ID NO: 45196 - RNA, 21 nt, Homo sapiens
cacugcacuugccuucugggu

SEQ ID NO: 45197 - RNA, 22 nt, Homo sapiens
cagauggucuuaaggcagccuu

SEQ ID NO: 45198 - RNA, 22 nt, Homo sapiens
cagaugguggucccacagccca

SEQ ID NO: 45199 - RNA, 21 nt, Homo sapiens
caucacauuacucaaaguccu

SEQ ID NO: 45200 - RNA, 22 nt, Homo sapiens
cauggcucuuguuuacucccag

SEQ ID NO: 45201 - RNA, 22 nt, Homo sapiens
ccacugcacuccagcccggcaa

SEQ ID NO: 45202 - RNA, 22 nt, Homo sapiens
cccagagacagaaugauaaacu

SEQ ID NO: 45203 - RNA, 19 nt, Homo sapiens
ccuuugguuuccaugacau

SEQ ID NO: 45204 - RNA, 22 nt, Homo sapiens
cuaagauugucuuaguguguug

SEQ ID NO: 45205 - RNA, 22 nt, Homo sapiens
cuacaguucuuaauuaaguagu

SEQ ID NO: 45206 - RNA, 22 nt, Homo sapiens
cuaugagucugcagaucuauua

SEQ ID NO: 45207 - RNA, 22 nt, Homo sapiens
cucaaagugcugggacuggcug

SEQ ID NO: 45208 - RNA, 22 nt, Homo sapiens
cucacugugguguccuuaggua

SEQ ID NO: 45209 - RNA, 22 nt, Homo sapiens
cucagaguacuuuucccacuuc

SEQ ID NO: 45210 - RNA, 22 nt, Homo sapiens
cucaguguuucagcugcucaga

SEQ ID NO: 45211 - RNA, 22 nt, Homo sapiens
cucucaagaugcugggauuaca

SEQ ID NO: 45212 - RNA, 22 nt, Homo sapiens
cucuuuaguaagcaguugauga

SEQ ID NO: 45213 - RNA, 22 nt, Homo sapiens
cugaauguuuucuucuauucug

SEQ ID NO: 45214 - RNA, 22 nt, Homo sapiens
cugagacacucuuaucugcaua

SEQ ID NO: 45215 - RNA, 22 nt, Homo sapiens
cugauaguucucuuuagaguuu

SEQ ID NO: 45216 - RNA, 20 nt, Homo sapiens
cugcacauccacucuacuuc

SEQ ID NO: 45217 - RNA, 22 nt, Homo sapiens
cugcacugagacccucuuugcu

SEQ ID NO: 45218 - RNA, 22 nt, Homo sapiens
cuggaaagcaaagggugcauug

SEQ ID NO: 45219 - RNA, 22 nt, Homo sapiens
cugugaucuuuuuucauguggu

SEQ ID NO: 45220 - RNA, 22 nt, Homo sapiens
cuguugguguuuaaucacugca

SEQ ID NO: 45221 - RNA, 22 nt, Homo sapiens
cuucaucugguuugugaacuuu

SEQ ID NO: 45222 - RNA, 22 nt, Homo sapiens
cuuggcuagucaaaccuccccg

SEQ ID NO: 45223 - RNA, 21 nt, Homo sapiens
cuugucuugcuuagaauagac

SEQ ID NO: 45224 - RNA, 22 nt, Homo sapiens
cuuuggccauagcuaaaugauu

SEQ ID NO: 45225 - RNA, 22 nt, Homo sapiens
cuuuugugauucuucaguugcu

SEQ ID NO: 45226 - RNA, 22 nt, Homo sapiens
ucccguuauuaaccccugccuu

SEQ ID NO: 45227 - RNA, 22 nt, Homo sapiens
ucccugaaagcugagauuggaa

SEQ ID NO: 45228 - RNA, 16 nt, Homo sapiens
ucccugugacaugugc

SEQ ID NO: 45229 - RNA, 22 nt, Homo sapiens
uccugcauucugacuugcuuuc

SEQ ID NO: 45230 - RNA, 20 nt, Homo sapiens
ucgcaccacuauacuccagc

SEQ ID NO: 45231 - RNA, 22 nt, Homo sapiens
ucuauuugggguaccuguggua

SEQ ID NO: 45232 - RNA, 22 nt, Homo sapiens
ucucagugugguaaaaguuuuu

SEQ ID NO: 45233 - RNA, 21 nt, Homo sapiens
ucucauugugguuuuaauugg

SEQ ID NO: 45234 - RNA, 22 nt, Homo sapiens
ucuguacuuccguaccuaaagu

SEQ ID NO: 45235 - RNA, 22 nt, Homo sapiens
ucuguugguucuuugaggagga

SEQ ID NO: 45236 - RNA, 22 nt, Homo sapiens
ucuugaacuucugcacacucag

SEQ ID NO: 45237 - RNA, 22 nt, Homo sapiens
ucuuucacuuagcaugauguuu

SEQ ID NO: 45238 - RNA, 22 nt, Homo sapiens
ucuuugguucuguuuauguaau

SEQ ID NO: 45239 - RNA, 22 nt, Homo sapiens
ugaauguuugcagcuuauacca

SEQ ID NO: 45240 - RNA, 22 nt, Homo sapiens
ugagauaguuguagauguacau

SEQ ID NO: 45241 - RNA, 22 nt, Homo sapiens
ugagaucacgccacugcacucc

SEQ ID NO: 45242 - RNA, 22 nt, Homo sapiens
ugagguaagauguucauuuuuc

SEQ ID NO: 45243 - RNA, 22 nt, Homo sapiens
ugagguuauuuguucaagaagu

SEQ ID NO: 45244 - RNA, 22 nt, Homo sapiens
ugagugugacuuagcagaagga

SEQ ID NO: 45245 - RNA, 17 nt, Homo sapiens
ugauaagugugagguga

SEQ ID NO: 45246 - RNA, 18 nt, Homo sapiens
ugauaucaucacaauuga

SEQ ID NO: 45247 - RNA, 22 nt, Homo sapiens
ugauaugucccucgacaucagg

SEQ ID NO: 45248 - RNA, 22 nt, Homo sapiens
ugauguaggcauuuaagguuau

SEQ ID NO: 45249 - RNA, 22 nt, Homo sapiens
ugcaccacacuccauccugggc

SEQ ID NO: 45250 - RNA, 22 nt, Homo sapiens
ugcaccacuacacuccaggcug

SEQ ID NO: 45251 - RNA, 22 nt, Homo sapiens
ugcaccacugcaccccagucug

SEQ ID NO: 45252 - RNA, 22 nt, Homo sapiens
ugcaccacugcacuccacccug

SEQ ID NO: 45253 - RNA, 22 nt, Homo sapiens
ugcaccacugcacuccaggcug

SEQ ID NO: 45254 - RNA, 22 nt, Homo sapiens
ugcagagucuguccugccugcc

SEQ ID NO: 45255 - RNA, 22 nt, Homo sapiens
ugcaguuuaggaacugguaaca

SEQ ID NO: 45256 - RNA, 22 nt, Homo sapiens
ugcugcuguuguuguuacuagc

SEQ ID NO: 45257 - RNA, 22 nt, Homo sapiens
uggaacacaucuaaggaagcag

SEQ ID NO: 45258 - RNA, 23 nt, Homo sapiens
uggaagacuccucucuuggcugc

SEQ ID NO: 45259 - RNA, 22 nt, Homo sapiens
uggaagacucuagucucuugag

SEQ ID NO: 45260 - RNA, 22 nt, Homo sapiens
uggaagucauugagguguguua

SEQ ID NO: 45261 - RNA, 20 nt, Homo sapiens
uggaccagagagguggggac

SEQ ID NO: 45262 - RNA, 22 nt, Homo sapiens
uggaguguuggggcaggaucuc

SEQ ID NO: 45263 - RNA, 22 nt, Homo sapiens
uggcaaaugaagucagcuguac

SEQ ID NO: 45264 - RNA, 20 nt, Homo sapiens
uggcuaaaugaaugauagca

SEQ ID NO: 45265 - RNA, 20 nt, Homo sapiens
uggcuucuuaauugcaggca

SEQ ID NO: 45266 - RNA, 22 nt, Homo sapiens
ugggaugaauacaaugggauca

SEQ ID NO: 45267 - RNA, 22 nt, Homo sapiens
ugggaugaugcuugagaauauc

SEQ ID NO: 45268 - RNA, 22 nt, Homo sapiens
ugggcaagugacuuggcuucuc

SEQ ID NO: 45269 - RNA, 22 nt, Homo sapiens
uggggugugagggagaaagaaa

SEQ ID NO: 45270 - RNA, 23 nt, Homo sapiens
ugggucaguuuuucugacaucau

SEQ ID NO: 45271 - RNA, 22 nt, Homo sapiens
uguaaaucuuucacaguugaug

SEQ ID NO: 45272 - RNA, 22 nt, Homo sapiens
uguauguaauugaaguuaaguu

SEQ ID NO: 45273 - RNA, 22 nt, Homo sapiens
ugucaugugagggaacuuguuc

SEQ ID NO: 45274 - RNA, 22 nt, Homo sapiens
ugugaacagcagcugggcuuug

SEQ ID NO: 45275 - RNA, 21 nt, Homo sapiens
ugugaacauguuggguggcau

SEQ ID NO: 45276 - RNA, 22 nt, Homo sapiens
uguggcaaagucuugugaauau

SEQ ID NO: 45277 - RNA, 22 nt, Homo sapiens
uguggcaaauggucaggaagaa

SEQ ID NO: 45278 - RNA, 21 nt, Homo sapiens
uguggcaauggccucacagau

SEQ ID NO: 45279 - RNA, 22 nt, Homo sapiens
ugugguuuuuuucuccaauagg

SEQ ID NO: 45280 - RNA, 22 nt, Homo sapiens
uguguaauaccuuugacuauau

SEQ ID NO: 45281 - RNA, 22 nt, Homo sapiens
uguguacugcagaguauucugu

SEQ ID NO: 45282 - RNA, 22 nt, Homo sapiens
uguugcacacacugaaauacac

SEQ ID NO: 45283 - RNA, 20 nt, Homo sapiens
uguugcacucuagccugggu

SEQ ID NO: 45284 - RNA, 18 nt, Homo sapiens
uguugguguucacucacu

SEQ ID NO: 45285 - RNA, 22 nt, Homo sapiens
uguuuaguuaagacauagaauu

SEQ ID NO: 45286 - RNA, 22 nt, Homo sapiens
uuaaaugcuagaauuuucuuug

SEQ ID NO: 45287 - RNA, 22 nt, Homo sapiens
uuaaaugucuguagaugugcug

SEQ ID NO: 45288 - RNA, 22 nt, Homo sapiens
uuaaggaaggagucuuaaaugg

SEQ ID NO: 45289 - RNA, 22 nt, Homo sapiens
uuaagugcucaguuacucaguu

SEQ ID NO: 45290 - RNA, 22 nt, Homo sapiens
uuaaugaacuuuauuuuguaga

SEQ ID NO: 45291 - RNA, 22 nt, Homo sapiens
uuacagguggagaaguaaggcu

SEQ ID NO: 45292 - RNA, 22 nt, Homo sapiens
uuagagcacugaucugcucuuu

SEQ ID NO: 45293 - RNA, 22 nt, Homo sapiens
uuagaguacaggggaaucaagg

SEQ ID NO: 45294 - RNA, 20 nt, Homo sapiens
uuagaguaguaugauuuaua

SEQ ID NO: 45295 - RNA, 22 nt, Homo sapiens
uuagcacaguucauucauguua

SEQ ID NO: 45296 - RNA, 22 nt, Homo sapiens
uucaagugaacaaaaugaggag

SEQ ID NO: 45297 - RNA, 22 nt, Homo sapiens
uucagaguggacagaaauuaag

SEQ ID NO: 45298 - RNA, 22 nt, Homo sapiens
uucaggguggagaguaugaggu

SEQ ID NO: 45299 - RNA, 22 nt, Homo sapiens
uucaguacacguguucucauuu

SEQ ID NO: 45300 - RNA, 18 nt, Homo sapiens
uucaucaguccucagcug

SEQ ID NO: 45301 - RNA, 21 nt, Homo sapiens
uucaucuggccguauuccagg

SEQ ID NO: 45302 - RNA, 22 nt, Homo sapiens
uucauggaauauugaccauuuu

SEQ ID NO: 45303 - RNA, 22 nt, Homo sapiens
uucauguaauuccauaagguaa

SEQ ID NO: 45304 - RNA, 22 nt, Homo sapiens
uuccacaauggcugaacuaguu

SEQ ID NO: 45305 - RNA, 22 nt, Homo sapiens
uuccacaaugguugaacuaauu

SEQ ID NO: 45306 - RNA, 22 nt, Homo sapiens
uuccaugugggcuugucaagua

SEQ ID NO: 45307 - RNA, 22 nt, Homo sapiens
uucccugaguaucuuaccaugg

SEQ ID NO: 45308 - RNA, 22 nt, Homo sapiens
uucccugugguauagaagccgu

SEQ ID NO: 45309 - RNA, 20 nt, Homo sapiens
uuccuuaggcauuggaagaa

SEQ ID NO: 45310 - RNA, 22 nt, Homo sapiens
uucucaguucgguggcagugcu

SEQ ID NO: 45311 - RNA, 22 nt, Homo sapiens
uucuugcacugaucccauaagc

SEQ ID NO: 45312 - RNA, 22 nt, Homo sapiens
uucuugcacuuaacugacauuc

SEQ ID NO: 45313 - RNA, 22 nt, Homo sapiens
uucuugguguaguaguugaaaa

SEQ ID NO: 45314 - RNA, 22 nt, Homo sapiens
uugacauguaaguacucuauag

SEQ ID NO: 45315 - RNA, 22 nt, Homo sapiens
uugacugugguaauggaagcug

SEQ ID NO: 45316 - RNA, 22 nt, Homo sapiens
cuugcacuugaaauuccaguuu

SEQ ID NO: 45317 - RNA, 22 nt, Homo sapiens
cuuggcuugguaucaaauaacc

SEQ ID NO: 45318 - RNA, 22 nt, Homo sapiens
cuuuggucaauugcugcgggga

SEQ ID NO: 45319 - RNA, 22 nt, Homo sapiens
cuuuggucaauugcugugggga

SEQ ID NO: 45320 - RNA, 22 nt, Homo sapiens
cuuugguguauuuucagagacc

SEQ ID NO: 45321 - RNA, 22 nt, Homo sapiens
gaaaguguugagauuacaggca

SEQ ID NO: 45322 - RNA, 22 nt, Homo sapiens
gacaucauuaugagauuuaaac

SEQ ID NO: 45323 - RNA, 19 nt, Homo sapiens
gacuccagaguugugugcu

SEQ ID NO: 45324 - RNA, 22 nt, Homo sapiens
gagcaaaaguauguauugguua

SEQ ID NO: 45325 - RNA, 22 nt, Homo sapiens
gagguagugagcagcugaacua

SEQ ID NO: 45326 - RNA, 22 nt, Homo sapiens
gagguauagaacaccuuucaag

SEQ ID NO: 45327 - RNA, 22 nt, Homo sapiens
gagguugggaugagggauacag

SEQ ID NO: 45328 - RNA, 22 nt, Homo sapiens
gagugcauaugggccuguguca

SEQ ID NO: 45329 - RNA, 22 nt, Homo sapiens
gagugcugagcccacuuccuug

SEQ ID NO: 45330 - RNA, 22 nt, Homo sapiens
gaucuggagguuuuccucauga

SEQ ID NO: 45331 - RNA, 21 nt, Homo sapiens
gcaaacauccuuugaugccag

SEQ ID NO: 45332 - RNA, 22 nt, Homo sapiens
gcauggagaaggggacugauuc

SEQ ID NO: 45333 - RNA, 22 nt, Homo sapiens
gcccugagauucuuggauucug

SEQ ID NO: 45334 - RNA, 22 nt, Homo sapiens
gcuaggagaucugcugcucucu

SEQ ID NO: 45335 - RNA, 19 nt, Homo sapiens
gcugauguuacauucuugc

SEQ ID NO: 45336 - RNA, 22 nt, Homo sapiens
gcugauguuggccucugggcuu

SEQ ID NO: 45337 - RNA, 22 nt, Homo sapiens
gcugcacuuuaaggcauccccu

SEQ ID NO: 45338 - RNA, 22 nt, Homo sapiens
gcugcuguaccagaugugguua

SEQ ID NO: 45339 - RNA, 22 nt, Homo sapiens
gcugcuguuuaguuucuccugg

SEQ ID NO: 45340 - RNA, 22 nt, Homo sapiens
gcugucuggagucuguucaaug

SEQ ID NO: 45341 - RNA, 22 nt, Homo sapiens
gcuguugguaaaaaggacauga

SEQ ID NO: 45342 - RNA, 22 nt, Homo sapiens
ggaagacaguguggugauuccu

SEQ ID NO: 45343 - RNA, 22 nt, Homo sapiens
ggagaauugcuuggacccggga

SEQ ID NO: 45344 - RNA, 22 nt, Homo sapiens
ggagaucacucuuuguagcgug

SEQ ID NO: 45345 - RNA, 22 nt, Homo sapiens
ggagggugagaucaauuuggga

SEQ ID NO: 45346 - RNA, 22 nt, Homo sapiens
ggagguagucuuucccuuauca

SEQ ID NO: 45347 - RNA, 22 nt, Homo sapiens
aaagaagucagccuguccuuug

SEQ ID NO: 45348 - RNA, 22 nt, Homo sapiens
aaagcuaagguagcauuggaga

SEQ ID NO: 45349 - RNA, 22 nt, Homo sapiens
aaaggcacugaucuuauccagu

SEQ ID NO: 45350 - RNA, 22 nt, Homo sapiens
aaagugaauguaucccguaagu

SEQ ID NO: 45351 - RNA, 22 nt, Homo sapiens
aaagugcuuccuuuuugagggu

SEQ ID NO: 45352 - RNA, 22 nt, Homo sapiens
aaaugcauggacagcuggucuu

SEQ ID NO: 45353 - RNA, 22 nt, Homo sapiens
aaauugcacaaguggugauuug

SEQ ID NO: 45354 - RNA, 19 nt, Homo sapiens
aagaugauguuugggcuaa

SEQ ID NO: 45355 - RNA, 22 nt, Homo sapiens
aaggaacuggaauauuuugaac

SEQ ID NO: 45356 - RNA, 22 nt, Homo sapiens
aaggcaagauacugguugcuga

SEQ ID NO: 45357 - RNA, 22 nt, Homo sapiens
aagggaaugcgcugccuguguu

SEQ ID NO: 45358 - RNA, 22 nt, Homo sapiens
aagugauguuauugggugacuc

SEQ ID NO: 45359 - RNA, 20 nt, Homo sapiens
aagugcuauuucuuuugugg

SEQ ID NO: 45360 - RNA, 22 nt, Homo sapiens
aagugcuucagaagacaauauu

SEQ ID NO: 45361 - RNA, 22 nt, Homo sapiens
aagugcuuuguacagggguuga

SEQ ID NO: 45362 - RNA, 22 nt, Homo sapiens
aauaaagcuuugagcuuugcug

SEQ ID NO: 45363 - RNA, 22 nt, Homo sapiens
aauaagcauaguaccugauagg

SEQ ID NO: 45364 - RNA, 22 nt, Homo sapiens
aaucacuuugcuacaaggcagu

SEQ ID NO: 45365 - RNA, 22 nt, Homo sapiens
aaucucagcauuuugggcugag

SEQ ID NO: 45366 - RNA, 22 nt, Homo sapiens
aaugaaguuagauguugagaag

SEQ ID NO: 45367 - RNA, 22 nt, Homo sapiens
aaugcuguguuauuucaugacc

SEQ ID NO: 45368 - RNA, 22 nt, Homo sapiens
aaugugcuuucuuucacacagu

SEQ ID NO: 45369 - RNA, 22 nt, Homo sapiens
acaaagugccuccuuuuagagu

SEQ ID NO: 45370 - RNA, 22 nt, Homo sapiens
acaagcacaaaugcauagaugg

SEQ ID NO: 45371 - RNA, 22 nt, Homo sapiens
acacauuagcaagugcuguuau

SEQ ID NO: 45372 - RNA, 22 nt, Homo sapiens
acacuuucuggagcugcacaua

SEQ ID NO: 45373 - RNA, 22 nt, Homo sapiens
acagugcuuggcacacaguaau

SEQ ID NO: 45374 - RNA, 17 nt, Homo sapiens
accagugcaugugcuuu

SEQ ID NO: 45375 - RNA, 22 nt, Homo sapiens
acugcacuccagcccgggugac

SEQ ID NO: 45376 - RNA, 22 nt, Homo sapiens
acugcacuccagccucaugaca

SEQ ID NO: 45377 - RNA, 22 nt, Homo sapiens
acugcacuccagccucgcaaca

SEQ ID NO: 45378 - RNA, 22 nt, Homo sapiens
acugcacuccagccucggggac

SEQ ID NO: 45379 - RNA, 22 nt, Homo sapiens
acugcacuccagccucggugac

SEQ ID NO: 45380 - RNA, 22 nt, Homo sapiens
acugcacuccagccuucggaca

SEQ ID NO: 45381 - RNA, 22 nt, Homo sapiens
acugcacuccggccuggcaaca

SEQ ID NO: 45382 - RNA, 22 nt, Homo sapiens
acugcacuucagccuugugaca

SEQ ID NO: 45383 - RNA, 22 nt, Homo sapiens
acugcauuugucugucucaauu

SEQ ID NO: 45384 - RNA, 22 nt, Homo sapiens
acuucauucucuggaucagaau

SEQ ID NO: 45385 - RNA, 20 nt, Homo sapiens
agaaccuguaguguagaggg

SEQ ID NO: 45386 - RNA, 22 nt, Homo sapiens
agacccuguauguguuuaguuu

SEQ ID NO: 45387 - RNA, 22 nt, Homo sapiens
agagagguggguggagccccca

SEQ ID NO: 45388 - RNA, 22 nt, Homo sapiens
agagaucaauaugaaggaaaug

SEQ ID NO: 45389 - RNA, 20 nt, Homo sapiens
agagcaaagccgcaccccua

SEQ ID NO: 45390 - RNA, 22 nt, Homo sapiens
agagguauuggaaggaguguca

SEQ ID NO: 45391 - RNA, 22 nt, Homo sapiens
agagugcaauggcaccaucucg

SEQ ID NO: 45392 - RNA, 22 nt, Homo sapiens
agaucauaugcaguaaugaacu

SEQ ID NO: 45393 - RNA, 22 nt, Homo sapiens
agaugccuaugaagagaaauua

SEQ ID NO: 45394 - RNA, 22 nt, Homo sapiens
agauggguuuucacauguuggc

SEQ ID NO: 45395 - RNA, 22 nt, Homo sapiens
ugucacugugcagucaugcauu

SEQ ID NO: 45396 - RNA, 22 nt, Homo sapiens
ugucaugaacucacauucuggg

SEQ ID NO: 45397 - RNA, 20 nt, Homo sapiens
ugucauuaagcacugugcca

SEQ ID NO: 45398 - RNA, 19 nt, Homo sapiens
uguccuagaggaguucaca

SEQ ID NO: 45399 - RNA, 22 nt, Homo sapiens
uguccugcagagguguuugccu

SEQ ID NO: 45400 - RNA, 22 nt, Homo sapiens
ugucucaguucccuucucugga

SEQ ID NO: 45401 - RNA, 22 nt, Homo sapiens
ugucugagacuguuuuacuuuc

SEQ ID NO: 45402 - RNA, 23 nt, Homo sapiens
ugugcacauuuacauauauacac

SEQ ID NO: 45403 - RNA, 22 nt, Homo sapiens
ugugcgcaucggggccugcuuc

SEQ ID NO: 45404 - RNA, 22 nt, Homo sapiens
ugugcuaauacauacagugcua

SEQ ID NO: 45405 - RNA, 22 nt, Homo sapiens
ugugcuugaauuuaguagcuua

SEQ ID NO: 45406 - RNA, 22 nt, Homo sapiens
uguuacagugacuaauguuuua

SEQ ID NO: 45407 - RNA, 22 nt, Homo sapiens
uguuaucauuacguucuuaguu

SEQ ID NO: 45408 - RNA, 22 nt, Homo sapiens
uuaacagcacaugcugucccuu

SEQ ID NO: 45409 - RNA, 22 nt, Homo sapiens
uuaacagcacuacguggggauc

SEQ ID NO: 45410 - RNA, 22 nt, Homo sapiens
uuaacagugucaaucuguagua

SEQ ID NO: 45411 - RNA, 22 nt, Homo sapiens
uuaaguuaggcuucagcagucu

SEQ ID NO: 45412 - RNA, 22 nt, Homo sapiens
uuaauguaauugauugauugac

SEQ ID NO: 45413 - RNA, 22 nt, Homo sapiens
uuacagucuuaggcagugcuuu

SEQ ID NO: 45414 - RNA, 18 nt, Homo sapiens
uuagagugcauuacuuug

SEQ ID NO: 45415 - RNA, 22 nt, Homo sapiens
uuagaguguagcaggaagaggc

SEQ ID NO: 45416 - RNA, 22 nt, Homo sapiens
uuauguaaaucaaucuggaauc

SEQ ID NO: 45417 - RNA, 22 nt, Homo sapiens
uuauucauuaauugcuaagguu

SEQ ID NO: 45418 - RNA, 22 nt, Homo sapiens
uucaaaguuggaggacaaacug

SEQ ID NO: 45419 - RNA, 23 nt, Homo sapiens
uucaacagguagacccucccugc

SEQ ID NO: 45420 - RNA, 22 nt, Homo sapiens
uucaagugguucagaagucuga

SEQ ID NO: 45421 - RNA, 22 nt, Homo sapiens
uucacaguguuucucacgguua

SEQ ID NO: 45422 - RNA, 22 nt, Homo sapiens
uucacaugguugccuuuugauc

SEQ ID NO: 45423 - RNA, 22 nt, Homo sapiens
uucacugugaauaaaggcuccc

SEQ ID NO: 45424 - RNA, 22 nt, Homo sapiens
uucacugugugacccugggcca

SEQ ID NO: 45425 - RNA, 22 nt, Homo sapiens
uucauggacucaauaguuucgc

SEQ ID NO: 45426 - RNA, 22 nt, Homo sapiens
uuccaguguuugacucaccuuu

SEQ ID NO: 45427 - RNA, 22 nt, Homo sapiens
uuccauguaguugaacgguuuu

SEQ ID NO: 45428 - RNA, 20 nt, Homo sapiens
uucccucagccuugagggua

SEQ ID NO: 45429 - RNA, 22 nt, Homo sapiens
uucccuuucugaaaaucucauu

SEQ ID NO: 45430 - RNA, 22 nt, Homo sapiens
uuccguguaguugagcaguuuu

SEQ ID NO: 45431 - RNA, 20 nt, Homo sapiens
uucuaguacuucuguuucca

SEQ ID NO: 45432 - RNA, 22 nt, Homo sapiens
uucucagugaacuccagcuugu

SEQ ID NO: 45433 - RNA, 22 nt, Homo sapiens
uugaaguaugaccgcugagaau

SEQ ID NO: 45434 - RNA, 17 nt, Homo sapiens
uugagaguauaucuuac

SEQ ID NO: 45435 - RNA, 22 nt, Homo sapiens
uugagaugaagucuugcucucu

SEQ ID NO: 45436 - RNA, 22 nt, Homo sapiens
uugagaugaaguuuugcucuuu

SEQ ID NO: 45437 - RNA, 22 nt, Homo sapiens
uugagauggagucuugcucugu

SEQ ID NO: 45438 - RNA, 22 nt, Homo sapiens
uugcaccacugcacuccacccu

SEQ ID NO: 45439 - RNA, 22 nt, Homo sapiens
gaagcauugauccacaggcgug

SEQ ID NO: 45440 - RNA, 22 nt, Homo sapiens
gaauguuuacuuuguuuaauac

SEQ ID NO: 45441 - RNA, 22 nt, Homo sapiens
gagauggugugcuguuggaagu

SEQ ID NO: 45442 - RNA, 22 nt, Homo sapiens
gagcucauuaaaaauguagaau

SEQ ID NO: 45443 - RNA, 22 nt, Homo sapiens
gagcucauuguugcuaaagaga

SEQ ID NO: 45444 - RNA, 22 nt, Homo sapiens
gagcugguccuuuaaggaugca

SEQ ID NO: 45445 - RNA, 22 nt, Homo sapiens
gagguagaauguuuuucagcug

SEQ ID NO: 45446 - RNA, 22 nt, Homo sapiens
gagguguagagauauaccugaa

SEQ ID NO: 45447 - RNA, 22 nt, Homo sapiens
gagugcauugguggucaggugu

SEQ ID NO: 45448 - RNA, 20 nt, Homo sapiens
gcaaaguuuagcucccacua

SEQ ID NO: 45449 - RNA, 17 nt, Homo sapiens
gcacuggcguaucccac

SEQ ID NO: 45450 - RNA, 16 nt, Homo sapiens
gcucuuguucucuguu

SEQ ID NO: 45451 - RNA, 22 nt, Homo sapiens
gcugauggugcaguucuagccu

SEQ ID NO: 45452 - RNA, 17 nt, Homo sapiens
gcugauguuugcauuuu

SEQ ID NO: 45453 - RNA, 19 nt, Homo sapiens
gcugguuguccacucucuc

SEQ ID NO: 45454 - RNA, 22 nt, Homo sapiens
gcuguaguugaggauuuuaaga

SEQ ID NO: 45455 - RNA, 20 nt, Homo sapiens
gcugugcuuaauacacuuuc

SEQ ID NO: 45456 - RNA, 22 nt, Homo sapiens
gcuguugugaacuauacaucua

SEQ ID NO: 45457 - RNA, 17 nt, Homo sapiens
gacgaucaucaggaggc

SEQ ID NO: 45458 - RNA, 18 nt, Homo sapiens
gacuccauuucagccaga

SEQ ID NO: 45459 - RNA, 22 nt, Homo sapiens
gagagugcuuggcaucugcuga

SEQ ID NO: 45460 - RNA, 22 nt, Homo sapiens
gagaucaguuaaugaagugagc

SEQ ID NO: 45461 - RNA, 22 nt, Homo sapiens
gagaugguguuccacugccagu

SEQ ID NO: 45462 - RNA, 22 nt, Homo sapiens
gagauguuuguuucacugucac

SEQ ID NO: 45463 - RNA, 22 nt, Homo sapiens
gagauuaauacacaucaaaugc

SEQ ID NO: 45464 - RNA, 22 nt, Homo sapiens
gagcugccuugccuaugcaaga

SEQ ID NO: 45465 - RNA, 22 nt, Homo sapiens
gagcuuguggucuucguguuau

SEQ ID NO: 45466 - RNA, 22 nt, Homo sapiens
gaggagauauucugcuggaugg

SEQ ID NO: 45467 - RNA, 17 nt, Homo sapiens
gagguaguuuacuuuca

SEQ ID NO: 45468 - RNA, 22 nt, Homo sapiens
gagguaguuuaguuuuggggaa

SEQ ID NO: 45469 - RNA, 22 nt, Homo sapiens
gaguauguauaugagugugucu

SEQ ID NO: 45470 - RNA, 22 nt, Homo sapiens
gaucacauuguuucauacauau

SEQ ID NO: 45471 - RNA, 22 nt, Homo sapiens
gaugauguuugauaaauaauaa

SEQ ID NO: 45472 - RNA, 22 nt, Homo sapiens
gcaaggacucccugggucauuc

SEQ ID NO: 45473 - RNA, 22 nt, Homo sapiens
gcaggaaucuugagaaggauuc

SEQ ID NO: 45474 - RNA, 22 nt, Homo sapiens
gcaguguggguagagggcaaga

SEQ ID NO: 45475 - RNA, 22 nt, Homo sapiens
gccuguagaagaguagaugacc

SEQ ID NO: 45476 - RNA, 22 nt, Homo sapiens
gcggguguuuuacccuugcaga

SEQ ID NO: 45477 - RNA, 22 nt, Homo sapiens
gcuaggagauccacugcucucu

SEQ ID NO: 45478 - RNA, 22 nt, Homo sapiens
gcuggucugccguaguaggugc

SEQ ID NO: 45479 - RNA, 22 nt, Homo sapiens
gcugucaugagcaacacaugaa

SEQ ID NO: 45480 - RNA, 22 nt, Homo sapiens
ggaagaauaaugggccuuagag

SEQ ID NO: 45481 - RNA, 20 nt, Homo sapiens
ggaauagucuacacucugac

SEQ ID NO: 45482 - RNA, 22 nt, Homo sapiens
ggagauguuuaaccuuuuaucu

SEQ ID NO: 45483 - RNA, 22 nt, Homo sapiens
ggaguguuccauuugucacauu

SEQ ID NO: 45484 - RNA, 22 nt, Homo sapiens
ggcagcucaggccccgcgcuga

SEQ ID NO: 45485 - RNA, 22 nt, Homo sapiens
ggcaguuuguucuugcuccuuu

SEQ ID NO: 45486 - RNA, 22 nt, Homo sapiens
ggcaguuuguuugugaggucca

SEQ ID NO: 45487 - RNA, 22 nt, Homo sapiens
gggaagugugcagaguucucuu

SEQ ID NO: 45488 - RNA, 22 nt, Homo sapiens
gggaagugugguuucuuuacag

SEQ ID NO: 45489 - RNA, 19 nt, Homo sapiens
gggaggaugcgucuucagg

SEQ ID NO: 45490 - RNA, 22 nt, Homo sapiens
guaaauguccugcuacagagug

SEQ ID NO: 45491 - RNA, 18 nt, Homo sapiens
guaggucaguaccaagca

SEQ ID NO: 45492 - RNA, 22 nt, Homo sapiens
guauacuucugaaaauagcuau

SEQ ID NO: 45493 - RNA, 22 nt, Homo sapiens
gucacugugaggaggggccagg

SEQ ID NO: 45494 - RNA, 22 nt, Homo sapiens
gucagugugauaucugcagggg

SEQ ID NO: 45495 - RNA, 22 nt, Homo sapiens
gucccugaggaacauccagggc

SEQ ID NO: 45496 - RNA, 22 nt, Homo sapiens
gucccugcgauugugggauccu

SEQ ID NO: 45497 - RNA, 22 nt, Homo sapiens
gucuuuaguugaaacauguggu

SEQ ID NO: 45498 - RNA, 22 nt, Homo sapiens
gucuuuguuauuaugaaucaac

SEQ ID NO: 45499 - RNA, 22 nt, Homo sapiens
gugaaacuggguggugagagac

SEQ ID NO: 45500 - RNA, 22 nt, Homo sapiens
gugacugcauauaaguguaugu

SEQ ID NO: 45501 - RNA, 22 nt, Homo sapiens
gugagaagaaaaauauggcugu

SEQ ID NO: 45502 - RNA, 22 nt, Homo sapiens
gugauaucacuguaucacucca

SEQ ID NO: 45503 - RNA, 22 nt, Homo sapiens
gugcaacaucccuccauaauuu

SEQ ID NO: 45504 - RNA, 22 nt, Homo sapiens
guggaagcacaggccuccugga

SEQ ID NO: 45505 - RNA, 22 nt, Homo sapiens
guggcaaggaaaugcugcucac

SEQ ID NO: 45506 - RNA, 22 nt, Homo sapiens
guggcuaaagauuuggaaucug

SEQ ID NO: 45507 - RNA, 22 nt, Homo sapiens
guguagagaaauagccugaagg

SEQ ID NO: 45508 - RNA, 22 nt, Homo sapiens
gugugcaugucuuuuuaguagg

SEQ ID NO: 45509 - RNA, 22 nt, Homo sapiens
guugccuaggcuggagugcagu

SEQ ID NO: 45510 - RNA, 20 nt, Homo sapiens
uaaagcugcucagggggcuc

SEQ ID NO: 45511 - RNA, 22 nt, Homo sapiens
uaacacagagcuccuaaucccu

SEQ ID NO: 45512 - RNA, 19 nt, Homo sapiens
uaacacaguuguguuugag

SEQ ID NO: 45513 - RNA, 22 nt, Homo sapiens
uaacccuuacaacuacacucgu

SEQ ID NO: 45514 - RNA, 21 nt, Homo sapiens
uaagacugccaguagggcugu

SEQ ID NO: 45515 - RNA, 22 nt, Homo sapiens
uaaggcuugaucuuggugagau

SEQ ID NO: 45516 - RNA, 22 nt, Homo sapiens
uaaguaauugugguuuuugcca

SEQ ID NO: 45517 - RNA, 22 nt, Homo sapiens
uaaguaauuuguauuuuaccca

SEQ ID NO: 45518 - RNA, 22 nt, Homo sapiens
uaagugaaggaaguguguuuac

SEQ ID NO: 45519 - RNA, 22 nt, Homo sapiens
uaagugaauauggacaguuagc

SEQ ID NO: 45520 - RNA, 22 nt, Homo sapiens
uaagugaauuucacuacugagu

SEQ ID NO: 45521 - RNA, 18 nt, Homo sapiens
uaauaacugugaccuuga

SEQ ID NO: 45522 - RNA, 22 nt, Homo sapiens
uaauagcaguguuacuaggacu

SEQ ID NO: 45523 - RNA, 22 nt, Homo sapiens
uaaugcuguggucugguuuaaa

SEQ ID NO: 45524 - RNA, 22 nt, Homo sapiens
uacaguagaaugucuuucaaaa

SEQ ID NO: 45525 - RNA, 22 nt, Homo sapiens
uacagugcuugguaucuaguaa

SEQ ID NO: 45526 - RNA, 22 nt, Homo sapiens
uacauguauccauuguuuuugg

SEQ ID NO: 45527 - RNA, 22 nt, Homo sapiens
ucacuuuggguacuauggaaau

SEQ ID NO: 45528 - RNA, 22 nt, Homo sapiens
ucacuuuguauagcgacuggcu

SEQ ID NO: 45529 - RNA, 22 nt, Homo sapiens
ucagcagugccccacucuacug

SEQ ID NO: 45530 - RNA, 21 nt, Homo sapiens
ucaggaccucuaguuagccag

SEQ ID NO: 45531 - RNA, 20 nt, Homo sapiens
ucagguagaucuuugagguc

SEQ ID NO: 45532 - RNA, 23 nt, Homo sapiens
ucaguacuccacuuucaauagug

SEQ ID NO: 45533 - RNA, 22 nt, Homo sapiens
ucagugcuguuugcccucguuu

SEQ ID NO: 45534 - RNA, 22 nt, Homo sapiens
ucaguguugauggcugcugacu

SEQ ID NO: 45535 - RNA, 22 nt, Homo sapiens
ucaguguuuuauccuccagagc

SEQ ID NO: 45536 - RNA, 22 nt, Homo sapiens
ucaugcaaugagucaggaggca

SEQ ID NO: 45537 - RNA, 22 nt, Homo sapiens
ucauggggugcuuugcuagauu

SEQ ID NO: 45538 - RNA, 22 nt, Homo sapiens
uccacagugguggaauuguuca

SEQ ID NO: 45539 - RNA, 18 nt, Homo sapiens
ucccucagaauuauagaa

SEQ ID NO: 45540 - RNA, 22 nt, Homo sapiens
ucucacagaguugaauguuucu

SEQ ID NO: 45541 - RNA, 22 nt, Homo sapiens
ucucaguguuaucuaucugccu

SEQ ID NO: 45542 - RNA, 22 nt, Homo sapiens
ucuugcacacaguaaguguuuu

SEQ ID NO: 45543 - RNA, 22 nt, Homo sapiens
ugaacacuggauaaggagucag

SEQ ID NO: 45544 - RNA, 22 nt, Homo sapiens
ugaacagcacguuuauucagaa

SEQ ID NO: 45545 - RNA, 21 nt, Homo sapiens
ugaaugucuaggcagaaguuu

SEQ ID NO: 45546 - RNA, 22 nt, Homo sapiens
ugaauucuguccaaaauaacug

SEQ ID NO: 45547 - RNA, 22 nt, Homo sapiens
ugacauguugcauuauauuucc

SEQ ID NO: 45548 - RNA, 18 nt, Homo sapiens
agaugguguugcuucugu

SEQ ID NO: 45549 - RNA, 22 nt, Homo sapiens
agaugguguuggcugaguguau

SEQ ID NO: 45550 - RNA, 22 nt, Homo sapiens
agcuggaauuuaagguagauag

SEQ ID NO: 45551 - RNA, 22 nt, Homo sapiens
agcuguuguuaauuaacucauu

SEQ ID NO: 45552 - RNA, 22 nt, Homo sapiens
agcuuuuugggcagcuauugac

SEQ ID NO: 45553 - RNA, 22 nt, Homo sapiens
aggaagugugcaauuaauuucu

SEQ ID NO: 45554 - RNA, 22 nt, Homo sapiens
aggaauguuaguacuucuuagu

SEQ ID NO: 45555 - RNA, 21 nt, Homo sapiens
aggcaagguguuauuauugaa

SEQ ID NO: 45556 - RNA, 22 nt, Homo sapiens
agguagucuuuuccuauuguca

SEQ ID NO: 45557 - RNA, 22 nt, Homo sapiens
aguacacuguuaaaaagaagug

SEQ ID NO: 45558 - RNA, 22 nt, Homo sapiens
agucauggcagaaggcaccucu

SEQ ID NO: 45559 - RNA, 22 nt, Homo sapiens
agucaugggagagaugugaucg

SEQ ID NO: 45560 - RNA, 23 nt, Homo sapiens
agugccuaguauauaggaggcgc

SEQ ID NO: 45561 - RNA, 22 nt, Homo sapiens
aguuaguguugugauaaaucca

SEQ ID NO: 45562 - RNA, 22 nt, Homo sapiens
auacaguugccauuucuugugc

SEQ ID NO: 45563 - RNA, 22 nt, Homo sapiens
auacuguuuuacaucauugccu

SEQ ID NO: 45564 - RNA, 22 nt, Homo sapiens
auccauguggauaaauguguau

SEQ ID NO: 45565 - RNA, 22 nt, Homo sapiens
aucuagagaggcagucuggccg

SEQ ID NO: 45566 - RNA, 22 nt, Homo sapiens
aucugcacaucuguguuuuugu

SEQ ID NO: 45567 - RNA, 21 nt, Homo sapiens
aucugugagaccuuggggguu

SEQ ID NO: 45568 - RNA, 22 nt, Homo sapiens
augacugucagggcagucauug

SEQ ID NO: 45569 - RNA, 22 nt, Homo sapiens
augagguguuuauuguauccug

SEQ ID NO: 45570 - RNA, 22 nt, Homo sapiens
augaucuguuuggugaucuugu

SEQ ID NO: 45571 - RNA, 22 nt, Homo sapiens
augcaaaucuuaaguaugugug

SEQ ID NO: 45572 - RNA, 22 nt, Homo sapiens
augcauauuuuaccuagaagag

SEQ ID NO: 45573 - RNA, 22 nt, Homo sapiens
auggaguuugaacaauuuccug

SEQ ID NO: 45574 - RNA, 22 nt, Homo sapiens
auggcucuguuccaugugucuu

SEQ ID NO: 45575 - RNA, 22 nt, Homo sapiens
auggcuuuuauuguguugaggu

SEQ ID NO: 45576 - RNA, 21 nt, Homo sapiens
augggguagaagagaaggcuu

SEQ ID NO: 45577 - RNA, 22 nt, Homo sapiens
auguaguagcagaaaauauuuu

SEQ ID NO: 45578 - RNA, 22 nt, Homo sapiens
augugcacaugcuuacauguga

SEQ ID NO: 45579 - RNA, 21 nt, Homo sapiens
augugcacuaugucauuuaau

SEQ ID NO: 45580 - RNA, 22 nt, Homo sapiens
auguggcacuugacuuucucgc

SEQ ID NO: 45581 - RNA, 22 nt, Homo sapiens
auguggcauuucucauucauuu

SEQ ID NO: 45582 - RNA, 22 nt, Homo sapiens
auguggugguagccaggacagg

SEQ ID NO: 45583 - RNA, 18 nt, Homo sapiens
auugagcaugacagaccu

SEQ ID NO: 45584 - RNA, 22 nt, Homo sapiens
auugcaauuaguccauagaguu

SEQ ID NO: 45585 - RNA, 22 nt, Homo sapiens
auugcacaucugcacuacagcc

SEQ ID NO: 45586 - RNA, 19 nt, Homo sapiens
auugcacuccaaccugggu

SEQ ID NO: 45587 - RNA, 22 nt, Homo sapiens
auugcacuccacccugggcaac

SEQ ID NO: 45588 - RNA, 22 nt, Homo sapiens
auugcacuccagccuggaugac

SEQ ID NO: 45589 - RNA, 22 nt, Homo sapiens
auugcacuccagccuggccgag

SEQ ID NO: 45590 - RNA, 22 nt, Homo sapiens
auugcacuccagccugggcuag

SEQ ID NO: 45591 - RNA, 22 nt, Homo sapiens
auugcacuccauccuaggugac

SEQ ID NO: 45592 - RNA, 22 nt, Homo sapiens
auugcacuccauccugggcaau

SEQ ID NO: 45593 - RNA, 22 nt, Homo sapiens
auugcacucuagccuuggcgac

SEQ ID NO: 45594 - RNA, 22 nt, Homo sapiens
auugcacugcagccugggcaac

SEQ ID NO: 45595 - RNA, 22 nt, Homo sapiens
caaaugcuucuauggacugucu

SEQ ID NO: 45596 - RNA, 22 nt, Homo sapiens
caagugaauaguugcucucaga

SEQ ID NO: 45597 - RNA, 19 nt, Homo sapiens
caauacuucuuggcauaca

SEQ ID NO: 45598 - RNA, 22 nt, Homo sapiens
cacaggccugucucuuucuaac

SEQ ID NO: 45599 - RNA, 22 nt, Homo sapiens
cacagugaaugucaucauugcc

SEQ ID NO: 45600 - RNA, 22 nt, Homo sapiens
cacuuugguucaccugaguuuc

SEQ ID NO: 45601 - RNA, 22 nt, Homo sapiens
cagccgggugagguggcuuguu

SEQ ID NO: 45602 - RNA, 20 nt, Homo sapiens
cagucauagacaucagaguc

SEQ ID NO: 45603 - RNA, 22 nt, Homo sapiens
cagugaauuucaggucaagagu

SEQ ID NO: 45604 - RNA, 21 nt, Homo sapiens
cauaaugcuacuuauuuuaug

SEQ ID NO: 45605 - RNA, 22 nt, Homo sapiens
cauggcccugggcugggcgaac

SEQ ID NO: 45606 - RNA, 22 nt, Homo sapiens
cauggcuuuuauaacaagaaau

SEQ ID NO: 45607 - RNA, 22 nt, Homo sapiens
cuaaaacuuucugagugcagca

SEQ ID NO: 45608 - RNA, 22 nt, Homo sapiens
cuacagcacugagcugugugca

SEQ ID NO: 45609 - RNA, 22 nt, Homo sapiens
cucagugucuggggccccaggg

SEQ ID NO: 45610 - RNA, 22 nt, Homo sapiens
cugacugugcaugcccagcccc

SEQ ID NO: 45611 - RNA, 22 nt, Homo sapiens
cugagguauaucccauuagaag

SEQ ID NO: 45612 - RNA, 22 nt, Homo sapiens
cugauugucaucaauauuauua

SEQ ID NO: 45613 - RNA, 19 nt, Homo sapiens
cugcacugagaaaaggagg

SEQ ID NO: 45614 - RNA, 22 nt, Homo sapiens
cugcuggucuuuaaggucuagg

SEQ ID NO: 45615 - RNA, 22 nt, Homo sapiens
cugcuguuguuaacuuuuggag

SEQ ID NO: 45616 - RNA, 22 nt, Homo sapiens
cuggaguaugaaccauguauca

SEQ ID NO: 45617 - RNA, 22 nt, Homo sapiens
cuggcgagacagcuccaucacu

SEQ ID NO: 45618 - RNA, 22 nt, Homo sapiens
cuggugagaugucuuuccucuu

SEQ ID NO: 45619 - RNA, 22 nt, Homo sapiens
cugucucagccucuccaguagc

SEQ ID NO: 45620 - RNA, 22 nt, Homo sapiens
cugucuguuucaaaagugguua

SEQ ID NO: 45621 - RNA, 22 nt, Homo sapiens
cuuaaagcgaauauugguggua

SEQ ID NO: 45622 - RNA, 22 nt, Homo sapiens
cuuaacagugguauugaugacc

SEQ ID NO: 45623 - RNA, 22 nt, Homo sapiens
cuuaggguacuuuggugcauca

SEQ ID NO: 45624 - RNA, 22 nt, Homo sapiens
cuucaugagacuuuuggaaggc

SEQ ID NO: 45625 - RNA, 22 nt, Homo sapiens
ggcacaauugcagcaauaaaca

SEQ ID NO: 45626 - RNA, 22 nt, Homo sapiens
ggcacaguuaagugcuaccuaa

SEQ ID NO: 45627 - RNA, 22 nt, Homo sapiens
gguaaguuuggggcuaauuugu

SEQ ID NO: 45628 - RNA, 22 nt, Homo sapiens
ggucaacaucaucaugguaagu

SEQ ID NO: 45629 - RNA, 20 nt, Homo sapiens
guaacagcacuuucccaaag

SEQ ID NO: 45630 - RNA, 22 nt, Homo sapiens
guaaucucagcuacucgggagg

SEQ ID NO: 45631 - RNA, 22 nt, Homo sapiens
guauacaguugacccuugaacc

SEQ ID NO: 45632 - RNA, 22 nt, Homo sapiens
gucauugagucagggaguaucu

SEQ ID NO: 45633 - RNA, 22 nt, Homo sapiens
gucugucuuuugucuuugaaau

SEQ ID NO: 45634 - RNA, 22 nt, Homo sapiens
gugaauguuuucuuacauggua

SEQ ID NO: 45635 - RNA, 22 nt, Homo sapiens
gugauugugaaaacauuaagaa

SEQ ID NO: 45636 - RNA, 22 nt, Homo sapiens
gugcacaacaugcaguuuuguu

SEQ ID NO: 45637 - RNA, 22 nt, Homo sapiens
gugcacaaucgugcauuccuug

SEQ ID NO: 45638 - RNA, 21 nt, Homo sapiens
gugcagacacacauauaggcu

SEQ ID NO: 45639 - RNA, 22 nt, Homo sapiens
guggaagucuuugguauuggua

SEQ ID NO: 45640 - RNA, 22 nt, Homo sapiens
guggaguaugaaaacugacuuu

SEQ ID NO: 45641 - RNA, 22 nt, Homo sapiens
gugggcaagucacuucaguucu

SEQ ID NO: 45642 - RNA, 22 nt, Homo sapiens
guguauauccuauuaguucugu

SEQ ID NO: 45643 - RNA, 22 nt, Homo sapiens
gugucucagcccagaccuauuu

SEQ ID NO: 45644 - RNA, 22 nt, Homo sapiens
gugugcaacuuucauuaauauu

SEQ ID NO: 45645 - RNA, 22 nt, Homo sapiens
guguucaaauucugacagagag

SEQ ID NO: 45646 - RNA, 22 nt, Homo sapiens
uaagagagcuccaucuuuuccu

SEQ ID NO: 45647 - RNA, 19 nt, Homo sapiens
uaaguagaugacugaugcu

SEQ ID NO: 45648 - RNA, 22 nt, Homo sapiens
uaaguauuaugugcugcauuuu

SEQ ID NO: 45649 - RNA, 22 nt, Homo sapiens
uaagucacuccagguuaaagug

SEQ ID NO: 45650 - RNA, 22 nt, Homo sapiens
uaagugaauuugacagguaaug

SEQ ID NO: 45651 - RNA, 22 nt, Homo sapiens
uaaguucauucaugaaacuuag

SEQ ID NO: 45652 - RNA, 22 nt, Homo sapiens
uacaacacugguucgacaugug

SEQ ID NO: 45653 - RNA, 22 nt, Homo sapiens
uacagccacauaauguaugauu

SEQ ID NO: 45654 - RNA, 22 nt, Homo sapiens
uacugcacucuagccuggguga

SEQ ID NO: 45655 - RNA, 22 nt, Homo sapiens
uagagugcugucaaagacuugu

SEQ ID NO: 45656 - RNA, 22 nt, Homo sapiens
uagauuauuggcugauuugauc

SEQ ID NO: 45657 - RNA, 22 nt, Homo sapiens
uaggugaaugcuggaagaaaug

SEQ ID NO: 45658 - RNA, 20 nt, Homo sapiens
uauagcaauuuuuuucuccu

SEQ ID NO: 45659 - RNA, 21 nt, Homo sapiens
uauaguaguaugauuuacaau

SEQ ID NO: 45660 - RNA, 22 nt, Homo sapiens
uaucacaguaaaucugggugca

SEQ ID NO: 45661 - RNA, 22 nt, Homo sapiens
uaucaugggggguguacacucc

SEQ ID NO: 45662 - RNA, 22 nt, Homo sapiens
uaugacuguuugcucauucagg

SEQ ID NO: 45663 - RNA, 22 nt, Homo sapiens
uauggauuuuuuugacaagagc

SEQ ID NO: 45664 - RNA, 22 nt, Homo sapiens
uauggcucuauuuccuugucua

SEQ ID NO: 45665 - RNA, 22 nt, Homo sapiens
uauggguuuuucauaaauaggu

SEQ ID NO: 45666 - RNA, 17 nt, Homo sapiens
uauguaguacuuauaaa

SEQ ID NO: 45667 - RNA, 22 nt, Homo sapiens
uauuccacucuguuggagguaa

SEQ ID NO: 45668 - RNA, 22 nt, Homo sapiens
ucaaaaccucagagaguagagc

SEQ ID NO: 45669 - RNA, 22 nt, Homo sapiens
ucacacgugaacucaucacaga

SEQ ID NO: 45670 - RNA, 22 nt, Homo sapiens
ucacagaugaggcgagaggcag

SEQ ID NO: 45671 - RNA, 22 nt, Homo sapiens
ucacaguagcaaauguuagaaa

SEQ ID NO: 45672 - RNA, 22 nt, Homo sapiens
ucaccuggggcacagcugaaga

SEQ ID NO: 45673 - RNA, 22 nt, Homo sapiens
ucagauacuggugacaugaaug

SEQ ID NO: 45674 - RNA, 22 nt, Homo sapiens
ucagcaguggacagaaugguag

SEQ ID NO: 45675 - RNA, 22 nt, Homo sapiens
ucaggugcagagaagaaauggg

SEQ ID NO: 45676 - RNA, 22 nt, Homo sapiens
ucagugaauauauaacagcgau

SEQ ID NO: 45677 - RNA, 22 nt, Homo sapiens
ucagugcuuggcacagagagcu

SEQ ID NO: 45678 - RNA, 22 nt, Homo sapiens
ucauacaggccaccagggaagu

SEQ ID NO: 45679 - RNA, 22 nt, Homo sapiens
ucauacuguugugaaacaaaac

SEQ ID NO: 45680 - RNA, 22 nt, Homo sapiens
ucauaugucauaguaugaucuu

SEQ ID NO: 45681 - RNA, 21 nt, Homo sapiens
ucaucagucaaagacaauggu

SEQ ID NO: 45682 - RNA, 22 nt, Homo sapiens
ucaugugagcaaguugggcuca

SEQ ID NO: 45683 - RNA, 22 nt, Homo sapiens
uccacagugguugaacuaguaa

SEQ ID NO: 45684 - RNA, 22 nt, Homo sapiens
auugcacuccagccuaggcaac

SEQ ID NO: 45685 - RNA, 22 nt, Homo sapiens
auugcacuccagccugcggaac

SEQ ID NO: 45686 - RNA, 22 nt, Homo sapiens
auugcacuccagccugggcaac

SEQ ID NO: 45687 - RNA, 21 nt, Homo sapiens
auugcacuccagccugggcga

SEQ ID NO: 45688 - RNA, 22 nt, Homo sapiens
auugcacuccagccugggcgac

SEQ ID NO: 45689 - RNA, 22 nt, Homo sapiens
auugcacuccagcuugggugac

SEQ ID NO: 45690 - RNA, 22 nt, Homo sapiens
auugcacuccagucugggcaac

SEQ ID NO: 45691 - RNA, 22 nt, Homo sapiens
auugcacucuaaccuaggugac

SEQ ID NO: 45692 - RNA, 22 nt, Homo sapiens
auuguacuccagccuaggcaac

SEQ ID NO: 45693 - RNA, 22 nt, Homo sapiens
caauugcacucuuagguguaca

SEQ ID NO: 45694 - RNA, 22 nt, Homo sapiens
caccacagccauuauugucccc

SEQ ID NO: 45695 - RNA, 22 nt, Homo sapiens
cacuagagaauagguaguucug

SEQ ID NO: 45696 - RNA, 22 nt, Homo sapiens
cacugcacuccagucccgucuc

SEQ ID NO: 45697 - RNA, 22 nt, Homo sapiens
cacugcacuccagucuggcgac

SEQ ID NO: 45698 - RNA, 22 nt, Homo sapiens
cacugcauccuugaccuucugg

SEQ ID NO: 45699 - RNA, 22 nt, Homo sapiens
cagcaguuguuucggauuggga

SEQ ID NO: 45700 - RNA, 20 nt, Homo sapiens
cagcuagugguaggagucgg

SEQ ID NO: 45701 - RNA, 22 nt, Homo sapiens
cagugcuuguuauuguucuauu

SEQ ID NO: 45702 - RNA, 22 nt, Homo sapiens
cauggcuuuauuuucagcuucu

SEQ ID NO: 45703 - RNA, 22 nt, Homo sapiens
caugucuuuuaaacauucaacu

SEQ ID NO: 45704 - RNA, 22 nt, Homo sapiens
cauugggugagaacaugcuccu

SEQ ID NO: 45705 - RNA, 20 nt, Homo sapiens
ccaucaguccucucuuguuc

SEQ ID NO: 45706 - RNA, 22 nt, Homo sapiens
ccauggcuucugcauucuguca

SEQ ID NO: 45707 - RNA, 22 nt, Homo sapiens
cccugagagcagggucuuucuc

SEQ ID NO: 45708 - RNA, 22 nt, Homo sapiens
cccuugcacuucagagcugcau

SEQ ID NO: 45709 - RNA, 22 nt, Homo sapiens
ccuuuguuaguuugcugagaau

SEQ ID NO: 45710 - RNA, 22 nt, Homo sapiens
cuacagguaugaaagggaguau

SEQ ID NO: 45711 - RNA, 22 nt, Homo sapiens
cuagaguguaguuuucuuagga

SEQ ID NO: 45712 - RNA, 22 nt, Homo sapiens
cuagcugcacuuccugcuacug

SEQ ID NO: 45713 - RNA, 22 nt, Homo sapiens
cucacagucagaagggacuugc

SEQ ID NO: 45714 - RNA, 22 nt, Homo sapiens
cucacugucaacauguauuugg

SEQ ID NO: 45715 - RNA, 22 nt, Homo sapiens
cuccccuuuaguuucuuaauaa

SEQ ID NO: 45716 - RNA, 22 nt, Homo sapiens
cugagaauguaaaugaagcuuu

SEQ ID NO: 45717 - RNA, 22 nt, Homo sapiens
cugaggacaucagggaagcauc

SEQ ID NO: 45718 - RNA, 22 nt, Homo sapiens
cuggagcaaaggugacucuugu

SEQ ID NO: 45719 - RNA, 22 nt, Homo sapiens
cuggaguaugauguuagcguug

SEQ ID NO: 45720 - RNA, 22 nt, Homo sapiens
cuggauagagauugaugaugcu

SEQ ID NO: 45721 - RNA, 22 nt, Homo sapiens
cugggauggaggagaauuagag

SEQ ID NO: 45722 - RNA, 22 nt, Homo sapiens
cuguaugugagaaauaauaagu

SEQ ID NO: 45723 - RNA, 22 nt, Homo sapiens
cugugguauuauuagaaauauc

SEQ ID NO: 45724 - RNA, 22 nt, Homo sapiens
cuucaguucuguaaggacagca

SEQ ID NO: 45725 - RNA, 22 nt, Homo sapiens
cuugcacuguuguaagggacuu

SEQ ID NO: 45726 - RNA, 22 nt, Homo sapiens
cuuucucagugagacccgagau

SEQ ID NO: 45727 - RNA, 22 nt, Homo sapiens
cuuugcacaucucugcuuuccc

SEQ ID NO: 45728 - RNA, 22 nt, Homo sapiens
cuuuggugauagauaccccaua

SEQ ID NO: 45729 - RNA, 22 nt, Homo sapiens
gacauguaaggcucucucuguu

SEQ ID NO: 45730 - RNA, 22 nt, Homo sapiens
gagagugcuuuggguguaggcc

SEQ ID NO: 45731 - RNA, 22 nt, Homo sapiens
gagauggagucuuuuucuguca

SEQ ID NO: 45732 - RNA, 22 nt, Homo sapiens
gagaugugguucaaggguguuu

SEQ ID NO: 45733 - RNA, 22 nt, Homo sapiens
gagauuaacauuugaggagcug

SEQ ID NO: 45734 - RNA, 22 nt, Homo sapiens
gagcaguugagagugcuggcca

SEQ ID NO: 45735 - RNA, 22 nt, Homo sapiens
gaggaguagggcacaaagccuu

SEQ ID NO: 45736 - RNA, 22 nt, Homo sapiens
gagguaguuaaugcauucacua

SEQ ID NO: 45737 - RNA, 22 nt, Homo sapiens
gagugcuguuagcccuggguuu

SEQ ID NO: 45738 - RNA, 21 nt, Homo sapiens
gauaaguuggcagccagcacc

SEQ ID NO: 45739 - RNA, 22 nt, Homo sapiens
gauauguaaaaauuauaucuga

SEQ ID NO: 45740 - RNA, 22 nt, Homo sapiens
gauauguacagcucucuaggau

SEQ ID NO: 45741 - RNA, 22 nt, Homo sapiens
aaaugcacaaagauuuugcacu

SEQ ID NO: 45742 - RNA, 22 nt, Homo sapiens
aaaugcagauuccuaggcccca

SEQ ID NO: 45743 - RNA, 22 nt, Homo sapiens
aaaugcagcacucaagugggaa

SEQ ID NO: 45744 - RNA, 22 nt, Homo sapiens
aaauggcacaguaagggcauuu

SEQ ID NO: 45745 - RNA, 22 nt, Homo sapiens
aaauucaugucaccucuaggua

SEQ ID NO: 45746 - RNA, 20 nt, Homo sapiens
aagagcucaccagaauaucu

SEQ ID NO: 45747 - RNA, 22 nt, Homo sapiens
aagagguagucugucccuuagc

SEQ ID NO: 45748 - RNA, 22 nt, Homo sapiens
aagagugucuuugugcuggccc

SEQ ID NO: 45749 - RNA, 22 nt, Homo sapiens
aagcaggugaugagugggugug

SEQ ID NO: 45750 - RNA, 22 nt, Homo sapiens
aagcugccuugcugaggagaaa

SEQ ID NO: 45751 - RNA, 23 nt, Homo sapiens
aagguaagcuagaaagauguaga

SEQ ID NO: 45752 - RNA, 22 nt, Homo sapiens
aaguaauugagguuuuugcugu

SEQ ID NO: 45753 - RNA, 22 nt, Homo sapiens
aaguccccugacagaggggagg

SEQ ID NO: 45754 - RNA, 22 nt, Homo sapiens
aagugcuuuacacaugcaugau

SEQ ID NO: 45755 - RNA, 22 nt, Homo sapiens
aaguguaaguuaauguuuaggu

SEQ ID NO: 45756 - RNA, 23 nt, Homo sapiens
aaguucaugcucaucuguuacac

SEQ ID NO: 45757 - RNA, 21 nt, Homo sapiens
aauaaagcaaccuuaugccau

SEQ ID NO: 45758 - RNA, 22 nt, Homo sapiens
aauaaagcaggguccuugcacu

SEQ ID NO: 45759 - RNA, 22 nt, Homo sapiens
aaucacuuuggcaccaaccuaa

SEQ ID NO: 45760 - RNA, 20 nt, Homo sapiens
aaucuacuugcccauuuagc

SEQ ID NO: 45761 - RNA, 22 nt, Homo sapiens
aaugcacauauauuuccuuauu

SEQ ID NO: 45762 - RNA, 22 nt, Homo sapiens
acagaacugggcuugcuuuugg

SEQ ID NO: 45763 - RNA, 22 nt, Homo sapiens
acaguagaaaacaauggauuug

SEQ ID NO: 45764 - RNA, 22 nt, Homo sapiens
acagugcuuuuguuccucuccu

SEQ ID NO: 45765 - RNA, 22 nt, Homo sapiens
acccucagaccaguuucccugg

SEQ ID NO: 45766 - RNA, 22 nt, Homo sapiens
acugcacuccagccucgugaca

SEQ ID NO: 45767 - RNA, 22 nt, Homo sapiens
acugcacuccagccuucgugac

SEQ ID NO: 45768 - RNA, 20 nt, Homo sapiens
acugcacuccagucucuggg

SEQ ID NO: 45769 - RNA, 22 nt, Homo sapiens
acugcacuccggccucgugaca

SEQ ID NO: 45770 - RNA, 22 nt, Homo sapiens
acugugcuguuuuaauuauuga

SEQ ID NO: 45771 - RNA, 22 nt, Homo sapiens
acuuugcuuaucccaggcacug

SEQ ID NO: 45772 - RNA, 19 nt, Homo sapiens
agaaucuaaauuauuucug

SEQ ID NO: 45773 - RNA, 22 nt, Homo sapiens
agacagcuggaguaucauagcu

SEQ ID NO: 45774 - RNA, 22 nt, Homo sapiens
agacagcugggaaauggagugu

SEQ ID NO: 45775 - RNA, 23 nt, Homo sapiens
agagugcaauggugccaucucgg

SEQ ID NO: 45776 - RNA, 22 nt, Homo sapiens
uguggaguguaugugacagaga

SEQ ID NO: 45777 - RNA, 18 nt, Homo sapiens
uguggcuguuuuccaaua

SEQ ID NO: 45778 - RNA, 19 nt, Homo sapiens
uguggucauccugggacga

SEQ ID NO: 45779 - RNA, 22 nt, Homo sapiens
ugugguuuuaguaaaacuaugu

SEQ ID NO: 45780 - RNA, 22 nt, Homo sapiens
uguguaauacucuaaugaugca

SEQ ID NO: 45781 - RNA, 22 nt, Homo sapiens
uguugcacuccagccuagguga

SEQ ID NO: 45782 - RNA, 22 nt, Homo sapiens
uguugcacuccagccuggguga

SEQ ID NO: 45783 - RNA, 22 nt, Homo sapiens
uguugcacugguaauguacuga

SEQ ID NO: 45784 - RNA, 22 nt, Homo sapiens
uuaaguagaugaaugugaaugu

SEQ ID NO: 45785 - RNA, 22 nt, Homo sapiens
uuaauguaucuaucacaucaca

SEQ ID NO: 45786 - RNA, 22 nt, Homo sapiens
uuaaugugaaucaggaugcauu

SEQ ID NO: 45787 - RNA, 22 nt, Homo sapiens
uuacagucucaagagugcugca

SEQ ID NO: 45788 - RNA, 22 nt, Homo sapiens
uuacaugucuugguaagguuag

SEQ ID NO: 45789 - RNA, 22 nt, Homo sapiens
uuacauguuguggguuguggcc

SEQ ID NO: 45790 - RNA, 22 nt, Homo sapiens
uuacuugagaugaguuggacaa

SEQ ID NO: 45791 - RNA, 22 nt, Homo sapiens
uuaguuuaucagugguuucuga

SEQ ID NO: 45792 - RNA, 21 nt, Homo sapiens
uuauaguggcaugauuuauaa

SEQ ID NO: 45793 - RNA, 22 nt, Homo sapiens
uuauugaguaaaaagaaugguu

SEQ ID NO: 45794 - RNA, 22 nt, Homo sapiens
uucacaguguguacaccagggg

SEQ ID NO: 45795 - RNA, 22 nt, Homo sapiens
uucagggacuuuagacaagaga

SEQ ID NO: 45796 - RNA, 22 nt, Homo sapiens
uucaucuggcaauucagagauu

SEQ ID NO: 45797 - RNA, 22 nt, Homo sapiens
uuccauguugauacgugaaguu

SEQ ID NO: 45798 - RNA, 22 nt, Homo sapiens
uucucagugaaguuuagaacau

SEQ ID NO: 45799 - RNA, 22 nt, Homo sapiens
uucucagugcuaucuuuuaugc

SEQ ID NO: 45800 - RNA, 22 nt, Homo sapiens
uugacuguaagauggcuauuac

SEQ ID NO: 45801 - RNA, 21 nt, Homo sapiens
uugagaagaauuagcucuucc

SEQ ID NO: 45802 - RNA, 22 nt, Homo sapiens
uugaggaggcagucuucccauu

SEQ ID NO: 45803 - RNA, 22 nt, Homo sapiens
uugaggugaauuugcaggaugc

SEQ ID NO: 45804 - RNA, 22 nt, Homo sapiens
uugagugaaugaaugauuaaau

SEQ ID NO: 45805 - RNA, 23 nt, Homo sapiens
uugcauagacauccucauagauu

SEQ ID NO: 45806 - RNA, 22 nt, Homo sapiens
uugccuaggcuggagugcagua

SEQ ID NO: 45807 - RNA, 22 nt, Homo sapiens
uuggacuucuaacugacaugga

SEQ ID NO: 45808 - RNA, 22 nt, Homo sapiens
uuggagagugauauucagaugc

SEQ ID NO: 45809 - RNA, 22 nt, Homo sapiens
uuggagugugucuuauuccauu

SEQ ID NO: 45810 - RNA, 22 nt, Homo sapiens
uuggcuuggagaguugaaaugu

SEQ ID NO: 45811 - RNA, 22 nt, Homo sapiens
uugggacuggaaggaguaaggg

SEQ ID NO: 45812 - RNA, 22 nt, Homo sapiens
uugugguuuuuaaaacuaggug

SEQ ID NO: 45813 - RNA, 22 nt, Homo sapiens
uuuauccagccucuagcaaggu

SEQ ID NO: 45814 - RNA, 22 nt, Homo sapiens
uuucaacuaauuuuuuggugag

SEQ ID NO: 45815 - RNA, 22 nt, Homo sapiens
uuucacagcaauugccuauugu

SEQ ID NO: 45816 - RNA, 22 nt, Homo sapiens
uuucccuuuagcuuagugauuu

SEQ ID NO: 45817 - RNA, 23 nt, Homo sapiens
uuugagugugauaaacacuguca

SEQ ID NO: 45818 - RNA, 23 nt, Homo sapiens
uuugccacuuauuagcugggagg

SEQ ID NO: 45819 - RNA, 22 nt, Homo sapiens
uuuggcuuuuguaauaacugcc

SEQ ID NO: 45820 - RNA, 22 nt, Homo sapiens
uuuguaauaccugaggcugggu

SEQ ID NO: 45821 - RNA, 21 nt, Homo sapiens
uuugugguuacugugugagcu

SEQ ID NO: 45822 - RNA, 22 nt, Homo sapiens
uuuuauguuuguucccugccaa

SEQ ID NO: 45823 - RNA, 22 nt, Homo sapiens
uuuucaguggccauaguggaga

SEQ ID NO: 45824 - RNA, 22 nt, Homo sapiens
uuuugcuuuuccucggucccac

SEQ ID NO: 45825 - RNA, 19 nt, Homo sapiens
uuuuggaaaugugaacagc

SEQ ID NO: 45826 - RNA, 22 nt, Homo sapiens
uuuuggcucugucuguaucuuu

SEQ ID NO: 45827 - RNA, 22 nt, Homo sapiens
uuuuugagaauuggugaaacac

SEQ ID NO: 45828 - RNA, 22 nt, Homo sapiens
uuuuugaguagcuggagagcag

SEQ ID NO: 45829 - RNA, 22 nt, Homo sapiens
uacuccccuuguucugugagcu

SEQ ID NO: 45830 - RNA, 22 nt, Homo sapiens
uacucugcaguaauuccagccc

SEQ ID NO: 45831 - RNA, 19 nt, Homo sapiens
uacuggcucgggaauuuuc

SEQ ID NO: 45832 - RNA, 22 nt, Homo sapiens
uagcaaaucaauggaauugaag

SEQ ID NO: 45833 - RNA, 22 nt, Homo sapiens
uagcucagcccagcuaagcuca

SEQ ID NO: 45834 - RNA, 22 nt, Homo sapiens
uaggucccguuucagacugaga

SEQ ID NO: 45835 - RNA, 22 nt, Homo sapiens
uagguuauucauucaucauuua

SEQ ID NO: 45836 - RNA, 22 nt, Homo sapiens
uauacagcaaguuacugugcug

SEQ ID NO: 45837 - RNA, 21 nt, Homo sapiens
uaucacaguagaauaggaucu

SEQ ID NO: 45838 - RNA, 22 nt, Homo sapiens
uaucauggaaagauguugaaau

SEQ ID NO: 45839 - RNA, 20 nt, Homo sapiens
uaucuacuugcaaaugccau

SEQ ID NO: 45840 - RNA, 22 nt, Homo sapiens
uaucucagaugagacuuguaac

SEQ ID NO: 45841 - RNA, 22 nt, Homo sapiens
uaugacugagacuuaaauugug

SEQ ID NO: 45842 - RNA, 22 nt, Homo sapiens
uaugcccauuuaaauugaacaa

SEQ ID NO: 45843 - RNA, 22 nt, Homo sapiens
uauggcuuuguuaacauuuucu

SEQ ID NO: 45844 - RNA, 20 nt, Homo sapiens
uauucacucuccagucuugc

SEQ ID NO: 45845 - RNA, 22 nt, Homo sapiens
uauugacuuuuuuguuaggagg

SEQ ID NO: 45846 - RNA, 22 nt, Homo sapiens
uauugcuggcucugucuucauu

SEQ ID NO: 45847 - RNA, 22 nt, Homo sapiens
uauugcuuuacucucuuauccu

SEQ ID NO: 45848 - RNA, 22 nt, Homo sapiens
uauuuguccccuccaaaaguca

SEQ ID NO: 45849 - RNA, 22 nt, Homo sapiens
ucaaaugauucuccugccucag

SEQ ID NO: 45850 - RNA, 19 nt, Homo sapiens
ucacacuguggcuucuuua

SEQ ID NO: 45851 - RNA, 22 nt, Homo sapiens
ucacagauaaauaaagaugauu

SEQ ID NO: 45852 - RNA, 22 nt, Homo sapiens
ucacaggguguuauuagaauua

SEQ ID NO: 45853 - RNA, 22 nt, Homo sapiens
ucacugugcaugaaggaugcug

SEQ ID NO: 45854 - RNA, 22 nt, Homo sapiens
ucacugugguuuugaugugcau

SEQ ID NO: 45855 - RNA, 19 nt, Homo sapiens
ucagcaguaaucaacuuca

SEQ ID NO: 45856 - RNA, 22 nt, Homo sapiens
ucagguagugccaugauugauu

SEQ ID NO: 45857 - RNA, 22 nt, Homo sapiens
ucaggucauuccaggagggcca

SEQ ID NO: 45858 - RNA, 22 nt, Homo sapiens
ucaguaccugagagugggcaga

SEQ ID NO: 45859 - RNA, 23 nt, Homo sapiens
ucaguacucuauaagugccagcu

SEQ ID NO: 45860 - RNA, 22 nt, Homo sapiens
ucagugucugugauggagaggu

SEQ ID NO: 45861 - RNA, 23 nt, Homo sapiens
ucaugaggccauucaaauccauu

SEQ ID NO: 45862 - RNA, 19 nt, Homo sapiens
ucauggcuuuuucagcugu

SEQ ID NO: 45863 - RNA, 22 nt, Homo sapiens
ucauggggugagcuacaggcac

SEQ ID NO: 45864 - RNA, 22 nt, Homo sapiens
ucauuagagaucuuggggaaaa

SEQ ID NO: 45865 - RNA, 22 nt, Homo sapiens
uccaugaggcuacaguaaucuc

SEQ ID NO: 45866 - RNA, 22 nt, Homo sapiens
uccccuuuguaagauggaaacg

SEQ ID NO: 45867 - RNA, 22 nt, Homo sapiens
ucccugaguaucuaauguguuu

SEQ ID NO: 45868 - RNA, 22 nt, Homo sapiens
uccuuugguggagucuuuaggg

SEQ ID NO: 45869 - RNA, 22 nt, Homo sapiens
ucgcaccauugcacuccagcca

SEQ ID NO: 45870 - RNA, 18 nt, Homo sapiens
ucucacagcaaucuguca

SEQ ID NO: 45871 - RNA, 22 nt, Homo sapiens
ucucagugaauguggaaaaagc

SEQ ID NO: 45872 - RNA, 22 nt, Homo sapiens
ucucagugaauugguuuugucu

SEQ ID NO: 45873 - RNA, 22 nt, Homo sapiens
ucucaguggugcuggcagggga

SEQ ID NO: 45874 - RNA, 22 nt, Homo sapiens
ucuggcuuauuucacuuagcau

SEQ ID NO: 45875 - RNA, 22 nt, Homo sapiens
ucuggcuuucuuuacuuaaugu

SEQ ID NO: 45876 - RNA, 22 nt, Homo sapiens
ucugucuuugccuaaguuuguc

SEQ ID NO: 45877 - RNA, 22 nt, Homo sapiens
ugaauuguuucauucuuuacau

SEQ ID NO: 45878 - RNA, 22 nt, Homo sapiens
ugacacauguagacaucuggug

SEQ ID NO: 45879 - RNA, 21 nt, Homo sapiens
ugacauuauuucaugucagua

SEQ ID NO: 45880 - RNA, 22 nt, Homo sapiens
ugacucaguuguuagucuucau

SEQ ID NO: 45881 - RNA, 22 nt, Homo sapiens
ugacucaguuucucagguagua

SEQ ID NO: 45882 - RNA, 22 nt, Homo sapiens
ugagaagcauaccagugucugu

SEQ ID NO: 45883 - RNA, 22 nt, Homo sapiens
ugaggauaguguugaaggcagg

SEQ ID NO: 45884 - RNA, 22 nt, Homo sapiens
ugagguaacaaacuaugaguua

SEQ ID NO: 45885 - RNA, 22 nt, Homo sapiens
ugaguacuacuaguuacugcua

SEQ ID NO: 45886 - RNA, 22 nt, Homo sapiens
ugagugccuggagggcagggac

SEQ ID NO: 45887 - RNA, 22 nt, Homo sapiens
ugaguucaauguuaaugaagca

SEQ ID NO: 45888 - RNA, 22 nt, Homo sapiens
ugaguucaauuguauuuuauua

SEQ ID NO: 45889 - RNA, 18 nt, Homo sapiens
ugauaucaaugauagcca

SEQ ID NO: 45890 - RNA, 22 nt, Homo sapiens
ugauauguggauucagcucaaa

SEQ ID NO: 45891 - RNA, 22 nt, Homo sapiens
ugaucuguccaccucagcuucc

SEQ ID NO: 45892 - RNA, 22 nt, Homo sapiens
ugcaaaugucaaggguuagugu

SEQ ID NO: 45893 - RNA, 22 nt, Homo sapiens
ugcaagaugauuucaauugaua

SEQ ID NO: 45894 - RNA, 22 nt, Homo sapiens
ugcaccacuguacuccagucug

SEQ ID NO: 45895 - RNA, 22 nt, Homo sapiens
ugcagcucaaauuccuaacaag

SEQ ID NO: 45896 - RNA, 20 nt, Homo sapiens
ugcaguguccucacuuguca

SEQ ID NO: 45897 - RNA, 19 nt, Homo sapiens
ugcauaggguuacauacuc

SEQ ID NO: 45898 - RNA, 21 nt, Homo sapiens
ugcauuguugcugagagcagg

SEQ ID NO: 45899 - RNA, 22 nt, Homo sapiens
ugccuacagaaggggcucagca

SEQ ID NO: 45900 - RNA, 22 nt, Homo sapiens
ugcuguuguuugaugaaguaau

SEQ ID NO: 45901 - RNA, 22 nt, Homo sapiens
uggaauuaauuaaaauauacug

SEQ ID NO: 45902 - RNA, 22 nt, Homo sapiens
uggacuguaauuuuauaggcau

SEQ ID NO: 45903 - RNA, 22 nt, Homo sapiens
uggcuuuuauuauguugaggua

SEQ ID NO: 45904 - RNA, 22 nt, Homo sapiens
ugggaagaagguuuacuugcca

SEQ ID NO: 45905 - RNA, 22 nt, Homo sapiens
uguaaacuuuugagauugacuu

SEQ ID NO: 45906 - RNA, 22 nt, Homo sapiens
uguaauguuucaucauuauuaa

SEQ ID NO: 45907 - RNA, 22 nt, Homo sapiens
uguacuucaagauuaugguuua

SEQ ID NO: 45908 - RNA, 22 nt, Homo sapiens
uguauaguugagucaaguuuca

SEQ ID NO: 45909 - RNA, 22 nt, Homo sapiens
ugucaguuucuugagauggaac

SEQ ID NO: 45910 - RNA, 22 nt, Homo sapiens
ugucauguaaagaguaaauggu

SEQ ID NO: 45911 - RNA, 22 nt, Homo sapiens
ugucaugucuuuguguaucaau

SEQ ID NO: 45912 - RNA, 22 nt, Homo sapiens
ugucucaguuacggcaauucca

SEQ ID NO: 45913 - RNA, 22 nt, Homo sapiens
ugucuuuguuaguuguccuagu

SEQ ID NO: 45914 - RNA, 22 nt, Homo sapiens
ugugaaaucagauagccuuuuu

SEQ ID NO: 45915 - RNA, 22 nt, Homo sapiens
ugugaacaugacagugggcuag

SEQ ID NO: 45916 - RNA, 22 nt, Homo sapiens
ugugacucuggcacauggugag

SEQ ID NO: 45917 - RNA, 22 nt, Homo sapiens
ugugcucaucucagucaacugu

SEQ ID NO: 45918 - RNA, 22 nt, Homo sapiens
uguggaaauuguuguauuuaau

SEQ ID NO: 45919 - RNA, 22 nt, Homo sapiens
ggaaagcuagguguggguguac

SEQ ID NO: 45920 - RNA, 22 nt, Homo sapiens
ggaaugagaaauauuacacaau

SEQ ID NO: 45921 - RNA, 22 nt, Homo sapiens
ggagugcuguuguuacacaagg

SEQ ID NO: 45922 - RNA, 22 nt, Homo sapiens
ggaguguaguggcuccaucucg

SEQ ID NO: 45923 - RNA, 23 nt, Homo sapiens
ggauggaaaguuuugagggccac

SEQ ID NO: 45924 - RNA, 22 nt, Homo sapiens
gggaguagagaguuucucugac

SEQ ID NO: 45925 - RNA, 22 nt, Homo sapiens
gggagugugcacacaugguaua

SEQ ID NO: 45926 - RNA, 23 nt, Homo sapiens
ggugaggaguacagagucuucau

SEQ ID NO: 45927 - RNA, 19 nt, Homo sapiens
ggugcuugaauauuccucc

SEQ ID NO: 45928 - RNA, 22 nt, Homo sapiens
gguguguaaauuacuuaucucu

SEQ ID NO: 45929 - RNA, 22 nt, Homo sapiens
guaacucugucacuuacuaguu

SEQ ID NO: 45930 - RNA, 22 nt, Homo sapiens
guaauaacuguggaaaaagguu

SEQ ID NO: 45931 - RNA, 22 nt, Homo sapiens
guaaucucagcuacucgggaga

SEQ ID NO: 45932 - RNA, 22 nt, Homo sapiens
guacaugugcacagugugcagg

SEQ ID NO: 45933 - RNA, 22 nt, Homo sapiens
guagagagaaauacaaagcugu

SEQ ID NO: 45934 - RNA, 22 nt, Homo sapiens
gucauugucaauugacaauugu

SEQ ID NO: 45935 - RNA, 22 nt, Homo sapiens
gucuggagacuugggucaucaa

SEQ ID NO: 45936 - RNA, 22 nt, Homo sapiens
gucuggcuccugucuaaucacu

SEQ ID NO: 45937 - RNA, 22 nt, Homo sapiens
gucuuugagauaggguuauuuu

SEQ ID NO: 45938 - RNA, 22 nt, Homo sapiens
gucuuuguuuggucuguaucag

SEQ ID NO: 45939 - RNA, 22 nt, Homo sapiens
gucuuuugcuagccagagagcu

SEQ ID NO: 45940 - RNA, 22 nt, Homo sapiens
gugacugcauccauccaggcuu

SEQ ID NO: 45941 - RNA, 22 nt, Homo sapiens
gugagaaucaaacuacauaaau

SEQ ID NO: 45942 - RNA, 22 nt, Homo sapiens
gugcaacaugccuggcuaauuu

SEQ ID NO: 45943 - RNA, 22 nt, Homo sapiens
gugcacaaaucuuaaauguaca

SEQ ID NO: 45944 - RNA, 22 nt, Homo sapiens
gugcacaucgugcagguuuguu

SEQ ID NO: 45945 - RNA, 22 nt, Homo sapiens
gugcuaggugcuaggaagauag

SEQ ID NO: 45946 - RNA, 21 nt, Homo sapiens
gugcuuguagccucacuucug

SEQ ID NO: 45947 - RNA, 22 nt, Homo sapiens
guggaaguuaagugacuuucug

SEQ ID NO: 45948 - RNA, 22 nt, Homo sapiens
guggcaagaauguacaaaaggu

SEQ ID NO: 45949 - RNA, 22 nt, Homo sapiens
gugggaagcuggaacucccucc

SEQ ID NO: 45950 - RNA, 22 nt, Homo sapiens
guguaaaucugcugugaacauu

SEQ ID NO: 45951 - RNA, 22 nt, Homo sapiens
guguauucaucuggcugaggua

SEQ ID NO: 45952 - RNA, 22 nt, Homo sapiens
gugugcaauuuugugggaggca

SEQ ID NO: 45953 - RNA, 22 nt, Homo sapiens
guguggcaggugggggcucaga

SEQ ID NO: 45954 - RNA, 22 nt, Homo sapiens
gugugguaggauugguuacuca

SEQ ID NO: 45955 - RNA, 22 nt, Homo sapiens
guuaagaaguguaacuuaaguu

SEQ ID NO: 45956 - RNA, 22 nt, Homo sapiens
guucagguauucuggaacagag

SEQ ID NO: 45957 - RNA, 22 nt, Homo sapiens
guuuguaacucuagugacuaga

SEQ ID NO: 45958 - RNA, 22 nt, Homo sapiens
uaaagcacaaguaaagaauacu

SEQ ID NO: 45959 - RNA, 16 nt, Homo sapiens
uaacacaguucccacc

SEQ ID NO: 45960 - RNA, 22 nt, Homo sapiens
uaagugaauguuggcuacugaa

SEQ ID NO: 45961 - RNA, 23 nt, Homo sapiens
uaaguucaucucuaauaggugga

SEQ ID NO: 45962 - RNA, 22 nt, Homo sapiens
uaauacuugucauaaaggcauu

SEQ ID NO: 45963 - RNA, 22 nt, Homo sapiens
uaaucucagcugagcugagauu

SEQ ID NO: 45964 - RNA, 22 nt, Homo sapiens
uacaccaauuuaaucaaaagca

SEQ ID NO: 45965 - RNA, 22 nt, Homo sapiens
uacauacuucacagacuuuaaa

SEQ ID NO: 45966 - RNA, 22 nt, Homo sapiens
uacauguauacaggguuuacuu

SEQ ID NO: 45967 - RNA, 22 nt, Homo sapiens
uacugagagaggaauauugaaa

SEQ ID NO: 45968 - RNA, 22 nt, Homo sapiens
uacugcacuccacccuggguga

SEQ ID NO: 45969 - RNA, 22 nt, Homo sapiens
uacugcacuccagccuggguga

SEQ ID NO: 45970 - RNA, 20 nt, Homo sapiens
uagacagcuagauuagauag

SEQ ID NO: 45971 - RNA, 22 nt, Homo sapiens
uagcaguucauuguugugugaa

SEQ ID NO: 45972 - RNA, 22 nt, Homo sapiens
uagccucacaaagugcuuaaga

SEQ ID NO: 45973 - RNA, 22 nt, Homo sapiens
uagguagguggaaaaguaauug

SEQ ID NO: 45974 - RNA, 22 nt, Homo sapiens
uaggucaguuuuggcuuggcuu

SEQ ID NO: 45975 - RNA, 22 nt, Homo sapiens
uagguuaugauccaucuuggcu

SEQ ID NO: 45976 - RNA, 22 nt, Homo sapiens
uagucccuuucuauuaaugaga

SEQ ID NO: 45977 - RNA, 20 nt, Homo sapiens
uauaacaguuuggacccagu

SEQ ID NO: 45978 - RNA, 22 nt, Homo sapiens
uaucauuguguuauuucuucca

SEQ ID NO: 45979 - RNA, 22 nt, Homo sapiens
uaugcacacacguguuuaugug

SEQ ID NO: 45980 - RNA, 22 nt, Homo sapiens
uaugcuuauaaacauuugucag

SEQ ID NO: 45981 - RNA, 22 nt, Homo sapiens
uauggcuucuauaaggaagcuu

SEQ ID NO: 45982 - RNA, 22 nt, Homo sapiens
uauuacauccauaggcucugcu

SEQ ID NO: 45983 - RNA, 22 nt, Homo sapiens
ucaaaugcuguauuguaguaau

SEQ ID NO: 45984 - RNA, 22 nt, Homo sapiens
ucaauguaucuccaagaauuga

SEQ ID NO: 45985 - RNA, 23 nt, Homo sapiens
ucacaguuacuuuugcaucaacc

SEQ ID NO: 45986 - RNA, 22 nt, Homo sapiens
ucacccuguguuuugcguuugc

SEQ ID NO: 45987 - RNA, 22 nt, Homo sapiens
ucacucagaccuggugauaugc

SEQ ID NO: 45988 - RNA, 22 nt, Homo sapiens
ucacugagcacaggagaugugc

SEQ ID NO: 45989 - RNA, 22 nt, Homo sapiens
ucacuguugaugggcaugcagg

SEQ ID NO: 45990 - RNA, 22 nt, Homo sapiens
ucacuuugacggccaacuucua

SEQ ID NO: 45991 - RNA, 22 nt, Homo sapiens
aggacacugagcaugggagguu

SEQ ID NO: 45992 - RNA, 22 nt, Homo sapiens
aggcaagugggagacagcauuu

SEQ ID NO: 45993 - RNA, 22 nt, Homo sapiens
agggaagugugcuaugcauuua

SEQ ID NO: 45994 - RNA, 22 nt, Homo sapiens
agugcaguggcauggucauaac

SEQ ID NO: 45995 - RNA, 22 nt, Homo sapiens
aguggaguguaaagcgucuuuu

SEQ ID NO: 45996 - RNA, 22 nt, Homo sapiens
aguucaaugcucuuucuacuau

SEQ ID NO: 45997 - RNA, 22 nt, Homo sapiens
auaacagcauuauugcauacgu

SEQ ID NO: 45998 - RNA, 22 nt, Homo sapiens
auaacagcugcaaggcaaaagc

SEQ ID NO: 45999 - RNA, 22 nt, Homo sapiens
auaaguauuuggacuuuacugu

SEQ ID NO: 46000 - RNA, 22 nt, Homo sapiens
auaagucaauggaacagauuaa

SEQ ID NO: 46001 - RNA, 22 nt, Homo sapiens
auacugguuuuugucaugugga

SEQ ID NO: 46002 - RNA, 22 nt, Homo sapiens
auacuguauaggauuguagccu

SEQ ID NO: 46003 - RNA, 22 nt, Homo sapiens
auagacacugaaaucccugcca

SEQ ID NO: 46004 - RNA, 22 nt, Homo sapiens
auagugcugcaaucaacauaca

SEQ ID NO: 46005 - RNA, 22 nt, Homo sapiens
auagugcugcaauuaacauaca

SEQ ID NO: 46006 - RNA, 22 nt, Homo sapiens
auagugcugcagucaauguacg

SEQ ID NO: 46007 - RNA, 22 nt, Homo sapiens
auagugcuggaauaaauauacg

SEQ ID NO: 46008 - RNA, 22 nt, Homo sapiens
auaugcuaauuuuuagucgagc

SEQ ID NO: 46009 - RNA, 22 nt, Homo sapiens
auauucaagugaggauggcuaa

SEQ ID NO: 46010 - RNA, 22 nt, Homo sapiens
agagugcuauagauuagauuuc

SEQ ID NO: 46011 - RNA, 22 nt, Homo sapiens
agauggugauaaaugugguacc

SEQ ID NO: 46012 - RNA, 22 nt, Homo sapiens
agccaguauuuugaguuggucu

SEQ ID NO: 46013 - RNA, 22 nt, Homo sapiens
agcuacuguuagucuaguuagg

SEQ ID NO: 46014 - RNA, 22 nt, Homo sapiens
agcugcacaaauggaugugagg

SEQ ID NO: 46015 - RNA, 22 nt, Homo sapiens
agcuguuguacacuuuaccuuu

SEQ ID NO: 46016 - RNA, 22 nt, Homo sapiens
agcuguuguucucagaggcuuu

SEQ ID NO: 46017 - RNA, 22 nt, Homo sapiens
agcuguuguuuuaagauacuaa

SEQ ID NO: 46018 - RNA, 22 nt, Homo sapiens
agcuuuuugggaggccuuagga

SEQ ID NO: 46019 - RNA, 22 nt, Homo sapiens
aggaucauugacuauuauaagg

SEQ ID NO: 46020 - RNA, 22 nt, Homo sapiens
aggugcugacaggauagguuuc

SEQ ID NO: 46021 - RNA, 22 nt, Homo sapiens
aggugcugagcagagaauccug

SEQ ID NO: 46022 - RNA, 22 nt, Homo sapiens
agguuaacaucuauuuuggaug

SEQ ID NO: 46023 - RNA, 22 nt, Homo sapiens
aguucaauggguuuucacucau

SEQ ID NO: 46024 - RNA, 22 nt, Homo sapiens
auaaagccaugagcuugagaug

SEQ ID NO: 46025 - RNA, 22 nt, Homo sapiens
auagugcugcaacaaauauacg

SEQ ID NO: 46026 - RNA, 22 nt, Homo sapiens
auagugcugcaauaaacacacg

SEQ ID NO: 46027 - RNA, 22 nt, Homo sapiens
auauaugcacacgugugcauau

SEQ ID NO: 46028 - RNA, 22 nt, Homo sapiens
auaucacaggaaaggaagauac

SEQ ID NO: 46029 - RNA, 22 nt, Homo sapiens
auaucacagguguuuaccugau

SEQ ID NO: 46030 - RNA, 22 nt, Homo sapiens
auaugcacuauacacacguaua

SEQ ID NO: 46031 - RNA, 22 nt, Homo sapiens
auauguaguauggaaacauugu

SEQ ID NO: 46032 - RNA, 22 nt, Homo sapiens
auauguaguuucagaaguggaa

SEQ ID NO: 46033 - RNA, 22 nt, Homo sapiens
aucacaguuauaacauccuuuu

SEQ ID NO: 46034 - RNA, 22 nt, Homo sapiens
aucacuguuuugaugcucggac

SEQ ID NO: 46035 - RNA, 22 nt, Homo sapiens
aucacuuucuauuucugugcca

SEQ ID NO: 46036 - RNA, 22 nt, Homo sapiens
aucauggaguauuugcaagucu

SEQ ID NO: 46037 - RNA, 22 nt, Homo sapiens
auccacagugucaauguuguga

SEQ ID NO: 46038 - RNA, 22 nt, Homo sapiens
auccaucagacggcaggcguug

SEQ ID NO: 46039 - RNA, 22 nt, Homo sapiens
uucccucagaaacacacagccc

SEQ ID NO: 46040 - RNA, 22 nt, Homo sapiens
uucuacuucauuaggaggauug

SEQ ID NO: 46041 - RNA, 23 nt, Homo sapiens
uucuaucaggcccaggagcccug

SEQ ID NO: 46042 - RNA, 22 nt, Homo sapiens
uucucaguaauuccagauuuuu

SEQ ID NO: 46043 - RNA, 22 nt, Homo sapiens
uucucaguuccuacuuugguga

SEQ ID NO: 46044 - RNA, 17 nt, Homo sapiens
uucucaguucugaucuc

SEQ ID NO: 46045 - RNA, 22 nt, Homo sapiens
uucuucugguuaugaaauuuga

SEQ ID NO: 46046 - RNA, 22 nt, Homo sapiens
uucuugguuuaucgcuuuaaaa

SEQ ID NO: 46047 - RNA, 22 nt, Homo sapiens
uugacaaggagccauugcaucu

SEQ ID NO: 46048 - RNA, 23 nt, Homo sapiens
uugacuguggguacaaugugaua

SEQ ID NO: 46049 - RNA, 22 nt, Homo sapiens
uugagauggagucuugcucuug

SEQ ID NO: 46050 - RNA, 22 nt, Homo sapiens
uugagauuauuguguuccuuua

SEQ ID NO: 46051 - RNA, 22 nt, Homo sapiens
uugaggucagagguucgagacc

SEQ ID NO: 46052 - RNA, 22 nt, Homo sapiens
uugaucaaaucugagugagaau

SEQ ID NO: 46053 - RNA, 22 nt, Homo sapiens
uuggagagaaaggcaguuccug

SEQ ID NO: 46054 - RNA, 22 nt, Homo sapiens
uuguaacaguucugcgagcagc

SEQ ID NO: 46055 - RNA, 23 nt, Homo sapiens
uuguaacuggagaguaacauucc

SEQ ID NO: 46056 - RNA, 22 nt, Homo sapiens
uuguacucucaccguaucccag

SEQ ID NO: 46057 - RNA, 22 nt, Homo sapiens
uuguacuggguuuucuggaauu

SEQ ID NO: 46058 - RNA, 22 nt, Homo sapiens
uuguauaggcucaguaagaauc

SEQ ID NO: 46059 - RNA, 22 nt, Homo sapiens
uuguaugucuucauuugaaaaa

SEQ ID NO: 46060 - RNA, 22 nt, Homo sapiens
uugucaaacucauucuccaucc

SEQ ID NO: 46061 - RNA, 22 nt, Homo sapiens
uugugaaaucuaggcagagguu

SEQ ID NO: 46062 - RNA, 17 nt, Homo sapiens
uuguucccauuaaaaag

SEQ ID NO: 46063 - RNA, 22 nt, Homo sapiens
uuuaauguuacaguauugguau

SEQ ID NO: 46064 - RNA, 22 nt, Homo sapiens
uuucacaguguucucccccaga

SEQ ID NO: 46065 - RNA, 22 nt, Homo sapiens
uuucaguguggcaggcauagcu

SEQ ID NO: 46066 - RNA, 22 nt, Homo sapiens
uuuccaguuggaagaaggggga

SEQ ID NO: 46067 - RNA, 22 nt, Homo sapiens
uuuccauguuggugaaaugagg

SEQ ID NO: 46068 - RNA, 22 nt, Homo sapiens
uuugaagugugaugccuugaug

SEQ ID NO: 46069 - RNA, 22 nt, Homo sapiens
uuugcaauagguuguggggagg

SEQ ID NO: 46070 - RNA, 23 nt, Homo sapiens
uuugcacuugcuccuucuauggc

SEQ ID NO: 46071 - RNA, 22 nt, Homo sapiens
uuugcuucacuguuuggcaaaa

SEQ ID NO: 46072 - RNA, 22 nt, Homo sapiens
uuuguacucccuuuagauaaaa

SEQ ID NO: 46073 - RNA, 22 nt, Homo sapiens
uuuguccccgcccagaucucau

SEQ ID NO: 46074 - RNA, 22 nt, Homo sapiens
uuuugcaguuacagagagugag

SEQ ID NO: 46075 - RNA, 22 nt, Homo sapiens
gauauguaguaguugaaaaaga

SEQ ID NO: 46076 - RNA, 22 nt, Homo sapiens
gauauguguaucuauguacaug

SEQ ID NO: 46077 - RNA, 22 nt, Homo sapiens
gcaaaugcuaugccauuuuaua

SEQ ID NO: 46078 - RNA, 22 nt, Homo sapiens
gcacgugcucauuugaggucuu

SEQ ID NO: 46079 - RNA, 22 nt, Homo sapiens
gcacugggccacauuuauuuuc

SEQ ID NO: 46080 - RNA, 22 nt, Homo sapiens
gcagugcuggagcccccgugug

SEQ ID NO: 46081 - RNA, 22 nt, Homo sapiens
gcuaaggcaggagcauugcuug

SEQ ID NO: 46082 - RNA, 17 nt, Homo sapiens
gcugcauucauguagaa

SEQ ID NO: 46083 - RNA, 22 nt, Homo sapiens
ggaaguuaauacagauagagua

SEQ ID NO: 46084 - RNA, 19 nt, Homo sapiens
ggaaugcuauucaaccuuu

SEQ ID NO: 46085 - RNA, 22 nt, Homo sapiens
ggcaaaauggccagugggucac

SEQ ID NO: 46086 - RNA, 19 nt, Homo sapiens
ggcaauacuuucuuguugg

SEQ ID NO: 46087 - RNA, 17 nt, Homo sapiens
ggcaggauccaggaucc

SEQ ID NO: 46088 - RNA, 22 nt, Homo sapiens
ggcaguuucucaggcaggggua

SEQ ID NO: 46089 - RNA, 22 nt, Homo sapiens
ggcaguuuggcaguuucauaaa

SEQ ID NO: 46090 - RNA, 19 nt, Homo sapiens
ggucagcaaagucuagcug

SEQ ID NO: 46091 - RNA, 22 nt, Homo sapiens
ggugagaaaaacauagucucag

SEQ ID NO: 46092 - RNA, 22 nt, Homo sapiens
ggugagaaagggauuccuguuc

SEQ ID NO: 46093 - RNA, 22 nt, Homo sapiens
gguuagaaacagguccucagga

SEQ ID NO: 46094 - RNA, 22 nt, Homo sapiens
guacaguucucuuuguugucag

SEQ ID NO: 46095 - RNA, 22 nt, Homo sapiens
guacaguuuucaguguucacug

SEQ ID NO: 46096 - RNA, 22 nt, Homo sapiens
guaugaaaaucggagauugggu

SEQ ID NO: 46097 - RNA, 22 nt, Homo sapiens
guauuuguugcagcagcacuau

SEQ ID NO: 46098 - RNA, 20 nt, Homo sapiens
gucugucuccgaguagaauu

SEQ ID NO: 46099 - RNA, 22 nt, Homo sapiens
gucuugaaggcugaguaccugu

SEQ ID NO: 46100 - RNA, 20 nt, Homo sapiens
gucuuguagcucaaguuauu

SEQ ID NO: 46101 - RNA, 22 nt, Homo sapiens
gugaacagaaccugggaucgaa

SEQ ID NO: 46102 - RNA, 22 nt, Homo sapiens
gugaaguuuuugugaggccuaa

SEQ ID NO: 46103 - RNA, 22 nt, Homo sapiens
gugaaguuuuuugcugagaguc

SEQ ID NO: 46104 - RNA, 22 nt, Homo sapiens
gugaauguaaagucaugugacu

SEQ ID NO: 46105 - RNA, 22 nt, Homo sapiens
gugagaggaggcagcuuuuaca

SEQ ID NO: 46106 - RNA, 22 nt, Homo sapiens
gugcauauaaguuguuucuagu

SEQ ID NO: 46107 - RNA, 22 nt, Homo sapiens
gugcauaucugugguuggcuga

SEQ ID NO: 46108 - RNA, 22 nt, Homo sapiens
guggaagguaaugcagcuuacu

SEQ ID NO: 46109 - RNA, 22 nt, Homo sapiens
guggagacaaaggcugagugag

SEQ ID NO: 46110 - RNA, 22 nt, Homo sapiens
guggcaagaugacuacucacug

SEQ ID NO: 46111 - RNA, 22 nt, Homo sapiens
guggcaaguguuccaagaggcg

SEQ ID NO: 46112 - RNA, 22 nt, Homo sapiens
guucacacuugcaaccccagca

SEQ ID NO: 46113 - RNA, 22 nt, Homo sapiens
aaacugaucugaaggccaggcu

SEQ ID NO: 46114 - RNA, 22 nt, Homo sapiens
aacagagcuggugacuccaggu

SEQ ID NO: 46115 - RNA, 22 nt, Homo sapiens
aagagcucucuguagcauguga

SEQ ID NO: 46116 - RNA, 22 nt, Homo sapiens
aaguaaauauccgguaguccca

SEQ ID NO: 46117 - RNA, 22 nt, Homo sapiens
aagucacugagacuuguggcug

SEQ ID NO: 46118 - RNA, 22 nt, Homo sapiens
aagugaaugaugugaaguguaa

SEQ ID NO: 46119 - RNA, 22 nt, Homo sapiens
aagugcuuaggauagugugugg

SEQ ID NO: 46120 - RNA, 22 nt, Homo sapiens
aagugucagaguugcuaaugac

SEQ ID NO: 46121 - RNA, 22 nt, Homo sapiens
aaguuaauguuuaagacuccua

SEQ ID NO: 46122 - RNA, 22 nt, Homo sapiens
aauaaagcagcuuuuugggacu

SEQ ID NO: 46123 - RNA, 22 nt, Homo sapiens
aauaaagccugucucuuuagag

SEQ ID NO: 46124 - RNA, 22 nt, Homo sapiens
aauacugagaugugagguacua

SEQ ID NO: 46125 - RNA, 22 nt, Homo sapiens
aaucauauugucugccaagagg

SEQ ID NO: 46126 - RNA, 22 nt, Homo sapiens
aaugacugugauauuuuucuuc

SEQ ID NO: 46127 - RNA, 22 nt, Homo sapiens
aaugugcuguucagaggagucc

SEQ ID NO: 46128 - RNA, 22 nt, Homo sapiens
aaugugcuuugaaaagagcuga

SEQ ID NO: 46129 - RNA, 22 nt, Homo sapiens
aauguguuuugaaaucaggaag

SEQ ID NO: 46130 - RNA, 22 nt, Homo sapiens
acaagacuucuuguauucuagu

SEQ ID NO: 46131 - RNA, 22 nt, Homo sapiens
acacauacacauaugguguaua

SEQ ID NO: 46132 - RNA, 22 nt, Homo sapiens
acagaucagagauauuuagguu

SEQ ID NO: 46133 - RNA, 18 nt, Homo sapiens
acagugcuggcaugagau

SEQ ID NO: 46134 - RNA, 22 nt, Homo sapiens
acagugcuucugauaugaugcc

SEQ ID NO: 46135 - RNA, 22 nt, Homo sapiens
accucagcccggggaaguugag

SEQ ID NO: 46136 - RNA, 18 nt, Homo sapiens
acugcacuccaccuuggg

SEQ ID NO: 46137 - RNA, 22 nt, Homo sapiens
acugcacuccagcccaggugac

SEQ ID NO: 46138 - RNA, 22 nt, Homo sapiens
acugcacuccagccuccugaca

SEQ ID NO: 46139 - RNA, 22 nt, Homo sapiens
acugcacuccagccugaugaaa

SEQ ID NO: 46140 - RNA, 22 nt, Homo sapiens
acugcacuccagccugugagac

SEQ ID NO: 46141 - RNA, 22 nt, Homo sapiens
acugcacuccagccuugugaca

SEQ ID NO: 46142 - RNA, 22 nt, Homo sapiens
acugcacuccagcuuuggugac

SEQ ID NO: 46143 - RNA, 22 nt, Homo sapiens
acugcacucuagcauggguaau

SEQ ID NO: 46144 - RNA, 22 nt, Homo sapiens
acugcacucuagccccugcgac

SEQ ID NO: 46145 - RNA, 22 nt, Homo sapiens
agaauucugucauguuuauauu

SEQ ID NO: 46146 - RNA, 22 nt, Homo sapiens
agagaugauuaacauuuuggua

SEQ ID NO: 46147 - RNA, 22 nt, Homo sapiens
agagguagaagauaggcuacag

SEQ ID NO: 46148 - RNA, 20 nt, Homo sapiens
agagugcuggacugaggagc

SEQ ID NO: 46149 - RNA, 22 nt, Homo sapiens
agcaccacauacuacagagaua

SEQ ID NO: 46150 - RNA, 22 nt, Homo sapiens
agcuucauuguuaugaauguca

SEQ ID NO: 46151 - RNA, 22 nt, Homo sapiens
aaagcugucaaggcaggaggcu

SEQ ID NO: 46152 - RNA, 22 nt, Homo sapiens
aaagugucuguuccuagcauga

SEQ ID NO: 46153 - RNA, 22 nt, Homo sapiens
aaauccauuuguucagcuaugc

SEQ ID NO: 46154 - RNA, 21 nt, Homo sapiens
aaaugcacauuacugcuggug

SEQ ID NO: 46155 - RNA, 22 nt, Homo sapiens
aaaugcagucuuuguucugggc

SEQ ID NO: 46156 - RNA, 22 nt, Homo sapiens
aaaugcauugagggaaaaggca

SEQ ID NO: 46157 - RNA, 22 nt, Homo sapiens
aaauugcaguuaggaugauggu

SEQ ID NO: 46158 - RNA, 22 nt, Homo sapiens
aagagcucauccauaguuguca

SEQ ID NO: 46159 - RNA, 22 nt, Homo sapiens
aagcugccaggcaugguggcug

SEQ ID NO: 46160 - RNA, 22 nt, Homo sapiens
aagcuguuguucauccugaauu

SEQ ID NO: 46161 - RNA, 22 nt, Homo sapiens
aaggcuauuugagaaugugugu

SEQ ID NO: 46162 - RNA, 18 nt, Homo sapiens
aaggugcuucuguucuga

SEQ ID NO: 46163 - RNA, 22 nt, Homo sapiens
aagugcuuccuuucagaggguu

SEQ ID NO: 46164 - RNA, 20 nt, Homo sapiens
aagugcuuccuuuuagaggg

SEQ ID NO: 46165 - RNA, 22 nt, Homo sapiens
aauaaagucugaagugugcuua

SEQ ID NO: 46166 - RNA, 22 nt, Homo sapiens
aauaaguugagaugaggucaua

SEQ ID NO: 46167 - RNA, 21 nt, Homo sapiens
aauacucuagguuaagagagc

SEQ ID NO: 46168 - RNA, 22 nt, Homo sapiens
aauacugaaaguauuuucaaau

SEQ ID NO: 46169 - RNA, 22 nt, Homo sapiens
aaucacaggucuuggcugcaug

SEQ ID NO: 46170 - RNA, 22 nt, Homo sapiens
aauccaugugcuuuaccauuuu

SEQ ID NO: 46171 - RNA, 22 nt, Homo sapiens
aaugcacuccagccugggcgac

SEQ ID NO: 46172 - RNA, 22 nt, Homo sapiens
aauggcuucuuauugugguuca

SEQ ID NO: 46173 - RNA, 19 nt, Homo sapiens
aauggcuuuuccuguuccc

SEQ ID NO: 46174 - RNA, 22 nt, Homo sapiens
aaugucacugugguccuccagu

SEQ ID NO: 46175 - RNA, 22 nt, Homo sapiens
aaugugcacuauuagggugaua

SEQ ID NO: 46176 - RNA, 23 nt, Homo sapiens
aauugcuuuugaggacuuaguug

SEQ ID NO: 46177 - RNA, 20 nt, Homo sapiens
acaaaugcauucugugacau

SEQ ID NO: 46178 - RNA, 22 nt, Homo sapiens
acaccaguacuuuauacaagca

SEQ ID NO: 46179 - RNA, 20 nt, Homo sapiens
acacugugcuaaggauuuuc

SEQ ID NO: 46180 - RNA, 22 nt, Homo sapiens
acagagcaaugagcuacggucu

SEQ ID NO: 46181 - RNA, 22 nt, Homo sapiens
acagauagcacuaagggaucug

SEQ ID NO: 46182 - RNA, 22 nt, Homo sapiens
acagugcuguggucaugggucu

SEQ ID NO: 46183 - RNA, 19 nt, Homo sapiens
acagugcuuugucagaagc

SEQ ID NO: 46184 - RNA, 22 nt, Homo sapiens
acauguaauugauuuuguguua

SEQ ID NO: 46185 - RNA, 22 nt, Homo sapiens
acuauacuguaacuguauucag

SEQ ID NO: 46186 - RNA, 22 nt, Homo sapiens
acuccauuucauuuuagcucuu

SEQ ID NO: 46187 - RNA, 23 nt, Homo sapiens
acugagcaauguuuacauacuug

SEQ ID NO: 46188 - RNA, 22 nt, Homo sapiens
acugaucaauguuaaggcuuau

SEQ ID NO: 46189 - RNA, 22 nt, Homo sapiens
acugcacuccagccuccugggu

SEQ ID NO: 46190 - RNA, 22 nt, Homo sapiens
acugcacuccagccugcugaca

SEQ ID NO: 46191 - RNA, 22 nt, Homo sapiens
acugcacuccagccuugagagc

SEQ ID NO: 46192 - RNA, 22 nt, Homo sapiens
acugcacuccagccuuggagac

SEQ ID NO: 46193 - RNA, 22 nt, Homo sapiens
acugcacucccgcccgggugac

SEQ ID NO: 46194 - RNA, 22 nt, Homo sapiens
acugcacuucagccuugggaaa

SEQ ID NO: 46195 - RNA, 20 nt, Homo sapiens
acugcauuuaguccucagga

SEQ ID NO: 46196 - RNA, 22 nt, Homo sapiens
acugcauuugguaaagucaaga

SEQ ID NO: 46197 - RNA, 22 nt, Homo sapiens
acuggacuuaaugaugaauugu

SEQ ID NO: 46198 - RNA, 22 nt, Homo sapiens
acuuuuugauggggagaacauu

SEQ ID NO: 46199 - RNA, 22 nt, Homo sapiens
acuuuuugcaaccauuuggacc

SEQ ID NO: 46200 - RNA, 22 nt, Homo sapiens
agagauaaagauuuuaauuuug

SEQ ID NO: 46201 - RNA, 20 nt, Homo sapiens
agagugcugucuguccugag

SEQ ID NO: 46202 - RNA, 22 nt, Homo sapiens
agagugcuuuauuagauguagc

SEQ ID NO: 46203 - RNA, 22 nt, Homo sapiens
agauauguuauugauguuaaug

SEQ ID NO: 46204 - RNA, 22 nt, Homo sapiens
agcagguguccacaauguuugc

SEQ ID NO: 46205 - RNA, 19 nt, Homo sapiens
agcaguguggagauuucuc

SEQ ID NO: 46206 - RNA, 22 nt, Homo sapiens
agcugaguguuccaagagcgag

SEQ ID NO: 46207 - RNA, 20 nt, Homo sapiens
agcuguuguuaaaaaggagg

SEQ ID NO: 46208 - RNA, 20 nt, Homo sapiens
agcuguuguuaugagguuua

SEQ ID NO: 46209 - RNA, 22 nt, Homo sapiens
agcuugugauuuagagugagag

SEQ ID NO: 46210 - RNA, 22 nt, Homo sapiens
aggcagucucugccggcugagg

SEQ ID NO: 46211 - RNA, 22 nt, Homo sapiens
agggcuuaucuguguagaguuc

SEQ ID NO: 46212 - RNA, 22 nt, Homo sapiens
uugcacuccggccuggguaaca

SEQ ID NO: 46213 - RNA, 22 nt, Homo sapiens
uugcauugacacaugaagcuca

SEQ ID NO: 46214 - RNA, 22 nt, Homo sapiens
uugcuucuuucgucuggcccca

SEQ ID NO: 46215 - RNA, 22 nt, Homo sapiens
uuggagagagaggacucccggc

SEQ ID NO: 46216 - RNA, 22 nt, Homo sapiens
uuggagagucacuaguuagugc

SEQ ID NO: 46217 - RNA, 22 nt, Homo sapiens
uuggagugugcucauaacugcu

SEQ ID NO: 46218 - RNA, 22 nt, Homo sapiens
uuggauuuuaacaaacuaggug

SEQ ID NO: 46219 - RNA, 22 nt, Homo sapiens
uugggcuugagggugcccaguc

SEQ ID NO: 46220 - RNA, 22 nt, Homo sapiens
uuguacuccagccugggugaca

SEQ ID NO: 46221 - RNA, 20 nt, Homo sapiens
uuguacuccugggcucaagc

SEQ ID NO: 46222 - RNA, 22 nt, Homo sapiens
uuguauguugaaugaugguaua

SEQ ID NO: 46223 - RNA, 22 nt, Homo sapiens
uugucucacuggaguuuaguaa

SEQ ID NO: 46224 - RNA, 22 nt, Homo sapiens
uugugcuuguaacuacauucag

SEQ ID NO: 46225 - RNA, 22 nt, Homo sapiens
uuuaaagcaugacgagaagaag

SEQ ID NO: 46226 - RNA, 22 nt, Homo sapiens
uuuaaugcgucucugaguuuug

SEQ ID NO: 46227 - RNA, 22 nt, Homo sapiens
uuuacccugaggaaucuauuuu

SEQ ID NO: 46228 - RNA, 22 nt, Homo sapiens
uuuagguauuugguauagcagu

SEQ ID NO: 46229 - RNA, 22 nt, Homo sapiens
uuuaguacugcuuuaugugugu

SEQ ID NO: 46230 - RNA, 22 nt, Homo sapiens
uuuccaguuguucuagaaagcu

SEQ ID NO: 46231 - RNA, 17 nt, Homo sapiens
uuucucagcccucuucu

SEQ ID NO: 46232 - RNA, 22 nt, Homo sapiens
uuucucaguguuucaggguagg

SEQ ID NO: 46233 - RNA, 22 nt, Homo sapiens
uuugaaccauuugaagaaugau

SEQ ID NO: 46234 - RNA, 22 nt, Homo sapiens
uuugaaguguggcacugaguuu

SEQ ID NO: 46235 - RNA, 22 nt, Homo sapiens
uuugagcaagaggugacauuau

SEQ ID NO: 46236 - RNA, 22 nt, Homo sapiens
uuugcugagucugacuucaugg

SEQ ID NO: 46237 - RNA, 22 nt, Homo sapiens
uuuggaagaugccacuguauca

SEQ ID NO: 46238 - RNA, 22 nt, Homo sapiens
uuuggucuuuuguaaguuaucu

SEQ ID NO: 46239 - RNA, 22 nt, Homo sapiens
uuugucccccguaguucauaua

SEQ ID NO: 46240 - RNA, 18 nt, Homo sapiens
uuuugcuuaacugcgcca

SEQ ID NO: 46241 - RNA, 22 nt, Homo sapiens
aagaggcuguaggauaaugccu

SEQ ID NO: 46242 - RNA, 22 nt, Homo sapiens
aagcacccagccucacgccugc

SEQ ID NO: 46243 - RNA, 22 nt, Homo sapiens
aaggcaagauacugguugcuga

SEQ ID NO: 46244 - RNA, 20 nt, Homo sapiens
aaggcuuucgaguuccaggg

SEQ ID NO: 46245 - RNA, 22 nt, Homo sapiens
aauaucacaggguguacacuca

SEQ ID NO: 46246 - RNA, 22 nt, Homo sapiens
acuggcuguuaggaauuaccuc

SEQ ID NO: 46247 - RNA, 17 nt, Homo sapiens
acuuuuugaggaggcau

SEQ ID NO: 46248 - RNA, 22 nt, Homo sapiens
agaauguuuuagaccaauacaa

SEQ ID NO: 46249 - RNA, 22 nt, Homo sapiens
agagguuuugcccucgagauaa

SEQ ID NO: 46250 - RNA, 22 nt, Homo sapiens
agagguuuuggggcugagagcu

SEQ ID NO: 46251 - RNA, 22 nt, Homo sapiens
agaguaguaggaugaauggacu

SEQ ID NO: 46252 - RNA, 22 nt, Homo sapiens
agcagauguuuagugagcgccu

SEQ ID NO: 46253 - RNA, 22 nt, Homo sapiens
agcuggauuguuuaccuggggc

SEQ ID NO: 46254 - RNA, 22 nt, Homo sapiens
agucauggcagaaggcaccucu

SEQ ID NO: 46255 - RNA, 22 nt, Homo sapiens
agugggccccuagaggugaggu

SEQ ID NO: 46256 - RNA, 22 nt, Homo sapiens
aguggguguuccauuggauaaa

SEQ ID NO: 46257 - RNA, 22 nt, Homo sapiens
auauagcucuggcuggaugacu

SEQ ID NO: 46258 - RNA, 22 nt, Homo sapiens
aucauggaguauuugcaagucu

SEQ ID NO: 46259 - RNA, 22 nt, Homo sapiens
auccugaagcuuuacugaauuc

SEQ ID NO: 46260 - RNA, 22 nt, Homo sapiens
auccugagacuuugcugaaguu

SEQ ID NO: 46261 - RNA, 22 nt, Homo sapiens
aaagcuagagaagcugcuguca

SEQ ID NO: 46262 - RNA, 22 nt, Homo sapiens
aacacuguuuccagucaugauc

SEQ ID NO: 46263 - RNA, 22 nt, Homo sapiens
aaggaagcuagcaggaauuggu

SEQ ID NO: 46264 - RNA, 22 nt, Homo sapiens
aagggaaugcgcugccuguguu

SEQ ID NO: 46265 - RNA, 22 nt, Homo sapiens
aagggaaugcuuccaguuugug

SEQ ID NO: 46266 - RNA, 22 nt, Homo sapiens
aaguaaacauuuuguacaauaa

SEQ ID NO: 46267 - RNA, 21 nt, Homo sapiens
aauacucuagguuaagagagc

SEQ ID NO: 46268 - RNA, 22 nt, Homo sapiens
aauaugucugcuaauuguuucu

SEQ ID NO: 46269 - RNA, 22 nt, Homo sapiens
aauugcaauggacaaugcagca

SEQ ID NO: 46270 - RNA, 22 nt, Homo sapiens
aauuggcagugcucuugccaca

SEQ ID NO: 46271 - RNA, 22 nt, Homo sapiens
acagugcuguggucaugggucu

SEQ ID NO: 46272 - RNA, 17 nt, Homo sapiens
accagugcaugugcuuu

SEQ ID NO: 46273 - RNA, 21 nt, Homo sapiens
acccucuaguuuucaacaggc

SEQ ID NO: 46274 - RNA, 22 nt, Homo sapiens
acccugugagagaguuaauauu

SEQ ID NO: 46275 - RNA, 21 nt, Homo sapiens
acugagagaucuggggcacau

SEQ ID NO: 46276 - RNA, 22 nt, Homo sapiens
agaagaacauagggugacugaa

SEQ ID NO: 46277 - RNA, 22 nt, Homo sapiens
agagauaguuuccaacucauac

SEQ ID NO: 46278 - RNA, 23 nt, Homo sapiens
agagguuuaaucaggcaguugcu

SEQ ID NO: 46279 - RNA, 22 nt, Homo sapiens
agcggcuguuccccuggucuau

SEQ ID NO: 46280 - RNA, 22 nt, Homo sapiens
agcuggcuguggagaaaccccu

SEQ ID NO: 46281 - RNA, 21 nt, Homo sapiens
aggagauguuuguccuuuuag

SEQ ID NO: 46282 - RNA, 22 nt, Homo sapiens
aggcaagaaugcuuguuucacc

SEQ ID NO: 46283 - RNA, 22 nt, Homo sapiens
agucacaugcauuuucuucaau

SEQ ID NO: 46284 - RNA, 22 nt, Homo sapiens
auagaucauugucauuuuagau

SEQ ID NO: 46285 - RNA, 22 nt, Homo sapiens
auagcacaguguguguacacca

SEQ ID NO: 46286 - RNA, 21 nt, Homo sapiens
auagcacaucagauuuuauua

SEQ ID NO: 46287 - RNA, 20 nt, Homo sapiens
aucaccacagcucguucaug

SEQ ID NO: 46288 - RNA, 22 nt, Homo sapiens
auccugagacuuuucugaaguu

SEQ ID NO: 46289 - RNA, 22 nt, Homo sapiens
aucuuuggauacuugauauagu

SEQ ID NO: 46290 - RNA, 22 nt, Homo sapiens
aucuuuggucaucacagcuaga

SEQ ID NO: 46291 - RNA, 22 nt, Homo sapiens
augaaaagcauaaacgcugaag

SEQ ID NO: 46292 - RNA, 19 nt, Homo sapiens
augagcaauaguuuuaauc

SEQ ID NO: 46293 - RNA, 22 nt, Homo sapiens
augaggcuauaauuuuuaugua

SEQ ID NO: 46294 - RNA, 22 nt, Homo sapiens
augauugugaauaugugguuuu

SEQ ID NO: 46295 - RNA, 22 nt, Homo sapiens
augccacugcacuucagccugg

SEQ ID NO: 46296 - RNA, 22 nt, Homo sapiens
augccacuguuuaugucacuua

SEQ ID NO: 46297 - RNA, 22 nt, Homo sapiens
augcuacuggacaauggugacu

SEQ ID NO: 46298 - RNA, 22 nt, Homo sapiens
auggaaugccauuuauaaugga

SEQ ID NO: 46299 - RNA, 22 nt, Homo sapiens
auggaauggcacuuugaagauu

SEQ ID NO: 46300 - RNA, 22 nt, Homo sapiens
auggcaguuucacucugggauu

SEQ ID NO: 46301 - RNA, 22 nt, Homo sapiens
auggccugaugcaccuguccca

SEQ ID NO: 46302 - RNA, 22 nt, Homo sapiens
auggcuucuuacucuucugcau

SEQ ID NO: 46303 - RNA, 22 nt, Homo sapiens
auucaagggauuucaggaggcu

SEQ ID NO: 46304 - RNA, 22 nt, Homo sapiens
auucaagugaugcagcuguuuu

SEQ ID NO: 46305 - RNA, 22 nt, Homo sapiens
auuggaguuguacgcacgcuca

SEQ ID NO: 46306 - RNA, 22 nt, Homo sapiens
auuuggcaguauaaugcuuugg

SEQ ID NO: 46307 - RNA, 22 nt, Homo sapiens
auuuggcauagaguaucauucu

SEQ ID NO: 46308 - RNA, 22 nt, Homo sapiens
auuuuugguugguaggcuauua

SEQ ID NO: 46309 - RNA, 22 nt, Homo sapiens
caaaggauucauuuccaggagu

SEQ ID NO: 46310 - RNA, 22 nt, Homo sapiens
caagggguggaaaugguagugu

SEQ ID NO: 46311 - RNA, 22 nt, Homo sapiens
caauggcaaugaaauagugaga

SEQ ID NO: 46312 - RNA, 22 nt, Homo sapiens
cacuggguuagaacaugcuccu

SEQ ID NO: 46313 - RNA, 22 nt, Homo sapiens
cagcaaaucauccuauuugagc

SEQ ID NO: 46314 - RNA, 22 nt, Homo sapiens
aagggaaugugguagcugguuu

SEQ ID NO: 46315 - RNA, 22 nt, Homo sapiens
aauauguccuugaaauggugcu

SEQ ID NO: 46316 - RNA, 22 nt, Homo sapiens
aaugacagugcuaaagaacccu

SEQ ID NO: 46317 - RNA, 22 nt, Homo sapiens
aauggcauugguccuuuuggau

SEQ ID NO: 46318 - RNA, 22 nt, Homo sapiens
acauaguagacacugaaaauau

SEQ ID NO: 46319 - RNA, 22 nt, Homo sapiens
acaucccuuucccacccuucac

SEQ ID NO: 46320 - RNA, 22 nt, Homo sapiens
acauucagcuguuguuucaaug

SEQ ID NO: 46321 - RNA, 22 nt, Homo sapiens
acccagaagucauucaggaaca

SEQ ID NO: 46322 - RNA, 20 nt, Homo sapiens
agaagcauugcucucuucag

SEQ ID NO: 46323 - RNA, 22 nt, Homo sapiens
agaguaguuuauuaugcuaagg

SEQ ID NO: 46324 - RNA, 21 nt, Homo sapiens
agccaguguuccuuguggcuc

SEQ ID NO: 46325 - RNA, 22 nt, Homo sapiens
agcccugugauuacuuuuauaa

SEQ ID NO: 46326 - RNA, 21 nt, Homo sapiens
agccugugggucauaguugcc

SEQ ID NO: 46327 - RNA, 22 nt, Homo sapiens
agccuguguugaauuauagaaa

SEQ ID NO: 46328 - RNA, 22 nt, Homo sapiens
agcuaaaucucauguugaauug

SEQ ID NO: 46329 - RNA, 22 nt, Homo sapiens
agcuggcuguagcugcaagucu

SEQ ID NO: 46330 - RNA, 20 nt, Homo sapiens
agcuggguguguuggugcau

SEQ ID NO: 46331 - RNA, 22 nt, Homo sapiens
agcuggucucaggugcccugcu

SEQ ID NO: 46332 - RNA, 22 nt, Homo sapiens
aggcacgguggcucacaccugu

SEQ ID NO: 46333 - RNA, 22 nt, Homo sapiens
aggcacggugucucaugccugu

SEQ ID NO: 46334 - RNA, 22 nt, Homo sapiens
aggcagaugagguccucagcug

SEQ ID NO: 46335 - RNA, 22 nt, Homo sapiens
aggugcaauggugguuuugugg

SEQ ID NO: 46336 - RNA, 22 nt, Homo sapiens
aguaacaggauccaaagaaugu

SEQ ID NO: 46337 - RNA, 22 nt, Homo sapiens
agucaugggagagaugugaucg

SEQ ID NO: 46338 - RNA, 22 nt, Homo sapiens
agucaugguaguaaauuuggac

SEQ ID NO: 46339 - RNA, 22 nt, Homo sapiens
auacauguucaagggcauauau

SEQ ID NO: 46340 - RNA, 16 nt, Homo sapiens
auaccacagugacaca

SEQ ID NO: 46341 - RNA, 22 nt, Homo sapiens
auacugucucuugcuccugccc

SEQ ID NO: 46342 - RNA, 22 nt, Homo sapiens
auauuggccuaaaauucucuuu

SEQ ID NO: 46343 - RNA, 22 nt, Homo sapiens
auauuguacugcuacugguucu

SEQ ID NO: 46344 - RNA, 22 nt, Homo sapiens
aucaccauguguacauuagacc

SEQ ID NO: 46345 - RNA, 22 nt, Homo sapiens
auccaagagacugaugacuucc

SEQ ID NO: 46346 - RNA, 22 nt, Homo sapiens
auccaguguuuucuuuugucac

SEQ ID NO: 46347 - RNA, 22 nt, Homo sapiens
auccuugagaaaauaaaugacc

SEQ ID NO: 46348 - RNA, 22 nt, Homo sapiens
aucuggcuucuuuuaguccaca

SEQ ID NO: 46349 - RNA, 22 nt, Homo sapiens
augaauacugcugcaaugaaca

SEQ ID NO: 46350 - RNA, 22 nt, Homo sapiens
augaauuuucugauguugggua

SEQ ID NO: 46351 - RNA, 22 nt, Homo sapiens
augccacugcacuucagccugc

SEQ ID NO: 46352 - RNA, 22 nt, Homo sapiens
augccacugcacuucagcuugg

SEQ ID NO: 46353 - RNA, 22 nt, Homo sapiens
augccauugcacuccagccuag

SEQ ID NO: 46354 - RNA, 22 nt, Homo sapiens
augccauugcacuccagccugg

SEQ ID NO: 46355 - RNA, 22 nt, Homo sapiens
auggaaucauccuccugggagc

SEQ ID NO: 46356 - RNA, 22 nt, Homo sapiens
auggcagugucuagggguguuu

SEQ ID NO: 46357 - RNA, 22 nt, Homo sapiens
auggcaguuuauucuaaaucaa

SEQ ID NO: 46358 - RNA, 22 nt, Homo sapiens
auggcucuuauuauuuugaggu

SEQ ID NO: 46359 - RNA, 22 nt, Homo sapiens
augggguagguagcucggggaa

SEQ ID NO: 46360 - RNA, 22 nt, Homo sapiens
auguaacaguauuuggagaugu

SEQ ID NO: 46361 - RNA, 22 nt, Homo sapiens
auuauuagucggccagcuguua

SEQ ID NO: 46362 - RNA, 22 nt, Homo sapiens
auuggcaauagcuuucuuacua

SEQ ID NO: 46363 - RNA, 22 nt, Homo sapiens
auuggcaaucgucuccauuuuu

SEQ ID NO: 46364 - RNA, 22 nt, Homo sapiens
auuggcuuuauacauaagaaua

SEQ ID NO: 46365 - RNA, 22 nt, Homo sapiens
auuggggaaugguggcuuuagu

SEQ ID NO: 46366 - RNA, 22 nt, Homo sapiens
auuguaauuuuagagaaagugg

SEQ ID NO: 46367 - RNA, 22 nt, Homo sapiens
auuuggcaauuuugaagaugcc

SEQ ID NO: 46368 - RNA, 22 nt, Homo sapiens
auuuggcagugaagggaucaca

SEQ ID NO: 46369 - RNA, 22 nt, Homo sapiens
cagcuaaauuguuaaauccaag

SEQ ID NO: 46370 - RNA, 22 nt, Homo sapiens
caucacaguacuaaucgucaua

SEQ ID NO: 46371 - RNA, 22 nt, Homo sapiens
cauggcauuucaagauuuacca

SEQ ID NO: 46372 - RNA, 22 nt, Homo sapiens
cauugcaacuucugccucccag

SEQ ID NO: 46373 - RNA, 18 nt, Homo sapiens
ccagugcaaggaaagccc

SEQ ID NO: 46374 - RNA, 22 nt, Homo sapiens
ccuggcacugggccccguggcu

SEQ ID NO: 46375 - RNA, 22 nt, Homo sapiens
cgcccuguagcuagcuagaggu

SEQ ID NO: 46376 - RNA, 22 nt, Homo sapiens
cuacucuggagagugacaauca

SEQ ID NO: 46377 - RNA, 22 nt, Homo sapiens
cucagguaguuccuuauagcaa

SEQ ID NO: 46378 - RNA, 19 nt, Homo sapiens
cucuuuggugucucuucuu

SEQ ID NO: 46379 - RNA, 22 nt, Homo sapiens
cuggaaucuagaaaagguaagg

SEQ ID NO: 46380 - RNA, 22 nt, Homo sapiens
cuggcaguguuucuugugggcu

SEQ ID NO: 46381 - RNA, 18 nt, Homo sapiens
cuuaacauugggaugaua

SEQ ID NO: 46382 - RNA, 22 nt, Homo sapiens
cuuggcacucuguggaguuagg

SEQ ID NO: 46383 - RNA, 22 nt, Homo sapiens
cuuggcuucuuuauguggcuau

SEQ ID NO: 46384 - RNA, 22 nt, Homo sapiens
cuuuggcaaugucauuuucaau

SEQ ID NO: 46385 - RNA, 22 nt, Homo sapiens
cuuugguuaauaggauauggca

SEQ ID NO: 46386 - RNA, 22 nt, Homo sapiens
cuuuuacacugguggugggaau

SEQ ID NO: 46387 - RNA, 22 nt, Homo sapiens
cuuuuggcuuaagauugucuug

SEQ ID NO: 46388 - RNA, 22 nt, Homo sapiens
cuuuuggcuuagaauugucuug

SEQ ID NO: 46389 - RNA, 22 nt, Homo sapiens
cuuuuugguagagcaggugugc

SEQ ID NO: 46390 - RNA, 22 nt, Homo sapiens
gaaagauuuccugagcuagaaa

SEQ ID NO: 46391 - RNA, 22 nt, Homo sapiens
gaaagauuuuaacugggagacu

SEQ ID NO: 46392 - RNA, 22 nt, Homo sapiens
gaagaaguacaagacaaauuuu

SEQ ID NO: 46393 - RNA, 22 nt, Homo sapiens
gagauaaauaggucacaguucu

SEQ ID NO: 46394 - RNA, 22 nt, Homo sapiens
gagcacccuuuguugauugcaa

SEQ ID NO: 46395 - RNA, 22 nt, Homo sapiens
gaggcagucuguccauucucag

SEQ ID NO: 46396 - RNA, 22 nt, Homo sapiens
gaggcaguguguccguucucgg

SEQ ID NO: 46397 - RNA, 21 nt, Homo sapiens
gauaucuuuauucccaagagc

SEQ ID NO: 46398 - RNA, 22 nt, Homo sapiens
gcaauguuacugaauguguuuu

SEQ ID NO: 46399 - RNA, 22 nt, Homo sapiens
gcacauuacaaguauuagcuca

SEQ ID NO: 46400 - RNA, 22 nt, Homo sapiens
gcagugcuggagcccccgugug

SEQ ID NO: 46401 - RNA, 22 nt, Homo sapiens
gcauggagaaggggacugauuc

SEQ ID NO: 46402 - RNA, 22 nt, Homo sapiens
gcauggagcauacauuucuguu

SEQ ID NO: 46403 - RNA, 22 nt, Homo sapiens
gcauggaguggaaauucuuggg

SEQ ID NO: 46404 - RNA, 18 nt, Homo sapiens
ggaagccuauuuaguaac

SEQ ID NO: 46405 - RNA, 22 nt, Homo sapiens
ggaagccuggaaaaaauuguga

SEQ ID NO: 46406 - RNA, 17 nt, Homo sapiens
ggaagccuuugguuuaa

SEQ ID NO: 46407 - RNA, 22 nt, Homo sapiens
ggaaugugugucaugcuuuugc

SEQ ID NO: 46408 - RNA, 22 nt, Homo sapiens
ggacugagaggacuacagugua

SEQ ID NO: 46409 - RNA, 22 nt, Homo sapiens
ggagucugaacuggacaaugac

SEQ ID NO: 46410 - RNA, 21 nt, Homo sapiens
ggcaagugugagguuuggggu

SEQ ID NO: 46411 - RNA, 21 nt, Homo sapiens
ggcucuguggucucagguuuc

SEQ ID NO: 46412 - RNA, 22 nt, Homo sapiens
gggaagugugcagaguucucuu

SEQ ID NO: 46413 - RNA, 22 nt, Homo sapiens
ggguucaaaucuuggcucuuac

SEQ ID NO: 46414 - RNA, 22 nt, Homo sapiens
guaaauguccugcuacagagug

SEQ ID NO: 46415 - RNA, 22 nt, Homo sapiens
guacauguaugcaugcaugcau

SEQ ID NO: 46416 - RNA, 22 nt, Homo sapiens
gucauggaaaucuacauuguua

SEQ ID NO: 46417 - RNA, 22 nt, Homo sapiens
gucauggaacaacuuaaaguca

SEQ ID NO: 46418 - RNA, 22 nt, Homo sapiens
gucauggacaaggugugagcca

SEQ ID NO: 46419 - RNA, 21 nt, Homo sapiens
guccaaaacaguguccaaugc

SEQ ID NO: 46420 - RNA, 22 nt, Homo sapiens
gugagcauucaaggaaggagcu

SEQ ID NO: 46421 - RNA, 22 nt, Homo sapiens
gugggguaggguaggacucaac

SEQ ID NO: 46422 - RNA, 22 nt, Homo sapiens
gugguuuuaucccagaaauuaa

SEQ ID NO: 46423 - RNA, 22 nt, Homo sapiens
gugugcaugucuuuuuaguagg

SEQ ID NO: 46424 - RNA, 22 nt, Homo sapiens
uaagacuuuuugggaauauaga

SEQ ID NO: 46425 - RNA, 22 nt, Homo sapiens
uaaggaacucugauaucuggaa

SEQ ID NO: 46426 - RNA, 22 nt, Homo sapiens
uaaggaaggcugugugcuuuua

SEQ ID NO: 46427 - RNA, 22 nt, Homo sapiens
uaaguaauugugguuucugcca

SEQ ID NO: 46428 - RNA, 22 nt, Homo sapiens
uaagugaaggaaguguguuuac

SEQ ID NO: 46429 - RNA, 22 nt, Homo sapiens
uaauauguuuugaaaucaggaa

SEQ ID NO: 46430 - RNA, 19 nt, Homo sapiens
uacugcacuccagucuggg

SEQ ID NO: 46431 - RNA, 22 nt, Homo sapiens
uagauuaucccugauuugucca

SEQ ID NO: 46432 - RNA, 22 nt, Homo sapiens
uagauuauuccuuugaauggcc

SEQ ID NO: 46433 - RNA, 22 nt, Homo sapiens
uaucacagauucuccaggguuu

SEQ ID NO: 46434 - RNA, 21 nt, Homo sapiens
uaucagagacauugagaggca

SEQ ID NO: 46435 - RNA, 22 nt, Homo sapiens
uaucagaguuacacugaagacu

SEQ ID NO: 46436 - RNA, 22 nt, Homo sapiens
uaugccuuuuggcucaagaaac

SEQ ID NO: 46437 - RNA, 22 nt, Homo sapiens
uauggcuuuguucaacagccuc

SEQ ID NO: 46438 - RNA, 22 nt, Homo sapiens
uaugucuucuuuagagaaaugu

SEQ ID NO: 46439 - RNA, 22 nt, Homo sapiens
uauuuggauagucuggaaaaaa

SEQ ID NO: 46440 - RNA, 22 nt, Homo sapiens
ucacugugguuugggaaagugc

SEQ ID NO: 46441 - RNA, 17 nt, Homo sapiens
ucagugcauuuaagaga

SEQ ID NO: 46442 - RNA, 22 nt, Homo sapiens
uccacaguaaggacccugccuu

SEQ ID NO: 46443 - RNA, 22 nt, Homo sapiens
ucccuacugggguacugccuag

SEQ ID NO: 46444 - RNA, 22 nt, Homo sapiens
uccugagacucacaggcucccc

SEQ ID NO: 46445 - RNA, 22 nt, Homo sapiens
uccuuugguggagucuuuaggg

SEQ ID NO: 46446 - RNA, 20 nt, Homo sapiens
ucucauggagguagagaaua

SEQ ID NO: 46447 - RNA, 20 nt, Homo sapiens
ucuugggaauguagccuagg

SEQ ID NO: 46448 - RNA, 22 nt, Homo sapiens
ucuuugauguucugaaagaugg

SEQ ID NO: 46449 - RNA, 22 nt, Homo sapiens
ugacuccagagacugugcuguc

SEQ ID NO: 46450 - RNA, 22 nt, Homo sapiens
ugagacugagucucccucuguc

SEQ ID NO: 46451 - RNA, 22 nt, Homo sapiens
ugagacugaguuucucucuugu

SEQ ID NO: 46452 - RNA, 22 nt, Homo sapiens
ugagacuguuuuggggaacuuc

SEQ ID NO: 46453 - RNA, 22 nt, Homo sapiens
ugagaucaugccacugcacuuc

SEQ ID NO: 46454 - RNA, 22 nt, Homo sapiens
ugagaugauuuaauggagccca

SEQ ID NO: 46455 - RNA, 22 nt, Homo sapiens
ugaggaauguguguuaaagaua

SEQ ID NO: 46456 - RNA, 22 nt, Homo sapiens
ugagucagucucacucugcugc

SEQ ID NO: 46457 - RNA, 22 nt, Homo sapiens
uucauggaacaaguggguucaa

SEQ ID NO: 46458 - RNA, 22 nt, Homo sapiens
uuccugagaucagaauucaaau

SEQ ID NO: 46459 - RNA, 22 nt, Homo sapiens
uucuuuggaaacaguacuaauu

SEQ ID NO: 46460 - RNA, 22 nt, Homo sapiens
uugcacauugauuuuguauccu

SEQ ID NO: 46461 - RNA, 22 nt, Homo sapiens
uuggcaauugcuaugauuugaa

SEQ ID NO: 46462 - RNA, 22 nt, Homo sapiens
uuggccccuccaaaucucaugu

SEQ ID NO: 46463 - RNA, 22 nt, Homo sapiens
uuggccccucccaaauuucaug

SEQ ID NO: 46464 - RNA, 22 nt, Homo sapiens
uuggccccuuucauccacagcu

SEQ ID NO: 46465 - RNA, 22 nt, Homo sapiens
uuggccuccuggucauauccag

SEQ ID NO: 46466 - RNA, 23 nt, Homo sapiens
uuggccuccuugugucuagggcu

SEQ ID NO: 46467 - RNA, 22 nt, Homo sapiens
uugggccacuuuaguuuccuua

SEQ ID NO: 46468 - RNA, 22 nt, Homo sapiens
uugucaaacucauucuccaucc

SEQ ID NO: 46469 - RNA, 22 nt, Homo sapiens
uugugaauggugccucaguaaa

SEQ ID NO: 46470 - RNA, 22 nt, Homo sapiens
uugugaauggugcugcaguaaa

SEQ ID NO: 46471 - RNA, 22 nt, Homo sapiens
uuuaacauuggaugagaucguc

SEQ ID NO: 46472 - RNA, 22 nt, Homo sapiens
uuuacagucucauagguggaag

SEQ ID NO: 46473 - RNA, 22 nt, Homo sapiens
uuuccaguuggaagaaggggga

SEQ ID NO: 46474 - RNA, 22 nt, Homo sapiens
uuucccuuuagcuuagugauuu

SEQ ID NO: 46475 - RNA, 22 nt, Homo sapiens
uuuggcacuauagguaaauuug

SEQ ID NO: 46476 - RNA, 22 nt, Homo sapiens
uuuggcacuguaaauuucucuu

SEQ ID NO: 46477 - RNA, 22 nt, Homo sapiens
uuuggcuuaagauugacugcaa

SEQ ID NO: 46478 - RNA, 22 nt, Homo sapiens
uuuggcuuugagaagcagugga

SEQ ID NO: 46479 - RNA, 22 nt, Homo sapiens
uuuguaauccuauuccaaagga

SEQ ID NO: 46480 - RNA, 22 nt, Homo sapiens
uuugucacucuuggagguuguu

SEQ ID NO: 46481 - RNA, 22 nt, Homo sapiens
uuuuggcacuuugucugauucu

SEQ ID NO: 46482 - RNA, 22 nt, Homo sapiens
uuuuugaguagcuggagagcag

SEQ ID NO: 46483 - RNA, 22 nt, Homo sapiens
aaauugcuuuugaagacuuagu

SEQ ID NO: 46484 - RNA, 23 nt, Homo sapiens
aaauuugccuauuauuccuaugg

SEQ ID NO: 46485 - RNA, 22 nt, Homo sapiens
aacagaccuagauaguauaguc

SEQ ID NO: 46486 - RNA, 22 nt, Homo sapiens
aagggaauguuguagcugguuu

SEQ ID NO: 46487 - RNA, 22 nt, Homo sapiens
aaguaauugagguuuuugcugu

SEQ ID NO: 46488 - RNA, 22 nt, Homo sapiens
aauacucuauaagggaagcugu

SEQ ID NO: 46489 - RNA, 22 nt, Homo sapiens
acaagugaauacaggauucucu

SEQ ID NO: 46490 - RNA, 22 nt, Homo sapiens
acaccuguggucccaguaacuu

SEQ ID NO: 46491 - RNA, 22 nt, Homo sapiens
acagugacagaaagcugauuau

SEQ ID NO: 46492 - RNA, 22 nt, Homo sapiens
acccagaauucagucuuaggcc

SEQ ID NO: 46493 - RNA, 22 nt, Homo sapiens
agagaacuggcuucaccauucu

SEQ ID NO: 46494 - RNA, 22 nt, Homo sapiens
agagagguggguggagccccca

SEQ ID NO: 46495 - RNA, 22 nt, Homo sapiens
agagguuuaacuggcuuauggu

SEQ ID NO: 46496 - RNA, 22 nt, Homo sapiens
agaucauaugcaguaaugaacu

SEQ ID NO: 46497 - RNA, 22 nt, Homo sapiens
agcacauauauuucccaaaaca

SEQ ID NO: 46498 - RNA, 22 nt, Homo sapiens
agcuggaauuuaagguagauag

SEQ ID NO: 46499 - RNA, 22 nt, Homo sapiens
agcugguauuuguuagggaguu

SEQ ID NO: 46500 - RNA, 22 nt, Homo sapiens
aggcaagcaucuugcucccuuc

SEQ ID NO: 46501 - RNA, 22 nt, Homo sapiens
agucauggaucacaguagccuc

SEQ ID NO: 46502 - RNA, 22 nt, Homo sapiens
agugaacaaagaagugcagaua

SEQ ID NO: 46503 - RNA, 22 nt, Homo sapiens
agugcauugagacuugugaguu

SEQ ID NO: 46504 - RNA, 22 nt, Homo sapiens
auaauagcugaucauuuagaag

SEQ ID NO: 46505 - RNA, 20 nt, Homo sapiens
auaugguugugagugauuuu

SEQ ID NO: 46506 - RNA, 22 nt, Homo sapiens
auaugucuguuuagucuguaau

SEQ ID NO: 46507 - RNA, 22 nt, Homo sapiens
aucacagaacuuugagcagaga

SEQ ID NO: 46508 - RNA, 22 nt, Homo sapiens
aucagcaugcagaagucggggg

SEQ ID NO: 46509 - RNA, 22 nt, Homo sapiens
auccacauucauggaccagucc

SEQ ID NO: 46510 - RNA, 22 nt, Homo sapiens
aucucugagauguucugauuuu

SEQ ID NO: 46511 - RNA, 22 nt, Homo sapiens
aucuuuggugaguucuuugguc

SEQ ID NO: 46512 - RNA, 22 nt, Homo sapiens
aucuuuggugcaugauacuuug

SEQ ID NO: 46513 - RNA, 18 nt, Homo sapiens
augcauauuuuaaguugu

SEQ ID NO: 46514 - RNA, 22 nt, Homo sapiens
augccacugcacuccaaccugg

SEQ ID NO: 46515 - RNA, 22 nt, Homo sapiens
auuauuaguuguugaaugaagu

SEQ ID NO: 46516 - RNA, 22 nt, Homo sapiens
auucaaggacuggauugcggga

SEQ ID NO: 46517 - RNA, 22 nt, Homo sapiens
auugcacaccagucugggcaaa

SEQ ID NO: 46518 - RNA, 22 nt, Homo sapiens
auugcacaucugcacuacagcc

SEQ ID NO: 46519 - RNA, 22 nt, Homo sapiens
auuggcaauguacauaucuugc

SEQ ID NO: 46520 - RNA, 22 nt, Homo sapiens
auugugcuaaaguaauaaguca

SEQ ID NO: 46521 - RNA, 22 nt, Homo sapiens
auuucuacuccuguguccagaa

SEQ ID NO: 46522 - RNA, 22 nt, Homo sapiens
auuuggcaacguagggaggcau

SEQ ID NO: 46523 - RNA, 22 nt, Homo sapiens
auuuuugguugucagcacuagg

SEQ ID NO: 46524 - RNA, 22 nt, Homo sapiens
cacauugcaggaaaguucauua

SEQ ID NO: 46525 - RNA, 22 nt, Homo sapiens
cagagguaagcaagucagcauu

SEQ ID NO: 46526 - RNA, 22 nt, Homo sapiens
cagcucauugcagucucgaccu

SEQ ID NO: 46527 - RNA, 22 nt, Homo sapiens
caguacaauguugauuagaagu

SEQ ID NO: 46528 - RNA, 20 nt, Homo sapiens
cagugcacuuucccacuggu

SEQ ID NO: 46529 - RNA, 22 nt, Homo sapiens
caucacuguugguacaaguaau

SEQ ID NO: 46530 - RNA, 22 nt, Homo sapiens
cauugcaaugaggucuugcagu

SEQ ID NO: 46531 - RNA, 22 nt, Homo sapiens
ccagugucugacagacacggcg

SEQ ID NO: 46532 - RNA, 18 nt, Homo sapiens
cccagugacuuauggccu

SEQ ID NO: 46533 - RNA, 22 nt, Homo sapiens
cccugagagcagggucuuucuc

SEQ ID NO: 46534 - RNA, 21 nt, Homo sapiens
cgucauggagauguguuguac

SEQ ID NO: 46535 - RNA, 22 nt, Homo sapiens
cucauggaauacuucacagcca

SEQ ID NO: 46536 - RNA, 19 nt, Homo sapiens
cucauggagaaggagaaua

SEQ ID NO: 46537 - RNA, 22 nt, Homo sapiens
cucauggauggucuggcagcca

SEQ ID NO: 46538 - RNA, 22 nt, Homo sapiens
cugagagugguauguuuaagug

SEQ ID NO: 46539 - RNA, 22 nt, Homo sapiens
cugaggguagaaggaucacuug

SEQ ID NO: 46540 - RNA, 22 nt, Homo sapiens
cugagguaggcccugagaauau

SEQ ID NO: 46541 - RNA, 22 nt, Homo sapiens
cugggguaggacuggcuuuuga

SEQ ID NO: 46542 - RNA, 22 nt, Homo sapiens
cuucaaguguggccaccugacc

SEQ ID NO: 46543 - RNA, 22 nt, Homo sapiens
cuuggguaagucauuaaaauua

SEQ ID NO: 46544 - RNA, 21 nt, Homo sapiens
cuugucuugcuuagaauagac

SEQ ID NO: 46545 - RNA, 20 nt, Homo sapiens
cuuuggcaaugagaacaggg

SEQ ID NO: 46546 - RNA, 22 nt, Homo sapiens
gaaagugcugcaaggccaugca

SEQ ID NO: 46547 - RNA, 22 nt, Homo sapiens
gagaugauuugccccauguauu

SEQ ID NO: 46548 - RNA, 22 nt, Homo sapiens
gagcuacauggauagucugcau

SEQ ID NO: 46549 - RNA, 22 nt, Homo sapiens
gaggcagucugacccuuagcag

SEQ ID NO: 46550 - RNA, 22 nt, Homo sapiens
gaggcagucugucccuuagcag

SEQ ID NO: 46551 - RNA, 22 nt, Homo sapiens
gaguuacauuguaauugccgag

SEQ ID NO: 46552 - RNA, 22 nt, Homo sapiens
gaucuguuuuccuauuguuugu

SEQ ID NO: 46553 - RNA, 22 nt, Homo sapiens
gauuggcauugcugcaccugag

SEQ ID NO: 46554 - RNA, 22 nt, Homo sapiens
gauuuuuggggaagccucuuau

SEQ ID NO: 46555 - RNA, 22 nt, Homo sapiens
gcaagaaucugggaguaaaauu

SEQ ID NO: 46556 - RNA, 22 nt, Homo sapiens
gcacaggguuacauucuaaggu

SEQ ID NO: 46557 - RNA, 22 nt, Homo sapiens
gcaccccuuaccgggcuggguu

SEQ ID NO: 46558 - RNA, 22 nt, Homo sapiens
gcagugacaugugccaguuuau

SEQ ID NO: 46559 - RNA, 22 nt, Homo sapiens
ggaagccugcacucgggcaggg

SEQ ID NO: 46560 - RNA, 22 nt, Homo sapiens
ggaauauaaaaagccccagaau

SEQ ID NO: 46561 - RNA, 22 nt, Homo sapiens
ggagagugacauauuucuaggc

SEQ ID NO: 46562 - RNA, 22 nt, Homo sapiens
ggagaugaaaugagcuacuuaa

SEQ ID NO: 46563 - RNA, 22 nt, Homo sapiens
gggcagaugucuggacaccuca

SEQ ID NO: 46564 - RNA, 22 nt, Homo sapiens
ggugagcacagaaugcccugag

SEQ ID NO: 46565 - RNA, 22 nt, Homo sapiens
guacagugcucacaaugagagc

SEQ ID NO: 46566 - RNA, 22 nt, Homo sapiens
guaccacaguugcucacggguu

SEQ ID NO: 46567 - RNA, 22 nt, Homo sapiens
guagaauguauacaguauacag

SEQ ID NO: 46568 - RNA, 22 nt, Homo sapiens
gucacggaauguaaguggaagu

SEQ ID NO: 46569 - RNA, 22 nt, Homo sapiens
gucauggacaguuugcuaauug

SEQ ID NO: 46570 - RNA, 22 nt, Homo sapiens
gucccugcgauugugggauccu

SEQ ID NO: 46571 - RNA, 22 nt, Homo sapiens
gucuuuggaaagacaaaguuca

SEQ ID NO: 46572 - RNA, 22 nt, Homo sapiens
gugagauuaccauuuaaaucag

SEQ ID NO: 46573 - RNA, 22 nt, Homo sapiens
gugaggcugguccugccuccca

SEQ ID NO: 46574 - RNA, 22 nt, Homo sapiens
gugccacugcaccuggccuaag

SEQ ID NO: 46575 - RNA, 22 nt, Homo sapiens
guggaagcacaggccuccugga

SEQ ID NO: 46576 - RNA, 21 nt, Homo sapiens
gugucaugguugacuuuggca

SEQ ID NO: 46577 - RNA, 20 nt, Homo sapiens
guucacagagguuaugauua

SEQ ID NO: 46578 - RNA, 22 nt, Homo sapiens
guuuuuggggucacuauuaccg

SEQ ID NO: 46579 - RNA, 22 nt, Homo sapiens
uaacuaguggaauuugauuuca

SEQ ID NO: 46580 - RNA, 22 nt, Homo sapiens
uaagcuagcauagggguaaauu

SEQ ID NO: 46581 - RNA, 22 nt, Homo sapiens
uacaggacuauagaacuuuccc

SEQ ID NO: 46582 - RNA, 22 nt, Homo sapiens
uagaggaaugaauuuggccaga

SEQ ID NO: 46583 - RNA, 22 nt, Homo sapiens
uagcacccucuccuaguccugc

SEQ ID NO: 46584 - RNA, 22 nt, Homo sapiens
uagugaaugucacuggcuguug

SEQ ID NO: 46585 - RNA, 22 nt, Homo sapiens
uauauguucuugcacuggaaag

SEQ ID NO: 46586 - RNA, 22 nt, Homo sapiens
uauauguuuucauaaggcuaga

SEQ ID NO: 46587 - RNA, 22 nt, Homo sapiens
uaucacaguaaaucugggugca

SEQ ID NO: 46588 - RNA, 22 nt, Homo sapiens
uaugcacacguguccaugugca

SEQ ID NO: 46589 - RNA, 22 nt, Homo sapiens
uauggcuuuucacuuaaguccu

SEQ ID NO: 46590 - RNA, 22 nt, Homo sapiens
uauugccugucuccaaaaauca

SEQ ID NO: 46591 - RNA, 18 nt, Homo sapiens
ucaaauacuuugggcagu

SEQ ID NO: 46592 - RNA, 23 nt, Homo sapiens
ucaagugaugguggccacaaggg

SEQ ID NO: 46593 - RNA, 22 nt, Homo sapiens
ucacucagaccuggugauaugc

SEQ ID NO: 46594 - RNA, 22 nt, Homo sapiens
ucagugacuggguauuaaauca

SEQ ID NO: 46595 - RNA, 22 nt, Homo sapiens
uccaaaucucuggcacugggau

SEQ ID NO: 46596 - RNA, 19 nt, Homo sapiens
uccaccgcgugcaccucua

SEQ ID NO: 46597 - RNA, 21 nt, Homo sapiens
ucuuuggucaccaguuuucau

SEQ ID NO: 46598 - RNA, 22 nt, Homo sapiens
ucuuuguuuucugauccugaag

SEQ ID NO: 46599 - RNA, 22 nt, Homo sapiens
ugagacacuucccagaucccuu

SEQ ID NO: 46600 - RNA, 22 nt, Homo sapiens
ugagagaugaacucugauaugu

SEQ ID NO: 46601 - RNA, 22 nt, Homo sapiens
ugagagcuuuuuugccugguga

SEQ ID NO: 46602 - RNA, 22 nt, Homo sapiens
ugagauguuuguuucagugccu

SEQ ID NO: 46603 - RNA, 22 nt, Homo sapiens
ugaggagugaacuauuucugau

SEQ ID NO: 46604 - RNA, 22 nt, Homo sapiens
ugaguauguuuagaaguaaagg

SEQ ID NO: 46605 - RNA, 22 nt, Homo sapiens
ugagugaggcugggcagucccu

SEQ ID NO: 46606 - RNA, 22 nt, Homo sapiens
ugagugagguucuacucuguga

SEQ ID NO: 46607 - RNA, 23 nt, Homo sapiens
cagcucauuuggguccccuuguc

SEQ ID NO: 46608 - RNA, 20 nt, Homo sapiens
cagggcaaugaggagguaaa

SEQ ID NO: 46609 - RNA, 21 nt, Homo sapiens
ccaguguaaugauagcaggca

SEQ ID NO: 46610 - RNA, 22 nt, Homo sapiens
cuacucugugguguauuugcau

SEQ ID NO: 46611 - RNA, 22 nt, Homo sapiens
cucauggagaacaucugcuagg

SEQ ID NO: 46612 - RNA, 21 nt, Homo sapiens
cucucugcuuaugaauaguga

SEQ ID NO: 46613 - RNA, 22 nt, Homo sapiens
cucuuuggaugccuuaggguua

SEQ ID NO: 46614 - RNA, 22 nt, Homo sapiens
cuuacagucuaucagccacaac

SEQ ID NO: 46615 - RNA, 20 nt, Homo sapiens
cuugaagacuaugcugcuga

SEQ ID NO: 46616 - RNA, 22 nt, Homo sapiens
cuuggcacugcucacccuccuu

SEQ ID NO: 46617 - RNA, 22 nt, Homo sapiens
cuuggcuuguuguccccugcuc

SEQ ID NO: 46618 - RNA, 20 nt, Homo sapiens
cuuggcuuucuugguguuaa

SEQ ID NO: 46619 - RNA, 22 nt, Homo sapiens
cuuuggagaaaaguucuugggc

SEQ ID NO: 46620 - RNA, 22 nt, Homo sapiens
cuuuggcauuagccuguauaga

SEQ ID NO: 46621 - RNA, 22 nt, Homo sapiens
cuuuuacacugcuggugggaau

SEQ ID NO: 46622 - RNA, 22 nt, Homo sapiens
cuuuuacacuguuagugggaau

SEQ ID NO: 46623 - RNA, 22 nt, Homo sapiens
cuuuuacacuguuggcaggauu

SEQ ID NO: 46624 - RNA, 22 nt, Homo sapiens
gagauuuucagcuugacuggga

SEQ ID NO: 46625 - RNA, 22 nt, Homo sapiens
gagucagugucuugcucuguca

SEQ ID NO: 46626 - RNA, 22 nt, Homo sapiens
gaugagguaggccugcuuugaa

SEQ ID NO: 46627 - RNA, 22 nt, Homo sapiens
gaugguggucuacccuuucccu

SEQ ID NO: 46628 - RNA, 22 nt, Homo sapiens
gccccgggugaugcagccguca

SEQ ID NO: 46629 - RNA, 22 nt, Homo sapiens
gcuaggagaucugcugcucucu

SEQ ID NO: 46630 - RNA, 22 nt, Homo sapiens
gcugguguucaggcccucaguc

SEQ ID NO: 46631 - RNA, 22 nt, Homo sapiens
ggaauauaaaacuuuugacagg

SEQ ID NO: 46632 - RNA, 22 nt, Homo sapiens
ggcaagugucagcagcaacacc

SEQ ID NO: 46633 - RNA, 22 nt, Homo sapiens
ggucauggauaagauccagaag

SEQ ID NO: 46634 - RNA, 22 nt, Homo sapiens
guacucuggaguaggccuaauu

SEQ ID NO: 46635 - RNA, 22 nt, Homo sapiens
guagagagaaauacaaagcugu

SEQ ID NO: 46636 - RNA, 22 nt, Homo sapiens
guagcagaauaucagauaauuu

SEQ ID NO: 46637 - RNA, 22 nt, Homo sapiens
guaguuuaucagaaagaauagg

SEQ ID NO: 46638 - RNA, 22 nt, Homo sapiens
gugauuauccacgucuuuguga

SEQ ID NO: 46639 - RNA, 22 nt, Homo sapiens
guggcacgaugaucugggcuca

SEQ ID NO: 46640 - RNA, 22 nt, Homo sapiens
gugggcucguucguguuagaca

SEQ ID NO: 46641 - RNA, 22 nt, Homo sapiens
gugggguaggaggaguacuucc

SEQ ID NO: 46642 - RNA, 22 nt, Homo sapiens
gugguuuuaauauucagucuag

SEQ ID NO: 46643 - RNA, 22 nt, Homo sapiens
gugugcauaugucuuuauagua

SEQ ID NO: 46644 - RNA, 20 nt, Homo sapiens
gugugcauuucagauuuugg

SEQ ID NO: 46645 - RNA, 22 nt, Homo sapiens
guuaagaaguguaacuuaaguu

SEQ ID NO: 46646 - RNA, 22 nt, Homo sapiens
uaaaccacguuuacauuugaga

SEQ ID NO: 46647 - RNA, 22 nt, Homo sapiens
uaaagccauugucaaguuugua

SEQ ID NO: 46648 - RNA, 22 nt, Homo sapiens
uaacauucacaugcugcaaaaa

SEQ ID NO: 46649 - RNA, 22 nt, Homo sapiens
uacaagcaggaaaugguauaug

SEQ ID NO: 46650 - RNA, 22 nt, Homo sapiens
uacagugcuuuuugguggagaa

SEQ ID NO: 46651 - RNA, 19 nt, Homo sapiens
uacaugcagcaggcacgca

SEQ ID NO: 46652 - RNA, 16 nt, Homo sapiens
uacauuuguuacaugg

SEQ ID NO: 46653 - RNA, 18 nt, Homo sapiens
uagaauauaggucauucu

SEQ ID NO: 46654 - RNA, 22 nt, Homo sapiens
uagaggaaggauuggaaacgca

SEQ ID NO: 46655 - RNA, 22 nt, Homo sapiens
uagcagcagugguguauuuaga

SEQ ID NO: 46656 - RNA, 22 nt, Homo sapiens
uauaguguuuucaaaaguaugu

SEQ ID NO: 46657 - RNA, 23 nt, Homo sapiens
uaucucaaugcacagagaggaaa

SEQ ID NO: 46658 - RNA, 22 nt, Homo sapiens
uauggcuucuauaaggaagcuu

SEQ ID NO: 46659 - RNA, 22 nt, Homo sapiens
uauugccucuuuuguaaaagug

SEQ ID NO: 46660 - RNA, 22 nt, Homo sapiens
ucaaaucaucuuuuccaaagcu

SEQ ID NO: 46661 - RNA, 18 nt, Homo sapiens
ucacggggagcagcagcc

SEQ ID NO: 46662 - RNA, 22 nt, Homo sapiens
ucagaguggagucugcagccuu

SEQ ID NO: 46663 - RNA, 22 nt, Homo sapiens
ucagugacugcugcuuguauac

SEQ ID NO: 46664 - RNA, 22 nt, Homo sapiens
ucauauguaugugcaauuuugu

SEQ ID NO: 46665 - RNA, 22 nt, Homo sapiens
ucauucuuucuguggaggggcu

SEQ ID NO: 46666 - RNA, 22 nt, Homo sapiens
uccacaauggagaagaguauga

SEQ ID NO: 46667 - RNA, 19 nt, Homo sapiens
uccccaguuuuccguucag

SEQ ID NO: 46668 - RNA, 19 nt, Homo sapiens
uccccgggucuagugcagc

SEQ ID NO: 46669 - RNA, 22 nt, Homo sapiens
uccccuuuguaagauggaaacg

SEQ ID NO: 46670 - RNA, 22 nt, Homo sapiens
uccugagacugaggagcuuugg

SEQ ID NO: 46671 - RNA, 22 nt, Homo sapiens
uccugagagcagacccucuaua

SEQ ID NO: 46672 - RNA, 22 nt, Homo sapiens
uccuugagaggacagagccaua

SEQ ID NO: 46673 - RNA, 22 nt, Homo sapiens
uccuuuggcuaacuuucuaagu

SEQ ID NO: 46674 - RNA, 22 nt, Homo sapiens
ucuucuagcggaacccucuugu

SEQ ID NO: 46675 - RNA, 22 nt, Homo sapiens
ucuuuggugaauggucauccag

SEQ ID NO: 46676 - RNA, 22 nt, Homo sapiens
ugaauauagacagggguagaga

SEQ ID NO: 46677 - RNA, 22 nt, Homo sapiens
ugaauguacacgcguacuuguu

SEQ ID NO: 46678 - RNA, 22 nt, Homo sapiens
ugagacugaaauuaggaaacug

SEQ ID NO: 46679 - RNA, 22 nt, Homo sapiens
ugagacugagucuugcucuugu

SEQ ID NO: 46680 - RNA, 22 nt, Homo sapiens
ugagacugaguuucgcucuugu

SEQ ID NO: 46681 - RNA, 22 nt, Homo sapiens
ugagacugguaauguguagggc

SEQ ID NO: 46682 - RNA, 22 nt, Homo sapiens
ugagcagagaagugcccugcgc

SEQ ID NO: 46683 - RNA, 22 nt, Homo sapiens
ugcaauauccucuacuauaggu

SEQ ID NO: 46684 - RNA, 22 nt, Homo sapiens
uggauagaacuaagugcuuaga

SEQ ID NO: 46685 - RNA, 22 nt, Homo sapiens
uggcagcgugaauguggcugaa

SEQ ID NO: 46686 - RNA, 22 nt, Homo sapiens
uggcauguguuugaaugaguau

SEQ ID NO: 46687 - RNA, 22 nt, Homo sapiens
uggccaguguuuuuccugggcu

SEQ ID NO: 46688 - RNA, 18 nt, Homo sapiens
uggcuacugaacuagaug

SEQ ID NO: 46689 - RNA, 22 nt, Homo sapiens
uggcuuuuguuauuuggaagcu

SEQ ID NO: 46690 - RNA, 22 nt, Homo sapiens
ugggaacugaggugaaaagaca

SEQ ID NO: 46691 - RNA, 22 nt, Homo sapiens
ugguaagaggcccugaguuugu

SEQ ID NO: 46692 - RNA, 22 nt, Homo sapiens
uggucauggaaauagaaugcac

SEQ ID NO: 46693 - RNA, 22 nt, Homo sapiens
ugguccuuuccauuggagacac

SEQ ID NO: 46694 - RNA, 22 nt, Homo sapiens
uggugagaaaagaugucuuugu

SEQ ID NO: 46695 - RNA, 22 nt, Homo sapiens
aucuuuggcgggaauaucacag

SEQ ID NO: 46696 - RNA, 22 nt, Homo sapiens
augacauugaaaagcaagugga

SEQ ID NO: 46697 - RNA, 22 nt, Homo sapiens
augaugucauuuuaauuucuaa

SEQ ID NO: 46698 - RNA, 22 nt, Homo sapiens
augcagaucacauuuuucuguc

SEQ ID NO: 46699 - RNA, 19 nt, Homo sapiens
augccacagugaggucaga

SEQ ID NO: 46700 - RNA, 22 nt, Homo sapiens
auggcccccuguuugugaacau

SEQ ID NO: 46701 - RNA, 22 nt, Homo sapiens
auggcuucuucuaaaagugggg

SEQ ID NO: 46702 - RNA, 22 nt, Homo sapiens
auugagcaaggucuccuaguau

SEQ ID NO: 46703 - RNA, 22 nt, Homo sapiens
auugcacaaagagggaaacuga

SEQ ID NO: 46704 - RNA, 22 nt, Homo sapiens
auuggcaagauagcauaugagg

SEQ ID NO: 46705 - RNA, 22 nt, Homo sapiens
auuggcaauccauauauuuucu

SEQ ID NO: 46706 - RNA, 22 nt, Homo sapiens
auuggcuuuugaaagucugcga

SEQ ID NO: 46707 - RNA, 20 nt, Homo sapiens
auuuggcauaguuuaagcaa

SEQ ID NO: 46708 - RNA, 22 nt, Homo sapiens
auuuuuggauauagggaaggau

SEQ ID NO: 46709 - RNA, 22 nt, Homo sapiens
auuuuugguuucaccugcacgc

SEQ ID NO: 46710 - RNA, 19 nt, Homo sapiens
caaaguguucuucuuugcc

SEQ ID NO: 46711 - RNA, 22 nt, Homo sapiens
caacaguaaagcauuuuuaagu

SEQ ID NO: 46712 - RNA, 23 nt, Homo sapiens
cacugggcagcagguguucccag

SEQ ID NO: 46713 - RNA, 22 nt, Homo sapiens
caugccacugcacuccaaccug

SEQ ID NO: 46714 - RNA, 22 nt, Homo sapiens
cauuuuacuuuccagacgugga

SEQ ID NO: 46715 - RNA, 22 nt, Homo sapiens
cccagugaagagaaccuuacga

SEQ ID NO: 46716 - RNA, 22 nt, Homo sapiens
cccugagaaaacuuuguccuua

SEQ ID NO: 46717 - RNA, 22 nt, Homo sapiens
cccugagaugcuguuaaucugu

SEQ ID NO: 46718 - RNA, 22 nt, Homo sapiens
cccugugaauauuaccuuauuu

SEQ ID NO: 46719 - RNA, 22 nt, Homo sapiens
cucauggagaaccucugcuagg

SEQ ID NO: 46720 - RNA, 22 nt, Homo sapiens
cucauggagauagagaauagaa

SEQ ID NO: 46721 - RNA, 22 nt, Homo sapiens
cuccagugcaaagucaugauca

SEQ ID NO: 46722 - RNA, 23 nt, Homo sapiens
cuccaugagccguccagggccug

SEQ ID NO: 46723 - RNA, 22 nt, Homo sapiens
cugaaaagcaucugcauagcug

SEQ ID NO: 46724 - RNA, 22 nt, Homo sapiens
cugagaguugaugaaauauggu

SEQ ID NO: 46725 - RNA, 22 nt, Homo sapiens
cuuccugaguccugggcucaca

SEQ ID NO: 46726 - RNA, 22 nt, Homo sapiens
cuucuugcuguguccucacaug

SEQ ID NO: 46727 - RNA, 22 nt, Homo sapiens
cuuggcacgugauagguguuga

SEQ ID NO: 46728 - RNA, 22 nt, Homo sapiens
cuuggcuugguaucaaauaacc

SEQ ID NO: 46729 - RNA, 22 nt, Homo sapiens
cuuguguuacauauuuaagaga

SEQ ID NO: 46730 - RNA, 22 nt, Homo sapiens
cuuuggcacuuccuaagugcca

SEQ ID NO: 46731 - RNA, 22 nt, Homo sapiens
cuuuuacacuguuggugggaau

SEQ ID NO: 46732 - RNA, 22 nt, Homo sapiens
gagguaugugggcagacauuua

SEQ ID NO: 46733 - RNA, 22 nt, Homo sapiens
gagugcuguuagcccuggguuu

SEQ ID NO: 46734 - RNA, 22 nt, Homo sapiens
gcaaagaaugcagauuugccuc

SEQ ID NO: 46735 - RNA, 23 nt, Homo sapiens
gcaaauaucguagagugucccug

SEQ ID NO: 46736 - RNA, 22 nt, Homo sapiens
gcauggaaggcgcuuugugacu

SEQ ID NO: 46737 - RNA, 22 nt, Homo sapiens
gcccuguguuuggguaugguca

SEQ ID NO: 46738 - RNA, 22 nt, Homo sapiens
gcuaggagauccacugcucucu

SEQ ID NO: 46739 - RNA, 22 nt, Homo sapiens
ggaaaguaacccauucucuuac

SEQ ID NO: 46740 - RNA, 22 nt, Homo sapiens
ggaaugcagugagcauuagaua

SEQ ID NO: 46741 - RNA, 22 nt, Homo sapiens
ggcaagugggagggaguguuuc

SEQ ID NO: 46742 - RNA, 22 nt, Homo sapiens
ggucauggagcuuuacuuuaug

SEQ ID NO: 46743 - RNA, 19 nt, Homo sapiens
ggucauggagguuguguga

SEQ ID NO: 46744 - RNA, 22 nt, Homo sapiens
ggucauggauguuuauaguaca

SEQ ID NO: 46745 - RNA, 22 nt, Homo sapiens
ggucauggauugucuuuucuug

SEQ ID NO: 46746 - RNA, 22 nt, Homo sapiens
ggugauguuugaguugagacag

SEQ ID NO: 46747 - RNA, 22 nt, Homo sapiens
guaaugaacuugaaagccuguu

SEQ ID NO: 46748 - RNA, 22 nt, Homo sapiens
guagaagcacagggccuguauu

SEQ ID NO: 46749 - RNA, 22 nt, Homo sapiens
gucauggaggaugaauggccaa

SEQ ID NO: 46750 - RNA, 22 nt, Homo sapiens
gucauggagggacauaacuaac

SEQ ID NO: 46751 - RNA, 22 nt, Homo sapiens
guccaguguuggagguuuuacc

SEQ ID NO: 46752 - RNA, 22 nt, Homo sapiens
gucuuuggaaaaaaugucuguu

SEQ ID NO: 46753 - RNA, 17 nt, Homo sapiens
gucuuugguugaguuua

SEQ ID NO: 46754 - RNA, 22 nt, Homo sapiens
gugaaaagaugagcaccauaca

SEQ ID NO: 46755 - RNA, 22 nt, Homo sapiens
gugacauuauuucagcuacaug

SEQ ID NO: 46756 - RNA, 22 nt, Homo sapiens
gugaggcuuuuccuguuagacu

SEQ ID NO: 46757 - RNA, 22 nt, Homo sapiens
gugccacugcacuccggccugg

SEQ ID NO: 46758 - RNA, 22 nt, Homo sapiens
guguaaaucugcugugaacauu

SEQ ID NO: 46759 - RNA, 22 nt, Homo sapiens
guguauguuguccauggaugcg

SEQ ID NO: 46760 - RNA, 22 nt, Homo sapiens
gugucaugggcauguccuuaac

SEQ ID NO: 46761 - RNA, 22 nt, Homo sapiens
guucaaggaauguuggcuucuc

SEQ ID NO: 46762 - RNA, 22 nt, Homo sapiens
guuggcuuuuuaaggaaauugc

SEQ ID NO: 46763 - RNA, 15 nt, Homo sapiens
guuuuuggauacaau

SEQ ID NO: 46764 - RNA, 22 nt, Homo sapiens
uaaaguguuuguuauuaaaggu

SEQ ID NO: 46765 - RNA, 22 nt, Homo sapiens
uaacaccuuugauagcacuuuu

SEQ ID NO: 46766 - RNA, 22 nt, Homo sapiens
uaagguuacaaaggacuucaua

SEQ ID NO: 46767 - RNA, 22 nt, Homo sapiens
uaaguaaaugaaagguugauuu

SEQ ID NO: 46768 - RNA, 22 nt, Homo sapiens
uaauagcaguguuacuaggacu

SEQ ID NO: 46769 - RNA, 22 nt, Homo sapiens
uaccacugccgagaaaacagau

SEQ ID NO: 46770 - RNA, 22 nt, Homo sapiens
uacucugcagagaugcauaaca

SEQ ID NO: 46771 - RNA, 22 nt, Homo sapiens
uacucugcagccauaaaacaga

SEQ ID NO: 46772 - RNA, 22 nt, Homo sapiens
uacucugcaguaauuccagccc

SEQ ID NO: 46773 - RNA, 22 nt, Homo sapiens
uagaucaacuuugguaagagaa

SEQ ID NO: 46774 - RNA, 22 nt, Homo sapiens
uagcaccuuagcauuucuagug

SEQ ID NO: 46775 - RNA, 22 nt, Homo sapiens
uaggcaaguugcccaaucucuc

SEQ ID NO: 46776 - RNA, 22 nt, Homo sapiens
uauaguuuuuccugggaggaaa

SEQ ID NO: 46777 - RNA, 22 nt, Homo sapiens
uaucucuuuucauguguaaaug

SEQ ID NO: 46778 - RNA, 22 nt, Homo sapiens
uaucugcacauacacuuauagc

SEQ ID NO: 46779 - RNA, 22 nt, Homo sapiens
uauggcucuguaauuuuagaug

SEQ ID NO: 46780 - RNA, 22 nt, Homo sapiens
uaugucuuuugcuugcaaauag

SEQ ID NO: 46781 - RNA, 22 nt, Homo sapiens
ucaaaguauucuucugagaacc

SEQ ID NO: 46782 - RNA, 22 nt, Homo sapiens
ucaagugauucuugugccuuag

SEQ ID NO: 46783 - RNA, 16 nt, Homo sapiens
ucaccccuagagaucc

SEQ ID NO: 46784 - RNA, 22 nt, Homo sapiens
ucacugugcaugaaggaugcug

SEQ ID NO: 46785 - RNA, 22 nt, Homo sapiens
ucagaucaugcuuaugauggga

SEQ ID NO: 46786 - RNA, 22 nt, Homo sapiens
ucagauguuugagaaguauacu

SEQ ID NO: 46787 - RNA, 22 nt, Homo sapiens
uucaaaggauuuagauuagcua

SEQ ID NO: 46788 - RNA, 22 nt, Homo sapiens
uucauggagccauccuuugauc

SEQ ID NO: 46789 - RNA, 22 nt, Homo sapiens
uucauggaguugagaaggcuaa

SEQ ID NO: 46790 - RNA, 22 nt, Homo sapiens
uucauggauggaaaugauuuug

SEQ ID NO: 46791 - RNA, 22 nt, Homo sapiens
uuccaguggaguaaauggacaa

SEQ ID NO: 46792 - RNA, 22 nt, Homo sapiens
uuccagugggacgagaugugga

SEQ ID NO: 46793 - RNA, 22 nt, Homo sapiens
uucuuuggauaaaguuuuaugc

SEQ ID NO: 46794 - RNA, 22 nt, Homo sapiens
uucuuugguacaagggccgacc

SEQ ID NO: 46795 - RNA, 22 nt, Homo sapiens
uugcaagaaaugcagauucuca

SEQ ID NO: 46796 - RNA, 22 nt, Homo sapiens
uugcuuaggcuggagugcagug

SEQ ID NO: 46797 - RNA, 23 nt, Homo sapiens
uuggaaugagaccuaagaguuuu

SEQ ID NO: 46798 - RNA, 22 nt, Homo sapiens
uuggaaugcacacugagccugc

SEQ ID NO: 46799 - RNA, 22 nt, Homo sapiens
uuggcaagaaccuucuuccaag

SEQ ID NO: 46800 - RNA, 22 nt, Homo sapiens
uuggcaagcuguuaauuauaaa

SEQ ID NO: 46801 - RNA, 22 nt, Homo sapiens
uugggaauguccuaauaucucg

SEQ ID NO: 46802 - RNA, 22 nt, Homo sapiens
uugguaaugggcugguauaacc

SEQ ID NO: 46803 - RNA, 22 nt, Homo sapiens
uuguaacaguuuauugacucga

SEQ ID NO: 46804 - RNA, 18 nt, Homo sapiens
uuuacaguagaaggacuu

SEQ ID NO: 46805 - RNA, 22 nt, Homo sapiens
uuucuacagggcuugccaggua

SEQ ID NO: 46806 - RNA, 23 nt, Homo sapiens
uuugccacuuauuagcugggagg

SEQ ID NO: 46807 - RNA, 22 nt, Homo sapiens
uuugccuuugugauauggucua

SEQ ID NO: 46808 - RNA, 20 nt, Homo sapiens
uuuggcacugagugguauaa

SEQ ID NO: 46809 - RNA, 21 nt, Homo sapiens
uuuggcuucucugcugcagcc

SEQ ID NO: 46810 - RNA, 22 nt, Homo sapiens
uuuguaauaccugaggcugggu

SEQ ID NO: 46811 - RNA, 22 nt, Homo sapiens
uuuugcuugugaauagccacau

SEQ ID NO: 46812 - RNA, 22 nt, Homo sapiens
ugucauggauucugagucuggg

SEQ ID NO: 46813 - RNA, 22 nt, Homo sapiens
ugucauggcauuuguaaacugc

SEQ ID NO: 46814 - RNA, 22 nt, Homo sapiens
ugucaugguguuaauuuuccug

SEQ ID NO: 46815 - RNA, 22 nt, Homo sapiens
ugucccugagccuggauuccug

SEQ ID NO: 46816 - RNA, 22 nt, Homo sapiens
uguccuguaggaggcagaacaa

SEQ ID NO: 46817 - RNA, 18 nt, Homo sapiens
ugugcaauauuaaccacc

SEQ ID NO: 46818 - RNA, 22 nt, Homo sapiens
ugugcaaucuuccauuuuuagg

SEQ ID NO: 46819 - RNA, 23 nt, Homo sapiens
ugugguauuauuccauuuauagg

SEQ ID NO: 46820 - RNA, 22 nt, Homo sapiens
uguuuuggaguggacuuugcau

SEQ ID NO: 46821 - RNA, 22 nt, Homo sapiens
uuaaggcagugcaucuggaguu

SEQ ID NO: 46822 - RNA, 22 nt, Homo sapiens
uuaauuguccaaguucaucucu

SEQ ID NO: 46823 - RNA, 21 nt, Homo sapiens
uuacaauggcuccuugaaggu

SEQ ID NO: 46824 - RNA, 22 nt, Homo sapiens
uuagaucaacauggaacucuau

SEQ ID NO: 46825 - RNA, 22 nt, Homo sapiens
uucauggaauauugaccauuuu

SEQ ID NO: 46826 - RNA, 22 nt, Homo sapiens
uucauggacucaauaguuucgc

SEQ ID NO: 46827 - RNA, 22 nt, Homo sapiens
uucauggaugcauuugaggggu

SEQ ID NO: 46828 - RNA, 22 nt, Homo sapiens
uuccaguggacuacuucauccu

SEQ ID NO: 46829 - RNA, 22 nt, Homo sapiens
uuccaguguguucauccucaga

SEQ ID NO: 46830 - RNA, 22 nt, Homo sapiens
uucccuuuguuaaauuggaaga

SEQ ID NO: 46831 - RNA, 22 nt, Homo sapiens
uugagaaucuuugcuaaaggaa

SEQ ID NO: 46832 - RNA, 22 nt, Homo sapiens
uugagcuauguacagaugcugu

SEQ ID NO: 46833 - RNA, 22 nt, Homo sapiens
uugaggaggcagucucuccauu

SEQ ID NO: 46834 - RNA, 22 nt, Homo sapiens
uugaggaggcagucugcccauu

SEQ ID NO: 46835 - RNA, 22 nt, Homo sapiens
uugagguagcuuugauggaggu

SEQ ID NO: 46836 - RNA, 22 nt, Homo sapiens
uugcacauugauuuuguaucuu

SEQ ID NO: 46837 - RNA, 22 nt, Homo sapiens
uugcaggcaugagccaccgugc

SEQ ID NO: 46838 - RNA, 22 nt, Homo sapiens
uuggaagauuacuuaguuuucu

SEQ ID NO: 46839 - RNA, 22 nt, Homo sapiens
uuggaauuuuacuucuguaaga

SEQ ID NO: 46840 - RNA, 22 nt, Homo sapiens
uuggagagugauauucagaugc

SEQ ID NO: 46841 - RNA, 22 nt, Homo sapiens
uuggcacgugguggggcucgga

SEQ ID NO: 46842 - RNA, 22 nt, Homo sapiens
uuggcuucuggacuauugugca

SEQ ID NO: 46843 - RNA, 22 nt, Homo sapiens
ugcaaguggauuuuuccccaga

SEQ ID NO: 46844 - RNA, 22 nt, Homo sapiens
ugcauacacaagcauacaugua

SEQ ID NO: 46845 - RNA, 21 nt, Homo sapiens
ugcauugucuugaguuuaaau

SEQ ID NO: 46846 - RNA, 22 nt, Homo sapiens
ugccaggaugaggucaauguuu

SEQ ID NO: 46847 - RNA, 22 nt, Homo sapiens
ugcugcaaacaugagaggaagu

SEQ ID NO: 46848 - RNA, 20 nt, Homo sapiens
uggaagccuggugcuaucuu

SEQ ID NO: 46849 - RNA, 22 nt, Homo sapiens
uggaaugcucuccccacggacu

SEQ ID NO: 46850 - RNA, 22 nt, Homo sapiens
uggaauuuagguugauaguaua

SEQ ID NO: 46851 - RNA, 22 nt, Homo sapiens
uggagugagaacuucaaugaug

SEQ ID NO: 46852 - RNA, 22 nt, Homo sapiens
uggagugauaugguuauauggg

SEQ ID NO: 46853 - RNA, 22 nt, Homo sapiens
uggauagaaauguacuguuuuc

SEQ ID NO: 46854 - RNA, 22 nt, Homo sapiens
uggccaguugaagacaaugcuc

SEQ ID NO: 46855 - RNA, 22 nt, Homo sapiens
ugggaaacauccagcacauacu

SEQ ID NO: 46856 - RNA, 20 nt, Homo sapiens
ugguguuugaacagugaaug

SEQ ID NO: 46857 - RNA, 22 nt, Homo sapiens
uguauguaaagacaggauaaca

SEQ ID NO: 46858 - RNA, 22 nt, Homo sapiens
ugucacaguuuguacuuuauag

SEQ ID NO: 46859 - RNA, 22 nt, Homo sapiens
ugucauggggaaaauaacagac

SEQ ID NO: 46860 - RNA, 22 nt, Homo sapiens
ugucauggugcucugggcccug

SEQ ID NO: 46861 - RNA, 22 nt, Homo sapiens
ugugcaaaaacaauugcgguuu

SEQ ID NO: 46862 - RNA, 22 nt, Homo sapiens
ugugccacuccaaccuggguga

SEQ ID NO: 46863 - RNA, 22 nt, Homo sapiens
ugugccacugcacucugggcaa

SEQ ID NO: 46864 - RNA, 22 nt, Homo sapiens
uguggccccuagcuacuagaga

SEQ ID NO: 46865 - RNA, 22 nt, Homo sapiens
uguguuuuuauguaaaauggaa

SEQ ID NO: 46866 - RNA, 22 nt, Homo sapiens
uguucuugagccuuuagaccua

SEQ ID NO: 46867 - RNA, 22 nt, Homo sapiens
uuaacagucacuuagcucauuu

SEQ ID NO: 46868 - RNA, 22 nt, Homo sapiens
uuaagcaguggauuagaauuuu

SEQ ID NO: 46869 - RNA, 22 nt, Homo sapiens
uuacauguggugugaagaagag

SEQ ID NO: 46870 - RNA, 22 nt, Homo sapiens
uucauggaguuuaaauuguagu

SEQ ID NO: 46871 - RNA, 21 nt, Homo sapiens
uuccagugagccuagaugccu

SEQ ID NO: 46872 - RNA, 22 nt, Homo sapiens
uuccaguguuugacucaccuuu

SEQ ID NO: 46873 - RNA, 22 nt, Homo sapiens
uugggauaaucacaaaguaaaa

SEQ ID NO: 46874 - RNA, 22 nt, Homo sapiens
uugugagggagcuaagaugagu

SEQ ID NO: 46875 - RNA, 22 nt, Homo sapiens
uugugcuucaucaccuagcaga

SEQ ID NO: 46876 - RNA, 22 nt, Homo sapiens
uugugcuuuugagcugagauga

SEQ ID NO: 46877 - RNA, 22 nt, Homo sapiens
uuugagguguauggcaaguuga

SEQ ID NO: 46878 - RNA, 22 nt, Homo sapiens
uuugauuguacuaaaauuguac

SEQ ID NO: 46879 - RNA, 22 nt, Homo sapiens
uuuggcuuuugugauacguaau

SEQ ID NO: 46880 - RNA, 22 nt, Homo sapiens
uuugggaaugaguuuaucauuu

SEQ ID NO: 46881 - RNA, 22 nt, Homo sapiens
uuugggaaugguuugucuccca

SEQ ID NO: 46882 - RNA, 22 nt, Homo sapiens
uuugugcuaaugcuagauuacu

SEQ ID NO: 46883 - RNA, 22 nt, Homo sapiens
uuugugcuccuguugagaaucu

SEQ ID NO: 46884 - RNA, 19 nt, Homo sapiens
uuuuggaaaugugaacagc

SEQ ID NO: 46885 - RNA, 22 nt, Homo sapiens
uuuuggcuagaaauauaccucc

SEQ ID NO: 46886 - RNA, 22 nt, Homo sapiens
uuuuggcucugucuguaucuuu

SEQ ID NO: 46887 - RNA, 22 nt, Homo sapiens
uuuugguuguuggguaagagua

SEQ ID NO: 46888 - RNA, 22 nt, Homo sapiens
uuuuuugguaauugaacaauga

SEQ ID NO: 46889 - RNA, 22 nt, Homo sapiens
aaagaagucagccuguccuuug

SEQ ID NO: 46890 - RNA, 22 nt, Homo sapiens
aaagggcuguuucuugacuugg

SEQ ID NO: 46891 - RNA, 18 nt, Homo sapiens
aaagugaugucauucuuu

SEQ ID NO: 46892 - RNA, 22 nt, Homo sapiens
aagcacccuuugucuggacaug

SEQ ID NO: 46893 - RNA, 22 nt, Homo sapiens
uucccugugguauagaagccgu

SEQ ID NO: 46894 - RNA, 19 nt, Homo sapiens
uuccugagaacaagggcuu

SEQ ID NO: 46895 - RNA, 22 nt, Homo sapiens
uuccugugacuguguggcaccc

SEQ ID NO: 46896 - RNA, 22 nt, Homo sapiens
uucucuguggauugggugagag

SEQ ID NO: 46897 - RNA, 22 nt, Homo sapiens
uucuguguuuaggucacggcua

SEQ ID NO: 46898 - RNA, 23 nt, Homo sapiens
uugaaaagucaguagccucugau

SEQ ID NO: 46899 - RNA, 22 nt, Homo sapiens
uuggagagucacuaguuagugc

SEQ ID NO: 46900 - RNA, 22 nt, Homo sapiens
uuggagucaucucuguacugua

SEQ ID NO: 46901 - RNA, 22 nt, Homo sapiens
uuggagugugcucauaacugcu

SEQ ID NO: 46902 - RNA, 22 nt, Homo sapiens
uuggcauugaguuucaaaucau

SEQ ID NO: 46903 - RNA, 22 nt, Homo sapiens
uuggccuuuucaaugccucuuu

SEQ ID NO: 46904 - RNA, 23 nt, Homo sapiens
uuguaacuggagaguaacauucc

SEQ ID NO: 46905 - RNA, 22 nt, Homo sapiens
uuuggcauauuuuaagcugguu

SEQ ID NO: 46906 - RNA, 22 nt, Homo sapiens
uuuggcuuuuguaauaacugcc

SEQ ID NO: 46907 - RNA, 22 nt, Homo sapiens
uuuuagcagccaugacaaagau

SEQ ID NO: 46908 - RNA, 18 nt, Homo sapiens
uuuuugaggcacagggga

SEQ ID NO: 46909 - RNA, 22 nt, Homo sapiens
ugagucauuuccuuaugcuacu

SEQ ID NO: 46910 - RNA, 22 nt, Homo sapiens
ugauauauugaaugaugaaaca

SEQ ID NO: 46911 - RNA, 20 nt, Homo sapiens
ugauauuucuggaaguggag

SEQ ID NO: 46912 - RNA, 22 nt, Homo sapiens
ugcaggguccauugucccaagu

SEQ ID NO: 46913 - RNA, 18 nt, Homo sapiens
ugccuacugggcucaagc

SEQ ID NO: 46914 - RNA, 22 nt, Homo sapiens
uggaacacaucuaaggaagcag

SEQ ID NO: 46915 - RNA, 22 nt, Homo sapiens
uggaagccuagauucuuuucuu

SEQ ID NO: 46916 - RNA, 22 nt, Homo sapiens
uggaaugucuauguuuuugauu

SEQ ID NO: 46917 - RNA, 22 nt, Homo sapiens
uggagugaaaacacacuaaucu

SEQ ID NO: 46918 - RNA, 21 nt, Homo sapiens
uggagugaagaguuuauugac

SEQ ID NO: 46919 - RNA, 22 nt, Homo sapiens
uggcaagagauaugugucuaua

SEQ ID NO: 46920 - RNA, 22 nt, Homo sapiens
uggcauaugguauuugauaucu

SEQ ID NO: 46921 - RNA, 23 nt, Homo sapiens
uggcauuuuaguuagcuucagug

SEQ ID NO: 46922 - RNA, 22 nt, Homo sapiens
uggcauuuucucuguucuuaga

SEQ ID NO: 46923 - RNA, 22 nt, Homo sapiens
ugggcggagacgugcagccgcc

SEQ ID NO: 46924 - RNA, 22 nt, Homo sapiens
uguagacaccaaagacagcaua

SEQ ID NO: 46925 - RNA, 21 nt, Homo sapiens
uguagcagcaugauuuauaau

SEQ ID NO: 46926 - RNA, 22 nt, Homo sapiens
uguagcagccauaaacacagug

SEQ ID NO: 46927 - RNA, 21 nt, Homo sapiens
ugucaagugggaaaacaugua

SEQ ID NO: 46928 - RNA, 22 nt, Homo sapiens
ugucauggucacaggcauuuca

SEQ ID NO: 46929 - RNA, 22 nt, Homo sapiens
ugucuaaagaauggcagacuca

SEQ ID NO: 46930 - RNA, 22 nt, Homo sapiens
ugugaguguguacuaguuauca

SEQ ID NO: 46931 - RNA, 22 nt, Homo sapiens
ugugcaaaaguaauugcgguuu

SEQ ID NO: 46932 - RNA, 22 nt, Homo sapiens
ugugccuaguaauguguccaga

SEQ ID NO: 46933 - RNA, 22 nt, Homo sapiens
uguggccuuuguuucaguuggg

SEQ ID NO: 46934 - RNA, 19 nt, Homo sapiens
uguggucauccugggacga

SEQ ID NO: 46935 - RNA, 22 nt, Homo sapiens
uguguaaagcuuguuccagaaa

SEQ ID NO: 46936 - RNA, 22 nt, Homo sapiens
uuaaugaacuuuauuuuguaga

SEQ ID NO: 46937 - RNA, 22 nt, Homo sapiens
uuacaguagaugaggguauaau

SEQ ID NO: 46938 - RNA, 22 nt, Homo sapiens
uuacagucaccugggggacaua

SEQ ID NO: 46939 - RNA, 22 nt, Homo sapiens
uuacauguuguggguuguggcc

SEQ ID NO: 46940 - RNA, 22 nt, Homo sapiens
uuaggcuuuauugaaaacaaua

SEQ ID NO: 46941 - RNA, 22 nt, Homo sapiens
uuaugguuuuucugugagaugg

SEQ ID NO: 46942 - RNA, 22 nt, Homo sapiens
uuaugucuuuuguguucagcua

SEQ ID NO: 46943 - RNA, 22 nt, Homo sapiens
uucacagccgcaccccaucacu

SEQ ID NO: 46944 - RNA, 22 nt, Homo sapiens
ucauccauacaguuagcaaagg

SEQ ID NO: 46945 - RNA, 23 nt, Homo sapiens
uccccgggagcaccagcuuguug

SEQ ID NO: 46946 - RNA, 22 nt, Homo sapiens
ucccuacuggggcacugccuag

SEQ ID NO: 46947 - RNA, 22 nt, Homo sapiens
ucccuuucuggaguuucccaag

SEQ ID NO: 46948 - RNA, 22 nt, Homo sapiens
uccuggcuccacuguuuauucc

SEQ ID NO: 46949 - RNA, 22 nt, Homo sapiens
ucuagccuaugaagcuugucca

SEQ ID NO: 46950 - RNA, 22 nt, Homo sapiens
ucucagugugguaaaaguuuuu

SEQ ID NO: 46951 - RNA, 22 nt, Homo sapiens
ucucuugguugaacaguuugga

SEQ ID NO: 46952 - RNA, 19 nt, Homo sapiens
ucugugcuugucccccugu

SEQ ID NO: 46953 - RNA, 19 nt, Homo sapiens
ucuuuagucacauuuuuau

SEQ ID NO: 46954 - RNA, 22 nt, Homo sapiens
ucuuugccuaacccaaggucau

SEQ ID NO: 46955 - RNA, 22 nt, Homo sapiens
ucuuugguagaagcuauuuuau

SEQ ID NO: 46956 - RNA, 22 nt, Homo sapiens
ugacuacauaaguaaucucaaa

SEQ ID NO: 46957 - RNA, 22 nt, Homo sapiens
ugagacugagucucgcucuugu

SEQ ID NO: 46958 - RNA, 22 nt, Homo sapiens
ugagacugaguuuugcucuugu

SEQ ID NO: 46959 - RNA, 22 nt, Homo sapiens
ugagaucaaggugggcccuggg

SEQ ID NO: 46960 - RNA, 22 nt, Homo sapiens
ugagaucacgccacugcacucc

SEQ ID NO: 46961 - RNA, 20 nt, Homo sapiens
ugagccccuggacucaagcg

SEQ ID NO: 46962 - RNA, 22 nt, Homo sapiens
ugagucauguaauaaugcugcu

SEQ ID NO: 46963 - RNA, 22 nt, Homo sapiens
uggaagugucugugcccagcuc

SEQ ID NO: 46964 - RNA, 22 nt, Homo sapiens
uggaaucuacuaaagcaaaauc

SEQ ID NO: 46965 - RNA, 22 nt, Homo sapiens
uggagacaaagauagaaaagca

SEQ ID NO: 46966 - RNA, 22 nt, Homo sapiens
uggcauggaguggauggcccca

SEQ ID NO: 46967 - RNA, 22 nt, Homo sapiens
ugggaagauucuguguuuuucc

SEQ ID NO: 46968 - RNA, 22 nt, Homo sapiens
uggugagaaaugagaugcuuuu

SEQ ID NO: 46969 - RNA, 21 nt, Homo sapiens
uguagcagcauaauuuauaau

SEQ ID NO: 46970 - RNA, 22 nt, Homo sapiens
ugucaguggucuggaugcagcc

SEQ ID NO: 46971 - RNA, 22 nt, Homo sapiens
ugucaugguagcaaggacgagg

SEQ ID NO: 46972 - RNA, 22 nt, Homo sapiens
ugugccacugcacuccugggug

SEQ ID NO: 46973 - RNA, 22 nt, Homo sapiens
uuaaauacagcaugguguuucu

SEQ ID NO: 46974 - RNA, 22 nt, Homo sapiens
uuaauacucuucuaaguagucc

SEQ ID NO: 46975 - RNA, 19 nt, Homo sapiens
uuacacaaccuaguggggc

SEQ ID NO: 46976 - RNA, 22 nt, Homo sapiens
uuacaguucugguggagaggua

SEQ ID NO: 46977 - RNA, 22 nt, Homo sapiens
uuacauugcuucaaauucagug

SEQ ID NO: 46978 - RNA, 22 nt, Homo sapiens
uuauuagagauauuugguuagg

SEQ ID NO: 46979 - RNA, 22 nt, Homo sapiens
uucaaaggauagauuaagauca

SEQ ID NO: 46980 - RNA, 22 nt, Homo sapiens
gcacaggguuacauucuaaggu

SEQ ID NO: 46981 - RNA, 22 nt, Homo sapiens
gcacauuacaaguauuagcuca

SEQ ID NO: 46982 - RNA, 22 nt, Homo sapiens
gcagagaaacaggucuaaggag

SEQ ID NO: 46983 - RNA, 22 nt, Homo sapiens
gcagucacagggagauggugac

SEQ ID NO: 46984 - RNA, 22 nt, Homo sapiens
gcauaugucuuuauagcagcau

SEQ ID NO: 46985 - RNA, 22 nt, Homo sapiens
gcauggaaggcgcuuugugacu

SEQ ID NO: 46986 - RNA, 22 nt, Homo sapiens
gcauggaguggaaauucuuggg

SEQ ID NO: 46987 - RNA, 22 nt, Homo sapiens
gccauugcacuacagccuaggc

SEQ ID NO: 46988 - RNA, 22 nt, Homo sapiens
gccauugcacuccagccuaggu

SEQ ID NO: 46989 - RNA, 22 nt, Homo sapiens
gcuauggccugaauguuugugu

SEQ ID NO: 46990 - RNA, 22 nt, Homo sapiens
gcugcuguaccagaugugguua

SEQ ID NO: 46991 - RNA, 22 nt, Homo sapiens
gcugcuguuauucaucagaacu

SEQ ID NO: 46992 - RNA, 22 nt, Homo sapiens
gcuggauguuucaauacaaaua

SEQ ID NO: 46993 - RNA, 19 nt, Homo sapiens
gcuuguccacgugagauaa

SEQ ID NO: 46994 - RNA, 22 nt, Homo sapiens
gcuuuguugauggugagucugu

SEQ ID NO: 46995 - RNA, 22 nt, Homo sapiens
ggaaagacaccuuacuauguua

SEQ ID NO: 46996 - RNA, 22 nt, Homo sapiens
ggaaaguaacccauucucuuac

SEQ ID NO: 46997 - RNA, 22 nt, Homo sapiens
ggaaauguaaacaauggggcua

SEQ ID NO: 46998 - RNA, 22 nt, Homo sapiens
ggaagagugaauuaucuugacu

SEQ ID NO: 46999 - RNA, 22 nt, Homo sapiens
ggaaucugaaccaugggaaugg

SEQ ID NO: 47000 - RNA, 22 nt, Homo sapiens
ggacaagagacugggacacuga

SEQ ID NO: 47001 - RNA, 22 nt, Homo sapiens
ggacaagaucuuccaccauuca

SEQ ID NO: 47002 - RNA, 22 nt, Homo sapiens
ggacaucauuaccauggaccca

SEQ ID NO: 47003 - RNA, 22 nt, Homo sapiens
ggacugagaggacuacagugua

SEQ ID NO: 47004 - RNA, 22 nt, Homo sapiens
ggagagcuaggcagagguuugu

SEQ ID NO: 47005 - RNA, 21 nt, Homo sapiens
ggaguauaaggcaaaggagug

SEQ ID NO: 47006 - RNA, 22 nt, Homo sapiens
ggagucugaacuggacaaugac

SEQ ID NO: 47007 - RNA, 22 nt, Homo sapiens
ggagucugauguucuaaggcag

SEQ ID NO: 47008 - RNA, 22 nt, Homo sapiens
ggaguguguuuuccaacuuggu

SEQ ID NO: 47009 - RNA, 22 nt, Homo sapiens
ggaugcauucaacuuccaguuc

SEQ ID NO: 47010 - RNA, 22 nt, Homo sapiens
ggcaagaaaaugcaauuacugu

SEQ ID NO: 47011 - RNA, 22 nt, Homo sapiens
ggcaaggugaugaaugucuaca

SEQ ID NO: 47012 - RNA, 22 nt, Homo sapiens
ggcaaguucuaaugauuagaau

SEQ ID NO: 47013 - RNA, 22 nt, Homo sapiens
ggcagcacaauuuucugaugga

SEQ ID NO: 47014 - RNA, 22 nt, Homo sapiens
ggcaguuuguuugugaggucca

SEQ ID NO: 47015 - RNA, 22 nt, Homo sapiens
ggcuguguguuaaaauaggcuu

SEQ ID NO: 47016 - RNA, 22 nt, Homo sapiens
ggcuuggaggaaugugagggcu

SEQ ID NO: 47017 - RNA, 19 nt, Homo sapiens
gggaggaugcgucuucagg

SEQ ID NO: 47018 - RNA, 22 nt, Homo sapiens
gggaugaaguugauguagaaag

SEQ ID NO: 47019 - RNA, 22 nt, Homo sapiens
gggcaaauuauguaucucucag

SEQ ID NO: 47020 - RNA, 22 nt, Homo sapiens
gggcaugugugugcacacacau

SEQ ID NO: 47021 - RNA, 22 nt, Homo sapiens
ggggaauguuaaagaauuugca

SEQ ID NO: 47022 - RNA, 22 nt, Homo sapiens
ggguaaaucucuuuucauggcu

SEQ ID NO: 47023 - RNA, 22 nt, Homo sapiens
gguaaaucuucacuaagacuga

SEQ ID NO: 47024 - RNA, 22 nt, Homo sapiens
ggucaaguaauccuggguguca

SEQ ID NO: 47025 - RNA, 22 nt, Homo sapiens
ggucacauugcuagcauggguu

SEQ ID NO: 47026 - RNA, 22 nt, Homo sapiens
ggucuuggagaauuguccuggg

SEQ ID NO: 47027 - RNA, 22 nt, Homo sapiens
ggugagauaucugcugauguuu

SEQ ID NO: 47028 - RNA, 22 nt, Homo sapiens
guaaacuuccccucaugaauga

SEQ ID NO: 47029 - RNA, 22 nt, Homo sapiens
guacaguaguaaaagugaauga

SEQ ID NO: 47030 - RNA, 22 nt, Homo sapiens
guacagugcucacaaugagagc

SEQ ID NO: 47031 - RNA, 22 nt, Homo sapiens
guacaguggguguagggaccag

SEQ ID NO: 47032 - RNA, 22 nt, Homo sapiens
guaucauugccuaaugcucuca

SEQ ID NO: 47033 - RNA, 22 nt, Homo sapiens
guaugucuugucuauggcugcu

SEQ ID NO: 47034 - RNA, 22 nt, Homo sapiens
guauuuguugcagcagcacuau

SEQ ID NO: 47035 - RNA, 22 nt, Homo sapiens
gucaacauauuaauuauguucu

SEQ ID NO: 47036 - RNA, 22 nt, Homo sapiens
gucacagaaaaagauaugccaa

SEQ ID NO: 47037 - RNA, 22 nt, Homo sapiens
gucagugccugucccaggcuuu

SEQ ID NO: 47038 - RNA, 22 nt, Homo sapiens
guccaaauccaugggauguaca

SEQ ID NO: 47039 - RNA, 22 nt, Homo sapiens
guccugaagaccuuccucugga

SEQ ID NO: 47040 - RNA, 22 nt, Homo sapiens
gucuaugguucaggguggagug

SEQ ID NO: 47041 - RNA, 22 nt, Homo sapiens
gucucacaggcaugaugccagc

SEQ ID NO: 47042 - RNA, 20 nt, Homo sapiens
gucugucuccgaguagaauu

SEQ ID NO: 47043 - RNA, 22 nt, Homo sapiens
gucugugguuccuaugucaccu

SEQ ID NO: 47044 - RNA, 22 nt, Homo sapiens
gucuguuugauccagaucaaaa

SEQ ID NO: 47045 - RNA, 22 nt, Homo sapiens
gucuuuaguugaaacauguggu

SEQ ID NO: 47046 - RNA, 22 nt, Homo sapiens
gucuuuggaaagacaaaguuca

SEQ ID NO: 47047 - RNA, 17 nt, Homo sapiens
gucuuugguugaguuua

SEQ ID NO: 47048 - RNA, 22 nt, Homo sapiens
gugaaagacagcauuaauggcu

SEQ ID NO: 47049 - RNA, 22 nt, Homo sapiens
gugaacagcagaugagugagug

SEQ ID NO: 47050 - RNA, 22 nt, Homo sapiens
gugaaguuuuuugcugagaguc

SEQ ID NO: 47051 - RNA, 22 nt, Homo sapiens
gugaauugagagaacuguguua

SEQ ID NO: 47052 - RNA, 20 nt, Homo sapiens
gugacugagcacgggcacag

SEQ ID NO: 47053 - RNA, 22 nt, Homo sapiens
gugacugggaguggugaagaua

SEQ ID NO: 47054 - RNA, 22 nt, Homo sapiens
gugagauacuagagauauagug

SEQ ID NO: 47055 - RNA, 22 nt, Homo sapiens
gugagauaucuagacuagggaa

SEQ ID NO: 47056 - RNA, 22 nt, Homo sapiens
gugagauuagcugagauccuug

SEQ ID NO: 47057 - RNA, 22 nt, Homo sapiens
gugagauuuucuccagguucag

SEQ ID NO: 47058 - RNA, 22 nt, Homo sapiens
gugagcacugaaagaaggcaag

SEQ ID NO: 47059 - RNA, 22 nt, Homo sapiens
gugaggcuuuuccuguuagacu

SEQ ID NO: 47060 - RNA, 22 nt, Homo sapiens
gugagggaugugaaaaagguca

SEQ ID NO: 47061 - RNA, 17 nt, Homo sapiens
gugagguggguaguauc

SEQ ID NO: 47062 - RNA, 22 nt, Homo sapiens
gugauguguuuguucuaucucu

SEQ ID NO: 47063 - RNA, 22 nt, Homo sapiens
gugcaaugucaggagaugcagc

SEQ ID NO: 47064 - RNA, 22 nt, Homo sapiens
gugcacauauggugcauaagug

SEQ ID NO: 47065 - RNA, 22 nt, Homo sapiens
gugcaugcaucuuuauaguagc

SEQ ID NO: 47066 - RNA, 22 nt, Homo sapiens
gugcauguccacuaguccauau

SEQ ID NO: 47067 - RNA, 22 nt, Homo sapiens
gugcaugucugugacgacccug

SEQ ID NO: 47068 - RNA, 22 nt, Homo sapiens
gugcuaggugcuaggaagauag

SEQ ID NO: 47069 - RNA, 16 nt, Homo sapiens
gugcuguguuguuagg

SEQ ID NO: 47070 - RNA, 22 nt, Homo sapiens
guggaaagaacacaaaauuagg

SEQ ID NO: 47071 - RNA, 22 nt, Homo sapiens
guggaagaaaucagguuauuug

SEQ ID NO: 47072 - RNA, 22 nt, Homo sapiens
guggaagauaguguguuaaugu

SEQ ID NO: 47073 - RNA, 22 nt, Homo sapiens
guggaaucuagagaggcaguag

SEQ ID NO: 47074 - RNA, 22 nt, Homo sapiens
guggaauggaaugauuguguau

SEQ ID NO: 47075 - RNA, 22 nt, Homo sapiens
guggagacaaaggcugagugag

SEQ ID NO: 47076 - RNA, 22 nt, Homo sapiens
guggaucacuugaggucaagag

SEQ ID NO: 47077 - RNA, 22 nt, Homo sapiens
guggcuuuaaguacgauugagg

SEQ ID NO: 47078 - RNA, 22 nt, Homo sapiens
gugggaagcuggaacucccucc

SEQ ID NO: 47079 - RNA, 22 nt, Homo sapiens
gugggauggaaaugggcuucag

SEQ ID NO: 47080 - RNA, 22 nt, Homo sapiens
gugguuguuggaguggcaauuu

SEQ ID NO: 47081 - RNA, 22 nt, Homo sapiens
gugguuuuaucccagaaauuaa

SEQ ID NO: 47082 - RNA, 22 nt, Homo sapiens
guguauauccuauuaguucugu

SEQ ID NO: 47083 - RNA, 22 nt, Homo sapiens
guguaugugagaaugcucaugu

SEQ ID NO: 47084 - RNA, 22 nt, Homo sapiens
uugugcuuuacuuacuaccaga

SEQ ID NO: 47085 - RNA, 17 nt, Homo sapiens
uuguucccauuaaaaag

SEQ ID NO: 47086 - RNA, 22 nt, Homo sapiens
uuuaacauuggaugagaucguc

SEQ ID NO: 47087 - RNA, 20 nt, Homo sapiens
uuuaagacaugcugaauuga

SEQ ID NO: 47088 - RNA, 22 nt, Homo sapiens
uuuaauguuacaguauugguau

SEQ ID NO: 47089 - RNA, 22 nt, Homo sapiens
uuuacugugggguuucuuagag

SEQ ID NO: 47090 - RNA, 22 nt, Homo sapiens
uuuagcaauucauuuugugucu

SEQ ID NO: 47091 - RNA, 22 nt, Homo sapiens
uuuagguagucaaagguuaguc

SEQ ID NO: 47092 - RNA, 22 nt, Homo sapiens
uuuaguacugcuuuaugugugu

SEQ ID NO: 47093 - RNA, 22 nt, Homo sapiens
uuuauugcucuaaaguugccau

SEQ ID NO: 47094 - RNA, 22 nt, Homo sapiens
uuucacagcaauugccuauugu

SEQ ID NO: 47095 - RNA, 22 nt, Homo sapiens
uuucauccggcuguguauuaug

SEQ ID NO: 47096 - RNA, 23 nt, Homo sapiens
uuucauggggauuuacucauucc

SEQ ID NO: 47097 - RNA, 22 nt, Homo sapiens
uuucccugaaggcucugaaguc

SEQ ID NO: 47098 - RNA, 22 nt, Homo sapiens
uuuccuggagaaucuuaacaaa

SEQ ID NO: 47099 - RNA, 21 nt, Homo sapiens
uuuccuggagcguauggcuuc

SEQ ID NO: 47100 - RNA, 22 nt, Homo sapiens
uuucuacagggcuugccaggua

SEQ ID NO: 47101 - RNA, 17 nt, Homo sapiens
uuucucagcccucuucu

SEQ ID NO: 47102 - RNA, 20 nt, Homo sapiens
uuucuccccuauaaaucuca

SEQ ID NO: 47103 - RNA, 22 nt, Homo sapiens
uuugaaguguggcacugaguuu

SEQ ID NO: 47104 - RNA, 22 nt, Homo sapiens
uuugagcauguaguuuaacccu

SEQ ID NO: 47105 - RNA, 21 nt, Homo sapiens
uuugcauauguugaaccagcc

SEQ ID NO: 47106 - RNA, 22 nt, Homo sapiens
uuuggcauuagagagacuugca

SEQ ID NO: 47107 - RNA, 22 nt, Homo sapiens
uuuggcauuuaaauaugcaugg

SEQ ID NO: 47108 - RNA, 22 nt, Homo sapiens
uuuggcucugugucccacccaa

SEQ ID NO: 47109 - RNA, 18 nt, Homo sapiens
uuuggcuguucaugacuc

SEQ ID NO: 47110 - RNA, 22 nt, Homo sapiens
uuuggcuuugagaagcagugga

SEQ ID NO: 47111 - RNA, 22 nt, Homo sapiens
uuugggaaugguuugucuccca

SEQ ID NO: 47112 - RNA, 22 nt, Homo sapiens
uuugguguauaaaaaugcuagu

SEQ ID NO: 47113 - RNA, 22 nt, Homo sapiens
uuuguacacuguuggugguuau

SEQ ID NO: 47114 - RNA, 22 nt, Homo sapiens
uuuguacuugaagaaucuuuau

SEQ ID NO: 47115 - RNA, 20 nt, Homo sapiens
uuuguaucucuggguacugg

SEQ ID NO: 47116 - RNA, 22 nt, Homo sapiens
uuugucacccugaauguaagau

SEQ ID NO: 47117 - RNA, 22 nt, Homo sapiens
uuugucacucuuggagguuguu

SEQ ID NO: 47118 - RNA, 22 nt, Homo sapiens
uuugugcaaacuaggauugcga

SEQ ID NO: 47119 - RNA, 22 nt, Homo sapiens
uuugugcuccuguugagaaucu

SEQ ID NO: 47120 - RNA, 22 nt, Homo sapiens
uuugugugugauuauaaaaggu

SEQ ID NO: 47121 - RNA, 20 nt, Homo sapiens
uuuuagcacuuguuauggug

SEQ ID NO: 47122 - RNA, 22 nt, Homo sapiens
uuuucaguggccauaguggaga

SEQ ID NO: 47123 - RNA, 23 nt, Homo sapiens
uuuugcaauaagucacuggaaua

SEQ ID NO: 47124 - RNA, 22 nt, Homo sapiens
uuuugcucuucauagguccugu

SEQ ID NO: 47125 - RNA, 18 nt, Homo sapiens
uuuugcuuaacugcgcca

SEQ ID NO: 47126 - RNA, 22 nt, Homo sapiens
uuuugcuuuuccucggucccac

SEQ ID NO: 47127 - RNA, 17 nt, Homo sapiens
uuuuggauuagaaaucc

SEQ ID NO: 47128 - RNA, 22 nt, Homo sapiens
uuuuggcuagaaauauaccucc

SEQ ID NO: 47129 - RNA, 22 nt, Homo sapiens
uuuuguacaacagcucugggga

SEQ ID NO: 47130 - RNA, 22 nt, Homo sapiens
uuuuugagguauaguguggcua

SEQ ID NO: 47131 - RNA, 23 nt, Homo sapiens
uuuuuguguuucauggaaauagg

SEQ ID NO: 47132 - RNA, 19 nt, Homo sapiens
ucaccuugcccugcacaca

SEQ ID NO: 47133 - RNA, 22 nt, Homo sapiens
ucacucagaccuggugauaugc

SEQ ID NO: 47134 - RNA, 22 nt, Homo sapiens
ucacugaaaccacugccuccug

SEQ ID NO: 47135 - RNA, 22 nt, Homo sapiens
ucacugugguuugggaaagugc

SEQ ID NO: 47136 - RNA, 22 nt, Homo sapiens
ucacuuugacggccaacuucua

SEQ ID NO: 47137 - RNA, 22 nt, Homo sapiens
ucagaguagagcgacuucuccu

SEQ ID NO: 47138 - RNA, 18 nt, Homo sapiens
ucagagugcagacuauac

SEQ ID NO: 47139 - RNA, 22 nt, Homo sapiens
ucagagugcagggaguagcagc

SEQ ID NO: 47140 - RNA, 22 nt, Homo sapiens
ucagaucaguuccacaagaacu

SEQ ID NO: 47141 - RNA, 22 nt, Homo sapiens
ucagaugaugucccuguucuaa

SEQ ID NO: 47142 - RNA, 22 nt, Homo sapiens
ucagcagugugaaaauggacua

SEQ ID NO: 47143 - RNA, 21 nt, Homo sapiens
ucagcucaucacugccuggag

SEQ ID NO: 47144 - RNA, 21 nt, Homo sapiens
ucaggaccucuaguuagccag

SEQ ID NO: 47145 - RNA, 22 nt, Homo sapiens
ucagguagugccaugauugauu

SEQ ID NO: 47146 - RNA, 22 nt, Homo sapiens
ucaguaaucuuagcugugcaga

SEQ ID NO: 47147 - RNA, 22 nt, Homo sapiens
ucagucuuuuaccauuaaguau

SEQ ID NO: 47148 - RNA, 17 nt, Homo sapiens
ucagugcauuuaagaga

SEQ ID NO: 47149 - RNA, 22 nt, Homo sapiens
ucagugcuuuuuguugucauca

SEQ ID NO: 47150 - RNA, 22 nt, Homo sapiens
ucagugucugugcaccgcugga

SEQ ID NO: 47151 - RNA, 21 nt, Homo sapiens
ucaguuacugagagagaagug

SEQ ID NO: 47152 - RNA, 22 nt, Homo sapiens
ucauaguagucacuuaauaaau

SEQ ID NO: 47153 - RNA, 22 nt, Homo sapiens
ucaugaaguaguuaacugguug

SEQ ID NO: 47154 - RNA, 22 nt, Homo sapiens
ucaugagacacacuggaaagga

SEQ ID NO: 47155 - RNA, 22 nt, Homo sapiens
ucauggguuuugguccaagcaa

SEQ ID NO: 47156 - RNA, 22 nt, Homo sapiens
uccagcuuuuucuaauucugug

SEQ ID NO: 47157 - RNA, 22 nt, Homo sapiens
uccaguguuccucagucacccc

SEQ ID NO: 47158 - RNA, 19 nt, Homo sapiens
uccaugagcccacagugau

SEQ ID NO: 47159 - RNA, 22 nt, Homo sapiens
uccauuuguagguagugagaca

SEQ ID NO: 47160 - RNA, 22 nt, Homo sapiens
uccauuuguuguaggguauagu

SEQ ID NO: 47161 - RNA, 19 nt, Homo sapiens
ucccuguagaccacagugc

SEQ ID NO: 47162 - RNA, 22 nt, Homo sapiens
uccuuggugacauuucuugucu

SEQ ID NO: 47163 - RNA, 22 nt, Homo sapiens
uccuuuggguagcuguucagau

SEQ ID NO: 47164 - RNA, 22 nt, Homo sapiens
uccuuugguggagucuuuaggg

SEQ ID NO: 47165 - RNA, 22 nt, Homo sapiens
ucuaagacuaagggcuagcuuc

SEQ ID NO: 47166 - RNA, 22 nt, Homo sapiens
ucucaauggguuguagacaaag

SEQ ID NO: 47167 - RNA, 22 nt, Homo sapiens
ucucagugaauugguuuugucu

SEQ ID NO: 47168 - RNA, 22 nt, Homo sapiens
ucucaguggcuuccucacuuuu

SEQ ID NO: 47169 - RNA, 22 nt, Homo sapiens
ucucaguggugcuggcagggga

SEQ ID NO: 47170 - RNA, 22 nt, Homo sapiens
ucucaugaagguggagaguagg

SEQ ID NO: 47171 - RNA, 22 nt, Homo sapiens
ucucauggagguagagaguaaa

SEQ ID NO: 47172 - RNA, 20 nt, Homo sapiens
ucucccaaacagcaggcccu

SEQ ID NO: 47173 - RNA, 22 nt, Homo sapiens
ucucuguuuauuuuugguguau

SEQ ID NO: 47174 - RNA, 22 nt, Homo sapiens
ucugacucuggagucucagguu

SEQ ID NO: 47175 - RNA, 22 nt, Homo sapiens
ucuggauuuuugaggcaauaua

SEQ ID NO: 47176 - RNA, 22 nt, Homo sapiens
ucuggcacucagaggccuugcu

SEQ ID NO: 47177 - RNA, 22 nt, Homo sapiens
ugagagacagacauuaucuuau

SEQ ID NO: 47178 - RNA, 22 nt, Homo sapiens
ugagagacaguuucgucggagg

SEQ ID NO: 47179 - RNA, 22 nt, Homo sapiens
ugagauagaaaacauaggagaa

SEQ ID NO: 47180 - RNA, 22 nt, Homo sapiens
ugagauagggucucacucuguc

SEQ ID NO: 47181 - RNA, 22 nt, Homo sapiens
ugagaucugucuuuauaguauu

SEQ ID NO: 47182 - RNA, 22 nt, Homo sapiens
ugagaucuuuuguggcugagaa

SEQ ID NO: 47183 - RNA, 22 nt, Homo sapiens
ugagaugaagcuagaagaaugg

SEQ ID NO: 47184 - RNA, 22 nt, Homo sapiens
ugagaugaucaaaguauaggcu

SEQ ID NO: 47185 - RNA, 21 nt, Homo sapiens
ugagaugauccugcaugcaug

SEQ ID NO: 47186 - RNA, 20 nt, Homo sapiens
ugagaugcauugggauguuu

SEQ ID NO: 47187 - RNA, 22 nt, Homo sapiens
ugagaugguaaauuuuuguugu

SEQ ID NO: 47188 - RNA, 23 nt, Homo sapiens
ugagcaauauucuacuauugagu

SEQ ID NO: 47189 - RNA, 22 nt, Homo sapiens
ugagcacaggugcgcgguuacu

SEQ ID NO: 47190 - RNA, 22 nt, Homo sapiens
ugagcagaaagcugcaaggucg

SEQ ID NO: 47191 - RNA, 22 nt, Homo sapiens
ugagcagagggagaaguaaauu

SEQ ID NO: 47192 - RNA, 22 nt, Homo sapiens
ugagcagugaguguggugcagg

SEQ ID NO: 47193 - RNA, 22 nt, Homo sapiens
ugagccaugguuagcuucucau

SEQ ID NO: 47194 - RNA, 22 nt, Homo sapiens
ugagcuccuucauaaaaaggca

SEQ ID NO: 47195 - RNA, 22 nt, Homo sapiens
ugaggauaguguugaaggcagg

SEQ ID NO: 47196 - RNA, 22 nt, Homo sapiens
ugagguguauugggggaaauuc

SEQ ID NO: 47197 - RNA, 22 nt, Homo sapiens
ugaguagugcugcaauaaacau

SEQ ID NO: 47198 - RNA, 19 nt, Homo sapiens
ugaguaucuuuacacaucu

SEQ ID NO: 47199 - RNA, 22 nt, Homo sapiens
ugagugaaagaagcacuaagga

SEQ ID NO: 47200 - RNA, 22 nt, Homo sapiens
ugagugaggcugggcagucccu

SEQ ID NO: 47201 - RNA, 22 nt, Homo sapiens
ugaguuuaucuaaagaccuggg

SEQ ID NO: 47202 - RNA, 22 nt, Homo sapiens
ugauaagugagauagcaaguga

SEQ ID NO: 47203 - RNA, 22 nt, Homo sapiens
ugauaggagauuuucaucugua

SEQ ID NO: 47204 - RNA, 22 nt, Homo sapiens
ugauauauugaaugaugaaaca

SEQ ID NO: 47205 - RNA, 18 nt, Homo sapiens
ugauaucaucacaauuga

SEQ ID NO: 47206 - RNA, 22 nt, Homo sapiens
ugauauguaugugaccuagaaa

SEQ ID NO: 47207 - RNA, 22 nt, Homo sapiens
ugauaugucccucgacaucagg

SEQ ID NO: 47208 - RNA, 22 nt, Homo sapiens
ugaugacacugauuucuucaau

SEQ ID NO: 47209 - RNA, 22 nt, Homo sapiens
ugauuagagcccaagcuuugaa

SEQ ID NO: 47210 - RNA, 22 nt, Homo sapiens
ugcaacacauugccccugcucu

SEQ ID NO: 47211 - RNA, 22 nt, Homo sapiens
ugcaagaggagacuguacucag

SEQ ID NO: 47212 - RNA, 22 nt, Homo sapiens
ugcaagaugauuucaauugaua

SEQ ID NO: 47213 - RNA, 17 nt, Homo sapiens
ugcaauuuaagcuagau

SEQ ID NO: 47214 - RNA, 23 nt, Homo sapiens
ugcaccacuacacacucuugggu

SEQ ID NO: 47215 - RNA, 22 nt, Homo sapiens
ugcagagaaacauuuuguauuu

SEQ ID NO: 47216 - RNA, 22 nt, Homo sapiens
ugcagcacugaacuucugggcu

SEQ ID NO: 47217 - RNA, 20 nt, Homo sapiens
ugcaguguccucacuuguca

SEQ ID NO: 47218 - RNA, 22 nt, Homo sapiens
ugcauauuuuauaaagauggaa

SEQ ID NO: 47219 - RNA, 22 nt, Homo sapiens
ugcauggagcucucuuuggacu

SEQ ID NO: 47220 - RNA, 22 nt, Homo sapiens
ugcauuguaggauguuuagcag

SEQ ID NO: 47221 - RNA, 22 nt, Homo sapiens
ugcauuguggaucuaaaugcau

SEQ ID NO: 47222 - RNA, 20 nt, Homo sapiens
ugccaagaaaugaggguauu

SEQ ID NO: 47223 - RNA, 20 nt, Homo sapiens
ugccaagaugacuauagcuc

SEQ ID NO: 47224 - RNA, 22 nt, Homo sapiens
uuuggucacugccgccgccagc

SEQ ID NO: 47225 - RNA, 22 nt, Homo sapiens
uuuggucagcugcgggucagcu

SEQ ID NO: 47226 - RNA, 22 nt, Homo sapiens
uuugguuuuuguuaucacucau

SEQ ID NO: 47227 - RNA, 23 nt, Homo sapiens
uuuguacuaugucaguuuagaua

SEQ ID NO: 47228 - RNA, 22 nt, Homo sapiens
uuuguacucccuuuagauaaaa

SEQ ID NO: 47229 - RNA, 23 nt, Homo sapiens
uuuguaguagcaugauuuauaau

SEQ ID NO: 47230 - RNA, 22 nt, Homo sapiens
uuugucuccuaagacucugugg

SEQ ID NO: 47231 - RNA, 22 nt, Homo sapiens
uuugugcaugaagagggggugc

SEQ ID NO: 47232 - RNA, 16 nt, Homo sapiens
uuugugugugacgaga

SEQ ID NO: 47233 - RNA, 22 nt, Homo sapiens
uuuguucaccucaaggauggga

SEQ ID NO: 47234 - RNA, 22 nt, Homo sapiens
uuuuacacuguugguuggaaug

SEQ ID NO: 47235 - RNA, 22 nt, Homo sapiens
uuuuagcaaagagacugguggc

SEQ ID NO: 47236 - RNA, 20 nt, Homo sapiens
uuuuagcuuuuauugaaagc

SEQ ID NO: 47237 - RNA, 22 nt, Homo sapiens
uuuuaguugcucagguauucuc

SEQ ID NO: 47238 - RNA, 22 nt, Homo sapiens
uuuuaugggcuauuugcauuag

SEQ ID NO: 47239 - RNA, 22 nt, Homo sapiens
uuuuccagugggacucccauua

SEQ ID NO: 47240 - RNA, 22 nt, Homo sapiens
uuuugcaaauuccaguggccau

SEQ ID NO: 47241 - RNA, 22 nt, Homo sapiens
uuuugcaauauguuccugaaua

SEQ ID NO: 47242 - RNA, 22 nt, Homo sapiens
uuuugcacuagaaccagagguu

SEQ ID NO: 47243 - RNA, 22 nt, Homo sapiens
uuuugcaguuacagagagugag

SEQ ID NO: 47244 - RNA, 22 nt, Homo sapiens
uuuugcauuggcugaggagugu

SEQ ID NO: 47245 - RNA, 22 nt, Homo sapiens
uuuuggcucuugguaggucaga

SEQ ID NO: 47246 - RNA, 19 nt, Homo sapiens
uuuuguacucugugacuug

SEQ ID NO: 47247 - RNA, 21 nt, Homo sapiens
uuuugugcaugugcagccugc

SEQ ID NO: 47248 - RNA, 18 nt, Homo sapiens
uuuuugaggcacagggga

SEQ ID NO: 47249 - RNA, 21 nt, Homo sapiens
uuuuugggcuuucauaguguu

SEQ ID NO: 47250 - RNA, 22 nt, Homo sapiens
uuuuuggguaaugauuaucaau

SEQ ID NO: 47251 - RNA, 22 nt, Homo sapiens
uuuuugugguauauugcaacaa

SEQ ID NO: 47252 - RNA, 22 nt, Homo sapiens
ugucacauccaagaaggugcag

SEQ ID NO: 47253 - RNA, 22 nt, Homo sapiens
ugucagaaucuagaggcugcua

SEQ ID NO: 47254 - RNA, 22 nt, Homo sapiens
ugucauguaaagaguaaauggu

SEQ ID NO: 47255 - RNA, 22 nt, Homo sapiens
uguccaaauugaaucaucuggu

SEQ ID NO: 47256 - RNA, 18 nt, Homo sapiens
ugucccuuugcuguucau

SEQ ID NO: 47257 - RNA, 22 nt, Homo sapiens
ugucuguuugcgaaauugcuuc

SEQ ID NO: 47258 - RNA, 21 nt, Homo sapiens
ugucuuggagccagacgccag

SEQ ID NO: 47259 - RNA, 22 nt, Homo sapiens
ugugacucuggcacauggugag

SEQ ID NO: 47260 - RNA, 22 nt, Homo sapiens
ugugacugguugucccgcuuuc

SEQ ID NO: 47261 - RNA, 23 nt, Homo sapiens
ugugcacauuuacauauauacac

SEQ ID NO: 47262 - RNA, 22 nt, Homo sapiens
uguggcaaagucuugugaauau

SEQ ID NO: 47263 - RNA, 21 nt, Homo sapiens
uguggcaauggccucacagau

SEQ ID NO: 47264 - RNA, 22 nt, Homo sapiens
uguggcuuuuucuuggcugagg

SEQ ID NO: 47265 - RNA, 22 nt, Homo sapiens
uguguauaucacugcaugagug

SEQ ID NO: 47266 - RNA, 22 nt, Homo sapiens
ugugucuacugagaugaucaug

SEQ ID NO: 47267 - RNA, 22 nt, Homo sapiens
uguuaugaagaugccugguaca

SEQ ID NO: 47268 - RNA, 22 nt, Homo sapiens
uguuuuggaggccagaagucca

SEQ ID NO: 47269 - RNA, 22 nt, Homo sapiens
uuaaaagcuaucuccaagguca

SEQ ID NO: 47270 - RNA, 22 nt, Homo sapiens
uuaaaugcuagaauuuucuuug

SEQ ID NO: 47271 - RNA, 22 nt, Homo sapiens
uuaacagugucaaucuguagua

SEQ ID NO: 47272 - RNA, 22 nt, Homo sapiens
uuaagcaguggauuagaauuuu

SEQ ID NO: 47273 - RNA, 22 nt, Homo sapiens
uuaaggcauucuuugucuucau

SEQ ID NO: 47274 - RNA, 19 nt, Homo sapiens
uuaagguacuuagaugugu

SEQ ID NO: 47275 - RNA, 22 nt, Homo sapiens
uuaagugaauuaucuaacaugu

SEQ ID NO: 47276 - RNA, 19 nt, Homo sapiens
uuacacaaccuaguggggc

SEQ ID NO: 47277 - RNA, 22 nt, Homo sapiens
uuacaguguuuguucuguuacu

SEQ ID NO: 47278 - RNA, 22 nt, Homo sapiens
uuacaucaucacauuaguuugc

SEQ ID NO: 47279 - RNA, 22 nt, Homo sapiens
uuacccuuuaacccuuuaaagu

SEQ ID NO: 47280 - RNA, 22 nt, Homo sapiens
uuagacaguggugcacugcacu

SEQ ID NO: 47281 - RNA, 22 nt, Homo sapiens
uuagauuauugguguuuugcaa

SEQ ID NO: 47282 - RNA, 22 nt, Homo sapiens
uuagcacuaauucguuggggca

SEQ ID NO: 47283 - RNA, 22 nt, Homo sapiens
uuagcacugagaauggcuugcu

SEQ ID NO: 47284 - RNA, 21 nt, Homo sapiens
uuagcauccauguucaucaac

SEQ ID NO: 47285 - RNA, 22 nt, Homo sapiens
uuagcccagugggugcuucucu

SEQ ID NO: 47286 - RNA, 22 nt, Homo sapiens
uuaggcuuuuuaaccaguuguu

SEQ ID NO: 47287 - RNA, 22 nt, Homo sapiens
uuagguagucucugucagaggg

SEQ ID NO: 47288 - RNA, 23 nt, Homo sapiens
uuaguaaacucaaugacaccaca

SEQ ID NO: 47289 - RNA, 22 nt, Homo sapiens
uuauacacugugggaguguaaa

SEQ ID NO: 47290 - RNA, 22 nt, Homo sapiens
uuaugguacaugugcacaaugu

SEQ ID NO: 47291 - RNA, 22 nt, Homo sapiens
uuauuagcacccuaccaugugg

SEQ ID NO: 47292 - RNA, 22 nt, Homo sapiens
uucacacugggccuacucugug

SEQ ID NO: 47293 - RNA, 22 nt, Homo sapiens
uucacaguacucccuggaauua

SEQ ID NO: 47294 - RNA, 22 nt, Homo sapiens
uucacaguggugggagacguca

SEQ ID NO: 47295 - RNA, 23 nt, Homo sapiens
uucaccguguuggccaggcuggu

SEQ ID NO: 47296 - RNA, 22 nt, Homo sapiens
uucaguauugcaccuggagucc

SEQ ID NO: 47297 - RNA, 22 nt, Homo sapiens
uucaguggguggaugaauauga

SEQ ID NO: 47298 - RNA, 22 nt, Homo sapiens
uucaucaguugagcugguugcu

SEQ ID NO: 47299 - RNA, 22 nt, Homo sapiens
uucauccccuccaaaucucaug

SEQ ID NO: 47300 - RNA, 22 nt, Homo sapiens
uucauggaguugagaaggcuaa

SEQ ID NO: 47301 - RNA, 22 nt, Homo sapiens
uuccacaaugguugaacuaguu

SEQ ID NO: 47302 - RNA, 22 nt, Homo sapiens
uuccacaggguugaacuaguuu

SEQ ID NO: 47303 - RNA, 23 nt, Homo sapiens
uuccaccauugacuaguuacaua

SEQ ID NO: 47304 - RNA, 22 nt, Homo sapiens
uuccagugggacgagaugugga

SEQ ID NO: 47305 - RNA, 22 nt, Homo sapiens
uuccauguaguugagcaguuuu

SEQ ID NO: 47306 - RNA, 22 nt, Homo sapiens
uucccugugggaguaggaaagu

SEQ ID NO: 47307 - RNA, 22 nt, Homo sapiens
uucccuuucugccuugaaucuu

SEQ ID NO: 47308 - RNA, 22 nt, Homo sapiens
uucccuuugaaacuaaacuugc

SEQ ID NO: 47309 - RNA, 22 nt, Homo sapiens
uucccuuugugcauaggauuug

SEQ ID NO: 47310 - RNA, 22 nt, Homo sapiens
uuccugugacuguguggcaccc

SEQ ID NO: 47311 - RNA, 22 nt, Homo sapiens
uuccuuguuuauuuacaggagg

SEQ ID NO: 47312 - RNA, 22 nt, Homo sapiens
uucuaaacaucuuacaaugcau

SEQ ID NO: 47313 - RNA, 22 nt, Homo sapiens
uucucaauggaugugggaccag

SEQ ID NO: 47314 - RNA, 22 nt, Homo sapiens
uucucacaguacagggagcucu

SEQ ID NO: 47315 - RNA, 21 nt, Homo sapiens
uucucaggguguguccuaccc

SEQ ID NO: 47316 - RNA, 22 nt, Homo sapiens
uucucuguggauugggugagag

SEQ ID NO: 47317 - RNA, 22 nt, Homo sapiens
uucugagguuauauucucucaa

SEQ ID NO: 47318 - RNA, 19 nt, Homo sapiens
uucugguguuuuaagccaa

SEQ ID NO: 47319 - RNA, 22 nt, Homo sapiens
uucugugguuucauuuaccugu

SEQ ID NO: 47320 - RNA, 22 nt, Homo sapiens
uucuuuggaaacaguacuaauu

SEQ ID NO: 47321 - RNA, 22 nt, Homo sapiens
uucuuuggauaaaguuuuaugc

SEQ ID NO: 47322 - RNA, 22 nt, Homo sapiens
uugaaagacaucaccuacugcu

SEQ ID NO: 47323 - RNA, 22 nt, Homo sapiens
uugaaagaugaacuggauugga

SEQ ID NO: 47324 - RNA, 22 nt, Homo sapiens
uugaaaguguucacaaugguau

SEQ ID NO: 47325 - RNA, 22 nt, Homo sapiens
uugaagacuauaugauucuuca

SEQ ID NO: 47326 - RNA, 19 nt, Homo sapiens
uugaaggccgccuugcaga

SEQ ID NO: 47327 - RNA, 23 nt, Homo sapiens
uugacuguggguacaaugugaua

SEQ ID NO: 47328 - RNA, 21 nt, Homo sapiens
uugagaagaauuagcucuucc

SEQ ID NO: 47329 - RNA, 22 nt, Homo sapiens
uugagaaucuuucgaauguucu

SEQ ID NO: 47330 - RNA, 22 nt, Homo sapiens
uugagagagaacauuuguuaca

SEQ ID NO: 47331 - RNA, 22 nt, Homo sapiens
uugagauacauaauuaugaaug

SEQ ID NO: 47332 - RNA, 22 nt, Homo sapiens
uugagauaggaacucacuaugc

SEQ ID NO: 47333 - RNA, 22 nt, Homo sapiens
uugagauagggucuaccucugu

SEQ ID NO: 47334 - RNA, 22 nt, Homo sapiens
uugagcaaaacauuaauauuag

SEQ ID NO: 47335 - RNA, 22 nt, Homo sapiens
uugagcacugucugugugcagu

SEQ ID NO: 47336 - RNA, 22 nt, Homo sapiens
uugagcucaucuucagggguga

SEQ ID NO: 47337 - RNA, 22 nt, Homo sapiens
uugauauuacucaguaacagau

SEQ ID NO: 47338 - RNA, 22 nt, Homo sapiens
uugauuuguagaaugccccaac

SEQ ID NO: 47339 - RNA, 22 nt, Homo sapiens
uugcacagugguuuagagccug

SEQ ID NO: 47340 - RNA, 22 nt, Homo sapiens
uugcacuccggccuggguaaca

SEQ ID NO: 47341 - RNA, 22 nt, Homo sapiens
uugcacuugcugaggagugauu

SEQ ID NO: 47342 - RNA, 22 nt, Homo sapiens
uugcaucagcaggcauaauugg

SEQ ID NO: 47343 - RNA, 22 nt, Homo sapiens
uugccaucaucucuuacucagu

SEQ ID NO: 47344 - RNA, 20 nt, Homo sapiens
uugccgagagaaagguguua

SEQ ID NO: 47345 - RNA, 22 nt, Homo sapiens
uugccuuuguuggaaacaagug

SEQ ID NO: 47346 - RNA, 22 nt, Homo sapiens
uuggaaacaccuggugagguua

SEQ ID NO: 47347 - RNA, 22 nt, Homo sapiens
uuggaaagagguguuuaugacu

SEQ ID NO: 47348 - RNA, 20 nt, Homo sapiens
uuggaaaugugaauugggag

SEQ ID NO: 47349 - RNA, 22 nt, Homo sapiens
uuggaaauguguuugcauucag

SEQ ID NO: 47350 - RNA, 22 nt, Homo sapiens
uuggaagacauucugucugcua

SEQ ID NO: 47351 - RNA, 22 nt, Homo sapiens
uuggaagauuacuuaguuuucu

SEQ ID NO: 47352 - RNA, 22 nt, Homo sapiens
uuggaauuuuaaaauaggcaac

SEQ ID NO: 47353 - RNA, 22 nt, Homo sapiens
uuggagugugagagcagccugg

SEQ ID NO: 47354 - RNA, 22 nt, Homo sapiens
uuggcaauucagauucuuuuau

SEQ ID NO: 47355 - RNA, 22 nt, Homo sapiens
uuggccccuccaaaucucaugu

SEQ ID NO: 47356 - RNA, 22 nt, Homo sapiens
uuggccccuuucauccacagcu

SEQ ID NO: 47357 - RNA, 22 nt, Homo sapiens
uuggcuucuggacuauugugca

SEQ ID NO: 47358 - RNA, 22 nt, Homo sapiens
uugggaauguccuaauaucucg

SEQ ID NO: 47359 - RNA, 22 nt, Homo sapiens
uugggauggaacuuuucaguga

SEQ ID NO: 47360 - RNA, 21 nt, Homo sapiens
uuggucuucucugugauucuu

SEQ ID NO: 47361 - RNA, 22 nt, Homo sapiens
uugguuauccugucgguaauuc

SEQ ID NO: 47362 - RNA, 22 nt, Homo sapiens
uugucaaacucauucuccaucc

SEQ ID NO: 47363 - RNA, 21 nt, Homo sapiens
uuguccccacccaaaucucau

SEQ ID NO: 47364 - RNA, 22 nt, Homo sapiens
uuguccccacccaaaugucauc

SEQ ID NO: 47365 - RNA, 22 nt, Homo sapiens
uuguccccaucugcugccagaa

SEQ ID NO: 47366 - RNA, 22 nt, Homo sapiens
uuguccucuccaaaucucaugu

SEQ ID NO: 47367 - RNA, 22 nt, Homo sapiens
uuguccuugagauaguuugcug

SEQ ID NO: 47368 - RNA, 22 nt, Homo sapiens
uugucuagugaauacauuaaug

SEQ ID NO: 47369 - RNA, 22 nt, Homo sapiens
uugugaaaaaccucucguggaa

SEQ ID NO: 47370 - RNA, 22 nt, Homo sapiens
uugugccccuucucagucgggc

SEQ ID NO: 47371 - RNA, 22 nt, Homo sapiens
uugugucaaauggcaauuagca

SEQ ID NO: 47372 - RNA, 22 nt, Homo sapiens
uuguguuuuuaguagggaaggg

SEQ ID NO: 47373 - RNA, 22 nt, Homo sapiens
uuguucaggagguuggggaugc

SEQ ID NO: 47374 - RNA, 22 nt, Homo sapiens
uuuaaacugucuuggguuugga

SEQ ID NO: 47375 - RNA, 22 nt, Homo sapiens
uuuaaagcaugacgagaagaag

SEQ ID NO: 47376 - RNA, 22 nt, Homo sapiens
uuuaaagcuccaagcaugucug

SEQ ID NO: 47377 - RNA, 23 nt, Homo sapiens
uuuaagcuucauguccuaacauc

SEQ ID NO: 47378 - RNA, 22 nt, Homo sapiens
uuuaagguauguggugaaaauu

SEQ ID NO: 47379 - RNA, 22 nt, Homo sapiens
uuuaaugcgucucugaguuuug

SEQ ID NO: 47380 - RNA, 22 nt, Homo sapiens
uuuauccagccucuagcaaggu

SEQ ID NO: 47381 - RNA, 22 nt, Homo sapiens
uuuaugguuuucugggagauug

SEQ ID NO: 47382 - RNA, 23 nt, Homo sapiens
uuucacagaaggauuguagggcc

SEQ ID NO: 47383 - RNA, 21 nt, Homo sapiens
uuucacugugaguuuuucugu

SEQ ID NO: 47384 - RNA, 18 nt, Homo sapiens
uuucaggguggacaugag

SEQ ID NO: 47385 - RNA, 22 nt, Homo sapiens
uuucugaggccucaccagaagc

SEQ ID NO: 47386 - RNA, 22 nt, Homo sapiens
uuucugcuugagagaauugcug

SEQ ID NO: 47387 - RNA, 23 nt, Homo sapiens
uuucuugggcaugcuaugucagu

SEQ ID NO: 47388 - RNA, 22 nt, Homo sapiens
uuucuugguuguauuuagacuu

SEQ ID NO: 47389 - RNA, 19 nt, Homo sapiens
uuugaauauaaugcagcua

SEQ ID NO: 47390 - RNA, 22 nt, Homo sapiens
uuugaauguaaugagcaggaag

SEQ ID NO: 47391 - RNA, 22 nt, Homo sapiens
uuugacucacagccuggcugcc

SEQ ID NO: 47392 - RNA, 18 nt, Homo sapiens
uuugccacuucccagaaa

SEQ ID NO: 47393 - RNA, 22 nt, Homo sapiens
uuugcuuaguaaauguagaaaa

SEQ ID NO: 47394 - RNA, 22 nt, Homo sapiens
uuugggcuuuuaaucuagagca

SEQ ID NO: 47395 - RNA, 22 nt, Homo sapiens
uuuggguuuuauguaacagcua

SEQ ID NO: 47396 - RNA, 22 nt, Homo sapiens
uuuguaauccuauuccaaagga

SEQ ID NO: 47397 - RNA, 22 nt, Homo sapiens
uuuguacacgugggugaauugu

SEQ ID NO: 47398 - RNA, 22 nt, Homo sapiens
uuuguacacuguugguaggauu

SEQ ID NO: 47399 - RNA, 22 nt, Homo sapiens
uuuguacuaugguuuuucacua

SEQ ID NO: 47400 - RNA, 22 nt, Homo sapiens
uuugugcuaacuuuaacucuua

SEQ ID NO: 47401 - RNA, 18 nt, Homo sapiens
uuugugcuccacaaagga

SEQ ID NO: 47402 - RNA, 22 nt, Homo sapiens
uuugugcugcaauuaauuuccc

SEQ ID NO: 47403 - RNA, 22 nt, Homo sapiens
uuuuacacuucgguugugugca

SEQ ID NO: 47404 - RNA, 22 nt, Homo sapiens
uuuuacagaggagguugcugau

SEQ ID NO: 47405 - RNA, 22 nt, Homo sapiens
uuuucaguuuuccagguagccg

SEQ ID NO: 47406 - RNA, 22 nt, Homo sapiens
uuuugcaggucaggggcagaga

SEQ ID NO: 47407 - RNA, 22 nt, Homo sapiens
uuuuggcuuaaagagaauguau

SEQ ID NO: 47408 - RNA, 22 nt, Homo sapiens
uuuuggcuuuuccucagcaagc

SEQ ID NO: 47409 - RNA, 22 nt, Homo sapiens
uuuugguauacacaaggguccu

SEQ ID NO: 47410 - RNA, 22 nt, Homo sapiens
uuuugguauaugcaggggucuu

SEQ ID NO: 47411 - RNA, 22 nt, Homo sapiens
uuuuguacgccuguguccauca

SEQ ID NO: 47412 - RNA, 22 nt, Homo sapiens
uuuuugagaauuggugaaacac

SEQ ID NO: 47413 - RNA, 22 nt, Homo sapiens
uuuuugaguaaauauaaauugu

SEQ ID NO: 47414 - RNA, 16 nt, Homo sapiens
uuuuugcagaaaugac

SEQ ID NO: 47415 - RNA, 21 nt, Homo sapiens
uuuuugguggucauggauaga

SEQ ID NO: 47416 - RNA, 22 nt, Homo sapiens
uuuuuuaguuagcugggcauga

SEQ ID NO: 47417 - RNA, 22 nt, Homo sapiens
uuuuuugguaauugaacaauga

SEQ ID NO: 47418 - RNA, 20 nt, Homo sapiens
gcauaugucuuuauggcagc

SEQ ID NO: 47419 - RNA, 22 nt, Homo sapiens
gcaugaugaauaauaucacaag

SEQ ID NO: 47420 - RNA, 22 nt, Homo sapiens
gccauugcacuccagccucggc

SEQ ID NO: 47421 - RNA, 22 nt, Homo sapiens
gccccgggugaugcagccguca

SEQ ID NO: 47422 - RNA, 22 nt, Homo sapiens
gccuagagaaguaaauauuauc

SEQ ID NO: 47423 - RNA, 22 nt, Homo sapiens
gcucaguuuccucagcugcaaa

SEQ ID NO: 47424 - RNA, 22 nt, Homo sapiens
gcucuuuugggguaauucugag

SEQ ID NO: 47425 - RNA, 22 nt, Homo sapiens
gcuucauggaggcugggcgcag

SEQ ID NO: 47426 - RNA, 22 nt, Homo sapiens
gcuuguguucaagucacccuua

SEQ ID NO: 47427 - RNA, 21 nt, Homo sapiens
gcuuuuucggaagucuuuggc

SEQ ID NO: 47428 - RNA, 22 nt, Homo sapiens
ggaaagacuauuguaaaggaug

SEQ ID NO: 47429 - RNA, 19 nt, Homo sapiens
ggaaaugucuauuaagauc

SEQ ID NO: 47430 - RNA, 22 nt, Homo sapiens
ggaagacaguguggugauuccu

SEQ ID NO: 47431 - RNA, 22 nt, Homo sapiens
ggaaggucaaagggaaagcaga

SEQ ID NO: 47432 - RNA, 22 nt, Homo sapiens
ggaaugagaaauauuacacaau

SEQ ID NO: 47433 - RNA, 22 nt, Homo sapiens
ggaauggaacaaagucuugaaa

SEQ ID NO: 47434 - RNA, 22 nt, Homo sapiens
ggacagugaaugccacuccucc

SEQ ID NO: 47435 - RNA, 22 nt, Homo sapiens
ggagauaauccagggagggacu

SEQ ID NO: 47436 - RNA, 22 nt, Homo sapiens
ggagugucagaaacaguguccu

SEQ ID NO: 47437 - RNA, 22 nt, Homo sapiens
ggagugucccaaucucagcuca

SEQ ID NO: 47438 - RNA, 22 nt, Homo sapiens
ggcaaaauggccagugggucac

SEQ ID NO: 47439 - RNA, 22 nt, Homo sapiens
ggcaaauucuuguaugccuacu

SEQ ID NO: 47440 - RNA, 22 nt, Homo sapiens
ggcaagaaccacaauuacuuuu

SEQ ID NO: 47441 - RNA, 17 nt, Homo sapiens
ggcaagaaguggaacuc

SEQ ID NO: 47442 - RNA, 21 nt, Homo sapiens
ggcaagagaauacaacauaaa

SEQ ID NO: 47443 - RNA, 22 nt, Homo sapiens
ggcaaggugcuacagacaguga

SEQ ID NO: 47444 - RNA, 17 nt, Homo sapiens
ggcaggaauuaauguca

SEQ ID NO: 47445 - RNA, 22 nt, Homo sapiens
ggcucagugaucuguuucugua

SEQ ID NO: 47446 - RNA, 22 nt, Homo sapiens
gggaauggaagacauuaugaug

SEQ ID NO: 47447 - RNA, 22 nt, Homo sapiens
gggcauugugggcagagggcag

SEQ ID NO: 47448 - RNA, 22 nt, Homo sapiens
gggggagugugguacccagcau

SEQ ID NO: 47449 - RNA, 17 nt, Homo sapiens
gggucaccuugcaggua

SEQ ID NO: 47450 - RNA, 22 nt, Homo sapiens
gggucauggaugugaagcuaga

SEQ ID NO: 47451 - RNA, 15 nt, Homo sapiens
ggguccucucccaaa

SEQ ID NO: 47452 - RNA, 22 nt, Homo sapiens
gguaaguuuggggcuaauuugu

SEQ ID NO: 47453 - RNA, 22 nt, Homo sapiens
gguagacucuguaagugaucau

SEQ ID NO: 47454 - RNA, 22 nt, Homo sapiens
gguguguaaauuacuuaucucu

SEQ ID NO: 47455 - RNA, 22 nt, Homo sapiens
guaaaucucuguuuucauggac

SEQ ID NO: 47456 - RNA, 22 nt, Homo sapiens
guaacacaugcugcucucuggu

SEQ ID NO: 47457 - RNA, 22 nt, Homo sapiens
guacaguacugaaugaauguau

SEQ ID NO: 47458 - RNA, 22 nt, Homo sapiens
guacaguauaguaauaggauuu

SEQ ID NO: 47459 - RNA, 22 nt, Homo sapiens
guagaaaguuugcugucacaug

SEQ ID NO: 47460 - RNA, 22 nt, Homo sapiens
guaugacacaggaagcuuaacc

SEQ ID NO: 47461 - RNA, 22 nt, Homo sapiens
guaugugacuggaacaguagga

SEQ ID NO: 47462 - RNA, 22 nt, Homo sapiens
gucacuguggagaagaaagugg

SEQ ID NO: 47463 - RNA, 22 nt, Homo sapiens
gucacuguuuccuauuauauuu

SEQ ID NO: 47464 - RNA, 22 nt, Homo sapiens
gucagcaucaccaugucuauga

SEQ ID NO: 47465 - RNA, 22 nt, Homo sapiens
gucaggugcuuacgcggagauc

SEQ ID NO: 47466 - RNA, 22 nt, Homo sapiens
gucaugggguacuacacauggg

SEQ ID NO: 47467 - RNA, 22 nt, Homo sapiens
gucauggguuaaagguggauac

SEQ ID NO: 47468 - RNA, 22 nt, Homo sapiens
guccaguuguuuucugagguug

SEQ ID NO: 47469 - RNA, 21 nt, Homo sapiens
gucugguguuuuaaugaggac

SEQ ID NO: 47470 - RNA, 22 nt, Homo sapiens
gucugugcauuaauacgugcug

SEQ ID NO: 47471 - RNA, 22 nt, Homo sapiens
gucuguuuggggaccuguggcc

SEQ ID NO: 47472 - RNA, 22 nt, Homo sapiens
gucuuuggaaaaaaugucuguu

SEQ ID NO: 47473 - RNA, 22 nt, Homo sapiens
gugaaaagaugagcaccauaca

SEQ ID NO: 47474 - RNA, 22 nt, Homo sapiens
gugaaagauuaaaccagugugu

SEQ ID NO: 47475 - RNA, 17 nt, Homo sapiens
gugaaaucaucauuuuu

SEQ ID NO: 47476 - RNA, 22 nt, Homo sapiens
gugaaaugaaucuggaaauauu

SEQ ID NO: 47477 - RNA, 22 nt, Homo sapiens
gugaaguuuuugugaggccuaa

SEQ ID NO: 47478 - RNA, 22 nt, Homo sapiens
gugacagucaaagacaugacuu

SEQ ID NO: 47479 - RNA, 22 nt, Homo sapiens
gugacauuuuuacugaugagag

SEQ ID NO: 47480 - RNA, 22 nt, Homo sapiens
gugagaagaaaaauauggcugu

SEQ ID NO: 47481 - RNA, 22 nt, Homo sapiens
aaguauuagugaggauauggaa

SEQ ID NO: 47482 - RNA, 22 nt, Homo sapiens
aagugaauguuugguagcagug

SEQ ID NO: 47483 - RNA, 22 nt, Homo sapiens
aagugcuguccuaccuuuggga

SEQ ID NO: 47484 - RNA, 22 nt, Homo sapiens
aaguggaauguuuguggcacaa

SEQ ID NO: 47485 - RNA, 22 nt, Homo sapiens
aaguguaaguuaauguuuaggu

SEQ ID NO: 47486 - RNA, 23 nt, Homo sapiens
aaguucaugcucaucuguuacac

SEQ ID NO: 47487 - RNA, 22 nt, Homo sapiens
aauaaaguaggaggugaggaaa

SEQ ID NO: 47488 - RNA, 21 nt, Homo sapiens
aauacucuagguuaagagagc

SEQ ID NO: 47489 - RNA, 22 nt, Homo sapiens
aauagcauugaaucuaccaauu

SEQ ID NO: 47490 - RNA, 23 nt, Homo sapiens
aauaucacaguggguguacaccc

SEQ ID NO: 47491 - RNA, 19 nt, Homo sapiens
aauauugacaguggugucu

SEQ ID NO: 47492 - RNA, 22 nt, Homo sapiens
aaucauauugucugccaagagg

SEQ ID NO: 47493 - RNA, 22 nt, Homo sapiens
aaucccuuuguccagucucuuu

SEQ ID NO: 47494 - RNA, 22 nt, Homo sapiens
aaucucagagauaucugugucc

SEQ ID NO: 47495 - RNA, 22 nt, Homo sapiens
aaugcacuccagccugggcgac

SEQ ID NO: 47496 - RNA, 22 nt, Homo sapiens
aaugcuguguuauuucaugacc

SEQ ID NO: 47497 - RNA, 22 nt, Homo sapiens
aauggcaagagccacagaggcg

SEQ ID NO: 47498 - RNA, 22 nt, Homo sapiens
aaugugcacuauuagggugaua

SEQ ID NO: 47499 - RNA, 22 nt, Homo sapiens
aauuaguugucgugagaguggu

SEQ ID NO: 47500 - RNA, 22 nt, Homo sapiens
aauucuguauuguuuagggacu

SEQ ID NO: 47501 - RNA, 23 nt, Homo sapiens
aauugcuuuugaggacuuaguug

SEQ ID NO: 47502 - RNA, 22 nt, Homo sapiens
acaaagcgcuucucuuuagagu

SEQ ID NO: 47503 - RNA, 22 nt, Homo sapiens
acacagugucuguguauuuaaa

SEQ ID NO: 47504 - RNA, 22 nt, Homo sapiens
acacaugugaaaaaaauguuac

SEQ ID NO: 47505 - RNA, 22 nt, Homo sapiens
acacuacuggguauauguguuu

SEQ ID NO: 47506 - RNA, 22 nt, Homo sapiens
acagaacugggcuugcuuuugg

SEQ ID NO: 47507 - RNA, 22 nt, Homo sapiens
acagcagugccccacucuacug

SEQ ID NO: 47508 - RNA, 22 nt, Homo sapiens
acaguacaugauaaauaaggua

SEQ ID NO: 47509 - RNA, 20 nt, Homo sapiens
acaguauguuuggaugcaua

SEQ ID NO: 47510 - RNA, 22 nt, Homo sapiens
acagucacaauuuguaccuuuu

SEQ ID NO: 47511 - RNA, 18 nt, Homo sapiens
acagugucuuacaccugu

SEQ ID NO: 47512 - RNA, 22 nt, Homo sapiens
acauaaagaagcaggacauugu

SEQ ID NO: 47513 - RNA, 22 nt, Homo sapiens
acauauaaggagacuagggcau

SEQ ID NO: 47514 - RNA, 21 nt, Homo sapiens
acaucagaguugugaagguag

SEQ ID NO: 47515 - RNA, 18 nt, Homo sapiens
acccuucagcacugggcc

SEQ ID NO: 47516 - RNA, 22 nt, Homo sapiens
acucagagugggccccuagaua

SEQ ID NO: 47517 - RNA, 22 nt, Homo sapiens
acugagccuuuaaaugacuuca

SEQ ID NO: 47518 - RNA, 22 nt, Homo sapiens
acugcaaugucgaauagagaug

SEQ ID NO: 47519 - RNA, 18 nt, Homo sapiens
acuggauguaaagggucc

SEQ ID NO: 47520 - RNA, 22 nt, Homo sapiens
acuggcuguuaggaauuaccuc

SEQ ID NO: 47521 - RNA, 22 nt, Homo sapiens
acuggcuuaaggaugggccacu

SEQ ID NO: 47522 - RNA, 21 nt, Homo sapiens
acuuucuguggcaguccauuc

SEQ ID NO: 47523 - RNA, 22 nt, Homo sapiens
ucauggcauuguuaaggguuuu

SEQ ID NO: 47524 - RNA, 19 nt, Homo sapiens
ucaugugcauacauuuggg

SEQ ID NO: 47525 - RNA, 22 nt, Homo sapiens
ucauuagagaucuuggggaaaa

SEQ ID NO: 47526 - RNA, 22 nt, Homo sapiens
ucauucacucccuugaaguuag

SEQ ID NO: 47527 - RNA, 22 nt, Homo sapiens
ucauucauucauccagcuugag

SEQ ID NO: 47528 - RNA, 22 nt, Homo sapiens
ucauucauuugcucacuccaca

SEQ ID NO: 47529 - RNA, 22 nt, Homo sapiens
ucauugcaaucucugccucccg

SEQ ID NO: 47530 - RNA, 22 nt, Homo sapiens
ucauugcacucccagacacccu

SEQ ID NO: 47531 - RNA, 22 nt, Homo sapiens
uccacaauggcugaacuagauu

SEQ ID NO: 47532 - RNA, 22 nt, Homo sapiens
uccacagugguugaacuaguaa

SEQ ID NO: 47533 - RNA, 22 nt, Homo sapiens
ucccagaaacgcauauguucau

SEQ ID NO: 47534 - RNA, 22 nt, Homo sapiens
uccccugagaacuugcuagaaa

SEQ ID NO: 47535 - RNA, 22 nt, Homo sapiens
ucccuugagccuggcuucucac

SEQ ID NO: 47536 - RNA, 22 nt, Homo sapiens
uccugagagcagacccucuaua

SEQ ID NO: 47537 - RNA, 22 nt, Homo sapiens
uccuucacucuacaucuuuguu

SEQ ID NO: 47538 - RNA, 22 nt, Homo sapiens
uccuugcacuaacuuaaggagg

SEQ ID NO: 47539 - RNA, 22 nt, Homo sapiens
uccuuugguucuugucacccca

SEQ ID NO: 47540 - RNA, 22 nt, Homo sapiens
ucuacccugugagggacacagu

SEQ ID NO: 47541 - RNA, 22 nt, Homo sapiens
ucuaguaaugagaggcaggaga

SEQ ID NO: 47542 - RNA, 22 nt, Homo sapiens
ucucacacugaauguguguggg

SEQ ID NO: 47543 - RNA, 22 nt, Homo sapiens
ucucacagccauuucucccucu

SEQ ID NO: 47544 - RNA, 19 nt, Homo sapiens
ucucaguguuggucaggug

SEQ ID NO: 47545 - RNA, 22 nt, Homo sapiens
ucucauagaggcagagaguaaa

SEQ ID NO: 47546 - RNA, 22 nt, Homo sapiens
ucucaugaagauagagaauaga

SEQ ID NO: 47547 - RNA, 21 nt, Homo sapiens
ucucauugugguuuuaauugg

SEQ ID NO: 47548 - RNA, 22 nt, Homo sapiens
ucugagcaauagauguggauau

SEQ ID NO: 47549 - RNA, 22 nt, Homo sapiens
ucugccuacugagcacacagug

SEQ ID NO: 47550 - RNA, 22 nt, Homo sapiens
ucuggccccucucaaaucucau

SEQ ID NO: 47551 - RNA, 23 nt, Homo sapiens
ucugguguugucaaaugcugguu

SEQ ID NO: 47552 - RNA, 22 nt, Homo sapiens
ucuguaguuaacagcuucagcu

SEQ ID NO: 47553 - RNA, 22 nt, Homo sapiens
ucugugguaagaaacgcauguc

SEQ ID NO: 47554 - RNA, 22 nt, Homo sapiens
ucuguggucagaguccuuggcc

SEQ ID NO: 47555 - RNA, 22 nt, Homo sapiens
ucuguggugggcuccacccagu

SEQ ID NO: 47556 - RNA, 22 nt, Homo sapiens
ucugugguucaggcuggagugc

SEQ ID NO: 47557 - RNA, 22 nt, Homo sapiens
ucuuggguuguuggcuucuccu

SEQ ID NO: 47558 - RNA, 23 nt, Homo sapiens
ucuugguuauagaaaaauaguug

SEQ ID NO: 47559 - RNA, 22 nt, Homo sapiens
ucuuugaguuauugugcagacu

SEQ ID NO: 47560 - RNA, 21 nt, Homo sapiens
ucuuuggucaccaguuuucau

SEQ ID NO: 47561 - RNA, 22 nt, Homo sapiens
ucuuuugggccucuugucagac

SEQ ID NO: 47562 - RNA, 22 nt, Homo sapiens
ugaaagacacagaaguugccca

SEQ ID NO: 47563 - RNA, 22 nt, Homo sapiens
ugaaagacugaaagcuuuucuu

SEQ ID NO: 47564 - RNA, 22 nt, Homo sapiens
ugaaagacugaagaauaggcau

SEQ ID NO: 47565 - RNA, 22 nt, Homo sapiens
ugaaaguaauugcaguuuuuac

SEQ ID NO: 47566 - RNA, 22 nt, Homo sapiens
ugaaaucauguaguuauugcaa

SEQ ID NO: 47567 - RNA, 22 nt, Homo sapiens
ugaaaucuaaaauguuccaaga

SEQ ID NO: 47568 - RNA, 22 nt, Homo sapiens
ugaaaugauuauaugguguuug

SEQ ID NO: 47569 - RNA, 22 nt, Homo sapiens
ugaacagagaaacacuggccau

SEQ ID NO: 47570 - RNA, 22 nt, Homo sapiens
ugaacucagcauccagggccaa

SEQ ID NO: 47571 - RNA, 18 nt, Homo sapiens
ugaauacagcguugggaa

SEQ ID NO: 47572 - RNA, 22 nt, Homo sapiens
ugaauauguuaaauaauguucu

SEQ ID NO: 47573 - RNA, 22 nt, Homo sapiens
ugaauauguuucuaaaagugca

SEQ ID NO: 47574 - RNA, 22 nt, Homo sapiens
ugaauguuugcagcuuauacca

SEQ ID NO: 47575 - RNA, 22 nt, Homo sapiens
ugacaagacuacauaucccauu

SEQ ID NO: 47576 - RNA, 23 nt, Homo sapiens
ugacaagagcgagacuuggucuc

SEQ ID NO: 47577 - RNA, 22 nt, Homo sapiens
ugacaagauauggucuuaucaa

SEQ ID NO: 47578 - RNA, 22 nt, Homo sapiens
ugacaaguaaacagucagcacc

SEQ ID NO: 47579 - RNA, 21 nt, Homo sapiens
ugacagaaaauugaguuugcu

SEQ ID NO: 47580 - RNA, 22 nt, Homo sapiens
ugacagguugauaggugcagca

SEQ ID NO: 47581 - RNA, 22 nt, Homo sapiens
ugacagugugagacuuugucuc

SEQ ID NO: 47582 - RNA, 22 nt, Homo sapiens
ugacagugugagauccugucuc

SEQ ID NO: 47583 - RNA, 22 nt, Homo sapiens
ugacaguuuccagggcugucuc

SEQ ID NO: 47584 - RNA, 22 nt, Homo sapiens
ugacauguagagaacuucucau

SEQ ID NO: 47585 - RNA, 19 nt, Homo sapiens
ugaccagggacagaaacca

SEQ ID NO: 47586 - RNA, 22 nt, Homo sapiens
gugagaugugacuucugccucu

SEQ ID NO: 47587 - RNA, 22 nt, Homo sapiens
gugaucuucauggaaggugaaa

SEQ ID NO: 47588 - RNA, 22 nt, Homo sapiens
gugcaaauguuauugagguuuu

SEQ ID NO: 47589 - RNA, 21 nt, Homo sapiens
gugcaacucccucucccuaca

SEQ ID NO: 47590 - RNA, 22 nt, Homo sapiens
gugcaagagugacugcaguuuu

SEQ ID NO: 47591 - RNA, 22 nt, Homo sapiens
gugcaaugagaaggggcucugg

SEQ ID NO: 47592 - RNA, 22 nt, Homo sapiens
gugcacaaaucuuaaauguaca

SEQ ID NO: 47593 - RNA, 22 nt, Homo sapiens
gugcagugugauccuuccguau

SEQ ID NO: 47594 - RNA, 22 nt, Homo sapiens
gugccacaguguuaagggauuc

SEQ ID NO: 47595 - RNA, 22 nt, Homo sapiens
gugcccacugucuguccuguag

SEQ ID NO: 47596 - RNA, 22 nt, Homo sapiens
guggaaaacauaugcuuguuga

SEQ ID NO: 47597 - RNA, 20 nt, Homo sapiens
guggaagauaaguagccuga

SEQ ID NO: 47598 - RNA, 22 nt, Homo sapiens
guggaagcacaggccuccugga

SEQ ID NO: 47599 - RNA, 22 nt, Homo sapiens
guggaaugaaaacucucucaca

SEQ ID NO: 47600 - RNA, 22 nt, Homo sapiens
guggcaugaaagcaucugugau

SEQ ID NO: 47601 - RNA, 22 nt, Homo sapiens
gugggaugaucacaguucacug

SEQ ID NO: 47602 - RNA, 22 nt, Homo sapiens
gugguguuugagcugccaggga

SEQ ID NO: 47603 - RNA, 22 nt, Homo sapiens
guguaauacacacauauaugca

SEQ ID NO: 47604 - RNA, 22 nt, Homo sapiens
guguauguuguccauggaugcg

SEQ ID NO: 47605 - RNA, 22 nt, Homo sapiens
gugucacagcuuccaucucggu

SEQ ID NO: 47606 - RNA, 22 nt, Homo sapiens
gugugcaauuuugugggaggca

SEQ ID NO: 47607 - RNA, 22 nt, Homo sapiens
guuaagaaguguaacuuaaguu

SEQ ID NO: 47608 - RNA, 22 nt, Homo sapiens
guuagguagaaguuuacuuuga

SEQ ID NO: 47609 - RNA, 20 nt, Homo sapiens
guucacaggcuuccuuucag

SEQ ID NO: 47610 - RNA, 22 nt, Homo sapiens
guucacagugguugccuuccag

SEQ ID NO: 47611 - RNA, 22 nt, Homo sapiens
guucacaguucagccuguaaca

SEQ ID NO: 47612 - RNA, 22 nt, Homo sapiens
guucacucuggagaauauugac

SEQ ID NO: 47613 - RNA, 22 nt, Homo sapiens
guucaucagggauacuggcuua

SEQ ID NO: 47614 - RNA, 22 nt, Homo sapiens
guucaucagggauauuggcuua

SEQ ID NO: 47615 - RNA, 22 nt, Homo sapiens
guucuggagauaaagccaaggu

SEQ ID NO: 47616 - RNA, 22 nt, Homo sapiens
guuggaauguauugcuacuucu

SEQ ID NO: 47617 - RNA, 22 nt, Homo sapiens
guuggaauuaaaaggcaaguau

SEQ ID NO: 47618 - RNA, 22 nt, Homo sapiens
guuuacagucgacuugggaaua

SEQ ID NO: 47619 - RNA, 22 nt, Homo sapiens
guuugcauagugcugggagggg

SEQ ID NO: 47620 - RNA, 21 nt, Homo sapiens
uaaaacuguaacuuuguccug

SEQ ID NO: 47621 - RNA, 22 nt, Homo sapiens
uaaacacucacuucauagccau

SEQ ID NO: 47622 - RNA, 22 nt, Homo sapiens
uaaagcugaaaugauuaugaca

SEQ ID NO: 47623 - RNA, 18 nt, Homo sapiens
uaaaggcacuguguuguu

SEQ ID NO: 47624 - RNA, 22 nt, Homo sapiens
uaaauugcauaaguacaaauga

SEQ ID NO: 47625 - RNA, 22 nt, Homo sapiens
uaacaacauucuaacugacggc

SEQ ID NO: 47626 - RNA, 22 nt, Homo sapiens
uaacugucucccuugguccuga

SEQ ID NO: 47627 - RNA, 22 nt, Homo sapiens
uaacuguggaaaugacuuuaaa

SEQ ID NO: 47628 - RNA, 22 nt, Homo sapiens
augaggcuauaauuuuuaugua

SEQ ID NO: 47629 - RNA, 22 nt, Homo sapiens
augaguaguugcuaaauauuga

SEQ ID NO: 47630 - RNA, 22 nt, Homo sapiens
augaguaugagaauacauuaag

SEQ ID NO: 47631 - RNA, 15 nt, Homo sapiens
augaguuuuauggag

SEQ ID NO: 47632 - RNA, 22 nt, Homo sapiens
augauacugaguugaguucuca

SEQ ID NO: 47633 - RNA, 22 nt, Homo sapiens
augauacuggcuucauagaaug

SEQ ID NO: 47634 - RNA, 22 nt, Homo sapiens
augauagguuuagguuuagaca

SEQ ID NO: 47635 - RNA, 22 nt, Homo sapiens
augcaaacaucauagaguguac

SEQ ID NO: 47636 - RNA, 22 nt, Homo sapiens
augcaaacaucugaagagacau

SEQ ID NO: 47637 - RNA, 22 nt, Homo sapiens
augcaagaaauaucucuuuuuc

SEQ ID NO: 47638 - RNA, 22 nt, Homo sapiens
augcaagacaccgauuagcuuu

SEQ ID NO: 47639 - RNA, 22 nt, Homo sapiens
augcacuguauaggaucuugcg

SEQ ID NO: 47640 - RNA, 22 nt, Homo sapiens
augcauauuuuaccuagaagag

SEQ ID NO: 47641 - RNA, 22 nt, Homo sapiens
augccacugcacuccaaccugg

SEQ ID NO: 47642 - RNA, 22 nt, Homo sapiens
augccacuguuuaugucacuua

SEQ ID NO: 47643 - RNA, 22 nt, Homo sapiens
augccagggagaauuguucaag

SEQ ID NO: 47644 - RNA, 22 nt, Homo sapiens
augcuacuggauuuguauaaau

SEQ ID NO: 47645 - RNA, 22 nt, Homo sapiens
auggaagaaacgauuuucugga

SEQ ID NO: 47646 - RNA, 22 nt, Homo sapiens
auggaaugguugggucauaagg

SEQ ID NO: 47647 - RNA, 22 nt, Homo sapiens
auggagaugaacuuggguaaag

SEQ ID NO: 47648 - RNA, 22 nt, Homo sapiens
auggagaugugcgaacugagua

SEQ ID NO: 47649 - RNA, 22 nt, Homo sapiens
auggauauuuuuugaacauaga

SEQ ID NO: 47650 - RNA, 22 nt, Homo sapiens
auggcucuuauuauuuugaggu

SEQ ID NO: 47651 - RNA, 22 nt, Homo sapiens
auggcuucuucuaaaagugggg

SEQ ID NO: 47652 - RNA, 22 nt, Homo sapiens
augggaaaaucagaaggccugg

SEQ ID NO: 47653 - RNA, 22 nt, Homo sapiens
augucaaggugggugauaguuu

SEQ ID NO: 47654 - RNA, 22 nt, Homo sapiens
augucuagagcaagagaugcug

SEQ ID NO: 47655 - RNA, 22 nt, Homo sapiens
augucuagagugauacugaagc

SEQ ID NO: 47656 - RNA, 22 nt, Homo sapiens
augugaacugaauuaauucaca

SEQ ID NO: 47657 - RNA, 22 nt, Homo sapiens
augugacagugguuuuaagcgu

SEQ ID NO: 47658 - RNA, 22 nt, Homo sapiens
augugacugauguaaucagaca

SEQ ID NO: 47659 - RNA, 22 nt, Homo sapiens
augugugcuugugacacagccu

SEQ ID NO: 47660 - RNA, 22 nt, Homo sapiens
auguuauguucuucucuguaua

SEQ ID NO: 47661 - RNA, 22 nt, Homo sapiens
auuaaggaguggguucauggug

SEQ ID NO: 47662 - RNA, 22 nt, Homo sapiens
auuaauguaauuaguaaaguug

SEQ ID NO: 47663 - RNA, 22 nt, Homo sapiens
auuacauagucaaggugucuca

SEQ ID NO: 47664 - RNA, 20 nt, Homo sapiens
auucauggaggagcaauugg

SEQ ID NO: 47665 - RNA, 22 nt, Homo sapiens
auugacaguuggccaguaagug

SEQ ID NO: 47666 - RNA, 22 nt, Homo sapiens
auugagcuuuuuaaaauauagu

SEQ ID NO: 47667 - RNA, 22 nt, Homo sapiens
auugcaaagcguagacucuaaa

SEQ ID NO: 47668 - RNA, 22 nt, Homo sapiens
auugcaacaguguugagaggug

SEQ ID NO: 47669 - RNA, 22 nt, Homo sapiens
auugcaacuuccgccuccuggg

SEQ ID NO: 47670 - RNA, 22 nt, Homo sapiens
auugccuaacauagauguucag

SEQ ID NO: 47671 - RNA, 22 nt, Homo sapiens
auugcucaaaucaguacuugag

SEQ ID NO: 47672 - RNA, 22 nt, Homo sapiens
auuggcaauggcaaagcagagu

SEQ ID NO: 47673 - RNA, 22 nt, Homo sapiens
auuguaauuuuagagaaagugg

SEQ ID NO: 47674 - RNA, 19 nt, Homo sapiens
auuugaucaucaggcacag

SEQ ID NO: 47675 - RNA, 21 nt, Homo sapiens
auuugcacugagcuccugugc

SEQ ID NO: 47676 - RNA, 22 nt, Homo sapiens
auuuggcaauuuugaagaugcc

SEQ ID NO: 47677 - RNA, 22 nt, Homo sapiens
auuuggcaguauaaugcuuugg

SEQ ID NO: 47678 - RNA, 18 nt, Homo sapiens
auuuuugcaguccacaug

SEQ ID NO: 47679 - RNA, 22 nt, Homo sapiens
caaaguaauugcuguuuugcca

SEQ ID NO: 47680 - RNA, 22 nt, Homo sapiens
caaagugcuggccgggcgcagu

SEQ ID NO: 47681 - RNA, 22 nt, Homo sapiens
caagacuguccaacauauuggg

SEQ ID NO: 47682 - RNA, 22 nt, Homo sapiens
caagaggcuguguauaaagcca

SEQ ID NO: 47683 - RNA, 22 nt, Homo sapiens
caaggcacagccccuacuuccu

SEQ ID NO: 47684 - RNA, 22 nt, Homo sapiens
caagugaauaguugcucucaga

SEQ ID NO: 47685 - RNA, 22 nt, Homo sapiens
caauacuguguugaauaagagu

SEQ ID NO: 47686 - RNA, 21 nt, Homo sapiens
caaugacacuguagcugugcu

SEQ ID NO: 47687 - RNA, 22 nt, Homo sapiens
cacaaaguagauuagucuucca

SEQ ID NO: 47688 - RNA, 22 nt, Homo sapiens
cacaguugccuaucuccugaag

SEQ ID NO: 47689 - RNA, 22 nt, Homo sapiens
caccacauuccauugaucaggc

SEQ ID NO: 47690 - RNA, 22 nt, Homo sapiens
caccagcuggcauugaauaccu

SEQ ID NO: 47691 - RNA, 22 nt, Homo sapiens
ugacuggaaacaguguuauuug

SEQ ID NO: 47692 - RNA, 22 nt, Homo sapiens
ugagaacagauggcuuuauuau

SEQ ID NO: 47693 - RNA, 16 nt, Homo sapiens
ugagaacaugggguau

SEQ ID NO: 47694 - RNA, 22 nt, Homo sapiens
ugagaacaugugauauuuggug

SEQ ID NO: 47695 - RNA, 20 nt, Homo sapiens
ugagaacaugugguauuugg

SEQ ID NO: 47696 - RNA, 22 nt, Homo sapiens
ugagaacucaugggucugcugg

SEQ ID NO: 47697 - RNA, 22 nt, Homo sapiens
ugagaaugacugggcaugcugc

SEQ ID NO: 47698 - RNA, 22 nt, Homo sapiens
ugagaauguagggcucucccag

SEQ ID NO: 47699 - RNA, 22 nt, Homo sapiens
ugagacugagucucccucuguc

SEQ ID NO: 47700 - RNA, 22 nt, Homo sapiens
ugagagacaguuuguuaaaauu

SEQ ID NO: 47701 - RNA, 22 nt, Homo sapiens
ugagagcuuuuuugccugguga

SEQ ID NO: 47702 - RNA, 22 nt, Homo sapiens
ugagaggugauaaagcaagggu

SEQ ID NO: 47703 - RNA, 21 nt, Homo sapiens
ugagauaauauguuucugaug

SEQ ID NO: 47704 - RNA, 22 nt, Homo sapiens
ugagauaaucaugugauuucau

SEQ ID NO: 47705 - RNA, 22 nt, Homo sapiens
ugagauaaugcaugugaagauc

SEQ ID NO: 47706 - RNA, 22 nt, Homo sapiens
ugagaucaguuguuauaauucu

SEQ ID NO: 47707 - RNA, 22 nt, Homo sapiens
ugagaugagaaucaguucuaau

SEQ ID NO: 47708 - RNA, 22 nt, Homo sapiens
ugagaugauuuaauggagccca

SEQ ID NO: 47709 - RNA, 22 nt, Homo sapiens
ugagauggagucuugucgccua

SEQ ID NO: 47710 - RNA, 22 nt, Homo sapiens
ugagauggaguuucgcuuuugu

SEQ ID NO: 47711 - RNA, 22 nt, Homo sapiens
ugagauguuccaaugacuauua

SEQ ID NO: 47712 - RNA, 23 nt, Homo sapiens
ugagauuacccagaaagaguaua

SEQ ID NO: 47713 - RNA, 22 nt, Homo sapiens
ugagauuauauuucuuaacaga

SEQ ID NO: 47714 - RNA, 22 nt, Homo sapiens
ugagcaauaaaguuacacaguu

SEQ ID NO: 47715 - RNA, 22 nt, Homo sapiens
ugagcugagaucaugcuauugu

SEQ ID NO: 47716 - RNA, 20 nt, Homo sapiens
ugagcuuguaaacacuguuu

SEQ ID NO: 47717 - RNA, 22 nt, Homo sapiens
ugaggacugagaggcacugugg

SEQ ID NO: 47718 - RNA, 22 nt, Homo sapiens
ugaggcaagauacugauuucau

SEQ ID NO: 47719 - RNA, 22 nt, Homo sapiens
ugagggaugcguacccuaugcc

SEQ ID NO: 47720 - RNA, 22 nt, Homo sapiens
ugagguuggggucagggcuagc

SEQ ID NO: 47721 - RNA, 22 nt, Homo sapiens
ugaguagaacuagucuagagcu

SEQ ID NO: 47722 - RNA, 22 nt, Homo sapiens
ugaguauagaucaguucaagug

SEQ ID NO: 47723 - RNA, 22 nt, Homo sapiens
ugaguauguaggaugugucuua

SEQ ID NO: 47724 - RNA, 22 nt, Homo sapiens
ugagucaugcuggagucauggc

SEQ ID NO: 47725 - RNA, 22 nt, Homo sapiens
ugagucuguucucacauugcua

SEQ ID NO: 47726 - RNA, 22 nt, Homo sapiens
ugaguuaaucucuacgauagaa

SEQ ID NO: 47727 - RNA, 22 nt, Homo sapiens
ugaguuccuugugugaccuugc

SEQ ID NO: 47728 - RNA, 22 nt, Homo sapiens
ugaguuguaggggucaccuggc

SEQ ID NO: 47729 - RNA, 22 nt, Homo sapiens
ugauaacauugggggaagcuga

SEQ ID NO: 47730 - RNA, 22 nt, Homo sapiens
ugauaucugaucauccuugaua

SEQ ID NO: 47731 - RNA, 22 nt, Homo sapiens
ugauauguguaaacaauguaua

SEQ ID NO: 47732 - RNA, 20 nt, Homo sapiens
ugauauuucuggaaguggag

SEQ ID NO: 47733 - RNA, 20 nt, Homo sapiens
cucacagacagcuucuuucu

SEQ ID NO: 47734 - RNA, 20 nt, Homo sapiens
cucaccagguguaggcugag

SEQ ID NO: 47735 - RNA, 22 nt, Homo sapiens
cucaccuugugauccaccggcc

SEQ ID NO: 47736 - RNA, 22 nt, Homo sapiens
cuccaggugucauccaccuccu

SEQ ID NO: 47737 - RNA, 20 nt, Homo sapiens
cucccugacaaauguggaaa

SEQ ID NO: 47738 - RNA, 20 nt, Homo sapiens
cuccuucauuccuuuggacc

SEQ ID NO: 47739 - RNA, 22 nt, Homo sapiens
cucugagguuauucguaauauu

SEQ ID NO: 47740 - RNA, 22 nt, Homo sapiens
cucugcuuaaugucccacuuga

SEQ ID NO: 47741 - RNA, 22 nt, Homo sapiens
cucugguuaaggcugaacuaua

SEQ ID NO: 47742 - RNA, 22 nt, Homo sapiens
cucugguucugcagugcacccu

SEQ ID NO: 47743 - RNA, 21 nt, Homo sapiens
cucugguuugcauuggauuau

SEQ ID NO: 47744 - RNA, 22 nt, Homo sapiens
cugaaggcagguagaauagaga

SEQ ID NO: 47745 - RNA, 22 nt, Homo sapiens
cugaauguuucacucugaaaug

SEQ ID NO: 47746 - RNA, 22 nt, Homo sapiens
cugagcaaagaagugauaauga

SEQ ID NO: 47747 - RNA, 22 nt, Homo sapiens
cugaggaaguucuuuaacaguu

SEQ ID NO: 47748 - RNA, 20 nt, Homo sapiens
cugagguacgaggguuaaau

SEQ ID NO: 47749 - RNA, 22 nt, Homo sapiens
cugagguagcucaggguauugc

SEQ ID NO: 47750 - RNA, 22 nt, Homo sapiens
cugauaguucucuuuagaguuu

SEQ ID NO: 47751 - RNA, 22 nt, Homo sapiens
cugcaaauacuugugggauuuu

SEQ ID NO: 47752 - RNA, 22 nt, Homo sapiens
cugcuaagagaaugagacuuag

SEQ ID NO: 47753 - RNA, 22 nt, Homo sapiens
cuggaauuacaggguugagcua

SEQ ID NO: 47754 - RNA, 22 nt, Homo sapiens
cuggagucugacugacacaagg

SEQ ID NO: 47755 - RNA, 22 nt, Homo sapiens
cuggcaaauguuuucuguaaag

SEQ ID NO: 47756 - RNA, 22 nt, Homo sapiens
cugggaugugacuguugccccc

SEQ ID NO: 47757 - RNA, 19 nt, Homo sapiens
cugucacugaggaagacug

SEQ ID NO: 47758 - RNA, 22 nt, Homo sapiens
cugugcaaacaagugaaccccu

SEQ ID NO: 47759 - RNA, 22 nt, Homo sapiens
cugugcaaguuauaggccaggu

SEQ ID NO: 47760 - RNA, 19 nt, Homo sapiens
cugugcauuucuguggaag

SEQ ID NO: 47761 - RNA, 22 nt, Homo sapiens
cugugcuugagagaugacacag

SEQ ID NO: 47762 - RNA, 23 nt, Homo sapiens
cuguggugaggcccuagaaucug

SEQ ID NO: 47763 - RNA, 22 nt, Homo sapiens
cuguucaaauuguuugugaagu

SEQ ID NO: 47764 - RNA, 19 nt, Homo sapiens
cuguuguacuccaggcauu

SEQ ID NO: 47765 - RNA, 20 nt, Homo sapiens
cuuaaugcagcauuucucag

SEQ ID NO: 47766 - RNA, 22 nt, Homo sapiens
cuucaguucuguaaggacagca

SEQ ID NO: 47767 - RNA, 22 nt, Homo sapiens
cuuccagcuggguucagucagu

SEQ ID NO: 47768 - RNA, 22 nt, Homo sapiens
cuucuguuaguucugauaacuu

SEQ ID NO: 47769 - RNA, 22 nt, Homo sapiens
cuugccuaaucugcaugauuuu

SEQ ID NO: 47770 - RNA, 22 nt, Homo sapiens
cuuggauuauaauggaauauuu

SEQ ID NO: 47771 - RNA, 22 nt, Homo sapiens
cuuggcauuguguugauagaag

SEQ ID NO: 47772 - RNA, 22 nt, Homo sapiens
cuuuacaguuggacucacgagg

SEQ ID NO: 47773 - RNA, 22 nt, Homo sapiens
cuuugcaaaacauugagaccuc

SEQ ID NO: 47774 - RNA, 22 nt, Homo sapiens
cuuuggcacuuccuaagugcca

SEQ ID NO: 47775 - RNA, 22 nt, Homo sapiens
cuuuguggggucuuuccucaaa

SEQ ID NO: 47776 - RNA, 22 nt, Homo sapiens
cuuuuacacuguuggcaggauu

SEQ ID NO: 47777 - RNA, 22 nt, Homo sapiens
cuuuuacacuguuggugggaau

SEQ ID NO: 47778 - RNA, 22 nt, Homo sapiens
cuuuuugcugcagcaauacugg

SEQ ID NO: 47779 - RNA, 22 nt, Homo sapiens
gaagaaguacaagacaaauuuu

SEQ ID NO: 47780 - RNA, 23 nt, Homo sapiens
gaaguaauaaauggauucuuaac

SEQ ID NO: 47781 - RNA, 22 nt, Homo sapiens
gaaguaguaaaauuuauugcag

SEQ ID NO: 47782 - RNA, 22 nt, Homo sapiens
gaagugcaguggcacagucaug

SEQ ID NO: 47783 - RNA, 22 nt, Homo sapiens
gaauacugacuauuucaucugg

SEQ ID NO: 47784 - RNA, 22 nt, Homo sapiens
gaauacuguccaagagugaugg

SEQ ID NO: 47785 - RNA, 22 nt, Homo sapiens
gaauagugcugcaaugaacaua

SEQ ID NO: 47786 - RNA, 22 nt, Homo sapiens
gaaucaauugaucuaugugucu

SEQ ID NO: 47787 - RNA, 22 nt, Homo sapiens
gaaucacaguuauuagagcagc

SEQ ID NO: 47788 - RNA, 22 nt, Homo sapiens
gaauggaacugacuauagcuga

SEQ ID NO: 47789 - RNA, 22 nt, Homo sapiens
gaauguuuacuuuguuuaauac

SEQ ID NO: 47790 - RNA, 22 nt, Homo sapiens
gacagguuuucuguuucugaaa

SEQ ID NO: 47791 - RNA, 22 nt, Homo sapiens
gacagugagaugucaugugaaa

SEQ ID NO: 47792 - RNA, 18 nt, Homo sapiens
gacaguguggcaauuccu

SEQ ID NO: 47793 - RNA, 22 nt, Homo sapiens
gacauguuuucaagauuuauaa

SEQ ID NO: 47794 - RNA, 18 nt, Homo sapiens
gacuuggaguuuacagug

SEQ ID NO: 47795 - RNA, 22 nt, Homo sapiens
gagaacauacggcauuugguuu

SEQ ID NO: 47796 - RNA, 22 nt, Homo sapiens
ugucucccuucccauuaggaag

SEQ ID NO: 47797 - RNA, 21 nt, Homo sapiens
ugucugagagaggagaucuac

SEQ ID NO: 47798 - RNA, 22 nt, Homo sapiens
ugucuggaaggguggccuccug

SEQ ID NO: 47799 - RNA, 22 nt, Homo sapiens
ugugaaacauggauagaacugg

SEQ ID NO: 47800 - RNA, 22 nt, Homo sapiens
ugugaauggugcugcaaugaac

SEQ ID NO: 47801 - RNA, 21 nt, Homo sapiens
ugugaccucugucucugaguc

SEQ ID NO: 47802 - RNA, 22 nt, Homo sapiens
ugugauugauuaaugugugcua

SEQ ID NO: 47803 - RNA, 22 nt, Homo sapiens
ugugcaaaaacaauugcgguuu

SEQ ID NO: 47804 - RNA, 22 nt, Homo sapiens
ugugcaaucuuccauuuuuagg

SEQ ID NO: 47805 - RNA, 22 nt, Homo sapiens
ugugguuuuuuucuccaauagg

SEQ ID NO: 47806 - RNA, 22 nt, Homo sapiens
uguguaaauaugauagaggaau

SEQ ID NO: 47807 - RNA, 22 nt, Homo sapiens
uguguacaucucuacacacaug

SEQ ID NO: 47808 - RNA, 22 nt, Homo sapiens
uguguagagaaauauuacuuau

SEQ ID NO: 47809 - RNA, 22 nt, Homo sapiens
uguuuguuugagauggagucuc

SEQ ID NO: 47810 - RNA, 22 nt, Homo sapiens
uuaacagucacuuagcucauuu

SEQ ID NO: 47811 - RNA, 23 nt, Homo sapiens
uuaagcaacggcugcuuuucaga

SEQ ID NO: 47812 - RNA, 22 nt, Homo sapiens
uuaaggcuccuguuggcuuuua

SEQ ID NO: 47813 - RNA, 22 nt, Homo sapiens
uuaaggcuuguacuuguuuucu

SEQ ID NO: 47814 - RNA, 22 nt, Homo sapiens
uuaaguagaugaaugugaaugu

SEQ ID NO: 47815 - RNA, 22 nt, Homo sapiens
uuaaucaggccguuuccuaaga

SEQ ID NO: 47816 - RNA, 22 nt, Homo sapiens
uuaauguaucuaucacaucaca

SEQ ID NO: 47817 - RNA, 22 nt, Homo sapiens
uuacaguagaugaggguauaau

SEQ ID NO: 47818 - RNA, 22 nt, Homo sapiens
uuacaguaugaguaagaguucu

SEQ ID NO: 47819 - RNA, 20 nt, Homo sapiens
uuacagugggaccuuccuga

SEQ ID NO: 47820 - RNA, 22 nt, Homo sapiens
uuacaguggugaccuuguauug

SEQ ID NO: 47821 - RNA, 19 nt, Homo sapiens
uuacagugugcccuuuuag

SEQ ID NO: 47822 - RNA, 22 nt, Homo sapiens
uuagaacaguguuugccucgcu

SEQ ID NO: 47823 - RNA, 22 nt, Homo sapiens
uuagcacugucuacucuggauu

SEQ ID NO: 47824 - RNA, 22 nt, Homo sapiens
uuaggcuuuucagacacuucau

SEQ ID NO: 47825 - RNA, 20 nt, Homo sapiens
uuaguucauuuagaagguuu

SEQ ID NO: 47826 - RNA, 22 nt, Homo sapiens
uuaguuuaucagugguuucuga

SEQ ID NO: 47827 - RNA, 22 nt, Homo sapiens
uuauccagcgcuguuuuggaga

SEQ ID NO: 47828 - RNA, 22 nt, Homo sapiens
uuaucccacuuucuguuccugu

SEQ ID NO: 47829 - RNA, 22 nt, Homo sapiens
uuaugcagcaaagugcuugaaa

SEQ ID NO: 47830 - RNA, 22 nt, Homo sapiens
uuauguaggcuauagcucugca

SEQ ID NO: 47831 - RNA, 22 nt, Homo sapiens
uuauguguuuaauguuucugaa

SEQ ID NO: 47832 - RNA, 22 nt, Homo sapiens
uucacuguagcuuggauguuua

SEQ ID NO: 47833 - RNA, 22 nt, Homo sapiens
uucagagagggagggauaccua

SEQ ID NO: 47834 - RNA, 22 nt, Homo sapiens
uucagguucauuugcugcuauu

SEQ ID NO: 47835 - RNA, 22 nt, Homo sapiens
uucaguaaauguucuuacuaua

SEQ ID NO: 47836 - RNA, 22 nt, Homo sapiens
uucaguaguaaguuggaacucu

SEQ ID NO: 47837 - RNA, 22 nt, Homo sapiens
uucaguaguacauucccguguu

SEQ ID NO: 47838 - RNA, 22 nt, Homo sapiens
ugccauugcacuccagccuggg

SEQ ID NO: 47839 - RNA, 23 nt, Homo sapiens
ugccuagaugcugcccugggaca

SEQ ID NO: 47840 - RNA, 22 nt, Homo sapiens
ugccuaggcuggaaugcaaugg

SEQ ID NO: 47841 - RNA, 22 nt, Homo sapiens
ugccuaguggaaggagagcaaa

SEQ ID NO: 47842 - RNA, 22 nt, Homo sapiens
ugcuauguuuucccuccuuauc

SEQ ID NO: 47843 - RNA, 22 nt, Homo sapiens
ugcucaccugcugcucaccucc

SEQ ID NO: 47844 - RNA, 19 nt, Homo sapiens
ugcugcauugugaccuugc

SEQ ID NO: 47845 - RNA, 22 nt, Homo sapiens
ugcugcuguuguuguuacuagc

SEQ ID NO: 47846 - RNA, 22 nt, Homo sapiens
ugcuuaggcuaacaaaaauagc

SEQ ID NO: 47847 - RNA, 22 nt, Homo sapiens
ugcuucauuggccaccaggaag

SEQ ID NO: 47848 - RNA, 22 nt, Homo sapiens
uggaagacauugggugaagggu

SEQ ID NO: 47849 - RNA, 22 nt, Homo sapiens
uggaagcauagcagcgugugug

SEQ ID NO: 47850 - RNA, 22 nt, Homo sapiens
uggaagucaugcugcaagaaca

SEQ ID NO: 47851 - RNA, 21 nt, Homo sapiens
uggaaugaauggccaacaugg

SEQ ID NO: 47852 - RNA, 22 nt, Homo sapiens
uggaaugggauuggaaauuuug

SEQ ID NO: 47853 - RNA, 22 nt, Homo sapiens
uggaaugguuggugugauuuua

SEQ ID NO: 47854 - RNA, 21 nt, Homo sapiens
uggaauuaauggagagguguu

SEQ ID NO: 47855 - RNA, 22 nt, Homo sapiens
uggacaagugcccuccaccuca

SEQ ID NO: 47856 - RNA, 22 nt, Homo sapiens
uggacagagagaccggcauuuu

SEQ ID NO: 47857 - RNA, 21 nt, Homo sapiens
uggaccccuacuucucaccau

SEQ ID NO: 47858 - RNA, 22 nt, Homo sapiens
uggaccccugcucgggagcccu

SEQ ID NO: 47859 - RNA, 19 nt, Homo sapiens
uggaccccuuccuuacacc

SEQ ID NO: 47860 - RNA, 22 nt, Homo sapiens
uggaguguaaauuaguucagcc

SEQ ID NO: 47861 - RNA, 22 nt, Homo sapiens
uggaguguagcggcaccuauua

SEQ ID NO: 47862 - RNA, 22 nt, Homo sapiens
uggaucuguucuauuuaucuga

SEQ ID NO: 47863 - RNA, 22 nt, Homo sapiens
uggcaaaaaaacgcaauuacgu

SEQ ID NO: 47864 - RNA, 22 nt, Homo sapiens
uggcaagaagagcaugagacca

SEQ ID NO: 47865 - RNA, 22 nt, Homo sapiens
uggcaagagaacaacaucucuc

SEQ ID NO: 47866 - RNA, 22 nt, Homo sapiens
uggcagugggagauauuuuauu

SEQ ID NO: 47867 - RNA, 22 nt, Homo sapiens
uggcaguuucauaugguucaac

SEQ ID NO: 47868 - RNA, 22 nt, Homo sapiens
uggcaugaaguguguuuuaucu

SEQ ID NO: 47869 - RNA, 22 nt, Homo sapiens
uggcauuguccaauaaaauuuu

SEQ ID NO: 47870 - RNA, 22 nt, Homo sapiens
uggccuguaacccucucauagg

SEQ ID NO: 47871 - RNA, 22 nt, Homo sapiens
uggcucauuucuaaacccagcu

SEQ ID NO: 47872 - RNA, 22 nt, Homo sapiens
ugggaacugaggugaaaagaca

SEQ ID NO: 47873 - RNA, 22 nt, Homo sapiens
ugggaccccuacucuuuccaca

SEQ ID NO: 47874 - RNA, 22 nt, Homo sapiens
ugggaugaauacaaugggauca

SEQ ID NO: 47875 - RNA, 22 nt, Homo sapiens
ugggaugauguuaaacguacuc

SEQ ID NO: 47876 - RNA, 22 nt, Homo sapiens
ugggaugugagucuucgcuuuc

SEQ ID NO: 47877 - RNA, 22 nt, Homo sapiens
ugggcagugggacagcuuugug

SEQ ID NO: 47878 - RNA, 22 nt, Homo sapiens
ugguaagaggcccugaguuugu

SEQ ID NO: 47879 - RNA, 22 nt, Homo sapiens
ugguauguaugauuaacaugga

SEQ ID NO: 47880 - RNA, 22 nt, Homo sapiens
ugguauuuaauauaugagaguu

SEQ ID NO: 47881 - RNA, 20 nt, Homo sapiens
uggucaccuucaggagguuc

SEQ ID NO: 47882 - RNA, 22 nt, Homo sapiens
uggucaugaggugaggcuucuc

SEQ ID NO: 47883 - RNA, 22 nt, Homo sapiens
uggucauggaaauagaaugcac

SEQ ID NO: 47884 - RNA, 21 nt, Homo sapiens
uggucccauaagauuacaaug

SEQ ID NO: 47885 - RNA, 15 nt, Homo sapiens
uggugguguugagac

SEQ ID NO: 47886 - RNA, 22 nt, Homo sapiens
uguaaacucaguauguuuuacu

SEQ ID NO: 47887 - RNA, 22 nt, Homo sapiens
uguacccuuagagagugaucga

SEQ ID NO: 47888 - RNA, 21 nt, Homo sapiens
uguagcagcaugauucauagu

SEQ ID NO: 47889 - RNA, 21 nt, Homo sapiens
ugucaagugggaaaacaugua

SEQ ID NO: 47890 - RNA, 22 nt, Homo sapiens
ugucaccuugcucauccucgga

SEQ ID NO: 47891 - RNA, 22 nt, Homo sapiens
ugucauguagaaauuguccauu

SEQ ID NO: 47892 - RNA, 22 nt, Homo sapiens
ugucauguuucuacugaccaaa

SEQ ID NO: 47893 - RNA, 22 nt, Homo sapiens
uguccuagagggaugucacccc

SEQ ID NO: 47894 - RNA, 21 nt, Homo sapiens
ugucgugcaggaucuguggga

SEQ ID NO: 47895 - RNA, 22 nt, Homo sapiens
ugucuacugaugauguaguuaa

SEQ ID NO: 47896 - RNA, 23 nt, Homo sapiens
cuacuagucaagucuuuuccagu

SEQ ID NO: 47897 - RNA, 22 nt, Homo sapiens
cuaugguaggggcuggaggaag

SEQ ID NO: 47898 - RNA, 22 nt, Homo sapiens
cuauucacaggcaauauguaca

SEQ ID NO: 47899 - RNA, 22 nt, Homo sapiens
cuauuugcauucagaggcaugu

SEQ ID NO: 47900 - RNA, 22 nt, Homo sapiens
cucaaguagugguuuucauuga

SEQ ID NO: 47901 - RNA, 22 nt, Homo sapiens
cucaccuugugauccacccacc

SEQ ID NO: 47902 - RNA, 22 nt, Homo sapiens
cucaccuugugauccuccugcc

SEQ ID NO: 47903 - RNA, 22 nt, Homo sapiens
cucacugucaacauguauuugg

SEQ ID NO: 47904 - RNA, 22 nt, Homo sapiens
cucagcaguggauuuaccacca

SEQ ID NO: 47905 - RNA, 22 nt, Homo sapiens
cucagcuacuugagaggcuuag

SEQ ID NO: 47906 - RNA, 22 nt, Homo sapiens
cucagggugguggacucuaaua

SEQ ID NO: 47907 - RNA, 22 nt, Homo sapiens
cucaguuuugccuuguuuaagg

SEQ ID NO: 47908 - RNA, 21 nt, Homo sapiens
cucauauugcuuuuccauggu

SEQ ID NO: 47909 - RNA, 22 nt, Homo sapiens
cucauuaguuguuuuaagauga

SEQ ID NO: 47910 - RNA, 22 nt, Homo sapiens
cucauugcaaucuccaccuccc

SEQ ID NO: 47911 - RNA, 23 nt, Homo sapiens
cuccaugagccguccagggccug

SEQ ID NO: 47912 - RNA, 22 nt, Homo sapiens
cucccuuugcugaauguuuuuc

SEQ ID NO: 47913 - RNA, 22 nt, Homo sapiens
cucucuguuugucuguuauugg

SEQ ID NO: 47914 - RNA, 19 nt, Homo sapiens
cucuuuggugucucuucuu

SEQ ID NO: 47915 - RNA, 22 nt, Homo sapiens
cugaaaagcaucugcauagcug

SEQ ID NO: 47916 - RNA, 22 nt, Homo sapiens
cugaaagagcauguaacacagu

SEQ ID NO: 47917 - RNA, 22 nt, Homo sapiens
cugaaaguuauucaggggcaag

SEQ ID NO: 47918 - RNA, 22 nt, Homo sapiens
cugaauagagcacacugauggg

SEQ ID NO: 47919 - RNA, 22 nt, Homo sapiens
cugagaacaucauucagauauu

SEQ ID NO: 47920 - RNA, 22 nt, Homo sapiens
cugagaagaaacagguaaggac

SEQ ID NO: 47921 - RNA, 22 nt, Homo sapiens
cugagaguugaugaaauauggu

SEQ ID NO: 47922 - RNA, 22 nt, Homo sapiens
cugagauaauuucuagguguca

SEQ ID NO: 47923 - RNA, 22 nt, Homo sapiens
cugagaucuuauuagaaaugca

SEQ ID NO: 47924 - RNA, 22 nt, Homo sapiens
cugagauggagucucgcauugu

SEQ ID NO: 47925 - RNA, 22 nt, Homo sapiens
cugaggacaucagggaagcauc

SEQ ID NO: 47926 - RNA, 22 nt, Homo sapiens
cugaggauauucagccucugug

SEQ ID NO: 47927 - RNA, 20 nt, Homo sapiens
cugagguugggguccuuccc

SEQ ID NO: 47928 - RNA, 20 nt, Homo sapiens
cugauacagccugagcucuc

SEQ ID NO: 47929 - RNA, 22 nt, Homo sapiens
cugccuagauguuguagggggu

SEQ ID NO: 47930 - RNA, 22 nt, Homo sapiens
cuggaaagaaacccuuaauucu

SEQ ID NO: 47931 - RNA, 22 nt, Homo sapiens
cuggaaagcaaagggugcauug

SEQ ID NO: 47932 - RNA, 22 nt, Homo sapiens
cuggaagcacaacgcauuuauu

SEQ ID NO: 47933 - RNA, 22 nt, Homo sapiens
cuggaaggaaaaacaaccacag

SEQ ID NO: 47934 - RNA, 22 nt, Homo sapiens
cuggagauauuggaagaaagaa

SEQ ID NO: 47935 - RNA, 20 nt, Homo sapiens
cuggaugucgaggcagaggu

SEQ ID NO: 47936 - RNA, 22 nt, Homo sapiens
cuggugagaugucuuuccucuu

SEQ ID NO: 47937 - RNA, 21 nt, Homo sapiens
cugguguuagcacuucuuccc

SEQ ID NO: 47938 - RNA, 22 nt, Homo sapiens
cuguaguuagcagaugaugaau

SEQ ID NO: 47939 - RNA, 22 nt, Homo sapiens
cugucacugggaggggcagcag

SEQ ID NO: 47940 - RNA, 22 nt, Homo sapiens
cugucuggaggccugcaaauaa

SEQ ID NO: 47941 - RNA, 22 nt, Homo sapiens
cugucuguuucaaaagugguua

SEQ ID NO: 47942 - RNA, 22 nt, Homo sapiens
cugugaagaaagucauugguag

SEQ ID NO: 47943 - RNA, 22 nt, Homo sapiens
cugugauuauauaguuaaggua

SEQ ID NO: 47944 - RNA, 22 nt, Homo sapiens
cugugcuugauuauaugagugu

SEQ ID NO: 47945 - RNA, 23 nt, Homo sapiens
cuguggauaugaguuguaaaugg

SEQ ID NO: 47946 - RNA, 22 nt, Homo sapiens
cugugguauuauuagaaauauc

SEQ ID NO: 47947 - RNA, 22 nt, Homo sapiens
cuguuagguuaaggaauggcaa

SEQ ID NO: 47948 - RNA, 18 nt, Homo sapiens
cuuaacauugggaugaua

SEQ ID NO: 47949 - RNA, 22 nt, Homo sapiens
cuucaaguaauucugauggcua

SEQ ID NO: 47950 - RNA, 20 nt, Homo sapiens
cuucacagaaguggaaucau

SEQ ID NO: 47951 - RNA, 22 nt, Homo sapiens
cuucaccaguuuggcagucuca

SEQ ID NO: 47952 - RNA, 22 nt, Homo sapiens
cuucugauugaaaauggaguag

SEQ ID NO: 47953 - RNA, 20 nt, Homo sapiens
cuugaagacuaugcugcuga

SEQ ID NO: 47954 - RNA, 22 nt, Homo sapiens
cuugagcuugagauccuuucug

SEQ ID NO: 47955 - RNA, 22 nt, Homo sapiens
cuugcagagcccauggauguca

SEQ ID NO: 47956 - RNA, 22 nt, Homo sapiens
cuugccuuugucuucaaaggcu

SEQ ID NO: 47957 - RNA, 22 nt, Homo sapiens
cuuggguugauugauaaugcca

SEQ ID NO: 47958 - RNA, 22 nt, Homo sapiens
cuugugcaugaccccagguggg

SEQ ID NO: 47959 - RNA, 22 nt, Homo sapiens
cuuguucuccuaagaugaaugc

SEQ ID NO: 47960 - RNA, 22 nt, Homo sapiens
uucaguagucuccauagaaccg

SEQ ID NO: 47961 - RNA, 22 nt, Homo sapiens
uucagugguuauuugugagauu

SEQ ID NO: 47962 - RNA, 22 nt, Homo sapiens
uucaucaggaauauugaccugu

SEQ ID NO: 47963 - RNA, 22 nt, Homo sapiens
uucaucagggguauuggccaau

SEQ ID NO: 47964 - RNA, 21 nt, Homo sapiens
uucaucuggccguauuccagg

SEQ ID NO: 47965 - RNA, 22 nt, Homo sapiens
uucauggaauauugaccauuuu

SEQ ID NO: 47966 - RNA, 22 nt, Homo sapiens
uucauggaguuuaaauuguagu

SEQ ID NO: 47967 - RNA, 20 nt, Homo sapiens
uucaugggagcaaagaggcc

SEQ ID NO: 47968 - RNA, 22 nt, Homo sapiens
uuccaauguuccguguugcagu

SEQ ID NO: 47969 - RNA, 22 nt, Homo sapiens
uuccacaaugguugaacuaauu

SEQ ID NO: 47970 - RNA, 22 nt, Homo sapiens
uuccacaaugguugaacuagcu

SEQ ID NO: 47971 - RNA, 22 nt, Homo sapiens
uuccacagggauuugcauugau

SEQ ID NO: 47972 - RNA, 22 nt, Homo sapiens
uuccaggugggcgugggccugg

SEQ ID NO: 47973 - RNA, 22 nt, Homo sapiens
uuccaguugugagcuauccggg

SEQ ID NO: 47974 - RNA, 22 nt, Homo sapiens
uuccauugugucaucuuggugg

SEQ ID NO: 47975 - RNA, 22 nt, Homo sapiens
uucccguugcugugcuccugcc

SEQ ID NO: 47976 - RNA, 22 nt, Homo sapiens
uucccuguaucuucugccaugu

SEQ ID NO: 47977 - RNA, 22 nt, Homo sapiens
uucccugugugcagaugggugu

SEQ ID NO: 47978 - RNA, 22 nt, Homo sapiens
uucccuuugaauuggaaaggug

SEQ ID NO: 47979 - RNA, 22 nt, Homo sapiens
uuccuacugugcaaaguugcaa

SEQ ID NO: 47980 - RNA, 22 nt, Homo sapiens
uuccuguagcgauuuuaguaau

SEQ ID NO: 47981 - RNA, 22 nt, Homo sapiens
uuccuugugacuaguagugacc

SEQ ID NO: 47982 - RNA, 21 nt, Homo sapiens
uucuacuccggcguuguuuuu

SEQ ID NO: 47983 - RNA, 22 nt, Homo sapiens
uucuucaggccacaaaaauggu

SEQ ID NO: 47984 - RNA, 22 nt, Homo sapiens
uugaagacuaauuuagauaaug

SEQ ID NO: 47985 - RNA, 22 nt, Homo sapiens
uugaauagaaguguugaaagug

SEQ ID NO: 47986 - RNA, 22 nt, Homo sapiens
uugacugggccagacagagauc

SEQ ID NO: 47987 - RNA, 22 nt, Homo sapiens
uugacuguaagauggcuauuac

SEQ ID NO: 47988 - RNA, 22 nt, Homo sapiens
uugacuucagagcugauucaag

SEQ ID NO: 47989 - RNA, 22 nt, Homo sapiens
uugagagaaaaggccaugccuu

SEQ ID NO: 47990 - RNA, 22 nt, Homo sapiens
uugagauagaauaggaauggga

SEQ ID NO: 47991 - RNA, 22 nt, Homo sapiens
uugagauaggagcuguuguucu

SEQ ID NO: 47992 - RNA, 22 nt, Homo sapiens
uugagaucuuuuaggccuuugu

SEQ ID NO: 47993 - RNA, 22 nt, Homo sapiens
uugagauggagucucacgcauu

SEQ ID NO: 47994 - RNA, 22 nt, Homo sapiens
uugagauuauuguguuccuuua

SEQ ID NO: 47995 - RNA, 22 nt, Homo sapiens
uugagcacaguagguuguggcu

SEQ ID NO: 47996 - RNA, 22 nt, Homo sapiens
uugagggaaacauucacaucau

SEQ ID NO: 47997 - RNA, 22 nt, Homo sapiens
uugagggaggcagggcuugucu

SEQ ID NO: 47998 - RNA, 22 nt, Homo sapiens
uugagugaaugaaugauuaaau

SEQ ID NO: 47999 - RNA, 22 nt, Homo sapiens
uugauauuaaguacugaagugg

SEQ ID NO: 48000 - RNA, 22 nt, Homo sapiens
uugauauucugagaagcugaag

SEQ ID NO: 48001 - RNA, 22 nt, Homo sapiens
uugcaagaaaugcagauucuca

SEQ ID NO: 48002 - RNA, 22 nt, Homo sapiens
uugcacagugcuuucuuugccc

SEQ ID NO: 48003 - RNA, 22 nt, Homo sapiens
uugcacauuuuuucuggcagaa

SEQ ID NO: 48004 - RNA, 22 nt, Homo sapiens
uugcaccuuaugucuguucucu

SEQ ID NO: 48005 - RNA, 22 nt, Homo sapiens
uugcacuauaggaaaauguguc

SEQ ID NO: 48006 - RNA, 22 nt, Homo sapiens
uugcacuccagcucuaggugac

SEQ ID NO: 48007 - RNA, 22 nt, Homo sapiens
uugcacuucauguaggccaaag

SEQ ID NO: 48008 - RNA, 22 nt, Homo sapiens
uugcagagaaauuucugguuua

SEQ ID NO: 48009 - RNA, 22 nt, Homo sapiens
uugcagcaaauaggaaugagga

SEQ ID NO: 48010 - RNA, 18 nt, Homo sapiens
uugcaucauuuuguuguu

SEQ ID NO: 48011 - RNA, 22 nt, Homo sapiens
uugcaugguggaacuuggagcu

SEQ ID NO: 48012 - RNA, 22 nt, Homo sapiens
uugccauggaguagaauugaag

SEQ ID NO: 48013 - RNA, 22 nt, Homo sapiens
uugccugagaagccaagaauaa

SEQ ID NO: 48014 - RNA, 22 nt, Homo sapiens
uuggaaaccucugcagguguuu

SEQ ID NO: 48015 - RNA, 22 nt, Homo sapiens
uuggaaacgucaccuuuuccuu

SEQ ID NO: 48016 - RNA, 22 nt, Homo sapiens
uuggaaauauguuaagugucau

SEQ ID NO: 48017 - RNA, 22 nt, Homo sapiens
uuggaaaugguaaaggguuaau

SEQ ID NO: 48018 - RNA, 23 nt, Homo sapiens
uuggaaugagaccuaagaguuuu

SEQ ID NO: 48019 - RNA, 22 nt, Homo sapiens
uuggagagucacuaguuagugc

SEQ ID NO: 48020 - RNA, 22 nt, Homo sapiens
uuggagagugauauucagaugc

SEQ ID NO: 48021 - RNA, 22 nt, Homo sapiens
uuggauuuuaacaaacuaggug

SEQ ID NO: 48022 - RNA, 22 nt, Homo sapiens
uuggauuuugguggcaacucau

SEQ ID NO: 48023 - RNA, 20 nt, Homo sapiens
uuggcauuuagacaagaguu

SEQ ID NO: 48024 - RNA, 22 nt, Homo sapiens
uuggccccucccaaauuucaug

SEQ ID NO: 48025 - RNA, 22 nt, Homo sapiens
uuggcuaugaguccuaugugca

SEQ ID NO: 48026 - RNA, 22 nt, Homo sapiens
uugggaaugcuaaaccucuauu

SEQ ID NO: 48027 - RNA, 22 nt, Homo sapiens
uugggcaauaggaagcaggugg

SEQ ID NO: 48028 - RNA, 22 nt, Homo sapiens
uuggucacugacauguuugaaa

SEQ ID NO: 48029 - RNA, 22 nt, Homo sapiens
uuggucaggcuaaucucgaacg

SEQ ID NO: 48030 - RNA, 22 nt, Homo sapiens
uuggucugcucugauguuuucu

SEQ ID NO: 48031 - RNA, 22 nt, Homo sapiens
uuguaguagcauuauuuauaau

SEQ ID NO: 48032 - RNA, 22 nt, Homo sapiens
uuguauguuguuugucagagaa

SEQ ID NO: 48033 - RNA, 22 nt, Homo sapiens
uugucaaugggugagugcagag

SEQ ID NO: 48034 - RNA, 22 nt, Homo sapiens
uugucacccuacauaacaggga

SEQ ID NO: 48035 - RNA, 22 nt, Homo sapiens
uugucacuauaaauaagcauuu

SEQ ID NO: 48036 - RNA, 22 nt, Homo sapiens
uugucauggucuugauccauua

SEQ ID NO: 48037 - RNA, 22 nt, Homo sapiens
uugucauuuucagaguguuacg

SEQ ID NO: 48038 - RNA, 23 nt, Homo sapiens
uuguccccuccaaagcucauguu

SEQ ID NO: 48039 - RNA, 19 nt, Homo sapiens
uuguccccucuaaaucuca

SEQ ID NO: 48040 - RNA, 22 nt, Homo sapiens
uuguccuccacauuugaucagu

SEQ ID NO: 48041 - RNA, 21 nt, Homo sapiens
uugucuagagaaauauaucuc

SEQ ID NO: 48042 - RNA, 22 nt, Homo sapiens
uugucuugcagcuuaggcauca

SEQ ID NO: 48043 - RNA, 22 nt, Homo sapiens
uugugaauggugccucaguaaa

SEQ ID NO: 48044 - RNA, 22 nt, Homo sapiens
uugugcaaaaguaauugcgguu

SEQ ID NO: 48045 - RNA, 22 nt, Homo sapiens
uugugccacugaagcccuccag

SEQ ID NO: 48046 - RNA, 22 nt, Homo sapiens
uugugguaaucugugacagcag

SEQ ID NO: 48047 - RNA, 22 nt, Homo sapiens
uuguguacuacaguaugccaca

SEQ ID NO: 48048 - RNA, 22 nt, Homo sapiens
uuuaaagcacggaguuuguggc

SEQ ID NO: 48049 - RNA, 22 nt, Homo sapiens
uuuaaaguuagaaggaaagggc

SEQ ID NO: 48050 - RNA, 22 nt, Homo sapiens
uuuaaugcaucccaaaauguag

SEQ ID NO: 48051 - RNA, 22 nt, Homo sapiens
uuuacagucucauagguggaag

SEQ ID NO: 48052 - RNA, 22 nt, Homo sapiens
uuuagguaauauuaaguagcug

SEQ ID NO: 48053 - RNA, 22 nt, Homo sapiens
uuuccauguuggugaaaugagg

SEQ ID NO: 48054 - RNA, 19 nt, Homo sapiens
uuucccugcagaccuacua

SEQ ID NO: 48055 - RNA, 22 nt, Homo sapiens
uuucuacagugaacgauuucua

SEQ ID NO: 48056 - RNA, 22 nt, Homo sapiens
uuucuauguugaccagucuaga

SEQ ID NO: 48057 - RNA, 16 nt, Homo sapiens
uuucuauguuuuacua

SEQ ID NO: 48058 - RNA, 22 nt, Homo sapiens
uuugaagacuacugggagugaa

SEQ ID NO: 48059 - RNA, 22 nt, Homo sapiens
uuugacuuuuagaauaugaguu

SEQ ID NO: 48060 - RNA, 22 nt, Homo sapiens
uuugagaucuuuagaaucaggc

SEQ ID NO: 48061 - RNA, 22 nt, Homo sapiens
uuugagcaagaggugacauuau

SEQ ID NO: 48062 - RNA, 22 nt, Homo sapiens
uuugagcaggcuaaucaauaua

SEQ ID NO: 48063 - RNA, 22 nt, Homo sapiens
uuugaguaggcuuauauuuugg

SEQ ID NO: 48064 - RNA, 22 nt, Homo sapiens
uuugauuguacuaaaauuguac

SEQ ID NO: 48065 - RNA, 22 nt, Homo sapiens
uuugcaagaugaaaaaguucua

SEQ ID NO: 48066 - RNA, 22 nt, Homo sapiens
uuuggcauuuuacuacucaaau

SEQ ID NO: 48067 - RNA, 22 nt, Homo sapiens
uuugggaaugaguuuaucauuu

SEQ ID NO: 48068 - RNA, 22 nt, Homo sapiens
aucaagcuacacccuuuggaaa

SEQ ID NO: 48069 - RNA, 22 nt, Homo sapiens
aucacagagucacgggcaacuu

SEQ ID NO: 48070 - RNA, 22 nt, Homo sapiens
aucacagcccuccucuuggaug

SEQ ID NO: 48071 - RNA, 22 nt, Homo sapiens
aucacagugagcauaugucuau

SEQ ID NO: 48072 - RNA, 22 nt, Homo sapiens
aucaccuuucccuuucugaauc

SEQ ID NO: 48073 - RNA, 22 nt, Homo sapiens
aucacuguccacucaucuuucu

SEQ ID NO: 48074 - RNA, 22 nt, Homo sapiens
aucagauuccacauuuuaucag

SEQ ID NO: 48075 - RNA, 22 nt, Homo sapiens
auccauugucuaaugcuaagau

SEQ ID NO: 48076 - RNA, 22 nt, Homo sapiens
aucccuguguccagcaccugug

SEQ ID NO: 48077 - RNA, 22 nt, Homo sapiens
aucccuuucugauacuuucccu

SEQ ID NO: 48078 - RNA, 22 nt, Homo sapiens
auccuguacuaagguuuuccca

SEQ ID NO: 48079 - RNA, 22 nt, Homo sapiens
aucgcugagaaagggacuuuca

SEQ ID NO: 48080 - RNA, 22 nt, Homo sapiens
aucucauggagguagagaguaa

SEQ ID NO: 48081 - RNA, 22 nt, Homo sapiens
aucugcuccuggugaggguuuc

SEQ ID NO: 48082 - RNA, 22 nt, Homo sapiens
aucugguguuuccuucacauug

SEQ ID NO: 48083 - RNA, 22 nt, Homo sapiens
aucuuuggcgggaauaucacag

SEQ ID NO: 48084 - RNA, 22 nt, Homo sapiens
aucuuuggugaguucuuugguc

SEQ ID NO: 48085 - RNA, 22 nt, Homo sapiens
augaaagguugucuuaagccau

SEQ ID NO: 48086 - RNA, 22 nt, Homo sapiens
augaaaguguguggaaacuuga

SEQ ID NO: 48087 - RNA, 18 nt, Homo sapiens
augaagucaucacuuuua

SEQ ID NO: 48088 - RNA, 22 nt, Homo sapiens
augaaguuagcucauuucuuuu

SEQ ID NO: 48089 - RNA, 22 nt, Homo sapiens
augacacugcagagauguccca

SEQ ID NO: 48090 - RNA, 23 nt, Homo sapiens
augacacuguccuugaccauuuc

SEQ ID NO: 48091 - RNA, 22 nt, Homo sapiens
augacagagauaugugaauuuu

SEQ ID NO: 48092 - RNA, 22 nt, Homo sapiens
augacugaguagcauuccauua

SEQ ID NO: 48093 - RNA, 22 nt, Homo sapiens
augacugucagggcagucauug

SEQ ID NO: 48094 - RNA, 22 nt, Homo sapiens
augagacaguucccuuuaucuu

SEQ ID NO: 48095 - RNA, 22 nt, Homo sapiens
augagauaaaccaucucuuaag

SEQ ID NO: 48096 - RNA, 22 nt, Homo sapiens
augagauauguuaaaaguuaaa

SEQ ID NO: 48097 - RNA, 22 nt, Homo sapiens
augagauauuuuauaagaucau

SEQ ID NO: 48098 - RNA, 22 nt, Homo sapiens
augagaugaggaauggcccucc

SEQ ID NO: 48099 - RNA, 22 nt, Homo sapiens
augaguugaagcuacaagaggc

SEQ ID NO: 48100 - RNA, 22 nt, Homo sapiens
ucacaguugauugaaacacagc

SEQ ID NO: 48101 - RNA, 22 nt, Homo sapiens
ucacaguuggccuggccuuuua

SEQ ID NO: 48102 - RNA, 22 nt, Homo sapiens
ucacaugaagauuuuaguauac

SEQ ID NO: 48103 - RNA, 21 nt, Homo sapiens
ucacauggccagaguaggaac

SEQ ID NO: 48104 - RNA, 22 nt, Homo sapiens
ucacaugggugcaauauaauca

SEQ ID NO: 48105 - RNA, 22 nt, Homo sapiens
ucacaugugaagauugggagua

SEQ ID NO: 48106 - RNA, 22 nt, Homo sapiens
ucaccaccugcugaucauagag

SEQ ID NO: 48107 - RNA, 20 nt, Homo sapiens
ucacccugacaucugcccag

SEQ ID NO: 48108 - RNA, 22 nt, Homo sapiens
ucaccuggagacaugaagacug

SEQ ID NO: 48109 - RNA, 22 nt, Homo sapiens
ucacgguggaaucccagauccc

SEQ ID NO: 48110 - RNA, 22 nt, Homo sapiens
ucacuggagauagcaaucuggu

SEQ ID NO: 48111 - RNA, 22 nt, Homo sapiens
ucacugugcaugaaggaugcug

SEQ ID NO: 48112 - RNA, 22 nt, Homo sapiens
ucacuguguauguauaugcagg

SEQ ID NO: 48113 - RNA, 22 nt, Homo sapiens
ucagaucauauucuucgcugcu

SEQ ID NO: 48114 - RNA, 22 nt, Homo sapiens
ucagaugaucugguaagaacuu

SEQ ID NO: 48115 - RNA, 19 nt, Homo sapiens
ucagcaguaaucaacuuca

SEQ ID NO: 48116 - RNA, 22 nt, Homo sapiens
ucagcagucacuccuaugacaa

SEQ ID NO: 48117 - RNA, 20 nt, Homo sapiens
ucagcagucuggagcagagg

SEQ ID NO: 48118 - RNA, 22 nt, Homo sapiens
ucagcaguggacagaaugguag

SEQ ID NO: 48119 - RNA, 22 nt, Homo sapiens
ucagguaaucuauuugucuuuu

SEQ ID NO: 48120 - RNA, 22 nt, Homo sapiens
ucagguagcauuuuggaaacag

SEQ ID NO: 48121 - RNA, 22 nt, Homo sapiens
ucaguagcauugcuuauacagu

SEQ ID NO: 48122 - RNA, 22 nt, Homo sapiens
ucaguaguuuuuuuacuaggug

SEQ ID NO: 48123 - RNA, 22 nt, Homo sapiens
ucagugcaggaaucucuagcca

SEQ ID NO: 48124 - RNA, 19 nt, Homo sapiens
ucagugcuauguaauguag

SEQ ID NO: 48125 - RNA, 22 nt, Homo sapiens
ucaguuuguauuucagguugca

SEQ ID NO: 48126 - RNA, 22 nt, Homo sapiens
ucauaaaguuguuuuaauggga

SEQ ID NO: 48127 - RNA, 22 nt, Homo sapiens
ucauaugucauaguaugaucuu

SEQ ID NO: 48128 - RNA, 22 nt, Homo sapiens
ucaucagaguuuacaagcucag

SEQ ID NO: 48129 - RNA, 22 nt, Homo sapiens
ucaucucaguuucuugccguac

SEQ ID NO: 48130 - RNA, 22 nt, Homo sapiens
ucauggggugcuuugcuagauu

SEQ ID NO: 48131 - RNA, 22 nt, Homo sapiens
ucauugcacuucuuuaguugca

SEQ ID NO: 48132 - RNA, 22 nt, Homo sapiens
uccaauguaaucaucauugaau

SEQ ID NO: 48133 - RNA, 22 nt, Homo sapiens
uccacagugguugaacuaguuu

SEQ ID NO: 48134 - RNA, 21 nt, Homo sapiens
uccagcuuugagaguuguggu

SEQ ID NO: 48135 - RNA, 22 nt, Homo sapiens
uccaguuuuguuaacauauggu

SEQ ID NO: 48136 - RNA, 22 nt, Homo sapiens
uccauggagacacauuuuauau

SEQ ID NO: 48137 - RNA, 22 nt, Homo sapiens
uccauugucuagauguaacaca

SEQ ID NO: 48138 - RNA, 16 nt, Homo sapiens
ucccaccauugcuugu

SEQ ID NO: 48139 - RNA, 22 nt, Homo sapiens
ucccugacagggucugagcuuu

SEQ ID NO: 48140 - RNA, 22 nt, Homo sapiens
uccuacugucuucggggcacug

SEQ ID NO: 48141 - RNA, 22 nt, Homo sapiens
uccuugagccucccagacucag

SEQ ID NO: 48142 - RNA, 22 nt, Homo sapiens
uccuuuggucaguauucuuuug

SEQ ID NO: 48143 - RNA, 18 nt, Homo sapiens
uccuuuugggguaggaga

SEQ ID NO: 48144 - RNA, 22 nt, Homo sapiens
ucggcucagugcaagcucugcc

SEQ ID NO: 48145 - RNA, 22 nt, Homo sapiens
ucgugcaaacguaauugugguu

SEQ ID NO: 48146 - RNA, 22 nt, Homo sapiens
ucuaaaguacuacuacuguugg

SEQ ID NO: 48147 - RNA, 21 nt, Homo sapiens
ucuaccuacugcucacaggcu

SEQ ID NO: 48148 - RNA, 22 nt, Homo sapiens
ucuauugguaggggcugaggca

SEQ ID NO: 48149 - RNA, 22 nt, Homo sapiens
ucucaguuuucaagcugucgau

SEQ ID NO: 48150 - RNA, 21 nt, Homo sapiens
ucucauagaguuucacuuucu

SEQ ID NO: 48151 - RNA, 22 nt, Homo sapiens
ucucugguuuucaaagcaguau

SEQ ID NO: 48152 - RNA, 22 nt, Homo sapiens
ucucuguuuagagccagcaauu

SEQ ID NO: 48153 - RNA, 23 nt, Homo sapiens
ucugauguuauaaaauucuuugg

SEQ ID NO: 48154 - RNA, 21 nt, Homo sapiens
ucuggcccccucaaaucucau

SEQ ID NO: 48155 - RNA, 22 nt, Homo sapiens
ucuggccuacaucauuuuuccg

SEQ ID NO: 48156 - RNA, 18 nt, Homo sapiens
ucuggcuucuuuguucca

SEQ ID NO: 48157 - RNA, 22 nt, Homo sapiens
ucugugaaugaacacuugaaaa

SEQ ID NO: 48158 - RNA, 22 nt, Homo sapiens
ucugugcauggcagaggaauga

SEQ ID NO: 48159 - RNA, 22 nt, Homo sapiens
ucugugcauuguaacaacuaaa

SEQ ID NO: 48160 - RNA, 22 nt, Homo sapiens
ucugugcauuguaggauguuua

SEQ ID NO: 48161 - RNA, 22 nt, Homo sapiens
ucugugcauuuucuuuuagacu

SEQ ID NO: 48162 - RNA, 22 nt, Homo sapiens
ucugugcuugucauaugcuuug

SEQ ID NO: 48163 - RNA, 18 nt, Homo sapiens
ucugugguguaaauacgu

SEQ ID NO: 48164 - RNA, 22 nt, Homo sapiens
ucuguguugaucacacugggag

SEQ ID NO: 48165 - RNA, 21 nt, Homo sapiens
ucuguguugaucucacuggga

SEQ ID NO: 48166 - RNA, 22 nt, Homo sapiens
ucuuaguuuagauuagcaauuc

SEQ ID NO: 48167 - RNA, 17 nt, Homo sapiens
ucuucuguuacuguggc

SEQ ID NO: 48168 - RNA, 22 nt, Homo sapiens
ucuuugauuuuguuacuaagac

SEQ ID NO: 48169 - RNA, 19 nt, Homo sapiens
ucuuugcuuuucuaagagg

SEQ ID NO: 48170 - RNA, 22 nt, Homo sapiens
ucuuuggaggcgaucuguuuga

SEQ ID NO: 48171 - RNA, 19 nt, Homo sapiens
ucuuugguacgugcuuuga

SEQ ID NO: 48172 - RNA, 20 nt, Homo sapiens
ugaaacacauggacuggggu

SEQ ID NO: 48173 - RNA, 22 nt, Homo sapiens
ugaaagcuacagucuccuagga

SEQ ID NO: 48174 - RNA, 22 nt, Homo sapiens
ugaaauacuuaauuucuccaug

SEQ ID NO: 48175 - RNA, 22 nt, Homo sapiens
ugaaaugaucaguuugguuacu

SEQ ID NO: 48176 - RNA, 21 nt, Homo sapiens
ugaaaugcaugugcacauuaa

SEQ ID NO: 48177 - RNA, 22 nt, Homo sapiens
ugaaauuauucuuaccaaggug

SEQ ID NO: 48178 - RNA, 22 nt, Homo sapiens
ugaaauuguuugcaaggauagg

SEQ ID NO: 48179 - RNA, 22 nt, Homo sapiens
ugaacagcuaucuugucagugu

SEQ ID NO: 48180 - RNA, 22 nt, Homo sapiens
ugaagacucaauuauuaugaac

SEQ ID NO: 48181 - RNA, 22 nt, Homo sapiens
ugaagacucaguuugagggaca

SEQ ID NO: 48182 - RNA, 22 nt, Homo sapiens
ugaaggacauucuaugguagau

SEQ ID NO: 48183 - RNA, 22 nt, Homo sapiens
ugaaggccgggcaugguggcuc

SEQ ID NO: 48184 - RNA, 22 nt, Homo sapiens
aaacuugucuaauuauaagcau

SEQ ID NO: 48185 - RNA, 22 nt, Homo sapiens
aaagggcuugaauacucuuuuu

SEQ ID NO: 48186 - RNA, 19 nt, Homo sapiens
aaagguaguaaccucugau

SEQ ID NO: 48187 - RNA, 18 nt, Homo sapiens
aaagugaugucauucuuu

SEQ ID NO: 48188 - RNA, 22 nt, Homo sapiens
aaagugcacuuggaagagggcc

SEQ ID NO: 48189 - RNA, 22 nt, Homo sapiens
aaagugcaguauuugggcagga

SEQ ID NO: 48190 - RNA, 22 nt, Homo sapiens
aaagugccuucuauuuuaguga

SEQ ID NO: 48191 - RNA, 22 nt, Homo sapiens
aaaguucugcguuagggcuaaa

SEQ ID NO: 48192 - RNA, 22 nt, Homo sapiens
aaauaacugucagguucuggaa

SEQ ID NO: 48193 - RNA, 15 nt, Homo sapiens
aaauaugucaguucu

SEQ ID NO: 48194 - RNA, 21 nt, Homo sapiens
aaaugcacauuacugcuggug

SEQ ID NO: 48195 - RNA, 22 nt, Homo sapiens
aaaugcagauuccuaggcccca

SEQ ID NO: 48196 - RNA, 22 nt, Homo sapiens
aaaugcagcacucaagugggaa

SEQ ID NO: 48197 - RNA, 22 nt, Homo sapiens
aaaugcaguugguggggauaug

SEQ ID NO: 48198 - RNA, 22 nt, Homo sapiens
aaaugcauugagggaaaaggca

SEQ ID NO: 48199 - RNA, 22 nt, Homo sapiens
aaaugcucucuacacguuucug

SEQ ID NO: 48200 - RNA, 22 nt, Homo sapiens
aaaugcucuuuaugaaguugga

SEQ ID NO: 48201 - RNA, 22 nt, Homo sapiens
aaauucaugucaccucuaggua

SEQ ID NO: 48202 - RNA, 22 nt, Homo sapiens
aaauugcaaugcgaggcagagg

SEQ ID NO: 48203 - RNA, 22 nt, Homo sapiens
aaauugcuuuugaagacuuagu

SEQ ID NO: 48204 - RNA, 22 nt, Homo sapiens
aacugcuguuuggguacuggug

SEQ ID NO: 48205 - RNA, 22 nt, Homo sapiens
aacuggcauguuuuaaggcuua

SEQ ID NO: 48206 - RNA, 19 nt, Homo sapiens
aacuggugugagaugauau

SEQ ID NO: 48207 - RNA, 22 nt, Homo sapiens
aagaccuaugcaggaagaaaug

SEQ ID NO: 48208 - RNA, 22 nt, Homo sapiens
aagagguagaagcuugccuucu

SEQ ID NO: 48209 - RNA, 22 nt, Homo sapiens
aagagguaggaaauggucauuu

SEQ ID NO: 48210 - RNA, 22 nt, Homo sapiens
aagagguagucugucccuuagc

SEQ ID NO: 48211 - RNA, 22 nt, Homo sapiens
aagauagcuaagcuucuucuaa

SEQ ID NO: 48212 - RNA, 22 nt, Homo sapiens
aagaucauucagggaaggcuga

SEQ ID NO: 48213 - RNA, 22 nt, Homo sapiens
aagaugcagucauacuggagua

SEQ ID NO: 48214 - RNA, 21 nt, Homo sapiens
aagcacauugaguguguguga

SEQ ID NO: 48215 - RNA, 22 nt, Homo sapiens
aagcaucacuggaggcagccau

SEQ ID NO: 48216 - RNA, 22 nt, Homo sapiens
aagccacuguaccugucucuua

SEQ ID NO: 48217 - RNA, 22 nt, Homo sapiens
aagcuggagugcaguggugcaa

SEQ ID NO: 48218 - RNA, 22 nt, Homo sapiens
aagcuggagugcaguggugcga

SEQ ID NO: 48219 - RNA, 22 nt, Homo sapiens
aagcugguguugcugcucuguu

SEQ ID NO: 48220 - RNA, 22 nt, Homo sapiens
aaggaacuggaauauuuugaac

SEQ ID NO: 48221 - RNA, 22 nt, Homo sapiens
aaggagcuuaagugacuuguac

SEQ ID NO: 48222 - RNA, 22 nt, Homo sapiens
aaggcaagagaaaauuucgagu

SEQ ID NO: 48223 - RNA, 22 nt, Homo sapiens
aaggcaagauacugguugcuga

SEQ ID NO: 48224 - RNA, 22 nt, Homo sapiens
aaggcagugugcacauaacacu

SEQ ID NO: 48225 - RNA, 22 nt, Homo sapiens
aaggcauucucaaacuaguucu

SEQ ID NO: 48226 - RNA, 22 nt, Homo sapiens
aaggcuauuugagaaugugugu

SEQ ID NO: 48227 - RNA, 22 nt, Homo sapiens
aagggagcugcauaaucuugug

SEQ ID NO: 48228 - RNA, 22 nt, Homo sapiens
aagguagguuccaaaauaccua

SEQ ID NO: 48229 - RNA, 22 nt, Homo sapiens
aaguaaacauugagagacaaga

SEQ ID NO: 48230 - RNA, 22 nt, Homo sapiens
aaguaaauauccgguaguccca

SEQ ID NO: 48231 - RNA, 22 nt, Homo sapiens
aaguagugcuugugcucaucuc

SEQ ID NO: 48232 - RNA, 22 nt, Homo sapiens
aaguauuagcuaauugugcuua

SEQ ID NO: 48233 - RNA, 22 nt, Homo sapiens
aaguauuaugaguccuuguuuu

SEQ ID NO: 48234 - RNA, 22 nt, Homo sapiens
gcaguagugugaucuuggcuca

SEQ ID NO: 48235 - RNA, 22 nt, Homo sapiens
gcagugcaugacgguauauaua

SEQ ID NO: 48236 - RNA, 17 nt, Homo sapiens
gcauaugucgaaccagc

SEQ ID NO: 48237 - RNA, 17 nt, Homo sapiens
gcauauguugaaccagc

SEQ ID NO: 48238 - RNA, 17 nt, Homo sapiens
gcauauguugaaccagu

SEQ ID NO: 48239 - RNA, 22 nt, Homo sapiens
gcaucaaugucuauaguguuug

SEQ ID NO: 48240 - RNA, 22 nt, Homo sapiens
gcauggagcauacauuucuguu

SEQ ID NO: 48241 - RNA, 22 nt, Homo sapiens
gccauugcacuccagccuagcg

SEQ ID NO: 48242 - RNA, 22 nt, Homo sapiens
gccauugcacuccagccuaggc

SEQ ID NO: 48243 - RNA, 22 nt, Homo sapiens
gccauugcacuccagccucggg

SEQ ID NO: 48244 - RNA, 22 nt, Homo sapiens
gccauugcacucuagccuaggu

SEQ ID NO: 48245 - RNA, 22 nt, Homo sapiens
gccuagauccaaauauggugca

SEQ ID NO: 48246 - RNA, 23 nt, Homo sapiens
gcuaggagagaugaaacacaggu

SEQ ID NO: 48247 - RNA, 19 nt, Homo sapiens
gcucaccuugcugcuccag

SEQ ID NO: 48248 - RNA, 22 nt, Homo sapiens
gcuguaguugaggauuuuaaga

SEQ ID NO: 48249 - RNA, 22 nt, Homo sapiens
gcugucuggagucuguucaaug

SEQ ID NO: 48250 - RNA, 22 nt, Homo sapiens
gcuuuguuaaaacacagccaca

SEQ ID NO: 48251 - RNA, 22 nt, Homo sapiens
ggaagccugcacucgggcaggg

SEQ ID NO: 48252 - RNA, 22 nt, Homo sapiens
ggaagguaauuggguaaugaga

SEQ ID NO: 48253 - RNA, 22 nt, Homo sapiens
ggaagguaauugucagcucaua

SEQ ID NO: 48254 - RNA, 22 nt, Homo sapiens
ggaagugcuguguggaagucug

SEQ ID NO: 48255 - RNA, 22 nt, Homo sapiens
ggaauauaaaaagccccagaau

SEQ ID NO: 48256 - RNA, 22 nt, Homo sapiens
ggaaugugugucaugcuuuugc

SEQ ID NO: 48257 - RNA, 22 nt, Homo sapiens
ggacagaaaggguucaccaaac

SEQ ID NO: 48258 - RNA, 22 nt, Homo sapiens
ggagcugugauuugaguccaga

SEQ ID NO: 48259 - RNA, 22 nt, Homo sapiens
ggaggcuaguaaaaagguagaa

SEQ ID NO: 48260 - RNA, 22 nt, Homo sapiens
ggagugucugugcuggucaaag

SEQ ID NO: 48261 - RNA, 22 nt, Homo sapiens
ggagugugauucaguauaauau

SEQ ID NO: 48262 - RNA, 21 nt, Homo sapiens
ggauagaaaacuuggcuguau

SEQ ID NO: 48263 - RNA, 22 nt, Homo sapiens
ggaucauaugauagcucaauuu

SEQ ID NO: 48264 - RNA, 22 nt, Homo sapiens
ggauugcuuaagaaguuucauu

SEQ ID NO: 48265 - RNA, 22 nt, Homo sapiens
ggcaagaaccucaauuaccuuu

SEQ ID NO: 48266 - RNA, 22 nt, Homo sapiens
ggcaagaacuucacucacuuuu

SEQ ID NO: 48267 - RNA, 23 nt, Homo sapiens
ggcacggaauucaaagaggcauu

SEQ ID NO: 48268 - RNA, 22 nt, Homo sapiens
ggcaguguauuacuuaggguuc

SEQ ID NO: 48269 - RNA, 22 nt, Homo sapiens
ggcauguguggguuauuaaaga

SEQ ID NO: 48270 - RNA, 22 nt, Homo sapiens
ggcucaguuuccuccgucugcu

SEQ ID NO: 48271 - RNA, 22 nt, Homo sapiens
gggaagaaggagugguuuacuc

SEQ ID NO: 48272 - RNA, 22 nt, Homo sapiens
gggaggucauuguaaggucuua

SEQ ID NO: 48273 - RNA, 16 nt, Homo sapiens
gggcaugugaagccua

SEQ ID NO: 48274 - RNA, 22 nt, Homo sapiens
gggcgagaaucggcugcucagc

SEQ ID NO: 48275 - RNA, 22 nt, Homo sapiens
gguagacaucgugcucugugau

SEQ ID NO: 48276 - RNA, 19 nt, Homo sapiens
ggucauggagguuguguga

SEQ ID NO: 48277 - RNA, 22 nt, Homo sapiens
ggugacugguuuaucuggcagu

SEQ ID NO: 48278 - RNA, 22 nt, Homo sapiens
gguggugguauuucagaaaaug

SEQ ID NO: 48279 - RNA, 20 nt, Homo sapiens
guaaacucucagcauagaug

SEQ ID NO: 48280 - RNA, 22 nt, Homo sapiens
guaaauaccaguuucuggaaca

SEQ ID NO: 48281 - RNA, 22 nt, Homo sapiens
guaaugaacuugaaagccuguu

SEQ ID NO: 48282 - RNA, 22 nt, Homo sapiens
guacacauacauauaugugugu

SEQ ID NO: 48283 - RNA, 22 nt, Homo sapiens
guaucucaguucucgugauuag

SEQ ID NO: 48284 - RNA, 22 nt, Homo sapiens
guauuuuguuagggugugguau

SEQ ID NO: 48285 - RNA, 22 nt, Homo sapiens
gucaagugaagcagugggagua

SEQ ID NO: 48286 - RNA, 22 nt, Homo sapiens
gucaaguguuuucaaggcuucc

SEQ ID NO: 48287 - RNA, 22 nt, Homo sapiens
gucacugccugaggcugaugca

SEQ ID NO: 48288 - RNA, 22 nt, Homo sapiens
gucacugugacggcaguuacau

SEQ ID NO: 48289 - RNA, 22 nt, Homo sapiens
gucagugucuuaacagagauua

SEQ ID NO: 48290 - RNA, 22 nt, Homo sapiens
gucagugucuuugcagcucaga

SEQ ID NO: 48291 - RNA, 22 nt, Homo sapiens
gucaucaggacgggucaucugc

SEQ ID NO: 48292 - RNA, 22 nt, Homo sapiens
gucucccaaccccugugcccag

SEQ ID NO: 48293 - RNA, 22 nt, Homo sapiens
gucuuugcauguauguucauga

SEQ ID NO: 48294 - RNA, 22 nt, Homo sapiens
gucuuuguuuugauuuaccaga

SEQ ID NO: 48295 - RNA, 22 nt, Homo sapiens
gugaaagacauauaugguuuga

SEQ ID NO: 48296 - RNA, 22 nt, Homo sapiens
gugaacagaaccugggaucgaa

SEQ ID NO: 48297 - RNA, 22 nt, Homo sapiens
uuggagcccuaacucucaguac

SEQ ID NO: 48298 - RNA, 22 nt, Homo sapiens
uuggaugauaaagaagccuaag

SEQ ID NO: 48299 - RNA, 22 nt, Homo sapiens
uuggcacuugauaauauucugg

SEQ ID NO: 48300 - RNA, 22 nt, Homo sapiens
uuggccagugucuuuuuuuccu

SEQ ID NO: 48301 - RNA, 22 nt, Homo sapiens
uugggacuggaaggaguaaggg

SEQ ID NO: 48302 - RNA, 22 nt, Homo sapiens
uugggauggaaauuuguacccc

SEQ ID NO: 48303 - RNA, 21 nt, Homo sapiens
uuggggaauggagagguuuuc

SEQ ID NO: 48304 - RNA, 22 nt, Homo sapiens
uuggucagcuagauuauucccu

SEQ ID NO: 48305 - RNA, 22 nt, Homo sapiens
uuggucagcucaauggagaggg

SEQ ID NO: 48306 - RNA, 22 nt, Homo sapiens
uuggucaggagccucccucuuu

SEQ ID NO: 48307 - RNA, 23 nt, Homo sapiens
uuggucucccaaaguguugagau

SEQ ID NO: 48308 - RNA, 22 nt, Homo sapiens
uugguuaucaucauuucagcaa

SEQ ID NO: 48309 - RNA, 22 nt, Homo sapiens
uuguaaaguucucucccgaaaa

SEQ ID NO: 48310 - RNA, 22 nt, Homo sapiens
uuguaaucaacacaucauuggg

SEQ ID NO: 48311 - RNA, 22 nt, Homo sapiens
uuguaccacagggcaugaagug

SEQ ID NO: 48312 - RNA, 22 nt, Homo sapiens
uuguaugucuucauuugaaaaa

SEQ ID NO: 48313 - RNA, 22 nt, Homo sapiens
uugucacccucucuuggugucu

SEQ ID NO: 48314 - RNA, 22 nt, Homo sapiens
uuguccccuuccaaaucucaug

SEQ ID NO: 48315 - RNA, 22 nt, Homo sapiens
uuguccuugagauaguuugcag

SEQ ID NO: 48316 - RNA, 22 nt, Homo sapiens
uugucucacuggaguuuaguaa

SEQ ID NO: 48317 - RNA, 19 nt, Homo sapiens
uugucuuagaguugucauu

SEQ ID NO: 48318 - RNA, 22 nt, Homo sapiens
uugugaauggaguagcaggauc

SEQ ID NO: 48319 - RNA, 22 nt, Homo sapiens
uugugcauaucagagguuugcu

SEQ ID NO: 48320 - RNA, 22 nt, Homo sapiens
uugugcaugaugcauacauggu

SEQ ID NO: 48321 - RNA, 20 nt, Homo sapiens
uugugcauugggccauuggg

SEQ ID NO: 48322 - RNA, 21 nt, Homo sapiens
uugugccaaacccuggaggga

SEQ ID NO: 48323 - RNA, 22 nt, Homo sapiens
uugugcuuuuuaaauagcuucc

SEQ ID NO: 48324 - RNA, 19 nt, Homo sapiens
uugugggaggacagagggg

SEQ ID NO: 48325 - RNA, 22 nt, Homo sapiens
uugugguaggaguugccauguu

SEQ ID NO: 48326 - RNA, 22 nt, Homo sapiens
uugugguuuucagcuuauauau

SEQ ID NO: 48327 - RNA, 22 nt, Homo sapiens
uuuaaagcuaaaauauguuuau

SEQ ID NO: 48328 - RNA, 22 nt, Homo sapiens
uuuaauacugcaucuuuacucu

SEQ ID NO: 48329 - RNA, 22 nt, Homo sapiens
uuuacaguuuucuaggcuacca

SEQ ID NO: 48330 - RNA, 22 nt, Homo sapiens
uuuagguuacauauaauccaaa

SEQ ID NO: 48331 - RNA, 22 nt, Homo sapiens
uuuaucaggccuuuggaaaaau

SEQ ID NO: 48332 - RNA, 22 nt, Homo sapiens
uuuaucuguuuaaaacuguuca

SEQ ID NO: 48333 - RNA, 22 nt, Homo sapiens
uuuaugcuacauguguuggaaa

SEQ ID NO: 48334 - RNA, 22 nt, Homo sapiens
uuucaacaggucuggggugguc

SEQ ID NO: 48335 - RNA, 22 nt, Homo sapiens
uuucacagagggcuucuuucua

SEQ ID NO: 48336 - RNA, 22 nt, Homo sapiens
uuucacagcugucuuccgucuc

SEQ ID NO: 48337 - RNA, 23 nt, Homo sapiens
uuucacaguagcuggaucagccu

SEQ ID NO: 48338 - RNA, 22 nt, Homo sapiens
uuucacaguguucucccccaga

SEQ ID NO: 48339 - RNA, 22 nt, Homo sapiens
aaagaagucagccuguccuuug

SEQ ID NO: 48340 - RNA, 23 nt, Homo sapiens
aaagacuagucaggugcaguggu

SEQ ID NO: 48341 - RNA, 22 nt, Homo sapiens
aaagagaucuaugggcacuaug

SEQ ID NO: 48342 - RNA, 22 nt, Homo sapiens
aaagaguucagguagauuucaa

SEQ ID NO: 48343 - RNA, 22 nt, Homo sapiens
aaagcacuggagucaucaucua

SEQ ID NO: 48344 - RNA, 22 nt, Homo sapiens
aaaggaccacauauaugguggc

SEQ ID NO: 48345 - RNA, 20 nt, Homo sapiens
aaaggcugugagaacgagau

SEQ ID NO: 48346 - RNA, 22 nt, Homo sapiens
aaagggcuguuucuugacuugg

SEQ ID NO: 48347 - RNA, 22 nt, Homo sapiens
aaagguaguacuucuagaaggg

SEQ ID NO: 48348 - RNA, 22 nt, Homo sapiens
aaaguaauugcaguuuuugcaa

SEQ ID NO: 48349 - RNA, 22 nt, Homo sapiens
aaagugcugagaguucuaacuu

SEQ ID NO: 48350 - RNA, 22 nt, Homo sapiens
aaaguggacuaagugaauauga

SEQ ID NO: 48351 - RNA, 19 nt, Homo sapiens
aaaguguuuuaaagaggau

SEQ ID NO: 48352 - RNA, 22 nt, Homo sapiens
aaaguucuugcugaaggauuau

SEQ ID NO: 48353 - RNA, 22 nt, Homo sapiens
aaaucccuugcucucucagacc

SEQ ID NO: 48354 - RNA, 22 nt, Homo sapiens
aaaugcacaaagauuuugcacu

SEQ ID NO: 48355 - RNA, 22 nt, Homo sapiens
aaaugcagucuuuguucugggc

SEQ ID NO: 48356 - RNA, 18 nt, Homo sapiens
aaaugcucuucuggaaua

SEQ ID NO: 48357 - RNA, 22 nt, Homo sapiens
aaaugcuuucuuggaccauuug

SEQ ID NO: 48358 - RNA, 22 nt, Homo sapiens
aaaugucauggaguguuucccc

SEQ ID NO: 48359 - RNA, 22 nt, Homo sapiens
aaauugcacaaguggugauuug

SEQ ID NO: 48360 - RNA, 22 nt, Homo sapiens
aaauugcaguuaggaugauggu

SEQ ID NO: 48361 - RNA, 22 nt, Homo sapiens
aaccacauggcucaguggacau

SEQ ID NO: 48362 - RNA, 22 nt, Homo sapiens
aaccuauaguauugaaaucaag

SEQ ID NO: 48363 - RNA, 22 nt, Homo sapiens
aacuaugucaaauaaaaugagg

SEQ ID NO: 48364 - RNA, 22 nt, Homo sapiens
aacuggcacuacaucaagagcu

SEQ ID NO: 48365 - RNA, 22 nt, Homo sapiens
aacuggcauagccagacuucuc

SEQ ID NO: 48366 - RNA, 22 nt, Homo sapiens
aacuggcauauucugguugcgg

SEQ ID NO: 48367 - RNA, 22 nt, Homo sapiens
aacuggucuuaugcaagcacua

SEQ ID NO: 48368 - RNA, 22 nt, Homo sapiens
aagaggcuguaggauaaugccu

SEQ ID NO: 48369 - RNA, 23 nt, Homo sapiens
aagagguaugacuaugaagugga

SEQ ID NO: 48370 - RNA, 22 nt, Homo sapiens
aagagguuuaacugacucacag

SEQ ID NO: 48371 - RNA, 22 nt, Homo sapiens
aaggaauucaaauuuucucugg

SEQ ID NO: 48372 - RNA, 22 nt, Homo sapiens
aaggcaagguggauaaugaagc

SEQ ID NO: 48373 - RNA, 22 nt, Homo sapiens
aaggcaguggcagaagauguca

SEQ ID NO: 48374 - RNA, 22 nt, Homo sapiens
aaggcauggugacuauuuaggc

SEQ ID NO: 48375 - RNA, 22 nt, Homo sapiens
aaggcucuuucaacguaaauua

SEQ ID NO: 48376 - RNA, 22 nt, Homo sapiens
aaggcuuuuugcugacguccuu

SEQ ID NO: 48377 - RNA, 22 nt, Homo sapiens
aaggucauugugguuuuugcca

SEQ ID NO: 48378 - RNA, 22 nt, Homo sapiens
aaguaauggaguuauuuuauga

SEQ ID NO: 48379 - RNA, 22 nt, Homo sapiens
aaguaguuaggaacauucucuc

SEQ ID NO: 48380 - RNA, 22 nt, Homo sapiens
aaguauuaagacuaagaggcuu

SEQ ID NO: 48381 - RNA, 22 nt, Homo sapiens
aagucaguuugggagaagcuau

SEQ ID NO: 48382 - RNA, 20 nt, Homo sapiens
aagugaguguuaaacugaac

SEQ ID NO: 48383 - RNA, 22 nt, Homo sapiens
aaucagcacacugugcuuucca

SEQ ID NO: 48384 - RNA, 22 nt, Homo sapiens
aaucugucaguuuuguguuaau

SEQ ID NO: 48385 - RNA, 22 nt, Homo sapiens
aaugacacugagcaucuuucau

SEQ ID NO: 48386 - RNA, 22 nt, Homo sapiens
aaugacuaagaugguacauuuu

SEQ ID NO: 48387 - RNA, 22 nt, Homo sapiens
aagucauggagaagguggaggu

SEQ ID NO: 48388 - RNA, 22 nt, Homo sapiens
aaguccaugaagucuugugggu

SEQ ID NO: 48389 - RNA, 19 nt, Homo sapiens
aagugaaugcuuuguucac

SEQ ID NO: 48390 - RNA, 22 nt, Homo sapiens
aagugaaugugcuggaauagcu

SEQ ID NO: 48391 - RNA, 22 nt, Homo sapiens
aagugaauucauuguguuauau

SEQ ID NO: 48392 - RNA, 22 nt, Homo sapiens
aaguugguguaugagacagaag

SEQ ID NO: 48393 - RNA, 22 nt, Homo sapiens
aaguuguuggaguuccauuguu

SEQ ID NO: 48394 - RNA, 22 nt, Homo sapiens
aauagugcugugcagugagugg

SEQ ID NO: 48395 - RNA, 22 nt, Homo sapiens
aaucacauugaaucugcuaccu

SEQ ID NO: 48396 - RNA, 22 nt, Homo sapiens
aaucaccaugcacuacagccuu

SEQ ID NO: 48397 - RNA, 22 nt, Homo sapiens
aaucacuaugccaugaaguaca

SEQ ID NO: 48398 - RNA, 22 nt, Homo sapiens
aauggcaaauguuuucuguuga

SEQ ID NO: 48399 - RNA, 22 nt, Homo sapiens
aauggcucuuccuggaguugug

SEQ ID NO: 48400 - RNA, 22 nt, Homo sapiens
aaugugcuuucuuucacacagu

SEQ ID NO: 48401 - RNA, 22 nt, Homo sapiens
aauuaggcuagaauguuauuaa

SEQ ID NO: 48402 - RNA, 22 nt, Homo sapiens
aauuaguuggcugccuaugauu

SEQ ID NO: 48403 - RNA, 22 nt, Homo sapiens
aauuaguuggcugggugcggug

SEQ ID NO: 48404 - RNA, 22 nt, Homo sapiens
aauugugcuuguaggccaggca

SEQ ID NO: 48405 - RNA, 20 nt, Homo sapiens
acaaaugcauucugugacau

SEQ ID NO: 48406 - RNA, 17 nt, Homo sapiens
acaaauugccagcuagg

SEQ ID NO: 48407 - RNA, 22 nt, Homo sapiens
acaagugaauacaggauucucu

SEQ ID NO: 48408 - RNA, 22 nt, Homo sapiens
acacauuagcaagugcuguuau

SEQ ID NO: 48409 - RNA, 22 nt, Homo sapiens
acacuuucuggagcugcacaua

SEQ ID NO: 48410 - RNA, 20 nt, Homo sapiens
acagcacugguuucaagcaa

SEQ ID NO: 48411 - RNA, 22 nt, Homo sapiens
acagugcuuuuguuccucuccu

SEQ ID NO: 48412 - RNA, 22 nt, Homo sapiens
acaguguacaauagccuuuuaa

SEQ ID NO: 48413 - RNA, 18 nt, Homo sapiens
acaguguguaaggguucu

SEQ ID NO: 48414 - RNA, 22 nt, Homo sapiens
acaucaggcuugugaugauuac

SEQ ID NO: 48415 - RNA, 22 nt, Homo sapiens
acaucauugggggcuacaggug

SEQ ID NO: 48416 - RNA, 22 nt, Homo sapiens
acauucagcuguuguuucaaug

SEQ ID NO: 48417 - RNA, 22 nt, Homo sapiens
acccugucauccacauggugcu

SEQ ID NO: 48418 - RNA, 22 nt, Homo sapiens
acccuguugguggaucagauug

SEQ ID NO: 48419 - RNA, 22 nt, Homo sapiens
acccuuaagcacuaguucagcu

SEQ ID NO: 48420 - RNA, 22 nt, Homo sapiens
accugcacagccgaacauagac

SEQ ID NO: 48421 - RNA, 22 nt, Homo sapiens
acgugcaugcacacacaugcgc

SEQ ID NO: 48422 - RNA, 22 nt, Homo sapiens
acuacuucuaaguuuuggaaga

SEQ ID NO: 48423 - RNA, 22 nt, Homo sapiens
acugagaucuuuaaauaaauaa

SEQ ID NO: 48424 - RNA, 22 nt, Homo sapiens
acuggaguuuguucaagaaaua

SEQ ID NO: 48425 - RNA, 22 nt, Homo sapiens
acuuugguuuauagaauuuagg

SEQ ID NO: 48426 - RNA, 17 nt, Homo sapiens
acuuuuugaggaggcau

SEQ ID NO: 48427 - RNA, 22 nt, Homo sapiens
agaaacauucucuugccuccuu

SEQ ID NO: 48428 - RNA, 22 nt, Homo sapiens
agaaagugcuucccuuugguga

SEQ ID NO: 48429 - RNA, 22 nt, Homo sapiens
agaaauguuuauucaaacccgu

SEQ ID NO: 48430 - RNA, 20 nt, Homo sapiens
agacaguguggagauuccuu

SEQ ID NO: 48431 - RNA, 22 nt, Homo sapiens
agagagcuugggguguuaaauu

SEQ ID NO: 48432 - RNA, 23 nt, Homo sapiens
agagugcaauggugccaucucgg

SEQ ID NO: 48433 - RNA, 22 nt, Homo sapiens
agagugcuuuauuagauguagc

SEQ ID NO: 48434 - RNA, 22 nt, Homo sapiens
agauauguuuaguuucaaaaug

SEQ ID NO: 48435 - RNA, 22 nt, Homo sapiens
agauauuuguuaggucugucag

SEQ ID NO: 48436 - RNA, 22 nt, Homo sapiens
agaucauaugcaguaaugaacu

SEQ ID NO: 48437 - RNA, 22 nt, Homo sapiens
agauggguuuucacauguuggc

SEQ ID NO: 48438 - RNA, 22 nt, Homo sapiens
agauggugauaaaugugguacc

SEQ ID NO: 48439 - RNA, 22 nt, Homo sapiens
agcaaaucuaugaauguauauu

SEQ ID NO: 48440 - RNA, 22 nt, Homo sapiens
agcaacauuguucauaauagcu

SEQ ID NO: 48441 - RNA, 22 nt, Homo sapiens
agcaauaugacauugcuacauc

SEQ ID NO: 48442 - RNA, 22 nt, Homo sapiens
agcacacuggguggcuuaaaca

SEQ ID NO: 48443 - RNA, 23 nt, Homo sapiens
agcaccaccccaggucacaagug

SEQ ID NO: 48444 - RNA, 22 nt, Homo sapiens
agcaccaccguugcucuauccc

SEQ ID NO: 48445 - RNA, 22 nt, Homo sapiens
agcagcauuaguggaaucuugu

SEQ ID NO: 48446 - RNA, 22 nt, Homo sapiens
agcagcauuaugauauaucuua

SEQ ID NO: 48447 - RNA, 22 nt, Homo sapiens
agcagguguggcuuauccugaa

SEQ ID NO: 48448 - RNA, 19 nt, Homo sapiens
agcaucauuauuguuuugg

SEQ ID NO: 48449 - RNA, 22 nt, Homo sapiens
agccuucauucugacaguagga

SEQ ID NO: 48450 - RNA, 23 nt, Homo sapiens
agcuagagaggcuggggauacag

SEQ ID NO: 48451 - RNA, 22 nt, Homo sapiens
agcucauugcaaccuccgccuc

SEQ ID NO: 48452 - RNA, 22 nt, Homo sapiens
agcuccaugauaguaugucugu

SEQ ID NO: 48453 - RNA, 22 nt, Homo sapiens
agcuccuacuguuacaucauug

SEQ ID NO: 48454 - RNA, 22 nt, Homo sapiens
agcugguuuaauaugcugucug

SEQ ID NO: 48455 - RNA, 20 nt, Homo sapiens
agcuguuguuaugagguuua

SEQ ID NO: 48456 - RNA, 22 nt, Homo sapiens
agcuuguuuucccauaacuaga

SEQ ID NO: 48457 - RNA, 22 nt, Homo sapiens
aggaagacauauagaacuaaaa

SEQ ID NO: 48458 - RNA, 22 nt, Homo sapiens
aggaaguaauaaguuugguucu

SEQ ID NO: 48459 - RNA, 22 nt, Homo sapiens
aggagcacuggccuuggaguca

SEQ ID NO: 48460 - RNA, 21 nt, Homo sapiens
aggagcauuguugugguggag

SEQ ID NO: 48461 - RNA, 23 nt, Homo sapiens
aggagcuuagaaguugccauugc

SEQ ID NO: 48462 - RNA, 22 nt, Homo sapiens
aggaggauugcuuucaucuuuu

SEQ ID NO: 48463 - RNA, 22 nt, Homo sapiens
aggcaaaugccagcaaucacac

SEQ ID NO: 48464 - RNA, 22 nt, Homo sapiens
aggcaguuucagugagagguga

SEQ ID NO: 48465 - RNA, 22 nt, Homo sapiens
agggcacuguagguccugccuc

SEQ ID NO: 48466 - RNA, 22 nt, Homo sapiens
agggcaguguuaggacugucug

SEQ ID NO: 48467 - RNA, 22 nt, Homo sapiens
aggucaccucaggaaauacuga

SEQ ID NO: 48468 - RNA, 22 nt, Homo sapiens
aggugacugguuuaucuggcag

SEQ ID NO: 48469 - RNA, 22 nt, Homo sapiens
aggugcugagcagagaauccug

SEQ ID NO: 48470 - RNA, 21 nt, Homo sapiens
aggugucuuggguucccuggc

SEQ ID NO: 48471 - RNA, 18 nt, Homo sapiens
agguuauuucccaagacu

SEQ ID NO: 48472 - RNA, 22 nt, Homo sapiens
aguaaaucacuaauggcuuccg

SEQ ID NO: 48473 - RNA, 22 nt, Homo sapiens
aguacacuguuaaaaagaagug

SEQ ID NO: 48474 - RNA, 20 nt, Homo sapiens
aguauucacuuuuuucaugg

SEQ ID NO: 48475 - RNA, 23 nt, Homo sapiens
agucuguguuuacaggcucucug

SEQ ID NO: 48476 - RNA, 22 nt, Homo sapiens
agugaaaugucaccuuuuagga

SEQ ID NO: 48477 - RNA, 22 nt, Homo sapiens
agugcacugcccgcuuccuguc

SEQ ID NO: 48478 - RNA, 22 nt, Homo sapiens
agugccauggcugcuagauggc

SEQ ID NO: 48479 - RNA, 22 nt, Homo sapiens
aguggauguuguggccugggag

SEQ ID NO: 48480 - RNA, 22 nt, Homo sapiens
agugucaggagacagguagcug

SEQ ID NO: 48481 - RNA, 22 nt, Homo sapiens
aguguuuuuaacaagaaagggu

SEQ ID NO: 48482 - RNA, 22 nt, Homo sapiens
aguguuuuuaucaugaaagggu

SEQ ID NO: 48483 - RNA, 22 nt, Homo sapiens
aguguuuuucaugggauacuuu

SEQ ID NO: 48484 - RNA, 21 nt, Homo sapiens
aguucacauggcuccuguguu

SEQ ID NO: 48485 - RNA, 22 nt, Homo sapiens
auaaaugcaaugguauuuuuga

SEQ ID NO: 48486 - RNA, 22 nt, Homo sapiens
auaagcuaagaguuucugggcu

SEQ ID NO: 48487 - RNA, 22 nt, Homo sapiens
auaaguagaaugauggucaaaa

SEQ ID NO: 48488 - RNA, 22 nt, Homo sapiens
auaagugagugauucaguguua

SEQ ID NO: 48489 - RNA, 22 nt, Homo sapiens
auaaucacacccagguuaaaug

SEQ ID NO: 48490 - RNA, 22 nt, Homo sapiens
auacaagcaguccaacuccaua

SEQ ID NO: 48491 - RNA, 22 nt, Homo sapiens
auacaguaaugucuuaggcugu

SEQ ID NO: 48492 - RNA, 22 nt, Homo sapiens
aaugauauguuauguuuagguu

SEQ ID NO: 48493 - RNA, 22 nt, Homo sapiens
aaugcaagauguuaauuauagg

SEQ ID NO: 48494 - RNA, 22 nt, Homo sapiens
aaugcaucuagaaaggugaauu

SEQ ID NO: 48495 - RNA, 22 nt, Homo sapiens
aauggcaucuacguuaaauguc

SEQ ID NO: 48496 - RNA, 22 nt, Homo sapiens
aauggcauugguccuuuuggau

SEQ ID NO: 48497 - RNA, 22 nt, Homo sapiens
aauggcucugauguuguuguga

SEQ ID NO: 48498 - RNA, 22 nt, Homo sapiens
aauuaguugaaagucugcuuuu

SEQ ID NO: 48499 - RNA, 22 nt, Homo sapiens
aauugaaugauaugggacauuu

SEQ ID NO: 48500 - RNA, 22 nt, Homo sapiens
aauugcaauggacaaugcagca

SEQ ID NO: 48501 - RNA, 22 nt, Homo sapiens
aauugcuucuguauuuuggaca

SEQ ID NO: 48502 - RNA, 22 nt, Homo sapiens
acaagcacaaaugcauagaugg

SEQ ID NO: 48503 - RNA, 22 nt, Homo sapiens
acaagcacaaauuuaauccugu

SEQ ID NO: 48504 - RNA, 22 nt, Homo sapiens
acacaaugguaaguguuugugu

SEQ ID NO: 48505 - RNA, 22 nt, Homo sapiens
acaccaguacuuuauacaagca

SEQ ID NO: 48506 - RNA, 22 nt, Homo sapiens
acacuguacuuauguuuugcag

SEQ ID NO: 48507 - RNA, 22 nt, Homo sapiens
acacugucugaugaaaguaguu

SEQ ID NO: 48508 - RNA, 22 nt, Homo sapiens
acacuuucuagacaagggaaua

SEQ ID NO: 48509 - RNA, 22 nt, Homo sapiens
acagaccuauuucaaucauuua

SEQ ID NO: 48510 - RNA, 23 nt, Homo sapiens
acagucuaguuugaagucaggua

SEQ ID NO: 48511 - RNA, 18 nt, Homo sapiens
acagugcugucacugcuu

SEQ ID NO: 48512 - RNA, 22 nt, Homo sapiens
acagugcuguggucaugggucu

SEQ ID NO: 48513 - RNA, 19 nt, Homo sapiens
acagugucucuauaaugau

SEQ ID NO: 48514 - RNA, 22 nt, Homo sapiens
acaucccaugccuggguacucc

SEQ ID NO: 48515 - RNA, 22 nt, Homo sapiens
acaugagacuggguuuguaggg

SEQ ID NO: 48516 - RNA, 22 nt, Homo sapiens
acauguauauaaugcauagcga

SEQ ID NO: 48517 - RNA, 22 nt, Homo sapiens
acauugcauauggcacccucuu

SEQ ID NO: 48518 - RNA, 22 nt, Homo sapiens
accacagugcuuccugcucacg

SEQ ID NO: 48519 - RNA, 23 nt, Homo sapiens
accugauguuucuguggggagcc

SEQ ID NO: 48520 - RNA, 22 nt, Homo sapiens
acucagagauuagcacauguuu

SEQ ID NO: 48521 - RNA, 22 nt, Homo sapiens
acucugucuaguuguaaaauuu

SEQ ID NO: 48522 - RNA, 22 nt, Homo sapiens
acugcauuugucugucucaauu

SEQ ID NO: 48523 - RNA, 22 nt, Homo sapiens
acuggcaauggcagaaauaguu

SEQ ID NO: 48524 - RNA, 22 nt, Homo sapiens
acuuaguauggggcuuuugaga

SEQ ID NO: 48525 - RNA, 22 nt, Homo sapiens
acuucauucucuggaucagaau

SEQ ID NO: 48526 - RNA, 22 nt, Homo sapiens
agaaaugcagcaugaggcggca

SEQ ID NO: 48527 - RNA, 22 nt, Homo sapiens
agaaauguuuacucacccccuu

SEQ ID NO: 48528 - RNA, 22 nt, Homo sapiens
agaagaacauagggugacugaa

SEQ ID NO: 48529 - RNA, 22 nt, Homo sapiens
agacaguguguguauauauggu

SEQ ID NO: 48530 - RNA, 22 nt, Homo sapiens
agacaucauuugauggugggag

SEQ ID NO: 48531 - RNA, 20 nt, Homo sapiens
agacuagggagcagaaagcc

SEQ ID NO: 48532 - RNA, 22 nt, Homo sapiens
agacuuagagagucuauucuau

SEQ ID NO: 48533 - RNA, 19 nt, Homo sapiens
agagacucauuguagcauu

SEQ ID NO: 48534 - RNA, 22 nt, Homo sapiens
agagagcuuuugguugcccuaa

SEQ ID NO: 48535 - RNA, 22 nt, Homo sapiens
agagaucauuuuguuucaaauc

SEQ ID NO: 48536 - RNA, 22 nt, Homo sapiens
agagguauacauuugagagcca

SEQ ID NO: 48537 - RNA, 19 nt, Homo sapiens
agaguauugaauuugcccu

SEQ ID NO: 48538 - RNA, 22 nt, Homo sapiens
agagugaagcuuuuuauauucu

SEQ ID NO: 48539 - RNA, 22 nt, Homo sapiens
agauaugucugcuauuugcugu

SEQ ID NO: 48540 - RNA, 22 nt, Homo sapiens
agaugccuaugaagagaaauua

SEQ ID NO: 48541 - RNA, 22 nt, Homo sapiens
agaugccucauguucuagguuc

SEQ ID NO: 48542 - RNA, 22 nt, Homo sapiens
agcagcaauuuuguaugguuua

SEQ ID NO: 48543 - RNA, 22 nt, Homo sapiens
agcagcacaucccuuucuggcc

SEQ ID NO: 48544 - RNA, 22 nt, Homo sapiens
agcagcaugaggggacuucugc

SEQ ID NO: 48545 - RNA, 22 nt, Homo sapiens
agcagcaugcaaauggacuaau

SEQ ID NO: 48546 - RNA, 22 nt, Homo sapiens
agcaucauguuuucgagguuca

SEQ ID NO: 48547 - RNA, 21 nt, Homo sapiens
agccaguguuccuuguggcuc

SEQ ID NO: 48548 - RNA, 22 nt, Homo sapiens
agcuaaaucucauguugaauug

SEQ ID NO: 48549 - RNA, 22 nt, Homo sapiens
agcuguaguuuauucauguuaa

SEQ ID NO: 48550 - RNA, 22 nt, Homo sapiens
agcuguaguuugguggauguaa

SEQ ID NO: 48551 - RNA, 19 nt, Homo sapiens
agcuguguugccugugaga

SEQ ID NO: 48552 - RNA, 22 nt, Homo sapiens
agcuguuguacacuuuaccuuu

SEQ ID NO: 48553 - RNA, 22 nt, Homo sapiens
agcuuguuuuccugcaacuaga

SEQ ID NO: 48554 - RNA, 22 nt, Homo sapiens
aggaaucuaagguaucagguua

SEQ ID NO: 48555 - RNA, 22 nt, Homo sapiens
aggaauggaaacuuuugauggu

SEQ ID NO: 48556 - RNA, 22 nt, Homo sapiens
aggacacugauagucuuuggca

SEQ ID NO: 48557 - RNA, 19 nt, Homo sapiens
aggacuaaagacuagaagu

SEQ ID NO: 48558 - RNA, 22 nt, Homo sapiens
aggagaugaagcuuuaucuaaa

SEQ ID NO: 48559 - RNA, 22 nt, Homo sapiens
aggagcacaggacuuugauuau

SEQ ID NO: 48560 - RNA, 22 nt, Homo sapiens
aggagguagggugugaaacagc

SEQ ID NO: 48561 - RNA, 22 nt, Homo sapiens
aggcaagugggagacagcauuu

SEQ ID NO: 48562 - RNA, 22 nt, Homo sapiens
aggcuuuuggagaacacugcac

SEQ ID NO: 48563 - RNA, 22 nt, Homo sapiens
agguaauuuucccagagggaaa

SEQ ID NO: 48564 - RNA, 22 nt, Homo sapiens
agguacuuucccaaccauacug

SEQ ID NO: 48565 - RNA, 21 nt, Homo sapiens
aggucaguaagaaugcagcac

SEQ ID NO: 48566 - RNA, 21 nt, Homo sapiens
aggucaugaagauguucuaau

SEQ ID NO: 48567 - RNA, 22 nt, Homo sapiens
aggugaaugcucacauucuaau

SEQ ID NO: 48568 - RNA, 22 nt, Homo sapiens
aguaccauuacucacuuauuuu

SEQ ID NO: 48569 - RNA, 22 nt, Homo sapiens
aguagguguugguagagguuuc

SEQ ID NO: 48570 - RNA, 22 nt, Homo sapiens
agucaagugguuucugaguugg

SEQ ID NO: 48571 - RNA, 22 nt, Homo sapiens
agucaguguguauugauggcac

SEQ ID NO: 48572 - RNA, 22 nt, Homo sapiens
agugauggagccaggauuuaau

SEQ ID NO: 48573 - RNA, 22 nt, Homo sapiens
agugcaguggcacaaucuuggc

SEQ ID NO: 48574 - RNA, 22 nt, Homo sapiens
agugcaguggcauggucauaac

SEQ ID NO: 48575 - RNA, 22 nt, Homo sapiens
aguggaguguaaagcgucuuuu

SEQ ID NO: 48576 - RNA, 22 nt, Homo sapiens
aguggcuuuuuaguggcagaug

SEQ ID NO: 48577 - RNA, 23 nt, Homo sapiens
aguggucuccugggcccagcugu

SEQ ID NO: 48578 - RNA, 19 nt, Homo sapiens
agugucauggucauuauuu

SEQ ID NO: 48579 - RNA, 22 nt, Homo sapiens
auaaaagcaggucuaggucagg

SEQ ID NO: 48580 - RNA, 18 nt, Homo sapiens
auaaccuggugcuuucaa

SEQ ID NO: 48581 - RNA, 22 nt, Homo sapiens
auaacucuguuuuuuucaugca

SEQ ID NO: 48582 - RNA, 22 nt, Homo sapiens
auaaggcugguauagacauuca

SEQ ID NO: 48583 - RNA, 22 nt, Homo sapiens
auaaguauuuggacuuuacugu

SEQ ID NO: 48584 - RNA, 22 nt, Homo sapiens
auaauguuuauccagaggaguu

SEQ ID NO: 48585 - RNA, 22 nt, Homo sapiens
auacacgugcagaacaugcagg

SEQ ID NO: 48586 - RNA, 22 nt, Homo sapiens
auacagguauacaaugcauaau

SEQ ID NO: 48587 - RNA, 22 nt, Homo sapiens
auacaguaucuucuggcaagca

SEQ ID NO: 48588 - RNA, 22 nt, Homo sapiens
auacagugaauaucuggggcag

SEQ ID NO: 48589 - RNA, 22 nt, Homo sapiens
auacaguguauguauaguacau

SEQ ID NO: 48590 - RNA, 22 nt, Homo sapiens
auacuagucaagaauguaugag

SEQ ID NO: 48591 - RNA, 22 nt, Homo sapiens
auacuccugucucagcugagau

SEQ ID NO: 48592 - RNA, 22 nt, Homo sapiens
auacuguuuuacaucauugccu

SEQ ID NO: 48593 - RNA, 20 nt, Homo sapiens
auagaagacuagugcagcag

SEQ ID NO: 48594 - RNA, 22 nt, Homo sapiens
auagcacaguguguguacacca

SEQ ID NO: 48595 - RNA, 21 nt, Homo sapiens
auagcacaucagauuuuauua

SEQ ID NO: 48596 - RNA, 22 nt, Homo sapiens
auagugcugcaacaaauauacg

SEQ ID NO: 48597 - RNA, 22 nt, Homo sapiens
auacagucuguuagauuuccuc

SEQ ID NO: 48598 - RNA, 22 nt, Homo sapiens
auacaguguucugggaagaagu

SEQ ID NO: 48599 - RNA, 22 nt, Homo sapiens
auacugucucuugcuccugccc

SEQ ID NO: 48600 - RNA, 22 nt, Homo sapiens
auagcaaugcaagaauggcuua

SEQ ID NO: 48601 - RNA, 22 nt, Homo sapiens
auagcaauuugggaaucagacu

SEQ ID NO: 48602 - RNA, 22 nt, Homo sapiens
auagcacuuaccacaggcugca

SEQ ID NO: 48603 - RNA, 22 nt, Homo sapiens
auagccucauucuucagaugag

SEQ ID NO: 48604 - RNA, 22 nt, Homo sapiens
auagugcuggaauaaauauacg

SEQ ID NO: 48605 - RNA, 15 nt, Homo sapiens
auauaugcaaugugu

SEQ ID NO: 48606 - RNA, 22 nt, Homo sapiens
auauauguuuucugggaagaaa

SEQ ID NO: 48607 - RNA, 22 nt, Homo sapiens
auaucacaggaaaggaagauac

SEQ ID NO: 48608 - RNA, 22 nt, Homo sapiens
auaugcacaguggaguacuauu

SEQ ID NO: 48609 - RNA, 22 nt, Homo sapiens
auaugcauacauguaugcagga

SEQ ID NO: 48610 - RNA, 22 nt, Homo sapiens
auauguauuuuaacguguaagg

SEQ ID NO: 48611 - RNA, 22 nt, Homo sapiens
auaugucuguuuagucuguaau

SEQ ID NO: 48612 - RNA, 21 nt, Homo sapiens
auaugugcuguggaagucagc

SEQ ID NO: 48613 - RNA, 22 nt, Homo sapiens
aucacagaguuaaaacuuucuu

SEQ ID NO: 48614 - RNA, 22 nt, Homo sapiens
aucacagcuacuccucugucuu

SEQ ID NO: 48615 - RNA, 22 nt, Homo sapiens
aucacauggccagguaguaauc

SEQ ID NO: 48616 - RNA, 22 nt, Homo sapiens
aucacuuucuauuucugugcca

SEQ ID NO: 48617 - RNA, 22 nt, Homo sapiens
aucacuuugcucuccagugugg

SEQ ID NO: 48618 - RNA, 22 nt, Homo sapiens
aucauuaguuguggaauucuug

SEQ ID NO: 48619 - RNA, 22 nt, Homo sapiens
auccacaugcaguuggaaacag

SEQ ID NO: 48620 - RNA, 22 nt, Homo sapiens
auccauguggauaaauguguau

SEQ ID NO: 48621 - RNA, 22 nt, Homo sapiens
aucccuguaacuagcagccccu

SEQ ID NO: 48622 - RNA, 22 nt, Homo sapiens
aucccuguaguaauauucuagc

SEQ ID NO: 48623 - RNA, 22 nt, Homo sapiens
aucccugugacgagcaucccua

SEQ ID NO: 48624 - RNA, 22 nt, Homo sapiens
aucccuuucucuggcuaggggg

SEQ ID NO: 48625 - RNA, 22 nt, Homo sapiens
aucugguguauuggugcugggu

SEQ ID NO: 48626 - RNA, 22 nt, Homo sapiens
aucugguguccucgugggaguc

SEQ ID NO: 48627 - RNA, 22 nt, Homo sapiens
aucuguagauucagcacaagcu

SEQ ID NO: 48628 - RNA, 22 nt, Homo sapiens
aucugugguuguaugcauauua

SEQ ID NO: 48629 - RNA, 22 nt, Homo sapiens
augaaaacaugauuugccuguu

SEQ ID NO: 48630 - RNA, 22 nt, Homo sapiens
augaagauguugccuuuuuaau

SEQ ID NO: 48631 - RNA, 20 nt, Homo sapiens
augaaggcaggugugaguuu

SEQ ID NO: 48632 - RNA, 22 nt, Homo sapiens
augaaguauuaggacacauuua

SEQ ID NO: 48633 - RNA, 20 nt, Homo sapiens
augaagugaaguuagggaac

SEQ ID NO: 48634 - RNA, 22 nt, Homo sapiens
augacagcaucugugaaguugu

SEQ ID NO: 48635 - RNA, 22 nt, Homo sapiens
augacugagacuaacuuacuuu

SEQ ID NO: 48636 - RNA, 22 nt, Homo sapiens
augagaauguaaguuaaugaaa

SEQ ID NO: 48637 - RNA, 22 nt, Homo sapiens
augagauacuacaaaugaguuu

SEQ ID NO: 48638 - RNA, 22 nt, Homo sapiens
augagaucugugaacaccuguc

SEQ ID NO: 48639 - RNA, 22 nt, Homo sapiens
augagaugcaagauuagauggg

SEQ ID NO: 48640 - RNA, 20 nt, Homo sapiens
augagcucaucuugaaaacc

SEQ ID NO: 48641 - RNA, 22 nt, Homo sapiens
augagcuccucaaggucagaga

SEQ ID NO: 48642 - RNA, 22 nt, Homo sapiens
augagcugauuuccuuaccaua

SEQ ID NO: 48643 - RNA, 22 nt, Homo sapiens
augagggcggacgcccuggaga

SEQ ID NO: 48644 - RNA, 22 nt, Homo sapiens
augaggugggagaaucacuuga

SEQ ID NO: 48645 - RNA, 22 nt, Homo sapiens
augagugugaccugccaagaga

SEQ ID NO: 48646 - RNA, 19 nt, Homo sapiens
augaguuaggggaaauuuc

SEQ ID NO: 48647 - RNA, 22 nt, Homo sapiens
augauacuguucuaagauuuuu

SEQ ID NO: 48648 - RNA, 22 nt, Homo sapiens
augauagucuugagaagcauuu

SEQ ID NO: 48649 - RNA, 22 nt, Homo sapiens
augaucauggaaguuuuccugu

SEQ ID NO: 48650 - RNA, 22 nt, Homo sapiens
augcacuuggcaggaugauucc

SEQ ID NO: 48651 - RNA, 22 nt, Homo sapiens
augcagagucccagccccuagc

SEQ ID NO: 48652 - RNA, 22 nt, Homo sapiens
augcagaucacauuuuucuguc

SEQ ID NO: 48653 - RNA, 20 nt, Homo sapiens
augccacugagcagugguga

SEQ ID NO: 48654 - RNA, 22 nt, Homo sapiens
augcccauuuguuuucugaaag

SEQ ID NO: 48655 - RNA, 19 nt, Homo sapiens
augccucaguuuuguacuu

SEQ ID NO: 48656 - RNA, 22 nt, Homo sapiens
augcuacugaccccuacuuaca

SEQ ID NO: 48657 - RNA, 22 nt, Homo sapiens
augcuguuuugaauucucuaga

SEQ ID NO: 48658 - RNA, 22 nt, Homo sapiens
augcuuguguuggggcagugga

SEQ ID NO: 48659 - RNA, 22 nt, Homo sapiens
auggaauggcacuuugaagauu

SEQ ID NO: 48660 - RNA, 22 nt, Homo sapiens
auggagagaauuauucucucag

SEQ ID NO: 48661 - RNA, 22 nt, Homo sapiens
auggaggaggaagcugaaacaa

SEQ ID NO: 48662 - RNA, 19 nt, Homo sapiens
auggauacauuuucugcua

SEQ ID NO: 48663 - RNA, 22 nt, Homo sapiens
auggaucuuucugcuuuugaau

SEQ ID NO: 48664 - RNA, 22 nt, Homo sapiens
auggauuuugaacuugagaguu

SEQ ID NO: 48665 - RNA, 22 nt, Homo sapiens
auggauuuuggggccagaggca

SEQ ID NO: 48666 - RNA, 22 nt, Homo sapiens
auggcaauguaagucagaaaaa

SEQ ID NO: 48667 - RNA, 22 nt, Homo sapiens
auggcagcaccccacucuacug

SEQ ID NO: 48668 - RNA, 20 nt, Homo sapiens
auggcccugcugggaguguc

SEQ ID NO: 48669 - RNA, 22 nt, Homo sapiens
auggcggugugaucuuggcuca

SEQ ID NO: 48670 - RNA, 22 nt, Homo sapiens
augggacugggugccguggagc

SEQ ID NO: 48671 - RNA, 22 nt, Homo sapiens
augggcacugauguauucugug

SEQ ID NO: 48672 - RNA, 22 nt, Homo sapiens
augucacagguccuagccaagu

SEQ ID NO: 48673 - RNA, 20 nt, Homo sapiens
augucaggaagggagucagg

SEQ ID NO: 48674 - RNA, 22 nt, Homo sapiens
auguccaugagcacauguauca

SEQ ID NO: 48675 - RNA, 22 nt, Homo sapiens
augucugguagccaccuggagg

SEQ ID NO: 48676 - RNA, 22 nt, Homo sapiens
augugcaacugcuggaacaguc

SEQ ID NO: 48677 - RNA, 22 nt, Homo sapiens
augugcaauguguacguagccc

SEQ ID NO: 48678 - RNA, 22 nt, Homo sapiens
augugucaaaucuaggccaaag

SEQ ID NO: 48679 - RNA, 22 nt, Homo sapiens
auguuuagagagggugucaaau

SEQ ID NO: 48680 - RNA, 22 nt, Homo sapiens
auuaaguugugccugaaaacuu

SEQ ID NO: 48681 - RNA, 22 nt, Homo sapiens
auuacuuugcaccaaccuaaua

SEQ ID NO: 48682 - RNA, 22 nt, Homo sapiens
auuauauguguaugugcauacc

SEQ ID NO: 48683 - RNA, 22 nt, Homo sapiens
auucaaggacuggauugcggga

SEQ ID NO: 48684 - RNA, 22 nt, Homo sapiens
auucacagcuuuaaaaggcgug

SEQ ID NO: 48685 - RNA, 22 nt, Homo sapiens
auucacagggggagaaggguau

SEQ ID NO: 48686 - RNA, 19 nt, Homo sapiens
auugcaguguaaaacuauu

SEQ ID NO: 48687 - RNA, 22 nt, Homo sapiens
auugcugagacauugcuaaucu

SEQ ID NO: 48688 - RNA, 22 nt, Homo sapiens
auugcuuacccuguauuagauc

SEQ ID NO: 48689 - RNA, 22 nt, Homo sapiens
auuguacugccccccuguugcu

SEQ ID NO: 48690 - RNA, 22 nt, Homo sapiens
auugugcuaaaguaauaaguca

SEQ ID NO: 48691 - RNA, 22 nt, Homo sapiens
auuguuccccggucauuuuugu

SEQ ID NO: 48692 - RNA, 22 nt, Homo sapiens
auuguucuuacaugcugucauc

SEQ ID NO: 48693 - RNA, 22 nt, Homo sapiens
auuguucuuguguccuuuuccu

SEQ ID NO: 48694 - RNA, 22 nt, Homo sapiens
auuuggcagugaagggaucaca

SEQ ID NO: 48695 - RNA, 22 nt, Homo sapiens
auuuuugguugguaggcuauua

SEQ ID NO: 48696 - RNA, 22 nt, Homo sapiens
caaagcacuuggcuuggaagau

SEQ ID NO: 48697 - RNA, 22 nt, Homo sapiens
caaaguaauuacgguuuuggcc

SEQ ID NO: 48698 - RNA, 19 nt, Homo sapiens
caaaguguucuucuuugcc

SEQ ID NO: 48699 - RNA, 22 nt, Homo sapiens
caaaugcuucuauggacugucu

SEQ ID NO: 48700 - RNA, 22 nt, Homo sapiens
caaauugcuugucuguagugga

SEQ ID NO: 48701 - RNA, 20 nt, Homo sapiens
caaauugcuuucuugguuuu

SEQ ID NO: 48702 - RNA, 22 nt, Homo sapiens
gaugccuuuuuguccucaguua

SEQ ID NO: 48703 - RNA, 22 nt, Homo sapiens
gauggaguugacuaagacaaca

SEQ ID NO: 48704 - RNA, 22 nt, Homo sapiens
gauggcucugcaggugagggua

SEQ ID NO: 48705 - RNA, 22 nt, Homo sapiens
gauguguugggaagauuucaag

SEQ ID NO: 48706 - RNA, 22 nt, Homo sapiens
gauuccacuuucaaauucaaau

SEQ ID NO: 48707 - RNA, 22 nt, Homo sapiens
gauuuuccaguggcccugauca

SEQ ID NO: 48708 - RNA, 23 nt, Homo sapiens
gcaaauaucguagagugucccug

SEQ ID NO: 48709 - RNA, 22 nt, Homo sapiens
gcaagaauggaacaggagagcc

SEQ ID NO: 48710 - RNA, 22 nt, Homo sapiens
gugucuccugccuucaugcagc

SEQ ID NO: 48711 - RNA, 22 nt, Homo sapiens
ugagacgaagucucguucugua

SEQ ID NO: 48712 - RNA, 22 nt, Homo sapiens
ugagacugaguuucucucuugu

SEQ ID NO: 48713 - RNA, 22 nt, Homo sapiens
ugagagcuuugaugcacuguuu

SEQ ID NO: 48714 - RNA, 20 nt, Homo sapiens
ugagauaguaauccccuaca

SEQ ID NO: 48715 - RNA, 22 nt, Homo sapiens
ugagauaguacuuuuuuaaagg

SEQ ID NO: 48716 - RNA, 20 nt, Homo sapiens
ugagauccacgugaaguaug

SEQ ID NO: 48717 - RNA, 22 nt, Homo sapiens
ugagaugaaagcagaaagacuu

SEQ ID NO: 48718 - RNA, 22 nt, Homo sapiens
ugagaugaagucuugcucuguu

SEQ ID NO: 48719 - RNA, 22 nt, Homo sapiens
ugagaugaggucucacucuguu

SEQ ID NO: 48720 - RNA, 22 nt, Homo sapiens
ugagaugaguugcuggcucuga

SEQ ID NO: 48721 - RNA, 22 nt, Homo sapiens
ugagaugugaagaucacaugaa

SEQ ID NO: 48722 - RNA, 22 nt, Homo sapiens
ugagaugugaucaccugaaggg

SEQ ID NO: 48723 - RNA, 22 nt, Homo sapiens
ugagaugugugcauucaacuca

SEQ ID NO: 48724 - RNA, 22 nt, Homo sapiens
ugagauuaaucuuuaaguaaga

SEQ ID NO: 48725 - RNA, 22 nt, Homo sapiens
ugagcagugagugugcugcagg

SEQ ID NO: 48726 - RNA, 22 nt, Homo sapiens
ugagccauggcaccuugucuaa

SEQ ID NO: 48727 - RNA, 22 nt, Homo sapiens
ugagcuagggccuggaauaggg

SEQ ID NO: 48728 - RNA, 22 nt, Homo sapiens
ugagcucagcuuucuuuuucac

SEQ ID NO: 48729 - RNA, 22 nt, Homo sapiens
ugagcucaguauuucauaaaca

SEQ ID NO: 48730 - RNA, 22 nt, Homo sapiens
ugagcucaugcauucuugagga

SEQ ID NO: 48731 - RNA, 22 nt, Homo sapiens
ugagcuguuugaagaagcauuu

SEQ ID NO: 48732 - RNA, 22 nt, Homo sapiens
ugagguaagauguucauuuuuc

SEQ ID NO: 48733 - RNA, 22 nt, Homo sapiens
ugagguguuauccagaguucuu

SEQ ID NO: 48734 - RNA, 22 nt, Homo sapiens
ugaguagaacaucaagucauac

SEQ ID NO: 48735 - RNA, 22 nt, Homo sapiens
ugagucauguaauaaugcugcu

SEQ ID NO: 48736 - RNA, 22 nt, Homo sapiens
ugaguguccaaguaaggugaaa

SEQ ID NO: 48737 - RNA, 22 nt, Homo sapiens
ugaguucaauuguauuuuauua

SEQ ID NO: 48738 - RNA, 22 nt, Homo sapiens
ugauauguggauucagcucaaa

SEQ ID NO: 48739 - RNA, 20 nt, Homo sapiens
ugauauuuucugagcaggaa

SEQ ID NO: 48740 - RNA, 21 nt, Homo sapiens
ugaucacaugaaaaccaugca

SEQ ID NO: 48741 - RNA, 22 nt, Homo sapiens
ugaucugucucggguuaucagu

SEQ ID NO: 48742 - RNA, 22 nt, Homo sapiens
ugaucuguguaacauaggaguc

SEQ ID NO: 48743 - RNA, 22 nt, Homo sapiens
ugauuuguccauguggcacgug

SEQ ID NO: 48744 - RNA, 22 nt, Homo sapiens
ugauuuguuuagugccaaguuu

SEQ ID NO: 48745 - RNA, 22 nt, Homo sapiens
ugauuuguuucaggaguuuucu

SEQ ID NO: 48746 - RNA, 19 nt, Homo sapiens
ugcaaagucagugaagggu

SEQ ID NO: 48747 - RNA, 22 nt, Homo sapiens
ugcaaguaauuccagcuacuga

SEQ ID NO: 48748 - RNA, 22 nt, Homo sapiens
ugcaccacugcacuccagcuug

SEQ ID NO: 48749 - RNA, 19 nt, Homo sapiens
ugcagcaauguaaaagaca

SEQ ID NO: 48750 - RNA, 22 nt, Homo sapiens
ugcagcacaguagguuugcaau

SEQ ID NO: 48751 - RNA, 22 nt, Homo sapiens
ugcagcauguaggcacguuauu

SEQ ID NO: 48752 - RNA, 21 nt, Homo sapiens
ugcagugugguugcccugcug

SEQ ID NO: 48753 - RNA, 22 nt, Homo sapiens
ugcauugcacuugcaugagaua

SEQ ID NO: 48754 - RNA, 22 nt, Homo sapiens
ugcauuguuuagaaacacuggg

SEQ ID NO: 48755 - RNA, 22 nt, Homo sapiens
ugccaguauuuuacugaggauu

SEQ ID NO: 48756 - RNA, 22 nt, Homo sapiens
ugccauagagauuuguggaacu

SEQ ID NO: 48757 - RNA, 22 nt, Homo sapiens
ugccaugaagagaggaagcagu

SEQ ID NO: 48758 - RNA, 22 nt, Homo sapiens
ugcucaguuuaaaacuuuugag

SEQ ID NO: 48759 - RNA, 21 nt, Homo sapiens
ugcucaugaguaaugcaguga

SEQ ID NO: 48760 - RNA, 22 nt, Homo sapiens
ugcuggugauuaaauccugaag

SEQ ID NO: 48761 - RNA, 22 nt, Homo sapiens
ugcugguggucccauaugauua

SEQ ID NO: 48762 - RNA, 22 nt, Homo sapiens
ugcugguuuaaaaugcaaauuc

SEQ ID NO: 48763 - RNA, 22 nt, Homo sapiens
ugcugguuuucaucaucagugg

SEQ ID NO: 48764 - RNA, 22 nt, Homo sapiens
uggaaaacaugcacauuggauu

SEQ ID NO: 48765 - RNA, 20 nt, Homo sapiens
uggaaaguaagucaugauau

SEQ ID NO: 48766 - RNA, 22 nt, Homo sapiens
uggaaauaaaugugccaagauc

SEQ ID NO: 48767 - RNA, 22 nt, Homo sapiens
uggaacaccaggcuggcguggc

SEQ ID NO: 48768 - RNA, 23 nt, Homo sapiens
uggaagacuccucucuuggcugc

SEQ ID NO: 48769 - RNA, 22 nt, Homo sapiens
uggaagauucuagaagauucca

SEQ ID NO: 48770 - RNA, 22 nt, Homo sapiens
uggaaguuaaaugacucuuucu

SEQ ID NO: 48771 - RNA, 21 nt, Homo sapiens
uggaaucuauagaggcaguag

SEQ ID NO: 48772 - RNA, 22 nt, Homo sapiens
uggaaugucagcuacaagaggg

SEQ ID NO: 48773 - RNA, 22 nt, Homo sapiens
uggaaugugaauaacuuccuuc

SEQ ID NO: 48774 - RNA, 22 nt, Homo sapiens
uggaauuuagguugauaguaua

SEQ ID NO: 48775 - RNA, 22 nt, Homo sapiens
uggagagcaaaaucaauccaaa

SEQ ID NO: 48776 - RNA, 18 nt, Homo sapiens
uggagauaagaagaacuu

SEQ ID NO: 48777 - RNA, 22 nt, Homo sapiens
uggaguaggccuaagaaugaca

SEQ ID NO: 48778 - RNA, 19 nt, Homo sapiens
uggagucaucaugcugcua

SEQ ID NO: 48779 - RNA, 22 nt, Homo sapiens
uggauggagaggcuugugaugc

SEQ ID NO: 48780 - RNA, 22 nt, Homo sapiens
uggcaaaaaaccgcaguugccu

SEQ ID NO: 48781 - RNA, 22 nt, Homo sapiens
uggcaaaauauuuugguuucug

SEQ ID NO: 48782 - RNA, 22 nt, Homo sapiens
uggcaaaauggaauauguuggg

SEQ ID NO: 48783 - RNA, 21 nt, Homo sapiens
uggcaaaaugggcaguggguu

SEQ ID NO: 48784 - RNA, 22 nt, Homo sapiens
uggcaagauuguuccgguuugg

SEQ ID NO: 48785 - RNA, 22 nt, Homo sapiens
uggcaauaaggacuccuuaggu

SEQ ID NO: 48786 - RNA, 22 nt, Homo sapiens
uggcacaaugacccuugugggc

SEQ ID NO: 48787 - RNA, 22 nt, Homo sapiens
uggcaguuuuaugugguucaac

SEQ ID NO: 48788 - RNA, 22 nt, Homo sapiens
uggcccccucccaaaucucaua

SEQ ID NO: 48789 - RNA, 22 nt, Homo sapiens
uggcuuuucauccugggacauu

SEQ ID NO: 48790 - RNA, 22 nt, Homo sapiens
ugggaauaugauacaggucuuu

SEQ ID NO: 48791 - RNA, 22 nt, Homo sapiens
ugggcaguauggucauuuucgu

SEQ ID NO: 48792 - RNA, 23 nt, Homo sapiens
ugguaacauguuguggcagggga

SEQ ID NO: 48793 - RNA, 22 nt, Homo sapiens
uggucaccugaauuaugcaugu

SEQ ID NO: 48794 - RNA, 22 nt, Homo sapiens
uggucauggggcagcugacacu

SEQ ID NO: 48795 - RNA, 22 nt, Homo sapiens
uggugcuuaaauaaggcuuuca

SEQ ID NO: 48796 - RNA, 20 nt, Homo sapiens
ugguguuugaacagugaaug

SEQ ID NO: 48797 - RNA, 21 nt, Homo sapiens
ugguucaguucguuacgugug

SEQ ID NO: 48798 - RNA, 22 nt, Homo sapiens
ugguucaguugcacaggcuguu

SEQ ID NO: 48799 - RNA, 22 nt, Homo sapiens
uguaaacuaugagcugauuauu

SEQ ID NO: 48800 - RNA, 20 nt, Homo sapiens
uguaaaggagauugcagcug

SEQ ID NO: 48801 - RNA, 22 nt, Homo sapiens
uguaacaguaguuacuauucuu

SEQ ID NO: 48802 - RNA, 22 nt, Homo sapiens
uguaauuuaaaugauccuugga

SEQ ID NO: 48803 - RNA, 22 nt, Homo sapiens
uguagauauucuuucaguuuuu

SEQ ID NO: 48804 - RNA, 22 nt, Homo sapiens
uguauacauauguauguuuugu

SEQ ID NO: 48805 - RNA, 21 nt, Homo sapiens
uguauacauauguuaggugca

SEQ ID NO: 48806 - RNA, 22 nt, Homo sapiens
uguaugucugcucuuuggaacu

SEQ ID NO: 48807 - RNA, 22 nt, Homo sapiens
uguauguugauguuauauucug

SEQ ID NO: 48808 - RNA, 22 nt, Homo sapiens
uguauguugggucaaaguacau

SEQ ID NO: 48809 - RNA, 22 nt, Homo sapiens
ugucaaaugcagugauauuuga

SEQ ID NO: 48810 - RNA, 22 nt, Homo sapiens
uuaaaguguuuucaaaauguca

SEQ ID NO: 48811 - RNA, 22 nt, Homo sapiens
uuaaauacagcaugguguuucu

SEQ ID NO: 48812 - RNA, 22 nt, Homo sapiens
uuaagacaccaaucauuggauu

SEQ ID NO: 48813 - RNA, 22 nt, Homo sapiens
uuaagcaaagguaacaugagaa

SEQ ID NO: 48814 - RNA, 22 nt, Homo sapiens
uuaagccacucaagagauagag

SEQ ID NO: 48815 - RNA, 22 nt, Homo sapiens
uuaaggaaagcauuuaauucag

SEQ ID NO: 48816 - RNA, 22 nt, Homo sapiens
uuaaggcuuuaaguaaacacag

SEQ ID NO: 48817 - RNA, 22 nt, Homo sapiens
uuaaguaaucagagaagagaac

SEQ ID NO: 48818 - RNA, 22 nt, Homo sapiens
uuaaguagcugggcaugguggu

SEQ ID NO: 48819 - RNA, 22 nt, Homo sapiens
uuaaugaacuuuauuuuguaga

SEQ ID NO: 48820 - RNA, 22 nt, Homo sapiens
uuacaacugucuuacugguuau

SEQ ID NO: 48821 - RNA, 23 nt, Homo sapiens
uuacaguggcaugaucucugcuc

SEQ ID NO: 48822 - RNA, 22 nt, Homo sapiens
uuacagugguugcuauugugaa

SEQ ID NO: 48823 - RNA, 22 nt, Homo sapiens
uuacaugucuugguaagguuag

SEQ ID NO: 48824 - RNA, 22 nt, Homo sapiens
uuacauguggugugaagaagag

SEQ ID NO: 48825 - RNA, 22 nt, Homo sapiens
uuacugcuagcugugugcucuu

SEQ ID NO: 48826 - RNA, 22 nt, Homo sapiens
uuagcucaguuggugagagcgu

SEQ ID NO: 48827 - RNA, 22 nt, Homo sapiens
uuaggcuaguugauauaguuug

SEQ ID NO: 48828 - RNA, 22 nt, Homo sapiens
uuagguaauauauugcugcuuu

SEQ ID NO: 48829 - RNA, 22 nt, Homo sapiens
uuagugcaaacucuucaaugcu

SEQ ID NO: 48830 - RNA, 22 nt, Homo sapiens
uuauaacagagacuccugugcu

SEQ ID NO: 48831 - RNA, 21 nt, Homo sapiens
uuauccagcacuguuucggac

SEQ ID NO: 48832 - RNA, 22 nt, Homo sapiens
uuaugcuguuuucuggagauuu

SEQ ID NO: 48833 - RNA, 22 nt, Homo sapiens
uuaugugccuuuuugccauuca

SEQ ID NO: 48834 - RNA, 22 nt, Homo sapiens
uucaagaauuaaaguggcuuuu

SEQ ID NO: 48835 - RNA, 22 nt, Homo sapiens
uucaagugaacaaaaugaggag

SEQ ID NO: 48836 - RNA, 20 nt, Homo sapiens
uucaagugauucucaugccu

SEQ ID NO: 48837 - RNA, 22 nt, Homo sapiens
uucaaguguucaggagcuacag

SEQ ID NO: 48838 - RNA, 22 nt, Homo sapiens
uucaauuaauauuauacucuca

SEQ ID NO: 48839 - RNA, 22 nt, Homo sapiens
uucacagaaaaaggcgaugagg

SEQ ID NO: 48840 - RNA, 22 nt, Homo sapiens
uucaccuugcccacagcagucu

SEQ ID NO: 48841 - RNA, 22 nt, Homo sapiens
uucaccuugggucccacuugcu

SEQ ID NO: 48842 - RNA, 22 nt, Homo sapiens
uucagaugcacacuguagucua

SEQ ID NO: 48843 - RNA, 22 nt, Homo sapiens
uucagcaggccaggcccugacu

SEQ ID NO: 48844 - RNA, 22 nt, Homo sapiens
uucagggagaaggcaaacguug

SEQ ID NO: 48845 - RNA, 22 nt, Homo sapiens
uucaguagucaaaagauaaggg

SEQ ID NO: 48846 - RNA, 22 nt, Homo sapiens
uucaguggagaggcugaguggu

SEQ ID NO: 48847 - RNA, 22 nt, Homo sapiens
uucagugucauuaacacaguag

SEQ ID NO: 48848 - RNA, 22 nt, Homo sapiens
uucauagucuaauuuuuuccac

SEQ ID NO: 48849 - RNA, 22 nt, Homo sapiens
uucauagugaaaaauucaaagu

SEQ ID NO: 48850 - RNA, 21 nt, Homo sapiens
uucaucagccagaaaucaagc

SEQ ID NO: 48851 - RNA, 22 nt, Homo sapiens
uucaucagcuguagaugucaug

SEQ ID NO: 48852 - RNA, 20 nt, Homo sapiens
uucaucaggauauuggucua

SEQ ID NO: 48853 - RNA, 22 nt, Homo sapiens
uucaucagggagaaauaauuuc

SEQ ID NO: 48854 - RNA, 23 nt, Homo sapiens
uucaucagggauauuggccugaa

SEQ ID NO: 48855 - RNA, 18 nt, Homo sapiens
uucaucaguccucagcug

SEQ ID NO: 48856 - RNA, 22 nt, Homo sapiens
uucaucaguuauauuggccuga

SEQ ID NO: 48857 - RNA, 22 nt, Homo sapiens
uucauggaacaaguggguucaa

SEQ ID NO: 48858 - RNA, 22 nt, Homo sapiens
uucauggguuaauuuguucgau

SEQ ID NO: 48859 - RNA, 22 nt, Homo sapiens
uuccagcugggggcaacucugc

SEQ ID NO: 48860 - RNA, 22 nt, Homo sapiens
uuccaguuauuauaccucuuaa

SEQ ID NO: 48861 - RNA, 22 nt, Homo sapiens
uucccugugggcuggugcucca

SEQ ID NO: 48862 - RNA, 22 nt, Homo sapiens
uucccuuucugaaaaucucauu

SEQ ID NO: 48863 - RNA, 22 nt, Homo sapiens
uucccuuucuuaaagaguuagg

SEQ ID NO: 48864 - RNA, 22 nt, Homo sapiens
uuccuacugcccauuaaaaugg

SEQ ID NO: 48865 - RNA, 22 nt, Homo sapiens
uucuacuccucauggcagguug

SEQ ID NO: 48866 - RNA, 22 nt, Homo sapiens
uucucauggugauggcaaaauc

SEQ ID NO: 48867 - RNA, 22 nt, Homo sapiens
uucuccugguggacccuaaacg

SEQ ID NO: 48868 - RNA, 22 nt, Homo sapiens
uucuggaaaucagcagagggug

SEQ ID NO: 48869 - RNA, 22 nt, Homo sapiens
uucugugguugaaaggagagau

SEQ ID NO: 48870 - RNA, 21 nt, Homo sapiens
uucuuugcucaguguuagagu

SEQ ID NO: 48871 - RNA, 22 nt, Homo sapiens
uucuuugguacaagggccgacc

SEQ ID NO: 48872 - RNA, 22 nt, Homo sapiens
gugaagugugaccucagcaucu

SEQ ID NO: 48873 - RNA, 22 nt, Homo sapiens
gugaaucuguuuucuucuguuc

SEQ ID NO: 48874 - RNA, 22 nt, Homo sapiens
gugagacugaguuucgcucuug

SEQ ID NO: 48875 - RNA, 22 nt, Homo sapiens
gugagauaaugucucauugugg

SEQ ID NO: 48876 - RNA, 22 nt, Homo sapiens
gugaggcugguccugccuccca

SEQ ID NO: 48877 - RNA, 22 nt, Homo sapiens
gugauguguuucaacagcuccu

SEQ ID NO: 48878 - RNA, 22 nt, Homo sapiens
gugcaaaucucugaguaucuuu

SEQ ID NO: 48879 - RNA, 21 nt, Homo sapiens
gugcacaguaguguuuaauag

SEQ ID NO: 48880 - RNA, 22 nt, Homo sapiens
gugccuuuucugagcaaugagc

SEQ ID NO: 48881 - RNA, 22 nt, Homo sapiens
guggaaaucucugugugacuua

SEQ ID NO: 48882 - RNA, 22 nt, Homo sapiens
guggaagaccagacuuuccaac

SEQ ID NO: 48883 - RNA, 20 nt, Homo sapiens
guggaaguagaaacauaugu

SEQ ID NO: 48884 - RNA, 22 nt, Homo sapiens
guggaggacuggauaaagaaaa

SEQ ID NO: 48885 - RNA, 22 nt, Homo sapiens
guggcagaaaagagaagcaaug

SEQ ID NO: 48886 - RNA, 22 nt, Homo sapiens
gugggauggagagaagguauga

SEQ ID NO: 48887 - RNA, 22 nt, Homo sapiens
gugucacugugaggauauugua

SEQ ID NO: 48888 - RNA, 22 nt, Homo sapiens
gugucaguggggagugaucuuc

SEQ ID NO: 48889 - RNA, 22 nt, Homo sapiens
guguccucgaguacacaucagg

SEQ ID NO: 48890 - RNA, 22 nt, Homo sapiens
gugugcaacuuucauuaauauu

SEQ ID NO: 48891 - RNA, 19 nt, Homo sapiens
gugugcauaucacagagca

SEQ ID NO: 48892 - RNA, 22 nt, Homo sapiens
guucaguuuugaaauguuaauu

SEQ ID NO: 48893 - RNA, 22 nt, Homo sapiens
guugaucuauguugcuggcagu

SEQ ID NO: 48894 - RNA, 22 nt, Homo sapiens
guuugguugcauggaaaauuua

SEQ ID NO: 48895 - RNA, 22 nt, Homo sapiens
guuuguaacucuagugacuaga

SEQ ID NO: 48896 - RNA, 15 nt, Homo sapiens
guuuuuggauacaau

SEQ ID NO: 48897 - RNA, 22 nt, Homo sapiens
uaaagcacuuuuuucugcaugg

SEQ ID NO: 48898 - RNA, 22 nt, Homo sapiens
uaaagugaggauggcaguaggu

SEQ ID NO: 48899 - RNA, 22 nt, Homo sapiens
uaaaugcucuuuaaaagugcuu

SEQ ID NO: 48900 - RNA, 22 nt, Homo sapiens
uaaaugcuugagaugauggaua

SEQ ID NO: 48901 - RNA, 21 nt, Homo sapiens
uaaaugucauacaaagcaaug

SEQ ID NO: 48902 - RNA, 22 nt, Homo sapiens
uaacauuguugauuauacuaag

SEQ ID NO: 48903 - RNA, 22 nt, Homo sapiens
uaagacuguguaauuuaugaag

SEQ ID NO: 48904 - RNA, 22 nt, Homo sapiens
uaagcagugcaagaauggaaua

SEQ ID NO: 48905 - RNA, 22 nt, Homo sapiens
uaaggcauuuuuuugaguugca

SEQ ID NO: 48906 - RNA, 22 nt, Homo sapiens
uaagggcaugcugcaugagagu

SEQ ID NO: 48907 - RNA, 22 nt, Homo sapiens
uaaguaauugcagcaauuugcc

SEQ ID NO: 48908 - RNA, 22 nt, Homo sapiens
uaaguauuaugugcugcauuuu

SEQ ID NO: 48909 - RNA, 22 nt, Homo sapiens
uaagugcaugauuacaugcaua

SEQ ID NO: 48910 - RNA, 22 nt, Homo sapiens
uaagugcuugacuuugauguuu

SEQ ID NO: 48911 - RNA, 23 nt, Homo sapiens
uaaguucaucucuaauaggugga

SEQ ID NO: 48912 - RNA, 22 nt, Homo sapiens
uaauacuguaauggugguuccg

SEQ ID NO: 48913 - RNA, 22 nt, Homo sapiens
uacaaagugggaaacgaagguu

SEQ ID NO: 48914 - RNA, 22 nt, Homo sapiens
uacaaguaauaagggaagaauu

SEQ ID NO: 48915 - RNA, 22 nt, Homo sapiens
gugucuccuguggagcuaugua

SEQ ID NO: 48916 - RNA, 22 nt, Homo sapiens
gugugcaaauguguaccuacau

SEQ ID NO: 48917 - RNA, 22 nt, Homo sapiens
guuauugcucucgaagacucuc

SEQ ID NO: 48918 - RNA, 22 nt, Homo sapiens
guucaagcaauucugcugccuc

SEQ ID NO: 48919 - RNA, 20 nt, Homo sapiens
guucacagagguuaugauua

SEQ ID NO: 48920 - RNA, 22 nt, Homo sapiens
guucacaguuucuaaucccagc

SEQ ID NO: 48921 - RNA, 22 nt, Homo sapiens
guucagcaggggcuucaauggu

SEQ ID NO: 48922 - RNA, 22 nt, Homo sapiens
guuccuuguagaugcuggauau

SEQ ID NO: 48923 - RNA, 22 nt, Homo sapiens
guugcaaaguaauugugguuuu

SEQ ID NO: 48924 - RNA, 22 nt, Homo sapiens
guuuggcucuuguuucugucaa

SEQ ID NO: 48925 - RNA, 22 nt, Homo sapiens
guuuggcuuucucucuauccug

SEQ ID NO: 48926 - RNA, 22 nt, Homo sapiens
guuugugcuccuaugagaaucu

SEQ ID NO: 48927 - RNA, 22 nt, Homo sapiens
uaaagccagugauuaugucucu

SEQ ID NO: 48928 - RNA, 22 nt, Homo sapiens
uaaagcuagaauuguuccagca

SEQ ID NO: 48929 - RNA, 22 nt, Homo sapiens
uaaagcuagagcuggaguggca

SEQ ID NO: 48930 - RNA, 22 nt, Homo sapiens
uaaagcuaugagaacaccguag

SEQ ID NO: 48931 - RNA, 22 nt, Homo sapiens
uaaaugcuuaauugaaugugga

SEQ ID NO: 48932 - RNA, 22 nt, Homo sapiens
uaacaagagagucagucagucc

SEQ ID NO: 48933 - RNA, 22 nt, Homo sapiens
uaacaguggucugugguaucug

SEQ ID NO: 48934 - RNA, 20 nt, Homo sapiens
uaacuguggcuucuuuuggc

SEQ ID NO: 48935 - RNA, 18 nt, Homo sapiens
uaacugugggaacuaacu

SEQ ID NO: 48936 - RNA, 22 nt, Homo sapiens
uaagacuuuuugggaauauaga

SEQ ID NO: 48937 - RNA, 19 nt, Homo sapiens
uaagaugaagcugucuggg

SEQ ID NO: 48938 - RNA, 22 nt, Homo sapiens
uaaggaaggcugugugcuuuua

SEQ ID NO: 48939 - RNA, 22 nt, Homo sapiens
uaaggcccgugaguuucauauc

SEQ ID NO: 48940 - RNA, 22 nt, Homo sapiens
uaaggcuuuuguucagcguggg

SEQ ID NO: 48941 - RNA, 22 nt, Homo sapiens
uaagguauuuacauuucuguuu

SEQ ID NO: 48942 - RNA, 22 nt, Homo sapiens
uaaguauagguaacagaagcaa

SEQ ID NO: 48943 - RNA, 22 nt, Homo sapiens
uaagugaauauggacaguuagc

SEQ ID NO: 48944 - RNA, 20 nt, Homo sapiens
uaagugcuugaugaaugaac

SEQ ID NO: 48945 - RNA, 22 nt, Homo sapiens
uaauacucuucucauuuuacag

SEQ ID NO: 48946 - RNA, 22 nt, Homo sapiens
uaauugaaugcagacaccaggg

SEQ ID NO: 48947 - RNA, 22 nt, Homo sapiens
uacaaaucuagguuuguuacug

SEQ ID NO: 48948 - RNA, 22 nt, Homo sapiens
uacacacguguguauauauaca

SEQ ID NO: 48949 - RNA, 22 nt, Homo sapiens
uacagaguauccauuugaguuc

SEQ ID NO: 48950 - RNA, 19 nt, Homo sapiens
uacaggacugagcugaggu

SEQ ID NO: 48951 - RNA, 22 nt, Homo sapiens
uacaguaggauuuucagggucu

SEQ ID NO: 48952 - RNA, 22 nt, Homo sapiens
uacaguggugugaucucagcuc

SEQ ID NO: 48953 - RNA, 22 nt, Homo sapiens
uaccaaguauuuucacaugaac

SEQ ID NO: 48954 - RNA, 22 nt, Homo sapiens
uaccacaggcuggguaaucuau

SEQ ID NO: 48955 - RNA, 19 nt, Homo sapiens
uacugcaccucaaccuggg

SEQ ID NO: 48956 - RNA, 22 nt, Homo sapiens
uacuguacugcaguucugcaaa

SEQ ID NO: 48957 - RNA, 22 nt, Homo sapiens
uacuuuguagauuguuuccuuu

SEQ ID NO: 48958 - RNA, 22 nt, Homo sapiens
uagaacauuccaggugauguug

SEQ ID NO: 48959 - RNA, 20 nt, Homo sapiens
uagagagauauggggguucc

SEQ ID NO: 48960 - RNA, 22 nt, Homo sapiens
uagagguagccuacuacacacc

SEQ ID NO: 48961 - RNA, 22 nt, Homo sapiens
uagagguaggucuucgagucuc

SEQ ID NO: 48962 - RNA, 22 nt, Homo sapiens
uagauuaucuguaugugcucuu

SEQ ID NO: 48963 - RNA, 22 nt, Homo sapiens
uagcaaaucaauggaauugaag

SEQ ID NO: 48964 - RNA, 22 nt, Homo sapiens
uagcacaugucagguaauuugc

SEQ ID NO: 48965 - RNA, 22 nt, Homo sapiens
uagcagaauaacuugccagccu

SEQ ID NO: 48966 - RNA, 20 nt, Homo sapiens
uagcagcagacagagggagg

SEQ ID NO: 48967 - RNA, 22 nt, Homo sapiens
uagcaguauugaaagaugaggg

SEQ ID NO: 48968 - RNA, 22 nt, Homo sapiens
uagcugcugcuaggcuaaggau

SEQ ID NO: 48969 - RNA, 22 nt, Homo sapiens
uaggaaguacaucucagaaucu

SEQ ID NO: 48970 - RNA, 22 nt, Homo sapiens
uagguaaguaugugugaugggg

SEQ ID NO: 48971 - RNA, 22 nt, Homo sapiens
uagguaguuacacagcaaugua

SEQ ID NO: 48972 - RNA, 22 nt, Homo sapiens
uaggucacugcucugugucuaa

SEQ ID NO: 48973 - RNA, 22 nt, Homo sapiens
uaggucaguuuuggcuuggcuu

SEQ ID NO: 48974 - RNA, 22 nt, Homo sapiens
uaguaaacauuuuucuaucauu

SEQ ID NO: 48975 - RNA, 22 nt, Homo sapiens
uagugcugagauugagaagccc

SEQ ID NO: 48976 - RNA, 18 nt, Homo sapiens
uagugcuguucucaugau

SEQ ID NO: 48977 - RNA, 22 nt, Homo sapiens
uauaacacccacauauagucuu

SEQ ID NO: 48978 - RNA, 22 nt, Homo sapiens
uauacacgugugcauauauaca

SEQ ID NO: 48979 - RNA, 22 nt, Homo sapiens
uauacaguaggcacucaguggc

SEQ ID NO: 48980 - RNA, 22 nt, Homo sapiens
uauagcacugagaauguaauuc

SEQ ID NO: 48981 - RNA, 21 nt, Homo sapiens
uauaguaguaugauuuacaau

SEQ ID NO: 48982 - RNA, 22 nt, Homo sapiens
uauaucuagagcggaccaggcu

SEQ ID NO: 48983 - RNA, 23 nt, Homo sapiens
uauaugugucuaggagcuauggu

SEQ ID NO: 48984 - RNA, 19 nt, Homo sapiens
uaucaaguaugcacuguac

SEQ ID NO: 48985 - RNA, 22 nt, Homo sapiens
uaucauaguuuggacuuucauu

SEQ ID NO: 48986 - RNA, 23 nt, Homo sapiens
uaucccuugccuuaugaugugag

SEQ ID NO: 48987 - RNA, 22 nt, Homo sapiens
uaucucauccuccuugauccca

SEQ ID NO: 48988 - RNA, 22 nt, Homo sapiens
uaugagacugguuaauuuuugu

SEQ ID NO: 48989 - RNA, 22 nt, Homo sapiens
uaugagacugugagugagaaau

SEQ ID NO: 48990 - RNA, 22 nt, Homo sapiens
uaugccuuuugguucaagcaac

SEQ ID NO: 48991 - RNA, 22 nt, Homo sapiens
uauggcauuauuuugauagaca

SEQ ID NO: 48992 - RNA, 22 nt, Homo sapiens
uaugguuuuaagguuaaggacu

SEQ ID NO: 48993 - RNA, 20 nt, Homo sapiens
uaugguuuuagguauagcau

SEQ ID NO: 48994 - RNA, 17 nt, Homo sapiens
uauguaguacuuauaaa

SEQ ID NO: 48995 - RNA, 22 nt, Homo sapiens
uauucacuguaucauugauggg

SEQ ID NO: 48996 - RNA, 22 nt, Homo sapiens
uauuccuuuugcauuuccacau

SEQ ID NO: 48997 - RNA, 22 nt, Homo sapiens
uauugauuuucaguguucagcu

SEQ ID NO: 48998 - RNA, 22 nt, Homo sapiens
uauugcuaaauucuuuuccuag

SEQ ID NO: 48999 - RNA, 22 nt, Homo sapiens
uauugcugaugcugaagggaag

SEQ ID NO: 49000 - RNA, 22 nt, Homo sapiens
uauuguacauauccucccuuca

SEQ ID NO: 49001 - RNA, 22 nt, Homo sapiens
uauuguccaauaggauguuccu

SEQ ID NO: 49002 - RNA, 22 nt, Homo sapiens
ucaaagugagcuccuucucacu

SEQ ID NO: 49003 - RNA, 21 nt, Homo sapiens
ucaaaguguucuuuuguugaa

SEQ ID NO: 49004 - RNA, 22 nt, Homo sapiens
ucaaaucaucuuuuccaaagcu

SEQ ID NO: 49005 - RNA, 17 nt, Homo sapiens
ucaaaugcucccaguga

SEQ ID NO: 49006 - RNA, 22 nt, Homo sapiens
ucaacagugauggaaaguuaua

SEQ ID NO: 49007 - RNA, 23 nt, Homo sapiens
ucaagugaugguggccacaaggg

SEQ ID NO: 49008 - RNA, 22 nt, Homo sapiens
ucaagugauucuugugccuuag

SEQ ID NO: 49009 - RNA, 22 nt, Homo sapiens
ucaaugcaugugacaaagagua

SEQ ID NO: 49010 - RNA, 18 nt, Homo sapiens
ucaauguggauguucuuu

SEQ ID NO: 49011 - RNA, 22 nt, Homo sapiens
ucacaaguguauagacaugucc

SEQ ID NO: 49012 - RNA, 22 nt, Homo sapiens
ucacaauggagacucgggcgga

SEQ ID NO: 49013 - RNA, 22 nt, Homo sapiens
ucacaauggcugaacuaauuua

SEQ ID NO: 49014 - RNA, 22 nt, Homo sapiens
ucacacucucaccaacauuugg

SEQ ID NO: 49015 - RNA, 18 nt, Homo sapiens
ucacagguaauuaggauu

SEQ ID NO: 49016 - RNA, 22 nt, Homo sapiens
ucacagucaaaguaaucauaga

SEQ ID NO: 49017 - RNA, 20 nt, Homo sapiens
ucacagucacacauaauccu

SEQ ID NO: 49018 - RNA, 22 nt, Homo sapiens
ucacaguguuaaaccuuucuuu

SEQ ID NO: 49019 - RNA, 22 nt, Homo sapiens
ucacaguucagcauggcugagg

SEQ ID NO: 49020 - RNA, 22 nt, Homo sapiens
augauaucuuguuuuucaugca

SEQ ID NO: 49021 - RNA, 22 nt, Homo sapiens
augaucuguuuggugaucuugu

SEQ ID NO: 49022 - RNA, 22 nt, Homo sapiens
augcacaguccagcccaugugg

SEQ ID NO: 49023 - RNA, 22 nt, Homo sapiens
augcacaugcgaaaacuugugu

SEQ ID NO: 49024 - RNA, 22 nt, Homo sapiens
augcagcugaggguaguggagc

SEQ ID NO: 49025 - RNA, 22 nt, Homo sapiens
augcagguguuuugcacugagu

SEQ ID NO: 49026 - RNA, 22 nt, Homo sapiens
augcaugucaaauuuguagguu

SEQ ID NO: 49027 - RNA, 22 nt, Homo sapiens
augccaagaugagcacgcgucu

SEQ ID NO: 49028 - RNA, 22 nt, Homo sapiens
augcuguuuuguagcucccucu

SEQ ID NO: 49029 - RNA, 22 nt, Homo sapiens
auggaaacauaagaguauagau

SEQ ID NO: 49030 - RNA, 22 nt, Homo sapiens
auggaaagcuguuccuacacaa

SEQ ID NO: 49031 - RNA, 22 nt, Homo sapiens
auggaagaaaguuggguucuug

SEQ ID NO: 49032 - RNA, 22 nt, Homo sapiens
auggagaugaauaucaucuguu

SEQ ID NO: 49033 - RNA, 22 nt, Homo sapiens
auggaguguggaacugggaauc

SEQ ID NO: 49034 - RNA, 22 nt, Homo sapiens
auggauauugccuaggguagua

SEQ ID NO: 49035 - RNA, 22 nt, Homo sapiens
auggauuuguaguacaugguug

SEQ ID NO: 49036 - RNA, 22 nt, Homo sapiens
auggauuuuaggauacaguuga

SEQ ID NO: 49037 - RNA, 22 nt, Homo sapiens
auggcacuaaugggaguuuacu

SEQ ID NO: 49038 - RNA, 22 nt, Homo sapiens
auggcagcccucuuuauccaug

SEQ ID NO: 49039 - RNA, 22 nt, Homo sapiens
auggcaguguaugauuauauua

SEQ ID NO: 49040 - RNA, 22 nt, Homo sapiens
auggcaguuucagcuauaguuu

SEQ ID NO: 49041 - RNA, 22 nt, Homo sapiens
auggccauuacuaagaauguuu

SEQ ID NO: 49042 - RNA, 22 nt, Homo sapiens
auggcccccuguuugugaacau

SEQ ID NO: 49043 - RNA, 23 nt, Homo sapiens
auggcccuggugggagugucuuu

SEQ ID NO: 49044 - RNA, 22 nt, Homo sapiens
auggccuuucuggcacauuucc

SEQ ID NO: 49045 - RNA, 22 nt, Homo sapiens
auggcucaauucuuucccugaa

SEQ ID NO: 49046 - RNA, 22 nt, Homo sapiens
auggcucuguuuuuuaugcucu

SEQ ID NO: 49047 - RNA, 22 nt, Homo sapiens
auggcuucuuacucuucugcau

SEQ ID NO: 49048 - RNA, 22 nt, Homo sapiens
auggcuuuugcccuaaauggau

SEQ ID NO: 49049 - RNA, 22 nt, Homo sapiens
augggcaaauguuggaaauucc

SEQ ID NO: 49050 - RNA, 22 nt, Homo sapiens
auguaaacauuuggucuaaauu

SEQ ID NO: 49051 - RNA, 22 nt, Homo sapiens
auguaauugagguuuuugccau

SEQ ID NO: 49052 - RNA, 22 nt, Homo sapiens
auguauacauagauacgugugu

SEQ ID NO: 49053 - RNA, 22 nt, Homo sapiens
augucaaggugaagaaagauca

SEQ ID NO: 49054 - RNA, 22 nt, Homo sapiens
auguccuagagagauggugguc

SEQ ID NO: 49055 - RNA, 22 nt, Homo sapiens
augugaugguuaauuuuaugug

SEQ ID NO: 49056 - RNA, 22 nt, Homo sapiens
augugcaaagcacuguucagca

SEQ ID NO: 49057 - RNA, 22 nt, Homo sapiens
augugcaaaguuaagaucccag

SEQ ID NO: 49058 - RNA, 22 nt, Homo sapiens
augugcaagaucauuaaagcuc

SEQ ID NO: 49059 - RNA, 20 nt, Homo sapiens
augugcaguguggcaaccaa

SEQ ID NO: 49060 - RNA, 22 nt, Homo sapiens
augugggaggaauguguuucca

SEQ ID NO: 49061 - RNA, 23 nt, Homo sapiens
augugugcuuggagagcaggaug

SEQ ID NO: 49062 - RNA, 22 nt, Homo sapiens
auguuguaguaugagucaaaau

SEQ ID NO: 49063 - RNA, 22 nt, Homo sapiens
auuaacaucuagaguuuuggug

SEQ ID NO: 49064 - RNA, 22 nt, Homo sapiens
auuaaguuaggauuuugagaua

SEQ ID NO: 49065 - RNA, 22 nt, Homo sapiens
auuagguuaggcaaacuucugu

SEQ ID NO: 49066 - RNA, 22 nt, Homo sapiens
auuccagauggaguugaggguu

SEQ ID NO: 49067 - RNA, 22 nt, Homo sapiens
auucccuguagaauaaggaugg

SEQ ID NO: 49068 - RNA, 22 nt, Homo sapiens
auugaacaugccauauguacca

SEQ ID NO: 49069 - RNA, 22 nt, Homo sapiens
auugaauuugguuugcuaagaa

SEQ ID NO: 49070 - RNA, 22 nt, Homo sapiens
auugcauaaacacauuucuuau

SEQ ID NO: 49071 - RNA, 22 nt, Homo sapiens
auugcuaacugaaauaagacca

SEQ ID NO: 49072 - RNA, 22 nt, Homo sapiens
auuggggaaugguggcuuuagu

SEQ ID NO: 49073 - RNA, 22 nt, Homo sapiens
auugucauuuauaacuguguag

SEQ ID NO: 49074 - RNA, 20 nt, Homo sapiens
auuugcauuauggagcaccc

SEQ ID NO: 49075 - RNA, 22 nt, Homo sapiens
auuuggcauagaguaucauucu

SEQ ID NO: 49076 - RNA, 20 nt, Homo sapiens
auuuggcauaguuuaagcaa

SEQ ID NO: 49077 - RNA, 22 nt, Homo sapiens
auuuugcauugcuguaaaggaa

SEQ ID NO: 49078 - RNA, 22 nt, Homo sapiens
auuuuuggauauagggaaggau

SEQ ID NO: 49079 - RNA, 22 nt, Homo sapiens
caaaguaauugugguuuugcca

SEQ ID NO: 49080 - RNA, 22 nt, Homo sapiens
caaagugcuggaauuggccggg

SEQ ID NO: 49081 - RNA, 22 nt, Homo sapiens
caaaugacaucauuucauucaa

SEQ ID NO: 49082 - RNA, 22 nt, Homo sapiens
caaauugcuuguggaggauaau

SEQ ID NO: 49083 - RNA, 22 nt, Homo sapiens
caagguacuuuuacaauuuccc

SEQ ID NO: 49084 - RNA, 22 nt, Homo sapiens
caaguguuuccuuaaauacuug

SEQ ID NO: 49085 - RNA, 22 nt, Homo sapiens
cacagcuagucaaugguagaca

SEQ ID NO: 49086 - RNA, 22 nt, Homo sapiens
cacaguguuacugguaugaagu

SEQ ID NO: 49087 - RNA, 22 nt, Homo sapiens
cacauguucaggagcacuuaga

SEQ ID NO: 49088 - RNA, 22 nt, Homo sapiens
caccauguguucagaaggauug

SEQ ID NO: 49089 - RNA, 21 nt, Homo sapiens
cacugcacuugccuucugggu

SEQ ID NO: 49090 - RNA, 17 nt, Homo sapiens
cacugggugcaagagga

SEQ ID NO: 49091 - RNA, 22 nt, Homo sapiens
cagcaaaucauccuauuugagc

SEQ ID NO: 49092 - RNA, 22 nt, Homo sapiens
cagcacauagcaguugcucagu

SEQ ID NO: 49093 - RNA, 22 nt, Homo sapiens
cagcacauuacaaguacuuggu

SEQ ID NO: 49094 - RNA, 22 nt, Homo sapiens
cagcuguuguugggguauagga

SEQ ID NO: 49095 - RNA, 22 nt, Homo sapiens
cagguaguauuugguuacauaa

SEQ ID NO: 49096 - RNA, 22 nt, Homo sapiens
caguuguuuuaugacauaagau

SEQ ID NO: 49097 - RNA, 22 nt, Homo sapiens
cauaaugcuaagagcugccccu

SEQ ID NO: 49098 - RNA, 22 nt, Homo sapiens
cauacaagcuacaaucacaaag

SEQ ID NO: 49099 - RNA, 22 nt, Homo sapiens
cauauaguaggugcucuguguu

SEQ ID NO: 49100 - RNA, 21 nt, Homo sapiens
caucacauuacucaaaguccu

SEQ ID NO: 49101 - RNA, 22 nt, Homo sapiens
caucagcaauguaugaggguuc

SEQ ID NO: 49102 - RNA, 22 nt, Homo sapiens
caucccugucgucaagucucug

SEQ ID NO: 49103 - RNA, 22 nt, Homo sapiens
caugauauugcagaauguuggu

SEQ ID NO: 49104 - RNA, 22 nt, Homo sapiens
cauggcuuguauaagauucuca

SEQ ID NO: 49105 - RNA, 22 nt, Homo sapiens
ccaaaguauuuucacugauauc

SEQ ID NO: 49106 - RNA, 22 nt, Homo sapiens
ccaaguguucucauuguucaau

SEQ ID NO: 49107 - RNA, 19 nt, Homo sapiens
ccacaaugguugaacuaga

SEQ ID NO: 49108 - RNA, 23 nt, Homo sapiens
ccacaaugguugaacuagauuac

SEQ ID NO: 49109 - RNA, 22 nt, Homo sapiens
ccacaguugaaauuuugacugu

SEQ ID NO: 49110 - RNA, 22 nt, Homo sapiens
ccaguuuucccagcaccauuaa

SEQ ID NO: 49111 - RNA, 22 nt, Homo sapiens
ccaguuuuuggcaaugaugaau

SEQ ID NO: 49112 - RNA, 22 nt, Homo sapiens
ccauacugucaaauagauuucc

SEQ ID NO: 49113 - RNA, 21 nt, Homo sapiens
ccaugggacggaaugaauaca

SEQ ID NO: 49114 - RNA, 22 nt, Homo sapiens
ccauuucacucuuccugaagga

SEQ ID NO: 49115 - RNA, 22 nt, Homo sapiens
ccccauuugaacuccuucaacu

SEQ ID NO: 49116 - RNA, 17 nt, Homo sapiens
cccuaguagcugggacu

SEQ ID NO: 49117 - RNA, 19 nt, Homo sapiens
ccugcuguucuuuugcacc

SEQ ID NO: 49118 - RNA, 22 nt, Homo sapiens
ccuggaucauugucauucccaa

SEQ ID NO: 49119 - RNA, 22 nt, Homo sapiens
ccuggcacugggccccguggcu

SEQ ID NO: 49120 - RNA, 22 nt, Homo sapiens
cgccgggggaugggcaccagcg

SEQ ID NO: 49121 - RNA, 22 nt, Homo sapiens
cgccugagcugaggaagcugca

SEQ ID NO: 49122 - RNA, 22 nt, Homo sapiens
cuaagggaggaagcugugcagg

SEQ ID NO: 49123 - RNA, 20 nt, Homo sapiens
cuaaucaucccagaagaaau

SEQ ID NO: 49124 - RNA, 22 nt, Homo sapiens
cuacagugggucuguaguccuu

SEQ ID NO: 49125 - RNA, 22 nt, Homo sapiens
ucagugucugugauggagaggu

SEQ ID NO: 49126 - RNA, 22 nt, Homo sapiens
ucaguuaaugcugccugcugga

SEQ ID NO: 49127 - RNA, 21 nt, Homo sapiens
ucauaagcucaacaucuguag

SEQ ID NO: 49128 - RNA, 21 nt, Homo sapiens
ucaucaagcuguagacaugau

SEQ ID NO: 49129 - RNA, 22 nt, Homo sapiens
ucaucagaaucccuuagggaug

SEQ ID NO: 49130 - RNA, 21 nt, Homo sapiens
ucaucagucaaagacaauggu

SEQ ID NO: 49131 - RNA, 22 nt, Homo sapiens
ucaugugaggauaacaauagug

SEQ ID NO: 49132 - RNA, 22 nt, Homo sapiens
ucauuagucaccuagccagcuu

SEQ ID NO: 49133 - RNA, 22 nt, Homo sapiens
ucauugguucuggguguuguug

SEQ ID NO: 49134 - RNA, 22 nt, Homo sapiens
uccagguuuugugaguuuaaau

SEQ ID NO: 49135 - RNA, 22 nt, Homo sapiens
uccauuugucuauguuucuguu

SEQ ID NO: 49136 - RNA, 22 nt, Homo sapiens
ucccuagagaagugauuuuuga

SEQ ID NO: 49137 - RNA, 22 nt, Homo sapiens
uccugcauucauccugguguug

SEQ ID NO: 49138 - RNA, 22 nt, Homo sapiens
uccuuuaguuaauaaagacaag

SEQ ID NO: 49139 - RNA, 22 nt, Homo sapiens
ucucagugaaauaaauuauuuu

SEQ ID NO: 49140 - RNA, 22 nt, Homo sapiens
ucucagugaauguggaaaaagc

SEQ ID NO: 49141 - RNA, 20 nt, Homo sapiens
ucucauggagguagagaaua

SEQ ID NO: 49142 - RNA, 21 nt, Homo sapiens
ucucauuacugaugagccaga

SEQ ID NO: 49143 - RNA, 22 nt, Homo sapiens
ucuccaguuuccuucgucuauc

SEQ ID NO: 49144 - RNA, 22 nt, Homo sapiens
ucuccggguggcggcgaaggga

SEQ ID NO: 49145 - RNA, 22 nt, Homo sapiens
ucucugauuaaacaagauagug

SEQ ID NO: 49146 - RNA, 22 nt, Homo sapiens
ucucuggauaucuacuuauguu

SEQ ID NO: 49147 - RNA, 22 nt, Homo sapiens
ucucugguuuguggaaucuuag

SEQ ID NO: 49148 - RNA, 22 nt, Homo sapiens
ucucuuggcggaaguugcagug

SEQ ID NO: 49149 - RNA, 22 nt, Homo sapiens
ucugagaugagacuuugaauuu

SEQ ID NO: 49150 - RNA, 22 nt, Homo sapiens
ucugcauaucaugcagaacuau

SEQ ID NO: 49151 - RNA, 21 nt, Homo sapiens
ucuggccccuccaaaucucau

SEQ ID NO: 49152 - RNA, 20 nt, Homo sapiens
ucuggccccucuaaaucuca

SEQ ID NO: 49153 - RNA, 22 nt, Homo sapiens
ucuggcuuauuucacuuagcau

SEQ ID NO: 49154 - RNA, 22 nt, Homo sapiens
ucuggcuugugaacugucuucu

SEQ ID NO: 49155 - RNA, 22 nt, Homo sapiens
ucuggcuuugugaguugccaga

SEQ ID NO: 49156 - RNA, 22 nt, Homo sapiens
ucugguggugaugagagacagu

SEQ ID NO: 49157 - RNA, 22 nt, Homo sapiens
ucugucuugugguuugagugcc

SEQ ID NO: 49158 - RNA, 22 nt, Homo sapiens
ucugugcauuacacuuuucuca

SEQ ID NO: 49159 - RNA, 19 nt, Homo sapiens
ucugugcuugucccccugu

SEQ ID NO: 49160 - RNA, 22 nt, Homo sapiens
ucuguggucagcauccgccacu

SEQ ID NO: 49161 - RNA, 22 nt, Homo sapiens
ucugugguucuagcuacuuugg

SEQ ID NO: 49162 - RNA, 22 nt, Homo sapiens
ucugugguuguugcauggaaug

SEQ ID NO: 49163 - RNA, 22 nt, Homo sapiens
ucuguguuuagacccaggguag

SEQ ID NO: 49164 - RNA, 22 nt, Homo sapiens
ucuguuguuaucauaauauuga

SEQ ID NO: 49165 - RNA, 22 nt, Homo sapiens
ucuucagucauauuggccugga

SEQ ID NO: 49166 - RNA, 22 nt, Homo sapiens
ucuuugauuaugcagauggguu

SEQ ID NO: 49167 - RNA, 22 nt, Homo sapiens
ucuuuggguagauauguagcug

SEQ ID NO: 49168 - RNA, 22 nt, Homo sapiens
ucuuugguaauggaugucugau

SEQ ID NO: 49169 - RNA, 22 nt, Homo sapiens
ucuuuguuuucugauccugaag

SEQ ID NO: 49170 - RNA, 22 nt, Homo sapiens
ucuuuugugagucagccucucc

SEQ ID NO: 49171 - RNA, 22 nt, Homo sapiens
ugaaaagucuaagauuaagguu

SEQ ID NO: 49172 - RNA, 18 nt, Homo sapiens
ugaaacacauuuuuuccu

SEQ ID NO: 49173 - RNA, 22 nt, Homo sapiens
ugaaacauacacucugaugggg

SEQ ID NO: 49174 - RNA, 22 nt, Homo sapiens
ugaaaugccuugagauuuugac

SEQ ID NO: 49175 - RNA, 22 nt, Homo sapiens
ugaaaugcugucuaggggaaau

SEQ ID NO: 49176 - RNA, 22 nt, Homo sapiens
ugaaauguuaaacaaguggcuc

SEQ ID NO: 49177 - RNA, 22 nt, Homo sapiens
ugaaauguugggugauggaauc

SEQ ID NO: 49178 - RNA, 16 nt, Homo sapiens
ugaacagagaggauuc

SEQ ID NO: 49179 - RNA, 22 nt, Homo sapiens
ugaacagucaucucucuuguau

SEQ ID NO: 49180 - RNA, 22 nt, Homo sapiens
ugaagacauuuuugggugugua

SEQ ID NO: 49181 - RNA, 22 nt, Homo sapiens
ugaauauuugcuacucacucuu

SEQ ID NO: 49182 - RNA, 21 nt, Homo sapiens
ugaauauuuggguugugucca

SEQ ID NO: 49183 - RNA, 22 nt, Homo sapiens
ugaauggauccaauucuuagua

SEQ ID NO: 49184 - RNA, 22 nt, Homo sapiens
ugaauguaagaugucugcuggu

SEQ ID NO: 49185 - RNA, 21 nt, Homo sapiens
ugaaugucuaggcagaaguuu

SEQ ID NO: 49186 - RNA, 22 nt, Homo sapiens
ugaauuguuuacgagaugugag

SEQ ID NO: 49187 - RNA, 22 nt, Homo sapiens
ugacaagagaccccuccgcagg

SEQ ID NO: 49188 - RNA, 22 nt, Homo sapiens
cacuggcacuguguuuagaugg

SEQ ID NO: 49189 - RNA, 16 nt, Homo sapiens
cacuggucuuaccaug

SEQ ID NO: 49190 - RNA, 22 nt, Homo sapiens
cacuuugguucaccugaguuuc

SEQ ID NO: 49191 - RNA, 22 nt, Homo sapiens
cagagguaagcaagucagcauu

SEQ ID NO: 49192 - RNA, 22 nt, Homo sapiens
caggcagugggagacaaaacug

SEQ ID NO: 49193 - RNA, 22 nt, Homo sapiens
caggcuuuuccacacauggguu

SEQ ID NO: 49194 - RNA, 22 nt, Homo sapiens
cagguaagaugcuuucucuuau

SEQ ID NO: 49195 - RNA, 22 nt, Homo sapiens
caggugguauuugguuuucugu

SEQ ID NO: 49196 - RNA, 22 nt, Homo sapiens
cagugacacugaaaaguucggg

SEQ ID NO: 49197 - RNA, 22 nt, Homo sapiens
caguucaugguaggcaccauag

SEQ ID NO: 49198 - RNA, 22 nt, Homo sapiens
cauacaguaggcacuauuugua

SEQ ID NO: 49199 - RNA, 22 nt, Homo sapiens
cauacaugugcuugucuuaugc

SEQ ID NO: 49200 - RNA, 22 nt, Homo sapiens
cauaugguuuuauguucuucau

SEQ ID NO: 49201 - RNA, 22 nt, Homo sapiens
caucacagcaaguagggagugg

SEQ ID NO: 49202 - RNA, 22 nt, Homo sapiens
caugcagcacacaugucugugc

SEQ ID NO: 49203 - RNA, 22 nt, Homo sapiens
caugccacuguggacaaagaca

SEQ ID NO: 49204 - RNA, 22 nt, Homo sapiens
caugucuuuuaaacauucaacu

SEQ ID NO: 49205 - RNA, 22 nt, Homo sapiens
cauugcagauccuucaaaugac

SEQ ID NO: 49206 - RNA, 22 nt, Homo sapiens
cauuguacauaaguauggagua

SEQ ID NO: 49207 - RNA, 22 nt, Homo sapiens
cauugucccucaaugacuauga

SEQ ID NO: 49208 - RNA, 22 nt, Homo sapiens
cauugucccucaaugucuauga

SEQ ID NO: 49209 - RNA, 22 nt, Homo sapiens
cauuuuacuuuccagacgugga

SEQ ID NO: 49210 - RNA, 22 nt, Homo sapiens
ccaagccucaguuucccucugu

SEQ ID NO: 49211 - RNA, 20 nt, Homo sapiens
ccagcaucauuagauucugg

SEQ ID NO: 49212 - RNA, 21 nt, Homo sapiens
ccaguguaaugauagcaggca

SEQ ID NO: 49213 - RNA, 22 nt, Homo sapiens
ccaguuuucaagauaaugguuu

SEQ ID NO: 49214 - RNA, 22 nt, Homo sapiens
ccaucacacugugauuauuauc

SEQ ID NO: 49215 - RNA, 22 nt, Homo sapiens
ccucauggagaaccucugcuag

SEQ ID NO: 49216 - RNA, 22 nt, Homo sapiens
ccugugguuaaccagcuagaug

SEQ ID NO: 49217 - RNA, 22 nt, Homo sapiens
ccuguguuaugguuucuaaugu

SEQ ID NO: 49218 - RNA, 22 nt, Homo sapiens
cggcaguggguaagccaagcuu

SEQ ID NO: 49219 - RNA, 18 nt, Homo sapiens
cuaagacacuuggcagag

SEQ ID NO: 49220 - RNA, 22 nt, Homo sapiens
cuacacaugcaggcucccugcc

SEQ ID NO: 49221 - RNA, 22 nt, Homo sapiens
cuacaguagagaggauguagaa

SEQ ID NO: 49222 - RNA, 22 nt, Homo sapiens
cuacaguaugaaaccuuuacuc

SEQ ID NO: 49223 - RNA, 22 nt, Homo sapiens
cuacccuuaaguuucugugggg

SEQ ID NO: 49224 - RNA, 22 nt, Homo sapiens
cuagaguacuuaccacagcaug

SEQ ID NO: 49225 - RNA, 22 nt, Homo sapiens
cuauauacugccugcugauuag

SEQ ID NO: 49226 - RNA, 22 nt, Homo sapiens
cuauggcuguaaggauaguaac

SEQ ID NO: 49227 - RNA, 22 nt, Homo sapiens
cuauuagguuggugcaaaagua

SEQ ID NO: 49228 - RNA, 22 nt, Homo sapiens
cucaaguaauccucccgccuug

SEQ ID NO: 49229 - RNA, 22 nt, Homo sapiens
cucaauuuggaauugucaguaa

SEQ ID NO: 49230 - RNA, 22 nt, Homo sapiens
ugucuggaguccauagaagugu

SEQ ID NO: 49231 - RNA, 22 nt, Homo sapiens
ugugaccaaaaucaacauaccu

SEQ ID NO: 49232 - RNA, 19 nt, Homo sapiens
ugugacugguugucucgcu

SEQ ID NO: 49233 - RNA, 22 nt, Homo sapiens
ugugcaaauguuaaacuaacuu

SEQ ID NO: 49234 - RNA, 22 nt, Homo sapiens
ugugcacaugauauaucacaua

SEQ ID NO: 49235 - RNA, 22 nt, Homo sapiens
ugugcaugacagcauacaaacg

SEQ ID NO: 49236 - RNA, 22 nt, Homo sapiens
ugugcuugaauuuaguagcuua

SEQ ID NO: 49237 - RNA, 22 nt, Homo sapiens
ugugcuuguaaaggccagagca

SEQ ID NO: 49238 - RNA, 22 nt, Homo sapiens
ugugggugguaaaauacaauga

SEQ ID NO: 49239 - RNA, 22 nt, Homo sapiens
ugugguuuuaguaaaacuaugu

SEQ ID NO: 49240 - RNA, 22 nt, Homo sapiens
ugugguuuuucacauuuagaga

SEQ ID NO: 49241 - RNA, 22 nt, Homo sapiens
ugugucacugaggguuagugua

SEQ ID NO: 49242 - RNA, 22 nt, Homo sapiens
ugugucacugcacuccagccug

SEQ ID NO: 49243 - RNA, 22 nt, Homo sapiens
ugugucuugagagucucgagaa

SEQ ID NO: 49244 - RNA, 22 nt, Homo sapiens
uguguuugauaaguccauaguu

SEQ ID NO: 49245 - RNA, 22 nt, Homo sapiens
uguguuuuuauguaaaauggaa

SEQ ID NO: 49246 - RNA, 22 nt, Homo sapiens
uguucacaguguuucuuugaga

SEQ ID NO: 49247 - RNA, 22 nt, Homo sapiens
uguucuggagaggcaggccaca

SEQ ID NO: 49248 - RNA, 22 nt, Homo sapiens
uguugcaccugccuugcuuuag

SEQ ID NO: 49249 - RNA, 22 nt, Homo sapiens
uguugcuuaagccacccagucu

SEQ ID NO: 49250 - RNA, 22 nt, Homo sapiens
uguuuguuugauaugggauaaa

SEQ ID NO: 49251 - RNA, 22 nt, Homo sapiens
uuaaagcuggcguuacaguuug

SEQ ID NO: 49252 - RNA, 22 nt, Homo sapiens
uuaaaggcauguacacuagagu

SEQ ID NO: 49253 - RNA, 22 nt, Homo sapiens
uuaacaguuaauucuuuggcaa

SEQ ID NO: 49254 - RNA, 22 nt, Homo sapiens
uuaagcaguaguuaaggagagg

SEQ ID NO: 49255 - RNA, 22 nt, Homo sapiens
uuaauguaauugauugauugac

SEQ ID NO: 49256 - RNA, 22 nt, Homo sapiens
uuacagauggcacacucaaggg

SEQ ID NO: 49257 - RNA, 17 nt, Homo sapiens
uuacaggugcugagagu

SEQ ID NO: 49258 - RNA, 22 nt, Homo sapiens
uuacaguauugcaaggacuagg

SEQ ID NO: 49259 - RNA, 22 nt, Homo sapiens
uuagaguacaggggaaucaagg

SEQ ID NO: 49260 - RNA, 20 nt, Homo sapiens
uuagaguaguaugauuuaua

SEQ ID NO: 49261 - RNA, 22 nt, Homo sapiens
uuagcacauuuccagcacaugg

SEQ ID NO: 49262 - RNA, 22 nt, Homo sapiens
uuaggagacuggauaucucuuu

SEQ ID NO: 49263 - RNA, 22 nt, Homo sapiens
uuauauguuagacauggugggu

SEQ ID NO: 49264 - RNA, 22 nt, Homo sapiens
uuaucucaguguuuguaaacaa

SEQ ID NO: 49265 - RNA, 17 nt, Homo sapiens
uuaugagacuucuuagc

SEQ ID NO: 49266 - RNA, 22 nt, Homo sapiens
uucaagugguucagaagucuga

SEQ ID NO: 49267 - RNA, 22 nt, Homo sapiens
uucaauaugucauuggcaggca

SEQ ID NO: 49268 - RNA, 22 nt, Homo sapiens
uucacagagagaacucaaacca

SEQ ID NO: 49269 - RNA, 22 nt, Homo sapiens
uucacagucacccuucuccaug

SEQ ID NO: 49270 - RNA, 22 nt, Homo sapiens
uucacaugguugccuuuugauc

SEQ ID NO: 49271 - RNA, 21 nt, Homo sapiens
uucaccauggcuccacacucu

SEQ ID NO: 49272 - RNA, 22 nt, Homo sapiens
uucaccuggaguucaggauaag

SEQ ID NO: 49273 - RNA, 20 nt, Homo sapiens
uucacugggcucucuguugg

SEQ ID NO: 49274 - RNA, 22 nt, Homo sapiens
uucacuguaaaaugaagagggu

SEQ ID NO: 49275 - RNA, 22 nt, Homo sapiens
uucacugugaacucauauucag

SEQ ID NO: 49276 - RNA, 22 nt, Homo sapiens
uucacugugcuuaaauucugcu

SEQ ID NO: 49277 - RNA, 22 nt, Homo sapiens
uucagagugguaugaagugaug

SEQ ID NO: 49278 - RNA, 22 nt, Homo sapiens
uucagauugcauaccgaaagua

SEQ ID NO: 49279 - RNA, 22 nt, Homo sapiens
uucagcaguggccaguggaaau

SEQ ID NO: 49280 - RNA, 22 nt, Homo sapiens
uugaaagucauggcacaggcaa

SEQ ID NO: 49281 - RNA, 22 nt, Homo sapiens
uugaaagucauuucuucuaagu

SEQ ID NO: 49282 - RNA, 22 nt, Homo sapiens
uugaaggaggugcucacucucg

SEQ ID NO: 49283 - RNA, 22 nt, Homo sapiens
uugacaguugggcagggaaguu

SEQ ID NO: 49284 - RNA, 22 nt, Homo sapiens
uugacuuuuaggaggaaaauga

SEQ ID NO: 49285 - RNA, 22 nt, Homo sapiens
uugagauauccauaaaugggaa

SEQ ID NO: 49286 - RNA, 22 nt, Homo sapiens
uugagauaucuuggccuuugca

SEQ ID NO: 49287 - RNA, 22 nt, Homo sapiens
uugagauggagucucacugugu

SEQ ID NO: 49288 - RNA, 22 nt, Homo sapiens
uugagauggauagacauagcau

SEQ ID NO: 49289 - RNA, 22 nt, Homo sapiens
uugagauguaguuucacuccug

SEQ ID NO: 49290 - RNA, 22 nt, Homo sapiens
uugagauguauguauauaaugu

SEQ ID NO: 49291 - RNA, 22 nt, Homo sapiens
uugagcaacauagugagacugu

SEQ ID NO: 49292 - RNA, 22 nt, Homo sapiens
uugaggacugcuaagcauuuga

SEQ ID NO: 49293 - RNA, 22 nt, Homo sapiens
uugaggcuuuugaccucaugug

SEQ ID NO: 49294 - RNA, 22 nt, Homo sapiens
uugcaagaaaucagagccuucc

SEQ ID NO: 49295 - RNA, 22 nt, Homo sapiens
uugcagcaaagagggaggggca

SEQ ID NO: 49296 - RNA, 19 nt, Homo sapiens
uugcauagguugaaccagc

SEQ ID NO: 49297 - RNA, 19 nt, Homo sapiens
uugcauauguugaaccagg

SEQ ID NO: 49298 - RNA, 22 nt, Homo sapiens
uugcaugucauaacugauggaa

SEQ ID NO: 49299 - RNA, 22 nt, Homo sapiens
uugcaugucugcuucuccuccu

SEQ ID NO: 49300 - RNA, 22 nt, Homo sapiens
uugcuacuuggauguacaugug

SEQ ID NO: 49301 - RNA, 22 nt, Homo sapiens
uugcuucauucaacauugaggg

SEQ ID NO: 49302 - RNA, 22 nt, Homo sapiens
uugcuuuguuacugcaguuucc

SEQ ID NO: 49303 - RNA, 22 nt, Homo sapiens
uuggaaacauuuaugguaacag

SEQ ID NO: 49304 - RNA, 22 nt, Homo sapiens
uuggaagacaaugcugauucuc

SEQ ID NO: 49305 - RNA, 22 nt, Homo sapiens
uuggaauuuuacuucuguaaga

SEQ ID NO: 49306 - RNA, 22 nt, Homo sapiens
uuggacugagaguuccaccauu

SEQ ID NO: 49307 - RNA, 22 nt, Homo sapiens
uuggacugugagguuucguggg

SEQ ID NO: 49308 - RNA, 22 nt, Homo sapiens
uuggagagagaggacucccggc

SEQ ID NO: 49309 - RNA, 22 nt, Homo sapiens
uuggcauaguugcacuuacuag

SEQ ID NO: 49310 - RNA, 22 nt, Homo sapiens
uuggcuguguuuauaugcugga

SEQ ID NO: 49311 - RNA, 22 nt, Homo sapiens
uugguccccacuccccugccaa

SEQ ID NO: 49312 - RNA, 22 nt, Homo sapiens
uuggucuucuaauguaccuguu

SEQ ID NO: 49313 - RNA, 22 nt, Homo sapiens
uugguuccuuagccuaggacua

SEQ ID NO: 49314 - RNA, 22 nt, Homo sapiens
uuguaaacaucuguacauugcu

SEQ ID NO: 49315 - RNA, 22 nt, Homo sapiens
uuguacuauuuuuaucagugau

SEQ ID NO: 49316 - RNA, 22 nt, Homo sapiens
uuguacuuuuaguagagacggg

SEQ ID NO: 49317 - RNA, 22 nt, Homo sapiens
uuguauguuucugugcacauga

SEQ ID NO: 49318 - RNA, 22 nt, Homo sapiens
uugucaccucuaaaucucauau

SEQ ID NO: 49319 - RNA, 22 nt, Homo sapiens
uugugaaaucuaggcagagguu

SEQ ID NO: 49320 - RNA, 22 nt, Homo sapiens
uugugaauggugcugcaguaaa

SEQ ID NO: 49321 - RNA, 22 nt, Homo sapiens
uugugcaaaguugugguuucug

SEQ ID NO: 49322 - RNA, 22 nt, Homo sapiens
uugugcuccagagacgggcucg

SEQ ID NO: 49323 - RNA, 22 nt, Homo sapiens
uugugcuugcuguguucuaugc

SEQ ID NO: 49324 - RNA, 20 nt, Homo sapiens
aaacucugucuucuuuauca

SEQ ID NO: 49325 - RNA, 22 nt, Homo sapiens
aaacugucuucugacaguuucc

SEQ ID NO: 49326 - RNA, 22 nt, Homo sapiens
aaagucacuggagaaggaauau

SEQ ID NO: 49327 - RNA, 22 nt, Homo sapiens
aaagugaauguaucccguaagu

SEQ ID NO: 49328 - RNA, 22 nt, Homo sapiens
aaagugcaguauuugggcagaa

SEQ ID NO: 49329 - RNA, 22 nt, Homo sapiens
aaagugcuuccuuuuugagggu

SEQ ID NO: 49330 - RNA, 22 nt, Homo sapiens
aaagugguuuuucagacuuuga

SEQ ID NO: 49331 - RNA, 22 nt, Homo sapiens
aaauccauuuguucagcuaugc

SEQ ID NO: 49332 - RNA, 22 nt, Homo sapiens
aaaugcagauucugcuuagguu

SEQ ID NO: 49333 - RNA, 22 nt, Homo sapiens
aaaugcaucauuaggugauuuu

SEQ ID NO: 49334 - RNA, 22 nt, Homo sapiens
aaaugccucccauucuacugac

SEQ ID NO: 49335 - RNA, 22 nt, Homo sapiens
aaaugcucuguggguaguaaug

SEQ ID NO: 49336 - RNA, 22 nt, Homo sapiens
aaauggcuuugaggguaggaca

SEQ ID NO: 49337 - RNA, 22 nt, Homo sapiens
aaaugggacugggguccuuuga

SEQ ID NO: 49338 - RNA, 22 nt, Homo sapiens
aaaugguguuaguagaucuuua

SEQ ID NO: 49339 - RNA, 22 nt, Homo sapiens
aaauugcauugagcugcuuauu

SEQ ID NO: 49340 - RNA, 22 nt, Homo sapiens
aacagacugucacauaaaauug

SEQ ID NO: 49341 - RNA, 22 nt, Homo sapiens
aacagagcuggugacuccaggu

SEQ ID NO: 49342 - RNA, 22 nt, Homo sapiens
aacuggcauaugaacuuguucu

SEQ ID NO: 49343 - RNA, 22 nt, Homo sapiens
aacuggccuggcgugcagaggg

SEQ ID NO: 49344 - RNA, 21 nt, Homo sapiens
aacuggugugagaugguaugu

SEQ ID NO: 49345 - RNA, 20 nt, Homo sapiens
aagacacuguccccacugga

SEQ ID NO: 49346 - RNA, 22 nt, Homo sapiens
aagagcauuauuuaguaauuuc

SEQ ID NO: 49347 - RNA, 22 nt, Homo sapiens
aagagguagcagucacaaaaga

SEQ ID NO: 49348 - RNA, 22 nt, Homo sapiens
aagaguuaguaaaauuuccucu

SEQ ID NO: 49349 - RNA, 22 nt, Homo sapiens
aagcaggugucugugucuguaa

SEQ ID NO: 49350 - RNA, 22 nt, Homo sapiens
aagcaucauuuggaauuugaga

SEQ ID NO: 49351 - RNA, 22 nt, Homo sapiens
aagcuggauuucgcauccuguu

SEQ ID NO: 49352 - RNA, 22 nt, Homo sapiens
aagcuguguguaagcucucaca

SEQ ID NO: 49353 - RNA, 22 nt, Homo sapiens
aagcuguugguggaucuaccau

SEQ ID NO: 49354 - RNA, 22 nt, Homo sapiens
aagcuuucaacuguuugccauu

SEQ ID NO: 49355 - RNA, 22 nt, Homo sapiens
aaggaagcuagcaggaauuggu

SEQ ID NO: 49356 - RNA, 22 nt, Homo sapiens
aaggcagucacuaaauagugag

SEQ ID NO: 49357 - RNA, 23 nt, Homo sapiens
aagguaagcuagaaagauguaga

SEQ ID NO: 49358 - RNA, 22 nt, Homo sapiens
aaguauagcuaugauaaacauu

SEQ ID NO: 49359 - RNA, 22 nt, Homo sapiens
aagugaaugaugugaaguguaa

SEQ ID NO: 49360 - RNA, 22 nt, Homo sapiens
aauacucuauaagggaagcugu

SEQ ID NO: 49361 - RNA, 22 nt, Homo sapiens
aauacugcuuugauguaagcua

SEQ ID NO: 49362 - RNA, 16 nt, Homo sapiens
ugagaacaugugauau

SEQ ID NO: 49363 - RNA, 17 nt, Homo sapiens
ugagaacaugugguauu

SEQ ID NO: 49364 - RNA, 19 nt, Homo sapiens
ugagaacaugugguauuug

SEQ ID NO: 49365 - RNA, 22 nt, Homo sapiens
ugagaauauuuuccaugucuca

SEQ ID NO: 49366 - RNA, 21 nt, Homo sapiens
ugagacaauccuggucaauau

SEQ ID NO: 49367 - RNA, 22 nt, Homo sapiens
ugagacaugugaauauuuguac

SEQ ID NO: 49368 - RNA, 22 nt, Homo sapiens
ugucaagaugguuugauguugu

SEQ ID NO: 49369 - RNA, 22 nt, Homo sapiens
ugucaauauguaauaacugaau

SEQ ID NO: 49370 - RNA, 22 nt, Homo sapiens
aaaaggcuagcuaguaacagaa

SEQ ID NO: 49371 - RNA, 22 nt, Homo sapiens
aaaaugcugauauugggcccca

SEQ ID NO: 49372 - RNA, 22 nt, Homo sapiens
aaaccacagugugcugcugggg

SEQ ID NO: 49373 - RNA, 22 nt, Homo sapiens
aaacugaucugaaggccaggcu

SEQ ID NO: 49374 - RNA, 22 nt, Homo sapiens
aaagucuagaggaucaugugug

SEQ ID NO: 49375 - RNA, 22 nt, Homo sapiens
aaagucuguuuugucagagacu

SEQ ID NO: 49376 - RNA, 22 nt, Homo sapiens
aaagugauguccaggcuuucag

SEQ ID NO: 49377 - RNA, 22 nt, Homo sapiens
aaaguguguuuccaaccugugg

SEQ ID NO: 49378 - RNA, 22 nt, Homo sapiens
aaaugcaccacucuggugcagg

SEQ ID NO: 49379 - RNA, 22 nt, Homo sapiens
aaaugcacgcuacccagcuaga

SEQ ID NO: 49380 - RNA, 23 nt, Homo sapiens
aaaugcucucaggugccaguaga

SEQ ID NO: 49381 - RNA, 22 nt, Homo sapiens
aaaugcuguuccaggaccuauc

SEQ ID NO: 49382 - RNA, 22 nt, Homo sapiens
aaccuguggauuuugguaucug

SEQ ID NO: 49383 - RNA, 22 nt, Homo sapiens
aacuggucuuuggaggaggagg

SEQ ID NO: 49384 - RNA, 19 nt, Homo sapiens
aacuggugugagaugguau

SEQ ID NO: 49385 - RNA, 18 nt, Homo sapiens
aagagcucagcacagguu

SEQ ID NO: 49386 - RNA, 22 nt, Homo sapiens
aagagcucucuguagcauguga

SEQ ID NO: 49387 - RNA, 22 nt, Homo sapiens
aagagguaauaacaaagcuucu

SEQ ID NO: 49388 - RNA, 22 nt, Homo sapiens
aagaugcagaagcccagauguu

SEQ ID NO: 49389 - RNA, 22 nt, Homo sapiens
aagaugcagucauacuggagga

SEQ ID NO: 49390 - RNA, 22 nt, Homo sapiens
aagcaguguggacuaaugggaa

SEQ ID NO: 49391 - RNA, 22 nt, Homo sapiens
aagcaucacauaauggaucaug

SEQ ID NO: 49392 - RNA, 22 nt, Homo sapiens
aagcucuuguugaaucuuguca

SEQ ID NO: 49393 - RNA, 22 nt, Homo sapiens
aagcugccaggcaugguggcug

SEQ ID NO: 49394 - RNA, 22 nt, Homo sapiens
aagcugccuugugaaggcauuc

SEQ ID NO: 49395 - RNA, 22 nt, Homo sapiens
aagcuggauuuaguguggagca

SEQ ID NO: 49396 - RNA, 22 nt, Homo sapiens
aagcugugucuugucagcuacc

SEQ ID NO: 49397 - RNA, 22 nt, Homo sapiens
aagcuguugguggauguaccau

SEQ ID NO: 49398 - RNA, 22 nt, Homo sapiens
aaggaaguaauuugguuuauag

SEQ ID NO: 49399 - RNA, 20 nt, Homo sapiens
aaggcuuucgaguuccaggg

SEQ ID NO: 49400 - RNA, 22 nt, Homo sapiens
aagggaaugcgcugccuguguu

SEQ ID NO: 49401 - RNA, 22 nt, Homo sapiens
aagguguagucucuggauaagc

SEQ ID NO: 49402 - RNA, 22 nt, Homo sapiens
gugcaguguuugcauggaauca

SEQ ID NO: 49403 - RNA, 22 nt, Homo sapiens
gugcaugucuaugcgagucuaa

SEQ ID NO: 49404 - RNA, 22 nt, Homo sapiens
guggaaggucaugaauguucuu

SEQ ID NO: 49405 - RNA, 22 nt, Homo sapiens
guggaucacuugagguuagaag

SEQ ID NO: 49406 - RNA, 22 nt, Homo sapiens
guggcaagaugacuacucacug

SEQ ID NO: 49407 - RNA, 22 nt, Homo sapiens
guggggucaucucauuugugga

SEQ ID NO: 49408 - RNA, 22 nt, Homo sapiens
guggucagaaaucucaguggca

SEQ ID NO: 49409 - RNA, 22 nt, Homo sapiens
gugucacuguauaauauuuauu

SEQ ID NO: 49410 - RNA, 22 nt, Homo sapiens
gugucacuguugagaaguccac

SEQ ID NO: 49411 - RNA, 22 nt, Homo sapiens
gugugcacaaucuggcaugugc

SEQ ID NO: 49412 - RNA, 22 nt, Homo sapiens
gugugucuugaccaggaucgga

SEQ ID NO: 49413 - RNA, 22 nt, Homo sapiens
guuaaugcuggaauaaguuaag

SEQ ID NO: 49414 - RNA, 18 nt, Homo sapiens
guuagguaguaugaugcu

SEQ ID NO: 49415 - RNA, 22 nt, Homo sapiens
guuauguuaaauuguuguaugc

SEQ ID NO: 49416 - RNA, 22 nt, Homo sapiens
guuauguuaguuacaaggcuag

SEQ ID NO: 49417 - RNA, 22 nt, Homo sapiens
guucacaguuaggacaacugcu

SEQ ID NO: 49418 - RNA, 22 nt, Homo sapiens
guucagguauucuggaacagag

SEQ ID NO: 49419 - RNA, 20 nt, Homo sapiens
guucuugcucguguaucuuc

SEQ ID NO: 49420 - RNA, 22 nt, Homo sapiens
guuggucaaugugauuaggcca

SEQ ID NO: 49421 - RNA, 22 nt, Homo sapiens
guugugcuuaagccuauugauu

SEQ ID NO: 49422 - RNA, 22 nt, Homo sapiens
guuugugcuccuaugagaaccu

SEQ ID NO: 49423 - RNA, 22 nt, Homo sapiens
guuuuuggggucacuauuaccg

SEQ ID NO: 49424 - RNA, 22 nt, Homo sapiens
uaaacugucuugcaguuacaug

SEQ ID NO: 49425 - RNA, 22 nt, Homo sapiens
uaaacugucuuuggagcuuugc

SEQ ID NO: 49426 - RNA, 22 nt, Homo sapiens
uaaagagcuuuugaggugucau

SEQ ID NO: 49427 - RNA, 22 nt, Homo sapiens
uaaagcacaaguaaagaauacu

SEQ ID NO: 49428 - RNA, 22 nt, Homo sapiens
uaaagcuauuauaguuauguuu

SEQ ID NO: 49429 - RNA, 22 nt, Homo sapiens
uaaaugacugucaguagaugaa

SEQ ID NO: 49430 - RNA, 20 nt, Homo sapiens
uaaaugccucaugcuuuauu

SEQ ID NO: 49431 - RNA, 22 nt, Homo sapiens
uaacaguauauuuaccaaaccu

SEQ ID NO: 49432 - RNA, 22 nt, Homo sapiens
uaacagucaagguuugaccagg

SEQ ID NO: 49433 - RNA, 22 nt, Homo sapiens
uaacuaaagagaagucaauguc

SEQ ID NO: 49434 - RNA, 22 nt, Homo sapiens
uaagacugccccagacagcaag

SEQ ID NO: 49435 - RNA, 22 nt, Homo sapiens
uaagacuguuggcaauuuuugc

SEQ ID NO: 49436 - RNA, 22 nt, Homo sapiens
uaagcaguaaaugaagucuugc

SEQ ID NO: 49437 - RNA, 20 nt, Homo sapiens
uaagccacacagucuaaggu

SEQ ID NO: 49438 - RNA, 22 nt, Homo sapiens
uaaguaaaugaaagguugauuu

SEQ ID NO: 49439 - RNA, 22 nt, Homo sapiens
uaagugcuguguuguuaccuaa

SEQ ID NO: 49440 - RNA, 18 nt, Homo sapiens
uaagugcuuuaaacacau

SEQ ID NO: 49441 - RNA, 22 nt, Homo sapiens
uaaguuagugugagaauuuugc

SEQ ID NO: 49442 - RNA, 22 nt, Homo sapiens
uaaguucauucaugaaacuuag

SEQ ID NO: 49443 - RNA, 22 nt, Homo sapiens
uaauacugcugugcuugaguug

SEQ ID NO: 49444 - RNA, 22 nt, Homo sapiens
uaaugcucauuagcaggccaau

SEQ ID NO: 49445 - RNA, 22 nt, Homo sapiens
uaaugcuccauggguuauuaaa

SEQ ID NO: 49446 - RNA, 22 nt, Homo sapiens
uaaugcuguggucugguuuaaa

SEQ ID NO: 49447 - RNA, 22 nt, Homo sapiens
uacacagucaaaaauuuccagg

SEQ ID NO: 49448 - RNA, 22 nt, Homo sapiens
uacaccaauuuaaucaaaagca

SEQ ID NO: 49449 - RNA, 22 nt, Homo sapiens
uacaccauuugauucuuuaagc

SEQ ID NO: 49450 - RNA, 22 nt, Homo sapiens
uacagcacugugcauagugguu

SEQ ID NO: 49451 - RNA, 22 nt, Homo sapiens
uacaggauagacaauuuauuaa

SEQ ID NO: 49452 - RNA, 22 nt, Homo sapiens
uacaggugcucuacagacagga

SEQ ID NO: 49453 - RNA, 22 nt, Homo sapiens
uacaggugcuuauguggacaua

SEQ ID NO: 49454 - RNA, 22 nt, Homo sapiens
uacaucagccugaaagagcucg

SEQ ID NO: 49455 - RNA, 22 nt, Homo sapiens
uacucaguaagugcuggcugcu

SEQ ID NO: 49456 - RNA, 22 nt, Homo sapiens
uacugcacuccaaccugagaga

SEQ ID NO: 49457 - RNA, 20 nt, Homo sapiens
uacugcacuuuccucauggu

SEQ ID NO: 49458 - RNA, 21 nt, Homo sapiens
uacuggagauacagucugcaa

SEQ ID NO: 49459 - RNA, 22 nt, Homo sapiens
uacuguguaguuagaccucaga

SEQ ID NO: 49460 - RNA, 22 nt, Homo sapiens
uagaaaguagggaagguaggau

SEQ ID NO: 49461 - RNA, 22 nt, Homo sapiens
uagaagcacuaucccuccuagu

SEQ ID NO: 49462 - RNA, 18 nt, Homo sapiens
uagaauauaggucauucu

SEQ ID NO: 49463 - RNA, 22 nt, Homo sapiens
uagaauggaagguugagaagaa

SEQ ID NO: 49464 - RNA, 22 nt, Homo sapiens
uagaccaauuggcauauaguaa

SEQ ID NO: 49465 - RNA, 22 nt, Homo sapiens
uagacccauuguucagagagug

SEQ ID NO: 49466 - RNA, 22 nt, Homo sapiens
uagagguagguguaugaacuag

SEQ ID NO: 49467 - RNA, 22 nt, Homo sapiens
uagagguauguauaguauucuu

SEQ ID NO: 49468 - RNA, 19 nt, Homo sapiens
uagaugucuuugcauagau

SEQ ID NO: 49469 - RNA, 22 nt, Homo sapiens
uagauuguaauaugcagaaugg

SEQ ID NO: 49470 - RNA, 22 nt, Homo sapiens
uagcacaucccuaaaaugcugu

SEQ ID NO: 49471 - RNA, 20 nt, Homo sapiens
uagcacaucuggcuguagag

SEQ ID NO: 49472 - RNA, 22 nt, Homo sapiens
uagcacugucuugcaccugugc

SEQ ID NO: 49473 - RNA, 22 nt, Homo sapiens
uagcagcaccccacucuacugg

SEQ ID NO: 49474 - RNA, 22 nt, Homo sapiens
uagcagcauaaauggacuaaga

SEQ ID NO: 49475 - RNA, 22 nt, Homo sapiens
uagcagcauuuuuguagaguau

SEQ ID NO: 49476 - RNA, 22 nt, Homo sapiens
uagcaucaauucauguuaugau

SEQ ID NO: 49477 - RNA, 22 nt, Homo sapiens
uagcugcacuuacaagugagaa

SEQ ID NO: 49478 - RNA, 22 nt, Homo sapiens
uagcugcccagcacgaaguugg

SEQ ID NO: 49479 - RNA, 22 nt, Homo sapiens
uaggacauugcccuuguggaga

SEQ ID NO: 49480 - RNA, 22 nt, Homo sapiens
uaggcacacaucuacuacaaau

SEQ ID NO: 49481 - RNA, 22 nt, Homo sapiens
uaggcuuuucugggaugugggc

SEQ ID NO: 49482 - RNA, 22 nt, Homo sapiens
uaggcuuuuggacccugucucu

SEQ ID NO: 49483 - RNA, 22 nt, Homo sapiens
uaggucuccuuuuugccuaaau

SEQ ID NO: 49484 - RNA, 22 nt, Homo sapiens
uagugcacuacuugugggaaug

SEQ ID NO: 49485 - RNA, 22 nt, Homo sapiens
uagugcaguggcuccaucucag

SEQ ID NO: 49486 - RNA, 22 nt, Homo sapiens
uagugcccuuauaagagcagga

SEQ ID NO: 49487 - RNA, 20 nt, Homo sapiens
uauagcaauuuuuuucuccu

SEQ ID NO: 49488 - RNA, 17 nt, Homo sapiens
uauagcacuucucacau

SEQ ID NO: 49489 - RNA, 22 nt, Homo sapiens
uauagcuuuuuagggaauuugg

SEQ ID NO: 49490 - RNA, 22 nt, Homo sapiens
uauaugcauugugggguacuga

SEQ ID NO: 49491 - RNA, 22 nt, Homo sapiens
uauauguuuucauaaggcuaga

SEQ ID NO: 49492 - RNA, 22 nt, Homo sapiens
uaucaaguguuagggagaugug

SEQ ID NO: 49493 - RNA, 22 nt, Homo sapiens
uaucacagcgggguguacaccc

SEQ ID NO: 49494 - RNA, 20 nt, Homo sapiens
uaucacaggucagaaacccu

SEQ ID NO: 49495 - RNA, 22 nt, Homo sapiens
uaucacagguggacugcacacc

SEQ ID NO: 49496 - RNA, 21 nt, Homo sapiens
uaucacauuggugauuaaguu

SEQ ID NO: 49497 - RNA, 21 nt, Homo sapiens
uaucucaguuuuccuuugugg

SEQ ID NO: 49498 - RNA, 22 nt, Homo sapiens
uaugcacacguguccaugugca

SEQ ID NO: 49499 - RNA, 22 nt, Homo sapiens
uaugccuuugaccauuuuguga

SEQ ID NO: 49500 - RNA, 22 nt, Homo sapiens
uauggguaguacaaaguguaua

SEQ ID NO: 49501 - RNA, 22 nt, Homo sapiens
uaugugcaaauuaauugcuaga

SEQ ID NO: 49502 - RNA, 22 nt, Homo sapiens
uauguguuuuauggucagggag

SEQ ID NO: 49503 - RNA, 20 nt, Homo sapiens
uauuacagaguaauggugga

SEQ ID NO: 49504 - RNA, 18 nt, Homo sapiens
uauuccucuuccucuauc

SEQ ID NO: 49505 - RNA, 22 nt, Homo sapiens
uauugugcauguugaauaacua

SEQ ID NO: 49506 - RNA, 22 nt, Homo sapiens
uauuugauugacuuuagcagga

SEQ ID NO: 49507 - RNA, 20 nt, Homo sapiens
cuuuggcaaugagaacaggg

SEQ ID NO: 49508 - RNA, 20 nt, Homo sapiens
cuuuguccuccugcugugcu

SEQ ID NO: 49509 - RNA, 22 nt, Homo sapiens
cuuugugcccuucugcccauca

SEQ ID NO: 49510 - RNA, 21 nt, Homo sapiens
cuuuugcacuccagccugggu

SEQ ID NO: 49511 - RNA, 18 nt, Homo sapiens
gaaaugccucuugcuuac

SEQ ID NO: 49512 - RNA, 22 nt, Homo sapiens
gaaaugcucagggguuuuccag

SEQ ID NO: 49513 - RNA, 22 nt, Homo sapiens
gaaaugcucauuuuggauccuu

SEQ ID NO: 49514 - RNA, 22 nt, Homo sapiens
gaaauguuuuucaugugggcaa

SEQ ID NO: 49515 - RNA, 22 nt, Homo sapiens
gaacuguuucuggugaaagagu

SEQ ID NO: 49516 - RNA, 22 nt, Homo sapiens
gaaucauuggguugauucaaga

SEQ ID NO: 49517 - RNA, 22 nt, Homo sapiens
gaccacagacuggaaagagggc

SEQ ID NO: 49518 - RNA, 22 nt, Homo sapiens
gagacucuuagauuggaaaucu

SEQ ID NO: 49519 - RNA, 22 nt, Homo sapiens
gagauagguauuucauuuaccc

SEQ ID NO: 49520 - RNA, 22 nt, Homo sapiens
gagaugauuugccccauguauu

SEQ ID NO: 49521 - RNA, 22 nt, Homo sapiens
gagaugucuauuucagagaugu

SEQ ID NO: 49522 - RNA, 22 nt, Homo sapiens
gagauuuucagcuugacuggga

SEQ ID NO: 49523 - RNA, 22 nt, Homo sapiens
gagcaaaaguauguauugguua

SEQ ID NO: 49524 - RNA, 22 nt, Homo sapiens
gagcuacauggauagucugcau

SEQ ID NO: 49525 - RNA, 20 nt, Homo sapiens
gagcugguguacugccgggc

SEQ ID NO: 49526 - RNA, 22 nt, Homo sapiens
gagcuguuuuucacuagaccaa

SEQ ID NO: 49527 - RNA, 22 nt, Homo sapiens
gagcuuggguuaaaguugccuu

SEQ ID NO: 49528 - RNA, 22 nt, Homo sapiens
gaggcaagaguaguuaaguuag

SEQ ID NO: 49529 - RNA, 22 nt, Homo sapiens
gaggcauuauucccaucuuaca

SEQ ID NO: 49530 - RNA, 22 nt, Homo sapiens
gagguggauacauuaaauaaug

SEQ ID NO: 49531 - RNA, 22 nt, Homo sapiens
gaguaaauguccuagcuucuug

SEQ ID NO: 49532 - RNA, 22 nt, Homo sapiens
gaguaacauugacaacuucaug

SEQ ID NO: 49533 - RNA, 22 nt, Homo sapiens
gagugcaauggcgcgaucucgg

SEQ ID NO: 49534 - RNA, 22 nt, Homo sapiens
gaguuagguugucaaugucuua

SEQ ID NO: 49535 - RNA, 22 nt, Homo sapiens
gauaaaguauuggguacuaugc

SEQ ID NO: 49536 - RNA, 22 nt, Homo sapiens
gauauguuagggggagaaguua

SEQ ID NO: 49537 - RNA, 22 nt, Homo sapiens
gaucacauguguacucaaugug

SEQ ID NO: 49538 - RNA, 20 nt, Homo sapiens
gaucaguuuggaguaagugc

SEQ ID NO: 49539 - RNA, 22 nt, Homo sapiens
gaugagaugagcauuugaauug

SEQ ID NO: 49540 - RNA, 22 nt, Homo sapiens
gaugcagcuaggauuugugaca

SEQ ID NO: 49541 - RNA, 22 nt, Homo sapiens
gauggcagugcagccccuggcu

SEQ ID NO: 49542 - RNA, 22 nt, Homo sapiens
gauguguuuuaggaucucagca

SEQ ID NO: 49543 - RNA, 22 nt, Homo sapiens
gauuccacuuacuuagcauucc

SEQ ID NO: 49544 - RNA, 22 nt, Homo sapiens
gcaaaaaguagugcugguuagg

SEQ ID NO: 49545 - RNA, 22 nt, Homo sapiens
gcaaaugcuacaccauuuugua

SEQ ID NO: 49546 - RNA, 22 nt, Homo sapiens
gcaagugucugagguuuuguau

SEQ ID NO: 49547 - RNA, 22 nt, Homo sapiens
gcauaaagcuaauaagacgaag

SEQ ID NO: 49548 - RNA, 20 nt, Homo sapiens
gcauaugucuuuauagcaga

SEQ ID NO: 49549 - RNA, 20 nt, Homo sapiens
acuuuuugaugaggucguuu

SEQ ID NO: 49550 - RNA, 22 nt, Homo sapiens
agaaccaaucccacauggauac

SEQ ID NO: 49551 - RNA, 20 nt, Homo sapiens
agaagcauugcucucuucag

SEQ ID NO: 49552 - RNA, 22 nt, Homo sapiens
agaauguaaacagaauagagga

SEQ ID NO: 49553 - RNA, 22 nt, Homo sapiens
agacaagauggcuugagguuca

SEQ ID NO: 49554 - RNA, 22 nt, Homo sapiens
agacacuguugaaaaggcccca

SEQ ID NO: 49555 - RNA, 22 nt, Homo sapiens
agacaguauuggcaaagugugu

SEQ ID NO: 49556 - RNA, 22 nt, Homo sapiens
agacucauuuccauagucagcu

SEQ ID NO: 49557 - RNA, 22 nt, Homo sapiens
agagcuguguuuuaacuuuuua

SEQ ID NO: 49558 - RNA, 22 nt, Homo sapiens
agagguaugccugggcuggagc

SEQ ID NO: 49559 - RNA, 20 nt, Homo sapiens
agagugcuggacugaggagc

SEQ ID NO: 49560 - RNA, 17 nt, Homo sapiens
agcaccacacucucuug

SEQ ID NO: 49561 - RNA, 21 nt, Homo sapiens
agcagaguggcagcucuuuug

SEQ ID NO: 49562 - RNA, 20 nt, Homo sapiens
agcagccacagauuccucag

SEQ ID NO: 49563 - RNA, 17 nt, Homo sapiens
agcagcccauaucccca

SEQ ID NO: 49564 - RNA, 22 nt, Homo sapiens
agcaggacaauaugggaucagg

SEQ ID NO: 49565 - RNA, 22 nt, Homo sapiens
agcagguguccacaauguuugc

SEQ ID NO: 49566 - RNA, 20 nt, Homo sapiens
agcaucagugguaguguugc

SEQ ID NO: 49567 - RNA, 22 nt, Homo sapiens
agccuagagagccacuuugaga

SEQ ID NO: 49568 - RNA, 18 nt, Homo sapiens
agcucaguguuugcuuac

SEQ ID NO: 49569 - RNA, 22 nt, Homo sapiens
agcugguuuauuucucacaaca

SEQ ID NO: 49570 - RNA, 22 nt, Homo sapiens
agcugugucuucuuaaagauuu

SEQ ID NO: 49571 - RNA, 22 nt, Homo sapiens
agcuguuguucucagaggcuuu

SEQ ID NO: 49572 - RNA, 22 nt, Homo sapiens
agcuguuguuuuaagauacuaa

SEQ ID NO: 49573 - RNA, 22 nt, Homo sapiens
agcuucauuccaacuuccuucu

SEQ ID NO: 49574 - RNA, 21 nt, Homo sapiens
agcuuguguguaucacagugu

SEQ ID NO: 49575 - RNA, 22 nt, Homo sapiens
agcuuguguuugucugccuggg

SEQ ID NO: 49576 - RNA, 22 nt, Homo sapiens
agcuuuggauaccugcuguucc

SEQ ID NO: 49577 - RNA, 22 nt, Homo sapiens
aggaagcuagcauuuguucagu

SEQ ID NO: 49578 - RNA, 21 nt, Homo sapiens
aggagauguuuguccuuuuag

SEQ ID NO: 49579 - RNA, 22 nt, Homo sapiens
aggagcuuuggggaaaacagau

SEQ ID NO: 49580 - RNA, 22 nt, Homo sapiens
aggcaaguugcucaaaugcaaa

SEQ ID NO: 49581 - RNA, 22 nt, Homo sapiens
aggcacggugucucaugccugu

SEQ ID NO: 49582 - RNA, 22 nt, Homo sapiens
aggcaugaaauacaugcauuga

SEQ ID NO: 49583 - RNA, 20 nt, Homo sapiens
aggcauguugguuugcgugu

SEQ ID NO: 49584 - RNA, 22 nt, Homo sapiens
agguaauuuuaucauuauguga

SEQ ID NO: 49585 - RNA, 22 nt, Homo sapiens
agguccauuauuuucauucaug

SEQ ID NO: 49586 - RNA, 22 nt, Homo sapiens
aggugguuuugaugagcaggua

SEQ ID NO: 49587 - RNA, 22 nt, Homo sapiens
aguaacauuucuaguagagagu

SEQ ID NO: 49588 - RNA, 22 nt, Homo sapiens
aguaccacgugaugccauuuuc

SEQ ID NO: 49589 - RNA, 21 nt, Homo sapiens
aguagcacugugucuuacaaa

SEQ ID NO: 49590 - RNA, 22 nt, Homo sapiens
aguauuuguuggaauaccuguu

SEQ ID NO: 49591 - RNA, 22 nt, Homo sapiens
agucaagugggguuagauaguu

SEQ ID NO: 49592 - RNA, 22 nt, Homo sapiens
agucaaguuuuuucagagaaua

SEQ ID NO: 49593 - RNA, 22 nt, Homo sapiens
agucacagugaccuugucugac

SEQ ID NO: 49594 - RNA, 22 nt, Homo sapiens
agucagugucuguaaggagaac

SEQ ID NO: 49595 - RNA, 22 nt, Homo sapiens
agugcuuaauagauguccagca

SEQ ID NO: 49596 - RNA, 19 nt, Homo sapiens
auaaacuagaacugucccc

SEQ ID NO: 49597 - RNA, 22 nt, Homo sapiens
auaaauaguaguugugguggcc

SEQ ID NO: 49598 - RNA, 22 nt, Homo sapiens
auaacauggaguuugucauuua

SEQ ID NO: 49599 - RNA, 22 nt, Homo sapiens
auaagauaguggaagugggauu

SEQ ID NO: 49600 - RNA, 22 nt, Homo sapiens
auaauacuuuuauuuugaggaa

SEQ ID NO: 49601 - RNA, 22 nt, Homo sapiens
auaauaguguuuagauuuggga

SEQ ID NO: 49602 - RNA, 22 nt, Homo sapiens
auaauguuugauugagcagaua

SEQ ID NO: 49603 - RNA, 19 nt, Homo sapiens
auacacguguauacauaca

SEQ ID NO: 49604 - RNA, 22 nt, Homo sapiens
auacagugaauacuuacagugu

SEQ ID NO: 49605 - RNA, 22 nt, Homo sapiens
auacaugugccaugcuggugug

SEQ ID NO: 49606 - RNA, 23 nt, Homo sapiens
auagagcuaggaugcagacagau

SEQ ID NO: 49607 - RNA, 22 nt, Homo sapiens
auagaguuagaaagaaauguuu

SEQ ID NO: 49608 - RNA, 22 nt, Homo sapiens
auagcaaugccccacuccuugg

SEQ ID NO: 49609 - RNA, 22 nt, Homo sapiens
auagcagugugaaaauugacug

SEQ ID NO: 49610 - RNA, 20 nt, Homo sapiens
auagcauugauggacucaaa

SEQ ID NO: 49611 - RNA, 22 nt, Homo sapiens
auagcuguccuuacuagcuagg

SEQ ID NO: 49612 - RNA, 22 nt, Homo sapiens
uauuugcacucccaucauggug

SEQ ID NO: 49613 - RNA, 22 nt, Homo sapiens
ucaaacugcuugaggccauuua

SEQ ID NO: 49614 - RNA, 22 nt, Homo sapiens
ucaacauugcugucaggcaucu

SEQ ID NO: 49615 - RNA, 22 nt, Homo sapiens
ucaagcaauucuccucucagcc

SEQ ID NO: 49616 - RNA, 22 nt, Homo sapiens
ucaagcaauucugcugccucag

SEQ ID NO: 49617 - RNA, 18 nt, Homo sapiens
ucaagcaauugucaugcc

SEQ ID NO: 49618 - RNA, 22 nt, Homo sapiens
ucaaggcacauuugacauuuuc

SEQ ID NO: 49619 - RNA, 21 nt, Homo sapiens
ucacaaugaacagcagcagaa

SEQ ID NO: 49620 - RNA, 23 nt, Homo sapiens
ucacacuuaagagaaaugcagcu

SEQ ID NO: 49621 - RNA, 22 nt, Homo sapiens
ucacaguccuguuuaggagagg

SEQ ID NO: 49622 - RNA, 22 nt, Homo sapiens
ucacauggaggugauaguugaa

SEQ ID NO: 49623 - RNA, 18 nt, Homo sapiens
ucacauggccgagagaga

SEQ ID NO: 49624 - RNA, 22 nt, Homo sapiens
ucacauggggaagggacuagcu

SEQ ID NO: 49625 - RNA, 22 nt, Homo sapiens
ucacauguguaaauugguguaa

SEQ ID NO: 49626 - RNA, 22 nt, Homo sapiens
ucacccugacaugcggccgaac

SEQ ID NO: 49627 - RNA, 22 nt, Homo sapiens
ucaccucgugaucugcccacuu

SEQ ID NO: 49628 - RNA, 22 nt, Homo sapiens
ucacgcugcugcaaccagccug

SEQ ID NO: 49629 - RNA, 18 nt, Homo sapiens
ucacggggagcagcagcc

SEQ ID NO: 49630 - RNA, 22 nt, Homo sapiens
ucacuauugacaacagugugga

SEQ ID NO: 49631 - RNA, 22 nt, Homo sapiens
ucacugagaaugauguuucuga

SEQ ID NO: 49632 - RNA, 22 nt, Homo sapiens
ucacugagcacaggagaugugc

SEQ ID NO: 49633 - RNA, 22 nt, Homo sapiens
ucacugcacuucaggcuuucuc

SEQ ID NO: 49634 - RNA, 19 nt, Homo sapiens
ucacuggacagcacacuca

SEQ ID NO: 49635 - RNA, 22 nt, Homo sapiens
ucacugggagaccaaagccauc

SEQ ID NO: 49636 - RNA, 22 nt, Homo sapiens
ucacugggagcauuugagccuu

SEQ ID NO: 49637 - RNA, 22 nt, Homo sapiens
ucacugugcacauaugauaggu

SEQ ID NO: 49638 - RNA, 22 nt, Homo sapiens
ucacugugguuuugaugugcau

SEQ ID NO: 49639 - RNA, 22 nt, Homo sapiens
ucagaguggccucucuugaaga

SEQ ID NO: 49640 - RNA, 19 nt, Homo sapiens
ucagaucagcccaagggau

SEQ ID NO: 49641 - RNA, 22 nt, Homo sapiens
ucagcaaugaccuaagcaaaua

SEQ ID NO: 49642 - RNA, 22 nt, Homo sapiens
ucagcagugccccacucuacug

SEQ ID NO: 49643 - RNA, 22 nt, Homo sapiens
ucagcagugugaaaacaaacua

SEQ ID NO: 49644 - RNA, 22 nt, Homo sapiens
ucagggacuuacaaaccagaag

SEQ ID NO: 49645 - RNA, 22 nt, Homo sapiens
ucagguccuuacugugcucccu

SEQ ID NO: 49646 - RNA, 22 nt, Homo sapiens
ucagugaacgaggaggagggug

SEQ ID NO: 49647 - RNA, 22 nt, Homo sapiens
ucagugacuggguauuaaauca

SEQ ID NO: 49648 - RNA, 21 nt, Homo sapiens
ucagugcaauucuauggggaa

SEQ ID NO: 49649 - RNA, 20 nt, Homo sapiens
ucagugcagauuguccaagu

SEQ ID NO: 49650 - RNA, 22 nt, Homo sapiens
ucagugguuaaaagauucuaga

SEQ ID NO: 49651 - RNA, 21 nt, Homo sapiens
ucauauguaucuuugugccuc

SEQ ID NO: 49652 - RNA, 22 nt, Homo sapiens
ucauauguaugugcaauuuugu

SEQ ID NO: 49653 - RNA, 22 nt, Homo sapiens
ucaucuggcgaaugugaagagu

SEQ ID NO: 49654 - RNA, 22 nt, Homo sapiens
uaagaauucuguccgguauacu

SEQ ID NO: 49655 - RNA, 22 nt, Homo sapiens
uaagacacuuaaaauguuacau

SEQ ID NO: 49656 - RNA, 22 nt, Homo sapiens
uaagagagcuccaucuuuuccu

SEQ ID NO: 49657 - RNA, 22 nt, Homo sapiens
uaagagcuaggauuuuaaauca

SEQ ID NO: 49658 - RNA, 22 nt, Homo sapiens
uaaggaguagaauaguaaggca

SEQ ID NO: 49659 - RNA, 22 nt, Homo sapiens
uaaggcacccuucugaguagag

SEQ ID NO: 49660 - RNA, 22 nt, Homo sapiens
uaagguguagacuggucacaag

SEQ ID NO: 49661 - RNA, 22 nt, Homo sapiens
uaagugaugucuuuuugugugc

SEQ ID NO: 49662 - RNA, 22 nt, Homo sapiens
uaauauguauacagacagauac

SEQ ID NO: 49663 - RNA, 22 nt, Homo sapiens
uaaucacagagguuuggccuca

SEQ ID NO: 49664 - RNA, 22 nt, Homo sapiens
uaauucuguauguaucagaguu

SEQ ID NO: 49665 - RNA, 22 nt, Homo sapiens
uacacaugugaguucuuuucua

SEQ ID NO: 49666 - RNA, 20 nt, Homo sapiens
uacacguaugagcacaugug

SEQ ID NO: 49667 - RNA, 22 nt, Homo sapiens
uacagaguagaagauuugcaga

SEQ ID NO: 49668 - RNA, 23 nt, Homo sapiens
uacagcugcagaaucaggcuaag

SEQ ID NO: 49669 - RNA, 22 nt, Homo sapiens
uacaggacuucucagaguuauu

SEQ ID NO: 49670 - RNA, 22 nt, Homo sapiens
uacaguacagugacaccauuau

SEQ ID NO: 49671 - RNA, 22 nt, Homo sapiens
uacagucuggaggccuguguug

SEQ ID NO: 49672 - RNA, 22 nt, Homo sapiens
uacaugcaugggcaugugugca

SEQ ID NO: 49673 - RNA, 22 nt, Homo sapiens
uacaugugcaggucuguggggg

SEQ ID NO: 49674 - RNA, 22 nt, Homo sapiens
uaccacagucauuacacuugua

SEQ ID NO: 49675 - RNA, 22 nt, Homo sapiens
uaccacccuuuuuccagaagcc

SEQ ID NO: 49676 - RNA, 19 nt, Homo sapiens
uacccagaagcagcauugu

SEQ ID NO: 49677 - RNA, 22 nt, Homo sapiens
uacccuguaaucugaaacauga

SEQ ID NO: 49678 - RNA, 16 nt, Homo sapiens
uacuacugccuauuau

SEQ ID NO: 49679 - RNA, 22 nt, Homo sapiens
uacucugcagccauaaaacaga

SEQ ID NO: 49680 - RNA, 22 nt, Homo sapiens
uacugagagaggaauauugaaa

SEQ ID NO: 49681 - RNA, 22 nt, Homo sapiens
uacuuuguagagugugagaauu

SEQ ID NO: 49682 - RNA, 22 nt, Homo sapiens
uagaaagcaugaccuucagaua

SEQ ID NO: 49683 - RNA, 22 nt, Homo sapiens
uagacacugcauauuuuuuuaa

SEQ ID NO: 49684 - RNA, 22 nt, Homo sapiens
uagagguauaccaaaaaggcau

SEQ ID NO: 49685 - RNA, 22 nt, Homo sapiens
uagagguauuaacaguagaaga

SEQ ID NO: 49686 - RNA, 22 nt, Homo sapiens
uagauuauuggcugauuugauc

SEQ ID NO: 49687 - RNA, 21 nt, Homo sapiens
uagcaaauugcuauuaaggca

SEQ ID NO: 49688 - RNA, 23 nt, Homo sapiens
uagcaacaguuggaggugaggua

SEQ ID NO: 49689 - RNA, 22 nt, Homo sapiens
uagcaagaugaauuugugcaaa

SEQ ID NO: 49690 - RNA, 22 nt, Homo sapiens
uagcacagugucauucuaggua

SEQ ID NO: 49691 - RNA, 22 nt, Homo sapiens
uagcaccacaaucaagauacag

SEQ ID NO: 49692 - RNA, 22 nt, Homo sapiens
uagcaguaccccaguauccugg

SEQ ID NO: 49693 - RNA, 22 nt, Homo sapiens
uagcucagcccagcuaagcuca

SEQ ID NO: 49694 - RNA, 23 nt, Homo sapiens
uagcuucucccagaccugcuccc

SEQ ID NO: 49695 - RNA, 22 nt, Homo sapiens
uaggcaaaugcaagaguagaac

SEQ ID NO: 49696 - RNA, 22 nt, Homo sapiens
uaggcaguggagaaauaaacag

SEQ ID NO: 49697 - RNA, 22 nt, Homo sapiens
uagguaagauguuaacagcuga

SEQ ID NO: 49698 - RNA, 22 nt, Homo sapiens
uagguagucagcagugcuuaca

SEQ ID NO: 49699 - RNA, 19 nt, Homo sapiens
uaggugguuuuccccucac

SEQ ID NO: 49700 - RNA, 22 nt, Homo sapiens
uagguucucaggaaugagcuuc

SEQ ID NO: 49701 - RNA, 22 nt, Homo sapiens
uagguucuccacagguucucca

SEQ ID NO: 49702 - RNA, 22 nt, Homo sapiens
uagucacacacucaacuuuuca

SEQ ID NO: 49703 - RNA, 21 nt, Homo sapiens
uauagcagcacgauuuauaau

SEQ ID NO: 49704 - RNA, 22 nt, Homo sapiens
uauaggacuugguguaguuucu

SEQ ID NO: 49705 - RNA, 21 nt, Homo sapiens
uauaugacuuacuauugccuc

SEQ ID NO: 49706 - RNA, 22 nt, Homo sapiens
uauaugcaacauaguguaugug

SEQ ID NO: 49707 - RNA, 22 nt, Homo sapiens
uauaugucuuuguuauguugag

SEQ ID NO: 49708 - RNA, 22 nt, Homo sapiens
uaucacagcauugucuauaaua

SEQ ID NO: 49709 - RNA, 22 nt, Homo sapiens
uaucacaguagaacucuuucca

SEQ ID NO: 49710 - RNA, 22 nt, Homo sapiens
uaucuacauguagguauguaug

SEQ ID NO: 49711 - RNA, 22 nt, Homo sapiens
uaucucuuuucauguguaaaug

SEQ ID NO: 49712 - RNA, 22 nt, Homo sapiens
uaugcacuauggaaguagcuca

SEQ ID NO: 49713 - RNA, 22 nt, Homo sapiens
uaugccuuucucacuaagcuua

SEQ ID NO: 49714 - RNA, 22 nt, Homo sapiens
uaugccuuuuggcucaagaaac

SEQ ID NO: 49715 - RNA, 22 nt, Homo sapiens
uaugucuuuugcuugcaaauag

SEQ ID NO: 49716 - RNA, 22 nt, Homo sapiens
uaugugcacaugcccuggugac

SEQ ID NO: 49717 - RNA, 22 nt, Homo sapiens
auauaugcacacgugugcauau

SEQ ID NO: 49718 - RNA, 22 nt, Homo sapiens
auaugcauacccucaccaacua

SEQ ID NO: 49719 - RNA, 22 nt, Homo sapiens
auaugcauguacccacacaggc

SEQ ID NO: 49720 - RNA, 21 nt, Homo sapiens
auauggaacuggugacguguu

SEQ ID NO: 49721 - RNA, 22 nt, Homo sapiens
auaugguacuuaugcucaaacu

SEQ ID NO: 49722 - RNA, 22 nt, Homo sapiens
auaugugacuucaugcaaggcu

SEQ ID NO: 49723 - RNA, 18 nt, Homo sapiens
auauugcauuggauggau

SEQ ID NO: 49724 - RNA, 22 nt, Homo sapiens
aucaaaguuucccagaaguugu

SEQ ID NO: 49725 - RNA, 22 nt, Homo sapiens
aucaagccaaagaaaguccuug

SEQ ID NO: 49726 - RNA, 22 nt, Homo sapiens
aucaagcugcuuguuugaaucu

SEQ ID NO: 49727 - RNA, 22 nt, Homo sapiens
aucaagcuggcauauguaguuc

SEQ ID NO: 49728 - RNA, 22 nt, Homo sapiens
aucacacuguuauuuuaguuaa

SEQ ID NO: 49729 - RNA, 22 nt, Homo sapiens
aucacagguacuauggcugaca

SEQ ID NO: 49730 - RNA, 22 nt, Homo sapiens
aucacauuuauaguggcacgca

SEQ ID NO: 49731 - RNA, 22 nt, Homo sapiens
aucacugggcaagauaucauga

SEQ ID NO: 49732 - RNA, 22 nt, Homo sapiens
aucacuguaaguuuacacuuug

SEQ ID NO: 49733 - RNA, 23 nt, Homo sapiens
aucagauaguuguagguaugugg

SEQ ID NO: 49734 - RNA, 20 nt, Homo sapiens
aucagguagggccccauuau

SEQ ID NO: 49735 - RNA, 22 nt, Homo sapiens
aucagugauugauuuaaagacg

SEQ ID NO: 49736 - RNA, 22 nt, Homo sapiens
aucauauccuagauauaacuuc

SEQ ID NO: 49737 - RNA, 22 nt, Homo sapiens
auccaguuuuaggagauuucua

SEQ ID NO: 49738 - RNA, 22 nt, Homo sapiens
auccauugcacuauggaaagug

SEQ ID NO: 49739 - RNA, 22 nt, Homo sapiens
aucccugugauccaaucacuuc

SEQ ID NO: 49740 - RNA, 22 nt, Homo sapiens
aucugcauucccauguuuauug

SEQ ID NO: 49741 - RNA, 22 nt, Homo sapiens
aucugggguuggcaaaguuugg

SEQ ID NO: 49742 - RNA, 22 nt, Homo sapiens
aucugguguggcugugauccuc

SEQ ID NO: 49743 - RNA, 22 nt, Homo sapiens
aucuuugauuguagguacaaug

SEQ ID NO: 49744 - RNA, 22 nt, Homo sapiens
aucuuuggucaucacagcuaga

SEQ ID NO: 49745 - RNA, 22 nt, Homo sapiens
aucuuuggugcaugauacuuug

SEQ ID NO: 49746 - RNA, 23 nt, Homo sapiens
augaaagcccuugcaaaugcugg

SEQ ID NO: 49747 - RNA, 22 nt, Homo sapiens
augaaagucaauccccaagugu

SEQ ID NO: 49748 - RNA, 22 nt, Homo sapiens
augaaagugauaaaugucucua

SEQ ID NO: 49749 - RNA, 22 nt, Homo sapiens
augaauacagcuaugcgugcau

SEQ ID NO: 49750 - RNA, 20 nt, Homo sapiens
augaauguccuugauggcau

SEQ ID NO: 49751 - RNA, 22 nt, Homo sapiens
augacaguguggauuauuguaa

SEQ ID NO: 49752 - RNA, 22 nt, Homo sapiens
augacguugugggcucucaagc

SEQ ID NO: 49753 - RNA, 22 nt, Homo sapiens
augacuuuucugaaaaccacca

SEQ ID NO: 49754 - RNA, 22 nt, Homo sapiens
augagaugauaggcguucuaac

SEQ ID NO: 49755 - RNA, 22 nt, Homo sapiens
augagcucauaaagagugauuu

SEQ ID NO: 49756 - RNA, 22 nt, Homo sapiens
augagcucauugggugacuggg

SEQ ID NO: 49757 - RNA, 22 nt, Homo sapiens
augagcuguuuggaagacacuu

SEQ ID NO: 49758 - RNA, 22 nt, Homo sapiens
augaggagguaugauuuucuga

SEQ ID NO: 49759 - RNA, 17 nt, Homo sapiens
ugauauuuucccagaua

SEQ ID NO: 49760 - RNA, 22 nt, Homo sapiens
ugaucacagcuugacuaaagga

SEQ ID NO: 49761 - RNA, 22 nt, Homo sapiens
ugaucugucacuuaucacauuu

SEQ ID NO: 49762 - RNA, 22 nt, Homo sapiens
ugcaaagaaauuuuggugacca

SEQ ID NO: 49763 - RNA, 22 nt, Homo sapiens
ugcaagaaucagccuaucauua

SEQ ID NO: 49764 - RNA, 21 nt, Homo sapiens
ugcaagaaucaggaagcugcc

SEQ ID NO: 49765 - RNA, 22 nt, Homo sapiens
ugcaauauccucuacuauaggu

SEQ ID NO: 49766 - RNA, 17 nt, Homo sapiens
ugcagcacacugauggg

SEQ ID NO: 49767 - RNA, 21 nt, Homo sapiens
ugcagccauucagcccuaugc

SEQ ID NO: 49768 - RNA, 22 nt, Homo sapiens
ugcauacacaagcauacaugua

SEQ ID NO: 49769 - RNA, 19 nt, Homo sapiens
ugcauaggguuacauacuc

SEQ ID NO: 49770 - RNA, 22 nt, Homo sapiens
ugcauauucgaguuauuuuggg

SEQ ID NO: 49771 - RNA, 22 nt, Homo sapiens
ugcaugcaucuuuuauaguagc

SEQ ID NO: 49772 - RNA, 19 nt, Homo sapiens
ugccauguagcacaugguc

SEQ ID NO: 49773 - RNA, 22 nt, Homo sapiens
ugccuaggcccaguccucagaa

SEQ ID NO: 49774 - RNA, 22 nt, Homo sapiens
ugccuaguggccuuaugaguau

SEQ ID NO: 49775 - RNA, 22 nt, Homo sapiens
ugccuaguguguugagaguuuu

SEQ ID NO: 49776 - RNA, 22 nt, Homo sapiens
ugccugagcccagcccuguagu

SEQ ID NO: 49777 - RNA, 22 nt, Homo sapiens
ugcuagaagaucacacacauca

SEQ ID NO: 49778 - RNA, 23 nt, Homo sapiens
ugcugagaccuagauccuaaaga

SEQ ID NO: 49779 - RNA, 22 nt, Homo sapiens
ugcuuagucuugcuuuagcuau

SEQ ID NO: 49780 - RNA, 22 nt, Homo sapiens
uggaagacucaagguggugaau

SEQ ID NO: 49781 - RNA, 22 nt, Homo sapiens
uggaagaugggaccucaguuuu

SEQ ID NO: 49782 - RNA, 22 nt, Homo sapiens
uggaauggagagagggugcacg

SEQ ID NO: 49783 - RNA, 19 nt, Homo sapiens
uggaauggauuuaaaugug

SEQ ID NO: 49784 - RNA, 22 nt, Homo sapiens
uggaaugucuauguuuuugauu

SEQ ID NO: 49785 - RNA, 21 nt, Homo sapiens
uggaccccuuccuugcaccau

SEQ ID NO: 49786 - RNA, 22 nt, Homo sapiens
uggacuguaauagagaacagaa

SEQ ID NO: 49787 - RNA, 22 nt, Homo sapiens
uggaggacugcagaacugaggc

SEQ ID NO: 49788 - RNA, 22 nt, Homo sapiens
uggauuuuaauuauucugucau

SEQ ID NO: 49789 - RNA, 22 nt, Homo sapiens
uggcaagaaccacaguuacuuu

SEQ ID NO: 49790 - RNA, 22 nt, Homo sapiens
uggcaagaacgaaauguagggu

SEQ ID NO: 49791 - RNA, 22 nt, Homo sapiens
uggcaugucagguuucuggguu

SEQ ID NO: 49792 - RNA, 22 nt, Homo sapiens
uggcgagaugcucgugugcaga

SEQ ID NO: 49793 - RNA, 23 nt, Homo sapiens
uggcuagacguccuuuccugaug

SEQ ID NO: 49794 - RNA, 22 nt, Homo sapiens
uggcuagaugagauguacugca

SEQ ID NO: 49795 - RNA, 22 nt, Homo sapiens
uggcuuuuaucuacucucaacu

SEQ ID NO: 49796 - RNA, 22 nt, Homo sapiens
uggcuuuuauuauguugaggua

SEQ ID NO: 49797 - RNA, 18 nt, Homo sapiens
ugggaagaaauucuucuc

SEQ ID NO: 49798 - RNA, 22 nt, Homo sapiens
ugggcaagagagcaugacccug

SEQ ID NO: 49799 - RNA, 22 nt, Homo sapiens
uggggcaaugaacauuuuugca

SEQ ID NO: 49800 - RNA, 22 nt, Homo sapiens
ugguaagaaaaccauuauuagc

SEQ ID NO: 49801 - RNA, 22 nt, Homo sapiens
ugguaauguaauuuggagaagg

SEQ ID NO: 49802 - RNA, 22 nt, Homo sapiens
uggucuccuuuguacccugggc

SEQ ID NO: 49803 - RNA, 22 nt, Homo sapiens
uggucuggagagucccgcccag

SEQ ID NO: 49804 - RNA, 22 nt, Homo sapiens
ugguguccugucucugcgcuug

SEQ ID NO: 49805 - RNA, 22 nt, Homo sapiens
uguaaacauguauguguuuaug

SEQ ID NO: 49806 - RNA, 23 nt, Homo sapiens
uguaaagcuaugaauuauucuuu

SEQ ID NO: 49807 - RNA, 22 nt, Homo sapiens
uguaagcagcagagacuauccu

SEQ ID NO: 49808 - RNA, 22 nt, Homo sapiens
uguaauguuucaucauuauuaa

SEQ ID NO: 49809 - RNA, 22 nt, Homo sapiens
uguacaugggacaggaggagag

SEQ ID NO: 49810 - RNA, 22 nt, Homo sapiens
uguagacaccaaagacagcaua

SEQ ID NO: 49811 - RNA, 22 nt, Homo sapiens
uguauaacucacauugaaguuu

SEQ ID NO: 49812 - RNA, 22 nt, Homo sapiens
uguauauguuuguacauauguc

SEQ ID NO: 49813 - RNA, 22 nt, Homo sapiens
uguauguaaagacaggauaaca

SEQ ID NO: 49814 - RNA, 22 nt, Homo sapiens
ugucaaguugugguucaauuuu

SEQ ID NO: 49815 - RNA, 22 nt, Homo sapiens
ugucacagagauuuugguaugu

SEQ ID NO: 49816 - RNA, 22 nt, Homo sapiens
ugucacaguuuguacuuuauag

SEQ ID NO: 49817 - RNA, 18 nt, Homo sapiens
ugucacuggauaaugguc

SEQ ID NO: 49818 - RNA, 22 nt, Homo sapiens
ugucaggaggguccagagaaaa

SEQ ID NO: 49819 - RNA, 19 nt, Homo sapiens
ugucaucaucuuuucuugc

SEQ ID NO: 49820 - RNA, 22 nt, Homo sapiens
ugucaugucaacuauggaauuu

SEQ ID NO: 49821 - RNA, 20 nt, Homo sapiens
ugucauuaagcacugugcca

SEQ ID NO: 49822 - RNA, 22 nt, Homo sapiens
uauugcagugagauccaucugg

SEQ ID NO: 49823 - RNA, 22 nt, Homo sapiens
uauuucaguugcguuucccgag

SEQ ID NO: 49824 - RNA, 22 nt, Homo sapiens
uauuuguccccuccaaaaguca

SEQ ID NO: 49825 - RNA, 22 nt, Homo sapiens
ucaaaugaucugcccgccuugg

SEQ ID NO: 49826 - RNA, 22 nt, Homo sapiens
ucaaaugauucacccaccuuug

SEQ ID NO: 49827 - RNA, 22 nt, Homo sapiens
ucaaaugauucuccugccucag

SEQ ID NO: 49828 - RNA, 22 nt, Homo sapiens
ucaaaugcacguagagaaaaua

SEQ ID NO: 49829 - RNA, 22 nt, Homo sapiens
ucaaaugcucuuugcagagagg

SEQ ID NO: 49830 - RNA, 22 nt, Homo sapiens
ucaagcaauucuccugccucag

SEQ ID NO: 49831 - RNA, 19 nt, Homo sapiens
ucaagcuauucuccugccu

SEQ ID NO: 49832 - RNA, 22 nt, Homo sapiens
ucaaggacucagagagggauua

SEQ ID NO: 49833 - RNA, 20 nt, Homo sapiens
ucaaggcacgaauaaaaguu

SEQ ID NO: 49834 - RNA, 22 nt, Homo sapiens
ucacaauguaaaugaggguugg

SEQ ID NO: 49835 - RNA, 22 nt, Homo sapiens
ucacaguaaauccagaagaaau

SEQ ID NO: 49836 - RNA, 22 nt, Homo sapiens
ucacagugaguggaguggggug

SEQ ID NO: 49837 - RNA, 23 nt, Homo sapiens
ucacaguuacuuuugcaucaacc

SEQ ID NO: 49838 - RNA, 22 nt, Homo sapiens
ucacaucucagguuucuugaca

SEQ ID NO: 49839 - RNA, 22 nt, Homo sapiens
ucacaugaauugucuuguucca

SEQ ID NO: 49840 - RNA, 22 nt, Homo sapiens
ucacauggcagagaagaagcuc

SEQ ID NO: 49841 - RNA, 22 nt, Homo sapiens
ucacaugucagccguggggaag

SEQ ID NO: 49842 - RNA, 22 nt, Homo sapiens
ucacauuaagcuguuauuucuu

SEQ ID NO: 49843 - RNA, 22 nt, Homo sapiens
ucacccacacaggagacaggga

SEQ ID NO: 49844 - RNA, 19 nt, Homo sapiens
ucacgugcagcagccacac

SEQ ID NO: 49845 - RNA, 22 nt, Homo sapiens
ucacgugguucauaaggcagaa

SEQ ID NO: 49846 - RNA, 20 nt, Homo sapiens
ucacugagugguccacagua

SEQ ID NO: 49847 - RNA, 22 nt, Homo sapiens
ucacugcacuccagccuuuaug

SEQ ID NO: 49848 - RNA, 22 nt, Homo sapiens
ucacugcacucuccgccuugcg

SEQ ID NO: 49849 - RNA, 22 nt, Homo sapiens
ucacugcgaccucugccucccg

SEQ ID NO: 49850 - RNA, 20 nt, Homo sapiens
ucacugugaacuucuugagg

SEQ ID NO: 49851 - RNA, 22 nt, Homo sapiens
ucacugugguuggaaggcuuaa

SEQ ID NO: 49852 - RNA, 22 nt, Homo sapiens
ucagaguagcugucugaggugc

SEQ ID NO: 49853 - RNA, 22 nt, Homo sapiens
ucagaucacuggcgcuggcgga

SEQ ID NO: 49854 - RNA, 22 nt, Homo sapiens
ucagaugauuccguugacgaga

SEQ ID NO: 49855 - RNA, 22 nt, Homo sapiens
ucagaugauucuguuguugugu

SEQ ID NO: 49856 - RNA, 22 nt, Homo sapiens
ucagauguuugagaaguauacu

SEQ ID NO: 49857 - RNA, 22 nt, Homo sapiens
ucagcagugagagaccucaccc

SEQ ID NO: 49858 - RNA, 22 nt, Homo sapiens
ucagcaucacaggcagugagug

SEQ ID NO: 49859 - RNA, 22 nt, Homo sapiens
ucagcaucacgugggcucccgu

SEQ ID NO: 49860 - RNA, 23 nt, Homo sapiens
ucaguagucauugggaaagugug

SEQ ID NO: 49861 - RNA, 18 nt, Homo sapiens
ucagucacugccuggcuu

SEQ ID NO: 49862 - RNA, 22 nt, Homo sapiens
ucagugcaggaauuuccuuaga

SEQ ID NO: 49863 - RNA, 23 nt, Homo sapiens
ucagugucuggauccugcucagu

SEQ ID NO: 49864 - RNA, 22 nt, Homo sapiens
ucuggcauuuucucugcuugca

SEQ ID NO: 49865 - RNA, 20 nt, Homo sapiens
ucuggccccuccaaaucuca

SEQ ID NO: 49866 - RNA, 22 nt, Homo sapiens
ucuggccccucccaaaucucau

SEQ ID NO: 49867 - RNA, 22 nt, Homo sapiens
ucugguguuauucauguaguuu

SEQ ID NO: 49868 - RNA, 22 nt, Homo sapiens
ucugguuccugcauucauucaa

SEQ ID NO: 49869 - RNA, 22 nt, Homo sapiens
ucugugcggucuguguuaugaa

SEQ ID NO: 49870 - RNA, 22 nt, Homo sapiens
ucugugcugagaguugaaaguu

SEQ ID NO: 49871 - RNA, 22 nt, Homo sapiens
ucugugguucaaaccagcaacu

SEQ ID NO: 49872 - RNA, 22 nt, Homo sapiens
ucuguguugaugcucauuaauu

SEQ ID NO: 49873 - RNA, 22 nt, Homo sapiens
ucuguugguucuuugaggagga

SEQ ID NO: 49874 - RNA, 22 nt, Homo sapiens
ucuuaguuggaaugggauaagg

SEQ ID NO: 49875 - RNA, 22 nt, Homo sapiens
ucuucaugcuugaaauaauagc

SEQ ID NO: 49876 - RNA, 22 nt, Homo sapiens
ucuugcuuguuguucccuucau

SEQ ID NO: 49877 - RNA, 22 nt, Homo sapiens
ucuuucacuuagcaugauguuu

SEQ ID NO: 49878 - RNA, 22 nt, Homo sapiens
ucuuuggguguauuucacagcc

SEQ ID NO: 49879 - RNA, 22 nt, Homo sapiens
ucuuugguugcacugcaggugu

SEQ ID NO: 49880 - RNA, 22 nt, Homo sapiens
ucuuugguuucugucucuguaa

SEQ ID NO: 49881 - RNA, 22 nt, Homo sapiens
ucuuuguucaggagccaacucc

SEQ ID NO: 49882 - RNA, 22 nt, Homo sapiens
ucuuuguugcauaggcuuguuc

SEQ ID NO: 49883 - RNA, 22 nt, Homo sapiens
ucuuuuggguauggagccauca

SEQ ID NO: 49884 - RNA, 22 nt, Homo sapiens
ugaaacacacagagaagggaga

SEQ ID NO: 49885 - RNA, 22 nt, Homo sapiens
ugaaaugcagaacuuuaggucu

SEQ ID NO: 49886 - RNA, 22 nt, Homo sapiens
ugaaaugccuuuaaugaauuua

SEQ ID NO: 49887 - RNA, 22 nt, Homo sapiens
ugaaaugcuaauucguagcuaa

SEQ ID NO: 49888 - RNA, 22 nt, Homo sapiens
ugaaauguguuaucugggccug

SEQ ID NO: 49889 - RNA, 22 nt, Homo sapiens
ugaacacagccugccucugcca

SEQ ID NO: 49890 - RNA, 20 nt, Homo sapiens
ugaacugguuacuuucuguc

SEQ ID NO: 49891 - RNA, 22 nt, Homo sapiens
ugaacuguugggggaaauucag

SEQ ID NO: 49892 - RNA, 22 nt, Homo sapiens
ugaagggcauuguuuugccaaa

SEQ ID NO: 49893 - RNA, 22 nt, Homo sapiens
ugaauacagcacacccaugggu

SEQ ID NO: 49894 - RNA, 22 nt, Homo sapiens
ugaauacuucaaaaaaauagcu

SEQ ID NO: 49895 - RNA, 22 nt, Homo sapiens
ugaauacuucguucaaagauaa

SEQ ID NO: 49896 - RNA, 22 nt, Homo sapiens
ugaauaggcaguuaaguuuaug

SEQ ID NO: 49897 - RNA, 22 nt, Homo sapiens
ugaauaguaauguguuuggucu

SEQ ID NO: 49898 - RNA, 22 nt, Homo sapiens
ugaauaguuugacagaacucuu

SEQ ID NO: 49899 - RNA, 22 nt, Homo sapiens
ugaaugcaucuagaaauuuauu

SEQ ID NO: 49900 - RNA, 22 nt, Homo sapiens
ugaauguaacuaaaccugugaa

SEQ ID NO: 49901 - RNA, 22 nt, Homo sapiens
ugacaagaacuuuccauaguaa

SEQ ID NO: 49902 - RNA, 20 nt, Homo sapiens
ugacaagugagaauuauggg

SEQ ID NO: 49903 - RNA, 22 nt, Homo sapiens
ugacagagcaggacuucaucuc

SEQ ID NO: 49904 - RNA, 22 nt, Homo sapiens
ugacaggauggagaucgguauu

SEQ ID NO: 49905 - RNA, 22 nt, Homo sapiens
ugacaguguccucauucccaac

SEQ ID NO: 49906 - RNA, 18 nt, Homo sapiens
ugacaguuucuuuauauu

SEQ ID NO: 49907 - RNA, 22 nt, Homo sapiens
ugacaugauuguauauuuagaa

SEQ ID NO: 49908 - RNA, 21 nt, Homo sapiens
ugacauuauuucaugucagua

SEQ ID NO: 49909 - RNA, 21 nt, Homo sapiens
ugacuacuggucucuuggguc

SEQ ID NO: 49910 - RNA, 22 nt, Homo sapiens
ugacuagagggcuuuuguguag

SEQ ID NO: 49911 - RNA, 23 nt, Homo sapiens
ugacugaguauauguuuggugcu

SEQ ID NO: 49912 - RNA, 21 nt, Homo sapiens
ugagaacaacaggucaagcag

SEQ ID NO: 49913 - RNA, 22 nt, Homo sapiens
ugagaacagcagcuugggacac

SEQ ID NO: 49914 - RNA, 22 nt, Homo sapiens
ugagaacauggagaacccccca

SEQ ID NO: 49915 - RNA, 16 nt, Homo sapiens
ugagaacaugugacau

SEQ ID NO: 49916 - RNA, 22 nt, Homo sapiens
ugagaacauuccucuuccuggc

SEQ ID NO: 49917 - RNA, 22 nt, Homo sapiens
ugagaacugccuguauuuaucu

SEQ ID NO: 49918 - RNA, 22 nt, Homo sapiens
ugagaacuuugucuuuuacucu

SEQ ID NO: 49919 - RNA, 22 nt, Homo sapiens
ugagaagacaucuuugcuuugu

SEQ ID NO: 49920 - RNA, 22 nt, Homo sapiens
ugagaagugacgcagcaggguu

SEQ ID NO: 49921 - RNA, 22 nt, Homo sapiens
ugagaaugcagaaucucgugca

SEQ ID NO: 49922 - RNA, 22 nt, Homo sapiens
ugagacauauuauacugcuuuu

SEQ ID NO: 49923 - RNA, 22 nt, Homo sapiens
ugagacaucucuccugagacag

SEQ ID NO: 49924 - RNA, 22 nt, Homo sapiens
gacuacaacuucuauuauucag

SEQ ID NO: 49925 - RNA, 22 nt, Homo sapiens
gacuugaagaaucuaagggagg

SEQ ID NO: 49926 - RNA, 22 nt, Homo sapiens
gagaacuaaugauguacuaggc

SEQ ID NO: 49927 - RNA, 22 nt, Homo sapiens
gagaaguaaauuuauuugcaaa

SEQ ID NO: 49928 - RNA, 21 nt, Homo sapiens
gagaaucuuuucagggcaaac

SEQ ID NO: 49929 - RNA, 22 nt, Homo sapiens
gagacauguuugccaauaauuu

SEQ ID NO: 49930 - RNA, 22 nt, Homo sapiens
gagauaggauucacuuucaugu

SEQ ID NO: 49931 - RNA, 22 nt, Homo sapiens
gagauggaguuucacuucgcuc

SEQ ID NO: 49932 - RNA, 22 nt, Homo sapiens
gagauucuucaauauuuauucu

SEQ ID NO: 49933 - RNA, 22 nt, Homo sapiens
gaggcagucuguccauucucag

SEQ ID NO: 49934 - RNA, 22 nt, Homo sapiens
gaggcauugaagauauggaagu

SEQ ID NO: 49935 - RNA, 22 nt, Homo sapiens
gagguaagaaagucaguccuuc

SEQ ID NO: 49936 - RNA, 22 nt, Homo sapiens
gagguaaguaagaauggcaagc

SEQ ID NO: 49937 - RNA, 22 nt, Homo sapiens
gaguaaaugucaaguacuuagg

SEQ ID NO: 49938 - RNA, 22 nt, Homo sapiens
gagugcaaagguccugaggugg

SEQ ID NO: 49939 - RNA, 22 nt, Homo sapiens
gagugcaauggcagaucuccgc

SEQ ID NO: 49940 - RNA, 22 nt, Homo sapiens
gauauuacuuccaauauugcaa

SEQ ID NO: 49941 - RNA, 22 nt, Homo sapiens
gaucacaugggagaaugagagu

SEQ ID NO: 49942 - RNA, 22 nt, Homo sapiens
gaucucaguggauacugugaug

SEQ ID NO: 49943 - RNA, 22 nt, Homo sapiens
gaucuggagguuuuccucauga

SEQ ID NO: 49944 - RNA, 22 nt, Homo sapiens
gaucugugugauuggaugcauu

SEQ ID NO: 49945 - RNA, 22 nt, Homo sapiens
gaugagguaguguaccuagucu

SEQ ID NO: 49946 - RNA, 22 nt, Homo sapiens
gauuagaacagaagucagauua

SEQ ID NO: 49947 - RNA, 22 nt, Homo sapiens
gcaaaguguuuuccaacuuggu

SEQ ID NO: 49948 - RNA, 22 nt, Homo sapiens
gcaagaguauuucaaggaagau

SEQ ID NO: 49949 - RNA, 22 nt, Homo sapiens
gcacagucaacacuuauucacc

SEQ ID NO: 49950 - RNA, 22 nt, Homo sapiens
gcacaguuaaagggucauguga

SEQ ID NO: 49951 - RNA, 22 nt, Homo sapiens
gcagcacaugacuguauguaua

SEQ ID NO: 49952 - RNA, 22 nt, Homo sapiens
gcagcagugcccuggauggaaa

SEQ ID NO: 49953 - RNA, 22 nt, Homo sapiens
gcagugcaguggcgcgaucucg

SEQ ID NO: 49954 - RNA, 22 nt, Homo sapiens
gcauauguuuggguguguauau

SEQ ID NO: 49955 - RNA, 22 nt, Homo sapiens
gcauggagaaggggacugauuc

SEQ ID NO: 49956 - RNA, 22 nt, Homo sapiens
gccauggaggauuuauagaggc

SEQ ID NO: 49957 - RNA, 22 nt, Homo sapiens
gccauugcacuccgcccugggc

SEQ ID NO: 49958 - RNA, 22 nt, Homo sapiens
gcucaaguaauggcaguuuugc

SEQ ID NO: 49959 - RNA, 22 nt, Homo sapiens
gcucugguuacaaaggcaaauu

SEQ ID NO: 49960 - RNA, 17 nt, Homo sapiens
gcugcauucauguagaa

SEQ ID NO: 49961 - RNA, 22 nt, Homo sapiens
gcugcuguggcagauuggauuc

SEQ ID NO: 49962 - RNA, 22 nt, Homo sapiens
gcugcuguuuaguuucuccugg

SEQ ID NO: 49963 - RNA, 22 nt, Homo sapiens
gcugcuguuucucuuucagcau

SEQ ID NO: 49964 - RNA, 22 nt, Homo sapiens
gcugcuuuugaugacaaaaaca

SEQ ID NO: 49965 - RNA, 22 nt, Homo sapiens
gcugguauuacaggcaugagcc

SEQ ID NO: 49966 - RNA, 22 nt, Homo sapiens
gcuggucugccguaguaggugc

SEQ ID NO: 49967 - RNA, 22 nt, Homo sapiens
gcuguauugacuuuguaucaua

SEQ ID NO: 49968 - RNA, 22 nt, Homo sapiens
gcugucaugagcaacacaugaa

SEQ ID NO: 49969 - RNA, 22 nt, Homo sapiens
gcuguguugugcccagcaucau

SEQ ID NO: 49970 - RNA, 19 nt, Homo sapiens
gcuuuguggggaaggagcc

SEQ ID NO: 49971 - RNA, 22 nt, Homo sapiens
ggaaagaucagcuaaauguaag

SEQ ID NO: 49972 - RNA, 22 nt, Homo sapiens
ggaaaucaucauucucgguaua

SEQ ID NO: 49973 - RNA, 22 nt, Homo sapiens
ggaaauguuggugucaugaguu

SEQ ID NO: 49974 - RNA, 22 nt, Homo sapiens
ggaaauguuuagcauccacuuu

SEQ ID NO: 49975 - RNA, 20 nt, Homo sapiens
ggaagagugacacaagguau

SEQ ID NO: 49976 - RNA, 22 nt, Homo sapiens
ggaauguauuaaggcauugggc

SEQ ID NO: 49977 - RNA, 21 nt, Homo sapiens
ggaauuuagggaaugauuuag

SEQ ID NO: 49978 - RNA, 22 nt, Homo sapiens
ggagaugugccugcucugcucu

SEQ ID NO: 49979 - RNA, 22 nt, Homo sapiens
ggagauguuuaaccuuuuaucu

SEQ ID NO: 49980 - RNA, 22 nt, Homo sapiens
ggagguagguuugugauuugua

SEQ ID NO: 49981 - RNA, 22 nt, Homo sapiens
ggaguaaaagaguaggaggaau

SEQ ID NO: 49982 - RNA, 22 nt, Homo sapiens
ggagucugauuuuuauguugcu

SEQ ID NO: 49983 - RNA, 22 nt, Homo sapiens
ggagugugauuguucucuguua

SEQ ID NO: 49984 - RNA, 22 nt, Homo sapiens
ggaugcauuuuugguugucaca

SEQ ID NO: 49985 - RNA, 21 nt, Homo sapiens
ggcaagaaacacaaucaagua

SEQ ID NO: 49986 - RNA, 22 nt, Homo sapiens
ggcaagaagaacuauaacuuuu

SEQ ID NO: 49987 - RNA, 22 nt, Homo sapiens
ggcaagaagagaguuuaaacau

SEQ ID NO: 49988 - RNA, 22 nt, Homo sapiens
ggcaagugucagcagcaacacc

SEQ ID NO: 49989 - RNA, 22 nt, Homo sapiens
ggcaccacagacgccaggcgug

SEQ ID NO: 49990 - RNA, 22 nt, Homo sapiens
ggcacuguggcucaagccugua

SEQ ID NO: 49991 - RNA, 22 nt, Homo sapiens
gggaagugugguuucuuuacag

SEQ ID NO: 49992 - RNA, 22 nt, Homo sapiens
gggagugucuaaccuguuaaca

SEQ ID NO: 49993 - RNA, 20 nt, Homo sapiens
gggcaaguaugugggaaguc

SEQ ID NO: 49994 - RNA, 18 nt, Homo sapiens
gggcaaguugccuggcuu

SEQ ID NO: 49995 - RNA, 22 nt, Homo sapiens
gguaaacauacugcugucuucu

SEQ ID NO: 49996 - RNA, 22 nt, Homo sapiens
gguauuauuugccuuuuacuga

SEQ ID NO: 49997 - RNA, 22 nt, Homo sapiens
gguauuuaaaguaccugucugc

SEQ ID NO: 49998 - RNA, 19 nt, Homo sapiens
ggugcuugaauauuccucc

SEQ ID NO: 49999 - RNA, 22 nt, Homo sapiens
guaaguagcuuuagauauaaau

SEQ ID NO: 50000 - RNA, 22 nt, Homo sapiens
guaccugggugacaggauuauu

SEQ ID NO: 50001 - RNA, 18 nt, Homo sapiens
guaggucaguaccaagca

SEQ ID NO: 50002 - RNA, 22 nt, Homo sapiens
guauacacccugugauauuauu

SEQ ID NO: 50003 - RNA, 22 nt, Homo sapiens
guauacaugucaaaacucacau

SEQ ID NO: 50004 - RNA, 22 nt, Homo sapiens
gucaagugaagaccugacucuu

SEQ ID NO: 50005 - RNA, 22 nt, Homo sapiens
gucagugugauaucugcagggg

SEQ ID NO: 50006 - RNA, 22 nt, Homo sapiens
gucccugugucuuuauguggcc

SEQ ID NO: 50007 - RNA, 22 nt, Homo sapiens
guccuggagaagcguggaccgg

SEQ ID NO: 50008 - RNA, 22 nt, Homo sapiens
gucuaugagucccugaauuuaa

SEQ ID NO: 50009 - RNA, 22 nt, Homo sapiens
gucucugagaugucaacaccua

SEQ ID NO: 50010 - RNA, 22 nt, Homo sapiens
gucuggagacuugggucaucaa

SEQ ID NO: 50011 - RNA, 22 nt, Homo sapiens
gucugguugacagcauguggcc

SEQ ID NO: 50012 - RNA, 22 nt, Homo sapiens
gucuuggagacauugccauuga

SEQ ID NO: 50013 - RNA, 22 nt, Homo sapiens
gucuuuguuauuaugaaucaac

SEQ ID NO: 50014 - RNA, 22 nt, Homo sapiens
gucuuuguuuggucuguaucag

SEQ ID NO: 50015 - RNA, 22 nt, Homo sapiens
gugaaugcauuaagaaggggga

SEQ ID NO: 50016 - RNA, 22 nt, Homo sapiens
gugaauguaaagucaugugacu

SEQ ID NO: 50017 - RNA, 22 nt, Homo sapiens
gugaccagaugggcaggggugu

SEQ ID NO: 50018 - RNA, 22 nt, Homo sapiens
gugaccucuguugcugucacua

SEQ ID NO: 50019 - RNA, 22 nt, Homo sapiens
gugacugcauauaaguguaugu

SEQ ID NO: 50020 - RNA, 22 nt, Homo sapiens
gugacuggacucugaagaaaau

SEQ ID NO: 50021 - RNA, 22 nt, Homo sapiens
gugagaugaggucucacucugu

SEQ ID NO: 50022 - RNA, 22 nt, Homo sapiens
gugagcaguguccuugggggca

SEQ ID NO: 50023 - RNA, 20 nt, Homo sapiens
gugauuggucacugguuguu

SEQ ID NO: 50024 - RNA, 21 nt, Homo sapiens
gugcaaacaucauagaaugua

SEQ ID NO: 50025 - RNA, 22 nt, Homo sapiens
gugcaagagugauugcaguuuu

SEQ ID NO: 50026 - RNA, 22 nt, Homo sapiens
gugcaaugaguguggcaaagcc

SEQ ID NO: 50027 - RNA, 22 nt, Homo sapiens
gugcacaucuguguuccagcua

SEQ ID NO: 50028 - RNA, 22 nt, Homo sapiens
gugcacaugguagguauugagu

SEQ ID NO: 50029 - RNA, 19 nt, Homo sapiens
caauacuucuuggcauaca

SEQ ID NO: 50030 - RNA, 22 nt, Homo sapiens
caauugcacucuuagguguaca

SEQ ID NO: 50031 - RNA, 22 nt, Homo sapiens
cacacugucuucauuacuguag

SEQ ID NO: 50032 - RNA, 22 nt, Homo sapiens
cacaguguucauagccaucagg

SEQ ID NO: 50033 - RNA, 22 nt, Homo sapiens
cacugcauuacucaugagcaug

SEQ ID NO: 50034 - RNA, 22 nt, Homo sapiens
cacuggucagugaaacaguauu

SEQ ID NO: 50035 - RNA, 22 nt, Homo sapiens
cacuggucucauggcaugagag

SEQ ID NO: 50036 - RNA, 22 nt, Homo sapiens
cagaguuaguagccuuugacaa

SEQ ID NO: 50037 - RNA, 22 nt, Homo sapiens
cagauacuccuggucucaggag

SEQ ID NO: 50038 - RNA, 22 nt, Homo sapiens
cagauaguuguagauaugcagc

SEQ ID NO: 50039 - RNA, 22 nt, Homo sapiens
caggcacgcuugggagacacac

SEQ ID NO: 50040 - RNA, 19 nt, Homo sapiens
cagguagugugcugacaug

SEQ ID NO: 50041 - RNA, 22 nt, Homo sapiens
cagucacagugacaggaugugg

SEQ ID NO: 50042 - RNA, 22 nt, Homo sapiens
cagugaauuucaggucaagagu

SEQ ID NO: 50043 - RNA, 18 nt, Homo sapiens
cagugcaauacaggagag

SEQ ID NO: 50044 - RNA, 21 nt, Homo sapiens
cauaaugcuacuuauuuuaug

SEQ ID NO: 50045 - RNA, 18 nt, Homo sapiens
cauagcacuucagcacau

SEQ ID NO: 50046 - RNA, 22 nt, Homo sapiens
cauauaguaguacuguuagguu

SEQ ID NO: 50047 - RNA, 22 nt, Homo sapiens
caucacacuuggauguaagaca

SEQ ID NO: 50048 - RNA, 23 nt, Homo sapiens
caucacauagaggaaagaggaca

SEQ ID NO: 50049 - RNA, 22 nt, Homo sapiens
caucacaugcuuauuuuccuca

SEQ ID NO: 50050 - RNA, 22 nt, Homo sapiens
caucacauucugagauacugag

SEQ ID NO: 50051 - RNA, 22 nt, Homo sapiens
caucagagugagauauaagauc

SEQ ID NO: 50052 - RNA, 22 nt, Homo sapiens
caucagauugagaucaucuaag

SEQ ID NO: 50053 - RNA, 22 nt, Homo sapiens
caugacacauguuuaccuaugu

SEQ ID NO: 50054 - RNA, 22 nt, Homo sapiens
cauggcccuggguccauaggaa

SEQ ID NO: 50055 - RNA, 22 nt, Homo sapiens
cauggccuuuggaaugugucua

SEQ ID NO: 50056 - RNA, 22 nt, Homo sapiens
caugucuuuuauucugugugau

SEQ ID NO: 50057 - RNA, 22 nt, Homo sapiens
cauuaguugaagugcagggaga

SEQ ID NO: 50058 - RNA, 22 nt, Homo sapiens
cauuccacuggauaaacaaggu

SEQ ID NO: 50059 - RNA, 18 nt, Homo sapiens
ccagugcaaggaaagccc

SEQ ID NO: 50060 - RNA, 22 nt, Homo sapiens
ccagugcauggaucccaggggg

SEQ ID NO: 50061 - RNA, 22 nt, Homo sapiens
ccccagguuucaauaaagccca

SEQ ID NO: 50062 - RNA, 22 nt, Homo sapiens
ccuucauugcaucuuuaagaga

SEQ ID NO: 50063 - RNA, 22 nt, Homo sapiens
ccuucuuuuguaaggcugaaua

SEQ ID NO: 50064 - RNA, 22 nt, Homo sapiens
ccuuuuugaguugccagaguuc

SEQ ID NO: 50065 - RNA, 22 nt, Homo sapiens
cuaaaacuuucugagugcagca

SEQ ID NO: 50066 - RNA, 22 nt, Homo sapiens
cuaaaguauugagugguaaaga

SEQ ID NO: 50067 - RNA, 22 nt, Homo sapiens
cuaacuaugucucaggaugucc

SEQ ID NO: 50068 - RNA, 22 nt, Homo sapiens
cuaagcaccuuaguggggaauc

SEQ ID NO: 50069 - RNA, 22 nt, Homo sapiens
cuacaguuauguuuuaaaugug

SEQ ID NO: 50070 - RNA, 22 nt, Homo sapiens
auaucacaaacaagucuguacu

SEQ ID NO: 50071 - RNA, 20 nt, Homo sapiens
auaugcauguguuuucacuu

SEQ ID NO: 50072 - RNA, 22 nt, Homo sapiens
auaugcuuauuagcaagaaaua

SEQ ID NO: 50073 - RNA, 22 nt, Homo sapiens
auaugucuauuauuagggcagg

SEQ ID NO: 50074 - RNA, 22 nt, Homo sapiens
auauuacagagaggaccuggga

SEQ ID NO: 50075 - RNA, 22 nt, Homo sapiens
auauucacagguaucagagauu

SEQ ID NO: 50076 - RNA, 18 nt, Homo sapiens
auauugccuucagacuag

SEQ ID NO: 50077 - RNA, 22 nt, Homo sapiens
aucaaaguaggcauauguuuuu

SEQ ID NO: 50078 - RNA, 22 nt, Homo sapiens
aucacaauuguacguaggagcc

SEQ ID NO: 50079 - RNA, 22 nt, Homo sapiens
aucacagaacuuugagcagaga

SEQ ID NO: 50080 - RNA, 22 nt, Homo sapiens
aucacagauauggguuuaaauc

SEQ ID NO: 50081 - RNA, 22 nt, Homo sapiens
aucacaguuauaacauccuuuu

SEQ ID NO: 50082 - RNA, 22 nt, Homo sapiens
aucacaguuuuaccauuuggua

SEQ ID NO: 50083 - RNA, 20 nt, Homo sapiens
aucaccacagcucguucaug

SEQ ID NO: 50084 - RNA, 23 nt, Homo sapiens
aucacuguuaacaauuucuuccu

SEQ ID NO: 50085 - RNA, 22 nt, Homo sapiens
aucagcagcaugaaaacaggcu

SEQ ID NO: 50086 - RNA, 22 nt, Homo sapiens
aucaucacaguuguguguaaug

SEQ ID NO: 50087 - RNA, 22 nt, Homo sapiens
aucauggaguauuugcaagucu

SEQ ID NO: 50088 - RNA, 22 nt, Homo sapiens
aucauugugcaucuucauucca

SEQ ID NO: 50089 - RNA, 22 nt, Homo sapiens
auccaucagacggcaggcguug

SEQ ID NO: 50090 - RNA, 22 nt, Homo sapiens
auccauugcucaagagaaguca

SEQ ID NO: 50091 - RNA, 21 nt, Homo sapiens
auccuucuuuuucaaccugug

SEQ ID NO: 50092 - RNA, 22 nt, Homo sapiens
aucuagagaggcagucuggccg

SEQ ID NO: 50093 - RNA, 22 nt, Homo sapiens
aucucaguucaggcuggccaca

SEQ ID NO: 50094 - RNA, 22 nt, Homo sapiens
aucuccaggugccagcugcgcc

SEQ ID NO: 50095 - RNA, 22 nt, Homo sapiens
aucugacuuuuaauuugaaaac

SEQ ID NO: 50096 - RNA, 19 nt, Homo sapiens
aucuggaguuccuggggcu

SEQ ID NO: 50097 - RNA, 22 nt, Homo sapiens
aucuuugcugagaugcauggca

SEQ ID NO: 50098 - RNA, 22 nt, Homo sapiens
aucuuuggauacuugauauagu

SEQ ID NO: 50099 - RNA, 22 nt, Homo sapiens
augaaaagcauaaacgcugaag

SEQ ID NO: 50100 - RNA, 22 nt, Homo sapiens
augaacagagccuugagaaccu

SEQ ID NO: 50101 - RNA, 22 nt, Homo sapiens
augaagagaaaguggaucuugg

SEQ ID NO: 50102 - RNA, 22 nt, Homo sapiens
augaagugcaugauaguugguu

SEQ ID NO: 50103 - RNA, 22 nt, Homo sapiens
augaauacugcugcaaugaaca

SEQ ID NO: 50104 - RNA, 22 nt, Homo sapiens
augaaugucuuauuuugagaaa

SEQ ID NO: 50105 - RNA, 22 nt, Homo sapiens
augaauuuucugauguugggua

SEQ ID NO: 50106 - RNA, 22 nt, Homo sapiens
augacauguauuuccaggauuu

SEQ ID NO: 50107 - RNA, 22 nt, Homo sapiens
augacauugaugcucuggcugg

SEQ ID NO: 50108 - RNA, 22 nt, Homo sapiens
augaccagagagugcgcagggu

SEQ ID NO: 50109 - RNA, 22 nt, Homo sapiens
augacuagaggagggauggcca

SEQ ID NO: 50110 - RNA, 22 nt, Homo sapiens
augacuggauaauggacacaca

SEQ ID NO: 50111 - RNA, 22 nt, Homo sapiens
augagacuguucuuccucauug

SEQ ID NO: 50112 - RNA, 22 nt, Homo sapiens
augagauaggaacaaacuuaca

SEQ ID NO: 50113 - RNA, 22 nt, Homo sapiens
augagaugaauaccgacgaugu

SEQ ID NO: 50114 - RNA, 21 nt, Homo sapiens
augagauguuagacuuuagac

SEQ ID NO: 50115 - RNA, 22 nt, Homo sapiens
augagauucuuagagaagucug

SEQ ID NO: 50116 - RNA, 21 nt, Homo sapiens
augagguguacuguggugaaa

SEQ ID NO: 50117 - RNA, 20 nt, Homo sapiens
augagguguaugacacugaa

SEQ ID NO: 50118 - RNA, 19 nt, Homo sapiens
augauugucuauggaggaa

SEQ ID NO: 50119 - RNA, 22 nt, Homo sapiens
augcacuguuuucuugaugaga

SEQ ID NO: 50120 - RNA, 22 nt, Homo sapiens
augcauggucugaagucaaccu

SEQ ID NO: 50121 - RNA, 22 nt, Homo sapiens
augccaguguccagaguggguu

SEQ ID NO: 50122 - RNA, 22 nt, Homo sapiens
augcuacugauaagcaaucauu

SEQ ID NO: 50123 - RNA, 22 nt, Homo sapiens
augcuacuggacaauggugacu

SEQ ID NO: 50124 - RNA, 22 nt, Homo sapiens
auggaagaauugucggggaugu

SEQ ID NO: 50125 - RNA, 22 nt, Homo sapiens
auggaagacuccucuuugggua

SEQ ID NO: 50126 - RNA, 22 nt, Homo sapiens
auggaggacaaugucaccuuca

SEQ ID NO: 50127 - RNA, 22 nt, Homo sapiens
auggcaaaauguuccuaguggu

SEQ ID NO: 50128 - RNA, 22 nt, Homo sapiens
auggcagagucagaaagucagg

SEQ ID NO: 50129 - RNA, 22 nt, Homo sapiens
auggcagugagucucuaguauu

SEQ ID NO: 50130 - RNA, 22 nt, Homo sapiens
auggcaguuuauucuaaaucaa

SEQ ID NO: 50131 - RNA, 22 nt, Homo sapiens
auggcucaguguguaucuauca

SEQ ID NO: 50132 - RNA, 22 nt, Homo sapiens
auggcucuggauagaaugcagg

SEQ ID NO: 50133 - RNA, 22 nt, Homo sapiens
auggcucuguuccaugugucuu

SEQ ID NO: 50134 - RNA, 22 nt, Homo sapiens
auggcucuuauuauuugaggua

SEQ ID NO: 50135 - RNA, 22 nt, Homo sapiens
auggcugagugauuucaaacag

SEQ ID NO: 50136 - RNA, 22 nt, Homo sapiens
auggcuuuuccugucuugcaug

SEQ ID NO: 50137 - RNA, 22 nt, Homo sapiens
augggagugugguuagagaccu

SEQ ID NO: 50138 - RNA, 22 nt, Homo sapiens
augguauuuaacagucuuucua

SEQ ID NO: 50139 - RNA, 22 nt, Homo sapiens
augugcaaauuuccaaacucuu

SEQ ID NO: 50140 - RNA, 22 nt, Homo sapiens
augugcaauggugucaccacau

SEQ ID NO: 50141 - RNA, 18 nt, Homo sapiens
augugcaauuuuguauuu

SEQ ID NO: 50142 - RNA, 22 nt, Homo sapiens
augugcacaacgugcagguuug

SEQ ID NO: 50143 - RNA, 22 nt, Homo sapiens
augugcacaugcuuacauguga

SEQ ID NO: 50144 - RNA, 22 nt, Homo sapiens
augugcaugcuguucugccaga

SEQ ID NO: 50145 - RNA, 22 nt, Homo sapiens
auguggaaagcagcaugauaug

SEQ ID NO: 50146 - RNA, 22 nt, Homo sapiens
auguguauuaccucgauuguga

SEQ ID NO: 50147 - RNA, 22 nt, Homo sapiens
auguuagcaucuggcacuaugg

SEQ ID NO: 50148 - RNA, 22 nt, Homo sapiens
auuauaugucaucacagacacc

SEQ ID NO: 50149 - RNA, 22 nt, Homo sapiens
auuaucacaguuuugcauaugg

SEQ ID NO: 50150 - RNA, 22 nt, Homo sapiens
auucaucagggauauugguuga

SEQ ID NO: 50151 - RNA, 22 nt, Homo sapiens
auuccacagccgauaccaugac

SEQ ID NO: 50152 - RNA, 23 nt, Homo sapiens
auugaacacuuucauaugugagg

SEQ ID NO: 50153 - RNA, 22 nt, Homo sapiens
auugaggcaggaggaccaucua

SEQ ID NO: 50154 - RNA, 22 nt, Homo sapiens
auugaguaaaaaauagugaugu

SEQ ID NO: 50155 - RNA, 18 nt, Homo sapiens
auugcacaccagccuggg

SEQ ID NO: 50156 - RNA, 22 nt, Homo sapiens
auuguacauacaccggugugua

SEQ ID NO: 50157 - RNA, 19 nt, Homo sapiens
auuuccuggagcuggucuc

SEQ ID NO: 50158 - RNA, 22 nt, Homo sapiens
auuuccuguaggggcuugcgaa

SEQ ID NO: 50159 - RNA, 22 nt, Homo sapiens
auuuggcaacguagggaggcau

SEQ ID NO: 50160 - RNA, 22 nt, Homo sapiens
auuuggccuuuguaugcaguau

SEQ ID NO: 50161 - RNA, 22 nt, Homo sapiens
auuugguuauucaguuguucag

SEQ ID NO: 50162 - RNA, 22 nt, Homo sapiens
auuuuugguugucagcacuagg

SEQ ID NO: 50163 - RNA, 22 nt, Homo sapiens
auuuuugguuucaccugcacgc

SEQ ID NO: 50164 - RNA, 22 nt, Homo sapiens
caaagcuauagcaccagaggga

SEQ ID NO: 50165 - RNA, 22 nt, Homo sapiens
caaagugcugggacuggccggg

SEQ ID NO: 50166 - RNA, 22 nt, Homo sapiens
caaagugcugggaugggccagg

SEQ ID NO: 50167 - RNA, 22 nt, Homo sapiens
caaauccucaccucaucaugaa

SEQ ID NO: 50168 - RNA, 22 nt, Homo sapiens
caacacuguuuauuggauagcc

SEQ ID NO: 50169 - RNA, 19 nt, Homo sapiens
caacccugcagagaaagga

SEQ ID NO: 50170 - RNA, 21 nt, Homo sapiens
caagugaugcuucugcuuuaa

SEQ ID NO: 50171 - RNA, 22 nt, Homo sapiens
caagugcuugaugaaugaucaa

SEQ ID NO: 50172 - RNA, 22 nt, Homo sapiens
caagugcuuucuuggggauuua

SEQ ID NO: 50173 - RNA, 23 nt, Homo sapiens
caauacugaccucacguuaauag

SEQ ID NO: 50174 - RNA, 22 nt, Homo sapiens
caauacuguuaccugaaauagg

SEQ ID NO: 50175 - RNA, 22 nt, Homo sapiens
caacaguaaagcauuuuuaagu

SEQ ID NO: 50176 - RNA, 22 nt, Homo sapiens
caagagaccugagugucauucu

SEQ ID NO: 50177 - RNA, 22 nt, Homo sapiens
caagagagcugaugguuuuaaa

SEQ ID NO: 50178 - RNA, 22 nt, Homo sapiens
caaggaauucucaauagaguua

SEQ ID NO: 50179 - RNA, 22 nt, Homo sapiens
caaugugcuuggggcacaugag

SEQ ID NO: 50180 - RNA, 22 nt, Homo sapiens
cacacugucuucaauggguggu

SEQ ID NO: 50181 - RNA, 22 nt, Homo sapiens
cacacugucuuucagaaugguu

SEQ ID NO: 50182 - RNA, 22 nt, Homo sapiens
cacagucugggcuuguuuguac

SEQ ID NO: 50183 - RNA, 22 nt, Homo sapiens
cacaguguuccagcuauuugaa

SEQ ID NO: 50184 - RNA, 21 nt, Homo sapiens
cacauggaggcagagagugua

SEQ ID NO: 50185 - RNA, 22 nt, Homo sapiens
caccacagccauuauugucccc

SEQ ID NO: 50186 - RNA, 19 nt, Homo sapiens
caccgccugcccccugcug

SEQ ID NO: 50187 - RNA, 22 nt, Homo sapiens
cacucaguuugugguacuuugu

SEQ ID NO: 50188 - RNA, 22 nt, Homo sapiens
cacugcacucuucuucugggca

SEQ ID NO: 50189 - RNA, 22 nt, Homo sapiens
cagagguauugcaaaagccuag

SEQ ID NO: 50190 - RNA, 22 nt, Homo sapiens
cagaugguggucccacagccca

SEQ ID NO: 50191 - RNA, 20 nt, Homo sapiens
cagcaaccugcucucuuccu

SEQ ID NO: 50192 - RNA, 22 nt, Homo sapiens
cagcuaaauuguuaaauccaag

SEQ ID NO: 50193 - RNA, 22 nt, Homo sapiens
cagcuaguaauuuauugaagau

SEQ ID NO: 50194 - RNA, 22 nt, Homo sapiens
cagcucauugcagucucgaccu

SEQ ID NO: 50195 - RNA, 23 nt, Homo sapiens
cagcucauuuggguccccuuguc

SEQ ID NO: 50196 - RNA, 22 nt, Homo sapiens
cagcugaugucgaaugcacucu

SEQ ID NO: 50197 - RNA, 22 nt, Homo sapiens
cagcugcuuuggaaaauauuuu

SEQ ID NO: 50198 - RNA, 22 nt, Homo sapiens
cagcuguuguuaugucugcagg

SEQ ID NO: 50199 - RNA, 22 nt, Homo sapiens
cagcuguuguuccagucuuuua

SEQ ID NO: 50200 - RNA, 22 nt, Homo sapiens
caggaccucuugccuggaagcc

SEQ ID NO: 50201 - RNA, 22 nt, Homo sapiens
caggcagucuggggguguaucc

SEQ ID NO: 50202 - RNA, 22 nt, Homo sapiens
caggcauuguauuguaaucccc

SEQ ID NO: 50203 - RNA, 22 nt, Homo sapiens
cagugcauaggaucuaaaauuu

SEQ ID NO: 50204 - RNA, 22 nt, Homo sapiens
caguugcacuagccccguuuca

SEQ ID NO: 50205 - RNA, 22 nt, Homo sapiens
cauaaagauggaggaggccagg

SEQ ID NO: 50206 - RNA, 22 nt, Homo sapiens
cauauucacuuuacagagcugu

SEQ ID NO: 50207 - RNA, 22 nt, Homo sapiens
caucacaucugcaugguaagua

SEQ ID NO: 50208 - RNA, 22 nt, Homo sapiens
caucacuguugguacaaguaau

SEQ ID NO: 50209 - RNA, 22 nt, Homo sapiens
caucaggugaggauucaaugca

SEQ ID NO: 50210 - RNA, 22 nt, Homo sapiens
caucccugaaccccagaaaucu

SEQ ID NO: 50211 - RNA, 22 nt, Homo sapiens
cauguauagauuccauaguggu

SEQ ID NO: 50212 - RNA, 22 nt, Homo sapiens
cauuaagcuacuuagaaggugc

SEQ ID NO: 50213 - RNA, 22 nt, Homo sapiens
cauugcuuuuggugguuuagac

SEQ ID NO: 50214 - RNA, 22 nt, Homo sapiens
cauugguuuauagauggggaaa

SEQ ID NO: 50215 - RNA, 22 nt, Homo sapiens
ccaaguguuuucauuguuccau

SEQ ID NO: 50216 - RNA, 22 nt, Homo sapiens
ccacagucuaugcaacaagguc

SEQ ID NO: 50217 - RNA, 22 nt, Homo sapiens
ccacccuggagaauuugagguc

SEQ ID NO: 50218 - RNA, 22 nt, Homo sapiens
ccaguuuuucauuuauacuagu

SEQ ID NO: 50219 - RNA, 20 nt, Homo sapiens
ccccuggaguggggcugcuu

SEQ ID NO: 50220 - RNA, 22 nt, Homo sapiens
ccuccauuugugucaggaaguc

SEQ ID NO: 50221 - RNA, 22 nt, Homo sapiens
ccugagacugauugacucacaa

SEQ ID NO: 50222 - RNA, 22 nt, Homo sapiens
ccuuggcaauggcuggggcuga

SEQ ID NO: 50223 - RNA, 22 nt, Homo sapiens
cuaaagauagugacaugauuug

SEQ ID NO: 50224 - RNA, 22 nt, Homo sapiens
cuaaaguucuucugagagaaca

SEQ ID NO: 50225 - RNA, 22 nt, Homo sapiens
cuaagugaguauaauuuuaaga

SEQ ID NO: 50226 - RNA, 23 nt, Homo sapiens
cuacagugccugucucuuuggcc

SEQ ID NO: 50227 - RNA, 22 nt, Homo sapiens
cuagaguagaguuuccuuagga

SEQ ID NO: 50228 - RNA, 22 nt, Homo sapiens
cuagcacauaguuauucacuca

SEQ ID NO: 50229 - RNA, 22 nt, Homo sapiens
cuaggcuguagagaaguucagu

SEQ ID NO: 50230 - RNA, 22 nt, Homo sapiens
cucacagucucucccuaauuuu

SEQ ID NO: 50231 - RNA, 22 nt, Homo sapiens
cucacaguucuaaaggcaagaa

SEQ ID NO: 50232 - RNA, 22 nt, Homo sapiens
cucaccuugugauccacccgcc

SEQ ID NO: 50233 - RNA, 22 nt, Homo sapiens
cucacugugguguccuuaggua

SEQ ID NO: 50234 - RNA, 22 nt, Homo sapiens
cucagauacuugggagguugag

SEQ ID NO: 50235 - RNA, 22 nt, Homo sapiens
cuccaggugagguuaagggacu

SEQ ID NO: 50236 - RNA, 22 nt, Homo sapiens
cucuggauauuccugucuaaaa

SEQ ID NO: 50237 - RNA, 22 nt, Homo sapiens
cucuuuuguuuagcugagaggg

SEQ ID NO: 50238 - RNA, 22 nt, Homo sapiens
cugaaagagcauuugaaugggu

SEQ ID NO: 50239 - RNA, 22 nt, Homo sapiens
cugacugaggaucaguucauca

SEQ ID NO: 50240 - RNA, 22 nt, Homo sapiens
cugacuuuagaacccaaaaagu

SEQ ID NO: 50241 - RNA, 22 nt, Homo sapiens
cugagaauguaaaugaagcuuu

SEQ ID NO: 50242 - RNA, 22 nt, Homo sapiens
cugagagaugagaccucucacu

SEQ ID NO: 50243 - RNA, 22 nt, Homo sapiens
cugagauaggacucugcuggcu

SEQ ID NO: 50244 - RNA, 22 nt, Homo sapiens
cugagaucaagucuugcucugu

SEQ ID NO: 50245 - RNA, 22 nt, Homo sapiens
cugauaaguuuuucuuuauaag

SEQ ID NO: 50246 - RNA, 19 nt, Homo sapiens
cugcaagguaauaggucag

SEQ ID NO: 50247 - RNA, 22 nt, Homo sapiens
cugcauaaucaucucucugcau

SEQ ID NO: 50248 - RNA, 18 nt, Homo sapiens
cugccagugugcucuccg

SEQ ID NO: 50249 - RNA, 22 nt, Homo sapiens
cugccugagaaaauggagggca

SEQ ID NO: 50250 - RNA, 22 nt, Homo sapiens
cugcuguuguuaacuuuuggag

SEQ ID NO: 50251 - RNA, 22 nt, Homo sapiens
cuggagauuaaccaauugccau

SEQ ID NO: 50252 - RNA, 22 nt, Homo sapiens
cuggugugugacuuuucauuau

SEQ ID NO: 50253 - RNA, 22 nt, Homo sapiens
cuguaugugagaaauaauaagu

SEQ ID NO: 50254 - RNA, 22 nt, Homo sapiens
cugucacaguuuuggaggccag

SEQ ID NO: 50255 - RNA, 22 nt, Homo sapiens
cugucuagagggcacaugaugc

SEQ ID NO: 50256 - RNA, 22 nt, Homo sapiens
cugugaucuuuuuucauguggu

SEQ ID NO: 50257 - RNA, 22 nt, Homo sapiens
cugugcauuggaugucucccug

SEQ ID NO: 50258 - RNA, 22 nt, Homo sapiens
cugugcuaggcaaugugguaga

SEQ ID NO: 50259 - RNA, 22 nt, Homo sapiens
cuguggauguauugcacagucu

SEQ ID NO: 50260 - RNA, 22 nt, Homo sapiens
cuguuuguuuaggguacucaga

SEQ ID NO: 50261 - RNA, 22 nt, Homo sapiens
cuuccaaguggggcacgugcca

SEQ ID NO: 50262 - RNA, 22 nt, Homo sapiens
cuucuugcuguguccucacaug

SEQ ID NO: 50263 - RNA, 20 nt, Homo sapiens
cuugccuagcccuuugccuc

SEQ ID NO: 50264 - RNA, 19 nt, Homo sapiens
cuuguacucggcgcaguug

SEQ ID NO: 50265 - RNA, 18 nt, Homo sapiens
cuugucaaaucuuuccuc

SEQ ID NO: 50266 - RNA, 22 nt, Homo sapiens
cuuucugaggagaauagagaac

SEQ ID NO: 50267 - RNA, 22 nt, Homo sapiens
cuuugggaccgcgguuuauacu

SEQ ID NO: 50268 - RNA, 22 nt, Homo sapiens
cuuuuacacugcuggugggaau

SEQ ID NO: 50269 - RNA, 22 nt, Homo sapiens
cuuuuacacuguuagugggaau

SEQ ID NO: 50270 - RNA, 22 nt, Homo sapiens
gaaauguugauagugggcauug

SEQ ID NO: 50271 - RNA, 22 nt, Homo sapiens
gaacuuucuacauuaccucuuu

SEQ ID NO: 50272 - RNA, 18 nt, Homo sapiens
gaagaaguaggcauggca

SEQ ID NO: 50273 - RNA, 22 nt, Homo sapiens
gaagaucacacuguagaucuau

SEQ ID NO: 50274 - RNA, 22 nt, Homo sapiens
gaauaaacuagagaggacugag

SEQ ID NO: 50275 - RNA, 22 nt, Homo sapiens
gaaugcagcagugacagggcug

SEQ ID NO: 50276 - RNA, 22 nt, Homo sapiens
gaauuguacugcaaucagggga

SEQ ID NO: 50277 - RNA, 22 nt, Homo sapiens
gacaguguggcgauuccucaag

SEQ ID NO: 50278 - RNA, 22 nt, Homo sapiens
gacauguaaggcucucucuguu

SEQ ID NO: 50279 - RNA, 22 nt, Homo sapiens
gacauguuucucucuguuuacu

SEQ ID NO: 50280 - RNA, 22 nt, Homo sapiens
uucaguggacuuaguagugcuu

SEQ ID NO: 50281 - RNA, 22 nt, Homo sapiens
uucauaguaacaguaacuaugg

SEQ ID NO: 50282 - RNA, 18 nt, Homo sapiens
uucauaguagcaugauuu

SEQ ID NO: 50283 - RNA, 22 nt, Homo sapiens
uuccaagugggaaacaaaaaug

SEQ ID NO: 50284 - RNA, 22 nt, Homo sapiens
uuccacaauggcugaacuaguu

SEQ ID NO: 50285 - RNA, 20 nt, Homo sapiens
uuccagcacauuagggaagc

SEQ ID NO: 50286 - RNA, 22 nt, Homo sapiens
uuccaguuuuauggguauagag

SEQ ID NO: 50287 - RNA, 22 nt, Homo sapiens
uuccauuuguucggugucgcca

SEQ ID NO: 50288 - RNA, 22 nt, Homo sapiens
uucccugugguauagaagccgu

SEQ ID NO: 50289 - RNA, 22 nt, Homo sapiens
uucccuuuguuaaauuggaaga

SEQ ID NO: 50290 - RNA, 22 nt, Homo sapiens
uucccuuuuuucuaguagguag

SEQ ID NO: 50291 - RNA, 22 nt, Homo sapiens
uuccuagagauuagcaagcugc

SEQ ID NO: 50292 - RNA, 22 nt, Homo sapiens
uuccugugacccccaagcccac

SEQ ID NO: 50293 - RNA, 22 nt, Homo sapiens
uuccuucaugcuugaaggguau

SEQ ID NO: 50294 - RNA, 22 nt, Homo sapiens
uuccuuguagcaaaugcgauga

SEQ ID NO: 50295 - RNA, 22 nt, Homo sapiens
uucugcuugaucuaguguguug

SEQ ID NO: 50296 - RNA, 22 nt, Homo sapiens
uucugugcugaaucaaagacug

SEQ ID NO: 50297 - RNA, 22 nt, Homo sapiens
uucugugcuuguggaugaagug

SEQ ID NO: 50298 - RNA, 22 nt, Homo sapiens
uucuuccagccuugaggggccc

SEQ ID NO: 50299 - RNA, 22 nt, Homo sapiens
uucuucugguuaugaaauuuga

SEQ ID NO: 50300 - RNA, 22 nt, Homo sapiens
uucuugguguaguaguugaaaa

SEQ ID NO: 50301 - RNA, 23 nt, Homo sapiens
uugaaaagucaguagccucugau

SEQ ID NO: 50302 - RNA, 22 nt, Homo sapiens
uugaaagaaaggagacugaguu

SEQ ID NO: 50303 - RNA, 22 nt, Homo sapiens
uugaaagcuaucagagauucca

SEQ ID NO: 50304 - RNA, 22 nt, Homo sapiens
uugaaaguaaacaucacaaaga

SEQ ID NO: 50305 - RNA, 22 nt, Homo sapiens
uugaaagucuaggcuuacagua

SEQ ID NO: 50306 - RNA, 22 nt, Homo sapiens
uugaaaucuuccacagcccaag

SEQ ID NO: 50307 - RNA, 22 nt, Homo sapiens
uugaagagaaccgcggcuuauu

SEQ ID NO: 50308 - RNA, 22 nt, Homo sapiens
uugaaugaaaugaugucauuug

SEQ ID NO: 50309 - RNA, 22 nt, Homo sapiens
uugacagaccuuggucauaucc

SEQ ID NO: 50310 - RNA, 22 nt, Homo sapiens
uugacaggaugcucagggccca

SEQ ID NO: 50311 - RNA, 22 nt, Homo sapiens
uugacuuuuauucacucugcua

SEQ ID NO: 50312 - RNA, 22 nt, Homo sapiens
uugagagaaaaaauuuauuggu

SEQ ID NO: 50313 - RNA, 22 nt, Homo sapiens
uugagauggagucucacuccuu

SEQ ID NO: 50314 - RNA, 22 nt, Homo sapiens
uugagauggagucucgcacugu

SEQ ID NO: 50315 - RNA, 22 nt, Homo sapiens
uugagauggagucuugcacugu

SEQ ID NO: 50316 - RNA, 22 nt, Homo sapiens
uugagcacaggaguuugagacc

SEQ ID NO: 50317 - RNA, 22 nt, Homo sapiens
uugagcacauguguuaaggggu

SEQ ID NO: 50318 - RNA, 22 nt, Homo sapiens
uugagccaaggauugucuuucc

SEQ ID NO: 50319 - RNA, 21 nt, Homo sapiens
uugagcuuuuaguacagacag

SEQ ID NO: 50320 - RNA, 22 nt, Homo sapiens
uugaggacugguugaaagcuuu

SEQ ID NO: 50321 - RNA, 22 nt, Homo sapiens
uugaguuuaucuaaagaccugg

SEQ ID NO: 50322 - RNA, 22 nt, Homo sapiens
uugaucaauagaauacaacaga

SEQ ID NO: 50323 - RNA, 22 nt, Homo sapiens
uugaucacuguacuaugacuau

SEQ ID NO: 50324 - RNA, 20 nt, Homo sapiens
uugauucccucuaaacucgc

SEQ ID NO: 50325 - RNA, 23 nt, Homo sapiens
uugcaaagccugaaacucuucag

SEQ ID NO: 50326 - RNA, 22 nt, Homo sapiens
uugcaaaguugccaaggaagga

SEQ ID NO: 50327 - RNA, 22 nt, Homo sapiens
uugcaacauuguaaguuuauau

SEQ ID NO: 50328 - RNA, 22 nt, Homo sapiens
uugcacuccagcucgggugaca

SEQ ID NO: 50329 - RNA, 22 nt, Homo sapiens
uugcacuccauccuggguugac

SEQ ID NO: 50330 - RNA, 22 nt, Homo sapiens
uugcacucugaagaccuacugu

SEQ ID NO: 50331 - RNA, 22 nt, Homo sapiens
uugcacuuccgccugggugaca

SEQ ID NO: 50332 - RNA, 19 nt, Homo sapiens
uugcauauguugaaccagc

SEQ ID NO: 50333 - RNA, 22 nt, Homo sapiens
uugcauguacguacagagagag

SEQ ID NO: 50334 - RNA, 22 nt, Homo sapiens
uugccgggugcaguggcucaug

SEQ ID NO: 50335 - RNA, 22 nt, Homo sapiens
uugcuagaugaaaaugguaccu

SEQ ID NO: 50336 - RNA, 22 nt, Homo sapiens
uugcuuuguugucuggggaaua

SEQ ID NO: 50337 - RNA, 22 nt, Homo sapiens
uuggaagagaagggagauaaac

SEQ ID NO: 50338 - RNA, 22 nt, Homo sapiens
uuggaagguaaucaaaaguucu

SEQ ID NO: 50339 - RNA, 22 nt, Homo sapiens
uuggaaugcacacugagccugc

SEQ ID NO: 50340 - RNA, 19 nt, Homo sapiens
uuggaauuuuagaguuuga

SEQ ID NO: 50341 - RNA, 22 nt, Homo sapiens
uuggacucccuccccagcuuca

SEQ ID NO: 50342 - RNA, 22 nt, Homo sapiens
uuggagagaaaggcaguuccug

SEQ ID NO: 50343 - RNA, 22 nt, Homo sapiens
ugacaagugauuaaggcauauu

SEQ ID NO: 50344 - RNA, 22 nt, Homo sapiens
ugacacagugggggauccuuuu

SEQ ID NO: 50345 - RNA, 23 nt, Homo sapiens
ugacagugcuugaaauugcucuu

SEQ ID NO: 50346 - RNA, 22 nt, Homo sapiens
ugacaguguccuccuccugaga

SEQ ID NO: 50347 - RNA, 20 nt, Homo sapiens
ugacaguuaagggauagaag

SEQ ID NO: 50348 - RNA, 18 nt, Homo sapiens
ugacaucauuuagaaagg

SEQ ID NO: 50349 - RNA, 22 nt, Homo sapiens
ugaccacagaaagugagggagc

SEQ ID NO: 50350 - RNA, 22 nt, Homo sapiens
ugaccuguuugaaauugccaau

SEQ ID NO: 50351 - RNA, 22 nt, Homo sapiens
ugacuacacacaauuugucaag

SEQ ID NO: 50352 - RNA, 22 nt, Homo sapiens
ugacucaguuguuagucuucau

SEQ ID NO: 50353 - RNA, 20 nt, Homo sapiens
ugacuggauacccuuuggcu

SEQ ID NO: 50354 - RNA, 22 nt, Homo sapiens
ugacuugaucauuacacauucu

SEQ ID NO: 50355 - RNA, 22 nt, Homo sapiens
ugagaacaugcacuugagguug

SEQ ID NO: 50356 - RNA, 16 nt, Homo sapiens
ugagaacaugcagcau

SEQ ID NO: 50357 - RNA, 20 nt, Homo sapiens
ugagaacauguggcauuugg

SEQ ID NO: 50358 - RNA, 18 nt, Homo sapiens
ugagaacauguguacaca

SEQ ID NO: 50359 - RNA, 22 nt, Homo sapiens
ugagaacuaaugaagaauuuau

SEQ ID NO: 50360 - RNA, 22 nt, Homo sapiens
ugagaaugaugauugguaaacc

SEQ ID NO: 50361 - RNA, 22 nt, Homo sapiens
ugagacaaaguuguuggauguu

SEQ ID NO: 50362 - RNA, 22 nt, Homo sapiens
ugagacaucugagauuuuaagc

SEQ ID NO: 50363 - RNA, 22 nt, Homo sapiens
ugagacugaaauuaggaaacug

SEQ ID NO: 50364 - RNA, 22 nt, Homo sapiens
ugagacuguuuuggggaacuuc

SEQ ID NO: 50365 - RNA, 22 nt, Homo sapiens
ugagagaugaacuauucuugaa

SEQ ID NO: 50366 - RNA, 22 nt, Homo sapiens
ugagaggugaauggcaggcuca

SEQ ID NO: 50367 - RNA, 22 nt, Homo sapiens
ugagauaacuaaaaacauuuug

SEQ ID NO: 50368 - RNA, 22 nt, Homo sapiens
ugagauaaggaaauugaggcuc

SEQ ID NO: 50369 - RNA, 22 nt, Homo sapiens
ugagauaauuuacuuguugagg

SEQ ID NO: 50370 - RNA, 22 nt, Homo sapiens
ugagauagcauaagggacagaa

SEQ ID NO: 50371 - RNA, 22 nt, Homo sapiens
ugagauaggaucuugcucuguu

SEQ ID NO: 50372 - RNA, 22 nt, Homo sapiens
ugagaugaacuugauuguuuua

SEQ ID NO: 50373 - RNA, 22 nt, Homo sapiens
ugagaugaagucucacucuguc

SEQ ID NO: 50374 - RNA, 22 nt, Homo sapiens
ugagaugauagauauguuaauu

SEQ ID NO: 50375 - RNA, 22 nt, Homo sapiens
ugagaugauaucuuauuguaau

SEQ ID NO: 50376 - RNA, 22 nt, Homo sapiens
ugagauggaguuucgcucuugu

SEQ ID NO: 50377 - RNA, 22 nt, Homo sapiens
ugagcacauuuacaucaguucc

SEQ ID NO: 50378 - RNA, 22 nt, Homo sapiens
ugagcagaaguuuugauuggcg

SEQ ID NO: 50379 - RNA, 20 nt, Homo sapiens
ugagcucaauuguugcaagu

SEQ ID NO: 50380 - RNA, 22 nt, Homo sapiens
ugagcugagaaaugcagcagcu

SEQ ID NO: 50381 - RNA, 22 nt, Homo sapiens
ugagcugagaucgugccauugu

SEQ ID NO: 50382 - RNA, 22 nt, Homo sapiens
ugaggugaaguaauauucuaag

SEQ ID NO: 50383 - RNA, 23 nt, Homo sapiens
ugauaacagcauaugaagauucu

SEQ ID NO: 50384 - RNA, 22 nt, Homo sapiens
ugauaauguuaggcuuuauuca

SEQ ID NO: 50385 - RNA, 22 nt, Homo sapiens
ugauagaucugggcaaaguaaa

SEQ ID NO: 50386 - RNA, 22 nt, Homo sapiens
ugauauuuuugauccuuaaguu

SEQ ID NO: 50387 - RNA, 22 nt, Homo sapiens
ugaucuuuuuaauguccauggg

SEQ ID NO: 50388 - RNA, 21 nt, Homo sapiens
ugaugcaauccgcuaggucgc

SEQ ID NO: 50389 - RNA, 22 nt, Homo sapiens
ugauuagaggaaugguagauua

SEQ ID NO: 50390 - RNA, 22 nt, Homo sapiens
ugcaauagcuucaggagaaggg

SEQ ID NO: 50391 - RNA, 22 nt, Homo sapiens
ugcaccacacuccauccugggc

SEQ ID NO: 50392 - RNA, 22 nt, Homo sapiens
ugcaccacugcacugccugggu

SEQ ID NO: 50393 - RNA, 22 nt, Homo sapiens
ugcagauucguuuugaggggua

SEQ ID NO: 50394 - RNA, 22 nt, Homo sapiens
ugcaggguccauugucccaagu

SEQ ID NO: 50395 - RNA, 22 nt, Homo sapiens
ugcagugugauuuucuggcuga

SEQ ID NO: 50396 - RNA, 21 nt, Homo sapiens
ugcauacuucucagaugauua

SEQ ID NO: 50397 - RNA, 18 nt, Homo sapiens
ugcauauguugaaccagc

SEQ ID NO: 50398 - RNA, 22 nt, Homo sapiens
ugcaucacaguacuccagccug

SEQ ID NO: 50399 - RNA, 22 nt, Homo sapiens
ugcauuaucagauguuugcuuu

SEQ ID NO: 50400 - RNA, 19 nt, Homo sapiens
ugccaagaaagucagcuua

SEQ ID NO: 50401 - RNA, 22 nt, Homo sapiens
ugccagaugcuggugugagggg

SEQ ID NO: 50402 - RNA, 22 nt, Homo sapiens
ugccuagaaacacuauuucucc

SEQ ID NO: 50403 - RNA, 21 nt, Homo sapiens
ugcuacugucacuuccuuugu

SEQ ID NO: 50404 - RNA, 22 nt, Homo sapiens
ugcugcacaguucuuaagauua

SEQ ID NO: 50405 - RNA, 22 nt, Homo sapiens
ugcugcacuuauggcucugagg

SEQ ID NO: 50406 - RNA, 22 nt, Homo sapiens
ugcugcuguuaucauuuuacca

SEQ ID NO: 50407 - RNA, 22 nt, Homo sapiens
ugcuguguugcuggcuuaaaga

SEQ ID NO: 50408 - RNA, 22 nt, Homo sapiens
ugcuguuguuugaugaaguaau

SEQ ID NO: 50409 - RNA, 22 nt, Homo sapiens
ugcuugagacacauaugaauuu

SEQ ID NO: 50410 - RNA, 22 nt, Homo sapiens
uggaaaguacuugaguuuguau

SEQ ID NO: 50411 - RNA, 22 nt, Homo sapiens
uggaaauuaacagggauugucc

SEQ ID NO: 50412 - RNA, 22 nt, Homo sapiens
uggaagauggaguuuuaucauu

SEQ ID NO: 50413 - RNA, 20 nt, Homo sapiens
uggaaggcaucugcauuauu

SEQ ID NO: 50414 - RNA, 22 nt, Homo sapiens
uggaaguagauagauuguguca

SEQ ID NO: 50415 - RNA, 22 nt, Homo sapiens
uggaagugucugugcccagcuc

SEQ ID NO: 50416 - RNA, 22 nt, Homo sapiens
uggaauaugagacgggguuguc

SEQ ID NO: 50417 - RNA, 22 nt, Homo sapiens
uggaaucaucaacgaaugaaau

SEQ ID NO: 50418 - RNA, 22 nt, Homo sapiens
uggaaugguaucuuguuggggu

SEQ ID NO: 50419 - RNA, 22 nt, Homo sapiens
uggaaugucuuuuccccaaagc

SEQ ID NO: 50420 - RNA, 22 nt, Homo sapiens
uggaauguuauggcuuuaaucu

SEQ ID NO: 50421 - RNA, 22 nt, Homo sapiens
uggaauuuacuuauuuaggggc

SEQ ID NO: 50422 - RNA, 18 nt, Homo sapiens
uggacagugauuauccau

SEQ ID NO: 50423 - RNA, 22 nt, Homo sapiens
uggacuuuaauaaaagggaaau

SEQ ID NO: 50424 - RNA, 22 nt, Homo sapiens
uggagggcuagucauuucuuuu

SEQ ID NO: 50425 - RNA, 22 nt, Homo sapiens
uggagugaaaacacacuaaucu

SEQ ID NO: 50426 - RNA, 22 nt, Homo sapiens
uggaguguagaagccagccucc

SEQ ID NO: 50427 - RNA, 20 nt, Homo sapiens
uggaguuguggcaguuugga

SEQ ID NO: 50428 - RNA, 22 nt, Homo sapiens
uggauaguaauaaacauauagg

SEQ ID NO: 50429 - RNA, 22 nt, Homo sapiens
uggaugaagagaugguaguugc

SEQ ID NO: 50430 - RNA, 22 nt, Homo sapiens
uggauugaaagcuuuaauauug

SEQ ID NO: 50431 - RNA, 23 nt, Homo sapiens
uggcaagaauucuuaccgugugg

SEQ ID NO: 50432 - RNA, 22 nt, Homo sapiens
uggcaagagauaugugucuaua

SEQ ID NO: 50433 - RNA, 22 nt, Homo sapiens
uggcaagagcaaaauguacagu

SEQ ID NO: 50434 - RNA, 22 nt, Homo sapiens
uggcaagagggaugcaagguuu

SEQ ID NO: 50435 - RNA, 20 nt, Homo sapiens
uggcaagauggcagaauaga

SEQ ID NO: 50436 - RNA, 22 nt, Homo sapiens
uggcaccugacuccgagaugca

SEQ ID NO: 50437 - RNA, 22 nt, Homo sapiens
uggcacuggagauacauuaaua

SEQ ID NO: 50438 - RNA, 22 nt, Homo sapiens
uggcaugaagaccccauccuuu

SEQ ID NO: 50439 - RNA, 22 nt, Homo sapiens
uggcauuuucucuguucuuaga

SEQ ID NO: 50440 - RNA, 22 nt, Homo sapiens
uggcuacugaccugcuaggggg

SEQ ID NO: 50441 - RNA, 22 nt, Homo sapiens
ugggaaugaaauuacauagcuu

SEQ ID NO: 50442 - RNA, 19 nt, Homo sapiens
ugggaauguaaauuaguuc

SEQ ID NO: 50443 - RNA, 22 nt, Homo sapiens
ugggauguagccuucuauuuuc

SEQ ID NO: 50444 - RNA, 22 nt, Homo sapiens
ugggcaaaacuaagagcugugg

SEQ ID NO: 50445 - RNA, 22 nt, Homo sapiens
uggucaccuucuugcucugucu

SEQ ID NO: 50446 - RNA, 20 nt, Homo sapiens
ugguccccugagucuggcuu

SEQ ID NO: 50447 - RNA, 22 nt, Homo sapiens
uggucuucuggccuccagaacc

SEQ ID NO: 50448 - RNA, 22 nt, Homo sapiens
gagaacauuuaagccacucagg

SEQ ID NO: 50449 - RNA, 22 nt, Homo sapiens
gagaacuggcgugaacugcacg

SEQ ID NO: 50450 - RNA, 22 nt, Homo sapiens
gagacugagucucacucuguca

SEQ ID NO: 50451 - RNA, 22 nt, Homo sapiens
gagagcaugugcuggcaucagu

SEQ ID NO: 50452 - RNA, 22 nt, Homo sapiens
gagagguaguuuuuuggucguc

SEQ ID NO: 50453 - RNA, 22 nt, Homo sapiens
gagaucaaugggauggaauuga

SEQ ID NO: 50454 - RNA, 22 nt, Homo sapiens
gagaucauguacuagaacaccu

SEQ ID NO: 50455 - RNA, 22 nt, Homo sapiens
gagaugaugagauguucacagu

SEQ ID NO: 50456 - RNA, 22 nt, Homo sapiens
gagaugugguucaaggguguuu

SEQ ID NO: 50457 - RNA, 22 nt, Homo sapiens
gagauguuuuguuaucaaagga

SEQ ID NO: 50458 - RNA, 22 nt, Homo sapiens
gagccauggagaaaacagcuau

SEQ ID NO: 50459 - RNA, 22 nt, Homo sapiens
gagcuagcauuuagacaucugg

SEQ ID NO: 50460 - RNA, 22 nt, Homo sapiens
gagcuagggucaugcuacugca

SEQ ID NO: 50461 - RNA, 22 nt, Homo sapiens
gagcuccuccccuuggcuuuca

SEQ ID NO: 50462 - RNA, 22 nt, Homo sapiens
gagcugaaguuuccauuuguac

SEQ ID NO: 50463 - RNA, 22 nt, Homo sapiens
gagcugaauugcugccauuugc

SEQ ID NO: 50464 - RNA, 22 nt, Homo sapiens
gagcugccuugccuaugcaaga

SEQ ID NO: 50465 - RNA, 22 nt, Homo sapiens
gagguguagagauauaccugaa

SEQ ID NO: 50466 - RNA, 22 nt, Homo sapiens
gagugcaagguuuuucugagug

SEQ ID NO: 50467 - RNA, 22 nt, Homo sapiens
gagugcaauggcaugaucuggg

SEQ ID NO: 50468 - RNA, 23 nt, Homo sapiens
gaguggagacucauugauuuccu

SEQ ID NO: 50469 - RNA, 18 nt, Homo sapiens
gaguggugcuucccuugu

SEQ ID NO: 50470 - RNA, 22 nt, Homo sapiens
gauacaguaugcaugugguauu

SEQ ID NO: 50471 - RNA, 22 nt, Homo sapiens
gauauguaguaguugaaaaaga

SEQ ID NO: 50472 - RNA, 22 nt, Homo sapiens
gaucuguguuuguaugcauaag

SEQ ID NO: 50473 - RNA, 22 nt, Homo sapiens
gaugaggcuagagacaugugua

SEQ ID NO: 50474 - RNA, 22 nt, Homo sapiens
gaugauguugaauguucucacc

SEQ ID NO: 50475 - RNA, 19 nt, Homo sapiens
gaugcaaugcacugagguc

SEQ ID NO: 50476 - RNA, 22 nt, Homo sapiens
gauggcauuucuggaucugaca

SEQ ID NO: 50477 - RNA, 22 nt, Homo sapiens
gauggugucccaggcucaggcu

SEQ ID NO: 50478 - RNA, 22 nt, Homo sapiens
gauuagugacguugagcacugu

SEQ ID NO: 50479 - RNA, 22 nt, Homo sapiens
gauuuguuggccugugagcuag

SEQ ID NO: 50480 - RNA, 22 nt, Homo sapiens
gcaaaguaauuguuguuuuugc

SEQ ID NO: 50481 - RNA, 22 nt, Homo sapiens
gcaaaguguuuuuaggaagucu

SEQ ID NO: 50482 - RNA, 22 nt, Homo sapiens
gcaaaugcuaugccauuuuaua

SEQ ID NO: 50483 - RNA, 22 nt, Homo sapiens
gcaacugguuucaguuuuucag

SEQ ID NO: 50484 - RNA, 22 nt, Homo sapiens
gcaagagguaucuuauuuuccc

SEQ ID NO: 50485 - RNA, 22 nt, Homo sapiens
gcacaaugccugacgaguccug

SEQ ID NO: 50486 - RNA, 22 nt, Homo sapiens
gcacuacugcacuccagucuag

SEQ ID NO: 50487 - RNA, 17 nt, Homo sapiens
gcacuggcguaucccac

SEQ ID NO: 50488 - RNA, 22 nt, Homo sapiens
gcagcaguggcaguuaauauuu

SEQ ID NO: 50489 - RNA, 22 nt, Homo sapiens
gcagcagugugggcugaaccua

SEQ ID NO: 50490 - RNA, 22 nt, Homo sapiens
uuucaccguguuggccaggcug

SEQ ID NO: 50491 - RNA, 22 nt, Homo sapiens
uuucauagccuucuaaugaguu

SEQ ID NO: 50492 - RNA, 22 nt, Homo sapiens
uuucaucaagcacagaguagau

SEQ ID NO: 50493 - RNA, 22 nt, Homo sapiens
uuucauggcgaggcuucauggg

SEQ ID NO: 50494 - RNA, 22 nt, Homo sapiens
uuuccuguagggggcaaggccu

SEQ ID NO: 50495 - RNA, 22 nt, Homo sapiens
uuucgugucuggucugugaugg

SEQ ID NO: 50496 - RNA, 22 nt, Homo sapiens
uuugaggaaaggcauaaguagg

SEQ ID NO: 50497 - RNA, 22 nt, Homo sapiens
uuugagugugauaucgauugga

SEQ ID NO: 50498 - RNA, 20 nt, Homo sapiens
uuugcagaaucuaagaagag

SEQ ID NO: 50499 - RNA, 22 nt, Homo sapiens
uuugcaugcuccuuaugagaau

SEQ ID NO: 50500 - RNA, 22 nt, Homo sapiens
uuugcugagucugacuucaugg

SEQ ID NO: 50501 - RNA, 22 nt, Homo sapiens
uuugcuuguguaaaaaucugga

SEQ ID NO: 50502 - RNA, 22 nt, Homo sapiens
uuuggaaugaaacagcagagcc

SEQ ID NO: 50503 - RNA, 22 nt, Homo sapiens
uuuggaaugugcacucagauug

SEQ ID NO: 50504 - RNA, 22 nt, Homo sapiens
uuugggaaaugaaguugguaga

SEQ ID NO: 50505 - RNA, 22 nt, Homo sapiens
uuuguacuugaaacccagggcc

SEQ ID NO: 50506 - RNA, 18 nt, Homo sapiens
uuuguacuuuuucuaaug

SEQ ID NO: 50507 - RNA, 22 nt, Homo sapiens
uuuguagcucacucugagcuga

SEQ ID NO: 50508 - RNA, 22 nt, Homo sapiens
uuugucaauaacuaccaacagg

SEQ ID NO: 50509 - RNA, 21 nt, Homo sapiens
uuuguccaccuguguucacca

SEQ ID NO: 50510 - RNA, 23 nt, Homo sapiens
uuugugacacucuccaucuccag

SEQ ID NO: 50511 - RNA, 22 nt, Homo sapiens
uuuguguggccuuggccuggca

SEQ ID NO: 50512 - RNA, 22 nt, Homo sapiens
uuuuauguuuguucccugccaa

SEQ ID NO: 50513 - RNA, 21 nt, Homo sapiens
uuuugcacacuaugcagcuuu

SEQ ID NO: 50514 - RNA, 22 nt, Homo sapiens
uuuuggcucugucuguaucuuu

SEQ ID NO: 50515 - RNA, 22 nt, Homo sapiens
uuuugggggugauucacacagu

SEQ ID NO: 50516 - RNA, 22 nt, Homo sapiens
uuuuugaguagcuggagagcag

SEQ ID NO: 50517 - RNA, 23 nt, Homo sapiens
ugguuuguaagagauggacugga

SEQ ID NO: 50518 - RNA, 20 nt, Homo sapiens
uguaacaaucuggauguugc

SEQ ID NO: 50519 - RNA, 22 nt, Homo sapiens
uguaagcauuauauaauuguug

SEQ ID NO: 50520 - RNA, 22 nt, Homo sapiens
uguaagcauugggcaugcaguc

SEQ ID NO: 50521 - RNA, 22 nt, Homo sapiens
uguagacagcacguaguugagu

SEQ ID NO: 50522 - RNA, 22 nt, Homo sapiens
uguagucauuccuuuuugcuuu

SEQ ID NO: 50523 - RNA, 22 nt, Homo sapiens
uguauacugucuaauauguugu

SEQ ID NO: 50524 - RNA, 21 nt, Homo sapiens
uguauauguuuauacacacac

SEQ ID NO: 50525 - RNA, 22 nt, Homo sapiens
uguaugagagugaaagcauuuc

SEQ ID NO: 50526 - RNA, 19 nt, Homo sapiens
ugucaaaugucuccugggg

SEQ ID NO: 50527 - RNA, 22 nt, Homo sapiens
ugucacugugcagucaugcauu

SEQ ID NO: 50528 - RNA, 22 nt, Homo sapiens
ugucacuuugccuucuggacuu

SEQ ID NO: 50529 - RNA, 22 nt, Homo sapiens
ugucaguguacuguaagaauua

SEQ ID NO: 50530 - RNA, 22 nt, Homo sapiens
ugucaucauuggaaucugccuc

SEQ ID NO: 50531 - RNA, 19 nt, Homo sapiens
ugucccagccauagaggca

SEQ ID NO: 50532 - RNA, 22 nt, Homo sapiens
uguccuggugaugcccaaauuc

SEQ ID NO: 50533 - RNA, 22 nt, Homo sapiens
ugucuuuguuaguuguccuagu

SEQ ID NO: 50534 - RNA, 22 nt, Homo sapiens
ugugaaacacgaaagucuaaaa

SEQ ID NO: 50535 - RNA, 21 nt, Homo sapiens
ugugacuguugcauuugucgu

SEQ ID NO: 50536 - RNA, 22 nt, Homo sapiens
ugugagaaaugcagaaucucag

SEQ ID NO: 50537 - RNA, 22 nt, Homo sapiens
ugugaugaagaguccaagaaca

SEQ ID NO: 50538 - RNA, 22 nt, Homo sapiens
ugugcaaaaguaauugcgguuu

SEQ ID NO: 50539 - RNA, 22 nt, Homo sapiens
ugugcaaggcucucaaccugug

SEQ ID NO: 50540 - RNA, 22 nt, Homo sapiens
ugugcaccucuucacacaggga

SEQ ID NO: 50541 - RNA, 22 nt, Homo sapiens
ugugcacuggaccuugucuucu

SEQ ID NO: 50542 - RNA, 22 nt, Homo sapiens
ugugcaugaaauuuaccuuuaa

SEQ ID NO: 50543 - RNA, 22 nt, Homo sapiens
ugugccacuccaaccuggguga

SEQ ID NO: 50544 - RNA, 22 nt, Homo sapiens
ugugcguguaagagaucuaggu

SEQ ID NO: 50545 - RNA, 22 nt, Homo sapiens
ugugcgugugccuguaagaauu

SEQ ID NO: 50546 - RNA, 22 nt, Homo sapiens
ugugcuauguuauucacauggg

SEQ ID NO: 50547 - RNA, 22 nt, Homo sapiens
ugugcucaucucagucaacugu

SEQ ID NO: 50548 - RNA, 22 nt, Homo sapiens
uguggccuuuguuucaguuggg

SEQ ID NO: 50549 - RNA, 22 nt, Homo sapiens
uguggcugguggcaccuuuucc

SEQ ID NO: 50550 - RNA, 22 nt, Homo sapiens
uguggcuuuacagcaugguuca

SEQ ID NO: 50551 - RNA, 22 nt, Homo sapiens
ugugggaggugcuaauguaaau

SEQ ID NO: 50552 - RNA, 23 nt, Homo sapiens
ugugguauuauuccauuuauagg

SEQ ID NO: 50553 - RNA, 22 nt, Homo sapiens
uguguaaauauauacacacgug

SEQ ID NO: 50554 - RNA, 22 nt, Homo sapiens
ugugucacugcacuccagcgug

SEQ ID NO: 50555 - RNA, 22 nt, Homo sapiens
uguuauugagguuacuuauaag

SEQ ID NO: 50556 - RNA, 22 nt, Homo sapiens
uguucaugaguucucauuuuua

SEQ ID NO: 50557 - RNA, 21 nt, Homo sapiens
uguuuuugcuguguaucucuc

SEQ ID NO: 50558 - RNA, 22 nt, Homo sapiens
uuaaaguaauugaaauggccuu

SEQ ID NO: 50559 - RNA, 22 nt, Homo sapiens
uacaggaaugucagguugcugu

SEQ ID NO: 50560 - RNA, 22 nt, Homo sapiens
uacagguauagauguguguucu

SEQ ID NO: 50561 - RNA, 22 nt, Homo sapiens
uacaguaauguuaaucuuugug

SEQ ID NO: 50562 - RNA, 22 nt, Homo sapiens
uacaguauuaugagugauugaa

SEQ ID NO: 50563 - RNA, 22 nt, Homo sapiens
uaccaccauuguaguuuggaaa

SEQ ID NO: 50564 - RNA, 22 nt, Homo sapiens
uaccaguaaugguucuagagga

SEQ ID NO: 50565 - RNA, 22 nt, Homo sapiens
uacucaauugcagucaccuggc

SEQ ID NO: 50566 - RNA, 22 nt, Homo sapiens
uagagauaucaauuucauggug

SEQ ID NO: 50567 - RNA, 22 nt, Homo sapiens
uagagcacaagguagauuucua

SEQ ID NO: 50568 - RNA, 22 nt, Homo sapiens
uagagguagagugacuucccca

SEQ ID NO: 50569 - RNA, 22 nt, Homo sapiens
uagaucaauuaauuguuacuug

SEQ ID NO: 50570 - RNA, 22 nt, Homo sapiens
uagauuaucuuaaggagcauca

SEQ ID NO: 50571 - RNA, 20 nt, Homo sapiens
uagcacacauguagaauagu

SEQ ID NO: 50572 - RNA, 22 nt, Homo sapiens
uagcacaguucacccucgauuu

SEQ ID NO: 50573 - RNA, 22 nt, Homo sapiens
uagcaccaaacauauacucagu

SEQ ID NO: 50574 - RNA, 22 nt, Homo sapiens
uagcagacuauuuugugauaau

SEQ ID NO: 50575 - RNA, 22 nt, Homo sapiens
uagcagcuuuauugagguaaau

SEQ ID NO: 50576 - RNA, 22 nt, Homo sapiens
uagcaguaagaaacugacauug

SEQ ID NO: 50577 - RNA, 22 nt, Homo sapiens
uagcugcuguauguacacggau

SEQ ID NO: 50578 - RNA, 22 nt, Homo sapiens
uagcuucuccauagcuccaugu

SEQ ID NO: 50579 - RNA, 22 nt, Homo sapiens
uaggaaugaacgauuuauuggu

SEQ ID NO: 50580 - RNA, 22 nt, Homo sapiens
uaggcgagauguguguuucaug

SEQ ID NO: 50581 - RNA, 22 nt, Homo sapiens
uagggcuuuaguuugcuugugu

SEQ ID NO: 50582 - RNA, 22 nt, Homo sapiens
uagguaaguaauauacagauga

SEQ ID NO: 50583 - RNA, 22 nt, Homo sapiens
uaguagcauaccuaaguauacu

SEQ ID NO: 50584 - RNA, 21 nt, Homo sapiens
uagugcagugggguaugacuu

SEQ ID NO: 50585 - RNA, 20 nt, Homo sapiens
uauaacaguuuggacccagu

SEQ ID NO: 50586 - RNA, 22 nt, Homo sapiens
uauacaugugggcaucaggaga

SEQ ID NO: 50587 - RNA, 21 nt, Homo sapiens
uauagcagcacgauuuauagu

SEQ ID NO: 50588 - RNA, 22 nt, Homo sapiens
uauagcuaugggauguauuugc

SEQ ID NO: 50589 - RNA, 22 nt, Homo sapiens
uauagcuauuguuaauggaacu

SEQ ID NO: 50590 - RNA, 22 nt, Homo sapiens
uauagcuugaaggaauggucau

SEQ ID NO: 50591 - RNA, 22 nt, Homo sapiens
uauagcuugauuauggugaugg

SEQ ID NO: 50592 - RNA, 22 nt, Homo sapiens
uauaugcacucagguguaugug

SEQ ID NO: 50593 - RNA, 22 nt, Homo sapiens
uaucaaguuggaagagaaguaa

SEQ ID NO: 50594 - RNA, 22 nt, Homo sapiens
uaucacaaacuuagcaguuuaa

SEQ ID NO: 50595 - RNA, 20 nt, Homo sapiens
uaucacauggggagaaaccu

SEQ ID NO: 50596 - RNA, 22 nt, Homo sapiens
uaucaccacccugggaaacaua

SEQ ID NO: 50597 - RNA, 22 nt, Homo sapiens
uaucaccauguccguuuuaaaa

SEQ ID NO: 50598 - RNA, 22 nt, Homo sapiens
uaucaucauuggcaggugagaa

SEQ ID NO: 50599 - RNA, 21 nt, Homo sapiens
uauccacuugcaacagagaag

SEQ ID NO: 50600 - RNA, 22 nt, Homo sapiens
uaucucagagaaucagauuuac

SEQ ID NO: 50601 - RNA, 22 nt, Homo sapiens
uaucucagaugagacuuguaac

SEQ ID NO: 50602 - RNA, 22 nt, Homo sapiens
uaugaauuuuauccaggauaua

SEQ ID NO: 50603 - RNA, 22 nt, Homo sapiens
uaugcacacucucccaggaggg

SEQ ID NO: 50604 - RNA, 19 nt, Homo sapiens
uauguaguuuucucaauau

SEQ ID NO: 50605 - RNA, 22 nt, Homo sapiens
uauuacagaccauaucgccggg

SEQ ID NO: 50606 - RNA, 22 nt, Homo sapiens
uauuaguuguaugauucccaag

SEQ ID NO: 50607 - RNA, 22 nt, Homo sapiens
uauuaguuuucuguggauuaca

SEQ ID NO: 50608 - RNA, 22 nt, Homo sapiens
uauugaacgugggauauugaag

SEQ ID NO: 50609 - RNA, 22 nt, Homo sapiens
uauugcaaauggugaucccagg

SEQ ID NO: 50610 - RNA, 22 nt, Homo sapiens
ucaaaugauucagaagccaccu

SEQ ID NO: 50611 - RNA, 22 nt, Homo sapiens
ucaaaugcuguauuguaguaau

SEQ ID NO: 50612 - RNA, 22 nt, Homo sapiens
ucaacugcuugagaucacaaau

SEQ ID NO: 50613 - RNA, 22 nt, Homo sapiens
ucaaggacuacauggggugaaa

SEQ ID NO: 50614 - RNA, 22 nt, Homo sapiens
ucacaagugagaggaauuagau

SEQ ID NO: 50615 - RNA, 22 nt, Homo sapiens
ucacagacugagccaaauagag

SEQ ID NO: 50616 - RNA, 22 nt, Homo sapiens
ucacagauaaauaaagaugauu

SEQ ID NO: 50617 - RNA, 22 nt, Homo sapiens
ucacagucuccucuagggaggg

SEQ ID NO: 50618 - RNA, 22 nt, Homo sapiens
ucacaugugacauauauauuug

SEQ ID NO: 50619 - RNA, 22 nt, Homo sapiens
ucaccaccugcugauuguagag

SEQ ID NO: 50620 - RNA, 22 nt, Homo sapiens
ucaccaccuuccaggaccacug

SEQ ID NO: 50621 - RNA, 22 nt, Homo sapiens
cuacaguguauuuauggagggu

SEQ ID NO: 50622 - RNA, 22 nt, Homo sapiens
cuacaguucucaggaguuggcc

SEQ ID NO: 50623 - RNA, 22 nt, Homo sapiens
cuacaguucuuaauuaaguagu

SEQ ID NO: 50624 - RNA, 22 nt, Homo sapiens
cuacuauguagagauauugaau

SEQ ID NO: 50625 - RNA, 22 nt, Homo sapiens
cuagaacuagaacugcuggggu

SEQ ID NO: 50626 - RNA, 22 nt, Homo sapiens
cuagcacauuuaucuuuauaca

SEQ ID NO: 50627 - RNA, 22 nt, Homo sapiens
cuagcuuuuuaugacaaucuug

SEQ ID NO: 50628 - RNA, 22 nt, Homo sapiens
cuagugcaauccuuugauggua

SEQ ID NO: 50629 - RNA, 22 nt, Homo sapiens
cuauuagguuggggcgaaagua

SEQ ID NO: 50630 - RNA, 22 nt, Homo sapiens
cuauuagguuggugcaaaaguc

SEQ ID NO: 50631 - RNA, 22 nt, Homo sapiens
cuauucacaauggugaagauau

SEQ ID NO: 50632 - RNA, 22 nt, Homo sapiens
cucaaagugcuaagauuaggcu

SEQ ID NO: 50633 - RNA, 22 nt, Homo sapiens
cucaaguacaugggauuacagg

SEQ ID NO: 50634 - RNA, 22 nt, Homo sapiens
cucaguguuaaggccaccucug

SEQ ID NO: 50635 - RNA, 22 nt, Homo sapiens
cucaguguuucagcugcucaga

SEQ ID NO: 50636 - RNA, 22 nt, Homo sapiens
cucauggaauacuucacagcca

SEQ ID NO: 50637 - RNA, 22 nt, Homo sapiens
cucauugcaaucucugccuccc

SEQ ID NO: 50638 - RNA, 22 nt, Homo sapiens
cuccaguacagagagguuccuc

SEQ ID NO: 50639 - RNA, 21 nt, Homo sapiens
cucucugcuuaugaauaguga

SEQ ID NO: 50640 - RNA, 22 nt, Homo sapiens
cucugguggaagcagggggcaa

SEQ ID NO: 50641 - RNA, 22 nt, Homo sapiens
cucuuggguagauuuugcagag

SEQ ID NO: 50642 - RNA, 22 nt, Homo sapiens
cucuuuggaugccuuaggguua

SEQ ID NO: 50643 - RNA, 22 nt, Homo sapiens
cugagauacacuaauagucucu

SEQ ID NO: 50644 - RNA, 22 nt, Homo sapiens
cugagcaauauagugagaucuu

SEQ ID NO: 50645 - RNA, 22 nt, Homo sapiens
cugauacucuccuuuuagagag

SEQ ID NO: 50646 - RNA, 22 nt, Homo sapiens
cuggaaacaucuuaggaaugca

SEQ ID NO: 50647 - RNA, 22 nt, Homo sapiens
cuggaaagaaucaggcuaaacu

SEQ ID NO: 50648 - RNA, 22 nt, Homo sapiens
cuggaaaguagacaaucuaaaa

SEQ ID NO: 50649 - RNA, 22 nt, Homo sapiens
cuggaagaaaaucacgccaucu

SEQ ID NO: 50650 - RNA, 22 nt, Homo sapiens
cuggagaucuugacauugaagu

SEQ ID NO: 50651 - RNA, 22 nt, Homo sapiens
cuggaggccugaacauaaaugg

SEQ ID NO: 50652 - RNA, 22 nt, Homo sapiens
cuggaguuugaggcugcaguga

SEQ ID NO: 50653 - RNA, 22 nt, Homo sapiens
cuggcaguguuucuugugggcu

SEQ ID NO: 50654 - RNA, 22 nt, Homo sapiens
cugggaugauguaaauaggcua

SEQ ID NO: 50655 - RNA, 22 nt, Homo sapiens
cuguaaggcacuaagcauaugu

SEQ ID NO: 50656 - RNA, 22 nt, Homo sapiens
cugugcaaagcgcucucggggu

SEQ ID NO: 50657 - RNA, 19 nt, Homo sapiens
cuguggucauuauuuugcu

SEQ ID NO: 50658 - RNA, 22 nt, Homo sapiens
cugugguguaacucuuggggcg

SEQ ID NO: 50659 - RNA, 22 nt, Homo sapiens
cuuagguuaugauaaauuuagu

SEQ ID NO: 50660 - RNA, 20 nt, Homo sapiens
cuuaucaguggcaaguauaa

SEQ ID NO: 50661 - RNA, 22 nt, Homo sapiens
cuucacuggagucccuggauuc

SEQ ID NO: 50662 - RNA, 22 nt, Homo sapiens
cuuccugaguccugggcucaca

SEQ ID NO: 50663 - RNA, 18 nt, Homo sapiens
cuuccuuagucugguuaa

SEQ ID NO: 50664 - RNA, 22 nt, Homo sapiens
cuucuugagggccugcugggaa

SEQ ID NO: 50665 - RNA, 22 nt, Homo sapiens
cuugaucaaugugguacuugau

SEQ ID NO: 50666 - RNA, 22 nt, Homo sapiens
cuugcauagaguuauugcccuu

SEQ ID NO: 50667 - RNA, 19 nt, Homo sapiens
cuugccccauucauccucu

SEQ ID NO: 50668 - RNA, 22 nt, Homo sapiens
cuuugauuauaaaaggguguuu

SEQ ID NO: 50669 - RNA, 22 nt, Homo sapiens
cuuugcaaauggccuuuccaag

SEQ ID NO: 50670 - RNA, 23 nt, Homo sapiens
cuuuguacagcuugacuacuggg

SEQ ID NO: 50671 - RNA, 22 nt, Homo sapiens
cuuuuacacugguggugggaau

SEQ ID NO: 50672 - RNA, 23 nt, Homo sapiens
cuuuugcaaugugaucuugccac

SEQ ID NO: 50673 - RNA, 22 nt, Homo sapiens
cuuuuggcuuaagauugucuug

SEQ ID NO: 50674 - RNA, 22 nt, Homo sapiens
cuuuuggcuuagaauugucuug

SEQ ID NO: 50675 - RNA, 22 nt, Homo sapiens
cuuuuugguagagcaggugugc

SEQ ID NO: 50676 - RNA, 22 nt, Homo sapiens
gaaagacuuucugcuguggaua

SEQ ID NO: 50677 - RNA, 22 nt, Homo sapiens
gaaaguaauuaacgauuguugc

SEQ ID NO: 50678 - RNA, 23 nt, Homo sapiens
gaaaugucuuagugaaauugcuu

SEQ ID NO: 50679 - RNA, 22 nt, Homo sapiens
gaacuuguguugcuucacaugu

SEQ ID NO: 50680 - RNA, 22 nt, Homo sapiens
gaaucacagauuaugaguaucu

SEQ ID NO: 50681 - RNA, 22 nt, Homo sapiens
gaaucauuguuucuaaguuugu

SEQ ID NO: 50682 - RNA, 22 nt, Homo sapiens
gaauugcacaaaaacugcuugu

SEQ ID NO: 50683 - RNA, 22 nt, Homo sapiens
gacaguuuggugaggaagacga

SEQ ID NO: 50684 - RNA, 20 nt, Homo sapiens
gacauaggcugguaucuggc

SEQ ID NO: 50685 - RNA, 21 nt, Homo sapiens
gaccacagcagggaaugucag

SEQ ID NO: 50686 - RNA, 20 nt, Homo sapiens
gacuucagaagcuucagagu

SEQ ID NO: 50687 - RNA, 22 nt, Homo sapiens
gagaacauuaauaguuaauuuu

SEQ ID NO: 50688 - RNA, 22 nt, Homo sapiens
gagaacugagauaagugauauu

SEQ ID NO: 50689 - RNA, 22 nt, Homo sapiens
gagaccauuuacugccuacuua

SEQ ID NO: 50690 - RNA, 22 nt, Homo sapiens
gagagugugucagaggcugcga

SEQ ID NO: 50691 - RNA, 22 nt, Homo sapiens
gagaugaagugucaauaaggau

SEQ ID NO: 50692 - RNA, 22 nt, Homo sapiens
gagaugguguuccacugccagu

SEQ ID NO: 50693 - RNA, 22 nt, Homo sapiens
gagcacauguggagagucuggg

SEQ ID NO: 50694 - RNA, 22 nt, Homo sapiens
gagcaguugagagugcuggcca

SEQ ID NO: 50695 - RNA, 22 nt, Homo sapiens
gagcuacacugauucauuuguu

SEQ ID NO: 50696 - RNA, 22 nt, Homo sapiens
gagcucaccuuaccucuggagc

SEQ ID NO: 50697 - RNA, 22 nt, Homo sapiens
gagcugaucuuuauguaaauuc

SEQ ID NO: 50698 - RNA, 22 nt, Homo sapiens
gagcuguugguuugaaagaauu

SEQ ID NO: 50699 - RNA, 22 nt, Homo sapiens
gaggagauauucugcuggaugg

SEQ ID NO: 50700 - RNA, 22 nt, Homo sapiens
gaggcaaguggccaccgagucu

SEQ ID NO: 50701 - RNA, 22 nt, Homo sapiens
gaggcagucugacccuuagcag

SEQ ID NO: 50702 - RNA, 22 nt, Homo sapiens
gaggcagucugucccuuagcag

SEQ ID NO: 50703 - RNA, 22 nt, Homo sapiens
gaggcaguguguccguucucgg

SEQ ID NO: 50704 - RNA, 22 nt, Homo sapiens
gagguaagagaauaaacaguuu

SEQ ID NO: 50705 - RNA, 22 nt, Homo sapiens
gagguaagaguuuuccauuucu

SEQ ID NO: 50706 - RNA, 22 nt, Homo sapiens
gagguaagaugauucguguccu

SEQ ID NO: 50707 - RNA, 22 nt, Homo sapiens
gagguaaguggauuaugagguc

SEQ ID NO: 50708 - RNA, 21 nt, Homo sapiens
gagguagggauuaaagaccuc

SEQ ID NO: 50709 - RNA, 22 nt, Homo sapiens
gagugcauaugggccuguguca

SEQ ID NO: 50710 - RNA, 22 nt, Homo sapiens
gaguuacauuguaauugccgag

SEQ ID NO: 50711 - RNA, 22 nt, Homo sapiens
gauaacagauaaugucaguuau

SEQ ID NO: 50712 - RNA, 22 nt, Homo sapiens
gauauguaaaaauuauaucuga

SEQ ID NO: 50713 - RNA, 22 nt, Homo sapiens
gauauguacagcucucuaggau

SEQ ID NO: 50714 - RNA, 17 nt, Homo sapiens
gaucacagucgucuccu

SEQ ID NO: 50715 - RNA, 22 nt, Homo sapiens
gaucacaguuccucacgggcau

SEQ ID NO: 50716 - RNA, 22 nt, Homo sapiens
gaucagauggcuguuggugugu

SEQ ID NO: 50717 - RNA, 22 nt, Homo sapiens
aauacuuccaaaucuagucauu

SEQ ID NO: 50718 - RNA, 22 nt, Homo sapiens
aauaguggcuuggacuaaauau

SEQ ID NO: 50719 - RNA, 22 nt, Homo sapiens
aauaugguuuuaugaagcaauu

SEQ ID NO: 50720 - RNA, 21 nt, Homo sapiens
aaucacaguuguucugccuuc

SEQ ID NO: 50721 - RNA, 22 nt, Homo sapiens
aaucacuuugcuacaaggcagu

SEQ ID NO: 50722 - RNA, 22 nt, Homo sapiens
aaucccugagcuagacacaaag

SEQ ID NO: 50723 - RNA, 22 nt, Homo sapiens
aauccuguagauucuaauuccu

SEQ ID NO: 50724 - RNA, 22 nt, Homo sapiens
aaucucagcauuuugggcugag

SEQ ID NO: 50725 - RNA, 22 nt, Homo sapiens
aaucugauguuaucagcuuaag

SEQ ID NO: 50726 - RNA, 22 nt, Homo sapiens
aaugacagugcuaaagaacccu

SEQ ID NO: 50727 - RNA, 22 nt, Homo sapiens
aaugcauaauuuguaugaggua

SEQ ID NO: 50728 - RNA, 22 nt, Homo sapiens
aaugccaucagagaaaacucuu

SEQ ID NO: 50729 - RNA, 22 nt, Homo sapiens
aauggcacuuuauaaauguuaa

SEQ ID NO: 50730 - RNA, 22 nt, Homo sapiens
aauggcuucuuauugugguuca

SEQ ID NO: 50731 - RNA, 22 nt, Homo sapiens
aaugucaugaguccaaccagaa

SEQ ID NO: 50732 - RNA, 22 nt, Homo sapiens
aauguguuuugaaaucaggaag

SEQ ID NO: 50733 - RNA, 22 nt, Homo sapiens
acacauacacauaugguguaua

SEQ ID NO: 50734 - RNA, 22 nt, Homo sapiens
acacugcugaguaaauaauuuu

SEQ ID NO: 50735 - RNA, 22 nt, Homo sapiens
acacuggaguuaaaggugauuu

SEQ ID NO: 50736 - RNA, 22 nt, Homo sapiens
acacuguagcugagggcaugcg

SEQ ID NO: 50737 - RNA, 19 nt, Homo sapiens
acagauagaauguucuaca

SEQ ID NO: 50738 - RNA, 22 nt, Homo sapiens
acagaucagagauauuuagguu

SEQ ID NO: 50739 - RNA, 22 nt, Homo sapiens
acaguaaugggccccuuuuccu

SEQ ID NO: 50740 - RNA, 23 nt, Homo sapiens
acaguggugugaucuuggcucag

SEQ ID NO: 50741 - RNA, 22 nt, Homo sapiens
acaguguuccuuuguugugacu

SEQ ID NO: 50742 - RNA, 22 nt, Homo sapiens
acauaguagacacugaaaauau

SEQ ID NO: 50743 - RNA, 22 nt, Homo sapiens
acaucccuuucccacccuucac

SEQ ID NO: 50744 - RNA, 19 nt, Homo sapiens
acccuguccccaccuuuac

SEQ ID NO: 50745 - RNA, 22 nt, Homo sapiens
acccuguugucagaauguggau

SEQ ID NO: 50746 - RNA, 20 nt, Homo sapiens
accgggugaaacccuaucuc

SEQ ID NO: 50747 - RNA, 23 nt, Homo sapiens
accuucauucauucagcugaagu

SEQ ID NO: 50748 - RNA, 22 nt, Homo sapiens
acugccuaaugacuuauguuuu

SEQ ID NO: 50749 - RNA, 22 nt, Homo sapiens
acuuugguuaucauacuuucag

SEQ ID NO: 50750 - RNA, 22 nt, Homo sapiens
acuuuuguuauacagugugaua

SEQ ID NO: 50751 - RNA, 22 nt, Homo sapiens
acuuuuugauggggagaacauu

SEQ ID NO: 50752 - RNA, 23 nt, Homo sapiens
agaaaugucuauucagggucccu

SEQ ID NO: 50753 - RNA, 22 nt, Homo sapiens
agacagcuggaguaucauagcu

SEQ ID NO: 50754 - RNA, 22 nt, Homo sapiens
agacuagagggaaaugaguugg

SEQ ID NO: 50755 - RNA, 22 nt, Homo sapiens
agagacauugcuccaacucacc

SEQ ID NO: 50756 - RNA, 22 nt, Homo sapiens
agaggucuuaucaaacaugcuu

SEQ ID NO: 50757 - RNA, 22 nt, Homo sapiens
agagugcuauagauuagauuuc

SEQ ID NO: 50758 - RNA, 22 nt, Homo sapiens
agcaacauuuuugaccuuucuu

SEQ ID NO: 50759 - RNA, 22 nt, Homo sapiens
agcacaguuaaaugaggcuucu

SEQ ID NO: 50760 - RNA, 22 nt, Homo sapiens
agcacauuaguaucuaagaaca

SEQ ID NO: 50761 - RNA, 22 nt, Homo sapiens
agcaccauuuauugaaaagaca

SEQ ID NO: 50762 - RNA, 22 nt, Homo sapiens
agcagagcaguggauuuuguga

SEQ ID NO: 50763 - RNA, 22 nt, Homo sapiens
agcagagcauauucauucgggg

SEQ ID NO: 50764 - RNA, 22 nt, Homo sapiens
agcagcaccaaacagacuaaga

SEQ ID NO: 50765 - RNA, 22 nt, Homo sapiens
agcagcauggguauaaaucucc

SEQ ID NO: 50766 - RNA, 22 nt, Homo sapiens
agcagguauucgggucaugggg

SEQ ID NO: 50767 - RNA, 22 nt, Homo sapiens
agcaucacacacuacagggaaa

SEQ ID NO: 50768 - RNA, 22 nt, Homo sapiens
agcauuaguugugaagccuuua

SEQ ID NO: 50769 - RNA, 22 nt, Homo sapiens
agcuauauugaggaugccauuc

SEQ ID NO: 50770 - RNA, 22 nt, Homo sapiens
agcucauugcuguccuggagga

SEQ ID NO: 50771 - RNA, 22 nt, Homo sapiens
agcuccauuguaaucaccuggu

SEQ ID NO: 50772 - RNA, 22 nt, Homo sapiens
agcuggucucaggugcccugcu

SEQ ID NO: 50773 - RNA, 22 nt, Homo sapiens
agcugguuuauuucuauauccu

SEQ ID NO: 50774 - RNA, 22 nt, Homo sapiens
agcuguguugucugaagucaga

SEQ ID NO: 50775 - RNA, 20 nt, Homo sapiens
agcuguuguuaaaaaggagg

SEQ ID NO: 50776 - RNA, 22 nt, Homo sapiens
agcuguuguuaauuaacucauu

SEQ ID NO: 50777 - RNA, 22 nt, Homo sapiens
aggaauguuaguacuucuuagu

SEQ ID NO: 50778 - RNA, 22 nt, Homo sapiens
aggaauuuaauguaugauaaua

SEQ ID NO: 50779 - RNA, 22 nt, Homo sapiens
aggacacugagcaugggagguu

SEQ ID NO: 50780 - RNA, 22 nt, Homo sapiens
aggaccccucaucagcaccagu

SEQ ID NO: 50781 - RNA, 21 nt, Homo sapiens
aggcaagguguuauuauugaa

SEQ ID NO: 50782 - RNA, 22 nt, Homo sapiens
agggaauguaaguuuuaugaga

SEQ ID NO: 50783 - RNA, 22 nt, Homo sapiens
agggcaagacuuguuaagaaca

SEQ ID NO: 50784 - RNA, 22 nt, Homo sapiens
agggcuuuugagcugagauggu

SEQ ID NO: 50785 - RNA, 22 nt, Homo sapiens
agguacuugagauucugaacug

SEQ ID NO: 50786 - RNA, 22 nt, Homo sapiens
agguaguguuauuugcagcuga

SEQ ID NO: 50787 - RNA, 22 nt, Homo sapiens
agguauauuggacagauguaaa

SEQ ID NO: 50788 - RNA, 22 nt, Homo sapiens
aggugguguuggguuccagccc

SEQ ID NO: 50789 - RNA, 22 nt, Homo sapiens
aguaucaagccacacaugguca

SEQ ID NO: 50790 - RNA, 22 nt, Homo sapiens
agucaaaugcuuauguauaaag

SEQ ID NO: 50791 - RNA, 22 nt, Homo sapiens
agucacaugcauuuucuucaau

SEQ ID NO: 50792 - RNA, 22 nt, Homo sapiens
agugcaaagccgagguuucuug

SEQ ID NO: 50793 - RNA, 22 nt, Homo sapiens
aguguuuuuacaagcacucugg

SEQ ID NO: 50794 - RNA, 22 nt, Homo sapiens
aguuggugauugauugggucug

SEQ ID NO: 50795 - RNA, 17 nt, Homo sapiens
auaaacucaucauuuuu

SEQ ID NO: 50796 - RNA, 18 nt, Homo sapiens
auaaacucaucauuuuua

SEQ ID NO: 50797 - RNA, 22 nt, Homo sapiens
auaaagcuauuccucucuuuuu

SEQ ID NO: 50798 - RNA, 22 nt, Homo sapiens
auaaaguucugcuggcauauau

SEQ ID NO: 50799 - RNA, 22 nt, Homo sapiens
auaaggaguaucauauuaaaac

SEQ ID NO: 50800 - RNA, 22 nt, Homo sapiens
auaauagguaguaauggauuga

SEQ ID NO: 50801 - RNA, 22 nt, Homo sapiens
auaauaucagguugugaugaug

SEQ ID NO: 50802 - RNA, 22 nt, Homo sapiens
auacacauuccugggccucacc

SEQ ID NO: 50803 - RNA, 22 nt, Homo sapiens
auacagcuaaaauauuaaguua

SEQ ID NO: 50804 - RNA, 22 nt, Homo sapiens
auacaguauggagggcccagcu

SEQ ID NO: 50805 - RNA, 22 nt, Homo sapiens
auacaugugccauguugguaug

SEQ ID NO: 50806 - RNA, 22 nt, Homo sapiens
auacccucugggugguuaguug

SEQ ID NO: 50807 - RNA, 22 nt, Homo sapiens
auacccugucgugagucagaga

SEQ ID NO: 50808 - RNA, 22 nt, Homo sapiens
auacuaugagauaauaaagacu

SEQ ID NO: 50809 - RNA, 22 nt, Homo sapiens
auacugguuuuugucaugugga

SEQ ID NO: 50810 - RNA, 22 nt, Homo sapiens
auagcagugugaaaauguacua

SEQ ID NO: 50811 - RNA, 22 nt, Homo sapiens
auagcauaucccacaugucaga

SEQ ID NO: 50812 - RNA, 22 nt, Homo sapiens
auaggcacauuaggaacuuuug

SEQ ID NO: 50813 - RNA, 22 nt, Homo sapiens
auagguauguaauacaaaugaa

SEQ ID NO: 50814 - RNA, 22 nt, Homo sapiens
auagguauuuuuaaaugacugu

SEQ ID NO: 50815 - RNA, 21 nt, Homo sapiens
auagugcuagagaguagcagg

SEQ ID NO: 50816 - RNA, 22 nt, Homo sapiens
auagugcugcaaucaacauaca

SEQ ID NO: 50817 - RNA, 22 nt, Homo sapiens
auauaugcuaagugcuaauaaa

SEQ ID NO: 50818 - RNA, 22 nt, Homo sapiens
auaugcaaauccauagagacag

SEQ ID NO: 50819 - RNA, 22 nt, Homo sapiens
auaugcacgugcauacacacuu

SEQ ID NO: 50820 - RNA, 20 nt, Homo sapiens
auaugcagacacauacauac

SEQ ID NO: 50821 - RNA, 22 nt, Homo sapiens
auauggcuaugugagcauacca

SEQ ID NO: 50822 - RNA, 22 nt, Homo sapiens
auaugguuuuuggaagcauauc

SEQ ID NO: 50823 - RNA, 22 nt, Homo sapiens
auauucacuauaugcagaacca

SEQ ID NO: 50824 - RNA, 22 nt, Homo sapiens
aucaaacugcaaggcagcagca

SEQ ID NO: 50825 - RNA, 19 nt, Homo sapiens
aucaaacugcucuuugagg

SEQ ID NO: 50826 - RNA, 22 nt, Homo sapiens
aucaaaguaucucaauauggua

SEQ ID NO: 50827 - RNA, 22 nt, Homo sapiens
ugaaguaggcauaaguuaagcu

SEQ ID NO: 50828 - RNA, 22 nt, Homo sapiens
ugaagugcugugggccaggcgu

SEQ ID NO: 50829 - RNA, 22 nt, Homo sapiens
ugaagugggaaaugaguauuaa

SEQ ID NO: 50830 - RNA, 22 nt, Homo sapiens
ugaauagugucacaauaaacau

SEQ ID NO: 50831 - RNA, 22 nt, Homo sapiens
ugaaucaugcugcuauaaagac

SEQ ID NO: 50832 - RNA, 22 nt, Homo sapiens
ugaaugcuucaugucugggcug

SEQ ID NO: 50833 - RNA, 22 nt, Homo sapiens
ugaaugugauggguuucaugug

SEQ ID NO: 50834 - RNA, 22 nt, Homo sapiens
ugacaagaaagcgucuucuuuu

SEQ ID NO: 50835 - RNA, 22 nt, Homo sapiens
ugacaagaguagagagggugcc

SEQ ID NO: 50836 - RNA, 22 nt, Homo sapiens
ugacacagcaagauggaaccau

SEQ ID NO: 50837 - RNA, 17 nt, Homo sapiens
ugacagaaacuuguugu

SEQ ID NO: 50838 - RNA, 22 nt, Homo sapiens
ugacaggagauuaugugauguu

SEQ ID NO: 50839 - RNA, 22 nt, Homo sapiens
ugacagugaacagguuaccacu

SEQ ID NO: 50840 - RNA, 22 nt, Homo sapiens
ugacagugaauaagucucuuaa

SEQ ID NO: 50841 - RNA, 22 nt, Homo sapiens
ugacauggaagauguucaugau

SEQ ID NO: 50842 - RNA, 18 nt, Homo sapiens
ugacauugagcugagaaa

SEQ ID NO: 50843 - RNA, 22 nt, Homo sapiens
ugacccauagaaauguggauaa

SEQ ID NO: 50844 - RNA, 22 nt, Homo sapiens
ugacuagcgauccccuuucuag

SEQ ID NO: 50845 - RNA, 22 nt, Homo sapiens
ugacuaggaggcuggaggauga

SEQ ID NO: 50846 - RNA, 22 nt, Homo sapiens
ugacucagauagguguguauuc

SEQ ID NO: 50847 - RNA, 22 nt, Homo sapiens
ugacuggagaccucaguagggu

SEQ ID NO: 50848 - RNA, 22 nt, Homo sapiens
agggcuuguuuaacuaucauua

SEQ ID NO: 50849 - RNA, 22 nt, Homo sapiens
agguagucuuuuccuauuguca

SEQ ID NO: 50850 - RNA, 22 nt, Homo sapiens
aggucccauguccucccugacc

SEQ ID NO: 50851 - RNA, 22 nt, Homo sapiens
agucagucuguccugugcugag

SEQ ID NO: 50852 - RNA, 22 nt, Homo sapiens
agugccauggcugcuagauggc

SEQ ID NO: 50853 - RNA, 22 nt, Homo sapiens
auagcacauggcauccucucuu

SEQ ID NO: 50854 - RNA, 22 nt, Homo sapiens
auaugcacuauacacacguaua

SEQ ID NO: 50855 - RNA, 22 nt, Homo sapiens
aucaaaugcuggcagagugccu

SEQ ID NO: 50856 - RNA, 22 nt, Homo sapiens
aucacagguacuauggcugaca

SEQ ID NO: 50857 - RNA, 22 nt, Homo sapiens
aucacaguuauaacauccuuuu

SEQ ID NO: 50858 - RNA, 21 nt, Homo sapiens
aucagagacccaggcuuccuc

SEQ ID NO: 50859 - RNA, 22 nt, Homo sapiens
aucagugcagugggaacuagaa

SEQ ID NO: 50860 - RNA, 22 nt, Homo sapiens
aucauguaguaagacacauuua

SEQ ID NO: 50861 - RNA, 22 nt, Homo sapiens
auccacauucauggaccagucc

SEQ ID NO: 50862 - RNA, 22 nt, Homo sapiens
aucugugguuguaugcauauua

SEQ ID NO: 50863 - RNA, 17 nt, Homo sapiens
augacuucuucagugug

SEQ ID NO: 50864 - RNA, 17 nt, Homo sapiens
augagcucaucauuuuu

SEQ ID NO: 50865 - RNA, 22 nt, Homo sapiens
augaggcaggaaaggcguaucu

SEQ ID NO: 50866 - RNA, 22 nt, Homo sapiens
augaggugauuucuguucgggu

SEQ ID NO: 50867 - RNA, 22 nt, Homo sapiens
augaggugcagaggaaaugagu

SEQ ID NO: 50868 - RNA, 22 nt, Homo sapiens
augaggugggagaaucacuuga

SEQ ID NO: 50869 - RNA, 22 nt, Homo sapiens
augauguccacagggguguuca

SEQ ID NO: 50870 - RNA, 22 nt, Homo sapiens
augccacagaaauaaccaaaau

SEQ ID NO: 50871 - RNA, 19 nt, Homo sapiens
augcugguguugcucaaac

SEQ ID NO: 50872 - RNA, 22 nt, Homo sapiens
augcuguuuugaauucucuaga

SEQ ID NO: 50873 - RNA, 22 nt, Homo sapiens
augggcacugauguauucugug

SEQ ID NO: 50874 - RNA, 21 nt, Homo sapiens
augugcacuaugucauuuaau

SEQ ID NO: 50875 - RNA, 19 nt, Homo sapiens
augugguuagcaugacugc

SEQ ID NO: 50876 - RNA, 22 nt, Homo sapiens
augugugcuugauguaaaaagu

SEQ ID NO: 50877 - RNA, 22 nt, Homo sapiens
auuaacaucuagaguuuuggug

SEQ ID NO: 50878 - RNA, 22 nt, Homo sapiens
auuacaugucuauccaugaaca

SEQ ID NO: 50879 - RNA, 22 nt, Homo sapiens
auuauaugucaucacagacacc

SEQ ID NO: 50880 - RNA, 22 nt, Homo sapiens
auuggcuuuugaaagucugcga

SEQ ID NO: 50881 - RNA, 22 nt, Homo sapiens
auuuggcagugaagggaucaca

SEQ ID NO: 50882 - RNA, 22 nt, Homo sapiens
caaagucuucaguugauucuga

SEQ ID NO: 50883 - RNA, 19 nt, Homo sapiens
caacccugcagagaaagga

SEQ ID NO: 50884 - RNA, 22 nt, Homo sapiens
cacaggccugucucuuucuaac

SEQ ID NO: 50885 - RNA, 22 nt, Homo sapiens
aaaugcaugaggugggaagaaa

SEQ ID NO: 50886 - RNA, 22 nt, Homo sapiens
aagggaaugcuuccaguuugug

SEQ ID NO: 50887 - RNA, 22 nt, Homo sapiens
aagugccauguggaugggcccu

SEQ ID NO: 50888 - RNA, 21 nt, Homo sapiens
aauacucuagguuaagagagc

SEQ ID NO: 50889 - RNA, 22 nt, Homo sapiens
aaugcacauauauuuccuuauu

SEQ ID NO: 50890 - RNA, 22 nt, Homo sapiens
aauggcucuuccuggaguugug

SEQ ID NO: 50891 - RNA, 22 nt, Homo sapiens
acacaguguuuauugugguuag

SEQ ID NO: 50892 - RNA, 22 nt, Homo sapiens
acagcacugccaagugacccau

SEQ ID NO: 50893 - RNA, 22 nt, Homo sapiens
acaggagugggauuugaguccu

SEQ ID NO: 50894 - RNA, 23 nt, Homo sapiens
acaguggugugaucuuggcucag

SEQ ID NO: 50895 - RNA, 22 nt, Homo sapiens
acaguguagugacugccaacuu

SEQ ID NO: 50896 - RNA, 22 nt, Homo sapiens
acaugcauccaugugaagagac

SEQ ID NO: 50897 - RNA, 22 nt, Homo sapiens
acccaguguugggcagaacugu

SEQ ID NO: 50898 - RNA, 22 nt, Homo sapiens
acccgggaggcaggagucauag

SEQ ID NO: 50899 - RNA, 22 nt, Homo sapiens
acccuggaggucuacagugcag

SEQ ID NO: 50900 - RNA, 22 nt, Homo sapiens
acccugucaaaacggaccaauc

SEQ ID NO: 50901 - RNA, 22 nt, Homo sapiens
acucagagugggccccuagaua

SEQ ID NO: 50902 - RNA, 22 nt, Homo sapiens
acugcacuccagcccgggugac

SEQ ID NO: 50903 - RNA, 22 nt, Homo sapiens
acugcacuccagccucggugac

SEQ ID NO: 50904 - RNA, 22 nt, Homo sapiens
acugcacucccgcccgggugac

SEQ ID NO: 50905 - RNA, 20 nt, Homo sapiens
acuggcacugguaggugugg

SEQ ID NO: 50906 - RNA, 22 nt, Homo sapiens
agcacacuggguggcuuaaaca

SEQ ID NO: 50907 - RNA, 22 nt, Homo sapiens
agcacagugaaugguuuacuca

SEQ ID NO: 50908 - RNA, 22 nt, Homo sapiens
agcaccacaauuuccugccuaa

SEQ ID NO: 50909 - RNA, 17 nt, Homo sapiens
agcaccacacucucuug

SEQ ID NO: 50910 - RNA, 16 nt, Homo sapiens
agcagguguuagguga

SEQ ID NO: 50911 - RNA, 22 nt, Homo sapiens
agcucacagccuagcacuguga

SEQ ID NO: 50912 - RNA, 22 nt, Homo sapiens
agcuguguugucugaagucaga

SEQ ID NO: 50913 - RNA, 22 nt, Homo sapiens
aggaccccucaucagcaccagu

SEQ ID NO: 50914 - RNA, 19 nt, Homo sapiens
aggcauugugcucaucugu

SEQ ID NO: 50915 - RNA, 21 nt, Homo sapiens
aggcuguuguuuugggaugga

SEQ ID NO: 50916 - RNA, 22 nt, Homo sapiens
ggaaugggauuugaagucuggc

SEQ ID NO: 50917 - RNA, 20 nt, Homo sapiens
ggaauguuaaucuccaugau

SEQ ID NO: 50918 - RNA, 20 nt, Homo sapiens
ggagagugacauaauucugg

SEQ ID NO: 50919 - RNA, 22 nt, Homo sapiens
ggcaaaugaagauggagaggcu

SEQ ID NO: 50920 - RNA, 22 nt, Homo sapiens
ggcaagaggagauucugcuccc

SEQ ID NO: 50921 - RNA, 22 nt, Homo sapiens
ggcagguaaggagugggagccu

SEQ ID NO: 50922 - RNA, 22 nt, Homo sapiens
ggcauugugauccaccagccuu

SEQ ID NO: 50923 - RNA, 22 nt, Homo sapiens
guauacaguugacccuugaacc

SEQ ID NO: 50924 - RNA, 22 nt, Homo sapiens
gucagugugauaucugcagggg

SEQ ID NO: 50925 - RNA, 22 nt, Homo sapiens
gucaguucuugugguugcauuc

SEQ ID NO: 50926 - RNA, 22 nt, Homo sapiens
gucguggagcucacagugugcc

SEQ ID NO: 50927 - RNA, 22 nt, Homo sapiens
gucucugguugcuuuuguacca

SEQ ID NO: 50928 - RNA, 22 nt, Homo sapiens
gucuuccagccuccaucuuucu

SEQ ID NO: 50929 - RNA, 22 nt, Homo sapiens
gucuugaaggcugaguaccugu

SEQ ID NO: 50930 - RNA, 22 nt, Homo sapiens
gugagguaauuagcucccuuag

SEQ ID NO: 50931 - RNA, 22 nt, Homo sapiens
gugcacauauggugcauaagug

SEQ ID NO: 50932 - RNA, 22 nt, Homo sapiens
gugcacaugcgugcgcacauau

SEQ ID NO: 50933 - RNA, 22 nt, Homo sapiens
gugcacuguagaacccuuuguu

SEQ ID NO: 50934 - RNA, 22 nt, Homo sapiens
guggcaugaaagcaucugugau

SEQ ID NO: 50935 - RNA, 21 nt, Homo sapiens
guucaagugauccuccugucu

SEQ ID NO: 50936 - RNA, 17 nt, Homo sapiens
guucccaguggcauuug

SEQ ID NO: 50937 - RNA, 22 nt, Homo sapiens
guuuacagucgacuugggaaua

SEQ ID NO: 50938 - RNA, 22 nt, Homo sapiens
guuuggcucuuguuucugucaa

SEQ ID NO: 50939 - RNA, 19 nt, Homo sapiens
uaacacaguuguguuugag

SEQ ID NO: 50940 - RNA, 22 nt, Homo sapiens
uaaggcauuuuuuugaguugca

SEQ ID NO: 50941 - RNA, 22 nt, Homo sapiens
uaaggcuuuuguucagcguggg

SEQ ID NO: 50942 - RNA, 22 nt, Homo sapiens
uacaagcacaggcagcaggcug

SEQ ID NO: 50943 - RNA, 22 nt, Homo sapiens
uacacagucaaaaauuuccagg

SEQ ID NO: 50944 - RNA, 22 nt, Homo sapiens
uacagccacauaauguaugauu

SEQ ID NO: 50945 - RNA, 22 nt, Homo sapiens
uacaguggugugaucucagcuc

SEQ ID NO: 50946 - RNA, 22 nt, Homo sapiens
uacauguauccauuguuuuugg

SEQ ID NO: 50947 - RNA, 22 nt, Homo sapiens
uacauguauguguuuauggcug

SEQ ID NO: 50948 - RNA, 22 nt, Homo sapiens
uacaugugcacaacgugcaggu

SEQ ID NO: 50949 - RNA, 22 nt, Homo sapiens
uagauuaucauucauacaggga

SEQ ID NO: 50950 - RNA, 22 nt, Homo sapiens
uagcaaaucaauggaauugaag

SEQ ID NO: 50951 - RNA, 21 nt, Homo sapiens
uagcaaauugcuauuaaggca

SEQ ID NO: 50952 - RNA, 20 nt, Homo sapiens
uagcacacauguagaauagu

SEQ ID NO: 50953 - RNA, 22 nt, Homo sapiens
uagcaguaucccaccaucuggu

SEQ ID NO: 50954 - RNA, 22 nt, Homo sapiens
uagggaguuuuggggugcagaa

SEQ ID NO: 50955 - RNA, 22 nt, Homo sapiens
uggaagugucugugcccagcuc

SEQ ID NO: 50956 - RNA, 21 nt, Homo sapiens
uggaccccuuccagucaucau

SEQ ID NO: 50957 - RNA, 19 nt, Homo sapiens
uggaccccuuccuuacacc

SEQ ID NO: 50958 - RNA, 22 nt, Homo sapiens
uggaccccuucuccuauuaaaa

SEQ ID NO: 50959 - RNA, 21 nt, Homo sapiens
uggaugccuaggcagaaguuu

SEQ ID NO: 50960 - RNA, 22 nt, Homo sapiens
uggcacaaugacccuugugggc

SEQ ID NO: 50961 - RNA, 22 nt, Homo sapiens
uggcaggugcacuggcuuugaa

SEQ ID NO: 50962 - RNA, 22 nt, Homo sapiens
uggcaguuucacauggcucaac

SEQ ID NO: 50963 - RNA, 21 nt, Homo sapiens
uggcuauuucuguggcauaca

SEQ ID NO: 50964 - RNA, 22 nt, Homo sapiens
uggcuuucuggggcuucuguuc

SEQ ID NO: 50965 - RNA, 21 nt, Homo sapiens
ugggccccuuccuuacaucau

SEQ ID NO: 50966 - RNA, 22 nt, Homo sapiens
uggucaguugugccucaauucc

SEQ ID NO: 50967 - RNA, 22 nt, Homo sapiens
uguaaaaagcccagccgcugag

SEQ ID NO: 50968 - RNA, 22 nt, Homo sapiens
uguaagcagcagagacuauccu

SEQ ID NO: 50969 - RNA, 22 nt, Homo sapiens
uguacaaauuucugugguggug

SEQ ID NO: 50970 - RNA, 22 nt, Homo sapiens
ugucaugguguuaauuuuccug

SEQ ID NO: 50971 - RNA, 22 nt, Homo sapiens
ugucuuguagacugaaggcuuc

SEQ ID NO: 50972 - RNA, 22 nt, Homo sapiens
ugucuuuguuaguuguccuagu

SEQ ID NO: 50973 - RNA, 22 nt, Homo sapiens
ugugcacaacaugcagguuugu

SEQ ID NO: 50974 - RNA, 22 nt, Homo sapiens
ugugcacauaacauuuuuuuag

SEQ ID NO: 50975 - RNA, 22 nt, Homo sapiens
ugugcguguaagagaucuaggu

SEQ ID NO: 50976 - RNA, 22 nt, Homo sapiens
ugugcgugugccuguaagaauu

SEQ ID NO: 50977 - RNA, 22 nt, Homo sapiens
uguuacaguguaggccuugggu

SEQ ID NO: 50978 - RNA, 22 nt, Homo sapiens
uuaaagcuggcguuacaguuug

SEQ ID NO: 50979 - RNA, 22 nt, Homo sapiens
uuaaaugcuagaauuuucuuug

SEQ ID NO: 50980 - RNA, 22 nt, Homo sapiens
uuaaugaacuuuauuuuguaga

SEQ ID NO: 50981 - RNA, 22 nt, Homo sapiens
uuacagauggcacacucaaggg

SEQ ID NO: 50982 - RNA, 22 nt, Homo sapiens
uuaccagucuagggcucaguuu

SEQ ID NO: 50983 - RNA, 22 nt, Homo sapiens
uuaccugagaaggugacauuug

SEQ ID NO: 50984 - RNA, 22 nt, Homo sapiens
uuacugcuuaagugauucaaca

SEQ ID NO: 50985 - RNA, 20 nt, Homo sapiens
uuauagcuacaucuugacug

SEQ ID NO: 50986 - RNA, 22 nt, Homo sapiens
uucacaguacucccuggaauua

SEQ ID NO: 50987 - RNA, 22 nt, Homo sapiens
uucacagugugaucuaugggca

SEQ ID NO: 50988 - RNA, 22 nt, Homo sapiens
uucacaugguugccuuuugauc

SEQ ID NO: 50989 - RNA, 22 nt, Homo sapiens
uucacugcacuccagccugagc

SEQ ID NO: 50990 - RNA, 22 nt, Homo sapiens
uucacugcaugaaaaggacagc

SEQ ID NO: 50991 - RNA, 22 nt, Homo sapiens
uucacuguagccucagccucuu

SEQ ID NO: 50992 - RNA, 22 nt, Homo sapiens
uucacuguagcuuggauguuua

SEQ ID NO: 50993 - RNA, 22 nt, Homo sapiens
uucaggcuuuuauuuacugaua

SEQ ID NO: 50994 - RNA, 22 nt, Homo sapiens
uuccaguguuugacucaccuuu

SEQ ID NO: 50995 - RNA, 22 nt, Homo sapiens
uuccaugagaugcaucaaagcu

SEQ ID NO: 50996 - RNA, 22 nt, Homo sapiens
uucccagugccaggcacuggga

SEQ ID NO: 50997 - RNA, 22 nt, Homo sapiens
uucccaguuggggaaagcgacc

SEQ ID NO: 50998 - RNA, 22 nt, Homo sapiens
uucccugagcaucuguugagcc

SEQ ID NO: 50999 - RNA, 22 nt, Homo sapiens
uucccuuugaaacuaaacuugc

SEQ ID NO: 51000 - RNA, 22 nt, Homo sapiens
uuccuugagaaaguacaaggcu

SEQ ID NO: 51001 - RNA, 22 nt, Homo sapiens
uuccuuguagcaaaugcgauga

SEQ ID NO: 51002 - RNA, 22 nt, Homo sapiens
uuccuuguuuauuuacaggagg

SEQ ID NO: 51003 - RNA, 21 nt, Homo sapiens
uucucaggguguguccuaccc

SEQ ID NO: 51004 - RNA, 22 nt, Homo sapiens
aaucucaacacuuugggaggcu

SEQ ID NO: 51005 - RNA, 22 nt, Homo sapiens
aauuacauggcaauugggaaau

SEQ ID NO: 51006 - RNA, 22 nt, Homo sapiens
aauugcacuaagcauaguccag

SEQ ID NO: 51007 - RNA, 20 nt, Homo sapiens
acaaaugcauucugugacau

SEQ ID NO: 51008 - RNA, 22 nt, Homo sapiens
acacaguauaugacaaugcuuu

SEQ ID NO: 51009 - RNA, 22 nt, Homo sapiens
acacauuggcaauucuggagca

SEQ ID NO: 51010 - RNA, 22 nt, Homo sapiens
acacuguuuuaguuauuauagc

SEQ ID NO: 51011 - RNA, 20 nt, Homo sapiens
acaguagaagggauuucaaa

SEQ ID NO: 51012 - RNA, 17 nt, Homo sapiens
acagugcuuugcuuucc

SEQ ID NO: 51013 - RNA, 22 nt, Homo sapiens
acagugcuuuuguuccucuccu

SEQ ID NO: 51014 - RNA, 18 nt, Homo sapiens
acagugucauggcucaau

SEQ ID NO: 51015 - RNA, 22 nt, Homo sapiens
acaugcauauguuggaagaaag

SEQ ID NO: 51016 - RNA, 22 nt, Homo sapiens
acccugucacucccaucaauuu

SEQ ID NO: 51017 - RNA, 19 nt, Homo sapiens
acccuguccccaccuuuac

SEQ ID NO: 51018 - RNA, 18 nt, Homo sapiens
acccuucagcacugggcc

SEQ ID NO: 51019 - RNA, 22 nt, Homo sapiens
acugcacuccuccuugggugac

SEQ ID NO: 51020 - RNA, 22 nt, Homo sapiens
agaaacauucucuugccuccuu

SEQ ID NO: 51021 - RNA, 18 nt, Homo sapiens
agagcacugaguuuuaga

SEQ ID NO: 51022 - RNA, 22 nt, Homo sapiens
agagugcaaagguuggggcugg

SEQ ID NO: 51023 - RNA, 22 nt, Homo sapiens
agcaagauccagucgcacagga

SEQ ID NO: 51024 - RNA, 22 nt, Homo sapiens
agcacagccuuguguuuucuug

SEQ ID NO: 51025 - RNA, 20 nt, Homo sapiens
agcagccacagauuccucag

SEQ ID NO: 51026 - RNA, 22 nt, Homo sapiens
agcaggacaauaugggaucagg

SEQ ID NO: 51027 - RNA, 22 nt, Homo sapiens
agcccagagacuguguaaauuu

SEQ ID NO: 51028 - RNA, 22 nt, Homo sapiens
agccuucauucugacaguagga

SEQ ID NO: 51029 - RNA, 22 nt, Homo sapiens
agcuuuuugggaggccuuagga

SEQ ID NO: 51030 - RNA, 22 nt, Homo sapiens
aggaagacugaaauugcuguuc

SEQ ID NO: 51031 - RNA, 22 nt, Homo sapiens
aggaaugcuaaguuuuccuccu

SEQ ID NO: 51032 - RNA, 22 nt, Homo sapiens
aggcacacaacccuggaccuga

SEQ ID NO: 51033 - RNA, 22 nt, Homo sapiens
aggcaggugaaagauaguuuua

SEQ ID NO: 51034 - RNA, 22 nt, Homo sapiens
aggcuguguggauaauauuggg

SEQ ID NO: 51035 - RNA, 22 nt, Homo sapiens
aggguaguaggcuugggauugg

SEQ ID NO: 51036 - RNA, 22 nt, Homo sapiens
agguaaacauggggacugcuac

SEQ ID NO: 51037 - RNA, 22 nt, Homo sapiens
aggugcugacaggauagguuuc

SEQ ID NO: 51038 - RNA, 22 nt, Homo sapiens
agucaaaugcuuauguauaaag

SEQ ID NO: 51039 - RNA, 22 nt, Homo sapiens
agucagugcauaagaaugaagu

SEQ ID NO: 51040 - RNA, 19 nt, Homo sapiens
agugagccaagauccuacc

SEQ ID NO: 51041 - RNA, 22 nt, Homo sapiens
aguggauuuuagacugagauuu

SEQ ID NO: 51042 - RNA, 21 nt, Homo sapiens
auagcacaucagauuuuauua

SEQ ID NO: 51043 - RNA, 22 nt, Homo sapiens
auaugcacgugcauacacacuu

SEQ ID NO: 51044 - RNA, 22 nt, Homo sapiens
aucaaagugaauuaaugagaau

SEQ ID NO: 51045 - RNA, 22 nt, Homo sapiens
aucaaaguuucccagaaguugu

SEQ ID NO: 51046 - RNA, 19 nt, Homo sapiens
uccuugauugcaccacugc

SEQ ID NO: 51047 - RNA, 22 nt, Homo sapiens
ucuagccuaugaagcuugucca

SEQ ID NO: 51048 - RNA, 22 nt, Homo sapiens
ucucaguggugcuggcagggga

SEQ ID NO: 51049 - RNA, 22 nt, Homo sapiens
ucuggcaagagccgagggcagu

SEQ ID NO: 51050 - RNA, 22 nt, Homo sapiens
ucugugcauuacacuuuucuca

SEQ ID NO: 51051 - RNA, 22 nt, Homo sapiens
ucuguggucagaguccuuggcc

SEQ ID NO: 51052 - RNA, 22 nt, Homo sapiens
ugaaggccgggcaugguggcuc

SEQ ID NO: 51053 - RNA, 22 nt, Homo sapiens
ugacacuugcccuuagaaacau

SEQ ID NO: 51054 - RNA, 22 nt, Homo sapiens
ugacccauagaaauguggauaa

SEQ ID NO: 51055 - RNA, 22 nt, Homo sapiens
ugagacacugaauccggccuga

SEQ ID NO: 51056 - RNA, 22 nt, Homo sapiens
ugagacugaguuucucucuugu

SEQ ID NO: 51057 - RNA, 22 nt, Homo sapiens
ugagacugguaauguguagggc

SEQ ID NO: 51058 - RNA, 22 nt, Homo sapiens
ugagacugguuaauugauaaag

SEQ ID NO: 51059 - RNA, 22 nt, Homo sapiens
ugaggcaagauacugauuucau

SEQ ID NO: 51060 - RNA, 22 nt, Homo sapiens
ugagguaacaaacuaugaguua

SEQ ID NO: 51061 - RNA, 22 nt, Homo sapiens
ugaguuaggagaguguggcucu

SEQ ID NO: 51062 - RNA, 18 nt, Homo sapiens
ugaguucauuagacuucc

SEQ ID NO: 51063 - RNA, 22 nt, Homo sapiens
ugaguugagauaagguuacauu

SEQ ID NO: 51064 - RNA, 22 nt, Homo sapiens
ugauccagugcucaguuggagu

SEQ ID NO: 51065 - RNA, 22 nt, Homo sapiens
ugcaaaugucaaggguuagugu

SEQ ID NO: 51066 - RNA, 22 nt, Homo sapiens
ugcaaauguuaggugucauuau

SEQ ID NO: 51067 - RNA, 22 nt, Homo sapiens
ugcaagcacacccagggauugu

SEQ ID NO: 51068 - RNA, 21 nt, Homo sapiens
ugcuccauuuucuagccugaa

SEQ ID NO: 51069 - RNA, 20 nt, Homo sapiens
ugcugcacuuaagcaugggc

SEQ ID NO: 51070 - RNA, 21 nt, Homo sapiens
ugcuuacugaauguuaauuuc

SEQ ID NO: 51071 - RNA, 21 nt, Homo sapiens
uggaacgcaaaugagaugaau

SEQ ID NO: 51072 - RNA, 22 nt, Homo sapiens
uggaagaugggaccucaguuuu

SEQ ID NO: 51073 - RNA, 22 nt, Homo sapiens
uggaagccuagauucuuuucuu

SEQ ID NO: 51074 - RNA, 22 nt, Homo sapiens
uggacaagauagguucuauauu

SEQ ID NO: 51075 - RNA, 22 nt, Homo sapiens
uggacagagagaccggcauuuu

SEQ ID NO: 51076 - RNA, 22 nt, Homo sapiens
uggaccccugcucgggagcccu

SEQ ID NO: 51077 - RNA, 21 nt, Homo sapiens
uggaccccuuucuuacaccgu

SEQ ID NO: 51078 - RNA, 22 nt, Homo sapiens
uggagacaaagauagaaaagca

SEQ ID NO: 51079 - RNA, 22 nt, Homo sapiens
uggaugaagagaugguaguugc

SEQ ID NO: 51080 - RNA, 22 nt, Homo sapiens
uggccagugucggaggccagga

SEQ ID NO: 51081 - RNA, 22 nt, Homo sapiens
uggcuguuuauuucacgugggu

SEQ ID NO: 51082 - RNA, 22 nt, Homo sapiens
uguagcaaauaaaagucuggau

SEQ ID NO: 51083 - RNA, 22 nt, Homo sapiens
ugucagaaucuagaggcugcua

SEQ ID NO: 51084 - RNA, 19 nt, Homo sapiens
ugugagcauuagcauuuag

SEQ ID NO: 51085 - RNA, 22 nt, Homo sapiens
ugugcacaacgugcagguuugu

SEQ ID NO: 51086 - RNA, 22 nt, Homo sapiens
ugugcacaaugugcagguuuga

SEQ ID NO: 51087 - RNA, 23 nt, Homo sapiens
ugugcacauuuacauauauacac

SEQ ID NO: 51088 - RNA, 22 nt, Homo sapiens
ugugcaugacagcauacaaacg

SEQ ID NO: 51089 - RNA, 23 nt, Homo sapiens
ugugguauuauuccauuuauagg

SEQ ID NO: 51090 - RNA, 22 nt, Homo sapiens
uguuugcuuaacguggagccag

SEQ ID NO: 51091 - RNA, 22 nt, Homo sapiens
uuaaaugcauagaauguguagu

SEQ ID NO: 51092 - RNA, 22 nt, Homo sapiens
uuaagggaggagcuucaagaug

SEQ ID NO: 51093 - RNA, 22 nt, Homo sapiens
uuaagugcucaguuacucaguu

SEQ ID NO: 51094 - RNA, 22 nt, Homo sapiens
uuacaggacuaagcagcuuugc

SEQ ID NO: 51095 - RNA, 22 nt, Homo sapiens
uuacagucaaguuacauuucuc

SEQ ID NO: 51096 - RNA, 22 nt, Homo sapiens
uucaaguaagaaagacaucagg

SEQ ID NO: 51097 - RNA, 22 nt, Homo sapiens
uucacugcacuccagccugggu

SEQ ID NO: 51098 - RNA, 22 nt, Homo sapiens
uucagagugguaugaagugaug

SEQ ID NO: 51099 - RNA, 22 nt, Homo sapiens
uucagcacaguguggaucauuc

SEQ ID NO: 51100 - RNA, 22 nt, Homo sapiens
uucagcuacuuggaaacagcaa

SEQ ID NO: 51101 - RNA, 22 nt, Homo sapiens
uucagggcauuggaguuucuga

SEQ ID NO: 51102 - RNA, 22 nt, Homo sapiens
ucagugcuguuugcccucguuu

SEQ ID NO: 51103 - RNA, 22 nt, Homo sapiens
ucagugcuuggcacagagagcu

SEQ ID NO: 51104 - RNA, 22 nt, Homo sapiens
ucagugcuuuuuguugucauca

SEQ ID NO: 51105 - RNA, 22 nt, Homo sapiens
ucagugucugugcaccgcugga

SEQ ID NO: 51106 - RNA, 22 nt, Homo sapiens
ucauagucuaagguucuuuugc

SEQ ID NO: 51107 - RNA, 22 nt, Homo sapiens
ucauggggugcuuugcuagauu

SEQ ID NO: 51108 - RNA, 22 nt, Homo sapiens
uccaguguuucuuccacuauuu

SEQ ID NO: 51109 - RNA, 19 nt, Homo sapiens
uccaugagcccacagugau

SEQ ID NO: 51110 - RNA, 22 nt, Homo sapiens
uccauggagacacauuuuauau

SEQ ID NO: 51111 - RNA, 22 nt, Homo sapiens
uccauuugucuauguuucuguu

SEQ ID NO: 51112 - RNA, 22 nt, Homo sapiens
uccauuuguucagcuucaggaa

SEQ ID NO: 51113 - RNA, 22 nt, Homo sapiens
ucccugaaaaauuggcuuaaca

SEQ ID NO: 51114 - RNA, 22 nt, Homo sapiens
ucccuguguccugggggcaccu

SEQ ID NO: 51115 - RNA, 22 nt, Homo sapiens
uccuuuguuacaguuggcucug

SEQ ID NO: 51116 - RNA, 22 nt, Homo sapiens
ucucauggagguagagaguaaa

SEQ ID NO: 51117 - RNA, 22 nt, Homo sapiens
ucucugacacugaccccaaaaa

SEQ ID NO: 51118 - RNA, 22 nt, Homo sapiens
ucugugcauuguaggauguuua

SEQ ID NO: 51119 - RNA, 22 nt, Homo sapiens
ucuugcuuguuguucccuucau

SEQ ID NO: 51120 - RNA, 22 nt, Homo sapiens
ucuuuagguguuauaguucaag

SEQ ID NO: 51121 - RNA, 22 nt, Homo sapiens
ugaaagcuacagucuccuagga

SEQ ID NO: 51122 - RNA, 22 nt, Homo sapiens
ugaaauacuuaauuucuccaug

SEQ ID NO: 51123 - RNA, 22 nt, Homo sapiens
ugaaauacuuuggcucuuuguu

SEQ ID NO: 51124 - RNA, 22 nt, Homo sapiens
ugaaguaauguuuuauucuauu

SEQ ID NO: 51125 - RNA, 22 nt, Homo sapiens
ugaauauguuucuaaaagugca

SEQ ID NO: 51126 - RNA, 22 nt, Homo sapiens
ugaaugcaucuagaaauuuauu

SEQ ID NO: 51127 - RNA, 22 nt, Homo sapiens
ugacaagauauggucuuaucaa

SEQ ID NO: 51128 - RNA, 22 nt, Homo sapiens
ugacucgaggcgccuccagucc

SEQ ID NO: 51129 - RNA, 22 nt, Homo sapiens
ugagaacuuauggugauuuuuu

SEQ ID NO: 51130 - RNA, 22 nt, Homo sapiens
ugagacugagucucgcucuugu

SEQ ID NO: 51131 - RNA, 22 nt, Homo sapiens
ugagacugagucuugcucuauu

SEQ ID NO: 51132 - RNA, 22 nt, Homo sapiens
ugagacugaguuucacuuuugu

SEQ ID NO: 51133 - RNA, 22 nt, Homo sapiens
ugagacugaguuuccaucuugu

SEQ ID NO: 51134 - RNA, 22 nt, Homo sapiens
ugagacugauaggacauuuucu

SEQ ID NO: 51135 - RNA, 22 nt, Homo sapiens
ugagacuguuuuggggaacuuc

SEQ ID NO: 51136 - RNA, 22 nt, Homo sapiens
ugagaugaguugcgcucugucg

SEQ ID NO: 51137 - RNA, 22 nt, Homo sapiens
ugagauggaguuucgcuuuugu

SEQ ID NO: 51138 - RNA, 22 nt, Homo sapiens
ugagaugguaaauuuuuguugu

SEQ ID NO: 51139 - RNA, 22 nt, Homo sapiens
ugagccaaguucacaccauugc

SEQ ID NO: 51140 - RNA, 22 nt, Homo sapiens
ugagccauggcaccuugucuaa

SEQ ID NO: 51141 - RNA, 22 nt, Homo sapiens
ugagguagaggugaacuugacc

SEQ ID NO: 51142 - RNA, 22 nt, Homo sapiens
ugaguuaguguggugcuuggaa

SEQ ID NO: 51143 - RNA, 22 nt, Homo sapiens
ugauaugucccucgacaucagg

SEQ ID NO: 51144 - RNA, 22 nt, Homo sapiens
ugcaaaugcugcuauuucucuu

SEQ ID NO: 51145 - RNA, 22 nt, Homo sapiens
ugcaaauguuauuuugguuucu

SEQ ID NO: 51146 - RNA, 22 nt, Homo sapiens
ugcaccacugcacuccagcuug

SEQ ID NO: 51147 - RNA, 22 nt, Homo sapiens
ugcuaugucagccaggcugguc

SEQ ID NO: 51148 - RNA, 20 nt, Homo sapiens
uggaagccuggugcuaucuu

SEQ ID NO: 51149 - RNA, 22 nt, Homo sapiens
uggaaggucauuguucauuuga

SEQ ID NO: 51150 - RNA, 22 nt, Homo sapiens
uggaagugaacaaccaaggcag

SEQ ID NO: 51151 - RNA, 22 nt, Homo sapiens
uggacagaaacauguuuucagu

SEQ ID NO: 51152 - RNA, 21 nt, Homo sapiens
uggaccccuuccuugcaccau

SEQ ID NO: 51153 - RNA, 22 nt, Homo sapiens
uggacugagauuucagcugcca

SEQ ID NO: 51154 - RNA, 22 nt, Homo sapiens
uggccuuuuccaagaacuacua

SEQ ID NO: 51155 - RNA, 22 nt, Homo sapiens
uguaaaucugguuaauuggaua

SEQ ID NO: 51156 - RNA, 22 nt, Homo sapiens
uguacaaaacaagaugggggua

SEQ ID NO: 51157 - RNA, 22 nt, Homo sapiens
uguccaaauugaaucaucuggu

SEQ ID NO: 51158 - RNA, 22 nt, Homo sapiens
ugucuugagagaggacaugacu

SEQ ID NO: 51159 - RNA, 22 nt, Homo sapiens
ugugaagauguuucuuaauuga

SEQ ID NO: 51160 - RNA, 22 nt, Homo sapiens
ugugcacauugugcagguugau

SEQ ID NO: 51161 - RNA, 22 nt, Homo sapiens
ugugucuuguuuuuucccaggc

SEQ ID NO: 51162 - RNA, 22 nt, Homo sapiens
uguuacagugacuaauguuuua

SEQ ID NO: 51163 - RNA, 20 nt, Homo sapiens
uuaaaucuagugcagacuca

SEQ ID NO: 51164 - RNA, 22 nt, Homo sapiens
uuaauaccgucacauggcugaa

SEQ ID NO: 51165 - RNA, 22 nt, Homo sapiens
uuacaucaucacauuaguuugc

SEQ ID NO: 51166 - RNA, 22 nt, Homo sapiens
uuagcaauagccugcaucugca

SEQ ID NO: 51167 - RNA, 22 nt, Homo sapiens
uuagggaggcucaggacaagag

SEQ ID NO: 51168 - RNA, 22 nt, Homo sapiens
uuauggccauucuuguaggagu

SEQ ID NO: 51169 - RNA, 22 nt, Homo sapiens
uuauuagagauauuugguuagg

SEQ ID NO: 51170 - RNA, 22 nt, Homo sapiens
uucacagucacccuucuccaug

SEQ ID NO: 51171 - RNA, 22 nt, Homo sapiens
uucacaguguguacaccagggg

SEQ ID NO: 51172 - RNA, 22 nt, Homo sapiens
uucacugcauuucagccugggc

SEQ ID NO: 51173 - RNA, 22 nt, Homo sapiens
uucacuggagcccaggaguugg

SEQ ID NO: 51174 - RNA, 22 nt, Homo sapiens
uucagcuacuugggaggcugaa

SEQ ID NO: 51175 - RNA, 22 nt, Homo sapiens
uuccaguguguucauccucaga

SEQ ID NO: 51176 - RNA, 22 nt, Homo sapiens
uucccuguaucuucugccaugu

SEQ ID NO: 51177 - RNA, 22 nt, Homo sapiens
uucucauggaacaucuguacug

SEQ ID NO: 51178 - RNA, 22 nt, Homo sapiens
uucugugcuuguggaugaagug

SEQ ID NO: 51179 - RNA, 22 nt, Homo sapiens
uugaaguagcauuucaugucua

SEQ ID NO: 51180 - RNA, 21 nt, Homo sapiens
uugagguaaaauccuauggga

SEQ ID NO: 51181 - RNA, 22 nt, Homo sapiens
uugagguaggaggagcuuggau

SEQ ID NO: 51182 - RNA, 22 nt, Homo sapiens
uugaggugaagggcagagcagc

SEQ ID NO: 51183 - RNA, 22 nt, Homo sapiens
uugcacuccagcucgggugaca

SEQ ID NO: 51184 - RNA, 22 nt, Homo sapiens
uugcacuugcugaggagugauu

SEQ ID NO: 51185 - RNA, 22 nt, Homo sapiens
uugccuaguuuaggucugugcu

SEQ ID NO: 51186 - RNA, 22 nt, Homo sapiens
uugucaguguucacucaaagcu

SEQ ID NO: 51187 - RNA, 22 nt, Homo sapiens
uuguccuugagauaguuugcug

SEQ ID NO: 51188 - RNA, 19 nt, Homo sapiens
uugucuuagaguugucauu

SEQ ID NO: 51189 - RNA, 22 nt, Homo sapiens
uugugcuucaucaccuagcaga

SEQ ID NO: 51190 - RNA, 19 nt, Homo sapiens
uugugggaggacagagggg

SEQ ID NO: 51191 - RNA, 22 nt, Homo sapiens
uuguguuuuuaguagggaaggg

SEQ ID NO: 51192 - RNA, 22 nt, Homo sapiens
uuucaggcaagggugacccuga

SEQ ID NO: 51193 - RNA, 20 nt, Homo sapiens
uuucaguacuuucuacuggc

SEQ ID NO: 51194 - RNA, 22 nt, Homo sapiens
uuucauagccuuugucgucuga

SEQ ID NO: 51195 - RNA, 22 nt, Homo sapiens
uuuccaguuuggaggaugcauu

SEQ ID NO: 51196 - RNA, 22 nt, Homo sapiens
uuucugguuaauuucuaagagc

SEQ ID NO: 51197 - RNA, 22 nt, Homo sapiens
uuucugugguccucuugaaggu

SEQ ID NO: 51198 - RNA, 22 nt, Homo sapiens
uuugcacuggagauucaauggg

SEQ ID NO: 51199 - RNA, 22 nt, Homo sapiens
uuugcacuugaaaacacucuca

SEQ ID NO: 51200 - RNA, 22 nt, Homo sapiens
uuugcacuuuuguaauaugguu

SEQ ID NO: 51201 - RNA, 22 nt, Homo sapiens
uuuggcucugugucccacccaa

SEQ ID NO: 51202 - RNA, 22 nt, Homo sapiens
uuuuacagaggagguugcugau

SEQ ID NO: 51203 - RNA, 22 nt, Homo sapiens
agcaagauugauggccugcagg

SEQ ID NO: 51204 - RNA, 22 nt, Homo sapiens
agcaccacauacuacagagaua

SEQ ID NO: 51205 - RNA, 22 nt, Homo sapiens
agcagcgacacccuguggugag

SEQ ID NO: 51206 - RNA, 22 nt, Homo sapiens
agcagguauucgggucaugggg

SEQ ID NO: 51207 - RNA, 22 nt, Homo sapiens
agcagguguggcuuauccugaa

SEQ ID NO: 51208 - RNA, 22 nt, Homo sapiens
agcccuuagauggcuccuucca

SEQ ID NO: 51209 - RNA, 22 nt, Homo sapiens
agcgccauugcacuccagccuu

SEQ ID NO: 51210 - RNA, 20 nt, Homo sapiens
agcuguuguuaugagguuua

SEQ ID NO: 51211 - RNA, 22 nt, Homo sapiens
agcuucauuguuaugaauguca

SEQ ID NO: 51212 - RNA, 21 nt, Homo sapiens
aggaagacuaugaucaauugg

SEQ ID NO: 51213 - RNA, 22 nt, Homo sapiens
aggaagugucuucuuuuaggca

SEQ ID NO: 51214 - RNA, 22 nt, Homo sapiens
aggauacugguaugggcugaau

SEQ ID NO: 51215 - RNA, 22 nt, Homo sapiens
aggcaugguggcacauacaugu

SEQ ID NO: 51216 - RNA, 22 nt, Homo sapiens
agggcuuuugagcugagauggu

SEQ ID NO: 51217 - RNA, 22 nt, Homo sapiens
aggugcucuuccuguaggucac

SEQ ID NO: 51218 - RNA, 22 nt, Homo sapiens
agucacagccuuuuacuuuaga

SEQ ID NO: 51219 - RNA, 22 nt, Homo sapiens
agucaguggaguaaauguaauu

SEQ ID NO: 51220 - RNA, 22 nt, Homo sapiens
aguccagguuuuguaauggcaa

SEQ ID NO: 51221 - RNA, 22 nt, Homo sapiens
agugcauuuguucugugucagg

SEQ ID NO: 51222 - RNA, 19 nt, Homo sapiens
auacacguguauacauaca

SEQ ID NO: 51223 - RNA, 22 nt, Homo sapiens
auacuagucaagaauguaugag

SEQ ID NO: 51224 - RNA, 22 nt, Homo sapiens
auagcagcuugucagggcagac

SEQ ID NO: 51225 - RNA, 22 nt, Homo sapiens
auaugcacaguggaguacuauu

SEQ ID NO: 51226 - RNA, 22 nt, Homo sapiens
auauguucucauucauaugugg

SEQ ID NO: 51227 - RNA, 22 nt, Homo sapiens
aucacagugagcauaugucuau

SEQ ID NO: 51228 - RNA, 22 nt, Homo sapiens
aucacaguggucagguauagau

SEQ ID NO: 51229 - RNA, 19 nt, Homo sapiens
aucagcacaagugugcuuu

SEQ ID NO: 51230 - RNA, 22 nt, Homo sapiens
auccccugcacggggugucauu

SEQ ID NO: 51231 - RNA, 21 nt, Homo sapiens
aucucacuugaauguaaaagc

SEQ ID NO: 51232 - RNA, 22 nt, Homo sapiens
augaaacuggcuaauuuuugua

SEQ ID NO: 51233 - RNA, 22 nt, Homo sapiens
augaggugaggucaguaaggua

SEQ ID NO: 51234 - RNA, 22 nt, Homo sapiens
augcacuuggcaggaugauucc

SEQ ID NO: 51235 - RNA, 22 nt, Homo sapiens
augcuguuuuguagcucccucu

SEQ ID NO: 51236 - RNA, 22 nt, Homo sapiens
auggcccccuguuugugaacau

SEQ ID NO: 51237 - RNA, 22 nt, Homo sapiens
auggugugugaauuaaauguua

SEQ ID NO: 51238 - RNA, 22 nt, Homo sapiens
auguaacaguauuuggagaugu

SEQ ID NO: 51239 - RNA, 22 nt, Homo sapiens
auguccaugagcacauguauca

SEQ ID NO: 51240 - RNA, 22 nt, Homo sapiens
auguccuggacccagacaaagc

SEQ ID NO: 51241 - RNA, 22 nt, Homo sapiens
augugcauaugaagcacagaca

SEQ ID NO: 51242 - RNA, 23 nt, Homo sapiens
augugugcuuggagagcaggaug

SEQ ID NO: 51243 - RNA, 22 nt, Homo sapiens
auuauuaguuguugaaugaagu

SEQ ID NO: 51244 - RNA, 22 nt, Homo sapiens
auuccagguggcgccauucaca

SEQ ID NO: 51245 - RNA, 22 nt, Homo sapiens
auuccaguggguuuacauccca

SEQ ID NO: 51246 - RNA, 22 nt, Homo sapiens
auucccuuagcugccucagccu

SEQ ID NO: 51247 - RNA, 22 nt, Homo sapiens
caaaggcuuccacugcauccuu

SEQ ID NO: 51248 - RNA, 22 nt, Homo sapiens
caacacagugaaacccgucucu

SEQ ID NO: 51249 - RNA, 22 nt, Homo sapiens
cacagcuaacaacuguuucuuc

SEQ ID NO: 51250 - RNA, 22 nt, Homo sapiens
cacaguagaauagagcacuagg

SEQ ID NO: 51251 - RNA, 22 nt, Homo sapiens
cacaguguucauagccaucagg

SEQ ID NO: 51252 - RNA, 22 nt, Homo sapiens
caccacagccauuauugucccc

SEQ ID NO: 51253 - RNA, 22 nt, Homo sapiens
cacccaguaagcaugaggcccu

SEQ ID NO: 51254 - RNA, 22 nt, Homo sapiens
caccgagguuggagugcagugg

SEQ ID NO: 51255 - RNA, 22 nt, Homo sapiens
cacuggucucauggcaugagag

SEQ ID NO: 51256 - RNA, 22 nt, Homo sapiens
cagcacauuacaaguacuuggu

SEQ ID NO: 51257 - RNA, 22 nt, Homo sapiens
cagcugguggcaagaagacaga

SEQ ID NO: 51258 - RNA, 22 nt, Homo sapiens
cagcuguuguugggguauagga

SEQ ID NO: 51259 - RNA, 22 nt, Homo sapiens
caggugcuuacuuaauagccau

SEQ ID NO: 51260 - RNA, 22 nt, Homo sapiens
caguacaauguugauuagaagu

SEQ ID NO: 51261 - RNA, 22 nt, Homo sapiens
cagugcauagaugugccacauu

SEQ ID NO: 51262 - RNA, 23 nt, Homo sapiens
cagugcaugacuguauaugcaaa

SEQ ID NO: 51263 - RNA, 22 nt, Homo sapiens
cauggcacuggugggagugucu

SEQ ID NO: 51264 - RNA, 22 nt, Homo sapiens
ccaccgggucccagcucugcuc

SEQ ID NO: 51265 - RNA, 20 nt, Homo sapiens
ccccuggaguggggcugcuu

SEQ ID NO: 51266 - RNA, 22 nt, Homo sapiens
cccugaagacuccaccgucaug

SEQ ID NO: 51267 - RNA, 22 nt, Homo sapiens
cccuguguuuagcugaagguuu

SEQ ID NO: 51268 - RNA, 22 nt, Homo sapiens
ccgugcacggaaaggcauauuu

SEQ ID NO: 51269 - RNA, 22 nt, Homo sapiens
ccuggaagaaaggugcuaaaua

SEQ ID NO: 51270 - RNA, 19 nt, Homo sapiens
ccuuugguuuccaugacau

SEQ ID NO: 51271 - RNA, 23 nt, Homo sapiens
cuacuagucaagucuuuuccagu

SEQ ID NO: 51272 - RNA, 22 nt, Homo sapiens
cuagaggcacagccuaggcacu

SEQ ID NO: 51273 - RNA, 22 nt, Homo sapiens
aucacagcuacuccucugucuu

SEQ ID NO: 51274 - RNA, 22 nt, Homo sapiens
aucacaguggcucacaagagcc

SEQ ID NO: 51275 - RNA, 22 nt, Homo sapiens
aucacaguuaagaggugaugaa

SEQ ID NO: 51276 - RNA, 20 nt, Homo sapiens
aucagagacuaggauugcca

SEQ ID NO: 51277 - RNA, 18 nt, Homo sapiens
aucauugcacugucuugc

SEQ ID NO: 51278 - RNA, 22 nt, Homo sapiens
augaaaacaugauuugccuguu

SEQ ID NO: 51279 - RNA, 22 nt, Homo sapiens
augaggugaguaaauaaaugaa

SEQ ID NO: 51280 - RNA, 21 nt, Homo sapiens
augagguguacuguggugaaa

SEQ ID NO: 51281 - RNA, 20 nt, Homo sapiens
augagguguaugacacugaa

SEQ ID NO: 51282 - RNA, 22 nt, Homo sapiens
augcagagaaaucuaaaauaug

SEQ ID NO: 51283 - RNA, 22 nt, Homo sapiens
augccucugacaauuggauucu

SEQ ID NO: 51284 - RNA, 22 nt, Homo sapiens
auggaagcauaguauucuauug

SEQ ID NO: 51285 - RNA, 22 nt, Homo sapiens
auggaaggagaauggucuuuga

SEQ ID NO: 51286 - RNA, 22 nt, Homo sapiens
auggacagacacuggccuucug

SEQ ID NO: 51287 - RNA, 22 nt, Homo sapiens
auggauagucucacucacauac

SEQ ID NO: 51288 - RNA, 22 nt, Homo sapiens
auggcucaauucuuucccugaa

SEQ ID NO: 51289 - RNA, 22 nt, Homo sapiens
augguauuuugugauaccuugu

SEQ ID NO: 51290 - RNA, 20 nt, Homo sapiens
augucaggaagggagucagg

SEQ ID NO: 51291 - RNA, 22 nt, Homo sapiens
augugcacaacgugcagguuug

SEQ ID NO: 51292 - RNA, 22 nt, Homo sapiens
augugcacauucugguaaauau

SEQ ID NO: 51293 - RNA, 22 nt, Homo sapiens
auguuagcaucaauauucauca

SEQ ID NO: 51294 - RNA, 22 nt, Homo sapiens
auucccuguagaauaaggaugg

SEQ ID NO: 51295 - RNA, 22 nt, Homo sapiens
cacagugaacugguggguuuuu

SEQ ID NO: 51296 - RNA, 22 nt, Homo sapiens
cacauagcuagucaguagugaa

SEQ ID NO: 51297 - RNA, 22 nt, Homo sapiens
caccaggugcccagcacggcca

SEQ ID NO: 51298 - RNA, 22 nt, Homo sapiens
cacugcacuccagcuugugggc

SEQ ID NO: 51299 - RNA, 22 nt, Homo sapiens
cacugcacucuucuucugggca

SEQ ID NO: 51300 - RNA, 21 nt, Homo sapiens
cacugcacuugccuucugggu

SEQ ID NO: 51301 - RNA, 23 nt, Homo sapiens
cacugggcagcagguguucccag

SEQ ID NO: 51302 - RNA, 22 nt, Homo sapiens
cagcaaaucauccuauuugagc

SEQ ID NO: 51303 - RNA, 22 nt, Homo sapiens
cagcccguaaucccagcacuuu

SEQ ID NO: 51304 - RNA, 22 nt, Homo sapiens
caggaccucuugccuggaagcc

SEQ ID NO: 51305 - RNA, 22 nt, Homo sapiens
caggcagugggagacaaaacug

SEQ ID NO: 51306 - RNA, 22 nt, Homo sapiens
cagguacuucugggcugagcag

SEQ ID NO: 51307 - RNA, 22 nt, Homo sapiens
cagucacagugacaggaugugg

SEQ ID NO: 51308 - RNA, 23 nt, Homo sapiens
cagugcauuguggcauucagcau

SEQ ID NO: 51309 - RNA, 22 nt, Homo sapiens
cauacaugugcuugucuuaugc

SEQ ID NO: 51310 - RNA, 23 nt, Homo sapiens
caucacagagccuuccuugacuc

SEQ ID NO: 51311 - RNA, 22 nt, Homo sapiens
caucacagcaaguagggagugg

SEQ ID NO: 51312 - RNA, 22 nt, Homo sapiens
caucacaguacuaaucgucaua

SEQ ID NO: 51313 - RNA, 22 nt, Homo sapiens
cauggcacagagaauguguucu

SEQ ID NO: 51314 - RNA, 22 nt, Homo sapiens
cauugcacuccagccuugguga

SEQ ID NO: 51315 - RNA, 22 nt, Homo sapiens
cauugcacuuagacaacuuuug

SEQ ID NO: 51316 - RNA, 22 nt, Homo sapiens
ccagugcugugcaguguaugag

SEQ ID NO: 51317 - RNA, 22 nt, Homo sapiens
cccacaguggccucauauccuu

SEQ ID NO: 51318 - RNA, 22 nt, Homo sapiens
cccagagacagaaugauaaacu

SEQ ID NO: 51319 - RNA, 22 nt, Homo sapiens
cccaguguuacgugacagccug

SEQ ID NO: 51320 - RNA, 22 nt, Homo sapiens
cccugagcagccugaguuuccc

SEQ ID NO: 51321 - RNA, 22 nt, Homo sapiens
cacagugaacaauauccucugu

SEQ ID NO: 51322 - RNA, 22 nt, Homo sapiens
cacagugaaugucaucauugcc

SEQ ID NO: 51323 - RNA, 22 nt, Homo sapiens
cacugcacuccagcuuugguga

SEQ ID NO: 51324 - RNA, 22 nt, Homo sapiens
cacugcauggucuagcuggguu

SEQ ID NO: 51325 - RNA, 22 nt, Homo sapiens
cacuuugguucaccugaguuuc

SEQ ID NO: 51326 - RNA, 22 nt, Homo sapiens
cagacagugucccgagucccug

SEQ ID NO: 51327 - RNA, 22 nt, Homo sapiens
cagagagcuugcccuuguauau

SEQ ID NO: 51328 - RNA, 22 nt, Homo sapiens
cagcagguuuuuaucaguuaag

SEQ ID NO: 51329 - RNA, 22 nt, Homo sapiens
caggcauuguccaugcugaagg

SEQ ID NO: 51330 - RNA, 22 nt, Homo sapiens
cagugcauccauguucagcagu

SEQ ID NO: 51331 - RNA, 22 nt, Homo sapiens
caguggaugauguuuucugugg

SEQ ID NO: 51332 - RNA, 22 nt, Homo sapiens
caucacauucugagauacugag

SEQ ID NO: 51333 - RNA, 22 nt, Homo sapiens
cauggucaccuuccaaguuauu

SEQ ID NO: 51334 - RNA, 22 nt, Homo sapiens
cauugcacacauuuaccuaugu

SEQ ID NO: 51335 - RNA, 22 nt, Homo sapiens
ccacaguggauuaaaguuacug

SEQ ID NO: 51336 - RNA, 22 nt, Homo sapiens
ccaucacaggccucagugggaa

SEQ ID NO: 51337 - RNA, 22 nt, Homo sapiens
cccugaagaaagccuaggacau

SEQ ID NO: 51338 - RNA, 22 nt, Homo sapiens
cuacaguuauguuuuaaaugug

SEQ ID NO: 51339 - RNA, 22 nt, Homo sapiens
cuagcagacacuuccagagagu

SEQ ID NO: 51340 - RNA, 22 nt, Homo sapiens
cucacagucagaagggacuugc

SEQ ID NO: 51341 - RNA, 22 nt, Homo sapiens
cucacuaguaaggcuguuuagu

SEQ ID NO: 51342 - RNA, 22 nt, Homo sapiens
cucauuaguuguuuuaagauga

SEQ ID NO: 51343 - RNA, 22 nt, Homo sapiens
cucccagugacccaggaacagg

SEQ ID NO: 51344 - RNA, 23 nt, Homo sapiens
cucccugaacaugacacaccaga

SEQ ID NO: 51345 - RNA, 22 nt, Homo sapiens
cugagauacacuaauagucucu

SEQ ID NO: 51346 - RNA, 22 nt, Homo sapiens
cugagcucauuucuuuugcuac

SEQ ID NO: 51347 - RNA, 22 nt, Homo sapiens
cugaggugggagaaucacauaa

SEQ ID NO: 51348 - RNA, 22 nt, Homo sapiens
cugcacugagacccucuuugcu

SEQ ID NO: 51349 - RNA, 22 nt, Homo sapiens
cuguagcuuuuauaugcuuagc

SEQ ID NO: 51350 - RNA, 22 nt, Homo sapiens
cugucuggaguccuucgugugc

SEQ ID NO: 51351 - RNA, 22 nt, Homo sapiens
cuguguaguacuagauugagca

SEQ ID NO: 51352 - RNA, 22 nt, Homo sapiens
cuguuagguuaaggaauggcaa

SEQ ID NO: 51353 - RNA, 22 nt, Homo sapiens
cuguuugguuaucuuuuccugu

SEQ ID NO: 51354 - RNA, 18 nt, Homo sapiens
cuuaacauugggaugaua

SEQ ID NO: 51355 - RNA, 22 nt, Homo sapiens
cuucaucugguuugugaacuuu

SEQ ID NO: 51356 - RNA, 22 nt, Homo sapiens
cuuccaguggcagccgggcaug

SEQ ID NO: 51357 - RNA, 22 nt, Homo sapiens
cuuggcuucuuuauguggcuau

SEQ ID NO: 51358 - RNA, 22 nt, Homo sapiens
gaggcacucuguacaaaucugc

SEQ ID NO: 51359 - RNA, 22 nt, Homo sapiens
gaggcagucuguccauucucag

SEQ ID NO: 51360 - RNA, 22 nt, Homo sapiens
gagguaugauugacauauaaaa

SEQ ID NO: 51361 - RNA, 22 nt, Homo sapiens
gagguauggauaucuggagagg

SEQ ID NO: 51362 - RNA, 22 nt, Homo sapiens
gagugcaauggcaugaucuggg

SEQ ID NO: 51363 - RNA, 22 nt, Homo sapiens
gaguucaauuuccagcuguucu

SEQ ID NO: 51364 - RNA, 21 nt, Homo sapiens
gauaucuuuauucccaagagc

SEQ ID NO: 51365 - RNA, 22 nt, Homo sapiens
gauaucuuuuguauggugagcu

SEQ ID NO: 51366 - RNA, 22 nt, Homo sapiens
gaucaguuucuggagauacgua

SEQ ID NO: 51367 - RNA, 22 nt, Homo sapiens
gaugaggcuagagacaugugua

SEQ ID NO: 51368 - RNA, 22 nt, Homo sapiens
gauggugucccaggcucaggcu

SEQ ID NO: 51369 - RNA, 22 nt, Homo sapiens
gcacaggguuacauucuaaggu

SEQ ID NO: 51370 - RNA, 22 nt, Homo sapiens
gcaccacugcacucucagcuug

SEQ ID NO: 51371 - RNA, 23 nt, Homo sapiens
gcagucauuuggaaaagguugaa

SEQ ID NO: 51372 - RNA, 22 nt, Homo sapiens
gccauugcacucuagccuaggu

SEQ ID NO: 51373 - RNA, 22 nt, Homo sapiens
ggaagacuggcuuguuuaccca

SEQ ID NO: 51374 - RNA, 22 nt, Homo sapiens
uucccaguaaacucuaucccuc

SEQ ID NO: 51375 - RNA, 22 nt, Homo sapiens
uuccuacugugcaaaguugcaa

SEQ ID NO: 51376 - RNA, 22 nt, Homo sapiens
uuccuuaguuauuugguccccu

SEQ ID NO: 51377 - RNA, 22 nt, Homo sapiens
uuccuugaaacagucaagagaa

SEQ ID NO: 51378 - RNA, 22 nt, Homo sapiens
uuccuugugacuaguagugacc

SEQ ID NO: 51379 - RNA, 22 nt, Homo sapiens
uucuacaugggucgucggugag

SEQ ID NO: 51380 - RNA, 22 nt, Homo sapiens
uucucagugaacuccagcuugu

SEQ ID NO: 51381 - RNA, 22 nt, Homo sapiens
uucuggcuuauaaacgugacuu

SEQ ID NO: 51382 - RNA, 22 nt, Homo sapiens
uucuuagguuaaggcugagaga

SEQ ID NO: 51383 - RNA, 22 nt, Homo sapiens
uucuuuaguucacuugcuccag

SEQ ID NO: 51384 - RNA, 22 nt, Homo sapiens
uugaaguagguaccguucaauu

SEQ ID NO: 51385 - RNA, 22 nt, Homo sapiens
uugacacuaauuauuauaggug

SEQ ID NO: 51386 - RNA, 22 nt, Homo sapiens
uugacauaguuucugaaauaga

SEQ ID NO: 51387 - RNA, 22 nt, Homo sapiens
uugacugugguaauggaagcug

SEQ ID NO: 51388 - RNA, 22 nt, Homo sapiens
uugagguaauaaacagccauuc

SEQ ID NO: 51389 - RNA, 22 nt, Homo sapiens
uugcacauguugaaccagcaaa

SEQ ID NO: 51390 - RNA, 22 nt, Homo sapiens
uuggacugggauggccgaggcu

SEQ ID NO: 51391 - RNA, 22 nt, Homo sapiens
uuggcacugagcaagaacaggg

SEQ ID NO: 51392 - RNA, 22 nt, Homo sapiens
uuggcauugaguuucaaaucau

SEQ ID NO: 51393 - RNA, 22 nt, Homo sapiens
uuguccauggacagcaccacag

SEQ ID NO: 51394 - RNA, 22 nt, Homo sapiens
uuguccccaucugcugccagaa

SEQ ID NO: 51395 - RNA, 22 nt, Homo sapiens
uuguccuugagauaguuugcag

SEQ ID NO: 51396 - RNA, 22 nt, Homo sapiens
uugucuugcagcuuaggcauca

SEQ ID NO: 51397 - RNA, 22 nt, Homo sapiens
uugugcacauguacccuagaac

SEQ ID NO: 51398 - RNA, 22 nt, Homo sapiens
uuuacagucucauagguggaag

SEQ ID NO: 51399 - RNA, 22 nt, Homo sapiens
uuuacaguuuucuaggcuacca

SEQ ID NO: 51400 - RNA, 22 nt, Homo sapiens
uuucaagugcugucuuagcugu

SEQ ID NO: 51401 - RNA, 22 nt, Homo sapiens
uuucugagaccaaaacuuguaa

SEQ ID NO: 51402 - RNA, 21 nt, Homo sapiens
uuucugggggagcauggcagg

SEQ ID NO: 51403 - RNA, 22 nt, Homo sapiens
uuugaagacuacugggagugaa

SEQ ID NO: 51404 - RNA, 22 nt, Homo sapiens
uuugaauguaaugagcaggaag

SEQ ID NO: 51405 - RNA, 22 nt, Homo sapiens
uuugaggaaaggcauaaguagg

SEQ ID NO: 51406 - RNA, 19 nt, Homo sapiens
uuuugcucuuuauaccuau

SEQ ID NO: 51407 - RNA, 22 nt, Homo sapiens
uucuugcugaauugugcccuuc

SEQ ID NO: 51408 - RNA, 22 nt, Homo sapiens
uucuugcuguauccucacaugg

SEQ ID NO: 51409 - RNA, 22 nt, Homo sapiens
uugaaagacaucaccuacugcu

SEQ ID NO: 51410 - RNA, 22 nt, Homo sapiens
uugaaagaugaacuggauugga

SEQ ID NO: 51411 - RNA, 22 nt, Homo sapiens
uugaaguaugaccgcugagaau

SEQ ID NO: 51412 - RNA, 22 nt, Homo sapiens
uugaggugaauuugcaggaugc

SEQ ID NO: 51413 - RNA, 22 nt, Homo sapiens
uugagguggugucuugcucugu

SEQ ID NO: 51414 - RNA, 22 nt, Homo sapiens
uugagguguauuguacagcaca

SEQ ID NO: 51415 - RNA, 22 nt, Homo sapiens
uuggacuuuaagauagagaugu

SEQ ID NO: 51416 - RNA, 22 nt, Homo sapiens
uuggaugauaaagaagccuaag

SEQ ID NO: 51417 - RNA, 22 nt, Homo sapiens
uugggcuugagggugcccaguc

SEQ ID NO: 51418 - RNA, 19 nt, Homo sapiens
uuggucccuuuggguucuu

SEQ ID NO: 51419 - RNA, 23 nt, Homo sapiens
uuguucccuuccacucagucucc

SEQ ID NO: 51420 - RNA, 22 nt, Homo sapiens
uuuaacauuggaugagaucguc

SEQ ID NO: 51421 - RNA, 22 nt, Homo sapiens
uuuacagucuuuugugugaguc

SEQ ID NO: 51422 - RNA, 19 nt, Homo sapiens
uuuccaguaaucuuaugug

SEQ ID NO: 51423 - RNA, 22 nt, Homo sapiens
uuucccauuguucugcucugug

SEQ ID NO: 51424 - RNA, 22 nt, Homo sapiens
uuucccugaaggcucugaaguc

SEQ ID NO: 51425 - RNA, 22 nt, Homo sapiens
uuugauguugauacuaccuuca

SEQ ID NO: 51426 - RNA, 22 nt, Homo sapiens
uuugcuuaguaaauguagaaaa

SEQ ID NO: 51427 - RNA, 19 nt, Homo sapiens
uuuguccugcccuuucuca

SEQ ID NO: 51428 - RNA, 22 nt, Homo sapiens
uuuuccagugggacucccauua

SEQ ID NO: 51429 - RNA, 22 nt, Homo sapiens
uuuuuugcuguaugcaaacauc

SEQ ID NO: 51430 - RNA, 23 nt, Homo sapiens
ggcagguuggucuaggucuauuc

SEQ ID NO: 51431 - RNA, 22 nt, Homo sapiens
ggugaggaaaguugaguuucua

SEQ ID NO: 51432 - RNA, 22 nt, Homo sapiens
ggugucaguuggccccuacugg

SEQ ID NO: 51433 - RNA, 22 nt, Homo sapiens
gucacaguggccagugauguuc

SEQ ID NO: 51434 - RNA, 22 nt, Homo sapiens
gucccaguggaaccuccaagcu

SEQ ID NO: 51435 - RNA, 20 nt, Homo sapiens
gucuugcuccguugcccagg

SEQ ID NO: 51436 - RNA, 22 nt, Homo sapiens
gucuuuaguugaaacauguggu

SEQ ID NO: 51437 - RNA, 22 nt, Homo sapiens
gugacagaguaagacccuguau

SEQ ID NO: 51438 - RNA, 22 nt, Homo sapiens
gugagcuccucuucugcugcag

SEQ ID NO: 51439 - RNA, 22 nt, Homo sapiens
gugagguaagaguugcuuugcu

SEQ ID NO: 51440 - RNA, 22 nt, Homo sapiens
gugagguauacugggaucacua

SEQ ID NO: 51441 - RNA, 22 nt, Homo sapiens
gugcacauuguuuaugucuguu

SEQ ID NO: 51442 - RNA, 22 nt, Homo sapiens
gugccuagugcuauugugcccu

SEQ ID NO: 51443 - RNA, 22 nt, Homo sapiens
gugcuauguuauccagcaagau

SEQ ID NO: 51444 - RNA, 22 nt, Homo sapiens
gugggauggaaaugggcuucag

SEQ ID NO: 51445 - RNA, 22 nt, Homo sapiens
gugguuuuaucccagaaauuaa

SEQ ID NO: 51446 - RNA, 22 nt, Homo sapiens
guuaaagacauccacauaggag

SEQ ID NO: 51447 - RNA, 22 nt, Homo sapiens
guuacagucuuguguaagguua

SEQ ID NO: 51448 - RNA, 22 nt, Homo sapiens
guuaugcagcaauugauaaucu

SEQ ID NO: 51449 - RNA, 22 nt, Homo sapiens
guuggcuguuucccccaaguga

SEQ ID NO: 51450 - RNA, 22 nt, Homo sapiens
guuguggcuugugauuaagcac

SEQ ID NO: 51451 - RNA, 22 nt, Homo sapiens
guuugccuuuuagauaggaaug

SEQ ID NO: 51452 - RNA, 22 nt, Homo sapiens
uaaaugcuuaauugaaugugga

SEQ ID NO: 51453 - RNA, 22 nt, Homo sapiens
uaagaugaaggcucaccuagaa

SEQ ID NO: 51454 - RNA, 22 nt, Homo sapiens
uacagaguauccauuugaguuc

SEQ ID NO: 51455 - RNA, 22 nt, Homo sapiens
uacauugucauauucucucucu

SEQ ID NO: 51456 - RNA, 22 nt, Homo sapiens
uacucaauugcagucaccuggc

SEQ ID NO: 51457 - RNA, 22 nt, Homo sapiens
uagagguauguauaguauucuu

SEQ ID NO: 51458 - RNA, 22 nt, Homo sapiens
uaggacacagaccuggauggaa

SEQ ID NO: 51459 - RNA, 22 nt, Homo sapiens
uaggcaguguucucacuuguaa

SEQ ID NO: 51460 - RNA, 22 nt, Homo sapiens
uaggcuguguggccguggggcu

SEQ ID NO: 51461 - RNA, 22 nt, Homo sapiens
uagggagugucuucauuuugua

SEQ ID NO: 51462 - RNA, 19 nt, Homo sapiens
uagggcacgaggcagaguc

SEQ ID NO: 51463 - RNA, 22 nt, Homo sapiens
uagguagcuuuggcguuucuug

SEQ ID NO: 51464 - RNA, 22 nt, Homo sapiens
uaucacaaacuuagcaguuuaa

SEQ ID NO: 51465 - RNA, 22 nt, Homo sapiens
uaucuacauguagguauguaug

SEQ ID NO: 51466 - RNA, 22 nt, Homo sapiens
uauugucaccaucccuguuuua

SEQ ID NO: 51467 - RNA, 22 nt, Homo sapiens
ucaaaugcacguagagaaaaua

SEQ ID NO: 51468 - RNA, 22 nt, Homo sapiens
ucaaauguuuguuuaaggcuua

SEQ ID NO: 51469 - RNA, 22 nt, Homo sapiens
ucaacacaguuaaauggggaaa

SEQ ID NO: 51470 - RNA, 22 nt, Homo sapiens
ucacaugcacaucucuggaacc

SEQ ID NO: 51471 - RNA, 22 nt, Homo sapiens
ucacugagcacaggagaugugc

SEQ ID NO: 51472 - RNA, 21 nt, Homo sapiens
ucacugagguuaaauaggguu

SEQ ID NO: 51473 - RNA, 22 nt, Homo sapiens
ucagagcaaagacacuuuauca

SEQ ID NO: 51474 - RNA, 22 nt, Homo sapiens
ucagagugcagggaguagcagc

SEQ ID NO: 51475 - RNA, 22 nt, Homo sapiens
ucugugcauuuucuuuuagacu

SEQ ID NO: 51476 - RNA, 22 nt, Homo sapiens
ugaauagacagucacugccucc

SEQ ID NO: 51477 - RNA, 22 nt, Homo sapiens
ugaauguuguugguugagauau

SEQ ID NO: 51478 - RNA, 23 nt, Homo sapiens
ugacaaccucaugcuuugucaug

SEQ ID NO: 51479 - RNA, 22 nt, Homo sapiens
ugacaacugauuaacuccuuua

SEQ ID NO: 51480 - RNA, 22 nt, Homo sapiens
ugacagcugaagauguugaacc

SEQ ID NO: 51481 - RNA, 22 nt, Homo sapiens
ugacagcugaggcccagaguac

SEQ ID NO: 51482 - RNA, 22 nt, Homo sapiens
ugacaguaucuacagcuucuua

SEQ ID NO: 51483 - RNA, 22 nt, Homo sapiens
ugagaacuaaaaugugguauau

SEQ ID NO: 51484 - RNA, 22 nt, Homo sapiens
ugagacugaaauuaggaaacug

SEQ ID NO: 51485 - RNA, 22 nt, Homo sapiens
ugagacugagucucccucuguc

SEQ ID NO: 51486 - RNA, 22 nt, Homo sapiens
ugagacugagucucgcucuauu

SEQ ID NO: 51487 - RNA, 22 nt, Homo sapiens
ugagacugagucuugcucuugu

SEQ ID NO: 51488 - RNA, 22 nt, Homo sapiens
ugagacugaguuucgcucuugu

SEQ ID NO: 51489 - RNA, 22 nt, Homo sapiens
ugagacugaguuuugccuuugu

SEQ ID NO: 51490 - RNA, 22 nt, Homo sapiens
ugagacugaguuuugcucguug

SEQ ID NO: 51491 - RNA, 22 nt, Homo sapiens
ugagacugaguuuugcucuugu

SEQ ID NO: 51492 - RNA, 22 nt, Homo sapiens
ugagaugaaagcagaaagacuu

SEQ ID NO: 51493 - RNA, 22 nt, Homo sapiens
ugagaugagucucgcucuguca

SEQ ID NO: 51494 - RNA, 22 nt, Homo sapiens
ugagaugaugggauaagagggc

SEQ ID NO: 51495 - RNA, 22 nt, Homo sapiens
ugagugaggcugggcagucccu

SEQ ID NO: 51496 - RNA, 22 nt, Homo sapiens
ugaguuagguguuuuaaauaua

SEQ ID NO: 51497 - RNA, 22 nt, Homo sapiens
ugaugucuugcaggcacgagau

SEQ ID NO: 51498 - RNA, 20 nt, Homo sapiens
ugauuaguccacuuggcucu

SEQ ID NO: 51499 - RNA, 22 nt, Homo sapiens
ugcaagacuaaaccuuccccuc

SEQ ID NO: 51500 - RNA, 22 nt, Homo sapiens
ugcaauauccucuacuauaggu

SEQ ID NO: 51501 - RNA, 22 nt, Homo sapiens
ugcacaguccagugcccacuga

SEQ ID NO: 51502 - RNA, 23 nt, Homo sapiens
ugcaccacuacacacucuugggu

SEQ ID NO: 51503 - RNA, 22 nt, Homo sapiens
ugcaccacugcacuccaggcug

SEQ ID NO: 51504 - RNA, 21 nt, Homo sapiens
ugcagccauucagcccuaugc

SEQ ID NO: 51505 - RNA, 22 nt, Homo sapiens
ugcaguacauucagcauccucu

SEQ ID NO: 51506 - RNA, 22 nt, Homo sapiens
ugcaguacugucagacuucuua

SEQ ID NO: 51507 - RNA, 20 nt, Homo sapiens
ugcauguccucacuuacuug

SEQ ID NO: 51508 - RNA, 22 nt, Homo sapiens
ugcauguucuuacucauacaug

SEQ ID NO: 51509 - RNA, 22 nt, Homo sapiens
ugcauuguuccgaauguguccu

SEQ ID NO: 51510 - RNA, 22 nt, Homo sapiens
ugcauuguuuuugguucccagg

SEQ ID NO: 51511 - RNA, 22 nt, Homo sapiens
ugccugagccagguuuuaggag

SEQ ID NO: 51512 - RNA, 21 nt, Homo sapiens
ugcuauguuguccaggcuggc

SEQ ID NO: 51513 - RNA, 22 nt, Homo sapiens
ugcugcacuuauggcucugagg

SEQ ID NO: 51514 - RNA, 22 nt, Homo sapiens
uggaagacucuagucucuugag

SEQ ID NO: 51515 - RNA, 22 nt, Homo sapiens
uggaagcauagcagcgugugug

SEQ ID NO: 51516 - RNA, 22 nt, Homo sapiens
ucagaguggagucugcagccuu

SEQ ID NO: 51517 - RNA, 22 nt, Homo sapiens
ucagcacauucaaggccugccu

SEQ ID NO: 51518 - RNA, 22 nt, Homo sapiens
ucagcagugccccacucuacug

SEQ ID NO: 51519 - RNA, 22 nt, Homo sapiens
ucagcaucacaggcagugagug

SEQ ID NO: 51520 - RNA, 22 nt, Homo sapiens
ucaggugcaguggcucaugcuu

SEQ ID NO: 51521 - RNA, 22 nt, Homo sapiens
ucaucucaguuucuugccguac

SEQ ID NO: 51522 - RNA, 22 nt, Homo sapiens
ucauggcuuuuauuauguugag

SEQ ID NO: 51523 - RNA, 22 nt, Homo sapiens
uccaguguuauaauaugcgucu

SEQ ID NO: 51524 - RNA, 22 nt, Homo sapiens
uccaugagaauaguuaggcucu

SEQ ID NO: 51525 - RNA, 22 nt, Homo sapiens
uccccugagaacuugcuagaaa

SEQ ID NO: 51526 - RNA, 20 nt, Homo sapiens
ucccuaagagccuuuccuuc

SEQ ID NO: 51527 - RNA, 22 nt, Homo sapiens
ucccuagacuccugccuuucag

SEQ ID NO: 51528 - RNA, 22 nt, Homo sapiens
ucccugaaaauuagcauuuuaa

SEQ ID NO: 51529 - RNA, 22 nt, Homo sapiens
ucccugagcaaaguuuucugua

SEQ ID NO: 51530 - RNA, 22 nt, Homo sapiens
uccuugagaggacagagccaua

SEQ ID NO: 51531 - RNA, 22 nt, Homo sapiens
uccuugagccucccagacucag

SEQ ID NO: 51532 - RNA, 22 nt, Homo sapiens
uccuugagucuuugcucagaug

SEQ ID NO: 51533 - RNA, 22 nt, Homo sapiens
ucucaagaugguagaugggaau

SEQ ID NO: 51534 - RNA, 22 nt, Homo sapiens
ucucaguggcacccccaacacc

SEQ ID NO: 51535 - RNA, 22 nt, Homo sapiens
ucucauggagucaggagcagaa

SEQ ID NO: 51536 - RNA, 22 nt, Homo sapiens
ucucauggcucacccugcauag

SEQ ID NO: 51537 - RNA, 23 nt, Homo sapiens
ucucauuccuugaaaauaaugac

SEQ ID NO: 51538 - RNA, 22 nt, Homo sapiens
ucucccauccguacacggauug

SEQ ID NO: 51539 - RNA, 19 nt, Homo sapiens
ucugacagccccagucaac

SEQ ID NO: 51540 - RNA, 22 nt, Homo sapiens
ucuuagugcggcugcugcagcc

SEQ ID NO: 51541 - RNA, 22 nt, Homo sapiens
ucuuuagugacaguugugcaag

SEQ ID NO: 51542 - RNA, 22 nt, Homo sapiens
ucuuuuugagucaguuucggua

SEQ ID NO: 51543 - RNA, 22 nt, Homo sapiens
ugaaggacauaaggcagaguga

SEQ ID NO: 51544 - RNA, 22 nt, Homo sapiens
ugaagugaagacucacagaagg

SEQ ID NO: 51545 - RNA, 22 nt, Homo sapiens
ugacaguguccuccuccugaga

SEQ ID NO: 51546 - RNA, 22 nt, Homo sapiens
ugagacaugugaacuguaguuc

SEQ ID NO: 51547 - RNA, 22 nt, Homo sapiens
ugagauguugcucugaaacaag

SEQ ID NO: 51548 - RNA, 22 nt, Homo sapiens
ugaggcaaggcugaaugaaggc

SEQ ID NO: 51549 - RNA, 22 nt, Homo sapiens
ugagguugguauuacugucucu

SEQ ID NO: 51550 - RNA, 22 nt, Homo sapiens
ugagucuguuccaaagaaauaa

SEQ ID NO: 51551 - RNA, 22 nt, Homo sapiens
ugagugaaugugaaggcuaggg

SEQ ID NO: 51552 - RNA, 22 nt, Homo sapiens
ugcaaagucgaaacugcaguuu

SEQ ID NO: 51553 - RNA, 22 nt, Homo sapiens
ugcaaauguuaguaacaccacu

SEQ ID NO: 51554 - RNA, 22 nt, Homo sapiens
ugcaccacuacacuccaggcug

SEQ ID NO: 51555 - RNA, 22 nt, Homo sapiens
ugcaccacugcacugccugggu

SEQ ID NO: 51556 - RNA, 22 nt, Homo sapiens
ugcagagaaacauuuuguauuu

SEQ ID NO: 51557 - RNA, 22 nt, Homo sapiens
ugcagugcaugacuguguuaug

SEQ ID NO: 51558 - RNA, 22 nt, Homo sapiens
ugcauuaucagauguuugcuuu

SEQ ID NO: 51559 - RNA, 21 nt, Homo sapiens
ugcauuguugcugagagcagg

SEQ ID NO: 51560 - RNA, 22 nt, Homo sapiens
ugccaacaugccuggcuguuuu

SEQ ID NO: 51561 - RNA, 22 nt, Homo sapiens
ugccuacugguuguucugggca

SEQ ID NO: 51562 - RNA, 22 nt, Homo sapiens
ugccugagcccagcccuguagu

SEQ ID NO: 51563 - RNA, 22 nt, Homo sapiens
ugcuuagucuugcuuuagcuau

SEQ ID NO: 51564 - RNA, 22 nt, Homo sapiens
uggacagacaagguuauagauc

SEQ ID NO: 51565 - RNA, 21 nt, Homo sapiens
uggaccccuacuucucaccau

SEQ ID NO: 51566 - RNA, 21 nt, Homo sapiens
uggaccccuuccuuacaucau

SEQ ID NO: 51567 - RNA, 22 nt, Homo sapiens
uggagacugaucccucuuuccu

SEQ ID NO: 51568 - RNA, 23 nt, Homo sapiens
uggaggacaagcauggauaguga

SEQ ID NO: 51569 - RNA, 22 nt, Homo sapiens
uggucuccuuuguacccugggc

SEQ ID NO: 51570 - RNA, 22 nt, Homo sapiens
uguagacaccaaagacagcaua

SEQ ID NO: 51571 - RNA, 22 nt, Homo sapiens
uguauuuguuguuaaauggaga

SEQ ID NO: 51572 - RNA, 22 nt, Homo sapiens
ugucaggaguuuuagaaucuua

SEQ ID NO: 51573 - RNA, 22 nt, Homo sapiens
ugucauggucacaggcauuuca

SEQ ID NO: 51574 - RNA, 19 nt, Homo sapiens
ugugaagaaaugcugcaag

SEQ ID NO: 51575 - RNA, 22 nt, Homo sapiens
ugugaagauggacuaauauagu

SEQ ID NO: 51576 - RNA, 22 nt, Homo sapiens
ugugacaaauuuaguggacugu

SEQ ID NO: 51577 - RNA, 18 nt, Homo sapiens
ugugcaauauuaaccacc

SEQ ID NO: 51578 - RNA, 22 nt, Homo sapiens
ugugcacaaccugcagguuugu

SEQ ID NO: 51579 - RNA, 22 nt, Homo sapiens
ugugcacaaugugcagguuugu

SEQ ID NO: 51580 - RNA, 22 nt, Homo sapiens
ugugcaccucuucacacaggga

SEQ ID NO: 51581 - RNA, 22 nt, Homo sapiens
uguguuugauaaguccauaguu

SEQ ID NO: 51582 - RNA, 22 nt, Homo sapiens
uguuaagaugucaauuuuccac

SEQ ID NO: 51583 - RNA, 22 nt, Homo sapiens
uguuauuuuguguuagggcaca

SEQ ID NO: 51584 - RNA, 22 nt, Homo sapiens
uuaaauacagcaugguguuucu

SEQ ID NO: 51585 - RNA, 22 nt, Homo sapiens
uuaaaugcacauacuugagaaa

SEQ ID NO: 51586 - RNA, 22 nt, Homo sapiens
uuaaaugcucacauaaagguag

SEQ ID NO: 51587 - RNA, 22 nt, Homo sapiens
uuaagaagugauuuuccucauu

SEQ ID NO: 51588 - RNA, 22 nt, Homo sapiens
uuacaguggugaccuuguauug

SEQ ID NO: 51589 - RNA, 22 nt, Homo sapiens
uuacagugguugcuauugugaa

SEQ ID NO: 51590 - RNA, 22 nt, Homo sapiens
uuaguaguagcugcaugucagu

SEQ ID NO: 51591 - RNA, 22 nt, Homo sapiens
uuaguaguagugcuguaauuuu

SEQ ID NO: 51592 - RNA, 22 nt, Homo sapiens
uuaguaguugugauagguaccu

SEQ ID NO: 51593 - RNA, 22 nt, Homo sapiens
uuaucauagugcaguuuucuga

SEQ ID NO: 51594 - RNA, 22 nt, Homo sapiens
uuaugguuuuucugugagaugg

SEQ ID NO: 51595 - RNA, 20 nt, Homo sapiens
uucacaggcagcuucuuucu

SEQ ID NO: 51596 - RNA, 22 nt, Homo sapiens
uucacaguggugggagacguca

SEQ ID NO: 51597 - RNA, 22 nt, Homo sapiens
uucacaguguuucucacgguua

SEQ ID NO: 51598 - RNA, 22 nt, Homo sapiens
uucaccuggaguucaggauaag

SEQ ID NO: 51599 - RNA, 22 nt, Homo sapiens
uucagagagggagggauaccua

SEQ ID NO: 51600 - RNA, 22 nt, Homo sapiens
uucagcacugaaaauaugucau

SEQ ID NO: 51601 - RNA, 22 nt, Homo sapiens
uucagcuaccugggaugcugaa

SEQ ID NO: 51602 - RNA, 22 nt, Homo sapiens
uucccagagagggacuucuaau

SEQ ID NO: 51603 - RNA, 22 nt, Homo sapiens
uucccagagccugggagugagg

SEQ ID NO: 51604 - RNA, 22 nt, Homo sapiens
uucccugaaguguuacucuaga

SEQ ID NO: 51605 - RNA, 19 nt, Homo sapiens
uuccugagaacaagggcuu

SEQ ID NO: 51606 - RNA, 22 nt, Homo sapiens
acccagaguuccuugucuuuca

SEQ ID NO: 51607 - RNA, 22 nt, Homo sapiens
acccugucaaaauagaccaauc

SEQ ID NO: 51608 - RNA, 22 nt, Homo sapiens
acccugucagcuggccugggca

SEQ ID NO: 51609 - RNA, 22 nt, Homo sapiens
acccugucauccacauggugcu

SEQ ID NO: 51610 - RNA, 22 nt, Homo sapiens
acccuuagguuaaaguugaguc

SEQ ID NO: 51611 - RNA, 22 nt, Homo sapiens
acuauacugaagcaaauuaaca

SEQ ID NO: 51612 - RNA, 22 nt, Homo sapiens
acucagagauuagcacauguuu

SEQ ID NO: 51613 - RNA, 22 nt, Homo sapiens
acugagccuuuaaaugacuuca

SEQ ID NO: 51614 - RNA, 22 nt, Homo sapiens
acugcacuccagcuugggugac

SEQ ID NO: 51615 - RNA, 22 nt, Homo sapiens
agacaguauuggcaaagugugu

SEQ ID NO: 51616 - RNA, 22 nt, Homo sapiens
agagaucacugaaucacggggg

SEQ ID NO: 51617 - RNA, 22 nt, Homo sapiens
agaugcuguuaucaacuguagc

SEQ ID NO: 51618 - RNA, 22 nt, Homo sapiens
agcaauaugacauugcuacauc

SEQ ID NO: 51619 - RNA, 22 nt, Homo sapiens
agcaccaccguugcucuauccc

SEQ ID NO: 51620 - RNA, 22 nt, Homo sapiens
agcagguguccacaauguuugc

SEQ ID NO: 51621 - RNA, 22 nt, Homo sapiens
agcuauauugaggaugccauuc

SEQ ID NO: 51622 - RNA, 22 nt, Homo sapiens
agcuggauguauguuaagugaa

SEQ ID NO: 51623 - RNA, 22 nt, Homo sapiens
agcuggucucaggugcccugcu

SEQ ID NO: 51624 - RNA, 22 nt, Homo sapiens
agcuguuguucucagaggcuuu

SEQ ID NO: 51625 - RNA, 22 nt, Homo sapiens
aggacacugauagucuuuggca

SEQ ID NO: 51626 - RNA, 22 nt, Homo sapiens
aggcuuuuggagaacacugcac

SEQ ID NO: 51627 - RNA, 22 nt, Homo sapiens
aggugcugagcagagaauccug

SEQ ID NO: 51628 - RNA, 22 nt, Homo sapiens
agucaguguguauugauggcac

SEQ ID NO: 51629 - RNA, 22 nt, Homo sapiens
agugguuugaucacagcucacu

SEQ ID NO: 51630 - RNA, 22 nt, Homo sapiens
auagacacugaaaucccugcca

SEQ ID NO: 51631 - RNA, 22 nt, Homo sapiens
auagaucauugucauuuuagau

SEQ ID NO: 51632 - RNA, 22 nt, Homo sapiens
auauaccuaggcuacaugguuu

SEQ ID NO: 51633 - RNA, 22 nt, Homo sapiens
auaucacaaacaagucuguacu

SEQ ID NO: 51634 - RNA, 22 nt, Homo sapiens
auaugcaaauccauagagacag

SEQ ID NO: 51635 - RNA, 22 nt, Homo sapiens
auaugguuuuuggaagcauauc

SEQ ID NO: 51636 - RNA, 22 nt, Homo sapiens
aucacagugaaaacagucaauu

SEQ ID NO: 51637 - RNA, 22 nt, Homo sapiens
aucacaguuuuaccauuuggua

SEQ ID NO: 51638 - RNA, 22 nt, Homo sapiens
aucagcacugaucauacagcuu

SEQ ID NO: 51639 - RNA, 22 nt, Homo sapiens
aucauauccuagauauaacuuc

SEQ ID NO: 51640 - RNA, 22 nt, Homo sapiens
aucuuuaguggcuguuuucaga

SEQ ID NO: 51641 - RNA, 22 nt, Homo sapiens
augagguaauaaguccuuggaa

SEQ ID NO: 51642 - RNA, 22 nt, Homo sapiens
augaggugauaucuggaaauua

SEQ ID NO: 51643 - RNA, 22 nt, Homo sapiens
augaggugggcggcuuggaaga

SEQ ID NO: 51644 - RNA, 22 nt, Homo sapiens
augagguguuuauuguauccug

SEQ ID NO: 51645 - RNA, 22 nt, Homo sapiens
auggcacuccagccugggcaac

SEQ ID NO: 51646 - RNA, 22 nt, Homo sapiens
auggcucaguguguaucuauca

SEQ ID NO: 51647 - RNA, 22 nt, Homo sapiens
auggcuguuccugggaguucua

SEQ ID NO: 51648 - RNA, 22 nt, Homo sapiens
augugcacaugcuuacauguga

SEQ ID NO: 51649 - RNA, 22 nt, Homo sapiens
augugugcuugugacacagccu

SEQ ID NO: 51650 - RNA, 22 nt, Homo sapiens
auuacauagucaaggugucuca

SEQ ID NO: 51651 - RNA, 22 nt, Homo sapiens
auugcacuccagccuggcaaua

SEQ ID NO: 51652 - RNA, 22 nt, Homo sapiens
auugucacuuaaaagugcaugu

SEQ ID NO: 51653 - RNA, 22 nt, Homo sapiens
cacaaaguagauuagucuucca

SEQ ID NO: 51654 - RNA, 21 nt, Homo sapiens
cacauggaggcagagagugua

SEQ ID NO: 51655 - RNA, 22 nt, Homo sapiens
cuuacagucuaucagccacaac

SEQ ID NO: 51656 - RNA, 22 nt, Homo sapiens
cuucacuggagucccuggauuc

SEQ ID NO: 51657 - RNA, 22 nt, Homo sapiens
cuuccugaguccugggcucaca

SEQ ID NO: 51658 - RNA, 22 nt, Homo sapiens
cuuggcuuguuguccccugcuc

SEQ ID NO: 51659 - RNA, 22 nt, Homo sapiens
cuuuacaguuggacucacgagg

SEQ ID NO: 51660 - RNA, 22 nt, Homo sapiens
cuuuggucaauugcugugggga

SEQ ID NO: 51661 - RNA, 22 nt, Homo sapiens
cuuuguguggacauuucaggca

SEQ ID NO: 51662 - RNA, 23 nt, Homo sapiens
cuuuugcaaugugaucuugccac

SEQ ID NO: 51663 - RNA, 22 nt, Homo sapiens
cuuuuguggaucuucuguugcu

SEQ ID NO: 51664 - RNA, 19 nt, Homo sapiens
gaaguguuguccuccagua

SEQ ID NO: 51665 - RNA, 22 nt, Homo sapiens
gacacagugaagucucuacuug

SEQ ID NO: 51666 - RNA, 22 nt, Homo sapiens
gacccuguugggguuuagggcu

SEQ ID NO: 51667 - RNA, 19 nt, Homo sapiens
gacuccagaguugugugcu

SEQ ID NO: 51668 - RNA, 16 nt, Homo sapiens
gacugggcugaggaau

SEQ ID NO: 51669 - RNA, 22 nt, Homo sapiens
gacuuugguagaggaaaaaucu

SEQ ID NO: 51670 - RNA, 22 nt, Homo sapiens
gagaacuggcgugaacugcacg

SEQ ID NO: 51671 - RNA, 22 nt, Homo sapiens
gagaaugaacagacugccucuu

SEQ ID NO: 51672 - RNA, 22 nt, Homo sapiens
gagagaguacuugauauaauuu

SEQ ID NO: 51673 - RNA, 22 nt, Homo sapiens
gagagugcuuggcaucugcuga

SEQ ID NO: 51674 - RNA, 21 nt, Homo sapiens
gagauagguaccgaagcuuag

SEQ ID NO: 51675 - RNA, 22 nt, Homo sapiens
gagugcugagcccacuuccuug

SEQ ID NO: 51676 - RNA, 22 nt, Homo sapiens
gaguuuguaaacuauucacuaa

SEQ ID NO: 51677 - RNA, 22 nt, Homo sapiens
gaucucaguggauacugugaug

SEQ ID NO: 51678 - RNA, 22 nt, Homo sapiens
gcacgugcucauuugaggucuu

SEQ ID NO: 51679 - RNA, 22 nt, Homo sapiens
gccauugcacuccagccuaggc

SEQ ID NO: 51680 - RNA, 22 nt, Homo sapiens
gccauugcacuccagccuaggu

SEQ ID NO: 51681 - RNA, 22 nt, Homo sapiens
gcccugagauucuuggauucug

SEQ ID NO: 51682 - RNA, 22 nt, Homo sapiens
gcugcguguagaguucucacug

SEQ ID NO: 51683 - RNA, 22 nt, Homo sapiens
gcuggguugccagguuacuuaa

SEQ ID NO: 51684 - RNA, 22 nt, Homo sapiens
ggaaauguuuagcauccacuuu

SEQ ID NO: 51685 - RNA, 22 nt, Homo sapiens
ggaagacuuagaguagcaucag

SEQ ID NO: 51686 - RNA, 17 nt, Homo sapiens
ggcaggauccaggaucc

SEQ ID NO: 51687 - RNA, 22 nt, Homo sapiens
gguaggcacuggugggaagaga

SEQ ID NO: 51688 - RNA, 23 nt, Homo sapiens
ggugaggaguacagagucuucau

SEQ ID NO: 51689 - RNA, 22 nt, Homo sapiens
guaacuggccuucaauuucuuc

SEQ ID NO: 51690 - RNA, 22 nt, Homo sapiens
gucacugccugaggcugaugca

SEQ ID NO: 51691 - RNA, 22 nt, Homo sapiens
gucuggcuuaucucacuuacca

SEQ ID NO: 51692 - RNA, 22 nt, Homo sapiens
gucuuuguuauuaugaaucaac

SEQ ID NO: 51693 - RNA, 22 nt, Homo sapiens
gugaaagacagcauuaauggcu

SEQ ID NO: 51694 - RNA, 22 nt, Homo sapiens
gugaaagacauauaugguuuga

SEQ ID NO: 51695 - RNA, 22 nt, Homo sapiens
gugaaguuuuuugcugagaguc

SEQ ID NO: 51696 - RNA, 22 nt, Homo sapiens
gugagaggaggcagcuuuuaca

SEQ ID NO: 51697 - RNA, 22 nt, Homo sapiens
gugagcaauugauacuugaagu

SEQ ID NO: 51698 - RNA, 20 nt, Homo sapiens
gugagguagaggguuaccug

SEQ ID NO: 51699 - RNA, 22 nt, Homo sapiens
gugaggucguagucauaggcaa

SEQ ID NO: 51700 - RNA, 22 nt, Homo sapiens
gugaucuuucaggcuugaccau

SEQ ID NO: 51701 - RNA, 22 nt, Homo sapiens
gugcaaugagaaggggcucugg

SEQ ID NO: 51702 - RNA, 22 nt, Homo sapiens
gugcacaaucgugcauuccuug

SEQ ID NO: 51703 - RNA, 22 nt, Homo sapiens
gugcuuuguuguggcaguggca

SEQ ID NO: 51704 - RNA, 22 nt, Homo sapiens
guggaaaacauaugcuuguuga

SEQ ID NO: 51705 - RNA, 20 nt, Homo sapiens
guguaagagcaagcuuccua

SEQ ID NO: 51706 - RNA, 20 nt, Homo sapiens
guucccuguaggugugcgga

SEQ ID NO: 51707 - RNA, 22 nt, Homo sapiens
uaaauugcauaaguacaaauga

SEQ ID NO: 51708 - RNA, 22 nt, Homo sapiens
cuaggcuuuucuuggauccagg

SEQ ID NO: 51709 - RNA, 22 nt, Homo sapiens
cuauggauuuacuguauagggu

SEQ ID NO: 51710 - RNA, 22 nt, Homo sapiens
cucacagugacacgaaccccca

SEQ ID NO: 51711 - RNA, 22 nt, Homo sapiens
cucacaugcucaccugguguuc

SEQ ID NO: 51712 - RNA, 22 nt, Homo sapiens
cuccacugagcaggugggaggc

SEQ ID NO: 51713 - RNA, 22 nt, Homo sapiens
cuccaugagauuguugaaguag

SEQ ID NO: 51714 - RNA, 23 nt, Homo sapiens
cuccaugagccguccagggccug

SEQ ID NO: 51715 - RNA, 22 nt, Homo sapiens
cucccagagccaguuauaggcu

SEQ ID NO: 51716 - RNA, 20 nt, Homo sapiens
cucccugacaaauguggaaa

SEQ ID NO: 51717 - RNA, 22 nt, Homo sapiens
cucuuuaguaagcaguugauga

SEQ ID NO: 51718 - RNA, 22 nt, Homo sapiens
cugaaagagcauuugaaugggu

SEQ ID NO: 51719 - RNA, 22 nt, Homo sapiens
cugacagaugacugccacugua

SEQ ID NO: 51720 - RNA, 22 nt, Homo sapiens
cugagcacugagauccucuagc

SEQ ID NO: 51721 - RNA, 22 nt, Homo sapiens
cugagugcaagugauccuccca

SEQ ID NO: 51722 - RNA, 22 nt, Homo sapiens
cugccugagaaaauggagggca

SEQ ID NO: 51723 - RNA, 22 nt, Homo sapiens
cuggauauguugcaacauuucc

SEQ ID NO: 51724 - RNA, 22 nt, Homo sapiens
cuggcucauuucauuuagcaua

SEQ ID NO: 51725 - RNA, 22 nt, Homo sapiens
cuguaauguaaugagacuacau

SEQ ID NO: 51726 - RNA, 22 nt, Homo sapiens
cugugcacaucuggcggcccga

SEQ ID NO: 51727 - RNA, 22 nt, Homo sapiens
cuguuugguaaggaugccucag

SEQ ID NO: 51728 - RNA, 18 nt, Homo sapiens
aaacagugucucuuucug

SEQ ID NO: 51729 - RNA, 22 nt, Homo sapiens
aaagugcugggaucacacugaa

SEQ ID NO: 51730 - RNA, 22 nt, Homo sapiens
aagcaucacauaauggaucaug

SEQ ID NO: 51731 - RNA, 22 nt, Homo sapiens
aaggcaagauacugguugcuga

SEQ ID NO: 51732 - RNA, 22 nt, Homo sapiens
aagugaccuaacaaugaaggcc

SEQ ID NO: 51733 - RNA, 22 nt, Homo sapiens
aagugagugacaaaaacugggc

SEQ ID NO: 51734 - RNA, 22 nt, Homo sapiens
aagugcuguaugggagccuagg

SEQ ID NO: 51735 - RNA, 22 nt, Homo sapiens
aaucacaggucuuggcugcaug

SEQ ID NO: 51736 - RNA, 22 nt, Homo sapiens
aaucacaguguucuugugaggg

SEQ ID NO: 51737 - RNA, 21 nt, Homo sapiens
aaucacaguuguucugccuuc

SEQ ID NO: 51738 - RNA, 22 nt, Homo sapiens
aauggcacuuuauaaauguuaa

SEQ ID NO: 51739 - RNA, 22 nt, Homo sapiens
acaaaguauggaauguuggugu

SEQ ID NO: 51740 - RNA, 22 nt, Homo sapiens
acaccauugcauuccagccugg

SEQ ID NO: 51741 - RNA, 21 nt, Homo sapiens
acaguaguaauaguguagcca

SEQ ID NO: 51742 - RNA, 18 nt, Homo sapiens
acagugcuggcaugagau

SEQ ID NO: 51743 - RNA, 22 nt, Homo sapiens
acagugcuguggucaugggucu

SEQ ID NO: 51744 - RNA, 22 nt, Homo sapiens
acauaguagacacugaaaauau

SEQ ID NO: 51745 - RNA, 22 nt, Homo sapiens
acccggagagcaggcgagaagg

SEQ ID NO: 51746 - RNA, 22 nt, Homo sapiens
acccuggaguaguaggaaucug

SEQ ID NO: 51747 - RNA, 22 nt, Homo sapiens
acccugguagcuaugaagucuu

SEQ ID NO: 51748 - RNA, 22 nt, Homo sapiens
acccugucaaaauggaccaauc

SEQ ID NO: 51749 - RNA, 22 nt, Homo sapiens
acucagagaacauucccagucu

SEQ ID NO: 51750 - RNA, 22 nt, Homo sapiens
acucagagagaacugucauuug

SEQ ID NO: 51751 - RNA, 22 nt, Homo sapiens
acucauugcucauaccuuaucu

SEQ ID NO: 51752 - RNA, 18 nt, Homo sapiens
acucuguauguggagugg

SEQ ID NO: 51753 - RNA, 22 nt, Homo sapiens
acugagacugagaauguuucuu

SEQ ID NO: 51754 - RNA, 22 nt, Homo sapiens
acugcacuccagccucggggac

SEQ ID NO: 51755 - RNA, 22 nt, Homo sapiens
acugcacuccagccucguggac

SEQ ID NO: 51756 - RNA, 22 nt, Homo sapiens
acugcacucuagcuugggugac

SEQ ID NO: 51757 - RNA, 21 nt, Homo sapiens
acuggaccccuuccauacacc

SEQ ID NO: 51758 - RNA, 20 nt, Homo sapiens
acugggcuaccgaaguaagg

SEQ ID NO: 51759 - RNA, 22 nt, Homo sapiens
acuucauucucuggaucagaau

SEQ ID NO: 51760 - RNA, 22 nt, Homo sapiens
agagguuuugcacugguucuuu

SEQ ID NO: 51761 - RNA, 22 nt, Homo sapiens
agagugcuuuauuagauguagc

SEQ ID NO: 51762 - RNA, 23 nt, Homo sapiens
agcaaaugcucuagcacuccaac

SEQ ID NO: 51763 - RNA, 22 nt, Homo sapiens
cuucaguucuguaaggacagca

SEQ ID NO: 51764 - RNA, 22 nt, Homo sapiens
cuuggcuccgacuccccuccaa

SEQ ID NO: 51765 - RNA, 22 nt, Homo sapiens
cuugucuugcacacgguugcca

SEQ ID NO: 51766 - RNA, 20 nt, Homo sapiens
gaaacaucuauccucuccuu

SEQ ID NO: 51767 - RNA, 22 nt, Homo sapiens
gaaggcaugcugcauggccaga

SEQ ID NO: 51768 - RNA, 22 nt, Homo sapiens
gaaugcaugaggggaucagaug

SEQ ID NO: 51769 - RNA, 20 nt, Homo sapiens
gaaugguuucgggguucuug

SEQ ID NO: 51770 - RNA, 22 nt, Homo sapiens
gaauuguacugcaaucagggga

SEQ ID NO: 51771 - RNA, 22 nt, Homo sapiens
gacugaggaagcgcucucuccu

SEQ ID NO: 51772 - RNA, 22 nt, Homo sapiens
gagagugcuuuggguguaggcc

SEQ ID NO: 51773 - RNA, 22 nt, Homo sapiens
gaggcaguguguccguucucgg

SEQ ID NO: 51774 - RNA, 22 nt, Homo sapiens
gagguguagucaugccaagauc

SEQ ID NO: 51775 - RNA, 22 nt, Homo sapiens
gagugcaauggcaagaucuugg

SEQ ID NO: 51776 - RNA, 22 nt, Homo sapiens
gagugcaauggcaugaucuugg

SEQ ID NO: 51777 - RNA, 22 nt, Homo sapiens
gagugcuguuagcccuggguuu

SEQ ID NO: 51778 - RNA, 19 nt, Homo sapiens
gauagacaucacagugcca

SEQ ID NO: 51779 - RNA, 22 nt, Homo sapiens
gaugagguaggccugcuuugaa

SEQ ID NO: 51780 - RNA, 22 nt, Homo sapiens
gauggcagugcagccccuggcu

SEQ ID NO: 51781 - RNA, 22 nt, Homo sapiens
gcaaaugcuacaccauuuugua

SEQ ID NO: 51782 - RNA, 22 nt, Homo sapiens
gcacauggccccaucgugccga

SEQ ID NO: 51783 - RNA, 22 nt, Homo sapiens
gcacugagagaagccccaagua

SEQ ID NO: 51784 - RNA, 22 nt, Homo sapiens
gcagcacauggcagaacauauu

SEQ ID NO: 51785 - RNA, 20 nt, Homo sapiens
gccacaguuaagcuucugcc

SEQ ID NO: 51786 - RNA, 22 nt, Homo sapiens
gccauugcacuccagccuagcg

SEQ ID NO: 51787 - RNA, 22 nt, Homo sapiens
gcucugguuacaaaggcaaauu

SEQ ID NO: 51788 - RNA, 22 nt, Homo sapiens
ggacaagaucuuccaccauuca

SEQ ID NO: 51789 - RNA, 22 nt, Homo sapiens
ggaucacagagcuugggaaagg

SEQ ID NO: 51790 - RNA, 22 nt, Homo sapiens
ggcaaggugcuacagacaguga

SEQ ID NO: 51791 - RNA, 22 nt, Homo sapiens
ggcaccauuuuacuccuucccu

SEQ ID NO: 51792 - RNA, 22 nt, Homo sapiens
ggugauguuugaguugagacag

SEQ ID NO: 51793 - RNA, 22 nt, Homo sapiens
guaaaucucuguuuucauggac

SEQ ID NO: 51794 - RNA, 22 nt, Homo sapiens
guacaggugcaggaugggcagg

SEQ ID NO: 51795 - RNA, 23 nt, Homo sapiens
guaguuugaugcaauccacuugu

SEQ ID NO: 51796 - RNA, 22 nt, Homo sapiens
guauaguaguacaaaaguuuuu

SEQ ID NO: 51797 - RNA, 22 nt, Homo sapiens
guauuugauuauagcaugcuua

SEQ ID NO: 51798 - RNA, 22 nt, Homo sapiens
gucacaguguuuguucauccca

SEQ ID NO: 51799 - RNA, 22 nt, Homo sapiens
gucagugauugauuuaaagacg

SEQ ID NO: 51800 - RNA, 22 nt, Homo sapiens
gucagugucuuugcagcucaga

SEQ ID NO: 51801 - RNA, 22 nt, Homo sapiens
guccaugagaugaauccacaca

SEQ ID NO: 51802 - RNA, 22 nt, Homo sapiens
gucgugcagaccucacagcauu

SEQ ID NO: 51803 - RNA, 22 nt, Homo sapiens
gugaaagauuaaaccagugugu

SEQ ID NO: 51804 - RNA, 22 nt, Homo sapiens
gugagcaaacuuaccuaagguu

SEQ ID NO: 51805 - RNA, 22 nt, Homo sapiens
gugagcacugaaagaaggcaag

SEQ ID NO: 51806 - RNA, 22 nt, Homo sapiens
gugaggcugguccugccuccca

SEQ ID NO: 51807 - RNA, 17 nt, Homo sapiens
gugagguggguaguauc

SEQ ID NO: 51808 - RNA, 22 nt, Homo sapiens
gugaggugguacaauauuaacu

SEQ ID NO: 51809 - RNA, 22 nt, Homo sapiens
gugagguguuaaccaaccugug

SEQ ID NO: 51810 - RNA, 22 nt, Homo sapiens
gugaucuucauggaaggugaaa

SEQ ID NO: 51811 - RNA, 22 nt, Homo sapiens
gugcauguccacuaguccauau

SEQ ID NO: 51812 - RNA, 22 nt, Homo sapiens
gugcuuguguuaauauguagcu

SEQ ID NO: 51813 - RNA, 22 nt, Homo sapiens
guggcuuuaaguacgauugagg

SEQ ID NO: 51814 - RNA, 22 nt, Homo sapiens
gugugcacaaucuggcaugugc

SEQ ID NO: 51815 - RNA, 22 nt, Homo sapiens
gugugucuugaccaggaucgga

SEQ ID NO: 51816 - RNA, 22 nt, Homo sapiens
guuaugcagcuuagaaaaugaa

SEQ ID NO: 51817 - RNA, 22 nt, Homo sapiens
guucacagugguugccuuccag

SEQ ID NO: 51818 - RNA, 22 nt, Homo sapiens
guuuggcuuucucucuauccug

SEQ ID NO: 51819 - RNA, 22 nt, Homo sapiens
uaaggcccauucuaugaagcag

SEQ ID NO: 51820 - RNA, 22 nt, Homo sapiens
uacaauagugacaaaucagcau

SEQ ID NO: 51821 - RNA, 23 nt, Homo sapiens
uacagcugcagaaucaggcuaag

SEQ ID NO: 51822 - RNA, 22 nt, Homo sapiens
uaccaaguauuuucacaugaac

SEQ ID NO: 51823 - RNA, 22 nt, Homo sapiens
uaccaugaagguggagagagaa

SEQ ID NO: 51824 - RNA, 22 nt, Homo sapiens
uacuccccuuguucugugagcu

SEQ ID NO: 51825 - RNA, 22 nt, Homo sapiens
uagcacagggaauugguucucu

SEQ ID NO: 51826 - RNA, 22 nt, Homo sapiens
uagcacagugucauucuaggua

SEQ ID NO: 51827 - RNA, 22 nt, Homo sapiens
uagcaucagauuccauauucua

SEQ ID NO: 51828 - RNA, 18 nt, Homo sapiens
uagcaugaugcugagugc

SEQ ID NO: 51829 - RNA, 22 nt, Homo sapiens
uaggcagccagcuguggauuga

SEQ ID NO: 51830 - RNA, 22 nt, Homo sapiens
uaggcuuuuggacccugucucu

SEQ ID NO: 51831 - RNA, 22 nt, Homo sapiens
uagggaguguccuuucgggaaa

SEQ ID NO: 51832 - RNA, 22 nt, Homo sapiens
uagggcuugugaucagguguag

SEQ ID NO: 51833 - RNA, 22 nt, Homo sapiens
uagggcuuuuccaagcugccac

SEQ ID NO: 51834 - RNA, 21 nt, Homo sapiens
uagugcugaggcaguauggga

SEQ ID NO: 51835 - RNA, 22 nt, Homo sapiens
uauauguuuucauaaggcuaga

SEQ ID NO: 51836 - RNA, 22 nt, Homo sapiens
uaucacagguggacugcacacc

SEQ ID NO: 51837 - RNA, 22 nt, Homo sapiens
uaucacugucaggcccucauau

SEQ ID NO: 51838 - RNA, 22 nt, Homo sapiens
uaugcuuauaaacauuugucag

SEQ ID NO: 51839 - RNA, 22 nt, Homo sapiens
ucaaaugcuguauuguaguaau

SEQ ID NO: 51840 - RNA, 22 nt, Homo sapiens
ucaaggcacuagcugagcugca

SEQ ID NO: 51841 - RNA, 22 nt, Homo sapiens
ucaauugcuuaugaagauacau

SEQ ID NO: 51842 - RNA, 19 nt, Homo sapiens
ucacaggguugacuugagg

SEQ ID NO: 51843 - RNA, 22 nt, Homo sapiens
ucacaguugauugaaacacagc

SEQ ID NO: 51844 - RNA, 22 nt, Homo sapiens
ucaccaguaauaaagagccugc

SEQ ID NO: 51845 - RNA, 22 nt, Homo sapiens
ucacgugcucuuguguguucug

SEQ ID NO: 51846 - RNA, 22 nt, Homo sapiens
ucacugaaacuguccuggguua

SEQ ID NO: 51847 - RNA, 19 nt, Homo sapiens
ucacuggacagcacacuca

SEQ ID NO: 51848 - RNA, 22 nt, Homo sapiens
ucacuuugacggccaacuucua

SEQ ID NO: 51849 - RNA, 22 nt, Homo sapiens
ucacuuuguauagcgacuggcu

SEQ ID NO: 51850 - RNA, 22 nt, Homo sapiens
ucacuuuguuuuuggauaaguu

SEQ ID NO: 51851 - RNA, 22 nt, Homo sapiens
ucagaucaugcuuaugauggga

SEQ ID NO: 51852 - RNA, 22 nt, Homo sapiens
ucaggcaccuuccucuuaucug

SEQ ID NO: 51853 - RNA, 19 nt, Homo sapiens
aaaguacucugaugccucu

SEQ ID NO: 51854 - RNA, 22 nt, Homo sapiens
aaagugcugagauuguaggcau

SEQ ID NO: 51855 - RNA, 22 nt, Homo sapiens
aaaugcaccacucuggugcagg

SEQ ID NO: 51856 - RNA, 22 nt, Homo sapiens
aacaccaucccuuugaugcuuu

SEQ ID NO: 51857 - RNA, 22 nt, Homo sapiens
aagagugucuuugugcuggccc

SEQ ID NO: 51858 - RNA, 22 nt, Homo sapiens
aagcuggauuucgcauccuguu

SEQ ID NO: 51859 - RNA, 22 nt, Homo sapiens
aagcugguguguauuauucacu

SEQ ID NO: 51860 - RNA, 22 nt, Homo sapiens
aagcugguuuuauaucugugag

SEQ ID NO: 51861 - RNA, 23 nt, Homo sapiens
aaggacacugaacacuucccagc

SEQ ID NO: 51862 - RNA, 22 nt, Homo sapiens
aaggcuguuguguaauaggauu

SEQ ID NO: 51863 - RNA, 22 nt, Homo sapiens
aaggugcucucuuauguagaaa

SEQ ID NO: 51864 - RNA, 17 nt, Homo sapiens
aaggugcuucgaccucc

SEQ ID NO: 51865 - RNA, 22 nt, Homo sapiens
aaguccccugacagaggggagg

SEQ ID NO: 51866 - RNA, 22 nt, Homo sapiens
aagugcuggccuacucaaucga

SEQ ID NO: 51867 - RNA, 22 nt, Homo sapiens
aagugguguuugggagcuggac

SEQ ID NO: 51868 - RNA, 22 nt, Homo sapiens
aaucugucuuuuguuauugagg

SEQ ID NO: 51869 - RNA, 22 nt, Homo sapiens
aauggcaucuacguuaaauguc

SEQ ID NO: 51870 - RNA, 21 nt, Homo sapiens
acaaagcuggagggagacugc

SEQ ID NO: 51871 - RNA, 23 nt, Homo sapiens
acacuugcugaguaaaucaaaua

SEQ ID NO: 51872 - RNA, 22 nt, Homo sapiens
acauacacuagggauguggugu

SEQ ID NO: 51873 - RNA, 19 nt, Homo sapiens
caccagugcaugcuacuau

SEQ ID NO: 51874 - RNA, 22 nt, Homo sapiens
cacuaggcuggagugcaguggc

SEQ ID NO: 51875 - RNA, 22 nt, Homo sapiens
cacugggccaucacuuaauauu

SEQ ID NO: 51876 - RNA, 22 nt, Homo sapiens
cagagguaagcaagucagcauu

SEQ ID NO: 51877 - RNA, 22 nt, Homo sapiens
cagcacauagcaguugcucagu

SEQ ID NO: 51878 - RNA, 22 nt, Homo sapiens
cagcuaguuuuugguuuacagu

SEQ ID NO: 51879 - RNA, 22 nt, Homo sapiens
caggugcauuggcugacaccug

SEQ ID NO: 51880 - RNA, 22 nt, Homo sapiens
caguggaugaacaagaagugau

SEQ ID NO: 51881 - RNA, 22 nt, Homo sapiens
caguuacuugacacaaccaauu

SEQ ID NO: 51882 - RNA, 22 nt, Homo sapiens
caucacaucugcaugguaagua

SEQ ID NO: 51883 - RNA, 19 nt, Homo sapiens
caucccugagcugaagugg

SEQ ID NO: 51884 - RNA, 22 nt, Homo sapiens
cauggccuuuggaaugugucua

SEQ ID NO: 51885 - RNA, 22 nt, Homo sapiens
cauggcucuuguuuacucccag

SEQ ID NO: 51886 - RNA, 22 nt, Homo sapiens
caugucuuuuaaacauucaacu

SEQ ID NO: 51887 - RNA, 22 nt, Homo sapiens
cauuaagcuacuuagaaggugc

SEQ ID NO: 51888 - RNA, 22 nt, Homo sapiens
ccaaggcacugauucuguacuc

SEQ ID NO: 51889 - RNA, 22 nt, Homo sapiens
ccacccuggagaauuugagguc

SEQ ID NO: 51890 - RNA, 20 nt, Homo sapiens
ccaguguuauuuauguucua

SEQ ID NO: 51891 - RNA, 22 nt, Homo sapiens
ccccuguaaacuggcuucccug

SEQ ID NO: 51892 - RNA, 22 nt, Homo sapiens
cccugagagcagggucuuucuc

SEQ ID NO: 51893 - RNA, 22 nt, Homo sapiens
cccuguguuguucaaggaucug

SEQ ID NO: 51894 - RNA, 22 nt, Homo sapiens
ccucauugcuaucccaggcuga

SEQ ID NO: 51895 - RNA, 22 nt, Homo sapiens
cuagacacugacguuccuccga

SEQ ID NO: 51896 - RNA, 18 nt, Homo sapiens
cuaguguuucuugaauca

SEQ ID NO: 51897 - RNA, 22 nt, Homo sapiens
cucacagucucucccuaauuuu

SEQ ID NO: 51898 - RNA, 22 nt, Homo sapiens
cucacaguucuaaaggcaagaa

SEQ ID NO: 51899 - RNA, 22 nt, Homo sapiens
cucauuggcuacugaggcuugu

SEQ ID NO: 51900 - RNA, 22 nt, Homo sapiens
cuccuugauuagaguauagagu

SEQ ID NO: 51901 - RNA, 22 nt, Homo sapiens
cugaaagagcauguaacacagu

SEQ ID NO: 51902 - RNA, 22 nt, Homo sapiens
cugaggacaucagggaagcauc

SEQ ID NO: 51903 - RNA, 20 nt, Homo sapiens
cugaggugggagaaucgcuu

SEQ ID NO: 51904 - RNA, 22 nt, Homo sapiens
cugaggugggaggauuacuuga

SEQ ID NO: 51905 - RNA, 22 nt, Homo sapiens
cugaggugggaguuuuucucau

SEQ ID NO: 51906 - RNA, 22 nt, Homo sapiens
cugccacugacaccucaaggac

SEQ ID NO: 51907 - RNA, 22 nt, Homo sapiens
cuggaaagcaaguccauugcuc

SEQ ID NO: 51908 - RNA, 19 nt, Homo sapiens
cugucacugaggaagacug

SEQ ID NO: 51909 - RNA, 22 nt, Homo sapiens
cugucacugggaggggcagcag

SEQ ID NO: 51910 - RNA, 22 nt, Homo sapiens
cugucagugggaguucaggcuu

SEQ ID NO: 51911 - RNA, 22 nt, Homo sapiens
cugugcaaguuauaggccaggu

SEQ ID NO: 51912 - RNA, 22 nt, Homo sapiens
cugugcuugagagaugacacag

SEQ ID NO: 51913 - RNA, 22 nt, Homo sapiens
cugugcuugauuauaugagugu

SEQ ID NO: 51914 - RNA, 21 nt, Homo sapiens
uucuaaguaaauguuggacau

SEQ ID NO: 51915 - RNA, 22 nt, Homo sapiens
uucuaugguuaccaggcuaguc

SEQ ID NO: 51916 - RNA, 22 nt, Homo sapiens
uugaaagaaaggagacugaguu

SEQ ID NO: 51917 - RNA, 22 nt, Homo sapiens
uugaaagacagaggggcaaguu

SEQ ID NO: 51918 - RNA, 22 nt, Homo sapiens
uugacuucagagcugauucaag

SEQ ID NO: 51919 - RNA, 22 nt, Homo sapiens
uugagguagcuuugauggaggu

SEQ ID NO: 51920 - RNA, 22 nt, Homo sapiens
uugagguauaaagguagguugu

SEQ ID NO: 51921 - RNA, 22 nt, Homo sapiens
uugaggugggaggaucacuuga

SEQ ID NO: 51922 - RNA, 20 nt, Homo sapiens
uugaggugugaggggcagag

SEQ ID NO: 51923 - RNA, 22 nt, Homo sapiens
uugcuucauucaacauugaggg

SEQ ID NO: 51924 - RNA, 22 nt, Homo sapiens
uugggcuuuuagguccuuaaca

SEQ ID NO: 51925 - RNA, 22 nt, Homo sapiens
uuguauaggcucaguaagaauc

SEQ ID NO: 51926 - RNA, 18 nt, Homo sapiens
uuuacaguagaaggacuu

SEQ ID NO: 51927 - RNA, 17 nt, Homo sapiens
uuucagaguggaagugu

SEQ ID NO: 51928 - RNA, 22 nt, Homo sapiens
uuugaagugugaugccuugaug

SEQ ID NO: 51929 - RNA, 22 nt, Homo sapiens
uuugagguguauggcaaguuga

SEQ ID NO: 51930 - RNA, 22 nt, Homo sapiens
uuugauguugagacuauaaagc

SEQ ID NO: 51931 - RNA, 22 nt, Homo sapiens
uuuuaacagccaggggacggcc

SEQ ID NO: 51932 - RNA, 22 nt, Homo sapiens
uaagugaauauggacaguuagc

SEQ ID NO: 51933 - RNA, 22 nt, Homo sapiens
uacaguaguaucuucauuuguu

SEQ ID NO: 51934 - RNA, 22 nt, Homo sapiens
uacugcugucagugccaaguag

SEQ ID NO: 51935 - RNA, 22 nt, Homo sapiens
uagcagccaggaagggcuggcu

SEQ ID NO: 51936 - RNA, 22 nt, Homo sapiens
uaggacacaggacauauguaga

SEQ ID NO: 51937 - RNA, 22 nt, Homo sapiens
uaggcauuuuucugauaaacua

SEQ ID NO: 51938 - RNA, 22 nt, Homo sapiens
uaguaguuuuguguauaauaau

SEQ ID NO: 51939 - RNA, 22 nt, Homo sapiens
uaguauguuuauagcauugagu

SEQ ID NO: 51940 - RNA, 23 nt, Homo sapiens
uaugacagaggaagggggagcug

SEQ ID NO: 51941 - RNA, 22 nt, Homo sapiens
uaugcacuauagcauauguggu

SEQ ID NO: 51942 - RNA, 22 nt, Homo sapiens
uaugcacuauggaaguagcuca

SEQ ID NO: 51943 - RNA, 22 nt, Homo sapiens
uaugcuuauugucucauccacu

SEQ ID NO: 51944 - RNA, 22 nt, Homo sapiens
ucaaauguucccuguacuggcc

SEQ ID NO: 51945 - RNA, 20 nt, Homo sapiens
ucaaauucuuggccuccagc

SEQ ID NO: 51946 - RNA, 19 nt, Homo sapiens
ucacacuguggcuucuuua

SEQ ID NO: 51947 - RNA, 22 nt, Homo sapiens
ucacagugaguggaguggggug

SEQ ID NO: 51948 - RNA, 22 nt, Homo sapiens
ucaccuggagagcuugcuaaua

SEQ ID NO: 51949 - RNA, 22 nt, Homo sapiens
ucagaugaucugguaagaacuu

SEQ ID NO: 51950 - RNA, 22 nt, Homo sapiens
ucagcagugagagaccucaccc

SEQ ID NO: 51951 - RNA, 22 nt, Homo sapiens
ucaggcaugcagcaaugcagug

SEQ ID NO: 51952 - RNA, 21 nt, Homo sapiens
ucagggaccugcuguacugau

SEQ ID NO: 51953 - RNA, 22 nt, Homo sapiens
ucagguaaucuauuugucuuuu

SEQ ID NO: 51954 - RNA, 22 nt, Homo sapiens
ucaggucauuccaggagggcca

SEQ ID NO: 51955 - RNA, 19 nt, Homo sapiens
ucagugcuauguaauguag

SEQ ID NO: 51956 - RNA, 23 nt, Homo sapiens
ucagugucuggauccugcucagu

SEQ ID NO: 51957 - RNA, 20 nt, Homo sapiens
ucaucaguuggugcucgcug

SEQ ID NO: 51958 - RNA, 19 nt, Homo sapiens
ucauggcuuuuucagcugu

SEQ ID NO: 51959 - RNA, 22 nt, Homo sapiens
uccacaguaaggacccugccuu

SEQ ID NO: 51960 - RNA, 22 nt, Homo sapiens
uccacugagcuagaccacuugg

SEQ ID NO: 51961 - RNA, 22 nt, Homo sapiens
uccaugaggcuacaguaaucuc

SEQ ID NO: 51962 - RNA, 22 nt, Homo sapiens
uccaugaguccauuagaaaaaa

SEQ ID NO: 51963 - RNA, 22 nt, Homo sapiens
ucccaguguguagcuugucucu

SEQ ID NO: 51964 - RNA, 22 nt, Homo sapiens
uccccugagaccccucagcacu

SEQ ID NO: 51965 - RNA, 22 nt, Homo sapiens
ucccuggacagccuugccuggg

SEQ ID NO: 51966 - RNA, 22 nt, Homo sapiens
ucccuggagcaagagaagaagg

SEQ ID NO: 51967 - RNA, 22 nt, Homo sapiens
ucccuuagccaaauccccagcc

SEQ ID NO: 51968 - RNA, 22 nt, Homo sapiens
uccuucaguccaguggguuuug

SEQ ID NO: 51969 - RNA, 22 nt, Homo sapiens
ccucaguguuuaucauuauuuu

SEQ ID NO: 51970 - RNA, 22 nt, Homo sapiens
ccuguguuaugguuucuaaugu

SEQ ID NO: 51971 - RNA, 22 nt, Homo sapiens
ccuucacaggcacugguucaga

SEQ ID NO: 51972 - RNA, 22 nt, Homo sapiens
cgccugagcugaggaagcugca

SEQ ID NO: 51973 - RNA, 22 nt, Homo sapiens
cuacauuguagguauucaaacu

SEQ ID NO: 51974 - RNA, 22 nt, Homo sapiens
cuaugguuucuccauaucauca

SEQ ID NO: 51975 - RNA, 22 nt, Homo sapiens
cuauucacaggcaauauguaca

SEQ ID NO: 51976 - RNA, 22 nt, Homo sapiens
cucacugcauuucaguuuuguu

SEQ ID NO: 51977 - RNA, 22 nt, Homo sapiens
cucacugugguguccuuaggua

SEQ ID NO: 51978 - RNA, 22 nt, Homo sapiens
cucaguguuucagcugcucaga

SEQ ID NO: 51979 - RNA, 22 nt, Homo sapiens
cucauugcaaucucugccuccc

SEQ ID NO: 51980 - RNA, 22 nt, Homo sapiens
cucucugagccccagacaccuu

SEQ ID NO: 51981 - RNA, 22 nt, Homo sapiens
cugagaagaaacagguaaggac

SEQ ID NO: 51982 - RNA, 18 nt, Homo sapiens
cugagcacugcuuuauga

SEQ ID NO: 51983 - RNA, 22 nt, Homo sapiens
cugaggugauauauacauauuu

SEQ ID NO: 51984 - RNA, 22 nt, Homo sapiens
cugaggugggaggauuggcuug

SEQ ID NO: 51985 - RNA, 22 nt, Homo sapiens
cugcuguuguuaacuuuuggag

SEQ ID NO: 51986 - RNA, 22 nt, Homo sapiens
cugugguuacguucuuugugcu

SEQ ID NO: 51987 - RNA, 17 nt, Homo sapiens
cuucaaauaauuucccc

SEQ ID NO: 51988 - RNA, 22 nt, Homo sapiens
gacucagaacuaaggguguuuc

SEQ ID NO: 51989 - RNA, 22 nt, Homo sapiens
gacuuugguaaacucgguggca

SEQ ID NO: 51990 - RNA, 22 nt, Homo sapiens
gagaaugagaggggaaggccac

SEQ ID NO: 51991 - RNA, 22 nt, Homo sapiens
gagauaggauucacuuucaugu

SEQ ID NO: 51992 - RNA, 22 nt, Homo sapiens
gagauggagacuuggccuuaaa

SEQ ID NO: 51993 - RNA, 22 nt, Homo sapiens
gaggcauugaaauauugcuuau

SEQ ID NO: 51994 - RNA, 22 nt, Homo sapiens
gagguaagaaagucaguccuuc

SEQ ID NO: 51995 - RNA, 22 nt, Homo sapiens
gagugcaagguuuuucugagug

SEQ ID NO: 51996 - RNA, 22 nt, Homo sapiens
gagugcaauggugcuaucucgg

SEQ ID NO: 51997 - RNA, 22 nt, Homo sapiens
gaguuguuuuaaggcacugacu

SEQ ID NO: 51998 - RNA, 22 nt, Homo sapiens
gaugagguaguguaccuagucu

SEQ ID NO: 51999 - RNA, 22 nt, Homo sapiens
gcaaaugcuaugccauuuuaua

SEQ ID NO: 52000 - RNA, 22 nt, Homo sapiens
gcagagaaacaggucuaaggag

SEQ ID NO: 52001 - RNA, 22 nt, Homo sapiens
gcagcacaugacuguauguaua

SEQ ID NO: 52002 - RNA, 22 nt, Homo sapiens
gcaugcacaugugaaaaaauga

SEQ ID NO: 52003 - RNA, 22 nt, Homo sapiens
gccauugcacuacagccuaggc

SEQ ID NO: 52004 - RNA, 22 nt, Homo sapiens
gccauugcacuccagccugagc

SEQ ID NO: 52005 - RNA, 22 nt, Homo sapiens
gccauugcacucuagccugagc

SEQ ID NO: 52006 - RNA, 22 nt, Homo sapiens
gccucaguuguggccagggauu

SEQ ID NO: 52007 - RNA, 22 nt, Homo sapiens
gcuagcacauugucaccucuca

SEQ ID NO: 52008 - RNA, 22 nt, Homo sapiens
gcugcuguuucucuuucagcau

SEQ ID NO: 52009 - RNA, 23 nt, Homo sapiens
ggaaacauccagucuuucaccau

SEQ ID NO: 52010 - RNA, 22 nt, Homo sapiens
ggaaagacaccuuacuauguua

SEQ ID NO: 52011 - RNA, 18 nt, Homo sapiens
ggaagauuggcuaugugc

SEQ ID NO: 52012 - RNA, 22 nt, Homo sapiens
ggauacaucuggacagccgaau

SEQ ID NO: 52013 - RNA, 22 nt, Homo sapiens
ggcacuguggcucaagccugua

SEQ ID NO: 52014 - RNA, 22 nt, Homo sapiens
uauagcuaugggauguauuugc

SEQ ID NO: 52015 - RNA, 22 nt, Homo sapiens
uaucaccacccugggaaacaua

SEQ ID NO: 52016 - RNA, 22 nt, Homo sapiens
uaucaccauguccguuuuaaaa

SEQ ID NO: 52017 - RNA, 22 nt, Homo sapiens
uaugcaugucucuguacacgug

SEQ ID NO: 52018 - RNA, 22 nt, Homo sapiens
uauugcuugaggaaaugguaau

SEQ ID NO: 52019 - RNA, 17 nt, Homo sapiens
ucaaaugcucccaguga

SEQ ID NO: 52020 - RNA, 22 nt, Homo sapiens
ucaaaugcucuuugcagagagg

SEQ ID NO: 52021 - RNA, 22 nt, Homo sapiens
ucacaaagcuuggccugcuucu

SEQ ID NO: 52022 - RNA, 22 nt, Homo sapiens
ucacaggguguuauuagaauua

SEQ ID NO: 52023 - RNA, 22 nt, Homo sapiens
ucacaguguuaaaccuuucuuu

SEQ ID NO: 52024 - RNA, 17 nt, Homo sapiens
ucacaguguuaggauga

SEQ ID NO: 52025 - RNA, 20 nt, Homo sapiens
ucacauccucucccaacaug

SEQ ID NO: 52026 - RNA, 22 nt, Homo sapiens
ucacauggaaaaguccaguaaa

SEQ ID NO: 52027 - RNA, 22 nt, Homo sapiens
ucacugagaaugauguuucuga

SEQ ID NO: 52028 - RNA, 22 nt, Homo sapiens
ucacugcacuagguaaugccac

SEQ ID NO: 52029 - RNA, 22 nt, Homo sapiens
ucacugcacucuccgccuugcg

SEQ ID NO: 52030 - RNA, 20 nt, Homo sapiens
ucacuggagcucauuugauu

SEQ ID NO: 52031 - RNA, 22 nt, Homo sapiens
ucacuuuggguacuauggaaau

SEQ ID NO: 52032 - RNA, 22 nt, Homo sapiens
ucagaucacuggcgcuggcgga

SEQ ID NO: 52033 - RNA, 22 nt, Homo sapiens
ucagcagugugaaaacaaacua

SEQ ID NO: 52034 - RNA, 21 nt, Homo sapiens
ucagcucaucacugccuggag

SEQ ID NO: 52035 - RNA, 20 nt, Homo sapiens
ucaggcuccgcauuaacuua

SEQ ID NO: 52036 - RNA, 22 nt, Homo sapiens
ucaggugcagagaagaaauggg

SEQ ID NO: 52037 - RNA, 22 nt, Homo sapiens
ucaggugcaguggcucugaccu

SEQ ID NO: 52038 - RNA, 22 nt, Homo sapiens
ucaggugccuuggcuaauuguu

SEQ ID NO: 52039 - RNA, 22 nt, Homo sapiens
ucagucauucacucacucggac

SEQ ID NO: 52040 - RNA, 21 nt, Homo sapiens
ucagugcugugggcaaggugc

SEQ ID NO: 52041 - RNA, 22 nt, Homo sapiens
ucaucaggcucauucaagcuga

SEQ ID NO: 52042 - RNA, 22 nt, Homo sapiens
ucauggcacugaugagaguuuc

SEQ ID NO: 52043 - RNA, 22 nt, Homo sapiens
ucaugggagcccccaucaugag

SEQ ID NO: 52044 - RNA, 22 nt, Homo sapiens
ucauuagagacagggugucacu

SEQ ID NO: 52045 - RNA, 22 nt, Homo sapiens
uccagugugcaggcaaguuuga

SEQ ID NO: 52046 - RNA, 22 nt, Homo sapiens
uccccaguaggcaauuaacacc

SEQ ID NO: 52047 - RNA, 19 nt, Homo sapiens
uccccaguuuuccguucag

SEQ ID NO: 52048 - RNA, 22 nt, Homo sapiens
uccccgagcccaggcugugacu

SEQ ID NO: 52049 - RNA, 22 nt, Homo sapiens
uccccgaggcuggagugcagug

SEQ ID NO: 52050 - RNA, 22 nt, Homo sapiens
ucccgaggacaucugggggcaa

SEQ ID NO: 52051 - RNA, 22 nt, Homo sapiens
uccuugagccugggaguuauag

SEQ ID NO: 52052 - RNA, 22 nt, Homo sapiens
uccuugagccuuaaauuauaaa

SEQ ID NO: 52053 - RNA, 22 nt, Homo sapiens
ucgcagcucacuggagccucga

SEQ ID NO: 52054 - RNA, 19 nt, Homo sapiens
ucuaaaucucuugauagac

SEQ ID NO: 52055 - RNA, 17 nt, Homo sapiens
ucuaauaauaugcauuu

SEQ ID NO: 52056 - RNA, 22 nt, Homo sapiens
ucucacagaguugaacuuucuu

SEQ ID NO: 52057 - RNA, 22 nt, Homo sapiens
ucucacauuucacagggauggg

SEQ ID NO: 52058 - RNA, 22 nt, Homo sapiens
ucucagagccuaggguuuuuca

SEQ ID NO: 52059 - RNA, 22 nt, Homo sapiens
ucucagcacagucagggcgccu

SEQ ID NO: 52060 - RNA, 22 nt, Homo sapiens
ucucaguggcuuccucacuuuu

SEQ ID NO: 52061 - RNA, 20 nt, Homo sapiens
ucucauggagguagagaaua

SEQ ID NO: 52062 - RNA, 22 nt, Homo sapiens
ucugacagugagagaaaucuga

SEQ ID NO: 52063 - RNA, 22 nt, Homo sapiens
ucugcaagucuaaacuagccau

SEQ ID NO: 52064 - RNA, 22 nt, Homo sapiens
ucugugcauggcagaggaauga

SEQ ID NO: 52065 - RNA, 22 nt, Homo sapiens
aaauugcaguuaggaugauggu

SEQ ID NO: 52066 - RNA, 22 nt, Homo sapiens
aacugggcaagcauuacauggu

SEQ ID NO: 52067 - RNA, 22 nt, Homo sapiens
aagcacccagccucacgccugc

SEQ ID NO: 52068 - RNA, 22 nt, Homo sapiens
aagcugguguugcugcucuguu

SEQ ID NO: 52069 - RNA, 22 nt, Homo sapiens
aaggcuguucauuuagcacagu

SEQ ID NO: 52070 - RNA, 22 nt, Homo sapiens
aaggugcuguaagcauccaugu

SEQ ID NO: 52071 - RNA, 18 nt, Homo sapiens
aaggugcuucuguucuga

SEQ ID NO: 52072 - RNA, 22 nt, Homo sapiens
aaguaaacauuuuguacaauaa

SEQ ID NO: 52073 - RNA, 23 nt, Homo sapiens
aagugagcuccaauugggugaga

SEQ ID NO: 52074 - RNA, 22 nt, Homo sapiens
aagugcuuacagggaacaugau

SEQ ID NO: 52075 - RNA, 22 nt, Homo sapiens
aagugguuuuuacaaagacaga

SEQ ID NO: 52076 - RNA, 22 nt, Homo sapiens
ugagacaucacaaaauccucaa

SEQ ID NO: 52077 - RNA, 22 nt, Homo sapiens
ugagacaucucuccugagacag

SEQ ID NO: 52078 - RNA, 22 nt, Homo sapiens
ugagaccugaucuugguacugc

SEQ ID NO: 52079 - RNA, 22 nt, Homo sapiens
ugagaccuuucauuucucagug

SEQ ID NO: 52080 - RNA, 22 nt, Homo sapiens
ugagagaugaacuauucuugaa

SEQ ID NO: 52081 - RNA, 22 nt, Homo sapiens
ugagauaacuaaaaacauuuug

SEQ ID NO: 52082 - RNA, 22 nt, Homo sapiens
ugagaucagaaggauuucucug

SEQ ID NO: 52083 - RNA, 22 nt, Homo sapiens
ugagaucaugucauuugcacuc

SEQ ID NO: 52084 - RNA, 22 nt, Homo sapiens
ugagcagugagugugcugcagg

SEQ ID NO: 52085 - RNA, 20 nt, Homo sapiens
ugagcucaugacauuuuucu

SEQ ID NO: 52086 - RNA, 22 nt, Homo sapiens
ugagcugagaucaugcuauugu

SEQ ID NO: 52087 - RNA, 22 nt, Homo sapiens
ugagcugagaucgugccauugu

SEQ ID NO: 52088 - RNA, 22 nt, Homo sapiens
ugagcugagauuaagcugcugc

SEQ ID NO: 52089 - RNA, 22 nt, Homo sapiens
ugagcuguuugaagaagcauuu

SEQ ID NO: 52090 - RNA, 22 nt, Homo sapiens
ugaggugagauggcuaccccaa

SEQ ID NO: 52091 - RNA, 22 nt, Homo sapiens
ugaggugagggguuaggugcua

SEQ ID NO: 52092 - RNA, 22 nt, Homo sapiens
ugagguugucagugucauucuu

SEQ ID NO: 52093 - RNA, 22 nt, Homo sapiens
ugagucaauggaggcucagagc

SEQ ID NO: 52094 - RNA, 23 nt, Homo sapiens
ugagucacuuugcuggggucucu

SEQ ID NO: 52095 - RNA, 22 nt, Homo sapiens
ugagucauuuccuuaugcuacu

SEQ ID NO: 52096 - RNA, 22 nt, Homo sapiens
ugaguguguaugugcauacaca

SEQ ID NO: 52097 - RNA, 22 nt, Homo sapiens
ugaugcugaugccugccagaag

SEQ ID NO: 52098 - RNA, 22 nt, Homo sapiens
ugcaaauguuaggugucauuau

SEQ ID NO: 52099 - RNA, 22 nt, Homo sapiens
ugcaaauguuaguaacaccacu

SEQ ID NO: 52100 - RNA, 22 nt, Homo sapiens
ugcaacacauugccccugcucu

SEQ ID NO: 52101 - RNA, 22 nt, Homo sapiens
ugcaauauccucuacuauaggu

SEQ ID NO: 52102 - RNA, 22 nt, Homo sapiens
ugcauaauuccuugcaccagaa

SEQ ID NO: 52103 - RNA, 22 nt, Homo sapiens
ugccuaggcuggagugcagugg

SEQ ID NO: 52104 - RNA, 22 nt, Homo sapiens
ugccugagcccagcccuguagu

SEQ ID NO: 52105 - RNA, 22 nt, Homo sapiens
ugcguucauuuggccaguggcg

SEQ ID NO: 52106 - RNA, 21 nt, Homo sapiens
ugcuuacugaauguuaauuuc

SEQ ID NO: 52107 - RNA, 22 nt, Homo sapiens
ugcuuuguugaaaaucauuugg

SEQ ID NO: 52108 - RNA, 22 nt, Homo sapiens
cuagcccagugcuccuggauca

SEQ ID NO: 52109 - RNA, 18 nt, Homo sapiens
cuaguguuucuugaauca

SEQ ID NO: 52110 - RNA, 22 nt, Homo sapiens
cuauauacugccugcugauuag

SEQ ID NO: 52111 - RNA, 22 nt, Homo sapiens
cuauggcuguagucccugugua

SEQ ID NO: 52112 - RNA, 22 nt, Homo sapiens
cuauucacaauggugaagauau

SEQ ID NO: 52113 - RNA, 22 nt, Homo sapiens
cucaguagaaaauacauggacu

SEQ ID NO: 52114 - RNA, 22 nt, Homo sapiens
cucauugcaaucucugccuccc

SEQ ID NO: 52115 - RNA, 22 nt, Homo sapiens
cuccacugagcaggugggaggc

SEQ ID NO: 52116 - RNA, 22 nt, Homo sapiens
cucucugagccauggcugcccu

SEQ ID NO: 52117 - RNA, 22 nt, Homo sapiens
cucuuacaguguguggugaaag

SEQ ID NO: 52118 - RNA, 22 nt, Homo sapiens
cugaaagagcauuugaaugggu

SEQ ID NO: 52119 - RNA, 18 nt, Homo sapiens
cugagucauuccuggguc

SEQ ID NO: 52120 - RNA, 22 nt, Homo sapiens
cugccuagauguuguagggggu

SEQ ID NO: 52121 - RNA, 22 nt, Homo sapiens
cuggaaacaucuuaggaaugca

SEQ ID NO: 52122 - RNA, 22 nt, Homo sapiens
cuggaaucuagaaaagguaagg

SEQ ID NO: 52123 - RNA, 22 nt, Homo sapiens
cuggaaucuauggauaacaucg

SEQ ID NO: 52124 - RNA, 22 nt, Homo sapiens
cuggcaccauuuugaucaaagg

SEQ ID NO: 52125 - RNA, 22 nt, Homo sapiens
cuggcugagugguaaguagagg

SEQ ID NO: 52126 - RNA, 22 nt, Homo sapiens
cugggaugauguaaauaggcua

SEQ ID NO: 52127 - RNA, 22 nt, Homo sapiens
cugugcauggauuuuaagauug

SEQ ID NO: 52128 - RNA, 22 nt, Homo sapiens
cuuacagucuaucagccacaac

SEQ ID NO: 52129 - RNA, 20 nt, Homo sapiens
cuuaucaguggcaaguauaa

SEQ ID NO: 52130 - RNA, 22 nt, Homo sapiens
cuucuguuaguucugauaacuu

SEQ ID NO: 52131 - RNA, 22 nt, Homo sapiens
cuuguuguggaggggagugcag

SEQ ID NO: 52132 - RNA, 22 nt, Homo sapiens
cuuuggcaaugucauuuucaau

SEQ ID NO: 52133 - RNA, 21 nt, Homo sapiens
cuuuugcacuccagccugggu

SEQ ID NO: 52134 - RNA, 22 nt, Homo sapiens
gaagcagcauucugguuuuugg

SEQ ID NO: 52135 - RNA, 22 nt, Homo sapiens
gaauacuguccaagagugaugg

SEQ ID NO: 52136 - RNA, 22 nt, Homo sapiens
gaauagugcugcaagaaacaua

SEQ ID NO: 52137 - RNA, 22 nt, Homo sapiens
gacaagagaacacugcuauauu

SEQ ID NO: 52138 - RNA, 22 nt, Homo sapiens
gacaguguggcgauuccucaag

SEQ ID NO: 52139 - RNA, 22 nt, Homo sapiens
gacauguuuucaagauuuauaa

SEQ ID NO: 52140 - RNA, 22 nt, Homo sapiens
gacccucuagagggaagcgcuu

SEQ ID NO: 52141 - RNA, 22 nt, Homo sapiens
gacuggagcuguaugugguuac

SEQ ID NO: 52142 - RNA, 22 nt, Homo sapiens
gagaaccauuuggagaaaaagu

SEQ ID NO: 52143 - RNA, 22 nt, Homo sapiens
gagaaugagaggggaaggccac

SEQ ID NO: 52144 - RNA, 23 nt, Homo sapiens
gagaccagcuucagaaagcacga

SEQ ID NO: 52145 - RNA, 22 nt, Homo sapiens
gagacggagucucgcucuguca

SEQ ID NO: 52146 - RNA, 21 nt, Homo sapiens
gagauagguaccgaagcuuag

SEQ ID NO: 52147 - RNA, 22 nt, Homo sapiens
gagaucauguacuagaacaccu

SEQ ID NO: 52148 - RNA, 23 nt, Homo sapiens
gagaucauucuggaauuagagug

SEQ ID NO: 52149 - RNA, 22 nt, Homo sapiens
gagauggugugcuguuggaagu

SEQ ID NO: 52150 - RNA, 22 nt, Homo sapiens
gagcuacacugauucauuuguu

SEQ ID NO: 52151 - RNA, 22 nt, Homo sapiens
gagcucauuguugcuaaagaga

SEQ ID NO: 52152 - RNA, 22 nt, Homo sapiens
gaggagucagacugugcaaggu

SEQ ID NO: 52153 - RNA, 22 nt, Homo sapiens
gagguaggaauaaacauuugaa

SEQ ID NO: 52154 - RNA, 22 nt, Homo sapiens
gagguagggucccacuauguug

SEQ ID NO: 52155 - RNA, 22 nt, Homo sapiens
gagugcaaagguccugaggugg

SEQ ID NO: 52156 - RNA, 22 nt, Homo sapiens
gagugcaauggcaagaucuugg

SEQ ID NO: 52157 - RNA, 22 nt, Homo sapiens
gagugcaauggcaugaucuugg

SEQ ID NO: 52158 - RNA, 17 nt, Homo sapiens
gaucacagucgucuccu

SEQ ID NO: 52159 - RNA, 22 nt, Homo sapiens
gauggauuuuuuaggcagagcu

SEQ ID NO: 52160 - RNA, 22 nt, Homo sapiens
gauggcauuucuggaucugccc

SEQ ID NO: 52161 - RNA, 22 nt, Homo sapiens
gauuagagaaauacugcugcua

SEQ ID NO: 52162 - RNA, 22 nt, Homo sapiens
gauuucaucuuuagaggaagga

SEQ ID NO: 52163 - RNA, 22 nt, Homo sapiens
gcacugagagaagccccaagua

SEQ ID NO: 52164 - RNA, 17 nt, Homo sapiens
agcaccacacucucuug

SEQ ID NO: 52165 - RNA, 16 nt, Homo sapiens
agcagguguuagguga

SEQ ID NO: 52166 - RNA, 16 nt, Homo sapiens
agccaccauuuacuug

SEQ ID NO: 52167 - RNA, 19 nt, Homo sapiens
agccaguuuucccagcacc

SEQ ID NO: 52168 - RNA, 17 nt, Homo sapiens
agccccauuagcuaguu

SEQ ID NO: 52169 - RNA, 22 nt, Homo sapiens
agcugccagucuuguaaggccu

SEQ ID NO: 52170 - RNA, 17 nt, Homo sapiens
agcuggaauuacgggag

SEQ ID NO: 52171 - RNA, 22 nt, Homo sapiens
aggaacuguaacuaugucucug

SEQ ID NO: 52172 - RNA, 22 nt, Homo sapiens
aggaagugugcaauuaauuucu

SEQ ID NO: 52173 - RNA, 22 nt, Homo sapiens
aggaaugcuaaguuuuccuccu

SEQ ID NO: 52174 - RNA, 22 nt, Homo sapiens
aggcaagugggagacagcauuu

SEQ ID NO: 52175 - RNA, 22 nt, Homo sapiens
aggcagcuguuauauacugagu

SEQ ID NO: 52176 - RNA, 22 nt, Homo sapiens
aggcuagaaucuuccaucuugg

SEQ ID NO: 52177 - RNA, 22 nt, Homo sapiens
agguagugugaugcuccuguuu

SEQ ID NO: 52178 - RNA, 22 nt, Homo sapiens
agguauguuuuaugguccauaa

SEQ ID NO: 52179 - RNA, 20 nt, Homo sapiens
agguuauuauaauuagaaga

SEQ ID NO: 52180 - RNA, 22 nt, Homo sapiens
aguacugucugguuaccugaca

SEQ ID NO: 52181 - RNA, 17 nt, Homo sapiens
agucaguaguuuguauu

SEQ ID NO: 52182 - RNA, 22 nt, Homo sapiens
aguccagguuuuguaauggcaa

SEQ ID NO: 52183 - RNA, 22 nt, Homo sapiens
aguggcaaugugauguccugaa

SEQ ID NO: 52184 - RNA, 22 nt, Homo sapiens
aguguuuuuaucaugaaagggu

SEQ ID NO: 52185 - RNA, 22 nt, Homo sapiens
aguguuuuucaugggauacuuu

SEQ ID NO: 52186 - RNA, 22 nt, Homo sapiens
auaaagcuauuccucucuuuuu

SEQ ID NO: 52187 - RNA, 22 nt, Homo sapiens
auaacauggaguuugucauuua

SEQ ID NO: 52188 - RNA, 22 nt, Homo sapiens
auaacucuguuuuuuucaugca

SEQ ID NO: 52189 - RNA, 22 nt, Homo sapiens
auacacgugcagaacaugcagg

SEQ ID NO: 52190 - RNA, 22 nt, Homo sapiens
auacaguaucuucuggcaagca

SEQ ID NO: 52191 - RNA, 22 nt, Homo sapiens
auacaguauggagggcccagcu

SEQ ID NO: 52192 - RNA, 22 nt, Homo sapiens
auacauguucaagggcauauau

SEQ ID NO: 52193 - RNA, 20 nt, Homo sapiens
auaccacagacuggguaguu

SEQ ID NO: 52194 - RNA, 20 nt, Homo sapiens
uggaaaguaagucaugauau

SEQ ID NO: 52195 - RNA, 22 nt, Homo sapiens
uggaagacucuagucucuugag

SEQ ID NO: 52196 - RNA, 22 nt, Homo sapiens
uggaaugugaauaacuuccuuc

SEQ ID NO: 52197 - RNA, 22 nt, Homo sapiens
uggagacugaucccucuuuccu

SEQ ID NO: 52198 - RNA, 22 nt, Homo sapiens
uggagguagggccuaggaaucu

SEQ ID NO: 52199 - RNA, 16 nt, Homo sapiens
uggagucauccuugac

SEQ ID NO: 52200 - RNA, 22 nt, Homo sapiens
uggaguguguuaacuuuacaag

SEQ ID NO: 52201 - RNA, 22 nt, Homo sapiens
uggauauguuuauuacccugaa

SEQ ID NO: 52202 - RNA, 22 nt, Homo sapiens
uggauuguuucucuugguauga

SEQ ID NO: 52203 - RNA, 22 nt, Homo sapiens
uggcaaaaaaccgcaguugccu

SEQ ID NO: 52204 - RNA, 22 nt, Homo sapiens
uggcaugauguguucauugaaa

SEQ ID NO: 52205 - RNA, 22 nt, Homo sapiens
uggccaguguuuuuccugggcu

SEQ ID NO: 52206 - RNA, 22 nt, Homo sapiens
uggccuguaacgcugucucagc

SEQ ID NO: 52207 - RNA, 22 nt, Homo sapiens
uggccuuuuccaagaacuacua

SEQ ID NO: 52208 - RNA, 23 nt, Homo sapiens
uggcuagacguccuuuccugaug

SEQ ID NO: 52209 - RNA, 22 nt, Homo sapiens
ugggaugaauacaaugggauca

SEQ ID NO: 52210 - RNA, 22 nt, Homo sapiens
ugggguaggcuguauacucugu

SEQ ID NO: 52211 - RNA, 22 nt, Homo sapiens
uguacaugggacaggaggagag

SEQ ID NO: 52212 - RNA, 22 nt, Homo sapiens
ugucaaaugcagugauauuuga

SEQ ID NO: 52213 - RNA, 21 nt, Homo sapiens
ugucaguuuccagaguucaac

SEQ ID NO: 52214 - RNA, 22 nt, Homo sapiens
ugucauagaugauuuuuuucgg

SEQ ID NO: 52215 - RNA, 22 nt, Homo sapiens
uguccaaauugaaucaucuggu

SEQ ID NO: 52216 - RNA, 22 nt, Homo sapiens
uguccuggugaugcccaaauuc

SEQ ID NO: 52217 - RNA, 22 nt, Homo sapiens
ugucuggaguccauagaagugu

SEQ ID NO: 52218 - RNA, 22 nt, Homo sapiens
ugugaaugaagaaugcuaaccu

SEQ ID NO: 52219 - RNA, 22 nt, Homo sapiens
ugugacaguuaguuugguguua

SEQ ID NO: 52220 - RNA, 18 nt, Homo sapiens
ugugacauugagcauguc

SEQ ID NO: 52221 - RNA, 22 nt, Homo sapiens
ugugaugguuuggaagcuucuu

SEQ ID NO: 52222 - RNA, 22 nt, Homo sapiens
ugugauuauuuauagacaguca

SEQ ID NO: 52223 - RNA, 22 nt, Homo sapiens
ugugcaaucuuccauuuuuagg

SEQ ID NO: 52224 - RNA, 22 nt, Homo sapiens
uguggaaauaaaagaaagguua

SEQ ID NO: 52225 - RNA, 22 nt, Homo sapiens
uguggaaauuguuguauuuaau

SEQ ID NO: 52226 - RNA, 22 nt, Homo sapiens
uguuuuggagguccucacuaga

SEQ ID NO: 52227 - RNA, 22 nt, Homo sapiens
uuaaaguaauugaaauggccuu

SEQ ID NO: 52228 - RNA, 22 nt, Homo sapiens
uuaaauacagcaugguguuucu

SEQ ID NO: 52229 - RNA, 22 nt, Homo sapiens
uuaaaugcucacauaaagguag

SEQ ID NO: 52230 - RNA, 22 nt, Homo sapiens
uuaaaugucuguagaugugcug

SEQ ID NO: 52231 - RNA, 22 nt, Homo sapiens
uuaagagcauggugccagguug

SEQ ID NO: 52232 - RNA, 22 nt, Homo sapiens
uuaauaccgucacauggcugaa

SEQ ID NO: 52233 - RNA, 21 nt, Homo sapiens
uuacaauggcuccuugaaggu

SEQ ID NO: 52234 - RNA, 22 nt, Homo sapiens
uuacaggacuaagcagcuuugc

SEQ ID NO: 52235 - RNA, 22 nt, Homo sapiens
uuacauugcuucaaauucagug

SEQ ID NO: 52236 - RNA, 22 nt, Homo sapiens
uuagagcacugaucugcucuuu

SEQ ID NO: 52237 - RNA, 22 nt, Homo sapiens
uuagggaggagucccucuuuuu

SEQ ID NO: 52238 - RNA, 22 nt, Homo sapiens
uuagggaguaaucuaaaaaugg

SEQ ID NO: 52239 - RNA, 23 nt, Homo sapiens
uuaguaaacucaaugacaccaca

SEQ ID NO: 52240 - RNA, 22 nt, Homo sapiens
uuauagacacguuguaacaaac

SEQ ID NO: 52241 - RNA, 22 nt, Homo sapiens
uuauugcuuaugauuagguguu

SEQ ID NO: 52242 - RNA, 22 nt, Homo sapiens
uucaaaggauagauuaagauca

SEQ ID NO: 52243 - RNA, 22 nt, Homo sapiens
uucaaaguuggaggacaaacug

SEQ ID NO: 52244 - RNA, 22 nt, Homo sapiens
uucaaauguucuuucaccaccc

SEQ ID NO: 52245 - RNA, 22 nt, Homo sapiens
uucaagucaacaagcacuugag

SEQ ID NO: 52246 - RNA, 22 nt, Homo sapiens
uucaccagggaagucucaacuc

SEQ ID NO: 52247 - RNA, 22 nt, Homo sapiens
uucacuguagccucagccucuu

SEQ ID NO: 52248 - RNA, 22 nt, Homo sapiens
uucagacugggugaagagggua

SEQ ID NO: 52249 - RNA, 22 nt, Homo sapiens
uucagauugcauaccgaaagua

SEQ ID NO: 52250 - RNA, 22 nt, Homo sapiens
uucagcuaccugggaugcugaa

SEQ ID NO: 52251 - RNA, 18 nt, Homo sapiens
uucauaguagcaugauuu

SEQ ID NO: 52252 - RNA, 22 nt, Homo sapiens
uucauaguauuuuucuccaaau

SEQ ID NO: 52253 - RNA, 22 nt, Homo sapiens
auuggcaauguacauaucuugc

SEQ ID NO: 52254 - RNA, 22 nt, Homo sapiens
auuguacuccagccugggcaaa

SEQ ID NO: 52255 - RNA, 22 nt, Homo sapiens
auuguacuccagccugggcagc

SEQ ID NO: 52256 - RNA, 22 nt, Homo sapiens
auuguacuccagccugggcuaa

SEQ ID NO: 52257 - RNA, 22 nt, Homo sapiens
auuguacuccagccugggugac

SEQ ID NO: 52258 - RNA, 22 nt, Homo sapiens
auugucacuuaaaagugcaugu

SEQ ID NO: 52259 - RNA, 22 nt, Homo sapiens
auuuggguaaugagugcaaggg

SEQ ID NO: 52260 - RNA, 22 nt, Homo sapiens
auuuuugguugguaggcuauua

SEQ ID NO: 52261 - RNA, 22 nt, Homo sapiens
caaaccuguaggggccaagagg

SEQ ID NO: 52262 - RNA, 22 nt, Homo sapiens
caaaguaauuacgguuuuggcc

SEQ ID NO: 52263 - RNA, 22 nt, Homo sapiens
caagagaccugagugucauucu

SEQ ID NO: 52264 - RNA, 21 nt, Homo sapiens
caaugacacuguagcugugcu

SEQ ID NO: 52265 - RNA, 22 nt, Homo sapiens
cacaaaguagauuagucuucca

SEQ ID NO: 52266 - RNA, 22 nt, Homo sapiens
cacacugucuucauuacuguag

SEQ ID NO: 52267 - RNA, 22 nt, Homo sapiens
cacacugucuuucagaaugguu

SEQ ID NO: 52268 - RNA, 22 nt, Homo sapiens
cacagaauucauuggauuaccu

SEQ ID NO: 52269 - RNA, 22 nt, Homo sapiens
cacagucuugcaauauugagau

SEQ ID NO: 52270 - RNA, 23 nt, Homo sapiens
cacugggcagcagguguucccag

SEQ ID NO: 52271 - RNA, 22 nt, Homo sapiens
cacugggugagauccauguuua

SEQ ID NO: 52272 - RNA, 22 nt, Homo sapiens
cagauaguuguagauaugcagc

SEQ ID NO: 52273 - RNA, 22 nt, Homo sapiens
cagcccguaaucccagcacuuu

SEQ ID NO: 52274 - RNA, 22 nt, Homo sapiens
cagcuaaauuguuaaauccaag

SEQ ID NO: 52275 - RNA, 22 nt, Homo sapiens
caguacaauguugauuagaagu

SEQ ID NO: 52276 - RNA, 22 nt, Homo sapiens
cagugcauagaugugccacauu

SEQ ID NO: 52277 - RNA, 22 nt, Homo sapiens
caucacacuuggauguaagaca

SEQ ID NO: 52278 - RNA, 22 nt, Homo sapiens
caucacaucugcaugguaagua

SEQ ID NO: 52279 - RNA, 22 nt, Homo sapiens
cauggcccuggguccauaggaa

SEQ ID NO: 52280 - RNA, 22 nt, Homo sapiens
gucaaagucuauuggcuaauuc

SEQ ID NO: 52281 - RNA, 22 nt, Homo sapiens
gucaccagcuguguuagccccu

SEQ ID NO: 52282 - RNA, 22 nt, Homo sapiens
gucauucauucagcaagcacug

SEQ ID NO: 52283 - RNA, 22 nt, Homo sapiens
guccaguacucuuuccugaaaa

SEQ ID NO: 52284 - RNA, 22 nt, Homo sapiens
gucccugcgauugugggauccu

SEQ ID NO: 52285 - RNA, 22 nt, Homo sapiens
gucuaugguucaggguggagug

SEQ ID NO: 52286 - RNA, 22 nt, Homo sapiens
gucucccagccuacauauuucu

SEQ ID NO: 52287 - RNA, 22 nt, Homo sapiens
gucuggcuccuucuacuacaug

SEQ ID NO: 52288 - RNA, 22 nt, Homo sapiens
gucuguuugauccagaucaaaa

SEQ ID NO: 52289 - RNA, 22 nt, Homo sapiens
gucuguuuggggaccuguggcc

SEQ ID NO: 52290 - RNA, 20 nt, Homo sapiens
gucuugcuccguugcccagg

SEQ ID NO: 52291 - RNA, 22 nt, Homo sapiens
gugaaagacauauaugguuuga

SEQ ID NO: 52292 - RNA, 21 nt, Homo sapiens
gugaggaguuacuggcuuuga

SEQ ID NO: 52293 - RNA, 22 nt, Homo sapiens
gugagucagucuguguagggcu

SEQ ID NO: 52294 - RNA, 22 nt, Homo sapiens
gugaugcaguacguagaggaga

SEQ ID NO: 52295 - RNA, 22 nt, Homo sapiens
guggaagguaaugcagcuuacu

SEQ ID NO: 52296 - RNA, 22 nt, Homo sapiens
guggaaguguaaaagcucuugg

SEQ ID NO: 52297 - RNA, 22 nt, Homo sapiens
guggcuagaaugaagguagcug

SEQ ID NO: 52298 - RNA, 22 nt, Homo sapiens
gugguucuaaaccuuuuuuggu

SEQ ID NO: 52299 - RNA, 20 nt, Homo sapiens
gugugcauuucagauuuugg

SEQ ID NO: 52300 - RNA, 22 nt, Homo sapiens
guuuaacugguacuucaagucu

SEQ ID NO: 52301 - RNA, 22 nt, Homo sapiens
uaaacacucacuucauagccau

SEQ ID NO: 52302 - RNA, 18 nt, Homo sapiens
uaaaggcacuguguuguu

SEQ ID NO: 52303 - RNA, 22 nt, Homo sapiens
uaaaguucuuuuaugggccggg

SEQ ID NO: 52304 - RNA, 22 nt, Homo sapiens
uaaaugacugucaguagaugaa

SEQ ID NO: 52305 - RNA, 22 nt, Homo sapiens
uaacaagagagucagucagucc

SEQ ID NO: 52306 - RNA, 19 nt, Homo sapiens
uaacacaguuguguuugag

SEQ ID NO: 52307 - RNA, 18 nt, Homo sapiens
uaacagucucucaggauc

SEQ ID NO: 52308 - RNA, 22 nt, Homo sapiens
uaaggaaggcugugugcuuuua

SEQ ID NO: 52309 - RNA, 22 nt, Homo sapiens
uaaguaguguugagacaaguuu

SEQ ID NO: 52310 - RNA, 22 nt, Homo sapiens
uaaguauagguaacagaagcaa

SEQ ID NO: 52311 - RNA, 22 nt, Homo sapiens
uaaugcauacagaagguguuuu

SEQ ID NO: 52312 - RNA, 22 nt, Homo sapiens
uaaugcaucaugguuggcaaac

SEQ ID NO: 52313 - RNA, 22 nt, Homo sapiens
uaauugcaguucuguguuauau

SEQ ID NO: 52314 - RNA, 22 nt, Homo sapiens
uacaaguauuuuuauuagugcc

SEQ ID NO: 52315 - RNA, 21 nt, Homo sapiens
uacaaugcacaggagagccuc

SEQ ID NO: 52316 - RNA, 22 nt, Homo sapiens
uacacagucaaaaauuuccagg

SEQ ID NO: 52317 - RNA, 22 nt, Homo sapiens
uacagcuaugugcaugcaugcu

SEQ ID NO: 52318 - RNA, 22 nt, Homo sapiens
uacagucacauuccugaccaua

SEQ ID NO: 52319 - RNA, 22 nt, Homo sapiens
uacaguggcaugucaggugcuu

SEQ ID NO: 52320 - RNA, 22 nt, Homo sapiens
uaccacaggcuggguaaucuau

SEQ ID NO: 52321 - RNA, 23 nt, Homo sapiens
uaccacauuccuucuuuccuguu

SEQ ID NO: 52322 - RNA, 22 nt, Homo sapiens
uaccaugaagguggagagagaa

SEQ ID NO: 52323 - RNA, 22 nt, Homo sapiens
uacuuuguagagugugagaauu

SEQ ID NO: 52324 - RNA, 22 nt, Homo sapiens
uagaccaauuggcauauaguaa

SEQ ID NO: 52325 - RNA, 22 nt, Homo sapiens
uagagguucuaagauucucaga

SEQ ID NO: 52326 - RNA, 20 nt, Homo sapiens
uagcacaucuggcuguagag

SEQ ID NO: 52327 - RNA, 22 nt, Homo sapiens
uagcaguuguuguuacuuguau

SEQ ID NO: 52328 - RNA, 22 nt, Homo sapiens
uagcugcauccugugcacucaa

SEQ ID NO: 52329 - RNA, 17 nt, Homo sapiens
uagcuucacauuaggaa

SEQ ID NO: 52330 - RNA, 23 nt, Homo sapiens
uagcuucucccagaccugcuccc

SEQ ID NO: 52331 - RNA, 22 nt, Homo sapiens
uaggagcacaaaccccauugug

SEQ ID NO: 52332 - RNA, 22 nt, Homo sapiens
uaggcaaguugcccaaucucuc

SEQ ID NO: 52333 - RNA, 22 nt, Homo sapiens
uagggaguguccuuucgggaaa

SEQ ID NO: 52334 - RNA, 22 nt, Homo sapiens
uagguaggaaguguuguuuuua

SEQ ID NO: 52335 - RNA, 22 nt, Homo sapiens
uagguaggauagucuuuauuuu

SEQ ID NO: 52336 - RNA, 22 nt, Homo sapiens
uagguaggugucauaauccaug

SEQ ID NO: 52337 - RNA, 22 nt, Homo sapiens
uaguaucacauggucuuaauua

SEQ ID NO: 52338 - RNA, 22 nt, Homo sapiens
uauagcuuaaaguuuagauccu

SEQ ID NO: 52339 - RNA, 22 nt, Homo sapiens
uauaugcaacauaguguaugug

SEQ ID NO: 52340 - RNA, 22 nt, Homo sapiens
uauaugcacucagguguaugug

SEQ ID NO: 52341 - RNA, 22 nt, Homo sapiens
aaugccacugugccugccaagg

SEQ ID NO: 52342 - RNA, 22 nt, Homo sapiens
aauggcaucuacguuaaauguc

SEQ ID NO: 52343 - RNA, 22 nt, Homo sapiens
aauggcaucuagaguggugaau

SEQ ID NO: 52344 - RNA, 22 nt, Homo sapiens
aauggcucugauguuguuguga

SEQ ID NO: 52345 - RNA, 18 nt, Homo sapiens
aauggcucuggguucuaa

SEQ ID NO: 52346 - RNA, 22 nt, Homo sapiens
aauugcuucuguauuuuggaca

SEQ ID NO: 52347 - RNA, 22 nt, Homo sapiens
aauugcuuuuauuuagggccag

SEQ ID NO: 52348 - RNA, 22 nt, Homo sapiens
acaaaguaggcagugggcugga

SEQ ID NO: 52349 - RNA, 22 nt, Homo sapiens
acacaaugguaaguguuugugu

SEQ ID NO: 52350 - RNA, 22 nt, Homo sapiens
acacaguauaugacaaugcuuu

SEQ ID NO: 52351 - RNA, 22 nt, Homo sapiens
acaccuguggucccaguaacuu

SEQ ID NO: 52352 - RNA, 22 nt, Homo sapiens
acacuguauccuucuguccuuu

SEQ ID NO: 52353 - RNA, 22 nt, Homo sapiens
acacuguccaguuaggcuacau

SEQ ID NO: 52354 - RNA, 19 nt, Homo sapiens
acagauagaauguucuaca

SEQ ID NO: 52355 - RNA, 22 nt, Homo sapiens
acagguauagaaagcuaaaggg

SEQ ID NO: 52356 - RNA, 22 nt, Homo sapiens
acagugcuucugauaugaugcc

SEQ ID NO: 52357 - RNA, 22 nt, Homo sapiens
acagugcuuucaauguucagua

SEQ ID NO: 52358 - RNA, 22 nt, Homo sapiens
acauaguagacacugaaaauau

SEQ ID NO: 52359 - RNA, 22 nt, Homo sapiens
acauggcuuaugaauuuggaga

SEQ ID NO: 52360 - RNA, 22 nt, Homo sapiens
acauugcucuuaccaaguuugu

SEQ ID NO: 52361 - RNA, 19 nt, Homo sapiens
accagauugcauucuugga

SEQ ID NO: 52362 - RNA, 22 nt, Homo sapiens
acccuguugagcaacuggccau

SEQ ID NO: 52363 - RNA, 22 nt, Homo sapiens
acccuguugguggaucagauug

SEQ ID NO: 52364 - RNA, 22 nt, Homo sapiens
acucacagcaaccuccgccucc

SEQ ID NO: 52365 - RNA, 22 nt, Homo sapiens
acugagucauugaggcccucuc

SEQ ID NO: 52366 - RNA, 22 nt, Homo sapiens
acugagucauugggugcccaga

SEQ ID NO: 52367 - RNA, 22 nt, Homo sapiens
acuuuuugauggggagaacauu

SEQ ID NO: 52368 - RNA, 22 nt, Homo sapiens
acuuuuugcaaccauuuggacc

SEQ ID NO: 52369 - RNA, 22 nt, Homo sapiens
agaaacauucucuugccuccuu

SEQ ID NO: 52370 - RNA, 22 nt, Homo sapiens
agaaugauccuucucagaggca

SEQ ID NO: 52371 - RNA, 22 nt, Homo sapiens
agagaccuguaaaguucaggca

SEQ ID NO: 52372 - RNA, 22 nt, Homo sapiens
agagcaaugggugaauauuaaa

SEQ ID NO: 52373 - RNA, 23 nt, Homo sapiens
agcaaaugcucuagcacuccaac

SEQ ID NO: 52374 - RNA, 22 nt, Homo sapiens
agcaauaugacauugcuacauc

SEQ ID NO: 52375 - RNA, 22 nt, Homo sapiens
agcacacuggguggcuuaaaca

SEQ ID NO: 52376 - RNA, 22 nt, Homo sapiens
agcaccagaaucugaguuauuc

SEQ ID NO: 52377 - RNA, 23 nt, Homo sapiens
agcaccuuuccuccacuaucugc

SEQ ID NO: 52378 - RNA, 20 nt, Homo sapiens
agcagccacagauuccucag

SEQ ID NO: 52379 - RNA, 20 nt, Homo sapiens
agcaucguuguguuauagcc

SEQ ID NO: 52380 - RNA, 22 nt, Homo sapiens
agcauggucacuuugggcccca

SEQ ID NO: 52381 - RNA, 22 nt, Homo sapiens
agcauuaguugugaagccuuua

SEQ ID NO: 52382 - RNA, 22 nt, Homo sapiens
agcucacagccuagcacuguga

SEQ ID NO: 52383 - RNA, 22 nt, Homo sapiens
agcuccuuugcuuuuuccagga

SEQ ID NO: 52384 - RNA, 20 nt, Homo sapiens
agcugcagauauaaauccgc

SEQ ID NO: 52385 - RNA, 22 nt, Homo sapiens
agcuggcuguggagaaaccccu

SEQ ID NO: 52386 - RNA, 20 nt, Homo sapiens
gcaaaguuuagcucccacua

SEQ ID NO: 52387 - RNA, 22 nt, Homo sapiens
gcaguacacuguugguaggaau

SEQ ID NO: 52388 - RNA, 22 nt, Homo sapiens
gcaguauuguugaaauguccau

SEQ ID NO: 52389 - RNA, 22 nt, Homo sapiens
gcaugcacaugugaaaaaauga

SEQ ID NO: 52390 - RNA, 22 nt, Homo sapiens
gcauggaguggaaauucuuggg

SEQ ID NO: 52391 - RNA, 22 nt, Homo sapiens
gcccagauguuuggggucaugg

SEQ ID NO: 52392 - RNA, 22 nt, Homo sapiens
gccugagaggauaugauccccu

SEQ ID NO: 52393 - RNA, 22 nt, Homo sapiens
gcuuuguuaaaacacagccaca

SEQ ID NO: 52394 - RNA, 22 nt, Homo sapiens
ggaagaauauuaggggauuucg

SEQ ID NO: 52395 - RNA, 18 nt, Homo sapiens
ggaagauuggcuaugugc

SEQ ID NO: 52396 - RNA, 22 nt, Homo sapiens
ggacuagggacauggggagcug

SEQ ID NO: 52397 - RNA, 22 nt, Homo sapiens
ggacugagaggacuacagugua

SEQ ID NO: 52398 - RNA, 22 nt, Homo sapiens
ggagaauguaauugguauuuug

SEQ ID NO: 52399 - RNA, 22 nt, Homo sapiens
ggaguaggcuguccggcaccca

SEQ ID NO: 52400 - RNA, 22 nt, Homo sapiens
ggcaagaucuuggcucacugaa

SEQ ID NO: 52401 - RNA, 22 nt, Homo sapiens
ggcuagaauagggauagaccuu

SEQ ID NO: 52402 - RNA, 22 nt, Homo sapiens
gggaguagagaguuucucugac

SEQ ID NO: 52403 - RNA, 22 nt, Homo sapiens
ggggaauguuaaagaauuugca

SEQ ID NO: 52404 - RNA, 22 nt, Homo sapiens
ggggcauugugucuggguuccu

SEQ ID NO: 52405 - RNA, 22 nt, Homo sapiens
ggugacugguuuaucuggcagu

SEQ ID NO: 52406 - RNA, 21 nt, Homo sapiens
ggugagaaaggagacauagac

SEQ ID NO: 52407 - RNA, 22 nt, Homo sapiens
ggugaggaaaguugaguuucua

SEQ ID NO: 52408 - RNA, 22 nt, Homo sapiens
guacaguauaguaauaggauuu

SEQ ID NO: 52409 - RNA, 22 nt, Homo sapiens
guacaguuuagugcuuugagaa

SEQ ID NO: 52410 - RNA, 22 nt, Homo sapiens
guaccacaguugcucacggguu

SEQ ID NO: 52411 - RNA, 22 nt, Homo sapiens
guauacuucugaaaauagcuau

SEQ ID NO: 52412 - RNA, 22 nt, Homo sapiens
guaucaucauguuggccaggcu

SEQ ID NO: 52413 - RNA, 19 nt, Homo sapiens
gucaaagucgguauucaaa

SEQ ID NO: 52414 - RNA, 22 nt, Homo sapiens
gucacagcacuuuuaguaagug

SEQ ID NO: 52415 - RNA, 22 nt, Homo sapiens
gucauugaaguggaaucaucca

SEQ ID NO: 52416 - RNA, 22 nt, Homo sapiens
gucuggcuccugucuaaucacu

SEQ ID NO: 52417 - RNA, 22 nt, Homo sapiens
gucuuugcuuuuaaccagaggu

SEQ ID NO: 52418 - RNA, 22 nt, Homo sapiens
gugagcaauugauacuugaagu

SEQ ID NO: 52419 - RNA, 22 nt, Homo sapiens
gugaggaaggaaaccugcuagc

SEQ ID NO: 52420 - RNA, 22 nt, Homo sapiens
gugagucaugucccaucugauu

SEQ ID NO: 52421 - RNA, 20 nt, Homo sapiens
gugagucauuaguaaccaaa

SEQ ID NO: 52422 - RNA, 22 nt, Homo sapiens
gugauguguuucaacagcuccu

SEQ ID NO: 52423 - RNA, 23 nt, Homo sapiens
gugcaguggcgagauuucggcuc

SEQ ID NO: 52424 - RNA, 22 nt, Homo sapiens
guggaaaauuauugcuguuuuu

SEQ ID NO: 52425 - RNA, 22 nt, Homo sapiens
gugggguaggguaggacucaac

SEQ ID NO: 52426 - RNA, 22 nt, Homo sapiens
gugguucuagaauugaguaucc

SEQ ID NO: 52427 - RNA, 22 nt, Homo sapiens
gugucaguggggagugaucuuc

SEQ ID NO: 52428 - RNA, 22 nt, Homo sapiens
guucaagcaauucugcugccuc

SEQ ID NO: 52429 - RNA, 22 nt, Homo sapiens
guuggaguuaagcaguaaugaa

SEQ ID NO: 52430 - RNA, 22 nt, Homo sapiens
uaaaugcuuaauugaaugugga

SEQ ID NO: 52431 - RNA, 21 nt, Homo sapiens
uaaaugucauacaaagcaaug

SEQ ID NO: 52432 - RNA, 22 nt, Homo sapiens
uaacacccuucuccagguacau

SEQ ID NO: 52433 - RNA, 22 nt, Homo sapiens
uaacagucuccucaagguguug

SEQ ID NO: 52434 - RNA, 22 nt, Homo sapiens
uaacuaaagagaagucaauguc

SEQ ID NO: 52435 - RNA, 22 nt, Homo sapiens
uaacuauagagaauguugagua

SEQ ID NO: 52436 - RNA, 22 nt, Homo sapiens
uaaugcaucagugguaguucuu

SEQ ID NO: 52437 - RNA, 22 nt, Homo sapiens
uacaagcacaggcagcaggcug

SEQ ID NO: 52438 - RNA, 18 nt, Homo sapiens
uggauaugaaauucugga

SEQ ID NO: 52439 - RNA, 22 nt, Homo sapiens
uggcgagaugcucgugugcaga

SEQ ID NO: 52440 - RNA, 19 nt, Homo sapiens
uggcuagaggccaggcguu

SEQ ID NO: 52441 - RNA, 22 nt, Homo sapiens
ugguauguguucuaaaauuaug

SEQ ID NO: 52442 - RNA, 22 nt, Homo sapiens
uggucaguugugccucaauucc

SEQ ID NO: 52443 - RNA, 22 nt, Homo sapiens
uguauagaucugauucaucucc

SEQ ID NO: 52444 - RNA, 22 nt, Homo sapiens
uguaugaguuguuuauaaauuu

SEQ ID NO: 52445 - RNA, 22 nt, Homo sapiens
ugucaccauuuguaggugagga

SEQ ID NO: 52446 - RNA, 22 nt, Homo sapiens
ugucauauagaauguucuauga

SEQ ID NO: 52447 - RNA, 22 nt, Homo sapiens
ugucauguggcuaacgauucau

SEQ ID NO: 52448 - RNA, 22 nt, Homo sapiens
uguccuguaggaggcagaacaa

SEQ ID NO: 52449 - RNA, 22 nt, Homo sapiens
ugugacagguauccuguguucu

SEQ ID NO: 52450 - RNA, 22 nt, Homo sapiens
ugugagacugguucugaaccca

SEQ ID NO: 52451 - RNA, 18 nt, Homo sapiens
ugugcaauauuaaccacc

SEQ ID NO: 52452 - RNA, 22 nt, Homo sapiens
ugugcgugugccuguaagaauu

SEQ ID NO: 52453 - RNA, 22 nt, Homo sapiens
uguggcaaagucuugugaauau

SEQ ID NO: 52454 - RNA, 23 nt, Homo sapiens
ugugguauuauuccauuuauagg

SEQ ID NO: 52455 - RNA, 22 nt, Homo sapiens
uguuaagaugucaauuuuccac

SEQ ID NO: 52456 - RNA, 22 nt, Homo sapiens
uguuacacugugcacuaaauuu

SEQ ID NO: 52457 - RNA, 22 nt, Homo sapiens
uguuagguuggugcaaaaguga

SEQ ID NO: 52458 - RNA, 22 nt, Homo sapiens
uguuuaguuaagacauagaauu

SEQ ID NO: 52459 - RNA, 22 nt, Homo sapiens
uguuuuggaguggacuuugcau

SEQ ID NO: 52460 - RNA, 22 nt, Homo sapiens
uuaaacugcuugaauuggguuu

SEQ ID NO: 52461 - RNA, 22 nt, Homo sapiens
ggcaagugucagcagcaacacc

SEQ ID NO: 52462 - RNA, 22 nt, Homo sapiens
ggcagguaaggagugggagccu

SEQ ID NO: 52463 - RNA, 22 nt, Homo sapiens
gggaaauguaaagucauaagau

SEQ ID NO: 52464 - RNA, 22 nt, Homo sapiens
gggagguaggaguuauuauuuu

SEQ ID NO: 52465 - RNA, 22 nt, Homo sapiens
gggaucauuuuucauccuacag

SEQ ID NO: 52466 - RNA, 22 nt, Homo sapiens
gggccagaugcauuuguuauuu

SEQ ID NO: 52467 - RNA, 22 nt, Homo sapiens
gguaaaucuucacuaagacuga

SEQ ID NO: 52468 - RNA, 22 nt, Homo sapiens
ggucauagagaauucaccagga

SEQ ID NO: 52469 - RNA, 22 nt, Homo sapiens
guaaauaccaguuucuggaaca

SEQ ID NO: 52470 - RNA, 22 nt, Homo sapiens
guaaaugcagaugcaugaccuu

SEQ ID NO: 52471 - RNA, 22 nt, Homo sapiens
guaaucuguaguaaagcaccau

SEQ ID NO: 52472 - RNA, 22 nt, Homo sapiens
guaguuuaucagaaagaauagg

SEQ ID NO: 52473 - RNA, 22 nt, Homo sapiens
guaucauugccuaaugcucuca

SEQ ID NO: 52474 - RNA, 22 nt, Homo sapiens
guccuguuuuuaagguucauag

SEQ ID NO: 52475 - RNA, 22 nt, Homo sapiens
gucuggcuuaucucacuuacca

SEQ ID NO: 52476 - RNA, 21 nt, Homo sapiens
gucuuacagccagaugccucu

SEQ ID NO: 52477 - RNA, 22 nt, Homo sapiens
gugaaagauuaaaccagugugu

SEQ ID NO: 52478 - RNA, 22 nt, Homo sapiens
gugaaauacauaaucccaagug

SEQ ID NO: 52479 - RNA, 22 nt, Homo sapiens
gugaaauauuuaacguccaggu

SEQ ID NO: 52480 - RNA, 22 nt, Homo sapiens
gugagaugugacuucugccucu

SEQ ID NO: 52481 - RNA, 22 nt, Homo sapiens
gugagcaguguccuugggggca

SEQ ID NO: 52482 - RNA, 22 nt, Homo sapiens
gugagucaaucugagggguuca

SEQ ID NO: 52483 - RNA, 22 nt, Homo sapiens
gugaucucagcucacuggaacc

SEQ ID NO: 52484 - RNA, 22 nt, Homo sapiens
gugcaaacuccaggucucuuca

SEQ ID NO: 52485 - RNA, 22 nt, Homo sapiens
gugguguuugagcugccaggga

SEQ ID NO: 52486 - RNA, 22 nt, Homo sapiens
gugucaugaagguuuuaugcag

SEQ ID NO: 52487 - RNA, 22 nt, Homo sapiens
gugugcacaaucuggcaugugc

SEQ ID NO: 52488 - RNA, 19 nt, Homo sapiens
gugugcauaucacagagca

SEQ ID NO: 52489 - RNA, 22 nt, Homo sapiens
guguuugguugauagagccacu

SEQ ID NO: 52490 - RNA, 22 nt, Homo sapiens
guuacagucuuguguaagguua

SEQ ID NO: 52491 - RNA, 22 nt, Homo sapiens
guuagugcuuauuaaauaguau

SEQ ID NO: 52492 - RNA, 22 nt, Homo sapiens
uaaacugcuugaaaugguguca

SEQ ID NO: 52493 - RNA, 22 nt, Homo sapiens
uaaacugucuuuggagcuuugc

SEQ ID NO: 52494 - RNA, 22 nt, Homo sapiens
uaagacuguguaauuuaugaag

SEQ ID NO: 52495 - RNA, 22 nt, Homo sapiens
uaaguacuuuacagacauuauc

SEQ ID NO: 52496 - RNA, 22 nt, Homo sapiens
uaaguaguccugauuuaaccuu

SEQ ID NO: 52497 - RNA, 22 nt, Homo sapiens
uaaguuguagaacguuuucuua

SEQ ID NO: 52498 - RNA, 22 nt, Homo sapiens
uaauaauguuaggcuuacucaa

SEQ ID NO: 52499 - RNA, 22 nt, Homo sapiens
uacaaaguaacaguuccuguau

SEQ ID NO: 52500 - RNA, 22 nt, Homo sapiens
uacaccaauuuaaucaaaagca

SEQ ID NO: 52501 - RNA, 22 nt, Homo sapiens
uacaguaggauuuucagggucu

SEQ ID NO: 52502 - RNA, 22 nt, Homo sapiens
uacagucauaaugccuagugac

SEQ ID NO: 52503 - RNA, 22 nt, Homo sapiens
uacaugcaugggcaugugugca

SEQ ID NO: 52504 - RNA, 22 nt, Homo sapiens
uaccagcauuucucuuuaagua

SEQ ID NO: 52505 - RNA, 22 nt, Homo sapiens
uaccaguaaugguucuagagga

SEQ ID NO: 52506 - RNA, 22 nt, Homo sapiens
uacucacauucuguuucuugcu

SEQ ID NO: 52507 - RNA, 22 nt, Homo sapiens
uacucaguagacacucauaugu

SEQ ID NO: 52508 - RNA, 22 nt, Homo sapiens
uacugagagaggaauauugaaa

SEQ ID NO: 52509 - RNA, 22 nt, Homo sapiens
uagcaaaucaauggaauugaag

SEQ ID NO: 52510 - RNA, 22 nt, Homo sapiens
uagcaccaaacauauacucagu

SEQ ID NO: 52511 - RNA, 22 nt, Homo sapiens
uagcaccaggguugacugaccu

SEQ ID NO: 52512 - RNA, 22 nt, Homo sapiens
uagcuguuggugggaagucaga

SEQ ID NO: 52513 - RNA, 22 nt, Homo sapiens
uagguagguggaaaaguaauug

SEQ ID NO: 52514 - RNA, 22 nt, Homo sapiens
uaguguuuuucauuggcagagg

SEQ ID NO: 52515 - RNA, 17 nt, Homo sapiens
uauagcacuucucacau

SEQ ID NO: 52516 - RNA, 22 nt, Homo sapiens
uauagcagugaguauugacuaa

SEQ ID NO: 52517 - RNA, 22 nt, Homo sapiens
uaucacacuguuggauuugauu

SEQ ID NO: 52518 - RNA, 22 nt, Homo sapiens
uaucaccuugguagucuugggg

SEQ ID NO: 52519 - RNA, 22 nt, Homo sapiens
uaucccuguggacuucccaaca

SEQ ID NO: 52520 - RNA, 22 nt, Homo sapiens
uaugaaagcuacuucucacaau

SEQ ID NO: 52521 - RNA, 22 nt, Homo sapiens
uaugacauaguccuuaacccuc

SEQ ID NO: 52522 - RNA, 22 nt, Homo sapiens
uaugauuuuugggagaggucaa

SEQ ID NO: 52523 - RNA, 19 nt, Homo sapiens
uaugcaacuuauagugcug

SEQ ID NO: 52524 - RNA, 22 nt, Homo sapiens
uaugucauggguaaagugcccu

SEQ ID NO: 52525 - RNA, 22 nt, Homo sapiens
uaugugcacaugcccuggugac

SEQ ID NO: 52526 - RNA, 22 nt, Homo sapiens
ugugaagaugagaugacgcccu

SEQ ID NO: 52527 - RNA, 22 nt, Homo sapiens
ugugaauguaagaaaauccaac

SEQ ID NO: 52528 - RNA, 22 nt, Homo sapiens
ugugaguguguacuaguuauca

SEQ ID NO: 52529 - RNA, 22 nt, Homo sapiens
ugugauguggagggcagaucca

SEQ ID NO: 52530 - RNA, 22 nt, Homo sapiens
ugugcaaauuagcacaacccga

SEQ ID NO: 52531 - RNA, 22 nt, Homo sapiens
ugugccuaguaauguguccaga

SEQ ID NO: 52532 - RNA, 22 nt, Homo sapiens
ugugcguguaagagaucuaggu

SEQ ID NO: 52533 - RNA, 22 nt, Homo sapiens
uguggaaauggugcuacgaaca

SEQ ID NO: 52534 - RNA, 22 nt, Homo sapiens
uguggccuuuguuucaguuggg

SEQ ID NO: 52535 - RNA, 22 nt, Homo sapiens
ugugucacugcacuccagccug

SEQ ID NO: 52536 - RNA, 22 nt, Homo sapiens
ugugucuccugaaaauucacau

SEQ ID NO: 52537 - RNA, 22 nt, Homo sapiens
uguguuugauaaguccauaguu

SEQ ID NO: 52538 - RNA, 22 nt, Homo sapiens
uguuacagugacuaauguuuua

SEQ ID NO: 52539 - RNA, 22 nt, Homo sapiens
uguuuuggaggccagaagucca

SEQ ID NO: 52540 - RNA, 22 nt, Homo sapiens
uguuuugguugucccuggccag

SEQ ID NO: 52541 - RNA, 22 nt, Homo sapiens
uuaaagccauaccugagagagu

SEQ ID NO: 52542 - RNA, 22 nt, Homo sapiens
uuaaaugcauagaauguguagu

SEQ ID NO: 52543 - RNA, 22 nt, Homo sapiens
uuaacagucacuuagcucauuu

SEQ ID NO: 52544 - RNA, 22 nt, Homo sapiens
uuaacaguugcaugagacugag

SEQ ID NO: 52545 - RNA, 22 nt, Homo sapiens
uuaaaugcacauacuugagaaa

SEQ ID NO: 52546 - RNA, 22 nt, Homo sapiens
uuaaaugcuagaauuuucuuug

SEQ ID NO: 52547 - RNA, 22 nt, Homo sapiens
uuaagaagugauuuuccucauu

SEQ ID NO: 52548 - RNA, 22 nt, Homo sapiens
uuaauuguccaaguucaucucu

SEQ ID NO: 52549 - RNA, 22 nt, Homo sapiens
uuacaguagaugaggguauaau

SEQ ID NO: 52550 - RNA, 22 nt, Homo sapiens
uuacagucaaguuacauuucuc

SEQ ID NO: 52551 - RNA, 22 nt, Homo sapiens
uuacagucuuaggcagugcuuu

SEQ ID NO: 52552 - RNA, 22 nt, Homo sapiens
uuaccacagugccugucuaaug

SEQ ID NO: 52553 - RNA, 22 nt, Homo sapiens
uuagauguuugacugggccuua

SEQ ID NO: 52554 - RNA, 22 nt, Homo sapiens
uuagcagcaucccuggccugua

SEQ ID NO: 52555 - RNA, 22 nt, Homo sapiens
uuagcagcucuggugacaaggu

SEQ ID NO: 52556 - RNA, 22 nt, Homo sapiens
uuagugaaugggugugauuugu

SEQ ID NO: 52557 - RNA, 20 nt, Homo sapiens
uuauaacuuuuguucugggg

SEQ ID NO: 52558 - RNA, 18 nt, Homo sapiens
uuauaugcauguguagga

SEQ ID NO: 52559 - RNA, 22 nt, Homo sapiens
uuauauguuacucccucuagca

SEQ ID NO: 52560 - RNA, 22 nt, Homo sapiens
uuauauguuucuguuuggaggc

SEQ ID NO: 52561 - RNA, 22 nt, Homo sapiens
uuauauguuuguacuuaggccu

SEQ ID NO: 52562 - RNA, 22 nt, Homo sapiens
uuaucucaguguuuguaaacaa

SEQ ID NO: 52563 - RNA, 22 nt, Homo sapiens
uuauguaaaucaaucuggaauc

SEQ ID NO: 52564 - RNA, 22 nt, Homo sapiens
uuauucauuaauugcuaagguu

SEQ ID NO: 52565 - RNA, 22 nt, Homo sapiens
uucaaaggauuuagauuagcua

SEQ ID NO: 52566 - RNA, 22 nt, Homo sapiens
uucaaaguaaaaauguguucac

SEQ ID NO: 52567 - RNA, 22 nt, Homo sapiens
uucaagauggccccagugagcc

SEQ ID NO: 52568 - RNA, 22 nt, Homo sapiens
uucacagacaacuggucccuua

SEQ ID NO: 52569 - RNA, 22 nt, Homo sapiens
uucacagucacccuucuccaug

SEQ ID NO: 52570 - RNA, 22 nt, Homo sapiens
uucaccaguuuugucacgaaug

SEQ ID NO: 52571 - RNA, 22 nt, Homo sapiens
uucaucaguuauauuggccuga

SEQ ID NO: 52572 - RNA, 22 nt, Homo sapiens
uuccacaaugguugaacuaauu

SEQ ID NO: 52573 - RNA, 22 nt, Homo sapiens
uuccacaggguugaacuaguuu

SEQ ID NO: 52574 - RNA, 22 nt, Homo sapiens
uucccuuugaaacuaaacuugc

SEQ ID NO: 52575 - RNA, 22 nt, Homo sapiens
uucccuuuguuaaauuggaaga

SEQ ID NO: 52576 - RNA, 19 nt, Homo sapiens
uuccugagaacaagggcuu

SEQ ID NO: 52577 - RNA, 22 nt, Homo sapiens
uuccugucuuccaagagagauu

SEQ ID NO: 52578 - RNA, 19 nt, Homo sapiens
uucucugguuguacuaccc

SEQ ID NO: 52579 - RNA, 22 nt, Homo sapiens
uucuggcuuauaaacgugacuu

SEQ ID NO: 52580 - RNA, 22 nt, Homo sapiens
uugaaagaaaggagacugaguu

SEQ ID NO: 52581 - RNA, 22 nt, Homo sapiens
uugaaaguguucacaaugguau

SEQ ID NO: 52582 - RNA, 22 nt, Homo sapiens
uugacuagaccaucuuucuaga

SEQ ID NO: 52583 - RNA, 22 nt, Homo sapiens
uugagaugaagucuugcucucu

SEQ ID NO: 52584 - RNA, 22 nt, Homo sapiens
uugagaugaaguuuugcucuuu

SEQ ID NO: 52585 - RNA, 22 nt, Homo sapiens
uugagauggaaucucgcuuugu

SEQ ID NO: 52586 - RNA, 22 nt, Homo sapiens
uugagauggagucuugcucucu

SEQ ID NO: 52587 - RNA, 22 nt, Homo sapiens
uugagauggaguguugcucugu

SEQ ID NO: 52588 - RNA, 22 nt, Homo sapiens
uugagauguaguuucacuccug

SEQ ID NO: 52589 - RNA, 22 nt, Homo sapiens
uugagcaacauagugagacugu

SEQ ID NO: 52590 - RNA, 22 nt, Homo sapiens
uugaggaaugugauuucaaaua

SEQ ID NO: 52591 - RNA, 22 nt, Homo sapiens
uugaggccugauaacacacuga

SEQ ID NO: 52592 - RNA, 22 nt, Homo sapiens
uugaguagauaccuaggaauag

SEQ ID NO: 52593 - RNA, 18 nt, Homo sapiens
uugcaaauucuucccugu

SEQ ID NO: 52594 - RNA, 22 nt, Homo sapiens
uugcacauuuuuucuggcagaa

SEQ ID NO: 52595 - RNA, 22 nt, Homo sapiens
uugcacuccagccugggugaca

SEQ ID NO: 52596 - RNA, 22 nt, Homo sapiens
uugcacuccagcucuaggugac

SEQ ID NO: 52597 - RNA, 22 nt, Homo sapiens
uugcacucuccagccucggcaa

SEQ ID NO: 52598 - RNA, 19 nt, Homo sapiens
uugcauagguugaaccagc

SEQ ID NO: 52599 - RNA, 19 nt, Homo sapiens
uugcauauguugaaccagc

SEQ ID NO: 52600 - RNA, 22 nt, Homo sapiens
uugccuaggcuggagugcagug

SEQ ID NO: 52601 - RNA, 22 nt, Homo sapiens
uugccuaguuuaggucugugcu

SEQ ID NO: 52602 - RNA, 22 nt, Homo sapiens
uugcucaggcuggaguacaaug

SEQ ID NO: 52603 - RNA, 22 nt, Homo sapiens
uugcugagucuuucuagguugc

SEQ ID NO: 52604 - RNA, 22 nt, Homo sapiens
uuggaaggcugaauggccucuc

SEQ ID NO: 52605 - RNA, 22 nt, Homo sapiens
uuggacuucuaacugacaugga

SEQ ID NO: 52606 - RNA, 22 nt, Homo sapiens
uuggcagcuguggaaucugggc

SEQ ID NO: 52607 - RNA, 22 nt, Homo sapiens
uuggcauugaguuucaaaucau

SEQ ID NO: 52608 - RNA, 22 nt, Homo sapiens
uuguagaucuucaguugcuaca

SEQ ID NO: 52609 - RNA, 19 nt, Homo sapiens
uugucuuagaguugucauu

SEQ ID NO: 52610 - RNA, 22 nt, Homo sapiens
uugugaauggugccacaauaaa

SEQ ID NO: 52611 - RNA, 22 nt, Homo sapiens
uugugauugagugauccuuguu

SEQ ID NO: 52612 - RNA, 22 nt, Homo sapiens
uugugucccugcggcugaggag

SEQ ID NO: 52613 - RNA, 22 nt, Homo sapiens
uuuaaugcacuaggugguguuc

SEQ ID NO: 52614 - RNA, 22 nt, Homo sapiens
aaaacgcauccucacaggucug

SEQ ID NO: 52615 - RNA, 22 nt, Homo sapiens
aaaagcauucagagugcugggc

SEQ ID NO: 52616 - RNA, 22 nt, Homo sapiens
aaaaguucuuugagccuugaca

SEQ ID NO: 52617 - RNA, 22 nt, Homo sapiens
aaaugcaugaggugggaagaaa

SEQ ID NO: 52618 - RNA, 22 nt, Homo sapiens
aaaugucauggaguguuucccc

SEQ ID NO: 52619 - RNA, 21 nt, Homo sapiens
aacagugcugaacagacaccu

SEQ ID NO: 52620 - RNA, 22 nt, Homo sapiens
aacuccauuuuagacccuagau

SEQ ID NO: 52621 - RNA, 22 nt, Homo sapiens
aagagguuguaccuaaaguguu

SEQ ID NO: 52622 - RNA, 22 nt, Homo sapiens
aagcaucacauaauggaucaug

SEQ ID NO: 52623 - RNA, 22 nt, Homo sapiens
aagcuacauuuuauuuauguca

SEQ ID NO: 52624 - RNA, 22 nt, Homo sapiens
aagcuggagugcaguggugcga

SEQ ID NO: 52625 - RNA, 22 nt, Homo sapiens
aagcuggauuucgcauccuguu

SEQ ID NO: 52626 - RNA, 22 nt, Homo sapiens
aaggagcuaagagaucauacau

SEQ ID NO: 52627 - RNA, 22 nt, Homo sapiens
aaggcuagagaagaagggcauc

SEQ ID NO: 52628 - RNA, 22 nt, Homo sapiens
aagguuguauuuaauauacugu

SEQ ID NO: 52629 - RNA, 22 nt, Homo sapiens
aaguacuguuuaaauugcagaa

SEQ ID NO: 52630 - RNA, 22 nt, Homo sapiens
aaguauagcuaugauaaacauu

SEQ ID NO: 52631 - RNA, 20 nt, Homo sapiens
aagugcaucguugugucugc

SEQ ID NO: 52632 - RNA, 22 nt, Homo sapiens
aagugcauguauuaguguaguc

SEQ ID NO: 52633 - RNA, 22 nt, Homo sapiens
aauaugucugcuaauuguuucu

SEQ ID NO: 52634 - RNA, 22 nt, Homo sapiens
aaucagcacacugugcuuucca

SEQ ID NO: 52635 - RNA, 22 nt, Homo sapiens
aaugcuguucuuugcuuaaguu

SEQ ID NO: 52636 - RNA, 23 nt, Homo sapiens
aauugcuuuugaggacuuaguug

SEQ ID NO: 52637 - RNA, 22 nt, Homo sapiens
acaaaguauggaauguuggugu

SEQ ID NO: 52638 - RNA, 22 nt, Homo sapiens
acacauuggcaauucuggagca

SEQ ID NO: 52639 - RNA, 22 nt, Homo sapiens
acacugucaugucucacaggca

SEQ ID NO: 52640 - RNA, 22 nt, Homo sapiens
acacugucugaugaaaguaguu

SEQ ID NO: 52641 - RNA, 22 nt, Homo sapiens
acacuguugacauuuuguagug

SEQ ID NO: 52642 - RNA, 22 nt, Homo sapiens
acacuguuggugggaguguaaa

SEQ ID NO: 52643 - RNA, 20 nt, Homo sapiens
acaguagaagggauuucaaa

SEQ ID NO: 52644 - RNA, 22 nt, Homo sapiens
acaucaggcuugugaugauuac

SEQ ID NO: 52645 - RNA, 22 nt, Homo sapiens
agcugguuuaauaugcugucug

SEQ ID NO: 52646 - RNA, 21 nt, Homo sapiens
agcugguuuccacagugugcu

SEQ ID NO: 52647 - RNA, 20 nt, Homo sapiens
agcugguuuuaugaaucuuu

SEQ ID NO: 52648 - RNA, 22 nt, Homo sapiens
agcuucauuguuaugaauguca

SEQ ID NO: 52649 - RNA, 22 nt, Homo sapiens
aggaagguaaacuaacuugccu

SEQ ID NO: 52650 - RNA, 22 nt, Homo sapiens
aggaauggaaacuuuugauggu

SEQ ID NO: 52651 - RNA, 22 nt, Homo sapiens
aggagguagaacauugccauuu

SEQ ID NO: 52652 - RNA, 22 nt, Homo sapiens
aggagguagucugucccuuagc

SEQ ID NO: 52653 - RNA, 22 nt, Homo sapiens
aggcauguggcucuguucugac

SEQ ID NO: 52654 - RNA, 22 nt, Homo sapiens
aggcuuuuguuuuggucucagg

SEQ ID NO: 52655 - RNA, 22 nt, Homo sapiens
agggagcaaaguggucuuucuc

SEQ ID NO: 52656 - RNA, 22 nt, Homo sapiens
agguaguguuauuugcagcuga

SEQ ID NO: 52657 - RNA, 22 nt, Homo sapiens
aguacugucagcaggguguuga

SEQ ID NO: 52658 - RNA, 22 nt, Homo sapiens
agugccaaaucgagggcucuga

SEQ ID NO: 52659 - RNA, 22 nt, Homo sapiens
agugguaguacaggagauaccg

SEQ ID NO: 52660 - RNA, 23 nt, Homo sapiens
aguggucuccugggcccagcugu

SEQ ID NO: 52661 - RNA, 22 nt, Homo sapiens
agugguuugaucacagcucacu

SEQ ID NO: 52662 - RNA, 22 nt, Homo sapiens
auaaaugcaaugguauuuuuga

SEQ ID NO: 52663 - RNA, 19 nt, Homo sapiens
auaaaugccuacaagggug

SEQ ID NO: 52664 - RNA, 22 nt, Homo sapiens
auaaaugcuuagaucuguauau

SEQ ID NO: 52665 - RNA, 22 nt, Homo sapiens
auaauaccugccucagagaguu

SEQ ID NO: 52666 - RNA, 22 nt, Homo sapiens
auaauagcugaucauuuagaag

SEQ ID NO: 52667 - RNA, 22 nt, Homo sapiens
auaaucacacccagguuaaaug

SEQ ID NO: 52668 - RNA, 22 nt, Homo sapiens
auacagcuaaaauauuaaguua

SEQ ID NO: 52669 - RNA, 22 nt, Homo sapiens
auacagucuguuagauuuccuc

SEQ ID NO: 52670 - RNA, 16 nt, Homo sapiens
auaccacagugacaca

SEQ ID NO: 52671 - RNA, 22 nt, Homo sapiens
auagcagcauauguaauguuga

SEQ ID NO: 52672 - RNA, 22 nt, Homo sapiens
auagcagugugaaaauguacua

SEQ ID NO: 52673 - RNA, 22 nt, Homo sapiens
auagcauaucccacaugucaga

SEQ ID NO: 52674 - RNA, 22 nt, Homo sapiens
auaucaacaucgugucauuagu

SEQ ID NO: 52675 - RNA, 20 nt, Homo sapiens
auaugcauguguuuucacuu

SEQ ID NO: 52676 - RNA, 22 nt, Homo sapiens
auauuggacucugugcuaggaa

SEQ ID NO: 52677 - RNA, 22 nt, Homo sapiens
aucaaagugaauuaaugagaau

SEQ ID NO: 52678 - RNA, 23 nt, Homo sapiens
aucagguuguagaauguguuugc

SEQ ID NO: 52679 - RNA, 22 nt, Homo sapiens
aucauccagccccagaagggag

SEQ ID NO: 52680 - RNA, 22 nt, Homo sapiens
aucauggaguauuugcaagucu

SEQ ID NO: 52681 - RNA, 22 nt, Homo sapiens
auccucugagaucuaggcagag

SEQ ID NO: 52682 - RNA, 22 nt, Homo sapiens
aucuacuugcugggucucugga

SEQ ID NO: 52683 - RNA, 22 nt, Homo sapiens
aucuuugauuagacugauggau

SEQ ID NO: 52684 - RNA, 22 nt, Homo sapiens
augaaauguaugagucuggguu

SEQ ID NO: 52685 - RNA, 22 nt, Homo sapiens
augaagcuagcugauugcugau

SEQ ID NO: 52686 - RNA, 22 nt, Homo sapiens
augaggaaggagccuuugucug

SEQ ID NO: 52687 - RNA, 22 nt, Homo sapiens
augaggagguaugauuuucuga

SEQ ID NO: 52688 - RNA, 22 nt, Homo sapiens
augauacugaguugaguucuca

SEQ ID NO: 52689 - RNA, 22 nt, Homo sapiens
augaugcugagguuugggguau

SEQ ID NO: 52690 - RNA, 20 nt, Homo sapiens
auaaauguauagguguacau

SEQ ID NO: 52691 - RNA, 22 nt, Homo sapiens
auaaccuauggaucuacucggg

SEQ ID NO: 52692 - RNA, 22 nt, Homo sapiens
auaagagcaggcuucuggccag

SEQ ID NO: 52693 - RNA, 22 nt, Homo sapiens
auagcagaacagugucucacug

SEQ ID NO: 52694 - RNA, 22 nt, Homo sapiens
auagcagaauuuggucaagucu

SEQ ID NO: 52695 - RNA, 22 nt, Homo sapiens
auauucacagguaucagagauu

SEQ ID NO: 52696 - RNA, 22 nt, Homo sapiens
aucacaguuuuaccauuuggua

SEQ ID NO: 52697 - RNA, 22 nt, Homo sapiens
gugccacaguguuaagggauuc

SEQ ID NO: 52698 - RNA, 22 nt, Homo sapiens
guggaaaucucugugugacuua

SEQ ID NO: 52699 - RNA, 20 nt, Homo sapiens
guggaagauaaguagccuga

SEQ ID NO: 52700 - RNA, 22 nt, Homo sapiens
gugggaugaucacaguucacug

SEQ ID NO: 52701 - RNA, 22 nt, Homo sapiens
guguaugugagaaugcucaugu

SEQ ID NO: 52702 - RNA, 22 nt, Homo sapiens
guuauuguccauuuauuuagca

SEQ ID NO: 52703 - RNA, 22 nt, Homo sapiens
guuugcagaucaugaagaaccc

SEQ ID NO: 52704 - RNA, 22 nt, Homo sapiens
uaaagccuagaacuuucagccc

SEQ ID NO: 52705 - RNA, 22 nt, Homo sapiens
uaacagucaagguuugaccagg

SEQ ID NO: 52706 - RNA, 22 nt, Homo sapiens
uaacucugccuagugacauggu

SEQ ID NO: 52707 - RNA, 22 nt, Homo sapiens
uaaggcucuuguuauuuugagg

SEQ ID NO: 52708 - RNA, 22 nt, Homo sapiens
uaaguagugugcauguauguau

SEQ ID NO: 52709 - RNA, 22 nt, Homo sapiens
uaagugcaugauuacaugcaua

SEQ ID NO: 52710 - RNA, 23 nt, Homo sapiens
uaaguucaucucuaauaggugga

SEQ ID NO: 52711 - RNA, 22 nt, Homo sapiens
uaaguucauucaugaaacuuag

SEQ ID NO: 52712 - RNA, 22 nt, Homo sapiens
uaaugcauguaaugggcugaua

SEQ ID NO: 52713 - RNA, 22 nt, Homo sapiens
uacaaagugggaaacgaagguu

SEQ ID NO: 52714 - RNA, 22 nt, Homo sapiens
uacagucuagaggagaaucagg

SEQ ID NO: 52715 - RNA, 22 nt, Homo sapiens
uacauacuucacagacuuuaaa

SEQ ID NO: 52716 - RNA, 22 nt, Homo sapiens
uacauguauccauuguuuuugg

SEQ ID NO: 52717 - RNA, 19 nt, Homo sapiens
uacccagaagcagcauugu

SEQ ID NO: 52718 - RNA, 22 nt, Homo sapiens
uacccucuggauacccuuguuc

SEQ ID NO: 52719 - RNA, 22 nt, Homo sapiens
uacuacuuucugacaucuuuaa

SEQ ID NO: 52720 - RNA, 22 nt, Homo sapiens
uagauuguaauaugcagaaugg

SEQ ID NO: 52721 - RNA, 22 nt, Homo sapiens
uagcaccacaaucaagauacag

SEQ ID NO: 52722 - RNA, 22 nt, Homo sapiens
uagcagccaggaagggcuggcu

SEQ ID NO: 52723 - RNA, 22 nt, Homo sapiens
uagcauaauuuguagaaaauca

SEQ ID NO: 52724 - RNA, 20 nt, Homo sapiens
uaggagcaaugagaguagaa

SEQ ID NO: 52725 - RNA, 22 nt, Homo sapiens
uaggagcacagcagcauguggg

SEQ ID NO: 52726 - RNA, 19 nt, Homo sapiens
uagguacauucaagucucc

SEQ ID NO: 52727 - RNA, 22 nt, Homo sapiens
uagguaggacguaguccuuuug

SEQ ID NO: 52728 - RNA, 22 nt, Homo sapiens
uauacaguaggcacucaguggc

SEQ ID NO: 52729 - RNA, 20 nt, Homo sapiens
uaucacaguucaggaacucu

SEQ ID NO: 52730 - RNA, 22 nt, Homo sapiens
uaucaccacccugggaaacaua

SEQ ID NO: 52731 - RNA, 22 nt, Homo sapiens
uaucaccauguccguuuuaaaa

SEQ ID NO: 52732 - RNA, 19 nt, Homo sapiens
uaucacuucccuggaaaca

SEQ ID NO: 52733 - RNA, 22 nt, Homo sapiens
uaugagacugguuaauuuuugu

SEQ ID NO: 52734 - RNA, 22 nt, Homo sapiens
uauggccuuuuuaaugauauug

SEQ ID NO: 52735 - RNA, 22 nt, Homo sapiens
uauggguuuuugucuguuuacu

SEQ ID NO: 52736 - RNA, 22 nt, Homo sapiens
uauuaagcuaguugucagugcu

SEQ ID NO: 52737 - RNA, 22 nt, Homo sapiens
uauugaacgugggauauugaag

SEQ ID NO: 52738 - RNA, 22 nt, Homo sapiens
uauugcaauuggcagagugcua

SEQ ID NO: 52739 - RNA, 22 nt, Homo sapiens
uauugcacuccagccuuggcaa

SEQ ID NO: 52740 - RNA, 22 nt, Homo sapiens
uauugcuuuugauucaaggcag

SEQ ID NO: 52741 - RNA, 22 nt, Homo sapiens
uauuugcacucccaucauggug

SEQ ID NO: 52742 - RNA, 22 nt, Homo sapiens
ucaaaguauucuucugagaacc

SEQ ID NO: 52743 - RNA, 22 nt, Homo sapiens
ucaaaugcuguauuguaguaau

SEQ ID NO: 52744 - RNA, 22 nt, Homo sapiens
ucaaauguucccuguacuggcc

SEQ ID NO: 52745 - RNA, 22 nt, Homo sapiens
ucaacagugggcacuguaaaug

SEQ ID NO: 52746 - RNA, 22 nt, Homo sapiens
ucaagcaauucgccugucucag

SEQ ID NO: 52747 - RNA, 19 nt, Homo sapiens
ucaagcuauucuccugccu

SEQ ID NO: 52748 - RNA, 23 nt, Homo sapiens
ucacacuuaagagaaaugcagcu

SEQ ID NO: 52749 - RNA, 22 nt, Homo sapiens
ucacagaggagaagaccuuuaa

SEQ ID NO: 52750 - RNA, 22 nt, Homo sapiens
ucacagucggugacuucuugcu

SEQ ID NO: 52751 - RNA, 22 nt, Homo sapiens
ucacauuguacaaacagguaag

SEQ ID NO: 52752 - RNA, 22 nt, Homo sapiens
ucacauuguauauguaccuauc

SEQ ID NO: 52753 - RNA, 22 nt, Homo sapiens
ucacuguugaugggcaugcagg

SEQ ID NO: 52754 - RNA, 22 nt, Homo sapiens
ucagcaaugaccuaagcaaaua

SEQ ID NO: 52755 - RNA, 21 nt, Homo sapiens
ucaggcuuuuugagugccaau

SEQ ID NO: 52756 - RNA, 23 nt, Homo sapiens
ucagguaggccuagaguauucuu

SEQ ID NO: 52757 - RNA, 22 nt, Homo sapiens
ucagguagugccaugauugauu

SEQ ID NO: 52758 - RNA, 22 nt, Homo sapiens
ucagguugcuaaguauaauauu

SEQ ID NO: 52759 - RNA, 23 nt, Homo sapiens
ucaguacuccacuuucaauagug

SEQ ID NO: 52760 - RNA, 20 nt, Homo sapiens
ucauagcuuuuuccacuuua

SEQ ID NO: 52761 - RNA, 22 nt, Homo sapiens
ucauaguacuuuguuuugaaaa

SEQ ID NO: 52762 - RNA, 23 nt, Homo sapiens
ucaucacagcauuuccugguauu

SEQ ID NO: 52763 - RNA, 16 nt, Homo sapiens
ucaucacagucucugg

SEQ ID NO: 52764 - RNA, 22 nt, Homo sapiens
ucaucagaaucccuuagggaug

SEQ ID NO: 52765 - RNA, 22 nt, Homo sapiens
ucaucaggcucauucaagcuga

SEQ ID NO: 52766 - RNA, 23 nt, Homo sapiens
ucaugaggccauucaaauccauu

SEQ ID NO: 52767 - RNA, 22 nt, Homo sapiens
ucauucauucuucaguggguac

SEQ ID NO: 52768 - RNA, 22 nt, Homo sapiens
ucauucauuugcucacuccaca

SEQ ID NO: 52769 - RNA, 22 nt, Homo sapiens
ucauugcuuauuuguuggugga

SEQ ID NO: 52770 - RNA, 22 nt, Homo sapiens
uccacagugguugaacuaguaa

SEQ ID NO: 52771 - RNA, 22 nt, Homo sapiens
uccacagugguugaacuaguuu

SEQ ID NO: 52772 - RNA, 22 nt, Homo sapiens
uccaugagaauaguuaggcucu

SEQ ID NO: 52773 - RNA, 19 nt, Homo sapiens
uccaugagcccacagugau

SEQ ID NO: 52774 - RNA, 22 nt, Homo sapiens
uccauggagacacauuuuauau

SEQ ID NO: 52775 - RNA, 20 nt, Homo sapiens
ucccucaaacuuuuccacug

SEQ ID NO: 52776 - RNA, 22 nt, Homo sapiens
uccuguaaucccagcuaccaga

SEQ ID NO: 52777 - RNA, 22 nt, Homo sapiens
ucggcucagugcaagcucugcc

SEQ ID NO: 52778 - RNA, 22 nt, Homo sapiens
ucuaaguaguagcuggucagaa

SEQ ID NO: 52779 - RNA, 17 nt, Homo sapiens
ucuaauaauaugcauuu

SEQ ID NO: 52780 - RNA, 22 nt, Homo sapiens
ucugagucaucacaaaugaugc

SEQ ID NO: 52781 - RNA, 22 nt, Homo sapiens
ucugccuacugguuggaggaac

SEQ ID NO: 52782 - RNA, 22 nt, Homo sapiens
ucuggccuacaaguaauuuuau

SEQ ID NO: 52783 - RNA, 22 nt, Homo sapiens
ucuggccuccuaugagaaucga

SEQ ID NO: 52784 - RNA, 22 nt, Homo sapiens
ucuggcuuuagcaugugggaag

SEQ ID NO: 52785 - RNA, 22 nt, Homo sapiens
ucugucuuugucaggaccagag

SEQ ID NO: 52786 - RNA, 17 nt, Homo sapiens
ucuucuguuacuguggc

SEQ ID NO: 52787 - RNA, 22 nt, Homo sapiens
ucuuuguuuucugauccugaag

SEQ ID NO: 52788 - RNA, 22 nt, Homo sapiens
ugaaaguuauauugugaaauuc

SEQ ID NO: 52789 - RNA, 22 nt, Homo sapiens
ugaaauggaaagaguguagacu

SEQ ID NO: 52790 - RNA, 22 nt, Homo sapiens
ugaauacuucguucaaagauaa

SEQ ID NO: 52791 - RNA, 22 nt, Homo sapiens
ugaaugugauggguuucaugug

SEQ ID NO: 52792 - RNA, 22 nt, Homo sapiens
ugacaagggaaaugcaaaaugu

SEQ ID NO: 52793 - RNA, 22 nt, Homo sapiens
ugacacuugcccuuagaaacau

SEQ ID NO: 52794 - RNA, 22 nt, Homo sapiens
ugacuuuagaauuuuauccaga

SEQ ID NO: 52795 - RNA, 22 nt, Homo sapiens
ugagaacaugugauauuuggug

SEQ ID NO: 52796 - RNA, 22 nt, Homo sapiens
ugagaacuuauggugauuuuuu

SEQ ID NO: 52797 - RNA, 22 nt, Homo sapiens
ugagaagaugaacuccuugguc

SEQ ID NO: 52798 - RNA, 22 nt, Homo sapiens
ugagaagcauaccagugucugu

SEQ ID NO: 52799 - RNA, 22 nt, Homo sapiens
ugagaagugacgcagcaggguu

SEQ ID NO: 52800 - RNA, 22 nt, Homo sapiens
ugagacaugugaacuguaguuc

SEQ ID NO: 52801 - RNA, 22 nt, Homo sapiens
ugagacugauaggacauuuucu

SEQ ID NO: 52802 - RNA, 22 nt, Homo sapiens
ugagauguaaucucgcucuguc

SEQ ID NO: 52803 - RNA, 22 nt, Homo sapiens
ugagauguuuguuucagugccu

SEQ ID NO: 52804 - RNA, 17 nt, Homo sapiens
ugagcuaagauuacccc

SEQ ID NO: 52805 - RNA, 22 nt, Homo sapiens
ugagcuagggccuggaauaggg

SEQ ID NO: 52806 - RNA, 22 nt, Homo sapiens
ugagcugagaaaugcagcagcu

SEQ ID NO: 52807 - RNA, 22 nt, Homo sapiens
ugaggcuaggauaggcugauuc

SEQ ID NO: 52808 - RNA, 22 nt, Homo sapiens
ugagguuggguaauuuaugaag

SEQ ID NO: 52809 - RNA, 22 nt, Homo sapiens
ugagugugacuuagcagaagga

SEQ ID NO: 52810 - RNA, 22 nt, Homo sapiens
ugagugugaggaagaauuagaa

SEQ ID NO: 52811 - RNA, 22 nt, Homo sapiens
ugaguucuuccuaucucugccu

SEQ ID NO: 52812 - RNA, 22 nt, Homo sapiens
ugauggcacagugaguuccagg

SEQ ID NO: 52813 - RNA, 22 nt, Homo sapiens
ugcaaagucgaaacugcaguuu

SEQ ID NO: 52814 - RNA, 22 nt, Homo sapiens
ugcaaaugcugcuauuucucuu

SEQ ID NO: 52815 - RNA, 22 nt, Homo sapiens
ugcaaauguuauuuugguuucu

SEQ ID NO: 52816 - RNA, 22 nt, Homo sapiens
ugcauagcauauauuguagagu

SEQ ID NO: 52817 - RNA, 22 nt, Homo sapiens
ugcauggaggagcuccccgcag

SEQ ID NO: 52818 - RNA, 22 nt, Homo sapiens
ugcauguucuuacucauacaug

SEQ ID NO: 52819 - RNA, 22 nt, Homo sapiens
ugcauuguuccgaauguguccu

SEQ ID NO: 52820 - RNA, 22 nt, Homo sapiens
ugccaacugguuucuuuuaguu

SEQ ID NO: 52821 - RNA, 20 nt, Homo sapiens
ugccaagaaaugaggguauu

SEQ ID NO: 52822 - RNA, 22 nt, Homo sapiens
ugccauagagacucaacagccu

SEQ ID NO: 52823 - RNA, 20 nt, Homo sapiens
ugcugcacuuaagcaugggc

SEQ ID NO: 52824 - RNA, 22 nt, Homo sapiens
ugcuuugguagaaaucuuuggu

SEQ ID NO: 52825 - RNA, 22 nt, Homo sapiens
uggaacacaucuaaggaagcag

SEQ ID NO: 52826 - RNA, 22 nt, Homo sapiens
uggacaugaagggcacaggagg

SEQ ID NO: 52827 - RNA, 22 nt, Homo sapiens
uggacauguacauauguguaug

SEQ ID NO: 52828 - RNA, 22 nt, Homo sapiens
uggagguagacauugggaagag

SEQ ID NO: 52829 - RNA, 22 nt, Homo sapiens
uggaguaggccuaagaaugaca

SEQ ID NO: 52830 - RNA, 19 nt, Homo sapiens
uggagucaucaugcugcua

SEQ ID NO: 52831 - RNA, 22 nt, Homo sapiens
uggcaaaaaucacaaguaccuu

SEQ ID NO: 52832 - RNA, 22 nt, Homo sapiens
uggcaaauuccaaaguuaauuc

SEQ ID NO: 52833 - RNA, 22 nt, Homo sapiens
uggcaagaagagcaugagacca

SEQ ID NO: 52834 - RNA, 22 nt, Homo sapiens
uggcaagagaacaacaucucuc

SEQ ID NO: 52835 - RNA, 22 nt, Homo sapiens
uggcaggugcacuggcuuugaa

SEQ ID NO: 52836 - RNA, 22 nt, Homo sapiens
uggcaguuucacauggcucaac

SEQ ID NO: 52837 - RNA, 22 nt, Homo sapiens
uggcgggaaaguugggagaaga

SEQ ID NO: 52838 - RNA, 20 nt, Homo sapiens
ugggaacaugugguauaugg

SEQ ID NO: 52839 - RNA, 22 nt, Homo sapiens
ugggaccccuacucuuuccaca

SEQ ID NO: 52840 - RNA, 22 nt, Homo sapiens
ugggagcauugcauuagaagcc

SEQ ID NO: 52841 - RNA, 22 nt, Homo sapiens
ugggagugugcacaauuucagc

SEQ ID NO: 52842 - RNA, 22 nt, Homo sapiens
ugggcaagagagcaugacccug

SEQ ID NO: 52843 - RNA, 22 nt, Homo sapiens
ugggcuagaugcuuugggguca

SEQ ID NO: 52844 - RNA, 22 nt, Homo sapiens
uggguaguuuuucagcucuugc

SEQ ID NO: 52845 - RNA, 21 nt, Homo sapiens
uggucaguuuucucacuagga

SEQ ID NO: 52846 - RNA, 22 nt, Homo sapiens
uggucucuuugcuuuagucauc

SEQ ID NO: 52847 - RNA, 22 nt, Homo sapiens
ugguucaguugcacaggcuguu

SEQ ID NO: 52848 - RNA, 18 nt, Homo sapiens
uguaaacuaccucaaccu

SEQ ID NO: 52849 - RNA, 16 nt, Homo sapiens
uguaaauguuuugcau

SEQ ID NO: 52850 - RNA, 22 nt, Homo sapiens
ugucaauauguaauaacugaau

SEQ ID NO: 52851 - RNA, 22 nt, Homo sapiens
ugucaguuucccuccucuuccu

SEQ ID NO: 52852 - RNA, 22 nt, Homo sapiens
ugucucaguucccuucucugga

SEQ ID NO: 52853 - RNA, 22 nt, Homo sapiens
ugucugagacuguuuuacuuuc

SEQ ID NO: 52854 - RNA, 22 nt, Homo sapiens
ugugcaugacagcauacaaacg

SEQ ID NO: 52855 - RNA, 22 nt, Homo sapiens
ugugccacugcacuccugggug

SEQ ID NO: 52856 - RNA, 22 nt, Homo sapiens
ugugggugguaaaauacaauga

SEQ ID NO: 52857 - RNA, 22 nt, Homo sapiens
ugugucuuguuuauagcuuucu

SEQ ID NO: 52858 - RNA, 21 nt, Homo sapiens
uguuaacaugcagauuacugg

SEQ ID NO: 52859 - RNA, 22 nt, Homo sapiens
uguuauugagguuacuuauaag

SEQ ID NO: 52860 - RNA, 22 nt, Homo sapiens
uguuauuuuguguuagggcaca

SEQ ID NO: 52861 - RNA, 22 nt, Homo sapiens
uguucaugaguucucauuuuua

SEQ ID NO: 52862 - RNA, 22 nt, Homo sapiens
uguuggcauugcugcugacccu

SEQ ID NO: 52863 - RNA, 22 nt, Homo sapiens
uguuucuacugucucuguagua

SEQ ID NO: 52864 - RNA, 22 nt, Homo sapiens
uuaauuguaucuauagauguca

SEQ ID NO: 52865 - RNA, 22 nt, Homo sapiens
uuacagcugcuccccaucacuc

SEQ ID NO: 52866 - RNA, 22 nt, Homo sapiens
uuacaguauugcaaggacuagg

SEQ ID NO: 52867 - RNA, 22 nt, Homo sapiens
uuacagucucaagagugcugca

SEQ ID NO: 52868 - RNA, 22 nt, Homo sapiens
uuaccucuguggcucucggacu

SEQ ID NO: 52869 - RNA, 22 nt, Homo sapiens
uuacuacucucuaugaccaguu

SEQ ID NO: 52870 - RNA, 22 nt, Homo sapiens
uuagcacauuuccagcacaugg

SEQ ID NO: 52871 - RNA, 23 nt, Homo sapiens
uacagcugcagaaucaggcuaag

SEQ ID NO: 52872 - RNA, 22 nt, Homo sapiens
uacaguauuaugagugauugaa

SEQ ID NO: 52873 - RNA, 22 nt, Homo sapiens
uacagucuggaggccuguguug

SEQ ID NO: 52874 - RNA, 22 nt, Homo sapiens
uacagugggcacuggcgcccug

SEQ ID NO: 52875 - RNA, 22 nt, Homo sapiens
uacauguauguguuuauggcug

SEQ ID NO: 52876 - RNA, 22 nt, Homo sapiens
uacauugcacuuuauuagauac

SEQ ID NO: 52877 - RNA, 22 nt, Homo sapiens
uaccacauuguagagggcauuc

SEQ ID NO: 52878 - RNA, 22 nt, Homo sapiens
uacucaauugcagucaccuggc

SEQ ID NO: 52879 - RNA, 22 nt, Homo sapiens
uacugcugucagugccaaguag

SEQ ID NO: 52880 - RNA, 20 nt, Homo sapiens
uagacagcuagauuagauag

SEQ ID NO: 52881 - RNA, 21 nt, Homo sapiens
uagcaaauugcuauuaaggca

SEQ ID NO: 52882 - RNA, 21 nt, Homo sapiens
uagcuacacugugauucaugg

SEQ ID NO: 52883 - RNA, 19 nt, Homo sapiens
uaggacccugguggccccc

SEQ ID NO: 52884 - RNA, 22 nt, Homo sapiens
uaggcagccagcuguggauuga

SEQ ID NO: 52885 - RNA, 22 nt, Homo sapiens
uauaggacuugguguaguuucu

SEQ ID NO: 52886 - RNA, 22 nt, Homo sapiens
uaucauaguuuggacuuucauu

SEQ ID NO: 52887 - RNA, 23 nt, Homo sapiens
uaucccuugccuuaugaugugag

SEQ ID NO: 52888 - RNA, 22 nt, Homo sapiens
uaucucacauauucaguagguu

SEQ ID NO: 52889 - RNA, 22 nt, Homo sapiens
uauggauuugccuauucuguau

SEQ ID NO: 52890 - RNA, 22 nt, Homo sapiens
uauggcuaugggaacugggagu

SEQ ID NO: 52891 - RNA, 22 nt, Homo sapiens
uauggguuuauuucuggucuca

SEQ ID NO: 52892 - RNA, 22 nt, Homo sapiens
uauuccauuugggucaggauga

SEQ ID NO: 52893 - RNA, 22 nt, Homo sapiens
uauugcacaugaggagacauug

SEQ ID NO: 52894 - RNA, 18 nt, Homo sapiens
uauugcuugguuuggaga

SEQ ID NO: 52895 - RNA, 22 nt, Homo sapiens
uauugcuuuacucucuuauccu

SEQ ID NO: 52896 - RNA, 22 nt, Homo sapiens
uauuguacauguuauagauuuu

SEQ ID NO: 52897 - RNA, 22 nt, Homo sapiens
uauuguccacuuugcacugugu

SEQ ID NO: 52898 - RNA, 22 nt, Homo sapiens
uauuucaguugugcagguaguu

SEQ ID NO: 52899 - RNA, 22 nt, Homo sapiens
uauuugauugacuuuagcagga

SEQ ID NO: 52900 - RNA, 22 nt, Homo sapiens
ucaaaguaaagccucaggaugg

SEQ ID NO: 52901 - RNA, 22 nt, Homo sapiens
ucaaagugacaaaguugcagca

SEQ ID NO: 52902 - RNA, 22 nt, Homo sapiens
ucaaggcacuagcugagcugca

SEQ ID NO: 52903 - RNA, 20 nt, Homo sapiens
ucaaggcaggaacuguacau

SEQ ID NO: 52904 - RNA, 22 nt, Homo sapiens
ucacagaugcuugacccauuuc

SEQ ID NO: 52905 - RNA, 20 nt, Homo sapiens
ucacagucacacauaauccu

SEQ ID NO: 52906 - RNA, 22 nt, Homo sapiens
auacaguaaugucuuaggcugu

SEQ ID NO: 52907 - RNA, 20 nt, Homo sapiens
auagaagacuagugcagcag

SEQ ID NO: 52908 - RNA, 22 nt, Homo sapiens
auagaagcugccaacguuucag

SEQ ID NO: 52909 - RNA, 22 nt, Homo sapiens
auagggcacgagaugugagccu

SEQ ID NO: 52910 - RNA, 22 nt, Homo sapiens
auauaccuaggcuacaugguuu

SEQ ID NO: 52911 - RNA, 22 nt, Homo sapiens
auaucacaggaaaggaagauac

SEQ ID NO: 52912 - RNA, 22 nt, Homo sapiens
auauccaugccauagguuuuga

SEQ ID NO: 52913 - RNA, 22 nt, Homo sapiens
auaucccaguguguaaacacug

SEQ ID NO: 52914 - RNA, 22 nt, Homo sapiens
auauggguuuuauauuaggcuc

SEQ ID NO: 52915 - RNA, 22 nt, Homo sapiens
auauuguacugcuacugguucu

SEQ ID NO: 52916 - RNA, 22 nt, Homo sapiens
aucacagcccuccucuuggaug

SEQ ID NO: 52917 - RNA, 22 nt, Homo sapiens
aucacagugagcauaugucuau

SEQ ID NO: 52918 - RNA, 22 nt, Homo sapiens
aucaccagaugcuucaagcaga

SEQ ID NO: 52919 - RNA, 22 nt, Homo sapiens
auccucaguggcuuaaguauag

SEQ ID NO: 52920 - RNA, 22 nt, Homo sapiens
aucuagagaggcagucuggccg

SEQ ID NO: 52921 - RNA, 21 nt, Homo sapiens
aucucacuugaauguaaaagc

SEQ ID NO: 52922 - RNA, 22 nt, Homo sapiens
aucuguguuuaaggucccagaa

SEQ ID NO: 52923 - RNA, 22 nt, Homo sapiens
augaaaucuuuccugugaggau

SEQ ID NO: 52924 - RNA, 22 nt, Homo sapiens
augacauugaugcucuggcugg

SEQ ID NO: 52925 - RNA, 22 nt, Homo sapiens
augagagcuaacuguggguaca

SEQ ID NO: 52926 - RNA, 19 nt, Homo sapiens
augagcaauaguuuuaauc

SEQ ID NO: 52927 - RNA, 20 nt, Homo sapiens
augagguguaugacacugaa

SEQ ID NO: 52928 - RNA, 22 nt, Homo sapiens
augaguaugagaauacauuaag

SEQ ID NO: 52929 - RNA, 22 nt, Homo sapiens
augauacuguucuaagauuuuu

SEQ ID NO: 52930 - RNA, 22 nt, Homo sapiens
augauguccacagggguguuca

SEQ ID NO: 52931 - RNA, 22 nt, Homo sapiens
augcaacuugaaauuuuccgga

SEQ ID NO: 52932 - RNA, 22 nt, Homo sapiens
augcaagcacacaagaggaaau

SEQ ID NO: 52933 - RNA, 19 nt, Homo sapiens
augccacagugaggucaga

SEQ ID NO: 52934 - RNA, 22 nt, Homo sapiens
augccuaagacccuguggggga

SEQ ID NO: 52935 - RNA, 19 nt, Homo sapiens
augccucaguuuuguacuu

SEQ ID NO: 52936 - RNA, 22 nt, Homo sapiens
auggaagaauugucggggaugu

SEQ ID NO: 52937 - RNA, 22 nt, Homo sapiens
auggauugucuccuugugccau

SEQ ID NO: 52938 - RNA, 22 nt, Homo sapiens
auggauuuuaggauacaguuga

SEQ ID NO: 52939 - RNA, 20 nt, Homo sapiens
auggcccugcugggaguguc

SEQ ID NO: 52940 - RNA, 22 nt, Homo sapiens
auggccugaugcaccuguccca

SEQ ID NO: 52941 - RNA, 22 nt, Homo sapiens
auggcuagauuguaugguaguu

SEQ ID NO: 52942 - RNA, 22 nt, Homo sapiens
augugcuuaaaaaugcagagaa

SEQ ID NO: 52943 - RNA, 22 nt, Homo sapiens
augugcuugagggaaaucaguu

SEQ ID NO: 52944 - RNA, 22 nt, Homo sapiens
auguggaaauguauaugugucu

SEQ ID NO: 52945 - RNA, 20 nt, Homo sapiens
auuagagcuacauggcuaca

SEQ ID NO: 52946 - RNA, 22 nt, Homo sapiens
auucagaggggcagcugucuug

SEQ ID NO: 52947 - RNA, 22 nt, Homo sapiens
auugcacaccagucugggcaaa

SEQ ID NO: 52948 - RNA, 22 nt, Homo sapiens
auugcacaucugcacuacagcc

SEQ ID NO: 52949 - RNA, 22 nt, Homo sapiens
auuggcaaucgucuccauuuuu

SEQ ID NO: 52950 - RNA, 22 nt, Homo sapiens
auuguacuccagccuguggagc

SEQ ID NO: 52951 - RNA, 22 nt, Homo sapiens
auuguacucuagccucugggca

SEQ ID NO: 52952 - RNA, 22 nt, Homo sapiens
auuguacugccccccuguugcu

SEQ ID NO: 52953 - RNA, 22 nt, Homo sapiens
auuugacacugagagccucagu

SEQ ID NO: 52954 - RNA, 22 nt, Homo sapiens
auuuugcauugcuguaaaggaa

SEQ ID NO: 52955 - RNA, 22 nt, Homo sapiens
caaaugcuucuauggacugucu

SEQ ID NO: 52956 - RNA, 22 nt, Homo sapiens
caaccaguagcugaguucaaaa

SEQ ID NO: 52957 - RNA, 22 nt, Homo sapiens
caaugcauuauucucccacuuc

SEQ ID NO: 52958 - RNA, 22 nt, Homo sapiens
cacacuguuuuccauggggguu

SEQ ID NO: 52959 - RNA, 22 nt, Homo sapiens
gcacacuuacacgaaccuagau

SEQ ID NO: 52960 - RNA, 22 nt, Homo sapiens
gcacagucaacacuuauucacc

SEQ ID NO: 52961 - RNA, 22 nt, Homo sapiens
gcagugcaguggcgcgaucucg

SEQ ID NO: 52962 - RNA, 22 nt, Homo sapiens
gcagugcaugacgguauauaua

SEQ ID NO: 52963 - RNA, 22 nt, Homo sapiens
gcaucacagcuccugugcuggc

SEQ ID NO: 52964 - RNA, 22 nt, Homo sapiens
gcaucacagggagacaggccuc

SEQ ID NO: 52965 - RNA, 22 nt, Homo sapiens
gcauggagaaggggacugauuc

SEQ ID NO: 52966 - RNA, 22 nt, Homo sapiens
gcaugguacuggaugguaguau

SEQ ID NO: 52967 - RNA, 22 nt, Homo sapiens
gcaugguaguaaccuacauuug

SEQ ID NO: 52968 - RNA, 22 nt, Homo sapiens
gcccagcguucagggaggggcu

SEQ ID NO: 52969 - RNA, 22 nt, Homo sapiens
gcccugauacauucuucugccu

SEQ ID NO: 52970 - RNA, 22 nt, Homo sapiens
gcccuguugcccaggcuggagu

SEQ ID NO: 52971 - RNA, 22 nt, Homo sapiens
gcuggaauuaacauagaugugc

SEQ ID NO: 52972 - RNA, 22 nt, Homo sapiens
gcuggguugccagguuacuuaa

SEQ ID NO: 52973 - RNA, 23 nt, Homo sapiens
ggaaacauccagucuuucaccau

SEQ ID NO: 52974 - RNA, 22 nt, Homo sapiens
ggaaauguuuagcauccacuuu

SEQ ID NO: 52975 - RNA, 23 nt, Homo sapiens
ggaaugaaaccugguuaugauau

SEQ ID NO: 52976 - RNA, 22 nt, Homo sapiens
ggaaugugugucaugcuuuugc

SEQ ID NO: 52977 - RNA, 22 nt, Homo sapiens
ggagucugacuuauaggaaccu

SEQ ID NO: 52978 - RNA, 22 nt, Homo sapiens
ggagucuugcuauguugccaag

SEQ ID NO: 52979 - RNA, 22 nt, Homo sapiens
ggauugugauaauuguugcaaa

SEQ ID NO: 52980 - RNA, 22 nt, Homo sapiens
ggcaagaaagaaaucaucuguc

SEQ ID NO: 52981 - RNA, 22 nt, Homo sapiens
ggcaagaacuucacucacuuuu

SEQ ID NO: 52982 - RNA, 22 nt, Homo sapiens
ggcaagaagagaguuuaaacau

SEQ ID NO: 52983 - RNA, 22 nt, Homo sapiens
cuuggacaccucaugcccaccu

SEQ ID NO: 52984 - RNA, 22 nt, Homo sapiens
cuuggcuagucaaaccuccccg

SEQ ID NO: 52985 - RNA, 22 nt, Homo sapiens
cuuguacacuguuggugggaau

SEQ ID NO: 52986 - RNA, 22 nt, Homo sapiens
cuugugauugcacggcugccug

SEQ ID NO: 52987 - RNA, 18 nt, Homo sapiens
cuuugcagcuuccagagg

SEQ ID NO: 52988 - RNA, 23 nt, Homo sapiens
cuuuugcaaugugaucuugccac

SEQ ID NO: 52989 - RNA, 22 nt, Homo sapiens
gaauagugcugcagcaaacaua

SEQ ID NO: 52990 - RNA, 22 nt, Homo sapiens
gaauagugcugcaguaaacaua

SEQ ID NO: 52991 - RNA, 22 nt, Homo sapiens
gaaucaauugaucuaugugucu

SEQ ID NO: 52992 - RNA, 22 nt, Homo sapiens
gaaucauuguuucuaaguuugu

SEQ ID NO: 52993 - RNA, 22 nt, Homo sapiens
gacacugucuucugcucuuaaa

SEQ ID NO: 52994 - RNA, 22 nt, Homo sapiens
gacauagcuagauaaccucaug

SEQ ID NO: 52995 - RNA, 22 nt, Homo sapiens
gacucagucuuggauuuuuaau

SEQ ID NO: 52996 - RNA, 22 nt, Homo sapiens
gacuuagaauuuuugccugcua

SEQ ID NO: 52997 - RNA, 22 nt, Homo sapiens
gacuugaagaaucuaagggagg

SEQ ID NO: 52998 - RNA, 22 nt, Homo sapiens
gagacugagucucacucuguca

SEQ ID NO: 52999 - RNA, 22 nt, Homo sapiens
gagacugagucuugcucuguca

SEQ ID NO: 53000 - RNA, 22 nt, Homo sapiens
gagagguaguuuuuuggucguc

SEQ ID NO: 53001 - RNA, 22 nt, Homo sapiens
gagagugaaguuugcuaccugu

SEQ ID NO: 53002 - RNA, 22 nt, Homo sapiens
gagauacacccagugcagaggc

SEQ ID NO: 53003 - RNA, 22 nt, Homo sapiens
gagauaggauucacuuucaugu

SEQ ID NO: 53004 - RNA, 22 nt, Homo sapiens
gagcaccagucccugucagugc

SEQ ID NO: 53005 - RNA, 22 nt, Homo sapiens
gagcucauuaaaaauguagaau

SEQ ID NO: 53006 - RNA, 22 nt, Homo sapiens
gagcugaucuuuucugauucca

SEQ ID NO: 53007 - RNA, 22 nt, Homo sapiens
gaggagauauucugcuggaugg

SEQ ID NO: 53008 - RNA, 22 nt, Homo sapiens
gagguaagaaagucaguccuuc

SEQ ID NO: 53009 - RNA, 22 nt, Homo sapiens
gagguaggaggauugcuuaagg

SEQ ID NO: 53010 - RNA, 21 nt, Homo sapiens
gagguagggauuaaagaccuc

SEQ ID NO: 53011 - RNA, 22 nt, Homo sapiens
gagguaggggccuuaaagaugc

SEQ ID NO: 53012 - RNA, 22 nt, Homo sapiens
gagguagguacaauugccacca

SEQ ID NO: 53013 - RNA, 22 nt, Homo sapiens
gagguauaauugacaagcaaaa

SEQ ID NO: 53014 - RNA, 22 nt, Homo sapiens
gagguaugauugacauauaaaa

SEQ ID NO: 53015 - RNA, 22 nt, Homo sapiens
gagguggugguggaggcauagc

SEQ ID NO: 53016 - RNA, 22 nt, Homo sapiens
gagugcaauggcagaucuccgc

SEQ ID NO: 53017 - RNA, 22 nt, Homo sapiens
gaucugugugauuggaugcauu

SEQ ID NO: 53018 - RNA, 22 nt, Homo sapiens
gaucuguuucaauugucuuagu

SEQ ID NO: 53019 - RNA, 20 nt, Homo sapiens
gauuagagagaggcugugca

SEQ ID NO: 53020 - RNA, 22 nt, Homo sapiens
aaaguaguagcaguuucugcca

SEQ ID NO: 53021 - RNA, 22 nt, Homo sapiens
aaaugcacagaaaggaugugga

SEQ ID NO: 53022 - RNA, 22 nt, Homo sapiens
aaaugcucucuacacguuucug

SEQ ID NO: 53023 - RNA, 22 nt, Homo sapiens
aaauucaucaaaugguuuguau

SEQ ID NO: 53024 - RNA, 22 nt, Homo sapiens
aaauugcuuuugaagacuuagu

SEQ ID NO: 53025 - RNA, 22 nt, Homo sapiens
aacacuguuuccagucaugauc

SEQ ID NO: 53026 - RNA, 22 nt, Homo sapiens
aacagugcauuccuguccauau

SEQ ID NO: 53027 - RNA, 22 nt, Homo sapiens
aaccacauggcucaguggacau

SEQ ID NO: 53028 - RNA, 22 nt, Homo sapiens
aagcuggauuuaguguggagca

SEQ ID NO: 53029 - RNA, 22 nt, Homo sapiens
aaggcaagauacugguugcuga

SEQ ID NO: 53030 - RNA, 22 nt, Homo sapiens
aaggcagucacuaaauagugag

SEQ ID NO: 53031 - RNA, 22 nt, Homo sapiens
aagguagguuccaaaauaccua

SEQ ID NO: 53032 - RNA, 22 nt, Homo sapiens
aaguaaauauccgguaguccca

SEQ ID NO: 53033 - RNA, 22 nt, Homo sapiens
aagugcaaauucccaggcucug

SEQ ID NO: 53034 - RNA, 22 nt, Homo sapiens
aagugcuuacagggaacaugau

SEQ ID NO: 53035 - RNA, 22 nt, Homo sapiens
aaguuaauguuuaagacuccua

SEQ ID NO: 53036 - RNA, 22 nt, Homo sapiens
aauaaguugagaugaggucaua

SEQ ID NO: 53037 - RNA, 22 nt, Homo sapiens
aauacagcacacagaugggucu

SEQ ID NO: 53038 - RNA, 22 nt, Homo sapiens
aauaugucuugaaauuggguaa

SEQ ID NO: 53039 - RNA, 22 nt, Homo sapiens
aaucccugagcuagacacaaag

SEQ ID NO: 53040 - RNA, 22 nt, Homo sapiens
augcaaacaucugaagagacau

SEQ ID NO: 53041 - RNA, 19 nt, Homo sapiens
augcaaugucacaggcugc

SEQ ID NO: 53042 - RNA, 22 nt, Homo sapiens
augcagagaaaucuaaaauaug

SEQ ID NO: 53043 - RNA, 22 nt, Homo sapiens
auggaacauuauagauguaaaa

SEQ ID NO: 53044 - RNA, 22 nt, Homo sapiens
auggagaugaauaucaucuguu

SEQ ID NO: 53045 - RNA, 22 nt, Homo sapiens
auggagugagaauggagguucc

SEQ ID NO: 53046 - RNA, 22 nt, Homo sapiens
auggauagucucacucacauac

SEQ ID NO: 53047 - RNA, 22 nt, Homo sapiens
auggauuuguaguacaugguug

SEQ ID NO: 53048 - RNA, 22 nt, Homo sapiens
auggcacugaagcguauugaca

SEQ ID NO: 53049 - RNA, 22 nt, Homo sapiens
auggcccccuguuugugaacau

SEQ ID NO: 53050 - RNA, 22 nt, Homo sapiens
auggcccuguguggagcugcug

SEQ ID NO: 53051 - RNA, 22 nt, Homo sapiens
auggcuagaaccuguauauuca

SEQ ID NO: 53052 - RNA, 22 nt, Homo sapiens
auggcuuuaagagugucugaau

SEQ ID NO: 53053 - RNA, 22 nt, Homo sapiens
auguaaacuacagauuuugggu

SEQ ID NO: 53054 - RNA, 22 nt, Homo sapiens
augucauagaagccugugaacc

SEQ ID NO: 53055 - RNA, 22 nt, Homo sapiens
auguccaugagcacauguauca

SEQ ID NO: 53056 - RNA, 22 nt, Homo sapiens
augugcuuauagguguauguuu

SEQ ID NO: 53057 - RNA, 22 nt, Homo sapiens
auguggaaagcagcaugauaug

SEQ ID NO: 53058 - RNA, 22 nt, Homo sapiens
augugguaggcccaugagucau

SEQ ID NO: 53059 - RNA, 22 nt, Homo sapiens
augugguaguuauagugauaag

SEQ ID NO: 53060 - RNA, 19 nt, Homo sapiens
augugguuagcaugacugc

SEQ ID NO: 53061 - RNA, 22 nt, Homo sapiens
auguuuagagagggugucaaau

SEQ ID NO: 53062 - RNA, 22 nt, Homo sapiens
auuaagagcacauguucugggu

SEQ ID NO: 53063 - RNA, 22 nt, Homo sapiens
auuacauagucaaggugucuca

SEQ ID NO: 53064 - RNA, 22 nt, Homo sapiens
auucccuuagcugccucagccu

SEQ ID NO: 53065 - RNA, 22 nt, Homo sapiens
auucuugcuugaacuuggugca

SEQ ID NO: 53066 - RNA, 22 nt, Homo sapiens
auugaacacagaguagcuuucc

SEQ ID NO: 53067 - RNA, 22 nt, Homo sapiens
auugaacaugccauauguacca

SEQ ID NO: 53068 - RNA, 22 nt, Homo sapiens
auugcauugugaucuucccaga

SEQ ID NO: 53069 - RNA, 22 nt, Homo sapiens
auugcuauuauuugaccauugu

SEQ ID NO: 53070 - RNA, 22 nt, Homo sapiens
auugcuuuuacugggagcuuug

SEQ ID NO: 53071 - RNA, 22 nt, Homo sapiens
auuguacuagguccuagggcuu

SEQ ID NO: 53072 - RNA, 22 nt, Homo sapiens
auuguacuccagccugggcaag

SEQ ID NO: 53073 - RNA, 22 nt, Homo sapiens
auuguacuccagccugggcgac

SEQ ID NO: 53074 - RNA, 22 nt, Homo sapiens
auuguacuccagccugggcugc

SEQ ID NO: 53075 - RNA, 22 nt, Homo sapiens
auuguacuuaagccugggugaa

SEQ ID NO: 53076 - RNA, 22 nt, Homo sapiens
caaauugcuugucuguagugga

SEQ ID NO: 53077 - RNA, 22 nt, Homo sapiens
caacacuguuuauuggauagcc

SEQ ID NO: 53078 - RNA, 22 nt, Homo sapiens
caagggguggaaaugguagugu

SEQ ID NO: 53079 - RNA, 22 nt, Homo sapiens
caaucugucuuuuagggggcca

SEQ ID NO: 53080 - RNA, 22 nt, Homo sapiens
cacagcuagucaaugguagaca

SEQ ID NO: 53081 - RNA, 22 nt, Homo sapiens
cacaguagaauagagcacuagg

SEQ ID NO: 53082 - RNA, 19 nt, Homo sapiens
ucauagucuaagaugagaa

SEQ ID NO: 53083 - RNA, 22 nt, Homo sapiens
ucauauugcgguucauugacuu

SEQ ID NO: 53084 - RNA, 22 nt, Homo sapiens
ucauccauacaguuagcaaagg

SEQ ID NO: 53085 - RNA, 22 nt, Homo sapiens
ucauuagagacagggugucacu

SEQ ID NO: 53086 - RNA, 22 nt, Homo sapiens
ucauugcaaucucugccucccg

SEQ ID NO: 53087 - RNA, 22 nt, Homo sapiens
ucauugcauuccagcccaagca

SEQ ID NO: 53088 - RNA, 22 nt, Homo sapiens
uccacagugguggaauuguuca

SEQ ID NO: 53089 - RNA, 22 nt, Homo sapiens
ucccuguguccugggggcaccu

SEQ ID NO: 53090 - RNA, 17 nt, Homo sapiens
ucccuguuuuuucaguc

SEQ ID NO: 53091 - RNA, 22 nt, Homo sapiens
uccugagagcagacccucuaua

SEQ ID NO: 53092 - RNA, 22 nt, Homo sapiens
uccuuugguggagucuuuaggg

SEQ ID NO: 53093 - RNA, 22 nt, Homo sapiens
ucgugcugugucaucuuguggc

SEQ ID NO: 53094 - RNA, 22 nt, Homo sapiens
ucucagugaaauaaauuauuuu

SEQ ID NO: 53095 - RNA, 22 nt, Homo sapiens
ucucuguuuagagccagcaauu

SEQ ID NO: 53096 - RNA, 20 nt, Homo sapiens
ucugauugcaacugcaugag

SEQ ID NO: 53097 - RNA, 22 nt, Homo sapiens
ucugccuacugagcacacagug

SEQ ID NO: 53098 - RNA, 22 nt, Homo sapiens
ucuggccuagaacaauuaauua

SEQ ID NO: 53099 - RNA, 22 nt, Homo sapiens
ucuguguuugaucaagauugua

SEQ ID NO: 53100 - RNA, 22 nt, Homo sapiens
ucuuuggucuacuuucauaugu

SEQ ID NO: 53101 - RNA, 22 nt, Homo sapiens
ucuuuugggccucuugucagac

SEQ ID NO: 53102 - RNA, 22 nt, Homo sapiens
ugaaacugcagugggcuuggca

SEQ ID NO: 53103 - RNA, 22 nt, Homo sapiens
ugaaagguuuaauucugugaga

SEQ ID NO: 53104 - RNA, 22 nt, Homo sapiens
ugaaaucauguaguuauugcaa

SEQ ID NO: 53105 - RNA, 21 nt, Homo sapiens
ugaaaugcaugugcacauuaa

SEQ ID NO: 53106 - RNA, 22 nt, Homo sapiens
ugaacacagccugccucugcca

SEQ ID NO: 53107 - RNA, 22 nt, Homo sapiens
ugacauuacagucacuugcugu

SEQ ID NO: 53108 - RNA, 19 nt, Homo sapiens
ugaccagggacagaaacca

SEQ ID NO: 53109 - RNA, 22 nt, Homo sapiens
ugagaacucaugggucugcugg

SEQ ID NO: 53110 - RNA, 22 nt, Homo sapiens
ugagaacugguagcacuuguga

SEQ ID NO: 53111 - RNA, 22 nt, Homo sapiens
ugagaccaacagauuccaguuc

SEQ ID NO: 53112 - RNA, 22 nt, Homo sapiens
ugagacugaaauuaggaaacug

SEQ ID NO: 53113 - RNA, 22 nt, Homo sapiens
ugagauaauuuacuuguugagg

SEQ ID NO: 53114 - RNA, 22 nt, Homo sapiens
ugagaucaagguuaauauaauc

SEQ ID NO: 53115 - RNA, 22 nt, Homo sapiens
ugagaugaacuugauuguuuua

SEQ ID NO: 53116 - RNA, 22 nt, Homo sapiens
ugagaugacgacacaccucagu

SEQ ID NO: 53117 - RNA, 22 nt, Homo sapiens
ugagaugagagaaugcuugccu

SEQ ID NO: 53118 - RNA, 21 nt, Homo sapiens
ugagcauuaguacaguaggga

SEQ ID NO: 53119 - RNA, 22 nt, Homo sapiens
ugagcugagacaauaaguuuuu

SEQ ID NO: 53120 - RNA, 22 nt, Homo sapiens
ugaggucacuuguuuuaugcuu

SEQ ID NO: 53121 - RNA, 22 nt, Homo sapiens
ugaguagcuaagacgauaggca

SEQ ID NO: 53122 - RNA, 22 nt, Homo sapiens
ugaguucauggucauuugucac

SEQ ID NO: 53123 - RNA, 22 nt, Homo sapiens
ugauauuuuugauccuuaaguu

SEQ ID NO: 53124 - RNA, 22 nt, Homo sapiens
ugaugcugaguggcuauuugaa

SEQ ID NO: 53125 - RNA, 21 nt, Homo sapiens
ugaugcuuuucuuaaccuugc

SEQ ID NO: 53126 - RNA, 22 nt, Homo sapiens
ugauggcaauggcauucauuuu

SEQ ID NO: 53127 - RNA, 22 nt, Homo sapiens
ugauuguucuguccccaggggc

SEQ ID NO: 53128 - RNA, 22 nt, Homo sapiens
ugcaaaugucaaggguuagugu

SEQ ID NO: 53129 - RNA, 22 nt, Homo sapiens
ugcagugcaugacuguguuaug

SEQ ID NO: 53130 - RNA, 22 nt, Homo sapiens
ugccauugcacuccagccuggg

SEQ ID NO: 53131 - RNA, 22 nt, Homo sapiens
ugccuaggcuggaaugcagugg

SEQ ID NO: 53132 - RNA, 22 nt, Homo sapiens
ugccugagccagguuuuaggag

SEQ ID NO: 53133 - RNA, 22 nt, Homo sapiens
ugccuggagagcuccuacauau

SEQ ID NO: 53134 - RNA, 22 nt, Homo sapiens
ugcugcacuuauggcucugagg

SEQ ID NO: 53135 - RNA, 21 nt, Homo sapiens
uggaaacuucuagcuuacgua

SEQ ID NO: 53136 - RNA, 22 nt, Homo sapiens
uggaaaguaguucuaaucuaag

SEQ ID NO: 53137 - RNA, 22 nt, Homo sapiens
uggaacugauauugauggaaaa

SEQ ID NO: 53138 - RNA, 22 nt, Homo sapiens
uggaagcauagcagcgugugug

SEQ ID NO: 53139 - RNA, 22 nt, Homo sapiens
uggagauguuuaaaauccacug

SEQ ID NO: 53140 - RNA, 22 nt, Homo sapiens
uggagguaggacgaagaacucu

SEQ ID NO: 53141 - RNA, 22 nt, Homo sapiens
uggagguaggugauauguagca

SEQ ID NO: 53142 - RNA, 20 nt, Homo sapiens
uggaguuguggcaguuugga

SEQ ID NO: 53143 - RNA, 22 nt, Homo sapiens
uggaugacauccuuguaugcag

SEQ ID NO: 53144 - RNA, 22 nt, Homo sapiens
uggaugacuguuauaugcauau

SEQ ID NO: 53145 - RNA, 23 nt, Homo sapiens
uggguucauucuugaagucagug

SEQ ID NO: 53146 - RNA, 20 nt, Homo sapiens
uguaaaggagauugcagcug

SEQ ID NO: 53147 - RNA, 22 nt, Homo sapiens
uguagucauuuggaguccagcu

SEQ ID NO: 53148 - RNA, 20 nt, Homo sapiens
ugucauuaagcacugugcca

SEQ ID NO: 53149 - RNA, 22 nt, Homo sapiens
uguccauuuuuaugcuuauggu

SEQ ID NO: 53150 - RNA, 22 nt, Homo sapiens
aaacagucuucuccugagggac

SEQ ID NO: 53151 - RNA, 22 nt, Homo sapiens
ucacagucacugucacguugaa

SEQ ID NO: 53152 - RNA, 22 nt, Homo sapiens
ucacagucuccucuagggaggg

SEQ ID NO: 53153 - RNA, 22 nt, Homo sapiens
ucacagucugcgugaugagaca

SEQ ID NO: 53154 - RNA, 22 nt, Homo sapiens
ucacauuguguagccugcucac

SEQ ID NO: 53155 - RNA, 22 nt, Homo sapiens
ucaccuggagaagauggaucau

SEQ ID NO: 53156 - RNA, 22 nt, Homo sapiens
ucacuagggagaaacugaggcu

SEQ ID NO: 53157 - RNA, 22 nt, Homo sapiens
ucacucagaccuggugauaugc

SEQ ID NO: 53158 - RNA, 22 nt, Homo sapiens
ucacuuggccgcagccuucucu

SEQ ID NO: 53159 - RNA, 22 nt, Homo sapiens
ucagguagcauuuuggaaacag

SEQ ID NO: 53160 - RNA, 22 nt, Homo sapiens
ucagguagcuagauuaugugag

SEQ ID NO: 53161 - RNA, 22 nt, Homo sapiens
ucaguagcaugaaaacagacua

SEQ ID NO: 53162 - RNA, 22 nt, Homo sapiens
ucagucauucaauuguugaaug

SEQ ID NO: 53163 - RNA, 22 nt, Homo sapiens
ucagucuuuuaccauuaaguau

SEQ ID NO: 53164 - RNA, 20 nt, Homo sapiens
ucagugcagauuguccaagu

SEQ ID NO: 53165 - RNA, 22 nt, Homo sapiens
ucauagucuaagguucuuuugc

SEQ ID NO: 53166 - RNA, 22 nt, Homo sapiens
ucauaucauuagaucuacugua

SEQ ID NO: 53167 - RNA, 22 nt, Homo sapiens
ucaucaggaaacuuaugcagug

SEQ ID NO: 53168 - RNA, 22 nt, Homo sapiens
ucaucagguaugucagcggagu

SEQ ID NO: 53169 - RNA, 22 nt, Homo sapiens
ucauggggugagcuacaggcac

SEQ ID NO: 53170 - RNA, 22 nt, Homo sapiens
ucauuagagaucuuggggaaaa

SEQ ID NO: 53171 - RNA, 22 nt, Homo sapiens
ucauucauucauccagcuugag

SEQ ID NO: 53172 - RNA, 22 nt, Homo sapiens
uccagguacucagggggcugag

SEQ ID NO: 53173 - RNA, 22 nt, Homo sapiens
uccaugaguccauuagaaaaaa

SEQ ID NO: 53174 - RNA, 19 nt, Homo sapiens
uccccaguuuuccguucag

SEQ ID NO: 53175 - RNA, 22 nt, Homo sapiens
ucccuggacagccuugccuggg

SEQ ID NO: 53176 - RNA, 22 nt, Homo sapiens
ucccugguguuaguuuguucuu

SEQ ID NO: 53177 - RNA, 22 nt, Homo sapiens
ucccuguuaggcacagauuuau

SEQ ID NO: 53178 - RNA, 22 nt, Homo sapiens
ucccuuucuggaguuucccaag

SEQ ID NO: 53179 - RNA, 22 nt, Homo sapiens
ucuauggauaaaaugcccucau

SEQ ID NO: 53180 - RNA, 22 nt, Homo sapiens
ucucacagccauuucucccucu

SEQ ID NO: 53181 - RNA, 22 nt, Homo sapiens
ucucaugaagguggagaguagg

SEQ ID NO: 53182 - RNA, 21 nt, Homo sapiens
ucucauuacugaugagccaga

SEQ ID NO: 53183 - RNA, 22 nt, Homo sapiens
ucucuuggcggaaguugcagug

SEQ ID NO: 53184 - RNA, 22 nt, Homo sapiens
ucugacuagacaagcaguguac

SEQ ID NO: 53185 - RNA, 21 nt, Homo sapiens
ucugagucauucaguggccug

SEQ ID NO: 53186 - RNA, 22 nt, Homo sapiens
ucuggccuacaucauuuuuccg

SEQ ID NO: 53187 - RNA, 22 nt, Homo sapiens
ucugucaaaucuuauguuguag

SEQ ID NO: 53188 - RNA, 23 nt, Homo sapiens
ucuuguacuuugagugagcaugg

SEQ ID NO: 53189 - RNA, 22 nt, Homo sapiens
ucuuuguuagaacccucuccuu

SEQ ID NO: 53190 - RNA, 22 nt, Homo sapiens
ugaaaugcuaauucguagcuaa

SEQ ID NO: 53191 - RNA, 22 nt, Homo sapiens
ugaaaugguuaugugaggagau

SEQ ID NO: 53192 - RNA, 20 nt, Homo sapiens
ugaaggaggucauuuauacc

SEQ ID NO: 53193 - RNA, 22 nt, Homo sapiens
ugaauacuucaaaaaaauagcu

SEQ ID NO: 53194 - RNA, 22 nt, Homo sapiens
ugaauagacagucacugccucc

SEQ ID NO: 53195 - RNA, 21 nt, Homo sapiens
ugaaugcuuuaaauauuagaa

SEQ ID NO: 53196 - RNA, 22 nt, Homo sapiens
ugaauguuguugguugagauau

SEQ ID NO: 53197 - RNA, 22 nt, Homo sapiens
ugacaagauauggucuuaucaa

SEQ ID NO: 53198 - RNA, 18 nt, Homo sapiens
ugacaucauuuagaaagg

SEQ ID NO: 53199 - RNA, 22 nt, Homo sapiens
ugacggaggacaccugcggaau

SEQ ID NO: 53200 - RNA, 22 nt, Homo sapiens
ugacugaguaguauuccacuau

SEQ ID NO: 53201 - RNA, 22 nt, Homo sapiens
ugagaacuaaaaugugguauau

SEQ ID NO: 53202 - RNA, 22 nt, Homo sapiens
ugagaacuaaugaagaauuuau

SEQ ID NO: 53203 - RNA, 22 nt, Homo sapiens
ugagaacucaugaaucuuucca

SEQ ID NO: 53204 - RNA, 22 nt, Homo sapiens
ugagaacuuugucuuuuacucu

SEQ ID NO: 53205 - RNA, 22 nt, Homo sapiens
ugagaagacaucagcuuucgga

SEQ ID NO: 53206 - RNA, 22 nt, Homo sapiens
gcagcacaugacuguauguaua

SEQ ID NO: 53207 - RNA, 20 nt, Homo sapiens
gcagcaccauauuucuaaga

SEQ ID NO: 53208 - RNA, 22 nt, Homo sapiens
gcaggcaugacauuucacucuu

SEQ ID NO: 53209 - RNA, 22 nt, Homo sapiens
gcagguaguuucugacuuuuac

SEQ ID NO: 53210 - RNA, 19 nt, Homo sapiens
gcaguauugaaggccaguc

SEQ ID NO: 53211 - RNA, 22 nt, Homo sapiens
gcauggagcauacauuucuguu

SEQ ID NO: 53212 - RNA, 22 nt, Homo sapiens
gcauugcacuuggcauagacug

SEQ ID NO: 53213 - RNA, 22 nt, Homo sapiens
gcugucaugagcaacacaugaa

SEQ ID NO: 53214 - RNA, 22 nt, Homo sapiens
ggaauggaacaaagucuugaaa

SEQ ID NO: 53215 - RNA, 22 nt, Homo sapiens
ggagaucuuuguuaucuuuuga

SEQ ID NO: 53216 - RNA, 22 nt, Homo sapiens
ggagaugaaaugagcuacuuaa

SEQ ID NO: 53217 - RNA, 22 nt, Homo sapiens
ggagguagguuugugauuugua

SEQ ID NO: 53218 - RNA, 22 nt, Homo sapiens
ggcaaaucugcaauuacuuuug

SEQ ID NO: 53219 - RNA, 22 nt, Homo sapiens
ggcaaaugaagauggagaggcu

SEQ ID NO: 53220 - RNA, 19 nt, Homo sapiens
ggcaagaguuguucugugu

SEQ ID NO: 53221 - RNA, 23 nt, Homo sapiens
ggcaagaucucagcucacugcaa

SEQ ID NO: 53222 - RNA, 22 nt, Homo sapiens
ggcaagugggagggaguguuuc

SEQ ID NO: 53223 - RNA, 22 nt, Homo sapiens
ggcagaauugcugaggaugcua

SEQ ID NO: 53224 - RNA, 22 nt, Homo sapiens
gggaagugugcagaguucucuu

SEQ ID NO: 53225 - RNA, 18 nt, Homo sapiens
gggcaaguugccuggcuu

SEQ ID NO: 53226 - RNA, 22 nt, Homo sapiens
ggucacauugcuagcauggguu

SEQ ID NO: 53227 - RNA, 22 nt, Homo sapiens
ggugagaaaaacauagucucag

SEQ ID NO: 53228 - RNA, 23 nt, Homo sapiens
ggugaggaguacagagucuucau

SEQ ID NO: 53229 - RNA, 22 nt, Homo sapiens
guaacagucucaacaguggucu

SEQ ID NO: 53230 - RNA, 22 nt, Homo sapiens
guaacuggccuucaauuucuuc

SEQ ID NO: 53231 - RNA, 17 nt, Homo sapiens
guacacuucuucuguga

SEQ ID NO: 53232 - RNA, 22 nt, Homo sapiens
guacagugcucacaaugagagc

SEQ ID NO: 53233 - RNA, 22 nt, Homo sapiens
guagcagaauaucagauaauuu

SEQ ID NO: 53234 - RNA, 22 nt, Homo sapiens
guauacaugucaaaacucacau

SEQ ID NO: 53235 - RNA, 22 nt, Homo sapiens
guaugaaaaucggagauugggu

SEQ ID NO: 53236 - RNA, 22 nt, Homo sapiens
guauuugauuauagcaugcuua

SEQ ID NO: 53237 - RNA, 18 nt, Homo sapiens
aaacugcuuccuuggccu

SEQ ID NO: 53238 - RNA, 22 nt, Homo sapiens
aaagugcaguacuucguauauu

SEQ ID NO: 53239 - RNA, 22 nt, Homo sapiens
aaaugcaucauuaggugauuuu

SEQ ID NO: 53240 - RNA, 22 nt, Homo sapiens
aaaugcauugagggaaaaggca

SEQ ID NO: 53241 - RNA, 18 nt, Homo sapiens
aaaugcucuucuggaaua

SEQ ID NO: 53242 - RNA, 22 nt, Homo sapiens
aacaggcuccuaggggugcacc

SEQ ID NO: 53243 - RNA, 22 nt, Homo sapiens
aacaguaucuaacgagugauga

SEQ ID NO: 53244 - RNA, 22 nt, Homo sapiens
aacagucaauugcugaugaccu

SEQ ID NO: 53245 - RNA, 22 nt, Homo sapiens
aacugcauuuucugauugugug

SEQ ID NO: 53246 - RNA, 22 nt, Homo sapiens
aacugcuguuuggguacuggug

SEQ ID NO: 53247 - RNA, 22 nt, Homo sapiens
aagagccgcaagggugaagggu

SEQ ID NO: 53248 - RNA, 22 nt, Homo sapiens
aagaugguauuucauuaguuuu

SEQ ID NO: 53249 - RNA, 22 nt, Homo sapiens
aagcaccaauaggagauuuguc

SEQ ID NO: 53250 - RNA, 22 nt, Homo sapiens
aagcuggagugcaguggugcaa

SEQ ID NO: 53251 - RNA, 22 nt, Homo sapiens
aaggcaguggcagaagauguca

SEQ ID NO: 53252 - RNA, 22 nt, Homo sapiens
aagggaaugcuuccaguuugug

SEQ ID NO: 53253 - RNA, 22 nt, Homo sapiens
aaggugguuuucucuuggaguc

SEQ ID NO: 53254 - RNA, 22 nt, Homo sapiens
aaguaaacauuuuguacaauaa

SEQ ID NO: 53255 - RNA, 22 nt, Homo sapiens
aaguauguaucaagucauacuu

SEQ ID NO: 53256 - RNA, 22 nt, Homo sapiens
aagugaguaauacgucaguugu

SEQ ID NO: 53257 - RNA, 22 nt, Homo sapiens
aagugccauguggaugggcccu

SEQ ID NO: 53258 - RNA, 22 nt, Homo sapiens
aagugguagggucaggauugga

SEQ ID NO: 53259 - RNA, 22 nt, Homo sapiens
aagugguuuuuacaaagacaga

SEQ ID NO: 53260 - RNA, 23 nt, Homo sapiens
aaguucaugcucaucuguuacac

SEQ ID NO: 53261 - RNA, 22 nt, Homo sapiens
aauaaagcagcuuuuugggacu

SEQ ID NO: 53262 - RNA, 22 nt, Homo sapiens
aauaaagcauggcuacuccaua

SEQ ID NO: 53263 - RNA, 22 nt, Homo sapiens
aauacugagaugugagguacua

SEQ ID NO: 53264 - RNA, 22 nt, Homo sapiens
aaucccuggacuuucggaggcu

SEQ ID NO: 53265 - RNA, 22 nt, Homo sapiens
aaucccuuuguccagucucuuu

SEQ ID NO: 53266 - RNA, 22 nt, Homo sapiens
aaucugucuuuuguuauugagg

SEQ ID NO: 53267 - RNA, 22 nt, Homo sapiens
aaugcaucuagaaaggugaauu

SEQ ID NO: 53268 - RNA, 22 nt, Homo sapiens
aauggcacuuuauaaauguuaa

SEQ ID NO: 53269 - RNA, 22 nt, Homo sapiens
aaugguguuuccguuaagcuga

SEQ ID NO: 53270 - RNA, 22 nt, Homo sapiens
aauuguacucccauaauucccu

SEQ ID NO: 53271 - RNA, 22 nt, Homo sapiens
aauuguacucccaucauuccua

SEQ ID NO: 53272 - RNA, 21 nt, Homo sapiens
acaaagcuggagggagacugc

SEQ ID NO: 53273 - RNA, 22 nt, Homo sapiens
acaaagugccuccuuuuagagu

SEQ ID NO: 53274 - RNA, 22 nt, Homo sapiens
acacagucaaauccacuuggcu

SEQ ID NO: 53275 - RNA, 22 nt, Homo sapiens
acacuguuuuaguuauuauagc

SEQ ID NO: 53276 - RNA, 22 nt, Homo sapiens
acagugcuuggcacacaguaau

SEQ ID NO: 53277 - RNA, 17 nt, Homo sapiens
acagugucuaugaaaug

SEQ ID NO: 53278 - RNA, 18 nt, Homo sapiens
acagugucuuacaccugu

SEQ ID NO: 53279 - RNA, 22 nt, Homo sapiens
acaucacuguuugauugauuga

SEQ ID NO: 53280 - RNA, 22 nt, Homo sapiens
acaucccaugccuggguacucc

SEQ ID NO: 53281 - RNA, 22 nt, Homo sapiens
accaccauugcacugaacuuuc

SEQ ID NO: 53282 - RNA, 22 nt, Homo sapiens
acccagaauucagucuuaggcc

SEQ ID NO: 53283 - RNA, 22 nt, Homo sapiens
acuauacuguaacuguauucag

SEQ ID NO: 53284 - RNA, 21 nt, Homo sapiens
acugagagaucuggggcacau

SEQ ID NO: 53285 - RNA, 18 nt, Homo sapiens
acuggaauuaaacuuuuu

SEQ ID NO: 53286 - RNA, 21 nt, Homo sapiens
acuuucuguggcaguccauuc

SEQ ID NO: 53287 - RNA, 22 nt, Homo sapiens
agaaccaaucccacauggauac

SEQ ID NO: 53288 - RNA, 22 nt, Homo sapiens
agacaagauggcuugagguuca

SEQ ID NO: 53289 - RNA, 19 nt, Homo sapiens
agagacucauuguagcauu

SEQ ID NO: 53290 - RNA, 22 nt, Homo sapiens
agagauccucauuuuauagaca

SEQ ID NO: 53291 - RNA, 22 nt, Homo sapiens
agagcaaugacaugcuaugugg

SEQ ID NO: 53292 - RNA, 22 nt, Homo sapiens
agagcacugcugcaggguucug

SEQ ID NO: 53293 - RNA, 22 nt, Homo sapiens
agagguagaagauaggcuacag

SEQ ID NO: 53294 - RNA, 22 nt, Homo sapiens
uucaucaggaauauugaccugu

SEQ ID NO: 53295 - RNA, 22 nt, Homo sapiens
uucaugcaucuguagugguuaa

SEQ ID NO: 53296 - RNA, 22 nt, Homo sapiens
uuccaguaauagcacagcauug

SEQ ID NO: 53297 - RNA, 22 nt, Homo sapiens
uucccugugggcuggugcucca

SEQ ID NO: 53298 - RNA, 22 nt, Homo sapiens
uuccuugugacuaguagugacc

SEQ ID NO: 53299 - RNA, 22 nt, Homo sapiens
uucuccugguggacccuaaacg

SEQ ID NO: 53300 - RNA, 22 nt, Homo sapiens
uugaaagacaucaccuacugcu

SEQ ID NO: 53301 - RNA, 22 nt, Homo sapiens
uugaaagaugaacuggauugga

SEQ ID NO: 53302 - RNA, 22 nt, Homo sapiens
uugaaagcuaucucaaaucgcu

SEQ ID NO: 53303 - RNA, 22 nt, Homo sapiens
uugaaggaacgcuguucccuug

SEQ ID NO: 53304 - RNA, 22 nt, Homo sapiens
uugaaggaggugcucacucucg

SEQ ID NO: 53305 - RNA, 22 nt, Homo sapiens
uugagauggagucuugcucugu

SEQ ID NO: 53306 - RNA, 22 nt, Homo sapiens
uugagauggagucuugcucuug

SEQ ID NO: 53307 - RNA, 22 nt, Homo sapiens
uugaggaagugguuccccagag

SEQ ID NO: 53308 - RNA, 22 nt, Homo sapiens
uugaggaguacugauuagguau

SEQ ID NO: 53309 - RNA, 22 nt, Homo sapiens
uugagguagcuuugauggaggu

SEQ ID NO: 53310 - RNA, 22 nt, Homo sapiens
uugaguuugaguauucuaaagc

SEQ ID NO: 53311 - RNA, 22 nt, Homo sapiens
uugaucaauagaauacaacaga

SEQ ID NO: 53312 - RNA, 22 nt, Homo sapiens
uugauccucugagaaucuaucg

SEQ ID NO: 53313 - RNA, 21 nt, Homo sapiens
uugcaaaugcugcugccugau

SEQ ID NO: 53314 - RNA, 22 nt, Homo sapiens
uugcaacauguauucuggugau

SEQ ID NO: 53315 - RNA, 22 nt, Homo sapiens
uugcacagugguuuagagccug

SEQ ID NO: 53316 - RNA, 22 nt, Homo sapiens
uugcacaguguguacagcacca

SEQ ID NO: 53317 - RNA, 18 nt, Homo sapiens
uugcacuccugccugggu

SEQ ID NO: 53318 - RNA, 22 nt, Homo sapiens
uugcacucuagccugggugaca

SEQ ID NO: 53319 - RNA, 19 nt, Homo sapiens
uugcauauguugaaccagg

SEQ ID NO: 53320 - RNA, 22 nt, Homo sapiens
uugccaacauggugaacuccca

SEQ ID NO: 53321 - RNA, 22 nt, Homo sapiens
uugcuacauugauugccucuuu

SEQ ID NO: 53322 - RNA, 22 nt, Homo sapiens
auacugcacauuuagggaggga

SEQ ID NO: 53323 - RNA, 22 nt, Homo sapiens
auaucacucccaauaucgcagg

SEQ ID NO: 53324 - RNA, 22 nt, Homo sapiens
auaugcaaauccauagagacag

SEQ ID NO: 53325 - RNA, 22 nt, Homo sapiens
auauuacagagaggaccuggga

SEQ ID NO: 53326 - RNA, 22 nt, Homo sapiens
aucaaaguuucccagaaguugu

SEQ ID NO: 53327 - RNA, 22 nt, Homo sapiens
aucaaguaaucugaguaagagu

SEQ ID NO: 53328 - RNA, 22 nt, Homo sapiens
aucacagcuacuccucugucuu

SEQ ID NO: 53329 - RNA, 22 nt, Homo sapiens
aucacugggagcagccauuaau

SEQ ID NO: 53330 - RNA, 22 nt, Homo sapiens
aucagagccugugugcccugaa

SEQ ID NO: 53331 - RNA, 22 nt, Homo sapiens
aucagaguggguuuuaaaagug

SEQ ID NO: 53332 - RNA, 22 nt, Homo sapiens
aucagugagugguuagugaaug

SEQ ID NO: 53333 - RNA, 22 nt, Homo sapiens
aucauauccuagauauaacuuc

SEQ ID NO: 53334 - RNA, 22 nt, Homo sapiens
aucaucacaguuguguguaaug

SEQ ID NO: 53335 - RNA, 22 nt, Homo sapiens
auccacagugucaauguuguga

SEQ ID NO: 53336 - RNA, 23 nt, Homo sapiens
auccacauucuaguccuuuaugc

SEQ ID NO: 53337 - RNA, 22 nt, Homo sapiens
auccauugucuaaugcuaagau

SEQ ID NO: 53338 - RNA, 22 nt, Homo sapiens
aucccuuucugauacuuucccu

SEQ ID NO: 53339 - RNA, 22 nt, Homo sapiens
auccuguaggcuaguagacagu

SEQ ID NO: 53340 - RNA, 22 nt, Homo sapiens
aucugcauuagggugaagaccu

SEQ ID NO: 53341 - RNA, 22 nt, Homo sapiens
aucuggcuccuuuugacaaugc

SEQ ID NO: 53342 - RNA, 22 nt, Homo sapiens
aucuggcuucuuuuaguccaca

SEQ ID NO: 53343 - RNA, 22 nt, Homo sapiens
aucuuugcugagaugcauggca

SEQ ID NO: 53344 - RNA, 22 nt, Homo sapiens
augaacagagccuugagaaccu

SEQ ID NO: 53345 - RNA, 22 nt, Homo sapiens
augaagagaaaguggaucuugg

SEQ ID NO: 53346 - RNA, 22 nt, Homo sapiens
augacauugaaaagcaagugga

SEQ ID NO: 53347 - RNA, 22 nt, Homo sapiens
augacugucagggcagucauug

SEQ ID NO: 53348 - RNA, 22 nt, Homo sapiens
augagaacauaucaagugauug

SEQ ID NO: 53349 - RNA, 22 nt, Homo sapiens
augagcugauuuccuuaccaua

SEQ ID NO: 53350 - RNA, 22 nt, Homo sapiens
augaggagauauuaaauaccau

SEQ ID NO: 53351 - RNA, 18 nt, Homo sapiens
augagucauuguggaaau

SEQ ID NO: 53352 - RNA, 20 nt, Homo sapiens
augcaaacccugcuuugugg

SEQ ID NO: 53353 - RNA, 22 nt, Homo sapiens
augcauagugggaugcucugug

SEQ ID NO: 53354 - RNA, 22 nt, Homo sapiens
augcauauuuuaccuagaagag

SEQ ID NO: 53355 - RNA, 22 nt, Homo sapiens
augccacagaaauaaccaaaau

SEQ ID NO: 53356 - RNA, 22 nt, Homo sapiens
auggacagaaaaaaauagaugu

SEQ ID NO: 53357 - RNA, 22 nt, Homo sapiens
auggagaugaacuuggguaaag

SEQ ID NO: 53358 - RNA, 22 nt, Homo sapiens
auggagaugugcgaacugagua

SEQ ID NO: 53359 - RNA, 22 nt, Homo sapiens
auggagcaaaacagauuuggga

SEQ ID NO: 53360 - RNA, 22 nt, Homo sapiens
auggaggacaaugucaccuuca

SEQ ID NO: 53361 - RNA, 22 nt, Homo sapiens
auggagguguggggagugaguu

SEQ ID NO: 53362 - RNA, 22 nt, Homo sapiens
auggcccugggaaaggaggcau

SEQ ID NO: 53363 - RNA, 23 nt, Homo sapiens
auggcccuggugggagugucuuu

SEQ ID NO: 53364 - RNA, 22 nt, Homo sapiens
auggcuauuccauaggcagagc

SEQ ID NO: 53365 - RNA, 22 nt, Homo sapiens
auggcucuguuccaugugucuu

SEQ ID NO: 53366 - RNA, 22 nt, Homo sapiens
auggcuuuuauuguguugaggu

SEQ ID NO: 53367 - RNA, 22 nt, Homo sapiens
auguaaacagaugugcagcuug

SEQ ID NO: 53368 - RNA, 22 nt, Homo sapiens
auguccuggacccagacaaagc

SEQ ID NO: 53369 - RNA, 22 nt, Homo sapiens
augugggaggacuuggcuguug

SEQ ID NO: 53370 - RNA, 22 nt, Homo sapiens
auuaaauguuggacguauacau

SEQ ID NO: 53371 - RNA, 22 nt, Homo sapiens
auuaacaucuagaguuuuggug

SEQ ID NO: 53372 - RNA, 22 nt, Homo sapiens
auuagaugguuauaggugugag

SEQ ID NO: 53373 - RNA, 22 nt, Homo sapiens
auugaacuguuggagagguuuu

SEQ ID NO: 53374 - RNA, 22 nt, Homo sapiens
auugacaguuggccaguaagug

SEQ ID NO: 53375 - RNA, 22 nt, Homo sapiens
auugcacacagaaucaggguaa

SEQ ID NO: 53376 - RNA, 22 nt, Homo sapiens
auugcccauaaggauauuguca

SEQ ID NO: 53377 - RNA, 22 nt, Homo sapiens
auugcucaaaucaguacuugag

SEQ ID NO: 53378 - RNA, 22 nt, Homo sapiens
auugcucuuagaaauauuucuu

SEQ ID NO: 53379 - RNA, 22 nt, Homo sapiens
auuggacagcauuucuagacuu

SEQ ID NO: 53380 - RNA, 22 nt, Homo sapiens
auuggcaauccauauauuuucu

SEQ ID NO: 53381 - RNA, 22 nt, Homo sapiens
auuggcaauggcaaagcagagu

SEQ ID NO: 53382 - RNA, 22 nt, Homo sapiens
uaucaguauggauucauggauu

SEQ ID NO: 53383 - RNA, 22 nt, Homo sapiens
uaucccuuagagcggggugguu

SEQ ID NO: 53384 - RNA, 22 nt, Homo sapiens
uaugaggaguauaacccgguga

SEQ ID NO: 53385 - RNA, 22 nt, Homo sapiens
uaugcacacguguccaugugca

SEQ ID NO: 53386 - RNA, 22 nt, Homo sapiens
uaugcaugucucuguacacgug

SEQ ID NO: 53387 - RNA, 22 nt, Homo sapiens
uauuccuuuugcauuuccacau

SEQ ID NO: 53388 - RNA, 22 nt, Homo sapiens
uauugcacgccagccugagcaa

SEQ ID NO: 53389 - RNA, 20 nt, Homo sapiens
uauugcacuccagucugggc

SEQ ID NO: 53390 - RNA, 22 nt, Homo sapiens
uauugcuugaggaaaugguaau

SEQ ID NO: 53391 - RNA, 22 nt, Homo sapiens
uauugcuuuuaacccaaucucu

SEQ ID NO: 53392 - RNA, 22 nt, Homo sapiens
uauugucaccaucccuguuuua

SEQ ID NO: 53393 - RNA, 22 nt, Homo sapiens
ucaaacugucagguugaccaga

SEQ ID NO: 53394 - RNA, 22 nt, Homo sapiens
ucaaaugguccacgugaacauu

SEQ ID NO: 53395 - RNA, 22 nt, Homo sapiens
ucaagcaauucuccugccucag

SEQ ID NO: 53396 - RNA, 22 nt, Homo sapiens
ucaaugcaaccuccaccucugg

SEQ ID NO: 53397 - RNA, 22 nt, Homo sapiens
ucacagucaaaguaaucauaga

SEQ ID NO: 53398 - RNA, 22 nt, Homo sapiens
ucacuaaagaaaauggcaugga

SEQ ID NO: 53399 - RNA, 22 nt, Homo sapiens
ucacuagaucaagggagagaaa

SEQ ID NO: 53400 - RNA, 22 nt, Homo sapiens
ucacugcgaccucugccucccg

SEQ ID NO: 53401 - RNA, 22 nt, Homo sapiens
ucagagucuagaucacucacug

SEQ ID NO: 53402 - RNA, 22 nt, Homo sapiens
ucagaucuucagcaggggcccc

SEQ ID NO: 53403 - RNA, 20 nt, Homo sapiens
ucagguagaucuuugagguc

SEQ ID NO: 53404 - RNA, 23 nt, Homo sapiens
ucagguaguuucagaggaccuug

SEQ ID NO: 53405 - RNA, 22 nt, Homo sapiens
ucaguaguuuuuuuacuaggug

SEQ ID NO: 53406 - RNA, 22 nt, Homo sapiens
ucagucauguuuaccagacgua

SEQ ID NO: 53407 - RNA, 21 nt, Homo sapiens
ucagugcaauucuauggggaa

SEQ ID NO: 53408 - RNA, 22 nt, Homo sapiens
uuggaaacauuuaugguaacag

SEQ ID NO: 53409 - RNA, 22 nt, Homo sapiens
uuggaaagagguguuuaugacu

SEQ ID NO: 53410 - RNA, 22 nt, Homo sapiens
uuggacugagaguuccaccauu

SEQ ID NO: 53411 - RNA, 22 nt, Homo sapiens
uuggauauucaguuuuuccauc

SEQ ID NO: 53412 - RNA, 22 nt, Homo sapiens
uuggcagcacgcaguccagagg

SEQ ID NO: 53413 - RNA, 22 nt, Homo sapiens
uuggccccucccaaauuucaug

SEQ ID NO: 53414 - RNA, 22 nt, Homo sapiens
uuggcuuuuaugcagcuuaggu

SEQ ID NO: 53415 - RNA, 22 nt, Homo sapiens
uuggucaggcuaaucucgaacg

SEQ ID NO: 53416 - RNA, 22 nt, Homo sapiens
uugguucucuuagccaucuuaa

SEQ ID NO: 53417 - RNA, 22 nt, Homo sapiens
uuguaaagaucauaugcuguuc

SEQ ID NO: 53418 - RNA, 22 nt, Homo sapiens
uuguacuuuuaguagagacggg

SEQ ID NO: 53419 - RNA, 22 nt, Homo sapiens
uuguauaggcucaguaagaauc

SEQ ID NO: 53420 - RNA, 22 nt, Homo sapiens
uugucauuuucagaguguuacg

SEQ ID NO: 53421 - RNA, 22 nt, Homo sapiens
uugugauggugcauacugagcu

SEQ ID NO: 53422 - RNA, 22 nt, Homo sapiens
uugugcauguauauuaguucac

SEQ ID NO: 53423 - RNA, 19 nt, Homo sapiens
uuguguccccacaaaauuc

SEQ ID NO: 53424 - RNA, 17 nt, Homo sapiens
uuguucccauuaaaaag

SEQ ID NO: 53425 - RNA, 22 nt, Homo sapiens
uuguuugguugaguauggaagu

SEQ ID NO: 53426 - RNA, 22 nt, Homo sapiens
uuguuuuggagaugagcuaaaa

SEQ ID NO: 53427 - RNA, 22 nt, Homo sapiens
uuuaaugcgucucugaguuuug

SEQ ID NO: 53428 - RNA, 21 nt, Homo sapiens
uuuagguagcuuuucugggag

SEQ ID NO: 53429 - RNA, 22 nt, Homo sapiens
uuuauucggcuaggagcuucgg

SEQ ID NO: 53430 - RNA, 17 nt, Homo sapiens
uuucagaguggaagugu

SEQ ID NO: 53431 - RNA, 22 nt, Homo sapiens
uuucaggcaagggugacccuga

SEQ ID NO: 53432 - RNA, 22 nt, Homo sapiens
uuucauagccuucuaaugaguu

SEQ ID NO: 53433 - RNA, 16 nt, Homo sapiens
uuucaucaguuuuaau

SEQ ID NO: 53434 - RNA, 22 nt, Homo sapiens
uuucauccggcuguguauuaug

SEQ ID NO: 53435 - RNA, 21 nt, Homo sapiens
uuuccuggagcguauggcuuc

SEQ ID NO: 53436 - RNA, 22 nt, Homo sapiens
uuuccuguaggaaggaaauaga

SEQ ID NO: 53437 - RNA, 22 nt, Homo sapiens
uuucucaguguuucaggguagg

SEQ ID NO: 53438 - RNA, 22 nt, Homo sapiens
uuucugugguccucuugaaggu

SEQ ID NO: 53439 - RNA, 20 nt, Homo sapiens
uuugcagaaucuaagaagag

SEQ ID NO: 53440 - RNA, 22 nt, Homo sapiens
uuugcugagucugacuucaugg

SEQ ID NO: 53441 - RNA, 22 nt, Homo sapiens
uuuggcagaaaacuaaaaggua

SEQ ID NO: 53442 - RNA, 22 nt, Homo sapiens
uuugggaaaugaaguugguaga

SEQ ID NO: 53443 - RNA, 22 nt, Homo sapiens
uuuguacacuguugguaggauu

SEQ ID NO: 53444 - RNA, 22 nt, Homo sapiens
uuugucaauaacuaccaacagg

SEQ ID NO: 53445 - RNA, 22 nt, Homo sapiens
uuuuaguggacaaagguauuua

SEQ ID NO: 53446 - RNA, 22 nt, Homo sapiens
uuuugcaggcauuggaaguuua

SEQ ID NO: 53447 - RNA, 17 nt, Homo sapiens
uuuuggauuagaaaucc

SEQ ID NO: 53448 - RNA, 22 nt, Homo sapiens
uuuugguauaugcaggggucuu

SEQ ID NO: 53449 - RNA, 22 nt, Homo sapiens
uuuuguacaacagcucugggga

SEQ ID NO: 53450 - RNA, 19 nt, Homo sapiens
uuuuguacucugugacuug

SEQ ID NO: 53451 - RNA, 22 nt, Homo sapiens
cuagagagaagcugugugaccu

SEQ ID NO: 53452 - RNA, 22 nt, Homo sapiens
cuagaggcacagccuaggcacu

SEQ ID NO: 53453 - RNA, 22 nt, Homo sapiens
cuagcacauuuaucuuuauaca

SEQ ID NO: 53454 - RNA, 21 nt, Homo sapiens
cucaaaguacugauauuacag

SEQ ID NO: 53455 - RNA, 18 nt, Homo sapiens
cucacaguaacuuuuaag

SEQ ID NO: 53456 - RNA, 20 nt, Homo sapiens
cucaccagguguaggcugag

SEQ ID NO: 53457 - RNA, 21 nt, Homo sapiens
cucauauugcuuuuccauggu

SEQ ID NO: 53458 - RNA, 22 nt, Homo sapiens
cuccaggugucauccaccuccu

SEQ ID NO: 53459 - RNA, 22 nt, Homo sapiens
cuccuguagccccaucaucuuu

SEQ ID NO: 53460 - RNA, 22 nt, Homo sapiens
cucugauggagauauacaagga

SEQ ID NO: 53461 - RNA, 22 nt, Homo sapiens
cugaauguuucacucugaaaug

SEQ ID NO: 53462 - RNA, 22 nt, Homo sapiens
cugacuaguuuuaaugcagauu

SEQ ID NO: 53463 - RNA, 22 nt, Homo sapiens
cugagcuagaccauuuggcucc

SEQ ID NO: 53464 - RNA, 22 nt, Homo sapiens
cugagcuaguagcauuguguca

SEQ ID NO: 53465 - RNA, 22 nt, Homo sapiens
cugagcuaugccuggaaaggca

SEQ ID NO: 53466 - RNA, 22 nt, Homo sapiens
cugaggucugaauccagguauc

SEQ ID NO: 53467 - RNA, 22 nt, Homo sapiens
cugagugcaagugauccuccca

SEQ ID NO: 53468 - RNA, 22 nt, Homo sapiens
cugccuaaagaaaaagacguug

SEQ ID NO: 53469 - RNA, 22 nt, Homo sapiens
cugccuagaucugaaccuggcu

SEQ ID NO: 53470 - RNA, 22 nt, Homo sapiens
cuggagaucuugacauugaagu

SEQ ID NO: 53471 - RNA, 22 nt, Homo sapiens
cuggagauuaaccaauugccau

SEQ ID NO: 53472 - RNA, 22 nt, Homo sapiens
cuggcaagagugaaccagcugu

SEQ ID NO: 53473 - RNA, 22 nt, Homo sapiens
cuggcucauuucauuuagcaua

SEQ ID NO: 53474 - RNA, 22 nt, Homo sapiens
cugucuagagggcacaugaugc

SEQ ID NO: 53475 - RNA, 22 nt, Homo sapiens
cugucucagugaauugguuuua

SEQ ID NO: 53476 - RNA, 22 nt, Homo sapiens
cugugaagaaagucauugguag

SEQ ID NO: 53477 - RNA, 22 nt, Homo sapiens
cugugcaugcgcggagcugaaa

SEQ ID NO: 53478 - RNA, 22 nt, Homo sapiens
cugugcauuggaugucucccug

SEQ ID NO: 53479 - RNA, 22 nt, Homo sapiens
cuguugcaguuauggcugcagg

SEQ ID NO: 53480 - RNA, 18 nt, Homo sapiens
cuuaacauugggaugaua

SEQ ID NO: 53481 - RNA, 22 nt, Homo sapiens
cuuuaugagguuggauggaucu

SEQ ID NO: 53482 - RNA, 22 nt, Homo sapiens
cuuugcaaaacauugagaccuc

SEQ ID NO: 53483 - RNA, 22 nt, Homo sapiens
gaaagcugguauagauacauua

SEQ ID NO: 53484 - RNA, 18 nt, Homo sapiens
gaagaaguaggcauggca

SEQ ID NO: 53485 - RNA, 22 nt, Homo sapiens
gaaugcagcagugacagggcug

SEQ ID NO: 53486 - RNA, 17 nt, Homo sapiens
gacauaggaaaaggaga

SEQ ID NO: 53487 - RNA, 22 nt, Homo sapiens
gacaucauuaugagauuuaaac

SEQ ID NO: 53488 - RNA, 22 nt, Homo sapiens
gacccucuagauggaagcacug

SEQ ID NO: 53489 - RNA, 22 nt, Homo sapiens
gacugcagugcagcuguuaggc

SEQ ID NO: 53490 - RNA, 22 nt, Homo sapiens
gacuggauagauaaaguuaguu

SEQ ID NO: 53491 - RNA, 22 nt, Homo sapiens
gagacggagucucgcucugucg

SEQ ID NO: 53492 - RNA, 22 nt, Homo sapiens
gagacggagucuugcucuguug

SEQ ID NO: 53493 - RNA, 22 nt, Homo sapiens
gagacugagucuugcccuguca

SEQ ID NO: 53494 - RNA, 22 nt, Homo sapiens
gagccuguaggaggagaggugg

SEQ ID NO: 53495 - RNA, 22 nt, Homo sapiens
gagcuacauggauagucugcau

SEQ ID NO: 53496 - RNA, 22 nt, Homo sapiens
gaggaaguagcuacugucuuuc

SEQ ID NO: 53497 - RNA, 22 nt, Homo sapiens
gagguagguuugguuacaaaag

SEQ ID NO: 53498 - RNA, 21 nt, Homo sapiens
gagugcaaauaaagagagggc

SEQ ID NO: 53499 - RNA, 23 nt, Homo sapiens
gagugcaaugacaugaucucgga

SEQ ID NO: 53500 - RNA, 22 nt, Homo sapiens
gagugcaauggcaccgucucgg

SEQ ID NO: 53501 - RNA, 22 nt, Homo sapiens
gagugcaauggcgcgaucuggg

SEQ ID NO: 53502 - RNA, 22 nt, Homo sapiens
gaucacaguuccucacgggcau

SEQ ID NO: 53503 - RNA, 22 nt, Homo sapiens
gaucuguuuuccuauuguuugu

SEQ ID NO: 53504 - RNA, 22 nt, Homo sapiens
gauuccacuuucaaauucaaau

SEQ ID NO: 53505 - RNA, 19 nt, Homo sapiens
gcagagaugugguagcuug

SEQ ID NO: 53506 - RNA, 22 nt, Homo sapiens
gcccuguugcccugaauacaua

SEQ ID NO: 53507 - RNA, 22 nt, Homo sapiens
gccuuuggugacaggcaugugu

SEQ ID NO: 53508 - RNA, 22 nt, Homo sapiens
gcugagcuaugccauauaugcc

SEQ ID NO: 53509 - RNA, 22 nt, Homo sapiens
gcuguauugacuuuguaucaua

SEQ ID NO: 53510 - RNA, 22 nt, Homo sapiens
gcuguguugugcccagcaucau

SEQ ID NO: 53511 - RNA, 22 nt, Homo sapiens
gcuuuguugauggugagucugu

SEQ ID NO: 53512 - RNA, 21 nt, Homo sapiens
ggaaaguuaaggaaauacccc

SEQ ID NO: 53513 - RNA, 22 nt, Homo sapiens
ggagauaauccagggagggacu

SEQ ID NO: 53514 - RNA, 22 nt, Homo sapiens
ggaggcuaguaaaaagguagaa

SEQ ID NO: 53515 - RNA, 22 nt, Homo sapiens
ggagguagucuuucccuuauca

SEQ ID NO: 53516 - RNA, 21 nt, Homo sapiens
ggcaagagaauacaacauaaa

SEQ ID NO: 53517 - RNA, 21 nt, Homo sapiens
ggcaagugugagguuuggggu

SEQ ID NO: 53518 - RNA, 22 nt, Homo sapiens
gggagguagguauuagcuuuuc

SEQ ID NO: 53519 - RNA, 20 nt, Homo sapiens
gggcaaguaugugggaaguc

SEQ ID NO: 53520 - RNA, 22 nt, Homo sapiens
ggggaguguggacaucacccug

SEQ ID NO: 53521 - RNA, 22 nt, Homo sapiens
gguaggcacuggugggaagaga

SEQ ID NO: 53522 - RNA, 19 nt, Homo sapiens
ggucagcaaagucuagcug

SEQ ID NO: 53523 - RNA, 22 nt, Homo sapiens
guaaauguccccugugauauug

SEQ ID NO: 53524 - RNA, 22 nt, Homo sapiens
guacaguacugaaugaauguau

SEQ ID NO: 53525 - RNA, 22 nt, Homo sapiens
guacaguaguaaaagugaauga

SEQ ID NO: 53526 - RNA, 22 nt, Homo sapiens
guagaggaauggcuccaccaua

SEQ ID NO: 53527 - RNA, 22 nt, Homo sapiens
guauacaguugacccuugaacc

SEQ ID NO: 53528 - RNA, 22 nt, Homo sapiens
guauuguacuacaagcucuuua

SEQ ID NO: 53529 - RNA, 22 nt, Homo sapiens
gucaaagugauuguaauuaggu

SEQ ID NO: 53530 - RNA, 22 nt, Homo sapiens
gucacagcuggcauugucugca

SEQ ID NO: 53531 - RNA, 22 nt, Homo sapiens
gucaguuucacucagcuggaac

SEQ ID NO: 53532 - RNA, 22 nt, Homo sapiens
gucauauaggguuuaccuguau

SEQ ID NO: 53533 - RNA, 22 nt, Homo sapiens
guccugaagaccuuccucugga

SEQ ID NO: 53534 - RNA, 22 nt, Homo sapiens
gucucccagccuacaucuuucu

SEQ ID NO: 53535 - RNA, 22 nt, Homo sapiens
gucucugguugcuuuuguacca

SEQ ID NO: 53536 - RNA, 22 nt, Homo sapiens
gucuuuaguugaaacauguggu

SEQ ID NO: 53537 - RNA, 22 nt, Homo sapiens
gucuuugaugucuaugugcuuc

SEQ ID NO: 53538 - RNA, 22 nt, Homo sapiens
gugaaagacagcauuaauggcu

SEQ ID NO: 53539 - RNA, 22 nt, Homo sapiens
gugagaagaaaaauauggcugu

SEQ ID NO: 53540 - RNA, 19 nt, Homo sapiens
gugagcaaugcauugcacu

SEQ ID NO: 53541 - RNA, 22 nt, Homo sapiens
uuagcccaucuugaggaaagua

SEQ ID NO: 53542 - RNA, 22 nt, Homo sapiens
uuagguaauauauugcugcuuu

SEQ ID NO: 53543 - RNA, 22 nt, Homo sapiens
uuagguagaauugauuaaguuu

SEQ ID NO: 53544 - RNA, 21 nt, Homo sapiens
uuaucccagugucucugcagg

SEQ ID NO: 53545 - RNA, 22 nt, Homo sapiens
uuauggcaaugccccacuccua

SEQ ID NO: 53546 - RNA, 22 nt, Homo sapiens
uuauguguuuaauguuucugaa

SEQ ID NO: 53547 - RNA, 23 nt, Homo sapiens
uucaaaggaugcuuuauggaauu

SEQ ID NO: 53548 - RNA, 22 nt, Homo sapiens
uucaagucaauuuuugaaugac

SEQ ID NO: 53549 - RNA, 22 nt, Homo sapiens
uucaauacuguugauccuuaug

SEQ ID NO: 53550 - RNA, 22 nt, Homo sapiens
uucacacugggccuacucugug

SEQ ID NO: 53551 - RNA, 22 nt, Homo sapiens
uucacagccgcaccccaucacu

SEQ ID NO: 53552 - RNA, 22 nt, Homo sapiens
uucacagcuuaauaaggcucag

SEQ ID NO: 53553 - RNA, 22 nt, Homo sapiens
uucacaugguugccuuuugauc

SEQ ID NO: 53554 - RNA, 22 nt, Homo sapiens
uucagcuacuugggaggcugaa

SEQ ID NO: 53555 - RNA, 22 nt, Homo sapiens
uucaguagucuccauagaaccg

SEQ ID NO: 53556 - RNA, 22 nt, Homo sapiens
uucaguauugcaccuggagucc

SEQ ID NO: 53557 - RNA, 22 nt, Homo sapiens
uucauaguaacaguaacuaugg

SEQ ID NO: 53558 - RNA, 22 nt, Homo sapiens
uucauaguguaccugaaggcac

SEQ ID NO: 53559 - RNA, 22 nt, Homo sapiens
uucauaguuuauacugauauuu

SEQ ID NO: 53560 - RNA, 21 nt, Homo sapiens
uucaucagccagaaaucaagc

SEQ ID NO: 53561 - RNA, 23 nt, Homo sapiens
uucaucagggauauuggccugaa

SEQ ID NO: 53562 - RNA, 18 nt, Homo sapiens
uucaucaguccucagcug

SEQ ID NO: 53563 - RNA, 22 nt, Homo sapiens
uuccugagagggcugggugcag

SEQ ID NO: 53564 - RNA, 22 nt, Homo sapiens
uuccuuguuuauuuacaggagg

SEQ ID NO: 53565 - RNA, 22 nt, Homo sapiens
uucugcuugaucuaguguguug

SEQ ID NO: 53566 - RNA, 22 nt, Homo sapiens
uucuggccccucccaaucucau

SEQ ID NO: 53567 - RNA, 22 nt, Homo sapiens
uucuggcucaggucaacacuuc

SEQ ID NO: 53568 - RNA, 22 nt, Homo sapiens
uucuggcucgauucucugaccg

SEQ ID NO: 53569 - RNA, 22 nt, Homo sapiens
uucuuagucauguaauagucca

SEQ ID NO: 53570 - RNA, 22 nt, Homo sapiens
uugaaagacagaggggcaaguu

SEQ ID NO: 53571 - RNA, 22 nt, Homo sapiens
uugacauguaaguacucuauag

SEQ ID NO: 53572 - RNA, 22 nt, Homo sapiens
uugagauggagucucgcucuuu

SEQ ID NO: 53573 - RNA, 22 nt, Homo sapiens
uugagauggaguucauuuuugu

SEQ ID NO: 53574 - RNA, 22 nt, Homo sapiens
uugagauggaguuucgcucuug

SEQ ID NO: 53575 - RNA, 22 nt, Homo sapiens
uugaggaggcagucugcccauu

SEQ ID NO: 53576 - RNA, 22 nt, Homo sapiens
uugaggaggcagucuguccguu

SEQ ID NO: 53577 - RNA, 22 nt, Homo sapiens
uugaggaggcagucuucccauu

SEQ ID NO: 53578 - RNA, 22 nt, Homo sapiens
uugcacagucuagcuccaccuu

SEQ ID NO: 53579 - RNA, 22 nt, Homo sapiens
uugcacauggcaggugcucaau

SEQ ID NO: 53580 - RNA, 22 nt, Homo sapiens
uugcacuccagccuuggggaga

SEQ ID NO: 53581 - RNA, 22 nt, Homo sapiens
uugcacuccagcucgggugaca

SEQ ID NO: 53582 - RNA, 22 nt, Homo sapiens
uugcacucugaagaccuacugu

SEQ ID NO: 53583 - RNA, 22 nt, Homo sapiens
uugcagcaaagagggaggggca

SEQ ID NO: 53584 - RNA, 22 nt, Homo sapiens
uugcagcaaauaggaaugagga

SEQ ID NO: 53585 - RNA, 22 nt, Homo sapiens
uugcaugcacaguucucaauag

SEQ ID NO: 53586 - RNA, 22 nt, Homo sapiens
uugccuaggcuggagugcagua

SEQ ID NO: 53587 - RNA, 22 nt, Homo sapiens
uugcucaggcuagaguucagcu

SEQ ID NO: 53588 - RNA, 22 nt, Homo sapiens
uugcuccucugccaggaccugu

SEQ ID NO: 53589 - RNA, 22 nt, Homo sapiens
uuggacaagauugcagagaauu

SEQ ID NO: 53590 - RNA, 22 nt, Homo sapiens
uuggacugggauggccgaggcu

SEQ ID NO: 53591 - RNA, 22 nt, Homo sapiens
uuggcagcauuccagccaagca

SEQ ID NO: 53592 - RNA, 22 nt, Homo sapiens
uuggcauuuuggacacccagga

SEQ ID NO: 53593 - RNA, 22 nt, Homo sapiens
uuguaacucugaauacauccua

SEQ ID NO: 53594 - RNA, 22 nt, Homo sapiens
uuguacaggaguguaagcuuca

SEQ ID NO: 53595 - RNA, 22 nt, Homo sapiens
uugucucacuggaguuuaguaa

SEQ ID NO: 53596 - RNA, 22 nt, Homo sapiens
uugugcuugcuguguucuaugc

SEQ ID NO: 53597 - RNA, 22 nt, Homo sapiens
uuuaacauuggaugagaucguc

SEQ ID NO: 53598 - RNA, 22 nt, Homo sapiens
uuuacagucuuuugugugaguc

SEQ ID NO: 53599 - RNA, 23 nt, Homo sapiens
uuuauacguugucauuuaucagg

SEQ ID NO: 53600 - RNA, 22 nt, Homo sapiens
uuuauugcucuaaaguugccau

SEQ ID NO: 53601 - RNA, 22 nt, Homo sapiens
uuucaacaggucuggggugguc

SEQ ID NO: 53602 - RNA, 22 nt, Homo sapiens
uuucccuuacuuaaacuuacuc

SEQ ID NO: 53603 - RNA, 22 nt, Homo sapiens
uuugacaaugugugcuuguauu

SEQ ID NO: 53604 - RNA, 21 nt, Homo sapiens
uuugaucauuaaaagugaauc

SEQ ID NO: 53605 - RNA, 22 nt, Homo sapiens
uuugcaucuuuugcuuccugga

SEQ ID NO: 53606 - RNA, 22 nt, Homo sapiens
uuugcuuaguaaauguagaaaa

SEQ ID NO: 53607 - RNA, 22 nt, Homo sapiens
uuuggcaacguuggaucccuca

SEQ ID NO: 53608 - RNA, 22 nt, Homo sapiens
uuuggcuauguuguaucuuucc

SEQ ID NO: 53609 - RNA, 22 nt, Homo sapiens
uuuguacacgugggugaauugu

SEQ ID NO: 53610 - RNA, 22 nt, Homo sapiens
uuuguauguuggagauuggaga

SEQ ID NO: 53611 - RNA, 22 nt, Homo sapiens
uuugugaaugucauaagcucca

SEQ ID NO: 53612 - RNA, 22 nt, Homo sapiens
uuugugcaugaagagggggugc

SEQ ID NO: 53613 - RNA, 22 nt, Homo sapiens
uuugugcugcaauuaauuuccc

SEQ ID NO: 53614 - RNA, 16 nt, Homo sapiens
uuugugugugacgaga

SEQ ID NO: 53615 - RNA, 22 nt, Homo sapiens
uuuuaugggcuauuugcauuag

SEQ ID NO: 53616 - RNA, 22 nt, Homo sapiens
uuuugcaggucaggggcagaga

SEQ ID NO: 53617 - RNA, 22 nt, Homo sapiens
uuuugcaguuacagagagugag

SEQ ID NO: 53618 - RNA, 22 nt, Homo sapiens
uuuuggugguuaugugucaaug

SEQ ID NO: 53619 - RNA, 22 nt, Homo sapiens
uuuuguacgccuguguccauca

SEQ ID NO: 53620 - RNA, 16 nt, Homo sapiens
uuuuugcagaaaugac

SEQ ID NO: 53621 - RNA, 22 nt, Homo sapiens
cauuacacuuguaagguuuuuc

SEQ ID NO: 53622 - RNA, 22 nt, Homo sapiens
cauugcaaugaggucuugcagu

SEQ ID NO: 53623 - RNA, 22 nt, Homo sapiens
cauugcauuuucuuuguaccuu

SEQ ID NO: 53624 - RNA, 22 nt, Homo sapiens
cauugguuccaguuuguccuua

SEQ ID NO: 53625 - RNA, 22 nt, Homo sapiens
ccacagucuaugcaacaagguc

SEQ ID NO: 53626 - RNA, 22 nt, Homo sapiens
ccacaguugaaauuuugacugu

SEQ ID NO: 53627 - RNA, 22 nt, Homo sapiens
ccaucacacugugauuauuauc

SEQ ID NO: 53628 - RNA, 22 nt, Homo sapiens
ccccagugguugcaacagcaga

SEQ ID NO: 53629 - RNA, 22 nt, Homo sapiens
cccugagaugugaauuucagag

SEQ ID NO: 53630 - RNA, 22 nt, Homo sapiens
ccuucauucauuaauuuagccc

SEQ ID NO: 53631 - RNA, 22 nt, Homo sapiens
ccuugguugugcuucaacuucu

SEQ ID NO: 53632 - RNA, 22 nt, Homo sapiens
cgccugagcugaggaagcugca

SEQ ID NO: 53633 - RNA, 22 nt, Homo sapiens
cgugaggaaaacagaggguguu

SEQ ID NO: 53634 - RNA, 22 nt, Homo sapiens
cuaaaugucucuacuaaguuua

SEQ ID NO: 53635 - RNA, 22 nt, Homo sapiens
cuaagggaggaagcugugcagg

SEQ ID NO: 53636 - RNA, 22 nt, Homo sapiens
cuagaagguaagagcuggaugc

SEQ ID NO: 53637 - RNA, 22 nt, Homo sapiens
cuagaguacuuaccacagcaug

SEQ ID NO: 53638 - RNA, 22 nt, Homo sapiens
cucaaguacaugggauuacagg

SEQ ID NO: 53639 - RNA, 22 nt, Homo sapiens
cucacugucaacauguauuugg

SEQ ID NO: 53640 - RNA, 20 nt, Homo sapiens
cucagguauuugaggcugca

SEQ ID NO: 53641 - RNA, 22 nt, Homo sapiens
cucugacagugguuagcacugu

SEQ ID NO: 53642 - RNA, 22 nt, Homo sapiens
cugagcaaaaugaagacacgau

SEQ ID NO: 53643 - RNA, 22 nt, Homo sapiens
cugagcucauuucuuuugcuac

SEQ ID NO: 53644 - RNA, 22 nt, Homo sapiens
cuggcaagaggauaaaguccua

SEQ ID NO: 53645 - RNA, 22 nt, Homo sapiens
cugugcauaucuuggacugugu

SEQ ID NO: 53646 - RNA, 22 nt, Homo sapiens
cugugcuugagagaugacacag

SEQ ID NO: 53647 - RNA, 22 nt, Homo sapiens
cuguucaggaggcauuuggugg

SEQ ID NO: 53648 - RNA, 22 nt, Homo sapiens
cuguuuguuuaggguacucaga

SEQ ID NO: 53649 - RNA, 22 nt, Homo sapiens
cuucaaaguuggcuaggagaca

SEQ ID NO: 53650 - RNA, 22 nt, Homo sapiens
cuugcauagaguuauugcccuu

SEQ ID NO: 53651 - RNA, 22 nt, Homo sapiens
cuuugauuauaaaaggguguuu

SEQ ID NO: 53652 - RNA, 22 nt, Homo sapiens
cuuugcaaauggccuuuccaag

SEQ ID NO: 53653 - RNA, 20 nt, Homo sapiens
cuuuggcaaugagaacaggg

SEQ ID NO: 53654 - RNA, 22 nt, Homo sapiens
cuuuuguggaucuucuguugcu

SEQ ID NO: 53655 - RNA, 22 nt, Homo sapiens
cuuuuugguagagcaggugugc

SEQ ID NO: 53656 - RNA, 22 nt, Homo sapiens
gaaacugcauuucuaacaagcu

SEQ ID NO: 53657 - RNA, 22 nt, Homo sapiens
gaaagauuuccugagcuagaaa

SEQ ID NO: 53658 - RNA, 23 nt, Homo sapiens
gaaguaauaaauggauucuuaac

SEQ ID NO: 53659 - RNA, 22 nt, Homo sapiens
gaauaaacuagagaggacugag

SEQ ID NO: 53660 - RNA, 22 nt, Homo sapiens
gaaucccuugcauuaucccuuu

SEQ ID NO: 53661 - RNA, 22 nt, Homo sapiens
gaaugcaugaggggaucagaug

SEQ ID NO: 53662 - RNA, 22 nt, Homo sapiens
gaccacauuccacacaggcuuu

SEQ ID NO: 53663 - RNA, 22 nt, Homo sapiens
gagaaccuccagcaagguagua

SEQ ID NO: 53664 - RNA, 22 nt, Homo sapiens
gagaacuaaugguuugauaagg

SEQ ID NO: 53665 - RNA, 22 nt, Homo sapiens
gagacggagucacgcccuguca

SEQ ID NO: 53666 - RNA, 22 nt, Homo sapiens
gagacugagucuugcucugucg

SEQ ID NO: 53667 - RNA, 22 nt, Homo sapiens
gagacugaguuuugcucuuguu

SEQ ID NO: 53668 - RNA, 22 nt, Homo sapiens
gagaugaugagauguucacagu

SEQ ID NO: 53669 - RNA, 22 nt, Homo sapiens
gagcugaucuuuauguaaauuc

SEQ ID NO: 53670 - RNA, 22 nt, Homo sapiens
gagcuguuuuucacuagaccaa

SEQ ID NO: 53671 - RNA, 22 nt, Homo sapiens
gagguaugugggcagacauuua

SEQ ID NO: 53672 - RNA, 22 nt, Homo sapiens
gagugcaagguuuuucugagug

SEQ ID NO: 53673 - RNA, 22 nt, Homo sapiens
gagugcaauggcaugaucuggg

SEQ ID NO: 53674 - RNA, 22 nt, Homo sapiens
gagugcaauggcgcgaucucgg

SEQ ID NO: 53675 - RNA, 22 nt, Homo sapiens
gagugcaauggugccaucucgg

SEQ ID NO: 53676 - RNA, 22 nt, Homo sapiens
gagugcaauggugcuaucucgg

SEQ ID NO: 53677 - RNA, 22 nt, Homo sapiens
gauacaguaugcaugugguauu

SEQ ID NO: 53678 - RNA, 22 nt, Homo sapiens
gaugaaacaucuuuggaaacug

SEQ ID NO: 53679 - RNA, 22 nt, Homo sapiens
gaugauguugaauguucucacc

SEQ ID NO: 53680 - RNA, 22 nt, Homo sapiens
gauggauuuuaagugaaugaaa

SEQ ID NO: 53681 - RNA, 22 nt, Homo sapiens
gauggcagugcagccccuggcu

SEQ ID NO: 53682 - RNA, 22 nt, Homo sapiens
gauuggcauugcugcaccugag

SEQ ID NO: 53683 - RNA, 22 nt, Homo sapiens
gcaaaguaauuguuguuuuugc

SEQ ID NO: 53684 - RNA, 22 nt, Homo sapiens
uauuacuugucugugucucaau

SEQ ID NO: 53685 - RNA, 22 nt, Homo sapiens
uauugcaauuggggaaacuggg

SEQ ID NO: 53686 - RNA, 22 nt, Homo sapiens
uauugcacuuuuccauaggagu

SEQ ID NO: 53687 - RNA, 22 nt, Homo sapiens
uauugcuaacaucccuuaugua

SEQ ID NO: 53688 - RNA, 22 nt, Homo sapiens
uauugcuuaugaugcugaauua

SEQ ID NO: 53689 - RNA, 22 nt, Homo sapiens
uauuguacauauccucccuuca

SEQ ID NO: 53690 - RNA, 22 nt, Homo sapiens
ucaaauguuuguuuaaggcuua

SEQ ID NO: 53691 - RNA, 22 nt, Homo sapiens
ucaagcaauucuccucucagcc

SEQ ID NO: 53692 - RNA, 22 nt, Homo sapiens
ucaagcaauucugcugccucag

SEQ ID NO: 53693 - RNA, 22 nt, Homo sapiens
ucaagugcauugauucaguauu

SEQ ID NO: 53694 - RNA, 22 nt, Homo sapiens
ucacagcuaaaaugaaaguagu

SEQ ID NO: 53695 - RNA, 22 nt, Homo sapiens
ucacaguccuguuuaggagagg

SEQ ID NO: 53696 - RNA, 22 nt, Homo sapiens
ucacauuguuauguaaauguuu

SEQ ID NO: 53697 - RNA, 22 nt, Homo sapiens
ucaccucgugaucugcccacuu

SEQ ID NO: 53698 - RNA, 22 nt, Homo sapiens
ucaccuggggaucuuguuuaca

SEQ ID NO: 53699 - RNA, 22 nt, Homo sapiens
ucacugaaaccacugccuccug

SEQ ID NO: 53700 - RNA, 22 nt, Homo sapiens
ucacugagcacaggagaugugc

SEQ ID NO: 53701 - RNA, 22 nt, Homo sapiens
ucagcagugugaaaacaaacua

SEQ ID NO: 53702 - RNA, 20 nt, Homo sapiens
ucagguagggcuucaacauu

SEQ ID NO: 53703 - RNA, 22 nt, Homo sapiens
ucagguaguuugugggagauga

SEQ ID NO: 53704 - RNA, 22 nt, Homo sapiens
ucagucauucacucacucggac

SEQ ID NO: 53705 - RNA, 16 nt, Homo sapiens
ucauaguaucucuucu

SEQ ID NO: 53706 - RNA, 22 nt, Homo sapiens
accacagugcuuccugcucacg

SEQ ID NO: 53707 - RNA, 22 nt, Homo sapiens
accaccacucccgcauucuaaa

SEQ ID NO: 53708 - RNA, 22 nt, Homo sapiens
accaugcaguccaauaugcaca

SEQ ID NO: 53709 - RNA, 22 nt, Homo sapiens
acccaguguucaacauucacau

SEQ ID NO: 53710 - RNA, 22 nt, Homo sapiens
acccuguugucagaauguggau

SEQ ID NO: 53711 - RNA, 22 nt, Homo sapiens
accugugguuacagucugucuc

SEQ ID NO: 53712 - RNA, 23 nt, Homo sapiens
accugugguuauuuuacucuucc

SEQ ID NO: 53713 - RNA, 22 nt, Homo sapiens
acuccacuuucaccacagcgga

SEQ ID NO: 53714 - RNA, 22 nt, Homo sapiens
acugugcuguuuuaauuauuga

SEQ ID NO: 53715 - RNA, 22 nt, Homo sapiens
agaaugugaacaucuugaaagu

SEQ ID NO: 53716 - RNA, 22 nt, Homo sapiens
agagagguggguggagccccca

SEQ ID NO: 53717 - RNA, 22 nt, Homo sapiens
agagguauacauuugagagcca

SEQ ID NO: 53718 - RNA, 22 nt, Homo sapiens
agaugccucauguucuagguuc

SEQ ID NO: 53719 - RNA, 23 nt, Homo sapiens
agauggcauuucaguucuuuagg

SEQ ID NO: 53720 - RNA, 22 nt, Homo sapiens
agaugguguuuucucaccagau

SEQ ID NO: 53721 - RNA, 19 nt, Homo sapiens
agcagaacaaauguguggg

SEQ ID NO: 53722 - RNA, 22 nt, Homo sapiens
agccaguauuuccacagagugg

SEQ ID NO: 53723 - RNA, 22 nt, Homo sapiens
agccccauuuguugaaaagacg

SEQ ID NO: 53724 - RNA, 23 nt, Homo sapiens
agcccugugacucgaacgaggag

SEQ ID NO: 53725 - RNA, 22 nt, Homo sapiens
agcccugugauuacuuuuauaa

SEQ ID NO: 53726 - RNA, 22 nt, Homo sapiens
agcccuuagauggcuccuucca

SEQ ID NO: 53727 - RNA, 22 nt, Homo sapiens
agcugauggucuuguaugaugu

SEQ ID NO: 53728 - RNA, 22 nt, Homo sapiens
agcuggaauuuaagguagauag

SEQ ID NO: 53729 - RNA, 22 nt, Homo sapiens
agcuuguuuucccauaacuaga

SEQ ID NO: 53730 - RNA, 22 nt, Homo sapiens
aggagaauugguucuucuugau

SEQ ID NO: 53731 - RNA, 22 nt, Homo sapiens
aggagaugaagcuuuaucuaaa

SEQ ID NO: 53732 - RNA, 22 nt, Homo sapiens
aggagguaggaauugugcuagg

SEQ ID NO: 53733 - RNA, 22 nt, Homo sapiens
aggagguagggugugaaacagc

SEQ ID NO: 53734 - RNA, 22 nt, Homo sapiens
aggcaagaaugcuuguuucacc

SEQ ID NO: 53735 - RNA, 22 nt, Homo sapiens
agguagcauagcgggaauauca

SEQ ID NO: 53736 - RNA, 22 nt, Homo sapiens
aguaacaggauccaaagaaugu

SEQ ID NO: 53737 - RNA, 22 nt, Homo sapiens
aguaccacgugaugccauuuuc

SEQ ID NO: 53738 - RNA, 17 nt, Homo sapiens
aguacugucccauccuu

SEQ ID NO: 53739 - RNA, 22 nt, Homo sapiens
agucacagugaccuugucugac

SEQ ID NO: 53740 - RNA, 22 nt, Homo sapiens
agugcaguggcacaaucuuggc

SEQ ID NO: 53741 - RNA, 22 nt, Homo sapiens
aguggauguuguggccugggag

SEQ ID NO: 53742 - RNA, 22 nt, Homo sapiens
auaaaugcuuccagucauuaaa

SEQ ID NO: 53743 - RNA, 22 nt, Homo sapiens
auacaaguuauuugaacugcgg

SEQ ID NO: 53744 - RNA, 22 nt, Homo sapiens
cacaguugccuaucuccugaag

SEQ ID NO: 53745 - RNA, 22 nt, Homo sapiens
cacauguucaggagcacuuaga

SEQ ID NO: 53746 - RNA, 22 nt, Homo sapiens
cacauugcaggaaaguucauua

SEQ ID NO: 53747 - RNA, 16 nt, Homo sapiens
cacauugcugcauggc

SEQ ID NO: 53748 - RNA, 22 nt, Homo sapiens
cacugcgacguccgccucccgg

SEQ ID NO: 53749 - RNA, 22 nt, Homo sapiens
cagagguauugcaaaagccuag

SEQ ID NO: 53750 - RNA, 22 nt, Homo sapiens
cagagucaagcucuuguuccau

SEQ ID NO: 53751 - RNA, 22 nt, Homo sapiens
cagcaaaucauccuauuugagc

SEQ ID NO: 53752 - RNA, 22 nt, Homo sapiens
cagcccuacacagacugacuca

SEQ ID NO: 53753 - RNA, 22 nt, Homo sapiens
cagcugaugucgaaugcacucu

SEQ ID NO: 53754 - RNA, 22 nt, Homo sapiens
cagguaggccaauguuuuccaa

SEQ ID NO: 53755 - RNA, 18 nt, Homo sapiens
cagugcaauacaggagag

SEQ ID NO: 53756 - RNA, 22 nt, Homo sapiens
caucccugucgucaagucucug

SEQ ID NO: 53757 - RNA, 22 nt, Homo sapiens
cauggcuacugcagauguaggg

SEQ ID NO: 53758 - RNA, 19 nt, Homo sapiens
cauggcuuauaauuuuaau

SEQ ID NO: 53759 - RNA, 22 nt, Homo sapiens
caugucuuuuaaacauucaacu

SEQ ID NO: 53760 - RNA, 22 nt, Homo sapiens
cauuaagcuacuuagaaggugc

SEQ ID NO: 53761 - RNA, 22 nt, Homo sapiens
cauugcacuccagccugcugac

SEQ ID NO: 53762 - RNA, 22 nt, Homo sapiens
cauugcacuuagacaacuuuug

SEQ ID NO: 53763 - RNA, 23 nt, Homo sapiens
ccacaaugguugaacuagauuac

SEQ ID NO: 53764 - RNA, 18 nt, Homo sapiens
ccagugcaaggaaagccc

SEQ ID NO: 53765 - RNA, 22 nt, Homo sapiens
ccccagguuucaauaaagccca

SEQ ID NO: 53766 - RNA, 22 nt, Homo sapiens
ccccauuugaacuccuucaacu

SEQ ID NO: 53767 - RNA, 22 nt, Homo sapiens
cgugaggaguauuuuuaggugc

SEQ ID NO: 53768 - RNA, 22 nt, Homo sapiens
cuaacacagagguuuauuucuc

SEQ ID NO: 53769 - RNA, 22 nt, Homo sapiens
cuaacuaugucucaggaugucc

SEQ ID NO: 53770 - RNA, 22 nt, Homo sapiens
cuaauacaguuguccaagcugg

SEQ ID NO: 53771 - RNA, 22 nt, Homo sapiens
cuacagaguaucuaaagaggua

SEQ ID NO: 53772 - RNA, 22 nt, Homo sapiens
cuacugcacaucaucugaguua

SEQ ID NO: 53773 - RNA, 22 nt, Homo sapiens
cuaucacuguuuugaugcccgg

SEQ ID NO: 53774 - RNA, 22 nt, Homo sapiens
cuauggccugcuuagaacauac

SEQ ID NO: 53775 - RNA, 22 nt, Homo sapiens
cuauggcucugguuauggcugu

SEQ ID NO: 53776 - RNA, 22 nt, Homo sapiens
cucacuggguguaaaacaugua

SEQ ID NO: 53777 - RNA, 22 nt, Homo sapiens
cuccuggugauuggagugugaa

SEQ ID NO: 53778 - RNA, 17 nt, Homo sapiens
cucucugguuuaaagca

SEQ ID NO: 53779 - RNA, 22 nt, Homo sapiens
cucucuguuugucuguuauugg

SEQ ID NO: 53780 - RNA, 22 nt, Homo sapiens
cugaaagagcauguaacacagu

SEQ ID NO: 53781 - RNA, 22 nt, Homo sapiens
cugagauacacuaauagucucu

SEQ ID NO: 53782 - RNA, 22 nt, Homo sapiens
cugagcacugagauccucuagc

SEQ ID NO: 53783 - RNA, 22 nt, Homo sapiens
cugagcuagaccacuuggcucc

SEQ ID NO: 53784 - RNA, 22 nt, Homo sapiens
cugaggaaguucuuuaacaguu

SEQ ID NO: 53785 - RNA, 20 nt, Homo sapiens
cugauacagccugagcucuc

SEQ ID NO: 53786 - RNA, 22 nt, Homo sapiens
cugcagucaucugaagauuuug

SEQ ID NO: 53787 - RNA, 20 nt, Homo sapiens
cugcuccccuacaaaucuca

SEQ ID NO: 53788 - RNA, 22 nt, Homo sapiens
cuggaauuacaggguugagcua

SEQ ID NO: 53789 - RNA, 22 nt, Homo sapiens
cuggagauauuggaagaaagaa

SEQ ID NO: 53790 - RNA, 22 nt, Homo sapiens
cuggauauguugcaacauuucc

SEQ ID NO: 53791 - RNA, 22 nt, Homo sapiens
cugggucaguuucugauuauug

SEQ ID NO: 53792 - RNA, 22 nt, Homo sapiens
cugguuuguaaaguuccugaga

SEQ ID NO: 53793 - RNA, 19 nt, Homo sapiens
cugucacugaggaagacug

SEQ ID NO: 53794 - RNA, 22 nt, Homo sapiens
uuaagggaggagcuucaagaug

SEQ ID NO: 53795 - RNA, 22 nt, Homo sapiens
uuaauuguccauuauucuguuc

SEQ ID NO: 53796 - RNA, 22 nt, Homo sapiens
uuacaguaugaguaagaguucu

SEQ ID NO: 53797 - RNA, 22 nt, Homo sapiens
uuaccugagaaggugacauuug

SEQ ID NO: 53798 - RNA, 22 nt, Homo sapiens
uuagggaggacaguuacaacag

SEQ ID NO: 53799 - RNA, 22 nt, Homo sapiens
uuagggaggcucaggacaagag

SEQ ID NO: 53800 - RNA, 22 nt, Homo sapiens
uuaguagcacagaguaucagca

SEQ ID NO: 53801 - RNA, 22 nt, Homo sapiens
uuauauguuucuuagggacaga

SEQ ID NO: 53802 - RNA, 22 nt, Homo sapiens
uuauggccauucuuguaggagu

SEQ ID NO: 53803 - RNA, 22 nt, Homo sapiens
uuaugguuuuucugugagaugg

SEQ ID NO: 53804 - RNA, 22 nt, Homo sapiens
uuauucauuaacagggaccaaa

SEQ ID NO: 53805 - RNA, 22 nt, Homo sapiens
uuauugcacuccagccugggua

SEQ ID NO: 53806 - RNA, 22 nt, Homo sapiens
uucaagauggcaccagugagug

SEQ ID NO: 53807 - RNA, 22 nt, Homo sapiens
uucaagucaaggaaagaggucu

SEQ ID NO: 53808 - RNA, 22 nt, Homo sapiens
uucaagucuuggcuuugccacc

SEQ ID NO: 53809 - RNA, 22 nt, Homo sapiens
uucaggcuccgugccagcuccg

SEQ ID NO: 53810 - RNA, 22 nt, Homo sapiens
uucagugccuggaagucgugcu

SEQ ID NO: 53811 - RNA, 22 nt, Homo sapiens
uucauagaggacauuacuggag

SEQ ID NO: 53812 - RNA, 21 nt, Homo sapiens
uucauaugcacugagugccca

SEQ ID NO: 53813 - RNA, 22 nt, Homo sapiens
uucaucagcuguagaugucaug

SEQ ID NO: 53814 - RNA, 22 nt, Homo sapiens
uucaucagggguauuggccaau

SEQ ID NO: 53815 - RNA, 22 nt, Homo sapiens
uucaucuggcaauucagagauu

SEQ ID NO: 53816 - RNA, 22 nt, Homo sapiens
uucauggaauauugaccauuuu

SEQ ID NO: 53817 - RNA, 22 nt, Homo sapiens
uucauugaaugauuuuuagaag

SEQ ID NO: 53818 - RNA, 22 nt, Homo sapiens
uuccaagugggaaacaaaaaug

SEQ ID NO: 53819 - RNA, 22 nt, Homo sapiens
uuccacagggauuugcauugau

SEQ ID NO: 53820 - RNA, 22 nt, Homo sapiens
uucccuguaucuucugccaugu

SEQ ID NO: 53821 - RNA, 22 nt, Homo sapiens
uucccugugugcagaugggugu

SEQ ID NO: 53822 - RNA, 22 nt, Homo sapiens
uuccugaggccuccccagaagc

SEQ ID NO: 53823 - RNA, 22 nt, Homo sapiens
uuccuggaggggaaguguccaa

SEQ ID NO: 53824 - RNA, 22 nt, Homo sapiens
uucugcacaucgaucacaagau

SEQ ID NO: 53825 - RNA, 22 nt, Homo sapiens
uucuggcuaugggauacuaaau

SEQ ID NO: 53826 - RNA, 22 nt, Homo sapiens
uucuggcuuuuaaagaaauguu

SEQ ID NO: 53827 - RNA, 22 nt, Homo sapiens
uucuguguuuaggucacggcua

SEQ ID NO: 53828 - RNA, 22 nt, Homo sapiens
uucuuaguggcaccacuuuuuu

SEQ ID NO: 53829 - RNA, 22 nt, Homo sapiens
uugaacuagaaccugcaaauuu

SEQ ID NO: 53830 - RNA, 22 nt, Homo sapiens
uugacagaccuuggucauaucc

SEQ ID NO: 53831 - RNA, 22 nt, Homo sapiens
uugacauugcuguaguguccag

SEQ ID NO: 53832 - RNA, 22 nt, Homo sapiens
uugagacugagucucgcccugu

SEQ ID NO: 53833 - RNA, 22 nt, Homo sapiens
uugagauggagucucacuccuu

SEQ ID NO: 53834 - RNA, 22 nt, Homo sapiens
uugagauggagucucacugugu

SEQ ID NO: 53835 - RNA, 22 nt, Homo sapiens
uugagauggagucucgcucugu

SEQ ID NO: 53836 - RNA, 22 nt, Homo sapiens
uugagauggaguuucgcucuuu

SEQ ID NO: 53837 - RNA, 22 nt, Homo sapiens
uugagauggaguuuugcucuug

SEQ ID NO: 53838 - RNA, 22 nt, Homo sapiens
uugagcucuucuagcaauucua

SEQ ID NO: 53839 - RNA, 22 nt, Homo sapiens
uugaggaaugucauuuguguuu

SEQ ID NO: 53840 - RNA, 22 nt, Homo sapiens
uugaggaggcagucucuccauu

SEQ ID NO: 53841 - RNA, 22 nt, Homo sapiens
uugaggcuuuugaccucaugug

SEQ ID NO: 53842 - RNA, 22 nt, Homo sapiens
uugcacuauuaguauagauguc

SEQ ID NO: 53843 - RNA, 22 nt, Homo sapiens
uugcauagacaauauuaaucuu

SEQ ID NO: 53844 - RNA, 18 nt, Homo sapiens
uugcauaguguauccaaa

SEQ ID NO: 53845 - RNA, 22 nt, Homo sapiens
uugcauuagugugguacauuug

SEQ ID NO: 53846 - RNA, 22 nt, Homo sapiens
uugcuucauucaacauugaggg

SEQ ID NO: 53847 - RNA, 22 nt, Homo sapiens
uuggcauaguugcacuuacuag

SEQ ID NO: 53848 - RNA, 22 nt, Homo sapiens
uuggccccuccaaaucucaugu

SEQ ID NO: 53849 - RNA, 22 nt, Homo sapiens
uuggccccuuucauccacagcu

SEQ ID NO: 53850 - RNA, 22 nt, Homo sapiens
uugggcauugcuauaaauucuu

SEQ ID NO: 53851 - RNA, 22 nt, Homo sapiens
uuggucacugacauguuugaaa

SEQ ID NO: 53852 - RNA, 22 nt, Homo sapiens
uugucaaacucauucuccaucc

SEQ ID NO: 53853 - RNA, 22 nt, Homo sapiens
uugugacacagcugggccuaua

SEQ ID NO: 53854 - RNA, 22 nt, Homo sapiens
uugugcaugaugcauacauggu

SEQ ID NO: 53855 - RNA, 20 nt, Homo sapiens
uugugcauugggccauuggg

SEQ ID NO: 53856 - RNA, 22 nt, Homo sapiens
uuuacagucucauagguggaag

SEQ ID NO: 53857 - RNA, 22 nt, Homo sapiens
uuuacaguuuucuaggcuacca

SEQ ID NO: 53858 - RNA, 22 nt, Homo sapiens
uuuacugucuucagucccucug

SEQ ID NO: 53859 - RNA, 22 nt, Homo sapiens
uuuauggcaugcucccucucaa

SEQ ID NO: 53860 - RNA, 22 nt, Homo sapiens
uuucacagagggcuucuuucua

SEQ ID NO: 53861 - RNA, 23 nt, Homo sapiens
uuucaggcaggugaaagaccagc

SEQ ID NO: 53862 - RNA, 22 nt, Homo sapiens
uuucaucaagcacagaguagau

SEQ ID NO: 53863 - RNA, 22 nt, Homo sapiens
uuuccuguagggggcaaggccu

SEQ ID NO: 53864 - RNA, 17 nt, Homo sapiens
uuucucagcccucuucu

SEQ ID NO: 53865 - RNA, 18 nt, Homo sapiens
gugcauagccauggcagc

SEQ ID NO: 53866 - RNA, 22 nt, Homo sapiens
aaaagagcugagagguauucuu

SEQ ID NO: 53867 - RNA, 18 nt, Homo sapiens
aaacagugucucuuucug

SEQ ID NO: 53868 - RNA, 22 nt, Homo sapiens
aaacugcuuuccaugguggcug

SEQ ID NO: 53869 - RNA, 22 nt, Homo sapiens
aaaugcauaucaagauugcccu

SEQ ID NO: 53870 - RNA, 22 nt, Homo sapiens
aaaugcaugaauaagcucgugu

SEQ ID NO: 53871 - RNA, 22 nt, Homo sapiens
aaaugcauggacagcuggucuu

SEQ ID NO: 53872 - RNA, 22 nt, Homo sapiens
aaauugcaguuaggaugauggu

SEQ ID NO: 53873 - RNA, 22 nt, Homo sapiens
aacagacugucacauaaaauug

SEQ ID NO: 53874 - RNA, 22 nt, Homo sapiens
aacagucuccaguuguauccau

SEQ ID NO: 53875 - RNA, 22 nt, Homo sapiens
aagauagcuaagcuucuucuaa

SEQ ID NO: 53876 - RNA, 22 nt, Homo sapiens
aaggcaagaaaauggauucucc

SEQ ID NO: 53877 - RNA, 22 nt, Homo sapiens
aagggagcugcauaaucuugug

SEQ ID NO: 53878 - RNA, 21 nt, Homo sapiens
aaggugguggugauugagaug

SEQ ID NO: 53879 - RNA, 22 nt, Homo sapiens
aagugcaaaucuguggcugaaa

SEQ ID NO: 53880 - RNA, 22 nt, Homo sapiens
aagugucagaguugcuaaugac

SEQ ID NO: 53881 - RNA, 21 nt, Homo sapiens
aauaaagcaaccuuaugccau

SEQ ID NO: 53882 - RNA, 22 nt, Homo sapiens
aaugcaagauguuaauuauagg

SEQ ID NO: 53883 - RNA, 22 nt, Homo sapiens
aaugcuguguuauuucaugacc

SEQ ID NO: 53884 - RNA, 22 nt, Homo sapiens
aauggcucuguuggcccaagac

SEQ ID NO: 53885 - RNA, 22 nt, Homo sapiens
aauggcucuuccuggaguugug

SEQ ID NO: 53886 - RNA, 22 nt, Homo sapiens
acaccaucuccuuauuucucuu

SEQ ID NO: 53887 - RNA, 22 nt, Homo sapiens
acacugucucuugcugaccaug

SEQ ID NO: 53888 - RNA, 22 nt, Homo sapiens
acacuuucuggagcugcacaua

SEQ ID NO: 53889 - RNA, 18 nt, Homo sapiens
acagugcuggcaugagau

SEQ ID NO: 53890 - RNA, 22 nt, Homo sapiens
acaguggaauguaggguuugag

SEQ ID NO: 53891 - RNA, 22 nt, Homo sapiens
acaguguagugacugccaacuu

SEQ ID NO: 53892 - RNA, 18 nt, Homo sapiens
acagugucauggcucaau

SEQ ID NO: 53893 - RNA, 17 nt, Homo sapiens
acaugagacuggauucu

SEQ ID NO: 53894 - RNA, 22 nt, Homo sapiens
acaugagacuggguuuguaggg

SEQ ID NO: 53895 - RNA, 22 nt, Homo sapiens
acaugcauauguuggaagaaag

SEQ ID NO: 53896 - RNA, 22 nt, Homo sapiens
acaugcauccaugugaagagac

SEQ ID NO: 53897 - RNA, 19 nt, Homo sapiens
acauugcauuuguaggcuu

SEQ ID NO: 53898 - RNA, 22 nt, Homo sapiens
accacaggguaaaguuagauau

SEQ ID NO: 53899 - RNA, 22 nt, Homo sapiens
accacuguuucaagaagcuugu

SEQ ID NO: 53900 - RNA, 22 nt, Homo sapiens
accauugcacuccuuucugggc

SEQ ID NO: 53901 - RNA, 18 nt, Homo sapiens
acccuucagcacugggcc

SEQ ID NO: 53902 - RNA, 22 nt, Homo sapiens
accucagcccggggaaguugag

SEQ ID NO: 53903 - RNA, 22 nt, Homo sapiens
acuggcucugcuuuacaaacag

SEQ ID NO: 53904 - RNA, 22 nt, Homo sapiens
acuuugcuuagagggcauuaaa

SEQ ID NO: 53905 - RNA, 22 nt, Homo sapiens
agacaguauuggcaaagugugu

SEQ ID NO: 53906 - RNA, 22 nt, Homo sapiens
agagagcuuuaacuacccauuu

SEQ ID NO: 53907 - RNA, 22 nt, Homo sapiens
agagcaauguuaucagucucug

SEQ ID NO: 53908 - RNA, 22 nt, Homo sapiens
agagccacauuaaauaugggaa

SEQ ID NO: 53909 - RNA, 22 nt, Homo sapiens
agagguuuugcacugguucuuu

SEQ ID NO: 53910 - RNA, 22 nt, Homo sapiens
agagucacaugaggcccuucau

SEQ ID NO: 53911 - RNA, 22 nt, Homo sapiens
agaugcuguuaucaacuguagc

SEQ ID NO: 53912 - RNA, 22 nt, Homo sapiens
agcaccacaauuuccugccuaa

SEQ ID NO: 53913 - RNA, 23 nt, Homo sapiens
agcaccaccccaggucacaagug

SEQ ID NO: 53914 - RNA, 22 nt, Homo sapiens
agcaggacaauaugggaucagg

SEQ ID NO: 53915 - RNA, 22 nt, Homo sapiens
agcaucacaugggcugcuuggg

SEQ ID NO: 53916 - RNA, 22 nt, Homo sapiens
agcccagagacuguguaaauuu

SEQ ID NO: 53917 - RNA, 20 nt, Homo sapiens
agccccauguaaaccacaug

SEQ ID NO: 53918 - RNA, 23 nt, Homo sapiens
agccugguuucccugcuucuccc

SEQ ID NO: 53919 - RNA, 16 nt, Homo sapiens
agcuggaauuacaggc

SEQ ID NO: 53920 - RNA, 22 nt, Homo sapiens
agcugguuuauuucuauauccu

SEQ ID NO: 53921 - RNA, 22 nt, Homo sapiens
agcugguuuauuucucacaaca

SEQ ID NO: 53922 - RNA, 22 nt, Homo sapiens
aggaagugucuucuuuuaggca

SEQ ID NO: 53923 - RNA, 21 nt, Homo sapiens
aggagauguuuguccuuuuag

SEQ ID NO: 53924 - RNA, 22 nt, Homo sapiens
aggagcacaggacuuugauuau

SEQ ID NO: 53925 - RNA, 16 nt, Homo sapiens
aggcaagaauugaggu

SEQ ID NO: 53926 - RNA, 21 nt, Homo sapiens
aggcaagacuuuuagguuugu

SEQ ID NO: 53927 - RNA, 21 nt, Homo sapiens
aggcaagauuacuuacgagca

SEQ ID NO: 53928 - RNA, 19 nt, Homo sapiens
aggcauugugcucaucugu

SEQ ID NO: 53929 - RNA, 22 nt, Homo sapiens
agguagguugagaugggcauca

SEQ ID NO: 53930 - RNA, 23 nt, Homo sapiens
aguacuguaguaauugaggggaa

SEQ ID NO: 53931 - RNA, 21 nt, Homo sapiens
agugagucauuuggaaagcaa

SEQ ID NO: 53932 - RNA, 22 nt, Homo sapiens
aguuuugguugaguuacuagca

SEQ ID NO: 53933 - RNA, 22 nt, Homo sapiens
auaaaugcauugagaacugcug

SEQ ID NO: 53934 - RNA, 22 nt, Homo sapiens
auaaaugccuguuguuuuaagc

SEQ ID NO: 53935 - RNA, 22 nt, Homo sapiens
ucagugcaggaaucucuagcca

SEQ ID NO: 53936 - RNA, 22 nt, Homo sapiens
ucagugcaggaauuuccuuaga

SEQ ID NO: 53937 - RNA, 17 nt, Homo sapiens
ucagugcauuuaagaga

SEQ ID NO: 53938 - RNA, 22 nt, Homo sapiens
ucaguuaaugcugccugcugga

SEQ ID NO: 53939 - RNA, 22 nt, Homo sapiens
ucauagaucaaguaauaagaca

SEQ ID NO: 53940 - RNA, 22 nt, Homo sapiens
ucauugcacucccagacacccu

SEQ ID NO: 53941 - RNA, 22 nt, Homo sapiens
ucauugcauguuaauuaaacag

SEQ ID NO: 53942 - RNA, 22 nt, Homo sapiens
uccacaguaaggacccugccuu

SEQ ID NO: 53943 - RNA, 22 nt, Homo sapiens
uccaugaggcuacaguaaucuc

SEQ ID NO: 53944 - RNA, 22 nt, Homo sapiens
ucccuguuguuucauaauuuua

SEQ ID NO: 53945 - RNA, 22 nt, Homo sapiens
ucuaaaacuagauugugaugau

SEQ ID NO: 53946 - RNA, 22 nt, Homo sapiens
ucucacagaguugaacuuucuu

SEQ ID NO: 53947 - RNA, 22 nt, Homo sapiens
ucucagagccuaggguuuuuca

SEQ ID NO: 53948 - RNA, 23 nt, Homo sapiens
ucucauuccuugaaaauaaugac

SEQ ID NO: 53949 - RNA, 22 nt, Homo sapiens
ucucuggauaucuacuuauguu

SEQ ID NO: 53950 - RNA, 22 nt, Homo sapiens
ucugaaucguucccaugcagga

SEQ ID NO: 53951 - RNA, 22 nt, Homo sapiens
ucuggcaagagccgagggcagu

SEQ ID NO: 53952 - RNA, 22 nt, Homo sapiens
ucuggcuucugacuuaggggac

SEQ ID NO: 53953 - RNA, 22 nt, Homo sapiens
ucugugcauggcagaggaauga

SEQ ID NO: 53954 - RNA, 22 nt, Homo sapiens
ucuuucacuuagcaugauguuu

SEQ ID NO: 53955 - RNA, 22 nt, Homo sapiens
ucuuuggcugugaagaauaaug

SEQ ID NO: 53956 - RNA, 22 nt, Homo sapiens
ucuuugguucuguuuauguaau

SEQ ID NO: 53957 - RNA, 22 nt, Homo sapiens
ugaaaaguuguugaaggcuuca

SEQ ID NO: 53958 - RNA, 22 nt, Homo sapiens
ugaaauacuuaauuucuccaug

SEQ ID NO: 53959 - RNA, 22 nt, Homo sapiens
ugaacagucaucucucuuguau

SEQ ID NO: 53960 - RNA, 22 nt, Homo sapiens
ugaaguaauguuuuauucuauu

SEQ ID NO: 53961 - RNA, 22 nt, Homo sapiens
ugaaugcaucuagaaauuuauu

SEQ ID NO: 53962 - RNA, 20 nt, Homo sapiens
ugacaaggugcaaagaauca

SEQ ID NO: 53963 - RNA, 22 nt, Homo sapiens
ugacagguuggaauuaugggag

SEQ ID NO: 53964 - RNA, 22 nt, Homo sapiens
ugacauggagguggaggaagau

SEQ ID NO: 53965 - RNA, 22 nt, Homo sapiens
ugacuaaaacugaguuucauua

SEQ ID NO: 53966 - RNA, 22 nt, Homo sapiens
ugacuaggaggcuggaggauga

SEQ ID NO: 53967 - RNA, 23 nt, Homo sapiens
ugacugaguauauguuuggugcu

SEQ ID NO: 53968 - RNA, 20 nt, Homo sapiens
ugagaacauguggcauuugg

SEQ ID NO: 53969 - RNA, 20 nt, Homo sapiens
ugagaacaugugguauuugg

SEQ ID NO: 53970 - RNA, 22 nt, Homo sapiens
ugagaacuagagaacaagguga

SEQ ID NO: 53971 - RNA, 22 nt, Homo sapiens
ugagaacugcagggagcugcau

SEQ ID NO: 53972 - RNA, 22 nt, Homo sapiens
ugagaacugccuguauuuaucu

SEQ ID NO: 53973 - RNA, 22 nt, Homo sapiens
ugagaacuguuuugguuugggu

SEQ ID NO: 53974 - RNA, 22 nt, Homo sapiens
ugagaagacaucuuugcuuugu

SEQ ID NO: 53975 - RNA, 22 nt, Homo sapiens
ugagaagugauauagaaguuaa

SEQ ID NO: 53976 - RNA, 22 nt, Homo sapiens
ugagccaaugauuugaauagag

SEQ ID NO: 53977 - RNA, 22 nt, Homo sapiens
ugagcuaagugccaauauuaau

SEQ ID NO: 53978 - RNA, 22 nt, Homo sapiens
ugagcucagcuaguugaggugu

SEQ ID NO: 53979 - RNA, 22 nt, Homo sapiens
ugaggaaugaccccgugugguc

SEQ ID NO: 53980 - RNA, 22 nt, Homo sapiens
ugaggaauguguguuaaagaua

SEQ ID NO: 53981 - RNA, 22 nt, Homo sapiens
ugaggauaguguugaaggcagg

SEQ ID NO: 53982 - RNA, 22 nt, Homo sapiens
ugagguuguccacuauaaucca

SEQ ID NO: 53983 - RNA, 20 nt, Homo sapiens
ugaguagaggaguucuauca

SEQ ID NO: 53984 - RNA, 22 nt, Homo sapiens
ugaugacauugucacagucuga

SEQ ID NO: 53985 - RNA, 22 nt, Homo sapiens
ugcaacauguguaccacucugu

SEQ ID NO: 53986 - RNA, 18 nt, Homo sapiens
ugcaccaguuuacacuuc

SEQ ID NO: 53987 - RNA, 22 nt, Homo sapiens
ugcagaaucccuucagauccga

SEQ ID NO: 53988 - RNA, 22 nt, Homo sapiens
ugcauaucuucuuuugagaaau

SEQ ID NO: 53989 - RNA, 22 nt, Homo sapiens
ugcccuguaucccacuguuuca

SEQ ID NO: 53990 - RNA, 22 nt, Homo sapiens
ugcugguggucccauaugauua

SEQ ID NO: 53991 - RNA, 22 nt, Homo sapiens
ugcuuagucuugcuuuagcuau

SEQ ID NO: 53992 - RNA, 22 nt, Homo sapiens
uggaaacuuauguucuucugug

SEQ ID NO: 53993 - RNA, 22 nt, Homo sapiens
uggaaaguacuugaguuuguau

SEQ ID NO: 53994 - RNA, 22 nt, Homo sapiens
uggaccccugcucgggagcccu

SEQ ID NO: 53995 - RNA, 22 nt, Homo sapiens
uggacuagagggugggcgaggu

SEQ ID NO: 53996 - RNA, 22 nt, Homo sapiens
uggacugagauuucagcugcca

SEQ ID NO: 53997 - RNA, 22 nt, Homo sapiens
uggagggcuagucauuucuuuu

SEQ ID NO: 53998 - RNA, 22 nt, Homo sapiens
uggagguagagaugggaucucc

SEQ ID NO: 53999 - RNA, 22 nt, Homo sapiens
uuuaaugcugcccagucauggg

SEQ ID NO: 54000 - RNA, 18 nt, Homo sapiens
uuuacaguagaaggacuu

SEQ ID NO: 54001 - RNA, 22 nt, Homo sapiens
uuuauagucaggaacuugagga

SEQ ID NO: 54002 - RNA, 22 nt, Homo sapiens
uuucaagugcugucuuagcugu

SEQ ID NO: 54003 - RNA, 22 nt, Homo sapiens
uuucauagccuuugucgucuga

SEQ ID NO: 54004 - RNA, 22 nt, Homo sapiens
uuugaaaguaauuugguuggug

SEQ ID NO: 54005 - RNA, 22 nt, Homo sapiens
uuugaauguaaugagcaggaag

SEQ ID NO: 54006 - RNA, 22 nt, Homo sapiens
uuugagaaugcuaccagagaag

SEQ ID NO: 54007 - RNA, 22 nt, Homo sapiens
uuuggcaauaaacuccccuaac

SEQ ID NO: 54008 - RNA, 20 nt, Homo sapiens
uuuggcaauaggguuuuugu

SEQ ID NO: 54009 - RNA, 22 nt, Homo sapiens
uuuggcaauuugacuguauagg

SEQ ID NO: 54010 - RNA, 22 nt, Homo sapiens
uuugggaaugguuugucuccca

SEQ ID NO: 54011 - RNA, 22 nt, Homo sapiens
uuuguacacuguuggugguuau

SEQ ID NO: 54012 - RNA, 22 nt, Homo sapiens
uuugucuccuaagacucugugg

SEQ ID NO: 54013 - RNA, 22 nt, Homo sapiens
uuugugcuauguuauauauucu

SEQ ID NO: 54014 - RNA, 22 nt, Homo sapiens
uuuuaacagccaggggacggcc

SEQ ID NO: 54015 - RNA, 22 nt, Homo sapiens
uuuuauguuuguucccugccaa

SEQ ID NO: 54016 - RNA, 22 nt, Homo sapiens
uuuugcauuggcugaggagugu

SEQ ID NO: 54017 - RNA, 19 nt, Homo sapiens
uuuugcucuuuauaccuau

SEQ ID NO: 54018 - RNA, 22 nt, Homo sapiens
uuucugguuaauuucuaagagc

SEQ ID NO: 54019 - RNA, 22 nt, Homo sapiens
uuugaagacuacugggagugaa

SEQ ID NO: 54020 - RNA, 22 nt, Homo sapiens
uuugagcauuagggcaaaggca

SEQ ID NO: 54021 - RNA, 22 nt, Homo sapiens
uuugcacuuuuguaauaugguu

SEQ ID NO: 54022 - RNA, 22 nt, Homo sapiens
uuugcagagacuuguuaggaau

SEQ ID NO: 54023 - RNA, 22 nt, Homo sapiens
uuugcugagucauuccaugcug

SEQ ID NO: 54024 - RNA, 22 nt, Homo sapiens
uuuggcaaagaucaacauguua

SEQ ID NO: 54025 - RNA, 22 nt, Homo sapiens
uuuguuugaagucgagacaacu

SEQ ID NO: 54026 - RNA, 20 nt, Homo sapiens
uuuuggacuaaaggcauccc

SEQ ID NO: 54027 - RNA, 22 nt, Homo sapiens
uuuuggcuuaaagagaauguau

SEQ ID NO: 54028 - RNA, 18 nt, Homo sapiens
uuuuugaggcacagggga

SEQ ID NO: 54029 - RNA, 21 nt, Homo sapiens
uuuuugggcuuucauaguguu

SEQ ID NO: 54030 - RNA, 22 nt, Homo sapiens
uuuuuuaguuagcugggcauga

SEQ ID NO: 54031 - RNA, 22 nt, Homo sapiens
uuuuuugcuguaugcaaacauc

SEQ ID NO: 54032 - RNA, 22 nt, Homo sapiens
cacaggaagaggcacggucccu

SEQ ID NO: 54033 - RNA, 22 nt, Homo sapiens
caccacauuccauugaucaggc

SEQ ID NO: 54034 - RNA, 23 nt, Homo sapiens
caccaguauaauuagcuuuuaaa

SEQ ID NO: 54035 - RNA, 22 nt, Homo sapiens
caccuagacuggagugcagugg

SEQ ID NO: 54036 - RNA, 22 nt, Homo sapiens
cacuggucucauggcaugagag

SEQ ID NO: 54037 - RNA, 22 nt, Homo sapiens
cagcuguuguuaugucugcagg

SEQ ID NO: 54038 - RNA, 22 nt, Homo sapiens
caguggaugauguuuucugugg

SEQ ID NO: 54039 - RNA, 22 nt, Homo sapiens
caguuacuugacacaaccaauu

SEQ ID NO: 54040 - RNA, 22 nt, Homo sapiens
cauacaagcuacaaucacaaag

SEQ ID NO: 54041 - RNA, 22 nt, Homo sapiens
cauacaguaggcacuauuugua

SEQ ID NO: 54042 - RNA, 22 nt, Homo sapiens
cauagguugggcguuugauuuu

SEQ ID NO: 54043 - RNA, 22 nt, Homo sapiens
caucccugaaccccagaaaucu

SEQ ID NO: 54044 - RNA, 19 nt, Homo sapiens
caucccugagcugaagugg

SEQ ID NO: 54045 - RNA, 23 nt, Homo sapiens
caugaacuaguuugcagccauga

SEQ ID NO: 54046 - RNA, 22 nt, Homo sapiens
cauggucaccuuccaaguuauu

SEQ ID NO: 54047 - RNA, 22 nt, Homo sapiens
caugugcaugagcacauacgug

SEQ ID NO: 54048 - RNA, 22 nt, Homo sapiens
cauugcaacuucugccucccag

SEQ ID NO: 54049 - RNA, 22 nt, Homo sapiens
cauugcaauccagccugggcaa

SEQ ID NO: 54050 - RNA, 22 nt, Homo sapiens
cauugcagauccuucaaaugac

SEQ ID NO: 54051 - RNA, 22 nt, Homo sapiens
cauugcuuuuggugguuuagac

SEQ ID NO: 54052 - RNA, 22 nt, Homo sapiens
cauugguuaguuaacuuuaaga

SEQ ID NO: 54053 - RNA, 22 nt, Homo sapiens
cauugguugaacagauuguguu

SEQ ID NO: 54054 - RNA, 22 nt, Homo sapiens
cauuuuacuuuccagacgugga

SEQ ID NO: 54055 - RNA, 19 nt, Homo sapiens
ccacaaugguugaacuaga

SEQ ID NO: 54056 - RNA, 22 nt, Homo sapiens
ccacauuggaaaggaucccccc

SEQ ID NO: 54057 - RNA, 22 nt, Homo sapiens
ccagugcauggaucccaggggg

SEQ ID NO: 54058 - RNA, 22 nt, Homo sapiens
ccauggcuauucuguaaggguu

SEQ ID NO: 54059 - RNA, 22 nt, Homo sapiens
cccacaguggccucauauccuu

SEQ ID NO: 54060 - RNA, 22 nt, Homo sapiens
ccccaguguguaaaggccuugc

SEQ ID NO: 54061 - RNA, 22 nt, Homo sapiens
ccccauguucucucugcagcuc

SEQ ID NO: 54062 - RNA, 22 nt, Homo sapiens
ccuggaaugaagcuuauauugc

SEQ ID NO: 54063 - RNA, 22 nt, Homo sapiens
cggucacagugauucaaggguc

SEQ ID NO: 54064 - RNA, 22 nt, Homo sapiens
cuaaagauagugacaugauuug

SEQ ID NO: 54065 - RNA, 22 nt, Homo sapiens
cuacaguagagaggauguagaa

SEQ ID NO: 54066 - RNA, 19 nt, Homo sapiens
aucaccagucuuuccacug

SEQ ID NO: 54067 - RNA, 18 nt, Homo sapiens
aucagggugaagagagga

SEQ ID NO: 54068 - RNA, 22 nt, Homo sapiens
aucauguuuauguguaggauau

SEQ ID NO: 54069 - RNA, 22 nt, Homo sapiens
auccauguggauaaauguguau

SEQ ID NO: 54070 - RNA, 20 nt, Homo sapiens
aucccauuccugaagauacu

SEQ ID NO: 54071 - RNA, 22 nt, Homo sapiens
aucccuguguccagcaccugug

SEQ ID NO: 54072 - RNA, 22 nt, Homo sapiens
auccugaagcuuuacugaauuc

SEQ ID NO: 54073 - RNA, 22 nt, Homo sapiens
auccuuuagacuguccaguuga

SEQ ID NO: 54074 - RNA, 22 nt, Homo sapiens
aucuccaggugccagcugcgcc

SEQ ID NO: 54075 - RNA, 22 nt, Homo sapiens
aucuuguguugaauggugcaga

SEQ ID NO: 54076 - RNA, 22 nt, Homo sapiens
augaaaacaugauuugccuguu

SEQ ID NO: 54077 - RNA, 22 nt, Homo sapiens
augaaagguugucuuaagccau

SEQ ID NO: 54078 - RNA, 22 nt, Homo sapiens
augaaaucuuuggcagaucuua

SEQ ID NO: 54079 - RNA, 22 nt, Homo sapiens
augaauacugcugcaaugaaca

SEQ ID NO: 54080 - RNA, 22 nt, Homo sapiens
augagaacugucaaugagagcu

SEQ ID NO: 54081 - RNA, 22 nt, Homo sapiens
augagcuauggagacagggcca

SEQ ID NO: 54082 - RNA, 22 nt, Homo sapiens
augaggaagucaggcccagggg

SEQ ID NO: 54083 - RNA, 22 nt, Homo sapiens
augaggugaggucaguaaggua

SEQ ID NO: 54084 - RNA, 22 nt, Homo sapiens
augagucacuuauuauuggggu

SEQ ID NO: 54085 - RNA, 22 nt, Homo sapiens
augcaaacagcuaucuggcugg

SEQ ID NO: 54086 - RNA, 22 nt, Homo sapiens
augcaacugcacuccagccugg

SEQ ID NO: 54087 - RNA, 22 nt, Homo sapiens
augcagugugcaacagauuaag

SEQ ID NO: 54088 - RNA, 22 nt, Homo sapiens
auggaagaaaguuggguucuug

SEQ ID NO: 54089 - RNA, 22 nt, Homo sapiens
auggcaguuucagcuauaguuu

SEQ ID NO: 54090 - RNA, 22 nt, Homo sapiens
auggcuuuguguucagagcuga

SEQ ID NO: 54091 - RNA, 22 nt, Homo sapiens
augguauuuugugauaccuugu

SEQ ID NO: 54092 - RNA, 22 nt, Homo sapiens
augguuuuacugcaaaauggga

SEQ ID NO: 54093 - RNA, 22 nt, Homo sapiens
augucaaggugggugauaguuu

SEQ ID NO: 54094 - RNA, 22 nt, Homo sapiens
auguccauggaaucuguagcaa

SEQ ID NO: 54095 - RNA, 22 nt, Homo sapiens
augugcauaugaagcacagaca

SEQ ID NO: 54096 - RNA, 22 nt, Homo sapiens
auuaagugcuugccagugcugg

SEQ ID NO: 54097 - RNA, 22 nt, Homo sapiens
auucaagugaugcagcuguuuu

SEQ ID NO: 54098 - RNA, 18 nt, Homo sapiens
auucuacaggccuuuuga

SEQ ID NO: 54099 - RNA, 22 nt, Homo sapiens
auucuauaguccuaggauuggg

SEQ ID NO: 54100 - RNA, 23 nt, Homo sapiens
auugaacacuuucauaugugagg

SEQ ID NO: 54101 - RNA, 22 nt, Homo sapiens
auugagucauuucaaauccaag

SEQ ID NO: 54102 - RNA, 22 nt, Homo sapiens
auugcaaugggaaacuaugaaa

SEQ ID NO: 54103 - RNA, 22 nt, Homo sapiens
auugcacaaagagggaaacuga

SEQ ID NO: 54104 - RNA, 18 nt, Homo sapiens
auugcacaccagccuggg

SEQ ID NO: 54105 - RNA, 22 nt, Homo sapiens
auugcacuccagccuggcaaua

SEQ ID NO: 54106 - RNA, 23 nt, Homo sapiens
auugcagaaucacagagguagug

SEQ ID NO: 54107 - RNA, 22 nt, Homo sapiens
auugcaguuagaacagaagucu

SEQ ID NO: 54108 - RNA, 22 nt, Homo sapiens
auugcccaggcuggagugcagu

SEQ ID NO: 54109 - RNA, 22 nt, Homo sapiens
auugcuuacccuguauuagauc

SEQ ID NO: 54110 - RNA, 22 nt, Homo sapiens
auugcuucugauuuuaaaugag

SEQ ID NO: 54111 - RNA, 22 nt, Homo sapiens
auuggcuuuauacauaagaaua

SEQ ID NO: 54112 - RNA, 22 nt, Homo sapiens
auuguacauacaccggugugua

SEQ ID NO: 54113 - RNA, 22 nt, Homo sapiens
auuguacuccagccuaggcaac

SEQ ID NO: 54114 - RNA, 22 nt, Homo sapiens
auugucacugugcuccaccagu

SEQ ID NO: 54115 - RNA, 22 nt, Homo sapiens
auugucauuuucugagaaguaa

SEQ ID NO: 54116 - RNA, 22 nt, Homo sapiens
auuguucuuacaugcugucauc

SEQ ID NO: 54117 - RNA, 22 nt, Homo sapiens
auuuaugguuaauauaggaagu

SEQ ID NO: 54118 - RNA, 22 nt, Homo sapiens
caacagucagcccauccacaga

SEQ ID NO: 54119 - RNA, 22 nt, Homo sapiens
cacacugucuucaauggguggu

SEQ ID NO: 54120 - RNA, 22 nt, Homo sapiens
cacauugaauuucugaugacaa

SEQ ID NO: 54121 - RNA, 22 nt, Homo sapiens
caccaggugcccagcacggcca

SEQ ID NO: 54122 - RNA, 22 nt, Homo sapiens
cacuagagaauagguaguucug

SEQ ID NO: 54123 - RNA, 22 nt, Homo sapiens
cagagguaagcaagucagcauu

SEQ ID NO: 54124 - RNA, 22 nt, Homo sapiens
cagauguaguauuuuagugaaa

SEQ ID NO: 54125 - RNA, 20 nt, Homo sapiens
cagggcaaugaggagguaaa

SEQ ID NO: 54126 - RNA, 21 nt, Homo sapiens
cagguagugucugaagccaga

SEQ ID NO: 54127 - RNA, 22 nt, Homo sapiens
caguaguagccccuuagaugga

SEQ ID NO: 54128 - RNA, 22 nt, Homo sapiens
cagugcaaagccucugcccaga

SEQ ID NO: 54129 - RNA, 22 nt, Homo sapiens
cagugcaaccuccaucucucgg

SEQ ID NO: 54130 - RNA, 22 nt, Homo sapiens
cagugcuuguuauuguucuauu

SEQ ID NO: 54131 - RNA, 22 nt, Homo sapiens
cauacaugugcuugucuuaugc

SEQ ID NO: 54132 - RNA, 19 nt, Homo sapiens
caucacagagucuuccauu

SEQ ID NO: 54133 - RNA, 22 nt, Homo sapiens
cauugcuaaaagucauauauaa

SEQ ID NO: 54134 - RNA, 22 nt, Homo sapiens
cauuguacauaaguauggagua

SEQ ID NO: 54135 - RNA, 22 nt, Homo sapiens
ccaaaguauuuucacugauauc

SEQ ID NO: 54136 - RNA, 22 nt, Homo sapiens
ccaaggaauacccucccuuuuu

SEQ ID NO: 54137 - RNA, 22 nt, Homo sapiens
ccaucacaggccucagugggaa

SEQ ID NO: 54138 - RNA, 22 nt, Homo sapiens
ccauugaacaugaaggaaugug

SEQ ID NO: 54139 - RNA, 22 nt, Homo sapiens
ccccauuguugugguuuuaucu

SEQ ID NO: 54140 - RNA, 23 nt, Homo sapiens
ccgugagagaguucauagaaagc

SEQ ID NO: 54141 - RNA, 22 nt, Homo sapiens
ccuucuuuuguaaggcugaaua

SEQ ID NO: 54142 - RNA, 22 nt, Homo sapiens
cgcccuguagcuagcuagaggu

SEQ ID NO: 54143 - RNA, 22 nt, Homo sapiens
cuaaaugcacugucaaaggaag

SEQ ID NO: 54144 - RNA, 18 nt, Homo sapiens
cuaagacacuuggcagag

SEQ ID NO: 54145 - RNA, 20 nt, Homo sapiens
cuaaucaucccagaagaaau

SEQ ID NO: 54146 - RNA, 22 nt, Homo sapiens
cuacaguaugaaaccuuuacuc

SEQ ID NO: 54147 - RNA, 22 nt, Homo sapiens
cuacaguguauuuauggagggu

SEQ ID NO: 54148 - RNA, 22 nt, Homo sapiens
cuacaguuauguuuuaaaugug

SEQ ID NO: 54149 - RNA, 22 nt, Homo sapiens
aaagugaauguaucccguaagu

SEQ ID NO: 54150 - RNA, 22 nt, Homo sapiens
aaagugcaguacuucguauauu

SEQ ID NO: 54151 - RNA, 22 nt, Homo sapiens
ugaaagcuacaggaaaguauuu

SEQ ID NO: 54152 - RNA, 22 nt, Homo sapiens
ugaagugaaugguaaguaugcc

SEQ ID NO: 54153 - RNA, 22 nt, Homo sapiens
ugacaguuuccagggcugucuc

SEQ ID NO: 54154 - RNA, 22 nt, Homo sapiens
ugacuaaggaaggauuaugugc

SEQ ID NO: 54155 - RNA, 22 nt, Homo sapiens
ugagaugagggaagccuaggca

SEQ ID NO: 54156 - RNA, 18 nt, Homo sapiens
ugaggaaaggguuugcua

SEQ ID NO: 54157 - RNA, 22 nt, Homo sapiens
ugaggucauguucugucagguu

SEQ ID NO: 54158 - RNA, 22 nt, Homo sapiens
ugcaagaaucuuucaggcuagc

SEQ ID NO: 54159 - RNA, 22 nt, Homo sapiens
ugcaugcaucuuuuauaguagc

SEQ ID NO: 54160 - RNA, 22 nt, Homo sapiens
ugcauuguggaucuaaaugcau

SEQ ID NO: 54161 - RNA, 21 nt, Homo sapiens
uggaauuaauggagagguguu

SEQ ID NO: 54162 - RNA, 22 nt, Homo sapiens
ugugacagguauccuguguucu

SEQ ID NO: 54163 - RNA, 22 nt, Homo sapiens
ugugacaguuaguuugguguua

SEQ ID NO: 54164 - RNA, 22 nt, Homo sapiens
uuaagacaccaaucauuggauu

SEQ ID NO: 54165 - RNA, 22 nt, Homo sapiens
uuaagcaguggauuagaauuuu

SEQ ID NO: 54166 - RNA, 20 nt, Homo sapiens
uuagcagcaugauuuauaau

SEQ ID NO: 54167 - RNA, 22 nt, Homo sapiens
uuaggcaggauaguuacauauu

SEQ ID NO: 54168 - RNA, 16 nt, Homo sapiens
uuaggcagugugauac

SEQ ID NO: 54169 - RNA, 22 nt, Homo sapiens
uuaggcaguuuauugauuuuca

SEQ ID NO: 54170 - RNA, 22 nt, Homo sapiens
uuaguaguagugcuguaauuuu

SEQ ID NO: 54171 - RNA, 22 nt, Homo sapiens
uuaguaguugugauagguaccu

SEQ ID NO: 54172 - RNA, 22 nt, Homo sapiens
uuaguaguuugauaggaauagc

SEQ ID NO: 54173 - RNA, 22 nt, Homo sapiens
uuaucucagugaacugagugga

SEQ ID NO: 54174 - RNA, 22 nt, Homo sapiens
uucagaguggacagaaauuaag

SEQ ID NO: 54175 - RNA, 22 nt, Homo sapiens
uucauagucuaauuuuuuccac

SEQ ID NO: 54176 - RNA, 22 nt, Homo sapiens
aaaugcauaucaagauugcccu

SEQ ID NO: 54177 - RNA, 22 nt, Homo sapiens
aaccuuuagucagcucuuagga

SEQ ID NO: 54178 - RNA, 18 nt, Homo sapiens
aagagcucagcacagguu

SEQ ID NO: 54179 - RNA, 22 nt, Homo sapiens
aagugcauguauuaguguaguc

SEQ ID NO: 54180 - RNA, 21 nt, Homo sapiens
aauaaagcaaccuuaugccau

SEQ ID NO: 54181 - RNA, 22 nt, Homo sapiens
aauaaagcauggcuacuccaua

SEQ ID NO: 54182 - RNA, 22 nt, Homo sapiens
aauaugguuuuaugaagcaauu

SEQ ID NO: 54183 - RNA, 22 nt, Homo sapiens
aaugcacauaaaauccuccagg

SEQ ID NO: 54184 - RNA, 22 nt, Homo sapiens
aaugcuguguuauuucaugacc

SEQ ID NO: 54185 - RNA, 22 nt, Homo sapiens
aauggcaucuagaguggugaau

SEQ ID NO: 54186 - RNA, 22 nt, Homo sapiens
acaguggugcgaucucggcuca

SEQ ID NO: 54187 - RNA, 22 nt, Homo sapiens
accaccacucccgcauucuaaa

SEQ ID NO: 54188 - RNA, 22 nt, Homo sapiens
agagaucaacugaauuacugga

SEQ ID NO: 54189 - RNA, 23 nt, Homo sapiens
agaugcauucuuguaggauauau

SEQ ID NO: 54190 - RNA, 22 nt, Homo sapiens
agcuuguagugauuugugguaa

SEQ ID NO: 54191 - RNA, 22 nt, Homo sapiens
agcuuguauuuguagccuguug

SEQ ID NO: 54192 - RNA, 22 nt, Homo sapiens
agguauauuggacagauguaaa

SEQ ID NO: 54193 - RNA, 22 nt, Homo sapiens
agguuaugauuauagagcgagg

SEQ ID NO: 54194 - RNA, 23 nt, Homo sapiens
agguuaugauuauagagcgagga

SEQ ID NO: 54195 - RNA, 22 nt, Homo sapiens
agguuaugauuguagagcgagg

SEQ ID NO: 54196 - RNA, 22 nt, Homo sapiens
aguaagucucaagguaggguag

SEQ ID NO: 54197 - RNA, 22 nt, Homo sapiens
aguccagguuuuguaauggcaa

SEQ ID NO: 54198 - RNA, 21 nt, Homo sapiens
agugagucauuuggaaagcaa

SEQ ID NO: 54199 - RNA, 22 nt, Homo sapiens
agugcaguugucacgugccuuc

SEQ ID NO: 54200 - RNA, 22 nt, Homo sapiens
auaaagccaggagacguaauug

SEQ ID NO: 54201 - RNA, 22 nt, Homo sapiens
auaagugcuuguugaauaauag

SEQ ID NO: 54202 - RNA, 22 nt, Homo sapiens
auaauaucagguugugaugaug

SEQ ID NO: 54203 - RNA, 22 nt, Homo sapiens
auagguuuucacuguagauucu

SEQ ID NO: 54204 - RNA, 22 nt, Homo sapiens
auaugcaaauccauagagacag

SEQ ID NO: 54205 - RNA, 20 nt, Homo sapiens
auaugcauguguuuucacuu

SEQ ID NO: 54206 - RNA, 22 nt, Homo sapiens
auaugguuuuuggaagcauauc

SEQ ID NO: 54207 - RNA, 22 nt, Homo sapiens
auauuugguuaccugugggucu

SEQ ID NO: 54208 - RNA, 22 nt, Homo sapiens
aucacagaacuuugagcagaga

SEQ ID NO: 54209 - RNA, 22 nt, Homo sapiens
aucauguaguaagacacauuua

SEQ ID NO: 54210 - RNA, 22 nt, Homo sapiens
auccagaugggcuuaauguaau

SEQ ID NO: 54211 - RNA, 22 nt, Homo sapiens
aucccugaggaauuucugcacu

SEQ ID NO: 54212 - RNA, 22 nt, Homo sapiens
auccuugagaaaauaaaugacc

SEQ ID NO: 54213 - RNA, 22 nt, Homo sapiens
aucugcauuagggugaagaccu

SEQ ID NO: 54214 - RNA, 22 nt, Homo sapiens
aucuguguuuaaggucccagaa

SEQ ID NO: 54215 - RNA, 22 nt, Homo sapiens
augacacugcagagauguccca

SEQ ID NO: 54216 - RNA, 20 nt, Homo sapiens
augacuagaggacaugguaa

SEQ ID NO: 54217 - RNA, 22 nt, Homo sapiens
augagaauguaaguuaaugaaa

SEQ ID NO: 54218 - RNA, 22 nt, Homo sapiens
augagauauuuuauaagaucau

SEQ ID NO: 54219 - RNA, 22 nt, Homo sapiens
augagcuguuuggaagacacuu

SEQ ID NO: 54220 - RNA, 22 nt, Homo sapiens
augagguguuuauuguauccug

SEQ ID NO: 54221 - RNA, 22 nt, Homo sapiens
augcauagugggaugcucugug

SEQ ID NO: 54222 - RNA, 22 nt, Homo sapiens
auggauaugcuuccaacugccu

SEQ ID NO: 54223 - RNA, 22 nt, Homo sapiens
augguuuauuuguaagcagagu

SEQ ID NO: 54224 - RNA, 21 nt, Homo sapiens
auuaaugcucugguuagaggc

SEQ ID NO: 54225 - RNA, 22 nt, Homo sapiens
auuauguuguauuuccuugcag

SEQ ID NO: 54226 - RNA, 22 nt, Homo sapiens
auucaaagugcauguucccacu

SEQ ID NO: 54227 - RNA, 22 nt, Homo sapiens
auuucuacuccuguguccagaa

SEQ ID NO: 54228 - RNA, 22 nt, Homo sapiens
auuugggaaugugcauuauacu

SEQ ID NO: 54229 - RNA, 22 nt, Homo sapiens
caauugcacucuuagguguaca

SEQ ID NO: 54230 - RNA, 22 nt, Homo sapiens
cacagugaacugguggguuuuu

SEQ ID NO: 54231 - RNA, 22 nt, Homo sapiens
cacaguguuacugguaugaagu

SEQ ID NO: 54232 - RNA, 22 nt, Homo sapiens
cacugcauuacucaugagcaug

SEQ ID NO: 54233 - RNA, 22 nt, Homo sapiens
cacugggugagauccauguuua

SEQ ID NO: 54234 - RNA, 22 nt, Homo sapiens
cacugggugccauauguuugcu

SEQ ID NO: 54235 - RNA, 22 nt, Homo sapiens
cagaugguggucccacagccca

SEQ ID NO: 54236 - RNA, 22 nt, Homo sapiens
cagggcauuggcugguaccugg

SEQ ID NO: 54237 - RNA, 21 nt, Homo sapiens
cauaaugcuacuuauuuuaug

SEQ ID NO: 54238 - RNA, 22 nt, Homo sapiens
cauugcauuuucuuuguaccuu

SEQ ID NO: 54239 - RNA, 22 nt, Homo sapiens
cauugguuaguuaacuuuaaga

SEQ ID NO: 54240 - RNA, 22 nt, Homo sapiens
cauugguuccaguuuguccuua

SEQ ID NO: 54241 - RNA, 22 nt, Homo sapiens
cauugguuggacaguucucucu

SEQ ID NO: 54242 - RNA, 22 nt, Homo sapiens
cauugguuuuucaggaguauau

SEQ ID NO: 54243 - RNA, 23 nt, Homo sapiens
ccacacuguuuagaauggcauca

SEQ ID NO: 54244 - RNA, 22 nt, Homo sapiens
cccacaguggccucauauccuu

SEQ ID NO: 54245 - RNA, 22 nt, Homo sapiens
cccagaguucuuaaauacugag

SEQ ID NO: 54246 - RNA, 22 nt, Homo sapiens
cccaguuuugccacuuacuagc

SEQ ID NO: 54247 - RNA, 20 nt, Homo sapiens
ccccaguuuuucuauuagcu

SEQ ID NO: 54248 - RNA, 22 nt, Homo sapiens
cccuucauucaaggguugugag

SEQ ID NO: 54249 - RNA, 22 nt, Homo sapiens
cucacaguucuaaaggcaagaa

SEQ ID NO: 54250 - RNA, 22 nt, Homo sapiens
cuucaaaguuggcuaggagaca

SEQ ID NO: 54251 - RNA, 22 nt, Homo sapiens
uuauuagguugguggaaaagua

SEQ ID NO: 54252 - RNA, 22 nt, Homo sapiens
uucagaugcacacuguagucua

SEQ ID NO: 54253 - RNA, 22 nt, Homo sapiens
uucaugucuuggcuguuagagu

SEQ ID NO: 54254 - RNA, 22 nt, Homo sapiens
uucauuggacuuguguucuuga

SEQ ID NO: 54255 - RNA, 22 nt, Homo sapiens
uucuuccagccuugaggggccc

SEQ ID NO: 54256 - RNA, 22 nt, Homo sapiens
uugaaggaacgcuguucccuug

SEQ ID NO: 54257 - RNA, 22 nt, Homo sapiens
uugaaggaggugcucacucucg

SEQ ID NO: 54258 - RNA, 22 nt, Homo sapiens
uugagguagcuuugauggaggu

SEQ ID NO: 54259 - RNA, 22 nt, Homo sapiens
uugaggugaagggcagagcagc

SEQ ID NO: 54260 - RNA, 22 nt, Homo sapiens
uugaggugggaggaucacuuga

SEQ ID NO: 54261 - RNA, 21 nt, Homo sapiens
uauagcagcacgauuuauagu

SEQ ID NO: 54262 - RNA, 22 nt, Homo sapiens
uauaugcacucagguguaugug

SEQ ID NO: 54263 - RNA, 22 nt, Homo sapiens
uauauguuuucauaaggcuaga

SEQ ID NO: 54264 - RNA, 22 nt, Homo sapiens
uaucucagagaaucagauuuac

SEQ ID NO: 54265 - RNA, 22 nt, Homo sapiens
uaucucagaugagacuuguaac

SEQ ID NO: 54266 - RNA, 22 nt, Homo sapiens
uauugcuuuacucucuuauccu

SEQ ID NO: 54267 - RNA, 22 nt, Homo sapiens
uauugcuuuuaacccaaucucu

SEQ ID NO: 54268 - RNA, 17 nt, Homo sapiens
ucaaaugcucccaguga

SEQ ID NO: 54269 - RNA, 22 nt, Homo sapiens
ucaaggacuacauggggugaaa

SEQ ID NO: 54270 - RNA, 22 nt, Homo sapiens
ucacagugcaggaucaguuaau

SEQ ID NO: 54271 - RNA, 23 nt, Homo sapiens
ucacaguggcugcuuaauuguga

SEQ ID NO: 54272 - RNA, 21 nt, Homo sapiens
ucacugagcaucaugguuuca

SEQ ID NO: 54273 - RNA, 20 nt, Homo sapiens
ucacugagugguccacagua

SEQ ID NO: 54274 - RNA, 22 nt, Homo sapiens
agucagucuguccugugcugag

SEQ ID NO: 54275 - RNA, 22 nt, Homo sapiens
auacaugugugagcgaagaugu

SEQ ID NO: 54276 - RNA, 22 nt, Homo sapiens
auacauguuucauguuggugug

SEQ ID NO: 54277 - RNA, 22 nt, Homo sapiens
auagcaaugccccacuccuugg

SEQ ID NO: 54278 - RNA, 20 nt, Homo sapiens
aucaaagacuuagaggggga

SEQ ID NO: 54279 - RNA, 22 nt, Homo sapiens
aucacauggccagguaguaauc

SEQ ID NO: 54280 - RNA, 22 nt, Homo sapiens
aucacauuuauaguggcacgca

SEQ ID NO: 54281 - RNA, 22 nt, Homo sapiens
aucagauggcuaaaacagaaga

SEQ ID NO: 54282 - RNA, 22 nt, Homo sapiens
aucuugggugggaacugagaau

SEQ ID NO: 54283 - RNA, 22 nt, Homo sapiens
augaaaugcauguuaaguccgu

SEQ ID NO: 54284 - RNA, 22 nt, Homo sapiens
augaagugcaugauaguugguu

SEQ ID NO: 54285 - RNA, 22 nt, Homo sapiens
augacagcaucugugaaguugu

SEQ ID NO: 54286 - RNA, 22 nt, Homo sapiens
auggcaccauguuaugauaaua

SEQ ID NO: 54287 - RNA, 22 nt, Homo sapiens
auguuuagagagggugucaaau

SEQ ID NO: 54288 - RNA, 22 nt, Homo sapiens
auuauauguguaugugcauacc

SEQ ID NO: 54289 - RNA, 21 nt, Homo sapiens
auuugguggcugugugacacu

SEQ ID NO: 54290 - RNA, 22 nt, Homo sapiens
caaaguaauuacgguuuuggcc

SEQ ID NO: 54291 - RNA, 22 nt, Homo sapiens
caaaguaauugcuguuuugcca

SEQ ID NO: 54292 - RNA, 22 nt, Homo sapiens
cacuguggauggaacuauguga

SEQ ID NO: 54293 - RNA, 22 nt, Homo sapiens
cagguacaugcaugugugugca

SEQ ID NO: 54294 - RNA, 22 nt, Homo sapiens
cauugguugaacagauuguguu

SEQ ID NO: 54295 - RNA, 22 nt, Homo sapiens
cauuugcacugagacucagcuu

SEQ ID NO: 54296 - RNA, 22 nt, Homo sapiens
ccaccuguacuuaagucacuuu

SEQ ID NO: 54297 - RNA, 22 nt, Homo sapiens
ccccaguguguaaaggccuugc

SEQ ID NO: 54298 - RNA, 22 nt, Homo sapiens
cuacaguguauuuauggagggu

SEQ ID NO: 54299 - RNA, 22 nt, Homo sapiens
cucacuaggaaguaaaguuugu

SEQ ID NO: 54300 - RNA, 22 nt, Homo sapiens
uucauaguucuuuuagucauua

SEQ ID NO: 54301 - RNA, 22 nt, Homo sapiens
uucaucagggagaaauaauuuc

SEQ ID NO: 54302 - RNA, 22 nt, Homo sapiens
uucauguaauauuucacagcuu

SEQ ID NO: 54303 - RNA, 22 nt, Homo sapiens
uuccguguaguugagcaguuuu

SEQ ID NO: 54304 - RNA, 22 nt, Homo sapiens
uuccuugagaaaggcacaaguu

SEQ ID NO: 54305 - RNA, 22 nt, Homo sapiens
uucucacaguacagggagcucu

SEQ ID NO: 54306 - RNA, 22 nt, Homo sapiens
uugcaggcaugagccaccgugc

SEQ ID NO: 54307 - RNA, 22 nt, Homo sapiens
uuguauugucuugaugaguuga

SEQ ID NO: 54308 - RNA, 22 nt, Homo sapiens
uuucauagaucaugcuuuugga

SEQ ID NO: 54309 - RNA, 22 nt, Homo sapiens
uuucauagccuuugucgucuga

SEQ ID NO: 54310 - RNA, 22 nt, Homo sapiens
uuucuacagugaacgauuucua

SEQ ID NO: 54311 - RNA, 22 nt, Homo sapiens
uuugauugguguaccugaaagu

SEQ ID NO: 54312 - RNA, 20 nt, Homo sapiens
uuugcagaaucuaagaagag

SEQ ID NO: 54313 - RNA, 22 nt, Homo sapiens
guaauacuggacaggguaucag

SEQ ID NO: 54314 - RNA, 22 nt, Homo sapiens
guaaucucagcuacucgggaga

SEQ ID NO: 54315 - RNA, 22 nt, Homo sapiens
guaaucucagcuacuugggagc

SEQ ID NO: 54316 - RNA, 22 nt, Homo sapiens
gucuuccagccuccaucuuucu

SEQ ID NO: 54317 - RNA, 17 nt, Homo sapiens
gucuuugguugaguuua

SEQ ID NO: 54318 - RNA, 22 nt, Homo sapiens
gugaaauguguagaggaucugg

SEQ ID NO: 54319 - RNA, 22 nt, Homo sapiens
gugacgucauuguuccuggcuc

SEQ ID NO: 54320 - RNA, 22 nt, Homo sapiens
gugagcuccucuucugcugcag

SEQ ID NO: 54321 - RNA, 22 nt, Homo sapiens
gugaggucguagucauaggcaa

SEQ ID NO: 54322 - RNA, 22 nt, Homo sapiens
gugaucucauuuggaauuagag

SEQ ID NO: 54323 - RNA, 22 nt, Homo sapiens
gugauugcauuaugaauauuau

SEQ ID NO: 54324 - RNA, 22 nt, Homo sapiens
gugcaaguguaauacagcuagg

SEQ ID NO: 54325 - RNA, 22 nt, Homo sapiens
gugcauguccacuaguccauau

SEQ ID NO: 54326 - RNA, 22 nt, Homo sapiens
gugcaugucuaugcgagucuaa

SEQ ID NO: 54327 - RNA, 22 nt, Homo sapiens
uaacaccuugcucugucaauaa

SEQ ID NO: 54328 - RNA, 22 nt, Homo sapiens
uaagccuaggucugugcucuuc

SEQ ID NO: 54329 - RNA, 22 nt, Homo sapiens
uaaggcuuugcuggacucaguc

SEQ ID NO: 54330 - RNA, 22 nt, Homo sapiens
uaaugcauguaaugggcugaua

SEQ ID NO: 54331 - RNA, 22 nt, Homo sapiens
uacagaauucugucccuugagu

SEQ ID NO: 54332 - RNA, 20 nt, Homo sapiens
uagaugcauuuagauucauu

SEQ ID NO: 54333 - RNA, 22 nt, Homo sapiens
uagcagaauaacuugccagccu

SEQ ID NO: 54334 - RNA, 22 nt, Homo sapiens
uagcagaauauaccucuuacuu

SEQ ID NO: 54335 - RNA, 22 nt, Homo sapiens
uauaugauugguagacccugca

SEQ ID NO: 54336 - RNA, 21 nt, Homo sapiens
uaucacauuggugauuaaguu

SEQ ID NO: 54337 - RNA, 22 nt, Homo sapiens
uaugucaugggguuuuugagau

SEQ ID NO: 54338 - RNA, 22 nt, Homo sapiens
uauuauuguccuucuauaccca

SEQ ID NO: 54339 - RNA, 22 nt, Homo sapiens
uauugauuaauugugauuaggc

SEQ ID NO: 54340 - RNA, 22 nt, Homo sapiens
uauugcuugaggaaaugguaau

SEQ ID NO: 54341 - RNA, 18 nt, Homo sapiens
uauugcuugguuuggaga

SEQ ID NO: 54342 - RNA, 22 nt, Homo sapiens
uauuugauuaacaagagccuaa

SEQ ID NO: 54343 - RNA, 22 nt, Homo sapiens
uauuugauugacuuuagcagga

SEQ ID NO: 54344 - RNA, 20 nt, Homo sapiens
ucaaaguaugcucugcacua

SEQ ID NO: 54345 - RNA, 18 nt, Homo sapiens
ucaaauacuuugggcagu

SEQ ID NO: 54346 - RNA, 22 nt, Homo sapiens
ucacuaggcuggagugcagugg

SEQ ID NO: 54347 - RNA, 20 nt, Homo sapiens
ucacugaguaucuacgauua

SEQ ID NO: 54348 - RNA, 22 nt, Homo sapiens
ucacugugcacauaugauaggu

SEQ ID NO: 54349 - RNA, 21 nt, Homo sapiens
ucauaagcucaacaucuguag

SEQ ID NO: 54350 - RNA, 18 nt, Homo sapiens
ucauagaucaugacagug

SEQ ID NO: 54351 - RNA, 22 nt, Homo sapiens
ucauguaauuuugugucuauga

SEQ ID NO: 54352 - RNA, 22 nt, Homo sapiens
ucauucauuugcucacuccaca

SEQ ID NO: 54353 - RNA, 22 nt, Homo sapiens
ucauugguagcucauggaaccg

SEQ ID NO: 54354 - RNA, 22 nt, Homo sapiens
ucauugguagcuugaaggggau

SEQ ID NO: 54355 - RNA, 22 nt, Homo sapiens
uccacaguggugaggugcagca

SEQ ID NO: 54356 - RNA, 22 nt, Homo sapiens
uccuugaaacaggaagaauuca

SEQ ID NO: 54357 - RNA, 22 nt, Homo sapiens
ucucaguggcuuccucacuuuu

SEQ ID NO: 54358 - RNA, 22 nt, Homo sapiens
ucugaguggcagaaugagcuga

SEQ ID NO: 54359 - RNA, 22 nt, Homo sapiens
ucugguguuacugagccuccca

SEQ ID NO: 54360 - RNA, 22 nt, Homo sapiens
ucugucuuugccuaaguuuguc

SEQ ID NO: 54361 - RNA, 22 nt, Homo sapiens
ucuugggugaguuugugaauaa

SEQ ID NO: 54362 - RNA, 22 nt, Homo sapiens
ucuuugaguuauugugcagacu

SEQ ID NO: 54363 - RNA, 22 nt, Homo sapiens
ugaaaugaucaguuugguuacu

SEQ ID NO: 54364 - RNA, 22 nt, Homo sapiens
ugaacagcuaucuugucagugu

SEQ ID NO: 54365 - RNA, 22 nt, Homo sapiens
ugaaugcauggggccaagaagg

SEQ ID NO: 54366 - RNA, 22 nt, Homo sapiens
ugacaggucuaauuuacugaca

SEQ ID NO: 54367 - RNA, 22 nt, Homo sapiens
ugacggaggcauuggaagcuug

SEQ ID NO: 54368 - RNA, 22 nt, Homo sapiens
ugacuaggggcccuggcuucuu

SEQ ID NO: 54369 - RNA, 22 nt, Homo sapiens
ugagagacagacauuaucuuau

SEQ ID NO: 54370 - RNA, 22 nt, Homo sapiens
ugagagacaguuucgucggagg

SEQ ID NO: 54371 - RNA, 22 nt, Homo sapiens
ugagagacaguuuguuaaaauu

SEQ ID NO: 54372 - RNA, 19 nt, Homo sapiens
ugagaucuuuacuggguuu

SEQ ID NO: 54373 - RNA, 19 nt, Homo sapiens
ugagaugaagacagggguu

SEQ ID NO: 54374 - RNA, 22 nt, Homo sapiens
ugagaugaucaaaguauaggcu

SEQ ID NO: 54375 - RNA, 22 nt, Homo sapiens
ugcaagaaucagccuaucauua

SEQ ID NO: 54376 - RNA, 22 nt, Homo sapiens
ugcugguauuauguuauccaga

SEQ ID NO: 54377 - RNA, 22 nt, Homo sapiens
uggaaucuuaggugaaggcuuu

SEQ ID NO: 54378 - RNA, 22 nt, Homo sapiens
uggcuagaccugcauaacagcu

SEQ ID NO: 54379 - RNA, 22 nt, Homo sapiens
uggcuuuucauccugggacauu

SEQ ID NO: 54380 - RNA, 16 nt, Homo sapiens
uguauugcuaaaaaga

SEQ ID NO: 54381 - RNA, 22 nt, Homo sapiens
uguauugcuugaagagugaauu

SEQ ID NO: 54382 - RNA, 22 nt, Homo sapiens
ugucauagaugauuuuuuucgg

SEQ ID NO: 54383 - RNA, 22 nt, Homo sapiens
uguccauuuuuaugcuuauggu

SEQ ID NO: 54384 - RNA, 22 nt, Homo sapiens
uguccuggugaugcccaaauuc

SEQ ID NO: 54385 - RNA, 22 nt, Homo sapiens
ugugucacugaggguuagugua

SEQ ID NO: 54386 - RNA, 22 nt, Homo sapiens
ugugucacugcacuccagcgug

SEQ ID NO: 54387 - RNA, 19 nt, Homo sapiens
uguuuggcuauaggucuaa

SEQ ID NO: 54388 - RNA, 22 nt, Homo sapiens
uuaaagcuggcguuacaguuug

SEQ ID NO: 54389 - RNA, 22 nt, Homo sapiens
uuaauuguccaaguucaucucu

SEQ ID NO: 54390 - RNA, 22 nt, Homo sapiens
uuacccuuuaacccuuuaaagu

SEQ ID NO: 54391 - RNA, 21 nt, Homo sapiens
uuagcauccauguucaucaac

SEQ ID NO: 54392 - RNA, 22 nt, Homo sapiens
uuaguaguaguuugcauuuacc

SEQ ID NO: 54393 - RNA, 22 nt, Homo sapiens
uuauuagguuaaccuauagcua

SEQ ID NO: 54394 - RNA, 22 nt, Homo sapiens
ucacuggagguuccugaaguuc

SEQ ID NO: 54395 - RNA, 22 nt, Homo sapiens
ucagagcaaagacacuuuauca

SEQ ID NO: 54396 - RNA, 22 nt, Homo sapiens
ucagaugaucugguaagaacuu

SEQ ID NO: 54397 - RNA, 20 nt, Homo sapiens
ucauagcuuuuuccacuuua

SEQ ID NO: 54398 - RNA, 22 nt, Homo sapiens
ucauagucuaagguucuuuugc

SEQ ID NO: 54399 - RNA, 22 nt, Homo sapiens
ucauugguucuggguguuguug

SEQ ID NO: 54400 - RNA, 22 nt, Homo sapiens
uccauuuguucagcuucaggaa

SEQ ID NO: 54401 - RNA, 22 nt, Homo sapiens
uccauuuguuguaggguauagu

SEQ ID NO: 54402 - RNA, 22 nt, Homo sapiens
ucccacugucuucucgugcucg

SEQ ID NO: 54403 - RNA, 22 nt, Homo sapiens
ucucagugacugcugggucccc

SEQ ID NO: 54404 - RNA, 20 nt, Homo sapiens
ucucauagagguagagaaua

SEQ ID NO: 54405 - RNA, 22 nt, Homo sapiens
ucucaugaagguggagaguagg

SEQ ID NO: 54406 - RNA, 22 nt, Homo sapiens
ucucugauuaaacaagauagug

SEQ ID NO: 54407 - RNA, 22 nt, Homo sapiens
ucucuguuuauuuuugguguau

SEQ ID NO: 54408 - RNA, 22 nt, Homo sapiens
ucuucaugcuugaaauaauagc

SEQ ID NO: 54409 - RNA, 22 nt, Homo sapiens
ugaaaugauuauaugguguuug

SEQ ID NO: 54410 - RNA, 22 nt, Homo sapiens
ugaauauguuaaauaauguucu

SEQ ID NO: 54411 - RNA, 22 nt, Homo sapiens
ugacaagcucccucugcaccuu

SEQ ID NO: 54412 - RNA, 22 nt, Homo sapiens
ugacagguuggaauuaugggag

SEQ ID NO: 54413 - RNA, 18 nt, Homo sapiens
ugacaguuucuuuauauu

SEQ ID NO: 54414 - RNA, 22 nt, Homo sapiens
ugagagacauuuguuguagagu

SEQ ID NO: 54415 - RNA, 22 nt, Homo sapiens
ugagauguuccaaugacuauua

SEQ ID NO: 54416 - RNA, 22 nt, Homo sapiens
ugagcuaagugccaauauuaau

SEQ ID NO: 54417 - RNA, 20 nt, Homo sapiens
ugaggucaggaguuacagac

SEQ ID NO: 54418 - RNA, 22 nt, Homo sapiens
ugcaagauaggcaguuugcacu

SEQ ID NO: 54419 - RNA, 22 nt, Homo sapiens
ugcagaaucccuucagauccga

SEQ ID NO: 54420 - RNA, 22 nt, Homo sapiens
ugcauacacaagcauacaugua

SEQ ID NO: 54421 - RNA, 22 nt, Homo sapiens
ugcauguucuuacucauacaug

SEQ ID NO: 54422 - RNA, 21 nt, Homo sapiens
ugcauugucuugaguuuaaau

SEQ ID NO: 54423 - RNA, 22 nt, Homo sapiens
ugggaucagcugggcucucugu

SEQ ID NO: 54424 - RNA, 22 nt, Homo sapiens
uguaagcauugggcaugcaguc

SEQ ID NO: 54425 - RNA, 21 nt, Homo sapiens
uguagcagcauaauuuauaau

SEQ ID NO: 54426 - RNA, 22 nt, Homo sapiens
ugucaaagagacaucugcacuc

SEQ ID NO: 54427 - RNA, 22 nt, Homo sapiens
ugucagaaucugagacgacaac

SEQ ID NO: 54428 - RNA, 22 nt, Homo sapiens
ugucuacugaugauguaguuaa

SEQ ID NO: 54429 - RNA, 22 nt, Homo sapiens
ugucucagugauuggcuuucug

SEQ ID NO: 54430 - RNA, 22 nt, Homo sapiens
ugugacagcacgguucaacugc

SEQ ID NO: 54431 - RNA, 22 nt, Homo sapiens
ugugacaguguuacauuucaug

SEQ ID NO: 54432 - RNA, 22 nt, Homo sapiens
ugugagcuauggaguuguagag

SEQ ID NO: 54433 - RNA, 22 nt, Homo sapiens
ugugcuaauacauacagugcua

SEQ ID NO: 54434 - RNA, 22 nt, Homo sapiens
uguggcuuuuucuuggcugagg

SEQ ID NO: 54435 - RNA, 22 nt, Homo sapiens
uuaagaagugauuuuccucauu

SEQ ID NO: 54436 - RNA, 21 nt, Homo sapiens
uuaggcagugucagaggugag

SEQ ID NO: 54437 - RNA, 22 nt, Homo sapiens
uuaguaguagcugcaugucagu

SEQ ID NO: 54438 - RNA, 22 nt, Homo sapiens
uucaaaggauagauuaagauca

SEQ ID NO: 54439 - RNA, 22 nt, Homo sapiens
uucaaguaguucucaugccuca

SEQ ID NO: 54440 - RNA, 22 nt, Homo sapiens
uucagagcauugguuuuuugaa

SEQ ID NO: 54441 - RNA, 22 nt, Homo sapiens
uucagagugguaugaagugaug

SEQ ID NO: 54442 - RNA, 22 nt, Homo sapiens
uucauguaauauauuucaggcc

SEQ ID NO: 54443 - RNA, 22 nt, Homo sapiens
uucauguaaucaaggcagcuaa

SEQ ID NO: 54444 - RNA, 22 nt, Homo sapiens
uucauuggauguuacacugugu

SEQ ID NO: 54445 - RNA, 22 nt, Homo sapiens
uucuucaggccacaaaaauggu

SEQ ID NO: 54446 - RNA, 22 nt, Homo sapiens
uugaaagcuaucagagauucca

SEQ ID NO: 54447 - RNA, 20 nt, Homo sapiens
uugaggugugaggggcagag

SEQ ID NO: 54448 - RNA, 22 nt, Homo sapiens
uugauauucuuucuggauccca

SEQ ID NO: 54449 - RNA, 22 nt, Homo sapiens
uugcaacuuagaaaaaucauuu

SEQ ID NO: 54450 - RNA, 22 nt, Homo sapiens
uugcaugcuccuuaugagaauc

SEQ ID NO: 54451 - RNA, 22 nt, Homo sapiens
uuggacagaugguuacauuuuu

SEQ ID NO: 54452 - RNA, 22 nt, Homo sapiens
uuggacuucuaacugacaugga

SEQ ID NO: 54453 - RNA, 22 nt, Homo sapiens
uuguauccaucuuucaggcaac

SEQ ID NO: 54454 - RNA, 22 nt, Homo sapiens
uuuaaugcacuaggugguguuc

SEQ ID NO: 54455 - RNA, 22 nt, Homo sapiens
uuuaaugcaucccaaaauguag

SEQ ID NO: 54456 - RNA, 22 nt, Homo sapiens
uuucauaguuugcauagggcau

SEQ ID NO: 54457 - RNA, 22 nt, Homo sapiens
aaagcacuggagucaucaucua

SEQ ID NO: 54458 - RNA, 22 nt, Homo sapiens
aaaugcacagaaaggaugugga

SEQ ID NO: 54459 - RNA, 22 nt, Homo sapiens
aacaccuugcagggauuaugac

SEQ ID NO: 54460 - RNA, 22 nt, Homo sapiens
aacuggccuggcgugcagaggg

SEQ ID NO: 54461 - RNA, 22 nt, Homo sapiens
aagagcauuauuuaguaauuuc

SEQ ID NO: 54462 - RNA, 22 nt, Homo sapiens
aaggugcuguaagcauccaugu

SEQ ID NO: 54463 - RNA, 22 nt, Homo sapiens
aagugaguaauacgucaguugu

SEQ ID NO: 54464 - RNA, 22 nt, Homo sapiens
accacagugcuuccugcucacg

SEQ ID NO: 54465 - RNA, 23 nt, Homo sapiens
accuucauucauucagcugaagu

SEQ ID NO: 54466 - RNA, 22 nt, Homo sapiens
agagauaaagauuuuaauuuug

SEQ ID NO: 54467 - RNA, 22 nt, Homo sapiens
agccuauccaauaucagugaga

SEQ ID NO: 54468 - RNA, 22 nt, Homo sapiens
aggaaauguuggucccauuucu

SEQ ID NO: 54469 - RNA, 22 nt, Homo sapiens
aggcaguuucagugagagguga

SEQ ID NO: 54470 - RNA, 22 nt, Homo sapiens
aggcuuauuaagauucccuuau

SEQ ID NO: 54471 - RNA, 22 nt, Homo sapiens
agugcaguggugccaucauaac

SEQ ID NO: 54472 - RNA, 22 nt, Homo sapiens
auaaagccaugagcuugagaug

SEQ ID NO: 54473 - RNA, 22 nt, Homo sapiens
auaauagcugaucauuuagaag

SEQ ID NO: 54474 - RNA, 22 nt, Homo sapiens
auagcaaugccccaauccuugg

SEQ ID NO: 54475 - RNA, 22 nt, Homo sapiens
aucagaaucucuugagaguguu

SEQ ID NO: 54476 - RNA, 22 nt, Homo sapiens
aucauagcucacugcagccucg

SEQ ID NO: 54477 - RNA, 22 nt, Homo sapiens
aucuuuggugaguucuuugguc

SEQ ID NO: 54478 - RNA, 22 nt, Homo sapiens
augacagugagugagcucucac

SEQ ID NO: 54479 - RNA, 22 nt, Homo sapiens
augacuagaggagggauggcca

SEQ ID NO: 54480 - RNA, 22 nt, Homo sapiens
augagcuauggagacagggcca

SEQ ID NO: 54481 - RNA, 22 nt, Homo sapiens
augaggugcagaggaaaugagu

SEQ ID NO: 54482 - RNA, 22 nt, Homo sapiens
augcaaaucuuaaguaugugug

SEQ ID NO: 54483 - RNA, 19 nt, Homo sapiens
augcacgugaaaugcauuu

SEQ ID NO: 54484 - RNA, 22 nt, Homo sapiens
augcauaugucuuuauaguggc

SEQ ID NO: 54485 - RNA, 22 nt, Homo sapiens
auguaagugugcucaaauguua

SEQ ID NO: 54486 - RNA, 22 nt, Homo sapiens
auguuugguaagaauauuguua

SEQ ID NO: 54487 - RNA, 22 nt, Homo sapiens
auuaaggaguggguucauggug

SEQ ID NO: 54488 - RNA, 18 nt, Homo sapiens
auucuacaggccuuuuga

SEQ ID NO: 54489 - RNA, 22 nt, Homo sapiens
auuggacagcauuucuagacuu

SEQ ID NO: 54490 - RNA, 22 nt, Homo sapiens
cacagugaacaauauccucugu

SEQ ID NO: 54491 - RNA, 22 nt, Homo sapiens
cacagugaaugucaucauugcc

SEQ ID NO: 54492 - RNA, 22 nt, Homo sapiens
caugcagcacacaugucugugc

SEQ ID NO: 54493 - RNA, 22 nt, Homo sapiens
ccacugggcuagguguuuugga

SEQ ID NO: 54494 - RNA, 22 nt, Homo sapiens
cccaguuuugcuucucaugagg

SEQ ID NO: 54495 - RNA, 21 nt, Homo sapiens
ccugaagaagugaccucugag

SEQ ID NO: 54496 - RNA, 22 nt, Homo sapiens
cuauuugguuggugaaaaaagu

SEQ ID NO: 54497 - RNA, 22 nt, Homo sapiens
cucagcaguggauuuaccacca

SEQ ID NO: 54498 - RNA, 22 nt, Homo sapiens
cugaaucauugcauuaucaagg

SEQ ID NO: 54499 - RNA, 22 nt, Homo sapiens
cuugcagagcccauggauguca

SEQ ID NO: 54500 - RNA, 22 nt, Homo sapiens
gaaggugcuuggugaaugcauu

SEQ ID NO: 54501 - RNA, 22 nt, Homo sapiens
gaaguaggugcuguuauuaucu

SEQ ID NO: 54502 - RNA, 22 nt, Homo sapiens
gagaaugagaggggaaggccac

SEQ ID NO: 54503 - RNA, 22 nt, Homo sapiens
gagccuguaggaggagaggugg

SEQ ID NO: 54504 - RNA, 22 nt, Homo sapiens
gaugcaguaagaaugcauagcg

SEQ ID NO: 54505 - RNA, 22 nt, Homo sapiens
gcacaguguuacuugauauauu

SEQ ID NO: 54506 - RNA, 20 nt, Homo sapiens
gccacaguuaagcuucugcc

SEQ ID NO: 54507 - RNA, 22 nt, Homo sapiens
gcugucuggagucuguucaaug

SEQ ID NO: 54508 - RNA, 19 nt, Homo sapiens
gcuuguccacgugagauaa

SEQ ID NO: 54509 - RNA, 22 nt, Homo sapiens
ggaaaucucugaggcucccuuc

SEQ ID NO: 54510 - RNA, 22 nt, Homo sapiens
ggaaauguuggugucaugaguu

SEQ ID NO: 54511 - RNA, 22 nt, Homo sapiens
ggagaugauuaugaaucacuua

SEQ ID NO: 54512 - RNA, 22 nt, Homo sapiens
ggagugucagaaacaguguccu

SEQ ID NO: 54513 - RNA, 22 nt, Homo sapiens
ggcaugcauuguacuaguaugc

SEQ ID NO: 54514 - RNA, 22 nt, Homo sapiens
ggcauugugaacauuucccugc

SEQ ID NO: 54515 - RNA, 22 nt, Homo sapiens
gguggucuuccccuggaguucg

SEQ ID NO: 54516 - RNA, 22 nt, Homo sapiens
guaaaucucuguuuucauggac

SEQ ID NO: 54517 - RNA, 22 nt, Homo sapiens
guaagugguagagcugggcuau

SEQ ID NO: 54518 - RNA, 23 nt, Homo sapiens
guaauacuagucauaguagcagg

SEQ ID NO: 54519 - RNA, 22 nt, Homo sapiens
guaaucucagcuacucgggagg

SEQ ID NO: 54520 - RNA, 22 nt, Homo sapiens
guaaucucagcuacuugggagu

SEQ ID NO: 54521 - RNA, 22 nt, Homo sapiens
guaaucucagcuucuugggagg

SEQ ID NO: 54522 - RNA, 22 nt, Homo sapiens
guagcagaauaucagauaauuu

SEQ ID NO: 54523 - RNA, 22 nt, Homo sapiens
guauacacccugugauauuauu

SEQ ID NO: 54524 - RNA, 22 nt, Homo sapiens
guaucucaguucucgugauuag

SEQ ID NO: 54525 - RNA, 22 nt, Homo sapiens
guauugcuugagcccaggaguu

SEQ ID NO: 54526 - RNA, 22 nt, Homo sapiens
guauuuggugaugccuccaaac

SEQ ID NO: 54527 - RNA, 18 nt, Homo sapiens
gucauagaaugaugguuc

SEQ ID NO: 54528 - RNA, 22 nt, Homo sapiens
gugaaagcaucugacugugcca

SEQ ID NO: 54529 - RNA, 22 nt, Homo sapiens
gugacaguggagacuuacuuca

SEQ ID NO: 54530 - RNA, 21 nt, Homo sapiens
gugcagaugccacagucacuc

SEQ ID NO: 54531 - RNA, 22 nt, Homo sapiens
gugcaugucugugacgacccug

SEQ ID NO: 54532 - RNA, 22 nt, Homo sapiens
gugcuuguauuuaaaucaugug

SEQ ID NO: 54533 - RNA, 22 nt, Homo sapiens
gugucacuguugagaaguccac

SEQ ID NO: 54534 - RNA, 22 nt, Homo sapiens
gugucaugagggggacaggaag

SEQ ID NO: 54535 - RNA, 22 nt, Homo sapiens
guuaugcagcaauugauaaucu

SEQ ID NO: 54536 - RNA, 22 nt, Homo sapiens
guuugcagaucaugaagaaccc

SEQ ID NO: 54537 - RNA, 22 nt, Homo sapiens
uaagagcuaggauuuuaaauca

SEQ ID NO: 54538 - RNA, 22 nt, Homo sapiens
uaaggaguagaauaguaaggca

SEQ ID NO: 54539 - RNA, 22 nt, Homo sapiens
uaaguaguguugagacaaguuu

SEQ ID NO: 54540 - RNA, 22 nt, Homo sapiens
uaaugcaucagugguaguucuu

SEQ ID NO: 54541 - RNA, 22 nt, Homo sapiens
uagauuauuggcugauuugauc

SEQ ID NO: 54542 - RNA, 19 nt, Homo sapiens
uagcagcaugauuuauaau

SEQ ID NO: 54543 - RNA, 22 nt, Homo sapiens
uaguaccauucccaaaccaacu

SEQ ID NO: 54544 - RNA, 21 nt, Homo sapiens
uauagcagcacgauuuauaau

SEQ ID NO: 54545 - RNA, 22 nt, Homo sapiens
aaaagucuguagugaaagguga

SEQ ID NO: 54546 - RNA, 22 nt, Homo sapiens
aaaugcaccacucuggugcagg

SEQ ID NO: 54547 - RNA, 22 nt, Homo sapiens
aaaugcaucauuaggugauuuu

SEQ ID NO: 54548 - RNA, 22 nt, Homo sapiens
aaaugcaugaggugggaagaaa

SEQ ID NO: 54549 - RNA, 22 nt, Homo sapiens
aaaugcauggacagcuggucuu

SEQ ID NO: 54550 - RNA, 22 nt, Homo sapiens
aaaugcauugagggaaaaggca

SEQ ID NO: 54551 - RNA, 22 nt, Homo sapiens
aagagguaauaacaaagcuucu

SEQ ID NO: 54552 - RNA, 22 nt, Homo sapiens
aagcucauugagaucuauggcu

SEQ ID NO: 54553 - RNA, 17 nt, Homo sapiens
aaggugcuucgaccucc

SEQ ID NO: 54554 - RNA, 22 nt, Homo sapiens
aagugagugacaaaaacugggc

SEQ ID NO: 54555 - RNA, 22 nt, Homo sapiens
aauaaagcaggguccuugcacu

SEQ ID NO: 54556 - RNA, 22 nt, Homo sapiens
aaugacuaagaugguacauuuu

SEQ ID NO: 54557 - RNA, 22 nt, Homo sapiens
aaugccaucagagaaaacucuu

SEQ ID NO: 54558 - RNA, 20 nt, Homo sapiens
acaaaugcauucugugacau

SEQ ID NO: 54559 - RNA, 22 nt, Homo sapiens
acagauagcacuaagggaucug

SEQ ID NO: 54560 - RNA, 22 nt, Homo sapiens
acaucccaugccuggguacucc

SEQ ID NO: 54561 - RNA, 18 nt, Homo sapiens
accuucauuccuuugccu

SEQ ID NO: 54562 - RNA, 22 nt, Homo sapiens
agaagugcuggguucaggcugg

SEQ ID NO: 54563 - RNA, 20 nt, Homo sapiens
agagaucaguaauucaucaa

SEQ ID NO: 54564 - RNA, 22 nt, Homo sapiens
agauucauccaaguuguugcau

SEQ ID NO: 54565 - RNA, 22 nt, Homo sapiens
cugaagugugaaagucuuuuuu

SEQ ID NO: 54566 - RNA, 22 nt, Homo sapiens
cugacuaguuuuaaugcagauu

SEQ ID NO: 54567 - RNA, 21 nt, Homo sapiens
cuuuaugcuguguuagaaaag

SEQ ID NO: 54568 - RNA, 22 nt, Homo sapiens
cuuugcaaaacauugagaccuc

SEQ ID NO: 54569 - RNA, 22 nt, Homo sapiens
gaaaguaauuaacgauuguugc

SEQ ID NO: 54570 - RNA, 22 nt, Homo sapiens
gaagaaguacaagacaaauuuu

SEQ ID NO: 54571 - RNA, 22 nt, Homo sapiens
gaaugcaugaggggaucagaug

SEQ ID NO: 54572 - RNA, 22 nt, Homo sapiens
gacuagggaaaauuauuuuguu

SEQ ID NO: 54573 - RNA, 22 nt, Homo sapiens
gaggcaauaugagggaggcuuc

SEQ ID NO: 54574 - RNA, 22 nt, Homo sapiens
gaucccauuggcugccaugugg

SEQ ID NO: 54575 - RNA, 22 nt, Homo sapiens
gauggcacuuaagagcaagagc

SEQ ID NO: 54576 - RNA, 22 nt, Homo sapiens
gcagugaugugaucauagcuca

SEQ ID NO: 54577 - RNA, 20 nt, Homo sapiens
ggaagagugacacaagguau

SEQ ID NO: 54578 - RNA, 22 nt, Homo sapiens
ggcacgguggcucacaccugua

SEQ ID NO: 54579 - RNA, 22 nt, Homo sapiens
ggcauuguccaauuucugcccu

SEQ ID NO: 54580 - RNA, 22 nt, Homo sapiens
guaaggaguaguguaacagugc

SEQ ID NO: 54581 - RNA, 22 nt, Homo sapiens
guaaucucagcuacuugggagg

SEQ ID NO: 54582 - RNA, 22 nt, Homo sapiens
guauuugauuauagcaugcuua

SEQ ID NO: 54583 - RNA, 22 nt, Homo sapiens
gucagaugcagauuccaguucu

SEQ ID NO: 54584 - RNA, 22 nt, Homo sapiens
gucauugguucuguuuauguga

SEQ ID NO: 54585 - RNA, 22 nt, Homo sapiens
gucccugugucuuuauguggcc

SEQ ID NO: 54586 - RNA, 22 nt, Homo sapiens
gucucugguugcuuuuguacca

SEQ ID NO: 54587 - RNA, 22 nt, Homo sapiens
gucuuuggaaaaaaugucuguu

SEQ ID NO: 54588 - RNA, 21 nt, Homo sapiens
gugaggucauugggcuuucug

SEQ ID NO: 54589 - RNA, 18 nt, Homo sapiens
gugcaaugaauagcagag

SEQ ID NO: 54590 - RNA, 19 nt, Homo sapiens
gugcauaguuauuaaagag

SEQ ID NO: 54591 - RNA, 22 nt, Homo sapiens
guguaaguccugaguuuggaua

SEQ ID NO: 54592 - RNA, 22 nt, Homo sapiens
guuaaugcuggaauaaguuaag

SEQ ID NO: 54593 - RNA, 22 nt, Homo sapiens
guugcagaguucuuccuccuga

SEQ ID NO: 54594 - RNA, 22 nt, Homo sapiens
guuuuuggggucacuauuaccg

SEQ ID NO: 54595 - RNA, 22 nt, Homo sapiens
uaaagccuagaacuuucagccc

SEQ ID NO: 54596 - RNA, 22 nt, Homo sapiens
uaaguauuaugugcugcauuuu

SEQ ID NO: 54597 - RNA, 22 nt, Homo sapiens
uaaugcauacagaagguguuuu

SEQ ID NO: 54598 - RNA, 22 nt, Homo sapiens
uaaugcaucaugguuggcaaac

SEQ ID NO: 54599 - RNA, 19 nt, Homo sapiens
uacugcacuccagucuggg

SEQ ID NO: 54600 - RNA, 22 nt, Homo sapiens
uaugcuguuucugauuuaggga

SEQ ID NO: 54601 - RNA, 22 nt, Homo sapiens
uauggucuuugagaggugacug

SEQ ID NO: 54602 - RNA, 22 nt, Homo sapiens
uaugguuuuggaauccugcaga

SEQ ID NO: 54603 - RNA, 22 nt, Homo sapiens
uauugcuuaugaugcugaauua

SEQ ID NO: 54604 - RNA, 22 nt, Homo sapiens
uauugcuuuugauucaaggcag

SEQ ID NO: 54605 - RNA, 22 nt, Homo sapiens
uauugguugcuaauuggcgcca

SEQ ID NO: 54606 - RNA, 22 nt, Homo sapiens
ucaaaguagaaaaggggcaauu

SEQ ID NO: 54607 - RNA, 22 nt, Homo sapiens
ucaaaguauucuucugagaacc

SEQ ID NO: 54608 - RNA, 20 nt, Homo sapiens
ucaaauucuuggccuccagc

SEQ ID NO: 54609 - RNA, 21 nt, Homo sapiens
ucaaggaguauacguaugcca

SEQ ID NO: 54610 - RNA, 22 nt, Homo sapiens
ucacagugaguggaguggggug

SEQ ID NO: 54611 - RNA, 22 nt, Homo sapiens
ucacccacacaggagacaggga

SEQ ID NO: 54612 - RNA, 22 nt, Homo sapiens
ucacugaggucugagcuuuaug

SEQ ID NO: 54613 - RNA, 20 nt, Homo sapiens
ucacuggguucuugaagucu

SEQ ID NO: 54614 - RNA, 22 nt, Homo sapiens
ucauagaucaaguaauaagaca

SEQ ID NO: 54615 - RNA, 22 nt, Homo sapiens
ucaugggagcccccaucaugag

SEQ ID NO: 54616 - RNA, 18 nt, Homo sapiens
ucauuggugagcaccucc

SEQ ID NO: 54617 - RNA, 22 nt, Homo sapiens
ucauugguugcguaauuugauu

SEQ ID NO: 54618 - RNA, 19 nt, Homo sapiens
uccacagugguugaacuag

SEQ ID NO: 54619 - RNA, 22 nt, Homo sapiens
uccacagugguugaacuaguuu

SEQ ID NO: 54620 - RNA, 22 nt, Homo sapiens
uccauuuguagguagugagaca

SEQ ID NO: 54621 - RNA, 18 nt, Homo sapiens
uccauuuguaugggaugg

SEQ ID NO: 54622 - RNA, 22 nt, Homo sapiens
uccuucaugcaucaauguaucc

SEQ ID NO: 54623 - RNA, 22 nt, Homo sapiens
uccuucauuugucaacucuagu

SEQ ID NO: 54624 - RNA, 18 nt, Homo sapiens
ucucacagcaaucuguca

SEQ ID NO: 54625 - RNA, 22 nt, Homo sapiens
ucucagcacaaacaaaauugcu

SEQ ID NO: 54626 - RNA, 22 nt, Homo sapiens
ucucaugaagauagagaauaga

SEQ ID NO: 54627 - RNA, 21 nt, Homo sapiens
ucucauugugguuuuaauugg

SEQ ID NO: 54628 - RNA, 22 nt, Homo sapiens
ucucugagaaaaguuucuccca

SEQ ID NO: 54629 - RNA, 22 nt, Homo sapiens
ucugagguaggugcauggauac

SEQ ID NO: 54630 - RNA, 22 nt, Homo sapiens
ucuugucacugcauccccagcu

SEQ ID NO: 54631 - RNA, 22 nt, Homo sapiens
ucuuugguuagguuuaguugau

SEQ ID NO: 54632 - RNA, 22 nt, Homo sapiens
uaucucaguguacaggaugaua

SEQ ID NO: 54633 - RNA, 22 nt, Homo sapiens
uaugguuuuaagguuaaggacu

SEQ ID NO: 54634 - RNA, 20 nt, Homo sapiens
uaugguuuuagguauagcau

SEQ ID NO: 54635 - RNA, 22 nt, Homo sapiens
uauugguuacuguugaucgcca

SEQ ID NO: 54636 - RNA, 22 nt, Homo sapiens
ucacagauaaauaaagaugauu

SEQ ID NO: 54637 - RNA, 22 nt, Homo sapiens
ucacaguguuaaaccuuucuuu

SEQ ID NO: 54638 - RNA, 17 nt, Homo sapiens
ucacaguguuaggauga

SEQ ID NO: 54639 - RNA, 22 nt, Homo sapiens
ucacugagcacaggagaugugc

SEQ ID NO: 54640 - RNA, 22 nt, Homo sapiens
ucacugggagaccaaagccauc

SEQ ID NO: 54641 - RNA, 22 nt, Homo sapiens
ucacugugguuggaaggcuuaa

SEQ ID NO: 54642 - RNA, 22 nt, Homo sapiens
ucagcaucacaggcagugagug

SEQ ID NO: 54643 - RNA, 23 nt, Homo sapiens
ucaugaggccauucaaauccauu

SEQ ID NO: 54644 - RNA, 21 nt, Homo sapiens
ucauugguuggcugcccugua

SEQ ID NO: 54645 - RNA, 22 nt, Homo sapiens
uccacaguaaggacccugccuu

SEQ ID NO: 54646 - RNA, 22 nt, Homo sapiens
uccacagugguggaauuguuca

SEQ ID NO: 54647 - RNA, 22 nt, Homo sapiens
uccacagugguugaacuaguaa

SEQ ID NO: 54648 - RNA, 22 nt, Homo sapiens
uccagguacucagggggcugag

SEQ ID NO: 54649 - RNA, 22 nt, Homo sapiens
uccauuugucuauguuucuguu

SEQ ID NO: 54650 - RNA, 22 nt, Homo sapiens
ucccugagcaaaguuuucugua

SEQ ID NO: 54651 - RNA, 22 nt, Homo sapiens
ucccugagguccuggauuauug

SEQ ID NO: 54652 - RNA, 22 nt, Homo sapiens
uccuguaaucccagcuaccaga

SEQ ID NO: 54653 - RNA, 22 nt, Homo sapiens
ucucagcacagucagggcgccu

SEQ ID NO: 54654 - RNA, 21 nt, Homo sapiens
ucucauagaguuucacuuucu

SEQ ID NO: 54655 - RNA, 22 nt, Homo sapiens
ucugaaucguucccaugcagga

SEQ ID NO: 54656 - RNA, 22 nt, Homo sapiens
ucugugcuugucauaugcuuug

SEQ ID NO: 54657 - RNA, 22 nt, Homo sapiens
ucuucguuuaaagcaguggaag

SEQ ID NO: 54658 - RNA, 22 nt, Homo sapiens
ucuugcaguucccaaauucaca

SEQ ID NO: 54659 - RNA, 22 nt, Homo sapiens
ugaaacacacauugcccuuuau

SEQ ID NO: 54660 - RNA, 22 nt, Homo sapiens
ugaaagcuacagucuccuagga

SEQ ID NO: 54661 - RNA, 22 nt, Homo sapiens
ugaagugaagcaguaguguggg

SEQ ID NO: 54662 - RNA, 22 nt, Homo sapiens
ugaaugcuucaugucugggcug

SEQ ID NO: 54663 - RNA, 20 nt, Homo sapiens
ugacaguuaagggauagaag

SEQ ID NO: 54664 - RNA, 20 nt, Homo sapiens
ugacaucagcaauguaauaa

SEQ ID NO: 54665 - RNA, 22 nt, Homo sapiens
ugagacacugaauccggccuga

SEQ ID NO: 54666 - RNA, 22 nt, Homo sapiens
ugagaugagaaucaguucuaau

SEQ ID NO: 54667 - RNA, 22 nt, Homo sapiens
ugaggagugagaaauugguuuc

SEQ ID NO: 54668 - RNA, 19 nt, Homo sapiens
ugcaaagucuuuuccuauu

SEQ ID NO: 54669 - RNA, 22 nt, Homo sapiens
ugcauagaauguucuguaaaua

SEQ ID NO: 54670 - RNA, 22 nt, Homo sapiens
ugcuaugucuucucucacagag

SEQ ID NO: 54671 - RNA, 22 nt, Homo sapiens
uggauagaacuaagugcuuaga

SEQ ID NO: 54672 - RNA, 20 nt, Homo sapiens
uggcuaaaugaaugauagca

SEQ ID NO: 54673 - RNA, 21 nt, Homo sapiens
uguagcagcaugauuuauaau

SEQ ID NO: 54674 - RNA, 22 nt, Homo sapiens
uguaugucugcucuuuggaacu

SEQ ID NO: 54675 - RNA, 22 nt, Homo sapiens
ugugacagcacagcaucucuuu

SEQ ID NO: 54676 - RNA, 22 nt, Homo sapiens
uguguaaauagcuacggaucug

SEQ ID NO: 54677 - RNA, 22 nt, Homo sapiens
uuaaagccauaccugagagagu

SEQ ID NO: 54678 - RNA, 22 nt, Homo sapiens
uuaaggaaggagucuuaaaugg

SEQ ID NO: 54679 - RNA, 22 nt, Homo sapiens
uuaagguaugugggcauuuugu

SEQ ID NO: 54680 - RNA, 22 nt, Homo sapiens
uuaauagugacucauuuuccac

SEQ ID NO: 54681 - RNA, 22 nt, Homo sapiens
uuaauguaauugauugauugac

SEQ ID NO: 54682 - RNA, 22 nt, Homo sapiens
uuaguaguuugaguggggguua

SEQ ID NO: 54683 - RNA, 22 nt, Homo sapiens
uuauuagguuagugcaaaaguu

SEQ ID NO: 54684 - RNA, 22 nt, Homo sapiens
uuauuugguuauuguaauuggg

SEQ ID NO: 54685 - RNA, 22 nt, Homo sapiens
uuauuugguugcugacuuggaa

SEQ ID NO: 54686 - RNA, 22 nt, Homo sapiens
uucacagccgcaccccaucacu

SEQ ID NO: 54687 - RNA, 22 nt, Homo sapiens
uucauacaguggcugcacucca

SEQ ID NO: 54688 - RNA, 21 nt, Homo sapiens
uucaucagccagaaaucaagc

SEQ ID NO: 54689 - RNA, 22 nt, Homo sapiens
uucauguaauuccauaagguaa

SEQ ID NO: 54690 - RNA, 22 nt, Homo sapiens
uuccacagggauuugcauugau

SEQ ID NO: 54691 - RNA, 22 nt, Homo sapiens
uuccuugagagcuugauaucac

SEQ ID NO: 54692 - RNA, 21 nt, Homo sapiens
uucuucaggcagaaggauuau

SEQ ID NO: 54693 - RNA, 22 nt, Homo sapiens
uucuuuggaaacaguacuaauu

SEQ ID NO: 54694 - RNA, 22 nt, Homo sapiens
uugaaagcuaucucaaaucgcu

SEQ ID NO: 54695 - RNA, 22 nt, Homo sapiens
uugacuagaccaucuuucuaga

SEQ ID NO: 54696 - RNA, 22 nt, Homo sapiens
uugacugggccagacagagauc

SEQ ID NO: 54697 - RNA, 22 nt, Homo sapiens
uuggacuuuaagauagagaugu

SEQ ID NO: 54698 - RNA, 22 nt, Homo sapiens
uuggacuuuuauucugcaggca

SEQ ID NO: 54699 - RNA, 22 nt, Homo sapiens
uuuaaugcugcccagucauggg

SEQ ID NO: 54700 - RNA, 22 nt, Homo sapiens
uuuauagucaggaacuugagga

SEQ ID NO: 54701 - RNA, 17 nt, Homo sapiens
uuucagaguggaagugu

SEQ ID NO: 54702 - RNA, 22 nt, Homo sapiens
uuucauagccuucuaaugaguu

SEQ ID NO: 54703 - RNA, 22 nt, Homo sapiens
uuucuacagggcuugccaggua

SEQ ID NO: 54704 - RNA, 22 nt, Homo sapiens
uuugagugugauaucgauugga

SEQ ID NO: 54705 - RNA, 22 nt, Homo sapiens
uuugauuguacuaaaauuguac

SEQ ID NO: 54706 - RNA, 22 nt, Homo sapiens
uuugcagagacuuguuaggaau

SEQ ID NO: 54707 - RNA, 22 nt, Homo sapiens
cuucaccaguuuggcagucuca

SEQ ID NO: 54708 - RNA, 22 nt, Homo sapiens
cuugcagaggcccuggggagag

SEQ ID NO: 54709 - RNA, 22 nt, Homo sapiens
cuugcagagucauucuaauuuc

SEQ ID NO: 54710 - RNA, 18 nt, Homo sapiens
gaagaaguaggcauggca

SEQ ID NO: 54711 - RNA, 22 nt, Homo sapiens
gaagugcuuuuggacuaacagu

SEQ ID NO: 54712 - RNA, 22 nt, Homo sapiens
gacaguguggcgauuccucaag

SEQ ID NO: 54713 - RNA, 20 nt, Homo sapiens
gacauaggcugguaucuggc

SEQ ID NO: 54714 - RNA, 22 nt, Homo sapiens
gagaugucuauuucagagaugu

SEQ ID NO: 54715 - RNA, 22 nt, Homo sapiens
gcaugcauuuuccuaacuagaa

SEQ ID NO: 54716 - RNA, 22 nt, Homo sapiens
gcuggucugccguaguaggugc

SEQ ID NO: 54717 - RNA, 22 nt, Homo sapiens
gcuguauugacuuuguaucaua

SEQ ID NO: 54718 - RNA, 22 nt, Homo sapiens
ggagcugugauuugaguccaga

SEQ ID NO: 54719 - RNA, 22 nt, Homo sapiens
ggcagaauugcugaggaugcua

SEQ ID NO: 54720 - RNA, 22 nt, Homo sapiens
gggaaauguaaagucauaagau

SEQ ID NO: 54721 - RNA, 22 nt, Homo sapiens
guaaaguaaagcacaucaaggu

SEQ ID NO: 54722 - RNA, 22 nt, Homo sapiens
aaaugcaugaauaagcucgugu

SEQ ID NO: 54723 - RNA, 22 nt, Homo sapiens
aaguaaacauuuuguacaauaa

SEQ ID NO: 54724 - RNA, 22 nt, Homo sapiens
aaguaauggaguuauuuuauga

SEQ ID NO: 54725 - RNA, 20 nt, Homo sapiens
aagugaguguuaaacugaac

SEQ ID NO: 54726 - RNA, 22 nt, Homo sapiens
aagugcuuacagggaacaugau

SEQ ID NO: 54727 - RNA, 22 nt, Homo sapiens
aagugcuucagaagacaauauu

SEQ ID NO: 54728 - RNA, 22 nt, Homo sapiens
aagugcuuuacacaugcaugau

SEQ ID NO: 54729 - RNA, 22 nt, Homo sapiens
aauaaagcugaauccuuccuga

SEQ ID NO: 54730 - RNA, 22 nt, Homo sapiens
aauacugaaaguauuuucaaau

SEQ ID NO: 54731 - RNA, 22 nt, Homo sapiens
aaugacacugagcaucuuucau

SEQ ID NO: 54732 - RNA, 22 nt, Homo sapiens
aaugcaucuagaaaggugaauu

SEQ ID NO: 54733 - RNA, 22 nt, Homo sapiens
acacaguguuuauugugguuag

SEQ ID NO: 54734 - RNA, 22 nt, Homo sapiens
accuucauuguugccaugucca

SEQ ID NO: 54735 - RNA, 22 nt, Homo sapiens
agacuagaaaucauuuguugag

SEQ ID NO: 54736 - RNA, 23 nt, Homo sapiens
agcuagagaggcuggggauacag

SEQ ID NO: 54737 - RNA, 20 nt, Homo sapiens
agguucaaaucccaaucaug

SEQ ID NO: 54738 - RNA, 22 nt, Homo sapiens
agguuuucagccccagccuagg

SEQ ID NO: 54739 - RNA, 17 nt, Homo sapiens
agugagaucauggcuua

SEQ ID NO: 54740 - RNA, 20 nt, Homo sapiens
auaaauguauagguguacau

SEQ ID NO: 54741 - RNA, 22 nt, Homo sapiens
auagcaaugccccauucccagu

SEQ ID NO: 54742 - RNA, 22 nt, Homo sapiens
aucagauguuuguauaggagua

SEQ ID NO: 54743 - RNA, 22 nt, Homo sapiens
auccauguggauaaauguguau

SEQ ID NO: 54744 - RNA, 22 nt, Homo sapiens
aucucagagaaaauuacuaaga

SEQ ID NO: 54745 - RNA, 22 nt, Homo sapiens
aucucuugccagucagaauggu

SEQ ID NO: 54746 - RNA, 23 nt, Homo sapiens
augaaagcccuugcaaaugcugg

SEQ ID NO: 54747 - RNA, 22 nt, Homo sapiens
augaaaucuuuccugugaggau

SEQ ID NO: 54748 - RNA, 19 nt, Homo sapiens
augagucugcaagaaccag

SEQ ID NO: 54749 - RNA, 22 nt, Homo sapiens
augcacauggcuaacuuuuuuc

SEQ ID NO: 54750 - RNA, 22 nt, Homo sapiens
auggcagcugacacuuccgucu

SEQ ID NO: 54751 - RNA, 22 nt, Homo sapiens
auguaguaugaagaagaugcuu

SEQ ID NO: 54752 - RNA, 22 nt, Homo sapiens
augucauagaagccugugaacc

SEQ ID NO: 54753 - RNA, 22 nt, Homo sapiens
auucauagugcuaagguguauc

SEQ ID NO: 54754 - RNA, 22 nt, Homo sapiens
caaaguaauugugguuuugcca

SEQ ID NO: 54755 - RNA, 22 nt, Homo sapiens
caaugcauuauucucccacuuc

SEQ ID NO: 54756 - RNA, 22 nt, Homo sapiens
cagcccguaaucccagcacuuu

SEQ ID NO: 54757 - RNA, 23 nt, Homo sapiens
cagguaguucuuuauaguagugu

SEQ ID NO: 54758 - RNA, 22 nt, Homo sapiens
cauugcacuccacuccugaaca

SEQ ID NO: 54759 - RNA, 22 nt, Homo sapiens
cauugguuuauagauggggaaa

SEQ ID NO: 54760 - RNA, 22 nt, Homo sapiens
ccacaguggauuaaaguuacug

SEQ ID NO: 54761 - RNA, 22 nt, Homo sapiens
ccacugggcaguuuauuaucag

SEQ ID NO: 54762 - RNA, 22 nt, Homo sapiens
ccagaguggagccuuugcgagg

SEQ ID NO: 54763 - RNA, 18 nt, Homo sapiens
ccauucaacagauuuguc

SEQ ID NO: 54764 - RNA, 22 nt, Homo sapiens
cguauccuguuuagcucuccca

SEQ ID NO: 54765 - RNA, 21 nt, Homo sapiens
cuaaucucacccuuuucuggg

SEQ ID NO: 54766 - RNA, 22 nt, Homo sapiens
cuagaagcauauucagaacaga

SEQ ID NO: 54767 - RNA, 22 nt, Homo sapiens
cuguccugcagagucagaauga

SEQ ID NO: 54768 - RNA, 22 nt, Homo sapiens
cugucucagccucuccaguagc

SEQ ID NO: 54769 - RNA, 22 nt, Homo sapiens
cugucucagugaauugguuuua

SEQ ID NO: 54770 - RNA, 22 nt, Homo sapiens
cugugguuacguucuuugugcu

SEQ ID NO: 54771 - RNA, 18 nt, Homo sapiens
cuucauugcuguuuugcu

SEQ ID NO: 54772 - RNA, 22 nt, Homo sapiens
cuugagcauauucuauauuaaa

SEQ ID NO: 54773 - RNA, 22 nt, Homo sapiens
cuuucucagugagacccgagau

SEQ ID NO: 54774 - RNA, 22 nt, Homo sapiens
cuuugcuaauccaacccucauc

SEQ ID NO: 54775 - RNA, 22 nt, Homo sapiens
gacagugagaugucaugugaaa

SEQ ID NO: 54776 - RNA, 22 nt, Homo sapiens
gaggucauguggcaggcagcca

SEQ ID NO: 54777 - RNA, 22 nt, Homo sapiens
gaguucaaaucucagcucuguu

SEQ ID NO: 54778 - RNA, 22 nt, Homo sapiens
gauagcauucaauuaucuguug

SEQ ID NO: 54779 - RNA, 22 nt, Homo sapiens
gaucagauggcuguuggugugu

SEQ ID NO: 54780 - RNA, 22 nt, Homo sapiens
gauugguugaaaguagaauacu

SEQ ID NO: 54781 - RNA, 22 nt, Homo sapiens
gcacaguggcucccgucuauaa

SEQ ID NO: 54782 - RNA, 22 nt, Homo sapiens
gcauaaagcuaauaagacgaag

SEQ ID NO: 54783 - RNA, 22 nt, Homo sapiens
ggaagacuuagaguagcaucag

SEQ ID NO: 54784 - RNA, 22 nt, Homo sapiens
ggauacauuuuuccuccucuuc

SEQ ID NO: 54785 - RNA, 22 nt, Homo sapiens
ggguucaaaucuuggcucuuac

SEQ ID NO: 54786 - RNA, 22 nt, Homo sapiens
guaaucucaccuacuugggagg

SEQ ID NO: 54787 - RNA, 19 nt, Homo sapiens
guauuugacuuucuuguuu

SEQ ID NO: 54788 - RNA, 19 nt, Homo sapiens
guauuugguaaacucucca

SEQ ID NO: 54789 - RNA, 22 nt, Homo sapiens
guauuugguuauugcagccuga

SEQ ID NO: 54790 - RNA, 22 nt, Homo sapiens
gugauacugaugacuuagagaa

SEQ ID NO: 54791 - RNA, 22 nt, Homo sapiens
gugaucucagcucacuggaacc

SEQ ID NO: 54792 - RNA, 22 nt, Homo sapiens
guguaugguaggaugacggagu

SEQ ID NO: 54793 - RNA, 22 nt, Homo sapiens
gugucacugugaggauauugua

SEQ ID NO: 54794 - RNA, 22 nt, Homo sapiens
guuauuguccauuuauuuagca

SEQ ID NO: 54795 - RNA, 22 nt, Homo sapiens
guucuauguugggaguucacua

SEQ ID NO: 54796 - RNA, 22 nt, Homo sapiens
uaacaggcuacucuugcauugc

SEQ ID NO: 54797 - RNA, 22 nt, Homo sapiens
uaaggcccgugaguuucauauc

SEQ ID NO: 54798 - RNA, 20 nt, Homo sapiens
uaagugcuugaugaaugaac

SEQ ID NO: 54799 - RNA, 22 nt, Homo sapiens
uaaguuguagaacguuuucuua

SEQ ID NO: 54800 - RNA, 20 nt, Homo sapiens
uaaguuguauuugucaugaa

SEQ ID NO: 54801 - RNA, 22 nt, Homo sapiens
uaauacauucaaggugguaguu

SEQ ID NO: 54802 - RNA, 22 nt, Homo sapiens
uaauagcaguguuacuaggacu

SEQ ID NO: 54803 - RNA, 22 nt, Homo sapiens
uaauagcucggauaaacaugau

SEQ ID NO: 54804 - RNA, 22 nt, Homo sapiens
uaaucucagcugagcugagauu

SEQ ID NO: 54805 - RNA, 22 nt, Homo sapiens
uaauuggaucucaaaaaagugu

SEQ ID NO: 54806 - RNA, 22 nt, Homo sapiens
uaccacaggcuggguaaucuau

SEQ ID NO: 54807 - RNA, 22 nt, Homo sapiens
uagcagcagugguguauuuaga

SEQ ID NO: 54808 - RNA, 22 nt, Homo sapiens
uaguaguuuuguguauaauaau

SEQ ID NO: 54809 - RNA, 21 nt, Homo sapiens
uauaugacuuacuauugccuc

SEQ ID NO: 54810 - RNA, 22 nt, Homo sapiens
uauaugcaacauaguguaugug

SEQ ID NO: 54811 - RNA, 22 nt, Homo sapiens
uauaugcucugggauccugaaa

SEQ ID NO: 54812 - RNA, 22 nt, Homo sapiens
uaucauagacaaucaguuauug

SEQ ID NO: 54813 - RNA, 22 nt, Homo sapiens
uugcacucugaagaccuacugu

SEQ ID NO: 54814 - RNA, 22 nt, Homo sapiens
uugcauagaccgaugucuugga

SEQ ID NO: 54815 - RNA, 22 nt, Homo sapiens
uuggacuucucaaggcaauaaa

SEQ ID NO: 54816 - RNA, 22 nt, Homo sapiens
uuggcaguaucuacuacagcua

SEQ ID NO: 54817 - RNA, 22 nt, Homo sapiens
uuuaaguguuuguuccugaaaa

SEQ ID NO: 54818 - RNA, 22 nt, Homo sapiens
uuuaauagcagggacuuccggg

SEQ ID NO: 54819 - RNA, 22 nt, Homo sapiens
uuuaaugcgucucugaguuuug

SEQ ID NO: 54820 - RNA, 17 nt, Homo sapiens
uuuaaugcuaggacucu

SEQ ID NO: 54821 - RNA, 18 nt, Homo sapiens
uuucauugagugugauau

SEQ ID NO: 54822 - RNA, 22 nt, Homo sapiens
uuugguuuuuguuaucacucau

SEQ ID NO: 54823 - RNA, 22 nt, Homo sapiens
uuuuaacagccaggggacggcc

SEQ ID NO: 54824 - RNA, 20 nt, Homo sapiens
aagugcaucguugugucugc

SEQ ID NO: 54825 - RNA, 22 nt, Homo sapiens
aagugcuuuuuagauaugguuu

SEQ ID NO: 54826 - RNA, 22 nt, Homo sapiens
aauaaagcagcuuuuugggacu

SEQ ID NO: 54827 - RNA, 22 nt, Homo sapiens
aauaaagccugucucuuuagag

SEQ ID NO: 54828 - RNA, 22 nt, Homo sapiens
aauaaagcuuugagcuuugcug

SEQ ID NO: 54829 - RNA, 22 nt, Homo sapiens
aauugcuuuuauuuagggccag

SEQ ID NO: 54830 - RNA, 22 nt, Homo sapiens
acacagugucuguguauuuaaa

SEQ ID NO: 54831 - RNA, 22 nt, Homo sapiens
acagugacagaaagcugauuau

SEQ ID NO: 54832 - RNA, 22 nt, Homo sapiens
acaguuaugugagggccaccag

SEQ ID NO: 54833 - RNA, 22 nt, Homo sapiens
acauguaauugauuuuguguua

SEQ ID NO: 54834 - RNA, 22 nt, Homo sapiens
ucugguuccugcauucauucaa

SEQ ID NO: 54835 - RNA, 22 nt, Homo sapiens
ucuguacuccuugaguagugcu

SEQ ID NO: 54836 - RNA, 22 nt, Homo sapiens
ucugugcggucuguguuaugaa

SEQ ID NO: 54837 - RNA, 21 nt, Homo sapiens
ucuguguugaucucacuggga

SEQ ID NO: 54838 - RNA, 22 nt, Homo sapiens
ucuuugauuuuguuacuaagac

SEQ ID NO: 54839 - RNA, 22 nt, Homo sapiens
ugaaacacacagagaagggaga

SEQ ID NO: 54840 - RNA, 22 nt, Homo sapiens
ugaaacacaccuccucuccauc

SEQ ID NO: 54841 - RNA, 20 nt, Homo sapiens
ugaaacacauggacuggggu

SEQ ID NO: 54842 - RNA, 22 nt, Homo sapiens
ugaaauacuuaauuucuccaug

SEQ ID NO: 54843 - RNA, 22 nt, Homo sapiens
ugaaauacuuuggcucuuuguu

SEQ ID NO: 54844 - RNA, 22 nt, Homo sapiens
ugaaaugauuauaugguguuug

SEQ ID NO: 54845 - RNA, 21 nt, Homo sapiens
ugaaaugcaugugcacauuaa

SEQ ID NO: 54846 - RNA, 22 nt, Homo sapiens
ugaaaugccuugagauuuugac

SEQ ID NO: 54847 - RNA, 22 nt, Homo sapiens
ugaaaugccuuuaaugaauuua

SEQ ID NO: 54848 - RNA, 22 nt, Homo sapiens
ugaaauuauucuuaccaaggug

SEQ ID NO: 54849 - RNA, 22 nt, Homo sapiens
ugaacacuggauaaggagucag

SEQ ID NO: 54850 - RNA, 22 nt, Homo sapiens
ugaauauguuaaauaauguucu

SEQ ID NO: 54851 - RNA, 21 nt, Homo sapiens
ugaauauuuggguugugucca

SEQ ID NO: 54852 - RNA, 21 nt, Homo sapiens
ugaaugcuuuaaauauuagaa

SEQ ID NO: 54853 - RNA, 22 nt, Homo sapiens
ugaaugguuuuuagagaacaau

SEQ ID NO: 54854 - RNA, 22 nt, Homo sapiens
ugaauguaacuaaaggacuuuu

SEQ ID NO: 54855 - RNA, 22 nt, Homo sapiens
ugacacuugcccuuagaaacau

SEQ ID NO: 54856 - RNA, 23 nt, Homo sapiens
ugacagaccuucuggaagaaguc

SEQ ID NO: 54857 - RNA, 22 nt, Homo sapiens
ugacaggauggagaucgguauu

SEQ ID NO: 54858 - RNA, 22 nt, Homo sapiens
ugacagugaacagguuaccacu

SEQ ID NO: 54859 - RNA, 22 nt, Homo sapiens
ugacagugaauaagucucuuaa

SEQ ID NO: 54860 - RNA, 22 nt, Homo sapiens
ugacaguguccucauucccaac

SEQ ID NO: 54861 - RNA, 22 nt, Homo sapiens
ugacagugugagacuuugucuc

SEQ ID NO: 54862 - RNA, 22 nt, Homo sapiens
ugacaugaagucucccucuguu

SEQ ID NO: 54863 - RNA, 18 nt, Homo sapiens
ugacauugagcugagaaa

SEQ ID NO: 54864 - RNA, 22 nt, Homo sapiens
ugacuagagcaauuggaaacaa

SEQ ID NO: 54865 - RNA, 22 nt, Homo sapiens
ugacuagagggcuuuuguguag

SEQ ID NO: 54866 - RNA, 22 nt, Homo sapiens
ugacucaguuguuagucuucau

SEQ ID NO: 54867 - RNA, 22 nt, Homo sapiens
ugacucaguuucucagguagua

SEQ ID NO: 54868 - RNA, 23 nt, Homo sapiens
ugacugaguauauguuuggugcu

SEQ ID NO: 54869 - RNA, 22 nt, Homo sapiens
ugagaacauggagaacccccca

SEQ ID NO: 54870 - RNA, 22 nt, Homo sapiens
ugagaacugccuguauuuaucu

SEQ ID NO: 54871 - RNA, 22 nt, Homo sapiens
ugagaacugguagcacuuguga

SEQ ID NO: 54872 - RNA, 22 nt, Homo sapiens
ugagacugaguuuugcucguug

SEQ ID NO: 54873 - RNA, 22 nt, Homo sapiens
ugagauaacuaaaaacauuuug

SEQ ID NO: 54874 - RNA, 18 nt, Homo sapiens
ugagauacuagaauaggu

SEQ ID NO: 54875 - RNA, 22 nt, Homo sapiens
ugagaucaacugagucagagca

SEQ ID NO: 54876 - RNA, 22 nt, Homo sapiens
ugagaugaagcuagaagaaugg

SEQ ID NO: 54877 - RNA, 22 nt, Homo sapiens
ugagaugaagugauguaaaaca

SEQ ID NO: 54878 - RNA, 22 nt, Homo sapiens
ugagauggagucuugucgccua

SEQ ID NO: 54879 - RNA, 22 nt, Homo sapiens
ugagauggaguuucacuuuugu

SEQ ID NO: 54880 - RNA, 22 nt, Homo sapiens
ugagauggguaauuaaauggug

SEQ ID NO: 54881 - RNA, 22 nt, Homo sapiens
ugagauguuccaaugacuauua

SEQ ID NO: 54882 - RNA, 23 nt, Homo sapiens
ugagauuacccagaaagaguaua

SEQ ID NO: 54883 - RNA, 21 nt, Homo sapiens
ugagauuauauuaacauggua

SEQ ID NO: 54884 - RNA, 21 nt, Homo sapiens
ugagcauuaguacaguaggga

SEQ ID NO: 54885 - RNA, 22 nt, Homo sapiens
aucacuguaaguuuacacuuug

SEQ ID NO: 54886 - RNA, 23 nt, Homo sapiens
aucagauaguuguagguaugugg

SEQ ID NO: 54887 - RNA, 22 nt, Homo sapiens
aucauccagccccagaagggag

SEQ ID NO: 54888 - RNA, 22 nt, Homo sapiens
aucauggaguauuugcaagucu

SEQ ID NO: 54889 - RNA, 22 nt, Homo sapiens
aucccugaggaauuucugcacu

SEQ ID NO: 54890 - RNA, 22 nt, Homo sapiens
aucccugugacgagcaucccua

SEQ ID NO: 54891 - RNA, 22 nt, Homo sapiens
aucugcauucccauguuuauug

SEQ ID NO: 54892 - RNA, 22 nt, Homo sapiens
aucuuggauuaccugggugggu

SEQ ID NO: 54893 - RNA, 22 nt, Homo sapiens
augaaaagcauaaacgcugaag

SEQ ID NO: 54894 - RNA, 22 nt, Homo sapiens
augaaagguauguuuucuguga

SEQ ID NO: 54895 - RNA, 22 nt, Homo sapiens
augaaagguugucuuaagccau

SEQ ID NO: 54896 - RNA, 22 nt, Homo sapiens
augaacacuccaauuguacucc

SEQ ID NO: 54897 - RNA, 21 nt, Homo sapiens
augaauguaaagaauguggga

SEQ ID NO: 54898 - RNA, 22 nt, Homo sapiens
augaauguaaagaaugugggaa

SEQ ID NO: 54899 - RNA, 23 nt, Homo sapiens
augaauguaaagaaugugggaag

SEQ ID NO: 54900 - RNA, 22 nt, Homo sapiens
augaaugucuuauuuugagaaa

SEQ ID NO: 54901 - RNA, 22 nt, Homo sapiens
augacauugaugcucuggcugg

SEQ ID NO: 54902 - RNA, 22 nt, Homo sapiens
augagauuauguaaagagacca

SEQ ID NO: 54903 - RNA, 22 nt, Homo sapiens
augagauuguuugugugaaaua

SEQ ID NO: 54904 - RNA, 22 nt, Homo sapiens
augaggaagucaggcccagggg

SEQ ID NO: 54905 - RNA, 22 nt, Homo sapiens
augaggagguaugauuuucuga

SEQ ID NO: 54906 - RNA, 22 nt, Homo sapiens
augaggcacugcgcccuacuga

SEQ ID NO: 54907 - RNA, 22 nt, Homo sapiens
augaggcaggaaaggcguaucu

SEQ ID NO: 54908 - RNA, 20 nt, Homo sapiens
augagguguaugacacugaa

SEQ ID NO: 54909 - RNA, 22 nt, Homo sapiens
aaaaguucuuugagccuugaca

SEQ ID NO: 54910 - RNA, 22 nt, Homo sapiens
aaacugucuucugacaguuucc

SEQ ID NO: 54911 - RNA, 22 nt, Homo sapiens
aaagcuaccagauucuguugga

SEQ ID NO: 54912 - RNA, 22 nt, Homo sapiens
aaaggcacugugacuuuauagg

SEQ ID NO: 54913 - RNA, 22 nt, Homo sapiens
aaagguaguacuucuagaaggg

SEQ ID NO: 54914 - RNA, 22 nt, Homo sapiens
aaagugauguccaggcuuucag

SEQ ID NO: 54915 - RNA, 22 nt, Homo sapiens
aaagugcugagucuaggcgggg

SEQ ID NO: 54916 - RNA, 22 nt, Homo sapiens
aaaugcaucauuaggugauuuu

SEQ ID NO: 54917 - RNA, 22 nt, Homo sapiens
aacacuggcugcucgaguucuc

SEQ ID NO: 54918 - RNA, 20 nt, Homo sapiens
aacagcacugucugaagcuu

SEQ ID NO: 54919 - RNA, 22 nt, Homo sapiens
aacagugcauuccuguccauau

SEQ ID NO: 54920 - RNA, 22 nt, Homo sapiens
aacaucaaccaugaggguugga

SEQ ID NO: 54921 - RNA, 22 nt, Homo sapiens
aacauugaacuuggcacaccca

SEQ ID NO: 54922 - RNA, 22 nt, Homo sapiens
aacuggcauguuuuaaggcuua

SEQ ID NO: 54923 - RNA, 19 nt, Homo sapiens
aacuggugugagaugguau

SEQ ID NO: 54924 - RNA, 22 nt, Homo sapiens
aagaccuaugcaggaagaaaug

SEQ ID NO: 54925 - RNA, 22 nt, Homo sapiens
aagaggcuguaggauaaugccu

SEQ ID NO: 54926 - RNA, 23 nt, Homo sapiens
aagagguaugacuaugaagugga

SEQ ID NO: 54927 - RNA, 22 nt, Homo sapiens
aagcaucauuuggaauuugaga

SEQ ID NO: 54928 - RNA, 21 nt, Homo sapiens
aagcaugguguaucuuuccau

SEQ ID NO: 54929 - RNA, 22 nt, Homo sapiens
aagcuggagugcaguggugcaa

SEQ ID NO: 54930 - RNA, 22 nt, Homo sapiens
aagcuggagugcaguggugcga

SEQ ID NO: 54931 - RNA, 22 nt, Homo sapiens
aagcuggauuuaguguggagca

SEQ ID NO: 54932 - RNA, 22 nt, Homo sapiens
aagcuguugguggaucuaccau

SEQ ID NO: 54933 - RNA, 22 nt, Homo sapiens
aaggaauucaaauuuucucugg

SEQ ID NO: 54934 - RNA, 22 nt, Homo sapiens
aaggcaauuuguugugaggauu

SEQ ID NO: 54935 - RNA, 21 nt, Homo sapiens
aaggugguggugauugagaug

SEQ ID NO: 54936 - RNA, 22 nt, Homo sapiens
aaguaauggaguuauuuuauga

SEQ ID NO: 54937 - RNA, 23 nt, Homo sapiens
aagucauggaaucaaaugaggug

SEQ ID NO: 54938 - RNA, 22 nt, Homo sapiens
aagugaaugaugugaaguguaa

SEQ ID NO: 54939 - RNA, 20 nt, Homo sapiens
aagugcaucguugugucugc

SEQ ID NO: 54940 - RNA, 22 nt, Homo sapiens
aaguugguguaugagacagaag

SEQ ID NO: 54941 - RNA, 22 nt, Homo sapiens
aauaaaguaggaggugaggaaa

SEQ ID NO: 54942 - RNA, 22 nt, Homo sapiens
aauaauggcaccaaagcacaag

SEQ ID NO: 54943 - RNA, 22 nt, Homo sapiens
aauacucuauaagggaagcugu

SEQ ID NO: 54944 - RNA, 22 nt, Homo sapiens
aauacugcuuugauguaagcua

SEQ ID NO: 54945 - RNA, 22 nt, Homo sapiens
aaucacuaugccaugaaguaca

SEQ ID NO: 54946 - RNA, 22 nt, Homo sapiens
aaucuguagaaggugcacauuc

SEQ ID NO: 54947 - RNA, 22 nt, Homo sapiens
aaugauauguuauguuuagguu

SEQ ID NO: 54948 - RNA, 22 nt, Homo sapiens
aaugccaucagagaaaacucuu

SEQ ID NO: 54949 - RNA, 22 nt, Homo sapiens
aauggcaaauguuuucuguuga

SEQ ID NO: 54950 - RNA, 22 nt, Homo sapiens
aauggcucugauguuguuguga

SEQ ID NO: 54951 - RNA, 22 nt, Homo sapiens
aaugucaugaguccaaccagaa

SEQ ID NO: 54952 - RNA, 22 nt, Homo sapiens
aaugugccuacagugggcuguu

SEQ ID NO: 54953 - RNA, 22 nt, Homo sapiens
aauguguuuugaaaucaggaag

SEQ ID NO: 54954 - RNA, 22 nt, Homo sapiens
aauuacauggcaauugggaaau

SEQ ID NO: 54955 - RNA, 22 nt, Homo sapiens
aauuaggcuagaauguuauuaa

SEQ ID NO: 54956 - RNA, 22 nt, Homo sapiens
aauucuguauuguuuagggacu

SEQ ID NO: 54957 - RNA, 23 nt, Homo sapiens
aauugcuuuugaggacuuaguug

SEQ ID NO: 54958 - RNA, 22 nt, Homo sapiens
acacagucaaauccacuuggcu

SEQ ID NO: 54959 - RNA, 22 nt, Homo sapiens
acacagugucuguguauuuaaa

SEQ ID NO: 54960 - RNA, 22 nt, Homo sapiens
acacuguacuuauguuuugcag

SEQ ID NO: 54961 - RNA, 22 nt, Homo sapiens
acacuguuggugggaguguaaa

SEQ ID NO: 54962 - RNA, 22 nt, Homo sapiens
acagccauuccagccaaauacu

SEQ ID NO: 54963 - RNA, 22 nt, Homo sapiens
acaguacuuuuggauuugugaa

SEQ ID NO: 54964 - RNA, 22 nt, Homo sapiens
acagugcugucugcuuuggcua

SEQ ID NO: 54965 - RNA, 22 nt, Homo sapiens
acagugcuguggucaugggucu

SEQ ID NO: 54966 - RNA, 22 nt, Homo sapiens
acagugcuucugauaugaugcc

SEQ ID NO: 54967 - RNA, 17 nt, Homo sapiens
acagugcuuugcuuucc

SEQ ID NO: 54968 - RNA, 23 nt, Homo sapiens
acaguggugugaucuuggcucag

SEQ ID NO: 54969 - RNA, 22 nt, Homo sapiens
acccagaagucauucaggaaca

SEQ ID NO: 54970 - RNA, 22 nt, Homo sapiens
acccuacauaguagauccuaca

SEQ ID NO: 54971 - RNA, 22 nt, Homo sapiens
acccugcuaaacagcccccugc

SEQ ID NO: 54972 - RNA, 22 nt, Homo sapiens
acccugucaaaauggaccaauc

SEQ ID NO: 54973 - RNA, 22 nt, Homo sapiens
accgaguuagccaggauggucu

SEQ ID NO: 54974 - RNA, 22 nt, Homo sapiens
acuacuucuaaguuuuggaaga

SEQ ID NO: 54975 - RNA, 22 nt, Homo sapiens
acugagaucuuuaaauaaauaa

SEQ ID NO: 54976 - RNA, 20 nt, Homo sapiens
acugauauguuccuguucuc

SEQ ID NO: 54977 - RNA, 22 nt, Homo sapiens
acugcaaugucgaauagagaug

SEQ ID NO: 54978 - RNA, 21 nt, Homo sapiens
acugcacuccaaccucaacag

SEQ ID NO: 54979 - RNA, 20 nt, Homo sapiens
acugcacuccaaccuuugug

SEQ ID NO: 54980 - RNA, 22 nt, Homo sapiens
acugcacuccacccuuggcagc

SEQ ID NO: 54981 - RNA, 22 nt, Homo sapiens
acugcacuccagcccgggugac

SEQ ID NO: 54982 - RNA, 20 nt, Homo sapiens
ucaaaguaugcucugcacua

SEQ ID NO: 54983 - RNA, 22 nt, Homo sapiens
ucaaaugcacguagagaaaaua

SEQ ID NO: 54984 - RNA, 22 nt, Homo sapiens
ucaacagugggcacuguaaaug

SEQ ID NO: 54985 - RNA, 18 nt, Homo sapiens
ucaagcaauugucaugcc

SEQ ID NO: 54986 - RNA, 22 nt, Homo sapiens
ucaaggcacauuugacauuuuc

SEQ ID NO: 54987 - RNA, 22 nt, Homo sapiens
ucacacugcaucuguuggaauu

SEQ ID NO: 54988 - RNA, 19 nt, Homo sapiens
ucacacuguggcuucuuua

SEQ ID NO: 54989 - RNA, 22 nt, Homo sapiens
ucacagcuaaaaugaaaguagu

SEQ ID NO: 54990 - RNA, 20 nt, Homo sapiens
ucacagucacacauaauccu

SEQ ID NO: 54991 - RNA, 22 nt, Homo sapiens
ucacaguuggccuggccuuuua

SEQ ID NO: 54992 - RNA, 22 nt, Homo sapiens
ucacaugaagauuuuaguauac

SEQ ID NO: 54993 - RNA, 22 nt, Homo sapiens
ucacauggcagagaagaagcuc

SEQ ID NO: 54994 - RNA, 22 nt, Homo sapiens
ucacauguguaaauugguguaa

SEQ ID NO: 54995 - RNA, 22 nt, Homo sapiens
ucacauuguacaaacagguaag

SEQ ID NO: 54996 - RNA, 22 nt, Homo sapiens
ucacgcugcugcaaccagccug

SEQ ID NO: 54997 - RNA, 18 nt, Homo sapiens
ucacggggagcagcagcc

SEQ ID NO: 54998 - RNA, 22 nt, Homo sapiens
ucacucagaccuggugauaugc

SEQ ID NO: 54999 - RNA, 22 nt, Homo sapiens
ucacugcacucuccgccuugcg

SEQ ID NO: 55000 - RNA, 22 nt, Homo sapiens
ucacuggcaaauauauccguug

SEQ ID NO: 55001 - RNA, 20 nt, Homo sapiens
ucacugugaacuucuugagg

SEQ ID NO: 55002 - RNA, 22 nt, Homo sapiens
ucacugugcaugaaggaugcug

SEQ ID NO: 55003 - RNA, 22 nt, Homo sapiens
ucacuguguauguauaugcagg

SEQ ID NO: 55004 - RNA, 22 nt, Homo sapiens
ucacugugugucucuguaucug

SEQ ID NO: 55005 - RNA, 21 nt, Homo sapiens
ucagaagcucccagggaggac

SEQ ID NO: 55006 - RNA, 22 nt, Homo sapiens
ucagacacuguggccuuuggac

SEQ ID NO: 55007 - RNA, 22 nt, Homo sapiens
ucagaguagcugucugaggugc

SEQ ID NO: 55008 - RNA, 22 nt, Homo sapiens
ucagaguggagucugcagccuu

SEQ ID NO: 55009 - RNA, 22 nt, Homo sapiens
ucagcaaugaccuaagcaaaua

SEQ ID NO: 55010 - RNA, 22 nt, Homo sapiens
ucagguagugccaugauugauu

SEQ ID NO: 55011 - RNA, 22 nt, Homo sapiens
ucaggucauuccaggagggcca

SEQ ID NO: 55012 - RNA, 22 nt, Homo sapiens
ucaguccccucgcugagucuac

SEQ ID NO: 55013 - RNA, 22 nt, Homo sapiens
ucagugcaggaauuuccuuaga

SEQ ID NO: 55014 - RNA, 23 nt, Homo sapiens
ucagugucuggauccugcucagu

SEQ ID NO: 55015 - RNA, 22 nt, Homo sapiens
ucaguguuuuauccuccagagc

SEQ ID NO: 55016 - RNA, 21 nt, Homo sapiens
ucauauguaucuuugugccuc

SEQ ID NO: 55017 - RNA, 22 nt, Homo sapiens
ucauauugguuaaaauaguggg

SEQ ID NO: 55018 - RNA, 22 nt, Homo sapiens
ucaucaggcucauucaagcuga

SEQ ID NO: 55019 - RNA, 22 nt, Homo sapiens
ucaucagguaugucagcggagu

SEQ ID NO: 55020 - RNA, 22 nt, Homo sapiens
ucaugaaguaguuaacugguug

SEQ ID NO: 55021 - RNA, 22 nt, Homo sapiens
ucauguaauuuugugucuauga

SEQ ID NO: 55022 - RNA, 22 nt, Homo sapiens
uccacaauggcugaacuagauu

SEQ ID NO: 55023 - RNA, 22 nt, Homo sapiens
uccacagugguugaacuaguaa

SEQ ID NO: 55024 - RNA, 22 nt, Homo sapiens
uccaguguuauaauaugcgucu

SEQ ID NO: 55025 - RNA, 20 nt, Homo sapiens
uccaguuuuggagacauucu

SEQ ID NO: 55026 - RNA, 22 nt, Homo sapiens
ucccugagcaaaguuuucugua

SEQ ID NO: 55027 - RNA, 22 nt, Homo sapiens
ucccugagguccuggauuauug

SEQ ID NO: 55028 - RNA, 22 nt, Homo sapiens
ucccugagugauugaaaauaaa

SEQ ID NO: 55029 - RNA, 19 nt, Homo sapiens
ucccuguagaccacagugc

SEQ ID NO: 55030 - RNA, 22 nt, Homo sapiens
uccugcauucugacuugcuuuc

SEQ ID NO: 55031 - RNA, 22 nt, Homo sapiens
uccuugagccucccagacucag

SEQ ID NO: 55032 - RNA, 22 nt, Homo sapiens
uccuugagccuuaaauuauaaa

SEQ ID NO: 55033 - RNA, 22 nt, Homo sapiens
uccuuggucauggaagagacag

SEQ ID NO: 55034 - RNA, 22 nt, Homo sapiens
uccuuggugacauuucuugucu

SEQ ID NO: 55035 - RNA, 21 nt, Homo sapiens
uccuuggugaugcccugcagu

SEQ ID NO: 55036 - RNA, 23 nt, Homo sapiens
uccuugguuggcgcccuaugugu

SEQ ID NO: 55037 - RNA, 19 nt, Homo sapiens
ucucacagcucuacuaugu

SEQ ID NO: 55038 - RNA, 22 nt, Homo sapiens
ucucaugaagauagagaauaga

SEQ ID NO: 55039 - RNA, 22 nt, Homo sapiens
ucucaugaagguggagaguagg

SEQ ID NO: 55040 - RNA, 22 nt, Homo sapiens
ucuccggguggcggcgaaggga

SEQ ID NO: 55041 - RNA, 22 nt, Homo sapiens
ucucuagagagccugguguuca

SEQ ID NO: 55042 - RNA, 22 nt, Homo sapiens
ucucugagaccacuccaaacuc

SEQ ID NO: 55043 - RNA, 22 nt, Homo sapiens
ucucuguuuauuuuugguguau

SEQ ID NO: 55044 - RNA, 22 nt, Homo sapiens
ucucuugguugaacaguuugga

SEQ ID NO: 55045 - RNA, 22 nt, Homo sapiens
ucugaaucguucccaugcagga

SEQ ID NO: 55046 - RNA, 22 nt, Homo sapiens
ucugacagugagagaaaucuga

SEQ ID NO: 55047 - RNA, 22 nt, Homo sapiens
ucugacuagacaagcaguguac

SEQ ID NO: 55048 - RNA, 22 nt, Homo sapiens
ucugacucuggagucucagguu

SEQ ID NO: 55049 - RNA, 22 nt, Homo sapiens
ugagguguuugugcaccaucug

SEQ ID NO: 55050 - RNA, 22 nt, Homo sapiens
ugaguauagaucaguucaagug

SEQ ID NO: 55051 - RNA, 19 nt, Homo sapiens
ugaguaucuuuacacaucu

SEQ ID NO: 55052 - RNA, 22 nt, Homo sapiens
ugagucaugcuggagucauggc

SEQ ID NO: 55053 - RNA, 22 nt, Homo sapiens
ugaguuccuugugugaccuugc

SEQ ID NO: 55054 - RNA, 22 nt, Homo sapiens
ugaguugagauaagguuacauu

SEQ ID NO: 55055 - RNA, 22 nt, Homo sapiens
ugaguuuaucuaaagaccuggg

SEQ ID NO: 55056 - RNA, 22 nt, Homo sapiens
ugauaacauuucuucugguaca

SEQ ID NO: 55057 - RNA, 22 nt, Homo sapiens
ugauaugaaagggaaauaagug

SEQ ID NO: 55058 - RNA, 20 nt, Homo sapiens
ugauauuuucugagcaggaa

SEQ ID NO: 55059 - RNA, 22 nt, Homo sapiens
ugaucaaagugcuggaauuaca

SEQ ID NO: 55060 - RNA, 22 nt, Homo sapiens
ugauuagagcccaagcuuugaa

SEQ ID NO: 55061 - RNA, 22 nt, Homo sapiens
ugcaaagaaauuuuggugacca

SEQ ID NO: 55062 - RNA, 22 nt, Homo sapiens
ugcaagaaucagccuaucauua

SEQ ID NO: 55063 - RNA, 22 nt, Homo sapiens
ugcacugucuugucgcauagca

SEQ ID NO: 55064 - RNA, 22 nt, Homo sapiens
ugcacuguggucugagagacag

SEQ ID NO: 55065 - RNA, 22 nt, Homo sapiens
ugcaugcaucuuuuauaguagc

SEQ ID NO: 55066 - RNA, 22 nt, Homo sapiens
ugcauggagcucucuuuggacu

SEQ ID NO: 55067 - RNA, 22 nt, Homo sapiens
ugcauugccgugauuacugucu

SEQ ID NO: 55068 - RNA, 19 nt, Homo sapiens
ugccauguagcacaugguc

SEQ ID NO: 55069 - RNA, 22 nt, Homo sapiens
ugccuaggcccaguccucagaa

SEQ ID NO: 55070 - RNA, 22 nt, Homo sapiens
ugccuggagagcuccuacauau

SEQ ID NO: 55071 - RNA, 22 nt, Homo sapiens
ugcuauguuuucccuccuuauc

SEQ ID NO: 55072 - RNA, 22 nt, Homo sapiens
ugcugcacuuauggcucugagg

SEQ ID NO: 55073 - RNA, 22 nt, Homo sapiens
ugcugguuuaaaaugcaaauuc

SEQ ID NO: 55074 - RNA, 22 nt, Homo sapiens
ugaaugcuaaaggaaaacagua

SEQ ID NO: 55075 - RNA, 22 nt, Homo sapiens
ugaauguauuuauuaccauuca

SEQ ID NO: 55076 - RNA, 22 nt, Homo sapiens
ugacaggucuaauuuacugaca

SEQ ID NO: 55077 - RNA, 22 nt, Homo sapiens
ugacaguuuccagggcugucuc

SEQ ID NO: 55078 - RNA, 22 nt, Homo sapiens
ugacccuguggcagcgucuaag

SEQ ID NO: 55079 - RNA, 22 nt, Homo sapiens
ugacggaggacaccugcggaau

SEQ ID NO: 55080 - RNA, 22 nt, Homo sapiens
ugacuacacacaauuugucaag

SEQ ID NO: 55081 - RNA, 22 nt, Homo sapiens
ugacuagggcucuaaacagcuc

SEQ ID NO: 55082 - RNA, 22 nt, Homo sapiens
ugacuggaaacaguguuauuug

SEQ ID NO: 55083 - RNA, 23 nt, Homo sapiens
ugacuggagacuguugauccuuu

SEQ ID NO: 55084 - RNA, 22 nt, Homo sapiens
ugagaagcauaccagugucugu

SEQ ID NO: 55085 - RNA, 22 nt, Homo sapiens
ugagaaugacugggcaugcugc

SEQ ID NO: 55086 - RNA, 22 nt, Homo sapiens
ugagacaugugaauauuuguac

SEQ ID NO: 55087 - RNA, 22 nt, Homo sapiens
ugagacugauaggacauuuucu

SEQ ID NO: 55088 - RNA, 22 nt, Homo sapiens
ugagagacaguuuguuaaaauu

SEQ ID NO: 55089 - RNA, 22 nt, Homo sapiens
ugagagcugguuguuuaaagga

SEQ ID NO: 55090 - RNA, 21 nt, Homo sapiens
ugagauaauauguuucugaug

SEQ ID NO: 55091 - RNA, 22 nt, Homo sapiens
ugagauaguacuuuuuuaaagg

SEQ ID NO: 55092 - RNA, 22 nt, Homo sapiens
ugagaugauagauauguuaauu

SEQ ID NO: 55093 - RNA, 21 nt, Homo sapiens
ugagaugauccugcaugcaug

SEQ ID NO: 55094 - RNA, 20 nt, Homo sapiens
ugagaugcauugggauguuu

SEQ ID NO: 55095 - RNA, 22 nt, Homo sapiens
ugagauggaguuucgcccuugu

SEQ ID NO: 55096 - RNA, 22 nt, Homo sapiens
ugagauggaguuucgcuuuugu

SEQ ID NO: 55097 - RNA, 22 nt, Homo sapiens
ugagauggaucuuggauuugaa

SEQ ID NO: 55098 - RNA, 22 nt, Homo sapiens
ugagauguggcuagagagguug

SEQ ID NO: 55099 - RNA, 22 nt, Homo sapiens
ugagauuaaucuuuaaguaaga

SEQ ID NO: 55100 - RNA, 22 nt, Homo sapiens
ugagauucucugauuguagguc

SEQ ID NO: 55101 - RNA, 22 nt, Homo sapiens
ugagcacaggugcgcgguuacu

SEQ ID NO: 55102 - RNA, 22 nt, Homo sapiens
ugagcacuguacuuuaucaggu

SEQ ID NO: 55103 - RNA, 22 nt, Homo sapiens
ugagccaaguucacaccauugc

SEQ ID NO: 55104 - RNA, 20 nt, Homo sapiens
ugagcuauauauguccuuga

SEQ ID NO: 55105 - RNA, 22 nt, Homo sapiens
ugagcugagaucuuaccacugc

SEQ ID NO: 55106 - RNA, 22 nt, Homo sapiens
ugaggaaugaccccgugugguc

SEQ ID NO: 55107 - RNA, 22 nt, Homo sapiens
ugaggcaagauacugauuucau

SEQ ID NO: 55108 - RNA, 22 nt, Homo sapiens
ugagguugucagugucauucuu

SEQ ID NO: 55109 - RNA, 22 nt, Homo sapiens
ugagucauguaauaaugcugcu

SEQ ID NO: 55110 - RNA, 22 nt, Homo sapiens
ugagugaggcugggcagucccu

SEQ ID NO: 55111 - RNA, 22 nt, Homo sapiens
ugaguguccaaguaaggugaaa

SEQ ID NO: 55112 - RNA, 22 nt, Homo sapiens
ugaguguguaugugcauacaca

SEQ ID NO: 55113 - RNA, 22 nt, Homo sapiens
ugaguuagguguuuuaaauaua

SEQ ID NO: 55114 - RNA, 23 nt, Homo sapiens
ugauaacagcauaugaagauucu

SEQ ID NO: 55115 - RNA, 22 nt, Homo sapiens
ugauauauugaaugaugaaaca

SEQ ID NO: 55116 - RNA, 22 nt, Homo sapiens
ugauaucugaucauccuugaua

SEQ ID NO: 55117 - RNA, 22 nt, Homo sapiens
ugauauggcuuggcuaugucac

SEQ ID NO: 55118 - RNA, 20 nt, Homo sapiens
ugauauuucuggaaguggag

SEQ ID NO: 55119 - RNA, 17 nt, Homo sapiens
ugauauuuucccagaua

SEQ ID NO: 55120 - RNA, 22 nt, Homo sapiens
ugauauuuuugauccuuaaguu

SEQ ID NO: 55121 - RNA, 22 nt, Homo sapiens
ugaucacagcuugacuaaagga

SEQ ID NO: 55122 - RNA, 21 nt, Homo sapiens
ugaucacaugaaaaccaugca

SEQ ID NO: 55123 - RNA, 22 nt, Homo sapiens
ugaucuguccaccucagcuucc

SEQ ID NO: 55124 - RNA, 22 nt, Homo sapiens
ugaucugucucggguuaucagu

SEQ ID NO: 55125 - RNA, 22 nt, Homo sapiens
ugaugacacugauuucuucaau

SEQ ID NO: 55126 - RNA, 22 nt, Homo sapiens
ugaugguaguucagucaaugua

SEQ ID NO: 55127 - RNA, 22 nt, Homo sapiens
ugauuagaggaaugguagauua

SEQ ID NO: 55128 - RNA, 22 nt, Homo sapiens
ugcaaaguccucauucuuaccc

SEQ ID NO: 55129 - RNA, 22 nt, Homo sapiens
ugcaaaugucaaggguuagugu

SEQ ID NO: 55130 - RNA, 22 nt, Homo sapiens
ugcaaauguuauuuugguuucu

SEQ ID NO: 55131 - RNA, 22 nt, Homo sapiens
ugcaagacaucguauuuugguc

SEQ ID NO: 55132 - RNA, 22 nt, Homo sapiens
ugcaagacuaaaccuuccccuc

SEQ ID NO: 55133 - RNA, 22 nt, Homo sapiens
ugcaagacugcaguuacuuuug

SEQ ID NO: 55134 - RNA, 22 nt, Homo sapiens
ugcaccacuacacuccaggcug

SEQ ID NO: 55135 - RNA, 22 nt, Homo sapiens
ugcaccacugcacuccaggcug

SEQ ID NO: 55136 - RNA, 22 nt, Homo sapiens
ugcaccaucuugcuucuguggu

SEQ ID NO: 55137 - RNA, 22 nt, Homo sapiens
ugcagagaaacauuuuguauuu

SEQ ID NO: 55138 - RNA, 22 nt, Homo sapiens
uguuagguuggugcaaaaguga

SEQ ID NO: 55139 - RNA, 22 nt, Homo sapiens
uguucaauucccaccuaugagu

SEQ ID NO: 55140 - RNA, 22 nt, Homo sapiens
uguucaugaguucucauuuuua

SEQ ID NO: 55141 - RNA, 22 nt, Homo sapiens
uuaaaagcuaucuccaagguca

SEQ ID NO: 55142 - RNA, 22 nt, Homo sapiens
uuaaagugaucauaaggauagu

SEQ ID NO: 55143 - RNA, 22 nt, Homo sapiens
uuaaggaaggagucuuaaaugg

SEQ ID NO: 55144 - RNA, 22 nt, Homo sapiens
uuaaugcuuggggaguaguucu

SEQ ID NO: 55145 - RNA, 22 nt, Homo sapiens
uuaauggagaguuucauuggug

SEQ ID NO: 55146 - RNA, 22 nt, Homo sapiens
uuacaacugucuuacugguuau

SEQ ID NO: 55147 - RNA, 22 nt, Homo sapiens
uuacacaguugguaggggcaga

SEQ ID NO: 55148 - RNA, 23 nt, Homo sapiens
uuacaguggcaugaucucugcuc

SEQ ID NO: 55149 - RNA, 22 nt, Homo sapiens
uuacaucaucacauuaguuugc

SEQ ID NO: 55150 - RNA, 19 nt, Homo sapiens
uuacauccauugcauuuca

SEQ ID NO: 55151 - RNA, 22 nt, Homo sapiens
uuaccuugcacugagucugaaa

SEQ ID NO: 55152 - RNA, 20 nt, Homo sapiens
uuagaguaguaugauuuaua

SEQ ID NO: 55153 - RNA, 22 nt, Homo sapiens
uuagaucaacauggaacucuau

SEQ ID NO: 55154 - RNA, 22 nt, Homo sapiens
uuagcagcucuggugacaaggu

SEQ ID NO: 55155 - RNA, 22 nt, Homo sapiens
uuaggcuaguugauauaguuug

SEQ ID NO: 55156 - RNA, 22 nt, Homo sapiens
uuaggcuuuuuaaccaguuguu

SEQ ID NO: 55157 - RNA, 22 nt, Homo sapiens
uuaguaguagcugcaugucagu

SEQ ID NO: 55158 - RNA, 22 nt, Homo sapiens
uuaguaguuugauaggaauagc

SEQ ID NO: 55159 - RNA, 22 nt, Homo sapiens
uuagugcaaacucuucaaugcu

SEQ ID NO: 55160 - RNA, 22 nt, Homo sapiens
uuauauguuagacauggugggu

SEQ ID NO: 55161 - RNA, 22 nt, Homo sapiens
uuaucccacuuucuguuccugu

SEQ ID NO: 55162 - RNA, 21 nt, Homo sapiens
uuaucccagugucucugcagg

SEQ ID NO: 55163 - RNA, 22 nt, Homo sapiens
uuaucucaguguuuguaaacaa

SEQ ID NO: 55164 - RNA, 22 nt, Homo sapiens
uuauggcuauugaugacaauug

SEQ ID NO: 55165 - RNA, 22 nt, Homo sapiens
uuauggcuuugcgguguuagca

SEQ ID NO: 55166 - RNA, 22 nt, Homo sapiens
uggagagugauaaguaaaugga

SEQ ID NO: 55167 - RNA, 18 nt, Homo sapiens
uggagauaagaagaacuu

SEQ ID NO: 55168 - RNA, 22 nt, Homo sapiens
uggagcccuaaacuucuaauau

SEQ ID NO: 55169 - RNA, 22 nt, Homo sapiens
uggagggcuagucauuucuuuu

SEQ ID NO: 55170 - RNA, 18 nt, Homo sapiens
uggauaguuguuggcaga

SEQ ID NO: 55171 - RNA, 22 nt, Homo sapiens
uggauggagaggcuugugaugc

SEQ ID NO: 55172 - RNA, 22 nt, Homo sapiens
uggcaaaauggaauauguuggg

SEQ ID NO: 55173 - RNA, 21 nt, Homo sapiens
uggcaaaaugggcaguggguu

SEQ ID NO: 55174 - RNA, 22 nt, Homo sapiens
uggcaaaugaagucagcuguac

SEQ ID NO: 55175 - RNA, 22 nt, Homo sapiens
uggcaacuugcaaccucauucu

SEQ ID NO: 55176 - RNA, 20 nt, Homo sapiens
uggcaccugacagauagcca

SEQ ID NO: 55177 - RNA, 22 nt, Homo sapiens
uggcacuggagauacauuaaua

SEQ ID NO: 55178 - RNA, 17 nt, Homo sapiens
uggcaugaggguguggg

SEQ ID NO: 55179 - RNA, 22 nt, Homo sapiens
uggcaugugugaagugcccagc

SEQ ID NO: 55180 - RNA, 22 nt, Homo sapiens
uggcuaagaugcacacuucacu

SEQ ID NO: 55181 - RNA, 22 nt, Homo sapiens
uggcuuuuauuauguugaggua

SEQ ID NO: 55182 - RNA, 22 nt, Homo sapiens
uggcuuuucauccugggacauu

SEQ ID NO: 55183 - RNA, 22 nt, Homo sapiens
uggcuuuuccuugaaucugccu

SEQ ID NO: 55184 - RNA, 22 nt, Homo sapiens
ugggaacugaggugaaaagaca

SEQ ID NO: 55185 - RNA, 22 nt, Homo sapiens
ugggaaugaaauuacauagcuu

SEQ ID NO: 55186 - RNA, 22 nt, Homo sapiens
ugggagugugcacaauuucagc

SEQ ID NO: 55187 - RNA, 22 nt, Homo sapiens
ugggcaaaacuaagagcugugg

SEQ ID NO: 55188 - RNA, 22 nt, Homo sapiens
ugggcagugggacagcuuugug

SEQ ID NO: 55189 - RNA, 22 nt, Homo sapiens
uggguaggcccucauuggacag

SEQ ID NO: 55190 - RNA, 22 nt, Homo sapiens
uggguagucauuggaggguuuu

SEQ ID NO: 55191 - RNA, 19 nt, Homo sapiens
uggguagugaugagacaua

SEQ ID NO: 55192 - RNA, 21 nt, Homo sapiens
uggguaguuuucaaggccccg

SEQ ID NO: 55193 - RNA, 23 nt, Homo sapiens
ugggucaguuuuucugacaucau

SEQ ID NO: 55194 - RNA, 22 nt, Homo sapiens
ugguaagaaaaccauuauuagc

SEQ ID NO: 55195 - RNA, 22 nt, Homo sapiens
ugguacuguccuucuagauucc

SEQ ID NO: 55196 - RNA, 22 nt, Homo sapiens
uggucaaaucugaugugagaaa

SEQ ID NO: 55197 - RNA, 22 nt, Homo sapiens
uggucauggggcagcugacacu

SEQ ID NO: 55198 - RNA, 21 nt, Homo sapiens
uggucccuucagaucggauuu

SEQ ID NO: 55199 - RNA, 22 nt, Homo sapiens
uggugcuuaaauaaggcuuuca

SEQ ID NO: 55200 - RNA, 22 nt, Homo sapiens
ugguguccugucucugcgcuug

SEQ ID NO: 55201 - RNA, 22 nt, Homo sapiens
uguaaaucugguuaauuggaua

SEQ ID NO: 55202 - RNA, 22 nt, Homo sapiens
uguaagcagcagagacuauccu

SEQ ID NO: 55203 - RNA, 22 nt, Homo sapiens
uguacaugggacaggaggagag

SEQ ID NO: 55204 - RNA, 22 nt, Homo sapiens
uguagauauucuuucaguuuuu

SEQ ID NO: 55205 - RNA, 22 nt, Homo sapiens
uguauacauauguauguuuugu

SEQ ID NO: 55206 - RNA, 22 nt, Homo sapiens
uguauagaucugauucaucucc

SEQ ID NO: 55207 - RNA, 22 nt, Homo sapiens
uguauaguugagucaaguuuca

SEQ ID NO: 55208 - RNA, 22 nt, Homo sapiens
uguauguaaagacaggauaaca

SEQ ID NO: 55209 - RNA, 22 nt, Homo sapiens
uguauguugauguuauauucug

SEQ ID NO: 55210 - RNA, 22 nt, Homo sapiens
uguauuuguuguuaaauggaga

SEQ ID NO: 55211 - RNA, 22 nt, Homo sapiens
ugucaauauguaauaacugaau

SEQ ID NO: 55212 - RNA, 22 nt, Homo sapiens
ugucacugugaguuugacugcu

SEQ ID NO: 55213 - RNA, 22 nt, Homo sapiens
ugucaggaggguccagagaaaa

SEQ ID NO: 55214 - RNA, 22 nt, Homo sapiens
ugucauguagaaauuguccauu

SEQ ID NO: 55215 - RNA, 22 nt, Homo sapiens
ugucucaguucccuucucugga

SEQ ID NO: 55216 - RNA, 22 nt, Homo sapiens
ugucuggaguccauagaagugu

SEQ ID NO: 55217 - RNA, 22 nt, Homo sapiens
ugucuuggagaauccuggguuu

SEQ ID NO: 55218 - RNA, 22 nt, Homo sapiens
ugucuuguagacaauguauagu

SEQ ID NO: 55219 - RNA, 22 nt, Homo sapiens
ugucuuuguuaguuguccuagu

SEQ ID NO: 55220 - RNA, 19 nt, Homo sapiens
ugugacugguugucucgcu

SEQ ID NO: 55221 - RNA, 21 nt, Homo sapiens
ugugacuguugcauuugucgu

SEQ ID NO: 55222 - RNA, 22 nt, Homo sapiens
ugugcacauugugcagguugau

SEQ ID NO: 55223 - RNA, 22 nt, Homo sapiens
uguggcaaagucuugugaauau

SEQ ID NO: 55224 - RNA, 22 nt, Homo sapiens
uguggcuuuuucuuggcugagg

SEQ ID NO: 55225 - RNA, 22 nt, Homo sapiens
ugugguauuagguguaguaucu

SEQ ID NO: 55226 - RNA, 22 nt, Homo sapiens
uguguauaucacugcaugagug

SEQ ID NO: 55227 - RNA, 22 nt, Homo sapiens
uugcacagugguuuagagccug

SEQ ID NO: 55228 - RNA, 22 nt, Homo sapiens
uugcacauguugaaccagcaaa

SEQ ID NO: 55229 - RNA, 22 nt, Homo sapiens
uugcacauugauuuuguaucuu

SEQ ID NO: 55230 - RNA, 22 nt, Homo sapiens
uugcacauugcaccuuuuguau

SEQ ID NO: 55231 - RNA, 22 nt, Homo sapiens
uugcacuccagccuggaugaca

SEQ ID NO: 55232 - RNA, 22 nt, Homo sapiens
uugcacuuccgccugggugaca

SEQ ID NO: 55233 - RNA, 22 nt, Homo sapiens
uugcacuugcugaggagugauu

SEQ ID NO: 55234 - RNA, 22 nt, Homo sapiens
uugcauguacguacagagagag

SEQ ID NO: 55235 - RNA, 22 nt, Homo sapiens
uuggaaagagguguuuaugacu

SEQ ID NO: 55236 - RNA, 22 nt, Homo sapiens
uuggaaaugguaaaggguuaau

SEQ ID NO: 55237 - RNA, 22 nt, Homo sapiens
uuggaauuuuacuucuguaaga

SEQ ID NO: 55238 - RNA, 22 nt, Homo sapiens
uuggacuucuaacugacaugga

SEQ ID NO: 55239 - RNA, 22 nt, Homo sapiens
uuggagagugauauucagaugc

SEQ ID NO: 55240 - RNA, 22 nt, Homo sapiens
uuggaugauaaagaagccuaag

SEQ ID NO: 55241 - RNA, 22 nt, Homo sapiens
uuggcauugccaaacugucaac

SEQ ID NO: 55242 - RNA, 22 nt, Homo sapiens
uuggccauaugacuugcuuugg

SEQ ID NO: 55243 - RNA, 22 nt, Homo sapiens
uugggauggaacuuuucaguga

SEQ ID NO: 55244 - RNA, 22 nt, Homo sapiens
uugggcaauaggaagcaggugg

SEQ ID NO: 55245 - RNA, 22 nt, Homo sapiens
uugggcuugagggugcccaguc

SEQ ID NO: 55246 - RNA, 21 nt, Homo sapiens
uuggggaauggagagguuuuc

SEQ ID NO: 55247 - RNA, 22 nt, Homo sapiens
uuggggcacggccucuguugcc

SEQ ID NO: 55248 - RNA, 22 nt, Homo sapiens
uugguaagguggaugaugaaua

SEQ ID NO: 55249 - RNA, 22 nt, Homo sapiens
uugguccccuucaaccagcugu

SEQ ID NO: 55250 - RNA, 19 nt, Homo sapiens
uuggucccuuuggguucuu

SEQ ID NO: 55251 - RNA, 22 nt, Homo sapiens
uuguaacaugcuuucacuucag

SEQ ID NO: 55252 - RNA, 22 nt, Homo sapiens
uugucauuuucagaguguuacg

SEQ ID NO: 55253 - RNA, 22 nt, Homo sapiens
uuguccuccacauuugaucagu

SEQ ID NO: 55254 - RNA, 22 nt, Homo sapiens
uugugaaaaaccucucguggaa

SEQ ID NO: 55255 - RNA, 22 nt, Homo sapiens
uugugcaaaaguaauugcgguu

SEQ ID NO: 55256 - RNA, 22 nt, Homo sapiens
uugugcuuguaacuacauucag

SEQ ID NO: 55257 - RNA, 22 nt, Homo sapiens
uugugcuuuacuuacuaccaga

SEQ ID NO: 55258 - RNA, 22 nt, Homo sapiens
acugcacuccagccuuagugac

SEQ ID NO: 55259 - RNA, 22 nt, Homo sapiens
acugcacuccagccuucaggac

SEQ ID NO: 55260 - RNA, 22 nt, Homo sapiens
acugcacuccagccuucggaca

SEQ ID NO: 55261 - RNA, 22 nt, Homo sapiens
acugcacuccagccuucgugac

SEQ ID NO: 55262 - RNA, 22 nt, Homo sapiens
acugcacuccagccuuggcggc

SEQ ID NO: 55263 - RNA, 22 nt, Homo sapiens
acugcacuccagcuugggugac

SEQ ID NO: 55264 - RNA, 20 nt, Homo sapiens
acugcacuccaggcugccca

SEQ ID NO: 55265 - RNA, 18 nt, Homo sapiens
acugcacuccauccuagg

SEQ ID NO: 55266 - RNA, 22 nt, Homo sapiens
aggugaaugcucacauucuaau

SEQ ID NO: 55267 - RNA, 22 nt, Homo sapiens
aggugguauuucaaaguggcag

SEQ ID NO: 55268 - RNA, 21 nt, Homo sapiens
aggugucuuggguucccuggc

SEQ ID NO: 55269 - RNA, 22 nt, Homo sapiens
agguuaucccgcauuauuuggu

SEQ ID NO: 55270 - RNA, 22 nt, Homo sapiens
aguaaauuucugugcuuucaua

SEQ ID NO: 55271 - RNA, 22 nt, Homo sapiens
aguaagauggcaacucuccaca

SEQ ID NO: 55272 - RNA, 22 nt, Homo sapiens
aguacacuguuaaaaagaagug

SEQ ID NO: 55273 - RNA, 23 nt, Homo sapiens
aguacuguaguaauugaggggaa

SEQ ID NO: 55274 - RNA, 22 nt, Homo sapiens
agucacaugcauuuucuucaau

SEQ ID NO: 55275 - RNA, 22 nt, Homo sapiens
agucacaugccagcacacccag

SEQ ID NO: 55276 - RNA, 22 nt, Homo sapiens
agucagugucuguaaggagaac

SEQ ID NO: 55277 - RNA, 22 nt, Homo sapiens
agugcaaugauccggugcuggg

SEQ ID NO: 55278 - RNA, 22 nt, Homo sapiens
agugcacugcccgcuuccuguc

SEQ ID NO: 55279 - RNA, 22 nt, Homo sapiens
agugcuuguacaaaccccgagg

SEQ ID NO: 55280 - RNA, 22 nt, Homo sapiens
aguggaguguaaagcgucuuuu

SEQ ID NO: 55281 - RNA, 22 nt, Homo sapiens
aguggcacuauucucagaguca

SEQ ID NO: 55282 - RNA, 22 nt, Homo sapiens
agugucaggagacagguagcug

SEQ ID NO: 55283 - RNA, 19 nt, Homo sapiens
agugucauggucauuauuu

SEQ ID NO: 55284 - RNA, 22 nt, Homo sapiens
auaaagguaauaauaguugcau

SEQ ID NO: 55285 - RNA, 22 nt, Homo sapiens
auaaaugcaaugguauuuuuga

SEQ ID NO: 55286 - RNA, 22 nt, Homo sapiens
auaaaugcuuagaucuguauau

SEQ ID NO: 55287 - RNA, 22 nt, Homo sapiens
auaacucuguuuuuuucaugca

SEQ ID NO: 55288 - RNA, 22 nt, Homo sapiens
auaagauaguggaagugggauu

SEQ ID NO: 55289 - RNA, 22 nt, Homo sapiens
auaagcuaagaguuucugggcu

SEQ ID NO: 55290 - RNA, 22 nt, Homo sapiens
auaaguauuuggacuuuacugu

SEQ ID NO: 55291 - RNA, 22 nt, Homo sapiens
auaauacugggaagaugagcau

SEQ ID NO: 55292 - RNA, 19 nt, Homo sapiens
auacacguguauacauaca

SEQ ID NO: 55293 - RNA, 22 nt, Homo sapiens
auacaguguucugggaagaagu

SEQ ID NO: 55294 - RNA, 22 nt, Homo sapiens
auacaugugccaugcuggugug

SEQ ID NO: 55295 - RNA, 21 nt, Homo sapiens
auacuugagacuggguaauuu

SEQ ID NO: 55296 - RNA, 22 nt, Homo sapiens
auagaaucaucugugcacuagu

SEQ ID NO: 55297 - RNA, 22 nt, Homo sapiens
auagcagaacagugucucacug

SEQ ID NO: 55298 - RNA, 22 nt, Homo sapiens
auagcagcuugucagggcagac

SEQ ID NO: 55299 - RNA, 22 nt, Homo sapiens
auagcagugugaaaauugacug

SEQ ID NO: 55300 - RNA, 22 nt, Homo sapiens
auaggucaucaugggaguggga

SEQ ID NO: 55301 - RNA, 22 nt, Homo sapiens
auagucaaaucucauuaccccc

SEQ ID NO: 55302 - RNA, 17 nt, Homo sapiens
auaugaauuuuggagau

SEQ ID NO: 55303 - RNA, 22 nt, Homo sapiens
auaugcacaguggaguacuauu

SEQ ID NO: 55304 - RNA, 22 nt, Homo sapiens
auaugcuaauuuuuagucgagc

SEQ ID NO: 55305 - RNA, 22 nt, Homo sapiens
auauguauuuuaacguguaagg

SEQ ID NO: 55306 - RNA, 22 nt, Homo sapiens
aucaaaguaggcauauguuuuu

SEQ ID NO: 55307 - RNA, 22 nt, Homo sapiens
aucacagaacuuugagcagaga

SEQ ID NO: 55308 - RNA, 22 nt, Homo sapiens
aucacagaguuaaaacuuucuu

SEQ ID NO: 55309 - RNA, 22 nt, Homo sapiens
aucacagauauggguuuaaauc

SEQ ID NO: 55310 - RNA, 22 nt, Homo sapiens
aucacagugagcauaugucuau

SEQ ID NO: 55311 - RNA, 22 nt, Homo sapiens
aucacaguuauaacauccuuuu

SEQ ID NO: 55312 - RNA, 22 nt, Homo sapiens
aucacuggccuuuuuaaaugcu

SEQ ID NO: 55313 - RNA, 22 nt, Homo sapiens
aucacugggcaagauaucauga

SEQ ID NO: 55314 - RNA, 22 nt, Homo sapiens
aucacuguccacucaucuuucu

SEQ ID NO: 55315 - RNA, 22 nt, Homo sapiens
aucacuuugcucuccagugugg

SEQ ID NO: 55316 - RNA, 22 nt, Homo sapiens
aucagcaugcagaagucggggg

SEQ ID NO: 55317 - RNA, 22 nt, Homo sapiens
aucaggcacacauuggaguuug

SEQ ID NO: 55318 - RNA, 22 nt, Homo sapiens
aucauguaguaagacacauuua

SEQ ID NO: 55319 - RNA, 22 nt, Homo sapiens
aucauugugcaucuucauucca

SEQ ID NO: 55320 - RNA, 22 nt, Homo sapiens
auccaucagacggcaggcguug

SEQ ID NO: 55321 - RNA, 22 nt, Homo sapiens
aucccugagaacuuuuaauguu

SEQ ID NO: 55322 - RNA, 22 nt, Homo sapiens
auccugaagcuuuacugaauuc

SEQ ID NO: 55323 - RNA, 22 nt, Homo sapiens
aucuacagccagucugguuugu

SEQ ID NO: 55324 - RNA, 22 nt, Homo sapiens
aucucauggagguagagaguaa

SEQ ID NO: 55325 - RNA, 22 nt, Homo sapiens
aucucauuccuucugggcugau

SEQ ID NO: 55326 - RNA, 22 nt, Homo sapiens
aucugcaaagcugggcugagac

SEQ ID NO: 55327 - RNA, 22 nt, Homo sapiens
aucugcaaauaaugaagauugg

SEQ ID NO: 55328 - RNA, 22 nt, Homo sapiens
aucuggguccguucugcuucuc

SEQ ID NO: 55329 - RNA, 22 nt, Homo sapiens
aucuuuggucaucacagcuaga

SEQ ID NO: 55330 - RNA, 22 nt, Homo sapiens
augaaaacaugauuugccuguu

SEQ ID NO: 55331 - RNA, 23 nt, Homo sapiens
augaaagcccuugcaaaugcugg

SEQ ID NO: 55332 - RNA, 22 nt, Homo sapiens
augaaaucuuuggcagaucuua

SEQ ID NO: 55333 - RNA, 22 nt, Homo sapiens
augaacagagccuugagaaccu

SEQ ID NO: 55334 - RNA, 20 nt, Homo sapiens
augaauguccuugauggcau

SEQ ID NO: 55335 - RNA, 22 nt, Homo sapiens
augacacugcagagauguccca

SEQ ID NO: 55336 - RNA, 22 nt, Homo sapiens
augacauugaaaagcaagugga

SEQ ID NO: 55337 - RNA, 22 nt, Homo sapiens
augacguugugggcucucaagc

SEQ ID NO: 55338 - RNA, 22 nt, Homo sapiens
augagacuagaagagaauaaua

SEQ ID NO: 55339 - RNA, 21 nt, Homo sapiens
augagauguuagacuuuagac

SEQ ID NO: 55340 - RNA, 22 nt, Homo sapiens
augagggagggguggugccgca

SEQ ID NO: 55341 - RNA, 22 nt, Homo sapiens
augauacugaguugaguucuca

SEQ ID NO: 55342 - RNA, 22 nt, Homo sapiens
augaucauggaaguuuuccugu

SEQ ID NO: 55343 - RNA, 22 nt, Homo sapiens
augcacaugcgaaaacuugugu

SEQ ID NO: 55344 - RNA, 22 nt, Homo sapiens
caucacauucugagauacugag

SEQ ID NO: 55345 - RNA, 22 nt, Homo sapiens
caucagagugagauauaagauc

SEQ ID NO: 55346 - RNA, 22 nt, Homo sapiens
caugcacugaguccaccucugg

SEQ ID NO: 55347 - RNA, 22 nt, Homo sapiens
caugcagcacacaugucugugc

SEQ ID NO: 55348 - RNA, 22 nt, Homo sapiens
caugccauugcucuccugggug

SEQ ID NO: 55349 - RNA, 22 nt, Homo sapiens
cauggcucuuugcugcuaaagu

SEQ ID NO: 55350 - RNA, 22 nt, Homo sapiens
cauguaguagaaggagccagac

SEQ ID NO: 55351 - RNA, 21 nt, Homo sapiens
caugucacugcacucuagccu

SEQ ID NO: 55352 - RNA, 22 nt, Homo sapiens
caugucacuuccucucugaugg

SEQ ID NO: 55353 - RNA, 23 nt, Homo sapiens
aaauuugccuauuauuccuaugg

SEQ ID NO: 55354 - RNA, 22 nt, Homo sapiens
aacagaauccucuuuuccuggg

SEQ ID NO: 55355 - RNA, 22 nt, Homo sapiens
aacagacugucacauaaaauug

SEQ ID NO: 55356 - RNA, 22 nt, Homo sapiens
aacaggguguuugcaguuucuu

SEQ ID NO: 55357 - RNA, 22 nt, Homo sapiens
aacaguaucuaacgagugauga

SEQ ID NO: 55358 - RNA, 21 nt, Homo sapiens
aacagugcugaacagacaccu

SEQ ID NO: 55359 - RNA, 22 nt, Homo sapiens
aacagugcuguuauaaauguac

SEQ ID NO: 55360 - RNA, 22 nt, Homo sapiens
aacauguuuagcagauaccugu

SEQ ID NO: 55361 - RNA, 22 nt, Homo sapiens
aaccacauggcucaguggacau

SEQ ID NO: 55362 - RNA, 22 nt, Homo sapiens
aacucugucuccuucaaguuca

SEQ ID NO: 55363 - RNA, 22 nt, Homo sapiens
aacugcacauauuuguaugggu

SEQ ID NO: 55364 - RNA, 22 nt, Homo sapiens
aacugcacuaggacagguuuuu

SEQ ID NO: 55365 - RNA, 22 nt, Homo sapiens
aacuggcauagccagacuucuc

SEQ ID NO: 55366 - RNA, 21 nt, Homo sapiens
aacuggugugagaugguaugu

SEQ ID NO: 55367 - RNA, 20 nt, Homo sapiens
aagacacuguccccacugga

SEQ ID NO: 55368 - RNA, 22 nt, Homo sapiens
aagagcauuauuuaguaauuuc

SEQ ID NO: 55369 - RNA, 18 nt, Homo sapiens
aagagcucagcacagguu

SEQ ID NO: 55370 - RNA, 22 nt, Homo sapiens
aagagguaauaacaaagcuucu

SEQ ID NO: 55371 - RNA, 22 nt, Homo sapiens
aagagguagaagcuugccuucu

SEQ ID NO: 55372 - RNA, 22 nt, Homo sapiens
aagagguaggaaauggucauuu

SEQ ID NO: 55373 - RNA, 22 nt, Homo sapiens
aagagguagucugucccuuagc

SEQ ID NO: 55374 - RNA, 20 nt, Homo sapiens
aagcaagcauuugcaaucau

SEQ ID NO: 55375 - RNA, 22 nt, Homo sapiens
aagcauccagcauggaacugaa

SEQ ID NO: 55376 - RNA, 20 nt, Homo sapiens
aagcauggguuuuaggguca

SEQ ID NO: 55377 - RNA, 22 nt, Homo sapiens
aagcaugguuuccaggggucac

SEQ ID NO: 55378 - RNA, 22 nt, Homo sapiens
aagcuacauuuuauuuauguca

SEQ ID NO: 55379 - RNA, 20 nt, Homo sapiens
aagcugaguguuuuuuuaau

SEQ ID NO: 55380 - RNA, 22 nt, Homo sapiens
aagcugccuugcugaggagaaa

SEQ ID NO: 55381 - RNA, 22 nt, Homo sapiens
aagcuguguguaagcucucaca

SEQ ID NO: 55382 - RNA, 22 nt, Homo sapiens
aaggcuauuugagaaugugugu

SEQ ID NO: 55383 - RNA, 22 nt, Homo sapiens
aagguggugucagagagcuuau

SEQ ID NO: 55384 - RNA, 22 nt, Homo sapiens
aagguguagucucuggauaagc

SEQ ID NO: 55385 - RNA, 22 nt, Homo sapiens
aaguagugcuugugcucaucuc

SEQ ID NO: 55386 - RNA, 22 nt, Homo sapiens
aaguaguuaggaacauucucuc

SEQ ID NO: 55387 - RNA, 22 nt, Homo sapiens
aaguccccugacagaggggagg

SEQ ID NO: 55388 - RNA, 22 nt, Homo sapiens
aagugguagggucaggauugga

SEQ ID NO: 55389 - RNA, 22 nt, Homo sapiens
aauaagcugagagaauucuaca

SEQ ID NO: 55390 - RNA, 19 nt, Homo sapiens
aauauugacaguggugucu

SEQ ID NO: 55391 - RNA, 22 nt, Homo sapiens
aaucacagccagcuuccgcuau

SEQ ID NO: 55392 - RNA, 22 nt, Homo sapiens
aaucauggaguauuuguccuug

SEQ ID NO: 55393 - RNA, 22 nt, Homo sapiens
aaucccugagcuagacacaaag

SEQ ID NO: 55394 - RNA, 22 nt, Homo sapiens
aaugacagugcuaaagaacccu

SEQ ID NO: 55395 - RNA, 22 nt, Homo sapiens
aauggcuuuuaauauccauaau

SEQ ID NO: 55396 - RNA, 22 nt, Homo sapiens
aaugugcuucuggcugugguca

SEQ ID NO: 55397 - RNA, 22 nt, Homo sapiens
aaugugcuuucuuucacacagu

SEQ ID NO: 55398 - RNA, 22 nt, Homo sapiens
aaugugcuuugaaaagagcuga

SEQ ID NO: 55399 - RNA, 22 nt, Homo sapiens
acaaaguauggaauguuggugu

SEQ ID NO: 55400 - RNA, 22 nt, Homo sapiens
acaagcacaaaugcauagaugg

SEQ ID NO: 55401 - RNA, 22 nt, Homo sapiens
acaagcacaaauuuaauccugu

SEQ ID NO: 55402 - RNA, 22 nt, Homo sapiens
acacaugugaaaaaaauguuac

SEQ ID NO: 55403 - RNA, 22 nt, Homo sapiens
acacaugugcguagacucuuua

SEQ ID NO: 55404 - RNA, 22 nt, Homo sapiens
acacuguugacauuuuguagug

SEQ ID NO: 55405 - RNA, 22 nt, Homo sapiens
acacuguuuuaguuauuauagc

SEQ ID NO: 55406 - RNA, 19 nt, Homo sapiens
acagauagaauguucuaca

SEQ ID NO: 55407 - RNA, 20 nt, Homo sapiens
acagcauagccuuuuaaagc

SEQ ID NO: 55408 - RNA, 21 nt, Homo sapiens
acaguacuugagaucuuuuga

SEQ ID NO: 55409 - RNA, 20 nt, Homo sapiens
acaguagaagggauuucaaa

SEQ ID NO: 55410 - RNA, 18 nt, Homo sapiens
acagugucuuacaccugu

SEQ ID NO: 55411 - RNA, 22 nt, Homo sapiens
acaguguuccuuuguugugacu

SEQ ID NO: 55412 - RNA, 22 nt, Homo sapiens
acauaugaguacaugugccaug

SEQ ID NO: 55413 - RNA, 21 nt, Homo sapiens
acaucagaguugugaagguag

SEQ ID NO: 55414 - RNA, 22 nt, Homo sapiens
acaucaggcuugugaugauuac

SEQ ID NO: 55415 - RNA, 23 nt, Homo sapiens
acauguauagacuuuuuuuccuu

SEQ ID NO: 55416 - RNA, 22 nt, Homo sapiens
acauguauauaaugcauagcga

SEQ ID NO: 55417 - RNA, 22 nt, Homo sapiens
accaccauugcacugaacuuuc

SEQ ID NO: 55418 - RNA, 22 nt, Homo sapiens
acccucagaccaguuucccugg

SEQ ID NO: 55419 - RNA, 22 nt, Homo sapiens
acccuggaggucuacagugcag

SEQ ID NO: 55420 - RNA, 22 nt, Homo sapiens
acccugucagcuggccugggca

SEQ ID NO: 55421 - RNA, 22 nt, Homo sapiens
acccuuuagguuggaugaggau

SEQ ID NO: 55422 - RNA, 18 nt, Homo sapiens
acucuguauguggagugg

SEQ ID NO: 55423 - RNA, 22 nt, Homo sapiens
acucugucuaguuguaaaauuu

SEQ ID NO: 55424 - RNA, 23 nt, Homo sapiens
acugcaauuacguuugcaccaac

SEQ ID NO: 55425 - RNA, 22 nt, Homo sapiens
acugcacuccagcccaggugac

SEQ ID NO: 55426 - RNA, 22 nt, Homo sapiens
acugcacuccagccuccugggu

SEQ ID NO: 55427 - RNA, 22 nt, Homo sapiens
acugcacuccagccucgcaaca

SEQ ID NO: 55428 - RNA, 22 nt, Homo sapiens
acugcacuccagccucggugac

SEQ ID NO: 55429 - RNA, 22 nt, Homo sapiens
acugcacuccagccucgugaca

SEQ ID NO: 55430 - RNA, 22 nt, Homo sapiens
acugcacuccagccugcccaac

SEQ ID NO: 55431 - RNA, 22 nt, Homo sapiens
acugcacuccagccugccgaca

SEQ ID NO: 55432 - RNA, 22 nt, Homo sapiens
acugcacuccagccugcuggau

SEQ ID NO: 55433 - RNA, 22 nt, Homo sapiens
acugcacuccagccuggaccac

SEQ ID NO: 55434 - RNA, 22 nt, Homo sapiens
acugcacuccagccugugcgua

SEQ ID NO: 55435 - RNA, 22 nt, Homo sapiens
acugcacuccagccuguugaca

SEQ ID NO: 55436 - RNA, 22 nt, Homo sapiens
cuauggcuguaaggauaguaac

SEQ ID NO: 55437 - RNA, 22 nt, Homo sapiens
cuauggcuguagucccugugua

SEQ ID NO: 55438 - RNA, 22 nt, Homo sapiens
cucaaaguguggucuguggguu

SEQ ID NO: 55439 - RNA, 22 nt, Homo sapiens
cucaaguagugguuuucauuga

SEQ ID NO: 55440 - RNA, 18 nt, Homo sapiens
cucacaguaacuuuuaag

SEQ ID NO: 55441 - RNA, 22 nt, Homo sapiens
cucacagucagaagggacuugc

SEQ ID NO: 55442 - RNA, 22 nt, Homo sapiens
cucacugugguguccuuaggua

SEQ ID NO: 55443 - RNA, 22 nt, Homo sapiens
cucagucuaugauacuuugcua

SEQ ID NO: 55444 - RNA, 22 nt, Homo sapiens
cucaguggauuagauaaugcac

SEQ ID NO: 55445 - RNA, 22 nt, Homo sapiens
cucaguguuucagcugcucaga

SEQ ID NO: 55446 - RNA, 22 nt, Homo sapiens
cucaguuuugccuuguuuaagg

SEQ ID NO: 55447 - RNA, 22 nt, Homo sapiens
cuccaguacagagagguuccuc

SEQ ID NO: 55448 - RNA, 22 nt, Homo sapiens
cuccagugcaaagucaugauca

SEQ ID NO: 55449 - RNA, 22 nt, Homo sapiens
cucucuguuugucuguuauugg

SEQ ID NO: 55450 - RNA, 20 nt, Homo sapiens
cucugguugugaauugucuu

SEQ ID NO: 55451 - RNA, 22 nt, Homo sapiens
cucugguuuuucuuccauuaag

SEQ ID NO: 55452 - RNA, 22 nt, Homo sapiens
cucuuuuguuccuaguuugauc

SEQ ID NO: 55453 - RNA, 22 nt, Homo sapiens
cugaagugcuugccacauaaaa

SEQ ID NO: 55454 - RNA, 22 nt, Homo sapiens
cugacuaguuuuaaugcagauu

SEQ ID NO: 55455 - RNA, 22 nt, Homo sapiens
cugagaagaaacagguaaggac

SEQ ID NO: 55456 - RNA, 22 nt, Homo sapiens
cugagagaggagcuaaaacugc

SEQ ID NO: 55457 - RNA, 22 nt, Homo sapiens
cugagauacacuaauagucucu

SEQ ID NO: 55458 - RNA, 22 nt, Homo sapiens
cugagaucugaaccaggagugu

SEQ ID NO: 55459 - RNA, 18 nt, Homo sapiens
cugagcacugcuuuauga

SEQ ID NO: 55460 - RNA, 22 nt, Homo sapiens
cugagcccauucuggggagaag

SEQ ID NO: 55461 - RNA, 22 nt, Homo sapiens
cugaggacaucagggaagcauc

SEQ ID NO: 55462 - RNA, 22 nt, Homo sapiens
cugaucuaugaacacaggauau

SEQ ID NO: 55463 - RNA, 22 nt, Homo sapiens
cugauuuguccccagccucaug

SEQ ID NO: 55464 - RNA, 22 nt, Homo sapiens
cugcaagaugcauaggaauuuu

SEQ ID NO: 55465 - RNA, 20 nt, Homo sapiens
cugcacauccacucuacuuc

SEQ ID NO: 55466 - RNA, 22 nt, Homo sapiens
cugcacugagacccucuuugcu

SEQ ID NO: 55467 - RNA, 18 nt, Homo sapiens
cugccagugugcucuccg

SEQ ID NO: 55468 - RNA, 22 nt, Homo sapiens
cugguaagaaggucuaagucaa

SEQ ID NO: 55469 - RNA, 21 nt, Homo sapiens
cugguguuagcacuucuuccc

SEQ ID NO: 55470 - RNA, 22 nt, Homo sapiens
cuguaauguaaugagacuacau

SEQ ID NO: 55471 - RNA, 22 nt, Homo sapiens
cugucuagagggcacaugaugc

SEQ ID NO: 55472 - RNA, 22 nt, Homo sapiens
cugugacugcagggcauauuug

SEQ ID NO: 55473 - RNA, 17 nt, Homo sapiens
cugugaugaucuugucu

SEQ ID NO: 55474 - RNA, 22 nt, Homo sapiens
cugugcuaggcaaugugguaga

SEQ ID NO: 55475 - RNA, 22 nt, Homo sapiens
cugugguauuauuagaaauauc

SEQ ID NO: 55476 - RNA, 22 nt, Homo sapiens
cugugguuacguucuuugugcu

SEQ ID NO: 55477 - RNA, 22 nt, Homo sapiens
cuguugcaguuauggcugcagg

SEQ ID NO: 55478 - RNA, 22 nt, Homo sapiens
cuucacuggagucccuggauuc

SEQ ID NO: 55479 - RNA, 20 nt, Homo sapiens
cuugaagacuaugcugcuga

SEQ ID NO: 55480 - RNA, 22 nt, Homo sapiens
cuuggcauuguguugauagaag

SEQ ID NO: 55481 - RNA, 22 nt, Homo sapiens
cuuguacacuguuggugggaau

SEQ ID NO: 55482 - RNA, 22 nt, Homo sapiens
cuuuccauuguuggagcauaaa

SEQ ID NO: 55483 - RNA, 23 nt, Homo sapiens
cuuuguacagcuugacuacuggg

SEQ ID NO: 55484 - RNA, 22 nt, Homo sapiens
cuuuugugauucuucaguuacu

SEQ ID NO: 55485 - RNA, 22 nt, Homo sapiens
gaaagauuuccugagcuagaaa

SEQ ID NO: 55486 - RNA, 22 nt, Homo sapiens
gaaagugcugcuugacugggau

SEQ ID NO: 55487 - RNA, 22 nt, Homo sapiens
gaaauguugauagugggcauug

SEQ ID NO: 55488 - RNA, 22 nt, Homo sapiens
gaacccuggaggcggagguugc

SEQ ID NO: 55489 - RNA, 22 nt, Homo sapiens
gaagaacuaggugagaucuaga

SEQ ID NO: 55490 - RNA, 22 nt, Homo sapiens
gaagguaguuuauagauguggu

SEQ ID NO: 55491 - RNA, 22 nt, Homo sapiens
gaaguaguaaaauuuauugcag

SEQ ID NO: 55492 - RNA, 22 nt, Homo sapiens
gaaucacaguuauuagagcagc

SEQ ID NO: 55493 - RNA, 22 nt, Homo sapiens
gaauucugucgcuuacuagaug

SEQ ID NO: 55494 - RNA, 22 nt, Homo sapiens
gacacuggguguuuguuggcgu

SEQ ID NO: 55495 - RNA, 22 nt, Homo sapiens
gacacugucuucugcucuuaaa

SEQ ID NO: 55496 - RNA, 22 nt, Homo sapiens
gacucagaacuaaggguguuuc

SEQ ID NO: 55497 - RNA, 22 nt, Homo sapiens
gacugaguaagcagaagcaauu

SEQ ID NO: 55498 - RNA, 22 nt, Homo sapiens
gacuggagcuguaugugguuac

SEQ ID NO: 55499 - RNA, 20 nt, Homo sapiens
gacuugagagugggagagua

SEQ ID NO: 55500 - RNA, 22 nt, Homo sapiens
gagaacuaaugauguacuaggc

SEQ ID NO: 55501 - RNA, 22 nt, Homo sapiens
gagaagugcgucguuugaugau

SEQ ID NO: 55502 - RNA, 21 nt, Homo sapiens
gagaaucuuuucagggcaaac

SEQ ID NO: 55503 - RNA, 22 nt, Homo sapiens
gagauacacccagugcagaggc

SEQ ID NO: 55504 - RNA, 22 nt, Homo sapiens
gagauagguauuucauuuaccc

SEQ ID NO: 55505 - RNA, 22 nt, Homo sapiens
gagaucauucugauccagaguc

SEQ ID NO: 55506 - RNA, 22 nt, Homo sapiens
gagaugaugagauguucacagu

SEQ ID NO: 55507 - RNA, 22 nt, Homo sapiens
gagaugucuauuucagagaugu

SEQ ID NO: 55508 - RNA, 22 nt, Homo sapiens
gagaugugguucaaggguguuu

SEQ ID NO: 55509 - RNA, 22 nt, Homo sapiens
gagauguuuguuucacugucac

SEQ ID NO: 55510 - RNA, 22 nt, Homo sapiens
gagcaaaaguauguauugguua

SEQ ID NO: 55511 - RNA, 22 nt, Homo sapiens
gagcaacaguggcagugguggg

SEQ ID NO: 55512 - RNA, 22 nt, Homo sapiens
gagcugaucuuuauguaaauuc

SEQ ID NO: 55513 - RNA, 22 nt, Homo sapiens
gagcugaucuuuucugauucca

SEQ ID NO: 55514 - RNA, 22 nt, Homo sapiens
gagguaaguaagaauggcaagc

SEQ ID NO: 55515 - RNA, 17 nt, Homo sapiens
gagguaguuuacuuuca

SEQ ID NO: 55516 - RNA, 22 nt, Homo sapiens
gagguggugguggaggcauagc

SEQ ID NO: 55517 - RNA, 23 nt, Homo sapiens
gaguggagacucauugauuuccu

SEQ ID NO: 55518 - RNA, 22 nt, Homo sapiens
gaguuagguugucaaugucuua

SEQ ID NO: 55519 - RNA, 22 nt, Homo sapiens
gaguuguuuuaaggcacugacu

SEQ ID NO: 55520 - RNA, 22 nt, Homo sapiens
gauaaagauagcaauagggaca

SEQ ID NO: 55521 - RNA, 22 nt, Homo sapiens
gauacaguaugcaugugguauu

SEQ ID NO: 55522 - RNA, 22 nt, Homo sapiens
cucuuuuguuuagcugagaggg

SEQ ID NO: 55523 - RNA, 22 nt, Homo sapiens
cugaaauguccaucgacugaug

SEQ ID NO: 55524 - RNA, 20 nt, Homo sapiens
cugaaugucaaggcagaggu

SEQ ID NO: 55525 - RNA, 22 nt, Homo sapiens
cugaauguccaggcagagguuu

SEQ ID NO: 55526 - RNA, 22 nt, Homo sapiens
cugaauguucuauagaagccgc

SEQ ID NO: 55527 - RNA, 22 nt, Homo sapiens
cugaauguuucacucugaaaug

SEQ ID NO: 55528 - RNA, 22 nt, Homo sapiens
gcucaugggcagugugauuguu

SEQ ID NO: 55529 - RNA, 22 nt, Homo sapiens
gcugagacauugguuuucuccu

SEQ ID NO: 55530 - RNA, 22 nt, Homo sapiens
gcugcuguuuaguuucuccugg

SEQ ID NO: 55531 - RNA, 22 nt, Homo sapiens
gcugucuggagucuguucaaug

SEQ ID NO: 55532 - RNA, 22 nt, Homo sapiens
gcuguguugugcccagcaucau

SEQ ID NO: 55533 - RNA, 22 nt, Homo sapiens
gcuuuguuguugaugggaaauc

SEQ ID NO: 55534 - RNA, 23 nt, Homo sapiens
ggaaacauccagucuuucaccau

SEQ ID NO: 55535 - RNA, 22 nt, Homo sapiens
ggaagccugcacucgggcaggg

SEQ ID NO: 55536 - RNA, 19 nt, Homo sapiens
ggaaugcaccaguccuugc

SEQ ID NO: 55537 - RNA, 22 nt, Homo sapiens
ggacagugaaugccacuccucc

SEQ ID NO: 55538 - RNA, 22 nt, Homo sapiens
ggacuagaucucccggcuucua

SEQ ID NO: 55539 - RNA, 22 nt, Homo sapiens
ggacuagggacauggggagcug

SEQ ID NO: 55540 - RNA, 22 nt, Homo sapiens
ggagcucaucuagcauagaggu

SEQ ID NO: 55541 - RNA, 22 nt, Homo sapiens
ggagguaauaaguuccagugua

SEQ ID NO: 55542 - RNA, 17 nt, Homo sapiens
ggcaagaaguggaacuc

SEQ ID NO: 55543 - RNA, 22 nt, Homo sapiens
ggcaagugucagcagcaacacc

SEQ ID NO: 55544 - RNA, 19 nt, Homo sapiens
ggcaauacuuucuuguugg

SEQ ID NO: 55545 - RNA, 22 nt, Homo sapiens
ggcaauauauucugaauucagu

SEQ ID NO: 55546 - RNA, 22 nt, Homo sapiens
ggcaccauggaaggacgggagc

SEQ ID NO: 55547 - RNA, 22 nt, Homo sapiens
ggcaccauuuuacuccuucccu

SEQ ID NO: 55548 - RNA, 17 nt, Homo sapiens
ggcaggauccaggaucc

SEQ ID NO: 55549 - RNA, 21 nt, Homo sapiens
ggcauugugcccuugcucuag

SEQ ID NO: 55550 - RNA, 22 nt, Homo sapiens
ggcuagaugcuagagauaucau

SEQ ID NO: 55551 - RNA, 21 nt, Homo sapiens
ggcucuguggucucagguuuc

SEQ ID NO: 55552 - RNA, 22 nt, Homo sapiens
ggcuuggaggaaugugagggcu

SEQ ID NO: 55553 - RNA, 22 nt, Homo sapiens
ggcuuuggucacacaggggcaa

SEQ ID NO: 55554 - RNA, 22 nt, Homo sapiens
gggaaaaugucuauugaaugaa

SEQ ID NO: 55555 - RNA, 18 nt, Homo sapiens
gggcaaguugccuggcuu

SEQ ID NO: 55556 - RNA, 22 nt, Homo sapiens
ggugaggaaaguugaguuucua

SEQ ID NO: 55557 - RNA, 22 nt, Homo sapiens
ggugcuugaggaacggaggcug

SEQ ID NO: 55558 - RNA, 22 nt, Homo sapiens
guaaauaccaguuucuggaaca

SEQ ID NO: 55559 - RNA, 22 nt, Homo sapiens
guaauagucucaaacuccugga

SEQ ID NO: 55560 - RNA, 22 nt, Homo sapiens
guacacguggcuguguaggagu

SEQ ID NO: 55561 - RNA, 22 nt, Homo sapiens
guacaguacugaaugaauguau

SEQ ID NO: 55562 - RNA, 22 nt, Homo sapiens
guacauguaugcaugcaugcau

SEQ ID NO: 55563 - RNA, 22 nt, Homo sapiens
guagcagaauaucagauaauuu

SEQ ID NO: 55564 - RNA, 22 nt, Homo sapiens
gucaacauauuaauuauguucu

SEQ ID NO: 55565 - RNA, 22 nt, Homo sapiens
gucacuggcugucuuguaugau

SEQ ID NO: 55566 - RNA, 22 nt, Homo sapiens
gucagcuuguccagagacucug

SEQ ID NO: 55567 - RNA, 22 nt, Homo sapiens
gucagggagggauagaugauua

SEQ ID NO: 55568 - RNA, 22 nt, Homo sapiens
gucagugucuuaacagagauua

SEQ ID NO: 55569 - RNA, 22 nt, Homo sapiens
gucauggacaaggugugagcca

SEQ ID NO: 55570 - RNA, 22 nt, Homo sapiens
gucauuguguggacauggagaa

SEQ ID NO: 55571 - RNA, 22 nt, Homo sapiens
guccaguacucuuuccugaaaa

SEQ ID NO: 55572 - RNA, 22 nt, Homo sapiens
gucccugaggaacauccagggc

SEQ ID NO: 55573 - RNA, 22 nt, Homo sapiens
gucucacagcuagcugcuuuau

SEQ ID NO: 55574 - RNA, 22 nt, Homo sapiens
gucucugguugcuuuuguacca

SEQ ID NO: 55575 - RNA, 22 nt, Homo sapiens
gucugagcauggggccggcagg

SEQ ID NO: 55576 - RNA, 22 nt, Homo sapiens
gucuggguuuguuuguacuugc

SEQ ID NO: 55577 - RNA, 22 nt, Homo sapiens
gucuuccagccuccaucuuucu

SEQ ID NO: 55578 - RNA, 22 nt, Homo sapiens
gucuuuaguugaaacauguggu

SEQ ID NO: 55579 - RNA, 22 nt, Homo sapiens
gugaaaagaugagcaccauaca

SEQ ID NO: 55580 - RNA, 22 nt, Homo sapiens
gugaauguuuucuuacauggua

SEQ ID NO: 55581 - RNA, 22 nt, Homo sapiens
gugacauuauuucagcuacaug

SEQ ID NO: 55582 - RNA, 22 nt, Homo sapiens
gugacauuuuuacugaugagag

SEQ ID NO: 55583 - RNA, 22 nt, Homo sapiens
gugaggaaggaaaccugcuagc

SEQ ID NO: 55584 - RNA, 22 nt, Homo sapiens
gugcaauguuaauuacuugacu

SEQ ID NO: 55585 - RNA, 22 nt, Homo sapiens
gugcauguccacuaguccauau

SEQ ID NO: 55586 - RNA, 22 nt, Homo sapiens
gugccacaguguuaagggauuc

SEQ ID NO: 55587 - RNA, 22 nt, Homo sapiens
gugcuaggugcuaggaagauag

SEQ ID NO: 55588 - RNA, 22 nt, Homo sapiens
guggaaaacauaugcuuguuga

SEQ ID NO: 55589 - RNA, 22 nt, Homo sapiens
guggaagcacaggccuccugga

SEQ ID NO: 55590 - RNA, 22 nt, Homo sapiens
guggagucaucacucagagugg

SEQ ID NO: 55591 - RNA, 22 nt, Homo sapiens
guggcagugugaggauccugcu

SEQ ID NO: 55592 - RNA, 22 nt, Homo sapiens
gugggauggagagaagguauga

SEQ ID NO: 55593 - RNA, 22 nt, Homo sapiens
gugggguaggaggaguacuucc

SEQ ID NO: 55594 - RNA, 22 nt, Homo sapiens
gugggguaggcaauuccuagug

SEQ ID NO: 55595 - RNA, 22 nt, Homo sapiens
guggucagaaaucucaguggca

SEQ ID NO: 55596 - RNA, 22 nt, Homo sapiens
gugguucuagaauugaguaucc

SEQ ID NO: 55597 - RNA, 22 nt, Homo sapiens
guguauauccuauuaguucugu

SEQ ID NO: 55598 - RNA, 22 nt, Homo sapiens
guguaugugagaaugcucaugu

SEQ ID NO: 55599 - RNA, 22 nt, Homo sapiens
gugucacugugaggauauugua

SEQ ID NO: 55600 - RNA, 18 nt, Homo sapiens
gugucugguuaugggagu

SEQ ID NO: 55601 - RNA, 22 nt, Homo sapiens
guuacugucuuccugauugcuu

SEQ ID NO: 55602 - RNA, 22 nt, Homo sapiens
guuauugcucucgaagacucuc

SEQ ID NO: 55603 - RNA, 22 nt, Homo sapiens
guuauuguccauuuauuuagca

SEQ ID NO: 55604 - RNA, 20 nt, Homo sapiens
guucacagagguuaugauua

SEQ ID NO: 55605 - RNA, 22 nt, Homo sapiens
guugaucuauguugcuggcagu

SEQ ID NO: 55606 - RNA, 22 nt, Homo sapiens
guugcaaaguaauugugguuuu

SEQ ID NO: 55607 - RNA, 22 nt, Homo sapiens
ugaauaggcaguuaaguuuaug

SEQ ID NO: 55608 - RNA, 22 nt, Homo sapiens
ugaauguaagaugucugcuggu

SEQ ID NO: 55609 - RNA, 22 nt, Homo sapiens
ugaauguccauugauguuuuga

SEQ ID NO: 55610 - RNA, 22 nt, Homo sapiens
ugaaugugauggguuucaugug

SEQ ID NO: 55611 - RNA, 22 nt, Homo sapiens
ugacaagaguagagagggugcc

SEQ ID NO: 55612 - RNA, 22 nt, Homo sapiens
ugacacagugggggauccuuuu

SEQ ID NO: 55613 - RNA, 22 nt, Homo sapiens
ugacaggagauuaugugauguu

SEQ ID NO: 55614 - RNA, 22 nt, Homo sapiens
ugacagguugauaggugcagca

SEQ ID NO: 55615 - RNA, 20 nt, Homo sapiens
ugacaguuaagggauagaag

SEQ ID NO: 55616 - RNA, 22 nt, Homo sapiens
ugacaugaaggcaccucugucc

SEQ ID NO: 55617 - RNA, 22 nt, Homo sapiens
ugacaugauuguauauuuagaa

SEQ ID NO: 55618 - RNA, 22 nt, Homo sapiens
ugacuaggaggcuggaggauga

SEQ ID NO: 55619 - RNA, 22 nt, Homo sapiens
ugacucagauagguguguauuc

SEQ ID NO: 55620 - RNA, 20 nt, Homo sapiens
uugauucccucuaaacucgc

SEQ ID NO: 55621 - RNA, 22 nt, Homo sapiens
uugcaaacaucuuguuucacau

SEQ ID NO: 55622 - RNA, 22 nt, Homo sapiens
uugcaagaaaugcagauucuca

SEQ ID NO: 55623 - RNA, 22 nt, Homo sapiens
uugcacuccagccuuggggaga

SEQ ID NO: 55624 - RNA, 22 nt, Homo sapiens
uugcacugagauuuugcuuaca

SEQ ID NO: 55625 - RNA, 22 nt, Homo sapiens
uugcagagaaauuucugguuua

SEQ ID NO: 55626 - RNA, 22 nt, Homo sapiens
uugcagcaaagagggaggggca

SEQ ID NO: 55627 - RNA, 22 nt, Homo sapiens
uugcagcaaauaggaaugagga

SEQ ID NO: 55628 - RNA, 18 nt, Homo sapiens
uugcaucauuuuguuguu

SEQ ID NO: 55629 - RNA, 22 nt, Homo sapiens
uugccauggaguagaauugaag

SEQ ID NO: 55630 - RNA, 22 nt, Homo sapiens
uugcuucauucaacauugaggg

SEQ ID NO: 55631 - RNA, 22 nt, Homo sapiens
uugcuuuguugucuggggaaua

SEQ ID NO: 55632 - RNA, 22 nt, Homo sapiens
uuggaaaaauccaccuugaucu

SEQ ID NO: 55633 - RNA, 22 nt, Homo sapiens
uuggaaacgucaccuuuuccuu

SEQ ID NO: 55634 - RNA, 22 nt, Homo sapiens
uuggaaaguuguuguaguuauu

SEQ ID NO: 55635 - RNA, 22 nt, Homo sapiens
uuggaaauauguuaagugucau

SEQ ID NO: 55636 - RNA, 22 nt, Homo sapiens
uuggaauauuauuauugggcag

SEQ ID NO: 55637 - RNA, 22 nt, Homo sapiens
uuggaaugcaacagaaggauaa

SEQ ID NO: 55638 - RNA, 22 nt, Homo sapiens
uuggacagaugguuacauuuuu

SEQ ID NO: 55639 - RNA, 22 nt, Homo sapiens
uuggacuuuaagauagagaugu

SEQ ID NO: 55640 - RNA, 22 nt, Homo sapiens
uuggauuauaaacugagauuug

SEQ ID NO: 55641 - RNA, 22 nt, Homo sapiens
uuggauuuuaacaaacuaggug

SEQ ID NO: 55642 - RNA, 22 nt, Homo sapiens
uuggcaagcuguuaauuauaaa

SEQ ID NO: 55643 - RNA, 22 nt, Homo sapiens
uuggcacugggaaaaugaccac

SEQ ID NO: 55644 - RNA, 22 nt, Homo sapiens
uuggcauugaguuucaaaucau

SEQ ID NO: 55645 - RNA, 22 nt, Homo sapiens
uuggcauuuuggacacccagga

SEQ ID NO: 55646 - RNA, 22 nt, Homo sapiens
uuggcauuuuuagucaugggaa

SEQ ID NO: 55647 - RNA, 22 nt, Homo sapiens
uugggguagaauugcaacauau

SEQ ID NO: 55648 - RNA, 22 nt, Homo sapiens
uugggguaggaauauggaauga

SEQ ID NO: 55649 - RNA, 22 nt, Homo sapiens
uugguaaaaugaccacagacau

SEQ ID NO: 55650 - RNA, 22 nt, Homo sapiens
uugguaaugggcugguauaacc

SEQ ID NO: 55651 - RNA, 22 nt, Homo sapiens
uugguaguaaucccucacaaaa

SEQ ID NO: 55652 - RNA, 22 nt, Homo sapiens
uugguccccacuccccugccaa

SEQ ID NO: 55653 - RNA, 23 nt, Homo sapiens
uuggucucccaaaguguugagau

SEQ ID NO: 55654 - RNA, 22 nt, Homo sapiens
uuguaauguuaccaaauggugu

SEQ ID NO: 55655 - RNA, 22 nt, Homo sapiens
uuguccuugagauaguuugcug

SEQ ID NO: 55656 - RNA, 19 nt, Homo sapiens
uugucuuagaguugucauu

SEQ ID NO: 55657 - RNA, 22 nt, Homo sapiens
uugugcuuuugagcugagauga

SEQ ID NO: 55658 - RNA, 22 nt, Homo sapiens
uuguuauguuggucaguaaugu

SEQ ID NO: 55659 - RNA, 17 nt, Homo sapiens
uuguucccauuaaaaag

SEQ ID NO: 55660 - RNA, 22 nt, Homo sapiens
uuuaacauuggaugagaucguc

SEQ ID NO: 55661 - RNA, 22 nt, Homo sapiens
uuuaagguauguggugaaaauu

SEQ ID NO: 55662 - RNA, 22 nt, Homo sapiens
uuuagcaauucauuuugugucu

SEQ ID NO: 55663 - RNA, 22 nt, Homo sapiens
uuuauccagccucuagcaaggu

SEQ ID NO: 55664 - RNA, 23 nt, Homo sapiens
uuucacagaaggauuguagggcc

SEQ ID NO: 55665 - RNA, 22 nt, Homo sapiens
uuucaggcagggagcuucagug

SEQ ID NO: 55666 - RNA, 22 nt, Homo sapiens
uuucagguauuuaagggccguu

SEQ ID NO: 55667 - RNA, 22 nt, Homo sapiens
uuucauccggcuguguauuaug

SEQ ID NO: 55668 - RNA, 22 nt, Homo sapiens
uuuccaguuguucuagaaagcu

SEQ ID NO: 55669 - RNA, 22 nt, Homo sapiens
uuuccaguuuggaggaugcauu

SEQ ID NO: 55670 - RNA, 19 nt, Homo sapiens
uuucccugcagaccuacua

SEQ ID NO: 55671 - RNA, 22 nt, Homo sapiens
uuucugaggccucaccagaagc

SEQ ID NO: 55672 - RNA, 22 nt, Homo sapiens
uuugaaccauuugaagaaugau

SEQ ID NO: 55673 - RNA, 18 nt, Homo sapiens
uuugacugguguccuuau

SEQ ID NO: 55674 - RNA, 23 nt, Homo sapiens
uuugagugugauaaacacuguca

SEQ ID NO: 55675 - RNA, 22 nt, Homo sapiens
uuugagugugauaucgauugga

SEQ ID NO: 55676 - RNA, 22 nt, Homo sapiens
uuugcaguguaguuggccagca

SEQ ID NO: 55677 - RNA, 22 nt, Homo sapiens
uuuggacuucuagccuccagag

SEQ ID NO: 55678 - RNA, 18 nt, Homo sapiens
uuuggcuguucaugacuc

SEQ ID NO: 55679 - RNA, 22 nt, Homo sapiens
uuugguccuccuacagggcagg

SEQ ID NO: 55680 - RNA, 22 nt, Homo sapiens
uuugguugcauucacauauuuc

SEQ ID NO: 55681 - RNA, 22 nt, Homo sapiens
uuuguacacuguugguaggauu

SEQ ID NO: 55682 - RNA, 22 nt, Homo sapiens
uuuguacucccuuuagauaaaa

SEQ ID NO: 55683 - RNA, 22 nt, Homo sapiens
uuugugcuaaugcuagauuacu

SEQ ID NO: 55684 - RNA, 22 nt, Homo sapiens
uuugugcuccuaugagaaucua

SEQ ID NO: 55685 - RNA, 22 nt, Homo sapiens
uuugugcuccucucaguaugug

SEQ ID NO: 55686 - RNA, 22 nt, Homo sapiens
uuugugcuccugugagaaucua

SEQ ID NO: 55687 - RNA, 22 nt, Homo sapiens
uuugugugugauuauaaaaggu

SEQ ID NO: 55688 - RNA, 22 nt, Homo sapiens
uuuguucuucguuccugagcca

SEQ ID NO: 55689 - RNA, 22 nt, Homo sapiens
uuuguuugaagucgagacaacu

SEQ ID NO: 55690 - RNA, 22 nt, Homo sapiens
uuuuaacagccaggggacggcc

SEQ ID NO: 55691 - RNA, 22 nt, Homo sapiens
uuuuagcuuuucccaggacucc

SEQ ID NO: 55692 - RNA, 22 nt, Homo sapiens
uccaguggacagacauaccaug

SEQ ID NO: 55693 - RNA, 22 nt, Homo sapiens
uccagugugcaggcaaguuuga

SEQ ID NO: 55694 - RNA, 22 nt, Homo sapiens
uccaguuuggaggcuugaugug

SEQ ID NO: 55695 - RNA, 22 nt, Homo sapiens
uccauuuguagguagugagaca

SEQ ID NO: 55696 - RNA, 16 nt, Homo sapiens
ucccaccauugcuugu

SEQ ID NO: 55697 - RNA, 22 nt, Homo sapiens
ucccagaaacgcauauguucau

SEQ ID NO: 55698 - RNA, 22 nt, Homo sapiens
uccccgaggcuggagugcagug

SEQ ID NO: 55699 - RNA, 22 nt, Homo sapiens
ucccgaggacaucugggggcaa

SEQ ID NO: 55700 - RNA, 18 nt, Homo sapiens
ucccucagaauuauagaa

SEQ ID NO: 55701 - RNA, 19 nt, Homo sapiens
ucccugagucuuagcuuga

SEQ ID NO: 55702 - RNA, 22 nt, Homo sapiens
uccuugguugauccugugcaga

SEQ ID NO: 55703 - RNA, 22 nt, Homo sapiens
ucuaauguaaccugcaaauauu

SEQ ID NO: 55704 - RNA, 22 nt, Homo sapiens
ucucaauuugauuacauucaua

SEQ ID NO: 55705 - RNA, 22 nt, Homo sapiens
ucucagcacagucagggcgccu

SEQ ID NO: 55706 - RNA, 22 nt, Homo sapiens
ucucauggagucaggagcagaa

SEQ ID NO: 55707 - RNA, 22 nt, Homo sapiens
ucucugauuauugcauuucauu

SEQ ID NO: 55708 - RNA, 22 nt, Homo sapiens
ucucuguuuagagccagcaauu

SEQ ID NO: 55709 - RNA, 19 nt, Homo sapiens
ucugacagccccagucaac

SEQ ID NO: 55710 - RNA, 22 nt, Homo sapiens
ucugacagugugaauauugacu

SEQ ID NO: 55711 - RNA, 22 nt, Homo sapiens
ucugagaugagacuuugaauuu

SEQ ID NO: 55712 - RNA, 22 nt, Homo sapiens
ucugagcaauagauguggauau

SEQ ID NO: 55713 - RNA, 22 nt, Homo sapiens
uuaugcuguuuucuggagauuu

SEQ ID NO: 55714 - RNA, 22 nt, Homo sapiens
uuauguguuuaauguuucugaa

SEQ ID NO: 55715 - RNA, 22 nt, Homo sapiens
uuauugaguaaaaagaaugguu

SEQ ID NO: 55716 - RNA, 16 nt, Homo sapiens
uuauugcauucuucuc

SEQ ID NO: 55717 - RNA, 22 nt, Homo sapiens
uuauuguccaaguuucccuuug

SEQ ID NO: 55718 - RNA, 22 nt, Homo sapiens
uuauuugguuauuguaauuggg

SEQ ID NO: 55719 - RNA, 22 nt, Homo sapiens
uucaaguguucaggagcuacag

SEQ ID NO: 55720 - RNA, 21 nt, Homo sapiens
uucaccauggcuccacacucu

SEQ ID NO: 55721 - RNA, 22 nt, Homo sapiens
uucacugagccagacuaagaca

SEQ ID NO: 55722 - RNA, 22 nt, Homo sapiens
uucacugcacuccagccugagc

SEQ ID NO: 55723 - RNA, 22 nt, Homo sapiens
uucacugugaacucauauucag

SEQ ID NO: 55724 - RNA, 22 nt, Homo sapiens
uucacugugcuuaaauucugcu

SEQ ID NO: 55725 - RNA, 22 nt, Homo sapiens
uucagagugguaugaagugaug

SEQ ID NO: 55726 - RNA, 22 nt, Homo sapiens
uucagcaggccaggcccugacu

SEQ ID NO: 55727 - RNA, 22 nt, Homo sapiens
uucagcaguggccaguggaaau

SEQ ID NO: 55728 - RNA, 22 nt, Homo sapiens
uucaggcaccauugucauugau

SEQ ID NO: 55729 - RNA, 22 nt, Homo sapiens
uucaggcuccugugagaaucua

SEQ ID NO: 55730 - RNA, 22 nt, Homo sapiens
uucagguucauuugcugcuauu

SEQ ID NO: 55731 - RNA, 22 nt, Homo sapiens
uucaguggguggaugaauauga

SEQ ID NO: 55732 - RNA, 22 nt, Homo sapiens
uucagugguuauuugugagauu

SEQ ID NO: 55733 - RNA, 22 nt, Homo sapiens
uucagugucauuaacacaguag

SEQ ID NO: 55734 - RNA, 22 nt, Homo sapiens
uucauacaguggcugcacucca

SEQ ID NO: 55735 - RNA, 22 nt, Homo sapiens
uucaucagggagaaauaauuuc

SEQ ID NO: 55736 - RNA, 23 nt, Homo sapiens
uucaucagggauauuggccugaa

SEQ ID NO: 55737 - RNA, 22 nt, Homo sapiens
uucaucagggguauuggccaau

SEQ ID NO: 55738 - RNA, 21 nt, Homo sapiens
uucaucuggccguauuccagg

SEQ ID NO: 55739 - RNA, 22 nt, Homo sapiens
uuccaguaauagcacagcauug

SEQ ID NO: 55740 - RNA, 22 nt, Homo sapiens
uuccaguauuugggcaagcgca

SEQ ID NO: 55741 - RNA, 22 nt, Homo sapiens
uuccaguuauuauaccucuuaa

SEQ ID NO: 55742 - RNA, 22 nt, Homo sapiens
uucccagagagggacuucuaau

SEQ ID NO: 55743 - RNA, 22 nt, Homo sapiens
uucccaguaaacucuaucccuc

SEQ ID NO: 55744 - RNA, 22 nt, Homo sapiens
uucccugaaauauucacuuuca

SEQ ID NO: 55745 - RNA, 22 nt, Homo sapiens
uucccuuugaauuggaaaggug

SEQ ID NO: 55746 - RNA, 22 nt, Homo sapiens
uucccuuugugcauaggauuug

SEQ ID NO: 55747 - RNA, 22 nt, Homo sapiens
uuccugugacuguguggcaccc

SEQ ID NO: 55748 - RNA, 20 nt, Homo sapiens
uucuaguacuucuguuucca

SEQ ID NO: 55749 - RNA, 22 nt, Homo sapiens
uucucaauggcaacuuguugcu

SEQ ID NO: 55750 - RNA, 23 nt, Homo sapiens
uucugccacugaaaaugccucag

SEQ ID NO: 55751 - RNA, 22 nt, Homo sapiens
uucugugguuucauuuaccugu

SEQ ID NO: 55752 - RNA, 22 nt, Homo sapiens
uucuguguuuaggucacggcua

SEQ ID NO: 55753 - RNA, 21 nt, Homo sapiens
uucuucaggcagaaggauuau

SEQ ID NO: 55754 - RNA, 22 nt, Homo sapiens
uucuucaggccacaaaaauggu

SEQ ID NO: 55755 - RNA, 22 nt, Homo sapiens
uucuucugguuaugaaauuuga

SEQ ID NO: 55756 - RNA, 22 nt, Homo sapiens
uucuugcuguauccucacaugg

SEQ ID NO: 55757 - RNA, 22 nt, Homo sapiens
uugaaagaaaggagacugaguu

SEQ ID NO: 55758 - RNA, 22 nt, Homo sapiens
uugaaggaggugcucacucucg

SEQ ID NO: 55759 - RNA, 22 nt, Homo sapiens
uugaaguagaaagacgaaauuu

SEQ ID NO: 55760 - RNA, 22 nt, Homo sapiens
uugaaguagcauuucaugucua

SEQ ID NO: 55761 - RNA, 22 nt, Homo sapiens
uugaaguguguauacauugugg

SEQ ID NO: 55762 - RNA, 22 nt, Homo sapiens
uugaaugaaaugaugucauuug

SEQ ID NO: 55763 - RNA, 22 nt, Homo sapiens
uugaauggaauguuggaacuau

SEQ ID NO: 55764 - RNA, 22 nt, Homo sapiens
uugaauguacuuguucucacua

SEQ ID NO: 55765 - RNA, 22 nt, Homo sapiens
uugaauguaugcuggguuuacu

SEQ ID NO: 55766 - RNA, 22 nt, Homo sapiens
uugaaugucuauuaaguuguuu

SEQ ID NO: 55767 - RNA, 23 nt, Homo sapiens
uugaauguuuccccucccaaauu

SEQ ID NO: 55768 - RNA, 20 nt, Homo sapiens
uugacaguggguuguuaaag

SEQ ID NO: 55769 - RNA, 22 nt, Homo sapiens
uugacauaguuucugaaauaga

SEQ ID NO: 55770 - RNA, 22 nt, Homo sapiens
uugacuuuuaggaggaaaauga

SEQ ID NO: 55771 - RNA, 22 nt, Homo sapiens
uugugcaaaguugugguuucug

SEQ ID NO: 55772 - RNA, 22 nt, Homo sapiens
uugugcuucaucaccuagcaga

SEQ ID NO: 55773 - RNA, 22 nt, Homo sapiens
uugugcuuuuuaaauagcuucc

SEQ ID NO: 55774 - RNA, 22 nt, Homo sapiens
uugugucccugcggcugaggag

SEQ ID NO: 55775 - RNA, 22 nt, Homo sapiens
uuguuauguuaaacuacugaaa

SEQ ID NO: 55776 - RNA, 22 nt, Homo sapiens
uuguucaggagguuggggaugc

SEQ ID NO: 55777 - RNA, 22 nt, Homo sapiens
uuuaaagcuaaaauauguuuau

SEQ ID NO: 55778 - RNA, 23 nt, Homo sapiens
uuuaagcuucauguccuaacauc

SEQ ID NO: 55779 - RNA, 21 nt, Homo sapiens
uuuacuguggacccauugcuu

SEQ ID NO: 55780 - RNA, 22 nt, Homo sapiens
uuuagcaaagcaauuuacacca

SEQ ID NO: 55781 - RNA, 22 nt, Homo sapiens
uuuaucuguuuaaaacuguuca

SEQ ID NO: 55782 - RNA, 22 nt, Homo sapiens
uuucacagagggcuucuuucua

SEQ ID NO: 55783 - RNA, 22 nt, Homo sapiens
uuucacagcaauugccuauugu

SEQ ID NO: 55784 - RNA, 22 nt, Homo sapiens
uuucacaguguucucccccaga

SEQ ID NO: 55785 - RNA, 23 nt, Homo sapiens
uuucaggcaggugaaagaccagc

SEQ ID NO: 55786 - RNA, 22 nt, Homo sapiens
uuucauggagaaucuucuuacu

SEQ ID NO: 55787 - RNA, 22 nt, Homo sapiens
uuucccugaaggcucugaaguc

SEQ ID NO: 55788 - RNA, 22 nt, Homo sapiens
uuucccuuacuuaaacuuacuc

SEQ ID NO: 55789 - RNA, 21 nt, Homo sapiens
uuuccuggagcguauggcuuc

SEQ ID NO: 55790 - RNA, 22 nt, Homo sapiens
uuugacuuuuagaauaugaguu

SEQ ID NO: 55791 - RNA, 22 nt, Homo sapiens
uuugcacauauuugggcaaaag

SEQ ID NO: 55792 - RNA, 23 nt, Homo sapiens
uuugcacuugcuccuucuauggc

SEQ ID NO: 55793 - RNA, 22 nt, Homo sapiens
uuugcugagucugacuucaugg

SEQ ID NO: 55794 - RNA, 22 nt, Homo sapiens
uuuggaaugugcacucagauug

SEQ ID NO: 55795 - RNA, 22 nt, Homo sapiens
uuuguaauaccugaggcugggu

SEQ ID NO: 55796 - RNA, 22 nt, Homo sapiens
uuuguaauccuauuccaaagga

SEQ ID NO: 55797 - RNA, 22 nt, Homo sapiens
uuuguacugagccaagauggua

SEQ ID NO: 55798 - RNA, 22 nt, Homo sapiens
uuugugcuaacuuuaacucuua

SEQ ID NO: 55799 - RNA, 22 nt, Homo sapiens
uuugugcuauguuauauauucu

SEQ ID NO: 55800 - RNA, 22 nt, Homo sapiens
uuugugcugcaauuaauuuccc

SEQ ID NO: 55801 - RNA, 22 nt, Homo sapiens
uuuugcacuagaaccagagguu

SEQ ID NO: 55802 - RNA, 22 nt, Homo sapiens
uuuugcaguuacagagagugag

SEQ ID NO: 55803 - RNA, 22 nt, Homo sapiens
uuuugcucuugguaaugaaaga

SEQ ID NO: 55804 - RNA, 18 nt, Homo sapiens
uuuugcuuaacugcgcca

SEQ ID NO: 55805 - RNA, 22 nt, Homo sapiens
uuuuggcacuuugucugauucu

SEQ ID NO: 55806 - RNA, 20 nt, Homo sapiens
uuuuggcuuaaagcagucug

SEQ ID NO: 55807 - RNA, 21 nt, Homo sapiens
uuuugugcaugugcagccugc

SEQ ID NO: 55808 - RNA, 18 nt, Homo sapiens
uuuuugaggcacagggga

SEQ ID NO: 55809 - RNA, 22 nt, Homo sapiens
uuuuugaguaaauauaaauugu

SEQ ID NO: 55810 - RNA, 22 nt, Homo sapiens
uuuuuugcuguaugcaaacauc

SEQ ID NO: 55811 - RNA, 22 nt, Homo sapiens
acuuuuguuauacagugugaua

SEQ ID NO: 55812 - RNA, 21 nt, Homo sapiens
agaaaaucuuaugggaaacau

SEQ ID NO: 55813 - RNA, 20 nt, Homo sapiens
agaagcauugcucucuucag

SEQ ID NO: 55814 - RNA, 22 nt, Homo sapiens
agaaugugaacaucuugaaagu

SEQ ID NO: 55815 - RNA, 22 nt, Homo sapiens
agaaugugaccuuauuuggaga

SEQ ID NO: 55816 - RNA, 22 nt, Homo sapiens
agaauguuuuagaccaauacaa

SEQ ID NO: 55817 - RNA, 22 nt, Homo sapiens
agaccacuuuagagauuguuca

SEQ ID NO: 55818 - RNA, 22 nt, Homo sapiens
agacuagagggaaaugaguugg

SEQ ID NO: 55819 - RNA, 22 nt, Homo sapiens
agacucauuuccauagucagcu

SEQ ID NO: 55820 - RNA, 22 nt, Homo sapiens
agaguacugacguuugcaaauu

SEQ ID NO: 55821 - RNA, 20 nt, Homo sapiens
agagugcuggacugaggagc

SEQ ID NO: 55822 - RNA, 22 nt, Homo sapiens
agauggauuuuguagccccagc

SEQ ID NO: 55823 - RNA, 22 nt, Homo sapiens
agaugguguuuucucaccagau

SEQ ID NO: 55824 - RNA, 22 nt, Homo sapiens
agcaacauuguucauaauagcu

SEQ ID NO: 55825 - RNA, 22 nt, Homo sapiens
agcaagaugaaguugagcuagg

SEQ ID NO: 55826 - RNA, 22 nt, Homo sapiens
agcacauuaguaucuaagaaca

SEQ ID NO: 55827 - RNA, 22 nt, Homo sapiens
agcaccacaauuuccugccuaa

SEQ ID NO: 55828 - RNA, 19 nt, Homo sapiens
agcagaacaaauguguggg

SEQ ID NO: 55829 - RNA, 17 nt, Homo sapiens
agcagcccauaucccca

SEQ ID NO: 55830 - RNA, 22 nt, Homo sapiens
agcagcgacacccuguggugag

SEQ ID NO: 55831 - RNA, 22 nt, Homo sapiens
agcccauguggcugaggcuucu

SEQ ID NO: 55832 - RNA, 18 nt, Homo sapiens
cugagucauuccuggguc

SEQ ID NO: 55833 - RNA, 22 nt, Homo sapiens
cugauaguucucuuuagaguuu

SEQ ID NO: 55834 - RNA, 22 nt, Homo sapiens
cugcagguaggggcagcuuugg

SEQ ID NO: 55835 - RNA, 22 nt, Homo sapiens
cugcaguaaacuuucccauuca

SEQ ID NO: 55836 - RNA, 21 nt, Homo sapiens
cugcauccauuucugagugau

SEQ ID NO: 55837 - RNA, 22 nt, Homo sapiens
cugccacugacaccucaaggac

SEQ ID NO: 55838 - RNA, 22 nt, Homo sapiens
cugcuaagagaaugagacuuag

SEQ ID NO: 55839 - RNA, 22 nt, Homo sapiens
cuggaaagaaacccuuaauucu

SEQ ID NO: 55840 - RNA, 22 nt, Homo sapiens
cuggaaagaaucaggcuaaacu

SEQ ID NO: 55841 - RNA, 22 nt, Homo sapiens
cuggaagcacaacgcauuuauu

SEQ ID NO: 55842 - RNA, 22 nt, Homo sapiens
cuggagauauuggaagaaagaa

SEQ ID NO: 55843 - RNA, 22 nt, Homo sapiens
cuggaggccugaacauaaaugg

SEQ ID NO: 55844 - RNA, 22 nt, Homo sapiens
cuggaguuugaggcugcaguga

SEQ ID NO: 55845 - RNA, 22 nt, Homo sapiens
cugggguaggacuggcuuuuga

SEQ ID NO: 55846 - RNA, 21 nt, Homo sapiens
cugguccccuuuauguaugug

SEQ ID NO: 55847 - RNA, 22 nt, Homo sapiens
cuggugauugguuucauucagu

SEQ ID NO: 55848 - RNA, 22 nt, Homo sapiens
cugguuuguaaaguuccugaga

SEQ ID NO: 55849 - RNA, 22 nt, Homo sapiens
cuguaagcauuauaaagagaua

SEQ ID NO: 55850 - RNA, 22 nt, Homo sapiens
cuguaugugagaaauaauaagu

SEQ ID NO: 55851 - RNA, 22 nt, Homo sapiens
cugucuggaggccugcaaauaa

SEQ ID NO: 55852 - RNA, 22 nt, Homo sapiens
cugucuggaguccuucgugugc

SEQ ID NO: 55853 - RNA, 22 nt, Homo sapiens
cugugcauuggaugucucccug

SEQ ID NO: 55854 - RNA, 22 nt, Homo sapiens
cuguggauguauugcacagucu

SEQ ID NO: 55855 - RNA, 22 nt, Homo sapiens
cugugguugagcuuugccauga

SEQ ID NO: 55856 - RNA, 22 nt, Homo sapiens
cuguugguuaaauuccaugcag

SEQ ID NO: 55857 - RNA, 22 nt, Homo sapiens
cuguuugaggguuugcuuucag

SEQ ID NO: 55858 - RNA, 22 nt, Homo sapiens
cuuagguuaugauaaauuuagu

SEQ ID NO: 55859 - RNA, 22 nt, Homo sapiens
cuucaccaguuuggcagucuca

SEQ ID NO: 55860 - RNA, 22 nt, Homo sapiens
cuuccagcuggguucagucagu

SEQ ID NO: 55861 - RNA, 22 nt, Homo sapiens
cuuccauaguauuuuuacaaaa

SEQ ID NO: 55862 - RNA, 22 nt, Homo sapiens
cuuccugaguccugggcucaca

SEQ ID NO: 55863 - RNA, 22 nt, Homo sapiens
cuuggcauugccccuggaauuu

SEQ ID NO: 55864 - RNA, 22 nt, Homo sapiens
cuugggauauguguuacucugu

SEQ ID NO: 55865 - RNA, 19 nt, Homo sapiens
cuuguacucggcgcaguug

SEQ ID NO: 55866 - RNA, 18 nt, Homo sapiens
cuugucaaaucuuuccuc

SEQ ID NO: 55867 - RNA, 22 nt, Homo sapiens
cuugugcaugaccccagguggg

SEQ ID NO: 55868 - RNA, 22 nt, Homo sapiens
cuuuggcaaugucauuuucaau

SEQ ID NO: 55869 - RNA, 21 nt, Homo sapiens
cuuuuuacucguucauaugca

SEQ ID NO: 55870 - RNA, 22 nt, Homo sapiens
gaaagguaggaacagggugcag

SEQ ID NO: 55871 - RNA, 21 nt, Homo sapiens
gaaauacugccuuaggagcug

SEQ ID NO: 55872 - RNA, 22 nt, Homo sapiens
gaacuguaaagaaauucuaagg

SEQ ID NO: 55873 - RNA, 22 nt, Homo sapiens
gaagaaguacaagacaaauuuu

SEQ ID NO: 55874 - RNA, 22 nt, Homo sapiens
gaagaucacacuguagaucuau

SEQ ID NO: 55875 - RNA, 22 nt, Homo sapiens
gaaggcacugugugccacccug

SEQ ID NO: 55876 - RNA, 23 nt, Homo sapiens
gaaguauagcaugcacauggaaa

SEQ ID NO: 55877 - RNA, 17 nt, Homo sapiens
gaaguguuucuucauga

SEQ ID NO: 55878 - RNA, 22 nt, Homo sapiens
gaauaaacuagagaggacugag

SEQ ID NO: 55879 - RNA, 22 nt, Homo sapiens
gaauagugcugcaagaaacaua

SEQ ID NO: 55880 - RNA, 22 nt, Homo sapiens
gaaucacagauuaugaguaucu

SEQ ID NO: 55881 - RNA, 22 nt, Homo sapiens
gaaucauuggguugauucaaga

SEQ ID NO: 55882 - RNA, 22 nt, Homo sapiens
gaaucauuguuucuaaguuugu

SEQ ID NO: 55883 - RNA, 22 nt, Homo sapiens
gacagugagaugucaugugaaa

SEQ ID NO: 55884 - RNA, 22 nt, Homo sapiens
gacaguuucucaggcuuccuua

SEQ ID NO: 55885 - RNA, 20 nt, Homo sapiens
gacaugacuaggagauagcc

SEQ ID NO: 55886 - RNA, 22 nt, Homo sapiens
gaccacagacuggaaagagggc

SEQ ID NO: 55887 - RNA, 21 nt, Homo sapiens
gaccacagcagggaaugucag

SEQ ID NO: 55888 - RNA, 22 nt, Homo sapiens
gaccacauuccacacaggcuuu

SEQ ID NO: 55889 - RNA, 22 nt, Homo sapiens
gaccuaggaggauugcuugagc

SEQ ID NO: 55890 - RNA, 22 nt, Homo sapiens
gaccuuguagaaucucaugauu

SEQ ID NO: 55891 - RNA, 17 nt, Homo sapiens
gacgaucaucaggaggc

SEQ ID NO: 55892 - RNA, 22 nt, Homo sapiens
gacuacaacuucuauuauucag

SEQ ID NO: 55893 - RNA, 22 nt, Homo sapiens
gagaacuggcgugaacugcacg

SEQ ID NO: 55894 - RNA, 21 nt, Homo sapiens
gagaaucaucauggcugcaua

SEQ ID NO: 55895 - RNA, 22 nt, Homo sapiens
gagaaugagaggggaaggccac

SEQ ID NO: 55896 - RNA, 22 nt, Homo sapiens
gagacggagucucgcucuguca

SEQ ID NO: 55897 - RNA, 22 nt, Homo sapiens
gagauaaauaggucacaguucu

SEQ ID NO: 55898 - RNA, 22 nt, Homo sapiens
gagauaauagcuauaggaucuu

SEQ ID NO: 55899 - RNA, 22 nt, Homo sapiens
gagauaggauucacuuucaugu

SEQ ID NO: 55900 - RNA, 22 nt, Homo sapiens
gagauaguguggguacagcuau

SEQ ID NO: 55901 - RNA, 22 nt, Homo sapiens
gagaucauuaugucagggguca

SEQ ID NO: 55902 - RNA, 22 nt, Homo sapiens
gagauggagucuuuuucuguca

SEQ ID NO: 55903 - RNA, 22 nt, Homo sapiens
gagauguuuuguuaucaaagga

SEQ ID NO: 55904 - RNA, 21 nt, Homo sapiens
gagcacauuguccucuaacgc

SEQ ID NO: 55905 - RNA, 22 nt, Homo sapiens
gagcuacacugauucauuuguu

SEQ ID NO: 55906 - RNA, 22 nt, Homo sapiens
gagcugaaguuuccauuuguac

SEQ ID NO: 55907 - RNA, 22 nt, Homo sapiens
gaggaucucuugagcccagaag

SEQ ID NO: 55908 - RNA, 22 nt, Homo sapiens
gaggcaauaugagggaggcuuc

SEQ ID NO: 55909 - RNA, 22 nt, Homo sapiens
gaggcauugaagauauggaagu

SEQ ID NO: 55910 - RNA, 22 nt, Homo sapiens
gagguaagaguuuuccauuucu

SEQ ID NO: 55911 - RNA, 22 nt, Homo sapiens
gagguaagaugauucguguccu

SEQ ID NO: 55912 - RNA, 22 nt, Homo sapiens
gaggugguagguucacagcagc

SEQ ID NO: 55913 - RNA, 18 nt, Homo sapiens
gagguuagguucugacag

SEQ ID NO: 55914 - RNA, 22 nt, Homo sapiens
gaguaacauugacaacuucaug

SEQ ID NO: 55915 - RNA, 22 nt, Homo sapiens
gaguauauuugcacuguuaugu

SEQ ID NO: 55916 - RNA, 22 nt, Homo sapiens
gagugcugagcccacuuccuug

SEQ ID NO: 55917 - RNA, 22 nt, Homo sapiens
gaguuuguaaacuauucacuaa

SEQ ID NO: 55918 - RNA, 22 nt, Homo sapiens
gauaaaguauuggguacuaugc

SEQ ID NO: 55919 - RNA, 22 nt, Homo sapiens
gaucacauguguacucaaugug

SEQ ID NO: 55920 - RNA, 22 nt, Homo sapiens
gaucuggagguuuuccucauga

SEQ ID NO: 55921 - RNA, 22 nt, Homo sapiens
gaucugugugauuggaugcauu

SEQ ID NO: 55922 - RNA, 22 nt, Homo sapiens
gaucuguguuuguaugcauaag

SEQ ID NO: 55923 - RNA, 22 nt, Homo sapiens
gucucauugcaguuagaccugu

SEQ ID NO: 55924 - RNA, 22 nt, Homo sapiens
gucucuugguuuagagcauuua

SEQ ID NO: 55925 - RNA, 22 nt, Homo sapiens
gucuggcaauggcagacuggca

SEQ ID NO: 55926 - RNA, 22 nt, Homo sapiens
gucuggcuuaucucacuuacca

SEQ ID NO: 55927 - RNA, 22 nt, Homo sapiens
gucugugguuccuaugucaccu

SEQ ID NO: 55928 - RNA, 22 nt, Homo sapiens
gucuuggagacauugccauuga

SEQ ID NO: 55929 - RNA, 22 nt, Homo sapiens
gucuuuguuuugauuuaccaga

SEQ ID NO: 55930 - RNA, 22 nt, Homo sapiens
gucuuuugcuagccagagagcu

SEQ ID NO: 55931 - RNA, 22 nt, Homo sapiens
gugaaagauuaaaccagugugu

SEQ ID NO: 55932 - RNA, 22 nt, Homo sapiens
gugaacuguuugaggaagagaa

SEQ ID NO: 55933 - RNA, 22 nt, Homo sapiens
gugacugcauccauccaggcuu

SEQ ID NO: 55934 - RNA, 22 nt, Homo sapiens
gugagacugaguuucgcucuug

SEQ ID NO: 55935 - RNA, 22 nt, Homo sapiens
gugagauacuagagauauagug

SEQ ID NO: 55936 - RNA, 22 nt, Homo sapiens
gugagaugauggguauguuaau

SEQ ID NO: 55937 - RNA, 22 nt, Homo sapiens
gugagauggagucuugcuuugu

SEQ ID NO: 55938 - RNA, 22 nt, Homo sapiens
gugagauggaguuggugucuuu

SEQ ID NO: 55939 - RNA, 22 nt, Homo sapiens
gugagcacugaaagaaggcaag

SEQ ID NO: 55940 - RNA, 22 nt, Homo sapiens
gugagcauaacaacagaguuua

SEQ ID NO: 55941 - RNA, 22 nt, Homo sapiens
gugagcauaggaggcuucuguu

SEQ ID NO: 55942 - RNA, 22 nt, Homo sapiens
gugaggcacugcugcuuuccag

SEQ ID NO: 55943 - RNA, 22 nt, Homo sapiens
gugagguacgugucaagaacca

SEQ ID NO: 55944 - RNA, 22 nt, Homo sapiens
gugagguugaaaauaauggaaa

SEQ ID NO: 55945 - RNA, 23 nt, Homo sapiens
gugaucauuguuguggguugaau

SEQ ID NO: 55946 - RNA, 22 nt, Homo sapiens
gugauguguuucaacagcuccu

SEQ ID NO: 55947 - RNA, 22 nt, Homo sapiens
gugauguguuuguucuaucucu

SEQ ID NO: 55948 - RNA, 18 nt, Homo sapiens
gugcaaugaauagcagag

SEQ ID NO: 55949 - RNA, 22 nt, Homo sapiens
gugcgggaggcgcgccuaggug

SEQ ID NO: 55950 - RNA, 22 nt, Homo sapiens
guggaagaccagacuuuccaac

SEQ ID NO: 55951 - RNA, 22 nt, Homo sapiens
guggcuauuguucccugguugc

SEQ ID NO: 55952 - RNA, 22 nt, Homo sapiens
guggcuuuaaguacgauugagg

SEQ ID NO: 55953 - RNA, 22 nt, Homo sapiens
guggcuuuauuuagaagcaggg

SEQ ID NO: 55954 - RNA, 22 nt, Homo sapiens
gugggcaaagcuaguguguaga

SEQ ID NO: 55955 - RNA, 22 nt, Homo sapiens
guggguaaaucucuggggcucu

SEQ ID NO: 55956 - RNA, 22 nt, Homo sapiens
uuuggcacuguaaauuucucuu

SEQ ID NO: 55957 - RNA, 22 nt, Homo sapiens
uuuggcagaaaacuaaaaggua

SEQ ID NO: 55958 - RNA, 22 nt, Homo sapiens
uuuggcuuuugugauacguaau

SEQ ID NO: 55959 - RNA, 22 nt, Homo sapiens
uuugguccaguguucagguccu

SEQ ID NO: 55960 - RNA, 22 nt, Homo sapiens
uuuggucccaaugugauaaggu

SEQ ID NO: 55961 - RNA, 22 nt, Homo sapiens
uuuguacacgugggugaauugu

SEQ ID NO: 55962 - RNA, 21 nt, Homo sapiens
uuuguaguagcaugauuuaua

SEQ ID NO: 55963 - RNA, 22 nt, Homo sapiens
uuugucaauaacuaccaacagg

SEQ ID NO: 55964 - RNA, 22 nt, Homo sapiens
uuugugcuccuguugagaaucu

SEQ ID NO: 55965 - RNA, 22 nt, Homo sapiens
uuuguucaccucaaggauggga

SEQ ID NO: 55966 - RNA, 20 nt, Homo sapiens
uuuuagcacuuguuauggug

SEQ ID NO: 55967 - RNA, 22 nt, Homo sapiens
uuuugcucuucauagguccugu

SEQ ID NO: 55968 - RNA, 20 nt, Homo sapiens
uuuuggacuaaaggcauccc

SEQ ID NO: 55969 - RNA, 22 nt, Homo sapiens
uuuugguguacaauucuaugga

SEQ ID NO: 55970 - RNA, 22 nt, Homo sapiens
uuuugguguauuguauaaggua

SEQ ID NO: 55971 - RNA, 22 nt, Homo sapiens
uuuuugagaauuggugaaacac

SEQ ID NO: 55972 - RNA, 22 nt, Homo sapiens
uuuuugaguagcuggagagcag

SEQ ID NO: 55973 - RNA, 22 nt, Homo sapiens
ugagcugagaaaugcagcagcu

SEQ ID NO: 55974 - RNA, 22 nt, Homo sapiens
ugagcugagacaauaaguuuuu

SEQ ID NO: 55975 - RNA, 22 nt, Homo sapiens
ugagcugagauuaagcugcugc

SEQ ID NO: 55976 - RNA, 22 nt, Homo sapiens
ugagguuggggucagggcuagc

SEQ ID NO: 55977 - RNA, 22 nt, Homo sapiens
ugagguugguauuacugucucu

SEQ ID NO: 55978 - RNA, 22 nt, Homo sapiens
ugaguacuacuaguuacugcua

SEQ ID NO: 55979 - RNA, 22 nt, Homo sapiens
ugaguacugauuuaagauacac

SEQ ID NO: 55980 - RNA, 22 nt, Homo sapiens
ugaguagcuaauguuuacugag

SEQ ID NO: 55981 - RNA, 22 nt, Homo sapiens
ugagucagucucacucugcugc

SEQ ID NO: 55982 - RNA, 22 nt, Homo sapiens
ugagugaaagaagcacuaagga

SEQ ID NO: 55983 - RNA, 22 nt, Homo sapiens
ugaguggagaucgcaccauugc

SEQ ID NO: 55984 - RNA, 22 nt, Homo sapiens
ugauaggagauuuucaucugua

SEQ ID NO: 55985 - RNA, 18 nt, Homo sapiens
ugauaucaucacaauuga

SEQ ID NO: 55986 - RNA, 22 nt, Homo sapiens
ugauaugugaguauaugguuau

SEQ ID NO: 55987 - RNA, 22 nt, Homo sapiens
ugauggcaauggcauucauuuu

SEQ ID NO: 55988 - RNA, 22 nt, Homo sapiens
ugauguguuuuguaguucaacu

SEQ ID NO: 55989 - RNA, 22 nt, Homo sapiens
ugauuggagaacaaacugcaua

SEQ ID NO: 55990 - RNA, 22 nt, Homo sapiens
ugauuuguccauguggcacgug

SEQ ID NO: 55991 - RNA, 22 nt, Homo sapiens
ugcaaacuuccuugggcagcau

SEQ ID NO: 55992 - RNA, 22 nt, Homo sapiens
ugcaagaggagacuguacucag

SEQ ID NO: 55993 - RNA, 22 nt, Homo sapiens
ugcaagaugauuucaauugaua

SEQ ID NO: 55994 - RNA, 22 nt, Homo sapiens
ugcaauauccucuacuauaggu

SEQ ID NO: 55995 - RNA, 18 nt, Homo sapiens
ugcauacuaucugauuuu

SEQ ID NO: 55996 - RNA, 22 nt, Homo sapiens
ugcauauucgaguuauuuuggg

SEQ ID NO: 55997 - RNA, 22 nt, Homo sapiens
ugcauauucuaggauuuuguau

SEQ ID NO: 55998 - RNA, 20 nt, Homo sapiens
ugccagugugucaauuuaua

SEQ ID NO: 55999 - RNA, 22 nt, Homo sapiens
ugccaguguuuuguugaagauu

SEQ ID NO: 56000 - RNA, 16 nt, Homo sapiens
ugccuucuucuguauu

SEQ ID NO: 56001 - RNA, 22 nt, Homo sapiens
ugcuaugucuucucucacagag

SEQ ID NO: 56002 - RNA, 22 nt, Homo sapiens
ugcuguguugcuggcuuaaaga

SEQ ID NO: 56003 - RNA, 18 nt, Homo sapiens
ugcuuagucauuuucaau

SEQ ID NO: 56004 - RNA, 22 nt, Homo sapiens
ugcuuaguuguauguuccacau

SEQ ID NO: 56005 - RNA, 22 nt, Homo sapiens
uggaaauaaaugugccaagauc

SEQ ID NO: 56006 - RNA, 20 nt, Homo sapiens
uggaagccuggugcuaucuu

SEQ ID NO: 56007 - RNA, 20 nt, Homo sapiens
uggaaggcaucugcauuauu

SEQ ID NO: 56008 - RNA, 22 nt, Homo sapiens
uggaagucuauggcauuugagu

SEQ ID NO: 56009 - RNA, 22 nt, Homo sapiens
uggaaucuagagaaaugcaaac

SEQ ID NO: 56010 - RNA, 21 nt, Homo sapiens
uggaaugaauggccaacaugg

SEQ ID NO: 56011 - RNA, 18 nt, Homo sapiens
uggaauguuuggguuaau

SEQ ID NO: 56012 - RNA, 22 nt, Homo sapiens
uggacagagagaccggcauuuu

SEQ ID NO: 56013 - RNA, 18 nt, Homo sapiens
uggacagugauuauccau

SEQ ID NO: 56014 - RNA, 21 nt, Homo sapiens
uggaccccuuccagucaucau

SEQ ID NO: 56015 - RNA, 22 nt, Homo sapiens
uggagagucauuuauaguauuu

SEQ ID NO: 56016 - RNA, 22 nt, Homo sapiens
uggaguaggccuaagaaugaca

SEQ ID NO: 56017 - RNA, 15 nt, Homo sapiens
aaacccugucucaag

SEQ ID NO: 56018 - RNA, 22 nt, Homo sapiens
aaaggcacugaucuuauccagu

SEQ ID NO: 56019 - RNA, 22 nt, Homo sapiens
aaagugcaguacuucguauauu

SEQ ID NO: 56020 - RNA, 22 nt, Homo sapiens
aaagugcaguauuugggcagga

SEQ ID NO: 56021 - RNA, 19 nt, Homo sapiens
uacauaguauuuaguggca

SEQ ID NO: 56022 - RNA, 22 nt, Homo sapiens
uaccacagucauuacacuugua

SEQ ID NO: 56023 - RNA, 19 nt, Homo sapiens
uacccagaagcagcauugu

SEQ ID NO: 56024 - RNA, 22 nt, Homo sapiens
uacccuuuaguauaaaaucaga

SEQ ID NO: 56025 - RNA, 22 nt, Homo sapiens
uacguaucagucguuucuguga

SEQ ID NO: 56026 - RNA, 20 nt, Homo sapiens
uacugcacuccaaccuaggc

SEQ ID NO: 56027 - RNA, 22 nt, Homo sapiens
uacugcacuccaaccugagaga

SEQ ID NO: 56028 - RNA, 22 nt, Homo sapiens
uacugcacuccacccuggguga

SEQ ID NO: 56029 - RNA, 20 nt, Homo sapiens
uacugcacuccauccugggu

SEQ ID NO: 56030 - RNA, 22 nt, Homo sapiens
uacugcacucuagccuggguga

SEQ ID NO: 56031 - RNA, 22 nt, Homo sapiens
uacugcacuggaggccucagau

SEQ ID NO: 56032 - RNA, 20 nt, Homo sapiens
uacugcacuuuccucauggu

SEQ ID NO: 56033 - RNA, 22 nt, Homo sapiens
uacugcuaccuccagcuucugg

SEQ ID NO: 56034 - RNA, 22 nt, Homo sapiens
uacugcugucagugccaaguag

SEQ ID NO: 56035 - RNA, 22 nt, Homo sapiens
uacuguacugcaguucugcaaa

SEQ ID NO: 56036 - RNA, 22 nt, Homo sapiens
uagaauggaagguugagaagaa

SEQ ID NO: 56037 - RNA, 21 nt, Homo sapiens
uagagagcaauaccuccagag

SEQ ID NO: 56038 - RNA, 22 nt, Homo sapiens
uagagauaucaauuucauggug

SEQ ID NO: 56039 - RNA, 22 nt, Homo sapiens
uagauuaucccugauuugucca

SEQ ID NO: 56040 - RNA, 22 nt, Homo sapiens
uagcaagaugaauuugugcaaa

SEQ ID NO: 56041 - RNA, 17 nt, Homo sapiens
uagcacagugccuggua

SEQ ID NO: 56042 - RNA, 22 nt, Homo sapiens
uagcacaugucagguaauuugc

SEQ ID NO: 56043 - RNA, 22 nt, Homo sapiens
uagcacugucuugcaccugugc

SEQ ID NO: 56044 - RNA, 22 nt, Homo sapiens
uagcagcauaaauggacuaaga

SEQ ID NO: 56045 - RNA, 22 nt, Homo sapiens
uagcagccaggaagggcuggcu

SEQ ID NO: 56046 - RNA, 22 nt, Homo sapiens
uagcauggagucaugcacggcu

SEQ ID NO: 56047 - RNA, 22 nt, Homo sapiens
uagcugaucuuuuaaagaauga

SEQ ID NO: 56048 - RNA, 22 nt, Homo sapiens
uagcugauguuugucuaguagc

SEQ ID NO: 56049 - RNA, 22 nt, Homo sapiens
uagcugcugcuaggcuaaggau

SEQ ID NO: 56050 - RNA, 22 nt, Homo sapiens
uaggacacagauggagaaaagc

SEQ ID NO: 56051 - RNA, 22 nt, Homo sapiens
uaggagcacaaacccuacugug

SEQ ID NO: 56052 - RNA, 22 nt, Homo sapiens
uaggcaaguugcccaaucucuc

SEQ ID NO: 56053 - RNA, 22 nt, Homo sapiens
uaggcacugagaauaugaggau

SEQ ID NO: 56054 - RNA, 22 nt, Homo sapiens
uaggcgagauguguguuucaug

SEQ ID NO: 56055 - RNA, 22 nt, Homo sapiens
uaggcuuuucugggaugugggc

SEQ ID NO: 56056 - RNA, 22 nt, Homo sapiens
uagggaguuuuggggugcagaa

SEQ ID NO: 56057 - RNA, 20 nt, Homo sapiens
uagguuuucacagaauugcc

SEQ ID NO: 56058 - RNA, 22 nt, Homo sapiens
uagugcacuacuugugggaaug

SEQ ID NO: 56059 - RNA, 22 nt, Homo sapiens
uagugguaguagcaguaauauu

SEQ ID NO: 56060 - RNA, 22 nt, Homo sapiens
uauaacaaugcaagaauggccu

SEQ ID NO: 56061 - RNA, 22 nt, Homo sapiens
uauaagguuaggaaaaauuucu

SEQ ID NO: 56062 - RNA, 22 nt, Homo sapiens
uauagcaaugugccacucucug

SEQ ID NO: 56063 - RNA, 20 nt, Homo sapiens
uauagcaauuuuuuucuccu

SEQ ID NO: 56064 - RNA, 22 nt, Homo sapiens
uauagcaguguaagaaucgagu

SEQ ID NO: 56065 - RNA, 22 nt, Homo sapiens
uauagcuugauuauggugaugg

SEQ ID NO: 56066 - RNA, 23 nt, Homo sapiens
uauaugugucuaggagcuauggu

SEQ ID NO: 56067 - RNA, 22 nt, Homo sapiens
uaucaaggccacucauuuuaug

SEQ ID NO: 56068 - RNA, 22 nt, Homo sapiens
uaucacagguggacugcacacc

SEQ ID NO: 56069 - RNA, 22 nt, Homo sapiens
uaucaccauguccguuuuaaaa

SEQ ID NO: 56070 - RNA, 22 nt, Homo sapiens
uaucagcacaguggguucaugg

SEQ ID NO: 56071 - RNA, 22 nt, Homo sapiens
uaucagcagagucauacuucaa

SEQ ID NO: 56072 - RNA, 22 nt, Homo sapiens
uaucaguauggauucauggauu

SEQ ID NO: 56073 - RNA, 22 nt, Homo sapiens
uaucauaguuuggacuuucauu

SEQ ID NO: 56074 - RNA, 22 nt, Homo sapiens
uaugaaagcuacuucucacaau

SEQ ID NO: 56075 - RNA, 22 nt, Homo sapiens
uaugaacacuuuugggaggcau

SEQ ID NO: 56076 - RNA, 22 nt, Homo sapiens
uaugauuuuugggagaggucaa

SEQ ID NO: 56077 - RNA, 22 nt, Homo sapiens
uauggaaaucuuaccuuauggu

SEQ ID NO: 56078 - RNA, 22 nt, Homo sapiens
uauggcuucuauaaggaagcuu

SEQ ID NO: 56079 - RNA, 22 nt, Homo sapiens
uauggcuuucuacuugaguucu

SEQ ID NO: 56080 - RNA, 22 nt, Homo sapiens
uauggcuuuuauuauguuguag

SEQ ID NO: 56081 - RNA, 20 nt, Homo sapiens
uaugguuuuagguauagcau

SEQ ID NO: 56082 - RNA, 22 nt, Homo sapiens
uauuacagaccauaucgccggg

SEQ ID NO: 56083 - RNA, 22 nt, Homo sapiens
uauuccauuugggucaggauga

SEQ ID NO: 56084 - RNA, 22 nt, Homo sapiens
uauuccucuuuguugagguuau

SEQ ID NO: 56085 - RNA, 22 nt, Homo sapiens
uauugauuuucaguguucagcu

SEQ ID NO: 56086 - RNA, 22 nt, Homo sapiens
uauugcauauuauucuaguggc

SEQ ID NO: 56087 - RNA, 22 nt, Homo sapiens
uauuggcucuguuucucugaag

SEQ ID NO: 56088 - RNA, 22 nt, Homo sapiens
uauuucaguugugcagguaguu

SEQ ID NO: 56089 - RNA, 22 nt, Homo sapiens
uauuugguuauaugaguaaguu

SEQ ID NO: 56090 - RNA, 22 nt, Homo sapiens
ucaaaaucucuuagcugugucu

SEQ ID NO: 56091 - RNA, 22 nt, Homo sapiens
ucaaacugcuugaggccauuua

SEQ ID NO: 56092 - RNA, 22 nt, Homo sapiens
ucaaagacacacaaggagaagg

SEQ ID NO: 56093 - RNA, 17 nt, Homo sapiens
ucaaaugcucccaguga

SEQ ID NO: 56094 - RNA, 22 nt, Homo sapiens
ucaaaugguccacgugaacauu

SEQ ID NO: 56095 - RNA, 22 nt, Homo sapiens
ucaacacaguuaaauggggaaa

SEQ ID NO: 56096 - RNA, 22 nt, Homo sapiens
ucaacauugcugucaggcaucu

SEQ ID NO: 56097 - RNA, 22 nt, Homo sapiens
ucaagaccucacauagaggaga

SEQ ID NO: 56098 - RNA, 22 nt, Homo sapiens
ucaaggcacuagcugagcugca

SEQ ID NO: 56099 - RNA, 23 nt, Homo sapiens
ucaagugaugguggccacaaggg

SEQ ID NO: 56100 - RNA, 19 nt, Homo sapiens
ucaauucugucaauggcuu

SEQ ID NO: 56101 - RNA, 20 nt, Homo sapiens
ucacaagccaagaucacguc

SEQ ID NO: 56102 - RNA, 22 nt, Homo sapiens
ucacacgugaacucaucacaga

SEQ ID NO: 56103 - RNA, 22 nt, Homo sapiens
ucacagacauugaggggaccuu

SEQ ID NO: 56104 - RNA, 22 nt, Homo sapiens
ucacagacugagccaaauagag

SEQ ID NO: 56105 - RNA, 22 nt, Homo sapiens
ucacagauaaauaaagaugauu

SEQ ID NO: 56106 - RNA, 21 nt, Homo sapiens
ucacagccuaggaccugaaga

SEQ ID NO: 56107 - RNA, 22 nt, Homo sapiens
ucacaguccuguuuaggagagg

SEQ ID NO: 56108 - RNA, 22 nt, Homo sapiens
ucacagucugcgugaugagaca

SEQ ID NO: 56109 - RNA, 22 nt, Homo sapiens
cuagaguagaguuuccuuagga

SEQ ID NO: 56110 - RNA, 22 nt, Homo sapiens
cuagcacauuuaucuuuauaca

SEQ ID NO: 56111 - RNA, 22 nt, Homo sapiens
cuagcaggcaagauaagauuca

SEQ ID NO: 56112 - RNA, 18 nt, Homo sapiens
cuaguguuucuugaauca

SEQ ID NO: 56113 - RNA, 22 nt, Homo sapiens
cuauggcucugguuauggcugu

SEQ ID NO: 56114 - RNA, 22 nt, Homo sapiens
cugacagaugacugccacugua

SEQ ID NO: 56115 - RNA, 22 nt, Homo sapiens
cugaccucugucaaagacaccc

SEQ ID NO: 56116 - RNA, 22 nt, Homo sapiens
cugagauaauuucuagguguca

SEQ ID NO: 56117 - RNA, 22 nt, Homo sapiens
cugagaucaugggucagguggu

SEQ ID NO: 56118 - RNA, 22 nt, Homo sapiens
cugagauuaagauauugggagu

SEQ ID NO: 56119 - RNA, 22 nt, Homo sapiens
cugagcuaguagcauuguguca

SEQ ID NO: 56120 - RNA, 22 nt, Homo sapiens
cugaggguagaaggaucacuug

SEQ ID NO: 56121 - RNA, 20 nt, Homo sapiens
cugauacagccugagcucuc

SEQ ID NO: 56122 - RNA, 22 nt, Homo sapiens
cugauacucuccuuuuagagag

SEQ ID NO: 56123 - RNA, 22 nt, Homo sapiens
cugcaagaaucguaguauuuga

SEQ ID NO: 56124 - RNA, 19 nt, Homo sapiens
cugcacugagaaaaggagg

SEQ ID NO: 56125 - RNA, 22 nt, Homo sapiens
cugccuagauguuguagggggu

SEQ ID NO: 56126 - RNA, 22 nt, Homo sapiens
cugcuggucuuuaaggucuagg

SEQ ID NO: 56127 - RNA, 22 nt, Homo sapiens
cuggagaucuugacauugaagu

SEQ ID NO: 56128 - RNA, 22 nt, Homo sapiens
cuggcccaguucugcguuuugc

SEQ ID NO: 56129 - RNA, 22 nt, Homo sapiens
cuguaguuagcagaugaugaau

SEQ ID NO: 56130 - RNA, 22 nt, Homo sapiens
cugucacaguuuuggaggccag

SEQ ID NO: 56131 - RNA, 19 nt, Homo sapiens
cugucacugaggaagacug

SEQ ID NO: 56132 - RNA, 22 nt, Homo sapiens
cugugaucuuuuuucauguggu

SEQ ID NO: 56133 - RNA, 22 nt, Homo sapiens
cugugcauggauuuuaagauug

SEQ ID NO: 56134 - RNA, 19 nt, Homo sapiens
cuguuguacuccaggcauu

SEQ ID NO: 56135 - RNA, 22 nt, Homo sapiens
cuguuuguuuaggguacucaga

SEQ ID NO: 56136 - RNA, 20 nt, Homo sapiens
cuuaucaguggcaaguauaa

SEQ ID NO: 56137 - RNA, 22 nt, Homo sapiens
cuugaacaaagagauuccauua

SEQ ID NO: 56138 - RNA, 22 nt, Homo sapiens
cuuggauuauaauggaauauuu

SEQ ID NO: 56139 - RNA, 22 nt, Homo sapiens
cuuggcacgugauagguguuga

SEQ ID NO: 56140 - RNA, 22 nt, Homo sapiens
cuuugauuauaaaaggguguuu

SEQ ID NO: 56141 - RNA, 22 nt, Homo sapiens
cuuugggaccgcgguuuauacu

SEQ ID NO: 56142 - RNA, 22 nt, Homo sapiens
cuuuggugagggauaaauuuca

SEQ ID NO: 56143 - RNA, 22 nt, Homo sapiens
cuuuguguaggugccucuggcu

SEQ ID NO: 56144 - RNA, 22 nt, Homo sapiens
cuuuuugcuagagucuaggguc

SEQ ID NO: 56145 - RNA, 20 nt, Homo sapiens
cuuuuugcugugcugggagc

SEQ ID NO: 56146 - RNA, 20 nt, Homo sapiens
gaaacaucuauccucuccuu

SEQ ID NO: 56147 - RNA, 22 nt, Homo sapiens
gaaacugcauuucuaacaagcu

SEQ ID NO: 56148 - RNA, 22 nt, Homo sapiens
gaaagcugguauagauacauua

SEQ ID NO: 56149 - RNA, 22 nt, Homo sapiens
gaaaugcucagggguuuuccag

SEQ ID NO: 56150 - RNA, 23 nt, Homo sapiens
gaaaugucuuagugaaauugcuu

SEQ ID NO: 56151 - RNA, 22 nt, Homo sapiens
gaaauguuuuucaugugggcaa

SEQ ID NO: 56152 - RNA, 18 nt, Homo sapiens
gaagaaguaggcauggca

SEQ ID NO: 56153 - RNA, 22 nt, Homo sapiens
gaagacauuuacaugggagacc

SEQ ID NO: 56154 - RNA, 22 nt, Homo sapiens
gaagugguaggauugcuuuuga

SEQ ID NO: 56155 - RNA, 22 nt, Homo sapiens
gaauacugacuauuucaucugg

SEQ ID NO: 56156 - RNA, 22 nt, Homo sapiens
gaauacuguccaagagugaugg

SEQ ID NO: 56157 - RNA, 22 nt, Homo sapiens
gaaucaauugaucuaugugucu

SEQ ID NO: 56158 - RNA, 22 nt, Homo sapiens
gaaugauacuguuaacgaaaga

SEQ ID NO: 56159 - RNA, 20 nt, Homo sapiens
gaaugguuucgggguucuug

SEQ ID NO: 56160 - RNA, 22 nt, Homo sapiens
gaauguuuacuuuguuuaauac

SEQ ID NO: 56161 - RNA, 22 nt, Homo sapiens
gacaguuuggugaggaagacga

SEQ ID NO: 56162 - RNA, 21 nt, Homo sapiens
gacuacaccaggaugcuaguu

SEQ ID NO: 56163 - RNA, 20 nt, Homo sapiens
gacuucagaagcuucagagu

SEQ ID NO: 56164 - RNA, 18 nt, Homo sapiens
gacuuggaguuuacagug

SEQ ID NO: 56165 - RNA, 22 nt, Homo sapiens
gagaacauuuaagccacucagg

SEQ ID NO: 56166 - RNA, 22 nt, Homo sapiens
gagaaguaaauuuauuugcaaa

SEQ ID NO: 56167 - RNA, 22 nt, Homo sapiens
gagacggagucacgcccuguca

SEQ ID NO: 56168 - RNA, 22 nt, Homo sapiens
gagacggagucucgcucugucg

SEQ ID NO: 56169 - RNA, 22 nt, Homo sapiens
gagacggagucuugcucuguug

SEQ ID NO: 56170 - RNA, 22 nt, Homo sapiens
gagaucacuucuguauucuaca

SEQ ID NO: 56171 - RNA, 22 nt, Homo sapiens
gagaucaugcugguucucucau

SEQ ID NO: 56172 - RNA, 22 nt, Homo sapiens
gagcaccagucccugucagugc

SEQ ID NO: 56173 - RNA, 22 nt, Homo sapiens
gagcagacaugaggaccgcugg

SEQ ID NO: 56174 - RNA, 22 nt, Homo sapiens
gagcuagggucaugcuacugca

SEQ ID NO: 56175 - RNA, 22 nt, Homo sapiens
gagcuuggguuaaaguugccuu

SEQ ID NO: 56176 - RNA, 22 nt, Homo sapiens
gaggcaaugugcccggcccaca

SEQ ID NO: 56177 - RNA, 22 nt, Homo sapiens
gagguaagaaagucaguccuuc

SEQ ID NO: 56178 - RNA, 22 nt, Homo sapiens
gagguaaguggauuaugagguc

SEQ ID NO: 56179 - RNA, 22 nt, Homo sapiens
gagguaguuuaguuuuggggaa

SEQ ID NO: 56180 - RNA, 22 nt, Homo sapiens
gagguguaaggacaacagagac

SEQ ID NO: 56181 - RNA, 18 nt, Homo sapiens
gaguggugcuucccuugu

SEQ ID NO: 56182 - RNA, 22 nt, Homo sapiens
gaguugagagaguuguuauuuc

SEQ ID NO: 56183 - RNA, 19 nt, Homo sapiens
gaguugggguuuacuguaa

SEQ ID NO: 56184 - RNA, 22 nt, Homo sapiens
gauauguaaaaauuauaucuga

SEQ ID NO: 56185 - RNA, 22 nt, Homo sapiens
gauauguacagcucucuaggau

SEQ ID NO: 56186 - RNA, 20 nt, Homo sapiens
gaucaguuuggaguaagugc

SEQ ID NO: 56187 - RNA, 22 nt, Homo sapiens
gaucuguuucaauugucuuagu

SEQ ID NO: 56188 - RNA, 22 nt, Homo sapiens
gaugagaugagcauuugaauug

SEQ ID NO: 56189 - RNA, 22 nt, Homo sapiens
gaugagguaguguaccuagucu

SEQ ID NO: 56190 - RNA, 22 nt, Homo sapiens
gauggcacuaagccauguagga

SEQ ID NO: 56191 - RNA, 22 nt, Homo sapiens
gauguguugggaagauuucaag

SEQ ID NO: 56192 - RNA, 22 nt, Homo sapiens
gauuccacuuacuuagcauucc

SEQ ID NO: 56193 - RNA, 22 nt, Homo sapiens
gauuccacuuucugucucuaug

SEQ ID NO: 56194 - RNA, 22 nt, Homo sapiens
gauuggcauugcugcaccugag

SEQ ID NO: 56195 - RNA, 22 nt, Homo sapiens
gauuuguauuaaaagugugacg

SEQ ID NO: 56196 - RNA, 22 nt, Homo sapiens
gcacaggguuacauucuaaggu

SEQ ID NO: 56197 - RNA, 22 nt, Homo sapiens
gcaccaugguagaauaauggua

SEQ ID NO: 56198 - RNA, 22 nt, Homo sapiens
gcacccugucaaaauggaccaa

SEQ ID NO: 56199 - RNA, 22 nt, Homo sapiens
ucacagugcaggaucaguuaau

SEQ ID NO: 56200 - RNA, 18 nt, Homo sapiens
ucacauggccgagagaga

SEQ ID NO: 56201 - RNA, 22 nt, Homo sapiens
ucacaugggugcaauauaauca

SEQ ID NO: 56202 - RNA, 22 nt, Homo sapiens
ucacaugugacauauauauuug

SEQ ID NO: 56203 - RNA, 22 nt, Homo sapiens
ucacauuguauauguaccuauc

SEQ ID NO: 56204 - RNA, 22 nt, Homo sapiens
ucacauuguuauguaaauguuu

SEQ ID NO: 56205 - RNA, 22 nt, Homo sapiens
ucacccacacaggagacaggga

SEQ ID NO: 56206 - RNA, 22 nt, Homo sapiens
ucacgugguucauaaggcagaa

SEQ ID NO: 56207 - RNA, 22 nt, Homo sapiens
aauggcacaagacaugaagaag

SEQ ID NO: 56208 - RNA, 22 nt, Homo sapiens
aaugugccuacuggagcuugca

SEQ ID NO: 56209 - RNA, 22 nt, Homo sapiens
aaugugcuguucagaggagucc

SEQ ID NO: 56210 - RNA, 22 nt, Homo sapiens
aauuaguuggcugccuaugauu

SEQ ID NO: 56211 - RNA, 22 nt, Homo sapiens
aauucacuucuuuuaggcaggg

SEQ ID NO: 56212 - RNA, 22 nt, Homo sapiens
aauugcauaugcaguagaucua

SEQ ID NO: 56213 - RNA, 22 nt, Homo sapiens
acaagugaauacaggauucucu

SEQ ID NO: 56214 - RNA, 22 nt, Homo sapiens
acaauguauauuuuacuguagg

SEQ ID NO: 56215 - RNA, 22 nt, Homo sapiens
acacugcugaguaaauaauuuu

SEQ ID NO: 56216 - RNA, 22 nt, Homo sapiens
acacuggaggagagcuguugcu

SEQ ID NO: 56217 - RNA, 20 nt, Homo sapiens
acacuggaguaucaaggccc

SEQ ID NO: 56218 - RNA, 22 nt, Homo sapiens
acacuggaguuaaaggugauuu

SEQ ID NO: 56219 - RNA, 20 nt, Homo sapiens
acacugugcuaaggauuuuc

SEQ ID NO: 56220 - RNA, 23 nt, Homo sapiens
acacuugcugaguaaaucaaaua

SEQ ID NO: 56221 - RNA, 22 nt, Homo sapiens
acagaacugggcuugcuuuugg

SEQ ID NO: 56222 - RNA, 22 nt, Homo sapiens
acagaucagagauauuuagguu

SEQ ID NO: 56223 - RNA, 20 nt, Homo sapiens
acagcacugguuucaagcaa

SEQ ID NO: 56224 - RNA, 22 nt, Homo sapiens
acaguacaugauaaauaaggua

SEQ ID NO: 56225 - RNA, 22 nt, Homo sapiens
acagucauagcagccuuuguua

SEQ ID NO: 56226 - RNA, 18 nt, Homo sapiens
acagugcuggcaugagau

SEQ ID NO: 56227 - RNA, 22 nt, Homo sapiens
acagugcuuggcacacaguaau

SEQ ID NO: 56228 - RNA, 22 nt, Homo sapiens
augcacuguuguuauuggauaa

SEQ ID NO: 56229 - RNA, 22 nt, Homo sapiens
augccacuguccuccugccuag

SEQ ID NO: 56230 - RNA, 22 nt, Homo sapiens
augccacuguuuaugucacuua

SEQ ID NO: 56231 - RNA, 22 nt, Homo sapiens
augccacuucucuaagucaugu

SEQ ID NO: 56232 - RNA, 22 nt, Homo sapiens
auggaagaaacgauuuucugga

SEQ ID NO: 56233 - RNA, 22 nt, Homo sapiens
auggaagcauaguauucuauug

SEQ ID NO: 56234 - RNA, 22 nt, Homo sapiens
auggaaggagaggaaugaauga

SEQ ID NO: 56235 - RNA, 22 nt, Homo sapiens
auggacagaaaaaaauagaugu

SEQ ID NO: 56236 - RNA, 22 nt, Homo sapiens
auggaggaggaagcugaaacaa

SEQ ID NO: 56237 - RNA, 22 nt, Homo sapiens
auggauuuugaacuugagaguu

SEQ ID NO: 56238 - RNA, 22 nt, Homo sapiens
auggcacagaguagaugcucaa

SEQ ID NO: 56239 - RNA, 22 nt, Homo sapiens
auggcacucaaucaaguugaga

SEQ ID NO: 56240 - RNA, 22 nt, Homo sapiens
auggcacuguguccugggguca

SEQ ID NO: 56241 - RNA, 22 nt, Homo sapiens
gucugucuuuugucuuugaaau

SEQ ID NO: 56242 - RNA, 22 nt, Homo sapiens
gucuugcacuuaccuaagaacu

SEQ ID NO: 56243 - RNA, 22 nt, Homo sapiens
gucuuugcauguauguucauga

SEQ ID NO: 56244 - RNA, 22 nt, Homo sapiens
gugaagugugaccucagcaucu

SEQ ID NO: 56245 - RNA, 22 nt, Homo sapiens
gugaaguuuuugugaggccuaa

SEQ ID NO: 56246 - RNA, 22 nt, Homo sapiens
gugaauguaaagucaugugacu

SEQ ID NO: 56247 - RNA, 22 nt, Homo sapiens
gugacagucaaagacaugacuu

SEQ ID NO: 56248 - RNA, 20 nt, Homo sapiens
gugacugagcacgggcacag

SEQ ID NO: 56249 - RNA, 22 nt, Homo sapiens
gugacugcauauaaguguaugu

SEQ ID NO: 56250 - RNA, 22 nt, Homo sapiens
gugacuggacucugaagaaaau

SEQ ID NO: 56251 - RNA, 22 nt, Homo sapiens
gugacugggaguggugaagaua

SEQ ID NO: 56252 - RNA, 22 nt, Homo sapiens
gugagaugugacuucugccucu

SEQ ID NO: 56253 - RNA, 17 nt, Homo sapiens
gugagguggguaguauc

SEQ ID NO: 56254 - RNA, 22 nt, Homo sapiens
gugagguguuaaccaaccugug

SEQ ID NO: 56255 - RNA, 22 nt, Homo sapiens
gugaugcaguacguagaggaga

SEQ ID NO: 56256 - RNA, 22 nt, Homo sapiens
gugcaaugaguguggcaaagcc

SEQ ID NO: 56257 - RNA, 22 nt, Homo sapiens
gugcacaugguagguauugagu

SEQ ID NO: 56258 - RNA, 22 nt, Homo sapiens
gugcaugcaucuuuauaguagc

SEQ ID NO: 56259 - RNA, 22 nt, Homo sapiens
gugcaugucuaugcgagucuaa

SEQ ID NO: 56260 - RNA, 22 nt, Homo sapiens
gugccacugcacuccggccugg

SEQ ID NO: 56261 - RNA, 22 nt, Homo sapiens
guggaagucuuugguauuggua

SEQ ID NO: 56262 - RNA, 22 nt, Homo sapiens
guggaauggaaugauuguguau

SEQ ID NO: 56263 - RNA, 17 nt, Homo sapiens
guggaaugucaugucaa

SEQ ID NO: 56264 - RNA, 22 nt, Homo sapiens
guggacggagguugcagugagc

SEQ ID NO: 56265 - RNA, 22 nt, Homo sapiens
guggaggagaaagaagcauuuc

SEQ ID NO: 56266 - RNA, 22 nt, Homo sapiens
guggcacaauuaaguagcuauu

SEQ ID NO: 56267 - RNA, 22 nt, Homo sapiens
guggcauuucccaaaguauucu

SEQ ID NO: 56268 - RNA, 22 nt, Homo sapiens
gugggguagcaggcuccuaucu

SEQ ID NO: 56269 - RNA, 22 nt, Homo sapiens
guguaaaacaauuagaggauuu

SEQ ID NO: 56270 - RNA, 22 nt, Homo sapiens
guguauacauagaauuguguau

SEQ ID NO: 56271 - RNA, 22 nt, Homo sapiens
guguauguuguccauggaugcg

SEQ ID NO: 56272 - RNA, 22 nt, Homo sapiens
gugugauggcgcacacagggug

SEQ ID NO: 56273 - RNA, 19 nt, Homo sapiens
gugugcauaucacagagca

SEQ ID NO: 56274 - RNA, 22 nt, Homo sapiens
guguucaaacccaggucugucu

SEQ ID NO: 56275 - RNA, 22 nt, Homo sapiens
guuaugcagcuuagaaaaugaa

SEQ ID NO: 56276 - RNA, 22 nt, Homo sapiens
guucaucagggauauuggcuua

SEQ ID NO: 56277 - RNA, 22 nt, Homo sapiens
guugagcaagcuuuggagccua

SEQ ID NO: 56278 - RNA, 22 nt, Homo sapiens
guuggcaagaggugcuguacac

SEQ ID NO: 56279 - RNA, 22 nt, Homo sapiens
guuugcacuccuaugagaaucu

SEQ ID NO: 56280 - RNA, 22 nt, Homo sapiens
guuugugcuccuaugagaaucu

SEQ ID NO: 56281 - RNA, 22 nt, Homo sapiens
uaaagcauguaauuagguuaga

SEQ ID NO: 56282 - RNA, 22 nt, Homo sapiens
uaaagcuaucacauuggugauu

SEQ ID NO: 56283 - RNA, 20 nt, Homo sapiens
uaaagcugcucagggggcuc

SEQ ID NO: 56284 - RNA, 22 nt, Homo sapiens
uaaagugaggauggcaguaggu

SEQ ID NO: 56285 - RNA, 22 nt, Homo sapiens
uaaagugcugagaugaggcugg

SEQ ID NO: 56286 - RNA, 22 nt, Homo sapiens
uaacauuguugauuauacuaag

SEQ ID NO: 56287 - RNA, 22 nt, Homo sapiens
uaacccugaggggcuuggggac

SEQ ID NO: 56288 - RNA, 22 nt, Homo sapiens
uaacuagaaaggagacaguugc

SEQ ID NO: 56289 - RNA, 22 nt, Homo sapiens
uaacugcaaccuccgccucccg

SEQ ID NO: 56290 - RNA, 22 nt, Homo sapiens
uaacuguggaaaugacuuuaaa

SEQ ID NO: 56291 - RNA, 18 nt, Homo sapiens
uaacugugggaacuaacu

SEQ ID NO: 56292 - RNA, 22 nt, Homo sapiens
uaagacugccccagacagcaag

SEQ ID NO: 56293 - RNA, 22 nt, Homo sapiens
uaagagagcuccaucuuuuccu

SEQ ID NO: 56294 - RNA, 19 nt, Homo sapiens
uaagaugaagcugucuggg

SEQ ID NO: 56295 - RNA, 22 nt, Homo sapiens
uaaggcuugaucuuggugagau

SEQ ID NO: 56296 - RNA, 22 nt, Homo sapiens
uaaggcuugcuucagucuugaa

SEQ ID NO: 56297 - RNA, 22 nt, Homo sapiens
uaagguguagacuggucacaag

SEQ ID NO: 56298 - RNA, 22 nt, Homo sapiens
uaaguauuaggccccaggcugg

SEQ ID NO: 56299 - RNA, 18 nt, Homo sapiens
uaauaacugugaccuuga

SEQ ID NO: 56300 - RNA, 22 nt, Homo sapiens
uaauucuguauguaucagaguu

SEQ ID NO: 56301 - RNA, 16 nt, Homo sapiens
uacaauguagaaaaca

SEQ ID NO: 56302 - RNA, 22 nt, Homo sapiens
uacagaguagaagauuugcaga

SEQ ID NO: 56303 - RNA, 22 nt, Homo sapiens
uacaggauagacaauuuauuaa

SEQ ID NO: 56304 - RNA, 22 nt, Homo sapiens
uacagguauagauguguguucu

SEQ ID NO: 56305 - RNA, 22 nt, Homo sapiens
uacaugcaugggcaugugugca

SEQ ID NO: 56306 - RNA, 22 nt, Homo sapiens
uaccaaguauuuucacaugaac

SEQ ID NO: 56307 - RNA, 22 nt, Homo sapiens
uacucugcagagaugcauaaca

SEQ ID NO: 56308 - RNA, 22 nt, Homo sapiens
uacugcacuccagccugccaac

SEQ ID NO: 56309 - RNA, 22 nt, Homo sapiens
uacugcacuugaccuccugggc

SEQ ID NO: 56310 - RNA, 22 nt, Homo sapiens
uacugcuuaaaagucaauuacu

SEQ ID NO: 56311 - RNA, 21 nt, Homo sapiens
uacuggagauacagucugcaa

SEQ ID NO: 56312 - RNA, 20 nt, Homo sapiens
uagagagauauggggguucc

SEQ ID NO: 56313 - RNA, 22 nt, Homo sapiens
uagagcacaagguagauuucua

SEQ ID NO: 56314 - RNA, 22 nt, Homo sapiens
uagagguagguguaugaacuag

SEQ ID NO: 56315 - RNA, 22 nt, Homo sapiens
uagagguauaccaaaaaggcau

SEQ ID NO: 56316 - RNA, 22 nt, Homo sapiens
uagcacaucccuaaaaugcugu

SEQ ID NO: 56317 - RNA, 20 nt, Homo sapiens
uagcacaucuggcuguagag

SEQ ID NO: 56318 - RNA, 22 nt, Homo sapiens
uggcggagacauggacuucaga

SEQ ID NO: 56319 - RNA, 22 nt, Homo sapiens
uggcuguguccucucccaaauc

SEQ ID NO: 56320 - RNA, 20 nt, Homo sapiens
ugggaaauguccaggacaua

SEQ ID NO: 56321 - RNA, 22 nt, Homo sapiens
ugggaugaugaaaaggcuuucu

SEQ ID NO: 56322 - RNA, 22 nt, Homo sapiens
ugggauguagccuucuauuuuc

SEQ ID NO: 56323 - RNA, 22 nt, Homo sapiens
ugggcaguauggucauuuucgu

SEQ ID NO: 56324 - RNA, 22 nt, Homo sapiens
ugggcggagacgugcagccgcc

SEQ ID NO: 56325 - RNA, 22 nt, Homo sapiens
ugggguaggccugguuaugugc

SEQ ID NO: 56326 - RNA, 22 nt, Homo sapiens
uggguaggaccagaaaugcacu

SEQ ID NO: 56327 - RNA, 22 nt, Homo sapiens
uggguaguuuuucagcucuugc

SEQ ID NO: 56328 - RNA, 22 nt, Homo sapiens
ugguauuuaauauaugagaguu

SEQ ID NO: 56329 - RNA, 22 nt, Homo sapiens
uggucaugaggugaggcuucuc

SEQ ID NO: 56330 - RNA, 22 nt, Homo sapiens
uggucccucugaaaauugggug

SEQ ID NO: 56331 - RNA, 22 nt, Homo sapiens
uggugcuugaugaggguggagc

SEQ ID NO: 56332 - RNA, 22 nt, Homo sapiens
ugguguuugagaagcugauguc

SEQ ID NO: 56333 - RNA, 22 nt, Homo sapiens
ugguucaguugcacaggcuguu

SEQ ID NO: 56334 - RNA, 23 nt, Homo sapiens
uaagacacuaacuuuaugcuuug

SEQ ID NO: 56335 - RNA, 20 nt, Homo sapiens
uaagacaugguccacaugcc

SEQ ID NO: 56336 - RNA, 21 nt, Homo sapiens
uaagcuaaacauucaguuaac

SEQ ID NO: 56337 - RNA, 22 nt, Homo sapiens
uaagcuauagugaauaaauugc

SEQ ID NO: 56338 - RNA, 22 nt, Homo sapiens
uaaggaaggcugugugcuuuua

SEQ ID NO: 56339 - RNA, 22 nt, Homo sapiens
uaaggcaaucagucaugguguu

SEQ ID NO: 56340 - RNA, 22 nt, Homo sapiens
uaaggcuuugucuuaggacuuu

SEQ ID NO: 56341 - RNA, 22 nt, Homo sapiens
uaagugaugucuuuuugugugc

SEQ ID NO: 56342 - RNA, 22 nt, Homo sapiens
uaauacuugucauaaaggcauu

SEQ ID NO: 56343 - RNA, 22 nt, Homo sapiens
uaaugugaauagugcuguaaug

SEQ ID NO: 56344 - RNA, 22 nt, Homo sapiens
uaaugugcuucucuaccauagg

SEQ ID NO: 56345 - RNA, 22 nt, Homo sapiens
uaauucugacaacaguggcguu

SEQ ID NO: 56346 - RNA, 22 nt, Homo sapiens
uacaaguaauaagggaagaauu

SEQ ID NO: 56347 - RNA, 22 nt, Homo sapiens
uacagaguauccauuugaguuc

SEQ ID NO: 56348 - RNA, 22 nt, Homo sapiens
uacaggacuucucagaguuauu

SEQ ID NO: 56349 - RNA, 22 nt, Homo sapiens
uacaucagccugaaagagcucg

SEQ ID NO: 56350 - RNA, 22 nt, Homo sapiens
uacauccauccugcugggcagu

SEQ ID NO: 56351 - RNA, 22 nt, Homo sapiens
uaccacaggcuggguaaucuau

SEQ ID NO: 56352 - RNA, 22 nt, Homo sapiens
uaccaguaaugguucuagagga

SEQ ID NO: 56353 - RNA, 22 nt, Homo sapiens
uaccuguagcucuucuaggcug

SEQ ID NO: 56354 - RNA, 22 nt, Homo sapiens
uacuacuuucugacaucuuuaa

SEQ ID NO: 56355 - RNA, 22 nt, Homo sapiens
uacugcacauaugaagguuccc

SEQ ID NO: 56356 - RNA, 19 nt, Homo sapiens
uacugcaccucaaccuggg

SEQ ID NO: 56357 - RNA, 22 nt, Homo sapiens
uacugcacuccagccucgguga

SEQ ID NO: 56358 - RNA, 22 nt, Homo sapiens
uacugcacuccagccugggaga

SEQ ID NO: 56359 - RNA, 22 nt, Homo sapiens
uacugcacuccagcuuaggaga

SEQ ID NO: 56360 - RNA, 19 nt, Homo sapiens
uacugcacuccagucuggg

SEQ ID NO: 56361 - RNA, 22 nt, Homo sapiens
uacugcaguugcagcuugagga

SEQ ID NO: 56362 - RNA, 22 nt, Homo sapiens
uacugcaucgaaaugcuuuuau

SEQ ID NO: 56363 - RNA, 22 nt, Homo sapiens
uacuguguaguuagaccucaga

SEQ ID NO: 56364 - RNA, 22 nt, Homo sapiens
uacuuagagacaugcagcacug

SEQ ID NO: 56365 - RNA, 21 nt, Homo sapiens
uacuugagacagggucuugcu

SEQ ID NO: 56366 - RNA, 22 nt, Homo sapiens
uacuuuguagagugugagaauu

SEQ ID NO: 56367 - RNA, 22 nt, Homo sapiens
uagaaaguagggaagguaggau

SEQ ID NO: 56368 - RNA, 22 nt, Homo sapiens
uagaagcacuaucccuccuagu

SEQ ID NO: 56369 - RNA, 22 nt, Homo sapiens
uagacccauuguucagagagug

SEQ ID NO: 56370 - RNA, 22 nt, Homo sapiens
uagagguaggucuucgagucuc

SEQ ID NO: 56371 - RNA, 22 nt, Homo sapiens
uagagguauguauaguauucuu

SEQ ID NO: 56372 - RNA, 22 nt, Homo sapiens
uagagguauuaacaguagaaga

SEQ ID NO: 56373 - RNA, 22 nt, Homo sapiens
uagauuguaauaugcagaaugg

SEQ ID NO: 56374 - RNA, 20 nt, Homo sapiens
uagcacacauguagaauagu

SEQ ID NO: 56375 - RNA, 22 nt, Homo sapiens
uagcagaauauaccucuuacuu

SEQ ID NO: 56376 - RNA, 22 nt, Homo sapiens
uagcagcaccccacucuacugg

SEQ ID NO: 56377 - RNA, 20 nt, Homo sapiens
uagcaggugucaggugauau

SEQ ID NO: 56378 - RNA, 22 nt, Homo sapiens
uagcagguguuccacaaauauu

SEQ ID NO: 56379 - RNA, 22 nt, Homo sapiens
uagcauggaggcggccauagug

SEQ ID NO: 56380 - RNA, 22 nt, Homo sapiens
uagcaugucagucgccacacgu

SEQ ID NO: 56381 - RNA, 22 nt, Homo sapiens
uagcccagugagguugauuugg

SEQ ID NO: 56382 - RNA, 22 nt, Homo sapiens
uagccuguggugaauguuucug

SEQ ID NO: 56383 - RNA, 21 nt, Homo sapiens
uagcugaugauguaggggaug

SEQ ID NO: 56384 - RNA, 22 nt, Homo sapiens
uagcugcuguauguacacggau

SEQ ID NO: 56385 - RNA, 17 nt, Homo sapiens
uagcuucacauuaggaa

SEQ ID NO: 56386 - RNA, 22 nt, Homo sapiens
uaggaaugaacgauuuauuggu

SEQ ID NO: 56387 - RNA, 22 nt, Homo sapiens
uaggagcacaaaccccauugug

SEQ ID NO: 56388 - RNA, 22 nt, Homo sapiens
uaggcaaaugcaagaguagaac

SEQ ID NO: 56389 - RNA, 22 nt, Homo sapiens
uaggcauuuuucugauaaacua

SEQ ID NO: 56390 - RNA, 22 nt, Homo sapiens
uagguaagauguuaacagcuga

SEQ ID NO: 56391 - RNA, 22 nt, Homo sapiens
uagguaaguaauauacagauga

SEQ ID NO: 56392 - RNA, 22 nt, Homo sapiens
uagguaaguaugugugaugggg

SEQ ID NO: 56393 - RNA, 19 nt, Homo sapiens
uaggugguuuuccccucac

SEQ ID NO: 56394 - RNA, 22 nt, Homo sapiens
uaguacuggcauguauuuccca

SEQ ID NO: 56395 - RNA, 18 nt, Homo sapiens
uaguacuguucucaugau

SEQ ID NO: 56396 - RNA, 22 nt, Homo sapiens
uaguagcauaccuaaguauacu

SEQ ID NO: 56397 - RNA, 22 nt, Homo sapiens
uagucaaaucugaaggaaauuu

SEQ ID NO: 56398 - RNA, 21 nt, Homo sapiens
uagugcagugggguaugacuu

SEQ ID NO: 56399 - RNA, 22 nt, Homo sapiens
uauaacacccacauauagucuu

SEQ ID NO: 56400 - RNA, 20 nt, Homo sapiens
uauaacaguuuggacccagu

SEQ ID NO: 56401 - RNA, 22 nt, Homo sapiens
uauacacgugugcauauauaca

SEQ ID NO: 56402 - RNA, 22 nt, Homo sapiens
uauagcacugaaagaggugauu

SEQ ID NO: 56403 - RNA, 22 nt, Homo sapiens
uauagcagugugagaacagacu

SEQ ID NO: 56404 - RNA, 21 nt, Homo sapiens
uauaguaguaugauuuacaau

SEQ ID NO: 56405 - RNA, 22 nt, Homo sapiens
uauaguguuuucaaaaguaugu

SEQ ID NO: 56406 - RNA, 20 nt, Homo sapiens
uaucacaggucagaaacccu

SEQ ID NO: 56407 - RNA, 22 nt, Homo sapiens
uaucacaguaaaucugggugca

SEQ ID NO: 56408 - RNA, 22 nt, Homo sapiens
uagcaccacaaucaagauacag

SEQ ID NO: 56409 - RNA, 22 nt, Homo sapiens
uagcaccucuuuggccuuucgu

SEQ ID NO: 56410 - RNA, 20 nt, Homo sapiens
uagcagcagacagagggagg

SEQ ID NO: 56411 - RNA, 22 nt, Homo sapiens
uagcaguauugaaagaugaggg

SEQ ID NO: 56412 - RNA, 22 nt, Homo sapiens
uaggacacaggacauauguaga

SEQ ID NO: 56413 - RNA, 22 nt, Homo sapiens
uaggacacucucuccaccagua

SEQ ID NO: 56414 - RNA, 22 nt, Homo sapiens
uaggagcacagcagcauguggg

SEQ ID NO: 56415 - RNA, 22 nt, Homo sapiens
uaggcaauguacauaucggccc

SEQ ID NO: 56416 - RNA, 22 nt, Homo sapiens
uaggcagccagcuguggauuga

SEQ ID NO: 56417 - RNA, 22 nt, Homo sapiens
uaggcuuuuggacccugucucu

SEQ ID NO: 56418 - RNA, 22 nt, Homo sapiens
uagguagucagcagugcuuaca

SEQ ID NO: 56419 - RNA, 23 nt, Homo sapiens
uaguaccauauuguuggcagcac

SEQ ID NO: 56420 - RNA, 22 nt, Homo sapiens
uagugcaguggcuccaucucag

SEQ ID NO: 56421 - RNA, 22 nt, Homo sapiens
uagugcugagauugagaagccc

SEQ ID NO: 56422 - RNA, 20 nt, Homo sapiens
uaguggcaugcaccuguagc

SEQ ID NO: 56423 - RNA, 22 nt, Homo sapiens
uauacaugugggcaucaggaga

SEQ ID NO: 56424 - RNA, 22 nt, Homo sapiens
uauagcagugaguauugacuaa

SEQ ID NO: 56425 - RNA, 22 nt, Homo sapiens
uauagcuaugggauguauuugc

SEQ ID NO: 56426 - RNA, 22 nt, Homo sapiens
uaucacaguugcauauuuaagg

SEQ ID NO: 56427 - RNA, 19 nt, Homo sapiens
uaucacuucccuggaaaca

SEQ ID NO: 56428 - RNA, 22 nt, Homo sapiens
uaucauugccucaaucuguauu

SEQ ID NO: 56429 - RNA, 22 nt, Homo sapiens
uauccuguagcucauccaccgc

SEQ ID NO: 56430 - RNA, 22 nt, Homo sapiens
uaucuacauguagguauguaug

SEQ ID NO: 56431 - RNA, 22 nt, Homo sapiens
uaucucauccuccuugauccca

SEQ ID NO: 56432 - RNA, 22 nt, Homo sapiens
uaugaucauuauguuauugcag

SEQ ID NO: 56433 - RNA, 22 nt, Homo sapiens
uauggcuuuuaacugucguaug

SEQ ID NO: 56434 - RNA, 22 nt, Homo sapiens
uauggcuuuucacuuaaguccu

SEQ ID NO: 56435 - RNA, 19 nt, Homo sapiens
uauguaguuuucucaauau

SEQ ID NO: 56436 - RNA, 22 nt, Homo sapiens
uaugucuuuugcuugcaaauag

SEQ ID NO: 56437 - RNA, 20 nt, Homo sapiens
uauuacagaguaauggugga

SEQ ID NO: 56438 - RNA, 22 nt, Homo sapiens
uauucacaggugugggacaaag

SEQ ID NO: 56439 - RNA, 22 nt, Homo sapiens
uauuccacacuguuggugggau

SEQ ID NO: 56440 - RNA, 22 nt, Homo sapiens
uauuccacuauuaguccagaug

SEQ ID NO: 56441 - RNA, 22 nt, Homo sapiens
uauuccacucuguuggagguaa

SEQ ID NO: 56442 - RNA, 22 nt, Homo sapiens
uauuccacuggcacugcauuug

SEQ ID NO: 56443 - RNA, 22 nt, Homo sapiens
uauuccacuuacaugagguauc

SEQ ID NO: 56444 - RNA, 22 nt, Homo sapiens
uauuccauuugugaaaggaagu

SEQ ID NO: 56445 - RNA, 18 nt, Homo sapiens
uauuccucuuccucuauc

SEQ ID NO: 56446 - RNA, 22 nt, Homo sapiens
uauugcacgccagccugagcaa

SEQ ID NO: 56447 - RNA, 22 nt, Homo sapiens
uauugcagugagauccaucugg

SEQ ID NO: 56448 - RNA, 22 nt, Homo sapiens
uauugcugaugcugaagggaag

SEQ ID NO: 56449 - RNA, 22 nt, Homo sapiens
uauuugguuacuugaauagcua

SEQ ID NO: 56450 - RNA, 22 nt, Homo sapiens
acugcacuccagccuaggcgac

SEQ ID NO: 56451 - RNA, 22 nt, Homo sapiens
acugcacuccagccucaugaca

SEQ ID NO: 56452 - RNA, 22 nt, Homo sapiens
acugcacuccagccuccugaca

SEQ ID NO: 56453 - RNA, 22 nt, Homo sapiens
acugcacuccagccucggcaau

SEQ ID NO: 56454 - RNA, 22 nt, Homo sapiens
acugcacuccagccuggacgaa

SEQ ID NO: 56455 - RNA, 22 nt, Homo sapiens
acugcacuccagccuggcggac

SEQ ID NO: 56456 - RNA, 22 nt, Homo sapiens
acugcacuccagccuugcgaca

SEQ ID NO: 56457 - RNA, 22 nt, Homo sapiens
cauugcacuccagccugaguga

SEQ ID NO: 56458 - RNA, 22 nt, Homo sapiens
cauugcacucuagccucggcaa

SEQ ID NO: 56459 - RNA, 22 nt, Homo sapiens
cauuuuacuuuccagacgugga

SEQ ID NO: 56460 - RNA, 22 nt, Homo sapiens
ccaagugcuuaaaauuucauuu

SEQ ID NO: 56461 - RNA, 19 nt, Homo sapiens
ccacaaugguugaacuaga

SEQ ID NO: 56462 - RNA, 22 nt, Homo sapiens
ccacccuggagaauuugagguc

SEQ ID NO: 56463 - RNA, 22 nt, Homo sapiens
ccagcaccauuuauuaaauagg

SEQ ID NO: 56464 - RNA, 22 nt, Homo sapiens
ccagcaccauuuguugaauagg

SEQ ID NO: 56465 - RNA, 20 nt, Homo sapiens
ccaguguuauuuauguucua

SEQ ID NO: 56466 - RNA, 22 nt, Homo sapiens
ccaguguucuggaaggcugagu

SEQ ID NO: 56467 - RNA, 19 nt, Homo sapiens
ccaguguugccagagcuga

SEQ ID NO: 56468 - RNA, 22 nt, Homo sapiens
ccaguguuuggauuagggaugc

SEQ ID NO: 56469 - RNA, 22 nt, Homo sapiens
cccagugugaacuuggcauuuu

SEQ ID NO: 56470 - RNA, 22 nt, Homo sapiens
cccaguuuugccacuuacuagc

SEQ ID NO: 56471 - RNA, 22 nt, Homo sapiens
cccaguuuugcuucucaugagg

SEQ ID NO: 56472 - RNA, 22 nt, Homo sapiens
ccccauguucucucugcagcuc

SEQ ID NO: 56473 - RNA, 22 nt, Homo sapiens
cccuguguuuagcugaagguuu

SEQ ID NO: 56474 - RNA, 22 nt, Homo sapiens
ccucuguaguccugcaagagga

SEQ ID NO: 56475 - RNA, 22 nt, Homo sapiens
ccugucuugaagagauccuccu

SEQ ID NO: 56476 - RNA, 22 nt, Homo sapiens
ccuguguuaugguuucuaaugu

SEQ ID NO: 56477 - RNA, 22 nt, Homo sapiens
cuaagcaccuuaguggggaauc

SEQ ID NO: 56478 - RNA, 22 nt, Homo sapiens
cuacagaguaucuaaagaggua

SEQ ID NO: 56479 - RNA, 22 nt, Homo sapiens
cuacaguagagaggauguagaa

SEQ ID NO: 56480 - RNA, 22 nt, Homo sapiens
cuacugcacaucaucugaguua

SEQ ID NO: 56481 - RNA, 22 nt, Homo sapiens
cuagagagaagcugugugaccu

SEQ ID NO: 56482 - RNA, 22 nt, Homo sapiens
cuagccuggagugcaguggugc

SEQ ID NO: 56483 - RNA, 22 nt, Homo sapiens
cucaaguacaugggauuacagg

SEQ ID NO: 56484 - RNA, 20 nt, Homo sapiens
cucacagacagcuucuuucu

SEQ ID NO: 56485 - RNA, 22 nt, Homo sapiens
cucagauacuugggagguugag

SEQ ID NO: 56486 - RNA, 22 nt, Homo sapiens
cucccugagccagggcuuugac

SEQ ID NO: 56487 - RNA, 22 nt, Homo sapiens
cucccuuugcugaauguuuuuc

SEQ ID NO: 56488 - RNA, 22 nt, Homo sapiens
cucugagguuauucguaauauu

SEQ ID NO: 56489 - RNA, 22 nt, Homo sapiens
cucugguuucgcaggaaauaga

SEQ ID NO: 56490 - RNA, 22 nt, Homo sapiens
cugaaaagcaucugcauagcug

SEQ ID NO: 56491 - RNA, 22 nt, Homo sapiens
cugaaaugaauuauuuucuuuc

SEQ ID NO: 56492 - RNA, 22 nt, Homo sapiens
cugaauguucuggauggaagag

SEQ ID NO: 56493 - RNA, 22 nt, Homo sapiens
cugaauguuuucuucuauucug

SEQ ID NO: 56494 - RNA, 22 nt, Homo sapiens
cugacacuucaaaacugccaau

SEQ ID NO: 56495 - RNA, 22 nt, Homo sapiens
cugagauggagucucgcauugu

SEQ ID NO: 56496 - RNA, 20 nt, Homo sapiens
cugaggugggagaaucgcuu

SEQ ID NO: 56497 - RNA, 20 nt, Homo sapiens
cugagguugggguccuuccc

SEQ ID NO: 56498 - RNA, 22 nt, Homo sapiens
cugcaaauacuugugggauuuu

SEQ ID NO: 56499 - RNA, 22 nt, Homo sapiens
cugcaauggagaaagugagacu

SEQ ID NO: 56500 - RNA, 22 nt, Homo sapiens
cugcaauguuugaaauggcaaa

SEQ ID NO: 56501 - RNA, 22 nt, Homo sapiens
cugcauuggguuaugcauuuuu

SEQ ID NO: 56502 - RNA, 22 nt, Homo sapiens
cugccuaaagaaaaagacguug

SEQ ID NO: 56503 - RNA, 22 nt, Homo sapiens
cugcuauauugguucaggcuug

SEQ ID NO: 56504 - RNA, 22 nt, Homo sapiens
cuggaaagcaaagggugcauug

SEQ ID NO: 56505 - RNA, 22 nt, Homo sapiens
cuggaaaguagacaaucuaaaa

SEQ ID NO: 56506 - RNA, 22 nt, Homo sapiens
cuggagauuaaccaauugccau

SEQ ID NO: 56507 - RNA, 20 nt, Homo sapiens
cuggaugucgaggcagaggu

SEQ ID NO: 56508 - RNA, 22 nt, Homo sapiens
cuggcaaauguuuucuguaaag

SEQ ID NO: 56509 - RNA, 22 nt, Homo sapiens
cugggcaaugcggcuggauaga

SEQ ID NO: 56510 - RNA, 22 nt, Homo sapiens
cuguaaggcacuaagcauaugu

SEQ ID NO: 56511 - RNA, 23 nt, Homo sapiens
cuguacacauauacaucuaagua

SEQ ID NO: 56512 - RNA, 22 nt, Homo sapiens
cugucacugggaggggcagcag

SEQ ID NO: 56513 - RNA, 22 nt, Homo sapiens
cugucucagccucuccaguagc

SEQ ID NO: 56514 - RNA, 22 nt, Homo sapiens
cugucucagugaauugguuuua

SEQ ID NO: 56515 - RNA, 22 nt, Homo sapiens
cugugcauaugacuuuauugga

SEQ ID NO: 56516 - RNA, 22 nt, Homo sapiens
cugugcuugagagaugacacag

SEQ ID NO: 56517 - RNA, 20 nt, Homo sapiens
cugugguagggaccaggaau

SEQ ID NO: 56518 - RNA, 22 nt, Homo sapiens
cuuaaagcgaauauugguggua

SEQ ID NO: 56519 - RNA, 22 nt, Homo sapiens
cuucaaguaauucugauggcua

SEQ ID NO: 56520 - RNA, 20 nt, Homo sapiens
cuucacagaaguggaaucau

SEQ ID NO: 56521 - RNA, 22 nt, Homo sapiens
cuucacggugccuacuuguguc

SEQ ID NO: 56522 - RNA, 22 nt, Homo sapiens
cuuccaaguggggcacgugcca

SEQ ID NO: 56523 - RNA, 20 nt, Homo sapiens
cuuccaguggccccaucuuu

SEQ ID NO: 56524 - RNA, 22 nt, Homo sapiens
cuucugauugaaaauggaguag

SEQ ID NO: 56525 - RNA, 22 nt, Homo sapiens
cuucuugagacuuaggcuuugg

SEQ ID NO: 56526 - RNA, 22 nt, Homo sapiens
cuucuugagggccugcugggaa

SEQ ID NO: 56527 - RNA, 19 nt, Homo sapiens
cuugccccauucauccucu

SEQ ID NO: 56528 - RNA, 21 nt, Homo sapiens
cuugucuugcuuagaauagac

SEQ ID NO: 56529 - RNA, 22 nt, Homo sapiens
cuuucugaggagaauagagaac

SEQ ID NO: 56530 - RNA, 23 nt, Homo sapiens
cuuuguccccacccaaaucucau

SEQ ID NO: 56531 - RNA, 20 nt, Homo sapiens
cuuuguccuccugcugugcu

SEQ ID NO: 56532 - RNA, 22 nt, Homo sapiens
cuuuugugauuccucaguuacu

SEQ ID NO: 56533 - RNA, 22 nt, Homo sapiens
gaaagugcugcaaggccaugca

SEQ ID NO: 56534 - RNA, 22 nt, Homo sapiens
gaaauguauuaaugaguugaaa

SEQ ID NO: 56535 - RNA, 22 nt, Homo sapiens
gaacuuguguugcuucacaugu

SEQ ID NO: 56536 - RNA, 22 nt, Homo sapiens
gacauguuuacaguguugagag

SEQ ID NO: 56537 - RNA, 22 nt, Homo sapiens
gacuagauauuguucuauguca

SEQ ID NO: 56538 - RNA, 22 nt, Homo sapiens
gacugaggaagcgcucucuccu

SEQ ID NO: 56539 - RNA, 22 nt, Homo sapiens
gacugcagugcagcuguuaggc

SEQ ID NO: 56540 - RNA, 22 nt, Homo sapiens
gacugcauuugccccaucgaau

SEQ ID NO: 56541 - RNA, 22 nt, Homo sapiens
gagaacauuaauaguuaauuuu

SEQ ID NO: 56542 - RNA, 22 nt, Homo sapiens
gagacauguuugccaauaauuu

SEQ ID NO: 56543 - RNA, 22 nt, Homo sapiens
gagagguaguuuuuuggucguc

SEQ ID NO: 56544 - RNA, 22 nt, Homo sapiens
gagagugugucagaggcugcga

SEQ ID NO: 56545 - RNA, 22 nt, Homo sapiens
gagaucacuguuuauauucucu

SEQ ID NO: 56546 - RNA, 22 nt, Homo sapiens
gagaugaaaucuugcucuguca

SEQ ID NO: 56547 - RNA, 22 nt, Homo sapiens
gagaugaagugucaauaaggau

SEQ ID NO: 56548 - RNA, 22 nt, Homo sapiens
acugcacuccaucuuagguggc

SEQ ID NO: 56549 - RNA, 19 nt, Homo sapiens
acugcacuccuccuugggu

SEQ ID NO: 56550 - RNA, 22 nt, Homo sapiens
acugcacugcagccuggccaac

SEQ ID NO: 56551 - RNA, 22 nt, Homo sapiens
acugcacuucaaccucauugac

SEQ ID NO: 56552 - RNA, 22 nt, Homo sapiens
acuggaguuuguucaagaaaua

SEQ ID NO: 56553 - RNA, 18 nt, Homo sapiens
acuggauguaaagggucc

SEQ ID NO: 56554 - RNA, 22 nt, Homo sapiens
acuggcauagggcgggcacagu

SEQ ID NO: 56555 - RNA, 22 nt, Homo sapiens
acugugcuguuuuaauuauuga

SEQ ID NO: 56556 - RNA, 22 nt, Homo sapiens
agaaagugcuucccuuugguga

SEQ ID NO: 56557 - RNA, 23 nt, Homo sapiens
agaaaugucuauucagggucccu

SEQ ID NO: 56558 - RNA, 22 nt, Homo sapiens
agaaccaaucccacauggauac

SEQ ID NO: 56559 - RNA, 22 nt, Homo sapiens
agaacccuuugaaauguguuug

SEQ ID NO: 56560 - RNA, 22 nt, Homo sapiens
agaauguaaacagaauagagga

SEQ ID NO: 56561 - RNA, 22 nt, Homo sapiens
agacagcuggaguaucauagcu

SEQ ID NO: 56562 - RNA, 22 nt, Homo sapiens
agacaguguguguauauauggu

SEQ ID NO: 56563 - RNA, 22 nt, Homo sapiens
agacaucauuugauggugggag

SEQ ID NO: 56564 - RNA, 22 nt, Homo sapiens
agacccuguauguguuuaguuu

SEQ ID NO: 56565 - RNA, 22 nt, Homo sapiens
agacuuagagagucuauucuau

SEQ ID NO: 56566 - RNA, 22 nt, Homo sapiens
agagaugaagauggggcucccg

SEQ ID NO: 56567 - RNA, 22 nt, Homo sapiens
agaggaguacuacuccaagucu

SEQ ID NO: 56568 - RNA, 22 nt, Homo sapiens
agaugccucauguucuagguuc

SEQ ID NO: 56569 - RNA, 23 nt, Homo sapiens
agauggcauuucaguucuuuagg

SEQ ID NO: 56570 - RNA, 22 nt, Homo sapiens
agcaauaugacauugcuacauc

SEQ ID NO: 56571 - RNA, 22 nt, Homo sapiens
agcaccaauaaucagaguucuu

SEQ ID NO: 56572 - RNA, 22 nt, Homo sapiens
agcaccaccguugcucuauccc

SEQ ID NO: 56573 - RNA, 22 nt, Homo sapiens
agcaccauugcacuccagccug

SEQ ID NO: 56574 - RNA, 22 nt, Homo sapiens
agcagguauucgggucaugggg

SEQ ID NO: 56575 - RNA, 22 nt, Homo sapiens
agcaucacacacuacagggaaa

SEQ ID NO: 56576 - RNA, 19 nt, Homo sapiens
agcaucauuauuguuuugg

SEQ ID NO: 56577 - RNA, 20 nt, Homo sapiens
agcaucguuguguuauagcc

SEQ ID NO: 56578 - RNA, 22 nt, Homo sapiens
agccuagagagccacuuugaga

SEQ ID NO: 56579 - RNA, 23 nt, Homo sapiens
agccugguuucccugcuucuccc

SEQ ID NO: 56580 - RNA, 22 nt, Homo sapiens
agcuccauuguaaucaccuggu

SEQ ID NO: 56581 - RNA, 22 nt, Homo sapiens
agcugcacaaauggaugugagg

SEQ ID NO: 56582 - RNA, 22 nt, Homo sapiens
agcuggauguauguuaagugaa

SEQ ID NO: 56583 - RNA, 20 nt, Homo sapiens
agcuugguuuggaugaucac

SEQ ID NO: 56584 - RNA, 22 nt, Homo sapiens
agcuugugauuuagagugagag

SEQ ID NO: 56585 - RNA, 22 nt, Homo sapiens
aggacacugauagucuuuggca

SEQ ID NO: 56586 - RNA, 19 nt, Homo sapiens
aggacuaaagacuagaagu

SEQ ID NO: 56587 - RNA, 22 nt, Homo sapiens
aggagaauugguucuucuugau

SEQ ID NO: 56588 - RNA, 22 nt, Homo sapiens
aggagcacaauggucaugugga

SEQ ID NO: 56589 - RNA, 22 nt, Homo sapiens
aggagcacuggccuuggaguca

SEQ ID NO: 56590 - RNA, 22 nt, Homo sapiens
aggcaagcaucuugcucccuuc

SEQ ID NO: 56591 - RNA, 22 nt, Homo sapiens
aggcaagugggagacagcauuu

SEQ ID NO: 56592 - RNA, 22 nt, Homo sapiens
aggcaaguugcucaaaugcaaa

SEQ ID NO: 56593 - RNA, 22 nt, Homo sapiens
aggcaaugugagaguuuauuca

SEQ ID NO: 56594 - RNA, 22 nt, Homo sapiens
aggcauguggcucuguucugac

SEQ ID NO: 56595 - RNA, 22 nt, Homo sapiens
aggcaugugugcagacugucug

SEQ ID NO: 56596 - RNA, 22 nt, Homo sapiens
agggcaguguuaggacugucug

SEQ ID NO: 56597 - RNA, 22 nt, Homo sapiens
aggguaguaggcuugggauugg

SEQ ID NO: 56598 - RNA, 22 nt, Homo sapiens
aggguuuuuauuuauguggcau

SEQ ID NO: 56599 - RNA, 22 nt, Homo sapiens
agguacuugagauucugaacug

SEQ ID NO: 56600 - RNA, 22 nt, Homo sapiens
aggugcugacaggauagguuuc

SEQ ID NO: 56601 - RNA, 22 nt, Homo sapiens
agguuaccuggugauuuugucu

SEQ ID NO: 56602 - RNA, 22 nt, Homo sapiens
aguaacacaccugcauggugug

SEQ ID NO: 56603 - RNA, 22 nt, Homo sapiens
aguacugucugguuaccugaca

SEQ ID NO: 56604 - RNA, 22 nt, Homo sapiens
agucaaaugcuuauguauaaag

SEQ ID NO: 56605 - RNA, 22 nt, Homo sapiens
agugagcuggagaaaagaaacu

SEQ ID NO: 56606 - RNA, 22 nt, Homo sapiens
aguggaauuaagaaacugaauu

SEQ ID NO: 56607 - RNA, 22 nt, Homo sapiens
aguggauuuuauuugacaacua

SEQ ID NO: 56608 - RNA, 22 nt, Homo sapiens
aguggcacaauuuugacucccc

SEQ ID NO: 56609 - RNA, 22 nt, Homo sapiens
agugguauaauauuauuuugaa

SEQ ID NO: 56610 - RNA, 21 nt, Homo sapiens
aguucacauggcuccuguguu

SEQ ID NO: 56611 - RNA, 19 nt, Homo sapiens
auaaacuagaacugucccc

SEQ ID NO: 56612 - RNA, 22 nt, Homo sapiens
auaacauggaguuugucauuua

SEQ ID NO: 56613 - RNA, 22 nt, Homo sapiens
auaagugcuuguugaauaauag

SEQ ID NO: 56614 - RNA, 22 nt, Homo sapiens
auaaucaugucugaaaccuuug

SEQ ID NO: 56615 - RNA, 22 nt, Homo sapiens
auaauguuuauccagaggaguu

SEQ ID NO: 56616 - RNA, 22 nt, Homo sapiens
auacaagcaguccaacuccaua

SEQ ID NO: 56617 - RNA, 22 nt, Homo sapiens
auacagcuaaaauauuaaguua

SEQ ID NO: 56618 - RNA, 22 nt, Homo sapiens
auacagguauacaaugcauaau

SEQ ID NO: 56619 - RNA, 22 nt, Homo sapiens
auacagugaauacuuacagugu

SEQ ID NO: 56620 - RNA, 22 nt, Homo sapiens
auacaugcauuugcacgagagu

SEQ ID NO: 56621 - RNA, 22 nt, Homo sapiens
auacccugucgugagucagaga

SEQ ID NO: 56622 - RNA, 22 nt, Homo sapiens
auacuagucaagaauguaugag

SEQ ID NO: 56623 - RNA, 22 nt, Homo sapiens
auacuccugucucagcugagau

SEQ ID NO: 56624 - RNA, 22 nt, Homo sapiens
auacugcacauuuagggaggga

SEQ ID NO: 56625 - RNA, 22 nt, Homo sapiens
auacugucucuugcuccugccc

SEQ ID NO: 56626 - RNA, 22 nt, Homo sapiens
auagacugaguggcuuaaacca

SEQ ID NO: 56627 - RNA, 23 nt, Homo sapiens
auagagcuaggaugcagacagau

SEQ ID NO: 56628 - RNA, 22 nt, Homo sapiens
auagagugcuucaucaguagua

SEQ ID NO: 56629 - RNA, 22 nt, Homo sapiens
auagcaaugccccaauccuugg

SEQ ID NO: 56630 - RNA, 22 nt, Homo sapiens
auagcaaugccccacuccuugg

SEQ ID NO: 56631 - RNA, 22 nt, Homo sapiens
auagcaauuugggaaucagacu

SEQ ID NO: 56632 - RNA, 22 nt, Homo sapiens
auagcagaccaccucucccacu

SEQ ID NO: 56633 - RNA, 22 nt, Homo sapiens
auagcagugugaaaauguacua

SEQ ID NO: 56634 - RNA, 22 nt, Homo sapiens
auaggcacauuaggaacuuuug

SEQ ID NO: 56635 - RNA, 22 nt, Homo sapiens
auagugcuggaauaaauauacg

SEQ ID NO: 56636 - RNA, 22 nt, Homo sapiens
auagugcuuuugaaucuuguug

SEQ ID NO: 56637 - RNA, 23 nt, Homo sapiens
auauaguagaugugcaguaacau

SEQ ID NO: 56638 - RNA, 22 nt, Homo sapiens
auaucugcauugccauuuaugu

SEQ ID NO: 56639 - RNA, 22 nt, Homo sapiens
acugcacuccagccuuggccac

SEQ ID NO: 56640 - RNA, 22 nt, Homo sapiens
acugcacuccagcuccagggug

SEQ ID NO: 56641 - RNA, 22 nt, Homo sapiens
acugcacuccagcuuuggguga

SEQ ID NO: 56642 - RNA, 22 nt, Homo sapiens
acugcacuccaguuccgggcaa

SEQ ID NO: 56643 - RNA, 22 nt, Homo sapiens
acugcacuccggccucgugaca

SEQ ID NO: 56644 - RNA, 22 nt, Homo sapiens
acugcacucuagcauggguaau

SEQ ID NO: 56645 - RNA, 22 nt, Homo sapiens
acugcacucuagccuuggcaac

SEQ ID NO: 56646 - RNA, 22 nt, Homo sapiens
acugcacuucagccuuggcuac

SEQ ID NO: 56647 - RNA, 22 nt, Homo sapiens
acuuauuguggcugacccaaac

SEQ ID NO: 56648 - RNA, 22 nt, Homo sapiens
acuuugguuaucauacuuucag

SEQ ID NO: 56649 - RNA, 20 nt, Homo sapiens
agacaguguggagauuccuu

SEQ ID NO: 56650 - RNA, 22 nt, Homo sapiens
agagacauugcuccaacucacc

SEQ ID NO: 56651 - RNA, 22 nt, Homo sapiens
agagagcuugggguguuaaauu

SEQ ID NO: 56652 - RNA, 22 nt, Homo sapiens
agagaucaauaugaaggaaaug

SEQ ID NO: 56653 - RNA, 22 nt, Homo sapiens
agagcacugcugcaggguucug

SEQ ID NO: 56654 - RNA, 22 nt, Homo sapiens
agagugcuuuauuagauguagc

SEQ ID NO: 56655 - RNA, 20 nt, Homo sapiens
agaugcaugcacauaaacac

SEQ ID NO: 56656 - RNA, 22 nt, Homo sapiens
agaugcuguuaucaacuguagc

SEQ ID NO: 56657 - RNA, 23 nt, Homo sapiens
agcaaaugcucuagcacuccaac

SEQ ID NO: 56658 - RNA, 22 nt, Homo sapiens
agcaacauggaguuugugcgca

SEQ ID NO: 56659 - RNA, 22 nt, Homo sapiens
agcaacauuuuugaccuuucuu

SEQ ID NO: 56660 - RNA, 22 nt, Homo sapiens
agcaagaaugaacucucccaga

SEQ ID NO: 56661 - RNA, 22 nt, Homo sapiens
agcaccaugggcugaguaagug

SEQ ID NO: 56662 - RNA, 22 nt, Homo sapiens
agcagcacaucccuuucuggcc

SEQ ID NO: 56663 - RNA, 22 nt, Homo sapiens
agcagcaccaaacagacuaaga

SEQ ID NO: 56664 - RNA, 22 nt, Homo sapiens
agcagguguccacaauguuugc

SEQ ID NO: 56665 - RNA, 22 nt, Homo sapiens
agcaucacaugggcugcuuggg

SEQ ID NO: 56666 - RNA, 18 nt, Homo sapiens
agcaucacugaucauccu

SEQ ID NO: 56667 - RNA, 22 nt, Homo sapiens
agcaucauguuuucgagguuca

SEQ ID NO: 56668 - RNA, 21 nt, Homo sapiens
agccaguguuccuuguggcuc

SEQ ID NO: 56669 - RNA, 22 nt, Homo sapiens
agcucacagccuagcacuguga

SEQ ID NO: 56670 - RNA, 22 nt, Homo sapiens
agcucauugcaaccuccgccuc

SEQ ID NO: 56671 - RNA, 22 nt, Homo sapiens
agcuggcuguagcugcaagucu

SEQ ID NO: 56672 - RNA, 19 nt, Homo sapiens
agcuguguugccugugaga

SEQ ID NO: 56673 - RNA, 22 nt, Homo sapiens
agcuuguuuuccugcaacuaga

SEQ ID NO: 56674 - RNA, 22 nt, Homo sapiens
aggaaguaauaaguuugguucu

SEQ ID NO: 56675 - RNA, 23 nt, Homo sapiens
aggaauggaaaaccaaguaucau

SEQ ID NO: 56676 - RNA, 22 nt, Homo sapiens
aggacacugagcaugggagguu

SEQ ID NO: 56677 - RNA, 22 nt, Homo sapiens
aggacacugauguaugcugugg

SEQ ID NO: 56678 - RNA, 22 nt, Homo sapiens
aggaccauuguguagcagacau

SEQ ID NO: 56679 - RNA, 22 nt, Homo sapiens
aggaccccucaucagcaccagu

SEQ ID NO: 56680 - RNA, 22 nt, Homo sapiens
aggagaugaagcuuuaucuaaa

SEQ ID NO: 56681 - RNA, 22 nt, Homo sapiens
aggagcacaggacuuugauuau

SEQ ID NO: 56682 - RNA, 22 nt, Homo sapiens
aggaggauugcuuucaucuuuu

SEQ ID NO: 56683 - RNA, 22 nt, Homo sapiens
aggagguugguaccaucuguuu

SEQ ID NO: 56684 - RNA, 21 nt, Homo sapiens
aggcaagguguuauuauugaa

SEQ ID NO: 56685 - RNA, 22 nt, Homo sapiens
aggcaugaaauacaugcauuga

SEQ ID NO: 56686 - RNA, 22 nt, Homo sapiens
aggcuuuuggagguggcuuucu

SEQ ID NO: 56687 - RNA, 22 nt, Homo sapiens
agguaauuuucccagagggaaa

SEQ ID NO: 56688 - RNA, 22 nt, Homo sapiens
agguagaguguuuuguucuucu

SEQ ID NO: 56689 - RNA, 20 nt, Homo sapiens
agguagauagaugauagaua

SEQ ID NO: 56690 - RNA, 21 nt, Homo sapiens
agguaguuuuccuuuuggagu

SEQ ID NO: 56691 - RNA, 21 nt, Homo sapiens
aggucaugaagauguucuaau

SEQ ID NO: 56692 - RNA, 22 nt, Homo sapiens
aggugcaugcuucacuggauau

SEQ ID NO: 56693 - RNA, 22 nt, Homo sapiens
aggugguuuugaugagcaggua

SEQ ID NO: 56694 - RNA, 22 nt, Homo sapiens
aguaaagcaucagcuagaugug

SEQ ID NO: 56695 - RNA, 22 nt, Homo sapiens
aguacugucagcaggguguuga

SEQ ID NO: 56696 - RNA, 22 nt, Homo sapiens
aguagcaauggcucugagcuau

SEQ ID NO: 56697 - RNA, 22 nt, Homo sapiens
aguaucaagccacacaugguca

SEQ ID NO: 56698 - RNA, 22 nt, Homo sapiens
agucaagaaucucagcaucuuu

SEQ ID NO: 56699 - RNA, 22 nt, Homo sapiens
agucaagauggcaagguaaggc

SEQ ID NO: 56700 - RNA, 22 nt, Homo sapiens
agucagucuguccugugcugag

SEQ ID NO: 56701 - RNA, 22 nt, Homo sapiens
agucaguguguauugauggcac

SEQ ID NO: 56702 - RNA, 22 nt, Homo sapiens
agugaacaaagaagugcagaua

SEQ ID NO: 56703 - RNA, 22 nt, Homo sapiens
aguguuuuuaucaugaaagggu

SEQ ID NO: 56704 - RNA, 22 nt, Homo sapiens
aguuaguguugugauaaaucca

SEQ ID NO: 56705 - RNA, 22 nt, Homo sapiens
aguucaaugcucuuucuacuau

SEQ ID NO: 56706 - RNA, 18 nt, Homo sapiens
auaaccuggugcuuucaa

SEQ ID NO: 56707 - RNA, 22 nt, Homo sapiens
auaaggaguaucauauuaaaac

SEQ ID NO: 56708 - RNA, 22 nt, Homo sapiens
auaaggcugguauagacauuca

SEQ ID NO: 56709 - RNA, 22 nt, Homo sapiens
auaagugagugauucaguguua

SEQ ID NO: 56710 - RNA, 22 nt, Homo sapiens
auaaucacacccagguuaaaug

SEQ ID NO: 56711 - RNA, 22 nt, Homo sapiens
auaauguuugauugagcagaua

SEQ ID NO: 56712 - RNA, 22 nt, Homo sapiens
auaauugcuaagugaagauggu

SEQ ID NO: 56713 - RNA, 22 nt, Homo sapiens
auacaaggaaugaagagauuug

SEQ ID NO: 56714 - RNA, 22 nt, Homo sapiens
auacaguauggagggcccagcu

SEQ ID NO: 56715 - RNA, 22 nt, Homo sapiens
auacaguguauguauaguacau

SEQ ID NO: 56716 - RNA, 22 nt, Homo sapiens
auaccugguagucuugcuacac

SEQ ID NO: 56717 - RNA, 22 nt, Homo sapiens
auacuguuuuacaucauugccu

SEQ ID NO: 56718 - RNA, 20 nt, Homo sapiens
auagaccauugguagguagg

SEQ ID NO: 56719 - RNA, 22 nt, Homo sapiens
auagaccuggagaguagauaua

SEQ ID NO: 56720 - RNA, 22 nt, Homo sapiens
auagaucauugucauuuuagau

SEQ ID NO: 56721 - RNA, 20 nt, Homo sapiens
auagcauugauggacucaaa

SEQ ID NO: 56722 - RNA, 21 nt, Homo sapiens
auagggcuuguugauaguuaa

SEQ ID NO: 56723 - RNA, 21 nt, Homo sapiens
auagugcuagagaguagcagg

SEQ ID NO: 56724 - RNA, 22 nt, Homo sapiens
auagugcugcaacaaauauacg

SEQ ID NO: 56725 - RNA, 15 nt, Homo sapiens
auauaugcaaugugu

SEQ ID NO: 56726 - RNA, 22 nt, Homo sapiens
auaucacaggaaaggaagauac

SEQ ID NO: 56727 - RNA, 22 nt, Homo sapiens
auaugcauguacccacacaggc

SEQ ID NO: 56728 - RNA, 20 nt, Homo sapiens
auaugcauguguuuucacuu

SEQ ID NO: 56729 - RNA, 22 nt, Homo sapiens
auauggcuuuuauuauguugag

SEQ ID NO: 56730 - RNA, 22 nt, Homo sapiens
gagaugaaguuaaggaucuuua

SEQ ID NO: 56731 - RNA, 22 nt, Homo sapiens
gagauucaucuagguccagaga

SEQ ID NO: 56732 - RNA, 18 nt, Homo sapiens
gagcaccuuuuuugcaga

SEQ ID NO: 56733 - RNA, 22 nt, Homo sapiens
gagcucauuaaaaauguagaau

SEQ ID NO: 56734 - RNA, 22 nt, Homo sapiens
gagcugaauugcugccauuugc

SEQ ID NO: 56735 - RNA, 22 nt, Homo sapiens
gagcugccuugccuaugcaaga

SEQ ID NO: 56736 - RNA, 22 nt, Homo sapiens
gagcugguccuuuaaggaugca

SEQ ID NO: 56737 - RNA, 22 nt, Homo sapiens
gaggagauauucugcuggaugg

SEQ ID NO: 56738 - RNA, 22 nt, Homo sapiens
gaggcauuauucccaucuuaca

SEQ ID NO: 56739 - RNA, 22 nt, Homo sapiens
gagguaagagaauaaacaguuu

SEQ ID NO: 56740 - RNA, 22 nt, Homo sapiens
gagguagugagcagcugaacua

SEQ ID NO: 56741 - RNA, 22 nt, Homo sapiens
gaggucauguggcaggcagcca

SEQ ID NO: 56742 - RNA, 22 nt, Homo sapiens
gaguaaaugucaaguacuuagg

SEQ ID NO: 56743 - RNA, 22 nt, Homo sapiens
gaguaaauguccuagcuucuug

SEQ ID NO: 56744 - RNA, 22 nt, Homo sapiens
gagugguaguuucuagaggugu

SEQ ID NO: 56745 - RNA, 22 nt, Homo sapiens
gaguuacauuguaauugccgag

SEQ ID NO: 56746 - RNA, 22 nt, Homo sapiens
gauaaaucuuggcuagucuaag

SEQ ID NO: 56747 - RNA, 22 nt, Homo sapiens
gauaacagauaaugucaguuau

SEQ ID NO: 56748 - RNA, 19 nt, Homo sapiens
gauagacaucacagugcca

SEQ ID NO: 56749 - RNA, 22 nt, Homo sapiens
gauauugacuuauucuauguuu

SEQ ID NO: 56750 - RNA, 17 nt, Homo sapiens
gaucacagucgucuccu

SEQ ID NO: 56751 - RNA, 22 nt, Homo sapiens
gaucacaugggagaaugagagu

SEQ ID NO: 56752 - RNA, 22 nt, Homo sapiens
gaucuggucuuugauuagacac

SEQ ID NO: 56753 - RNA, 22 nt, Homo sapiens
gaugacuaagaauuuuauaauu

SEQ ID NO: 56754 - RNA, 22 nt, Homo sapiens
gauggcacuuaagagcaagagc

SEQ ID NO: 56755 - RNA, 22 nt, Homo sapiens
gauggcauuucuggaucugccc

SEQ ID NO: 56756 - RNA, 22 nt, Homo sapiens
gauuagcacuucaguuacagua

SEQ ID NO: 56757 - RNA, 22 nt, Homo sapiens
gauuccauugcgaauuuucaga

SEQ ID NO: 56758 - RNA, 22 nt, Homo sapiens
gauuuguuggccugugagcuag

SEQ ID NO: 56759 - RNA, 22 nt, Homo sapiens
gcaaaugcuaugccauuuuaua

SEQ ID NO: 56760 - RNA, 22 nt, Homo sapiens
gcaacugguuucaguuuuucag

SEQ ID NO: 56761 - RNA, 22 nt, Homo sapiens
gcaagaaucugggaguaaaauu

SEQ ID NO: 56762 - RNA, 22 nt, Homo sapiens
gcaauacugacagcauuaguuu

SEQ ID NO: 56763 - RNA, 22 nt, Homo sapiens
gcacauggccccaucgugccga

SEQ ID NO: 56764 - RNA, 22 nt, Homo sapiens
gcagagaaacaggucuaaggag

SEQ ID NO: 56765 - RNA, 22 nt, Homo sapiens
gcaguacuuuauguccuaauua

SEQ ID NO: 56766 - RNA, 22 nt, Homo sapiens
gcaguagugugaucuuggcuca

SEQ ID NO: 56767 - RNA, 22 nt, Homo sapiens
gcagugcaugacgguauauaua

SEQ ID NO: 56768 - RNA, 20 nt, Homo sapiens
gcaguguucacuguauuccu

SEQ ID NO: 56769 - RNA, 20 nt, Homo sapiens
gcauaugucuuuauagcaga

SEQ ID NO: 56770 - RNA, 22 nt, Homo sapiens
gcaugcacuguauuuaaguauc

SEQ ID NO: 56771 - RNA, 22 nt, Homo sapiens
gcauggaaggcgcuuugugacu

SEQ ID NO: 56772 - RNA, 22 nt, Homo sapiens
gccaguguuuuauugagaauuu

SEQ ID NO: 56773 - RNA, 22 nt, Homo sapiens
gcccacuguuaaauuuguuuua

SEQ ID NO: 56774 - RNA, 22 nt, Homo sapiens
gccccgggugaugcagccguca

SEQ ID NO: 56775 - RNA, 22 nt, Homo sapiens
gccuaaaguagugguuuaggcu

SEQ ID NO: 56776 - RNA, 22 nt, Homo sapiens
gcuauggccugaauguuugugu

SEQ ID NO: 56777 - RNA, 22 nt, Homo sapiens
gcucaaguaauggcaguuuugc

SEQ ID NO: 56778 - RNA, 22 nt, Homo sapiens
gcucugguuacaaaggcaaauu

SEQ ID NO: 56779 - RNA, 22 nt, Homo sapiens
gcugucaugagcaacacaugaa

SEQ ID NO: 56780 - RNA, 22 nt, Homo sapiens
gcuguuugccgccaucgcagac

SEQ ID NO: 56781 - RNA, 21 nt, Homo sapiens
ggaaaguuaaggaaauacccc

SEQ ID NO: 56782 - RNA, 22 nt, Homo sapiens
ggaaaucaucauucucgguaua

SEQ ID NO: 56783 - RNA, 22 nt, Homo sapiens
ggaaauguuuagcauccacuuu

SEQ ID NO: 56784 - RNA, 22 nt, Homo sapiens
ggaagagugaauuaucuugacu

SEQ ID NO: 56785 - RNA, 22 nt, Homo sapiens
ggaaguauaaacuuaguggagu

SEQ ID NO: 56786 - RNA, 22 nt, Homo sapiens
ggaagugcuguguggaagucug

SEQ ID NO: 56787 - RNA, 22 nt, Homo sapiens
ggacaucauuaccauggaccca

SEQ ID NO: 56788 - RNA, 22 nt, Homo sapiens
ggacuguacuccuggccagugu

SEQ ID NO: 56789 - RNA, 22 nt, Homo sapiens
ggagaauguaauugguauuuug

SEQ ID NO: 56790 - RNA, 22 nt, Homo sapiens
ggagaguaauuagacugaaaga

SEQ ID NO: 56791 - RNA, 20 nt, Homo sapiens
ggagagugacauaauucugg

SEQ ID NO: 56792 - RNA, 16 nt, Homo sapiens
ggaggucaucugggaa

SEQ ID NO: 56793 - RNA, 22 nt, Homo sapiens
ggaguguguaggagaaagguaa

SEQ ID NO: 56794 - RNA, 21 nt, Homo sapiens
ggauucaucccucaugaauuu

SEQ ID NO: 56795 - RNA, 22 nt, Homo sapiens
ggcaaauucuuguaugccuacu

SEQ ID NO: 56796 - RNA, 22 nt, Homo sapiens
ggcaagaagagaguuuaaacau

SEQ ID NO: 56797 - RNA, 20 nt, Homo sapiens
ggcaagacccaaagugugug

SEQ ID NO: 56798 - RNA, 22 nt, Homo sapiens
ggcaaggugcuacagacaguga

SEQ ID NO: 56799 - RNA, 22 nt, Homo sapiens
ggcaauauuauuaacccucugu

SEQ ID NO: 56800 - RNA, 22 nt, Homo sapiens
ggcacugugaugugagggggua

SEQ ID NO: 56801 - RNA, 19 nt, Homo sapiens
ggcacugugugagugagga

SEQ ID NO: 56802 - RNA, 22 nt, Homo sapiens
ggcacuguugccggccugaauu

SEQ ID NO: 56803 - RNA, 22 nt, Homo sapiens
ggcagcacaauuuucugaugga

SEQ ID NO: 56804 - RNA, 17 nt, Homo sapiens
ggcaggaauuaauguca

SEQ ID NO: 56805 - RNA, 22 nt, Homo sapiens
ggcaguuuguucuugcuccuuu

SEQ ID NO: 56806 - RNA, 22 nt, Homo sapiens
ggcaugguggugugugccuaua

SEQ ID NO: 56807 - RNA, 22 nt, Homo sapiens
ggccagaugaucuaugaaggaa

SEQ ID NO: 56808 - RNA, 18 nt, Homo sapiens
ggcggguguuuuauucac

SEQ ID NO: 56809 - RNA, 22 nt, Homo sapiens
ggcucaguugcaaaucaguuca

SEQ ID NO: 56810 - RNA, 22 nt, Homo sapiens
gggaacaugagaaugugaauga

SEQ ID NO: 56811 - RNA, 20 nt, Homo sapiens
gggaaugcaaauucucaucc

SEQ ID NO: 56812 - RNA, 22 nt, Homo sapiens
gggaguagagaguuucucugac

SEQ ID NO: 56813 - RNA, 22 nt, Homo sapiens
gggagugugcacacaugguaua

SEQ ID NO: 56814 - RNA, 22 nt, Homo sapiens
gggcauugugggcagagggcag

SEQ ID NO: 56815 - RNA, 22 nt, Homo sapiens
gggggagugugguacccagcau

SEQ ID NO: 56816 - RNA, 22 nt, Homo sapiens
ggguaaaucucuuuucauggcu

SEQ ID NO: 56817 - RNA, 17 nt, Homo sapiens
gggucaccuugcaggua

SEQ ID NO: 56818 - RNA, 22 nt, Homo sapiens
gguaaaucuucacuaagacuga

SEQ ID NO: 56819 - RNA, 22 nt, Homo sapiens
gguaacaguggggcuaugcuua

SEQ ID NO: 56820 - RNA, 22 nt, Homo sapiens
ggucaacaucaucaugguaagu

SEQ ID NO: 56821 - RNA, 22 nt, Homo sapiens
ggucuagagagagggguggacu

SEQ ID NO: 56822 - RNA, 22 nt, Homo sapiens
auaugcaaauccauagagacag

SEQ ID NO: 56823 - RNA, 22 nt, Homo sapiens
auaugcauacauguaugcagga

SEQ ID NO: 56824 - RNA, 22 nt, Homo sapiens
auaugcuuauuagcaagaaaua

SEQ ID NO: 56825 - RNA, 22 nt, Homo sapiens
auauggcuaugugagcauacca

SEQ ID NO: 56826 - RNA, 22 nt, Homo sapiens
auauguaguauggaaacauugu

SEQ ID NO: 56827 - RNA, 21 nt, Homo sapiens
auaugugcuguggaagucagc

SEQ ID NO: 56828 - RNA, 22 nt, Homo sapiens
auauuacagagaggaccuggga

SEQ ID NO: 56829 - RNA, 21 nt, Homo sapiens
auauuacuguuagaggacugc

SEQ ID NO: 56830 - RNA, 22 nt, Homo sapiens
auauucaagugaggauggcuaa

SEQ ID NO: 56831 - RNA, 22 nt, Homo sapiens
auauuggacugugcuaguuaga

SEQ ID NO: 56832 - RNA, 22 nt, Homo sapiens
auauuguacugcuacugguucu

SEQ ID NO: 56833 - RNA, 22 nt, Homo sapiens
aucacaguggucagguauagau

SEQ ID NO: 56834 - RNA, 22 nt, Homo sapiens
aucaggaaccuuuuuggugugu

SEQ ID NO: 56835 - RNA, 22 nt, Homo sapiens
aucaucacaguuguguguaaug

SEQ ID NO: 56836 - RNA, 22 nt, Homo sapiens
auccauugcacuauggaaagug

SEQ ID NO: 56837 - RNA, 22 nt, Homo sapiens
aucccugagccugacucucaga

SEQ ID NO: 56838 - RNA, 22 nt, Homo sapiens
aucccuguaguaauauucuagc

SEQ ID NO: 56839 - RNA, 22 nt, Homo sapiens
aucccugugauccaaucacuuc

SEQ ID NO: 56840 - RNA, 22 nt, Homo sapiens
aucccuguguccagcaccugug

SEQ ID NO: 56841 - RNA, 22 nt, Homo sapiens
auccucaguggcuuaaguauag

SEQ ID NO: 56842 - RNA, 22 nt, Homo sapiens
aucugacuuuuaauuugaaaac

SEQ ID NO: 56843 - RNA, 22 nt, Homo sapiens
aucuuugauuguagguacaaug

SEQ ID NO: 56844 - RNA, 22 nt, Homo sapiens
augaaagugauaaaugucucua

SEQ ID NO: 56845 - RNA, 22 nt, Homo sapiens
augaagagaaaguggaucuugg

SEQ ID NO: 56846 - RNA, 22 nt, Homo sapiens
augaaguauuaggacacauuua

SEQ ID NO: 56847 - RNA, 20 nt, Homo sapiens
augaagugaaguuagggaac

SEQ ID NO: 56848 - RNA, 22 nt, Homo sapiens
augaauacugcugcaaugaaca

SEQ ID NO: 56849 - RNA, 22 nt, Homo sapiens
augaaugcagcacuguuuuucu

SEQ ID NO: 56850 - RNA, 22 nt, Homo sapiens
augaaugcuuuuggauguaucu

SEQ ID NO: 56851 - RNA, 23 nt, Homo sapiens
augaauguaaggaguguaagaaa

SEQ ID NO: 56852 - RNA, 22 nt, Homo sapiens
augaauuuucugauguugggua

SEQ ID NO: 56853 - RNA, 22 nt, Homo sapiens
augacagagauaugugaauuuu

SEQ ID NO: 56854 - RNA, 22 nt, Homo sapiens
augacauuccacagccguagag

SEQ ID NO: 56855 - RNA, 19 nt, Homo sapiens
augacauuuggggguggac

SEQ ID NO: 56856 - RNA, 20 nt, Homo sapiens
augacuagaggacaugguaa

SEQ ID NO: 56857 - RNA, 22 nt, Homo sapiens
augacuagaggagggauggcca

SEQ ID NO: 56858 - RNA, 22 nt, Homo sapiens
augacucagaucuguuccuggu

SEQ ID NO: 56859 - RNA, 22 nt, Homo sapiens
augacugagacuaacuuacuuu

SEQ ID NO: 56860 - RNA, 22 nt, Homo sapiens
augacugucagggcagucauug

SEQ ID NO: 56861 - RNA, 22 nt, Homo sapiens
augagaacauaucaagugauug

SEQ ID NO: 56862 - RNA, 22 nt, Homo sapiens
augagaacugucaaugagagcu

SEQ ID NO: 56863 - RNA, 22 nt, Homo sapiens
augagaauguaaguuaaugaaa

SEQ ID NO: 56864 - RNA, 22 nt, Homo sapiens
augagacaguucccuuuaucuu

SEQ ID NO: 56865 - RNA, 22 nt, Homo sapiens
augagauaggaacaaacuuaca

SEQ ID NO: 56866 - RNA, 22 nt, Homo sapiens
augagaugauaggcguucuaac

SEQ ID NO: 56867 - RNA, 22 nt, Homo sapiens
augaggaaggagccuuugucug

SEQ ID NO: 56868 - RNA, 22 nt, Homo sapiens
augagggcggacgcccuggaga

SEQ ID NO: 56869 - RNA, 22 nt, Homo sapiens
augauacuggcuucauagaaug

SEQ ID NO: 56870 - RNA, 22 nt, Homo sapiens
augauauguuuguagcuaucuc

SEQ ID NO: 56871 - RNA, 22 nt, Homo sapiens
augcaaaucuuaaguaugugug

SEQ ID NO: 56872 - RNA, 19 nt, Homo sapiens
augcaaugucacaggcugc

SEQ ID NO: 56873 - RNA, 22 nt, Homo sapiens
augcacaguccagcccaugugg

SEQ ID NO: 56874 - RNA, 22 nt, Homo sapiens
augcacauauguacugcccuau

SEQ ID NO: 56875 - RNA, 22 nt, Homo sapiens
augcacuguuuucuugaugaga

SEQ ID NO: 56876 - RNA, 22 nt, Homo sapiens
augcagagaaaucuaaaauaug

SEQ ID NO: 56877 - RNA, 22 nt, Homo sapiens
augccacugcacuucagccugg

SEQ ID NO: 56878 - RNA, 22 nt, Homo sapiens
augccacugcgcucuagccugg

SEQ ID NO: 56879 - RNA, 22 nt, Homo sapiens
augccuaagacccuguggggga

SEQ ID NO: 56880 - RNA, 21 nt, Homo sapiens
auggaaagacugccucuucaa

SEQ ID NO: 56881 - RNA, 22 nt, Homo sapiens
auggaagcugauuagauaguac

SEQ ID NO: 56882 - RNA, 22 nt, Homo sapiens
auggacagacacuggccuucug

SEQ ID NO: 56883 - RNA, 22 nt, Homo sapiens
auggagugagaauggagguucc

SEQ ID NO: 56884 - RNA, 22 nt, Homo sapiens
auggauuuuaggauacaguuga

SEQ ID NO: 56885 - RNA, 22 nt, Homo sapiens
auggcacuaaguucaacacuua

SEQ ID NO: 56886 - RNA, 22 nt, Homo sapiens
auggcacugaagcguauugaca

SEQ ID NO: 56887 - RNA, 22 nt, Homo sapiens
auggcacuguguauuuuucugu

SEQ ID NO: 56888 - RNA, 22 nt, Homo sapiens
auggcacuuuggacugcuagau

SEQ ID NO: 56889 - RNA, 22 nt, Homo sapiens
auggcagugucuagggguguuu

SEQ ID NO: 56890 - RNA, 22 nt, Homo sapiens
auggcaguuucacucugggauu

SEQ ID NO: 56891 - RNA, 22 nt, Homo sapiens
auggcaguuuggucucugugcu

SEQ ID NO: 56892 - RNA, 22 nt, Homo sapiens
auggcucuguuccaugugucuu

SEQ ID NO: 56893 - RNA, 22 nt, Homo sapiens
auggcucuguuuuuuaugcucu

SEQ ID NO: 56894 - RNA, 22 nt, Homo sapiens
auggcucuuauuauuuugaggu

SEQ ID NO: 56895 - RNA, 22 nt, Homo sapiens
auggcuguuccugggaguucua

SEQ ID NO: 56896 - RNA, 22 nt, Homo sapiens
auggcuguuuaagaguuucauu

SEQ ID NO: 56897 - RNA, 22 nt, Homo sapiens
auggcuuuaagagugucugaau

SEQ ID NO: 56898 - RNA, 22 nt, Homo sapiens
auggcuuucaggacguggcgag

SEQ ID NO: 56899 - RNA, 22 nt, Homo sapiens
auggcuuugggcugcucugccc

SEQ ID NO: 56900 - RNA, 22 nt, Homo sapiens
auggcuuuggucucccagugau

SEQ ID NO: 56901 - RNA, 22 nt, Homo sapiens
auggcuuuguguucagagcuga

SEQ ID NO: 56902 - RNA, 22 nt, Homo sapiens
auggcuuuuccugucuugcaug

SEQ ID NO: 56903 - RNA, 22 nt, Homo sapiens
augggcaaauguuggaaauucc

SEQ ID NO: 56904 - RNA, 22 nt, Homo sapiens
augggguagguagcucggggaa

SEQ ID NO: 56905 - RNA, 22 nt, Homo sapiens
auggucccuguuccaugcuccu

SEQ ID NO: 56906 - RNA, 20 nt, Homo sapiens
augucaggaagggagucagg

SEQ ID NO: 56907 - RNA, 22 nt, Homo sapiens
augugacagcaacccccagccc

SEQ ID NO: 56908 - RNA, 22 nt, Homo sapiens
augugcuuauagguguauguuu

SEQ ID NO: 56909 - RNA, 22 nt, Homo sapiens
augugggaggacuuggcuguug

SEQ ID NO: 56910 - RNA, 22 nt, Homo sapiens
augugugcuugauguaaaaagu

SEQ ID NO: 56911 - RNA, 23 nt, Homo sapiens
augugugcuuggagagcaggaug

SEQ ID NO: 56912 - RNA, 22 nt, Homo sapiens
auguuguaguaugagucaaaau

SEQ ID NO: 56913 - RNA, 22 nt, Homo sapiens
auaugucuguuuagucuguaau

SEQ ID NO: 56914 - RNA, 22 nt, Homo sapiens
auauugacuuucucuuagauca

SEQ ID NO: 56915 - RNA, 22 nt, Homo sapiens
aucaagccaaagaaaguccuug

SEQ ID NO: 56916 - RNA, 22 nt, Homo sapiens
aucacagugaaaacagucaauu

SEQ ID NO: 56917 - RNA, 22 nt, Homo sapiens
aucacaguuuuaccauuuggua

SEQ ID NO: 56918 - RNA, 22 nt, Homo sapiens
aucacauggccagguaguaauc

SEQ ID NO: 56919 - RNA, 20 nt, Homo sapiens
aucacuggagaaggaaaccu

SEQ ID NO: 56920 - RNA, 18 nt, Homo sapiens
aucagggugaagagagga

SEQ ID NO: 56921 - RNA, 22 nt, Homo sapiens
auccacagugucaauguuguga

SEQ ID NO: 56922 - RNA, 22 nt, Homo sapiens
auccacaugcaguuggaaacag

SEQ ID NO: 56923 - RNA, 22 nt, Homo sapiens
aucccuguaacuagcagccccu

SEQ ID NO: 56924 - RNA, 22 nt, Homo sapiens
auccucugagaucuaggcagag

SEQ ID NO: 56925 - RNA, 22 nt, Homo sapiens
auccugaugacacagugcugca

SEQ ID NO: 56926 - RNA, 22 nt, Homo sapiens
aucuacuugcugggucucugga

SEQ ID NO: 56927 - RNA, 22 nt, Homo sapiens
aucucaaugcuuuuguaggcca

SEQ ID NO: 56928 - RNA, 22 nt, Homo sapiens
aucucagcaacuaaagauccuu

SEQ ID NO: 56929 - RNA, 22 nt, Homo sapiens
aucuucucuugaagggugggga

SEQ ID NO: 56930 - RNA, 22 nt, Homo sapiens
aucuugcauuugcuaaaaugca

SEQ ID NO: 56931 - RNA, 22 nt, Homo sapiens
aucuuuggcgggaauaucacag

SEQ ID NO: 56932 - RNA, 22 nt, Homo sapiens
augaagaucaugaagacggcuu

SEQ ID NO: 56933 - RNA, 22 nt, Homo sapiens
augaagauguugccuuuuuaau

SEQ ID NO: 56934 - RNA, 22 nt, Homo sapiens
augaaguuagcucauuucuuuu

SEQ ID NO: 56935 - RNA, 23 nt, Homo sapiens
augacacuguccuugaccauuuc

SEQ ID NO: 56936 - RNA, 22 nt, Homo sapiens
augacagcaucugugaaguugu

SEQ ID NO: 56937 - RNA, 22 nt, Homo sapiens
augacagugagugagcucucac

SEQ ID NO: 56938 - RNA, 22 nt, Homo sapiens
augacugaguagcauuccauua

SEQ ID NO: 56939 - RNA, 22 nt, Homo sapiens
augagauauguuaaaaguuaaa

SEQ ID NO: 56940 - RNA, 22 nt, Homo sapiens
augagauucuuagagaagucug

SEQ ID NO: 56941 - RNA, 22 nt, Homo sapiens
augaggugggagaaucacuuga

SEQ ID NO: 56942 - RNA, 22 nt, Homo sapiens
augaggugggcggcuuggaaga

SEQ ID NO: 56943 - RNA, 22 nt, Homo sapiens
augaguugaagcuacaagaggc

SEQ ID NO: 56944 - RNA, 22 nt, Homo sapiens
augauaucuuguuuuucaugca

SEQ ID NO: 56945 - RNA, 22 nt, Homo sapiens
augauauggguugucaguugua

SEQ ID NO: 56946 - RNA, 22 nt, Homo sapiens
augcaagaaauaucucuuuuuc

SEQ ID NO: 56947 - RNA, 22 nt, Homo sapiens
augcaagacaccgauuagcuuu

SEQ ID NO: 56948 - RNA, 22 nt, Homo sapiens
augcaauucuagauugauagua

SEQ ID NO: 56949 - RNA, 22 nt, Homo sapiens
augcacuguauaggaucuugcg

SEQ ID NO: 56950 - RNA, 22 nt, Homo sapiens
augccacugcacuucagcuugg

SEQ ID NO: 56951 - RNA, 22 nt, Homo sapiens
augccacugcauaagguuuuca

SEQ ID NO: 56952 - RNA, 22 nt, Homo sapiens
augccacuguacucuagccuag

SEQ ID NO: 56953 - RNA, 22 nt, Homo sapiens
augcuaugugugacuucuuaug

SEQ ID NO: 56954 - RNA, 22 nt, Homo sapiens
auggaacauuauagauguaaaa

SEQ ID NO: 56955 - RNA, 22 nt, Homo sapiens
auggacucauugaauuaagucc

SEQ ID NO: 56956 - RNA, 21 nt, Homo sapiens
auggacugugugacccugcac

SEQ ID NO: 56957 - RNA, 22 nt, Homo sapiens
auggaguguggaacugggaauc

SEQ ID NO: 56958 - RNA, 22 nt, Homo sapiens
auggaucauauucuugaggagg

SEQ ID NO: 56959 - RNA, 22 nt, Homo sapiens
auggcaaaaaaugcaauuacuu

SEQ ID NO: 56960 - RNA, 22 nt, Homo sapiens
auggcacuacugggaaugucuu

SEQ ID NO: 56961 - RNA, 22 nt, Homo sapiens
auggcacugauggaaguaccuu

SEQ ID NO: 56962 - RNA, 22 nt, Homo sapiens
auggcacugccuggcuucaugg

SEQ ID NO: 56963 - RNA, 22 nt, Homo sapiens
auggcagcugacacuuccgucu

SEQ ID NO: 56964 - RNA, 22 nt, Homo sapiens
auggcagcugguuuuacccuag

SEQ ID NO: 56965 - RNA, 22 nt, Homo sapiens
auggcauuuuuagggcugggug

SEQ ID NO: 56966 - RNA, 22 nt, Homo sapiens
auggcccccuguuugugaacau

SEQ ID NO: 56967 - RNA, 22 nt, Homo sapiens
auggcuucuucuaaaagugggg

SEQ ID NO: 56968 - RNA, 22 nt, Homo sapiens
auggcuuuuauuguguugaggu

SEQ ID NO: 56969 - RNA, 22 nt, Homo sapiens
auggcuuuucacagaggguucu

SEQ ID NO: 56970 - RNA, 21 nt, Homo sapiens
augggguagaagagaaggcuu

SEQ ID NO: 56971 - RNA, 22 nt, Homo sapiens
augggguaggcuuugcugcagu

SEQ ID NO: 56972 - RNA, 22 nt, Homo sapiens
augguaagcugaaaauaucgaa

SEQ ID NO: 56973 - RNA, 22 nt, Homo sapiens
auggucccauucauucacguau

SEQ ID NO: 56974 - RNA, 22 nt, Homo sapiens
augguuuauuuguaagcagagu

SEQ ID NO: 56975 - RNA, 22 nt, Homo sapiens
augguuugugcuccuauaagaa

SEQ ID NO: 56976 - RNA, 22 nt, Homo sapiens
auguaauguuaaauugcuaauu

SEQ ID NO: 56977 - RNA, 22 nt, Homo sapiens
auguaugagaguuccagcugau

SEQ ID NO: 56978 - RNA, 22 nt, Homo sapiens
augucaacauagacaguagagu

SEQ ID NO: 56979 - RNA, 22 nt, Homo sapiens
augucaaggugaagaaagauca

SEQ ID NO: 56980 - RNA, 22 nt, Homo sapiens
augucuggcagaagacuucuca

SEQ ID NO: 56981 - RNA, 20 nt, Homo sapiens
augugcaguguggcaaccaa

SEQ ID NO: 56982 - RNA, 18 nt, Homo sapiens
auguggcuuuugaaggcu

SEQ ID NO: 56983 - RNA, 22 nt, Homo sapiens
auguuauguucuucucuguaua

SEQ ID NO: 56984 - RNA, 20 nt, Homo sapiens
auuagagcuacauggcuaca

SEQ ID NO: 56985 - RNA, 20 nt, Homo sapiens
auucaaguaugccuugagaa

SEQ ID NO: 56986 - RNA, 22 nt, Homo sapiens
auucaccauggcuaccaagggu

SEQ ID NO: 56987 - RNA, 20 nt, Homo sapiens
auucauggaggagcaauugg

SEQ ID NO: 56988 - RNA, 22 nt, Homo sapiens
auuccagauggaguugaggguu

SEQ ID NO: 56989 - RNA, 23 nt, Homo sapiens
auuccaguggcaauuggagaaac

SEQ ID NO: 56990 - RNA, 22 nt, Homo sapiens
auuccaguuugugagaagcugu

SEQ ID NO: 56991 - RNA, 23 nt, Homo sapiens
auugaacacuuucauaugugagg

SEQ ID NO: 56992 - RNA, 16 nt, Homo sapiens
auugacaguggguguu

SEQ ID NO: 56993 - RNA, 22 nt, Homo sapiens
auugcacuccagccuugugaca

SEQ ID NO: 56994 - RNA, 22 nt, Homo sapiens
auugcacucugaucugcacucc

SEQ ID NO: 56995 - RNA, 22 nt, Homo sapiens
auugcaguuagaacagaagucu

SEQ ID NO: 56996 - RNA, 22 nt, Homo sapiens
auugcuuacccuguauuagauc

SEQ ID NO: 56997 - RNA, 22 nt, Homo sapiens
auuggcaauggcaaagcagagu

SEQ ID NO: 56998 - RNA, 22 nt, Homo sapiens
auuggccaaugggacgucagca

SEQ ID NO: 56999 - RNA, 22 nt, Homo sapiens
auuggcuuuauacauaagaaua

SEQ ID NO: 57000 - RNA, 22 nt, Homo sapiens
auuggcuuuugaaagucugcga

SEQ ID NO: 57001 - RNA, 22 nt, Homo sapiens
auuguacauacaccggugugua

SEQ ID NO: 57002 - RNA, 19 nt, Homo sapiens
auuugaucaucaggcacag

SEQ ID NO: 57003 - RNA, 22 nt, Homo sapiens
auuuugcauugcuguaaaggaa

SEQ ID NO: 57004 - RNA, 22 nt, Homo sapiens
ggugagcacagaaugcccugag

SEQ ID NO: 57005 - RNA, 22 nt, Homo sapiens
ggugagguaguaagguacaaua

SEQ ID NO: 57006 - RNA, 22 nt, Homo sapiens
ggugcagcacaccaacauggca

SEQ ID NO: 57007 - RNA, 22 nt, Homo sapiens
gguguguaaauuacuuaucucu

SEQ ID NO: 57008 - RNA, 22 nt, Homo sapiens
guacaguauaguaauaggauuu

SEQ ID NO: 57009 - RNA, 22 nt, Homo sapiens
guacaguggguguagggaccag

SEQ ID NO: 57010 - RNA, 17 nt, Homo sapiens
guacucagugaccaugg

SEQ ID NO: 57011 - RNA, 22 nt, Homo sapiens
guagcagaacauguuccuugua

SEQ ID NO: 57012 - RNA, 22 nt, Homo sapiens
guagcagcaauuuacuccauac

SEQ ID NO: 57013 - RNA, 22 nt, Homo sapiens
guagugcaguuugagaaucagu

SEQ ID NO: 57014 - RNA, 22 nt, Homo sapiens
guaguuuaucagaaagaauagg

SEQ ID NO: 57015 - RNA, 22 nt, Homo sapiens
guauagaucguagaccaauaaa

SEQ ID NO: 57016 - RNA, 22 nt, Homo sapiens
guaugauacuguaacagugggu

SEQ ID NO: 57017 - RNA, 19 nt, Homo sapiens
guauuugguaaacucucca

SEQ ID NO: 57018 - RNA, 22 nt, Homo sapiens
guauuuggugaugccuccaaac

SEQ ID NO: 57019 - RNA, 22 nt, Homo sapiens
guauuuguugcagcagcacuau

SEQ ID NO: 57020 - RNA, 22 nt, Homo sapiens
gucacagcuggcauugucugca

SEQ ID NO: 57021 - RNA, 22 nt, Homo sapiens
gucacugugacggcaguuacau

SEQ ID NO: 57022 - RNA, 22 nt, Homo sapiens
gucacugugaggaggggccagg

SEQ ID NO: 57023 - RNA, 22 nt, Homo sapiens
gucacuguuuccuauuauauuu

SEQ ID NO: 57024 - RNA, 22 nt, Homo sapiens
gucaggaugauuuggggaggug

SEQ ID NO: 57025 - RNA, 22 nt, Homo sapiens
gucaggugcuuacgcggagauc

SEQ ID NO: 57026 - RNA, 22 nt, Homo sapiens
gucaucaggacgggucaucugc

SEQ ID NO: 57027 - RNA, 22 nt, Homo sapiens
gucccugcgauugugggauccu

SEQ ID NO: 57028 - RNA, 22 nt, Homo sapiens
gucccugugucuuuauguggcc

SEQ ID NO: 57029 - RNA, 22 nt, Homo sapiens
gucuaugguucaggguggagug

SEQ ID NO: 57030 - RNA, 22 nt, Homo sapiens
gucuggcacagggaaaguacaa

SEQ ID NO: 57031 - RNA, 20 nt, Homo sapiens
gucugucuccgaguagaauu

SEQ ID NO: 57032 - RNA, 22 nt, Homo sapiens
gucugugcauuaauacgugcug

SEQ ID NO: 57033 - RNA, 22 nt, Homo sapiens
gucuuggagaacucagcuuggc

SEQ ID NO: 57034 - RNA, 22 nt, Homo sapiens
gucuuggcaugugcagcuggga

SEQ ID NO: 57035 - RNA, 22 nt, Homo sapiens
gugaaaugaaacgcuaugucuu

SEQ ID NO: 57036 - RNA, 22 nt, Homo sapiens
gugaaguuuuuugcugagaguc

SEQ ID NO: 57037 - RNA, 22 nt, Homo sapiens
gugagaugguaucucauugugg

SEQ ID NO: 57038 - RNA, 22 nt, Homo sapiens
gugagcaauugauacuugaagu

SEQ ID NO: 57039 - RNA, 22 nt, Homo sapiens
gugagcuccucuucugcugcag

SEQ ID NO: 57040 - RNA, 21 nt, Homo sapiens
gugaggaguuacuggcuuuga

SEQ ID NO: 57041 - RNA, 22 nt, Homo sapiens
gugagggaugugaaaaagguca

SEQ ID NO: 57042 - RNA, 22 nt, Homo sapiens
gugauaucacuguaucacucca

SEQ ID NO: 57043 - RNA, 22 nt, Homo sapiens
gugauuauuaugcacugcaugc

SEQ ID NO: 57044 - RNA, 22 nt, Homo sapiens
gugcacuguagaacccuuuguu

SEQ ID NO: 57045 - RNA, 19 nt, Homo sapiens
gugcauaguuauuaaagag

SEQ ID NO: 57046 - RNA, 22 nt, Homo sapiens
gugccacugcaccuggccuaag

SEQ ID NO: 57047 - RNA, 22 nt, Homo sapiens
gugcuuuguuguggcaguggca

SEQ ID NO: 57048 - RNA, 22 nt, Homo sapiens
guggaaagaacacaaaauuagg

SEQ ID NO: 57049 - RNA, 22 nt, Homo sapiens
guggaaaucucugugugacuua

SEQ ID NO: 57050 - RNA, 21 nt, Homo sapiens
guggaaauggaauuuacuaau

SEQ ID NO: 57051 - RNA, 22 nt, Homo sapiens
guggaagauaguguguuaaugu

SEQ ID NO: 57052 - RNA, 22 nt, Homo sapiens
guggaaugauaucucauugugg

SEQ ID NO: 57053 - RNA, 22 nt, Homo sapiens
guggacagagacuaaauguugu

SEQ ID NO: 57054 - RNA, 22 nt, Homo sapiens
guggcaugaaagcaucugugau

SEQ ID NO: 57055 - RNA, 22 nt, Homo sapiens
gugggguaggguaggacucaac

SEQ ID NO: 57056 - RNA, 22 nt, Homo sapiens
gugggguaggugacuugaugag

SEQ ID NO: 57057 - RNA, 22 nt, Homo sapiens
gugguagaaauguagaugcuag

SEQ ID NO: 57058 - RNA, 22 nt, Homo sapiens
gugguauaaguaccuccuuuca

SEQ ID NO: 57059 - RNA, 22 nt, Homo sapiens
guguaauacacacauauaugca

SEQ ID NO: 57060 - RNA, 22 nt, Homo sapiens
guguagagaaauagccugaagg

SEQ ID NO: 57061 - RNA, 22 nt, Homo sapiens
gugucacuguauaauauuuauu

SEQ ID NO: 57062 - RNA, 22 nt, Homo sapiens
guguccucgaguacacaucagg

SEQ ID NO: 57063 - RNA, 22 nt, Homo sapiens
gugucucagcccagaccuauuu

SEQ ID NO: 57064 - RNA, 22 nt, Homo sapiens
gugugcacaaucuggcaugugc

SEQ ID NO: 57065 - RNA, 21 nt, Homo sapiens
gugugcuugaauucagcuguc

SEQ ID NO: 57066 - RNA, 22 nt, Homo sapiens
gugugucuugaccaggaucgga

SEQ ID NO: 57067 - RNA, 22 nt, Homo sapiens
guucacagugguugccuuccag

SEQ ID NO: 57068 - RNA, 22 nt, Homo sapiens
guucacaguucagccuguaaca

SEQ ID NO: 57069 - RNA, 22 nt, Homo sapiens
guucacaguuucuaaucccagc

SEQ ID NO: 57070 - RNA, 22 nt, Homo sapiens
guucagcaggggcuucaauggu

SEQ ID NO: 57071 - RNA, 22 nt, Homo sapiens
guucaucagggauacuggcuua

SEQ ID NO: 57072 - RNA, 22 nt, Homo sapiens
guucccaguugaaaugauuagu

SEQ ID NO: 57073 - RNA, 22 nt, Homo sapiens
guuugccuuuuagauaggaaug

SEQ ID NO: 57074 - RNA, 22 nt, Homo sapiens
guuuggcucuuguuucugucaa

SEQ ID NO: 57075 - RNA, 21 nt, Homo sapiens
uaaagcuuagcuauaguggcu

SEQ ID NO: 57076 - RNA, 22 nt, Homo sapiens
uaacacagagcuccuaaucccu

SEQ ID NO: 57077 - RNA, 22 nt, Homo sapiens
uaacaggcaaggucacaccuug

SEQ ID NO: 57078 - RNA, 22 nt, Homo sapiens
uaacaguauaugugguaucuau

SEQ ID NO: 57079 - RNA, 21 nt, Homo sapiens
uaacccugaaggagcucugga

SEQ ID NO: 57080 - RNA, 22 nt, Homo sapiens
uaacugcaaccucugccugcug

SEQ ID NO: 57081 - RNA, 20 nt, Homo sapiens
uaacuguggcuucuuuuggc

SEQ ID NO: 57082 - RNA, 22 nt, Homo sapiens
uaagacacuuaaaauguuacau

SEQ ID NO: 57083 - RNA, 22 nt, Homo sapiens
uaaggcuuaugguaaaguccug

SEQ ID NO: 57084 - RNA, 22 nt, Homo sapiens
uaaggcuucuuggaauacugca

SEQ ID NO: 57085 - RNA, 22 nt, Homo sapiens
uaaggcuuugcuggacucaguc

SEQ ID NO: 57086 - RNA, 22 nt, Homo sapiens
uaaggcuuugguagguuugguc

SEQ ID NO: 57087 - RNA, 22 nt, Homo sapiens
uaaguacaugcuagauggaaug

SEQ ID NO: 57088 - RNA, 22 nt, Homo sapiens
uaaguauuaugugcugcauuuu

SEQ ID NO: 57089 - RNA, 22 nt, Homo sapiens
uaaguucauucaugaaacuuag

SEQ ID NO: 57090 - RNA, 22 nt, Homo sapiens
uaauacugcugugcuugaguug

SEQ ID NO: 57091 - RNA, 22 nt, Homo sapiens
uaauacuguaauggugguuccg

SEQ ID NO: 57092 - RNA, 22 nt, Homo sapiens
uaauugaaugcagacaccaggg

SEQ ID NO: 57093 - RNA, 22 nt, Homo sapiens
uacacacguguguauauauaca

SEQ ID NO: 57094 - RNA, 22 nt, Homo sapiens
uacaccauuugauucuuuaagc

SEQ ID NO: 57095 - RNA, 22 nt, Homo sapiens
uggaaaauuaggggagguuaua

SEQ ID NO: 57096 - RNA, 22 nt, Homo sapiens
uggaauaugagacgggguuguc

SEQ ID NO: 57097 - RNA, 22 nt, Homo sapiens
uggacaagugcccuccaccuca

SEQ ID NO: 57098 - RNA, 22 nt, Homo sapiens
uggacugagauuucagcugcca

SEQ ID NO: 57099 - RNA, 22 nt, Homo sapiens
uggacuguaagugccuugagua

SEQ ID NO: 57100 - RNA, 22 nt, Homo sapiens
uggacuguaauagagaacagaa

SEQ ID NO: 57101 - RNA, 22 nt, Homo sapiens
uggagagugagggccuccuuaa

SEQ ID NO: 57102 - RNA, 22 nt, Homo sapiens
uggagauguuuaaaauccacug

SEQ ID NO: 57103 - RNA, 22 nt, Homo sapiens
uggcaaaaaaacgcaauuacgu

SEQ ID NO: 57104 - RNA, 22 nt, Homo sapiens
uggcaaagugugacgugggggu

SEQ ID NO: 57105 - RNA, 22 nt, Homo sapiens
uggcaaaugugagaugagaacu

SEQ ID NO: 57106 - RNA, 23 nt, Homo sapiens
uggcaagauuuguauugccugga

SEQ ID NO: 57107 - RNA, 22 nt, Homo sapiens
uggcaauaauucagugugggcu

SEQ ID NO: 57108 - RNA, 22 nt, Homo sapiens
uggcagugggagauauuuuauu

SEQ ID NO: 57109 - RNA, 19 nt, Homo sapiens
uggcaugaaugugaacuaa

SEQ ID NO: 57110 - RNA, 22 nt, Homo sapiens
uggcauggggcagaacauuaca

SEQ ID NO: 57111 - RNA, 22 nt, Homo sapiens
uggcaugggguaguagcgcugg

SEQ ID NO: 57112 - RNA, 22 nt, Homo sapiens
uggcauguagucugggaccugg

SEQ ID NO: 57113 - RNA, 20 nt, Homo sapiens
uggcucuuugcugcuaaagu

SEQ ID NO: 57114 - RNA, 21 nt, Homo sapiens
uggcuuauuugaaucuggcuu

SEQ ID NO: 57115 - RNA, 22 nt, Homo sapiens
uggcuuuuaucuacucucaacu

SEQ ID NO: 57116 - RNA, 22 nt, Homo sapiens
ugggaagcugcugaacuacagu

SEQ ID NO: 57117 - RNA, 22 nt, Homo sapiens
ugggaugaauacaaugggauca

SEQ ID NO: 57118 - RNA, 22 nt, Homo sapiens
ugggaugugagucuucgcuuuc

SEQ ID NO: 57119 - RNA, 22 nt, Homo sapiens
ugggguagaauagaauugauau

SEQ ID NO: 57120 - RNA, 22 nt, Homo sapiens
ugggguaggcuguauacucugu

SEQ ID NO: 57121 - RNA, 22 nt, Homo sapiens
uggguaauggagaaauaaaucu

SEQ ID NO: 57122 - RNA, 22 nt, Homo sapiens
uggguaguguaaagcacuccag

SEQ ID NO: 57123 - RNA, 22 nt, Homo sapiens
uggguaguuucuuacaacucug

SEQ ID NO: 57124 - RNA, 19 nt, Homo sapiens
uggguaguuuucuggcugg

SEQ ID NO: 57125 - RNA, 22 nt, Homo sapiens
ugguauguaugauuaacaugga

SEQ ID NO: 57126 - RNA, 22 nt, Homo sapiens
uggucaccuucuugcucugucu

SEQ ID NO: 57127 - RNA, 22 nt, Homo sapiens
uguaaacauguauguguuuaug

SEQ ID NO: 57128 - RNA, 22 nt, Homo sapiens
uguaagcauuauauaauuguug

SEQ ID NO: 57129 - RNA, 22 nt, Homo sapiens
uguacaaaacaagaugggggua

SEQ ID NO: 57130 - RNA, 22 nt, Homo sapiens
uguacaaauuucugugguggug

SEQ ID NO: 57131 - RNA, 22 nt, Homo sapiens
uguauauguuuguacauauguc

SEQ ID NO: 57132 - RNA, 22 nt, Homo sapiens
uguauguugggucaaaguacau

SEQ ID NO: 57133 - RNA, 19 nt, Homo sapiens
ugucaaaugucuccugggg

SEQ ID NO: 57134 - RNA, 22 nt, Homo sapiens
ugucaagaugguuugauguugu

SEQ ID NO: 57135 - RNA, 22 nt, Homo sapiens
ugucacagagauuuugguaugu

SEQ ID NO: 57136 - RNA, 22 nt, Homo sapiens
ugucacauccaagaaggugcag

SEQ ID NO: 57137 - RNA, 22 nt, Homo sapiens
ugucacugugcagucaugcauu

SEQ ID NO: 57138 - RNA, 22 nt, Homo sapiens
ugucaguggacugugaaaggca

SEQ ID NO: 57139 - RNA, 22 nt, Homo sapiens
ugucaucuagguauuaagcccc

SEQ ID NO: 57140 - RNA, 22 nt, Homo sapiens
ugucaucuagguuuuaagccuu

SEQ ID NO: 57141 - RNA, 21 nt, Homo sapiens
ugucaugcagagacccuggag

SEQ ID NO: 57142 - RNA, 22 nt, Homo sapiens
ugucauggauucugagucuggg

SEQ ID NO: 57143 - RNA, 22 nt, Homo sapiens
ugucauguaaagaguaaauggu

SEQ ID NO: 57144 - RNA, 22 nt, Homo sapiens
ugucauguuucuacugaccaaa

SEQ ID NO: 57145 - RNA, 22 nt, Homo sapiens
ugucucccuucccauuaggaag

SEQ ID NO: 57146 - RNA, 22 nt, Homo sapiens
ugucuggaaggguggccuccug

SEQ ID NO: 57147 - RNA, 22 nt, Homo sapiens
ugugaagauguuucuuaauuga

SEQ ID NO: 57148 - RNA, 22 nt, Homo sapiens
ugugacucuggcacauggugag

SEQ ID NO: 57149 - RNA, 18 nt, Homo sapiens
ugugcaauauuaaccacc

SEQ ID NO: 57150 - RNA, 22 nt, Homo sapiens
ugugcaaucagcuucauuacau

SEQ ID NO: 57151 - RNA, 22 nt, Homo sapiens
ugugcacaugauauaucacaua

SEQ ID NO: 57152 - RNA, 22 nt, Homo sapiens
ugugccacuccaggaggcuguu

SEQ ID NO: 57153 - RNA, 22 nt, Homo sapiens
ugugcugaucgggcacgguguc

SEQ ID NO: 57154 - RNA, 22 nt, Homo sapiens
ugugcuuguaaaggccagagca

SEQ ID NO: 57155 - RNA, 22 nt, Homo sapiens
uguggcuuuacagcaugguuca

SEQ ID NO: 57156 - RNA, 23 nt, Homo sapiens
ugugguauuauuccauuuauagg

SEQ ID NO: 57157 - RNA, 22 nt, Homo sapiens
uguguaaauauauacacacgug

SEQ ID NO: 57158 - RNA, 22 nt, Homo sapiens
ugugucuuuuaucacacaaugu

SEQ ID NO: 57159 - RNA, 22 nt, Homo sapiens
uguuacagcagaauugaaagag

SEQ ID NO: 57160 - RNA, 22 nt, Homo sapiens
uguuacagcagcacaaaaugga

SEQ ID NO: 57161 - RNA, 20 nt, Homo sapiens
ugcagauucaaccaacugug

SEQ ID NO: 57162 - RNA, 19 nt, Homo sapiens
ugcagcaauguaaaagaca

SEQ ID NO: 57163 - RNA, 17 nt, Homo sapiens
ugcagcacacugauggg

SEQ ID NO: 57164 - RNA, 22 nt, Homo sapiens
ugcagcacugaacuucugggcu

SEQ ID NO: 57165 - RNA, 21 nt, Homo sapiens
ugcagccauucagcccuaugc

SEQ ID NO: 57166 - RNA, 22 nt, Homo sapiens
ugcaggguccauugucccaagu

SEQ ID NO: 57167 - RNA, 22 nt, Homo sapiens
ugcagguacuugacaacuuggg

SEQ ID NO: 57168 - RNA, 22 nt, Homo sapiens
ugcagugcaugacuguguuaug

SEQ ID NO: 57169 - RNA, 22 nt, Homo sapiens
ugcauagaauguucuguaaaua

SEQ ID NO: 57170 - RNA, 22 nt, Homo sapiens
ugcauagcaaaauaggauuaga

SEQ ID NO: 57171 - RNA, 19 nt, Homo sapiens
ugcauaggguuacauacuc

SEQ ID NO: 57172 - RNA, 22 nt, Homo sapiens
ugcauggaggagcuccccgcag

SEQ ID NO: 57173 - RNA, 22 nt, Homo sapiens
ugccaugaagagaggaagcagu

SEQ ID NO: 57174 - RNA, 22 nt, Homo sapiens
ugcccuguaucccacuguuuca

SEQ ID NO: 57175 - RNA, 23 nt, Homo sapiens
ugccuagaugcugcccugggaca

SEQ ID NO: 57176 - RNA, 20 nt, Homo sapiens
ugcugcacuuaagcaugggc

SEQ ID NO: 57177 - RNA, 22 nt, Homo sapiens
ugcugcuguuaucauuuuacca

SEQ ID NO: 57178 - RNA, 22 nt, Homo sapiens
ugcugguguuuaggaauaagaa

SEQ ID NO: 57179 - RNA, 22 nt, Homo sapiens
ugcuucauuggccaccaggaag

SEQ ID NO: 57180 - RNA, 22 nt, Homo sapiens
uggaaaacaugcacauuggauu

SEQ ID NO: 57181 - RNA, 22 nt, Homo sapiens
uggaaacuuauguucuucugug

SEQ ID NO: 57182 - RNA, 22 nt, Homo sapiens
uggaaauuaacagggauugucc

SEQ ID NO: 57183 - RNA, 22 nt, Homo sapiens
uggaagauggaguuuuaucauu

SEQ ID NO: 57184 - RNA, 22 nt, Homo sapiens
uggaagccuagauucuuuucuu

SEQ ID NO: 57185 - RNA, 22 nt, Homo sapiens
uggaaguagauagauuguguca

SEQ ID NO: 57186 - RNA, 22 nt, Homo sapiens
uggaagucuucauuauguauag

SEQ ID NO: 57187 - RNA, 21 nt, Homo sapiens
uggaaucuauuauuccaguuu

SEQ ID NO: 57188 - RNA, 22 nt, Homo sapiens
uggaauuuacuuauuuaggggc

SEQ ID NO: 57189 - RNA, 22 nt, Homo sapiens
uggacagacaagguuauagauc

SEQ ID NO: 57190 - RNA, 22 nt, Homo sapiens
uggaccccugcucgggagcccu

SEQ ID NO: 57191 - RNA, 22 nt, Homo sapiens
uuguuauguaucucaagauaaa

SEQ ID NO: 57192 - RNA, 22 nt, Homo sapiens
uuguuugguugaguauggaagu

SEQ ID NO: 57193 - RNA, 22 nt, Homo sapiens
uuguuuuggagaugagcuaaaa

SEQ ID NO: 57194 - RNA, 22 nt, Homo sapiens
uuuaaacugucuuggguuugga

SEQ ID NO: 57195 - RNA, 22 nt, Homo sapiens
uuuaaugcaucccaaaauguag

SEQ ID NO: 57196 - RNA, 22 nt, Homo sapiens
uuuacagucucauagguggaag

SEQ ID NO: 57197 - RNA, 22 nt, Homo sapiens
uuuacugucuucagucccucug

SEQ ID NO: 57198 - RNA, 22 nt, Homo sapiens
uuuacugugggguuucuuagag

SEQ ID NO: 57199 - RNA, 22 nt, Homo sapiens
uuuauguggagcacuugacaca

SEQ ID NO: 57200 - RNA, 22 nt, Homo sapiens
uuucacagcugucuuccgucuc

SEQ ID NO: 57201 - RNA, 23 nt, Homo sapiens
uuucacaguagcuggaucagccu

SEQ ID NO: 57202 - RNA, 21 nt, Homo sapiens
uuucacugugaguuuuucugu

SEQ ID NO: 57203 - RNA, 22 nt, Homo sapiens
uuucaggcaagggugacccuga

SEQ ID NO: 57204 - RNA, 22 nt, Homo sapiens
uuuccaagaugcuuacuuucuc

SEQ ID NO: 57205 - RNA, 22 nt, Homo sapiens
uuugaagacuacugggagugaa

SEQ ID NO: 57206 - RNA, 22 nt, Homo sapiens
uuugaagugugaugccuugaug

SEQ ID NO: 57207 - RNA, 22 nt, Homo sapiens
uuugagcaugcagauugccagg

SEQ ID NO: 57208 - RNA, 22 nt, Homo sapiens
uuugauguugagacuauaaagc

SEQ ID NO: 57209 - RNA, 22 nt, Homo sapiens
uuugcaccuuccuaguggcuga

SEQ ID NO: 57210 - RNA, 22 nt, Homo sapiens
uuugcacuggagauucaauggg

SEQ ID NO: 57211 - RNA, 22 nt, Homo sapiens
uuugcacuuuaauauaauguga

SEQ ID NO: 57212 - RNA, 22 nt, Homo sapiens
uuugcacuuuuguaauaugguu

SEQ ID NO: 57213 - RNA, 22 nt, Homo sapiens
uuugcagagacuuguuaggaau

SEQ ID NO: 57214 - RNA, 22 nt, Homo sapiens
uuugcagugucagcuucugugu

SEQ ID NO: 57215 - RNA, 22 nt, Homo sapiens
uuugcuaaucaacacuggccug

SEQ ID NO: 57216 - RNA, 20 nt, Homo sapiens
uuuggcacugagugguauaa

SEQ ID NO: 57217 - RNA, 22 nt, Homo sapiens
uuugggaaugaguuuaucauuu

SEQ ID NO: 57218 - RNA, 18 nt, Homo sapiens
uuugguccuuuauaaaca

SEQ ID NO: 57219 - RNA, 22 nt, Homo sapiens
uuuguacacuguuggugguuau

SEQ ID NO: 57220 - RNA, 18 nt, Homo sapiens
uuuguacuuuuucuaaug

SEQ ID NO: 57221 - RNA, 22 nt, Homo sapiens
uuuguagcucacucugagcuga

SEQ ID NO: 57222 - RNA, 22 nt, Homo sapiens
uuugucuccuaagacucugugg

SEQ ID NO: 57223 - RNA, 22 nt, Homo sapiens
uuuguggaaugcucauguguag

SEQ ID NO: 57224 - RNA, 22 nt, Homo sapiens
uuuuaagcuacaagagacauau

SEQ ID NO: 57225 - RNA, 22 nt, Homo sapiens
uuuugcucuucggaagagcuug

SEQ ID NO: 57226 - RNA, 22 nt, Homo sapiens
uuuuggcuuuuccucagcaagc

SEQ ID NO: 57227 - RNA, 22 nt, Homo sapiens
uuuuguacaacagcucugggga

SEQ ID NO: 57228 - RNA, 19 nt, Homo sapiens
uuuuguacucugugacuug

SEQ ID NO: 57229 - RNA, 22 nt, Homo sapiens
uuuuugagguauaguguggcua

SEQ ID NO: 57230 - RNA, 23 nt, Homo sapiens
uuuuuguguuucauggaaauagg

SEQ ID NO: 57231 - RNA, 22 nt, Homo sapiens
uuuuuugguaauugaacaauga

SEQ ID NO: 57232 - RNA, 22 nt, Homo sapiens
augaguaguugcuaaauauuga

SEQ ID NO: 57233 - RNA, 15 nt, Homo sapiens
augaguuuuauggag

SEQ ID NO: 57234 - RNA, 22 nt, Homo sapiens
augauaaguuauuagaagaaga

SEQ ID NO: 57235 - RNA, 22 nt, Homo sapiens
augauacuguucuaagauuuuu

SEQ ID NO: 57236 - RNA, 22 nt, Homo sapiens
augauagucuugagaagcauuu

SEQ ID NO: 57237 - RNA, 22 nt, Homo sapiens
augauggagguagauuguccau

SEQ ID NO: 57238 - RNA, 20 nt, Homo sapiens
augccacugagcagugguga

SEQ ID NO: 57239 - RNA, 22 nt, Homo sapiens
augccacugcacuccaaccugg

SEQ ID NO: 57240 - RNA, 22 nt, Homo sapiens
augccacugcacucuagccugg

SEQ ID NO: 57241 - RNA, 22 nt, Homo sapiens
augccacugcacuucagccugc

SEQ ID NO: 57242 - RNA, 22 nt, Homo sapiens
auggaaagcuguuccuacacaa

SEQ ID NO: 57243 - RNA, 22 nt, Homo sapiens
auggaagacuccucuuugggua

SEQ ID NO: 57244 - RNA, 22 nt, Homo sapiens
auggagagaauuauucucucag

SEQ ID NO: 57245 - RNA, 22 nt, Homo sapiens
auggagaugugcgaacugagua

SEQ ID NO: 57246 - RNA, 19 nt, Homo sapiens
auggauacauuuucugcua

SEQ ID NO: 57247 - RNA, 22 nt, Homo sapiens
auggauuuguaguacaugguug

SEQ ID NO: 57248 - RNA, 22 nt, Homo sapiens
auggauuuuggggccagaggca

SEQ ID NO: 57249 - RNA, 22 nt, Homo sapiens
auggcaauaugaugcacuguuu

SEQ ID NO: 57250 - RNA, 22 nt, Homo sapiens
auggcacuaaugggaguuuacu

SEQ ID NO: 57251 - RNA, 22 nt, Homo sapiens
auggcacuccagccugggcaac

SEQ ID NO: 57252 - RNA, 22 nt, Homo sapiens
auggcagaaucaagccgacagc

SEQ ID NO: 57253 - RNA, 22 nt, Homo sapiens
auggcagcccucuuuauccaug

SEQ ID NO: 57254 - RNA, 22 nt, Homo sapiens
auggcagugagucucuaguauu

SEQ ID NO: 57255 - RNA, 22 nt, Homo sapiens
auggcaguuuauucuaaaucaa

SEQ ID NO: 57256 - RNA, 22 nt, Homo sapiens
auggcauugaagaguugucccu

SEQ ID NO: 57257 - RNA, 22 nt, Homo sapiens
auggcucuuauuauuugaggua

SEQ ID NO: 57258 - RNA, 22 nt, Homo sapiens
auggcuuuugaccugguaggau

SEQ ID NO: 57259 - RNA, 22 nt, Homo sapiens
auggcuuuugcccuaaauggau

SEQ ID NO: 57260 - RNA, 22 nt, Homo sapiens
auggcuuuuuaaaucauguugu

SEQ ID NO: 57261 - RNA, 22 nt, Homo sapiens
augggguaggcuugcuguagua

SEQ ID NO: 57262 - RNA, 22 nt, Homo sapiens
augguauuuugugauaccuugu

SEQ ID NO: 57263 - RNA, 21 nt, Homo sapiens
auggugagaaaguagugucaa

SEQ ID NO: 57264 - RNA, 22 nt, Homo sapiens
augucaaggugggugauaguuu

SEQ ID NO: 57265 - RNA, 21 nt, Homo sapiens
augucauggaugacuaauuca

SEQ ID NO: 57266 - RNA, 22 nt, Homo sapiens
augucuagagcaagagaugcug

SEQ ID NO: 57267 - RNA, 22 nt, Homo sapiens
augugacagugguuuuaagcgu

SEQ ID NO: 57268 - RNA, 22 nt, Homo sapiens
augugacuggaucauggggacg

SEQ ID NO: 57269 - RNA, 22 nt, Homo sapiens
augugcaacugcuggaacaguc

SEQ ID NO: 57270 - RNA, 22 nt, Homo sapiens
auguggaaauguauaugugucu

SEQ ID NO: 57271 - RNA, 22 nt, Homo sapiens
auguguaaagcuuuucuuuguu

SEQ ID NO: 57272 - RNA, 22 nt, Homo sapiens
auguguauuaccucgauuguga

SEQ ID NO: 57273 - RNA, 22 nt, Homo sapiens
auguguucaucacagcacaauu

SEQ ID NO: 57274 - RNA, 18 nt, Homo sapiens
auguuauguuuguagaag

SEQ ID NO: 57275 - RNA, 22 nt, Homo sapiens
auuaaggaguggguucauggug

SEQ ID NO: 57276 - RNA, 22 nt, Homo sapiens
auuaaguaaugguuccaauaau

SEQ ID NO: 57277 - RNA, 22 nt, Homo sapiens
auuauauguguaugugcauacc

SEQ ID NO: 57278 - RNA, 22 nt, Homo sapiens
auucacagggggagaaggguau

SEQ ID NO: 57279 - RNA, 22 nt, Homo sapiens
auucacuguggguccuuuggau

SEQ ID NO: 57280 - RNA, 22 nt, Homo sapiens
auucaucagggauacuggccug

SEQ ID NO: 57281 - RNA, 22 nt, Homo sapiens
auucaucagggauauugguuga

SEQ ID NO: 57282 - RNA, 22 nt, Homo sapiens
auugaacacagaguagcuuucc

SEQ ID NO: 57283 - RNA, 22 nt, Homo sapiens
auugaacaugccauauguacca

SEQ ID NO: 57284 - RNA, 22 nt, Homo sapiens
auugaggcaggaggaccaucua

SEQ ID NO: 57285 - RNA, 22 nt, Homo sapiens
auugcacuccagccugagcaaa

SEQ ID NO: 57286 - RNA, 22 nt, Homo sapiens
auugcacuggggguuagaauuu

SEQ ID NO: 57287 - RNA, 19 nt, Homo sapiens
auugcaguguaaaacuauu

SEQ ID NO: 57288 - RNA, 22 nt, Homo sapiens
auugcucaaaucaguacuugag

SEQ ID NO: 57289 - RNA, 22 nt, Homo sapiens
auuucacuucgcaugguguccg

SEQ ID NO: 57290 - RNA, 22 nt, Homo sapiens
auuuccuguaggggcuugcgaa

SEQ ID NO: 57291 - RNA, 20 nt, Homo sapiens
auuuggcauaguuuaagcaa

SEQ ID NO: 57292 - RNA, 22 nt, Homo sapiens
auuugucacuuaacagccauua

SEQ ID NO: 57293 - RNA, 22 nt, Homo sapiens
caaaggcuuccacugcauccuu

SEQ ID NO: 57294 - RNA, 22 nt, Homo sapiens
caaauacuuucauguugucuug

SEQ ID NO: 57295 - RNA, 22 nt, Homo sapiens
caaaugacaucauuucauucaa

SEQ ID NO: 57296 - RNA, 22 nt, Homo sapiens
caacaguaaagcauuuuuaagu

SEQ ID NO: 57297 - RNA, 22 nt, Homo sapiens
caagugcuugaugaaugaucaa

SEQ ID NO: 57298 - RNA, 22 nt, Homo sapiens
caagugcuuucuuggggauuua

SEQ ID NO: 57299 - RNA, 22 nt, Homo sapiens
caauacuguguugaauaagagu

SEQ ID NO: 57300 - RNA, 19 nt, Homo sapiens
caauacuucuuggcauaca

SEQ ID NO: 57301 - RNA, 22 nt, Homo sapiens
cacagaauucauuggauuaccu

SEQ ID NO: 57302 - RNA, 22 nt, Homo sapiens
cacagggcuaacauuuuugccc

SEQ ID NO: 57303 - RNA, 23 nt, Homo sapiens
cacagggugaacaccccuaaucc

SEQ ID NO: 57304 - RNA, 22 nt, Homo sapiens
cacagugaacugguggguuuuu

SEQ ID NO: 57305 - RNA, 22 nt, Homo sapiens
cacaguguuccagcuauuugaa

SEQ ID NO: 57306 - RNA, 22 nt, Homo sapiens
cacauugaauuucugaugacaa

SEQ ID NO: 57307 - RNA, 22 nt, Homo sapiens
caccagguggcugaggccauga

SEQ ID NO: 57308 - RNA, 19 nt, Homo sapiens
caccgccugcccccugcug

SEQ ID NO: 57309 - RNA, 22 nt, Homo sapiens
cacuaccucuacaggcagcugg

SEQ ID NO: 57310 - RNA, 22 nt, Homo sapiens
cacugcaauuacuuuugcacca

SEQ ID NO: 57311 - RNA, 22 nt, Homo sapiens
cacugcacuccagucuggcgac

SEQ ID NO: 57312 - RNA, 22 nt, Homo sapiens
cacugcacuccaguuuggauga

SEQ ID NO: 57313 - RNA, 21 nt, Homo sapiens
cacugcaucacaggacagcau

SEQ ID NO: 57314 - RNA, 22 nt, Homo sapiens
cacugcauuacucaugagcaug

SEQ ID NO: 57315 - RNA, 22 nt, Homo sapiens
cacuggguuagaacaugcuccu

SEQ ID NO: 57316 - RNA, 22 nt, Homo sapiens
cagauacuccuggucucaggag

SEQ ID NO: 57317 - RNA, 22 nt, Homo sapiens
cagcugaugucgaaugcacucu

SEQ ID NO: 57318 - RNA, 22 nt, Homo sapiens
cagcuguuguuaugucugcagg

SEQ ID NO: 57319 - RNA, 22 nt, Homo sapiens
cagcuugugguauugcugguug

SEQ ID NO: 57320 - RNA, 22 nt, Homo sapiens
caggcuuuuccacacauggguu

SEQ ID NO: 57321 - RNA, 22 nt, Homo sapiens
cagguaguguguagcacagcag

SEQ ID NO: 57322 - RNA, 23 nt, Homo sapiens
cagguaguucuuuauaguagugu

SEQ ID NO: 57323 - RNA, 22 nt, Homo sapiens
caggugcauuggcugacaccug

SEQ ID NO: 57324 - RNA, 22 nt, Homo sapiens
caggugguauuugguuuucugu

SEQ ID NO: 57325 - RNA, 22 nt, Homo sapiens
aaacugaucugaaggccaggcu

SEQ ID NO: 57326 - RNA, 22 nt, Homo sapiens
aaagaagucagccuguccuuug

SEQ ID NO: 57327 - RNA, 23 nt, Homo sapiens
aaagacuagucaggugcaguggu

SEQ ID NO: 57328 - RNA, 22 nt, Homo sapiens
aaagagaucuaugggcacuaug

SEQ ID NO: 57329 - RNA, 22 nt, Homo sapiens
aaagcacuggagucaucaucua

SEQ ID NO: 57330 - RNA, 22 nt, Homo sapiens
aaagcuaagguagcauuggaga

SEQ ID NO: 57331 - RNA, 22 nt, Homo sapiens
aaaggaccacauauaugguggc

SEQ ID NO: 57332 - RNA, 22 nt, Homo sapiens
aaaggcuucggaucagaaggua

SEQ ID NO: 57333 - RNA, 19 nt, Homo sapiens
aaagguaguaaccucugau

SEQ ID NO: 57334 - RNA, 22 nt, Homo sapiens
aaagugcacuuggaagagggcc

SEQ ID NO: 57335 - RNA, 22 nt, Homo sapiens
aaagugcaguauuugggcagaa

SEQ ID NO: 57336 - RNA, 22 nt, Homo sapiens
aaagugcugggauuggccgggc

SEQ ID NO: 57337 - RNA, 22 nt, Homo sapiens
aaagugcugggauuggcugggc

SEQ ID NO: 57338 - RNA, 19 nt, Homo sapiens
aaaguguuuuaaagaggau

SEQ ID NO: 57339 - RNA, 22 nt, Homo sapiens
aaaguucugcguuagggcuaaa

SEQ ID NO: 57340 - RNA, 22 nt, Homo sapiens
aaaguucuugcugaaggauuau

SEQ ID NO: 57341 - RNA, 22 nt, Homo sapiens
aaaugcauugagggaaaaggca

SEQ ID NO: 57342 - RNA, 22 nt, Homo sapiens
aaaugcugucaaauuguguucu

SEQ ID NO: 57343 - RNA, 22 nt, Homo sapiens
aaauggcuuugaggguaggaca

SEQ ID NO: 57344 - RNA, 19 nt, Homo sapiens
aaaugugcacuguuuucca

SEQ ID NO: 57345 - RNA, 22 nt, Homo sapiens
aaauucaugucaccucuaggua

SEQ ID NO: 57346 - RNA, 22 nt, Homo sapiens
aaauugcuuuugaagacuuagu

SEQ ID NO: 57347 - RNA, 22 nt, Homo sapiens
aacaggguggugccugguccau

SEQ ID NO: 57348 - RNA, 22 nt, Homo sapiens
aacagucaauugcugaugaccu

SEQ ID NO: 57349 - RNA, 22 nt, Homo sapiens
aacagugcuucauucacacauu

SEQ ID NO: 57350 - RNA, 22 nt, Homo sapiens
aacugcuguuuggguacuggug

SEQ ID NO: 57351 - RNA, 22 nt, Homo sapiens
aagagguagcagucacaaaaga

SEQ ID NO: 57352 - RNA, 22 nt, Homo sapiens
aagaguuaguaaaauuuccucu

SEQ ID NO: 57353 - RNA, 22 nt, Homo sapiens
aagcacaauuucaccuucuugu

SEQ ID NO: 57354 - RNA, 22 nt, Homo sapiens
aagcuccauuucugccaugaga

SEQ ID NO: 57355 - RNA, 22 nt, Homo sapiens
aagcugccaggcaugguggcug

SEQ ID NO: 57356 - RNA, 22 nt, Homo sapiens
aaggauuguaaaguugacaaau

SEQ ID NO: 57357 - RNA, 22 nt, Homo sapiens
aaggcaugcaaagaacauuuua

SEQ ID NO: 57358 - RNA, 17 nt, Homo sapiens
agccccauuagcuaguu

SEQ ID NO: 57359 - RNA, 22 nt, Homo sapiens
agcgccacugcacuccagccug

SEQ ID NO: 57360 - RNA, 21 nt, Homo sapiens
agcuccacucguucccaaagc

SEQ ID NO: 57361 - RNA, 22 nt, Homo sapiens
agcucuauuagaagccgugggu

SEQ ID NO: 57362 - RNA, 22 nt, Homo sapiens
agcuggauuguuuaccuggggc

SEQ ID NO: 57363 - RNA, 22 nt, Homo sapiens
agcuggucuacguguguaugag

SEQ ID NO: 57364 - RNA, 22 nt, Homo sapiens
agcugugucuucuuaaagauuu

SEQ ID NO: 57365 - RNA, 22 nt, Homo sapiens
agcuucauuccaacuuccuucu

SEQ ID NO: 57366 - RNA, 21 nt, Homo sapiens
agcuuguguguaucacagugu

SEQ ID NO: 57367 - RNA, 22 nt, Homo sapiens
aggaagugucuucuuuuaggca

SEQ ID NO: 57368 - RNA, 18 nt, Homo sapiens
aggaaugguaauacuuca

SEQ ID NO: 57369 - RNA, 23 nt, Homo sapiens
aggagcuuagaaguugccauugc

SEQ ID NO: 57370 - RNA, 22 nt, Homo sapiens
aggcagcuguuauauacugagu

SEQ ID NO: 57371 - RNA, 20 nt, Homo sapiens
aggcauguugguuugcgugu

SEQ ID NO: 57372 - RNA, 22 nt, Homo sapiens
aggcauugugcaucgaugauuu

SEQ ID NO: 57373 - RNA, 22 nt, Homo sapiens
aggcuagacuuugagaauuuuu

SEQ ID NO: 57374 - RNA, 22 nt, Homo sapiens
agggcaagacuuguuaagaaca

SEQ ID NO: 57375 - RNA, 22 nt, Homo sapiens
agggcuuuugagcugagauggu

SEQ ID NO: 57376 - RNA, 22 nt, Homo sapiens
agggguauuauguaaaucugac

SEQ ID NO: 57377 - RNA, 22 nt, Homo sapiens
aggugcuugaaucuaugagcuc

SEQ ID NO: 57378 - RNA, 22 nt, Homo sapiens
aggugguauuuaaaauuauuug

SEQ ID NO: 57379 - RNA, 22 nt, Homo sapiens
agguguuguugaggagauuuca

SEQ ID NO: 57380 - RNA, 17 nt, Homo sapiens
aguacugucccauccuu

SEQ ID NO: 57381 - RNA, 22 nt, Homo sapiens
aguagcacaugccacccugucu

SEQ ID NO: 57382 - RNA, 22 nt, Homo sapiens
agucauggcagaaggcaccucu

SEQ ID NO: 57383 - RNA, 22 nt, Homo sapiens
aguccaguguuaugaucaguag

SEQ ID NO: 57384 - RNA, 22 nt, Homo sapiens
aguggaaucuguuauacuaacu

SEQ ID NO: 57385 - RNA, 22 nt, Homo sapiens
aguggauguuguggccugggag

SEQ ID NO: 57386 - RNA, 23 nt, Homo sapiens
aguggucuccugggcccagcugu

SEQ ID NO: 57387 - RNA, 22 nt, Homo sapiens
auaaaccuacauuuucacuucu

SEQ ID NO: 57388 - RNA, 22 nt, Homo sapiens
auaaagguaagcacuauccuga

SEQ ID NO: 57389 - RNA, 22 nt, Homo sapiens
auaacauccuuucuuaucguug

SEQ ID NO: 57390 - RNA, 22 nt, Homo sapiens
auaauagcugaucauuuagaag

SEQ ID NO: 57391 - RNA, 22 nt, Homo sapiens
auaauaucagguugugaugaug

SEQ ID NO: 57392 - RNA, 22 nt, Homo sapiens
auacacauuccugggccucacc

SEQ ID NO: 57393 - RNA, 22 nt, Homo sapiens
auacacgugcagaacaugcagg

SEQ ID NO: 57394 - RNA, 22 nt, Homo sapiens
auacagacacagucagaggggu

SEQ ID NO: 57395 - RNA, 22 nt, Homo sapiens
auacaguaaugucuuaggcugu

SEQ ID NO: 57396 - RNA, 22 nt, Homo sapiens
auacaguaucuucuggcaagca

SEQ ID NO: 57397 - RNA, 22 nt, Homo sapiens
auacagugaauaucuggggcag

SEQ ID NO: 57398 - RNA, 22 nt, Homo sapiens
auacaugugccauguugguaug

SEQ ID NO: 57399 - RNA, 22 nt, Homo sapiens
auaccuuguagugcuauuugau

SEQ ID NO: 57400 - RNA, 22 nt, Homo sapiens
auacuaugagauaauaaagacu

SEQ ID NO: 57401 - RNA, 22 nt, Homo sapiens
auacuguuucugaacuuugauu

SEQ ID NO: 57402 - RNA, 21 nt, Homo sapiens
auagcacaucagauuuuauua

SEQ ID NO: 57403 - RNA, 22 nt, Homo sapiens
auagcacauggcauccucucuu

SEQ ID NO: 57404 - RNA, 22 nt, Homo sapiens
auagcagcaccucacucuacug

SEQ ID NO: 57405 - RNA, 22 nt, Homo sapiens
auagguauguaauacaaaugaa

SEQ ID NO: 57406 - RNA, 22 nt, Homo sapiens
auagguauuuuuaaaugacugu

SEQ ID NO: 57407 - RNA, 22 nt, Homo sapiens
auagugaacuuugugagaacaa

SEQ ID NO: 57408 - RNA, 22 nt, Homo sapiens
auagugcugcaaucaacauaca

SEQ ID NO: 57409 - RNA, 22 nt, Homo sapiens
auauaugcacacgugugcauau

SEQ ID NO: 57410 - RNA, 22 nt, Homo sapiens
auauaugcuaagugcuaauaaa

SEQ ID NO: 57411 - RNA, 22 nt, Homo sapiens
auauauguuuucugggaagaaa

SEQ ID NO: 57412 - RNA, 22 nt, Homo sapiens
auaucacaaacaagucuguacu

SEQ ID NO: 57413 - RNA, 20 nt, Homo sapiens
auaugcagacacauacauac

SEQ ID NO: 57414 - RNA, 22 nt, Homo sapiens
auaugcauacccucaccaacua

SEQ ID NO: 57415 - RNA, 22 nt, Homo sapiens
auaugguuuuuggaagcauauc

SEQ ID NO: 57416 - RNA, 22 nt, Homo sapiens
auaugucuauuauuagggcagg

SEQ ID NO: 57417 - RNA, 22 nt, Homo sapiens
auaugucuuaguuaccuugggc

SEQ ID NO: 57418 - RNA, 22 nt, Homo sapiens
auauguucucauucauaugugg

SEQ ID NO: 57419 - RNA, 22 nt, Homo sapiens
auauuugguuaccugugggucu

SEQ ID NO: 57420 - RNA, 22 nt, Homo sapiens
aucaaauugucauuuuaaggau

SEQ ID NO: 57421 - RNA, 22 nt, Homo sapiens
aucaaguaaucugaguaagagu

SEQ ID NO: 57422 - RNA, 22 nt, Homo sapiens
aucacaauuguacguaggagcc

SEQ ID NO: 57423 - RNA, 22 nt, Homo sapiens
aucacagagucacgggcaacuu

SEQ ID NO: 57424 - RNA, 22 nt, Homo sapiens
aucacagcccuccucuuggaug

SEQ ID NO: 57425 - RNA, 22 nt, Homo sapiens
aucacagcuacuccucugucuu

SEQ ID NO: 57426 - RNA, 22 nt, Homo sapiens
aucacaggucaaaucauuauuu

SEQ ID NO: 57427 - RNA, 20 nt, Homo sapiens
aucaccacagcucguucaug

SEQ ID NO: 57428 - RNA, 22 nt, Homo sapiens
uagagguagccuacuacacacc

SEQ ID NO: 57429 - RNA, 22 nt, Homo sapiens
uagaucacucaggcaauaaaag

SEQ ID NO: 57430 - RNA, 19 nt, Homo sapiens
uagaugucuuugcauagau

SEQ ID NO: 57431 - RNA, 22 nt, Homo sapiens
uagcacaguucacccucgauuu

SEQ ID NO: 57432 - RNA, 22 nt, Homo sapiens
uagcaccaaacauauacucagu

SEQ ID NO: 57433 - RNA, 22 nt, Homo sapiens
uagcaccugugcacaccaggca

SEQ ID NO: 57434 - RNA, 22 nt, Homo sapiens
uagcaccuuagcauuucuagug

SEQ ID NO: 57435 - RNA, 22 nt, Homo sapiens
uagcagaauaacuugccagccu

SEQ ID NO: 57436 - RNA, 22 nt, Homo sapiens
uagcagcauuuuuguagaguau

SEQ ID NO: 57437 - RNA, 22 nt, Homo sapiens
uagcuguuggugggaagucaga

SEQ ID NO: 57438 - RNA, 22 nt, Homo sapiens
uagcuucuccauagcuccaugu

SEQ ID NO: 57439 - RNA, 23 nt, Homo sapiens
uagcuucucccagaccugcuccc

SEQ ID NO: 57440 - RNA, 22 nt, Homo sapiens
uaggacacagaccuggauggaa

SEQ ID NO: 57441 - RNA, 22 nt, Homo sapiens
uaggcaauggagauagaggaug

SEQ ID NO: 57442 - RNA, 22 nt, Homo sapiens
uaggcaauguggcgaaacucug

SEQ ID NO: 57443 - RNA, 22 nt, Homo sapiens
uaggcacuguguuuguaggagu

SEQ ID NO: 57444 - RNA, 21 nt, Homo sapiens
uaggccgggugcaggaugcuu

SEQ ID NO: 57445 - RNA, 22 nt, Homo sapiens
uagggagugucuucauuuugua

SEQ ID NO: 57446 - RNA, 22 nt, Homo sapiens
uagggcuuuaguuugcuugugu

SEQ ID NO: 57447 - RNA, 22 nt, Homo sapiens
uaggucuccuuuuugccuaaau

SEQ ID NO: 57448 - RNA, 22 nt, Homo sapiens
uaggugguuugaaauacucaag

SEQ ID NO: 57449 - RNA, 22 nt, Homo sapiens
uaguaaacauaguucuuuugcu

SEQ ID NO: 57450 - RNA, 22 nt, Homo sapiens
uaguaucacaagguguacaccc

SEQ ID NO: 57451 - RNA, 22 nt, Homo sapiens
uauacaguaggcacucaguggc

SEQ ID NO: 57452 - RNA, 22 nt, Homo sapiens
uauagcacugagaauguaauuc

SEQ ID NO: 57453 - RNA, 22 nt, Homo sapiens
uauagcuugaaggaauggucau

SEQ ID NO: 57454 - RNA, 22 nt, Homo sapiens
uauagcuuuuuagggaauuugg

SEQ ID NO: 57455 - RNA, 22 nt, Homo sapiens
uauauaagcugaugagccacaa

SEQ ID NO: 57456 - RNA, 22 nt, Homo sapiens
uauaucacaugcacucauuuuc

SEQ ID NO: 57457 - RNA, 22 nt, Homo sapiens
uauaugcacucagguguaugug

SEQ ID NO: 57458 - RNA, 22 nt, Homo sapiens
uauauguuuucauaaggcuaga

SEQ ID NO: 57459 - RNA, 22 nt, Homo sapiens
uaucacaaacuuagcaguuuaa

SEQ ID NO: 57460 - RNA, 22 nt, Homo sapiens
uaucacaguagaacucuuucca

SEQ ID NO: 57461 - RNA, 21 nt, Homo sapiens
uauccacuugcaacagagaag

SEQ ID NO: 57462 - RNA, 22 nt, Homo sapiens
uaucucagagaaucagauuuac

SEQ ID NO: 57463 - RNA, 22 nt, Homo sapiens
uaugaauuuuauccaggauaua

SEQ ID NO: 57464 - RNA, 22 nt, Homo sapiens
gugguaaaauggcauagagcua

SEQ ID NO: 57465 - RNA, 22 nt, Homo sapiens
gugguuuucaacuccaccugca

SEQ ID NO: 57466 - RNA, 22 nt, Homo sapiens
gugucacagcuuccaucucggu

SEQ ID NO: 57467 - RNA, 22 nt, Homo sapiens
gugugacagcuauagacaugau

SEQ ID NO: 57468 - RNA, 22 nt, Homo sapiens
gugugguauuauaacuagguau

SEQ ID NO: 57469 - RNA, 22 nt, Homo sapiens
guguuauuuugcugggaaugau

SEQ ID NO: 57470 - RNA, 22 nt, Homo sapiens
guuaagaaguguaacuuaaguu

SEQ ID NO: 57471 - RNA, 22 nt, Homo sapiens
guuaaugcuggaauaaguuaag

SEQ ID NO: 57472 - RNA, 21 nt, Homo sapiens
guucaagugauccuccugucu

SEQ ID NO: 57473 - RNA, 20 nt, Homo sapiens
guucacaggcuuccuuucag

SEQ ID NO: 57474 - RNA, 22 nt, Homo sapiens
guucacaguuaggacaacugcu

SEQ ID NO: 57475 - RNA, 17 nt, Homo sapiens
guucccaguggcauuug

SEQ ID NO: 57476 - RNA, 22 nt, Homo sapiens
guucuggagauaaagccaaggu

SEQ ID NO: 57477 - RNA, 22 nt, Homo sapiens
uaaagaugcugggaaggcuagg

SEQ ID NO: 57478 - RNA, 22 nt, Homo sapiens
uaaagcacuuuuuucugcaugg

SEQ ID NO: 57479 - RNA, 22 nt, Homo sapiens
uaaagcuacaguauaugguauu

SEQ ID NO: 57480 - RNA, 22 nt, Homo sapiens
uaacaacauucuaacugacggc

SEQ ID NO: 57481 - RNA, 22 nt, Homo sapiens
uaacaagagagucagucagucc

SEQ ID NO: 57482 - RNA, 22 nt, Homo sapiens
uaacccagugucugugaugggu

SEQ ID NO: 57483 - RNA, 22 nt, Homo sapiens
uaacuaaagagaagucaauguc

SEQ ID NO: 57484 - RNA, 22 nt, Homo sapiens
uaagcaguaaaugaagucuugc

SEQ ID NO: 57485 - RNA, 22 nt, Homo sapiens
uaagcagugcaagaauggaaua

SEQ ID NO: 57486 - RNA, 16 nt, Homo sapiens
uaagccccacgugcau

SEQ ID NO: 57487 - RNA, 22 nt, Homo sapiens
uaagcuaauguguuuucucuua

SEQ ID NO: 57488 - RNA, 22 nt, Homo sapiens
uaaggcaaaccuuggcugcagu

SEQ ID NO: 57489 - RNA, 22 nt, Homo sapiens
uaaggcaaguuuuuaguggaca

SEQ ID NO: 57490 - RNA, 22 nt, Homo sapiens
uaaggcacccuucugaguagag

SEQ ID NO: 57491 - RNA, 22 nt, Homo sapiens
uaaggcuuuuguucagcguggg

SEQ ID NO: 57492 - RNA, 22 nt, Homo sapiens
uaagggcaugcugcaugagagu

SEQ ID NO: 57493 - RNA, 22 nt, Homo sapiens
uaaguacuuuacagacauuauc

SEQ ID NO: 57494 - RNA, 22 nt, Homo sapiens
uaagugaauauggacaguuagc

SEQ ID NO: 57495 - RNA, 22 nt, Homo sapiens
uaauagcucggauaaacaugau

SEQ ID NO: 57496 - RNA, 22 nt, Homo sapiens
uaauaugugguugcuugggcac

SEQ ID NO: 57497 - RNA, 22 nt, Homo sapiens
uaaucacagagguuuggccuca

SEQ ID NO: 57498 - RNA, 22 nt, Homo sapiens
uaaugcuguggucuaaugggga

SEQ ID NO: 57499 - RNA, 22 nt, Homo sapiens
uacaaaguaacaguuccuguau

SEQ ID NO: 57500 - RNA, 22 nt, Homo sapiens
uacaagcuaaaauggaagauca

SEQ ID NO: 57501 - RNA, 22 nt, Homo sapiens
uacagccacauaauguaugauu

SEQ ID NO: 57502 - RNA, 22 nt, Homo sapiens
uacagcuaugugcaugcaugcu

SEQ ID NO: 57503 - RNA, 22 nt, Homo sapiens
uacaggacuauagaacuuuccc

SEQ ID NO: 57504 - RNA, 19 nt, Homo sapiens
uacaggacugagcugaggu

SEQ ID NO: 57505 - RNA, 22 nt, Homo sapiens
uacaguaggauuuucagggucu

SEQ ID NO: 57506 - RNA, 22 nt, Homo sapiens
uacaguauuaugagugauugaa

SEQ ID NO: 57507 - RNA, 22 nt, Homo sapiens
uacagucuggaggccuguguug

SEQ ID NO: 57508 - RNA, 22 nt, Homo sapiens
uacagugcauagaggcaugaua

SEQ ID NO: 57509 - RNA, 22 nt, Homo sapiens
uacagugcuugguaucuaguaa

SEQ ID NO: 57510 - RNA, 22 nt, Homo sapiens
uacagugcuuuuugguggagaa

SEQ ID NO: 57511 - RNA, 22 nt, Homo sapiens
uacuacuuucucuucugggaaa

SEQ ID NO: 57512 - RNA, 22 nt, Homo sapiens
uacuagaggcgggguuucgcca

SEQ ID NO: 57513 - RNA, 22 nt, Homo sapiens
uacucaauugcagucaccuggc

SEQ ID NO: 57514 - RNA, 22 nt, Homo sapiens
uacugcacuccagccuggguga

SEQ ID NO: 57515 - RNA, 22 nt, Homo sapiens
uacugcacuccagccuugccaa

SEQ ID NO: 57516 - RNA, 22 nt, Homo sapiens
uacugcacuccaggcucaccug

SEQ ID NO: 57517 - RNA, 18 nt, Homo sapiens
uacugcacucuccagccu

SEQ ID NO: 57518 - RNA, 22 nt, Homo sapiens
uagaaagcaugaccuucagaua

SEQ ID NO: 57519 - RNA, 22 nt, Homo sapiens
uagaacauuccaggugauguug

SEQ ID NO: 57520 - RNA, 22 nt, Homo sapiens
uagagcaaugacucuggaaacc

SEQ ID NO: 57521 - RNA, 22 nt, Homo sapiens
uagagguagagugacuucccca

SEQ ID NO: 57522 - RNA, 22 nt, Homo sapiens
uugcuucuuucgucuggcccca

SEQ ID NO: 57523 - RNA, 22 nt, Homo sapiens
uuggacucccuccccagcuuca

SEQ ID NO: 57524 - RNA, 22 nt, Homo sapiens
uuggacuuuuauucugcaggca

SEQ ID NO: 57525 - RNA, 22 nt, Homo sapiens
uuggagagaaaggcaguuccug

SEQ ID NO: 57526 - RNA, 22 nt, Homo sapiens
uuggagagagaggacucccggc

SEQ ID NO: 57527 - RNA, 22 nt, Homo sapiens
uuggcacugagcaagaacaggg

SEQ ID NO: 57528 - RNA, 22 nt, Homo sapiens
uuggcacuugauaauauucugg

SEQ ID NO: 57529 - RNA, 22 nt, Homo sapiens
uuggcauagaggcucucaagcu

SEQ ID NO: 57530 - RNA, 20 nt, Homo sapiens
uuggcauuuagacaagaguu

SEQ ID NO: 57531 - RNA, 22 nt, Homo sapiens
uuggcauuuauucuaaggucaa

SEQ ID NO: 57532 - RNA, 22 nt, Homo sapiens
uuggccauggagcacuuuucua

SEQ ID NO: 57533 - RNA, 22 nt, Homo sapiens
uuggccccuuucauccacagcu

SEQ ID NO: 57534 - RNA, 19 nt, Homo sapiens
uuggcccugguucucuucu

SEQ ID NO: 57535 - RNA, 22 nt, Homo sapiens
uuggcuuuuaugcagcuuaggu

SEQ ID NO: 57536 - RNA, 22 nt, Homo sapiens
uugggaaugcuaaaccucuauu

SEQ ID NO: 57537 - RNA, 22 nt, Homo sapiens
uugguuccuuagccuaggacua

SEQ ID NO: 57538 - RNA, 21 nt, Homo sapiens
uuguagcagcauaaucccaga

SEQ ID NO: 57539 - RNA, 22 nt, Homo sapiens
uuguaguguuuauucugucaac

SEQ ID NO: 57540 - RNA, 22 nt, Homo sapiens
uugucaaacucauucuccaucc

SEQ ID NO: 57541 - RNA, 22 nt, Homo sapiens
uugucaaugggugagugcagag

SEQ ID NO: 57542 - RNA, 16 nt, Homo sapiens
uugucccuucccaaau

SEQ ID NO: 57543 - RNA, 22 nt, Homo sapiens
uuguccucuccaaaucucaugu

SEQ ID NO: 57544 - RNA, 22 nt, Homo sapiens
uuguccuugagauaguuugcag

SEQ ID NO: 57545 - RNA, 21 nt, Homo sapiens
uugucuagagaaauauaucuc

SEQ ID NO: 57546 - RNA, 22 nt, Homo sapiens
uugucucacuggaguuuaguaa

SEQ ID NO: 57547 - RNA, 22 nt, Homo sapiens
uugugaaaucuaggcagagguu

SEQ ID NO: 57548 - RNA, 22 nt, Homo sapiens
uugugaauggaguagcaggauc

SEQ ID NO: 57549 - RNA, 22 nt, Homo sapiens
uugugcauaucagagguuugcu

SEQ ID NO: 57550 - RNA, 22 nt, Homo sapiens
uugugcaugaugcauacauggu

SEQ ID NO: 57551 - RNA, 19 nt, Homo sapiens
uugugggaggacagagggg

SEQ ID NO: 57552 - RNA, 22 nt, Homo sapiens
uuguguuuuuaguagggaaggg

SEQ ID NO: 57553 - RNA, 22 nt, Homo sapiens
uuguuaugggguggcuugaaag

SEQ ID NO: 57554 - RNA, 22 nt, Homo sapiens
uuuaauguuacaguauugguau

SEQ ID NO: 57555 - RNA, 18 nt, Homo sapiens
uuuacaguagaaggacuu

SEQ ID NO: 57556 - RNA, 22 nt, Homo sapiens
uuuaugcuacauguguuggaaa

SEQ ID NO: 57557 - RNA, 22 nt, Homo sapiens
uuucaucaagcacagaguagau

SEQ ID NO: 57558 - RNA, 22 nt, Homo sapiens
uuucccagugguacaguuuaua

SEQ ID NO: 57559 - RNA, 22 nt, Homo sapiens
uuucccuuugcuuugucagcca

SEQ ID NO: 57560 - RNA, 22 nt, Homo sapiens
uuucgugucuggucugugaugg

SEQ ID NO: 57561 - RNA, 22 nt, Homo sapiens
uuugaaguguggcacugaguuu

SEQ ID NO: 57562 - RNA, 20 nt, Homo sapiens
uuugaauguaaagcauguca

SEQ ID NO: 57563 - RNA, 22 nt, Homo sapiens
uuugaauguaaugagcaggaag

SEQ ID NO: 57564 - RNA, 22 nt, Homo sapiens
uuugacucacagccuggcugcc

SEQ ID NO: 57565 - RNA, 22 nt, Homo sapiens
uuugagaucuuuagaaucaggc

SEQ ID NO: 57566 - RNA, 22 nt, Homo sapiens
uuugaggaaaggcauaaguagg

SEQ ID NO: 57567 - RNA, 22 nt, Homo sapiens
uuugcaguuuauuccuggggcu

SEQ ID NO: 57568 - RNA, 22 nt, Homo sapiens
uuuggcacuauagguaaauuug

SEQ ID NO: 57569 - RNA, 22 nt, Homo sapiens
ugugccacuccaaccuggguga

SEQ ID NO: 57570 - RNA, 22 nt, Homo sapiens
ugugcuauguuauucacauggg

SEQ ID NO: 57571 - RNA, 22 nt, Homo sapiens
uguggccuuuguuucaguuggg

SEQ ID NO: 57572 - RNA, 22 nt, Homo sapiens
ugugguuuuucacauuuagaga

SEQ ID NO: 57573 - RNA, 22 nt, Homo sapiens
uguguaaagcuuguuccagaaa

SEQ ID NO: 57574 - RNA, 22 nt, Homo sapiens
uguguuuuuauguaaaauggaa

SEQ ID NO: 57575 - RNA, 22 nt, Homo sapiens
uguuaaggcagagauaauacau

SEQ ID NO: 57576 - RNA, 22 nt, Homo sapiens
uguuauguauggagugauccca

SEQ ID NO: 57577 - RNA, 22 nt, Homo sapiens
uguuauguucuacuuuuaggug

SEQ ID NO: 57578 - RNA, 22 nt, Homo sapiens
uguuucuacugucucuguagua

SEQ ID NO: 57579 - RNA, 22 nt, Homo sapiens
uuaaaguaauugaaauggccuu

SEQ ID NO: 57580 - RNA, 22 nt, Homo sapiens
uuaacagucacuuagcucauuu

SEQ ID NO: 57581 - RNA, 22 nt, Homo sapiens
uuaacaguuaauucuuuggcaa

SEQ ID NO: 57582 - RNA, 22 nt, Homo sapiens
uuaagcaguggauuagaauuuu

SEQ ID NO: 57583 - RNA, 22 nt, Homo sapiens
uuaagcuaguuuauucaggaaa

SEQ ID NO: 57584 - RNA, 22 nt, Homo sapiens
uuaaggaguagugucugguauu

SEQ ID NO: 57585 - RNA, 22 nt, Homo sapiens
uuaagguaugugggcauuuugu

SEQ ID NO: 57586 - RNA, 22 nt, Homo sapiens
uuaaguagaugaaugugaaugu

SEQ ID NO: 57587 - RNA, 22 nt, Homo sapiens
uuaaguuaggcuucagcagucu

SEQ ID NO: 57588 - RNA, 22 nt, Homo sapiens
uuaauccugccuuauuucagua

SEQ ID NO: 57589 - RNA, 22 nt, Homo sapiens
uuaaugaacuuuauuuuguaga

SEQ ID NO: 57590 - RNA, 22 nt, Homo sapiens
uuaauuguaucuauagauguca

SEQ ID NO: 57591 - RNA, 22 nt, Homo sapiens
uuacaguagaugaggguauaau

SEQ ID NO: 57592 - RNA, 17 nt, Homo sapiens
uuagacagacauccugc

SEQ ID NO: 57593 - RNA, 22 nt, Homo sapiens
uuagauuauugguguuuugcaa

SEQ ID NO: 57594 - RNA, 22 nt, Homo sapiens
uuagcacauuuccagcacaugg

SEQ ID NO: 57595 - RNA, 22 nt, Homo sapiens
uuagccccuuugagccucaacu

SEQ ID NO: 57596 - RNA, 22 nt, Homo sapiens
uuaggacacuguggguggguca

SEQ ID NO: 57597 - RNA, 22 nt, Homo sapiens
uuauagacacguuguaacaaac

SEQ ID NO: 57598 - RNA, 20 nt, Homo sapiens
uuauagcuacaucuugacug

SEQ ID NO: 57599 - RNA, 22 nt, Homo sapiens
uuauauguuuguacuuaggccu

SEQ ID NO: 57600 - RNA, 22 nt, Homo sapiens
uuaucaaacccuaggagguggu

SEQ ID NO: 57601 - RNA, 22 nt, Homo sapiens
uuauccagcgcuguuuuggaga

SEQ ID NO: 57602 - RNA, 22 nt, Homo sapiens
uuauccucuagacauagguuua

SEQ ID NO: 57603 - RNA, 22 nt, Homo sapiens
uuauggcucuuggggaaguaga

SEQ ID NO: 57604 - RNA, 23 nt, Homo sapiens
uuauggcuuuuauuauguugagg

SEQ ID NO: 57605 - RNA, 22 nt, Homo sapiens
uucaaaaccucugcuuaagccc

SEQ ID NO: 57606 - RNA, 22 nt, Homo sapiens
uucaagcuauggugaucuuuuc

SEQ ID NO: 57607 - RNA, 22 nt, Homo sapiens
uucaauuaauauuauacucuca

SEQ ID NO: 57608 - RNA, 20 nt, Homo sapiens
uucacaggcagcuucuuucu

SEQ ID NO: 57609 - RNA, 22 nt, Homo sapiens
uucacaguggugggagacguca

SEQ ID NO: 57610 - RNA, 22 nt, Homo sapiens
uucagagagggagggauaccua

SEQ ID NO: 57611 - RNA, 22 nt, Homo sapiens
uucaggcuccgugccagcuccg

SEQ ID NO: 57612 - RNA, 22 nt, Homo sapiens
uucaguggacuuaguagugcuu

SEQ ID NO: 57613 - RNA, 22 nt, Homo sapiens
uucaguggagaggcugaguggu

SEQ ID NO: 57614 - RNA, 22 nt, Homo sapiens
uucaguucugcucugaucuuag

SEQ ID NO: 57615 - RNA, 22 nt, Homo sapiens
uucauagugaaaaauucaaagu

SEQ ID NO: 57616 - RNA, 22 nt, Homo sapiens
uucaucaggaauauugaccugu

SEQ ID NO: 57617 - RNA, 20 nt, Homo sapiens
uucaucaggauauuggucua

SEQ ID NO: 57618 - RNA, 18 nt, Homo sapiens
uucaucaguccucagcug

SEQ ID NO: 57619 - RNA, 22 nt, Homo sapiens
uucaucaguuauauuggccuga

SEQ ID NO: 57620 - RNA, 22 nt, Homo sapiens
uucaucaguugagcugguugcu

SEQ ID NO: 57621 - RNA, 22 nt, Homo sapiens
uuccacaauggcugaacuaguu

SEQ ID NO: 57622 - RNA, 22 nt, Homo sapiens
uuccacaaugguugaacuaguu

SEQ ID NO: 57623 - RNA, 22 nt, Homo sapiens
uuccacagggauuugcauugau

SEQ ID NO: 57624 - RNA, 23 nt, Homo sapiens
uuccaccauugacuaguuacaua

SEQ ID NO: 57625 - RNA, 22 nt, Homo sapiens
uuccaugugggcuugucaagua

SEQ ID NO: 57626 - RNA, 22 nt, Homo sapiens
uucccucagaaacacacagccc

SEQ ID NO: 57627 - RNA, 20 nt, Homo sapiens
uucccucagccuugagggua

SEQ ID NO: 57628 - RNA, 22 nt, Homo sapiens
uucccugaaguguuacucuaga

SEQ ID NO: 57629 - RNA, 22 nt, Homo sapiens
uucccugugugcagaugggugu

SEQ ID NO: 57630 - RNA, 22 nt, Homo sapiens
uuccugcacuugcuugccuaug

SEQ ID NO: 57631 - RNA, 22 nt, Homo sapiens
uucuaaacaucuuacaaugcau

SEQ ID NO: 57632 - RNA, 22 nt, Homo sapiens
uucucaauggaugugggaccag

SEQ ID NO: 57633 - RNA, 22 nt, Homo sapiens
uucucaguucgguggcagugcu

SEQ ID NO: 57634 - RNA, 22 nt, Homo sapiens
uucuggcucaggucaacacuuc

SEQ ID NO: 57635 - RNA, 22 nt, Homo sapiens
uucugugguugaaaggagagau

SEQ ID NO: 57636 - RNA, 22 nt, Homo sapiens
uucuucaggcauucccagaagc

SEQ ID NO: 57637 - RNA, 22 nt, Homo sapiens
uucuucaguuacaacaaggggg

SEQ ID NO: 57638 - RNA, 22 nt, Homo sapiens
uucuugaggcaugccgcuggga

SEQ ID NO: 57639 - RNA, 21 nt, Homo sapiens
uucuuugcucaguguuagagu

SEQ ID NO: 57640 - RNA, 22 nt, Homo sapiens
uucuuuggauaaaguuuuaugc

SEQ ID NO: 57641 - RNA, 22 nt, Homo sapiens
uucuuugguacaagggccgacc

SEQ ID NO: 57642 - RNA, 22 nt, Homo sapiens
uugaagacuaaguuaucaggau

SEQ ID NO: 57643 - RNA, 20 nt, Homo sapiens
uugacagagggaaaguugcu

SEQ ID NO: 57644 - RNA, 22 nt, Homo sapiens
uugacaguugggcagggaaguu

SEQ ID NO: 57645 - RNA, 22 nt, Homo sapiens
uugagaaucuuucgaauguucu

SEQ ID NO: 57646 - RNA, 22 nt, Homo sapiens
uugagauagggucuaccucugu

SEQ ID NO: 57647 - RNA, 22 nt, Homo sapiens
uugagcccuggagguggaggcu

SEQ ID NO: 57648 - RNA, 22 nt, Homo sapiens
uugaggacugguugaaagcuuu

SEQ ID NO: 57649 - RNA, 22 nt, Homo sapiens
uugaggaggcagucucuccauu

SEQ ID NO: 57650 - RNA, 22 nt, Homo sapiens
uugaggaucauuguuuucggag

SEQ ID NO: 57651 - RNA, 23 nt, Homo sapiens
uugaggcauguaccaucaauauc

SEQ ID NO: 57652 - RNA, 22 nt, Homo sapiens
uugagguauugauaaaacauuu

SEQ ID NO: 57653 - RNA, 22 nt, Homo sapiens
uugaggugggaggaucacuuga

SEQ ID NO: 57654 - RNA, 22 nt, Homo sapiens
uugcaaagaccucuucacuucc

SEQ ID NO: 57655 - RNA, 22 nt, Homo sapiens
uugcaugcuccuuaugagaauc

SEQ ID NO: 57656 - RNA, 22 nt, Homo sapiens
uugcauuuucuaggagggcaaa

SEQ ID NO: 57657 - RNA, 22 nt, Homo sapiens
uugccaauauuuuacugagaag

SEQ ID NO: 57658 - RNA, 22 nt, Homo sapiens
uugccacuucucuugccccauu

SEQ ID NO: 57659 - RNA, 22 nt, Homo sapiens
uugcuagaugaaaaugguaccu

SEQ ID NO: 57660 - RNA, 22 nt, Homo sapiens
auuacauagucaaggugucuca

SEQ ID NO: 57661 - RNA, 22 nt, Homo sapiens
auuaucacaguuuugcauaugg

SEQ ID NO: 57662 - RNA, 22 nt, Homo sapiens
auucaagugaugcagcuguuuu

SEQ ID NO: 57663 - RNA, 22 nt, Homo sapiens
auuccaguggguuuacauccca

SEQ ID NO: 57664 - RNA, 22 nt, Homo sapiens
auugcauaaacacauuucuuau

SEQ ID NO: 57665 - RNA, 22 nt, Homo sapiens
auugcuaacugaaauaagacca

SEQ ID NO: 57666 - RNA, 22 nt, Homo sapiens
auugcuuacuaaucaucuucag

SEQ ID NO: 57667 - RNA, 22 nt, Homo sapiens
auuguaguuugcuauggcaaua

SEQ ID NO: 57668 - RNA, 21 nt, Homo sapiens
auuguauguaaaccaaaugag

SEQ ID NO: 57669 - RNA, 22 nt, Homo sapiens
auugucauuuauaacuguguag

SEQ ID NO: 57670 - RNA, 19 nt, Homo sapiens
auuuccuggagcuggucuc

SEQ ID NO: 57671 - RNA, 22 nt, Homo sapiens
auuugacacugagagccucagu

SEQ ID NO: 57672 - RNA, 22 nt, Homo sapiens
auuugggaaugugcauuauacu

SEQ ID NO: 57673 - RNA, 22 nt, Homo sapiens
auuugguaauauuuaaggacuu

SEQ ID NO: 57674 - RNA, 22 nt, Homo sapiens
caaagcacuuggcuuggaagau

SEQ ID NO: 57675 - RNA, 22 nt, Homo sapiens
caaaggcuguuauaggccagga

SEQ ID NO: 57676 - RNA, 22 nt, Homo sapiens
caacacagugaaacccgucucu

SEQ ID NO: 57677 - RNA, 22 nt, Homo sapiens
caacacuguuuauuggauagcc

SEQ ID NO: 57678 - RNA, 19 nt, Homo sapiens
caacccugcagagaaagga

SEQ ID NO: 57679 - RNA, 22 nt, Homo sapiens
caacucuguaggauccaggugg

SEQ ID NO: 57680 - RNA, 22 nt, Homo sapiens
caaggaauucucaauagaguua

SEQ ID NO: 57681 - RNA, 22 nt, Homo sapiens
caaguguuuccuuaaauacuug

SEQ ID NO: 57682 - RNA, 22 nt, Homo sapiens
caauggcacgaucucgucucac

SEQ ID NO: 57683 - RNA, 22 nt, Homo sapiens
cacacugucuucaauggguggu

SEQ ID NO: 57684 - RNA, 22 nt, Homo sapiens
cacacugucuucauuacuguag

SEQ ID NO: 57685 - RNA, 22 nt, Homo sapiens
cacacugucuuucagaaugguu

SEQ ID NO: 57686 - RNA, 22 nt, Homo sapiens
cacagcacaggcaugaguguca

SEQ ID NO: 57687 - RNA, 22 nt, Homo sapiens
cacaguguuacugguaugaagu

SEQ ID NO: 57688 - RNA, 21 nt, Homo sapiens
cacauggaggcagagagugua

SEQ ID NO: 57689 - RNA, 23 nt, Homo sapiens
caccaguauaauuagcuuuuaaa

SEQ ID NO: 57690 - RNA, 22 nt, Homo sapiens
cacugaaugugagguuggggag

SEQ ID NO: 57691 - RNA, 22 nt, Homo sapiens
cacugcacuccagccuaagagg

SEQ ID NO: 57692 - RNA, 23 nt, Homo sapiens
cacugggcagcagguguucccag

SEQ ID NO: 57693 - RNA, 22 nt, Homo sapiens
cacugugcaaccuccaccuccc

SEQ ID NO: 57694 - RNA, 22 nt, Homo sapiens
cagagaaugucuuuuuuaacca

SEQ ID NO: 57695 - RNA, 22 nt, Homo sapiens
cagagcaaugcuuuugcuuuga

SEQ ID NO: 57696 - RNA, 22 nt, Homo sapiens
cagagguaagcaagucagcauu

SEQ ID NO: 57697 - RNA, 22 nt, Homo sapiens
cagcacauagcaguugcucagu

SEQ ID NO: 57698 - RNA, 22 nt, Homo sapiens
cagccggguggcuccuagggua

SEQ ID NO: 57699 - RNA, 22 nt, Homo sapiens
cagcuaaauuguuaaauccaag

SEQ ID NO: 57700 - RNA, 22 nt, Homo sapiens
cagcuguuguuccagucuuuua

SEQ ID NO: 57701 - RNA, 22 nt, Homo sapiens
caggaccucuugccuggaagcc

SEQ ID NO: 57702 - RNA, 22 nt, Homo sapiens
cagguaagaugcuuucucuuau

SEQ ID NO: 57703 - RNA, 22 nt, Homo sapiens
cagguacauuuuaaagggcuca

SEQ ID NO: 57704 - RNA, 22 nt, Homo sapiens
caguaaauaucugagcgagguc

SEQ ID NO: 57705 - RNA, 22 nt, Homo sapiens
caguacaauguggaaaaggagu

SEQ ID NO: 57706 - RNA, 22 nt, Homo sapiens
cagugcaaagccucugcccaga

SEQ ID NO: 57707 - RNA, 23 nt, Homo sapiens
cagugguguuagagaaaucuuuu

SEQ ID NO: 57708 - RNA, 22 nt, Homo sapiens
cagugguuuucucaguucagca

SEQ ID NO: 57709 - RNA, 22 nt, Homo sapiens
cauacaagcuacaaucacaaag

SEQ ID NO: 57710 - RNA, 22 nt, Homo sapiens
cauacaugugcuugucuuaugc

SEQ ID NO: 57711 - RNA, 22 nt, Homo sapiens
caucagcaauguaugaggguuc

SEQ ID NO: 57712 - RNA, 22 nt, Homo sapiens
caugaacacugugcggcuuccu

SEQ ID NO: 57713 - RNA, 22 nt, Homo sapiens
caugcauuggucuauuauguga

SEQ ID NO: 57714 - RNA, 22 nt, Homo sapiens
cauuccacuggauaaacaaggu

SEQ ID NO: 57715 - RNA, 22 nt, Homo sapiens
cauugcacuccagccugccugg

SEQ ID NO: 57716 - RNA, 22 nt, Homo sapiens
cauugcacuccagccuugguga

SEQ ID NO: 57717 - RNA, 22 nt, Homo sapiens
cauugcacuccagcucugggcg

SEQ ID NO: 57718 - RNA, 22 nt, Homo sapiens
cauugcacucuaucccgguggg

SEQ ID NO: 57719 - RNA, 22 nt, Homo sapiens
cauuugguggcuacagaguaac

SEQ ID NO: 57720 - RNA, 22 nt, Homo sapiens
ccaagccucaguuucccucugu

SEQ ID NO: 57721 - RNA, 22 nt, Homo sapiens
ccacacugucuuggugggaaac

SEQ ID NO: 57722 - RNA, 22 nt, Homo sapiens
ccacugcacuccagcccggcaa

SEQ ID NO: 57723 - RNA, 22 nt, Homo sapiens
ccacugggcaguuuauuaucag

SEQ ID NO: 57724 - RNA, 22 nt, Homo sapiens
ccagugcauggaucccaggggg

SEQ ID NO: 57725 - RNA, 22 nt, Homo sapiens
ccagugucugacagacacggcg

SEQ ID NO: 57726 - RNA, 22 nt, Homo sapiens
ccaucacacugugauuauuauc

SEQ ID NO: 57727 - RNA, 22 nt, Homo sapiens
ccauggcaauggucagucuauu

SEQ ID NO: 57728 - RNA, 21 nt, Homo sapiens
ccaugggacggaaugaauaca

SEQ ID NO: 57729 - RNA, 22 nt, Homo sapiens
cccagugugcugggugacagcu

SEQ ID NO: 57730 - RNA, 22 nt, Homo sapiens
cccaguguuacgugacagccug

SEQ ID NO: 57731 - RNA, 22 nt, Homo sapiens
ccccauuguugugguuuuaucu

SEQ ID NO: 57732 - RNA, 17 nt, Homo sapiens
ccccugagcgaugcagu

SEQ ID NO: 57733 - RNA, 22 nt, Homo sapiens
cccuggacacacacuuuuauuc

SEQ ID NO: 57734 - RNA, 19 nt, Homo sapiens
cccuggcacauggaaaaug

SEQ ID NO: 57735 - RNA, 22 nt, Homo sapiens
cccuucauucaaggguugugag

SEQ ID NO: 57736 - RNA, 22 nt, Homo sapiens
ccuaggcacugggguccagccc

SEQ ID NO: 57737 - RNA, 21 nt, Homo sapiens
ccuccauuuguauucuugccc

SEQ ID NO: 57738 - RNA, 22 nt, Homo sapiens
ccuucauccuccagcaggcuag

SEQ ID NO: 57739 - RNA, 22 nt, Homo sapiens
ccuucuuuuguaaggcugaaua

SEQ ID NO: 57740 - RNA, 22 nt, Homo sapiens
ccuugcacuucccaggugaggc

SEQ ID NO: 57741 - RNA, 19 nt, Homo sapiens
ccuuugguuuccaugacau

SEQ ID NO: 57742 - RNA, 22 nt, Homo sapiens
ccuuuguuuaguugaauuguau

SEQ ID NO: 57743 - RNA, 22 nt, Homo sapiens
cgcccuguagcuagcuagaggu

SEQ ID NO: 57744 - RNA, 22 nt, Homo sapiens
cgccugagcugaggaagcugca

SEQ ID NO: 57745 - RNA, 22 nt, Homo sapiens
cuaacacagggcaagucaggcu

SEQ ID NO: 57746 - RNA, 22 nt, Homo sapiens
cuaagauugucuuaguguguug

SEQ ID NO: 57747 - RNA, 22 nt, Homo sapiens
cuaauacaguuguccaagcugg

SEQ ID NO: 57748 - RNA, 22 nt, Homo sapiens
cuaauucuggccaaagggauaa

SEQ ID NO: 57749 - RNA, 22 nt, Homo sapiens
cuagacacugacguuccuccga

SEQ ID NO: 57750 - RNA, 22 nt, Homo sapiens
cuagaggcacagccuaggcacu

SEQ ID NO: 57751 - RNA, 22 nt, Homo sapiens
caaaagugauugcgguuuuugc

SEQ ID NO: 57752 - RNA, 22 nt, Homo sapiens
gauguguuuccaggauuuguuu

SEQ ID NO: 57753 - RNA, 22 nt, Homo sapiens
gcaaagaaugcagauuugccuc

SEQ ID NO: 57754 - RNA, 22 nt, Homo sapiens
gcaaaguguuuuccaacuuggu

SEQ ID NO: 57755 - RNA, 22 nt, Homo sapiens
gcaaaguguuuuuaggaagucu

SEQ ID NO: 57756 - RNA, 22 nt, Homo sapiens
gcaagagguaucuuauuuuccc

SEQ ID NO: 57757 - RNA, 22 nt, Homo sapiens
gcaccccuuaccgggcuggguu

SEQ ID NO: 57758 - RNA, 22 nt, Homo sapiens
gcagaucuucgcgguaaguguu

SEQ ID NO: 57759 - RNA, 22 nt, Homo sapiens
gcaggaaucuugagaaggauuc

SEQ ID NO: 57760 - RNA, 22 nt, Homo sapiens
gcaggaauuucucugcagaccc

SEQ ID NO: 57761 - RNA, 20 nt, Homo sapiens
gcaguguucugaccugaauc

SEQ ID NO: 57762 - RNA, 22 nt, Homo sapiens
gcaguguucugggcaggaagaa

SEQ ID NO: 57763 - RNA, 17 nt, Homo sapiens
gcauaugucgaaccagc

SEQ ID NO: 57764 - RNA, 22 nt, Homo sapiens
gcauaugucuuuauagcagcau

SEQ ID NO: 57765 - RNA, 17 nt, Homo sapiens
gcauauguugaaccagc

SEQ ID NO: 57766 - RNA, 17 nt, Homo sapiens
gcauauguugaaccagu

SEQ ID NO: 57767 - RNA, 22 nt, Homo sapiens
gcaucacagggagacaggccuc

SEQ ID NO: 57768 - RNA, 22 nt, Homo sapiens
gcaugaugaauaauaucacaag

SEQ ID NO: 57769 - RNA, 22 nt, Homo sapiens
gcauggagaaggggacugauuc

SEQ ID NO: 57770 - RNA, 22 nt, Homo sapiens
gcauggaguggaaauucuuggg

SEQ ID NO: 57771 - RNA, 18 nt, Homo sapiens
gccaacauguaaacaggu

SEQ ID NO: 57772 - RNA, 22 nt, Homo sapiens
gccaagauuuaauucaucaguu

SEQ ID NO: 57773 - RNA, 22 nt, Homo sapiens
gccauggaggauuuauagaggc

SEQ ID NO: 57774 - RNA, 22 nt, Homo sapiens
gcuaugucuguugcucuugggc

SEQ ID NO: 57775 - RNA, 22 nt, Homo sapiens
gcugaguaguauuucauuguau

SEQ ID NO: 57776 - RNA, 22 nt, Homo sapiens
gcuggauguuucaauacaaaua

SEQ ID NO: 57777 - RNA, 22 nt, Homo sapiens
gcugguguucaggcccucaguc

SEQ ID NO: 57778 - RNA, 22 nt, Homo sapiens
gcuucauggaggcugggcgcag

SEQ ID NO: 57779 - RNA, 22 nt, Homo sapiens
gcuugguccccacccaaaucgc

SEQ ID NO: 57780 - RNA, 22 nt, Homo sapiens
gcuuguguucaagucacccuua

SEQ ID NO: 57781 - RNA, 22 nt, Homo sapiens
gcuuuguuaaaacacagccaca

SEQ ID NO: 57782 - RNA, 19 nt, Homo sapiens
ggaaaugucuauuaagauc

SEQ ID NO: 57783 - RNA, 17 nt, Homo sapiens
ggaaugaauuccagccc

SEQ ID NO: 57784 - RNA, 22 nt, Homo sapiens
ggaauuaaggcaauugaaagcu

SEQ ID NO: 57785 - RNA, 22 nt, Homo sapiens
ggacuguaguuucccgggcugg

SEQ ID NO: 57786 - RNA, 22 nt, Homo sapiens
ggaggcuaguaaaaagguagaa

SEQ ID NO: 57787 - RNA, 22 nt, Homo sapiens
ggaguaggcuguccggcaccca

SEQ ID NO: 57788 - RNA, 21 nt, Homo sapiens
ggaguauaaggcaaaggagug

SEQ ID NO: 57789 - RNA, 22 nt, Homo sapiens
ggagucugauguucuaaggcag

SEQ ID NO: 57790 - RNA, 22 nt, Homo sapiens
ggaguguaauggcgccaucuca

SEQ ID NO: 57791 - RNA, 22 nt, Homo sapiens
ggauaacagccaggucaaacaa

SEQ ID NO: 57792 - RNA, 22 nt, Homo sapiens
ggcaacaaagacauuucaacau

SEQ ID NO: 57793 - RNA, 23 nt, Homo sapiens
ggcaagaucucagcucacugcaa

SEQ ID NO: 57794 - RNA, 22 nt, Homo sapiens
ggcaaggauuagauucuccccu

SEQ ID NO: 57795 - RNA, 22 nt, Homo sapiens
ggcaaggugaugaaugucuaca

SEQ ID NO: 57796 - RNA, 22 nt, Homo sapiens
ggcaccacagacgccaggcgug

SEQ ID NO: 57797 - RNA, 23 nt, Homo sapiens
ggcacggaauucaaagaggcauu

SEQ ID NO: 57798 - RNA, 22 nt, Homo sapiens
ggcacuguggcucaagccugua

SEQ ID NO: 57799 - RNA, 22 nt, Homo sapiens
ggccggguggccauggcugccc

SEQ ID NO: 57800 - RNA, 22 nt, Homo sapiens
ggccuguaggguauugguaggg

SEQ ID NO: 57801 - RNA, 22 nt, Homo sapiens
ggcgccauugcacuccagccug

SEQ ID NO: 57802 - RNA, 22 nt, Homo sapiens
ggcucaguuuccuccgucugcu

SEQ ID NO: 57803 - RNA, 22 nt, Homo sapiens
ggcucuguugcuaccaauuaag

SEQ ID NO: 57804 - RNA, 22 nt, Homo sapiens
gggaaauguaaagucauaagau

SEQ ID NO: 57805 - RNA, 22 nt, Homo sapiens
gggaagaaggagugguuuacuc

SEQ ID NO: 57806 - RNA, 22 nt, Homo sapiens
gggaagugugguuucuuuacag

SEQ ID NO: 57807 - RNA, 22 nt, Homo sapiens
gggcaaaacuguacugccaagg

SEQ ID NO: 57808 - RNA, 20 nt, Homo sapiens
gggcaaguaugugggaaguc

SEQ ID NO: 57809 - RNA, 22 nt, Homo sapiens
gggcacgugugugcugugcuca

SEQ ID NO: 57810 - RNA, 16 nt, Homo sapiens
gggcaugugaagccua

SEQ ID NO: 57811 - RNA, 22 nt, Homo sapiens
gggucauggaugugaagcuaga

SEQ ID NO: 57812 - RNA, 22 nt, Homo sapiens
gguagacaucgugcucugugau

SEQ ID NO: 57813 - RNA, 22 nt, Homo sapiens
gguauguaggucuacgguacaa

SEQ ID NO: 57814 - RNA, 22 nt, Homo sapiens
ggucagauggcagcugggccug

SEQ ID NO: 57815 - RNA, 22 nt, Homo sapiens
ggucauagagaauucaccagga

SEQ ID NO: 57816 - RNA, 21 nt, Homo sapiens
ggugagaaaggagacauagac

SEQ ID NO: 57817 - RNA, 23 nt, Homo sapiens
ggugaggaguacagagucuucau

SEQ ID NO: 57818 - RNA, 22 nt, Homo sapiens
guaacguaaugucaaaaucuau

SEQ ID NO: 57819 - RNA, 22 nt, Homo sapiens
guaaggcuguuaucuucacguc

SEQ ID NO: 57820 - RNA, 22 nt, Homo sapiens
guacacauacauauaugugugu

SEQ ID NO: 57821 - RNA, 22 nt, Homo sapiens
guacaugcauaguuuauuucug

SEQ ID NO: 57822 - RNA, 22 nt, Homo sapiens
guacaugcaugcaugggugugc

SEQ ID NO: 57823 - RNA, 22 nt, Homo sapiens
guagaaaguuugcugucacaug

SEQ ID NO: 57824 - RNA, 22 nt, Homo sapiens
guauacaguugacccuugaacc

SEQ ID NO: 57825 - RNA, 22 nt, Homo sapiens
guaucccuugcuaucugaaucu

SEQ ID NO: 57826 - RNA, 22 nt, Homo sapiens
gucacagaaaaagauaugccaa

SEQ ID NO: 57827 - RNA, 22 nt, Homo sapiens
gucacagcacuuuuaguaagug

SEQ ID NO: 57828 - RNA, 22 nt, Homo sapiens
gucacaguguuuguucauccca

SEQ ID NO: 57829 - RNA, 22 nt, Homo sapiens
gucacugagaagguuaguuugu

SEQ ID NO: 57830 - RNA, 22 nt, Homo sapiens
gucacugagcagaaggaagcga

SEQ ID NO: 57831 - RNA, 22 nt, Homo sapiens
gucacugucuacuguaauagcc

SEQ ID NO: 57832 - RNA, 22 nt, Homo sapiens
gucacuguggagaagaaagugg

SEQ ID NO: 57833 - RNA, 17 nt, Homo sapiens
gcacuggcguaucccac

SEQ ID NO: 57834 - RNA, 22 nt, Homo sapiens
gcagcacaugacuguauguaua

SEQ ID NO: 57835 - RNA, 22 nt, Homo sapiens
gcagcagugcccuggauggaaa

SEQ ID NO: 57836 - RNA, 22 nt, Homo sapiens
gcaugcacaugugaaaaaauga

SEQ ID NO: 57837 - RNA, 22 nt, Homo sapiens
gccaagaugcugcccacagaca

SEQ ID NO: 57838 - RNA, 22 nt, Homo sapiens
gccaguauuuuauugagaauuu

SEQ ID NO: 57839 - RNA, 22 nt, Homo sapiens
gccaguauuuuguugagaauuu

SEQ ID NO: 57840 - RNA, 22 nt, Homo sapiens
gccagugugaugugaucauggc

SEQ ID NO: 57841 - RNA, 21 nt, Homo sapiens
gccaguguggcaauuuuucaa

SEQ ID NO: 57842 - RNA, 22 nt, Homo sapiens
gccuagagaaguaaauauuauc

SEQ ID NO: 57843 - RNA, 22 nt, Homo sapiens
gccuagggacaaaccguccgac

SEQ ID NO: 57844 - RNA, 22 nt, Homo sapiens
gccucaguuguggccagggauu

SEQ ID NO: 57845 - RNA, 22 nt, Homo sapiens
aaaccacagugugcugcugggg

SEQ ID NO: 57846 - RNA, 22 nt, Homo sapiens
aaacuugucuaauuauaagcau

SEQ ID NO: 57847 - RNA, 22 nt, Homo sapiens
aaaggcaucugcucggcucccu

SEQ ID NO: 57848 - RNA, 17 nt, Homo sapiens
aaaguccuuugcuaucu

SEQ ID NO: 57849 - RNA, 22 nt, Homo sapiens
aaagucuguuacagcuauuucu

SEQ ID NO: 57850 - RNA, 18 nt, Homo sapiens
aaagugaugucauucuuu

SEQ ID NO: 57851 - RNA, 22 nt, Homo sapiens
aaaguguguuuccaaccugugg

SEQ ID NO: 57852 - RNA, 22 nt, Homo sapiens
aaaguguuucugcaguagguuu

SEQ ID NO: 57853 - RNA, 22 nt, Homo sapiens
aaaguucuguugauagugcuga

SEQ ID NO: 57854 - RNA, 15 nt, Homo sapiens
aaauaugucaguucu

SEQ ID NO: 57855 - RNA, 22 nt, Homo sapiens
aaauccauuuguucagcuaugc

SEQ ID NO: 57856 - RNA, 21 nt, Homo sapiens
aaaugcacauuacugcuggug

SEQ ID NO: 57857 - RNA, 20 nt, Homo sapiens
aaaugcuguaauguuuggga

SEQ ID NO: 57858 - RNA, 18 nt, Homo sapiens
aaauucugucccuucuuc

SEQ ID NO: 57859 - RNA, 22 nt, Homo sapiens
aaauugcacaaguggugauuug

SEQ ID NO: 57860 - RNA, 22 nt, Homo sapiens
aaauugcauugagcugcuuauu

SEQ ID NO: 57861 - RNA, 22 nt, Homo sapiens
aacacuaucugccuuacaggga

SEQ ID NO: 57862 - RNA, 22 nt, Homo sapiens
aacaguguuuuggguuuucugg

SEQ ID NO: 57863 - RNA, 22 nt, Homo sapiens
aacuaugucaaauaaaaugagg

SEQ ID NO: 57864 - RNA, 22 nt, Homo sapiens
aacugccucugacauaggcagg

SEQ ID NO: 57865 - RNA, 22 nt, Homo sapiens
aacuggcacuacaucaagagcu

SEQ ID NO: 57866 - RNA, 19 nt, Homo sapiens
aacuggugugagaugauau

SEQ ID NO: 57867 - RNA, 21 nt, Homo sapiens
aagaaagcuggacuugccgcu

SEQ ID NO: 57868 - RNA, 22 nt, Homo sapiens
aagagguuuaacugacucacag

SEQ ID NO: 57869 - RNA, 21 nt, Homo sapiens
aagcacauugaguguguguga

SEQ ID NO: 57870 - RNA, 22 nt, Homo sapiens
aagcacccuuugucuggacaug

SEQ ID NO: 57871 - RNA, 22 nt, Homo sapiens
aagcugccuugugaaggcauuc

SEQ ID NO: 57872 - RNA, 22 nt, Homo sapiens
aagcuguugguggauguaccau

SEQ ID NO: 57873 - RNA, 22 nt, Homo sapiens
aaggaacuggaauauuuugaac

SEQ ID NO: 57874 - RNA, 22 nt, Homo sapiens
aaggaguauugaaugaccaagu

SEQ ID NO: 57875 - RNA, 22 nt, Homo sapiens
aaggcaguggcagaagauguca

SEQ ID NO: 57876 - RNA, 22 nt, Homo sapiens
aaggcagugugcacauaacacu

SEQ ID NO: 57877 - RNA, 22 nt, Homo sapiens
aaggcaugcaguacguuucuau

SEQ ID NO: 57878 - RNA, 20 nt, Homo sapiens
aaggcuuucgaguuccaggg

SEQ ID NO: 57879 - RNA, 23 nt, Homo sapiens
aagguaagcuagaaagauguaga

SEQ ID NO: 57880 - RNA, 22 nt, Homo sapiens
aaggugguuuucucuuggaguc

SEQ ID NO: 57881 - RNA, 22 nt, Homo sapiens
aaguacuguuuaaauugcagaa

SEQ ID NO: 57882 - RNA, 22 nt, Homo sapiens
aaguaucaggaauaguuauugg

SEQ ID NO: 57883 - RNA, 22 nt, Homo sapiens
aaguauguaucaagucauacuu

SEQ ID NO: 57884 - RNA, 22 nt, Homo sapiens
aagugaaugugcuggaauagcu

SEQ ID NO: 57885 - RNA, 22 nt, Homo sapiens
aagugagaugcaguggaguucc

SEQ ID NO: 57886 - RNA, 22 nt, Homo sapiens
aagugcauguauuaguguaguc

SEQ ID NO: 57887 - RNA, 22 nt, Homo sapiens
aagugcucuugugggaagagag

SEQ ID NO: 57888 - RNA, 22 nt, Homo sapiens
aagugcuucuuuccucgagaag

SEQ ID NO: 57889 - RNA, 22 nt, Homo sapiens
aaguugcuuuagguaagucaau

SEQ ID NO: 57890 - RNA, 22 nt, Homo sapiens
aauaaagcagcuuuuugggacu

SEQ ID NO: 57891 - RNA, 21 nt, Homo sapiens
aauacucuagguuaagagagc

SEQ ID NO: 57892 - RNA, 22 nt, Homo sapiens
aauacugaaaguauuuucaaau

SEQ ID NO: 57893 - RNA, 22 nt, Homo sapiens
aauacuuccaaaucuagucauu

SEQ ID NO: 57894 - RNA, 22 nt, Homo sapiens
aauagugcugugcagugagugg

SEQ ID NO: 57895 - RNA, 22 nt, Homo sapiens
aaucacaguuaguaagggagaa

SEQ ID NO: 57896 - RNA, 21 nt, Homo sapiens
aaucacaguuguucugccuuc

SEQ ID NO: 57897 - RNA, 22 nt, Homo sapiens
aaucagcacacugugcuuucca

SEQ ID NO: 57898 - RNA, 22 nt, Homo sapiens
aaugacacugagcaucuuucau

SEQ ID NO: 57899 - RNA, 22 nt, Homo sapiens
aaugcacauauauuuccuuauu

SEQ ID NO: 57900 - RNA, 22 nt, Homo sapiens
aaugcauaauuuguaugaggua

SEQ ID NO: 57901 - RNA, 22 nt, Homo sapiens
aaugcuguguuauuucaugacc

SEQ ID NO: 57902 - RNA, 22 nt, Homo sapiens
agccaagacucuguuccccuug

SEQ ID NO: 57903 - RNA, 22 nt, Homo sapiens
agcgccauugcacuccagccuu

SEQ ID NO: 57904 - RNA, 22 nt, Homo sapiens
agcuccaugauaguaugucugu

SEQ ID NO: 57905 - RNA, 20 nt, Homo sapiens
agcuccauuccugaaggcug

SEQ ID NO: 57906 - RNA, 22 nt, Homo sapiens
agcuggauguggaugacccugu

SEQ ID NO: 57907 - RNA, 22 nt, Homo sapiens
agcugguauuuugucaaggaua

SEQ ID NO: 57908 - RNA, 22 nt, Homo sapiens
agcuguaguuuauucauguuaa

SEQ ID NO: 57909 - RNA, 22 nt, Homo sapiens
agcuguguugucugaagucaga

SEQ ID NO: 57910 - RNA, 22 nt, Homo sapiens
aggaaauguuggucccauuucu

SEQ ID NO: 57911 - RNA, 22 nt, Homo sapiens
aggaagugugcaauuaauuucu

SEQ ID NO: 57912 - RNA, 22 nt, Homo sapiens
aggaauuuaauguaugauaaua

SEQ ID NO: 57913 - RNA, 22 nt, Homo sapiens
aggcuguguggauaauauuggg

SEQ ID NO: 57914 - RNA, 22 nt, Homo sapiens
aggcuuuuggagaacacugcac

SEQ ID NO: 57915 - RNA, 22 nt, Homo sapiens
agggaauguaaguuuuaugaga

SEQ ID NO: 57916 - RNA, 22 nt, Homo sapiens
agggcacuguagguccugccuc

SEQ ID NO: 57917 - RNA, 22 nt, Homo sapiens
agggccuuuguagauguacuca

SEQ ID NO: 57918 - RNA, 20 nt, Homo sapiens
agguacacugacaugccuuc

SEQ ID NO: 57919 - RNA, 22 nt, Homo sapiens
agguccauuauuuucauucaug

SEQ ID NO: 57920 - RNA, 22 nt, Homo sapiens
aaagugccugacucauaguuag

SEQ ID NO: 57921 - RNA, 22 nt, Homo sapiens
aaagugcugagauuguaggcau

SEQ ID NO: 57922 - RNA, 22 nt, Homo sapiens
aaagugcugggauuaggccagg

SEQ ID NO: 57923 - RNA, 22 nt, Homo sapiens
aaagugcuguagacugggcgca

SEQ ID NO: 57924 - RNA, 22 nt, Homo sapiens
aaagugcuuccuuuuugagggu

SEQ ID NO: 57925 - RNA, 22 nt, Homo sapiens
aaagugcuucucuuuggugggu

SEQ ID NO: 57926 - RNA, 22 nt, Homo sapiens
aaauaacugucagguucuggaa

SEQ ID NO: 57927 - RNA, 22 nt, Homo sapiens
aaaugcaugaauaagcucgugu

SEQ ID NO: 57928 - RNA, 22 nt, Homo sapiens
aaaugcauggacagcuggucuu

SEQ ID NO: 57929 - RNA, 22 nt, Homo sapiens
aaauggcaccggcucuucccuc

SEQ ID NO: 57930 - RNA, 22 nt, Homo sapiens
aaaugguguuaguagaucuuua

SEQ ID NO: 57931 - RNA, 22 nt, Homo sapiens
aaaugucauggaguguuucccc

SEQ ID NO: 57932 - RNA, 22 nt, Homo sapiens
ucagcaccauguaacaauugau

SEQ ID NO: 57933 - RNA, 22 nt, Homo sapiens
ucaggcacuaguaagaaaaagg

SEQ ID NO: 57934 - RNA, 22 nt, Homo sapiens
ucaggcaugcagcaaugcagug

SEQ ID NO: 57935 - RNA, 20 nt, Homo sapiens
ucaggcuccgcauuaacuua

SEQ ID NO: 57936 - RNA, 21 nt, Homo sapiens
ucaggcuuuuugagugccaau

SEQ ID NO: 57937 - RNA, 19 nt, Homo sapiens
ucaguagugcacauaagcc

SEQ ID NO: 57938 - RNA, 18 nt, Homo sapiens
ucagucacugccuggcuu

SEQ ID NO: 57939 - RNA, 22 nt, Homo sapiens
ucagugauugcuuucauggaaa

SEQ ID NO: 57940 - RNA, 21 nt, Homo sapiens
ucagugcaauucuauggggaa

SEQ ID NO: 57941 - RNA, 22 nt, Homo sapiens
ucagugcaggaaucucuagcca

SEQ ID NO: 57942 - RNA, 22 nt, Homo sapiens
ucaguguugauggcugcugacu

SEQ ID NO: 57943 - RNA, 22 nt, Homo sapiens
ucauacgucuccuugugccacc

SEQ ID NO: 57944 - RNA, 21 nt, Homo sapiens
ucaucaagcuguagacaugau

SEQ ID NO: 57945 - RNA, 22 nt, Homo sapiens
ucaucaggaaacuuaugcagug

SEQ ID NO: 57946 - RNA, 22 nt, Homo sapiens
ucaugagacacacuggaaagga

SEQ ID NO: 57947 - RNA, 22 nt, Homo sapiens
ucauggggugcuuugcuagauu

SEQ ID NO: 57948 - RNA, 22 nt, Homo sapiens
uccacaguggugaggugcagca

SEQ ID NO: 57949 - RNA, 22 nt, Homo sapiens
uccaguguuccucagucacccc

SEQ ID NO: 57950 - RNA, 22 nt, Homo sapiens
uccaguguuucuuccacuauuu

SEQ ID NO: 57951 - RNA, 22 nt, Homo sapiens
uccauuugucuauguuucuguu

SEQ ID NO: 57952 - RNA, 22 nt, Homo sapiens
uccauuuguuguaggguauagu

SEQ ID NO: 57953 - RNA, 23 nt, Homo sapiens
ucccaagauggaccagaccaagg

SEQ ID NO: 57954 - RNA, 22 nt, Homo sapiens
ucccacugucuucucgugcucg

SEQ ID NO: 57955 - RNA, 22 nt, Homo sapiens
ucccauguagcuaggauuacag

SEQ ID NO: 57956 - RNA, 22 nt, Homo sapiens
ucccuguguccugggggcaccu

SEQ ID NO: 57957 - RNA, 22 nt, Homo sapiens
uccugcauucugaaauacaagu

SEQ ID NO: 57958 - RNA, 22 nt, Homo sapiens
ucgcugggaaccagagguaaag

SEQ ID NO: 57959 - RNA, 22 nt, Homo sapiens
ucuagccuaugaagcuugucca

SEQ ID NO: 57960 - RNA, 22 nt, Homo sapiens
ucucaauggguuguagacaaag

SEQ ID NO: 57961 - RNA, 22 nt, Homo sapiens
ucucagcacaaacaaaauugcu

SEQ ID NO: 57962 - RNA, 22 nt, Homo sapiens
ucucaguggugcuggcagggga

SEQ ID NO: 57963 - RNA, 22 nt, Homo sapiens
ucucuggauaucuacuuauguu

SEQ ID NO: 57964 - RNA, 22 nt, Homo sapiens
ucugacaaugaacaaucuauag

SEQ ID NO: 57965 - RNA, 22 nt, Homo sapiens
ucugagguaggugcauggauac

SEQ ID NO: 57966 - RNA, 22 nt, Homo sapiens
ucugccacugucauugugugau

SEQ ID NO: 57967 - RNA, 23 nt, Homo sapiens
ucugcggguguggacccuagugc

SEQ ID NO: 57968 - RNA, 22 nt, Homo sapiens
ucuggcacugaugugggaugcu

SEQ ID NO: 57969 - RNA, 21 nt, Homo sapiens
ucuggcccccucaaaucucau

SEQ ID NO: 57970 - RNA, 22 nt, Homo sapiens
ucuggccccucucaaaucucau

SEQ ID NO: 57971 - RNA, 22 nt, Homo sapiens
ucugggguuuccacuuuuacuu

SEQ ID NO: 57972 - RNA, 22 nt, Homo sapiens
caguacaauguugauuagaagu

SEQ ID NO: 57973 - RNA, 22 nt, Homo sapiens
cauaugguuuuauguucuucau

SEQ ID NO: 57974 - RNA, 22 nt, Homo sapiens
caucaaaguggagggaaggacc

SEQ ID NO: 57975 - RNA, 19 nt, Homo sapiens
caucacagagucuuccauu

SEQ ID NO: 57976 - RNA, 22 nt, Homo sapiens
caucacagcaaguagggagugg

SEQ ID NO: 57977 - RNA, 23 nt, Homo sapiens
caucacauagaggaaagaggaca

SEQ ID NO: 57978 - RNA, 22 nt, Homo sapiens
caucagauugagaucaucuaag

SEQ ID NO: 57979 - RNA, 22 nt, Homo sapiens
caucucauugaauugcugagca

SEQ ID NO: 57980 - RNA, 22 nt, Homo sapiens
caugcacugagagggucucggc

SEQ ID NO: 57981 - RNA, 22 nt, Homo sapiens
cauguauagauuccauaguggu

SEQ ID NO: 57982 - RNA, 22 nt, Homo sapiens
cauuaagcuacuuagaaggugc

SEQ ID NO: 57983 - RNA, 20 nt, Homo sapiens
cauuccacuuuccugucagu

SEQ ID NO: 57984 - RNA, 20 nt, Homo sapiens
cauugcacuccagccugcug

SEQ ID NO: 57985 - RNA, 22 nt, Homo sapiens
cauugcacuccagccugcugac

SEQ ID NO: 57986 - RNA, 20 nt, Homo sapiens
cauugcacuccagcuugggc

SEQ ID NO: 57987 - RNA, 23 nt, Homo sapiens
ccacacuguuuagaauggcauca

SEQ ID NO: 57988 - RNA, 22 nt, Homo sapiens
ccacauuaccuugcuugcucca

SEQ ID NO: 57989 - RNA, 22 nt, Homo sapiens
ccacccuuccauucuuccucuu

SEQ ID NO: 57990 - RNA, 22 nt, Homo sapiens
ccacugggcuagguguuuugga

SEQ ID NO: 57991 - RNA, 22 nt, Homo sapiens
ccacugugguaucugauacugg

SEQ ID NO: 57992 - RNA, 23 nt, Homo sapiens
ccaguauuuauguaaggaagugu

SEQ ID NO: 57993 - RNA, 18 nt, Homo sapiens
ccagugcaaggaaagccc

SEQ ID NO: 57994 - RNA, 22 nt, Homo sapiens
ccagugcugugcaguguaugag

SEQ ID NO: 57995 - RNA, 19 nt, Homo sapiens
ccaguguucugauugcacu

SEQ ID NO: 57996 - RNA, 22 nt, Homo sapiens
ccaguguuuuugaauuccagga

SEQ ID NO: 57997 - RNA, 22 nt, Homo sapiens
ccauugcacuccauccugggca

SEQ ID NO: 57998 - RNA, 22 nt, Homo sapiens
ccauuucacucuuccugaagga

SEQ ID NO: 57999 - RNA, 22 nt, Homo sapiens
cccaguguguuguggauauuua

SEQ ID NO: 58000 - RNA, 22 nt, Homo sapiens
cccaguguuuauuuugagccaa

SEQ ID NO: 58001 - RNA, 20 nt, Homo sapiens
ccccaguuuuucuauuagcu

SEQ ID NO: 58002 - RNA, 22 nt, Homo sapiens
cccgugucuuggucuagggccu

SEQ ID NO: 58003 - RNA, 17 nt, Homo sapiens
cccuaguagcugggacu

SEQ ID NO: 58004 - RNA, 22 nt, Homo sapiens
cccugaagaaagccuaggacau

SEQ ID NO: 58005 - RNA, 22 nt, Homo sapiens
ccugagacugauugacucacaa

SEQ ID NO: 58006 - RNA, 21 nt, Homo sapiens
ccugaguacaacccacuccac

SEQ ID NO: 58007 - RNA, 22 nt, Homo sapiens
ccuuggcaauggcuggggcuga

SEQ ID NO: 58008 - RNA, 22 nt, Homo sapiens
ccuugguugugcuucaacuucu

SEQ ID NO: 58009 - RNA, 22 nt, Homo sapiens
cuaacuaugucucaggaugucc

SEQ ID NO: 58010 - RNA, 22 nt, Homo sapiens
cuaagugaguauaauuuuaaga

SEQ ID NO: 58011 - RNA, 22 nt, Homo sapiens
cuacacaugcaggcucccugcc

SEQ ID NO: 58012 - RNA, 22 nt, Homo sapiens
cuagaguacuuaccacagcaug

SEQ ID NO: 58013 - RNA, 22 nt, Homo sapiens
cuagcuccauauaaagcaggau

SEQ ID NO: 58014 - RNA, 22 nt, Homo sapiens
cuagcugcacuuccugcuacug

SEQ ID NO: 58015 - RNA, 22 nt, Homo sapiens
cuauggcucugucuuuuaaguu

SEQ ID NO: 58016 - RNA, 22 nt, Homo sapiens
cuauuacuuuuauugaacucag

SEQ ID NO: 58017 - RNA, 22 nt, Homo sapiens
cucaaagugcuaagauuaggcu

SEQ ID NO: 58018 - RNA, 22 nt, Homo sapiens
cucacaguucuaaaggcaagaa

SEQ ID NO: 58019 - RNA, 22 nt, Homo sapiens
cucacugggaccacucugaagu

SEQ ID NO: 58020 - RNA, 22 nt, Homo sapiens
cucagugucuggcacacagaaa

SEQ ID NO: 58021 - RNA, 22 nt, Homo sapiens
cucaguguucccauucuaccuu

SEQ ID NO: 58022 - RNA, 22 nt, Homo sapiens
cuccacugagcaggugggaggc

SEQ ID NO: 58023 - RNA, 22 nt, Homo sapiens
cucugguuaaggcugaacuaua

SEQ ID NO: 58024 - RNA, 22 nt, Homo sapiens
cucuuuaguaagcaguugauga

SEQ ID NO: 58025 - RNA, 22 nt, Homo sapiens
cugaauagagcacacugauggg

SEQ ID NO: 58026 - RNA, 22 nt, Homo sapiens
cugacauuguugaucacagcca

SEQ ID NO: 58027 - RNA, 22 nt, Homo sapiens
cugacugaggaucaguucauca

SEQ ID NO: 58028 - RNA, 22 nt, Homo sapiens
cugagacuggugauuuaugaag

SEQ ID NO: 58029 - RNA, 22 nt, Homo sapiens
cugagauaggacucugcuggcu

SEQ ID NO: 58030 - RNA, 22 nt, Homo sapiens
cugagauuuuuagauccuggcg

SEQ ID NO: 58031 - RNA, 22 nt, Homo sapiens
cugagcaaaguucuauuuaugg

SEQ ID NO: 58032 - RNA, 22 nt, Homo sapiens
cugagcaagucauuuuguuaaa

SEQ ID NO: 58033 - RNA, 22 nt, Homo sapiens
cugagcacugagauccucuagc

SEQ ID NO: 58034 - RNA, 22 nt, Homo sapiens
cugaggaaguucuuuaacaguu

SEQ ID NO: 58035 - RNA, 22 nt, Homo sapiens
cugaggcacggcgaccuuaagu

SEQ ID NO: 58036 - RNA, 22 nt, Homo sapiens
cugaggugggaggauuggcuug

SEQ ID NO: 58037 - RNA, 22 nt, Homo sapiens
aaggcauggugacuauuuaggc

SEQ ID NO: 58038 - RNA, 22 nt, Homo sapiens
aaggcgguguggauccuacagc

SEQ ID NO: 58039 - RNA, 22 nt, Homo sapiens
aaggcuuuuugcugacguccuu

SEQ ID NO: 58040 - RNA, 22 nt, Homo sapiens
aaggugcucucuuauguagaaa

SEQ ID NO: 58041 - RNA, 22 nt, Homo sapiens
aaggugcuguaagcauccaugu

SEQ ID NO: 58042 - RNA, 22 nt, Homo sapiens
aagucaugaagaggaaaggaca

SEQ ID NO: 58043 - RNA, 22 nt, Homo sapiens
aagugaccuaacaaugaaggcc

SEQ ID NO: 58044 - RNA, 22 nt, Homo sapiens
aagugcuucagaagacaauauu

SEQ ID NO: 58045 - RNA, 20 nt, Homo sapiens
aagugcuuccuuuuagaggg

SEQ ID NO: 58046 - RNA, 22 nt, Homo sapiens
aaguggaauguuuguggcacaa

SEQ ID NO: 58047 - RNA, 23 nt, Homo sapiens
aaguucaugcucaucuguuacac

SEQ ID NO: 58048 - RNA, 22 nt, Homo sapiens
aauaagaaguggaagggaccgg

SEQ ID NO: 58049 - RNA, 22 nt, Homo sapiens
aauacugagaugugagguacua

SEQ ID NO: 58050 - RNA, 22 nt, Homo sapiens
aauagcauugaaucuaccaauu

SEQ ID NO: 58051 - RNA, 22 nt, Homo sapiens
aauauagcuauguacaugucca

SEQ ID NO: 58052 - RNA, 22 nt, Homo sapiens
aauauugucaaaauggauucca

SEQ ID NO: 58053 - RNA, 22 nt, Homo sapiens
aaucaacauuguuuuaagucaa

SEQ ID NO: 58054 - RNA, 22 nt, Homo sapiens
aaucacaguguucuugugaggg

SEQ ID NO: 58055 - RNA, 22 nt, Homo sapiens
aaucucagagauaucugugucc

SEQ ID NO: 58056 - RNA, 22 nt, Homo sapiens
aaugcacauaaaauccuccagg

SEQ ID NO: 58057 - RNA, 22 nt, Homo sapiens
aauggcaucuacguuaaauguc

SEQ ID NO: 58058 - RNA, 22 nt, Homo sapiens
aauggcucuguuggcccaagac

SEQ ID NO: 58059 - RNA, 22 nt, Homo sapiens
aauggcuucuuauugugguuca

SEQ ID NO: 58060 - RNA, 22 nt, Homo sapiens
aauugaaugauaugggacauuu

SEQ ID NO: 58061 - RNA, 22 nt, Homo sapiens
aauugcauugaauuuguagcuu

SEQ ID NO: 58062 - RNA, 22 nt, Homo sapiens
acacaguauaugacaaugcuuu

SEQ ID NO: 58063 - RNA, 22 nt, Homo sapiens
acacauuagcaagugcuguuau

SEQ ID NO: 58064 - RNA, 22 nt, Homo sapiens
acaccaugucuguuucugguuu

SEQ ID NO: 58065 - RNA, 22 nt, Homo sapiens
acacuguccaguuaggcuacau

SEQ ID NO: 58066 - RNA, 22 nt, Homo sapiens
acagauagcacuaagggaucug

SEQ ID NO: 58067 - RNA, 22 nt, Homo sapiens
acagcagugccccacucuacug

SEQ ID NO: 58068 - RNA, 22 nt, Homo sapiens
acaguacuguuguuugcugcca

SEQ ID NO: 58069 - RNA, 18 nt, Homo sapiens
acagugcugucacugcuu

SEQ ID NO: 58070 - RNA, 22 nt, Homo sapiens
acagugcuguuguguuuucacg

SEQ ID NO: 58071 - RNA, 19 nt, Homo sapiens
acagugucucuauaaugau

SEQ ID NO: 58072 - RNA, 22 nt, Homo sapiens
acaucuguacaguggguguggu

SEQ ID NO: 58073 - RNA, 22 nt, Homo sapiens
accacuguuucaagaagcuugu

SEQ ID NO: 58074 - RNA, 22 nt, Homo sapiens
acccagaauucagucuuaggcc

SEQ ID NO: 58075 - RNA, 21 nt, Homo sapiens
acccccacaccuccuuaguuc

SEQ ID NO: 58076 - RNA, 22 nt, Homo sapiens
acccuggaguaguaggaaucug

SEQ ID NO: 58077 - RNA, 22 nt, Homo sapiens
acccugucaaaauagaccaauc

SEQ ID NO: 58078 - RNA, 22 nt, Homo sapiens
accucagcccggggaaguugag

SEQ ID NO: 58079 - RNA, 22 nt, Homo sapiens
accugcacagccgaacauagac

SEQ ID NO: 58080 - RNA, 22 nt, Homo sapiens
accuggcacuuagcaaaucuga

SEQ ID NO: 58081 - RNA, 23 nt, Homo sapiens
accugugguuauuuuacucuucc

SEQ ID NO: 58082 - RNA, 22 nt, Homo sapiens
accuucauuguugccaugucca

SEQ ID NO: 58083 - RNA, 22 nt, Homo sapiens
acggaacugcuccauucuuugc

SEQ ID NO: 58084 - RNA, 22 nt, Homo sapiens
acuaugcuuuucuuagaauuaa

SEQ ID NO: 58085 - RNA, 22 nt, Homo sapiens
acucagagauuagcacauguuu

SEQ ID NO: 58086 - RNA, 22 nt, Homo sapiens
acugaauguaaacacggagugu

SEQ ID NO: 58087 - RNA, 23 nt, Homo sapiens
acugagcaauguuuacauacuug

SEQ ID NO: 58088 - RNA, 22 nt, Homo sapiens
acugagccuuuaaaugacuuca

SEQ ID NO: 58089 - RNA, 22 nt, Homo sapiens
acugcacuccaaccuguugggc

SEQ ID NO: 58090 - RNA, 22 nt, Homo sapiens
acugcacuccaccuugggcaac

SEQ ID NO: 58091 - RNA, 22 nt, Homo sapiens
acugcacuccagccucccgucu

SEQ ID NO: 58092 - RNA, 22 nt, Homo sapiens
acugcacuccagccugcuggca

SEQ ID NO: 58093 - RNA, 22 nt, Homo sapiens
acugcacuccagccugcugggu

SEQ ID NO: 58094 - RNA, 22 nt, Homo sapiens
acugcacuccagccuggacgac

SEQ ID NO: 58095 - RNA, 20 nt, Homo sapiens
acugcacuccagccuuccag

SEQ ID NO: 58096 - RNA, 22 nt, Homo sapiens
acugcacuccagccuugauggc

SEQ ID NO: 58097 - RNA, 22 nt, Homo sapiens
acugcacuccagccuuggagac

SEQ ID NO: 58098 - RNA, 22 nt, Homo sapiens
acugcacuccagccuuggcaac

SEQ ID NO: 58099 - RNA, 22 nt, Homo sapiens
acugcacuccagccuuugcgau

SEQ ID NO: 58100 - RNA, 22 nt, Homo sapiens
acugcacucccgcccgggugac

SEQ ID NO: 58101 - RNA, 22 nt, Homo sapiens
acugcacuccggccuggcaaca

SEQ ID NO: 58102 - RNA, 22 nt, Homo sapiens
acugcacuccuccuugggugac

SEQ ID NO: 58103 - RNA, 22 nt, Homo sapiens
acugcacucuagccccugcgac

SEQ ID NO: 58104 - RNA, 22 nt, Homo sapiens
acugcacucuagcuugggugac

SEQ ID NO: 58105 - RNA, 22 nt, Homo sapiens
acugcacugucaaccuccuggg

SEQ ID NO: 58106 - RNA, 22 nt, Homo sapiens
acugcacuuauccuccaauguu

SEQ ID NO: 58107 - RNA, 22 nt, Homo sapiens
acugcacuucagccuugggaaa

SEQ ID NO: 58108 - RNA, 18 nt, Homo sapiens
acuggaauuaaacuuuuu

SEQ ID NO: 58109 - RNA, 22 nt, Homo sapiens
acuuugguuuauagaauuuagg

SEQ ID NO: 58110 - RNA, 22 nt, Homo sapiens
gaugcaaauuaagcuugggaca

SEQ ID NO: 58111 - RNA, 22 nt, Homo sapiens
gauggaguugacuaagacaaca

SEQ ID NO: 58112 - RNA, 22 nt, Homo sapiens
gauguguuuuaggaucucagca

SEQ ID NO: 58113 - RNA, 22 nt, Homo sapiens
gauuagaacagaagucagauua

SEQ ID NO: 58114 - RNA, 22 nt, Homo sapiens
gauuccacuuucaaauucaaau

SEQ ID NO: 58115 - RNA, 22 nt, Homo sapiens
gauuccauuuguggcuauuuac

SEQ ID NO: 58116 - RNA, 22 nt, Homo sapiens
gcaaaugcuacaccauuuugua

SEQ ID NO: 58117 - RNA, 22 nt, Homo sapiens
gcaagacaugucuaagguuuaa

SEQ ID NO: 58118 - RNA, 22 nt, Homo sapiens
gcaaggacucccugggucauuc

SEQ ID NO: 58119 - RNA, 21 nt, Homo sapiens
gcaaguacuaucaucauuauc

SEQ ID NO: 58120 - RNA, 22 nt, Homo sapiens
gcaauguuacugaauguguuuu

SEQ ID NO: 58121 - RNA, 22 nt, Homo sapiens
gcacagucaacacuuauucacc

SEQ ID NO: 58122 - RNA, 22 nt, Homo sapiens
gcacaguuaaagggucauguga

SEQ ID NO: 58123 - RNA, 22 nt, Homo sapiens
gcaccacugcacucucagcuug

SEQ ID NO: 58124 - RNA, 20 nt, Homo sapiens
gcagcaccauauuucuaaga

SEQ ID NO: 58125 - RNA, 22 nt, Homo sapiens
gcagugcaguggcgcgaucucg

SEQ ID NO: 58126 - RNA, 22 nt, Homo sapiens
gcaguguucaaaucaugcccau

SEQ ID NO: 58127 - RNA, 22 nt, Homo sapiens
gcaguguuggggccggaggcug

SEQ ID NO: 58128 - RNA, 22 nt, Homo sapiens
gcaguguugugauccaggucuu

SEQ ID NO: 58129 - RNA, 20 nt, Homo sapiens
gcauaugucuuuauggcagc

SEQ ID NO: 58130 - RNA, 22 nt, Homo sapiens
gcauauguuuggguguguauau

SEQ ID NO: 58131 - RNA, 20 nt, Homo sapiens
gcaugagucuuuauaguaga

SEQ ID NO: 58132 - RNA, 22 nt, Homo sapiens
gcauggagcauacauuucuguu

SEQ ID NO: 58133 - RNA, 22 nt, Homo sapiens
gccaacauggcgcuccauucuu

SEQ ID NO: 58134 - RNA, 22 nt, Homo sapiens
gccaguguguguuguucuccgc

SEQ ID NO: 58135 - RNA, 22 nt, Homo sapiens
gccccugagacuugccucgggc

SEQ ID NO: 58136 - RNA, 22 nt, Homo sapiens
gcccugagauucuuggauucug

SEQ ID NO: 58137 - RNA, 22 nt, Homo sapiens
gcccuguugcccugaauacaua

SEQ ID NO: 58138 - RNA, 22 nt, Homo sapiens
gcuaugguuuuuagcuccauca

SEQ ID NO: 58139 - RNA, 22 nt, Homo sapiens
gcucaugagacaagcaggagua

SEQ ID NO: 58140 - RNA, 22 nt, Homo sapiens
gcuccuuugaguagcuucugug

SEQ ID NO: 58141 - RNA, 22 nt, Homo sapiens
gcugauggugcaguucuagccu

SEQ ID NO: 58142 - RNA, 22 nt, Homo sapiens
gcugcacuuuaaggcauccccu

SEQ ID NO: 58143 - RNA, 22 nt, Homo sapiens
gcuguaguugaggauuuuaaga

SEQ ID NO: 58144 - RNA, 22 nt, Homo sapiens
gcuguauuguugaaggaaaugu

SEQ ID NO: 58145 - RNA, 18 nt, Homo sapiens
ggaaaacuuuucuaagua

SEQ ID NO: 58146 - RNA, 22 nt, Homo sapiens
ggaaagacaccuuacuauguua

SEQ ID NO: 58147 - RNA, 22 nt, Homo sapiens
ggaaagaucagcuaaauguaag

SEQ ID NO: 58148 - RNA, 22 nt, Homo sapiens
ggaaagcuagguguggguguac

SEQ ID NO: 58149 - RNA, 22 nt, Homo sapiens
ggaaugagaaauauuacacaau

SEQ ID NO: 58150 - RNA, 22 nt, Homo sapiens
ggaaugcuaaaauaggaugcug

SEQ ID NO: 58151 - RNA, 22 nt, Homo sapiens
ggaaugugugucaugcuuuugc

SEQ ID NO: 58152 - RNA, 22 nt, Homo sapiens
ggacugagaggacuacagugua

SEQ ID NO: 58153 - RNA, 22 nt, Homo sapiens
ggagagugacauauuucuaggc

SEQ ID NO: 58154 - RNA, 22 nt, Homo sapiens
ggagguagguuugugauuugua

SEQ ID NO: 58155 - RNA, 22 nt, Homo sapiens
ggaguaaaagaguaggaggaau

SEQ ID NO: 58156 - RNA, 22 nt, Homo sapiens
ggagucuugcuauguugccaag

SEQ ID NO: 58157 - RNA, 22 nt, Homo sapiens
ggagugucccaaucucagcuca

SEQ ID NO: 58158 - RNA, 22 nt, Homo sapiens
ggcaagaaaaugcaauuacugu

SEQ ID NO: 58159 - RNA, 22 nt, Homo sapiens
ggcaagaagaacuauaacuuuu

SEQ ID NO: 58160 - RNA, 22 nt, Homo sapiens
ggcaagugggagggaguguuuc

SEQ ID NO: 58161 - RNA, 22 nt, Homo sapiens
ggcaaugaggcggaccagcagg

SEQ ID NO: 58162 - RNA, 23 nt, Homo sapiens
ggcagguuggucuaggucuauuc

SEQ ID NO: 58163 - RNA, 22 nt, Homo sapiens
ggcaguguauuacuuaggguuc

SEQ ID NO: 58164 - RNA, 23 nt, Homo sapiens
ggcauuguggcucacaucuguaa

SEQ ID NO: 58165 - RNA, 22 nt, Homo sapiens
ggcuagagagcucagggauaug

SEQ ID NO: 58166 - RNA, 22 nt, Homo sapiens
ggcuguguguuaaaauaggcuu

SEQ ID NO: 58167 - RNA, 19 nt, Homo sapiens
gggaggaugcgucuucagg

SEQ ID NO: 58168 - RNA, 22 nt, Homo sapiens
gggauguaaaagugggcacauu

SEQ ID NO: 58169 - RNA, 22 nt, Homo sapiens
gggcaagaagucuuguaguuuu

SEQ ID NO: 58170 - RNA, 22 nt, Homo sapiens
gggcauguggacuuguauguuu

SEQ ID NO: 58171 - RNA, 22 nt, Homo sapiens
gggguaguuacuguuguucuuu

SEQ ID NO: 58172 - RNA, 22 nt, Homo sapiens
ggguaggcaagcggaugucaga

SEQ ID NO: 58173 - RNA, 22 nt, Homo sapiens
gguauuuaaaguaccugucugc

SEQ ID NO: 58174 - RNA, 19 nt, Homo sapiens
ggucacagggguuacaagg

SEQ ID NO: 58175 - RNA, 19 nt, Homo sapiens
ggucagcaaagucuagcug

SEQ ID NO: 58176 - RNA, 19 nt, Homo sapiens
ggucauggagguuguguga

SEQ ID NO: 58177 - RNA, 22 nt, Homo sapiens
ggugacugguuuaucuggcagu

SEQ ID NO: 58178 - RNA, 22 nt, Homo sapiens
ggugucaguuggccccuacugg

SEQ ID NO: 58179 - RNA, 16 nt, Homo sapiens
guacacaguaaguaug

SEQ ID NO: 58180 - RNA, 22 nt, Homo sapiens
guacaguaguaaaagugaauga

SEQ ID NO: 58181 - RNA, 22 nt, Homo sapiens
guacaugcauacaugcacaucu

SEQ ID NO: 58182 - RNA, 22 nt, Homo sapiens
guacugagagacaguuacuguu

SEQ ID NO: 58183 - RNA, 22 nt, Homo sapiens
guagaaagcauuucagauuugc

SEQ ID NO: 58184 - RNA, 22 nt, Homo sapiens
guagagagaaauacaaagcugu

SEQ ID NO: 58185 - RNA, 22 nt, Homo sapiens
guaguagcacgagcucugucuc

SEQ ID NO: 58186 - RNA, 22 nt, Homo sapiens
guauacuucugaaaauagcuau

SEQ ID NO: 58187 - RNA, 22 nt, Homo sapiens
guauccugaaguucucagcacu

SEQ ID NO: 58188 - RNA, 22 nt, Homo sapiens
guaugacacaggaagcuuaacc

SEQ ID NO: 58189 - RNA, 21 nt, Homo sapiens
guaugguugaagugacaagcc

SEQ ID NO: 58190 - RNA, 22 nt, Homo sapiens
guauuugguuauugcagccuga

SEQ ID NO: 58191 - RNA, 22 nt, Homo sapiens
gucacugacaagagagaagaac

SEQ ID NO: 58192 - RNA, 22 nt, Homo sapiens
gucacugagauugguauuaaug

SEQ ID NO: 58193 - RNA, 22 nt, Homo sapiens
gucacugagcaauagaaaguuu

SEQ ID NO: 58194 - RNA, 22 nt, Homo sapiens
gucacugggugcugcgccuguc

SEQ ID NO: 58195 - RNA, 22 nt, Homo sapiens
gucagcaaagaggaauaguuug

SEQ ID NO: 58196 - RNA, 22 nt, Homo sapiens
gucaguggauacugucucuguc

SEQ ID NO: 58197 - RNA, 22 nt, Homo sapiens
gucagugucuuugcagcucaga

SEQ ID NO: 58198 - RNA, 22 nt, Homo sapiens
gucaguuugguuaaucauucca

SEQ ID NO: 58199 - RNA, 22 nt, Homo sapiens
guccugaagaccuuccucugga

SEQ ID NO: 58200 - RNA, 22 nt, Homo sapiens
gucguggagucucuggcuugua

SEQ ID NO: 58201 - RNA, 22 nt, Homo sapiens
uaugagaugaggccacugggua

SEQ ID NO: 58202 - RNA, 22 nt, Homo sapiens
uaugcacaugcaugcuugaaua

SEQ ID NO: 58203 - RNA, 22 nt, Homo sapiens
uaugcacuauggaaguagcuca

SEQ ID NO: 58204 - RNA, 22 nt, Homo sapiens
uaugccuuuuggcucaagaaac

SEQ ID NO: 58205 - RNA, 22 nt, Homo sapiens
uauggcauuauuuugauagaca

SEQ ID NO: 58206 - RNA, 22 nt, Homo sapiens
uauggcuucuuauucuuucccg

SEQ ID NO: 58207 - RNA, 22 nt, Homo sapiens
uauggcuucuuuaaauugaggu

SEQ ID NO: 58208 - RNA, 22 nt, Homo sapiens
uauggcuuuguuaacauuuucu

SEQ ID NO: 58209 - RNA, 22 nt, Homo sapiens
uauggcuuuguucaacagccuc

SEQ ID NO: 58210 - RNA, 22 nt, Homo sapiens
uaugguuuuaagguuaaggacu

SEQ ID NO: 58211 - RNA, 22 nt, Homo sapiens
uauuacauccauaggcucugcu

SEQ ID NO: 58212 - RNA, 22 nt, Homo sapiens
uauuacugucaauaucacagaa

SEQ ID NO: 58213 - RNA, 22 nt, Homo sapiens
uauucaagccaaauucaagcca

SEQ ID NO: 58214 - RNA, 22 nt, Homo sapiens
uauuccagcccuggugagccag

SEQ ID NO: 58215 - RNA, 22 nt, Homo sapiens
uauugacauuacagugggucuu

SEQ ID NO: 58216 - RNA, 22 nt, Homo sapiens
uauugcagauacccaggaaguu

SEQ ID NO: 58217 - RNA, 22 nt, Homo sapiens
uauugcuaaauucuuuuccuag

SEQ ID NO: 58218 - RNA, 22 nt, Homo sapiens
uauuucaguugcguuucccgag

SEQ ID NO: 58219 - RNA, 22 nt, Homo sapiens
uauuugauuaacaagagccuaa

SEQ ID NO: 58220 - RNA, 22 nt, Homo sapiens
uauuugauugacuuuagcagga

SEQ ID NO: 58221 - RNA, 22 nt, Homo sapiens
uauuugcacucccaucauggug

SEQ ID NO: 58222 - RNA, 22 nt, Homo sapiens
ucaaacacuccauaucgcgauu

SEQ ID NO: 58223 - RNA, 22 nt, Homo sapiens
ucaaagugagcuccuucucacu

SEQ ID NO: 58224 - RNA, 22 nt, Homo sapiens
ucaaaucaucuuuuccaaagcu

SEQ ID NO: 58225 - RNA, 22 nt, Homo sapiens
ucaacagugauggaaaguuaua

SEQ ID NO: 58226 - RNA, 18 nt, Homo sapiens
ucaagcuauugucaugcc

SEQ ID NO: 58227 - RNA, 22 nt, Homo sapiens
ucaaguacuuauuugauaauua

SEQ ID NO: 58228 - RNA, 22 nt, Homo sapiens
ucacaccauucuucuacuucag

SEQ ID NO: 58229 - RNA, 18 nt, Homo sapiens
ucacagguaauuaggauu

SEQ ID NO: 58230 - RNA, 22 nt, Homo sapiens
ucacaguagagcuucuuucaga

SEQ ID NO: 58231 - RNA, 22 nt, Homo sapiens
ucacagucaaaguaaucauaga

SEQ ID NO: 58232 - RNA, 22 nt, Homo sapiens
ucacagucacugucacguugaa

SEQ ID NO: 58233 - RNA, 22 nt, Homo sapiens
ucacagucggugacuucuugcu

SEQ ID NO: 58234 - RNA, 22 nt, Homo sapiens
ucacaguucagcauggcugagg

SEQ ID NO: 58235 - RNA, 22 nt, Homo sapiens
ucacaguugauugaaacacagc

SEQ ID NO: 58236 - RNA, 22 nt, Homo sapiens
ucacaugaauugucuuguucca

SEQ ID NO: 58237 - RNA, 22 nt, Homo sapiens
ucacauggaggugauaguugaa

SEQ ID NO: 58238 - RNA, 22 nt, Homo sapiens
ucacauggggaagggacuagcu

SEQ ID NO: 58239 - RNA, 22 nt, Homo sapiens
ucacaugucagccguggggaag

SEQ ID NO: 58240 - RNA, 22 nt, Homo sapiens
ucacauuguguagccugcucac

SEQ ID NO: 58241 - RNA, 22 nt, Homo sapiens
ucacccugacaugcggccgaac

SEQ ID NO: 58242 - RNA, 22 nt, Homo sapiens
ucaccuggagacaugaagacug

SEQ ID NO: 58243 - RNA, 22 nt, Homo sapiens
ucaccuguagcuaagaccuaau

SEQ ID NO: 58244 - RNA, 20 nt, Homo sapiens
ucacugagugguccacagua

SEQ ID NO: 58245 - RNA, 22 nt, Homo sapiens
ucacugcacuucaggcuuucuc

SEQ ID NO: 58246 - RNA, 22 nt, Homo sapiens
ucacuggagauagcaaucuggu

SEQ ID NO: 58247 - RNA, 20 nt, Homo sapiens
ucacuggagcucauuugauu

SEQ ID NO: 58248 - RNA, 22 nt, Homo sapiens
ucacugugcacauaugauaggu

SEQ ID NO: 58249 - RNA, 22 nt, Homo sapiens
ucacugugguuggaaggcuuaa

SEQ ID NO: 58250 - RNA, 22 nt, Homo sapiens
ucacugugguuugggaaagugc

SEQ ID NO: 58251 - RNA, 22 nt, Homo sapiens
ucacuguugaugggcaugcagg

SEQ ID NO: 58252 - RNA, 22 nt, Homo sapiens
ucagagucuagaucacucacug

SEQ ID NO: 58253 - RNA, 22 nt, Homo sapiens
ucagagugcagggaguagcagc

SEQ ID NO: 58254 - RNA, 22 nt, Homo sapiens
ucagaguguuuuccaacuuggu

SEQ ID NO: 58255 - RNA, 22 nt, Homo sapiens
ucagaucauauucuucgcugcu

SEQ ID NO: 58256 - RNA, 22 nt, Homo sapiens
uggagucuugcucuguugccca

SEQ ID NO: 58257 - RNA, 22 nt, Homo sapiens
uggcaaaaaucacaaguaccuu

SEQ ID NO: 58258 - RNA, 22 nt, Homo sapiens
uggcaaaucagaggcauggaca

SEQ ID NO: 58259 - RNA, 22 nt, Homo sapiens
uggcaaauuccaaaguuaauuc

SEQ ID NO: 58260 - RNA, 22 nt, Homo sapiens
uggcagauaggauacaggacua

SEQ ID NO: 58261 - RNA, 22 nt, Homo sapiens
uggcagcugcuucaugggaugc

SEQ ID NO: 58262 - RNA, 22 nt, Homo sapiens
uggcaggugcacuggcuuugaa

SEQ ID NO: 58263 - RNA, 22 nt, Homo sapiens
uggcaugcauuguggguaauua

SEQ ID NO: 58264 - RNA, 22 nt, Homo sapiens
uggcauggaaagcuuuucauac

SEQ ID NO: 58265 - RNA, 22 nt, Homo sapiens
uggcauggaguggauggcccca

SEQ ID NO: 58266 - RNA, 22 nt, Homo sapiens
uggcuacugaccugcuaggggg

SEQ ID NO: 58267 - RNA, 22 nt, Homo sapiens
uggcuacuguacuugagcuauu

SEQ ID NO: 58268 - RNA, 22 nt, Homo sapiens
uggcuagaccugcauaacagcu

SEQ ID NO: 58269 - RNA, 19 nt, Homo sapiens
uggcuagagcagauauccu

SEQ ID NO: 58270 - RNA, 20 nt, Homo sapiens
uggcuucuuaauugcaggca

SEQ ID NO: 58271 - RNA, 22 nt, Homo sapiens
uggcuuucuggggcuucuguuc

SEQ ID NO: 58272 - RNA, 22 nt, Homo sapiens
uggcuuuguaagguuucauuuu

SEQ ID NO: 58273 - RNA, 22 nt, Homo sapiens
ugggaagcugcauuuuaacaag

SEQ ID NO: 58274 - RNA, 22 nt, Homo sapiens
ugggaauaugauacaggucuuu

SEQ ID NO: 58275 - RNA, 22 nt, Homo sapiens
ugggaugaugcuugagaauauc

SEQ ID NO: 58276 - RNA, 22 nt, Homo sapiens
uggguagugucagcugauccau

SEQ ID NO: 58277 - RNA, 17 nt, Homo sapiens
ugguagguuuuucuggc

SEQ ID NO: 58278 - RNA, 22 nt, Homo sapiens
uggucauggaaauagaaugcac

SEQ ID NO: 58279 - RNA, 20 nt, Homo sapiens
ugguccccugagucuggcuu

SEQ ID NO: 58280 - RNA, 20 nt, Homo sapiens
uguaaaggagauugcagcug

SEQ ID NO: 58281 - RNA, 22 nt, Homo sapiens
uguacuucaagauuaugguuua

SEQ ID NO: 58282 - RNA, 22 nt, Homo sapiens
uguagacaccaaagacagcaua

SEQ ID NO: 58283 - RNA, 22 nt, Homo sapiens
uguauaacucacauugaaguuu

SEQ ID NO: 58284 - RNA, 22 nt, Homo sapiens
uguaugagagugaaagcauuuc

SEQ ID NO: 58285 - RNA, 22 nt, Homo sapiens
uguauguuguaagacuuagacc

SEQ ID NO: 58286 - RNA, 22 nt, Homo sapiens
ugucacaguuuguacuuuauag

SEQ ID NO: 58287 - RNA, 18 nt, Homo sapiens
ugucacuggauaaugguc

SEQ ID NO: 58288 - RNA, 22 nt, Homo sapiens
ugucagaaucuagaggcugcua

SEQ ID NO: 58289 - RNA, 20 nt, Homo sapiens
ugucccaaccccauggguuc

SEQ ID NO: 58290 - RNA, 22 nt, Homo sapiens
ugucccguuuucgaggcugcag

SEQ ID NO: 58291 - RNA, 22 nt, Homo sapiens
ugucccugagccuggauuccug

SEQ ID NO: 58292 - RNA, 22 nt, Homo sapiens
uguccuagagggaugucacccc

SEQ ID NO: 58293 - RNA, 22 nt, Homo sapiens
ugucuagaaaagccugccuucu

SEQ ID NO: 58294 - RNA, 21 nt, Homo sapiens
ugucugagagaggagaucuac

SEQ ID NO: 58295 - RNA, 22 nt, Homo sapiens
ugucuguuugcgaaauugcuuc

SEQ ID NO: 58296 - RNA, 22 nt, Homo sapiens
ugugaaacacgaaagucuaaaa

SEQ ID NO: 58297 - RNA, 22 nt, Homo sapiens
ugugaaugaagaaugcuaaccu

SEQ ID NO: 58298 - RNA, 22 nt, Homo sapiens
ugugaauggugcugcaaugaac

SEQ ID NO: 58299 - RNA, 22 nt, Homo sapiens
ugugagaucucagaauugaacu

SEQ ID NO: 58300 - RNA, 19 nt, Homo sapiens
ugugauaguugaaccugcc

SEQ ID NO: 58301 - RNA, 22 nt, Homo sapiens
ugugauaguuggcuaaagcagu

SEQ ID NO: 58302 - RNA, 22 nt, Homo sapiens
ugugaugaagaguccaagaaca

SEQ ID NO: 58303 - RNA, 22 nt, Homo sapiens
ugugcaugacagcauacaaacg

SEQ ID NO: 58304 - RNA, 22 nt, Homo sapiens
auggcagcaccccacucuacug

SEQ ID NO: 58305 - RNA, 22 nt, Homo sapiens
auggccauuacuaagaauguuu

SEQ ID NO: 58306 - RNA, 22 nt, Homo sapiens
auggcccaguuugcuaucccua

SEQ ID NO: 58307 - RNA, 22 nt, Homo sapiens
auggcggugugaucuuggcuca

SEQ ID NO: 58308 - RNA, 22 nt, Homo sapiens
auggcuauucuucuuuugucag

SEQ ID NO: 58309 - RNA, 22 nt, Homo sapiens
auggcuuuuuucuugggcacuc

SEQ ID NO: 58310 - RNA, 22 nt, Homo sapiens
augggagugugguuagagaccu

SEQ ID NO: 58311 - RNA, 22 nt, Homo sapiens
augggcacugauguauucugug

SEQ ID NO: 58312 - RNA, 22 nt, Homo sapiens
augguacucucuugucugcaaa

SEQ ID NO: 58313 - RNA, 22 nt, Homo sapiens
augguauuuaacagucuuucua

SEQ ID NO: 58314 - RNA, 22 nt, Homo sapiens
auggugugugaauuaaauguua

SEQ ID NO: 58315 - RNA, 22 nt, Homo sapiens
auguaacaguauuuggagaugu

SEQ ID NO: 58316 - RNA, 22 nt, Homo sapiens
augucacugcacuccugccugg

SEQ ID NO: 58317 - RNA, 22 nt, Homo sapiens
augucuagagugauacugaagc

SEQ ID NO: 58318 - RNA, 22 nt, Homo sapiens
augucugguagccaccuggagg

SEQ ID NO: 58319 - RNA, 22 nt, Homo sapiens
augugacuuuuuccugugccuu

SEQ ID NO: 58320 - RNA, 22 nt, Homo sapiens
augugcacaugcuuacauguga

SEQ ID NO: 58321 - RNA, 22 nt, Homo sapiens
augugggaggaauguguuucca

SEQ ID NO: 58322 - RNA, 22 nt, Homo sapiens
augugguaguuauagugauaag

SEQ ID NO: 58323 - RNA, 22 nt, Homo sapiens
augugugcuugugacacagccu

SEQ ID NO: 58324 - RNA, 22 nt, Homo sapiens
auuaaguugugccugaaaacuu

SEQ ID NO: 58325 - RNA, 22 nt, Homo sapiens
auuaaucaggcaaugcuugcua

SEQ ID NO: 58326 - RNA, 22 nt, Homo sapiens
auuauaugucaucacagacacc

SEQ ID NO: 58327 - RNA, 22 nt, Homo sapiens
auucaagugaugugauucuucu

SEQ ID NO: 58328 - RNA, 22 nt, Homo sapiens
auucacagcuuuaaaaggcgug

SEQ ID NO: 58329 - RNA, 22 nt, Homo sapiens
auucacuguggcuuucucugau

SEQ ID NO: 58330 - RNA, 22 nt, Homo sapiens
auucaucagggauauuggucug

SEQ ID NO: 58331 - RNA, 22 nt, Homo sapiens
auuccacagccgauaccaugac

SEQ ID NO: 58332 - RNA, 22 nt, Homo sapiens
auuccacuuacaugaaguaccu

SEQ ID NO: 58333 - RNA, 22 nt, Homo sapiens
auuccacuuccacuaguuucuc

SEQ ID NO: 58334 - RNA, 20 nt, Homo sapiens
auuccacuuguuugagguac

SEQ ID NO: 58335 - RNA, 22 nt, Homo sapiens
auugacaguuggccaguaagug

SEQ ID NO: 58336 - RNA, 22 nt, Homo sapiens
auugcacuccagccuugggcaa

SEQ ID NO: 58337 - RNA, 22 nt, Homo sapiens
auugcagcuugcagggugugua

SEQ ID NO: 58338 - RNA, 23 nt, Homo sapiens
auugcagucuugaacuccugggc

SEQ ID NO: 58339 - RNA, 22 nt, Homo sapiens
auugcaguuucaacuccagggc

SEQ ID NO: 58340 - RNA, 22 nt, Homo sapiens
auugcauugugaucuucccaga

SEQ ID NO: 58341 - RNA, 22 nt, Homo sapiens
auuggcaauagcuuucuuacua

SEQ ID NO: 58342 - RNA, 22 nt, Homo sapiens
auugucacccgggcaguaagca

SEQ ID NO: 58343 - RNA, 22 nt, Homo sapiens
auuucacugagacaugugccca

SEQ ID NO: 58344 - RNA, 22 nt, Homo sapiens
caaaggugcuuuccagguccaa

SEQ ID NO: 58345 - RNA, 22 nt, Homo sapiens
caaauccucaccucaucaugaa

SEQ ID NO: 58346 - RNA, 22 nt, Homo sapiens
caagacuguccaacauauuggg

SEQ ID NO: 58347 - RNA, 22 nt, Homo sapiens
caagagagcugaugguuuuaaa

SEQ ID NO: 58348 - RNA, 22 nt, Homo sapiens
caaggugcugagacaggagccc

SEQ ID NO: 58349 - RNA, 23 nt, Homo sapiens
caauacugaccucacguuaauag

SEQ ID NO: 58350 - RNA, 22 nt, Homo sapiens
caauacuguuaccugaaauagg

SEQ ID NO: 58351 - RNA, 21 nt, Homo sapiens
caaugacacuguagcugugcu

SEQ ID NO: 58352 - RNA, 21 nt, Homo sapiens
caauggcacaaucucugcuca

SEQ ID NO: 58353 - RNA, 22 nt, Homo sapiens
cacaaugucugguaggccacuu

SEQ ID NO: 58354 - RNA, 22 nt, Homo sapiens
cacagcuagucaaugguagaca

SEQ ID NO: 58355 - RNA, 22 nt, Homo sapiens
cacaguguucauagccaucagg

SEQ ID NO: 58356 - RNA, 22 nt, Homo sapiens
caccacagccauuauugucccc

SEQ ID NO: 58357 - RNA, 22 nt, Homo sapiens
caccauguguucagaaggauug

SEQ ID NO: 58358 - RNA, 18 nt, Homo sapiens
cacugagcccuucacucu

SEQ ID NO: 58359 - RNA, 22 nt, Homo sapiens
cacugcacuccagcuugugggc

SEQ ID NO: 58360 - RNA, 22 nt, Homo sapiens
cacugcacuccagcuuugguga

SEQ ID NO: 58361 - RNA, 22 nt, Homo sapiens
cacugcacuccagucccgucuc

SEQ ID NO: 58362 - RNA, 22 nt, Homo sapiens
cacugcacuccagucugacgac

SEQ ID NO: 58363 - RNA, 22 nt, Homo sapiens
cacugcacucuucuucugggca

SEQ ID NO: 58364 - RNA, 21 nt, Homo sapiens
cacugcacuugccuucugggu

SEQ ID NO: 58365 - RNA, 22 nt, Homo sapiens
cacugcauccuccaccuccugg

SEQ ID NO: 58366 - RNA, 22 nt, Homo sapiens
cacugcauggucuagcuggguu

SEQ ID NO: 58367 - RNA, 22 nt, Homo sapiens
cacugcgaccuccaccucccgg

SEQ ID NO: 58368 - RNA, 22 nt, Homo sapiens
cacugcgaccucugccuaccgg

SEQ ID NO: 58369 - RNA, 22 nt, Homo sapiens
cacugcgacguccgccucccgg

SEQ ID NO: 58370 - RNA, 22 nt, Homo sapiens
cacugggugagauccauguuua

SEQ ID NO: 58371 - RNA, 22 nt, Homo sapiens
cacugggugccauauguuugcu

SEQ ID NO: 58372 - RNA, 22 nt, Homo sapiens
cacuggucucauggcaugagag

SEQ ID NO: 58373 - RNA, 22 nt, Homo sapiens
cagagguauugcaaaagccuag

SEQ ID NO: 58374 - RNA, 22 nt, Homo sapiens
cagcaaaucauccuauuugagc

SEQ ID NO: 58375 - RNA, 20 nt, Homo sapiens
cagcaaccugcucucuuccu

SEQ ID NO: 58376 - RNA, 22 nt, Homo sapiens
cagcuaguaauuuauugaagau

SEQ ID NO: 58377 - RNA, 22 nt, Homo sapiens
cagcugguggcaagaagacaga

SEQ ID NO: 58378 - RNA, 23 nt, Homo sapiens
cagcuucauugaacauaacuccu

SEQ ID NO: 58379 - RNA, 22 nt, Homo sapiens
caggcagucuggggguguaucc

SEQ ID NO: 58380 - RNA, 22 nt, Homo sapiens
cagguaguauuugguuacauaa

SEQ ID NO: 58381 - RNA, 19 nt, Homo sapiens
cagguagugugcugacaug

SEQ ID NO: 58382 - RNA, 20 nt, Homo sapiens
cagucaugaagaacugugag

SEQ ID NO: 58383 - RNA, 18 nt, Homo sapiens
cagugcaauacaggagag

SEQ ID NO: 58384 - RNA, 22 nt, Homo sapiens
cagugcuuuaucaaguccucca

SEQ ID NO: 58385 - RNA, 22 nt, Homo sapiens
cagugucugcauuuggaacuca

SEQ ID NO: 58386 - RNA, 22 nt, Homo sapiens
caaagugcugaaagaggccagg

SEQ ID NO: 58387 - RNA, 19 nt, Homo sapiens
caaaguguucuucuuugcc

SEQ ID NO: 58388 - RNA, 22 nt, Homo sapiens
caaaugaucugcuggccucagc

SEQ ID NO: 58389 - RNA, 22 nt, Homo sapiens
caagagaccugagugucauucu

SEQ ID NO: 58390 - RNA, 21 nt, Homo sapiens
caagugaugcuucugcuuuaa

SEQ ID NO: 58391 - RNA, 22 nt, Homo sapiens
caaguguuggcuuguauacaaa

SEQ ID NO: 58392 - RNA, 22 nt, Homo sapiens
caaugcauuauucucccacuuc

SEQ ID NO: 58393 - RNA, 21 nt, Homo sapiens
caauggcacgaucuuggcuca

SEQ ID NO: 58394 - RNA, 22 nt, Homo sapiens
cacaaugucuaagauguuucua

SEQ ID NO: 58395 - RNA, 22 nt, Homo sapiens
cacaccuaccucauuauggaca

SEQ ID NO: 58396 - RNA, 22 nt, Homo sapiens
cacagucugggcuuguuuguac

SEQ ID NO: 58397 - RNA, 22 nt, Homo sapiens
cacaguugccuaucuccugaag

SEQ ID NO: 58398 - RNA, 22 nt, Homo sapiens
cacugcacuccaguuucgguaa

SEQ ID NO: 58399 - RNA, 22 nt, Homo sapiens
cacugcauccucugccuggcgg

SEQ ID NO: 58400 - RNA, 22 nt, Homo sapiens
cacugcauuggaugguuccucc

SEQ ID NO: 58401 - RNA, 23 nt, Homo sapiens
cagcucauuuggguccccuuguc

SEQ ID NO: 58402 - RNA, 22 nt, Homo sapiens
cagcugcuuuggaaaauauuuu

SEQ ID NO: 58403 - RNA, 22 nt, Homo sapiens
cagcuguuguugggguauagga

SEQ ID NO: 58404 - RNA, 22 nt, Homo sapiens
caggaaugugaggguucccugc

SEQ ID NO: 58405 - RNA, 22 nt, Homo sapiens
cagguaggccaauguuuuccaa

SEQ ID NO: 58406 - RNA, 22 nt, Homo sapiens
cagugcuuguuauuguucuauu

SEQ ID NO: 58407 - RNA, 22 nt, Homo sapiens
caguggaugaacaagaagugau

SEQ ID NO: 58408 - RNA, 22 nt, Homo sapiens
caguguuuuuaacaggugcccg

SEQ ID NO: 58409 - RNA, 22 nt, Homo sapiens
cauaaagauggaggaggccagg

SEQ ID NO: 58410 - RNA, 22 nt, Homo sapiens
cauacaguaggcacuauuugua

SEQ ID NO: 58411 - RNA, 22 nt, Homo sapiens
caucacacuuggauguaagaca

SEQ ID NO: 58412 - RNA, 22 nt, Homo sapiens
caucacaucugcaugguaagua

SEQ ID NO: 58413 - RNA, 22 nt, Homo sapiens
caucacuguugguacaaguaau

SEQ ID NO: 58414 - RNA, 22 nt, Homo sapiens
caugacacauguuuaccuaugu

SEQ ID NO: 58415 - RNA, 22 nt, Homo sapiens
caugauauugcagaauguuggu

SEQ ID NO: 58416 - RNA, 22 nt, Homo sapiens
cauggcacauauauaucuaggu

SEQ ID NO: 58417 - RNA, 22 nt, Homo sapiens
cauggcccugggcugggcgaac

SEQ ID NO: 58418 - RNA, 20 nt, Homo sapiens
cauuacacuccaaccugggu

SEQ ID NO: 58419 - RNA, 22 nt, Homo sapiens
cauuccacauguaggacaauuu

SEQ ID NO: 58420 - RNA, 19 nt, Homo sapiens
cauugcacuccacccuggg

SEQ ID NO: 58421 - RNA, 22 nt, Homo sapiens
cauugcacuccagccucggcaa

SEQ ID NO: 58422 - RNA, 22 nt, Homo sapiens
ccaaggcacugauucuguacuc

SEQ ID NO: 58423 - RNA, 23 nt, Homo sapiens
ccacaaugguugaacuagauuac

SEQ ID NO: 58424 - RNA, 22 nt, Homo sapiens
ccacagucuaugcaacaagguc

SEQ ID NO: 58425 - RNA, 22 nt, Homo sapiens
ccacaguugaaauuuugacugu

SEQ ID NO: 58426 - RNA, 22 nt, Homo sapiens
ccacccuuccacacccugggua

SEQ ID NO: 58427 - RNA, 22 nt, Homo sapiens
ccagaguggagccuuugcgagg

SEQ ID NO: 58428 - RNA, 21 nt, Homo sapiens
ccaguguaaugauagcaggca

SEQ ID NO: 58429 - RNA, 22 nt, Homo sapiens
ccauacugucaaauagauuucc

SEQ ID NO: 58430 - RNA, 22 nt, Homo sapiens
ccaucacaggccucagugggaa

SEQ ID NO: 58431 - RNA, 19 nt, Homo sapiens
cccagugucagagaagggu

SEQ ID NO: 58432 - RNA, 23 nt, Homo sapiens
cccucagaagugcagggagagaa

SEQ ID NO: 58433 - RNA, 22 nt, Homo sapiens
ccuggaagaaaggugcuaaaua

SEQ ID NO: 58434 - RNA, 22 nt, Homo sapiens
ccuggcacugggccccguggcu

SEQ ID NO: 58435 - RNA, 22 nt, Homo sapiens
ccugugguuaaccagcuagaug

SEQ ID NO: 58436 - RNA, 22 nt, Homo sapiens
ccuuuguuaguuugcugagaau

SEQ ID NO: 58437 - RNA, 22 nt, Homo sapiens
cgccgggggaugggcaccagcg

SEQ ID NO: 58438 - RNA, 22 nt, Homo sapiens
cggcaguggguaagccaagcuu

SEQ ID NO: 58439 - RNA, 16 nt, Homo sapiens
cuaaaaugucuacuug

SEQ ID NO: 58440 - RNA, 20 nt, Homo sapiens
cuaaucaucccagaagaaau

SEQ ID NO: 58441 - RNA, 22 nt, Homo sapiens
cuaaugcagucaggagaaggaa

SEQ ID NO: 58442 - RNA, 22 nt, Homo sapiens
cuaauucuguaccuggcacaua

SEQ ID NO: 58443 - RNA, 22 nt, Homo sapiens
cuacaguaugaaaccuuuacuc

SEQ ID NO: 58444 - RNA, 22 nt, Homo sapiens
cuagcacauaguuauucacuca

SEQ ID NO: 58445 - RNA, 22 nt, Homo sapiens
cuagcuuuuuaugacaaucuug

SEQ ID NO: 58446 - RNA, 22 nt, Homo sapiens
cuauaugucuguuuugguacca

SEQ ID NO: 58447 - RNA, 22 nt, Homo sapiens
cuaucucaggcccaggcccuug

SEQ ID NO: 58448 - RNA, 22 nt, Homo sapiens
cuauggcuguaugacgugcaug

SEQ ID NO: 58449 - RNA, 22 nt, Homo sapiens
cuaugguaggggcuggaggaag

SEQ ID NO: 58450 - RNA, 22 nt, Homo sapiens
cuauuugguuggugaaaaaagu

SEQ ID NO: 58451 - RNA, 22 nt, Homo sapiens
cucaauuuggaauugucaguaa

SEQ ID NO: 58452 - RNA, 22 nt, Homo sapiens
cucacagucucucccuaauuuu

SEQ ID NO: 58453 - RNA, 20 nt, Homo sapiens
cucaccagguguaggcugag

SEQ ID NO: 58454 - RNA, 22 nt, Homo sapiens
cucacggcccugcgcacuggca

SEQ ID NO: 58455 - RNA, 17 nt, Homo sapiens
cucacugagaacagcua

SEQ ID NO: 58456 - RNA, 22 nt, Homo sapiens
cucacugucaacauguauuugg

SEQ ID NO: 58457 - RNA, 22 nt, Homo sapiens
cucagaguacuuuucccacuuc

SEQ ID NO: 58458 - RNA, 22 nt, Homo sapiens
cucagcaguggauuuaccacca

SEQ ID NO: 58459 - RNA, 22 nt, Homo sapiens
cucaggcacucugauuccagug

SEQ ID NO: 58460 - RNA, 22 nt, Homo sapiens
cucaggguacuucuccuuugcu

SEQ ID NO: 58461 - RNA, 22 nt, Homo sapiens
cucagggugguggacucuaaua

SEQ ID NO: 58462 - RNA, 21 nt, Homo sapiens
cucauauugcuuuuccauggu

SEQ ID NO: 58463 - RNA, 22 nt, Homo sapiens
cucauuggcuacugaggcuugu

SEQ ID NO: 58464 - RNA, 23 nt, Homo sapiens
cuccaugagccguccagggccug

SEQ ID NO: 58465 - RNA, 22 nt, Homo sapiens
cucccagagccaguuauaggcu

SEQ ID NO: 58466 - RNA, 22 nt, Homo sapiens
cuccccuuuaguuucuuaauaa

SEQ ID NO: 58467 - RNA, 23 nt, Homo sapiens
cucccugaacaugacacaccaga

SEQ ID NO: 58468 - RNA, 20 nt, Homo sapiens
cucccugacaaauguggaaa

SEQ ID NO: 58469 - RNA, 22 nt, Homo sapiens
cuccuggugauuggagugugaa

SEQ ID NO: 58470 - RNA, 22 nt, Homo sapiens
cucugauggagauauacaagga

SEQ ID NO: 58471 - RNA, 22 nt, Homo sapiens
cucugguucugcagugcacccu

SEQ ID NO: 58472 - RNA, 21 nt, Homo sapiens
cucugguuugcauuggauuau

SEQ ID NO: 58473 - RNA, 15 nt, Homo sapiens
cucugguuuuucuuc

SEQ ID NO: 58474 - RNA, 22 nt, Homo sapiens
cucuuggguagauuuugcagag

SEQ ID NO: 58475 - RNA, 22 nt, Homo sapiens
cucuuugcuucuggcaucauug

SEQ ID NO: 58476 - RNA, 20 nt, Homo sapiens
uacacguaugagcacaugug

SEQ ID NO: 58477 - RNA, 21 nt, Homo sapiens
uacacuacugguggaaaugca

SEQ ID NO: 58478 - RNA, 22 nt, Homo sapiens
uacaguaauguuaaucuuugug

SEQ ID NO: 58479 - RNA, 22 nt, Homo sapiens
ucacugugagaguuuauccugu

SEQ ID NO: 58480 - RNA, 22 nt, Homo sapiens
ucagaguggccucucuugaaga

SEQ ID NO: 58481 - RNA, 22 nt, Homo sapiens
ucagagugguuguaccauuuga

SEQ ID NO: 58482 - RNA, 19 nt, Homo sapiens
ucagaucagcccaagggau

SEQ ID NO: 58483 - RNA, 22 nt, Homo sapiens
ucagaugaugucccuguucuaa

SEQ ID NO: 58484 - RNA, 22 nt, Homo sapiens
ucagauguuucuuuaacgcaug

SEQ ID NO: 58485 - RNA, 22 nt, Homo sapiens
ucagauguuugagaaguauacu

SEQ ID NO: 58486 - RNA, 20 nt, Homo sapiens
ucagcagucuggagcagagg

SEQ ID NO: 58487 - RNA, 21 nt, Homo sapiens
ucagcucaucacugccuggag

SEQ ID NO: 58488 - RNA, 21 nt, Homo sapiens
ucaggaccucuaguuagccag

SEQ ID NO: 58489 - RNA, 22 nt, Homo sapiens
ucaggcaccuuccucuuaucug

SEQ ID NO: 58490 - RNA, 22 nt, Homo sapiens
ucaggcuuuucccagagugaug

SEQ ID NO: 58491 - RNA, 22 nt, Homo sapiens
ucaguaaaugcuguucucuuuu

SEQ ID NO: 58492 - RNA, 22 nt, Homo sapiens
ucaguaaucuuagcugugcaga

SEQ ID NO: 58493 - RNA, 20 nt, Homo sapiens
ucagugcagauuguccaagu

SEQ ID NO: 58494 - RNA, 21 nt, Homo sapiens
ucagugcugugggcaaggugc

SEQ ID NO: 58495 - RNA, 22 nt, Homo sapiens
ucaguguuuggaaucucaauuu

SEQ ID NO: 58496 - RNA, 22 nt, Homo sapiens
ucaguuaaugcugccugcugga

SEQ ID NO: 58497 - RNA, 22 nt, Homo sapiens
ucaguuuguauuucagguugca

SEQ ID NO: 58498 - RNA, 22 nt, Homo sapiens
ucauauguaugugcaauuuugu

SEQ ID NO: 58499 - RNA, 22 nt, Homo sapiens
ucaucagaguuuacaagcucag

SEQ ID NO: 58500 - RNA, 21 nt, Homo sapiens
ucaucagucaaagacaauggu

SEQ ID NO: 58501 - RNA, 22 nt, Homo sapiens
ucaugcaaugagucaggaggca

SEQ ID NO: 58502 - RNA, 22 nt, Homo sapiens
ucauuagagaucuuggggaaaa

SEQ ID NO: 58503 - RNA, 22 nt, Homo sapiens
ucauucauuugcucacuccaca

SEQ ID NO: 58504 - RNA, 22 nt, Homo sapiens
uccaaaucucuggcacugggau

SEQ ID NO: 58505 - RNA, 22 nt, Homo sapiens
uccacagugguugaacuaguuu

SEQ ID NO: 58506 - RNA, 22 nt, Homo sapiens
uccacuuuugugcugaauugga

SEQ ID NO: 58507 - RNA, 22 nt, Homo sapiens
uccaguuuuguuaacauauggu

SEQ ID NO: 58508 - RNA, 22 nt, Homo sapiens
uccauaguugcacucuggagcc

SEQ ID NO: 58509 - RNA, 22 nt, Homo sapiens
uccauggagacacauuuuauau

SEQ ID NO: 58510 - RNA, 19 nt, Homo sapiens
ucccaagaugcucauacau

SEQ ID NO: 58511 - RNA, 22 nt, Homo sapiens
ucccugaguaucuaauguguuu

SEQ ID NO: 58512 - RNA, 22 nt, Homo sapiens
uccugagagcagacccucuaua

SEQ ID NO: 58513 - RNA, 22 nt, Homo sapiens
uccugcauucauccugguguug

SEQ ID NO: 58514 - RNA, 22 nt, Homo sapiens
uccuugaaacaggaagaauuca

SEQ ID NO: 58515 - RNA, 19 nt, Homo sapiens
uccuugauugcaccacugc

SEQ ID NO: 58516 - RNA, 22 nt, Homo sapiens
uccuuggucaaaaagaaagugu

SEQ ID NO: 58517 - RNA, 22 nt, Homo sapiens
uccuuuagacugaauccugaga

SEQ ID NO: 58518 - RNA, 22 nt, Homo sapiens
uccuuugguuauaggcaccucu

SEQ ID NO: 58519 - RNA, 22 nt, Homo sapiens
ucgcaccauugcacuccagcca

SEQ ID NO: 58520 - RNA, 22 nt, Homo sapiens
ucgcauggucuccaggcagcuc

SEQ ID NO: 58521 - RNA, 22 nt, Homo sapiens
ucucaagaugguagaugggaau

SEQ ID NO: 58522 - RNA, 18 nt, Homo sapiens
ucucacagcaaucuguca

SEQ ID NO: 58523 - RNA, 22 nt, Homo sapiens
ucucccauccguacacggauug

SEQ ID NO: 58524 - RNA, 22 nt, Homo sapiens
ucucugagaaaaguuucuccca

SEQ ID NO: 58525 - RNA, 22 nt, Homo sapiens
ucucuguuugucuguuacuggu

SEQ ID NO: 58526 - RNA, 22 nt, Homo sapiens
ucucuuggcggaaguugcagug

SEQ ID NO: 58527 - RNA, 22 nt, Homo sapiens
ucugagacuguuucuaacaagc

SEQ ID NO: 58528 - RNA, 22 nt, Homo sapiens
ucugagaucaugucugugcugu

SEQ ID NO: 58529 - RNA, 21 nt, Homo sapiens
ucugagucauucaguggccug

SEQ ID NO: 58530 - RNA, 22 nt, Homo sapiens
ucugccuuuucaugugggaugg

SEQ ID NO: 58531 - RNA, 22 nt, Homo sapiens
ucuggcaagauauccauugcuu

SEQ ID NO: 58532 - RNA, 21 nt, Homo sapiens
ucuggccccuccaaaucucau

SEQ ID NO: 58533 - RNA, 22 nt, Homo sapiens
ucuggccccucccaaaucucau

SEQ ID NO: 58534 - RNA, 17 nt, Homo sapiens
ucuggcuuucacaccug

SEQ ID NO: 58535 - RNA, 22 nt, Homo sapiens
ucuggguuuuuacaauguuuac

SEQ ID NO: 58536 - RNA, 22 nt, Homo sapiens
ucugugaaugaacacuugaaaa

SEQ ID NO: 58537 - RNA, 22 nt, Homo sapiens
ucugugcugagaguugaaaguu

SEQ ID NO: 58538 - RNA, 22 nt, Homo sapiens
ucugugcuugucauaugcuuug

SEQ ID NO: 58539 - RNA, 19 nt, Homo sapiens
ucugugcuugucccccugu

SEQ ID NO: 58540 - RNA, 22 nt, Homo sapiens
ucuuaguuggaaugggauaagg

SEQ ID NO: 58541 - RNA, 19 nt, Homo sapiens
ucuugcacaugugaacuca

SEQ ID NO: 58542 - RNA, 21 nt, Homo sapiens
ucuuggguugaauucucccag

SEQ ID NO: 58543 - RNA, 22 nt, Homo sapiens
ucuuuagguguuauaguucaag

SEQ ID NO: 58544 - RNA, 22 nt, Homo sapiens
ucuuugauuaugcagauggguu

SEQ ID NO: 58545 - RNA, 22 nt, Homo sapiens
ucuuuggaggcgaucuguuuga

SEQ ID NO: 58546 - RNA, 22 nt, Homo sapiens
ucuuuguuagaacccucuccuu

SEQ ID NO: 58547 - RNA, 22 nt, Homo sapiens
ucuuuguuuucugauccugaag

SEQ ID NO: 58548 - RNA, 22 nt, Homo sapiens
ucuuuugggccucuugucagac

SEQ ID NO: 58549 - RNA, 22 nt, Homo sapiens
ugaaaguuauauugugaaauuc

SEQ ID NO: 58550 - RNA, 22 nt, Homo sapiens
ugaaaugcagaacuuuaggucu

SEQ ID NO: 58551 - RNA, 22 nt, Homo sapiens
ugaaaugcuaauucguagcuaa

SEQ ID NO: 58552 - RNA, 22 nt, Homo sapiens
ugaaaugcugucuaggggaaau

SEQ ID NO: 58553 - RNA, 22 nt, Homo sapiens
ugaacacaucuccugguaccug

SEQ ID NO: 58554 - RNA, 21 nt, Homo sapiens
ugaacacuggacugagugucc

SEQ ID NO: 58555 - RNA, 22 nt, Homo sapiens
ugaacuguaagguauaggugau

SEQ ID NO: 58556 - RNA, 22 nt, Homo sapiens
ugaagcuaugacuauugagcau

SEQ ID NO: 58557 - RNA, 21 nt, Homo sapiens
ugaaguagcauaggaugucaa

SEQ ID NO: 58558 - RNA, 22 nt, Homo sapiens
ugaaguaggcauaaguuaagcu

SEQ ID NO: 58559 - RNA, 19 nt, Homo sapiens
ugaaguauagggcuucuga

SEQ ID NO: 58560 - RNA, 22 nt, Homo sapiens
ugaauacuucaaaaaaauagcu

SEQ ID NO: 58561 - RNA, 22 nt, Homo sapiens
ugaauagaaguggcaggaguag

SEQ ID NO: 58562 - RNA, 22 nt, Homo sapiens
gauauguaguaguugaaaaaga

SEQ ID NO: 58563 - RNA, 22 nt, Homo sapiens
gauauguuagggggagaaguua

SEQ ID NO: 58564 - RNA, 22 nt, Homo sapiens
gauauuacuuccaauauugcaa

SEQ ID NO: 58565 - RNA, 22 nt, Homo sapiens
gaucacaguuccucacgggcau

SEQ ID NO: 58566 - RNA, 22 nt, Homo sapiens
gaugagauguucucauggauug

SEQ ID NO: 58567 - RNA, 22 nt, Homo sapiens
gaugaucaugaccuacagaugg

SEQ ID NO: 58568 - RNA, 22 nt, Homo sapiens
gaugauguugaauguucucacc

SEQ ID NO: 58569 - RNA, 22 nt, Homo sapiens
gauggauuuuuuaggcagagcu

SEQ ID NO: 58570 - RNA, 22 nt, Homo sapiens
gauggcacuguagcaacacaaa

SEQ ID NO: 58571 - RNA, 22 nt, Homo sapiens
gauggcagugcagccccuggcu

SEQ ID NO: 58572 - RNA, 22 nt, Homo sapiens
acagugcuuucaauguucagua

SEQ ID NO: 58573 - RNA, 19 nt, Homo sapiens
acagugcuuugucagaagc

SEQ ID NO: 58574 - RNA, 22 nt, Homo sapiens
acagugcuuuuguuccucuccu

SEQ ID NO: 58575 - RNA, 22 nt, Homo sapiens
acaguggugcgaucucggcuca

SEQ ID NO: 58576 - RNA, 18 nt, Homo sapiens
acagugucauggcucaau

SEQ ID NO: 58577 - RNA, 18 nt, Homo sapiens
acaguguguaaggguucu

SEQ ID NO: 58578 - RNA, 22 nt, Homo sapiens
acaguguuacuugauaguguau

SEQ ID NO: 58579 - RNA, 22 nt, Homo sapiens
acauaaagaagcaggacauugu

SEQ ID NO: 58580 - RNA, 22 nt, Homo sapiens
acauaguagacacugaaaauau

SEQ ID NO: 58581 - RNA, 22 nt, Homo sapiens
acaucauugggggcuacaggug

SEQ ID NO: 58582 - RNA, 22 nt, Homo sapiens
acaucccuuucccacccuucac

SEQ ID NO: 58583 - RNA, 17 nt, Homo sapiens
acaugagacuggauucu

SEQ ID NO: 58584 - RNA, 22 nt, Homo sapiens
acaugagacuggguuuguaggg

SEQ ID NO: 58585 - RNA, 22 nt, Homo sapiens
accacagugcuuccugcucacg

SEQ ID NO: 58586 - RNA, 22 nt, Homo sapiens
accaccacucccgcauucuaaa

SEQ ID NO: 58587 - RNA, 22 nt, Homo sapiens
accaguguuuaccaaguagcau

SEQ ID NO: 58588 - RNA, 22 nt, Homo sapiens
acccggagagcaggcgagaagg

SEQ ID NO: 58589 - RNA, 22 nt, Homo sapiens
acccugucaaaacggaccaauc

SEQ ID NO: 58590 - RNA, 22 nt, Homo sapiens
acccugucauccacauggugcu

SEQ ID NO: 58591 - RNA, 19 nt, Homo sapiens
acccuguccccaccuuuac

SEQ ID NO: 58592 - RNA, 18 nt, Homo sapiens
acccuucagcacugggcc

SEQ ID NO: 58593 - RNA, 21 nt, Homo sapiens
accugauguuucaguuggagu

SEQ ID NO: 58594 - RNA, 23 nt, Homo sapiens
accugauguuucuguggggagcc

SEQ ID NO: 58595 - RNA, 22 nt, Homo sapiens
accugugguuacagucugucuc

SEQ ID NO: 58596 - RNA, 22 nt, Homo sapiens
acuacauaugacaucuucuuua

SEQ ID NO: 58597 - RNA, 22 nt, Homo sapiens
acucagagagaacugucauuug

SEQ ID NO: 58598 - RNA, 22 nt, Homo sapiens
acuccacuuucaccacagcgga

SEQ ID NO: 58599 - RNA, 22 nt, Homo sapiens
acucuguauaaacauugcugua

SEQ ID NO: 58600 - RNA, 19 nt, Homo sapiens
acugcacuccaaccuccug

SEQ ID NO: 58601 - RNA, 22 nt, Homo sapiens
acugcacuccaaccuuggugac

SEQ ID NO: 58602 - RNA, 18 nt, Homo sapiens
acugcacuccaccuuggg

SEQ ID NO: 58603 - RNA, 22 nt, Homo sapiens
acugcacuccagacucugucuc

SEQ ID NO: 58604 - RNA, 22 nt, Homo sapiens
acugcacuccagccucggggac

SEQ ID NO: 58605 - RNA, 22 nt, Homo sapiens
acugcacuccagccucguggac

SEQ ID NO: 58606 - RNA, 22 nt, Homo sapiens
acugcacuccagccugagccug

SEQ ID NO: 58607 - RNA, 22 nt, Homo sapiens
acugcacuccagccugaugaaa

SEQ ID NO: 58608 - RNA, 22 nt, Homo sapiens
acugcacuccagccugcugaca

SEQ ID NO: 58609 - RNA, 22 nt, Homo sapiens
acugcacuccagccugugagac

SEQ ID NO: 58610 - RNA, 22 nt, Homo sapiens
acugcacuccagccuugagagc

SEQ ID NO: 58611 - RNA, 22 nt, Homo sapiens
acugcacuccagccuugugaca

SEQ ID NO: 58612 - RNA, 22 nt, Homo sapiens
acugcacuccagcuuuggugac

SEQ ID NO: 58613 - RNA, 20 nt, Homo sapiens
acugcacuccagucucuggg

SEQ ID NO: 58614 - RNA, 22 nt, Homo sapiens
acugcacuccaguuugggcagc

SEQ ID NO: 58615 - RNA, 22 nt, Homo sapiens
acugcacuguccuagaguccuc

SEQ ID NO: 58616 - RNA, 20 nt, Homo sapiens
acugcacuucagccugcugg

SEQ ID NO: 58617 - RNA, 22 nt, Homo sapiens
acugcacuucagccuguugaca

SEQ ID NO: 58618 - RNA, 22 nt, Homo sapiens
acugcacuucagccuuggggac

SEQ ID NO: 58619 - RNA, 22 nt, Homo sapiens
acugcacuucagccuugugaca

SEQ ID NO: 58620 - RNA, 22 nt, Homo sapiens
acugcauaaauauguguaauau

SEQ ID NO: 58621 - RNA, 22 nt, Homo sapiens
acuggauguuagggauuuuauu

SEQ ID NO: 58622 - RNA, 22 nt, Homo sapiens
agaagaacauagggugacugaa

SEQ ID NO: 58623 - RNA, 19 nt, Homo sapiens
agaaucuaaauuauuucug

SEQ ID NO: 58624 - RNA, 22 nt, Homo sapiens
agacacuguugaaaaggcccca

SEQ ID NO: 58625 - RNA, 22 nt, Homo sapiens
agacaguauuggcaaagugugu

SEQ ID NO: 58626 - RNA, 22 nt, Homo sapiens
agacuguaaugcauaauuuacu

SEQ ID NO: 58627 - RNA, 19 nt, Homo sapiens
agagacucauuguagcauu

SEQ ID NO: 58628 - RNA, 22 nt, Homo sapiens
agagagguggguggagccccca

SEQ ID NO: 58629 - RNA, 22 nt, Homo sapiens
agagauaauuagguuaaaugag

SEQ ID NO: 58630 - RNA, 22 nt, Homo sapiens
agagccacacucuccuaacuca

SEQ ID NO: 58631 - RNA, 22 nt, Homo sapiens
agagguauacauuugagagcca

SEQ ID NO: 58632 - RNA, 22 nt, Homo sapiens
agagguguuaaagucucuuuua

SEQ ID NO: 58633 - RNA, 22 nt, Homo sapiens
agagugcuauagauuagauuuc

SEQ ID NO: 58634 - RNA, 20 nt, Homo sapiens
agagugcugucuguccugag

SEQ ID NO: 58635 - RNA, 22 nt, Homo sapiens
agauauuuguuaggucugucag

SEQ ID NO: 58636 - RNA, 22 nt, Homo sapiens
agauucauccaaguuguugcau

SEQ ID NO: 58637 - RNA, 22 nt, Homo sapiens
agcaagacauggcuuccaaaug

SEQ ID NO: 58638 - RNA, 22 nt, Homo sapiens
agcacacuggguggcuuaaaca

SEQ ID NO: 58639 - RNA, 17 nt, Homo sapiens
agcaccacacucucuug

SEQ ID NO: 58640 - RNA, 22 nt, Homo sapiens
agcaccauuguacuccagccug

SEQ ID NO: 58641 - RNA, 22 nt, Homo sapiens
agcaccauuucucuaaagcacu

SEQ ID NO: 58642 - RNA, 22 nt, Homo sapiens
agcagcaauuuuguaugguuua

SEQ ID NO: 58643 - RNA, 22 nt, Homo sapiens
agcagcaugcaaauggacuaau

SEQ ID NO: 58644 - RNA, 22 nt, Homo sapiens
agcaggacaauaugggaucagg

SEQ ID NO: 58645 - RNA, 17 nt, Homo sapiens
agcauguguuugagauu

SEQ ID NO: 58646 - RNA, 22 nt, Homo sapiens
ugacuggagaccucaguagggu

SEQ ID NO: 58647 - RNA, 22 nt, Homo sapiens
ugagaaccucugugugcccacu

SEQ ID NO: 58648 - RNA, 22 nt, Homo sapiens
ugagaacucaugggucugcugg

SEQ ID NO: 58649 - RNA, 22 nt, Homo sapiens
ugagaacuuauggugauuuuuu

SEQ ID NO: 58650 - RNA, 22 nt, Homo sapiens
ugagaagaugaacuccuugguc

SEQ ID NO: 58651 - RNA, 22 nt, Homo sapiens
ugagacugagucuugcucuugu

SEQ ID NO: 58652 - RNA, 22 nt, Homo sapiens
ugagacugguaauguguagggc

SEQ ID NO: 58653 - RNA, 22 nt, Homo sapiens
ugagaucauguguggaccccag

SEQ ID NO: 58654 - RNA, 20 nt, Homo sapiens
ugagauccacgugaaguaug

SEQ ID NO: 58655 - RNA, 22 nt, Homo sapiens
ugagaugaagucucacucuguc

SEQ ID NO: 58656 - RNA, 22 nt, Homo sapiens
ugagaugagaaucaguucuaau

SEQ ID NO: 58657 - RNA, 22 nt, Homo sapiens
ugagauggaguuucgcucuugu

SEQ ID NO: 58658 - RNA, 22 nt, Homo sapiens
ugagauggcuuuauugcugaau

SEQ ID NO: 58659 - RNA, 21 nt, Homo sapiens
ugagaugugaccagggcauca

SEQ ID NO: 58660 - RNA, 22 nt, Homo sapiens
ugagauguuuguuucagugccu

SEQ ID NO: 58661 - RNA, 21 nt, Homo sapiens
ugagauuaaguuguuuagaag

SEQ ID NO: 58662 - RNA, 22 nt, Homo sapiens
ugagauuauauuucuuaacaga

SEQ ID NO: 58663 - RNA, 22 nt, Homo sapiens
ugagauuaucguaauguaucuc

SEQ ID NO: 58664 - RNA, 23 nt, Homo sapiens
ugagcaauauucuacuauugagu

SEQ ID NO: 58665 - RNA, 22 nt, Homo sapiens
ugagcauauugugauaccuaaa

SEQ ID NO: 58666 - RNA, 20 nt, Homo sapiens
ugagcuuguaaacacuguuu

SEQ ID NO: 58667 - RNA, 22 nt, Homo sapiens
ugaggacugagaggcacugugg

SEQ ID NO: 58668 - RNA, 22 nt, Homo sapiens
ugagguguauugggggaaauuc

SEQ ID NO: 58669 - RNA, 22 nt, Homo sapiens
ugagguugaaggacauuuuuau

SEQ ID NO: 58670 - RNA, 22 nt, Homo sapiens
ugauaacugaucuggauuugua

SEQ ID NO: 58671 - RNA, 22 nt, Homo sapiens
ugauaugucccucgacaucagg

SEQ ID NO: 58672 - RNA, 22 nt, Homo sapiens
ugaucuuuuuaauguccauggg

SEQ ID NO: 58673 - RNA, 22 nt, Homo sapiens
ugauggcauuucauguuuguaa

SEQ ID NO: 58674 - RNA, 22 nt, Homo sapiens
ugauuuccaugagaacaugccu

SEQ ID NO: 58675 - RNA, 18 nt, Homo sapiens
ugcaaacauguguguguu

SEQ ID NO: 58676 - RNA, 22 nt, Homo sapiens
ugcaaauguuaggugucauuau

SEQ ID NO: 58677 - RNA, 22 nt, Homo sapiens
ugcaagaaacauauuccacaag

SEQ ID NO: 58678 - RNA, 21 nt, Homo sapiens
ugcaagaaucaggaagcugcc

SEQ ID NO: 58679 - RNA, 22 nt, Homo sapiens
ugcaagacacuguccugggcau

SEQ ID NO: 58680 - RNA, 22 nt, Homo sapiens
ugcagauucguuuugaggggua

SEQ ID NO: 58681 - RNA, 22 nt, Homo sapiens
ugcagcacaguagguuugcaau

SEQ ID NO: 58682 - RNA, 22 nt, Homo sapiens
ugcagguaggcaguaucauuua

SEQ ID NO: 58683 - RNA, 22 nt, Homo sapiens
ugcagugugauuuucuggcuga

SEQ ID NO: 58684 - RNA, 22 nt, Homo sapiens
ugcauugcacuugcaugagaua

SEQ ID NO: 58685 - RNA, 22 nt, Homo sapiens
ugccaguguugccuuucacuag

SEQ ID NO: 58686 - RNA, 22 nt, Homo sapiens
ugccaucauuaauauuaggcau

SEQ ID NO: 58687 - RNA, 22 nt, Homo sapiens
ugccuaggcuggaaugcaaugg

SEQ ID NO: 58688 - RNA, 22 nt, Homo sapiens
ugccuuauuccaacugagcucu

SEQ ID NO: 58689 - RNA, 22 nt, Homo sapiens
ugcuagaagaucacacacauca

SEQ ID NO: 58690 - RNA, 18 nt, Homo sapiens
ugcuaugagauuauuuua

SEQ ID NO: 58691 - RNA, 22 nt, Homo sapiens
ugcugcacaguucuuaagauua

SEQ ID NO: 58692 - RNA, 21 nt, Homo sapiens
ugcugcacuucuuuugcugug

SEQ ID NO: 58693 - RNA, 22 nt, Homo sapiens
ugcugcuguuguuguuacuagc

SEQ ID NO: 58694 - RNA, 22 nt, Homo sapiens
ugcugguuuucaucaucagugg

SEQ ID NO: 58695 - RNA, 22 nt, Homo sapiens
ugcuuagucuugcuuuagcuau

SEQ ID NO: 58696 - RNA, 22 nt, Homo sapiens
uggaaaguacuugaguuuguau

SEQ ID NO: 58697 - RNA, 22 nt, Homo sapiens
uggaaauaaaauagaguuugcc

SEQ ID NO: 58698 - RNA, 22 nt, Homo sapiens
uggaagaugggaccucaguuuu

SEQ ID NO: 58699 - RNA, 22 nt, Homo sapiens
uggaagcauagcagcgugugug

SEQ ID NO: 58700 - RNA, 22 nt, Homo sapiens
uggaaggcuucauauguaaaga

SEQ ID NO: 58701 - RNA, 22 nt, Homo sapiens
uggaaguuaaaugacucuuucu

SEQ ID NO: 58702 - RNA, 20 nt, Homo sapiens
uggaaucugaagaucucagu

SEQ ID NO: 58703 - RNA, 22 nt, Homo sapiens
uggaaugcuaagcaugugggag

SEQ ID NO: 58704 - RNA, 22 nt, Homo sapiens
uggaaugucagcuacaagaggg

SEQ ID NO: 58705 - RNA, 21 nt, Homo sapiens
uggaauuaauggagagguguu

SEQ ID NO: 58706 - RNA, 22 nt, Homo sapiens
uggaauuuagguugauaguaua

SEQ ID NO: 58707 - RNA, 22 nt, Homo sapiens
uggacagaaacauguuuucagu

SEQ ID NO: 58708 - RNA, 21 nt, Homo sapiens
uggaccccuacuucucaccau

SEQ ID NO: 58709 - RNA, 22 nt, Homo sapiens
uggacuguaaauuggggacucu

SEQ ID NO: 58710 - RNA, 22 nt, Homo sapiens
uggagcccuaguuccucauaac

SEQ ID NO: 58711 - RNA, 22 nt, Homo sapiens
uggaggacugcagaacugaggc

SEQ ID NO: 58712 - RNA, 19 nt, Homo sapiens
uggagucaucaugcugcua

SEQ ID NO: 58713 - RNA, 22 nt, Homo sapiens
uggaguuugacaugccuuuggg

SEQ ID NO: 58714 - RNA, 22 nt, Homo sapiens
uggcaagaacugcaauugcuuu

SEQ ID NO: 58715 - RNA, 22 nt, Homo sapiens
uggcaagagaacaacaucucuc

SEQ ID NO: 58716 - RNA, 22 nt, Homo sapiens
uggcaagagggaugcaagguuu

SEQ ID NO: 58717 - RNA, 22 nt, Homo sapiens
uggcaauauccacaauuacuuu

SEQ ID NO: 58718 - RNA, 22 nt, Homo sapiens
uggcauguaaugcagaaguugc

SEQ ID NO: 58719 - RNA, 22 nt, Homo sapiens
uggcauguauuuuguguauuaa

SEQ ID NO: 58720 - RNA, 22 nt, Homo sapiens
uggcaugucagguuucuggguu

SEQ ID NO: 58721 - RNA, 22 nt, Homo sapiens
uggcauuuucucuguucuuaga

SEQ ID NO: 58722 - RNA, 22 nt, Homo sapiens
uggccagugucggaggccagga

SEQ ID NO: 58723 - RNA, 22 nt, Homo sapiens
uggccuguaacgcugucucagc

SEQ ID NO: 58724 - RNA, 22 nt, Homo sapiens
gucagcaaaguucuccugcaga

SEQ ID NO: 58725 - RNA, 22 nt, Homo sapiens
gucaggcaccgauacaguuuuu

SEQ ID NO: 58726 - RNA, 22 nt, Homo sapiens
gucagucugucccugccuggcg

SEQ ID NO: 58727 - RNA, 22 nt, Homo sapiens
gucagugccugucccaggcuuu

SEQ ID NO: 58728 - RNA, 22 nt, Homo sapiens
gucagugugauaucugcagggg

SEQ ID NO: 58729 - RNA, 22 nt, Homo sapiens
gucaugcaggguucgccagccc

SEQ ID NO: 58730 - RNA, 22 nt, Homo sapiens
gucauggaggaugaauggccaa

SEQ ID NO: 58731 - RNA, 22 nt, Homo sapiens
gucauggguuaaagguggauac

SEQ ID NO: 58732 - RNA, 22 nt, Homo sapiens
gucgugcagaccucacagcauu

SEQ ID NO: 58733 - RNA, 22 nt, Homo sapiens
gucucacaggcaugaugccagc

SEQ ID NO: 58734 - RNA, 22 nt, Homo sapiens
gucuggagacuugggucaucaa

SEQ ID NO: 58735 - RNA, 22 nt, Homo sapiens
gucugguuccugggagauuucu

SEQ ID NO: 58736 - RNA, 22 nt, Homo sapiens
gucugguuggaguaguuuucag

SEQ ID NO: 58737 - RNA, 22 nt, Homo sapiens
gucugguuuuuuauauccucac

SEQ ID NO: 58738 - RNA, 22 nt, Homo sapiens
uguaagcauugggcaugcaguc

SEQ ID NO: 58739 - RNA, 22 nt, Homo sapiens
uguagcaaauaaaagucuggau

SEQ ID NO: 58740 - RNA, 22 nt, Homo sapiens
uguagcaaaucgauacuauugg

SEQ ID NO: 58741 - RNA, 23 nt, Homo sapiens
uguauacacccugugcaucuggg

SEQ ID NO: 58742 - RNA, 21 nt, Homo sapiens
uguauauguuuauacacacac

SEQ ID NO: 58743 - RNA, 16 nt, Homo sapiens
uguauugcuaaaaaga

SEQ ID NO: 58744 - RNA, 22 nt, Homo sapiens
ugucaaauucuggguuaaaaca

SEQ ID NO: 58745 - RNA, 22 nt, Homo sapiens
ugucaaguugugguucaauuuu

SEQ ID NO: 58746 - RNA, 22 nt, Homo sapiens
ugucacuuugccuucuggacuu

SEQ ID NO: 58747 - RNA, 22 nt, Homo sapiens
ugucaggaugcuccuuuuggcu

SEQ ID NO: 58748 - RNA, 22 nt, Homo sapiens
ugucagggaggcucggccgcac

SEQ ID NO: 58749 - RNA, 19 nt, Homo sapiens
ugucccagccauagaggca

SEQ ID NO: 58750 - RNA, 18 nt, Homo sapiens
ugucccuuugcuguucau

SEQ ID NO: 58751 - RNA, 21 nt, Homo sapiens
ugucgugcaggaucuguggga

SEQ ID NO: 58752 - RNA, 21 nt, Homo sapiens
ugucuagaccucauccuacag

SEQ ID NO: 58753 - RNA, 21 nt, Homo sapiens
ugucuuggagccagacgccag

SEQ ID NO: 58754 - RNA, 22 nt, Homo sapiens
ugugaauguaaccuuauuugga

SEQ ID NO: 58755 - RNA, 22 nt, Homo sapiens
ugugaccaaaaucaacauaccu

SEQ ID NO: 58756 - RNA, 22 nt, Homo sapiens
ugugaucaugugugccuuaguc

SEQ ID NO: 58757 - RNA, 22 nt, Homo sapiens
ugugcacaauguacagguuagu

SEQ ID NO: 58758 - RNA, 22 nt, Homo sapiens
uguggaaauggugcuacgaaca

SEQ ID NO: 58759 - RNA, 20 nt, Homo sapiens
uguggcacuguaucucucag

SEQ ID NO: 58760 - RNA, 22 nt, Homo sapiens
uguggcacuguguccagagaaa

SEQ ID NO: 58761 - RNA, 22 nt, Homo sapiens
ugugucuacugagaugaucaug

SEQ ID NO: 58762 - RNA, 22 nt, Homo sapiens
ugugucuugagagucucgagaa

SEQ ID NO: 58763 - RNA, 22 nt, Homo sapiens
uguuacagugacuaauguuuua

SEQ ID NO: 58764 - RNA, 22 nt, Homo sapiens
uguugcaccugccuugcuuuag

SEQ ID NO: 58765 - RNA, 22 nt, Homo sapiens
uguuggacuuacuuggcagauu

SEQ ID NO: 58766 - RNA, 22 nt, Homo sapiens
uuaaaugcauagaauguguagu

SEQ ID NO: 58767 - RNA, 22 nt, Homo sapiens
uuaagacaccaaucauuggauu

SEQ ID NO: 58768 - RNA, 22 nt, Homo sapiens
uuaagcaaagguaacaugagaa

SEQ ID NO: 58769 - RNA, 22 nt, Homo sapiens
uuaaggcauucuuugucuucau

SEQ ID NO: 58770 - RNA, 19 nt, Homo sapiens
uuaagguacuuagaugugu

SEQ ID NO: 58771 - RNA, 22 nt, Homo sapiens
uuaaguuguagcuacaaauaca

SEQ ID NO: 58772 - RNA, 22 nt, Homo sapiens
uuaaucaggccguuuccuaaga

SEQ ID NO: 58773 - RNA, 22 nt, Homo sapiens
uuacacaguaggucccuaguaa

SEQ ID NO: 58774 - RNA, 22 nt, Homo sapiens
uuaccacagugccugucuaaug

SEQ ID NO: 58775 - RNA, 22 nt, Homo sapiens
uuaccaguggugcuguaaacuu

SEQ ID NO: 58776 - RNA, 22 nt, Homo sapiens
uuagcacaucuuucuauguaag

SEQ ID NO: 58777 - RNA, 21 nt, Homo sapiens
uuagcauccauguucaucaac

SEQ ID NO: 58778 - RNA, 22 nt, Homo sapiens
uuagcaugucuacuaauuugcu

SEQ ID NO: 58779 - RNA, 22 nt, Homo sapiens
uuaggcuuuucagacacuucau

SEQ ID NO: 58780 - RNA, 22 nt, Homo sapiens
uuagggaggagucccucuuuuu

SEQ ID NO: 58781 - RNA, 22 nt, Homo sapiens
uuagugaaugcaccacuucuga

SEQ ID NO: 58782 - RNA, 22 nt, Homo sapiens
uuauaacagagacuccugugcu

SEQ ID NO: 58783 - RNA, 22 nt, Homo sapiens
uuaucagcagcaugaaaauaga

SEQ ID NO: 58784 - RNA, 21 nt, Homo sapiens
uuauccagcacuguuucggac

SEQ ID NO: 58785 - RNA, 22 nt, Homo sapiens
uuaugucauuuuuggauguuaa

SEQ ID NO: 58786 - RNA, 22 nt, Homo sapiens
uuauuacuccuauuuuguagau

SEQ ID NO: 58787 - RNA, 22 nt, Homo sapiens
uuauuagcacccuaccaugugg

SEQ ID NO: 58788 - RNA, 22 nt, Homo sapiens
uucacagaaaaaggcgaugagg

SEQ ID NO: 58789 - RNA, 20 nt, Homo sapiens
uucagcaaaggaaugggagu

SEQ ID NO: 58790 - RNA, 22 nt, Homo sapiens
uucaguacacguguucucauuu

SEQ ID NO: 58791 - RNA, 22 nt, Homo sapiens
uucaguucugcacugaucuuag

SEQ ID NO: 58792 - RNA, 22 nt, Homo sapiens
uucauaguaacaguaacuaugg

SEQ ID NO: 58793 - RNA, 22 nt, Homo sapiens
uucaucagcuguagaugucaug

SEQ ID NO: 58794 - RNA, 22 nt, Homo sapiens
uucauggaauauugaccauuuu

SEQ ID NO: 58795 - RNA, 22 nt, Homo sapiens
uucauggaguugagaaggcuaa

SEQ ID NO: 58796 - RNA, 22 nt, Homo sapiens
uucaugugagucuguauuaacu

SEQ ID NO: 58797 - RNA, 22 nt, Homo sapiens
uuccacaaugguugaacuaauu

SEQ ID NO: 58798 - RNA, 22 nt, Homo sapiens
uuccacaaugguugaacuagcu

SEQ ID NO: 58799 - RNA, 22 nt, Homo sapiens
uuccacuuuuuccuugugcucc

SEQ ID NO: 58800 - RNA, 22 nt, Homo sapiens
uuccagagucaccuuucugucg

SEQ ID NO: 58801 - RNA, 22 nt, Homo sapiens
uuccauaggcuagaucaaccag

SEQ ID NO: 58802 - RNA, 22 nt, Homo sapiens
uucccuguaucuucugccaugu

SEQ ID NO: 58803 - RNA, 22 nt, Homo sapiens
uucccugugggaguaggaaagu

SEQ ID NO: 58804 - RNA, 22 nt, Homo sapiens
uucccugugggcuggugcucca

SEQ ID NO: 58805 - RNA, 22 nt, Homo sapiens
uucccugugguauagaagccgu

SEQ ID NO: 58806 - RNA, 22 nt, Homo sapiens
uucccuuucuuaaagaguuagg

SEQ ID NO: 58807 - RNA, 22 nt, Homo sapiens
uuccuugagagcuugauaucac

SEQ ID NO: 58808 - RNA, 22 nt, Homo sapiens
uuccuugguucagggaaggucc

SEQ ID NO: 58809 - RNA, 21 nt, Homo sapiens
uucuacuccggcguuguuuuu

SEQ ID NO: 58810 - RNA, 22 nt, Homo sapiens
uucuggaaaucagcagagggug

SEQ ID NO: 58811 - RNA, 22 nt, Homo sapiens
uucuggcuuauaaacgugacuu

SEQ ID NO: 58812 - RNA, 19 nt, Homo sapiens
uucugguguuuuaagccaa

SEQ ID NO: 58813 - RNA, 22 nt, Homo sapiens
guugcagaguucuuccuccuga

SEQ ID NO: 58814 - RNA, 22 nt, Homo sapiens
guuggcaaguggcugagcuggg

SEQ ID NO: 58815 - RNA, 17 nt, Homo sapiens
guuuggguacuggguaa

SEQ ID NO: 58816 - RNA, 22 nt, Homo sapiens
guuugugcuccuaugagaaccu

SEQ ID NO: 58817 - RNA, 22 nt, Homo sapiens
uaaacacucacuucauagccau

SEQ ID NO: 58818 - RNA, 22 nt, Homo sapiens
uaaacugcuugaaaugguguca

SEQ ID NO: 58819 - RNA, 22 nt, Homo sapiens
uaaagcacaaguaaagaauacu

SEQ ID NO: 58820 - RNA, 22 nt, Homo sapiens
uaaagcuaugagaacaccguag

SEQ ID NO: 58821 - RNA, 22 nt, Homo sapiens
uaaagcuuagauccaugguggc

SEQ ID NO: 58822 - RNA, 18 nt, Homo sapiens
uaaaggcacuguguuguu

SEQ ID NO: 58823 - RNA, 22 nt, Homo sapiens
uaaauacguccauuugugguau

SEQ ID NO: 58824 - RNA, 22 nt, Homo sapiens
uaacaaugucuuaugggcuuaa

SEQ ID NO: 58825 - RNA, 16 nt, Homo sapiens
uaacacaguucccacc

SEQ ID NO: 58826 - RNA, 19 nt, Homo sapiens
uaacacaguuguguuugag

SEQ ID NO: 58827 - RNA, 22 nt, Homo sapiens
uaacaguggucugugguaucug

SEQ ID NO: 58828 - RNA, 23 nt, Homo sapiens
uaacauugcaugauuaccugcau

SEQ ID NO: 58829 - RNA, 22 nt, Homo sapiens
uaacucugccuagugacauggu

SEQ ID NO: 58830 - RNA, 22 nt, Homo sapiens
uaagaauucuguccgguauacu

SEQ ID NO: 58831 - RNA, 21 nt, Homo sapiens
uauaugacuuacuauugccuc

SEQ ID NO: 58832 - RNA, 22 nt, Homo sapiens
uauaugcaacauaguguaugug

SEQ ID NO: 58833 - RNA, 22 nt, Homo sapiens
uauaugcauugugggguacuga

SEQ ID NO: 58834 - RNA, 22 nt, Homo sapiens
uauaugucuuuguuauguugag

SEQ ID NO: 58835 - RNA, 22 nt, Homo sapiens
uauauguucuugcacuggaaag

SEQ ID NO: 58836 - RNA, 22 nt, Homo sapiens
uaucacagauucuccaggguuu

SEQ ID NO: 58837 - RNA, 22 nt, Homo sapiens
uaucacagcauugucuauaaua

SEQ ID NO: 58838 - RNA, 22 nt, Homo sapiens
uaucacagcgggguguacaccc

SEQ ID NO: 58839 - RNA, 22 nt, Homo sapiens
uaucacaguaucuagcacagug

SEQ ID NO: 58840 - RNA, 22 nt, Homo sapiens
uaucacagugcuggaguauucc

SEQ ID NO: 58841 - RNA, 20 nt, Homo sapiens
uaucacaguucaggaacucu

SEQ ID NO: 58842 - RNA, 22 nt, Homo sapiens
uaucaucauguuuuugcugugu

SEQ ID NO: 58843 - RNA, 22 nt, Homo sapiens
uaucucagaugagacuuguaac

SEQ ID NO: 58844 - RNA, 22 nt, Homo sapiens
uaucucaguguacaggaugaua

SEQ ID NO: 58845 - RNA, 21 nt, Homo sapiens
uaucucaguuuuccuuugugg

SEQ ID NO: 58846 - RNA, 22 nt, Homo sapiens
uaugagagcugguagguagaga

SEQ ID NO: 58847 - RNA, 22 nt, Homo sapiens
uaugcacacguguccaugugca

SEQ ID NO: 58848 - RNA, 22 nt, Homo sapiens
uaugcacacucucccaggaggg

SEQ ID NO: 58849 - RNA, 22 nt, Homo sapiens
uauggcuauggcuguggcuaug

SEQ ID NO: 58850 - RNA, 21 nt, Homo sapiens
uauggcuuagucaguguuucc

SEQ ID NO: 58851 - RNA, 22 nt, Homo sapiens
uaugugcuuuguuaaacagaug

SEQ ID NO: 58852 - RNA, 22 nt, Homo sapiens
uauuacuguuauuccuaucaaa

SEQ ID NO: 58853 - RNA, 22 nt, Homo sapiens
uauuccacaauaugauuuuuaa

SEQ ID NO: 58854 - RNA, 22 nt, Homo sapiens
uauugauuaauugugauuaggc

SEQ ID NO: 58855 - RNA, 22 nt, Homo sapiens
uauugcucaugcauuuaauuuc

SEQ ID NO: 58856 - RNA, 22 nt, Homo sapiens
uauugcuggauguauuacaugu

SEQ ID NO: 58857 - RNA, 22 nt, Homo sapiens
uauuuggauagucuggaaaaaa

SEQ ID NO: 58858 - RNA, 22 nt, Homo sapiens
ucaaacugucagguugaccaga

SEQ ID NO: 58859 - RNA, 21 nt, Homo sapiens
ucaacccuugcgucaccaagc

SEQ ID NO: 58860 - RNA, 22 nt, Homo sapiens
ucaacugcuugagaucacaaau

SEQ ID NO: 58861 - RNA, 20 nt, Homo sapiens
ucaaggcaggaacuguacau

SEQ ID NO: 58862 - RNA, 22 nt, Homo sapiens
ucaaguacugccuugcucuggc

SEQ ID NO: 58863 - RNA, 22 nt, Homo sapiens
ucaagugauucuugugccuuag

SEQ ID NO: 58864 - RNA, 22 nt, Homo sapiens
ucacaagugagaggaauuagau

SEQ ID NO: 58865 - RNA, 22 nt, Homo sapiens
ucacaaguguauagacaugucc

SEQ ID NO: 58866 - RNA, 22 nt, Homo sapiens
ucacacugaaacuaggguguga

SEQ ID NO: 58867 - RNA, 22 nt, Homo sapiens
ucacacugaauuugaagcaaug

SEQ ID NO: 58868 - RNA, 22 nt, Homo sapiens
ucacacugucuugguuacucuu

SEQ ID NO: 58869 - RNA, 22 nt, Homo sapiens
ucacacuguuuugauuauuaua

SEQ ID NO: 58870 - RNA, 22 nt, Homo sapiens
ucacagaugcuugacccauuuc

SEQ ID NO: 58871 - RNA, 22 nt, Homo sapiens
ucacagucuccucuagggaggg

SEQ ID NO: 58872 - RNA, 22 nt, Homo sapiens
ucacagugaguggaguggggug

SEQ ID NO: 58873 - RNA, 23 nt, Homo sapiens
ucacaguuacuuuugcaucaacc

SEQ ID NO: 58874 - RNA, 21 nt, Homo sapiens
ucacauggccagaguaggaac

SEQ ID NO: 58875 - RNA, 22 nt, Homo sapiens
ucacaugugaagauugggagua

SEQ ID NO: 58876 - RNA, 22 nt, Homo sapiens
ucacauuaagcuguuauuucuu

SEQ ID NO: 58877 - RNA, 20 nt, Homo sapiens
ucacccugacaucugcccag

SEQ ID NO: 58878 - RNA, 22 nt, Homo sapiens
ucacccuguguuuugcguuugc

SEQ ID NO: 58879 - RNA, 22 nt, Homo sapiens
ucacugaaaccacugccuccug

SEQ ID NO: 58880 - RNA, 22 nt, Homo sapiens
ucacugagcacaggagaugugc

SEQ ID NO: 58881 - RNA, 21 nt, Homo sapiens
ucacugagguuaaauaggguu

SEQ ID NO: 58882 - RNA, 22 nt, Homo sapiens
ucacugcacuccagccuuuaug

SEQ ID NO: 58883 - RNA, 19 nt, Homo sapiens
ucacuggacagcacacuca

SEQ ID NO: 58884 - RNA, 22 nt, Homo sapiens
ucacuguggaacucaaaaagcu

SEQ ID NO: 58885 - RNA, 22 nt, Homo sapiens
ucacugugguuuugaugugcau

SEQ ID NO: 58886 - RNA, 18 nt, Homo sapiens
ucacugugugucuugggu

SEQ ID NO: 58887 - RNA, 22 nt, Homo sapiens
ucacuuggccgcagccuucucu

SEQ ID NO: 58888 - RNA, 22 nt, Homo sapiens
ucacuuugacggccaacuucua

SEQ ID NO: 58889 - RNA, 18 nt, Homo sapiens
ucagagugcagacuauac

SEQ ID NO: 58890 - RNA, 22 nt, Homo sapiens
ucagaucaguuccacaagaacu

SEQ ID NO: 58891 - RNA, 22 nt, Homo sapiens
ucagcacauucaaggccugccu

SEQ ID NO: 58892 - RNA, 22 nt, Homo sapiens
ucagcagugagagaccucaccc

SEQ ID NO: 58893 - RNA, 22 nt, Homo sapiens
ucaggcacucagcuuagagucu

SEQ ID NO: 58894 - RNA, 21 nt, Homo sapiens
ucagggaccugcuguacugau

SEQ ID NO: 58895 - RNA, 22 nt, Homo sapiens
ucagguaaucuauuugucuuuu

SEQ ID NO: 58896 - RNA, 22 nt, Homo sapiens
ucaguagcauugcuuauacagu

SEQ ID NO: 58897 - RNA, 22 nt, Homo sapiens
ucagugacugcugcuuguauac

SEQ ID NO: 58898 - RNA, 17 nt, Homo sapiens
ucagugcauuuaagaga

SEQ ID NO: 58899 - RNA, 22 nt, Homo sapiens
ucauaguagucacuuaauaaau

SEQ ID NO: 58900 - RNA, 22 nt, Homo sapiens
ucauaugucauaguaugaucuu

SEQ ID NO: 58901 - RNA, 22 nt, Homo sapiens
ucaucagaaucccuuagggaug

SEQ ID NO: 58902 - RNA, 22 nt, Homo sapiens
ucauggggugagcuacaggcac

SEQ ID NO: 58903 - RNA, 22 nt, Homo sapiens
uccaagaugcuggcagcuacag

SEQ ID NO: 58904 - RNA, 22 nt, Homo sapiens
uucuuccagccuugaggggccc

SEQ ID NO: 58905 - RNA, 22 nt, Homo sapiens
uucuugcugaauugugcccuuc

SEQ ID NO: 58906 - RNA, 22 nt, Homo sapiens
uucuuuggaaacaguacuaauu

SEQ ID NO: 58907 - RNA, 22 nt, Homo sapiens
uugaagguaauugguuuuauga

SEQ ID NO: 58908 - RNA, 22 nt, Homo sapiens
uugaagguagaaguucucaauu

SEQ ID NO: 58909 - RNA, 22 nt, Homo sapiens
uugaaguaguacuuuauuauag

SEQ ID NO: 58910 - RNA, 22 nt, Homo sapiens
uugaaguauagaguuuaagaac

SEQ ID NO: 58911 - RNA, 22 nt, Homo sapiens
uugaaugaaauuggugugggga

SEQ ID NO: 58912 - RNA, 22 nt, Homo sapiens
uugaauguguugggaagcccuu

SEQ ID NO: 58913 - RNA, 22 nt, Homo sapiens
uugacaggaugcucagggccca

SEQ ID NO: 58914 - RNA, 22 nt, Homo sapiens
uugacauugcuguaguguccag

SEQ ID NO: 58915 - RNA, 22 nt, Homo sapiens
uugagauguauguauauaaugu

SEQ ID NO: 58916 - RNA, 22 nt, Homo sapiens
uugagcccuggaggcagaggcu

SEQ ID NO: 58917 - RNA, 21 nt, Homo sapiens
uugagcuuuuaguacagacag

SEQ ID NO: 58918 - RNA, 22 nt, Homo sapiens
uugaggaagugguuccccagag

SEQ ID NO: 58919 - RNA, 22 nt, Homo sapiens
uugaggaggcagucuguccguu

SEQ ID NO: 58920 - RNA, 22 nt, Homo sapiens
uugagggaagccagaggucugc

SEQ ID NO: 58921 - RNA, 22 nt, Homo sapiens
uugagggaggcagggcuugucu

SEQ ID NO: 58922 - RNA, 20 nt, Homo sapiens
uugaggugugaggggcagag

SEQ ID NO: 58923 - RNA, 22 nt, Homo sapiens
ucugagucaucacaaaugaugc

SEQ ID NO: 58924 - RNA, 22 nt, Homo sapiens
ucugauggaguugccagggaga

SEQ ID NO: 58925 - RNA, 22 nt, Homo sapiens
ucugcaagucuaaacuagccau

SEQ ID NO: 58926 - RNA, 22 nt, Homo sapiens
ucugccuacugguuggaggaac

SEQ ID NO: 58927 - RNA, 20 nt, Homo sapiens
ucuggccccuccaaaucuca

SEQ ID NO: 58928 - RNA, 20 nt, Homo sapiens
ucuggccccucuaaaucuca

SEQ ID NO: 58929 - RNA, 22 nt, Homo sapiens
ucugggguuagucaaagguaug

SEQ ID NO: 58930 - RNA, 22 nt, Homo sapiens
ucuggguuuuguaccgugcucg

SEQ ID NO: 58931 - RNA, 22 nt, Homo sapiens
ucugucuugugguuugagugcc

SEQ ID NO: 58932 - RNA, 22 nt, Homo sapiens
ucuguguugaugcucauuaauu

SEQ ID NO: 58933 - RNA, 22 nt, Homo sapiens
ucuguguuugaucaagauugua

SEQ ID NO: 58934 - RNA, 22 nt, Homo sapiens
ucuguguuugguuggcaauuuc

SEQ ID NO: 58935 - RNA, 22 nt, Homo sapiens
ucuguuguuaucauaauauuga

SEQ ID NO: 58936 - RNA, 17 nt, Homo sapiens
ucuucuguuacuguggc

SEQ ID NO: 58937 - RNA, 22 nt, Homo sapiens
ucuugaacuucugcacacucag

SEQ ID NO: 58938 - RNA, 22 nt, Homo sapiens
ucuuggccaugaauggcaaggc

SEQ ID NO: 58939 - RNA, 22 nt, Homo sapiens
ucuuugauguucugaaagaugg

SEQ ID NO: 58940 - RNA, 22 nt, Homo sapiens
ucuuuguucaggagccaacucc

SEQ ID NO: 58941 - RNA, 22 nt, Homo sapiens
ucuuuuguucuauucaggccuu

SEQ ID NO: 58942 - RNA, 18 nt, Homo sapiens
ugaaacacauuuuuuccu

SEQ ID NO: 58943 - RNA, 22 nt, Homo sapiens
ugaaacauacacucugaugggg

SEQ ID NO: 58944 - RNA, 22 nt, Homo sapiens
ugaaauaguuaaguugccuagu

SEQ ID NO: 58945 - RNA, 22 nt, Homo sapiens
ugaaaucauguaguuauugcaa

SEQ ID NO: 58946 - RNA, 22 nt, Homo sapiens
ugaaauguguuaucugggccug

SEQ ID NO: 58947 - RNA, 22 nt, Homo sapiens
ugaagacauuuuugggugugua

SEQ ID NO: 58948 - RNA, 22 nt, Homo sapiens
ugaagacucaauuauuaugaac

SEQ ID NO: 58949 - RNA, 22 nt, Homo sapiens
ugaaggccgggcaugguggcuc

SEQ ID NO: 58950 - RNA, 22 nt, Homo sapiens
ugaagggcauuguuuugccaaa

SEQ ID NO: 58951 - RNA, 22 nt, Homo sapiens
ugaagugaagcaguaguguggg

SEQ ID NO: 58952 - RNA, 22 nt, Homo sapiens
ugaauagagcugcaguggacau

SEQ ID NO: 58953 - RNA, 22 nt, Homo sapiens
ugaauucuguccaaaauaacug

SEQ ID NO: 58954 - RNA, 22 nt, Homo sapiens
ugacaagaacuuuccauaguaa

SEQ ID NO: 58955 - RNA, 22 nt, Homo sapiens
ugacagcuguugaggcauuuau

SEQ ID NO: 58956 - RNA, 22 nt, Homo sapiens
ugacaguaaacagucuugauua

SEQ ID NO: 58957 - RNA, 23 nt, Homo sapiens
ugacagugcuugaaauugcucuu

SEQ ID NO: 58958 - RNA, 22 nt, Homo sapiens
ugacaguguccuccuccugaga

SEQ ID NO: 58959 - RNA, 22 nt, Homo sapiens
ugacagugugagauccugucuc

SEQ ID NO: 58960 - RNA, 18 nt, Homo sapiens
ugacaguuucuuuauauu

SEQ ID NO: 58961 - RNA, 21 nt, Homo sapiens
ugacauguugguguucugcac

SEQ ID NO: 58962 - RNA, 21 nt, Homo sapiens
ugacauguugguuugcugcac

SEQ ID NO: 58963 - RNA, 22 nt, Homo sapiens
ugacuagagacagaaacuaaaa

SEQ ID NO: 58964 - RNA, 21 nt, Homo sapiens
ugagaacaacaggucaagcag

SEQ ID NO: 58965 - RNA, 18 nt, Homo sapiens
ugagaacauguguacaca

SEQ ID NO: 58966 - RNA, 22 nt, Homo sapiens
ugagaacucaugaaucuuucca

SEQ ID NO: 58967 - RNA, 22 nt, Homo sapiens
ugagaacuuugucuuuuacucu

SEQ ID NO: 58968 - RNA, 22 nt, Homo sapiens
ugagaagugacgcagcaggguu

SEQ ID NO: 58969 - RNA, 22 nt, Homo sapiens
ugagacacugaauccggccuga

SEQ ID NO: 58970 - RNA, 22 nt, Homo sapiens
ugagacaucugagauuuuaagc

SEQ ID NO: 58971 - RNA, 22 nt, Homo sapiens
ugagacugaguuuugcucuugu

SEQ ID NO: 58972 - RNA, 22 nt, Homo sapiens
ugagauaggaucuugcucuguu

SEQ ID NO: 58973 - RNA, 22 nt, Homo sapiens
ugagaucaagauguuagggacu

SEQ ID NO: 58974 - RNA, 22 nt, Homo sapiens
ugagaugaaagcagaaagacuu

SEQ ID NO: 58975 - RNA, 22 nt, Homo sapiens
ugagaugaggucucacucuguu

SEQ ID NO: 58976 - RNA, 22 nt, Homo sapiens
ugagauggcugaauucagaaua

SEQ ID NO: 58977 - RNA, 22 nt, Homo sapiens
ugagauggguucugguccccug

SEQ ID NO: 58978 - RNA, 22 nt, Homo sapiens
ugagaugguaaauuuuuguugu

SEQ ID NO: 58979 - RNA, 23 nt, Homo sapiens
ugagauuauaaucuuuuacuucu

SEQ ID NO: 58980 - RNA, 22 nt, Homo sapiens
ugagcaagaaauagaaacagau

SEQ ID NO: 58981 - RNA, 22 nt, Homo sapiens
ugagcuauguucuucuuguuuu

SEQ ID NO: 58982 - RNA, 22 nt, Homo sapiens
ugagcucaugcauucuugagga

SEQ ID NO: 58983 - RNA, 22 nt, Homo sapiens
ugagcugagaucacacuacugu

SEQ ID NO: 58984 - RNA, 22 nt, Homo sapiens
ugagcugagaucaugcuauugu

SEQ ID NO: 58985 - RNA, 22 nt, Homo sapiens
ugagcugagaucgugccauugu

SEQ ID NO: 58986 - RNA, 22 nt, Homo sapiens
ugaggaauguguguuaaagaua

SEQ ID NO: 58987 - RNA, 22 nt, Homo sapiens
ugaggauaguguugaaggcagg

SEQ ID NO: 58988 - RNA, 22 nt, Homo sapiens
ugaggcacucccuagcggggug

SEQ ID NO: 58989 - RNA, 22 nt, Homo sapiens
ugagguaagauguucauuuuuc

SEQ ID NO: 58990 - RNA, 22 nt, Homo sapiens
ugaggugaggguaucaaaugcu

SEQ ID NO: 58991 - RNA, 23 nt, Homo sapiens
ugagguguuaagcagacuugucu

SEQ ID NO: 58992 - RNA, 22 nt, Homo sapiens
ugagguguuauccagaguucuu

SEQ ID NO: 58993 - RNA, 22 nt, Homo sapiens
uuuuccagugggacucccauua

SEQ ID NO: 58994 - RNA, 17 nt, Homo sapiens
uuuuggauuagaaaucc

SEQ ID NO: 58995 - RNA, 22 nt, Homo sapiens
uuuuguacgccuguguccauca

SEQ ID NO: 58996 - RNA, 22 nt, Homo sapiens
uugagauacauaauuaugaaug

SEQ ID NO: 58997 - RNA, 22 nt, Homo sapiens
uugagcaaaacauuaauauuag

SEQ ID NO: 58998 - RNA, 22 nt, Homo sapiens
uugaggaaugucauuuguguuu

SEQ ID NO: 58999 - RNA, 22 nt, Homo sapiens
uugaggccugauaacacacuga

SEQ ID NO: 59000 - RNA, 22 nt, Homo sapiens
uugauagguuuuauguauaguu

SEQ ID NO: 59001 - RNA, 22 nt, Homo sapiens
uugauaguaccauugggaaauu

SEQ ID NO: 59002 - RNA, 22 nt, Homo sapiens
uugcaacauuguaaguuuauau

SEQ ID NO: 59003 - RNA, 22 nt, Homo sapiens
uugcacauugauuuuguauccu

SEQ ID NO: 59004 - RNA, 22 nt, Homo sapiens
uugcacuguaauuuauuuaugu

SEQ ID NO: 59005 - RNA, 22 nt, Homo sapiens
uugcagcauucugguuccuggu

SEQ ID NO: 59006 - RNA, 22 nt, Homo sapiens
uugcaugcacaguucucaauag

SEQ ID NO: 59007 - RNA, 22 nt, Homo sapiens
uugcauuagugugguacauuug

SEQ ID NO: 59008 - RNA, 22 nt, Homo sapiens
uugccugagaagccaagaauaa

SEQ ID NO: 59009 - RNA, 22 nt, Homo sapiens
uuggaacacauguuuuucuacc

SEQ ID NO: 59010 - RNA, 22 nt, Homo sapiens
uuggacuggaacuauaccauug

SEQ ID NO: 59011 - RNA, 22 nt, Homo sapiens
uuggacugugagguuucguggg

SEQ ID NO: 59012 - RNA, 22 nt, Homo sapiens
uuggagagucacuaguuagugc

SEQ ID NO: 59013 - RNA, 22 nt, Homo sapiens
uuggauuuugguggcaacucau

SEQ ID NO: 59014 - RNA, 22 nt, Homo sapiens
uuggcaaauagguuuuauugca

SEQ ID NO: 59015 - RNA, 22 nt, Homo sapiens
uuggcaaguccccaccucucuc

SEQ ID NO: 59016 - RNA, 21 nt, Homo sapiens
uuggcacucuucucuccuuau

SEQ ID NO: 59017 - RNA, 22 nt, Homo sapiens
uuggcagugcccgaugcugggg

SEQ ID NO: 59018 - RNA, 22 nt, Homo sapiens
uuggcauuguggauggaaucau

SEQ ID NO: 59019 - RNA, 22 nt, Homo sapiens
uuggccagugucuuuuuuuccu

SEQ ID NO: 59020 - RNA, 22 nt, Homo sapiens
uuggccccuccaaaucucaugu

SEQ ID NO: 59021 - RNA, 22 nt, Homo sapiens
uuggccccucccaaauuucaug

SEQ ID NO: 59022 - RNA, 21 nt, Homo sapiens
uuggcuacugcuucagaggga

SEQ ID NO: 59023 - RNA, 22 nt, Homo sapiens
uugguaaucccuagugucuaga

SEQ ID NO: 59024 - RNA, 22 nt, Homo sapiens
uuggucaaaucugaugggagaa

SEQ ID NO: 59025 - RNA, 22 nt, Homo sapiens
uuguagaucuucaguugcuaca

SEQ ID NO: 59026 - RNA, 22 nt, Homo sapiens
uuguagcaaauguguaaacaaa

SEQ ID NO: 59027 - RNA, 22 nt, Homo sapiens
uuguaugucuucauuugaaaaa

SEQ ID NO: 59028 - RNA, 22 nt, Homo sapiens
uuguccacugcuagccucugca

SEQ ID NO: 59029 - RNA, 22 nt, Homo sapiens
uuguccccaucugcugccagaa

SEQ ID NO: 59030 - RNA, 22 nt, Homo sapiens
uugucuagugaauacauuaaug

SEQ ID NO: 59031 - RNA, 22 nt, Homo sapiens
uugugaauggugcugcaguaaa

SEQ ID NO: 59032 - RNA, 22 nt, Homo sapiens
ugugucacugcacuccagccug

SEQ ID NO: 59033 - RNA, 22 nt, Homo sapiens
uguuacagcagaauugauugca

SEQ ID NO: 59034 - RNA, 22 nt, Homo sapiens
uguuauguuguuugagaaaguc

SEQ ID NO: 59035 - RNA, 22 nt, Homo sapiens
uguuauguuuuagagguuucaa

SEQ ID NO: 59036 - RNA, 22 nt, Homo sapiens
uguucacaguguuucuuugaga

SEQ ID NO: 59037 - RNA, 19 nt, Homo sapiens
uguugcacauaucaauaug

SEQ ID NO: 59038 - RNA, 22 nt, Homo sapiens
uguugcacugguaauguacuga

SEQ ID NO: 59039 - RNA, 22 nt, Homo sapiens
uguugcauuugucaaggucaag

SEQ ID NO: 59040 - RNA, 22 nt, Homo sapiens
uguuugcuguguggaguagcag

SEQ ID NO: 59041 - RNA, 22 nt, Homo sapiens
uguuugguggucucuucacaug

SEQ ID NO: 59042 - RNA, 22 nt, Homo sapiens
uuaaaccugucuucucacuaau

SEQ ID NO: 59043 - RNA, 22 nt, Homo sapiens
uuaaagugcacacgggucaggc

SEQ ID NO: 59044 - RNA, 22 nt, Homo sapiens
uuaaaguguuuucaaaauguca

SEQ ID NO: 59045 - RNA, 22 nt, Homo sapiens
uuaaauacagcaugguguuucu

SEQ ID NO: 59046 - RNA, 22 nt, Homo sapiens
uuaacaguugcaugagacugag

SEQ ID NO: 59047 - RNA, 22 nt, Homo sapiens
uuaagcaguaguuaaggagagg

SEQ ID NO: 59048 - RNA, 22 nt, Homo sapiens
uuaaguagcugggcaugguggu

SEQ ID NO: 59049 - RNA, 22 nt, Homo sapiens
uuaagugaauuaucuaacaugu

SEQ ID NO: 59050 - RNA, 22 nt, Homo sapiens
uuaauagugacucauuuuccac

SEQ ID NO: 59051 - RNA, 22 nt, Homo sapiens
uuaaugcuuuugggauauuucu

SEQ ID NO: 59052 - RNA, 19 nt, Homo sapiens
uuacacaaccuaguggggc

SEQ ID NO: 59053 - RNA, 22 nt, Homo sapiens
uuacaguaugaguaagaguucu

SEQ ID NO: 59054 - RNA, 22 nt, Homo sapiens
uuacaguauugcaaggacuagg

SEQ ID NO: 59055 - RNA, 20 nt, Homo sapiens
uuacagugggaccuuccuga

SEQ ID NO: 59056 - RNA, 22 nt, Homo sapiens
uuaccagucugauaaacagaaa

SEQ ID NO: 59057 - RNA, 22 nt, Homo sapiens
uuacugcauaauuccugggaag

SEQ ID NO: 59058 - RNA, 22 nt, Homo sapiens
uuagaguacaggggaaucaagg

SEQ ID NO: 59059 - RNA, 22 nt, Homo sapiens
uuagcagugugagcacagacua

SEQ ID NO: 59060 - RNA, 22 nt, Homo sapiens
uuagugaaugggugugauuugu

SEQ ID NO: 59061 - RNA, 22 nt, Homo sapiens
uuauagcagugcaggaacagac

SEQ ID NO: 59062 - RNA, 22 nt, Homo sapiens
uuauauguuucuguuuggaggc

SEQ ID NO: 59063 - RNA, 22 nt, Homo sapiens
uuaucagcagugcgaaaacaga

SEQ ID NO: 59064 - RNA, 22 nt, Homo sapiens
uuaugcaucuuccacacucauu

SEQ ID NO: 59065 - RNA, 22 nt, Homo sapiens
ucugagcaugcaucuugccugg

SEQ ID NO: 59066 - RNA, 23 nt, Homo sapiens
ucugauguuauaaaauucuuugg

SEQ ID NO: 59067 - RNA, 22 nt, Homo sapiens
ucugcauaucaugcagaacuau

SEQ ID NO: 59068 - RNA, 22 nt, Homo sapiens
ucuggcuuuagcaugugggaag

SEQ ID NO: 59069 - RNA, 22 nt, Homo sapiens
ucuggcuuuuaacaucuauaaa

SEQ ID NO: 59070 - RNA, 20 nt, Homo sapiens
ucuggguuuuggccacgccc

SEQ ID NO: 59071 - RNA, 22 nt, Homo sapiens
ucuggguuuuuccauugccggu

SEQ ID NO: 59072 - RNA, 22 nt, Homo sapiens
ucuguaguuaacagcuucagcu

SEQ ID NO: 59073 - RNA, 19 nt, Homo sapiens
ucuguaguuagggcuacag

SEQ ID NO: 59074 - RNA, 22 nt, Homo sapiens
ucugucuuguccucacccuaga

SEQ ID NO: 59075 - RNA, 22 nt, Homo sapiens
ucugugguaagaaacgcauguc

SEQ ID NO: 59076 - RNA, 22 nt, Homo sapiens
ucuguggucagcauccgccacu

SEQ ID NO: 59077 - RNA, 22 nt, Homo sapiens
ucuguguuuagacccaggguag

SEQ ID NO: 59078 - RNA, 22 nt, Homo sapiens
ucuuaguuuagauuagcaauuc

SEQ ID NO: 59079 - RNA, 22 nt, Homo sapiens
ucuucaugcuugaaauaauagc

SEQ ID NO: 59080 - RNA, 22 nt, Homo sapiens
ucuugcauuuuuaaauagugcu

SEQ ID NO: 59081 - RNA, 22 nt, Homo sapiens
ucuuggguuuguccuucuccua

SEQ ID NO: 59082 - RNA, 21 nt, Homo sapiens
ucuugguauguauuuaggagg

SEQ ID NO: 59083 - RNA, 22 nt, Homo sapiens
ucuugucacugcauccccagcu

SEQ ID NO: 59084 - RNA, 22 nt, Homo sapiens
ucuuugccuaacccaaggucau

SEQ ID NO: 59085 - RNA, 22 nt, Homo sapiens
ucuuuguuggaguccaaggaua

SEQ ID NO: 59086 - RNA, 22 nt, Homo sapiens
ucuuuuguaaaaugaggaggug

SEQ ID NO: 59087 - RNA, 22 nt, Homo sapiens
ucuuuugugagucagccucucc

SEQ ID NO: 59088 - RNA, 22 nt, Homo sapiens
ugaaaguaauugcaguuuuuac

SEQ ID NO: 59089 - RNA, 22 nt, Homo sapiens
ugaagcuaacuugauugugaug

SEQ ID NO: 59090 - RNA, 22 nt, Homo sapiens
ugaaucaugcugcuauaaagac

SEQ ID NO: 59091 - RNA, 22 nt, Homo sapiens
ugaaugcaucuagaaauuuauu

SEQ ID NO: 59092 - RNA, 22 nt, Homo sapiens
uuauuagguuagugcaaaaguu

SEQ ID NO: 59093 - RNA, 22 nt, Homo sapiens
uuauucagcaccugcuguguuc

SEQ ID NO: 59094 - RNA, 22 nt, Homo sapiens
uuauugcuuuugugcaggugag

SEQ ID NO: 59095 - RNA, 22 nt, Homo sapiens
uuauuugguugcugacuuggaa

SEQ ID NO: 59096 - RNA, 22 nt, Homo sapiens
uucacagagagaacucaaacca

SEQ ID NO: 59097 - RNA, 22 nt, Homo sapiens
uucacaguacucccuggaauua

SEQ ID NO: 59098 - RNA, 22 nt, Homo sapiens
uucacagucacccuucuccaug

SEQ ID NO: 59099 - RNA, 22 nt, Homo sapiens
uucaccuggaguucaggauaag

SEQ ID NO: 59100 - RNA, 22 nt, Homo sapiens
uucagcaaugacagccuauaua

SEQ ID NO: 59101 - RNA, 22 nt, Homo sapiens
uucaggcaccauggucauugau

SEQ ID NO: 59102 - RNA, 22 nt, Homo sapiens
uucaggcuuuuauuuacugaua

SEQ ID NO: 59103 - RNA, 22 nt, Homo sapiens
uucagggagaaggcaaacguug

SEQ ID NO: 59104 - RNA, 22 nt, Homo sapiens
uucagguaucccuugucuauag

SEQ ID NO: 59105 - RNA, 22 nt, Homo sapiens
uucaguaaauguucuuacuaua

SEQ ID NO: 59106 - RNA, 22 nt, Homo sapiens
uucagugccuggaagucgugcu

SEQ ID NO: 59107 - RNA, 19 nt, Homo sapiens
uucauacagugagagcagc

SEQ ID NO: 59108 - RNA, 21 nt, Homo sapiens
uucaucagccagaaaucaagc

SEQ ID NO: 59109 - RNA, 22 nt, Homo sapiens
uucaugcaucuguagugguuaa

SEQ ID NO: 59110 - RNA, 22 nt, Homo sapiens
uucccagagaaaaggguuucuu

SEQ ID NO: 59111 - RNA, 22 nt, Homo sapiens
uucccugagcaucuguugagcc

SEQ ID NO: 59112 - RNA, 22 nt, Homo sapiens
uucccugaguaucuuaccaugg

SEQ ID NO: 59113 - RNA, 22 nt, Homo sapiens
uucccuuugaaacuaaacuugc

SEQ ID NO: 59114 - RNA, 22 nt, Homo sapiens
uucccuuuguuaaauuggaaga

SEQ ID NO: 59115 - RNA, 22 nt, Homo sapiens
uucccuuuuuucuaguagguag

SEQ ID NO: 59116 - RNA, 22 nt, Homo sapiens
uuccugugacccccaagcccac

SEQ ID NO: 59117 - RNA, 22 nt, Homo sapiens
uucuacuccucauggcagguug

SEQ ID NO: 59118 - RNA, 21 nt, Homo sapiens
uucucagaggcaggggauaaa

SEQ ID NO: 59119 - RNA, 22 nt, Homo sapiens
uucucagugaaguuuagaacau

SEQ ID NO: 59120 - RNA, 22 nt, Homo sapiens
uucucauggugauggcaaaauc

SEQ ID NO: 59121 - RNA, 22 nt, Homo sapiens
uucuccugguggacccuaaacg

SEQ ID NO: 59122 - RNA, 22 nt, Homo sapiens
uucucuguggauugggugagag

SEQ ID NO: 59123 - RNA, 22 nt, Homo sapiens
uucugcacaucgaucacaagau

SEQ ID NO: 59124 - RNA, 20 nt, Homo sapiens
uucuugaguuaacaaguuac

SEQ ID NO: 59125 - RNA, 22 nt, Homo sapiens
uugaaagacaucaccuacugcu

SEQ ID NO: 59126 - RNA, 22 nt, Homo sapiens
uugaaagaugaacuggauugga

SEQ ID NO: 59127 - RNA, 22 nt, Homo sapiens
uugaaagucauggcacaggcaa

SEQ ID NO: 59128 - RNA, 22 nt, Homo sapiens
uugaagacuaauuuagauaaug

SEQ ID NO: 59129 - RNA, 22 nt, Homo sapiens
uugaagacuauaugauucuuca

SEQ ID NO: 59130 - RNA, 22 nt, Homo sapiens
uugaagguaggaugugcuauca

SEQ ID NO: 59131 - RNA, 22 nt, Homo sapiens
uugaaguaggaaaggaggaggu

SEQ ID NO: 59132 - RNA, 22 nt, Homo sapiens
uugaaguagguaccguucaauu

SEQ ID NO: 59133 - RNA, 22 nt, Homo sapiens
uugaaguaugaccgcugagaau

SEQ ID NO: 59134 - RNA, 22 nt, Homo sapiens
uugacagaccuuggucauaucc

SEQ ID NO: 59135 - RNA, 22 nt, Homo sapiens
uugacagagaaaagugugacuu

SEQ ID NO: 59136 - RNA, 21 nt, Homo sapiens
uugacagugacagguaaaguu

SEQ ID NO: 59137 - RNA, 22 nt, Homo sapiens
uugacugggccagacagagauc

SEQ ID NO: 59138 - RNA, 22 nt, Homo sapiens
uugacuucagagcugauucaag

SEQ ID NO: 59139 - RNA, 22 nt, Homo sapiens
uugagagaaaaggccaugccuu

SEQ ID NO: 59140 - RNA, 17 nt, Homo sapiens
uugagaguauaucuuac

SEQ ID NO: 59141 - RNA, 22 nt, Homo sapiens
uugagauaggaacucacuaugc

SEQ ID NO: 59142 - RNA, 22 nt, Homo sapiens
uugagauggagucucacgcauu

SEQ ID NO: 59143 - RNA, 22 nt, Homo sapiens
uugaggaaugugauuucaaaua

SEQ ID NO: 59144 - RNA, 22 nt, Homo sapiens
uugaggcaaugaggagaagcug

SEQ ID NO: 59145 - RNA, 16 nt, Homo sapiens
uugaggcaugucucag

SEQ ID NO: 59146 - RNA, 22 nt, Homo sapiens
uugagggaaacauucacaucau

SEQ ID NO: 59147 - RNA, 22 nt, Homo sapiens
uugagggagccuguuagucccg

SEQ ID NO: 59148 - RNA, 22 nt, Homo sapiens
uugaggguggcauauauugauu

SEQ ID NO: 59149 - RNA, 22 nt, Homo sapiens
uugagugaaugaaugauuaaau

SEQ ID NO: 59150 - RNA, 22 nt, Homo sapiens
uugaguuuaucuaaagaccugg

SEQ ID NO: 59151 - RNA, 22 nt, Homo sapiens
uugauauguaguuggacuugau

SEQ ID NO: 59152 - RNA, 22 nt, Homo sapiens
uugaucacuguacuaugacuau

SEQ ID NO: 59153 - RNA, 22 nt, Homo sapiens
uugauguugaggacauaaaccu

SEQ ID NO: 59154 - RNA, 21 nt, Homo sapiens
uugcaaaugcugcugccugau

SEQ ID NO: 59155 - RNA, 22 nt, Homo sapiens
aguggaauuaagaaacugaauu

SEQ ID NO: 59156 - RNA, 19 nt, Homo sapiens
agugucauggucauuauuu

SEQ ID NO: 59157 - RNA, 22 nt, Homo sapiens
aguguuuuuaacaagaaagggu

SEQ ID NO: 59158 - RNA, 22 nt, Homo sapiens
aguucaauggguuuucacucau

SEQ ID NO: 59159 - RNA, 22 nt, Homo sapiens
auaaacagcuuauccucuauuc

SEQ ID NO: 59160 - RNA, 22 nt, Homo sapiens
auaaaugcuuagaucuguauau

SEQ ID NO: 59161 - RNA, 20 nt, Homo sapiens
auaaauguauagguguacau

SEQ ID NO: 59162 - RNA, 22 nt, Homo sapiens
auaacagcugcaaggcaaaagc

SEQ ID NO: 59163 - RNA, 22 nt, Homo sapiens
auaaggcuaaggacuugaguua

SEQ ID NO: 59164 - RNA, 22 nt, Homo sapiens
auaauaucagguugugaugaug

SEQ ID NO: 59165 - RNA, 22 nt, Homo sapiens
auaaucaugucugaaaccuuug

SEQ ID NO: 59166 - RNA, 22 nt, Homo sapiens
auacaugcauuugcacgagagu

SEQ ID NO: 59167 - RNA, 22 nt, Homo sapiens
auacaugugccauguugguaug

SEQ ID NO: 59168 - RNA, 22 nt, Homo sapiens
auaccugguagucuugcuacac

SEQ ID NO: 59169 - RNA, 22 nt, Homo sapiens
auacuggcuuuccaauugugau

SEQ ID NO: 59170 - RNA, 20 nt, Homo sapiens
auagaagacuagugcagcag

SEQ ID NO: 59171 - RNA, 22 nt, Homo sapiens
auagcaagaugauugauccauu

SEQ ID NO: 59172 - RNA, 22 nt, Homo sapiens
auagcacaguguguguacacca

SEQ ID NO: 59173 - RNA, 21 nt, Homo sapiens
auagcacaucagauuuuauua

SEQ ID NO: 59174 - RNA, 20 nt, Homo sapiens
auagcaccagacagcccuag

SEQ ID NO: 59175 - RNA, 22 nt, Homo sapiens
auagcagcagcuaguagugaua

SEQ ID NO: 59176 - RNA, 22 nt, Homo sapiens
auauagcaaugaaagagaugaa

SEQ ID NO: 59177 - RNA, 22 nt, Homo sapiens
auaucacaggaaaggaagauac

SEQ ID NO: 59178 - RNA, 20 nt, Homo sapiens
auaugguugugagugauuuu

SEQ ID NO: 59179 - RNA, 22 nt, Homo sapiens
auauguaguauggaaacauugu

SEQ ID NO: 59180 - RNA, 22 nt, Homo sapiens
auauuguacugcuacugguucu

SEQ ID NO: 59181 - RNA, 22 nt, Homo sapiens
auauuguuggcugcuggcugau

SEQ ID NO: 59182 - RNA, 20 nt, Homo sapiens
aucaaagacuuagaggggga

SEQ ID NO: 59183 - RNA, 22 nt, Homo sapiens
aucaaagugaauuaaugagaau

SEQ ID NO: 59184 - RNA, 19 nt, Homo sapiens
aucaccagucuuuccacug

SEQ ID NO: 59185 - RNA, 22 nt, Homo sapiens
auuguacauacaccggugugua

SEQ ID NO: 59186 - RNA, 22 nt, Homo sapiens
auuguacuccagccugggcaag

SEQ ID NO: 59187 - RNA, 22 nt, Homo sapiens
auuguacuccagccugggcgac

SEQ ID NO: 59188 - RNA, 22 nt, Homo sapiens
auugucacccgggcaguaagca

SEQ ID NO: 59189 - RNA, 22 nt, Homo sapiens
auuguucuuacaugcugucauc

SEQ ID NO: 59190 - RNA, 22 nt, Homo sapiens
auuuggcauagaguaucauucu

SEQ ID NO: 59191 - RNA, 22 nt, Homo sapiens
auuugucacuuaacagccauua

SEQ ID NO: 59192 - RNA, 22 nt, Homo sapiens
auuuugguuacauaguugagcu

SEQ ID NO: 59193 - RNA, 22 nt, Homo sapiens
caaaggcuuccacugcauccuu

SEQ ID NO: 59194 - RNA, 22 nt, Homo sapiens
caaaggcuucugaaacugcaga

SEQ ID NO: 59195 - RNA, 22 nt, Homo sapiens
caaaguaauuacgguuuuggcc

SEQ ID NO: 59196 - RNA, 22 nt, Homo sapiens
caaaguaauugugguuuugcca

SEQ ID NO: 59197 - RNA, 22 nt, Homo sapiens
caaauacuuucauguugucuug

SEQ ID NO: 59198 - RNA, 22 nt, Homo sapiens
caaauugcuuguggaggauaau

SEQ ID NO: 59199 - RNA, 22 nt, Homo sapiens
caagacuguccaacauauuggg

SEQ ID NO: 59200 - RNA, 22 nt, Homo sapiens
caaguacugggcuauggauauu

SEQ ID NO: 59201 - RNA, 21 nt, Homo sapiens
caagugaugcuucugcuuuaa

SEQ ID NO: 59202 - RNA, 22 nt, Homo sapiens
caagugcuuucuuggggauuua

SEQ ID NO: 59203 - RNA, 19 nt, Homo sapiens
caauacuucuuggcauaca

SEQ ID NO: 59204 - RNA, 22 nt, Homo sapiens
caaugcagcuuuuggagagaaa

SEQ ID NO: 59205 - RNA, 22 nt, Homo sapiens
caauggcaaugaaauagugaga

SEQ ID NO: 59206 - RNA, 22 nt, Homo sapiens
caauugcacucuuagguguaca

SEQ ID NO: 59207 - RNA, 22 nt, Homo sapiens
cacaaaguagauuagucuucca

SEQ ID NO: 59208 - RNA, 22 nt, Homo sapiens
cacacugucuucauuacuguag

SEQ ID NO: 59209 - RNA, 22 nt, Homo sapiens
cacagcacaggcaugaguguca

SEQ ID NO: 59210 - RNA, 22 nt, Homo sapiens
cacagucugggcuuguuuguac

SEQ ID NO: 59211 - RNA, 22 nt, Homo sapiens
cacaguguucauagccaucagg

SEQ ID NO: 59212 - RNA, 22 nt, Homo sapiens
cacauguucaggagcacuuaga

SEQ ID NO: 59213 - RNA, 22 nt, Homo sapiens
cacauugaauuucugaugacaa

SEQ ID NO: 59214 - RNA, 22 nt, Homo sapiens
caccccuaccugagucaggagu

SEQ ID NO: 59215 - RNA, 22 nt, Homo sapiens
cacugcauuggaugguuccucc

SEQ ID NO: 59216 - RNA, 22 nt, Homo sapiens
cacugcgacguccgccucccgg

SEQ ID NO: 59217 - RNA, 22 nt, Homo sapiens
cacugggugagauccauguuua

SEQ ID NO: 59218 - RNA, 17 nt, Homo sapiens
cacugggugcaagagga

SEQ ID NO: 59219 - RNA, 22 nt, Homo sapiens
cacugugcaaccuccaccuccc

SEQ ID NO: 59220 - RNA, 22 nt, Homo sapiens
cagaaguauugguaugcucugu

SEQ ID NO: 59221 - RNA, 22 nt, Homo sapiens
cagagcacugauacuggguucu

SEQ ID NO: 59222 - RNA, 22 nt, Homo sapiens
cagagguauugcaaaagccuag

SEQ ID NO: 59223 - RNA, 22 nt, Homo sapiens
cagauacuggaguccugaaguu

SEQ ID NO: 59224 - RNA, 22 nt, Homo sapiens
cagcaagucucuaagaguucau

SEQ ID NO: 59225 - RNA, 22 nt, Homo sapiens
cagcagguuuuuaucaguuaag

SEQ ID NO: 59226 - RNA, 22 nt, Homo sapiens
cagccggguggcuccuagggua

SEQ ID NO: 59227 - RNA, 22 nt, Homo sapiens
cagcucauugcagucucgaccu

SEQ ID NO: 59228 - RNA, 22 nt, Homo sapiens
cagcuguguuauaaacuaccau

SEQ ID NO: 59229 - RNA, 23 nt, Homo sapiens
cagcuucauugaacauaacuccu

SEQ ID NO: 59230 - RNA, 17 nt, Homo sapiens
gaaguguuucuucauga

SEQ ID NO: 59231 - RNA, 22 nt, Homo sapiens
gaaugcaugaggggaucagaug

SEQ ID NO: 59232 - RNA, 22 nt, Homo sapiens
gaaugucuuauugcucguugua

SEQ ID NO: 59233 - RNA, 22 nt, Homo sapiens
gaauguuuacuuuguuuaauac

SEQ ID NO: 59234 - RNA, 18 nt, Homo sapiens
gacaguguggugauuccu

SEQ ID NO: 59235 - RNA, 21 nt, Homo sapiens
gacauggcgauacuccgucuc

SEQ ID NO: 59236 - RNA, 22 nt, Homo sapiens
gacauguuucucucuguuuacu

SEQ ID NO: 59237 - RNA, 22 nt, Homo sapiens
gaccacagacuggaaagagggc

SEQ ID NO: 59238 - RNA, 21 nt, Homo sapiens
gaccuguaguaagcauucaca

SEQ ID NO: 59239 - RNA, 22 nt, Homo sapiens
gaccuuguagaaucucaugauu

SEQ ID NO: 59240 - RNA, 18 nt, Homo sapiens
gacucaguuucuaaggca

SEQ ID NO: 59241 - RNA, 22 nt, Homo sapiens
gacuuugguaaacucgguggca

SEQ ID NO: 59242 - RNA, 22 nt, Homo sapiens
gagaacugacauuaucguguau

SEQ ID NO: 59243 - RNA, 22 nt, Homo sapiens
gagacugagucucgcucugccg

SEQ ID NO: 59244 - RNA, 22 nt, Homo sapiens
gagacugagucuugcucuguca

SEQ ID NO: 59245 - RNA, 22 nt, Homo sapiens
gagagaguacuugauauaauuu

SEQ ID NO: 59246 - RNA, 22 nt, Homo sapiens
gagagcaugugcuggcaucagu

SEQ ID NO: 59247 - RNA, 22 nt, Homo sapiens
gagauacacccagugcagaggc

SEQ ID NO: 59248 - RNA, 22 nt, Homo sapiens
gagauaggauucacuuucaugu

SEQ ID NO: 59249 - RNA, 22 nt, Homo sapiens
gagaucaguuaaugaagugagc

SEQ ID NO: 59250 - RNA, 22 nt, Homo sapiens
gagaucauguacuagaacaccu

SEQ ID NO: 59251 - RNA, 22 nt, Homo sapiens
gagaucauugugggccaagcug

SEQ ID NO: 59252 - RNA, 22 nt, Homo sapiens
gagaucuauuccucacccuucu

SEQ ID NO: 59253 - RNA, 22 nt, Homo sapiens
gagcacauguggagagucuggg

SEQ ID NO: 59254 - RNA, 22 nt, Homo sapiens
gagcacccuuuguugauugcaa

SEQ ID NO: 59255 - RNA, 22 nt, Homo sapiens
gagccauggagaaaacagcuau

SEQ ID NO: 59256 - RNA, 22 nt, Homo sapiens
gagcuacacugauucauuuguu

SEQ ID NO: 59257 - RNA, 22 nt, Homo sapiens
gagcuagaauauuuuguauagu

SEQ ID NO: 59258 - RNA, 22 nt, Homo sapiens
gaggagucagacugugcaaggu

SEQ ID NO: 59259 - RNA, 22 nt, Homo sapiens
gaggcaauaugagggaggcuuc

SEQ ID NO: 59260 - RNA, 22 nt, Homo sapiens
gaggcaaugugcccggcccaca

SEQ ID NO: 59261 - RNA, 22 nt, Homo sapiens
gagguaggggccuuaaagaugc

SEQ ID NO: 59262 - RNA, 22 nt, Homo sapiens
gaggucuuacauuuuaauauuu

SEQ ID NO: 59263 - RNA, 22 nt, Homo sapiens
gaguaaaugucaaguacuuagg

SEQ ID NO: 59264 - RNA, 22 nt, Homo sapiens
gaguagugcugcaguaaacaca

SEQ ID NO: 59265 - RNA, 22 nt, Homo sapiens
gaguauuuuacaucguguaauu

SEQ ID NO: 59266 - RNA, 22 nt, Homo sapiens
gagugcaauggcagaucuccgc

SEQ ID NO: 59267 - RNA, 22 nt, Homo sapiens
gagugcaauggcgcgaucuggg

SEQ ID NO: 59268 - RNA, 22 nt, Homo sapiens
gaguuacauuguaauugccgag

SEQ ID NO: 59269 - RNA, 22 nt, Homo sapiens
gaguucauaucuaugagugugc

SEQ ID NO: 59270 - RNA, 22 nt, Homo sapiens
gaguuccuuugagccugagagg

SEQ ID NO: 59271 - RNA, 22 nt, Homo sapiens
gauaaaucuuggcuagucuaag

SEQ ID NO: 59272 - RNA, 22 nt, Homo sapiens
gauaacagauaaugucaguuau

SEQ ID NO: 59273 - RNA, 22 nt, Homo sapiens
gauacaguaugcaugugguauu

SEQ ID NO: 59274 - RNA, 22 nt, Homo sapiens
gaucacaguuccucacgggcau

SEQ ID NO: 59275 - RNA, 22 nt, Homo sapiens
gaucuguuucaauugucuuagu

SEQ ID NO: 59276 - RNA, 22 nt, Homo sapiens
gaugacacugggucaaaucuca

SEQ ID NO: 59277 - RNA, 22 nt, Homo sapiens
gaugaugcuagguguuagggcu

SEQ ID NO: 59278 - RNA, 22 nt, Homo sapiens
gaugcaaauuaagcuugggaca

SEQ ID NO: 59279 - RNA, 22 nt, Homo sapiens
gauuagagaaauacugcugcua

SEQ ID NO: 59280 - RNA, 22 nt, Homo sapiens
ccccggguucugucugcccuug

SEQ ID NO: 59281 - RNA, 21 nt, Homo sapiens
ccccugauacuuagucaagag

SEQ ID NO: 59282 - RNA, 22 nt, Homo sapiens
cccugaagaaagccuaggacau

SEQ ID NO: 59283 - RNA, 22 nt, Homo sapiens
cccugacauucggagauguagu

SEQ ID NO: 59284 - RNA, 19 nt, Homo sapiens
ccucaaguacuaauauguu

SEQ ID NO: 59285 - RNA, 22 nt, Homo sapiens
ccucaguguuuaucauuauuuu

SEQ ID NO: 59286 - RNA, 21 nt, Homo sapiens
ccuccauuuguauucuugccc

SEQ ID NO: 59287 - RNA, 22 nt, Homo sapiens
ccugagacgaauggagugaaca

SEQ ID NO: 59288 - RNA, 22 nt, Homo sapiens
ccugagacuugagggggcuucu

SEQ ID NO: 59289 - RNA, 22 nt, Homo sapiens
ccuggaagaaaggugcuaaaua

SEQ ID NO: 59290 - RNA, 22 nt, Homo sapiens
ccugucuugaagagauccuccu

SEQ ID NO: 59291 - RNA, 21 nt, Homo sapiens
ccuugguuaucuucccauuca

SEQ ID NO: 59292 - RNA, 22 nt, Homo sapiens
cggucacagugauucaaggguc

SEQ ID NO: 59293 - RNA, 17 nt, Homo sapiens
cuaaggcaagagucugc

SEQ ID NO: 59294 - RNA, 23 nt, Homo sapiens
cuacagugccugucucuuuggcc

SEQ ID NO: 59295 - RNA, 22 nt, Homo sapiens
cuacaguucuuaauuaaguagu

SEQ ID NO: 59296 - RNA, 22 nt, Homo sapiens
cuaccuggguggcucaugacuu

SEQ ID NO: 59297 - RNA, 23 nt, Homo sapiens
cuacuagucaagucuuuuccagu

SEQ ID NO: 59298 - RNA, 22 nt, Homo sapiens
cuacucuggagagugacaauca

SEQ ID NO: 59299 - RNA, 22 nt, Homo sapiens
cuagaagguaagagcuggaugc

SEQ ID NO: 59300 - RNA, 22 nt, Homo sapiens
cuagcccugagauaaaugucau

SEQ ID NO: 59301 - RNA, 21 nt, Homo sapiens
cuaggaccaguucuguaauuc

SEQ ID NO: 59302 - RNA, 22 nt, Homo sapiens
cuagguagcuuuucugucaugu

SEQ ID NO: 59303 - RNA, 22 nt, Homo sapiens
cucaaagugcuaagauuaggcu

SEQ ID NO: 59304 - RNA, 22 nt, Homo sapiens
cucaaguacaugggauuacagg

SEQ ID NO: 59305 - RNA, 22 nt, Homo sapiens
cucaauuuggaauugucaguaa

SEQ ID NO: 59306 - RNA, 18 nt, Homo sapiens
cucacaguaacuuuuaag

SEQ ID NO: 59307 - RNA, 22 nt, Homo sapiens
cucacagucucucccuaauuuu

SEQ ID NO: 59308 - RNA, 22 nt, Homo sapiens
cucagcaguggauuuaccacca

SEQ ID NO: 59309 - RNA, 22 nt, Homo sapiens
cucaggcacucugauuccagug

SEQ ID NO: 59310 - RNA, 22 nt, Homo sapiens
cucaguacuugcacagaagaac

SEQ ID NO: 59311 - RNA, 22 nt, Homo sapiens
cucaguguuaaggccaccucug

SEQ ID NO: 59312 - RNA, 22 nt, Homo sapiens
cucaguguuucagcugcucaga

SEQ ID NO: 59313 - RNA, 22 nt, Homo sapiens
cuccauuuggaacagauguccu

SEQ ID NO: 59314 - RNA, 23 nt, Homo sapiens
cucccugaacaugacacaccaga

SEQ ID NO: 59315 - RNA, 22 nt, Homo sapiens
cucugacagugguuagcacugu

SEQ ID NO: 59316 - RNA, 22 nt, Homo sapiens
cucuggauauuccugucuaaaa

SEQ ID NO: 59317 - RNA, 22 nt, Homo sapiens
cucugguuaaggcugaacuaua

SEQ ID NO: 59318 - RNA, 22 nt, Homo sapiens
cucuuugaggugagcugcccau

SEQ ID NO: 59319 - RNA, 22 nt, Homo sapiens
cucuuugaugugaaccgugguu

SEQ ID NO: 59320 - RNA, 22 nt, Homo sapiens
cugaaagagcauuugaaugggu

SEQ ID NO: 59321 - RNA, 22 nt, Homo sapiens
cugaagugcuugccacauaaaa

SEQ ID NO: 59322 - RNA, 23 nt, Homo sapiens
ggauggaaaguuuugagggccac

SEQ ID NO: 59323 - RNA, 22 nt, Homo sapiens
ggauuagagauguuauuaagag

SEQ ID NO: 59324 - RNA, 22 nt, Homo sapiens
ggcaaaugaagauggagaggcu

SEQ ID NO: 59325 - RNA, 22 nt, Homo sapiens
ggcaacaaagacauuucaacau

SEQ ID NO: 59326 - RNA, 19 nt, Homo sapiens
ggcaagaguuguucugugu

SEQ ID NO: 59327 - RNA, 22 nt, Homo sapiens
ggcagacuguggaguucuuucu

SEQ ID NO: 59328 - RNA, 22 nt, Homo sapiens
ggcagcacaauuuucugaugga

SEQ ID NO: 59329 - RNA, 22 nt, Homo sapiens
ggcaguguaauaauuuauuaau

SEQ ID NO: 59330 - RNA, 22 nt, Homo sapiens
ggcaugguggugugugccuaua

SEQ ID NO: 59331 - RNA, 21 nt, Homo sapiens
ggcauugugcccuugcucuag

SEQ ID NO: 59332 - RNA, 22 nt, Homo sapiens
ggcccugauacaaguaaggucu

SEQ ID NO: 59333 - RNA, 22 nt, Homo sapiens
ggcuuggaggaaugugagggcu

SEQ ID NO: 59334 - RNA, 22 nt, Homo sapiens
gggaaaaugucuauugaaugaa

SEQ ID NO: 59335 - RNA, 22 nt, Homo sapiens
gggaauguagcaaaucugcaau

SEQ ID NO: 59336 - RNA, 22 nt, Homo sapiens
gggagguaggaguuauuauuuu

SEQ ID NO: 59337 - RNA, 22 nt, Homo sapiens
gggagguagguauuagcuuuuc

SEQ ID NO: 59338 - RNA, 20 nt, Homo sapiens
gggaugugagguacacucuu

SEQ ID NO: 59339 - RNA, 22 nt, Homo sapiens
ggguaggcaagcggaugucaga

SEQ ID NO: 59340 - RNA, 22 nt, Homo sapiens
gggucaguuuugagaaagcgug

SEQ ID NO: 59341 - RNA, 22 nt, Homo sapiens
ggucacauugcuagcauggguu

SEQ ID NO: 59342 - RNA, 22 nt, Homo sapiens
ggucauagagcaagcaaacagc

SEQ ID NO: 59343 - RNA, 22 nt, Homo sapiens
ggucauggagcuuuacuuuaug

SEQ ID NO: 59344 - RNA, 22 nt, Homo sapiens
ggucauggauguuuauaguaca

SEQ ID NO: 59345 - RNA, 22 nt, Homo sapiens
ggucccccuccacucucgcaaa

SEQ ID NO: 59346 - RNA, 22 nt, Homo sapiens
ggucuuggagaauuguccuggg

SEQ ID NO: 59347 - RNA, 22 nt, Homo sapiens
ggugagaaaaacauagucucag

SEQ ID NO: 59348 - RNA, 22 nt, Homo sapiens
ggugagcacagaaugcccugag

SEQ ID NO: 59349 - RNA, 22 nt, Homo sapiens
ggugagguaggaaaaguuagga

SEQ ID NO: 59350 - RNA, 22 nt, Homo sapiens
ggugcagcacaccaacauggca

SEQ ID NO: 59351 - RNA, 22 nt, Homo sapiens
guaaagacacaugcacacguau

SEQ ID NO: 59352 - RNA, 18 nt, Homo sapiens
guaaauguaucuauugcc

SEQ ID NO: 59353 - RNA, 17 nt, Homo sapiens
guacacuucuucuguga

SEQ ID NO: 59354 - RNA, 22 nt, Homo sapiens
guacaggcagcaaacaccauaa

SEQ ID NO: 59355 - RNA, 22 nt, Homo sapiens
guacaugcauacaugcacaucu

SEQ ID NO: 59356 - RNA, 22 nt, Homo sapiens
guaccacaguugcucacggguu

SEQ ID NO: 59357 - RNA, 22 nt, Homo sapiens
guagaggaauggcuccaccaua

SEQ ID NO: 59358 - RNA, 22 nt, Homo sapiens
guauacaugucaaaacucacau

SEQ ID NO: 59359 - RNA, 22 nt, Homo sapiens
guauaugccucaguuauagcac

SEQ ID NO: 59360 - RNA, 22 nt, Homo sapiens
guaucauugccuaaugcucuca

SEQ ID NO: 59361 - RNA, 22 nt, Homo sapiens
guauggaagucaguuuguuggc

SEQ ID NO: 59362 - RNA, 22 nt, Homo sapiens
guauuaguuaucuacugcugug

SEQ ID NO: 59363 - RNA, 22 nt, Homo sapiens
gucaaguguuuucaaggcuucc

SEQ ID NO: 59364 - RNA, 22 nt, Homo sapiens
gucacugagcaauagaaaguuu

SEQ ID NO: 59365 - RNA, 22 nt, Homo sapiens
gucagcaaaguucuccugcaga

SEQ ID NO: 59366 - RNA, 22 nt, Homo sapiens
gucaggcaccgauacaguuuuu

SEQ ID NO: 59367 - RNA, 22 nt, Homo sapiens
gucagugccugucccaggcuuu

SEQ ID NO: 59368 - RNA, 22 nt, Homo sapiens
gucaguuugguuaaucauucca

SEQ ID NO: 59369 - RNA, 22 nt, Homo sapiens
gucaucaucaguccucugugca

SEQ ID NO: 59370 - RNA, 22 nt, Homo sapiens
gucaugcaggguucgccagccc

SEQ ID NO: 59371 - RNA, 22 nt, Homo sapiens
gucauggaggaugaauggccaa

SEQ ID NO: 59372 - RNA, 22 nt, Homo sapiens
guccaaagugggagaggugggg

SEQ ID NO: 59373 - RNA, 18 nt, Homo sapiens
guccauuuguugguacac

SEQ ID NO: 59374 - RNA, 22 nt, Homo sapiens
gucguggagucucuggcuugua

SEQ ID NO: 59375 - RNA, 22 nt, Homo sapiens
gaaucccuugcauuaucccuuu

SEQ ID NO: 59376 - RNA, 22 nt, Homo sapiens
gaaugaauguuuauccuuagau

SEQ ID NO: 59377 - RNA, 22 nt, Homo sapiens
gacaagagaacacugcuauauu

SEQ ID NO: 59378 - RNA, 22 nt, Homo sapiens
gacagguuuucuguuucugaaa

SEQ ID NO: 59379 - RNA, 18 nt, Homo sapiens
gacagugugaagauuccu

SEQ ID NO: 59380 - RNA, 18 nt, Homo sapiens
gacaguguggcaauuccu

SEQ ID NO: 59381 - RNA, 18 nt, Homo sapiens
gacaguguggcgauuccu

SEQ ID NO: 59382 - RNA, 22 nt, Homo sapiens
gaccacauuccacacaggcuuu

SEQ ID NO: 59383 - RNA, 22 nt, Homo sapiens
gaccuggugguccacccgccuu

SEQ ID NO: 59384 - RNA, 22 nt, Homo sapiens
gacuaggagagcagcugcccau

SEQ ID NO: 59385 - RNA, 22 nt, Homo sapiens
gacugaguaagcagaagcaauu

SEQ ID NO: 59386 - RNA, 22 nt, Homo sapiens
gacuggccauugauacagaggu

SEQ ID NO: 59387 - RNA, 22 nt, Homo sapiens
gagaacauuaauaguuaauuuu

SEQ ID NO: 59388 - RNA, 22 nt, Homo sapiens
gagaaugaacagacugccucuu

SEQ ID NO: 59389 - RNA, 22 nt, Homo sapiens
gagacugagucuugcccuguca

SEQ ID NO: 59390 - RNA, 22 nt, Homo sapiens
gagacugagucuugcuuuguca

SEQ ID NO: 59391 - RNA, 21 nt, Homo sapiens
gagaggauucgccagccucuu

SEQ ID NO: 59392 - RNA, 22 nt, Homo sapiens
gagagguaguuuuuuggucguc

SEQ ID NO: 59393 - RNA, 22 nt, Homo sapiens
gagauauucugguuuacuaaau

SEQ ID NO: 59394 - RNA, 22 nt, Homo sapiens
gagcaucaauggcaugugggaa

SEQ ID NO: 59395 - RNA, 22 nt, Homo sapiens
gagcugccuugccuaugcaaga

SEQ ID NO: 59396 - RNA, 22 nt, Homo sapiens
gaggaaguaauuuuaggccugu

SEQ ID NO: 59397 - RNA, 22 nt, Homo sapiens
gaggcagucuguccauucucag

SEQ ID NO: 59398 - RNA, 22 nt, Homo sapiens
gagguaagaaagucaguccuuc

SEQ ID NO: 59399 - RNA, 22 nt, Homo sapiens
gagguagagacuauguauuaga

SEQ ID NO: 59400 - RNA, 21 nt, Homo sapiens
gagguagggauuaaagaccuc

SEQ ID NO: 59401 - RNA, 22 nt, Homo sapiens
gagguagguacaauugccacca

SEQ ID NO: 59402 - RNA, 22 nt, Homo sapiens
gagguaugauugacauauaaaa

SEQ ID NO: 59403 - RNA, 22 nt, Homo sapiens
gaggucaugucgggccccagga

SEQ ID NO: 59404 - RNA, 22 nt, Homo sapiens
gagguggugguggaggcauagc

SEQ ID NO: 59405 - RNA, 22 nt, Homo sapiens
gaguaaaugucacuguugcugu

SEQ ID NO: 59406 - RNA, 22 nt, Homo sapiens
gaguagaacugguuaucuaaua

SEQ ID NO: 59407 - RNA, 22 nt, Homo sapiens
gaguagugcuguaauaaacaua

SEQ ID NO: 59408 - RNA, 22 nt, Homo sapiens
gagugcaaagguccugaggugg

SEQ ID NO: 59409 - RNA, 21 nt, Homo sapiens
gagugcaaauaaagagagggc

SEQ ID NO: 59410 - RNA, 22 nt, Homo sapiens
gagugcaauggugccaucucgg

SEQ ID NO: 59411 - RNA, 22 nt, Homo sapiens
gagugcugagcccacuuccuug

SEQ ID NO: 59412 - RNA, 23 nt, Homo sapiens
gaguggagacucauugauuuccu

SEQ ID NO: 59413 - RNA, 22 nt, Homo sapiens
gaguuuguaaacuauucacuaa

SEQ ID NO: 59414 - RNA, 22 nt, Homo sapiens
guguucaaauucugacagagag

SEQ ID NO: 59415 - RNA, 22 nt, Homo sapiens
guuaaugcuggaauaaguuaag

SEQ ID NO: 59416 - RNA, 22 nt, Homo sapiens
guuaugcagcuuagaaaaugaa

SEQ ID NO: 59417 - RNA, 22 nt, Homo sapiens
guucaagugauucuacugccuc

SEQ ID NO: 59418 - RNA, 22 nt, Homo sapiens
guucaaguuuucucuugugggu

SEQ ID NO: 59419 - RNA, 22 nt, Homo sapiens
guucacacuugcaaccccagca

SEQ ID NO: 59420 - RNA, 20 nt, Homo sapiens
guucacaggcuuccuuucag

SEQ ID NO: 59421 - RNA, 22 nt, Homo sapiens
guucaucaggcuuucucuagag

SEQ ID NO: 59422 - RNA, 22 nt, Homo sapiens
guugagcaaacagcuuaacagu

SEQ ID NO: 59423 - RNA, 22 nt, Homo sapiens
guugcaaaguaauugugguuuu

SEQ ID NO: 59424 - RNA, 22 nt, Homo sapiens
guugccuaggcuggagugcagu

SEQ ID NO: 59425 - RNA, 22 nt, Homo sapiens
guugcucaggcuggagugcagu

SEQ ID NO: 59426 - RNA, 22 nt, Homo sapiens
guuggcaaguggcugagcuggg

SEQ ID NO: 59427 - RNA, 22 nt, Homo sapiens
guugguauuacagaaauuaguu

SEQ ID NO: 59428 - RNA, 21 nt, Homo sapiens
uaaaacuguaacuuuguccug

SEQ ID NO: 59429 - RNA, 22 nt, Homo sapiens
uaaaagucaucacaacuggagu

SEQ ID NO: 59430 - RNA, 22 nt, Homo sapiens
uaaacacucacuucauagccau

SEQ ID NO: 59431 - RNA, 22 nt, Homo sapiens
uaaacugcuugaggguaaguac

SEQ ID NO: 59432 - RNA, 22 nt, Homo sapiens
uaaagagcuuuugaggugucau

SEQ ID NO: 59433 - RNA, 22 nt, Homo sapiens
uaaagauaaggcucgcuuggau

SEQ ID NO: 59434 - RNA, 22 nt, Homo sapiens
uaaagccagugauuaugucucu

SEQ ID NO: 59435 - RNA, 22 nt, Homo sapiens
uaaagcuuagauccaugguggc

SEQ ID NO: 59436 - RNA, 22 nt, Homo sapiens
uaaagcuuggauuuaggcuaau

SEQ ID NO: 59437 - RNA, 18 nt, Homo sapiens
uaaaggcacuguguuguu

SEQ ID NO: 59438 - RNA, 22 nt, Homo sapiens
uaaagugaggauggcaguaggu

SEQ ID NO: 59439 - RNA, 21 nt, Homo sapiens
uaaaugucauacaaagcaaug

SEQ ID NO: 59440 - RNA, 22 nt, Homo sapiens
uaacagcucuacagcugcucuu

SEQ ID NO: 59441 - RNA, 22 nt, Homo sapiens
uaacaggcaaggucacaccuug

SEQ ID NO: 59442 - RNA, 22 nt, Homo sapiens
uaacaguauaugugguaucuau

SEQ ID NO: 59443 - RNA, 22 nt, Homo sapiens
uaacauuguugauuauacuaag

SEQ ID NO: 59444 - RNA, 22 nt, Homo sapiens
uaacuacuucugcuucagagua

SEQ ID NO: 59445 - RNA, 22 nt, Homo sapiens
uaacuaguggaauuugauuuca

SEQ ID NO: 59446 - RNA, 22 nt, Homo sapiens
uaacugcaaccuccgccucccg

SEQ ID NO: 59447 - RNA, 22 nt, Homo sapiens
uaagaugaaggcucaccuagaa

SEQ ID NO: 59448 - RNA, 22 nt, Homo sapiens
uaagcaguaaaugaagucuugc

SEQ ID NO: 59449 - RNA, 22 nt, Homo sapiens
uaagcagugcaagaauggaaua

SEQ ID NO: 59450 - RNA, 18 nt, Homo sapiens
uaaggcacuauaggcauu

SEQ ID NO: 59451 - RNA, 20 nt, Homo sapiens
uaaggcacugugcuuuuagg

SEQ ID NO: 59452 - RNA, 22 nt, Homo sapiens
uaagguauuuacauuucuguuu

SEQ ID NO: 59453 - RNA, 22 nt, Homo sapiens
uaagguuacaaaggacuucaua

SEQ ID NO: 59454 - RNA, 22 nt, Homo sapiens
uaaguaaaugaaagguugauuu

SEQ ID NO: 59455 - RNA, 22 nt, Homo sapiens
uaaguauagguaacagaagcaa

SEQ ID NO: 59456 - RNA, 22 nt, Homo sapiens
uaaguauuaugugcugcauuuu

SEQ ID NO: 59457 - RNA, 23 nt, Homo sapiens
uaagucacacagauuaauuuauu

SEQ ID NO: 59458 - RNA, 20 nt, Homo sapiens
uaagugcuugagacuucuga

SEQ ID NO: 59459 - RNA, 22 nt, Homo sapiens
uaauacucuucucauuuuacag

SEQ ID NO: 59460 - RNA, 22 nt, Homo sapiens
uaauauguauacagacagauac

SEQ ID NO: 59461 - RNA, 22 nt, Homo sapiens
uaauucacauaaagcacuuaga

SEQ ID NO: 59462 - RNA, 22 nt, Homo sapiens
uacagaguagaagauuugcaga

SEQ ID NO: 59463 - RNA, 19 nt, Homo sapiens
uacaggacugagcugaggu

SEQ ID NO: 59464 - RNA, 22 nt, Homo sapiens
uacaguagagaucagcaaacua

SEQ ID NO: 59465 - RNA, 22 nt, Homo sapiens
uacauguauguguuuauggcug

SEQ ID NO: 59466 - RNA, 22 nt, Homo sapiens
uacaugugcacaacgugcaggu

SEQ ID NO: 59467 - RNA, 23 nt, Homo sapiens
uaccacauuccuucuuuccuguu

SEQ ID NO: 59468 - RNA, 22 nt, Homo sapiens
uaccacauuguagagggcauuc

SEQ ID NO: 59469 - RNA, 19 nt, Homo sapiens
uacccagaagcagcauugu

SEQ ID NO: 59470 - RNA, 22 nt, Homo sapiens
cugaggcacggcgaccuuaagu

SEQ ID NO: 59471 - RNA, 22 nt, Homo sapiens
cugaggguagaaggaucacuug

SEQ ID NO: 59472 - RNA, 22 nt, Homo sapiens
cugagguaggcccugagaauau

SEQ ID NO: 59473 - RNA, 22 nt, Homo sapiens
cugaggugggaggauuggcuug

SEQ ID NO: 59474 - RNA, 22 nt, Homo sapiens
cugauaaguuuuucuuuauaag

SEQ ID NO: 59475 - RNA, 20 nt, Homo sapiens
cugcaaaugcugcugcugau

SEQ ID NO: 59476 - RNA, 22 nt, Homo sapiens
cugcacugagacccucuuugcu

SEQ ID NO: 59477 - RNA, 22 nt, Homo sapiens
cugcaguaaccacuguaggugu

SEQ ID NO: 59478 - RNA, 22 nt, Homo sapiens
cugcauuugaugacguauggug

SEQ ID NO: 59479 - RNA, 22 nt, Homo sapiens
cugcuguuguuaacuuuuggag

SEQ ID NO: 59480 - RNA, 22 nt, Homo sapiens
cuggaauauuagcuggucuuaa

SEQ ID NO: 59481 - RNA, 22 nt, Homo sapiens
cuggaaucuauggauaacaucg

SEQ ID NO: 59482 - RNA, 22 nt, Homo sapiens
cuggagauauuggaagaaagaa

SEQ ID NO: 59483 - RNA, 22 nt, Homo sapiens
cuggagaucuugacauugaagu

SEQ ID NO: 59484 - RNA, 22 nt, Homo sapiens
cuggaguaugauguuagcguug

SEQ ID NO: 59485 - RNA, 22 nt, Homo sapiens
cuggauauguugcaacauuucc

SEQ ID NO: 59486 - RNA, 22 nt, Homo sapiens
cuggcuaagugcuugagugugc

SEQ ID NO: 59487 - RNA, 22 nt, Homo sapiens
cuggcucauuucauuuagcaua

SEQ ID NO: 59488 - RNA, 22 nt, Homo sapiens
cugggauggaggagaauuagag

SEQ ID NO: 59489 - RNA, 22 nt, Homo sapiens
cugucacugggaggggcagcag

SEQ ID NO: 59490 - RNA, 22 nt, Homo sapiens
cugucaucauuucuaugugcca

SEQ ID NO: 59491 - RNA, 22 nt, Homo sapiens
cugugaucuuuuuucauguggu

SEQ ID NO: 59492 - RNA, 19 nt, Homo sapiens
cuguggucauuauuuugcu

SEQ ID NO: 59493 - RNA, 22 nt, Homo sapiens
cuguuaacauguuguggauaau

SEQ ID NO: 59494 - RNA, 22 nt, Homo sapiens
cuguuagguuaaggaauggcaa

SEQ ID NO: 59495 - RNA, 22 nt, Homo sapiens
cuuaacagugguauugaugacc

SEQ ID NO: 59496 - RNA, 22 nt, Homo sapiens
cuuaaguaguuguggaaugaau

SEQ ID NO: 59497 - RNA, 22 nt, Homo sapiens
cuucaaaguuggcuaggagaca

SEQ ID NO: 59498 - RNA, 17 nt, Homo sapiens
cuucaaauaauuucccc

SEQ ID NO: 59499 - RNA, 22 nt, Homo sapiens
cuucaaguaauucugauggcua

SEQ ID NO: 59500 - RNA, 22 nt, Homo sapiens
cuugaccaauauggugaaaccc

SEQ ID NO: 59501 - RNA, 22 nt, Homo sapiens
cuuguacacuguuggugggaau

SEQ ID NO: 59502 - RNA, 22 nt, Homo sapiens
cuugugcaugaccccagguggg

SEQ ID NO: 59503 - RNA, 22 nt, Homo sapiens
cuuguguuacauauuuaagaga

SEQ ID NO: 59504 - RNA, 22 nt, Homo sapiens
cuuuaguugucuccucaagggu

SEQ ID NO: 59505 - RNA, 22 nt, Homo sapiens
cuuugcacaucucugcuuuccc

SEQ ID NO: 59506 - RNA, 21 nt, Homo sapiens
cuuugcacugcuccucagcuc

SEQ ID NO: 59507 - RNA, 22 nt, Homo sapiens
cuuuguggggucuuuccucaaa

SEQ ID NO: 59508 - RNA, 22 nt, Homo sapiens
cuuuguguaggugccucuggcu

SEQ ID NO: 59509 - RNA, 22 nt, Homo sapiens
cuuuguguggacauuucaggca

SEQ ID NO: 59510 - RNA, 22 nt, Homo sapiens
cuuuuacacugguggugggaau

SEQ ID NO: 59511 - RNA, 22 nt, Homo sapiens
cuuuuacacuguuggcaggauu

SEQ ID NO: 59512 - RNA, 23 nt, Homo sapiens
cuuuugcaaugugaucuugccac

SEQ ID NO: 59513 - RNA, 22 nt, Homo sapiens
gaaauggaucagagcaagcuuu

SEQ ID NO: 59514 - RNA, 22 nt, Homo sapiens
gaaauguuuuucaugugggcaa

SEQ ID NO: 59515 - RNA, 22 nt, Homo sapiens
gaaggagcuuaucugccauuuc

SEQ ID NO: 59516 - RNA, 22 nt, Homo sapiens
gaagguauauucuguuaaugcu

SEQ ID NO: 59517 - RNA, 17 nt, Homo sapiens
gacauaggaaaaggaga

SEQ ID NO: 59518 - RNA, 22 nt, Homo sapiens
gacccucuagagggaagcgcuu

SEQ ID NO: 59519 - RNA, 22 nt, Homo sapiens
gacccucuagauggaagcacug

SEQ ID NO: 59520 - RNA, 22 nt, Homo sapiens
gacccuuagaaugugaucuuau

SEQ ID NO: 59521 - RNA, 22 nt, Homo sapiens
gacucuguagacaaucacaucu

SEQ ID NO: 59522 - RNA, 22 nt, Homo sapiens
gagaacagaagcauuccuaauu

SEQ ID NO: 59523 - RNA, 22 nt, Homo sapiens
gagaacaguguuguauuuuuuc

SEQ ID NO: 59524 - RNA, 22 nt, Homo sapiens
gagaacauacggcauuugguuu

SEQ ID NO: 59525 - RNA, 22 nt, Homo sapiens
gagaaccuccagcaagguagua

SEQ ID NO: 59526 - RNA, 22 nt, Homo sapiens
gagaaguaaauuuauuugcaaa

SEQ ID NO: 59527 - RNA, 22 nt, Homo sapiens
gagaaugagaggggaaggccac

SEQ ID NO: 59528 - RNA, 22 nt, Homo sapiens
augagaauguaaguuaaugaaa

SEQ ID NO: 59529 - RNA, 22 nt, Homo sapiens
augagauaaaccaucucuuaag

SEQ ID NO: 59530 - RNA, 22 nt, Homo sapiens
augagauacuacaaaugaguuu

SEQ ID NO: 59531 - RNA, 22 nt, Homo sapiens
augagaucaaauuuaagcuguu

SEQ ID NO: 59532 - RNA, 22 nt, Homo sapiens
augagaucugugaacaccuguc

SEQ ID NO: 59533 - RNA, 22 nt, Homo sapiens
augagaugcaagauuagauggg

SEQ ID NO: 59534 - RNA, 22 nt, Homo sapiens
augagcagaugcuccugccucu

SEQ ID NO: 59535 - RNA, 22 nt, Homo sapiens
augagcuauggagacagggcca

SEQ ID NO: 59536 - RNA, 22 nt, Homo sapiens
augaguugaagcuacaagaggc

SEQ ID NO: 59537 - RNA, 22 nt, Homo sapiens
augauacuguucuaagauuuuu

SEQ ID NO: 59538 - RNA, 22 nt, Homo sapiens
augaucauggaaguuuuccugu

SEQ ID NO: 59539 - RNA, 22 nt, Homo sapiens
augcaaacaucauagaguguac

SEQ ID NO: 59540 - RNA, 22 nt, Homo sapiens
augcaaacaucugaagagacau

SEQ ID NO: 59541 - RNA, 20 nt, Homo sapiens
augcaaacccugcuuugugg

SEQ ID NO: 59542 - RNA, 22 nt, Homo sapiens
augcagagucccagccccuagc

SEQ ID NO: 59543 - RNA, 22 nt, Homo sapiens
augcagcugaggguaguggagc

SEQ ID NO: 59544 - RNA, 22 nt, Homo sapiens
augcauauuuuaccuagaagag

SEQ ID NO: 59545 - RNA, 22 nt, Homo sapiens
augcuggugguucacaugcgca

SEQ ID NO: 59546 - RNA, 21 nt, Homo sapiens
auggacaugguuaggcuuugu

SEQ ID NO: 59547 - RNA, 22 nt, Homo sapiens
auggagaugaacuuggguaaag

SEQ ID NO: 59548 - RNA, 22 nt, Homo sapiens
auggagaugugcgaacugagua

SEQ ID NO: 59549 - RNA, 22 nt, Homo sapiens
auggcaaugcgauggugacuga

SEQ ID NO: 59550 - RNA, 22 nt, Homo sapiens
auggcacagaguagaugcucaa

SEQ ID NO: 59551 - RNA, 22 nt, Homo sapiens
auggcagaaucaagccgacagc

SEQ ID NO: 59552 - RNA, 22 nt, Homo sapiens
auggccauuacuaagaauguuu

SEQ ID NO: 59553 - RNA, 22 nt, Homo sapiens
auggcccugcuaccacuuuucu

SEQ ID NO: 59554 - RNA, 22 nt, Homo sapiens
auggcucaguguguaucuauca

SEQ ID NO: 59555 - RNA, 22 nt, Homo sapiens
auggcucuggauagaaugcagg

SEQ ID NO: 59556 - RNA, 22 nt, Homo sapiens
auggcugagugauuucaaacag

SEQ ID NO: 59557 - RNA, 22 nt, Homo sapiens
auggcuuuuuucuugggcacuc

SEQ ID NO: 59558 - RNA, 21 nt, Homo sapiens
augggacuaacugaugggucu

SEQ ID NO: 59559 - RNA, 22 nt, Homo sapiens
augggcacugauguauucugug

SEQ ID NO: 59560 - RNA, 22 nt, Homo sapiens
augguacuagaguaagaauugu

SEQ ID NO: 59561 - RNA, 22 nt, Homo sapiens
augguauuuaacagucuuucua

SEQ ID NO: 59562 - RNA, 22 nt, Homo sapiens
auguaaacauuuggucuaaauu

SEQ ID NO: 59563 - RNA, 22 nt, Homo sapiens
augucacagguccuagccaagu

SEQ ID NO: 59564 - RNA, 22 nt, Homo sapiens
auguccuggacccagacaaagc

SEQ ID NO: 59565 - RNA, 22 nt, Homo sapiens
augugacagugguuuuaagcgu

SEQ ID NO: 59566 - RNA, 22 nt, Homo sapiens
augugacugauguaaucagaca

SEQ ID NO: 59567 - RNA, 22 nt, Homo sapiens
augugcaauggugucaccacau

SEQ ID NO: 59568 - RNA, 22 nt, Homo sapiens
augugcaauguguacguagccc

SEQ ID NO: 59569 - RNA, 22 nt, Homo sapiens
augugcacaugcuuacauguga

SEQ ID NO: 59570 - RNA, 22 nt, Homo sapiens
augugcauaugaagcacagaca

SEQ ID NO: 59571 - RNA, 22 nt, Homo sapiens
augugccauucucauggcgcuu

SEQ ID NO: 59572 - RNA, 22 nt, Homo sapiens
augugcuugagggaaaucaguu

SEQ ID NO: 59573 - RNA, 22 nt, Homo sapiens
auguggcuuuucaacuguguga

SEQ ID NO: 59574 - RNA, 22 nt, Homo sapiens
auguguaaagcuuuucuuuguu

SEQ ID NO: 59575 - RNA, 22 nt, Homo sapiens
auuaaguugugccugaaaacuu

SEQ ID NO: 59576 - RNA, 22 nt, Homo sapiens
auuacuuugcaccaaccuaaua

SEQ ID NO: 59577 - RNA, 22 nt, Homo sapiens
auuauaugucaucacagacacc

SEQ ID NO: 59578 - RNA, 23 nt, Homo sapiens
auucaaguagugagagugguuau

SEQ ID NO: 59579 - RNA, 22 nt, Homo sapiens
auucaagugaugugauucuucu

SEQ ID NO: 59580 - RNA, 22 nt, Homo sapiens
guacaggugcaggaugggcagg

SEQ ID NO: 59581 - RNA, 22 nt, Homo sapiens
guagaucucaacacuggaagua

SEQ ID NO: 59582 - RNA, 22 nt, Homo sapiens
guagcagaacauguuccuugua

SEQ ID NO: 59583 - RNA, 22 nt, Homo sapiens
guagcagucacauagcagauug

SEQ ID NO: 59584 - RNA, 22 nt, Homo sapiens
guaguggcaugaucuuggcuca

SEQ ID NO: 59585 - RNA, 22 nt, Homo sapiens
guauaggcuuucaccacgccau

SEQ ID NO: 59586 - RNA, 22 nt, Homo sapiens
gucaaguaaauguuaugguuau

SEQ ID NO: 59587 - RNA, 22 nt, Homo sapiens
gucaagugaagaccugacucuu

SEQ ID NO: 59588 - RNA, 22 nt, Homo sapiens
gucacaguggccagugauguuc

SEQ ID NO: 59589 - RNA, 22 nt, Homo sapiens
gucacaguguuuguucauccca

SEQ ID NO: 59590 - RNA, 22 nt, Homo sapiens
gucagcuuguccagagacucug

SEQ ID NO: 59591 - RNA, 22 nt, Homo sapiens
gucaguggagaaaaggacaugu

SEQ ID NO: 59592 - RNA, 21 nt, Homo sapiens
guccaaaacaguguccaaugc

SEQ ID NO: 59593 - RNA, 22 nt, Homo sapiens
guccaguuguuuucugagguug

SEQ ID NO: 59594 - RNA, 22 nt, Homo sapiens
gucccagagauauugugucuuu

SEQ ID NO: 59595 - RNA, 22 nt, Homo sapiens
gucucagugcgaaucucaaaga

SEQ ID NO: 59596 - RNA, 22 nt, Homo sapiens
gucuuccagccuccaucuuucu

SEQ ID NO: 59597 - RNA, 22 nt, Homo sapiens
gucuugaaggcugaguaccugu

SEQ ID NO: 59598 - RNA, 22 nt, Homo sapiens
gucuuggagaacucagcuuggc

SEQ ID NO: 59599 - RNA, 22 nt, Homo sapiens
gucuuuggaaagacaaaguuca

SEQ ID NO: 59600 - RNA, 17 nt, Homo sapiens
gucuuugguugaguuua

SEQ ID NO: 59601 - RNA, 22 nt, Homo sapiens
gugaaagcaucugacugugcca

SEQ ID NO: 59602 - RNA, 22 nt, Homo sapiens
gugagguaauuagcucccuuag

SEQ ID NO: 59603 - RNA, 20 nt, Homo sapiens
gugagguagaggguuaccug

SEQ ID NO: 59604 - RNA, 22 nt, Homo sapiens
gugaggucagggcuguggacag

SEQ ID NO: 59605 - RNA, 22 nt, Homo sapiens
gugcaaacuccaggucucuuca

SEQ ID NO: 59606 - RNA, 22 nt, Homo sapiens
gugcaaauguuauugagguuuu

SEQ ID NO: 59607 - RNA, 22 nt, Homo sapiens
gugcaaugaguguggcaaagcc

SEQ ID NO: 59608 - RNA, 22 nt, Homo sapiens
gugcaaugucaggagaugcagc

SEQ ID NO: 59609 - RNA, 22 nt, Homo sapiens
gugcacaacgugcagguuaguu

SEQ ID NO: 59610 - RNA, 22 nt, Homo sapiens
gugcacaacgugcagguuuguu

SEQ ID NO: 59611 - RNA, 22 nt, Homo sapiens
gugccuuuucugagcaaugagc

SEQ ID NO: 59612 - RNA, 22 nt, Homo sapiens
gugcgggaggcgcgccuaggug

SEQ ID NO: 59613 - RNA, 22 nt, Homo sapiens
guggaaaaguaguugcgguuuu

SEQ ID NO: 59614 - RNA, 22 nt, Homo sapiens
guggagacaaaggcugagugag

SEQ ID NO: 59615 - RNA, 22 nt, Homo sapiens
guggcacaauuaaguagcuauu

SEQ ID NO: 59616 - RNA, 22 nt, Homo sapiens
guggcauuucccaaaguauucu

SEQ ID NO: 59617 - RNA, 21 nt, Homo sapiens
guggccuuuggagcaugucag

SEQ ID NO: 59618 - RNA, 22 nt, Homo sapiens
gugggauggaaaugggcuucag

SEQ ID NO: 59619 - RNA, 22 nt, Homo sapiens
gugggguaggguaggacucaac

SEQ ID NO: 59620 - RNA, 22 nt, Homo sapiens
gugguuuuuaaaguaccugugg

SEQ ID NO: 59621 - RNA, 22 nt, Homo sapiens
guguaauacacacauauaugca

SEQ ID NO: 59622 - RNA, 22 nt, Homo sapiens
cacugcauggucuagcuggguu

SEQ ID NO: 59623 - RNA, 22 nt, Homo sapiens
cacuguggauggaacuauguga

SEQ ID NO: 59624 - RNA, 22 nt, Homo sapiens
cacuuugguucaccugaguuuc

SEQ ID NO: 59625 - RNA, 22 nt, Homo sapiens
cagagagcuugcccuuguauau

SEQ ID NO: 59626 - RNA, 22 nt, Homo sapiens
cagagcaaugcuuuugcuuuga

SEQ ID NO: 59627 - RNA, 22 nt, Homo sapiens
cagagcacuaaagguaaaaggc

SEQ ID NO: 59628 - RNA, 22 nt, Homo sapiens
cagagucaagcucuuguuccau

SEQ ID NO: 59629 - RNA, 22 nt, Homo sapiens
cagagugcauguuuagaugagu

SEQ ID NO: 59630 - RNA, 22 nt, Homo sapiens
cagauacuccuggucucaggag

SEQ ID NO: 59631 - RNA, 22 nt, Homo sapiens
cagaugcaugaccugggcuugg

SEQ ID NO: 59632 - RNA, 22 nt, Homo sapiens
cagauggucuuaaggcagccuu

SEQ ID NO: 59633 - RNA, 20 nt, Homo sapiens
cagcacgcacaugagacugu

SEQ ID NO: 59634 - RNA, 22 nt, Homo sapiens
cagcuaaauuguuaaauccaag

SEQ ID NO: 59635 - RNA, 23 nt, Homo sapiens
cagcucauuuggguccccuuguc

SEQ ID NO: 59636 - RNA, 22 nt, Homo sapiens
cagcuugugguauugcugguug

SEQ ID NO: 59637 - RNA, 22 nt, Homo sapiens
caggaccucuugccuggaagcc

SEQ ID NO: 59638 - RNA, 22 nt, Homo sapiens
caggcagucuggcucccaagug

SEQ ID NO: 59639 - RNA, 22 nt, Homo sapiens
cagggcauuggcugguaccugg

SEQ ID NO: 59640 - RNA, 22 nt, Homo sapiens
cagguacuucugggcugagcag

SEQ ID NO: 59641 - RNA, 22 nt, Homo sapiens
cagguaggccaauguuuuccaa

SEQ ID NO: 59642 - RNA, 22 nt, Homo sapiens
cagguaguauuugguuacauaa

SEQ ID NO: 59643 - RNA, 22 nt, Homo sapiens
cagucacagugacaggaugugg

SEQ ID NO: 59644 - RNA, 22 nt, Homo sapiens
cagugcaaccuccaucucucgg

SEQ ID NO: 59645 - RNA, 22 nt, Homo sapiens
cagugcuuguuauuguucuauu

SEQ ID NO: 59646 - RNA, 22 nt, Homo sapiens
cagugucugcauuuggaacuca

SEQ ID NO: 59647 - RNA, 22 nt, Homo sapiens
caguugguguacauauauguau

SEQ ID NO: 59648 - RNA, 22 nt, Homo sapiens
cauacaguaggcacuauuugua

SEQ ID NO: 59649 - RNA, 22 nt, Homo sapiens
cauaugguuuuauguucuucau

SEQ ID NO: 59650 - RNA, 22 nt, Homo sapiens
cauauucacuuuacagagcugu

SEQ ID NO: 59651 - RNA, 21 nt, Homo sapiens
caucaaauugucauggugggu

SEQ ID NO: 59652 - RNA, 22 nt, Homo sapiens
caucacagcaaguagggagugg

SEQ ID NO: 59653 - RNA, 22 nt, Homo sapiens
caucacaucugcaugguaagua

SEQ ID NO: 59654 - RNA, 22 nt, Homo sapiens
caucacaugcuuauuuuccuca

SEQ ID NO: 59655 - RNA, 20 nt, Homo sapiens
caucaccuggcaggauuugu

SEQ ID NO: 59656 - RNA, 19 nt, Homo sapiens
caucccugagcugaagugg

SEQ ID NO: 59657 - RNA, 22 nt, Homo sapiens
caucucauugaauugcugagca

SEQ ID NO: 59658 - RNA, 22 nt, Homo sapiens
caugacacuggcauguuucuuu

SEQ ID NO: 59659 - RNA, 22 nt, Homo sapiens
caugucuuuuauucugugugau

SEQ ID NO: 59660 - RNA, 22 nt, Homo sapiens
cauugcacuccagcccuggcaa

SEQ ID NO: 59661 - RNA, 22 nt, Homo sapiens
cauugcacuccagccuggccaa

SEQ ID NO: 59662 - RNA, 22 nt, Homo sapiens
cauugcagauccuucaaaugac

SEQ ID NO: 59663 - RNA, 22 nt, Homo sapiens
cauuggugauuagugaaugaac

SEQ ID NO: 59664 - RNA, 22 nt, Homo sapiens
cauugguuaguuaacuuuaaga

SEQ ID NO: 59665 - RNA, 22 nt, Homo sapiens
cauugguuggacaguucucucu

SEQ ID NO: 59666 - RNA, 22 nt, Homo sapiens
ccaaguguucucauuguucaau

SEQ ID NO: 59667 - RNA, 22 nt, Homo sapiens
ccacaaccucaacagcaucuau

SEQ ID NO: 59668 - RNA, 22 nt, Homo sapiens
ccacaguggauuaaaguuacug

SEQ ID NO: 59669 - RNA, 22 nt, Homo sapiens
ccacaguugaaauuuugacugu

SEQ ID NO: 59670 - RNA, 19 nt, Homo sapiens
ccaguguucugauugcacu

SEQ ID NO: 59671 - RNA, 22 nt, Homo sapiens
ccaguuuucccagcaccauuaa

SEQ ID NO: 59672 - RNA, 22 nt, Homo sapiens
uacagucuagaggagaaucagg

SEQ ID NO: 59673 - RNA, 22 nt, Homo sapiens
uacaguggugugaucucagcuc

SEQ ID NO: 59674 - RNA, 22 nt, Homo sapiens
uacauguauccauuguuuuugg

SEQ ID NO: 59675 - RNA, 22 nt, Homo sapiens
uacaugugccauguugguuugc

SEQ ID NO: 59676 - RNA, 22 nt, Homo sapiens
uaccaugaagguggagagagaa

SEQ ID NO: 59677 - RNA, 22 nt, Homo sapiens
uacccuuuaguauaaaaucaga

SEQ ID NO: 59678 - RNA, 22 nt, Homo sapiens
uacgccuguaauaucagcauuu

SEQ ID NO: 59679 - RNA, 16 nt, Homo sapiens
uacuacugccuauuau

SEQ ID NO: 59680 - RNA, 22 nt, Homo sapiens
uacuccccuuguucugugagcu

SEQ ID NO: 59681 - RNA, 22 nt, Homo sapiens
uacugcacuccaaccugagaga

SEQ ID NO: 59682 - RNA, 22 nt, Homo sapiens
uacugcacuccacccuggguga

SEQ ID NO: 59683 - RNA, 22 nt, Homo sapiens
uacugcacucuagccuggguga

SEQ ID NO: 59684 - RNA, 22 nt, Homo sapiens
uacugcuuaagggcaugggccc

SEQ ID NO: 59685 - RNA, 22 nt, Homo sapiens
uagaauggaaggcauguuugcc

SEQ ID NO: 59686 - RNA, 20 nt, Homo sapiens
uagagagauauggggguucc

SEQ ID NO: 59687 - RNA, 22 nt, Homo sapiens
uagaucaacuuugguaagagaa

SEQ ID NO: 59688 - RNA, 22 nt, Homo sapiens
uagaucacucaggcaauaaaag

SEQ ID NO: 59689 - RNA, 17 nt, Homo sapiens
uagcacagugccuggua

SEQ ID NO: 59690 - RNA, 22 nt, Homo sapiens
uagcacuauuuauugaaaagga

SEQ ID NO: 59691 - RNA, 18 nt, Homo sapiens
uagcagacaucauugggg

SEQ ID NO: 59692 - RNA, 19 nt, Homo sapiens
uagcuagauuggguacuua

SEQ ID NO: 59693 - RNA, 22 nt, Homo sapiens
uagcugcugcuaggcuaaggau

SEQ ID NO: 59694 - RNA, 22 nt, Homo sapiens
uagcuucuccauagcuccaugu

SEQ ID NO: 59695 - RNA, 22 nt, Homo sapiens
uaggaaguacaucucagaaucu

SEQ ID NO: 59696 - RNA, 22 nt, Homo sapiens
uaggagcacagcagcauguggg

SEQ ID NO: 59697 - RNA, 22 nt, Homo sapiens
uaggcuuuuggacccugucucu

SEQ ID NO: 59698 - RNA, 22 nt, Homo sapiens
uagggcauuuagaggcuauuaa

SEQ ID NO: 59699 - RNA, 22 nt, Homo sapiens
uagguacuuuacauguuaucuc

SEQ ID NO: 59700 - RNA, 22 nt, Homo sapiens
uagguagaaucuugaagccauu

SEQ ID NO: 59701 - RNA, 22 nt, Homo sapiens
uagguagcuuuggcguuucuug

SEQ ID NO: 59702 - RNA, 22 nt, Homo sapiens
uagugcaguggcuccaucucag

SEQ ID NO: 59703 - RNA, 18 nt, Homo sapiens
uagugcuguucucaugau

SEQ ID NO: 59704 - RNA, 22 nt, Homo sapiens
uaguguuuuucauuggcagagg

SEQ ID NO: 59705 - RNA, 22 nt, Homo sapiens
uauacuguuuucuauaguggcu

SEQ ID NO: 59706 - RNA, 22 nt, Homo sapiens
uaucacacaucaugguaaaucu

SEQ ID NO: 59707 - RNA, 22 nt, Homo sapiens
uaucacagcauugucuauaaua

SEQ ID NO: 59708 - RNA, 22 nt, Homo sapiens
uaucacccuuucauuguucuuc

SEQ ID NO: 59709 - RNA, 22 nt, Homo sapiens
uaucagcagagucauacuucaa

SEQ ID NO: 59710 - RNA, 22 nt, Homo sapiens
uauccugaagcuuuauuuaagu

SEQ ID NO: 59711 - RNA, 22 nt, Homo sapiens
uaugaauuuuauccaggauaua

SEQ ID NO: 59712 - RNA, 22 nt, Homo sapiens
uaugacauaguccuuaacccuc

SEQ ID NO: 59713 - RNA, 22 nt, Homo sapiens
uaugagcacauauguaucuaug

SEQ ID NO: 59714 - RNA, 22 nt, Homo sapiens
uaugaucacuacagcagggaug

SEQ ID NO: 59715 - RNA, 22 nt, Homo sapiens
uaugcccauuuaaauugaacaa

SEQ ID NO: 59716 - RNA, 22 nt, Homo sapiens
uauggccccuacaugugcaaaa

SEQ ID NO: 59717 - RNA, 22 nt, Homo sapiens
uuaccagucugauuccuguuag

SEQ ID NO: 59718 - RNA, 22 nt, Homo sapiens
uuaccugagaaggugacauuug

SEQ ID NO: 59719 - RNA, 22 nt, Homo sapiens
uuacuauguuucaaagugucuc

SEQ ID NO: 59720 - RNA, 22 nt, Homo sapiens
uuagagcacugaucugcucuuu

SEQ ID NO: 59721 - RNA, 22 nt, Homo sapiens
uuagaugaaugucucuuaaaca

SEQ ID NO: 59722 - RNA, 22 nt, Homo sapiens
uuaggcuuuucagacacuucau

SEQ ID NO: 59723 - RNA, 22 nt, Homo sapiens
uuagguaauauauugcugcuuu

SEQ ID NO: 59724 - RNA, 22 nt, Homo sapiens
uuagguauuuuguuaugucagc

SEQ ID NO: 59725 - RNA, 23 nt, Homo sapiens
uuaguaaacucaaugacaccaca

SEQ ID NO: 59726 - RNA, 19 nt, Homo sapiens
uuauauaguuucugaggcu

SEQ ID NO: 59727 - RNA, 22 nt, Homo sapiens
uuauauguuucuguuuggaggc

SEQ ID NO: 59728 - RNA, 22 nt, Homo sapiens
uuauauguuuguacuuaggccu

SEQ ID NO: 59729 - RNA, 22 nt, Homo sapiens
uuauggauuuauauucuguagu

SEQ ID NO: 59730 - RNA, 22 nt, Homo sapiens
uuauugcacuccagccugggua

SEQ ID NO: 59731 - RNA, 22 nt, Homo sapiens
uuauugcuuaugauuagguguu

SEQ ID NO: 59732 - RNA, 22 nt, Homo sapiens
uucaagauggccccagugagcc

SEQ ID NO: 59733 - RNA, 22 nt, Homo sapiens
uucaaguagguaggaccacagg

SEQ ID NO: 59734 - RNA, 22 nt, Homo sapiens
uucaagucaaggaaagaggucu

SEQ ID NO: 59735 - RNA, 22 nt, Homo sapiens
uucaagugaacaaaaugaggag

SEQ ID NO: 59736 - RNA, 22 nt, Homo sapiens
uucaagugguucagaagucuga

SEQ ID NO: 59737 - RNA, 22 nt, Homo sapiens
uucacagagagaacucaaacca

SEQ ID NO: 59738 - RNA, 22 nt, Homo sapiens
uucacaugacagggugaagcau

SEQ ID NO: 59739 - RNA, 22 nt, Homo sapiens
uucacaugguugccuuuugauc

SEQ ID NO: 59740 - RNA, 22 nt, Homo sapiens
uucaccagggaagucucaacuc

SEQ ID NO: 59741 - RNA, 22 nt, Homo sapiens
uucaccuggaguucaggauaag

SEQ ID NO: 59742 - RNA, 22 nt, Homo sapiens
uucaccuugcccacagcagucu

SEQ ID NO: 59743 - RNA, 21 nt, Homo sapiens
uucacuggucuauuucccuuu

SEQ ID NO: 59744 - RNA, 22 nt, Homo sapiens
uucagaugcacacuguagucua

SEQ ID NO: 59745 - RNA, 22 nt, Homo sapiens
uucagcacaguguggaucauuc

SEQ ID NO: 59746 - RNA, 22 nt, Homo sapiens
uucaggguggagaguaugaggu

SEQ ID NO: 59747 - RNA, 22 nt, Homo sapiens
uucauacaguggcugcacucca

SEQ ID NO: 59748 - RNA, 22 nt, Homo sapiens
uucauggagccauccuuugauc

SEQ ID NO: 59749 - RNA, 22 nt, Homo sapiens
uucauggaugcauuugaggggu

SEQ ID NO: 59750 - RNA, 22 nt, Homo sapiens
uucccagagagggacuucuaau

SEQ ID NO: 59751 - RNA, 22 nt, Homo sapiens
uucccugugggaguaggaaagu

SEQ ID NO: 59752 - RNA, 22 nt, Homo sapiens
uucccuuucugccuugaaucuu

SEQ ID NO: 59753 - RNA, 22 nt, Homo sapiens
uucccuuugaauuggaaaggug

SEQ ID NO: 59754 - RNA, 22 nt, Homo sapiens
gauaaaguauuggguacuaugc

SEQ ID NO: 59755 - RNA, 22 nt, Homo sapiens
gauagguucuaagcagguguug

SEQ ID NO: 59756 - RNA, 22 nt, Homo sapiens
gaucacauggccauuucuagcu

SEQ ID NO: 59757 - RNA, 22 nt, Homo sapiens
gaucacaugggagaaugagagu

SEQ ID NO: 59758 - RNA, 22 nt, Homo sapiens
gaucuggagguuuuccucauga

SEQ ID NO: 59759 - RNA, 22 nt, Homo sapiens
gaugagcuaaguucucacagca

SEQ ID NO: 59760 - RNA, 22 nt, Homo sapiens
gaugauguuugauaaauaauaa

SEQ ID NO: 59761 - RNA, 22 nt, Homo sapiens
gauggcacuguagcaacacaaa

SEQ ID NO: 59762 - RNA, 22 nt, Homo sapiens
gauggcagugcagccccuggcu

SEQ ID NO: 59763 - RNA, 22 nt, Homo sapiens
gauguguuuguuucuggaggag

SEQ ID NO: 59764 - RNA, 20 nt, Homo sapiens
gauuagagagaggcugugca

SEQ ID NO: 59765 - RNA, 22 nt, Homo sapiens
gauugcaauuuaggugagagag

SEQ ID NO: 59766 - RNA, 22 nt, Homo sapiens
gauuuguauuaaaagugugacg

SEQ ID NO: 59767 - RNA, 20 nt, Homo sapiens
gcaaauggaucccacaagcc

SEQ ID NO: 59768 - RNA, 22 nt, Homo sapiens
gcaaggacucccugggucauuc

SEQ ID NO: 59769 - RNA, 22 nt, Homo sapiens
gcaaggaugagugcccaugaga

SEQ ID NO: 59770 - RNA, 22 nt, Homo sapiens
gcacaguggcucccgucuauaa

SEQ ID NO: 59771 - RNA, 22 nt, Homo sapiens
gcacgugcacccacaugcacgu

SEQ ID NO: 59772 - RNA, 22 nt, Homo sapiens
gcacugagagaagccccaagua

SEQ ID NO: 59773 - RNA, 19 nt, Homo sapiens
gcagagaugugguagcuug

SEQ ID NO: 59774 - RNA, 22 nt, Homo sapiens
gcagcagugcccuggauggaaa

SEQ ID NO: 59775 - RNA, 22 nt, Homo sapiens
gcagguaguuucugacuuuuac

SEQ ID NO: 59776 - RNA, 22 nt, Homo sapiens
gcaguagugcgaucucagcuca

SEQ ID NO: 59777 - RNA, 22 nt, Homo sapiens
gcauaaagcuaauaagacgaag

SEQ ID NO: 59778 - RNA, 22 nt, Homo sapiens
gcauggccuuuaaaugucacag

SEQ ID NO: 59779 - RNA, 22 nt, Homo sapiens
gccaaaaugcugggauuacagg

SEQ ID NO: 59780 - RNA, 22 nt, Homo sapiens
gccagugugaugugaucauggc

SEQ ID NO: 59781 - RNA, 22 nt, Homo sapiens
gccauugcacuccagcuugggc

SEQ ID NO: 59782 - RNA, 22 nt, Homo sapiens
gccccaguacaggcuccuuaga

SEQ ID NO: 59783 - RNA, 22 nt, Homo sapiens
gcuaggagaucugcugcucucu

SEQ ID NO: 59784 - RNA, 22 nt, Homo sapiens
gcucaugagacaagcaggagua

SEQ ID NO: 59785 - RNA, 22 nt, Homo sapiens
gcugacacugggcuauagaucu

SEQ ID NO: 59786 - RNA, 22 nt, Homo sapiens
gcuggauguuucaauacaaaua

SEQ ID NO: 59787 - RNA, 22 nt, Homo sapiens
gcuguauugacuuuguaucaua

SEQ ID NO: 59788 - RNA, 22 nt, Homo sapiens
gcuguauuguugaaggaaaugu

SEQ ID NO: 59789 - RNA, 22 nt, Homo sapiens
gcugucaugagcaacacaugaa

SEQ ID NO: 59790 - RNA, 22 nt, Homo sapiens
gcugucuggagucuguucaaug

SEQ ID NO: 59791 - RNA, 22 nt, Homo sapiens
gcuuuggauaaaugucaguuua

SEQ ID NO: 59792 - RNA, 22 nt, Homo sapiens
gcuuuguugauggugagucugu

SEQ ID NO: 59793 - RNA, 22 nt, Homo sapiens
ggaaagacaccuuacuauguua

SEQ ID NO: 59794 - RNA, 22 nt, Homo sapiens
ggaaagaucagcuaaauguaag

SEQ ID NO: 59795 - RNA, 22 nt, Homo sapiens
ggaaaguccuucuguaggcucc

SEQ ID NO: 59796 - RNA, 22 nt, Homo sapiens
ggaagaauaaugggccuuagag

SEQ ID NO: 59797 - RNA, 22 nt, Homo sapiens
ggaagccuggaaaaaauuguga

SEQ ID NO: 59798 - RNA, 22 nt, Homo sapiens
ggaagguaauuggguaaugaga

SEQ ID NO: 59799 - RNA, 22 nt, Homo sapiens
ggaagugugaguaggauuugga

SEQ ID NO: 59800 - RNA, 22 nt, Homo sapiens
ggaauguaguaauuugguuagu

SEQ ID NO: 59801 - RNA, 22 nt, Homo sapiens
ggaauugcaucaaaugcaggua

SEQ ID NO: 59802 - RNA, 22 nt, Homo sapiens
ggacaaaguauuuucaaaugua

SEQ ID NO: 59803 - RNA, 22 nt, Homo sapiens
ggacacaucaugugaccaaggu

SEQ ID NO: 59804 - RNA, 22 nt, Homo sapiens
ggacagugaaugccacuccucc

SEQ ID NO: 59805 - RNA, 22 nt, Homo sapiens
ggacugagaggacuacagugua

SEQ ID NO: 59806 - RNA, 22 nt, Homo sapiens
ggaggcuaguaaaaagguagaa

SEQ ID NO: 59807 - RNA, 22 nt, Homo sapiens
ggaguguaguggcuccaucucg

SEQ ID NO: 59808 - RNA, 22 nt, Homo sapiens
ggagugucagaaacaguguccu

SEQ ID NO: 59809 - RNA, 22 nt, Homo sapiens
ggaucacagccagcucccagaa

SEQ ID NO: 59810 - RNA, 22 nt, Homo sapiens
ggauugcuuaagaaguuucauu

SEQ ID NO: 59811 - RNA, 22 nt, Homo sapiens
uugggauggaacuuuucaguga

SEQ ID NO: 59812 - RNA, 21 nt, Homo sapiens
uuggggaauggagagguuuuc

SEQ ID NO: 59813 - RNA, 22 nt, Homo sapiens
uugguuuccuuccugcuuaacu

SEQ ID NO: 59814 - RNA, 22 nt, Homo sapiens
uuguaaacaucuguacauugcu

SEQ ID NO: 59815 - RNA, 22 nt, Homo sapiens
uuguacaggaguguaagcuuca

SEQ ID NO: 59816 - RNA, 22 nt, Homo sapiens
uuguauacucuauuuuagcagu

SEQ ID NO: 59817 - RNA, 22 nt, Homo sapiens
uuguauguuguuugucagagaa

SEQ ID NO: 59818 - RNA, 22 nt, Homo sapiens
uuguauugucuugaugaguuga

SEQ ID NO: 59819 - RNA, 22 nt, Homo sapiens
uuguccccuuccaaaucucaug

SEQ ID NO: 59820 - RNA, 22 nt, Homo sapiens
uuguccuccacauuugaucagu

SEQ ID NO: 59821 - RNA, 22 nt, Homo sapiens
uuguccuggagguucuugcaag

SEQ ID NO: 59822 - RNA, 22 nt, Homo sapiens
uugugaagaugugaagcaagca

SEQ ID NO: 59823 - RNA, 22 nt, Homo sapiens
uugugagggagcuaagaugagu

SEQ ID NO: 59824 - RNA, 20 nt, Homo sapiens
uugugcauugggccauuggg

SEQ ID NO: 59825 - RNA, 22 nt, Homo sapiens
uuguguuugaugcugacacgca

SEQ ID NO: 59826 - RNA, 22 nt, Homo sapiens
uuguugcacugcuuuccuggcc

SEQ ID NO: 59827 - RNA, 22 nt, Homo sapiens
uuuaaagcaugacgagaagaag

SEQ ID NO: 59828 - RNA, 22 nt, Homo sapiens
uuuaacauuggaugagaucguc

SEQ ID NO: 59829 - RNA, 22 nt, Homo sapiens
uuuaaugcugcccagucauggg

SEQ ID NO: 59830 - RNA, 22 nt, Homo sapiens
uuuacagucuuuugugugaguc

SEQ ID NO: 59831 - RNA, 22 nt, Homo sapiens
uuuagcagcaaagagccaugcu

SEQ ID NO: 59832 - RNA, 22 nt, Homo sapiens
uuuauagucaggaacuugagga

SEQ ID NO: 59833 - RNA, 22 nt, Homo sapiens
uuuaucuguuuaaaacuguuca

SEQ ID NO: 59834 - RNA, 22 nt, Homo sapiens
uuucaagugcugucuuagcugu

SEQ ID NO: 59835 - RNA, 22 nt, Homo sapiens
uuucauagccuucuaaugaguu

SEQ ID NO: 59836 - RNA, 22 nt, Homo sapiens
uuucauggaauauagucauuuu

SEQ ID NO: 59837 - RNA, 18 nt, Homo sapiens
uuucauugagugugauau

SEQ ID NO: 59838 - RNA, 19 nt, Homo sapiens
uuucccugcagaccuacua

SEQ ID NO: 59839 - RNA, 22 nt, Homo sapiens
uuucccuuacuuaaacuuacuc

SEQ ID NO: 59840 - RNA, 20 nt, Homo sapiens
uuucuccccuauaaaucuca

SEQ ID NO: 59841 - RNA, 22 nt, Homo sapiens
uuucugagaccaaaacuuguaa

SEQ ID NO: 59842 - RNA, 22 nt, Homo sapiens
uuucugcuugagagaauugcug

SEQ ID NO: 59843 - RNA, 22 nt, Homo sapiens
uuugaagacuacugggagugaa

SEQ ID NO: 59844 - RNA, 22 nt, Homo sapiens
uuugauguugauacuaccuuca

SEQ ID NO: 59845 - RNA, 22 nt, Homo sapiens
gucaaggaauuuauccauuucu

SEQ ID NO: 59846 - RNA, 22 nt, Homo sapiens
gucacggaauguaaguggaagu

SEQ ID NO: 59847 - RNA, 22 nt, Homo sapiens
gucagcaaagaggaauaguuug

SEQ ID NO: 59848 - RNA, 22 nt, Homo sapiens
gucagguaccugaaagcagcca

SEQ ID NO: 59849 - RNA, 22 nt, Homo sapiens
gucagugucuuaacagagauua

SEQ ID NO: 59850 - RNA, 22 nt, Homo sapiens
gucaguuucacucagcuggaac

SEQ ID NO: 59851 - RNA, 22 nt, Homo sapiens
gucauggaacaacuuaaaguca

SEQ ID NO: 59852 - RNA, 22 nt, Homo sapiens
gucauggacaaggugugagcca

SEQ ID NO: 59853 - RNA, 22 nt, Homo sapiens
gucauggagggacauaacuaac

SEQ ID NO: 59854 - RNA, 22 nt, Homo sapiens
gucaugucugcacauaguaaaa

SEQ ID NO: 59855 - RNA, 22 nt, Homo sapiens
gucauucauucagcaagcacug

SEQ ID NO: 59856 - RNA, 22 nt, Homo sapiens
gucauugagucagggaguaucu

SEQ ID NO: 59857 - RNA, 22 nt, Homo sapiens
guccaagacuaggaguuggcag

SEQ ID NO: 59858 - RNA, 22 nt, Homo sapiens
guccugaagaccuuccucugga

SEQ ID NO: 59859 - RNA, 22 nt, Homo sapiens
gucuaguuuuaauacauuaaga

SEQ ID NO: 59860 - RNA, 22 nt, Homo sapiens
gucucccagccuacauauuucu

SEQ ID NO: 59861 - RNA, 22 nt, Homo sapiens
gucucccagccuacaucuuucu

SEQ ID NO: 59862 - RNA, 22 nt, Homo sapiens
gucucuugguuuagagcauuua

SEQ ID NO: 59863 - RNA, 22 nt, Homo sapiens
gucugagcauggggccggcagg

SEQ ID NO: 59864 - RNA, 22 nt, Homo sapiens
gucuggcuuaucucacuuacca

SEQ ID NO: 59865 - RNA, 22 nt, Homo sapiens
gucugguugacagcauguggcc

SEQ ID NO: 59866 - RNA, 22 nt, Homo sapiens
gucugucuuuugucuuugaaau

SEQ ID NO: 59867 - RNA, 22 nt, Homo sapiens
gucuuuaguugaaacauguggu

SEQ ID NO: 59868 - RNA, 22 nt, Homo sapiens
gugaaagacagcauuaauggcu

SEQ ID NO: 59869 - RNA, 22 nt, Homo sapiens
gugaaauguguagaggaucugg

SEQ ID NO: 59870 - RNA, 22 nt, Homo sapiens
gugaccauuugacauauccuug

SEQ ID NO: 59871 - RNA, 22 nt, Homo sapiens
gugacugcauccauccaggcuu

SEQ ID NO: 59872 - RNA, 22 nt, Homo sapiens
gugagaggaggcagcuuuuaca

SEQ ID NO: 59873 - RNA, 22 nt, Homo sapiens
gugagauccucucuuauauggg

SEQ ID NO: 59874 - RNA, 22 nt, Homo sapiens
gugagaugugacuucugccucu

SEQ ID NO: 59875 - RNA, 22 nt, Homo sapiens
gugaggaaggaaaccugcuagc

SEQ ID NO: 59876 - RNA, 22 nt, Homo sapiens
gugagggaugugaaaaagguca

SEQ ID NO: 59877 - RNA, 22 nt, Homo sapiens
gugcaacaucccuccauaauuu

SEQ ID NO: 59878 - RNA, 22 nt, Homo sapiens
gugcaaguguaauacagcuagg

SEQ ID NO: 59879 - RNA, 22 nt, Homo sapiens
gugcacaacaugcagguuuguu

SEQ ID NO: 59880 - RNA, 22 nt, Homo sapiens
gugcacaacaugcaguuuuguu

SEQ ID NO: 59881 - RNA, 22 nt, Homo sapiens
gugcacaacgugcaaguuuguu

SEQ ID NO: 59882 - RNA, 22 nt, Homo sapiens
gugcacaacgugcaggcuuguu

SEQ ID NO: 59883 - RNA, 22 nt, Homo sapiens
gugcacaaugugcagguuuguu

SEQ ID NO: 59884 - RNA, 22 nt, Homo sapiens
gugcccacugucuguccuguag

SEQ ID NO: 59885 - RNA, 22 nt, Homo sapiens
gugcuauguuauccagcaagau

SEQ ID NO: 59886 - RNA, 22 nt, Homo sapiens
guggaaaacauaugcuuguuga

SEQ ID NO: 59887 - RNA, 22 nt, Homo sapiens
guggaaagaacacaaaauuagg

SEQ ID NO: 59888 - RNA, 22 nt, Homo sapiens
guggaaugcaguguugauucaa

SEQ ID NO: 59889 - RNA, 22 nt, Homo sapiens
guggaggacuggauaaagaaaa

SEQ ID NO: 59890 - RNA, 22 nt, Homo sapiens
guggagucaucacucagagugg

SEQ ID NO: 59891 - RNA, 18 nt, Homo sapiens
guggagugucuuccugga

SEQ ID NO: 59892 - RNA, 22 nt, Homo sapiens
guggcaagaugacuacucacug

SEQ ID NO: 59893 - RNA, 22 nt, Homo sapiens
guggcagagucagagggaaaug

SEQ ID NO: 59894 - RNA, 22 nt, Homo sapiens
guggcaugaaagcaucugugau

SEQ ID NO: 59895 - RNA, 22 nt, Homo sapiens
gugguaaaauggcauagagcua

SEQ ID NO: 59896 - RNA, 22 nt, Homo sapiens
guggucagaaaucucaguggca

SEQ ID NO: 59897 - RNA, 22 nt, Homo sapiens
gugucacagcuuccaucucggu

SEQ ID NO: 59898 - RNA, 22 nt, Homo sapiens
gugugacagcuauagacaugau

SEQ ID NO: 59899 - RNA, 22 nt, Homo sapiens
gugugcaauuuugugggaggca

SEQ ID NO: 59900 - RNA, 20 nt, Homo sapiens
gugugcauuucagauuuugg

SEQ ID NO: 59901 - RNA, 22 nt, Homo sapiens
guuaagaaguguaacuuaaguu

SEQ ID NO: 59902 - RNA, 22 nt, Homo sapiens
guucacaguuaggacaacugcu

SEQ ID NO: 59903 - RNA, 22 nt, Homo sapiens
guucaucagggauauuggcuua

SEQ ID NO: 59904 - RNA, 22 nt, Homo sapiens
guugacuaggagcuacuacuac

SEQ ID NO: 59905 - RNA, 22 nt, Homo sapiens
guuugugguuaaagccuuucau

SEQ ID NO: 59906 - RNA, 23 nt, Homo sapiens
ugcuauguaagcauuuauuaaau

SEQ ID NO: 59907 - RNA, 18 nt, Homo sapiens
ugcuccccugggugagca

SEQ ID NO: 59908 - RNA, 22 nt, Homo sapiens
ugcugcuguuguuguuacuagc

SEQ ID NO: 59909 - RNA, 22 nt, Homo sapiens
ugcuggugauuaaauccugaag

SEQ ID NO: 59910 - RNA, 22 nt, Homo sapiens
uggaagacucaagguggugaau

SEQ ID NO: 59911 - RNA, 22 nt, Homo sapiens
uggaagacucuagucucuugag

SEQ ID NO: 59912 - RNA, 23 nt, Homo sapiens
uggaaguauggaggaggcagaau

SEQ ID NO: 59913 - RNA, 22 nt, Homo sapiens
uggaagucuucauuauguauag

SEQ ID NO: 59914 - RNA, 21 nt, Homo sapiens
uggaaguguacaauuauaccc

SEQ ID NO: 59915 - RNA, 22 nt, Homo sapiens
uggaauguuauggcuuuaaucu

SEQ ID NO: 59916 - RNA, 22 nt, Homo sapiens
uggacaagugcccuccaccuca

SEQ ID NO: 59917 - RNA, 22 nt, Homo sapiens
uggacagaaacauguuuucagu

SEQ ID NO: 59918 - RNA, 20 nt, Homo sapiens
uggaccagagagguggggac

SEQ ID NO: 59919 - RNA, 22 nt, Homo sapiens
uggaccccugcucgggagcccu

SEQ ID NO: 59920 - RNA, 21 nt, Homo sapiens
uggaccccuuccuugcaccau

SEQ ID NO: 59921 - RNA, 22 nt, Homo sapiens
uggagagcaaagaauuuguuag

SEQ ID NO: 59922 - RNA, 22 nt, Homo sapiens
uggagagugauaaguaaaugga

SEQ ID NO: 59923 - RNA, 22 nt, Homo sapiens
uggagguagacauugggaagag

SEQ ID NO: 59924 - RNA, 22 nt, Homo sapiens
uggagguaggacgaagaacucu

SEQ ID NO: 59925 - RNA, 22 nt, Homo sapiens
uggagguagggccuaggaaucu

SEQ ID NO: 59926 - RNA, 20 nt, Homo sapiens
uggaggucaucugucacuac

SEQ ID NO: 59927 - RNA, 22 nt, Homo sapiens
uggaggucauuggaucaugggg

SEQ ID NO: 59928 - RNA, 22 nt, Homo sapiens
uggagucuugaugauuuucaaa

SEQ ID NO: 59929 - RNA, 22 nt, Homo sapiens
uggaguguaauuagccaucagu

SEQ ID NO: 59930 - RNA, 22 nt, Homo sapiens
uggaguguagcggcaccuauua

SEQ ID NO: 59931 - RNA, 22 nt, Homo sapiens
uggagugucaguuuccagaguu

SEQ ID NO: 59932 - RNA, 22 nt, Homo sapiens
uggaguguuggggcaggaucuc

SEQ ID NO: 59933 - RNA, 22 nt, Homo sapiens
uggauaguuuacugaagagugg

SEQ ID NO: 59934 - RNA, 22 nt, Homo sapiens
uggaucaugcgaggccuccccu

SEQ ID NO: 59935 - RNA, 22 nt, Homo sapiens
ucacagauaaauaaagaugauu

SEQ ID NO: 59936 - RNA, 22 nt, Homo sapiens
ucacagaugcuugacccauuuc

SEQ ID NO: 59937 - RNA, 18 nt, Homo sapiens
ucacagguaaaguugaca

SEQ ID NO: 59938 - RNA, 22 nt, Homo sapiens
ucacaguagggaacugacaaag

SEQ ID NO: 59939 - RNA, 22 nt, Homo sapiens
ucacaguauucaugaacaugga

SEQ ID NO: 59940 - RNA, 22 nt, Homo sapiens
ucacagucugcgugaugagaca

SEQ ID NO: 59941 - RNA, 23 nt, Homo sapiens
ucacaguggcugcuuaauuguga

SEQ ID NO: 59942 - RNA, 22 nt, Homo sapiens
ucacaguguuaaaccuuucuuu

SEQ ID NO: 59943 - RNA, 22 nt, Homo sapiens
ucacauggcagagaagaagcuc

SEQ ID NO: 59944 - RNA, 21 nt, Homo sapiens
ucacauggccagaguaggaac

SEQ ID NO: 59945 - RNA, 22 nt, Homo sapiens
ucacaugucagccguggggaag

SEQ ID NO: 59946 - RNA, 22 nt, Homo sapiens
ucacauguguaaauugguguaa

SEQ ID NO: 59947 - RNA, 22 nt, Homo sapiens
ucacauuguguagccugcucac

SEQ ID NO: 59948 - RNA, 22 nt, Homo sapiens
ucacauuguuauguaaauguuu

SEQ ID NO: 59949 - RNA, 22 nt, Homo sapiens
ucaccaguggcacuccagccug

SEQ ID NO: 59950 - RNA, 22 nt, Homo sapiens
ucaccuggagacaugaagacug

SEQ ID NO: 59951 - RNA, 22 nt, Homo sapiens
ucacuaaagaaaauggcaugga

SEQ ID NO: 59952 - RNA, 21 nt, Homo sapiens
ucacuaguaaaaggugaacug

SEQ ID NO: 59953 - RNA, 22 nt, Homo sapiens
ucacucagaccuggugauaugc

SEQ ID NO: 59954 - RNA, 22 nt, Homo sapiens
ucacugcgaccuccaccuccug

SEQ ID NO: 59955 - RNA, 22 nt, Homo sapiens
ucacugugcaugaaggaugcug

SEQ ID NO: 59956 - RNA, 21 nt, Homo sapiens
ucagaagcucccagggaggac

SEQ ID NO: 59957 - RNA, 22 nt, Homo sapiens
ucagacacugagcaaacgacua

SEQ ID NO: 59958 - RNA, 22 nt, Homo sapiens
ucagagucuagaucacucacug

SEQ ID NO: 59959 - RNA, 18 nt, Homo sapiens
ucagagugcagacuauac

SEQ ID NO: 59960 - RNA, 22 nt, Homo sapiens
ucagcaguggacagaaugguag

SEQ ID NO: 59961 - RNA, 22 nt, Homo sapiens
ucagcagugugaaaauggacua

SEQ ID NO: 59962 - RNA, 21 nt, Homo sapiens
ucagcucaucacugccuggag

SEQ ID NO: 59963 - RNA, 22 nt, Homo sapiens
ucaggcaccuuccucuuaucug

SEQ ID NO: 59964 - RNA, 22 nt, Homo sapiens
ucagguaaucuauuugucuuuu

SEQ ID NO: 59965 - RNA, 23 nt, Homo sapiens
ucagguaguuucagaggaccuug

SEQ ID NO: 59966 - RNA, 22 nt, Homo sapiens
ucagguauuucuuuuagcugug

SEQ ID NO: 59967 - RNA, 22 nt, Homo sapiens
ucaggugcaguggcucaugcuu

SEQ ID NO: 59968 - RNA, 22 nt, Homo sapiens
ucaggugcaguggcucugaccu

SEQ ID NO: 59969 - RNA, 23 nt, Homo sapiens
ucaguacucuauaagugccagcu

SEQ ID NO: 59970 - RNA, 20 nt, Homo sapiens
ucaguauauuguuuccacag

SEQ ID NO: 59971 - RNA, 23 nt, Homo sapiens
ucagugaaggaacaacuaaauag

SEQ ID NO: 59972 - RNA, 22 nt, Homo sapiens
ucagugaauauauaacagcgau

SEQ ID NO: 59973 - RNA, 21 nt, Homo sapiens
ucagugcaauucuauggggaa

SEQ ID NO: 59974 - RNA, 22 nt, Homo sapiens
ucagugucugugcaccgcugga

SEQ ID NO: 59975 - RNA, 22 nt, Homo sapiens
ucaguucauggaggugucugcu

SEQ ID NO: 59976 - RNA, 22 nt, Homo sapiens
ucauagaucaaguaauaagaca

SEQ ID NO: 59977 - RNA, 23 nt, Homo sapiens
ucaucacagcauuuccugguauu

SEQ ID NO: 59978 - RNA, 22 nt, Homo sapiens
ucaucucaguuucuugccguac

SEQ ID NO: 59979 - RNA, 22 nt, Homo sapiens
ucaugaccaugguauagaccac

SEQ ID NO: 59980 - RNA, 22 nt, Homo sapiens
ucaugagacacacuggaaagga

SEQ ID NO: 59981 - RNA, 22 nt, Homo sapiens
ucauggcuuuuauuauguugag

SEQ ID NO: 59982 - RNA, 22 nt, Homo sapiens
ucauuagagacagggugucacu

SEQ ID NO: 59983 - RNA, 22 nt, Homo sapiens
ucauugcaaucucugccucccg

SEQ ID NO: 59984 - RNA, 22 nt, Homo sapiens
ucauugcuuauuuguuggugga

SEQ ID NO: 59985 - RNA, 22 nt, Homo sapiens
ucauugguagcucauggaaccg

SEQ ID NO: 59986 - RNA, 22 nt, Homo sapiens
ucauugguagcuugaaggggau

SEQ ID NO: 59987 - RNA, 22 nt, Homo sapiens
uccacaguaaggacccugccuu

SEQ ID NO: 59988 - RNA, 18 nt, Homo sapiens
uccacgugcuuuccagau

SEQ ID NO: 59989 - RNA, 22 nt, Homo sapiens
uccacguggucuaucuguccuu

SEQ ID NO: 59990 - RNA, 22 nt, Homo sapiens
uccagugcauucagacacuugg

SEQ ID NO: 59991 - RNA, 22 nt, Homo sapiens
uccaguguuucuuccacuauuu

SEQ ID NO: 59992 - RNA, 22 nt, Homo sapiens
uccauaguugcacucuggagcc

SEQ ID NO: 59993 - RNA, 19 nt, Homo sapiens
uccaugagcccacagugau

SEQ ID NO: 59994 - RNA, 22 nt, Homo sapiens
uccauugucuagauguaacaca

SEQ ID NO: 59995 - RNA, 19 nt, Homo sapiens
uccccaguuuuccguucag

SEQ ID NO: 59996 - RNA, 22 nt, Homo sapiens
uccccugagucaccugcuucuc

SEQ ID NO: 59997 - RNA, 22 nt, Homo sapiens
ucccuagacuccugccuuucag

SEQ ID NO: 59998 - RNA, 22 nt, Homo sapiens
ucccugaagcugcagcaacaca

SEQ ID NO: 59999 - RNA, 22 nt, Homo sapiens
ucccugacagucacagagcuac

SEQ ID NO: 60000 - RNA, 22 nt, Homo sapiens
ucccuggagcaagagaagaagg

SEQ ID NO: 60001 - RNA, 22 nt, Homo sapiens
aaaagucuguagugaaagguga

SEQ ID NO: 60002 - RNA, 22 nt, Homo sapiens
aaacuugucuaauuauaagcau

SEQ ID NO: 60003 - RNA, 22 nt, Homo sapiens
aaagagcugagaccugguggag

SEQ ID NO: 60004 - RNA, 22 nt, Homo sapiens
aaagcagcaggugguuuucaau

SEQ ID NO: 60005 - RNA, 22 nt, Homo sapiens
aaaggcacuagaaguuaccuuu

SEQ ID NO: 60006 - RNA, 22 nt, Homo sapiens
aaaggcacugugacuuuauagg

SEQ ID NO: 60007 - RNA, 22 nt, Homo sapiens
aaaggcaucugcucggcucccu

SEQ ID NO: 60008 - RNA, 22 nt, Homo sapiens
aaaguacugggauuggccgggu

SEQ ID NO: 60009 - RNA, 22 nt, Homo sapiens
aaagugcacuuggaagagggcc

SEQ ID NO: 60010 - RNA, 22 nt, Homo sapiens
aaaguucugcguuagggcuaaa

SEQ ID NO: 60011 - RNA, 22 nt, Homo sapiens
aaaguucuguugauagugcuga

SEQ ID NO: 60012 - RNA, 22 nt, Homo sapiens
aaauaguagcugaaugagggaa

SEQ ID NO: 60013 - RNA, 22 nt, Homo sapiens
aaaucccuugcucucucagacc

SEQ ID NO: 60014 - RNA, 22 nt, Homo sapiens
aaaugcuuucuuggaccauuug

SEQ ID NO: 60015 - RNA, 19 nt, Homo sapiens
aaaugugcacuguuuucca

SEQ ID NO: 60016 - RNA, 22 nt, Homo sapiens
aacaccuugcagggauuaugac

SEQ ID NO: 60017 - RNA, 22 nt, Homo sapiens
aacagacugucacauaaaauug

SEQ ID NO: 60018 - RNA, 22 nt, Homo sapiens
aacaggcuccuaggggugcacc

SEQ ID NO: 60019 - RNA, 22 nt, Homo sapiens
aacagugcuguuauaaauguac

SEQ ID NO: 60020 - RNA, 22 nt, Homo sapiens
aacuggccuccuugggaaauua

SEQ ID NO: 60021 - RNA, 22 nt, Homo sapiens
caauggcacuauuggaaaaggu

SEQ ID NO: 60022 - RNA, 22 nt, Homo sapiens
cacacugucuucaauggguggu

SEQ ID NO: 60023 - RNA, 22 nt, Homo sapiens
cacacugucuuucagaaugguu

SEQ ID NO: 60024 - RNA, 22 nt, Homo sapiens
cacacuguuuuccauggggguu

SEQ ID NO: 60025 - RNA, 22 nt, Homo sapiens
cacaggaagaggcacggucccu

SEQ ID NO: 60026 - RNA, 22 nt, Homo sapiens
cacaggccugucucuuucuaac

SEQ ID NO: 60027 - RNA, 22 nt, Homo sapiens
cacuaggcuggagugcaguggc

SEQ ID NO: 60028 - RNA, 18 nt, Homo sapiens
cacugagcccuucacucu

SEQ ID NO: 60029 - RNA, 23 nt, Homo sapiens
cacugggcagcagguguucccag

SEQ ID NO: 60030 - RNA, 22 nt, Homo sapiens
cagacaugucuuguggccgugg

SEQ ID NO: 60031 - RNA, 22 nt, Homo sapiens
cagagaacugaguuauuuucuu

SEQ ID NO: 60032 - RNA, 22 nt, Homo sapiens
cagagguaagcaagucagcauu

SEQ ID NO: 60033 - RNA, 22 nt, Homo sapiens
cagaugguggucccacagccca

SEQ ID NO: 60034 - RNA, 22 nt, Homo sapiens
cagcacauuacaaguacuuggu

SEQ ID NO: 60035 - RNA, 22 nt, Homo sapiens
cagcaguuguuucggauuggga

SEQ ID NO: 60036 - RNA, 22 nt, Homo sapiens
cagcaucauucaucugggguaa

SEQ ID NO: 60037 - RNA, 22 nt, Homo sapiens
cagccgggugagguggcuuguu

SEQ ID NO: 60038 - RNA, 22 nt, Homo sapiens
cagcgaggucugcgucacauug

SEQ ID NO: 60039 - RNA, 22 nt, Homo sapiens
caggcacgcuugggagacacac

SEQ ID NO: 60040 - RNA, 22 nt, Homo sapiens
caggcuuuuccacacauggguu

SEQ ID NO: 60041 - RNA, 22 nt, Homo sapiens
cagguaguguguagcacagcag

SEQ ID NO: 60042 - RNA, 22 nt, Homo sapiens
caguacaauguugauuagaagu

SEQ ID NO: 60043 - RNA, 22 nt, Homo sapiens
caguagcaugccucagaaugag

SEQ ID NO: 60044 - RNA, 22 nt, Homo sapiens
caguaguagccccuuagaugga

SEQ ID NO: 60045 - RNA, 19 nt, Homo sapiens
caguaucauugcacauagu

SEQ ID NO: 60046 - RNA, 22 nt, Homo sapiens
caguggaugauguuuucugugg

SEQ ID NO: 60047 - RNA, 22 nt, Homo sapiens
cauacaugugcuugucuuaugc

SEQ ID NO: 60048 - RNA, 22 nt, Homo sapiens
caucccugaaccccagaaaucu

SEQ ID NO: 60049 - RNA, 22 nt, Homo sapiens
caugaaagugagaaacuccugg

SEQ ID NO: 60050 - RNA, 19 nt, Homo sapiens
caugauacugcucccucuc

SEQ ID NO: 60051 - RNA, 22 nt, Homo sapiens
cauggcccugggcugggcgaac

SEQ ID NO: 60052 - RNA, 21 nt, Homo sapiens
caugucacugcacucuagccu

SEQ ID NO: 60053 - RNA, 22 nt, Homo sapiens
cauuccacuggauaaacaaggu

SEQ ID NO: 60054 - RNA, 20 nt, Homo sapiens
cauugcacuccagccugcug

SEQ ID NO: 60055 - RNA, 22 nt, Homo sapiens
cauugcacuccagccugcugac

SEQ ID NO: 60056 - RNA, 22 nt, Homo sapiens
cauugcacuccagucugggcaa

SEQ ID NO: 60057 - RNA, 22 nt, Homo sapiens
cauugcuuuuggugguuuagac

SEQ ID NO: 60058 - RNA, 22 nt, Homo sapiens
cauugguuccaguuuguccuua

SEQ ID NO: 60059 - RNA, 22 nt, Homo sapiens
cauuguacauaaguauggagua

SEQ ID NO: 60060 - RNA, 22 nt, Homo sapiens
cauuuuacuuuccagacgugga

SEQ ID NO: 60061 - RNA, 22 nt, Homo sapiens
ccaaaguauuuucacugauauc

SEQ ID NO: 60062 - RNA, 22 nt, Homo sapiens
ccaagccucaguuucccucugu

SEQ ID NO: 60063 - RNA, 23 nt, Homo sapiens
ccacaaugguugaacuagauuac

SEQ ID NO: 60064 - RNA, 22 nt, Homo sapiens
ccacacugucuuggugggaaac

SEQ ID NO: 60065 - RNA, 22 nt, Homo sapiens
ccacauuggaaaggaucccccc

SEQ ID NO: 60066 - RNA, 22 nt, Homo sapiens
ccacugugguaucugauacugg

SEQ ID NO: 60067 - RNA, 22 nt, Homo sapiens
ccagauguuuucauucagcaag

SEQ ID NO: 60068 - RNA, 22 nt, Homo sapiens
ccaguucaaugauauggaaacu

SEQ ID NO: 60069 - RNA, 17 nt, Homo sapiens
ccaguuuucccucagug

SEQ ID NO: 60070 - RNA, 22 nt, Homo sapiens
ccaucacaggccucagugggaa

SEQ ID NO: 60071 - RNA, 21 nt, Homo sapiens
ccauggcaaugguaaacugac

SEQ ID NO: 60072 - RNA, 22 nt, Homo sapiens
cccagugguuacauaaggagua

SEQ ID NO: 60073 - RNA, 19 nt, Homo sapiens
cccagugucagagaagggu

SEQ ID NO: 60074 - RNA, 22 nt, Homo sapiens
ccccauuguugugguuuuaucu

SEQ ID NO: 60075 - RNA, 22 nt, Homo sapiens
ccucuuuguugagacuucacca

SEQ ID NO: 60076 - RNA, 22 nt, Homo sapiens
ccugagaucauacuguuaguaa

SEQ ID NO: 60077 - RNA, 22 nt, Homo sapiens
ccuggcacugagcaguguucua

SEQ ID NO: 60078 - RNA, 22 nt, Homo sapiens
ccuggcacugggccccguggcu

SEQ ID NO: 60079 - RNA, 22 nt, Homo sapiens
ccugguguuuugauggucgggu

SEQ ID NO: 60080 - RNA, 22 nt, Homo sapiens
ccuucuuuuguaaggcugaaua

SEQ ID NO: 60081 - RNA, 22 nt, Homo sapiens
ccuuuguuaguuugcugagaau

SEQ ID NO: 60082 - RNA, 22 nt, Homo sapiens
agagauaaagauuuuaauuuug

SEQ ID NO: 60083 - RNA, 22 nt, Homo sapiens
agagaucaacugaauuacugga

SEQ ID NO: 60084 - RNA, 22 nt, Homo sapiens
agagcaaugggugaauauuaaa

SEQ ID NO: 60085 - RNA, 22 nt, Homo sapiens
agagcuguguuuuaacuuuuua

SEQ ID NO: 60086 - RNA, 22 nt, Homo sapiens
agagguauuggaaggaguguca

SEQ ID NO: 60087 - RNA, 20 nt, Homo sapiens
agagguuuugauagguucug

SEQ ID NO: 60088 - RNA, 22 nt, Homo sapiens
agagguuuugcccucgagauaa

SEQ ID NO: 60089 - RNA, 22 nt, Homo sapiens
agaguacaggcaaguuagucau

SEQ ID NO: 60090 - RNA, 22 nt, Homo sapiens
agaguaguuuauuaugcuaagg

SEQ ID NO: 60091 - RNA, 21 nt, Homo sapiens
agagucaucucuaucuguacc

SEQ ID NO: 60092 - RNA, 22 nt, Homo sapiens
agaugccucauguucuagguuc

SEQ ID NO: 60093 - RNA, 22 nt, Homo sapiens
agaugcuguuaucaacuguagc

SEQ ID NO: 60094 - RNA, 22 nt, Homo sapiens
agauggugugcuaggaaaugua

SEQ ID NO: 60095 - RNA, 23 nt, Homo sapiens
agcaaaugcucuagcacuccaac

SEQ ID NO: 60096 - RNA, 22 nt, Homo sapiens
agcaagacauggcuuccaaaug

SEQ ID NO: 60097 - RNA, 22 nt, Homo sapiens
agcaauaugacauugcuacauc

SEQ ID NO: 60098 - RNA, 22 nt, Homo sapiens
agcacacuggguggcuuaaaca

SEQ ID NO: 60099 - RNA, 23 nt, Homo sapiens
agcaccaccccaggucacaagug

SEQ ID NO: 60100 - RNA, 22 nt, Homo sapiens
agcagagcauauucauucgggg

SEQ ID NO: 60101 - RNA, 22 nt, Homo sapiens
agcagcaauuuuguaugguuua

SEQ ID NO: 60102 - RNA, 22 nt, Homo sapiens
agcagcaccaaacagacuaaga

SEQ ID NO: 60103 - RNA, 22 nt, Homo sapiens
agcagcaugcaaauggacuaau

SEQ ID NO: 60104 - RNA, 22 nt, Homo sapiens
agcagcauuccaaaaaucugcu

SEQ ID NO: 60105 - RNA, 22 nt, Homo sapiens
agcaggacaauaugggaucagg

SEQ ID NO: 60106 - RNA, 22 nt, Homo sapiens
agcagugugaaaauggacuaau

SEQ ID NO: 60107 - RNA, 22 nt, Homo sapiens
agcagugugagaauggacuaau

SEQ ID NO: 60108 - RNA, 22 nt, Homo sapiens
agcaucauguuuucgagguuca

SEQ ID NO: 60109 - RNA, 22 nt, Homo sapiens
agcauuacaugguacagagaag

SEQ ID NO: 60110 - RNA, 22 nt, Homo sapiens
agcccagagacuguguaaauuu

SEQ ID NO: 60111 - RNA, 22 nt, Homo sapiens
agccucauucuacauguuaaug

SEQ ID NO: 60112 - RNA, 22 nt, Homo sapiens
agcgccacugcacuccagccug

SEQ ID NO: 60113 - RNA, 18 nt, Homo sapiens
agcucaguguuugcuuac

SEQ ID NO: 60114 - RNA, 22 nt, Homo sapiens
agcuccuuucugcagguagguu

SEQ ID NO: 60115 - RNA, 22 nt, Homo sapiens
agcugcauuuacuuuugcacaa

SEQ ID NO: 60116 - RNA, 22 nt, Homo sapiens
agcuggauuguuuaccuggggc

SEQ ID NO: 60117 - RNA, 19 nt, Homo sapiens
agcuguguugccugugaga

SEQ ID NO: 60118 - RNA, 22 nt, Homo sapiens
agcuugugauucuccaucaugu

SEQ ID NO: 60119 - RNA, 22 nt, Homo sapiens
agcuugugauuuagagugagag

SEQ ID NO: 60120 - RNA, 22 nt, Homo sapiens
agcuuguggugaauacugcuag

SEQ ID NO: 60121 - RNA, 22 nt, Homo sapiens
agcuuuuugggaggccuuagga

SEQ ID NO: 60122 - RNA, 22 nt, Homo sapiens
aggaagguaaacuaacuugccu

SEQ ID NO: 60123 - RNA, 22 nt, Homo sapiens
aggaagugucuucuuuuaggca

SEQ ID NO: 60124 - RNA, 22 nt, Homo sapiens
aggaagugugcaauuaauuucu

SEQ ID NO: 60125 - RNA, 22 nt, Homo sapiens
aggaaugucaaugguaguuuaa

SEQ ID NO: 60126 - RNA, 20 nt, Homo sapiens
aggagcauuuacauuggcuc

SEQ ID NO: 60127 - RNA, 22 nt, Homo sapiens
aggcaagaaugcuuguuucacc

SEQ ID NO: 60128 - RNA, 21 nt, Homo sapiens
aggcaagacuuuuagguuugu

SEQ ID NO: 60129 - RNA, 22 nt, Homo sapiens
aggcagcuguuauauacugagu

SEQ ID NO: 60130 - RNA, 22 nt, Homo sapiens
aggcaggugaaagauaguuuua

SEQ ID NO: 60131 - RNA, 22 nt, Homo sapiens
aggcaugaguucagaggguaug

SEQ ID NO: 60132 - RNA, 22 nt, Homo sapiens
aggcuuuuggagaacacugcac

SEQ ID NO: 60133 - RNA, 22 nt, Homo sapiens
agggcaagacuuguuaagaaca

SEQ ID NO: 60134 - RNA, 22 nt, Homo sapiens
agguauguaugucuguacagcg

SEQ ID NO: 60135 - RNA, 22 nt, Homo sapiens
aggucaccucaggaaauacuga

SEQ ID NO: 60136 - RNA, 22 nt, Homo sapiens
aggucccauguccucccugacc

SEQ ID NO: 60137 - RNA, 22 nt, Homo sapiens
aguaccacgugaugccauuuuc

SEQ ID NO: 60138 - RNA, 22 nt, Homo sapiens
agucacagugaccuugucugac

SEQ ID NO: 60139 - RNA, 22 nt, Homo sapiens
agucagugucuguaaggagaac

SEQ ID NO: 60140 - RNA, 22 nt, Homo sapiens
agucauggaucacaguagccuc

SEQ ID NO: 60141 - RNA, 22 nt, Homo sapiens
agucauggcagaaggcaccucu

SEQ ID NO: 60142 - RNA, 22 nt, Homo sapiens
aguccaguguuaugaucaguag

SEQ ID NO: 60143 - RNA, 22 nt, Homo sapiens
agugacaugggaucaaaucuga

SEQ ID NO: 60144 - RNA, 22 nt, Homo sapiens
agugacuagaauaugaauuuua

SEQ ID NO: 60145 - RNA, 22 nt, Homo sapiens
agugagcuggagaaaagaaacu

SEQ ID NO: 60146 - RNA, 22 nt, Homo sapiens
agugcaguggcucaaaaugccu

SEQ ID NO: 60147 - RNA, 22 nt, Homo sapiens
agugcauugagacuugugaguu

SEQ ID NO: 60148 - RNA, 22 nt, Homo sapiens
agugccacugcacucuagccug

SEQ ID NO: 60149 - RNA, 22 nt, Homo sapiens
ugcaguacugucagacuucuua

SEQ ID NO: 60150 - RNA, 22 nt, Homo sapiens
ugcaguacuuugaaauauacug

SEQ ID NO: 60151 - RNA, 22 nt, Homo sapiens
ugcaguagugugaucuuggcuc

SEQ ID NO: 60152 - RNA, 22 nt, Homo sapiens
ugcaguguucuuuagaggaaau

SEQ ID NO: 60153 - RNA, 22 nt, Homo sapiens
ugcauagaauguucuguaaaua

SEQ ID NO: 60154 - RNA, 22 nt, Homo sapiens
ugcauagcauauauuguagagu

SEQ ID NO: 60155 - RNA, 19 nt, Homo sapiens
ugcauaggguuacauacuc

SEQ ID NO: 60156 - RNA, 22 nt, Homo sapiens
ugcauguucuuacucauacaug

SEQ ID NO: 60157 - RNA, 22 nt, Homo sapiens
ugccaaaaugggcuuuauaccg

SEQ ID NO: 60158 - RNA, 22 nt, Homo sapiens
ugccaagaacauuuucuguuuu

SEQ ID NO: 60159 - RNA, 22 nt, Homo sapiens
ugccauagcaaugguaagcuga

SEQ ID NO: 60160 - RNA, 22 nt, Homo sapiens
ugccaugaagagaggaagcagu

SEQ ID NO: 60161 - RNA, 22 nt, Homo sapiens
ugcccuuugucagaugaguagg

SEQ ID NO: 60162 - RNA, 22 nt, Homo sapiens
ugccuagaaacacuauuucucc

SEQ ID NO: 60163 - RNA, 22 nt, Homo sapiens
ugccuucuguuaaacgaggaug

SEQ ID NO: 60164 - RNA, 22 nt, Homo sapiens
ugccuuuguucuggaaugggaa

SEQ ID NO: 60165 - RNA, 19 nt, Homo sapiens
ugcugcauugugaccuugc

SEQ ID NO: 60166 - RNA, 22 nt, Homo sapiens
ugcugguauuauguuauccaga

SEQ ID NO: 60167 - RNA, 22 nt, Homo sapiens
uggaagacaggcuguauuuuaa

SEQ ID NO: 60168 - RNA, 20 nt, Homo sapiens
uggaagccuggugcuaucuu

SEQ ID NO: 60169 - RNA, 22 nt, Homo sapiens
uggaaggucauuguucauuuga

SEQ ID NO: 60170 - RNA, 22 nt, Homo sapiens
uggaagugaacaaccaaggcag

SEQ ID NO: 60171 - RNA, 22 nt, Homo sapiens
uggacauguacauauguguaug

SEQ ID NO: 60172 - RNA, 21 nt, Homo sapiens
uggaccccuuccagucaucau

SEQ ID NO: 60173 - RNA, 19 nt, Homo sapiens
uggaccccuuccuuacacc

SEQ ID NO: 60174 - RNA, 22 nt, Homo sapiens
uggacugagauuucagcugcca

SEQ ID NO: 60175 - RNA, 22 nt, Homo sapiens
uggagagucauuuauaguauuu

SEQ ID NO: 60176 - RNA, 22 nt, Homo sapiens
uggagcaaaguugaggccaagc

SEQ ID NO: 60177 - RNA, 21 nt, Homo sapiens
uggagugcaacacuagguaua

SEQ ID NO: 60178 - RNA, 22 nt, Homo sapiens
uggaguguaaauuaguucagcc

SEQ ID NO: 60179 - RNA, 16 nt, Homo sapiens
uggaguguuuguuaga

SEQ ID NO: 60180 - RNA, 22 nt, Homo sapiens
uggaugacauccuuguaugcag

SEQ ID NO: 60181 - RNA, 22 nt, Homo sapiens
uggauggagaggcuugugaugc

SEQ ID NO: 60182 - RNA, 22 nt, Homo sapiens
uggauugcaaaaucuuuuugag

SEQ ID NO: 60183 - RNA, 22 nt, Homo sapiens
uggcaaaaaaacgcaauuacgu

SEQ ID NO: 60184 - RNA, 22 nt, Homo sapiens
uggcaaaauggaauauguuggg

SEQ ID NO: 60185 - RNA, 21 nt, Homo sapiens
uggcaaaaugggcaguggguu

SEQ ID NO: 60186 - RNA, 20 nt, Homo sapiens
uggcaagauggcagaauaga

SEQ ID NO: 60187 - RNA, 22 nt, Homo sapiens
uggcaagcaggacuaaagcacc

SEQ ID NO: 60188 - RNA, 18 nt, Homo sapiens
uggcaauaugguucuacc

SEQ ID NO: 60189 - RNA, 22 nt, Homo sapiens
uggcagauaggauacaggacua

SEQ ID NO: 60190 - RNA, 22 nt, Homo sapiens
uggcagaugggugagcuggaga

SEQ ID NO: 60191 - RNA, 22 nt, Homo sapiens
uggcagcugcuucaugggaugc

SEQ ID NO: 60192 - RNA, 22 nt, Homo sapiens
uggcauauaaagauguguucaa

SEQ ID NO: 60193 - RNA, 22 nt, Homo sapiens
uggcauaugguauuugauaucu

SEQ ID NO: 60194 - RNA, 20 nt, Homo sapiens
uggcaugaaauuuuccaagc

SEQ ID NO: 60195 - RNA, 19 nt, Homo sapiens
uggcaugaaugugaacuaa

SEQ ID NO: 60196 - RNA, 17 nt, Homo sapiens
uggcaugaggguguggg

SEQ ID NO: 60197 - RNA, 22 nt, Homo sapiens
uggcaugauauauauucguuug

SEQ ID NO: 60198 - RNA, 22 nt, Homo sapiens
uggcaugauguguucauugaaa

SEQ ID NO: 60199 - RNA, 22 nt, Homo sapiens
uggcauggggcagaacauuaca

SEQ ID NO: 60200 - RNA, 22 nt, Homo sapiens
uggcauuguccaauaaaauuuu

SEQ ID NO: 60201 - RNA, 23 nt, Homo sapiens
uggcauuuuaguuagcuucagug

SEQ ID NO: 60202 - RNA, 22 nt, Homo sapiens
uggcuacugacugaugauuaua

SEQ ID NO: 60203 - RNA, 22 nt, Homo sapiens
uggcucuguuuguuaacuagac

SEQ ID NO: 60204 - RNA, 22 nt, Homo sapiens
ugggaaacauccagcacauacu

SEQ ID NO: 60205 - RNA, 22 nt, Homo sapiens
ugggaaauguagccuagcugug

SEQ ID NO: 60206 - RNA, 20 nt, Homo sapiens
ugggaacaugugguauaugg

SEQ ID NO: 60207 - RNA, 22 nt, Homo sapiens
ugggaagaugcugcuucuuccu

SEQ ID NO: 60208 - RNA, 22 nt, Homo sapiens
ugggaauaugauacaggucuuu

SEQ ID NO: 60209 - RNA, 22 nt, Homo sapiens
ugggagugugcacaauuucagc

SEQ ID NO: 60210 - RNA, 22 nt, Homo sapiens
ugggcauggaguggccuuaugu

SEQ ID NO: 60211 - RNA, 22 nt, Homo sapiens
ugggcuagaugcuuugggguca

SEQ ID NO: 60212 - RNA, 21 nt, Homo sapiens
uggguaguuuucaaggccccg

SEQ ID NO: 60213 - RNA, 22 nt, Homo sapiens
ugguaagaggcccugaguuugu

SEQ ID NO: 60214 - RNA, 22 nt, Homo sapiens
uggugagaaacuagauauuuuu

SEQ ID NO: 60215 - RNA, 22 nt, Homo sapiens
uggugcaaauguaauugugguu

SEQ ID NO: 60216 - RNA, 22 nt, Homo sapiens
ugguuagucuguguguauauau

SEQ ID NO: 60217 - RNA, 22 nt, Homo sapiens
ugguucaguugcacaggcuguu

SEQ ID NO: 60218 - RNA, 22 nt, Homo sapiens
uguaaacuaugagcugauuauu

SEQ ID NO: 60219 - RNA, 22 nt, Homo sapiens
uguaauguuucaucauuauuaa

SEQ ID NO: 60220 - RNA, 22 nt, Homo sapiens
uguacaugggacaggaggagag

SEQ ID NO: 60221 - RNA, 22 nt, Homo sapiens
uguagcaaauaaaagucuggau

SEQ ID NO: 60222 - RNA, 22 nt, Homo sapiens
uguauguaaagacaggauaaca

SEQ ID NO: 60223 - RNA, 22 nt, Homo sapiens
uguaugucuucuuuagauaagu

SEQ ID NO: 60224 - RNA, 22 nt, Homo sapiens
uguauguugggucaaaguacau

SEQ ID NO: 60225 - RNA, 16 nt, Homo sapiens
uguauugcuaaaaaga

SEQ ID NO: 60226 - RNA, 22 nt, Homo sapiens
uguauugcuugaagagugaauu

SEQ ID NO: 60227 - RNA, 22 nt, Homo sapiens
ugucaaagagacaucugcacuc

SEQ ID NO: 60228 - RNA, 22 nt, Homo sapiens
ugucaacauuuaucaaguuauu

SEQ ID NO: 60229 - RNA, 22 nt, Homo sapiens
ugucaccauuuguaggugagga

SEQ ID NO: 60230 - RNA, 22 nt, Homo sapiens
ugucaggaggguccagagaaaa

SEQ ID NO: 60231 - RNA, 22 nt, Homo sapiens
ugucaguguaugagccccggau

SEQ ID NO: 60232 - RNA, 22 nt, Homo sapiens
ugucaucuagguauuaagcccc

SEQ ID NO: 60233 - RNA, 22 nt, Homo sapiens
ugucauggggaaaauaacagac

SEQ ID NO: 60234 - RNA, 22 nt, Homo sapiens
ugucauguuucuacugaccaaa

SEQ ID NO: 60235 - RNA, 16 nt, Homo sapiens
uguccaaauaaauaca

SEQ ID NO: 60236 - RNA, 22 nt, Homo sapiens
ucuguguuugaucaagauugua

SEQ ID NO: 60237 - RNA, 22 nt, Homo sapiens
ucuugcuuguuguucccuucau

SEQ ID NO: 60238 - RNA, 22 nt, Homo sapiens
ucuuggguuugccuugcugcug

SEQ ID NO: 60239 - RNA, 21 nt, Homo sapiens
ucuugguauguauuuaggagg

SEQ ID NO: 60240 - RNA, 22 nt, Homo sapiens
ucuuuagugacaguugugcaag

SEQ ID NO: 60241 - RNA, 22 nt, Homo sapiens
ucuuuaguuaagggacauuuua

SEQ ID NO: 60242 - RNA, 19 nt, Homo sapiens
ucuuugaggcaucgcccuc

SEQ ID NO: 60243 - RNA, 22 nt, Homo sapiens
ucuuugccuaacccaaggucau

SEQ ID NO: 60244 - RNA, 22 nt, Homo sapiens
ucuuuggauggaaauuggaguc

SEQ ID NO: 60245 - RNA, 22 nt, Homo sapiens
ucuuugggauauucugaaaggg

SEQ ID NO: 60246 - RNA, 22 nt, Homo sapiens
ucuuugguaauggaugucugau

SEQ ID NO: 60247 - RNA, 22 nt, Homo sapiens
ucuuuggucagaaagauuacac

SEQ ID NO: 60248 - RNA, 22 nt, Homo sapiens
ucuuugguucugugcagccuau

SEQ ID NO: 60249 - RNA, 22 nt, Homo sapiens
ucuuugguuguuuagggugcau

SEQ ID NO: 60250 - RNA, 22 nt, Homo sapiens
ucuuugucuacauccuguuaaa

SEQ ID NO: 60251 - RNA, 22 nt, Homo sapiens
guacaguucucuuuguugucag

SEQ ID NO: 60252 - RNA, 22 nt, Homo sapiens
guacaguuuagugcuuugagaa

SEQ ID NO: 60253 - RNA, 22 nt, Homo sapiens
guacaguuuucaguguucacug

SEQ ID NO: 60254 - RNA, 22 nt, Homo sapiens
guagcagaauaucagauaauuu

SEQ ID NO: 60255 - RNA, 18 nt, Homo sapiens
guaggucaguaccaagca

SEQ ID NO: 60256 - RNA, 22 nt, Homo sapiens
guaugauacuguaacagugggu

SEQ ID NO: 60257 - RNA, 22 nt, Homo sapiens
guauuuguugcagcagcacuau

SEQ ID NO: 60258 - RNA, 22 nt, Homo sapiens
gucaagauuuguaggacagaga

SEQ ID NO: 60259 - RNA, 22 nt, Homo sapiens
gucaagugaagcagugggagua

SEQ ID NO: 60260 - RNA, 22 nt, Homo sapiens
gucacaggaaacuaauaugcgc

SEQ ID NO: 60261 - RNA, 22 nt, Homo sapiens
gucaccagcuguguuagccccu

SEQ ID NO: 60262 - RNA, 22 nt, Homo sapiens
gucacugggugcugcgccuguc

SEQ ID NO: 60263 - RNA, 22 nt, Homo sapiens
gucacuguggagaagaaagugg

SEQ ID NO: 60264 - RNA, 22 nt, Homo sapiens
gucagcaucaccaugucuauga

SEQ ID NO: 60265 - RNA, 22 nt, Homo sapiens
gucagugcuuuaguucaggaug

SEQ ID NO: 60266 - RNA, 22 nt, Homo sapiens
gucaguggauacugucucuguc

SEQ ID NO: 60267 - RNA, 22 nt, Homo sapiens
gucauccaggcuggagugaagc

SEQ ID NO: 60268 - RNA, 22 nt, Homo sapiens
gucauggaaaucuacauuguua

SEQ ID NO: 60269 - RNA, 22 nt, Homo sapiens
gucauggacaguuugcuaauug

SEQ ID NO: 60270 - RNA, 22 nt, Homo sapiens
gucauugcuuaaggguucaugc

SEQ ID NO: 60271 - RNA, 22 nt, Homo sapiens
guccaguacucuuuccugaaaa

SEQ ID NO: 60272 - RNA, 22 nt, Homo sapiens
gucccugcgauugugggauccu

SEQ ID NO: 60273 - RNA, 22 nt, Homo sapiens
gucuggcuccuucuacuacaug

SEQ ID NO: 60274 - RNA, 20 nt, Homo sapiens
gucugucuccgaguagaauu

SEQ ID NO: 60275 - RNA, 22 nt, Homo sapiens
gucuguuugauccagaucaaaa

SEQ ID NO: 60276 - RNA, 22 nt, Homo sapiens
ugcaagaaucuuucaggcuagc

SEQ ID NO: 60277 - RNA, 22 nt, Homo sapiens
ugcaagcacacccagggauugu

SEQ ID NO: 60278 - RNA, 18 nt, Homo sapiens
ugcaauggagaugcagcc

SEQ ID NO: 60279 - RNA, 22 nt, Homo sapiens
ugcaccacugcacuccagcuug

SEQ ID NO: 60280 - RNA, 22 nt, Homo sapiens
ugcaccacugcacuucagccug

SEQ ID NO: 60281 - RNA, 22 nt, Homo sapiens
ugcagagaaacauuuuguauuu

SEQ ID NO: 60282 - RNA, 17 nt, Homo sapiens
ugcagcacacugauggg

SEQ ID NO: 60283 - RNA, 20 nt, Homo sapiens
ugcagcacgggcccuuucca

SEQ ID NO: 60284 - RNA, 22 nt, Homo sapiens
ugcagcacugaacuucugggcu

SEQ ID NO: 60285 - RNA, 20 nt, Homo sapiens
ugcagcacugggaaugcagu

SEQ ID NO: 60286 - RNA, 20 nt, Homo sapiens
gucuugcuccguugcccagg

SEQ ID NO: 60287 - RNA, 22 nt, Homo sapiens
gucuuggcaugugcagcuggga

SEQ ID NO: 60288 - RNA, 22 nt, Homo sapiens
gucuuuggaaaaaaugucuguu

SEQ ID NO: 60289 - RNA, 22 nt, Homo sapiens
gugaaagacauauaugguuuga

SEQ ID NO: 60290 - RNA, 22 nt, Homo sapiens
gugaaagauuaaaccagugugu

SEQ ID NO: 60291 - RNA, 22 nt, Homo sapiens
gugaaaugaaacgcuaugucuu

SEQ ID NO: 60292 - RNA, 22 nt, Homo sapiens
gugaaguuuuuugcugagaguc

SEQ ID NO: 60293 - RNA, 22 nt, Homo sapiens
gugaaugaaugggugaauacau

SEQ ID NO: 60294 - RNA, 22 nt, Homo sapiens
gugaaugcauuaagaaggggga

SEQ ID NO: 60295 - RNA, 22 nt, Homo sapiens
gugacacuggagcuggcacaau

SEQ ID NO: 60296 - RNA, 22 nt, Homo sapiens
gugaccucuguugcugucacua

SEQ ID NO: 60297 - RNA, 22 nt, Homo sapiens
gugagaccaauguacuaccuuc

SEQ ID NO: 60298 - RNA, 22 nt, Homo sapiens
gugagaugguaucucauugugg

SEQ ID NO: 60299 - RNA, 21 nt, Homo sapiens
gugaggaguuacuggcuuuga

SEQ ID NO: 60300 - RNA, 22 nt, Homo sapiens
gugagguaagaguugcuuugcu

SEQ ID NO: 60301 - RNA, 22 nt, Homo sapiens
gugagguauacugggaucacua

SEQ ID NO: 60302 - RNA, 22 nt, Homo sapiens
gugaucaugauccugaagcauu

SEQ ID NO: 60303 - RNA, 21 nt, Homo sapiens
gugaucaugucacugcacucc

SEQ ID NO: 60304 - RNA, 22 nt, Homo sapiens
gugcaagagugauugcaguuuu

SEQ ID NO: 60305 - RNA, 18 nt, Homo sapiens
gugcaaugaauagcagag

SEQ ID NO: 60306 - RNA, 22 nt, Homo sapiens
gugcacaaaucuuaaauguaca

SEQ ID NO: 60307 - RNA, 22 nt, Homo sapiens
gugcacuguagaacccuuuguu

SEQ ID NO: 60308 - RNA, 22 nt, Homo sapiens
gugccacaguguuaagggauuc

SEQ ID NO: 60309 - RNA, 21 nt, Homo sapiens
gugcuuguagccucacuucug

SEQ ID NO: 60310 - RNA, 22 nt, Homo sapiens
guggaaaauuauugcuguuuuu

SEQ ID NO: 60311 - RNA, 22 nt, Homo sapiens
guggaaaucucugugugacuua

SEQ ID NO: 60312 - RNA, 22 nt, Homo sapiens
guggaagaccagacuuuccaac

SEQ ID NO: 60313 - RNA, 22 nt, Homo sapiens
guggaagauaguguguuaaugu

SEQ ID NO: 60314 - RNA, 22 nt, Homo sapiens
guggaagucuuugguauuggua

SEQ ID NO: 60315 - RNA, 22 nt, Homo sapiens
guggaauauaaagcaucgugua

SEQ ID NO: 60316 - RNA, 22 nt, Homo sapiens
guggaggagaaagaagcauuuc

SEQ ID NO: 60317 - RNA, 22 nt, Homo sapiens
guggaucacuugaggucaagag

SEQ ID NO: 60318 - RNA, 22 nt, Homo sapiens
guggcagcacauauagguuguu

SEQ ID NO: 60319 - RNA, 22 nt, Homo sapiens
guggcuagaaugaagguagcug

SEQ ID NO: 60320 - RNA, 22 nt, Homo sapiens
gugggaagcuggaacucccucc

SEQ ID NO: 60321 - RNA, 22 nt, Homo sapiens
guggggucaucucauuugugga

SEQ ID NO: 60322 - RNA, 19 nt, Homo sapiens
gugguauuaccuuuugauu

SEQ ID NO: 60323 - RNA, 22 nt, Homo sapiens
gugguucuaaaccuuuuuuggu

SEQ ID NO: 60324 - RNA, 22 nt, Homo sapiens
guguaaaucugcugugaacauu

SEQ ID NO: 60325 - RNA, 20 nt, Homo sapiens
guguaagagcaagcuuccua

SEQ ID NO: 60326 - RNA, 22 nt, Homo sapiens
guguagagaaaaguaccauuuu

SEQ ID NO: 60327 - RNA, 22 nt, Homo sapiens
gugugcaaauguguaccuacau

SEQ ID NO: 60328 - RNA, 22 nt, Homo sapiens
gugugcacaaucuggcaugugc

SEQ ID NO: 60329 - RNA, 21 nt, Homo sapiens
gugugcuugaauucagcuguc

SEQ ID NO: 60330 - RNA, 21 nt, Homo sapiens
gugugcuugagugaugggauu

SEQ ID NO: 60331 - RNA, 22 nt, Homo sapiens
guguucauggaauuugcaauug

SEQ ID NO: 60332 - RNA, 22 nt, Homo sapiens
guuauuguccauuuauuuagca

SEQ ID NO: 60333 - RNA, 22 nt, Homo sapiens
guucaagcaauucugcugccuc

SEQ ID NO: 60334 - RNA, 22 nt, Homo sapiens
guucaaggaauguuggcuucuc

SEQ ID NO: 60335 - RNA, 21 nt, Homo sapiens
guucaagugauccuccugucu

SEQ ID NO: 60336 - RNA, 22 nt, Homo sapiens
guucccaguugaaaugauuagu

SEQ ID NO: 60337 - RNA, 22 nt, Homo sapiens
guugaucuauguugcuggcagu

SEQ ID NO: 60338 - RNA, 22 nt, Homo sapiens
guuggcuguuucccccaaguga

SEQ ID NO: 60339 - RNA, 22 nt, Homo sapiens
guuggugaccugaagagaguaa

SEQ ID NO: 60340 - RNA, 22 nt, Homo sapiens
uaaaugcucuuuaaaagugcuu

SEQ ID NO: 60341 - RNA, 22 nt, Homo sapiens
uaaaugcuuaauugaaugugga

SEQ ID NO: 60342 - RNA, 22 nt, Homo sapiens
uaaauggauaaaugaauaccua

SEQ ID NO: 60343 - RNA, 22 nt, Homo sapiens
uaacaacauucuaacugacggc

SEQ ID NO: 60344 - RNA, 22 nt, Homo sapiens
uaacacccuucuccagguacau

SEQ ID NO: 60345 - RNA, 22 nt, Homo sapiens
uaacaguauauuuaccaaaccu

SEQ ID NO: 60346 - RNA, 22 nt, Homo sapiens
uaacagucuccucaagguguug

SEQ ID NO: 60347 - RNA, 18 nt, Homo sapiens
uaacagucucucaggauc

SEQ ID NO: 60348 - RNA, 22 nt, Homo sapiens
uaacaguguauuuacuacuucc

SEQ ID NO: 60349 - RNA, 22 nt, Homo sapiens
uaacuauagagaauguugagua

SEQ ID NO: 60350 - RNA, 22 nt, Homo sapiens
uaagacucuggacucuaauguu

SEQ ID NO: 60351 - RNA, 22 nt, Homo sapiens
uaaggcaaguuuuuaguggaca

SEQ ID NO: 60352 - RNA, 22 nt, Homo sapiens
uaaggcacuacuuuaggcuuuc

SEQ ID NO: 60353 - RNA, 22 nt, Homo sapiens
uaaggcauuuuuuugaguugca

SEQ ID NO: 60354 - RNA, 22 nt, Homo sapiens
uaagggacauguguugccuaag

SEQ ID NO: 60355 - RNA, 22 nt, Homo sapiens
uaagggacgcccccuucucucu

SEQ ID NO: 60356 - RNA, 22 nt, Homo sapiens
uaagguuuuugauaugcugcug

SEQ ID NO: 60357 - RNA, 22 nt, Homo sapiens
uaaguaauugugguuucugcca

SEQ ID NO: 60358 - RNA, 22 nt, Homo sapiens
uaaguagaggaaucauuuugug

SEQ ID NO: 60359 - RNA, 22 nt, Homo sapiens
uaaguauuuuaauuccuggcau

SEQ ID NO: 60360 - RNA, 20 nt, Homo sapiens
uaagugcuugaugaaugaac

SEQ ID NO: 60361 - RNA, 22 nt, Homo sapiens
uaaguggugcauuguuaaaugg

SEQ ID NO: 60362 - RNA, 22 nt, Homo sapiens
uaaguuguagaacguuuucuua

SEQ ID NO: 60363 - RNA, 22 nt, Homo sapiens
uaauccugucuugaccaucagg

SEQ ID NO: 60364 - RNA, 22 nt, Homo sapiens
uaaugcuugguuguuuggaaaa

SEQ ID NO: 60365 - RNA, 22 nt, Homo sapiens
uaauugaaugcagacaccaggg

SEQ ID NO: 60366 - RNA, 22 nt, Homo sapiens
uacaaagugggaaacgaagguu

SEQ ID NO: 60367 - RNA, 22 nt, Homo sapiens
uacaacacugguucgacaugug

SEQ ID NO: 60368 - RNA, 22 nt, Homo sapiens
uacaccauuugauucuuuaagc

SEQ ID NO: 60369 - RNA, 22 nt, Homo sapiens
uacacgugcacaacgugcacgu

SEQ ID NO: 60370 - RNA, 22 nt, Homo sapiens
uacagaauauuucugcccugag

SEQ ID NO: 60371 - RNA, 22 nt, Homo sapiens
uacagaguauccauuugaguuc

SEQ ID NO: 60372 - RNA, 22 nt, Homo sapiens
uacagucuggaggccuguguug

SEQ ID NO: 60373 - RNA, 22 nt, Homo sapiens
uacagugcuugguaucuaguaa

SEQ ID NO: 60374 - RNA, 22 nt, Homo sapiens
uacauaguaagcaucuccugug

SEQ ID NO: 60375 - RNA, 22 nt, Homo sapiens
uacauccauccugcugggcagu

SEQ ID NO: 60376 - RNA, 22 nt, Homo sapiens
uacauuggcuagguuuggaggc

SEQ ID NO: 60377 - RNA, 22 nt, Homo sapiens
uacucaauugcagucaccuggc

SEQ ID NO: 60378 - RNA, 22 nt, Homo sapiens
uacugagagaggaauauugaaa

SEQ ID NO: 60379 - RNA, 22 nt, Homo sapiens
uacuggccccaaaguagguagu

SEQ ID NO: 60380 - RNA, 20 nt, Homo sapiens
uagaaaguagaguggugguu

SEQ ID NO: 60381 - RNA, 22 nt, Homo sapiens
uagagcaaugacucuggaaacc

SEQ ID NO: 60382 - RNA, 22 nt, Homo sapiens
uagagcuaguugcucacugcuu

SEQ ID NO: 60383 - RNA, 22 nt, Homo sapiens
uagauuaucauucauacaggga

SEQ ID NO: 60384 - RNA, 22 nt, Homo sapiens
uagcaaaucaauggaauugaag

SEQ ID NO: 60385 - RNA, 21 nt, Homo sapiens
uagcaaauugcuauuaaggca

SEQ ID NO: 60386 - RNA, 22 nt, Homo sapiens
uagcaagaugaauuugugcaaa

SEQ ID NO: 60387 - RNA, 20 nt, Homo sapiens
uagcacacauguagaauagu

SEQ ID NO: 60388 - RNA, 22 nt, Homo sapiens
uagcaccugugcacaccaggca

SEQ ID NO: 60389 - RNA, 22 nt, Homo sapiens
uagcaggaaaggggucagaucu

SEQ ID NO: 60390 - RNA, 22 nt, Homo sapiens
uagcaguaagaaacugacauug

SEQ ID NO: 60391 - RNA, 22 nt, Homo sapiens
uagcaucagauuccauauucua

SEQ ID NO: 60392 - RNA, 22 nt, Homo sapiens
uagcucagcccagcuaagcuca

SEQ ID NO: 60393 - RNA, 21 nt, Homo sapiens
uagcucagugguguugccaua

SEQ ID NO: 60394 - RNA, 22 nt, Homo sapiens
uagcugcccagcacgaaguugg

SEQ ID NO: 60395 - RNA, 22 nt, Homo sapiens
uaggaaguuuucuugcugggcc

SEQ ID NO: 60396 - RNA, 22 nt, Homo sapiens
uaggacacagaccuggauggaa

SEQ ID NO: 60397 - RNA, 20 nt, Homo sapiens
uaggagcaaugagaguagaa

SEQ ID NO: 60398 - RNA, 22 nt, Homo sapiens
uaggcaaguugcccaaucucuc

SEQ ID NO: 60399 - RNA, 22 nt, Homo sapiens
uaggcacacaucuacuacaaau

SEQ ID NO: 60400 - RNA, 22 nt, Homo sapiens
uaggcacuguguuuguaggagu

SEQ ID NO: 60401 - RNA, 22 nt, Homo sapiens
uagggcuugugaucagguguag

SEQ ID NO: 60402 - RNA, 22 nt, Homo sapiens
uagguaguuagcauacuacaca

SEQ ID NO: 60403 - RNA, 22 nt, Homo sapiens
uaguaaacauuuuucuaucauu

SEQ ID NO: 60404 - RNA, 22 nt, Homo sapiens
uaguacuggcauguauuuccca

SEQ ID NO: 60405 - RNA, 22 nt, Homo sapiens
uaguaucacauggucuuaauua

SEQ ID NO: 60406 - RNA, 22 nt, Homo sapiens
uaguauguuuauagcauugagu

SEQ ID NO: 60407 - RNA, 21 nt, Homo sapiens
uagugcagugggguaugacuu

SEQ ID NO: 60408 - RNA, 22 nt, Homo sapiens
uaguggucccccagucccagcu

SEQ ID NO: 60409 - RNA, 22 nt, Homo sapiens
uaguugcauuggcugcuaugcu

SEQ ID NO: 60410 - RNA, 22 nt, Homo sapiens
uauacagcaaguuacugugcug

SEQ ID NO: 60411 - RNA, 22 nt, Homo sapiens
uauacaugugccauguuggugu

SEQ ID NO: 60412 - RNA, 22 nt, Homo sapiens
uauagcagccugaacaaaguaa

SEQ ID NO: 60413 - RNA, 22 nt, Homo sapiens
uauagcagugugagaacagacu

SEQ ID NO: 60414 - RNA, 21 nt, Homo sapiens
uauaguaguaugauuuacaau

SEQ ID NO: 60415 - RNA, 22 nt, Homo sapiens
uauaucuagagcggaccaggcu

SEQ ID NO: 60416 - RNA, 22 nt, Homo sapiens
uaucaaguuggaagagaaguaa

SEQ ID NO: 60417 - RNA, 22 nt, Homo sapiens
uaucaccacccugggaaacaua

SEQ ID NO: 60418 - RNA, 22 nt, Homo sapiens
uaucagcagcaggggcugcaga

SEQ ID NO: 60419 - RNA, 22 nt, Homo sapiens
uaucauuguguuauuucuucca

SEQ ID NO: 60420 - RNA, 22 nt, Homo sapiens
uaucccaauguaauaucacaaa

SEQ ID NO: 60421 - RNA, 22 nt, Homo sapiens
uaucuacauguagguauguaug

SEQ ID NO: 60422 - RNA, 22 nt, Homo sapiens
uaucucagaugagacuuguaac

SEQ ID NO: 60423 - RNA, 22 nt, Homo sapiens
uaucugcaucccauuuuuauca

SEQ ID NO: 60424 - RNA, 22 nt, Homo sapiens
uaugaaacucuaagauucacau

SEQ ID NO: 60425 - RNA, 22 nt, Homo sapiens
uaugaaagcuacuucucacaau

SEQ ID NO: 60426 - RNA, 22 nt, Homo sapiens
uaugagacugugagugagaaau

SEQ ID NO: 60427 - RNA, 22 nt, Homo sapiens
uaugaucauuauguuauugcag

SEQ ID NO: 60428 - RNA, 22 nt, Homo sapiens
uaugaugcuguuuagaaucucu

SEQ ID NO: 60429 - RNA, 22 nt, Homo sapiens
uaugcacuauggaaguagcuca

SEQ ID NO: 60430 - RNA, 22 nt, Homo sapiens
uaugcagacauuguuccaacca

SEQ ID NO: 60431 - RNA, 22 nt, Homo sapiens
uaugcaugucucuguacacgug

SEQ ID NO: 60432 - RNA, 22 nt, Homo sapiens
uaugccuuuuggcucaagaaac

SEQ ID NO: 60433 - RNA, 20 nt, Homo sapiens
uauucacucuccagucuugc

SEQ ID NO: 60434 - RNA, 22 nt, Homo sapiens
uauuccagcccuggugagccag

SEQ ID NO: 60435 - RNA, 22 nt, Homo sapiens
uauuccauuugugaaaggaagu

SEQ ID NO: 60436 - RNA, 22 nt, Homo sapiens
uauugacuugagaagggauuag

SEQ ID NO: 60437 - RNA, 22 nt, Homo sapiens
uauugauuuucaguguucagcu

SEQ ID NO: 60438 - RNA, 22 nt, Homo sapiens
uauugcaacagaagaaagaguc

SEQ ID NO: 60439 - RNA, 22 nt, Homo sapiens
uauugcuggcucugucuucauu

SEQ ID NO: 60440 - RNA, 22 nt, Homo sapiens
uauuguuaaagauguuaaugau

SEQ ID NO: 60441 - RNA, 22 nt, Homo sapiens
uauuuguccccuccaaaaguca

SEQ ID NO: 60442 - RNA, 22 nt, Homo sapiens
ucaaaucaucuuuuccaaagcu

SEQ ID NO: 60443 - RNA, 22 nt, Homo sapiens
ucaaaugauucacccaccuuug

SEQ ID NO: 60444 - RNA, 22 nt, Homo sapiens
ucaaaugcuguauuguaguaau

SEQ ID NO: 60445 - RNA, 21 nt, Homo sapiens
ucaaauugaaauuaggucauu

SEQ ID NO: 60446 - RNA, 18 nt, Homo sapiens
ucaagcuauugucaugcc

SEQ ID NO: 60447 - RNA, 22 nt, Homo sapiens
ucaaguaauacucccaucuugg

SEQ ID NO: 60448 - RNA, 22 nt, Homo sapiens
ucaaguacuuugcauagugccg

SEQ ID NO: 60449 - RNA, 22 nt, Homo sapiens
ucaaguagugacucgaguuauu

SEQ ID NO: 60450 - RNA, 22 nt, Homo sapiens
ucaagugauucuugugccuuag

SEQ ID NO: 60451 - RNA, 22 nt, Homo sapiens
ucaaugaaugaugguugguaug

SEQ ID NO: 60452 - RNA, 22 nt, Homo sapiens
ucaaugggcuacacauugagug

SEQ ID NO: 60453 - RNA, 16 nt, Homo sapiens
ucacaaacucuagcag

SEQ ID NO: 60454 - RNA, 22 nt, Homo sapiens
ucacaaagcuuggccugcuucu

SEQ ID NO: 60455 - RNA, 21 nt, Homo sapiens
ucacaaugaacagcagcagaa

SEQ ID NO: 60456 - RNA, 22 nt, Homo sapiens
ucacacugaaacuaggguguga

SEQ ID NO: 60457 - RNA, 22 nt, Homo sapiens
ucacacugcaucuguuggaauu

SEQ ID NO: 60458 - RNA, 22 nt, Homo sapiens
ucacagaugaggcgagaggcag

SEQ ID NO: 60459 - RNA, 17 nt, Homo sapiens
ucacaguguuaggauga

SEQ ID NO: 60460 - RNA, 22 nt, Homo sapiens
ucacauaguuuucgggaccuug

SEQ ID NO: 60461 - RNA, 22 nt, Homo sapiens
ucacauggaaaaguccaguaaa

SEQ ID NO: 60462 - RNA, 22 nt, Homo sapiens
ucacauggaggugauaguugaa

SEQ ID NO: 60463 - RNA, 18 nt, Homo sapiens
ucacauggccgagagaga

SEQ ID NO: 60464 - RNA, 22 nt, Homo sapiens
ucacaugggugcaauauaauca

SEQ ID NO: 60465 - RNA, 22 nt, Homo sapiens
ucacauuguacaaacagguaag

SEQ ID NO: 60466 - RNA, 22 nt, Homo sapiens
ucaccaguaauaaagagccugc

SEQ ID NO: 60467 - RNA, 22 nt, Homo sapiens
ucacgugguucauaaggcagaa

SEQ ID NO: 60468 - RNA, 22 nt, Homo sapiens
ucacugaaaccgccuccaccuc

SEQ ID NO: 60469 - RNA, 22 nt, Homo sapiens
ucacugaaaccuccaccucucg

SEQ ID NO: 60470 - RNA, 22 nt, Homo sapiens
ucacugagcacaggagaugugc

SEQ ID NO: 60471 - RNA, 20 nt, Homo sapiens
ucacugagugguccacagua

SEQ ID NO: 60472 - RNA, 22 nt, Homo sapiens
ucacugcgaccuccaccucccg

SEQ ID NO: 60473 - RNA, 22 nt, Homo sapiens
ucacugcgaccuccgccucccg

SEQ ID NO: 60474 - RNA, 22 nt, Homo sapiens
uuuggucagcugcgggucagcu

SEQ ID NO: 60475 - RNA, 22 nt, Homo sapiens
uuuguacacgugggugaauugu

SEQ ID NO: 60476 - RNA, 22 nt, Homo sapiens
uuuguagcucacucugagcuga

SEQ ID NO: 60477 - RNA, 22 nt, Homo sapiens
uuugucacucuuggagguuguu

SEQ ID NO: 60478 - RNA, 22 nt, Homo sapiens
uuugugagguggauagauugca

SEQ ID NO: 60479 - RNA, 22 nt, Homo sapiens
uuugugcuccuaugagaaucua

SEQ ID NO: 60480 - RNA, 22 nt, Homo sapiens
uuugugcugcaauuaauuuccc

SEQ ID NO: 60481 - RNA, 22 nt, Homo sapiens
uuuguucuucguuccugagcca

SEQ ID NO: 60482 - RNA, 22 nt, Homo sapiens
uuuucaguggccauaguggaga

SEQ ID NO: 60483 - RNA, 22 nt, Homo sapiens
uuuucaguuuuccagguagccg

SEQ ID NO: 60484 - RNA, 22 nt, Homo sapiens
uuuugcaccauccuaauaguau

SEQ ID NO: 60485 - RNA, 22 nt, Homo sapiens
uuuugcacuguuuuaucugaca

SEQ ID NO: 60486 - RNA, 22 nt, Homo sapiens
uuuugcaguuacagagagugag

SEQ ID NO: 60487 - RNA, 20 nt, Homo sapiens
uuuuggacuaaaggcauccc

SEQ ID NO: 60488 - RNA, 22 nt, Homo sapiens
agcugcacgugguaaauguaaa

SEQ ID NO: 60489 - RNA, 20 nt, Homo sapiens
agcugcagauauaaauccgc

SEQ ID NO: 60490 - RNA, 16 nt, Homo sapiens
agcuggaauuacaggc

SEQ ID NO: 60491 - RNA, 17 nt, Homo sapiens
agcuggaauuacgggag

SEQ ID NO: 60492 - RNA, 22 nt, Homo sapiens
agcuggauguggaugacccugu

SEQ ID NO: 60493 - RNA, 22 nt, Homo sapiens
agcuggcuguagcugcaagucu

SEQ ID NO: 60494 - RNA, 22 nt, Homo sapiens
agcuguaguuuauucauguuaa

SEQ ID NO: 60495 - RNA, 22 nt, Homo sapiens
agcuuaugcuuggaagagauga

SEQ ID NO: 60496 - RNA, 21 nt, Homo sapiens
agcuuguguguaucacagugu

SEQ ID NO: 60497 - RNA, 18 nt, Homo sapiens
aggaaugguaauacuuca

SEQ ID NO: 60498 - RNA, 22 nt, Homo sapiens
aggaauuuaauguaugauaaua

SEQ ID NO: 60499 - RNA, 22 nt, Homo sapiens
aggagguugguaccaucuguuu

SEQ ID NO: 60500 - RNA, 22 nt, Homo sapiens
aggauacugguaugggcugaau

SEQ ID NO: 60501 - RNA, 22 nt, Homo sapiens
aggaucauugacuauuauaagg

SEQ ID NO: 60502 - RNA, 22 nt, Homo sapiens
aggcaagagugacuacgugaaa

SEQ ID NO: 60503 - RNA, 22 nt, Homo sapiens
aggcauggagacuaaaauuaua

SEQ ID NO: 60504 - RNA, 22 nt, Homo sapiens
aggcaugguggcacauacaugu

SEQ ID NO: 60505 - RNA, 22 nt, Homo sapiens
agggagcaaaguggucuuucuc

SEQ ID NO: 60506 - RNA, 22 nt, Homo sapiens
agguagugugaugcuccuguuu

SEQ ID NO: 60507 - RNA, 21 nt, Homo sapiens
aggucaugaagauguucuaau

SEQ ID NO: 60508 - RNA, 22 nt, Homo sapiens
aggugcugagcagagaauccug

SEQ ID NO: 60509 - RNA, 21 nt, Homo sapiens
aggugucuuggguucccuggc

SEQ ID NO: 60510 - RNA, 21 nt, Homo sapiens
aguagcacugugucuuacaaa

SEQ ID NO: 60511 - RNA, 22 nt, Homo sapiens
aguaucaucuuguuggccaggc

SEQ ID NO: 60512 - RNA, 22 nt, Homo sapiens
aguauguagugcaaucagucag

SEQ ID NO: 60513 - RNA, 22 nt, Homo sapiens
aguauugcuaauaagagauuug

SEQ ID NO: 60514 - RNA, 22 nt, Homo sapiens
agucagauuggcauuuguuggg

SEQ ID NO: 60515 - RNA, 22 nt, Homo sapiens
agucagucuguccugugcugag

SEQ ID NO: 60516 - RNA, 22 nt, Homo sapiens
agucagugcauaagaaugaagu

SEQ ID NO: 60517 - RNA, 22 nt, Homo sapiens
agucaguggaguaaauguaauu

SEQ ID NO: 60518 - RNA, 22 nt, Homo sapiens
agucaugggagagaugugaucg

SEQ ID NO: 60519 - RNA, 22 nt, Homo sapiens
agucaugguaguaaauuuggac

SEQ ID NO: 60520 - RNA, 22 nt, Homo sapiens
agugcaaagccgagguuucuug

SEQ ID NO: 60521 - RNA, 22 nt, Homo sapiens
agugcaguggcacaaucuuggc

SEQ ID NO: 60522 - RNA, 22 nt, Homo sapiens
agugcaguggcauggucauaac

SEQ ID NO: 60523 - RNA, 22 nt, Homo sapiens
agugcaguugucacgugccuuc

SEQ ID NO: 60524 - RNA, 22 nt, Homo sapiens
agugccauggcugcuagauggc

SEQ ID NO: 60525 - RNA, 22 nt, Homo sapiens
aguggcuuuuuaguggcagaug

SEQ ID NO: 60526 - RNA, 22 nt, Homo sapiens
aguguuuuuaucaugaaagggu

SEQ ID NO: 60527 - RNA, 22 nt, Homo sapiens
aguguuuuucaugggauacuuu

SEQ ID NO: 60528 - RNA, 22 nt, Homo sapiens
auaaaccuacauuuucacuucu

SEQ ID NO: 60529 - RNA, 22 nt, Homo sapiens
auaaacugucaguggagaguaa

SEQ ID NO: 60530 - RNA, 22 nt, Homo sapiens
auaaagcaagucucuggccuca

SEQ ID NO: 60531 - RNA, 22 nt, Homo sapiens
auaaagcuauuccucucuuuuu

SEQ ID NO: 60532 - RNA, 22 nt, Homo sapiens
auaaauucauuuaagcuccuua

SEQ ID NO: 60533 - RNA, 22 nt, Homo sapiens
auaaggcagcugcuaaaaggca

SEQ ID NO: 60534 - RNA, 22 nt, Homo sapiens
auaaggcugguauagacauuca

SEQ ID NO: 60535 - RNA, 22 nt, Homo sapiens
auaauguuugauugagcagaua

SEQ ID NO: 60536 - RNA, 22 nt, Homo sapiens
auacaaguuauuugaacugcgg

SEQ ID NO: 60537 - RNA, 22 nt, Homo sapiens
auacaguaaugucuuaggcugu

SEQ ID NO: 60538 - RNA, 22 nt, Homo sapiens
auacaguugccauuucuugugc

SEQ ID NO: 60539 - RNA, 22 nt, Homo sapiens
auacaugugcaggucagguuac

SEQ ID NO: 60540 - RNA, 22 nt, Homo sapiens
auacaugugccauguucgugug

SEQ ID NO: 60541 - RNA, 16 nt, Homo sapiens
auaccacagugacaca

SEQ ID NO: 60542 - RNA, 22 nt, Homo sapiens
auagaguuagaaagaaauguuu

SEQ ID NO: 60543 - RNA, 22 nt, Homo sapiens
auagcacacuauagcuucaaac

SEQ ID NO: 60544 - RNA, 22 nt, Homo sapiens
gagacauguuugcuuaucugag

SEQ ID NO: 60545 - RNA, 22 nt, Homo sapiens
gagacugagucuugcucugucg

SEQ ID NO: 60546 - RNA, 22 nt, Homo sapiens
gagaugugugugauuauauaau

SEQ ID NO: 60547 - RNA, 22 nt, Homo sapiens
gagcaccagucccugucagugc

SEQ ID NO: 60548 - RNA, 20 nt, Homo sapiens
gagcaucacaggccucugcu

SEQ ID NO: 60549 - RNA, 20 nt, Homo sapiens
gagcucaucuucuuuaccac

SEQ ID NO: 60550 - RNA, 20 nt, Homo sapiens
gagcugguguacugccgggc

SEQ ID NO: 60551 - RNA, 22 nt, Homo sapiens
gagcuuggguuaaaguugccuu

SEQ ID NO: 60552 - RNA, 22 nt, Homo sapiens
gaggcaagaguaguuaaguuag

SEQ ID NO: 60553 - RNA, 22 nt, Homo sapiens
gaggcaaguggccaccgagucu

SEQ ID NO: 60554 - RNA, 22 nt, Homo sapiens
gaggcauugaaauauugcuuau

SEQ ID NO: 60555 - RNA, 22 nt, Homo sapiens
gaggcggugugaugucacaugc

SEQ ID NO: 60556 - RNA, 22 nt, Homo sapiens
gagguacgaaauacacuguacu

SEQ ID NO: 60557 - RNA, 22 nt, Homo sapiens
gagguauggauaucuggagagg

SEQ ID NO: 60558 - RNA, 22 nt, Homo sapiens
gagguaugugggcagacauuua

SEQ ID NO: 60559 - RNA, 22 nt, Homo sapiens
gaggucaggacauuuuugcuuu

SEQ ID NO: 60560 - RNA, 22 nt, Homo sapiens
gaguaacagcauaaauuuguga

SEQ ID NO: 60561 - RNA, 22 nt, Homo sapiens
gaguagugcugcaauaaacaua

SEQ ID NO: 60562 - RNA, 23 nt, Homo sapiens
gagugcaaugacaugaucucgga

SEQ ID NO: 60563 - RNA, 22 nt, Homo sapiens
gagugcaauggugcuaucucgg

SEQ ID NO: 60564 - RNA, 22 nt, Homo sapiens
gagugcauugguggucaggugu

SEQ ID NO: 60565 - RNA, 22 nt, Homo sapiens
gaguucaaaucucagcucuguu

SEQ ID NO: 60566 - RNA, 22 nt, Homo sapiens
gauaaauccagauucugaugua

SEQ ID NO: 60567 - RNA, 21 nt, Homo sapiens
gauaucuuuauucccaagagc

SEQ ID NO: 60568 - RNA, 22 nt, Homo sapiens
gauauugacuuauucuauguuu

SEQ ID NO: 60569 - RNA, 22 nt, Homo sapiens
gaucagagugaaccuuguuaug

SEQ ID NO: 60570 - RNA, 22 nt, Homo sapiens
gaugagauguucucauggauug

SEQ ID NO: 60571 - RNA, 22 nt, Homo sapiens
gaugaggcuagagacaugugua

SEQ ID NO: 60572 - RNA, 22 nt, Homo sapiens
gaugagguaggccugcuuugaa

SEQ ID NO: 60573 - RNA, 22 nt, Homo sapiens
gauggcacuuaagagcaagagc

SEQ ID NO: 60574 - RNA, 22 nt, Homo sapiens
gauggcucugcaggugagggua

SEQ ID NO: 60575 - RNA, 22 nt, Homo sapiens
gauuguguucauaggcauguua

SEQ ID NO: 60576 - RNA, 22 nt, Homo sapiens
gauuucaucuuuagaggaagga

SEQ ID NO: 60577 - RNA, 22 nt, Homo sapiens
gcaaagaaugcagauuugccuc

SEQ ID NO: 60578 - RNA, 23 nt, Homo sapiens
gcaaauaucguagagugucccug

SEQ ID NO: 60579 - RNA, 22 nt, Homo sapiens
gcaaaugcuacaccauuuugua

SEQ ID NO: 60580 - RNA, 22 nt, Homo sapiens
gcaagaaucugggaguaaaauu

SEQ ID NO: 60581 - RNA, 22 nt, Homo sapiens
gcacacguagaagcaugcauca

SEQ ID NO: 60582 - RNA, 22 nt, Homo sapiens
gcacagucaacacuuauucacc

SEQ ID NO: 60583 - RNA, 22 nt, Homo sapiens
gcaccaugguagaauaauggua

SEQ ID NO: 60584 - RNA, 22 nt, Homo sapiens
gcacccugucaaaauggaccaa

SEQ ID NO: 60585 - RNA, 22 nt, Homo sapiens
gcacugggccacauuuauuuuc

SEQ ID NO: 60586 - RNA, 22 nt, Homo sapiens
gcaggaauuucucugcagaccc

SEQ ID NO: 60587 - RNA, 22 nt, Homo sapiens
gcagugugaucacagcuuacug

SEQ ID NO: 60588 - RNA, 22 nt, Homo sapiens
gcaguguggguagagggcaaga

SEQ ID NO: 60589 - RNA, 20 nt, Homo sapiens
gcaguguucugaccugaauc

SEQ ID NO: 60590 - RNA, 22 nt, Homo sapiens
gcaguguugugauccaggucuu

SEQ ID NO: 60591 - RNA, 22 nt, Homo sapiens
gcaucacagggagacaggccuc

SEQ ID NO: 60592 - RNA, 22 nt, Homo sapiens
gcaugcacaugugaaaaaauga

SEQ ID NO: 60593 - RNA, 22 nt, Homo sapiens
gcccacuguuaaauuuguuuua

SEQ ID NO: 60594 - RNA, 22 nt, Homo sapiens
gcccuguguuuggguaugguca

SEQ ID NO: 60595 - RNA, 17 nt, Homo sapiens
gcccuuugugccucuuc

SEQ ID NO: 60596 - RNA, 22 nt, Homo sapiens
gcugaguaguauuucauuguau

SEQ ID NO: 60597 - RNA, 22 nt, Homo sapiens
gcugcacuuuaaggcauccccu

SEQ ID NO: 60598 - RNA, 22 nt, Homo sapiens
gcuggaauuaacauagaugugc

SEQ ID NO: 60599 - RNA, 18 nt, Homo sapiens
gcuguugucagagcacau

SEQ ID NO: 60600 - RNA, 22 nt, Homo sapiens
ggaaauguuggugucaugaguu

SEQ ID NO: 60601 - RNA, 20 nt, Homo sapiens
ggaagagugacacaagguau

SEQ ID NO: 60602 - RNA, 18 nt, Homo sapiens
ggaagccuauuuaguaac

SEQ ID NO: 60603 - RNA, 22 nt, Homo sapiens
ggaauauaaaaagccccagaau

SEQ ID NO: 60604 - RNA, 22 nt, Homo sapiens
ggacuagaucucccggcuucua

SEQ ID NO: 60605 - RNA, 22 nt, Homo sapiens
ggagauguuuaaccuuuuaucu

SEQ ID NO: 60606 - RNA, 22 nt, Homo sapiens
ggaguaaaagaguaggaggaau

SEQ ID NO: 60607 - RNA, 23 nt, Homo sapiens
ggaguguaaugacucgaucucgg

SEQ ID NO: 60608 - RNA, 22 nt, Homo sapiens
ggauacaucuggacagccgaau

SEQ ID NO: 60609 - RNA, 22 nt, Homo sapiens
ggaucacuugagaccaggaguu

SEQ ID NO: 60610 - RNA, 22 nt, Homo sapiens
ggaucauaugauagcucaauuu

SEQ ID NO: 60611 - RNA, 22 nt, Homo sapiens
ggcaagaaaaugcaauuacugu

SEQ ID NO: 60612 - RNA, 22 nt, Homo sapiens
ggcaagaaccacaauuacuuuu

SEQ ID NO: 60613 - RNA, 22 nt, Homo sapiens
ggcaagauagauaucaguguca

SEQ ID NO: 60614 - RNA, 23 nt, Homo sapiens
ggcaagaucucagcucacugcaa

SEQ ID NO: 60615 - RNA, 22 nt, Homo sapiens
ggcaaugaggcggaccagcagg

SEQ ID NO: 60616 - RNA, 22 nt, Homo sapiens
ggcaccacagacgccaggcgug

SEQ ID NO: 60617 - RNA, 19 nt, Homo sapiens
ggcacugugugagugagga

SEQ ID NO: 60618 - RNA, 22 nt, Homo sapiens
ggcagcaugggugccuuuguga

SEQ ID NO: 60619 - RNA, 22 nt, Homo sapiens
ggcagguaaggagugggagccu

SEQ ID NO: 60620 - RNA, 22 nt, Homo sapiens
ggccagaugaucuaugaaggaa

SEQ ID NO: 60621 - RNA, 22 nt, Homo sapiens
ggccagaugcaguggcucacac

SEQ ID NO: 60622 - RNA, 22 nt, Homo sapiens
ggcuuuggucacacaggggcaa

SEQ ID NO: 60623 - RNA, 22 nt, Homo sapiens
gggaagugugguuucuuuacag

SEQ ID NO: 60624 - RNA, 22 nt, Homo sapiens
gggcauaucacuugaggucagg

SEQ ID NO: 60625 - RNA, 22 nt, Homo sapiens
ggggaauguuaaagaauuugca

SEQ ID NO: 60626 - RNA, 22 nt, Homo sapiens
ggggucauuaaauuccgcuggu

SEQ ID NO: 60627 - RNA, 19 nt, Homo sapiens
gggucaguuugaaugauua

SEQ ID NO: 60628 - RNA, 22 nt, Homo sapiens
ggucacauuggacuaucaaguu

SEQ ID NO: 60629 - RNA, 22 nt, Homo sapiens
ggucacccugaugcuggugguc

SEQ ID NO: 60630 - RNA, 23 nt, Homo sapiens
ggugaggaguacagagucuucau

SEQ ID NO: 60631 - RNA, 22 nt, Homo sapiens
gguggcuuuuugugauggcuga

SEQ ID NO: 60632 - RNA, 20 nt, Homo sapiens
guaaacucucagcauagaug

SEQ ID NO: 60633 - RNA, 22 nt, Homo sapiens
guaaacuuccccucaugaauga

SEQ ID NO: 60634 - RNA, 22 nt, Homo sapiens
guaaaugcagaugcaugaccuu

SEQ ID NO: 60635 - RNA, 22 nt, Homo sapiens
guaacagucucaacaguggucu

SEQ ID NO: 60636 - RNA, 22 nt, Homo sapiens
guaauacuuuugggauauuaga

SEQ ID NO: 60637 - RNA, 19 nt, Homo sapiens
guaaucucaguacuuuggu

SEQ ID NO: 60638 - RNA, 22 nt, Homo sapiens
aaaugcuucuauguggcauguu

SEQ ID NO: 60639 - RNA, 22 nt, Homo sapiens
aaauggauuaaguucacuugcu

SEQ ID NO: 60640 - RNA, 22 nt, Homo sapiens
aaauggcuuugaggguaggaca

SEQ ID NO: 60641 - RNA, 22 nt, Homo sapiens
aaauggcuuuuugggcaaggug

SEQ ID NO: 60642 - RNA, 21 nt, Homo sapiens
aaaugugcuuuaguacccuca

SEQ ID NO: 60643 - RNA, 22 nt, Homo sapiens
aaauugcuuuugaagacuuagu

SEQ ID NO: 60644 - RNA, 22 nt, Homo sapiens
aacaccaucccuuugaugcuuu

SEQ ID NO: 60645 - RNA, 22 nt, Homo sapiens
aacagaauccucuuuuccuggg

SEQ ID NO: 60646 - RNA, 22 nt, Homo sapiens
aacagcacacccgcugcuucca

SEQ ID NO: 60647 - RNA, 22 nt, Homo sapiens
aacagcauaguacccgugauaa

SEQ ID NO: 60648 - RNA, 22 nt, Homo sapiens
aacagugcauuccuguccauau

SEQ ID NO: 60649 - RNA, 22 nt, Homo sapiens
aacagugccugucauuuaguag

SEQ ID NO: 60650 - RNA, 21 nt, Homo sapiens
aacagugcugaacagacaccu

SEQ ID NO: 60651 - RNA, 22 nt, Homo sapiens
aacaguguuuuggguuuucugg

SEQ ID NO: 60652 - RNA, 22 nt, Homo sapiens
aacaucaaccaugaggguugga

SEQ ID NO: 60653 - RNA, 22 nt, Homo sapiens
aacucacauucuuucuugguac

SEQ ID NO: 60654 - RNA, 22 nt, Homo sapiens
aacucugucuccuucaaguuca

SEQ ID NO: 60655 - RNA, 22 nt, Homo sapiens
aacugguauuucccaugaauuu

SEQ ID NO: 60656 - RNA, 22 nt, Homo sapiens
aagaccuaugcaggaagaaaug

SEQ ID NO: 60657 - RNA, 22 nt, Homo sapiens
aagagguagaagcuugccuucu

SEQ ID NO: 60658 - RNA, 22 nt, Homo sapiens
aagaugcagucauacuggagua

SEQ ID NO: 60659 - RNA, 22 nt, Homo sapiens
aagcaccaauaggagauuuguc

SEQ ID NO: 60660 - RNA, 22 nt, Homo sapiens
aagcacccagccucacgccugc

SEQ ID NO: 60661 - RNA, 22 nt, Homo sapiens
aagcagacauguucauuuugaa

SEQ ID NO: 60662 - RNA, 22 nt, Homo sapiens
aagcaguguggacuaaugggaa

SEQ ID NO: 60663 - RNA, 22 nt, Homo sapiens
aagcucuuguugaaucuuguca

SEQ ID NO: 60664 - RNA, 22 nt, Homo sapiens
aagcugccaggcaugguggcug

SEQ ID NO: 60665 - RNA, 22 nt, Homo sapiens
aagcugccuugcugaggagaaa

SEQ ID NO: 60666 - RNA, 22 nt, Homo sapiens
aaggagcagagagcccuguuuc

SEQ ID NO: 60667 - RNA, 22 nt, Homo sapiens
aaggagugugauucuucaguuu

SEQ ID NO: 60668 - RNA, 22 nt, Homo sapiens
aaggcaugcaguacguuucuau

SEQ ID NO: 60669 - RNA, 22 nt, Homo sapiens
aaggcaugcugaguccuaaaag

SEQ ID NO: 60670 - RNA, 22 nt, Homo sapiens
aaggcauucucaaacuaguucu

SEQ ID NO: 60671 - RNA, 22 nt, Homo sapiens
aagggaaugcuuccaguuugug

SEQ ID NO: 60672 - RNA, 22 nt, Homo sapiens
aagggagcugcauaaucuugug

SEQ ID NO: 60673 - RNA, 22 nt, Homo sapiens
aagguauuucuaugggaauaga

SEQ ID NO: 60674 - RNA, 22 nt, Homo sapiens
aaggugguuuucucuuggaguc

SEQ ID NO: 60675 - RNA, 22 nt, Homo sapiens
aagguucuugcuugcaugacug

SEQ ID NO: 60676 - RNA, 22 nt, Homo sapiens
aagguuguauuuaauauacugu

SEQ ID NO: 60677 - RNA, 19 nt, Homo sapiens
aaguacuugucuuuugaag

SEQ ID NO: 60678 - RNA, 22 nt, Homo sapiens
gugucaguggggagugaucuuc

SEQ ID NO: 60679 - RNA, 22 nt, Homo sapiens
gugugcauggagggggcaguga

SEQ ID NO: 60680 - RNA, 22 nt, Homo sapiens
guguggcaggugggggcucaga

SEQ ID NO: 60681 - RNA, 22 nt, Homo sapiens
guguuauggagccaaacuacua

SEQ ID NO: 60682 - RNA, 22 nt, Homo sapiens
guguucaaagcugauugagauu

SEQ ID NO: 60683 - RNA, 22 nt, Homo sapiens
guguugcacauucuguggaugu

SEQ ID NO: 60684 - RNA, 22 nt, Homo sapiens
guguuugauugcaaauaaucua

SEQ ID NO: 60685 - RNA, 22 nt, Homo sapiens
guguuugguugauagagccacu

SEQ ID NO: 60686 - RNA, 22 nt, Homo sapiens
guuaugcagcaauugauaaucu

SEQ ID NO: 60687 - RNA, 22 nt, Homo sapiens
guucaucagggauacuggcuua

SEQ ID NO: 60688 - RNA, 17 nt, Homo sapiens
guucccaguggcauuug

SEQ ID NO: 60689 - RNA, 20 nt, Homo sapiens
guucccuguaggugugcgga

SEQ ID NO: 60690 - RNA, 22 nt, Homo sapiens
guucucacuggacugugaaaau

SEQ ID NO: 60691 - RNA, 22 nt, Homo sapiens
guugcucaggccggagugcagu

SEQ ID NO: 60692 - RNA, 22 nt, Homo sapiens
guuggaauguauugcuacuucu

SEQ ID NO: 60693 - RNA, 22 nt, Homo sapiens
guugggcccauagacugccagu

SEQ ID NO: 60694 - RNA, 22 nt, Homo sapiens
guugugcuuaagccuauugauu

SEQ ID NO: 60695 - RNA, 22 nt, Homo sapiens
guuguggagucuucuguucugg

SEQ ID NO: 60696 - RNA, 22 nt, Homo sapiens
guuuaacugguacuucaagucu

SEQ ID NO: 60697 - RNA, 22 nt, Homo sapiens
uaaacugcuugaaaugguguca

SEQ ID NO: 60698 - RNA, 22 nt, Homo sapiens
uaaagccuagaacuuucagccc

SEQ ID NO: 60699 - RNA, 22 nt, Homo sapiens
uaaaguuauugccccucaguua

SEQ ID NO: 60700 - RNA, 22 nt, Homo sapiens
uaaaugcuugagaugauggaua

SEQ ID NO: 60701 - RNA, 22 nt, Homo sapiens
uaaauugcauaaguacaaauga

SEQ ID NO: 60702 - RNA, 22 nt, Homo sapiens
uaacauugucuugcuuaguuuu

SEQ ID NO: 60703 - RNA, 22 nt, Homo sapiens
uaacuaguagauggcugacaua

SEQ ID NO: 60704 - RNA, 22 nt, Homo sapiens
uaagcucauuccagccaugucc

SEQ ID NO: 60705 - RNA, 22 nt, Homo sapiens
uaaggcacauaggccuggaaac

SEQ ID NO: 60706 - RNA, 22 nt, Homo sapiens
uaaggcacucuucugugugccu

SEQ ID NO: 60707 - RNA, 22 nt, Homo sapiens
uaaggcccggccuuuccaagca

SEQ ID NO: 60708 - RNA, 22 nt, Homo sapiens
uaaguaauugcagcaauuugcc

SEQ ID NO: 60709 - RNA, 22 nt, Homo sapiens
uaaguaauugugguuuuugcca

SEQ ID NO: 60710 - RNA, 22 nt, Homo sapiens
uaaguacugucagaauuggacu

SEQ ID NO: 60711 - RNA, 22 nt, Homo sapiens
uaaguacuuuacagacauuauc

SEQ ID NO: 60712 - RNA, 19 nt, Homo sapiens
uaaguagaugacugaugcu

SEQ ID NO: 60713 - RNA, 22 nt, Homo sapiens
uaaguaucaguuuagcuaugau

SEQ ID NO: 60714 - RNA, 22 nt, Homo sapiens
uaagugaaggaaguguguuuac

SEQ ID NO: 60715 - RNA, 22 nt, Homo sapiens
uaagugaauauggacaguuagc

SEQ ID NO: 60716 - RNA, 22 nt, Homo sapiens
uaagugaugucuuuuugugugc

SEQ ID NO: 60717 - RNA, 22 nt, Homo sapiens
uaagugcuguguuguuaccuaa

SEQ ID NO: 60718 - RNA, 22 nt, Homo sapiens
uaaguguaaugucugaaguuug

SEQ ID NO: 60719 - RNA, 21 nt, Homo sapiens
uaauaaugucucagacaccua

SEQ ID NO: 60720 - RNA, 22 nt, Homo sapiens
uaauacugcugugcuugaguug

SEQ ID NO: 60721 - RNA, 22 nt, Homo sapiens
uaauagagucauuauuauuguu

SEQ ID NO: 60722 - RNA, 22 nt, Homo sapiens
uaaugcacauuuauuuuaccuu

SEQ ID NO: 60723 - RNA, 22 nt, Homo sapiens
uaaugugaauagugcuguaaug

SEQ ID NO: 60724 - RNA, 22 nt, Homo sapiens
uacacagucaaaaauuuccagg

SEQ ID NO: 60725 - RNA, 22 nt, Homo sapiens
uacaccaauuuaaucaaaagca

SEQ ID NO: 60726 - RNA, 22 nt, Homo sapiens
uacagccacauaauguaugauu

SEQ ID NO: 60727 - RNA, 22 nt, Homo sapiens
uacaggcaccuggcuaauuuuu

SEQ ID NO: 60728 - RNA, 22 nt, Homo sapiens
uacaggcagguguucccugguu

SEQ ID NO: 60729 - RNA, 22 nt, Homo sapiens
uacaguaggauuuucagggucu

SEQ ID NO: 60730 - RNA, 22 nt, Homo sapiens
acauagaguaguggugaggaug

SEQ ID NO: 60731 - RNA, 22 nt, Homo sapiens
acauaguagacacugaaaauau

SEQ ID NO: 60732 - RNA, 17 nt, Homo sapiens
acaugagacuggauucu

SEQ ID NO: 60733 - RNA, 22 nt, Homo sapiens
acaugcauccaugugaagagac

SEQ ID NO: 60734 - RNA, 22 nt, Homo sapiens
acaugcauggcaugcauuguac

SEQ ID NO: 60735 - RNA, 22 nt, Homo sapiens
acauguauauaaugcauagcga

SEQ ID NO: 60736 - RNA, 18 nt, Homo sapiens
acauucagcuugaagaua

SEQ ID NO: 60737 - RNA, 19 nt, Homo sapiens
acauugcauuuguaggcuu

SEQ ID NO: 60738 - RNA, 22 nt, Homo sapiens
acauugcucuuaccaaguuugu

SEQ ID NO: 60739 - RNA, 22 nt, Homo sapiens
accacaggguaaaguuagauau

SEQ ID NO: 60740 - RNA, 22 nt, Homo sapiens
accagucucagguaugucuuua

SEQ ID NO: 60741 - RNA, 22 nt, Homo sapiens
accaugcaguccaauaugcaca

SEQ ID NO: 60742 - RNA, 22 nt, Homo sapiens
acccacuagaugccaguggcac

SEQ ID NO: 60743 - RNA, 22 nt, Homo sapiens
acccuggagagugcuguaguaa

SEQ ID NO: 60744 - RNA, 22 nt, Homo sapiens
acgcagcacauucacagcuaug

SEQ ID NO: 60745 - RNA, 23 nt, Homo sapiens
acugcaauuacguuugcaccaac

SEQ ID NO: 60746 - RNA, 22 nt, Homo sapiens
acugcacuccagccugcccaac

SEQ ID NO: 60747 - RNA, 22 nt, Homo sapiens
acugcacuguccuagaguccuc

SEQ ID NO: 60748 - RNA, 22 nt, Homo sapiens
acugcacuucagccuuggcuac

SEQ ID NO: 60749 - RNA, 20 nt, Homo sapiens
acuggcacugguaggugugg

SEQ ID NO: 60750 - RNA, 22 nt, Homo sapiens
acugggauauuauugguaauau

SEQ ID NO: 60751 - RNA, 22 nt, Homo sapiens
acuuggcaaaguuuuaaacagc

SEQ ID NO: 60752 - RNA, 22 nt, Homo sapiens
agaaacauucucuugccuccuu

SEQ ID NO: 60753 - RNA, 22 nt, Homo sapiens
agaagugcuggguucaggcugg

SEQ ID NO: 60754 - RNA, 19 nt, Homo sapiens
agaaucuaaauuauuucug

SEQ ID NO: 60755 - RNA, 22 nt, Homo sapiens
agaauguaacucuaugaaggca

SEQ ID NO: 60756 - RNA, 22 nt, Homo sapiens
agacaguguguguauauauggu

SEQ ID NO: 60757 - RNA, 22 nt, Homo sapiens
agacccuguauguguuuaguuu

SEQ ID NO: 60758 - RNA, 19 nt, Homo sapiens
agagacucauuguagcauu

SEQ ID NO: 60759 - RNA, 22 nt, Homo sapiens
agaugccuaugaagagaaauua

SEQ ID NO: 60760 - RNA, 22 nt, Homo sapiens
agauggauuuuguagccccagc

SEQ ID NO: 60761 - RNA, 22 nt, Homo sapiens
agaugguauuauagguuucugu

SEQ ID NO: 60762 - RNA, 22 nt, Homo sapiens
agcaacauuguucauaauagcu

SEQ ID NO: 60763 - RNA, 22 nt, Homo sapiens
agcaagaaugaacucucccaga

SEQ ID NO: 60764 - RNA, 22 nt, Homo sapiens
agcacauuaguaucuaagaaca

SEQ ID NO: 60765 - RNA, 22 nt, Homo sapiens
agcaccauuguacuccagccug

SEQ ID NO: 60766 - RNA, 22 nt, Homo sapiens
agcagcaugaggggacuucugc

SEQ ID NO: 60767 - RNA, 22 nt, Homo sapiens
agcagcauggguauaaaucucc

SEQ ID NO: 60768 - RNA, 22 nt, Homo sapiens
agcagcuuugcauggccuguga

SEQ ID NO: 60769 - RNA, 22 nt, Homo sapiens
agcagguguccacaauguuugc

SEQ ID NO: 60770 - RNA, 16 nt, Homo sapiens
agcagguguuagguga

SEQ ID NO: 60771 - RNA, 22 nt, Homo sapiens
agcaguagaauuccugcaucac

SEQ ID NO: 60772 - RNA, 22 nt, Homo sapiens
agcaucacacacuacagggaaa

SEQ ID NO: 60773 - RNA, 22 nt, Homo sapiens
cugccaguuugauucgggccac

SEQ ID NO: 60774 - RNA, 22 nt, Homo sapiens
cugccuagaucugaaccuggcu

SEQ ID NO: 60775 - RNA, 22 nt, Homo sapiens
cugccuagauguuguagggggu

SEQ ID NO: 60776 - RNA, 22 nt, Homo sapiens
cuggaaagaaacccuuaauucu

SEQ ID NO: 60777 - RNA, 22 nt, Homo sapiens
cuggaaagcaaguccauugcuc

SEQ ID NO: 60778 - RNA, 22 nt, Homo sapiens
cuggacguugaggcugcaguga

SEQ ID NO: 60779 - RNA, 22 nt, Homo sapiens
cuggagauuaaccaauugccau

SEQ ID NO: 60780 - RNA, 22 nt, Homo sapiens
cuggagcauugguggauuuguu

SEQ ID NO: 60781 - RNA, 22 nt, Homo sapiens
cuggaggccugaacauaaaugg

SEQ ID NO: 60782 - RNA, 22 nt, Homo sapiens
cuggcaauaaauuuuuguguug

SEQ ID NO: 60783 - RNA, 22 nt, Homo sapiens
cuggcucugagguguuuagggc

SEQ ID NO: 60784 - RNA, 22 nt, Homo sapiens
cuggcucugggcuaaagaaaua

SEQ ID NO: 60785 - RNA, 22 nt, Homo sapiens
cugguaguguuuauaaggguau

SEQ ID NO: 60786 - RNA, 22 nt, Homo sapiens
cuggugagaugucuuuccucuu

SEQ ID NO: 60787 - RNA, 22 nt, Homo sapiens
cuguagcuuuuauaugcuuagc

SEQ ID NO: 60788 - RNA, 22 nt, Homo sapiens
cugucacuggggcacauguccc

SEQ ID NO: 60789 - RNA, 22 nt, Homo sapiens
cugucucagccucuccaguagc

SEQ ID NO: 60790 - RNA, 22 nt, Homo sapiens
cugugaagaaagucauugguag

SEQ ID NO: 60791 - RNA, 22 nt, Homo sapiens
cugugcaaagcgcucucggggu

SEQ ID NO: 60792 - RNA, 22 nt, Homo sapiens
cugugcacaucuggcggcccga

SEQ ID NO: 60793 - RNA, 22 nt, Homo sapiens
cugugccaagcuugcgaugugc

SEQ ID NO: 60794 - RNA, 22 nt, Homo sapiens
cugugcuaggcaaugugguaga

SEQ ID NO: 60795 - RNA, 22 nt, Homo sapiens
cuguugcaguuauggcugcagg

SEQ ID NO: 60796 - RNA, 18 nt, Homo sapiens
cuuaacauugggaugaua

SEQ ID NO: 60797 - RNA, 22 nt, Homo sapiens
cuucaccaguuuggcagucuca

SEQ ID NO: 60798 - RNA, 22 nt, Homo sapiens
cuucagcaauauauccccuggg

SEQ ID NO: 60799 - RNA, 22 nt, Homo sapiens
cuuccaguggcagccgggcaug

SEQ ID NO: 60800 - RNA, 22 nt, Homo sapiens
cuuccugaguccugggcucaca

SEQ ID NO: 60801 - RNA, 21 nt, Homo sapiens
cuucuuggggcagggcagggu

SEQ ID NO: 60802 - RNA, 22 nt, Homo sapiens
cuuggacaccucaugcccaccu

SEQ ID NO: 60803 - RNA, 22 nt, Homo sapiens
cuuggcacugcucacccuccuu

SEQ ID NO: 60804 - RNA, 19 nt, Homo sapiens
cuuguacucggcgcaguug

SEQ ID NO: 60805 - RNA, 19 nt, Homo sapiens
cuugugccugaagcuuggg

SEQ ID NO: 60806 - RNA, 22 nt, Homo sapiens
cuuuacacauccuaaccagugu

SEQ ID NO: 60807 - RNA, 21 nt, Homo sapiens
cuuuaugcuguguuagaaaag

SEQ ID NO: 60808 - RNA, 22 nt, Homo sapiens
cuuucugaggagaauagagaac

SEQ ID NO: 60809 - RNA, 18 nt, Homo sapiens
cuuugcagcuuccagagg

SEQ ID NO: 60810 - RNA, 22 nt, Homo sapiens
cuuuggcacuuccuaagugcca

SEQ ID NO: 60811 - RNA, 22 nt, Homo sapiens
cuuuggccauagcuaaaugauu

SEQ ID NO: 60812 - RNA, 22 nt, Homo sapiens
cuuuggguauucucccuugggg

SEQ ID NO: 60813 - RNA, 23 nt, Homo sapiens
cuuugguaggaaauuugaauuau

SEQ ID NO: 60814 - RNA, 18 nt, Homo sapiens
cuuugguccccgcacccu

SEQ ID NO: 60815 - RNA, 22 nt, Homo sapiens
cuuuuacacuguuggugggaau

SEQ ID NO: 60816 - RNA, 22 nt, Homo sapiens
cuuuuugcugcagcaauacugg

SEQ ID NO: 60817 - RNA, 22 nt, Homo sapiens
gaaagacuuucugcuguggaua

SEQ ID NO: 60818 - RNA, 22 nt, Homo sapiens
gaaggcacugugugccacccug

SEQ ID NO: 60819 - RNA, 23 nt, Homo sapiens
gaaguauagcaugcacauggaaa

SEQ ID NO: 60820 - RNA, 22 nt, Homo sapiens
ucacauagcauaaugucugcaa

SEQ ID NO: 60821 - RNA, 22 nt, Homo sapiens
ucacaugcacaucucuggaacc

SEQ ID NO: 60822 - RNA, 22 nt, Homo sapiens
ucacaugugacauauauauuug

SEQ ID NO: 60823 - RNA, 22 nt, Homo sapiens
ucacauuguauauguaccuauc

SEQ ID NO: 60824 - RNA, 22 nt, Homo sapiens
ucaccaccugcugaucauagag

SEQ ID NO: 60825 - RNA, 22 nt, Homo sapiens
ucaccaccuuccaggaccacug

SEQ ID NO: 60826 - RNA, 22 nt, Homo sapiens
ucacccacacaggagacaggga

SEQ ID NO: 60827 - RNA, 20 nt, Homo sapiens
ucacccugacaucugcccag

SEQ ID NO: 60828 - RNA, 22 nt, Homo sapiens
ucaccucgugaucugcccacuu

SEQ ID NO: 60829 - RNA, 22 nt, Homo sapiens
ucaccuggagagcuugcuaaua

SEQ ID NO: 60830 - RNA, 22 nt, Homo sapiens
ucaccuggggaucuuguuuaca

SEQ ID NO: 60831 - RNA, 21 nt, Homo sapiens
ucaccuguugcgaugaagcug

SEQ ID NO: 60832 - RNA, 19 nt, Homo sapiens
ucacgugcagcagccacac

SEQ ID NO: 60833 - RNA, 22 nt, Homo sapiens
ucacuauagaaaacagugugga

SEQ ID NO: 60834 - RNA, 22 nt, Homo sapiens
ucacugaggucugagcuuuaug

SEQ ID NO: 60835 - RNA, 22 nt, Homo sapiens
ucacugcgaccucugccucccg

SEQ ID NO: 60836 - RNA, 22 nt, Homo sapiens
ucacuggccaaauucuggguga

SEQ ID NO: 60837 - RNA, 22 nt, Homo sapiens
ucacugugagaguuuauccugu

SEQ ID NO: 60838 - RNA, 22 nt, Homo sapiens
ucacugugcacauaugauaggu

SEQ ID NO: 60839 - RNA, 22 nt, Homo sapiens
ucacugugguuuugaugugcau

SEQ ID NO: 60840 - RNA, 22 nt, Homo sapiens
ucacuuggccgcagccuucucu

SEQ ID NO: 60841 - RNA, 22 nt, Homo sapiens
ucacuuggugaacacauuaugu

SEQ ID NO: 60842 - RNA, 22 nt, Homo sapiens
ucacuugguggcaaaguuuaug

SEQ ID NO: 60843 - RNA, 22 nt, Homo sapiens
ucagaaccuccuagcaguguuc

SEQ ID NO: 60844 - RNA, 22 nt, Homo sapiens
ucagaacugaacaaaccagucu

SEQ ID NO: 60845 - RNA, 22 nt, Homo sapiens
ucagaauguaacuuuaguugga

SEQ ID NO: 60846 - RNA, 22 nt, Homo sapiens
ucagacacuguggccuuuggac

SEQ ID NO: 60847 - RNA, 22 nt, Homo sapiens
ucagaguaguuccuggcagaaa

SEQ ID NO: 60848 - RNA, 22 nt, Homo sapiens
ucagcacauucaaggccugccu

SEQ ID NO: 60849 - RNA, 20 nt, Homo sapiens
ucagcagucuggagcagagg

SEQ ID NO: 60850 - RNA, 22 nt, Homo sapiens
ucagcagugugaaaacaaacua

SEQ ID NO: 60851 - RNA, 20 nt, Homo sapiens
ucagguagggcuucaacauu

SEQ ID NO: 60852 - RNA, 22 nt, Homo sapiens
ucagguauuuuaucacaugaag

SEQ ID NO: 60853 - RNA, 22 nt, Homo sapiens
ucaggugccuuggcuaauuguu

SEQ ID NO: 60854 - RNA, 22 nt, Homo sapiens
ucagguugcuaaguauaauauu

SEQ ID NO: 60855 - RNA, 22 nt, Homo sapiens
ucagugauugcuuucauggaaa

SEQ ID NO: 60856 - RNA, 22 nt, Homo sapiens
ucagugcuuuuuguugucauca

SEQ ID NO: 60857 - RNA, 22 nt, Homo sapiens
ucaguggacuuagucuuucccc

SEQ ID NO: 60858 - RNA, 22 nt, Homo sapiens
ucaguggagcuacaauucuggg

SEQ ID NO: 60859 - RNA, 22 nt, Homo sapiens
ucagugguuaaaagauucuaga

SEQ ID NO: 60860 - RNA, 22 nt, Homo sapiens
ucagugucugugauggagaggu

SEQ ID NO: 60861 - RNA, 22 nt, Homo sapiens
ucauacaggccaccagggaagu

SEQ ID NO: 60862 - RNA, 22 nt, Homo sapiens
ucauacaguaguccucacuugu

SEQ ID NO: 60863 - RNA, 22 nt, Homo sapiens
ucauacuguccaauucuagugg

SEQ ID NO: 60864 - RNA, 22 nt, Homo sapiens
ucaucaggcucauucaagcuga

SEQ ID NO: 60865 - RNA, 22 nt, Homo sapiens
ucaucaguuuuuuauaugugau

SEQ ID NO: 60866 - RNA, 19 nt, Homo sapiens
ucauggcuuuuucagcugu

SEQ ID NO: 60867 - RNA, 22 nt, Homo sapiens
ucaugggagcccccaucaugag

SEQ ID NO: 60868 - RNA, 22 nt, Homo sapiens
ucaggucauuccaggagggcca

SEQ ID NO: 60869 - RNA, 22 nt, Homo sapiens
ucaguaaucuuagcugugcaga

SEQ ID NO: 60870 - RNA, 22 nt, Homo sapiens
ucagucauguuuaccagacgua

SEQ ID NO: 60871 - RNA, 22 nt, Homo sapiens
ucagugccauugccauaugagu

SEQ ID NO: 60872 - RNA, 22 nt, Homo sapiens
ucagugccucaguuuuuaaaga

SEQ ID NO: 60873 - RNA, 22 nt, Homo sapiens
ucaguggauuuaaccugaauca

SEQ ID NO: 60874 - RNA, 22 nt, Homo sapiens
ucagugucaucuggguuguuug

SEQ ID NO: 60875 - RNA, 22 nt, Homo sapiens
ucagugucugcauucuuauugu

SEQ ID NO: 60876 - RNA, 22 nt, Homo sapiens
ucaguguuuggaaucucaauuu

SEQ ID NO: 60877 - RNA, 22 nt, Homo sapiens
ucauagucuaagguucuuuugc

SEQ ID NO: 60878 - RNA, 21 nt, Homo sapiens
ucaucagucaaagacaauggu

SEQ ID NO: 60879 - RNA, 22 nt, Homo sapiens
ucaucagugcuugcaaauuauu

SEQ ID NO: 60880 - RNA, 22 nt, Homo sapiens
ucauccauacaguuagcaaagg

SEQ ID NO: 60881 - RNA, 22 nt, Homo sapiens
ucauggcacugaugagaguuuc

SEQ ID NO: 60882 - RNA, 22 nt, Homo sapiens
ucauggggugcuuugcuagauu

SEQ ID NO: 60883 - RNA, 22 nt, Homo sapiens
ucauuagagaucuuggggaaaa

SEQ ID NO: 60884 - RNA, 22 nt, Homo sapiens
ucauucacucccuugaaguuag

SEQ ID NO: 60885 - RNA, 22 nt, Homo sapiens
ucauucauuugcucacuccaca

SEQ ID NO: 60886 - RNA, 18 nt, Homo sapiens
ucauuggugagcaccucc

SEQ ID NO: 60887 - RNA, 22 nt, Homo sapiens
ucauugguucuggguguuguug

SEQ ID NO: 60888 - RNA, 21 nt, Homo sapiens
ucauugguuggcugcccugua

SEQ ID NO: 60889 - RNA, 22 nt, Homo sapiens
ucauuguccaacuucuuucagu

SEQ ID NO: 60890 - RNA, 22 nt, Homo sapiens
uccacagugguggaauuguuca

SEQ ID NO: 60891 - RNA, 19 nt, Homo sapiens
uccacagugguugaacuag

SEQ ID NO: 60892 - RNA, 22 nt, Homo sapiens
uccacagugguugaacuaguuu

SEQ ID NO: 60893 - RNA, 19 nt, Homo sapiens
uccaccgcgugcaccucua

SEQ ID NO: 60894 - RNA, 22 nt, Homo sapiens
uccaccgugggcugcggggcuc

SEQ ID NO: 60895 - RNA, 22 nt, Homo sapiens
uccagguuucaugcucuuuauu

SEQ ID NO: 60896 - RNA, 22 nt, Homo sapiens
uccagguuuugugaguuuaaau

SEQ ID NO: 60897 - RNA, 22 nt, Homo sapiens
uccaugagaauaguuaggcucu

SEQ ID NO: 60898 - RNA, 22 nt, Homo sapiens
uccaugaguccauuagaaaaaa

SEQ ID NO: 60899 - RNA, 22 nt, Homo sapiens
uccaugugaaaaggucgugaua

SEQ ID NO: 60900 - RNA, 22 nt, Homo sapiens
uccauuugucuauguuucuguu

SEQ ID NO: 60901 - RNA, 22 nt, Homo sapiens
uccauuuguucagcuucaggaa

SEQ ID NO: 60902 - RNA, 16 nt, Homo sapiens
ucccaccauugcuugu

SEQ ID NO: 60903 - RNA, 19 nt, Homo sapiens
uuccugagaacaagggcuu

SEQ ID NO: 60904 - RNA, 22 nt, Homo sapiens
uuccuuaguuauuugguccccu

SEQ ID NO: 60905 - RNA, 22 nt, Homo sapiens
uucucagcccccugacagucag

SEQ ID NO: 60906 - RNA, 22 nt, Homo sapiens
uucucauggaacaucuguacug

SEQ ID NO: 60907 - RNA, 22 nt, Homo sapiens
uucuggcucgauucucugaccg

SEQ ID NO: 60908 - RNA, 22 nt, Homo sapiens
uucuguguuuaggucacggcua

SEQ ID NO: 60909 - RNA, 22 nt, Homo sapiens
uucuugcacuuaacugacauuc

SEQ ID NO: 60910 - RNA, 22 nt, Homo sapiens
uucuugcuguauccucacaugg

SEQ ID NO: 60911 - RNA, 22 nt, Homo sapiens
uucuuuggaaacaguacuaauu

SEQ ID NO: 60912 - RNA, 22 nt, Homo sapiens
uugaaguagaaagacgaaauuu

SEQ ID NO: 60913 - RNA, 22 nt, Homo sapiens
uugaaguagcauuucaugucua

SEQ ID NO: 60914 - RNA, 22 nt, Homo sapiens
uugaauaguggugaaaguuuga

SEQ ID NO: 60915 - RNA, 22 nt, Homo sapiens
uugaaugaaaugaugucauuug

SEQ ID NO: 60916 - RNA, 22 nt, Homo sapiens
uugacauugcuguaguguccag

SEQ ID NO: 60917 - RNA, 22 nt, Homo sapiens
uugaccuauguuucuucaucug

SEQ ID NO: 60918 - RNA, 22 nt, Homo sapiens
uugagacggagucucacucugu

SEQ ID NO: 60919 - RNA, 22 nt, Homo sapiens
uugagauggaaucucgcuuugu

SEQ ID NO: 60920 - RNA, 22 nt, Homo sapiens
uugagauggagucucgcucugu

SEQ ID NO: 60921 - RNA, 22 nt, Homo sapiens
uugagauggaguuucgcucuug

SEQ ID NO: 60922 - RNA, 22 nt, Homo sapiens
uugagauggaguuuugcucuug

SEQ ID NO: 60923 - RNA, 22 nt, Homo sapiens
uugagauggauagacauagcau

SEQ ID NO: 60924 - RNA, 22 nt, Homo sapiens
uugagauguaagauguuaauau

SEQ ID NO: 60925 - RNA, 22 nt, Homo sapiens
uugagcaauccuccugccaugu

SEQ ID NO: 60926 - RNA, 22 nt, Homo sapiens
uugagcacaggaguuuugagac

SEQ ID NO: 60927 - RNA, 22 nt, Homo sapiens
uugagcacugucugugugcagu

SEQ ID NO: 60928 - RNA, 22 nt, Homo sapiens
uugagcucuuccagccuggagc

SEQ ID NO: 60929 - RNA, 22 nt, Homo sapiens
uugagcuuuuuacuuguccaau

SEQ ID NO: 60930 - RNA, 22 nt, Homo sapiens
uugaggaggcagucucuccauu

SEQ ID NO: 60931 - RNA, 22 nt, Homo sapiens
uugaggaggcagucugcccauu

SEQ ID NO: 60932 - RNA, 22 nt, Homo sapiens
uugaggaggcagucuguccguu

SEQ ID NO: 60933 - RNA, 22 nt, Homo sapiens
uugaggaggcagucuucccauu

SEQ ID NO: 60934 - RNA, 22 nt, Homo sapiens
uugagguaauaaacagccauuc

SEQ ID NO: 60935 - RNA, 22 nt, Homo sapiens
uugaguaguaagugguucaccg

SEQ ID NO: 60936 - RNA, 22 nt, Homo sapiens
uugaguauuggacugguaucuu

SEQ ID NO: 60937 - RNA, 22 nt, Homo sapiens
uugaucaucagcuuugucaucu

SEQ ID NO: 60938 - RNA, 22 nt, Homo sapiens
uugaucugugucccugcccaau

SEQ ID NO: 60939 - RNA, 22 nt, Homo sapiens
uugauguaggcauucaaggcua

SEQ ID NO: 60940 - RNA, 22 nt, Homo sapiens
uugcaaacaucuuguuucacau

SEQ ID NO: 60941 - RNA, 22 nt, Homo sapiens
uugcaaaguugccaaggaagga

SEQ ID NO: 60942 - RNA, 20 nt, Homo sapiens
uugcacagagaaggaggcag

SEQ ID NO: 60943 - RNA, 22 nt, Homo sapiens
uugcacauguugaaccagcaaa

SEQ ID NO: 60944 - RNA, 22 nt, Homo sapiens
uugcacauuuuuucuggcagaa

SEQ ID NO: 60945 - RNA, 22 nt, Homo sapiens
uugcagagaaauuucugguuua

SEQ ID NO: 60946 - RNA, 22 nt, Homo sapiens
uugcagagccccacacugggcu

SEQ ID NO: 60947 - RNA, 22 nt, Homo sapiens
uugcagagucaguuauuuugcc

SEQ ID NO: 60948 - RNA, 22 nt, Homo sapiens
uugcagaucccacacucacccu

SEQ ID NO: 60949 - RNA, 22 nt, Homo sapiens
uugcagcaaauaggaaugagga

SEQ ID NO: 60950 - RNA, 22 nt, Homo sapiens
uugcauagaccgaugucuugga

SEQ ID NO: 60951 - RNA, 22 nt, Homo sapiens
uugcauguacguacagagagag

SEQ ID NO: 60952 - RNA, 22 nt, Homo sapiens
uugccauggaguagaauugaag

SEQ ID NO: 60953 - RNA, 22 nt, Homo sapiens
uugcuacauugauugccucuuu

SEQ ID NO: 60954 - RNA, 22 nt, Homo sapiens
uugcuccucugccaggaccugu

SEQ ID NO: 60955 - RNA, 22 nt, Homo sapiens
uuggaagacauucugucugcua

SEQ ID NO: 60956 - RNA, 22 nt, Homo sapiens
uuggaauuaagagauauuuucu

SEQ ID NO: 60957 - RNA, 22 nt, Homo sapiens
uuggacaagauugcagagaauu

SEQ ID NO: 60958 - RNA, 22 nt, Homo sapiens
uuggacuuuuauucugcaggca

SEQ ID NO: 60959 - RNA, 22 nt, Homo sapiens
uuggcaaaugucacaaaucagg

SEQ ID NO: 60960 - RNA, 22 nt, Homo sapiens
uuggcagcuguggaaucugggc

SEQ ID NO: 60961 - RNA, 22 nt, Homo sapiens
uuggcagugguucugacggacc

SEQ ID NO: 60962 - RNA, 22 nt, Homo sapiens
uuggccccuuucauccacagcu

SEQ ID NO: 60963 - RNA, 22 nt, Homo sapiens
uaugucuuuugcuugcaaauag

SEQ ID NO: 60964 - RNA, 22 nt, Homo sapiens
uauuaagcuaguugucagugcu

SEQ ID NO: 60965 - RNA, 22 nt, Homo sapiens
uauuacuugucugugucucaau

SEQ ID NO: 60966 - RNA, 22 nt, Homo sapiens
uauuaugcacuuuauaaaaauu

SEQ ID NO: 60967 - RNA, 22 nt, Homo sapiens
uauugaacgugggauauugaag

SEQ ID NO: 60968 - RNA, 22 nt, Homo sapiens
uauugcaauuggggaaacuggg

SEQ ID NO: 60969 - RNA, 22 nt, Homo sapiens
uauugcacaugaggagacauug

SEQ ID NO: 60970 - RNA, 22 nt, Homo sapiens
uauugcacuccagccuuggcaa

SEQ ID NO: 60971 - RNA, 22 nt, Homo sapiens
uauugcuaacaucccuuaugua

SEQ ID NO: 60972 - RNA, 22 nt, Homo sapiens
uauugcuacuuugccuuccaaa

SEQ ID NO: 60973 - RNA, 22 nt, Homo sapiens
uauugcuuuacucucuuauccu

SEQ ID NO: 60974 - RNA, 22 nt, Homo sapiens
uauugcuuuuaacccaaucucu

SEQ ID NO: 60975 - RNA, 22 nt, Homo sapiens
uauugcuuuugauucaaggcag

SEQ ID NO: 60976 - RNA, 22 nt, Homo sapiens
uauuugcacucccaucauggug

SEQ ID NO: 60977 - RNA, 22 nt, Homo sapiens
ucaaagacacacaaggagaagg

SEQ ID NO: 60978 - RNA, 20 nt, Homo sapiens
ucaaaguaugcucugcacua

SEQ ID NO: 60979 - RNA, 22 nt, Homo sapiens
ucaaagugcuauggcucagguu

SEQ ID NO: 60980 - RNA, 22 nt, Homo sapiens
ucaaaugauucuccugccucag

SEQ ID NO: 60981 - RNA, 22 nt, Homo sapiens
ucaaaugcacguagagaaaaua

SEQ ID NO: 60982 - RNA, 17 nt, Homo sapiens
ucaaaugcucccaguga

SEQ ID NO: 60983 - RNA, 22 nt, Homo sapiens
ucaaaugcucuuugcagagagg

SEQ ID NO: 60984 - RNA, 22 nt, Homo sapiens
ucaaauguuuguuuaaggcuua

SEQ ID NO: 60985 - RNA, 22 nt, Homo sapiens
ucaagcaauucugcugccucag

SEQ ID NO: 60986 - RNA, 22 nt, Homo sapiens
ucaaggcaguggccuuccuucu

SEQ ID NO: 60987 - RNA, 22 nt, Homo sapiens
ucaaguacugccuugcucuggc

SEQ ID NO: 60988 - RNA, 22 nt, Homo sapiens
ucaaugcaaccuccaccucugg

SEQ ID NO: 60989 - RNA, 22 nt, Homo sapiens
ucaauguaucuccaagaauuga

SEQ ID NO: 60990 - RNA, 22 nt, Homo sapiens
ucacaauucacuacaggcuuga

SEQ ID NO: 60991 - RNA, 22 nt, Homo sapiens
ucacaauucucaauuugugaaa

SEQ ID NO: 60992 - RNA, 22 nt, Homo sapiens
ucacacucucaccaacauuugg

SEQ ID NO: 60993 - RNA, 22 nt, Homo sapiens
ugagaagugauauagaaguuaa

SEQ ID NO: 60994 - RNA, 22 nt, Homo sapiens
ugagacacugaauccggccuga

SEQ ID NO: 60995 - RNA, 22 nt, Homo sapiens
ugagacaucucuccugagacag

SEQ ID NO: 60996 - RNA, 22 nt, Homo sapiens
ugagacggagucucgcuguguc

SEQ ID NO: 60997 - RNA, 22 nt, Homo sapiens
ugagagaugauaaaauguuugu

SEQ ID NO: 60998 - RNA, 19 nt, Homo sapiens
ugagagcacaacugaacaa

SEQ ID NO: 60999 - RNA, 22 nt, Homo sapiens
ugagaggugauaaagcaagggu

SEQ ID NO: 61000 - RNA, 21 nt, Homo sapiens
ugagauaauauguuucugaug

SEQ ID NO: 61001 - RNA, 22 nt, Homo sapiens
ugagaucaugccacugcacuuc

SEQ ID NO: 61002 - RNA, 22 nt, Homo sapiens
ugagauccaugcuauuugggcu

SEQ ID NO: 61003 - RNA, 22 nt, Homo sapiens
ugagaugaaagcagaaagacuu

SEQ ID NO: 61004 - RNA, 19 nt, Homo sapiens
ugagaugaagacagggguu

SEQ ID NO: 61005 - RNA, 22 nt, Homo sapiens
ugagaugaagcuagaagaaugg

SEQ ID NO: 61006 - RNA, 22 nt, Homo sapiens
ugagaugauuuaauggagccca

SEQ ID NO: 61007 - RNA, 22 nt, Homo sapiens
ugagauggaguuucgcuuuugu

SEQ ID NO: 61008 - RNA, 22 nt, Homo sapiens
ugagauguagauauggauuaga

SEQ ID NO: 61009 - RNA, 22 nt, Homo sapiens
ugagauguugcucugaaacaag

SEQ ID NO: 61010 - RNA, 23 nt, Homo sapiens
ugagauuacccagaaagaguaua

SEQ ID NO: 61011 - RNA, 22 nt, Homo sapiens
ugagauuauauuucuuaacaga

SEQ ID NO: 61012 - RNA, 22 nt, Homo sapiens
ugagcacagcgugugggagagc

SEQ ID NO: 61013 - RNA, 22 nt, Homo sapiens
ugagcagagaucacggcauugu

SEQ ID NO: 61014 - RNA, 22 nt, Homo sapiens
ugagcaucucuaaaaggagcaa

SEQ ID NO: 61015 - RNA, 22 nt, Homo sapiens
ugagccauggcaccuugucuaa

SEQ ID NO: 61016 - RNA, 22 nt, Homo sapiens
ugagccaugguuagcuucucau

SEQ ID NO: 61017 - RNA, 22 nt, Homo sapiens
ugaggaaugaccccgugugguc

SEQ ID NO: 61018 - RNA, 22 nt, Homo sapiens
ugagguacaacauggacugaag

SEQ ID NO: 61019 - RNA, 22 nt, Homo sapiens
ugaggugagggguuaggugcua

SEQ ID NO: 61020 - RNA, 22 nt, Homo sapiens
ugaggugaggguaucaaaugcu

SEQ ID NO: 61021 - RNA, 22 nt, Homo sapiens
ugagguguuugugcaccaucug

SEQ ID NO: 61022 - RNA, 22 nt, Homo sapiens
ugagguuauuuguucaagaagu

SEQ ID NO: 61023 - RNA, 22 nt, Homo sapiens
ugaguaauguugaucuuugaua

SEQ ID NO: 61024 - RNA, 22 nt, Homo sapiens
ugaguagcuaagacgauaggca

SEQ ID NO: 61025 - RNA, 22 nt, Homo sapiens
ugaguuaaucucuacgauagaa

SEQ ID NO: 61026 - RNA, 22 nt, Homo sapiens
ugaguuaggagaguguggcucu

SEQ ID NO: 61027 - RNA, 22 nt, Homo sapiens
ugaguucuuuguagauucugug

SEQ ID NO: 61028 - RNA, 22 nt, Homo sapiens
ugauaacauuucuucugguaca

SEQ ID NO: 61029 - RNA, 21 nt, Homo sapiens
ugauaugguuuggauaugugu

SEQ ID NO: 61030 - RNA, 22 nt, Homo sapiens
ugaucuuuuuaauguccauggg

SEQ ID NO: 61031 - RNA, 22 nt, Homo sapiens
ugauuagagagcuggguguccu

SEQ ID NO: 61032 - RNA, 22 nt, Homo sapiens
ugauuagaggaaugguagauua

SEQ ID NO: 61033 - RNA, 22 nt, Homo sapiens
ugcaaagaaauuuuggugacca

SEQ ID NO: 61034 - RNA, 19 nt, Homo sapiens
ugcaaagucuuuuccuauu

SEQ ID NO: 61035 - RNA, 22 nt, Homo sapiens
ugcaacacauugccccugcucu

SEQ ID NO: 61036 - RNA, 20 nt, Homo sapiens
ugcaaguugccuuuggaggc

SEQ ID NO: 61037 - RNA, 22 nt, Homo sapiens
ugcaccacuacacuccaggcug

SEQ ID NO: 61038 - RNA, 22 nt, Homo sapiens
ugcaccacugcacuccacccug

SEQ ID NO: 61039 - RNA, 22 nt, Homo sapiens
ugcaccacugcacuccaggcug

SEQ ID NO: 61040 - RNA, 18 nt, Homo sapiens
ugcaccaguuuacacuuc

SEQ ID NO: 61041 - RNA, 22 nt, Homo sapiens
ugcacuguggucugagagacag

SEQ ID NO: 61042 - RNA, 22 nt, Homo sapiens
ugcagaaucccuucagauccga

SEQ ID NO: 61043 - RNA, 22 nt, Homo sapiens
ugcagcauguaggcacguuauu

SEQ ID NO: 61044 - RNA, 21 nt, Homo sapiens
ugcagccauucagcccuaugc

SEQ ID NO: 61045 - RNA, 22 nt, Homo sapiens
ugcagcucaaauuccuaacaag

SEQ ID NO: 61046 - RNA, 22 nt, Homo sapiens
ugcagcucagcugcggaguuuu

SEQ ID NO: 61047 - RNA, 22 nt, Homo sapiens
ugcaggguccauugucccaagu

SEQ ID NO: 61048 - RNA, 22 nt, Homo sapiens
ugcauacacaagcauacaugua

SEQ ID NO: 61049 - RNA, 22 nt, Homo sapiens
ugcauauucuaggauuuuguau

SEQ ID NO: 61050 - RNA, 21 nt, Homo sapiens
ugcauggagaacacugagggu

SEQ ID NO: 61051 - RNA, 22 nt, Homo sapiens
ugccagaugugcccucuccacc

SEQ ID NO: 61052 - RNA, 22 nt, Homo sapiens
ugccuaggcuggagugcagugg

SEQ ID NO: 61053 - RNA, 22 nt, Homo sapiens
ugccuggagagcuccuacauau

SEQ ID NO: 61054 - RNA, 22 nt, Homo sapiens
ugccuuauuccaacugagcucu

SEQ ID NO: 61055 - RNA, 22 nt, Homo sapiens
ugcuagaagaucacacacauca

SEQ ID NO: 61056 - RNA, 22 nt, Homo sapiens
ugcuaucauugauuagugaugu

SEQ ID NO: 61057 - RNA, 22 nt, Homo sapiens
ugcuauguaacacauuaccuuu

SEQ ID NO: 61058 - RNA, 22 nt, Homo sapiens
ucccuuagccaaauccccagcc

SEQ ID NO: 61059 - RNA, 22 nt, Homo sapiens
uccucugaacuccagacccaua

SEQ ID NO: 61060 - RNA, 22 nt, Homo sapiens
uccuggcuccacuguuuauucc

SEQ ID NO: 61061 - RNA, 22 nt, Homo sapiens
uccuugagccucccagacucag

SEQ ID NO: 61062 - RNA, 19 nt, Homo sapiens
uccuugauugcaccacugc

SEQ ID NO: 61063 - RNA, 22 nt, Homo sapiens
uccuuggucaaaaagaaagugu

SEQ ID NO: 61064 - RNA, 22 nt, Homo sapiens
ucgugccacugcacuccagccu

SEQ ID NO: 61065 - RNA, 18 nt, Homo sapiens
ucucacagcaaucuguca

SEQ ID NO: 61066 - RNA, 22 nt, Homo sapiens
ucucacagccauuucucccucu

SEQ ID NO: 61067 - RNA, 22 nt, Homo sapiens
ucucagcacaaacaaaauugcu

SEQ ID NO: 61068 - RNA, 20 nt, Homo sapiens
ucucauggagguagagaaua

SEQ ID NO: 61069 - RNA, 21 nt, Homo sapiens
ucucauugugguuuuaauugg

SEQ ID NO: 61070 - RNA, 22 nt, Homo sapiens
ucugacucuggagucucagguu

SEQ ID NO: 61071 - RNA, 22 nt, Homo sapiens
ucugagacuguuucuaacaagc

SEQ ID NO: 61072 - RNA, 22 nt, Homo sapiens
ucugagcaugcaucuugccugg

SEQ ID NO: 61073 - RNA, 20 nt, Homo sapiens
ucugauugcaacugcaugag

SEQ ID NO: 61074 - RNA, 22 nt, Homo sapiens
ucugcauauucuagggcaccaa

SEQ ID NO: 61075 - RNA, 22 nt, Homo sapiens
ucugccacugucauugugugau

SEQ ID NO: 61076 - RNA, 22 nt, Homo sapiens
ucuggcaagauauccauugcuu

SEQ ID NO: 61077 - RNA, 22 nt, Homo sapiens
ucuggccccucccaaaucucau

SEQ ID NO: 61078 - RNA, 22 nt, Homo sapiens
ucuggccuacaaguaauuuuau

SEQ ID NO: 61079 - RNA, 22 nt, Homo sapiens
ucugguggugaugagagacagu

SEQ ID NO: 61080 - RNA, 22 nt, Homo sapiens
ucuguacuccuugaguagugcu

SEQ ID NO: 61081 - RNA, 22 nt, Homo sapiens
ucugucuuugucaggaccagag

SEQ ID NO: 61082 - RNA, 22 nt, Homo sapiens
ucugugcauuacacuuuucuca

SEQ ID NO: 61083 - RNA, 23 nt, Homo sapiens
ucuuguacuuugagugagcaugg

SEQ ID NO: 61084 - RNA, 22 nt, Homo sapiens
ucuuugauuuuguuacuaagac

SEQ ID NO: 61085 - RNA, 22 nt, Homo sapiens
ucuuuggagacaaccccagucu

SEQ ID NO: 61086 - RNA, 20 nt, Homo sapiens
uuugcagaaucuaagaagag

SEQ ID NO: 61087 - RNA, 22 nt, Homo sapiens
uuugcagagacuuguuaggaau

SEQ ID NO: 61088 - RNA, 22 nt, Homo sapiens
uuugcagugucagcuucugugu

SEQ ID NO: 61089 - RNA, 22 nt, Homo sapiens
uuugccaauauuuuacugagga

SEQ ID NO: 61090 - RNA, 22 nt, Homo sapiens
uuuggcaacguuggaucccuca

SEQ ID NO: 61091 - RNA, 22 nt, Homo sapiens
uuuggcaauaaacuccccuaac

SEQ ID NO: 61092 - RNA, 20 nt, Homo sapiens
uuuggcaauaggguuuuugu

SEQ ID NO: 61093 - RNA, 22 nt, Homo sapiens
uuuggcauuagagagacuugca

SEQ ID NO: 61094 - RNA, 22 nt, Homo sapiens
uuuggcauuuuacuacucaaau

SEQ ID NO: 61095 - RNA, 18 nt, Homo sapiens
uuuggcuguucaugacuc

SEQ ID NO: 61096 - RNA, 22 nt, Homo sapiens
uuuggcuuaagauugacugcaa

SEQ ID NO: 61097 - RNA, 21 nt, Homo sapiens
uuuggcuucucugcugcagcc

SEQ ID NO: 61098 - RNA, 22 nt, Homo sapiens
uuugggaaugguuugucuccca

SEQ ID NO: 61099 - RNA, 22 nt, Homo sapiens
uuuggucacugccgccgccagc

SEQ ID NO: 61100 - RNA, 22 nt, Homo sapiens
uuuguacacuguuggugguuau

SEQ ID NO: 61101 - RNA, 18 nt, Homo sapiens
uuugugcuccacaaagga

SEQ ID NO: 61102 - RNA, 22 nt, Homo sapiens
uuugugcuccugugagaaucua

SEQ ID NO: 61103 - RNA, 22 nt, Homo sapiens
uuugugcuccuguugagaaucu

SEQ ID NO: 61104 - RNA, 22 nt, Homo sapiens
uuuguggaaugcccuuauuuau

SEQ ID NO: 61105 - RNA, 22 nt, Homo sapiens
uuuguggaaugcucauguguag

SEQ ID NO: 61106 - RNA, 22 nt, Homo sapiens
uuuuaacagccaggggacggcc

SEQ ID NO: 61107 - RNA, 22 nt, Homo sapiens
uuuugcacauugauuugguauc

SEQ ID NO: 61108 - RNA, 22 nt, Homo sapiens
uuuugguaaugaacuuaggaag

SEQ ID NO: 61109 - RNA, 22 nt, Homo sapiens
uuuuuauggccaauccucagaa

SEQ ID NO: 61110 - RNA, 22 nt, Homo sapiens
uuuuucacuuaaguuaggcuca

SEQ ID NO: 61111 - RNA, 22 nt, Homo sapiens
uuuuugaguaaauauaaauugu

SEQ ID NO: 61112 - RNA, 21 nt, Homo sapiens
uuuuugggcuuucauaguguu

SEQ ID NO: 61113 - RNA, 22 nt, Homo sapiens
uuuuugugguauauugcaacaa

SEQ ID NO: 61114 - RNA, 22 nt, Homo sapiens
uuuuuuaguuagcugggcauga

SEQ ID NO: 61115 - RNA, 22 nt, Homo sapiens
uuuuuugcuguaugcaaacauc

SEQ ID NO: 61116 - RNA, 22 nt, Homo sapiens
uucuuugguacaagggccgacc

SEQ ID NO: 61117 - RNA, 22 nt, Homo sapiens
uugaaagacagaggggcaaguu

SEQ ID NO: 61118 - RNA, 22 nt, Homo sapiens
uugaaauguuuagaaguuugga

SEQ ID NO: 61119 - RNA, 22 nt, Homo sapiens
uugaacuagaaccugcaaauuu

SEQ ID NO: 61120 - RNA, 22 nt, Homo sapiens
uugacauaguuucugaaauaga

SEQ ID NO: 61121 - RNA, 21 nt, Homo sapiens
uugagacggagucucacucug

SEQ ID NO: 61122 - RNA, 20 nt, Homo sapiens
uugagaucuguaucugguuu

SEQ ID NO: 61123 - RNA, 22 nt, Homo sapiens
uugagaucugugcuuuugcguu

SEQ ID NO: 61124 - RNA, 22 nt, Homo sapiens
uugagaucuuuuaggccuuugu

SEQ ID NO: 61125 - RNA, 22 nt, Homo sapiens
uugagaugaagucuugcucucu

SEQ ID NO: 61126 - RNA, 22 nt, Homo sapiens
uugagaugaaguuuugcucuuu

SEQ ID NO: 61127 - RNA, 22 nt, Homo sapiens
uugagauggagccucacucugc

SEQ ID NO: 61128 - RNA, 22 nt, Homo sapiens
uugagauggagcuucacucuug

SEQ ID NO: 61129 - RNA, 22 nt, Homo sapiens
uugagauggagucucacucugu

SEQ ID NO: 61130 - RNA, 22 nt, Homo sapiens
uugagauggagucucacucuuc

SEQ ID NO: 61131 - RNA, 22 nt, Homo sapiens
uugagauggagucucguucugu

SEQ ID NO: 61132 - RNA, 22 nt, Homo sapiens
uugagauggagucuugcucuug

SEQ ID NO: 61133 - RNA, 22 nt, Homo sapiens
uugagauggagucuuguucuuu

SEQ ID NO: 61134 - RNA, 22 nt, Homo sapiens
uugagauggaguucauuuuugu

SEQ ID NO: 61135 - RNA, 22 nt, Homo sapiens
uugagauggaguuucgcucuuu

SEQ ID NO: 61136 - RNA, 22 nt, Homo sapiens
uugagccaaggauugucuuucc

SEQ ID NO: 61137 - RNA, 22 nt, Homo sapiens
uugagggcugaauaccaaucag

SEQ ID NO: 61138 - RNA, 22 nt, Homo sapiens
uugauauucugagaagcugaag

SEQ ID NO: 61139 - RNA, 22 nt, Homo sapiens
uugaucaaaucugagugagaau

SEQ ID NO: 61140 - RNA, 22 nt, Homo sapiens
uugauccucugagaaucuaucg

SEQ ID NO: 61141 - RNA, 22 nt, Homo sapiens
uugcaagaaaugcagauucuca

SEQ ID NO: 61142 - RNA, 22 nt, Homo sapiens
uugcaaggugcagcuuaugcaa

SEQ ID NO: 61143 - RNA, 22 nt, Homo sapiens
uugcaagugccguaacuaccaa

SEQ ID NO: 61144 - RNA, 22 nt, Homo sapiens
uugcaaguggagcuuccagggc

SEQ ID NO: 61145 - RNA, 22 nt, Homo sapiens
uugcacagugcuuucuuugccc

SEQ ID NO: 61146 - RNA, 22 nt, Homo sapiens
uugcacuauuaguauagauguc

SEQ ID NO: 61147 - RNA, 20 nt, Homo sapiens
uugcagagcccaacccugga

SEQ ID NO: 61148 - RNA, 22 nt, Homo sapiens
uugcagcaacauggaugaaacu

SEQ ID NO: 61149 - RNA, 22 nt, Homo sapiens
uugcaggcaugagccaccgugc

SEQ ID NO: 61150 - RNA, 22 nt, Homo sapiens
uugcaguagucugaaagcaaua

SEQ ID NO: 61151 - RNA, 22 nt, Homo sapiens
uugcagugugacgacuauauuu

SEQ ID NO: 61152 - RNA, 22 nt, Homo sapiens
uugcuggugguucgagcaacac

SEQ ID NO: 61153 - RNA, 22 nt, Homo sapiens
uugcuucauucaacauugaggg

SEQ ID NO: 61154 - RNA, 22 nt, Homo sapiens
uuggaaagagguguuuaugacu

SEQ ID NO: 61155 - RNA, 22 nt, Homo sapiens
uuggaaauauguuaagugucau

SEQ ID NO: 61156 - RNA, 22 nt, Homo sapiens
uuggaauguacucuagccuaug

SEQ ID NO: 61157 - RNA, 22 nt, Homo sapiens
uuggaauuuuaaaauaggcaac

SEQ ID NO: 61158 - RNA, 22 nt, Homo sapiens
uuggacugggauggccgaggcu

SEQ ID NO: 61159 - RNA, 22 nt, Homo sapiens
uuggacuucucaaggcaauaaa

SEQ ID NO: 61160 - RNA, 22 nt, Homo sapiens
uuggagagaaaggcaguuccug

SEQ ID NO: 61161 - RNA, 22 nt, Homo sapiens
uuggcaaagaggaaugccacuu

SEQ ID NO: 61162 - RNA, 22 nt, Homo sapiens
uuggcagaauguuagaaacuua

SEQ ID NO: 61163 - RNA, 22 nt, Homo sapiens
uuggcauuuauucuaaggucaa

SEQ ID NO: 61164 - RNA, 22 nt, Homo sapiens
uuggccuccuggucauauccag

SEQ ID NO: 61165 - RNA, 22 nt, Homo sapiens
uuggggcacggccucuguugcc

SEQ ID NO: 61166 - RNA, 22 nt, Homo sapiens
uuggucaggcuaaucucgaacg

SEQ ID NO: 61167 - RNA, 22 nt, Homo sapiens
uugguuccuuagccuaggacua

SEQ ID NO: 61168 - RNA, 22 nt, Homo sapiens
uugguucucuuagccaucuuaa

SEQ ID NO: 61169 - RNA, 22 nt, Homo sapiens
uuguaccacagggcaugaagug

SEQ ID NO: 61170 - RNA, 22 nt, Homo sapiens
uuguagaucuucaguugcuaca

SEQ ID NO: 61171 - RNA, 22 nt, Homo sapiens
uuguagcaaauguguaaacaaa

SEQ ID NO: 61172 - RNA, 22 nt, Homo sapiens
uugucacauggggcggcugccc

SEQ ID NO: 61173 - RNA, 22 nt, Homo sapiens
uugucacucuuccuaggguagg

SEQ ID NO: 61174 - RNA, 22 nt, Homo sapiens
uuguccccacccaaaugucauc

SEQ ID NO: 61175 - RNA, 19 nt, Homo sapiens
uuguccccucuaaaucuca

SEQ ID NO: 61176 - RNA, 22 nt, Homo sapiens
uuguccucuccaaaucucaugu

SEQ ID NO: 61177 - RNA, 22 nt, Homo sapiens
uugugcaaaguugugguuucug

SEQ ID NO: 61178 - RNA, 21 nt, Homo sapiens
uugugccaaacccuggaggga

SEQ ID NO: 61179 - RNA, 19 nt, Homo sapiens
uugugggaggacagagggg

SEQ ID NO: 61180 - RNA, 19 nt, Homo sapiens
uuguguccccacaaaauuc

SEQ ID NO: 61181 - RNA, 22 nt, Homo sapiens
uuuaaagcuccaagcaugucug

SEQ ID NO: 61182 - RNA, 22 nt, Homo sapiens
uuuagcaaagcaauuuacacca

SEQ ID NO: 61183 - RNA, 22 nt, Homo sapiens
uuuagcaaugcuguggggaagu

SEQ ID NO: 61184 - RNA, 22 nt, Homo sapiens
uuuagguaauauuaaguagcug

SEQ ID NO: 61185 - RNA, 22 nt, Homo sapiens
uuuauucggcuaggagcuucgg

SEQ ID NO: 61186 - RNA, 23 nt, Homo sapiens
uuucacaguagcuggaucagccu

SEQ ID NO: 61187 - RNA, 22 nt, Homo sapiens
uuucauagaucaugcuuuugga

SEQ ID NO: 61188 - RNA, 22 nt, Homo sapiens
uuucauaguuugcauagggcau

SEQ ID NO: 61189 - RNA, 22 nt, Homo sapiens
cauaaaucuuguugaauagcac

SEQ ID NO: 61190 - RNA, 22 nt, Homo sapiens
cauaaugcuaagagcugccccu

SEQ ID NO: 61191 - RNA, 21 nt, Homo sapiens
cauaaugcuacuuauuuuaug

SEQ ID NO: 61192 - RNA, 18 nt, Homo sapiens
cauagcacuucagcacau

SEQ ID NO: 61193 - RNA, 19 nt, Homo sapiens
caucacagagucuuccauu

SEQ ID NO: 61194 - RNA, 22 nt, Homo sapiens
caucacaguacuaaucgucaua

SEQ ID NO: 61195 - RNA, 22 nt, Homo sapiens
caucacuguugguacaaguaau

SEQ ID NO: 61196 - RNA, 22 nt, Homo sapiens
caucagcaauguaugaggguuc

SEQ ID NO: 61197 - RNA, 22 nt, Homo sapiens
caucccugucgucaagucucug

SEQ ID NO: 61198 - RNA, 22 nt, Homo sapiens
caucgcacuccagccugggcaa

SEQ ID NO: 61199 - RNA, 22 nt, Homo sapiens
caucgcacuccagcuugggcaa

SEQ ID NO: 61200 - RNA, 23 nt, Homo sapiens
caugaacuaguuugcagccauga

SEQ ID NO: 61201 - RNA, 22 nt, Homo sapiens
caugcacugagagggucucggc

SEQ ID NO: 61202 - RNA, 22 nt, Homo sapiens
cauggcacagagaauguguucu

SEQ ID NO: 61203 - RNA, 22 nt, Homo sapiens
cauggcacuggugggagugucu

SEQ ID NO: 61204 - RNA, 22 nt, Homo sapiens
cauggcccuggguccauaggaa

SEQ ID NO: 61205 - RNA, 22 nt, Homo sapiens
cauggucaccuuccaaguuauu

SEQ ID NO: 61206 - RNA, 22 nt, Homo sapiens
cauguauagauuccauaguggu

SEQ ID NO: 61207 - RNA, 22 nt, Homo sapiens
cauuaagcuacuuagaaggugc

SEQ ID NO: 61208 - RNA, 22 nt, Homo sapiens
cauuccacauguaggacaauuu

SEQ ID NO: 61209 - RNA, 22 nt, Homo sapiens
cauugcaauccagccugggcaa

SEQ ID NO: 61210 - RNA, 22 nt, Homo sapiens
cauugcacuccagccuuggcaa

SEQ ID NO: 61211 - RNA, 22 nt, Homo sapiens
cauugcacuccagcuugggcaa

SEQ ID NO: 61212 - RNA, 22 nt, Homo sapiens
cauugcacuccagcuugggcga

SEQ ID NO: 61213 - RNA, 22 nt, Homo sapiens
cauugcacuccauccuuggcaa

SEQ ID NO: 61214 - RNA, 22 nt, Homo sapiens
cauugcacuccaucuugggcaa

SEQ ID NO: 61215 - RNA, 22 nt, Homo sapiens
cauugcacucuagccucggcaa

SEQ ID NO: 61216 - RNA, 22 nt, Homo sapiens
cauugcaguuuuugguguaucu

SEQ ID NO: 61217 - RNA, 22 nt, Homo sapiens
cauugcauuuucuuuguaccuu

SEQ ID NO: 61218 - RNA, 22 nt, Homo sapiens
cauugcuaaaagucauauauaa

SEQ ID NO: 61219 - RNA, 22 nt, Homo sapiens
cauugguugaacagauuguguu

SEQ ID NO: 61220 - RNA, 22 nt, Homo sapiens
cauuguccuccuggggcuauuu

SEQ ID NO: 61221 - RNA, 22 nt, Homo sapiens
cauuugguggcuacagaguaac

SEQ ID NO: 61222 - RNA, 22 nt, Homo sapiens
cauuuugguuaaauagguagcu

SEQ ID NO: 61223 - RNA, 23 nt, Homo sapiens
ccacacuguuuagaauggcauca

SEQ ID NO: 61224 - RNA, 22 nt, Homo sapiens
ccacauuaccuugcuugcucca

SEQ ID NO: 61225 - RNA, 20 nt, Homo sapiens
gcaguacuuuuaguucuaag

SEQ ID NO: 61226 - RNA, 22 nt, Homo sapiens
gcagugcaugacgguauauaua

SEQ ID NO: 61227 - RNA, 19 nt, Homo sapiens
gcaucauuaguugcuuuuc

SEQ ID NO: 61228 - RNA, 22 nt, Homo sapiens
gcauggagaaggggacugauuc

SEQ ID NO: 61229 - RNA, 20 nt, Homo sapiens
gccacaguuaagcuucugcc

SEQ ID NO: 61230 - RNA, 19 nt, Homo sapiens
gccaccuggugcguguucu

SEQ ID NO: 61231 - RNA, 22 nt, Homo sapiens
gccuagggacaaaccguccgac

SEQ ID NO: 61232 - RNA, 22 nt, Homo sapiens
gccuuuggugacaggcaugugu

SEQ ID NO: 61233 - RNA, 22 nt, Homo sapiens
gcuaggagauccacugcucucu

SEQ ID NO: 61234 - RNA, 22 nt, Homo sapiens
gcucaguuuccucagcugcaaa

SEQ ID NO: 61235 - RNA, 22 nt, Homo sapiens
gcugagaucucuugccugaacu

SEQ ID NO: 61236 - RNA, 22 nt, Homo sapiens
gcuggguucagagugggcugcg

SEQ ID NO: 61237 - RNA, 22 nt, Homo sapiens
gcugguauuacaggcaugagcc

SEQ ID NO: 61238 - RNA, 22 nt, Homo sapiens
gcugguguugugaaucaggccg

SEQ ID NO: 61239 - RNA, 22 nt, Homo sapiens
gcuuugcaauggcauugaccau

SEQ ID NO: 61240 - RNA, 22 nt, Homo sapiens
gcuuuguuaaaacacagccaca

SEQ ID NO: 61241 - RNA, 21 nt, Homo sapiens
gcuuuuucggaagucuuuggc

SEQ ID NO: 61242 - RNA, 23 nt, Homo sapiens
ggaaauguuuaagggguugggag

SEQ ID NO: 61243 - RNA, 22 nt, Homo sapiens
ggaaauguuuagcauccacuuu

SEQ ID NO: 61244 - RNA, 22 nt, Homo sapiens
ggaacaccauuuuuccugccuu

SEQ ID NO: 61245 - RNA, 18 nt, Homo sapiens
ggaagauuggcuaugugc

SEQ ID NO: 61246 - RNA, 23 nt, Homo sapiens
ggaaugaaaccugguuaugauau

SEQ ID NO: 61247 - RNA, 17 nt, Homo sapiens
ggaaugaauuccagccc

SEQ ID NO: 61248 - RNA, 22 nt, Homo sapiens
ggaaugagaaauauuacacaau

SEQ ID NO: 61249 - RNA, 19 nt, Homo sapiens
ggaaugcuauucaaccuuu

SEQ ID NO: 61250 - RNA, 22 nt, Homo sapiens
ggaauguauuaaggcauugggc

SEQ ID NO: 61251 - RNA, 22 nt, Homo sapiens
ggacaucauuaccauggaccca

SEQ ID NO: 61252 - RNA, 19 nt, Homo sapiens
ggacugucauggaguaguu

SEQ ID NO: 61253 - RNA, 22 nt, Homo sapiens
ggagucugauguucuaaggcag

SEQ ID NO: 61254 - RNA, 23 nt, Homo sapiens
ggaguguauuggcacgaucucag

SEQ ID NO: 61255 - RNA, 22 nt, Homo sapiens
ggaguguguaggagaaagguaa

SEQ ID NO: 61256 - RNA, 22 nt, Homo sapiens
ggaucacagagcuugggaaagg

SEQ ID NO: 61257 - RNA, 22 nt, Homo sapiens
ggauggcauuucuuuagcuuuu

SEQ ID NO: 61258 - RNA, 22 nt, Homo sapiens
ggcaagaagagaguuuaaacau

SEQ ID NO: 61259 - RNA, 21 nt, Homo sapiens
ggcaagagaauacaacauaaa

SEQ ID NO: 61260 - RNA, 22 nt, Homo sapiens
ggcaaggugcuacagacaguga

SEQ ID NO: 61261 - RNA, 22 nt, Homo sapiens
ggcaaguucuaaugauuagaau

SEQ ID NO: 61262 - RNA, 22 nt, Homo sapiens
ggcacaguuaagugcuaccuaa

SEQ ID NO: 61263 - RNA, 23 nt, Homo sapiens
ggcacggaauucaaagaggcauu

SEQ ID NO: 61264 - RNA, 22 nt, Homo sapiens
ggcagagucuugcaucuuuaga

SEQ ID NO: 61265 - RNA, 22 nt, Homo sapiens
ggcagaguggacauuuaaaugu

SEQ ID NO: 61266 - RNA, 22 nt, Homo sapiens
ggcagcauugccuuugcaguga

SEQ ID NO: 61267 - RNA, 22 nt, Homo sapiens
ggcagcgugcacuuucgccacu

SEQ ID NO: 61268 - RNA, 17 nt, Homo sapiens
ggcaggauccaggaucc

SEQ ID NO: 61269 - RNA, 23 nt, Homo sapiens
ggcagguuggucuaggucuauuc

SEQ ID NO: 61270 - RNA, 22 nt, Homo sapiens
ggcaguguauuacuuaggguuc

SEQ ID NO: 61271 - RNA, 22 nt, Homo sapiens
ggccagaugcgguggcucacac

SEQ ID NO: 61272 - RNA, 22 nt, Homo sapiens
ggcuagagacaaguugcugaga

SEQ ID NO: 61273 - RNA, 22 nt, Homo sapiens
gggaagaaggagugguuuacuc

SEQ ID NO: 61274 - RNA, 22 nt, Homo sapiens
gggagcacaagaaauguuucau

SEQ ID NO: 61275 - RNA, 22 nt, Homo sapiens
gggagugugcacacaugguaua

SEQ ID NO: 61276 - RNA, 22 nt, Homo sapiens
gggcaugauggugcacacaugu

SEQ ID NO: 61277 - RNA, 22 nt, Homo sapiens
gggcaugaugucuuaugccuau

SEQ ID NO: 61278 - RNA, 22 nt, Homo sapiens
ggggaguguggacaucacccug

SEQ ID NO: 61279 - RNA, 22 nt, Homo sapiens
gggggagugugguacccagcau

SEQ ID NO: 61280 - RNA, 22 nt, Homo sapiens
gggucauggaugugaagcuaga

SEQ ID NO: 61281 - RNA, 19 nt, Homo sapiens
ggucacagggguuacaagg

SEQ ID NO: 61282 - RNA, 19 nt, Homo sapiens
ggucauggagguuguguga

SEQ ID NO: 61283 - RNA, 21 nt, Homo sapiens
ggugagaaaggagacauagac

SEQ ID NO: 61284 - RNA, 22 nt, Homo sapiens
ggugaguggugcuuaaguucag

SEQ ID NO: 61285 - RNA, 22 nt, Homo sapiens
gguggcaaaucugaguggcgcu

SEQ ID NO: 61286 - RNA, 22 nt, Homo sapiens
guaaaguaaagcacaucaaggu

SEQ ID NO: 61287 - RNA, 22 nt, Homo sapiens
guaaaucucuguuuucauggac

SEQ ID NO: 61288 - RNA, 22 nt, Homo sapiens
guaaauguccugcuacagagug

SEQ ID NO: 61289 - RNA, 22 nt, Homo sapiens
guaacuggccuucaauuucuuc

SEQ ID NO: 61290 - RNA, 22 nt, Homo sapiens
guaaugcacucccaaagaucca

SEQ ID NO: 61291 - RNA, 22 nt, Homo sapiens
guacaaguaagaaaauugccca

SEQ ID NO: 61292 - RNA, 22 nt, Homo sapiens
guacaagugcaguuucguuaca

SEQ ID NO: 61293 - RNA, 22 nt, Homo sapiens
guacagugcucacaaugagagc

SEQ ID NO: 61294 - RNA, 19 nt, Homo sapiens
ucacuggacagcacacuca

SEQ ID NO: 61295 - RNA, 22 nt, Homo sapiens
ucacuggagauagcaaucuggu

SEQ ID NO: 61296 - RNA, 22 nt, Homo sapiens
ucacuggaggagaggaagugga

SEQ ID NO: 61297 - RNA, 22 nt, Homo sapiens
ucacugggagaccaaagccauc

SEQ ID NO: 61298 - RNA, 20 nt, Homo sapiens
ucacugugaacuucuugagg

SEQ ID NO: 61299 - RNA, 22 nt, Homo sapiens
ucacugugugucucuguaucug

SEQ ID NO: 61300 - RNA, 22 nt, Homo sapiens
ucacuuugacggccaacuucua

SEQ ID NO: 61301 - RNA, 22 nt, Homo sapiens
ucagaacugauacuagaacuuu

SEQ ID NO: 61302 - RNA, 22 nt, Homo sapiens
ucagagcaaagacacuuuauca

SEQ ID NO: 61303 - RNA, 22 nt, Homo sapiens
ucagauacuggugacaugaaug

SEQ ID NO: 61304 - RNA, 19 nt, Homo sapiens
ucagaugcauuagggguua

SEQ ID NO: 61305 - RNA, 22 nt, Homo sapiens
ucagauguuugagaaguauacu

SEQ ID NO: 61306 - RNA, 22 nt, Homo sapiens
ucagcaccauguaacaauugau

SEQ ID NO: 61307 - RNA, 19 nt, Homo sapiens
ucagcaguaaucaacuuca

SEQ ID NO: 61308 - RNA, 22 nt, Homo sapiens
ucagcagucacuccuaugacaa

SEQ ID NO: 61309 - RNA, 22 nt, Homo sapiens
ucagcaucacaggcagugagug

SEQ ID NO: 61310 - RNA, 22 nt, Homo sapiens
ucaggcacuaguaagaaaaagg

SEQ ID NO: 61311 - RNA, 20 nt, Homo sapiens
ucaggcuccgcauuaacuua

SEQ ID NO: 61312 - RNA, 21 nt, Homo sapiens
ucagggaccugcuguacugau

SEQ ID NO: 61313 - RNA, 22 nt, Homo sapiens
ucaguacuuuggagcucacaua

SEQ ID NO: 61314 - RNA, 22 nt, Homo sapiens
ucaguauaugaaucuggggcag

SEQ ID NO: 61315 - RNA, 18 nt, Homo sapiens
ucagucacugccuggcuu

SEQ ID NO: 61316 - RNA, 22 nt, Homo sapiens
ucagugaacgaggaggagggug

SEQ ID NO: 61317 - RNA, 22 nt, Homo sapiens
ucagugaauacauguacucaug

SEQ ID NO: 61318 - RNA, 22 nt, Homo sapiens
ucagugaauguuggccacuacu

SEQ ID NO: 61319 - RNA, 20 nt, Homo sapiens
ucagugcagauuguccaagu

SEQ ID NO: 61320 - RNA, 22 nt, Homo sapiens
ucagugcaggaaucucuagcca

SEQ ID NO: 61321 - RNA, 23 nt, Homo sapiens
ucagugucuggauccugcucagu

SEQ ID NO: 61322 - RNA, 22 nt, Homo sapiens
ucauacuguuaaaugguuuagu

SEQ ID NO: 61323 - RNA, 22 nt, Homo sapiens
ucauaucauuagaucuacugua

SEQ ID NO: 61324 - RNA, 21 nt, Homo sapiens
ucaucaagcuguagacaugau

SEQ ID NO: 61325 - RNA, 22 nt, Homo sapiens
ucaugugagcacagagcaagau

SEQ ID NO: 61326 - RNA, 22 nt, Homo sapiens
ucauugcauguuaauuaaacag

SEQ ID NO: 61327 - RNA, 22 nt, Homo sapiens
ucauuggauggaaugcucugua

SEQ ID NO: 61328 - RNA, 22 nt, Homo sapiens
ucauugguugcguaauuugauu

SEQ ID NO: 61329 - RNA, 22 nt, Homo sapiens
uccaagaugcuggcagcuacag

SEQ ID NO: 61330 - RNA, 22 nt, Homo sapiens
uccacagugguugaacuaguaa

SEQ ID NO: 61331 - RNA, 22 nt, Homo sapiens
uccagaguggugaugcuggggc

SEQ ID NO: 61332 - RNA, 22 nt, Homo sapiens
uccagguuuggcuuuauaacuu

SEQ ID NO: 61333 - RNA, 22 nt, Homo sapiens
uccagugugcaggcaaguuuga

SEQ ID NO: 61334 - RNA, 22 nt, Homo sapiens
uccaguguuauaauaugcgucu

SEQ ID NO: 61335 - RNA, 22 nt, Homo sapiens
ucccacugucuucucgugcucg

SEQ ID NO: 61336 - RNA, 22 nt, Homo sapiens
uccccgaggcuggagugcagug

SEQ ID NO: 61337 - RNA, 22 nt, Homo sapiens
uccccugagaccccucagcacu

SEQ ID NO: 61338 - RNA, 22 nt, Homo sapiens
ucccugaaaaauuggcuuaaca

SEQ ID NO: 61339 - RNA, 22 nt, Homo sapiens
uccugagaauagaguugcaugu

SEQ ID NO: 61340 - RNA, 22 nt, Homo sapiens
uccuugagccugggaguuauag

SEQ ID NO: 61341 - RNA, 22 nt, Homo sapiens
uccuugagccuuaaauuauaaa

SEQ ID NO: 61342 - RNA, 22 nt, Homo sapiens
uccuuggucauggaagagacag

SEQ ID NO: 61343 - RNA, 22 nt, Homo sapiens
uccuuggugacauuucuugucu

SEQ ID NO: 61344 - RNA, 22 nt, Homo sapiens
ucgcaccauugcacuccagcca

SEQ ID NO: 61345 - RNA, 23 nt, Homo sapiens
ucgcagcauucaauaccaggcag

SEQ ID NO: 61346 - RNA, 22 nt, Homo sapiens
ucuagccuaugaagcuugucca

SEQ ID NO: 61347 - RNA, 22 nt, Homo sapiens
ucuaugguuuauuuccaagugu

SEQ ID NO: 61348 - RNA, 22 nt, Homo sapiens
ucucagcggacaggccggccag

SEQ ID NO: 61349 - RNA, 22 nt, Homo sapiens
ucucagugaaauaaauuauuuu

SEQ ID NO: 61350 - RNA, 22 nt, Homo sapiens
ucucagugaauugguuuugucu

SEQ ID NO: 61351 - RNA, 22 nt, Homo sapiens
ucucaguguuaucuaucugccu

SEQ ID NO: 61352 - RNA, 21 nt, Homo sapiens
ucucauagaguuucacuuucu

SEQ ID NO: 61353 - RNA, 22 nt, Homo sapiens
ucucauggagucaggagcagaa

SEQ ID NO: 61354 - RNA, 22 nt, Homo sapiens
ucucugagaccacuccaaacuc

SEQ ID NO: 61355 - RNA, 22 nt, Homo sapiens
ucucugauuauugcauuucauu

SEQ ID NO: 61356 - RNA, 22 nt, Homo sapiens
ucucuugguugaacaguuugga

SEQ ID NO: 61357 - RNA, 22 nt, Homo sapiens
ucugacaaugaacaaucuauag

SEQ ID NO: 61358 - RNA, 22 nt, Homo sapiens
ucugacuagacaagcaguguac

SEQ ID NO: 61359 - RNA, 22 nt, Homo sapiens
ucugagguaggugcauggauac

SEQ ID NO: 61360 - RNA, 22 nt, Homo sapiens
ucugagguuaaauuuuauaguu

SEQ ID NO: 61361 - RNA, 22 nt, Homo sapiens
ucugcaagucuaaacuagccau

SEQ ID NO: 61362 - RNA, 22 nt, Homo sapiens
ucugccuacugguuggaggaac

SEQ ID NO: 61363 - RNA, 22 nt, Homo sapiens
ucuggcaagagccgagggcagu

SEQ ID NO: 61364 - RNA, 21 nt, Homo sapiens
ucuggcccccucaaaucucau

SEQ ID NO: 61365 - RNA, 22 nt, Homo sapiens
ucuggcuccaaagucuauuuuu

SEQ ID NO: 61366 - RNA, 22 nt, Homo sapiens
ucuggcuucugacuuaggggac

SEQ ID NO: 61367 - RNA, 22 nt, Homo sapiens
ucuggcuuuagcaugugggaag

SEQ ID NO: 61368 - RNA, 22 nt, Homo sapiens
ucugguuccugcauucauucaa

SEQ ID NO: 61369 - RNA, 22 nt, Homo sapiens
ucuguaguuaacagcuucagcu

SEQ ID NO: 61370 - RNA, 22 nt, Homo sapiens
ucugucaaaucuuauguuguag

SEQ ID NO: 61371 - RNA, 22 nt, Homo sapiens
ucugucacugguggacgaucac

SEQ ID NO: 61372 - RNA, 22 nt, Homo sapiens
ucugugcugagaguugaaaguu

SEQ ID NO: 61373 - RNA, 22 nt, Homo sapiens
gaggcauuauucccaucuuaca

SEQ ID NO: 61374 - RNA, 22 nt, Homo sapiens
gagguauagaacaccuuucaag

SEQ ID NO: 61375 - RNA, 22 nt, Homo sapiens
gaggucauguggcaggcagcca

SEQ ID NO: 61376 - RNA, 22 nt, Homo sapiens
gagguguagucaugccaagauc

SEQ ID NO: 61377 - RNA, 22 nt, Homo sapiens
gagguugggaugagggauacag

SEQ ID NO: 61378 - RNA, 22 nt, Homo sapiens
gaguaaauguccuagcuucuug

SEQ ID NO: 61379 - RNA, 22 nt, Homo sapiens
gaguagugcugcaguaaacaua

SEQ ID NO: 61380 - RNA, 22 nt, Homo sapiens
gagugcaauggcaagaucuugg

SEQ ID NO: 61381 - RNA, 22 nt, Homo sapiens
gagugcaauggcgcgaucucgg

SEQ ID NO: 61382 - RNA, 22 nt, Homo sapiens
gaguuagguugucaaugucuua

SEQ ID NO: 61383 - RNA, 22 nt, Homo sapiens
gaguucaauuuccagcuguucu

SEQ ID NO: 61384 - RNA, 22 nt, Homo sapiens
gauagcagccauucuuuuuauu

SEQ ID NO: 61385 - RNA, 19 nt, Homo sapiens
gauaucuagggggagguuc

SEQ ID NO: 61386 - RNA, 22 nt, Homo sapiens
gauauguacagcucucuaggau

SEQ ID NO: 61387 - RNA, 22 nt, Homo sapiens
gauauguaguaguugaaaaaga

SEQ ID NO: 61388 - RNA, 22 nt, Homo sapiens
gauggaguugucgccugggcug

SEQ ID NO: 61389 - RNA, 22 nt, Homo sapiens
gcaaaaaguagugcugguuagg

SEQ ID NO: 61390 - RNA, 21 nt, Homo sapiens
gcaaacauccuuugaugccag

SEQ ID NO: 61391 - RNA, 22 nt, Homo sapiens
gcaaaguguuuuccaacuuggu

SEQ ID NO: 61392 - RNA, 22 nt, Homo sapiens
gcaagaauggaacaggagagcc

SEQ ID NO: 61393 - RNA, 22 nt, Homo sapiens
gcaagagguaucuuauuuuccc

SEQ ID NO: 61394 - RNA, 22 nt, Homo sapiens
gcaaugcugucugugcacagau

SEQ ID NO: 61395 - RNA, 22 nt, Homo sapiens
gcacaggguuacauucuaaggu

SEQ ID NO: 61396 - RNA, 22 nt, Homo sapiens
gcacauggccacuaggaauaaa

SEQ ID NO: 61397 - RNA, 22 nt, Homo sapiens
gcaccauugacaagaaauaggu

SEQ ID NO: 61398 - RNA, 17 nt, Homo sapiens
gcacuggcguaucccac

SEQ ID NO: 61399 - RNA, 22 nt, Homo sapiens
gcagcaguggcaguuaauauuu

SEQ ID NO: 61400 - RNA, 22 nt, Homo sapiens
gcagcagugugggcugaaccua

SEQ ID NO: 61401 - RNA, 22 nt, Homo sapiens
gcaggaaucuugagaaggauuc

SEQ ID NO: 61402 - RNA, 22 nt, Homo sapiens
aucaagcuacacccuuuggaaa

SEQ ID NO: 61403 - RNA, 22 nt, Homo sapiens
aucaagcugcuuguuugaaucu

SEQ ID NO: 61404 - RNA, 22 nt, Homo sapiens
aucacaauuguacguaggagcc

SEQ ID NO: 61405 - RNA, 22 nt, Homo sapiens
aucacagauauggguuuaaauc

SEQ ID NO: 61406 - RNA, 22 nt, Homo sapiens
aucacagcccuccucuuggaug

SEQ ID NO: 61407 - RNA, 22 nt, Homo sapiens
aucacaguuuuaccauuuggua

SEQ ID NO: 61408 - RNA, 22 nt, Homo sapiens
aucaccauguguacauuagacc

SEQ ID NO: 61409 - RNA, 23 nt, Homo sapiens
aucagauaguuguagguaugugg

SEQ ID NO: 61410 - RNA, 22 nt, Homo sapiens
aucagcagcaugaaaacggacu

SEQ ID NO: 61411 - RNA, 22 nt, Homo sapiens
aucaggcacacauuggaguuug

SEQ ID NO: 61412 - RNA, 22 nt, Homo sapiens
aucagugagugguuagugaaug

SEQ ID NO: 61413 - RNA, 22 nt, Homo sapiens
aucauggaguauuugcaagucu

SEQ ID NO: 61414 - RNA, 22 nt, Homo sapiens
auccacaugcaguuggaaacag

SEQ ID NO: 61415 - RNA, 22 nt, Homo sapiens
auccacauucauggaccagucc

SEQ ID NO: 61416 - RNA, 22 nt, Homo sapiens
auccccugcacggggugucauu

SEQ ID NO: 61417 - RNA, 22 nt, Homo sapiens
auccugaagcuuuacugaauuc

SEQ ID NO: 61418 - RNA, 22 nt, Homo sapiens
auccuguagagaugagggugga

SEQ ID NO: 61419 - RNA, 22 nt, Homo sapiens
auccuugagaaaauaaaugacc

SEQ ID NO: 61420 - RNA, 22 nt, Homo sapiens
aucucaaugcuuuuguaggcca

SEQ ID NO: 61421 - RNA, 16 nt, Homo sapiens
aucucagaccugcuga

SEQ ID NO: 61422 - RNA, 22 nt, Homo sapiens
aucucugagauguucugauuuu

SEQ ID NO: 61423 - RNA, 22 nt, Homo sapiens
aucuggguccguucugcuucuc

SEQ ID NO: 61424 - RNA, 22 nt, Homo sapiens
aucuucucuugaagggugggga

SEQ ID NO: 61425 - RNA, 22 nt, Homo sapiens
aucuuugcugagaugcauggca

SEQ ID NO: 61426 - RNA, 22 nt, Homo sapiens
aucuuuggauacuugauauagu

SEQ ID NO: 61427 - RNA, 22 nt, Homo sapiens
augaaaagcauaaacgcugaag

SEQ ID NO: 61428 - RNA, 22 nt, Homo sapiens
augaagagaaaguggaucuugg

SEQ ID NO: 61429 - RNA, 22 nt, Homo sapiens
augaagcuagcugauugcugau

SEQ ID NO: 61430 - RNA, 22 nt, Homo sapiens
augacaguaugacuccaaaagu

SEQ ID NO: 61431 - RNA, 18 nt, Homo sapiens
augacucuggguguuccu

SEQ ID NO: 61432 - RNA, 22 nt, Homo sapiens
augacugucuugcagaggcuau

SEQ ID NO: 61433 - RNA, 22 nt, Homo sapiens
augagaaucauuucagcuugua

SEQ ID NO: 61434 - RNA, 22 nt, Homo sapiens
augagauucuuagagaagucug

SEQ ID NO: 61435 - RNA, 22 nt, Homo sapiens
augagauuguuuguacuccaca

SEQ ID NO: 61436 - RNA, 22 nt, Homo sapiens
augagcagaagagauacacugu

SEQ ID NO: 61437 - RNA, 22 nt, Homo sapiens
augagcucauugggugacuggg

SEQ ID NO: 61438 - RNA, 22 nt, Homo sapiens
augagggagggcaccugaccuu

SEQ ID NO: 61439 - RNA, 22 nt, Homo sapiens
augagggagggguggugccgca

SEQ ID NO: 61440 - RNA, 15 nt, Homo sapiens
augaguuuuauggag

SEQ ID NO: 61441 - RNA, 22 nt, Homo sapiens
augcaaacagcuaucuggcugg

SEQ ID NO: 61442 - RNA, 22 nt, Homo sapiens
augcaacugcacuccagccugg

SEQ ID NO: 61443 - RNA, 22 nt, Homo sapiens
augcaauucuagauugauagua

SEQ ID NO: 61444 - RNA, 22 nt, Homo sapiens
augcacuguuguuauuggauaa

SEQ ID NO: 61445 - RNA, 22 nt, Homo sapiens
augcacuguuuucuugaugaga

SEQ ID NO: 61446 - RNA, 22 nt, Homo sapiens
augcacuuggcaggaugauucc

SEQ ID NO: 61447 - RNA, 22 nt, Homo sapiens
augcagugugcaacagauuaag

SEQ ID NO: 61448 - RNA, 22 nt, Homo sapiens
augccaguguccagaguggguu

SEQ ID NO: 61449 - RNA, 22 nt, Homo sapiens
augcuacauucuacaauuaggc

SEQ ID NO: 61450 - RNA, 22 nt, Homo sapiens
augcuuguguuggggcagugga

SEQ ID NO: 61451 - RNA, 22 nt, Homo sapiens
auggaaaugaagggcuggcccu

SEQ ID NO: 61452 - RNA, 22 nt, Homo sapiens
auggaaugguugggucauaagg

SEQ ID NO: 61453 - RNA, 22 nt, Homo sapiens
auggaauguauagucauguagg

SEQ ID NO: 61454 - RNA, 22 nt, Homo sapiens
auggacagacacuggccuucug

SEQ ID NO: 61455 - RNA, 22 nt, Homo sapiens
auggagaugaauaucaucuguu

SEQ ID NO: 61456 - RNA, 22 nt, Homo sapiens
auggaggccuacagaauuuugg

SEQ ID NO: 61457 - RNA, 22 nt, Homo sapiens
agcaacauugagacugcaguug

SEQ ID NO: 61458 - RNA, 22 nt, Homo sapiens
agcaagauugauggccugcagg

SEQ ID NO: 61459 - RNA, 22 nt, Homo sapiens
agcaccacaauuuccugccuaa

SEQ ID NO: 61460 - RNA, 17 nt, Homo sapiens
agcaccacacucucuug

SEQ ID NO: 61461 - RNA, 22 nt, Homo sapiens
agcaccguucaaacccagguua

SEQ ID NO: 61462 - RNA, 23 nt, Homo sapiens
agcaccuuuccuccacuaucugc

SEQ ID NO: 61463 - RNA, 22 nt, Homo sapiens
agcagauguuuagugagcgccu

SEQ ID NO: 61464 - RNA, 22 nt, Homo sapiens
agcagcacaucccuuucuggcc

SEQ ID NO: 61465 - RNA, 22 nt, Homo sapiens
agcagcauuaugauauaucuua

SEQ ID NO: 61466 - RNA, 22 nt, Homo sapiens
agcagcuuugcauggccugugg

SEQ ID NO: 61467 - RNA, 22 nt, Homo sapiens
agcaguacauaaaaagcauccu

SEQ ID NO: 61468 - RNA, 22 nt, Homo sapiens
agcauagugccuugaaaacaau

SEQ ID NO: 61469 - RNA, 18 nt, Homo sapiens
agcaucacugaucauccu

SEQ ID NO: 61470 - RNA, 17 nt, Homo sapiens
agcauguguuugagauu

SEQ ID NO: 61471 - RNA, 16 nt, Homo sapiens
agccaccauuuacuug

SEQ ID NO: 61472 - RNA, 23 nt, Homo sapiens
agccugguuucccugcuucuccc

SEQ ID NO: 61473 - RNA, 22 nt, Homo sapiens
agcuccuuucugcaggcagguc

SEQ ID NO: 61474 - RNA, 22 nt, Homo sapiens
agcugaguguuccaagagcgag

SEQ ID NO: 61475 - RNA, 22 nt, Homo sapiens
agcuggacuugauaaaugaaua

SEQ ID NO: 61476 - RNA, 22 nt, Homo sapiens
agcuggcuguggagaaaccccu

SEQ ID NO: 61477 - RNA, 22 nt, Homo sapiens
agcuguguugucugaagucaga

SEQ ID NO: 61478 - RNA, 22 nt, Homo sapiens
agcuguuguuaauuaacucauu

SEQ ID NO: 61479 - RNA, 22 nt, Homo sapiens
agcuguuguucucagaggcuuu

SEQ ID NO: 61480 - RNA, 22 nt, Homo sapiens
agcuucauuguuaugaauguca

SEQ ID NO: 61481 - RNA, 22 nt, Homo sapiens
agcuuguguuugucugccuggg

SEQ ID NO: 61482 - RNA, 22 nt, Homo sapiens
agcuuuggauaccugcuguucc

SEQ ID NO: 61483 - RNA, 21 nt, Homo sapiens
aggaagacuaugaucaauugg

SEQ ID NO: 61484 - RNA, 19 nt, Homo sapiens
aggacuaaagacuagaagu

SEQ ID NO: 61485 - RNA, 22 nt, Homo sapiens
aggagaauugguucuucuugau

SEQ ID NO: 61486 - RNA, 22 nt, Homo sapiens
aggagguagaacauugccauuu

SEQ ID NO: 61487 - RNA, 22 nt, Homo sapiens
aggagguagucugucccuuagc

SEQ ID NO: 61488 - RNA, 22 nt, Homo sapiens
aggaguguguauuaaugaaauu

SEQ ID NO: 61489 - RNA, 22 nt, Homo sapiens
aggcaacaugguaaaacccugu

SEQ ID NO: 61490 - RNA, 16 nt, Homo sapiens
aggcaagaauugaggu

SEQ ID NO: 61491 - RNA, 22 nt, Homo sapiens
aggcaagugggagacagcauuu

SEQ ID NO: 61492 - RNA, 22 nt, Homo sapiens
aggcacacaacccuggaccuga

SEQ ID NO: 61493 - RNA, 22 nt, Homo sapiens
aggcacgguggcucacaccugu

SEQ ID NO: 61494 - RNA, 22 nt, Homo sapiens
aggcacggugucucaugccugu

SEQ ID NO: 61495 - RNA, 22 nt, Homo sapiens
aggcagaugagguccucagcug

SEQ ID NO: 61496 - RNA, 22 nt, Homo sapiens
aggcagucucugccggcugagg

SEQ ID NO: 61497 - RNA, 22 nt, Homo sapiens
agggcaguguuaggacugucug

SEQ ID NO: 61498 - RNA, 22 nt, Homo sapiens
agggcuuguuuaacuaucauua

SEQ ID NO: 61499 - RNA, 22 nt, Homo sapiens
agggcuuuugagcugagauggu

SEQ ID NO: 61500 - RNA, 22 nt, Homo sapiens
agguagcauagcgggaauauca

SEQ ID NO: 61501 - RNA, 22 nt, Homo sapiens
agguccacuuacuacuccuguu

SEQ ID NO: 61502 - RNA, 22 nt, Homo sapiens
aggugcuugaaucuaugagcuc

SEQ ID NO: 61503 - RNA, 22 nt, Homo sapiens
agguuguugcaugcuccuuagg

SEQ ID NO: 61504 - RNA, 22 nt, Homo sapiens
aguaacacaccugcauggugug

SEQ ID NO: 61505 - RNA, 22 nt, Homo sapiens
aguaacaggauccaaagaaugu

SEQ ID NO: 61506 - RNA, 22 nt, Homo sapiens
aguaaucaucugagggcagaaa

SEQ ID NO: 61507 - RNA, 22 nt, Homo sapiens
aguacacuguugaacagaagug

SEQ ID NO: 61508 - RNA, 22 nt, Homo sapiens
aguaccauuacucacuuauuuu

SEQ ID NO: 61509 - RNA, 23 nt, Homo sapiens
ugugacacuuccgucaguucauu

SEQ ID NO: 61510 - RNA, 18 nt, Homo sapiens
ugugacauugagcauguc

SEQ ID NO: 61511 - RNA, 19 nt, Homo sapiens
ugugacugggccagccuag

SEQ ID NO: 61512 - RNA, 21 nt, Homo sapiens
ugugacuguugcauuugucgu

SEQ ID NO: 61513 - RNA, 22 nt, Homo sapiens
ugugcaugacagcauacaaacg

SEQ ID NO: 61514 - RNA, 22 nt, Homo sapiens
ugugccacugcacuccugggug

SEQ ID NO: 61515 - RNA, 22 nt, Homo sapiens
ugugccacuguucuguaaagug

SEQ ID NO: 61516 - RNA, 22 nt, Homo sapiens
uguggcaaauggucaggaagaa

SEQ ID NO: 61517 - RNA, 18 nt, Homo sapiens
uguggcuguuuuccaaua

SEQ ID NO: 61518 - RNA, 22 nt, Homo sapiens
ugugguauuagguguaguaucu

SEQ ID NO: 61519 - RNA, 23 nt, Homo sapiens
ugugguauuauuccauuuauagg

SEQ ID NO: 61520 - RNA, 22 nt, Homo sapiens
uguguaaauaugauagaggaau

SEQ ID NO: 61521 - RNA, 22 nt, Homo sapiens
uguguacaucucuacacacaug

SEQ ID NO: 61522 - RNA, 22 nt, Homo sapiens
uguguagagaaauauuacuuau

SEQ ID NO: 61523 - RNA, 22 nt, Homo sapiens
uguguauaucacugcaugagug

SEQ ID NO: 61524 - RNA, 22 nt, Homo sapiens
uguuaacauggucucagucugu

SEQ ID NO: 61525 - RNA, 22 nt, Homo sapiens
uguuacagcagaauugaaagag

SEQ ID NO: 61526 - RNA, 22 nt, Homo sapiens
uguuagguuggugcaaaaguga

SEQ ID NO: 61527 - RNA, 22 nt, Homo sapiens
uguuuuggaguggacuuugcau

SEQ ID NO: 61528 - RNA, 22 nt, Homo sapiens
uuaaagcuggcguuacaguuug

SEQ ID NO: 61529 - RNA, 22 nt, Homo sapiens
uuaaaguauaguuccucugguu

SEQ ID NO: 61530 - RNA, 22 nt, Homo sapiens
uuaacagugucaaucuguagua

SEQ ID NO: 61531 - RNA, 22 nt, Homo sapiens
uuaagccacucaagagauagag

SEQ ID NO: 61532 - RNA, 18 nt, Homo sapiens
uuaaggcaggacuuuaag

SEQ ID NO: 61533 - RNA, 22 nt, Homo sapiens
uuaaggcagugucuaugccagu

SEQ ID NO: 61534 - RNA, 22 nt, Homo sapiens
uuaaggcauucuuugucuucau

SEQ ID NO: 61535 - RNA, 19 nt, Homo sapiens
uuaagguacuuagaugugu

SEQ ID NO: 61536 - RNA, 21 nt, Homo sapiens
uuaagugcuuuguaugcacua

SEQ ID NO: 61537 - RNA, 22 nt, Homo sapiens
uuaaguuaggcuucagcagucu

SEQ ID NO: 61538 - RNA, 22 nt, Homo sapiens
uuaauagcaaagaguuuagacu

SEQ ID NO: 61539 - RNA, 22 nt, Homo sapiens
uuaauuguaucuauagauguca

SEQ ID NO: 61540 - RNA, 22 nt, Homo sapiens
uuacaaguggcaucucucugga

SEQ ID NO: 61541 - RNA, 22 nt, Homo sapiens
uuacagcagugccccacuccca

SEQ ID NO: 61542 - RNA, 22 nt, Homo sapiens
uuacaguaugaguaagaguucu

SEQ ID NO: 61543 - RNA, 22 nt, Homo sapiens
uuacagucaaguuacauuucuc

SEQ ID NO: 61544 - RNA, 22 nt, Homo sapiens
uuacagugguugcuauugugaa

SEQ ID NO: 61545 - RNA, 22 nt, Homo sapiens
uuacaguugugagccaccaugc

SEQ ID NO: 61546 - RNA, 22 nt, Homo sapiens
uuaccucagaccugcucugugu

SEQ ID NO: 61547 - RNA, 22 nt, Homo sapiens
uuagcagugugagcacagacua

SEQ ID NO: 61548 - RNA, 22 nt, Homo sapiens
uuagggaggagucccucuuuuu

SEQ ID NO: 61549 - RNA, 22 nt, Homo sapiens
uuaguaguuugaguggggguua

SEQ ID NO: 61550 - RNA, 22 nt, Homo sapiens
uuauaaacaugaagauuugggg

SEQ ID NO: 61551 - RNA, 22 nt, Homo sapiens
uuauauguuucuuagggacaga

SEQ ID NO: 61552 - RNA, 22 nt, Homo sapiens
uuauuagagauauuugguuagg

SEQ ID NO: 61553 - RNA, 22 nt, Homo sapiens
uuauucagcaccugcuguguuc

SEQ ID NO: 61554 - RNA, 22 nt, Homo sapiens
uuauugcuaaaucaugaccaca

SEQ ID NO: 61555 - RNA, 22 nt, Homo sapiens
uucaaaucuucguuuugccaua

SEQ ID NO: 61556 - RNA, 23 nt, Homo sapiens
uucaacagguagacccucccugc

SEQ ID NO: 61557 - RNA, 22 nt, Homo sapiens
uucaaguguucaggagcuacag

SEQ ID NO: 61558 - RNA, 22 nt, Homo sapiens
uucacaaugccuuguugauggu

SEQ ID NO: 61559 - RNA, 22 nt, Homo sapiens
uucacacugggccuacucugug

SEQ ID NO: 61560 - RNA, 22 nt, Homo sapiens
uucaccuggguuggccaucauu

SEQ ID NO: 61561 - RNA, 22 nt, Homo sapiens
uucaccuguagcaugcccuugg

SEQ ID NO: 61562 - RNA, 22 nt, Homo sapiens
uucaccuugggucccacuugcu

SEQ ID NO: 61563 - RNA, 22 nt, Homo sapiens
uucacuguuaagcaguuaaacu

SEQ ID NO: 61564 - RNA, 22 nt, Homo sapiens
uucagcacugaaaauaugucau

SEQ ID NO: 61565 - RNA, 22 nt, Homo sapiens
uucagcaguggccaguggaaau

SEQ ID NO: 61566 - RNA, 19 nt, Homo sapiens
uucagcagugucugcucuu

SEQ ID NO: 61567 - RNA, 22 nt, Homo sapiens
uucagcuaccugggaugcugaa

SEQ ID NO: 61568 - RNA, 22 nt, Homo sapiens
uucagcuacuugggaggcugaa

SEQ ID NO: 61569 - RNA, 22 nt, Homo sapiens
uucaggcuuuuauuuacugaua

SEQ ID NO: 61570 - RNA, 22 nt, Homo sapiens
uucagggcauuggaguuucuga

SEQ ID NO: 61571 - RNA, 22 nt, Homo sapiens
uucaguagucuccauagaaccg

SEQ ID NO: 61572 - RNA, 22 nt, Homo sapiens
uucaguccauuuccuuggucac

SEQ ID NO: 61573 - RNA, 20 nt, Homo sapiens
uucagugcagguaacaaucc

SEQ ID NO: 61574 - RNA, 22 nt, Homo sapiens
uucauaguuuauacugauauuu

SEQ ID NO: 61575 - RNA, 22 nt, Homo sapiens
uucauggauggaaaugauuuug

SEQ ID NO: 61576 - RNA, 22 nt, Homo sapiens
uuccacaauggcugaacuaguu

SEQ ID NO: 61577 - RNA, 22 nt, Homo sapiens
uuccacagggauuugcauugau

SEQ ID NO: 61578 - RNA, 20 nt, Homo sapiens
uucccucagccuugagggua

SEQ ID NO: 61579 - RNA, 22 nt, Homo sapiens
uucccuguaucuucugccaugu

SEQ ID NO: 61580 - RNA, 22 nt, Homo sapiens
uucucaauggcaacuuguugcu

SEQ ID NO: 61581 - RNA, 21 nt, Homo sapiens
uucucagaggcaggggauaaa

SEQ ID NO: 61582 - RNA, 22 nt, Homo sapiens
uucucaguucgguggcagugcu

SEQ ID NO: 61583 - RNA, 22 nt, Homo sapiens
uucucuaguuacuuuaauggag

SEQ ID NO: 61584 - RNA, 22 nt, Homo sapiens
uucugcuagucugucagaucuu

SEQ ID NO: 61585 - RNA, 22 nt, Homo sapiens
uucuggcucaggucaacacuuc

SEQ ID NO: 61586 - RNA, 22 nt, Homo sapiens
uucugguuaauacuugcaaaaa

SEQ ID NO: 61587 - RNA, 22 nt, Homo sapiens
uucugugcugaaucaaagacug

SEQ ID NO: 61588 - RNA, 22 nt, Homo sapiens
uucugugguagaaaucucaaau

SEQ ID NO: 61589 - RNA, 22 nt, Homo sapiens
uucuuuaguucacuugcuccag

SEQ ID NO: 61590 - RNA, 22 nt, Homo sapiens
uucuuuggauaaaguuuuaugc

SEQ ID NO: 61591 - RNA, 22 nt, Homo sapiens
uugaaagaaaggagacugaguu

SEQ ID NO: 61592 - RNA, 22 nt, Homo sapiens
uugaaagaugaacuggauugga

SEQ ID NO: 61593 - RNA, 22 nt, Homo sapiens
uugaaaguaaacaucacaaaga

SEQ ID NO: 61594 - RNA, 22 nt, Homo sapiens
uugaagagaaccgcggcuuauu

SEQ ID NO: 61595 - RNA, 22 nt, Homo sapiens
uugaaguaguacuuuauuauag

SEQ ID NO: 61596 - RNA, 22 nt, Homo sapiens
uugaagugaagaacaauaucac

SEQ ID NO: 61597 - RNA, 22 nt, Homo sapiens
uugaauagaagguuuuuuguuc

SEQ ID NO: 61598 - RNA, 22 nt, Homo sapiens
uugacaaggagugggguugaga

SEQ ID NO: 61599 - RNA, 22 nt, Homo sapiens
uugacauaaucauuucacagug

SEQ ID NO: 61600 - RNA, 22 nt, Homo sapiens
uugaccacugggcacaguaagu

SEQ ID NO: 61601 - RNA, 22 nt, Homo sapiens
uugagauggagucucacucugc

SEQ ID NO: 61602 - RNA, 22 nt, Homo sapiens
uugagauggagucucacucuuu

SEQ ID NO: 61603 - RNA, 22 nt, Homo sapiens
uugagauggagucucacugugu

SEQ ID NO: 61604 - RNA, 22 nt, Homo sapiens
uugagauggagucuugcucugu

SEQ ID NO: 61605 - RNA, 22 nt, Homo sapiens
uugagauggaguuucaauauug

SEQ ID NO: 61606 - RNA, 22 nt, Homo sapiens
uugagauggaguuucacucuug

SEQ ID NO: 61607 - RNA, 22 nt, Homo sapiens
uugagcccuggaggcagaggcu

SEQ ID NO: 61608 - RNA, 22 nt, Homo sapiens
uugaggccugauaacacacuga

SEQ ID NO: 61609 - RNA, 22 nt, Homo sapiens
uugagguauaaagguagguugu

SEQ ID NO: 61610 - RNA, 22 nt, Homo sapiens
uugagguauugauaaaacauuu

SEQ ID NO: 61611 - RNA, 22 nt, Homo sapiens
uugagguauuuugucaacugua

SEQ ID NO: 61612 - RNA, 22 nt, Homo sapiens
uugaguccauucgaugcugauu

SEQ ID NO: 61613 - RNA, 22 nt, Homo sapiens
uugagugaaugaaugauuaaau

SEQ ID NO: 61614 - RNA, 22 nt, Homo sapiens
uugauagaucagggauuugauu

SEQ ID NO: 61615 - RNA, 23 nt, Homo sapiens
uugcaaagccugaaacucuucag

SEQ ID NO: 61616 - RNA, 22 nt, Homo sapiens
uugcaacauguauucuggugau

SEQ ID NO: 61617 - RNA, 22 nt, Homo sapiens
uugcaagauguucaugggcugu

SEQ ID NO: 61618 - RNA, 22 nt, Homo sapiens
uugcacuccggccuggguaaca

SEQ ID NO: 61619 - RNA, 22 nt, Homo sapiens
uugcacuguaauuuauuuaugu

SEQ ID NO: 61620 - RNA, 22 nt, Homo sapiens
uugcagcauucugguuccuggu

SEQ ID NO: 61621 - RNA, 22 nt, Homo sapiens
uugcagugguuucacuggcaaa

SEQ ID NO: 61622 - RNA, 22 nt, Homo sapiens
uugcauaauaagagggauacgu

SEQ ID NO: 61623 - RNA, 23 nt, Homo sapiens
uugcauagacauccucauagauu

SEQ ID NO: 61624 - RNA, 22 nt, Homo sapiens
uugccuuuguuggaaacaagug

SEQ ID NO: 61625 - RNA, 22 nt, Homo sapiens
uugcuaagucaagagaaaugau

SEQ ID NO: 61626 - RNA, 22 nt, Homo sapiens
uugcuagaugaaaaugguaccu

SEQ ID NO: 61627 - RNA, 22 nt, Homo sapiens
uugcucaggcuagaguucagcu

SEQ ID NO: 61628 - RNA, 22 nt, Homo sapiens
uuggaagauuacuuaguuuucu

SEQ ID NO: 61629 - RNA, 22 nt, Homo sapiens
uuggaaggcuccuaaugaaugg

SEQ ID NO: 61630 - RNA, 22 nt, Homo sapiens
uuggaauauaaccuguuucuaa

SEQ ID NO: 61631 - RNA, 22 nt, Homo sapiens
uuggacugagaguuccaccauu

SEQ ID NO: 61632 - RNA, 22 nt, Homo sapiens
uuggagagucacuaguuagugc

SEQ ID NO: 61633 - RNA, 22 nt, Homo sapiens
uuggagugugagagcagccugg

SEQ ID NO: 61634 - RNA, 22 nt, Homo sapiens
uuggaugauaaagaagccuaag

SEQ ID NO: 61635 - RNA, 22 nt, Homo sapiens
uuggauggucuuuauauaguau

SEQ ID NO: 61636 - RNA, 22 nt, Homo sapiens
uuggcaagcuguuaauuauaaa

SEQ ID NO: 61637 - RNA, 22 nt, Homo sapiens
uuggcauugaguuucaaaucau

SEQ ID NO: 61638 - RNA, 22 nt, Homo sapiens
uuggcuuuuaugcagcuuaggu

SEQ ID NO: 61639 - RNA, 22 nt, Homo sapiens
uugguauguguuucauacucaa

SEQ ID NO: 61640 - RNA, 22 nt, Homo sapiens
uuggucaggagccucccucuuu

SEQ ID NO: 61641 - RNA, 22 nt, Homo sapiens
uuggucaggcuagaguguggug

SEQ ID NO: 61642 - RNA, 22 nt, Homo sapiens
uuggucaucucccuccuuuuag

SEQ ID NO: 61643 - RNA, 22 nt, Homo sapiens
uugguuaucaucauuucagcaa

SEQ ID NO: 61644 - RNA, 22 nt, Homo sapiens
uuguacuuuuaguagagacggg

SEQ ID NO: 61645 - RNA, 22 nt, Homo sapiens
uuguaguguuuauucugucaac

SEQ ID NO: 61646 - RNA, 22 nt, Homo sapiens
uugucacugcacuccagucugg

SEQ ID NO: 61647 - RNA, 22 nt, Homo sapiens
uugucauuuucagaguguuacg

SEQ ID NO: 61648 - RNA, 22 nt, Homo sapiens
uuguccaagucccauuuguuga

SEQ ID NO: 61649 - RNA, 22 nt, Homo sapiens
uugugcacauguacccuagaac

SEQ ID NO: 61650 - RNA, 22 nt, Homo sapiens
uuguguaguaccucucacauug

SEQ ID NO: 61651 - RNA, 22 nt, Homo sapiens
uuuaaugcaucccaaaauguag

SEQ ID NO: 61652 - RNA, 22 nt, Homo sapiens
uuuaauguuacaguauugguau

SEQ ID NO: 61653 - RNA, 22 nt, Homo sapiens
uuuacugucuucagucccucug

SEQ ID NO: 61654 - RNA, 21 nt, Homo sapiens
uuuacuguggacccauugcuu

SEQ ID NO: 61655 - RNA, 22 nt, Homo sapiens
uuuagcacugugauugacaaaa

SEQ ID NO: 61656 - RNA, 22 nt, Homo sapiens
uuucaccguguuggccaggcug

SEQ ID NO: 61657 - RNA, 22 nt, Homo sapiens
uuucacguuggggaguugagug

SEQ ID NO: 61658 - RNA, 22 nt, Homo sapiens
uuucagagucaucugcccaagu

SEQ ID NO: 61659 - RNA, 17 nt, Homo sapiens
uuucagaguggaagugu

SEQ ID NO: 61660 - RNA, 22 nt, Homo sapiens
uuucaggcagggagcuucagug

SEQ ID NO: 61661 - RNA, 23 nt, Homo sapiens
uuucaggcaggugaaagaccagc

SEQ ID NO: 61662 - RNA, 20 nt, Homo sapiens
uuucaguacuuucuacuggc

SEQ ID NO: 61663 - RNA, 22 nt, Homo sapiens
uuucauagccuuugucgucuga

SEQ ID NO: 61664 - RNA, 22 nt, Homo sapiens
uuucccauuguucugcucugug

SEQ ID NO: 61665 - RNA, 22 nt, Homo sapiens
uuucucaguguuucaggguagg

SEQ ID NO: 61666 - RNA, 22 nt, Homo sapiens
uuucugguuaauuucuaagagc

SEQ ID NO: 61667 - RNA, 22 nt, Homo sapiens
uuucugugguccucuugaaggu

SEQ ID NO: 61668 - RNA, 22 nt, Homo sapiens
uuugaauguaaugagcaggaag

SEQ ID NO: 61669 - RNA, 22 nt, Homo sapiens
uuugagauaucuuccaucagua

SEQ ID NO: 61670 - RNA, 21 nt, Homo sapiens
uuugaucauuaaaagugaauc

SEQ ID NO: 61671 - RNA, 22 nt, Homo sapiens
uuugcacuugaaaacacucuca

SEQ ID NO: 61672 - RNA, 22 nt, Homo sapiens
uuugcaguguaguuggccagca

SEQ ID NO: 61673 - RNA, 22 nt, Homo sapiens
uuuggcaauuugacuguauagg

SEQ ID NO: 61674 - RNA, 22 nt, Homo sapiens
uuuggcaugggcuauuugcuuu

SEQ ID NO: 61675 - RNA, 22 nt, Homo sapiens
uuugggaaugaguuuaucauuu

SEQ ID NO: 61676 - RNA, 22 nt, Homo sapiens
uuuguacuaugguuuuucacua

SEQ ID NO: 61677 - RNA, 22 nt, Homo sapiens
uuuguacuucauacaauaacuc

SEQ ID NO: 61678 - RNA, 22 nt, Homo sapiens
uuuguacuugguguucuggaaa

SEQ ID NO: 61679 - RNA, 22 nt, Homo sapiens
uuugucauagcagcaggaaugg

SEQ ID NO: 61680 - RNA, 22 nt, Homo sapiens
uuugugcuaacuuuaacucuua

SEQ ID NO: 61681 - RNA, 22 nt, Homo sapiens
uuugugcuaaugcuagauuacu

SEQ ID NO: 61682 - RNA, 22 nt, Homo sapiens
uuugugcuccucucaguaugug

SEQ ID NO: 61683 - RNA, 22 nt, Homo sapiens
uuuuaugggcuauuugcauuag

SEQ ID NO: 61684 - RNA, 22 nt, Homo sapiens
uuuugcaauauguuccugaaua

SEQ ID NO: 61685 - RNA, 19 nt, Homo sapiens
uuuuggaaaugugaacagc

SEQ ID NO: 61686 - RNA, 17 nt, Homo sapiens
uuuuggauuagaaaucc

SEQ ID NO: 61687 - RNA, 22 nt, Homo sapiens
uuuugugacuauuguaaauggg

SEQ ID NO: 61688 - RNA, 18 nt, Homo sapiens
uuuuugaggcacagggga

SEQ ID NO: 61689 - RNA, 22 nt, Homo sapiens
uuuuugauuaauggguagacca

SEQ ID NO: 61690 - RNA, 22 nt, Homo sapiens
uuuuuggaggagguuagaucau

SEQ ID NO: 61691 - RNA, 22 nt, Homo sapiens
aaacauugaccucauccuggca

SEQ ID NO: 61692 - RNA, 22 nt, Homo sapiens
aaacugcuuuccaugguggcug

SEQ ID NO: 61693 - RNA, 22 nt, Homo sapiens
aaagagaucuaugggcacuaug

SEQ ID NO: 61694 - RNA, 22 nt, Homo sapiens
aaaggcacacacuccuuguuau

SEQ ID NO: 61695 - RNA, 22 nt, Homo sapiens
aaagggcacugugcuuuggcaa

SEQ ID NO: 61696 - RNA, 22 nt, Homo sapiens
aaaguacucaguucaguuccgu

SEQ ID NO: 61697 - RNA, 19 nt, Homo sapiens
aaaguacucugaugccucu

SEQ ID NO: 61698 - RNA, 22 nt, Homo sapiens
aaagucuagaggaucaugugug

SEQ ID NO: 61699 - RNA, 18 nt, Homo sapiens
aaagugaugucauucuuu

SEQ ID NO: 61700 - RNA, 22 nt, Homo sapiens
aaaugcagauucugcuuagguu

SEQ ID NO: 61701 - RNA, 22 nt, Homo sapiens
aaaugcaguugguggggauaug

SEQ ID NO: 61702 - RNA, 22 nt, Homo sapiens
aaaugcaucauuaggugauuuu

SEQ ID NO: 61703 - RNA, 22 nt, Homo sapiens
aaaugcauugagggaaaaggca

SEQ ID NO: 61704 - RNA, 22 nt, Homo sapiens
aaaugcugcuuuggccucuucu

SEQ ID NO: 61705 - RNA, 20 nt, Homo sapiens
aaaugcuguaauguuuggga

SEQ ID NO: 61706 - RNA, 22 nt, Homo sapiens
aaaugguguuaguagaucuuua

SEQ ID NO: 61707 - RNA, 22 nt, Homo sapiens
aaauugcacaaguggugauuug

SEQ ID NO: 61708 - RNA, 22 nt, Homo sapiens
aacacuggcugcucgaguucuc

SEQ ID NO: 61709 - RNA, 22 nt, Homo sapiens
aacagugcauucagggauauau

SEQ ID NO: 61710 - RNA, 22 nt, Homo sapiens
aacagugcuucauucacacauu

SEQ ID NO: 61711 - RNA, 22 nt, Homo sapiens
auuauuaguuguugaaugaagu

SEQ ID NO: 61712 - RNA, 22 nt, Homo sapiens
auucaacuaauuauugaagaug

SEQ ID NO: 61713 - RNA, 22 nt, Homo sapiens
auucaaggacuggauugcggga

SEQ ID NO: 61714 - RNA, 22 nt, Homo sapiens
auucauagugcuaagguguauc

SEQ ID NO: 61715 - RNA, 20 nt, Homo sapiens
auucauggaggagcaauugg

SEQ ID NO: 61716 - RNA, 22 nt, Homo sapiens
auuccacaguuaacacagaccg

SEQ ID NO: 61717 - RNA, 22 nt, Homo sapiens
auucccuuagcugccucagccu

SEQ ID NO: 61718 - RNA, 22 nt, Homo sapiens
auugauaguuuaauaggaauug

SEQ ID NO: 61719 - RNA, 22 nt, Homo sapiens
auugcacaccagucugggcaaa

SEQ ID NO: 61720 - RNA, 23 nt, Homo sapiens
auugcagaaucacagagguagug

SEQ ID NO: 61721 - RNA, 22 nt, Homo sapiens
auugcagauucgcuuuguguug

SEQ ID NO: 61722 - RNA, 22 nt, Homo sapiens
auugcagcccacccugggugau

SEQ ID NO: 61723 - RNA, 22 nt, Homo sapiens
auugcuuacccuguauuagauc

SEQ ID NO: 61724 - RNA, 22 nt, Homo sapiens
auugcuucugauuuuaaaugag

SEQ ID NO: 61725 - RNA, 22 nt, Homo sapiens
auuggacagcauuucuagacuu

SEQ ID NO: 61726 - RNA, 22 nt, Homo sapiens
auuggguuaaaggauaugaaca

SEQ ID NO: 61727 - RNA, 22 nt, Homo sapiens
auuggugaccugcggcaguaug

SEQ ID NO: 61728 - RNA, 22 nt, Homo sapiens
auuguacuccagccuaggcaac

SEQ ID NO: 61729 - RNA, 22 nt, Homo sapiens
auuguacuccagccugggcugc

SEQ ID NO: 61730 - RNA, 22 nt, Homo sapiens
auuguacuccagccugggugac

SEQ ID NO: 61731 - RNA, 22 nt, Homo sapiens
auuguacugccccccuguugcu

SEQ ID NO: 61732 - RNA, 22 nt, Homo sapiens
auugucacuuaaaagugcaugu

SEQ ID NO: 61733 - RNA, 22 nt, Homo sapiens
auugugcuaaaguaauaaguca

SEQ ID NO: 61734 - RNA, 22 nt, Homo sapiens
auuguguagucuuacugcuugc

SEQ ID NO: 61735 - RNA, 22 nt, Homo sapiens
auugugucuuguagagagauau

SEQ ID NO: 61736 - RNA, 22 nt, Homo sapiens
auuguucuuguguccuuuuccu

SEQ ID NO: 61737 - RNA, 22 nt, Homo sapiens
auuucacuucgcaugguguccg

SEQ ID NO: 61738 - RNA, 21 nt, Homo sapiens
auuugcacugagcuccugugc

SEQ ID NO: 61739 - RNA, 22 nt, Homo sapiens
auuuggcagugaagggaucaca

SEQ ID NO: 61740 - RNA, 22 nt, Homo sapiens
auuuugcauugcuguaaaggaa

SEQ ID NO: 61741 - RNA, 22 nt, Homo sapiens
caaagcuauagcaccagaggga

SEQ ID NO: 61742 - RNA, 22 nt, Homo sapiens
caaagucuucaguugauucuga

SEQ ID NO: 61743 - RNA, 22 nt, Homo sapiens
caaagugguuuauacaugauug

SEQ ID NO: 61744 - RNA, 22 nt, Homo sapiens
gauuuguuggccugugagcuag

SEQ ID NO: 61745 - RNA, 21 nt, Homo sapiens
gcaaaguggcuaccuugcucc

SEQ ID NO: 61746 - RNA, 22 nt, Homo sapiens
gcaaaguguuuuuaggaagucu

SEQ ID NO: 61747 - RNA, 22 nt, Homo sapiens
gcaaaucuuauguccucacauu

SEQ ID NO: 61748 - RNA, 22 nt, Homo sapiens
gcaaaugcuaugccauuuuaua

SEQ ID NO: 61749 - RNA, 20 nt, Homo sapiens
gcaacauggccagagugaau

SEQ ID NO: 61750 - RNA, 22 nt, Homo sapiens
gcaagaugagagcccgggcagu

SEQ ID NO: 61751 - RNA, 22 nt, Homo sapiens
gcaauacugacagcauuaguuu

SEQ ID NO: 61752 - RNA, 22 nt, Homo sapiens
gcaauguuacugaauguguuuu

SEQ ID NO: 61753 - RNA, 22 nt, Homo sapiens
gcacagaugaggagaggucuca

SEQ ID NO: 61754 - RNA, 22 nt, Homo sapiens
gcacaguguuacuugauauauu

SEQ ID NO: 61755 - RNA, 22 nt, Homo sapiens
gcacauggccccaucgugccga

SEQ ID NO: 61756 - RNA, 22 nt, Homo sapiens
gcaccacugcacucucagcuug

SEQ ID NO: 61757 - RNA, 22 nt, Homo sapiens
gcaccguggaguauggggagga

SEQ ID NO: 61758 - RNA, 22 nt, Homo sapiens
gcagcacaugacuguauguaua

SEQ ID NO: 61759 - RNA, 22 nt, Homo sapiens
gcaguagugugaucuuggcuca

SEQ ID NO: 61760 - RNA, 23 nt, Homo sapiens
gcagucauuuggaaaagguugaa

SEQ ID NO: 61761 - RNA, 22 nt, Homo sapiens
gcagugugugaggaauuugggu

SEQ ID NO: 61762 - RNA, 16 nt, Homo sapiens
gcaguguguuuaauag

SEQ ID NO: 61763 - RNA, 22 nt, Homo sapiens
gcaguguucugggcaggaagaa

SEQ ID NO: 61764 - RNA, 22 nt, Homo sapiens
gcaugaugaauaauaucacaag

SEQ ID NO: 61765 - RNA, 22 nt, Homo sapiens
gcuaaggcaggagcauugcuug

SEQ ID NO: 61766 - RNA, 23 nt, Homo sapiens
gcuaggagagaugaaacacaggu

SEQ ID NO: 61767 - RNA, 22 nt, Homo sapiens
gcucaaguaauggcaguuuugc

SEQ ID NO: 61768 - RNA, 22 nt, Homo sapiens
gcucugguuacaaaggcaaauu

SEQ ID NO: 61769 - RNA, 22 nt, Homo sapiens
gcugagacauugguuuucuccu

SEQ ID NO: 61770 - RNA, 22 nt, Homo sapiens
gcugagguucaagaagguuaaa

SEQ ID NO: 61771 - RNA, 22 nt, Homo sapiens
gcugauggugcaguucuagccu

SEQ ID NO: 61772 - RNA, 17 nt, Homo sapiens
gcugcauucauguagaa

SEQ ID NO: 61773 - RNA, 22 nt, Homo sapiens
gcuggcuuucuccugaucucag

SEQ ID NO: 61774 - RNA, 22 nt, Homo sapiens
gcuggguugccagguuacuuaa

SEQ ID NO: 61775 - RNA, 23 nt, Homo sapiens
ggaaacauccagucuuucaccau

SEQ ID NO: 61776 - RNA, 22 nt, Homo sapiens
ggaaagcuagguguggguguac

SEQ ID NO: 61777 - RNA, 22 nt, Homo sapiens
ggaaauguaaacaauggggcua

SEQ ID NO: 61778 - RNA, 22 nt, Homo sapiens
ggaagaauauuaggggauuucg

SEQ ID NO: 61779 - RNA, 22 nt, Homo sapiens
ggaaugggauuugaagucuggc

SEQ ID NO: 61780 - RNA, 22 nt, Homo sapiens
ggaaugugugucaugcuuuugc

SEQ ID NO: 61781 - RNA, 21 nt, Homo sapiens
ggaauguugccagcagccaga

SEQ ID NO: 61782 - RNA, 22 nt, Homo sapiens
ggacaagagacugggacacuga

SEQ ID NO: 61783 - RNA, 22 nt, Homo sapiens
ggacagaaaggguucaccaaac

SEQ ID NO: 61784 - RNA, 22 nt, Homo sapiens
ggacuagggacauggggagcug

SEQ ID NO: 61785 - RNA, 22 nt, Homo sapiens
ggagguaauaaguuccagugua

SEQ ID NO: 61786 - RNA, 22 nt, Homo sapiens
ggagguagucuuucccuuauca

SEQ ID NO: 61787 - RNA, 21 nt, Homo sapiens
ggauagaaaacuuggcuguau

SEQ ID NO: 61788 - RNA, 22 nt, Homo sapiens
ugaaaugaucaguuugguuacu

SEQ ID NO: 61789 - RNA, 22 nt, Homo sapiens
ugaaaugccuuuaaugaauuua

SEQ ID NO: 61790 - RNA, 22 nt, Homo sapiens
ugaaauguaaguugucuagucu

SEQ ID NO: 61791 - RNA, 21 nt, Homo sapiens
ugaaguguaaccgugcagggc

SEQ ID NO: 61792 - RNA, 22 nt, Homo sapiens
ugaauagacagucacugccucc

SEQ ID NO: 61793 - RNA, 22 nt, Homo sapiens
ugaaugcauggggccaagaagg

SEQ ID NO: 61794 - RNA, 22 nt, Homo sapiens
ugaaugguaauuuaguaggcac

SEQ ID NO: 61795 - RNA, 22 nt, Homo sapiens
ugaauguccauugauguuuuga

SEQ ID NO: 61796 - RNA, 22 nt, Homo sapiens
ugacaagaguagagagggugcc

SEQ ID NO: 61797 - RNA, 22 nt, Homo sapiens
ugacacauguagacaucuggug

SEQ ID NO: 61798 - RNA, 18 nt, Homo sapiens
ugacagcacaugugggga

SEQ ID NO: 61799 - RNA, 22 nt, Homo sapiens
ugacaggagauuaugugauguu

SEQ ID NO: 61800 - RNA, 22 nt, Homo sapiens
ugacagguugauaggugcagca

SEQ ID NO: 61801 - RNA, 19 nt, Homo sapiens
ugacaugaaacccaagauc

SEQ ID NO: 61802 - RNA, 22 nt, Homo sapiens
ugacauggaaguagguauacau

SEQ ID NO: 61803 - RNA, 22 nt, Homo sapiens
ugacauguauaucuuacgcuau

SEQ ID NO: 61804 - RNA, 22 nt, Homo sapiens
ugacauguauuagcucagugcu

SEQ ID NO: 61805 - RNA, 21 nt, Homo sapiens
ugacauguugguguucugcac

SEQ ID NO: 61806 - RNA, 22 nt, Homo sapiens
ugacauuacagucacuugcugu

SEQ ID NO: 61807 - RNA, 17 nt, Homo sapiens
ugaccacugauucuacu

SEQ ID NO: 61808 - RNA, 22 nt, Homo sapiens
ugacuauaggauaacaugcauu

SEQ ID NO: 61809 - RNA, 22 nt, Homo sapiens
ugacucaguuguuagucuucau

SEQ ID NO: 61810 - RNA, 22 nt, Homo sapiens
ugacuugaacuucuaugucacc

SEQ ID NO: 61811 - RNA, 22 nt, Homo sapiens
ugacuugaucacccccuaaggg

SEQ ID NO: 61812 - RNA, 17 nt, Homo sapiens
ugagaacaugugguauu

SEQ ID NO: 61813 - RNA, 19 nt, Homo sapiens
ugagaacaugugguauuug

SEQ ID NO: 61814 - RNA, 22 nt, Homo sapiens
ugagaacauuccucuuccuggc

SEQ ID NO: 61815 - RNA, 22 nt, Homo sapiens
ugagaauauuugaagauguuag

SEQ ID NO: 61816 - RNA, 22 nt, Homo sapiens
ugagacggagucucgcucuguu

SEQ ID NO: 61817 - RNA, 22 nt, Homo sapiens
ugagacggagucuggcacuguc

SEQ ID NO: 61818 - RNA, 22 nt, Homo sapiens
ugagacggagucuugcucuguc

SEQ ID NO: 61819 - RNA, 22 nt, Homo sapiens
ugagacggaguuucacucuugu

SEQ ID NO: 61820 - RNA, 22 nt, Homo sapiens
ugagacggaguuucgcucuugu

SEQ ID NO: 61821 - RNA, 22 nt, Homo sapiens
ugagacugaaauuaggaaacug

SEQ ID NO: 61822 - RNA, 22 nt, Homo sapiens
ugagacugaguuuccaucuugu

SEQ ID NO: 61823 - RNA, 22 nt, Homo sapiens
ugagacugaguuucucucuugu

SEQ ID NO: 61824 - RNA, 22 nt, Homo sapiens
ugagacugauaggacauuuucu

SEQ ID NO: 61825 - RNA, 22 nt, Homo sapiens
ugagagaugaacuauucuugaa

SEQ ID NO: 61826 - RNA, 22 nt, Homo sapiens
ugagagcugcauucuugaaagc

SEQ ID NO: 61827 - RNA, 22 nt, Homo sapiens
ugagauaacuaaaaacauuuug

SEQ ID NO: 61828 - RNA, 22 nt, Homo sapiens
ugagauaaucaugugguuuuug

SEQ ID NO: 61829 - RNA, 22 nt, Homo sapiens
ugagauaauuuacuuguugagg

SEQ ID NO: 61830 - RNA, 18 nt, Homo sapiens
ugagauacuagaauaggu

SEQ ID NO: 61831 - RNA, 22 nt, Homo sapiens
ugagaucaagguuaauauaauc

SEQ ID NO: 61832 - RNA, 22 nt, Homo sapiens
ugagaucacgccacugcacucc

SEQ ID NO: 61833 - RNA, 22 nt, Homo sapiens
ugagaucacuaagagguaaugg

SEQ ID NO: 61834 - RNA, 18 nt, Homo sapiens
ugagaucagcaucaaggg

SEQ ID NO: 61835 - RNA, 20 nt, Homo sapiens
ugagaucaggauuaaggcua

SEQ ID NO: 61836 - RNA, 22 nt, Homo sapiens
ugagaucagugaagaaguguuu

SEQ ID NO: 61837 - RNA, 22 nt, Homo sapiens
ugagaucaguuguuauaauucu

SEQ ID NO: 61838 - RNA, 22 nt, Homo sapiens
ugagaucgagucucgcucuguc

SEQ ID NO: 61839 - RNA, 22 nt, Homo sapiens
gucuagaacuucugaccuuagg

SEQ ID NO: 61840 - RNA, 22 nt, Homo sapiens
gucuaugagucccugaauuuaa

SEQ ID NO: 61841 - RNA, 22 nt, Homo sapiens
gucugcaugucauaugauagua

SEQ ID NO: 61842 - RNA, 22 nt, Homo sapiens
gucuggcuccugucuaaucacu

SEQ ID NO: 61843 - RNA, 23 nt, Homo sapiens
gucuggucccugguuggaaacca

SEQ ID NO: 61844 - RNA, 22 nt, Homo sapiens
gucugugcauuaauacgugcug

SEQ ID NO: 61845 - RNA, 22 nt, Homo sapiens
gucuuggagacauugccauuga

SEQ ID NO: 61846 - RNA, 22 nt, Homo sapiens
gucuuuguuauuaugaaucaac

SEQ ID NO: 61847 - RNA, 22 nt, Homo sapiens
gugaacaagcaaaggcaggagg

SEQ ID NO: 61848 - RNA, 22 nt, Homo sapiens
gugacagucaaagacaugacuu

SEQ ID NO: 61849 - RNA, 22 nt, Homo sapiens
gugaccagaugggcaggggugu

SEQ ID NO: 61850 - RNA, 22 nt, Homo sapiens
gugagaugaggucucacucugu

SEQ ID NO: 61851 - RNA, 22 nt, Homo sapiens
gugagauggagucuugcuuugu

SEQ ID NO: 61852 - RNA, 22 nt, Homo sapiens
gugagcaguguccuugggggca

SEQ ID NO: 61853 - RNA, 22 nt, Homo sapiens
gugagccaugauuuuaccacug

SEQ ID NO: 61854 - RNA, 21 nt, Homo sapiens
gugaggucauugggcuuucug

SEQ ID NO: 61855 - RNA, 22 nt, Homo sapiens
gugauguguuuguucuaucucu

SEQ ID NO: 61856 - RNA, 21 nt, Homo sapiens
gugcaaacaucauagaaugua

SEQ ID NO: 61857 - RNA, 22 nt, Homo sapiens
gugcaaauuccagcucaacucc

SEQ ID NO: 61858 - RNA, 22 nt, Homo sapiens
gugcaaccaucaccacugacuc

SEQ ID NO: 61859 - RNA, 22 nt, Homo sapiens
gugcaagagugacugcaguuuu

SEQ ID NO: 61860 - RNA, 22 nt, Homo sapiens
gugcacaacguguagguuuguu

SEQ ID NO: 61861 - RNA, 21 nt, Homo sapiens
gugcagaugccacagucacuc

SEQ ID NO: 61862 - RNA, 22 nt, Homo sapiens
gugcauguccacuaguccauau

SEQ ID NO: 61863 - RNA, 22 nt, Homo sapiens
gugccacugcaccuggccuaag

SEQ ID NO: 61864 - RNA, 22 nt, Homo sapiens
guggacaugaauuuuggaggca

SEQ ID NO: 61865 - RNA, 22 nt, Homo sapiens
guggaucacuugagguuagaag

SEQ ID NO: 61866 - RNA, 22 nt, Homo sapiens
gugggauauaaucaguccugua

SEQ ID NO: 61867 - RNA, 22 nt, Homo sapiens
gugggguaggcaauuccuagug

SEQ ID NO: 61868 - RNA, 21 nt, Homo sapiens
gugguucuagagaaacagaau

SEQ ID NO: 61869 - RNA, 22 nt, Homo sapiens
gugguuuuaauauucagucuag

SEQ ID NO: 61870 - RNA, 22 nt, Homo sapiens
guguaaaucaaucuguugucuu

SEQ ID NO: 61871 - RNA, 22 nt, Homo sapiens
guguaauaaucguggacuaugu

SEQ ID NO: 61872 - RNA, 22 nt, Homo sapiens
guguauauccuauuaguucugu

SEQ ID NO: 61873 - RNA, 22 nt, Homo sapiens
guguauguuguccauggaugcg

SEQ ID NO: 61874 - RNA, 21 nt, Homo sapiens
gugucacagacaugacagaug

SEQ ID NO: 61875 - RNA, 22 nt, Homo sapiens
guguccucgaguacacaucagg

SEQ ID NO: 61876 - RNA, 22 nt, Homo sapiens
gugucuccugccuucaugcagc

SEQ ID NO: 61877 - RNA, 22 nt, Homo sapiens
gugugcaacuuucauuaauauu

SEQ ID NO: 61878 - RNA, 22 nt, Homo sapiens
gugugguauuauaacuagguau

SEQ ID NO: 61879 - RNA, 22 nt, Homo sapiens
guguucaaacccaggucugucu

SEQ ID NO: 61880 - RNA, 22 nt, Homo sapiens
ugauuugucucucagcccuacu

SEQ ID NO: 61881 - RNA, 22 nt, Homo sapiens
ugauuuguuucaggaguuuucu

SEQ ID NO: 61882 - RNA, 22 nt, Homo sapiens
ugcaaaugucaaggguuagugu

SEQ ID NO: 61883 - RNA, 22 nt, Homo sapiens
ugcaaauguuaguaacaccacu

SEQ ID NO: 61884 - RNA, 22 nt, Homo sapiens
ugcaaccauuguuaagugugca

SEQ ID NO: 61885 - RNA, 22 nt, Homo sapiens
ugcaauauccucuacuauaggu

SEQ ID NO: 61886 - RNA, 16 nt, Homo sapiens
ugcagaguaggugaau

SEQ ID NO: 61887 - RNA, 22 nt, Homo sapiens
ugcagagucuguccugccugcc

SEQ ID NO: 61888 - RNA, 22 nt, Homo sapiens
ugcagcacuguucacaauagcc

SEQ ID NO: 61889 - RNA, 22 nt, Homo sapiens
ugcagcauugcacuccagccug

SEQ ID NO: 61890 - RNA, 22 nt, Homo sapiens
ugcaggauguucaguaauuucc

SEQ ID NO: 61891 - RNA, 22 nt, Homo sapiens
ugcaguacauucagcauccucu

SEQ ID NO: 61892 - RNA, 22 nt, Homo sapiens
ugcagugcaugacuguguuaug

SEQ ID NO: 61893 - RNA, 21 nt, Homo sapiens
ugcagugugguugcccugcug

SEQ ID NO: 61894 - RNA, 22 nt, Homo sapiens
ugcaguuuaggaacugguaaca

SEQ ID NO: 61895 - RNA, 22 nt, Homo sapiens
ugcauagcaaaauaggauuaga

SEQ ID NO: 61896 - RNA, 22 nt, Homo sapiens
ugcauauuuuauaaagauggaa

SEQ ID NO: 61897 - RNA, 22 nt, Homo sapiens
ugcaucacaguacuccagccug

SEQ ID NO: 61898 - RNA, 22 nt, Homo sapiens
ugcauuguuccgaauguguccu

SEQ ID NO: 61899 - RNA, 19 nt, Homo sapiens
ugccaagaaagucagcuua

SEQ ID NO: 61900 - RNA, 22 nt, Homo sapiens
ugccagaugcuggugugagggg

SEQ ID NO: 61901 - RNA, 22 nt, Homo sapiens
ugccaguuuuuacauuuccugu

SEQ ID NO: 61902 - RNA, 22 nt, Homo sapiens
ugcccuguaucccacuguuuca

SEQ ID NO: 61903 - RNA, 22 nt, Homo sapiens
ugccuaggcuggaaugcagugg

SEQ ID NO: 61904 - RNA, 22 nt, Homo sapiens
ugccugagcccagcccuguagu

SEQ ID NO: 61905 - RNA, 22 nt, Homo sapiens
ugccugcugucuaauauauucu

SEQ ID NO: 61906 - RNA, 16 nt, Homo sapiens
ugccuucuucuguauu

SEQ ID NO: 61907 - RNA, 21 nt, Homo sapiens
ugcgauccucaauccucuguu

SEQ ID NO: 61908 - RNA, 23 nt, Homo sapiens
ugcuccccucauggaugaauaaa

SEQ ID NO: 61909 - RNA, 22 nt, Homo sapiens
ugcugcaaacaggcaucugugg

SEQ ID NO: 61910 - RNA, 20 nt, Homo sapiens
ugcugcacuuaagcaugggc

SEQ ID NO: 61911 - RNA, 22 nt, Homo sapiens
ugcugcacuuauggcucugagg

SEQ ID NO: 61912 - RNA, 22 nt, Homo sapiens
ugcuuagucuugcuuuagcuau

SEQ ID NO: 61913 - RNA, 22 nt, Homo sapiens
uggaaaacaugcacauuggauu

SEQ ID NO: 61914 - RNA, 20 nt, Homo sapiens
uggaaaguaagucaugauau

SEQ ID NO: 61915 - RNA, 22 nt, Homo sapiens
uggaaauaaaauagaguuugcc

SEQ ID NO: 61916 - RNA, 22 nt, Homo sapiens
uggaacacaucuaaggaagcag

SEQ ID NO: 61917 - RNA, 23 nt, Homo sapiens
uggaagacuccucucuuggcugc

SEQ ID NO: 61918 - RNA, 22 nt, Homo sapiens
uggaaguuaaauuaguugauga

SEQ ID NO: 61919 - RNA, 22 nt, Homo sapiens
uggaaugugaauaacuuccuuc

SEQ ID NO: 61920 - RNA, 22 nt, Homo sapiens
uggaccccuucuccuauuaaaa

SEQ ID NO: 61921 - RNA, 22 nt, Homo sapiens
uggacuagagggugggcgaggu

SEQ ID NO: 61922 - RNA, 22 nt, Homo sapiens
uggacuguaauagagaacagaa

SEQ ID NO: 61923 - RNA, 22 nt, Homo sapiens
uggagcccuaaacuucuaauau

SEQ ID NO: 61924 - RNA, 22 nt, Homo sapiens
uggagggcuagucauuucuuuu

SEQ ID NO: 61925 - RNA, 22 nt, Homo sapiens
uggagguagagaugggaucucc

SEQ ID NO: 61926 - RNA, 22 nt, Homo sapiens
uggagguaggugauauguagca

SEQ ID NO: 61927 - RNA, 22 nt, Homo sapiens
uggagugcaauggcaccaucuu

SEQ ID NO: 61928 - RNA, 22 nt, Homo sapiens
uggagugcaauggugagaucuu

SEQ ID NO: 61929 - RNA, 22 nt, Homo sapiens
uggaguguguuaacuuuacaag

SEQ ID NO: 61930 - RNA, 22 nt, Homo sapiens
uggauaguucuucuacuagagu

SEQ ID NO: 61931 - RNA, 22 nt, Homo sapiens
uggaucuguucuauuuaucuga

SEQ ID NO: 61932 - RNA, 19 nt, Homo sapiens
uggaugacugucugggucu

SEQ ID NO: 61933 - RNA, 22 nt, Homo sapiens
uggaugacuguuauaugcauau

SEQ ID NO: 61934 - RNA, 22 nt, Homo sapiens
acccucagaccaguuucccugg

SEQ ID NO: 61935 - RNA, 22 nt, Homo sapiens
acccuggaggucuacagugcag

SEQ ID NO: 61936 - RNA, 22 nt, Homo sapiens
acccuggauucguggccuugaa

SEQ ID NO: 61937 - RNA, 22 nt, Homo sapiens
acccugucagcuggccugggca

SEQ ID NO: 61938 - RNA, 22 nt, Homo sapiens
acccuguugagcaacuggccau

SEQ ID NO: 61939 - RNA, 18 nt, Homo sapiens
acccuucagcacugggcc

SEQ ID NO: 61940 - RNA, 23 nt, Homo sapiens
accugauguuucuguggggagcc

SEQ ID NO: 61941 - RNA, 22 nt, Homo sapiens
accugguuuucucacaguggcu

SEQ ID NO: 61942 - RNA, 23 nt, Homo sapiens
accugugguuauuuuacucuucc

SEQ ID NO: 61943 - RNA, 22 nt, Homo sapiens
acucauugcucauaccuuaucu

SEQ ID NO: 61944 - RNA, 22 nt, Homo sapiens
acugagaucuuuaaauaaauaa

SEQ ID NO: 61945 - RNA, 23 nt, Homo sapiens
acugagcaauguuuacauacuug

SEQ ID NO: 61946 - RNA, 22 nt, Homo sapiens
acugagucauugaggcccucuc

SEQ ID NO: 61947 - RNA, 21 nt, Homo sapiens
acugcacuccaaccucaacag

SEQ ID NO: 61948 - RNA, 22 nt, Homo sapiens
acugcacuccagccuccugaca

SEQ ID NO: 61949 - RNA, 22 nt, Homo sapiens
acugcacuccagccucgcaaca

SEQ ID NO: 61950 - RNA, 20 nt, Homo sapiens
acugcacuccagccuuccag

SEQ ID NO: 61951 - RNA, 20 nt, Homo sapiens
acugcauuuaguccucagga

SEQ ID NO: 61952 - RNA, 22 nt, Homo sapiens
acugccuaaugacuuauguuuu

SEQ ID NO: 61953 - RNA, 21 nt, Homo sapiens
acuggaccccuuccauacacc

SEQ ID NO: 61954 - RNA, 19 nt, Homo sapiens
acuguacuccagucugggc

SEQ ID NO: 61955 - RNA, 22 nt, Homo sapiens
agaaagugcuucccuuugguga

SEQ ID NO: 61956 - RNA, 22 nt, Homo sapiens
agaaugauccuucucagaggca

SEQ ID NO: 61957 - RNA, 22 nt, Homo sapiens
agaauguaaacagaauagagga

SEQ ID NO: 61958 - RNA, 22 nt, Homo sapiens
agacaguauuggcaaagugugu

SEQ ID NO: 61959 - RNA, 20 nt, Homo sapiens
agacaguguggagauuccuu

SEQ ID NO: 61960 - RNA, 22 nt, Homo sapiens
agagaccuguaaaguucaggca

SEQ ID NO: 61961 - RNA, 22 nt, Homo sapiens
aucaccuuucccuuucugaauc

SEQ ID NO: 61962 - RNA, 16 nt, Homo sapiens
aucacuugcuucuuuu

SEQ ID NO: 61963 - RNA, 22 nt, Homo sapiens
aucagauggcuaaaacagaaga

SEQ ID NO: 61964 - RNA, 22 nt, Homo sapiens
aucagauguuuguauaggagua

SEQ ID NO: 61965 - RNA, 22 nt, Homo sapiens
aucagugcauguuuguugagcu

SEQ ID NO: 61966 - RNA, 22 nt, Homo sapiens
aucauccagccccagaagggag

SEQ ID NO: 61967 - RNA, 23 nt, Homo sapiens
auccacauucuaguccuuuaugc

SEQ ID NO: 61968 - RNA, 22 nt, Homo sapiens
aucccugaggaauuucugcacu

SEQ ID NO: 61969 - RNA, 22 nt, Homo sapiens
aucccugugauccaaucacuuc

SEQ ID NO: 61970 - RNA, 22 nt, Homo sapiens
aucccuuucugauacuuucccu

SEQ ID NO: 61971 - RNA, 22 nt, Homo sapiens
auccucaguggcuuaaguauag

SEQ ID NO: 61972 - RNA, 22 nt, Homo sapiens
auccucugagaucuaggcagag

SEQ ID NO: 61973 - RNA, 22 nt, Homo sapiens
aucuccaggugccagcugcgcc

SEQ ID NO: 61974 - RNA, 22 nt, Homo sapiens
aucugcaaagcugggcugagac

SEQ ID NO: 61975 - RNA, 22 nt, Homo sapiens
aucuggcuccuuuugacaaugc

SEQ ID NO: 61976 - RNA, 22 nt, Homo sapiens
aucuggcuucuuuuaguccaca

SEQ ID NO: 61977 - RNA, 22 nt, Homo sapiens
augaacacuccaauuguacucc

SEQ ID NO: 61978 - RNA, 22 nt, Homo sapiens
augaaguauuaggacacauuua

SEQ ID NO: 61979 - RNA, 22 nt, Homo sapiens
augacagcaucugugaaguugu

SEQ ID NO: 61980 - RNA, 22 nt, Homo sapiens
augaccagagagugcgcagggu

SEQ ID NO: 61981 - RNA, 22 nt, Homo sapiens
augaccagagguaugauguuug

SEQ ID NO: 61982 - RNA, 22 nt, Homo sapiens
augagagcugacuuuaaggcaa

SEQ ID NO: 61983 - RNA, 22 nt, Homo sapiens
augagauaggaacaaacuuaca

SEQ ID NO: 61984 - RNA, 22 nt, Homo sapiens
augagauauuuuauaagaucau

SEQ ID NO: 61985 - RNA, 16 nt, Homo sapiens
augagauccugucuca

SEQ ID NO: 61986 - RNA, 21 nt, Homo sapiens
augagauguuagacuuuagac

SEQ ID NO: 61987 - RNA, 22 nt, Homo sapiens
augagcaucaccagaaucaaua

SEQ ID NO: 61988 - RNA, 22 nt, Homo sapiens
augaggugaggucaguaaggua

SEQ ID NO: 61989 - RNA, 20 nt, Homo sapiens
augagguguaugacacugaa

SEQ ID NO: 61990 - RNA, 22 nt, Homo sapiens
augauaaguuauuagaagaaga

SEQ ID NO: 61991 - RNA, 22 nt, Homo sapiens
augauauguuuguagcuaucuc

SEQ ID NO: 61992 - RNA, 22 nt, Homo sapiens
augauauuauucuagcccagag

SEQ ID NO: 61993 - RNA, 22 nt, Homo sapiens
augcaagacaccacgugagaau

SEQ ID NO: 61994 - RNA, 22 nt, Homo sapiens
augccacagaaauaaccaaaau

SEQ ID NO: 61995 - RNA, 19 nt, Homo sapiens
augccacagugaggucaga

SEQ ID NO: 61996 - RNA, 22 nt, Homo sapiens
augcccauuuguuuucugaaag

SEQ ID NO: 61997 - RNA, 22 nt, Homo sapiens
augccuaagacccuguggggga

SEQ ID NO: 61998 - RNA, 22 nt, Homo sapiens
augccucugacaauuggauucu

SEQ ID NO: 61999 - RNA, 22 nt, Homo sapiens
augcuguuuuguagcucccucu

SEQ ID NO: 62000 - RNA, 22 nt, Homo sapiens
auggaaacauaagaguauagau

SEQ ID NO: 62001 - RNA, 22 nt, Homo sapiens
auggaagcauaguauucuauug

SEQ ID NO: 62002 - RNA, 22 nt, Homo sapiens
auggaagcugauuagauaguac

SEQ ID NO: 62003 - RNA, 22 nt, Homo sapiens
auggacauuaaagcgauguaga

SEQ ID NO: 62004 - RNA, 22 nt, Homo sapiens
auggaggacaaugucaccuuca

SEQ ID NO: 62005 - RNA, 22 nt, Homo sapiens
auggcacagacucuuggucaag

SEQ ID NO: 62006 - RNA, 22 nt, Homo sapiens
auggcacuccagccugggcaac

SEQ ID NO: 62007 - RNA, 20 nt, Homo sapiens
auggcccugcugggaguguc

SEQ ID NO: 62008 - RNA, 22 nt, Homo sapiens
auggcccugggaaaggaggcau

SEQ ID NO: 62009 - RNA, 22 nt, Homo sapiens
auggccuuguauaccuggcaaa

SEQ ID NO: 62010 - RNA, 22 nt, Homo sapiens
auggcucuguuccaugugucuu

SEQ ID NO: 62011 - RNA, 22 nt, Homo sapiens
auggcugugagaucgacuuauu

SEQ ID NO: 62012 - RNA, 22 nt, Homo sapiens
auggcuuuugaccugguaggau

SEQ ID NO: 62013 - RNA, 21 nt, Homo sapiens
auggugagaaaguagugucaa

SEQ ID NO: 62014 - RNA, 22 nt, Homo sapiens
auggugugugaauuaaauguua

SEQ ID NO: 62015 - RNA, 22 nt, Homo sapiens
augugaacaucauagaaugcac

SEQ ID NO: 62016 - RNA, 18 nt, Homo sapiens
augugcaauuuuguauuu

SEQ ID NO: 62017 - RNA, 22 nt, Homo sapiens
augugggaggaauguguuucca

SEQ ID NO: 62018 - RNA, 22 nt, Homo sapiens
auguugcaguuuaauuauccua

SEQ ID NO: 62019 - RNA, 22 nt, Homo sapiens
auuaaauguuggacguauacau

SEQ ID NO: 62020 - RNA, 22 nt, Homo sapiens
auuaacaucuagaguuuuggug

SEQ ID NO: 62021 - RNA, 22 nt, Homo sapiens
auuaagagcacauguucugggu

SEQ ID NO: 62022 - RNA, 23 nt, Homo sapiens
auuaagguuacuacaguaugagg

SEQ ID NO: 62023 - RNA, 22 nt, Homo sapiens
auuaauguaauuaguaaaguug

SEQ ID NO: 62024 - RNA, 22 nt, Homo sapiens
auuagaugguuauaggugugag

SEQ ID NO: 62025 - RNA, 20 nt, Homo sapiens
aauaacagccccagggaggu

SEQ ID NO: 62026 - RNA, 22 nt, Homo sapiens
aauaaugucacaggggguuagc

SEQ ID NO: 62027 - RNA, 22 nt, Homo sapiens
aauacugagaugugagguacua

SEQ ID NO: 62028 - RNA, 22 nt, Homo sapiens
aauacuggcacugaagaccaug

SEQ ID NO: 62029 - RNA, 22 nt, Homo sapiens
aauaucacaggguguacacuca

SEQ ID NO: 62030 - RNA, 22 nt, Homo sapiens
aauaucacaguggguguacacc

SEQ ID NO: 62031 - RNA, 22 nt, Homo sapiens
aaucacuuuggcaccaaccuaa

SEQ ID NO: 62032 - RNA, 22 nt, Homo sapiens
aaucauauugucugccaagagg

SEQ ID NO: 62033 - RNA, 22 nt, Homo sapiens
aaucccuggacuuucggaggcu

SEQ ID NO: 62034 - RNA, 22 nt, Homo sapiens
aauccuguagauucuaauuccu

SEQ ID NO: 62035 - RNA, 20 nt, Homo sapiens
aaucuacuugcccauuuagc

SEQ ID NO: 62036 - RNA, 22 nt, Homo sapiens
aaucugauguuaucagcuuaag

SEQ ID NO: 62037 - RNA, 22 nt, Homo sapiens
aaugacagugcuaaagaacccu

SEQ ID NO: 62038 - RNA, 22 nt, Homo sapiens
aaugacucugccuaaauuucac

SEQ ID NO: 62039 - RNA, 22 nt, Homo sapiens
aaugaucaauguuugaggugau

SEQ ID NO: 62040 - RNA, 22 nt, Homo sapiens
aaugccacugugccugccaagg

SEQ ID NO: 62041 - RNA, 22 nt, Homo sapiens
aauggcagaugaaauugucauu

SEQ ID NO: 62042 - RNA, 22 nt, Homo sapiens
aauuaguaaccuaauuccaucu

SEQ ID NO: 62043 - RNA, 22 nt, Homo sapiens
aauugcuucuguauuuuggaca

SEQ ID NO: 62044 - RNA, 22 nt, Homo sapiens
aauuguacucccauaauucccu

SEQ ID NO: 62045 - RNA, 22 nt, Homo sapiens
acaaagcuagggaauccaucuu

SEQ ID NO: 62046 - RNA, 22 nt, Homo sapiens
acaaccauuguaagggcuuugg

SEQ ID NO: 62047 - RNA, 22 nt, Homo sapiens
acaagugaauacaggauucucu

SEQ ID NO: 62048 - RNA, 22 nt, Homo sapiens
acaauggaauggaguggaaagu

SEQ ID NO: 62049 - RNA, 23 nt, Homo sapiens
acacaguaaacuaaaagcuagcu

SEQ ID NO: 62050 - RNA, 22 nt, Homo sapiens
acacaguauaugacaaugcuuu

SEQ ID NO: 62051 - RNA, 22 nt, Homo sapiens
acacagugucuguguauuuaaa

SEQ ID NO: 62052 - RNA, 22 nt, Homo sapiens
acacauuggcaauucuggagca

SEQ ID NO: 62053 - RNA, 22 nt, Homo sapiens
acacuguuuuaguuauuauagc

SEQ ID NO: 62054 - RNA, 22 nt, Homo sapiens
acagaaccauucacuccccugg

SEQ ID NO: 62055 - RNA, 22 nt, Homo sapiens
acagaacugggcuugcuuuugg

SEQ ID NO: 62056 - RNA, 22 nt, Homo sapiens
acaguauaaugcuguagggaga

SEQ ID NO: 62057 - RNA, 23 nt, Homo sapiens
acaguauguggauguggcuaagu

SEQ ID NO: 62058 - RNA, 22 nt, Homo sapiens
acagucuggagaaugggugcuc

SEQ ID NO: 62059 - RNA, 22 nt, Homo sapiens
acagugcuguggucaugggucu

SEQ ID NO: 62060 - RNA, 22 nt, Homo sapiens
acagugcuuggcacacaguaau

SEQ ID NO: 62061 - RNA, 17 nt, Homo sapiens
acagugcuuugcuuucc

SEQ ID NO: 62062 - RNA, 22 nt, Homo sapiens
acagugucugacacguaggaag

SEQ ID NO: 62063 - RNA, 18 nt, Homo sapiens
acagugucuuacaccugu

SEQ ID NO: 62064 - RNA, 18 nt, Homo sapiens
acaguguguaaggguucu

SEQ ID NO: 62065 - RNA, 22 nt, Homo sapiens
acauauaaggagacuagggcau

SEQ ID NO: 62066 - RNA, 22 nt, Homo sapiens
acaugcauauguuggaagaaag

SEQ ID NO: 62067 - RNA, 22 nt, Homo sapiens
accaccauugcacugaacuuuc

SEQ ID NO: 62068 - RNA, 19 nt, Homo sapiens
accagauugcauucuugga

SEQ ID NO: 62069 - RNA, 22 nt, Homo sapiens
accaguagaaucaguggauucu

SEQ ID NO: 62070 - RNA, 22 nt, Homo sapiens
accauugcacuccagccugggc

SEQ ID NO: 62071 - RNA, 22 nt, Homo sapiens
acccgugcugaauauguaggug

SEQ ID NO: 62072 - RNA, 22 nt, Homo sapiens
acccuggaguaguaggaaucug

SEQ ID NO: 62073 - RNA, 22 nt, Homo sapiens
acccugucauccacauggugcu

SEQ ID NO: 62074 - RNA, 22 nt, Homo sapiens
acccuuagguuaaaguugaguc

SEQ ID NO: 62075 - RNA, 22 nt, Homo sapiens
acuccauuuccagagcagcccc

SEQ ID NO: 62076 - RNA, 22 nt, Homo sapiens
acugaucaauguuaaggcuuau

SEQ ID NO: 62077 - RNA, 22 nt, Homo sapiens
acugcacuccagccucaugaca

SEQ ID NO: 62078 - RNA, 22 nt, Homo sapiens
acugcacucuagcauggguaau

SEQ ID NO: 62079 - RNA, 22 nt, Homo sapiens
acugcacuuauccuccaauguu

SEQ ID NO: 62080 - RNA, 20 nt, Homo sapiens
acugcacuucagccugcugg

SEQ ID NO: 62081 - RNA, 22 nt, Homo sapiens
acuggaguuuguucaagaaaua

SEQ ID NO: 62082 - RNA, 22 nt, Homo sapiens
acuggcauagggcgggcacagu

SEQ ID NO: 62083 - RNA, 22 nt, Homo sapiens
acuggcucugcuuuacaaacag

SEQ ID NO: 62084 - RNA, 22 nt, Homo sapiens
cgcaguguuugugucccugggu

SEQ ID NO: 62085 - RNA, 22 nt, Homo sapiens
cuaaaacuuucugagugcagca

SEQ ID NO: 62086 - RNA, 22 nt, Homo sapiens
cuaagggaggaagcugugcagg

SEQ ID NO: 62087 - RNA, 21 nt, Homo sapiens
cuaaucucacccuuuucuggg

SEQ ID NO: 62088 - RNA, 22 nt, Homo sapiens
cuagaauguauaaaaccaagcu

SEQ ID NO: 62089 - RNA, 22 nt, Homo sapiens
cuagagagaagcugugugaccu

SEQ ID NO: 62090 - RNA, 22 nt, Homo sapiens
cuagcagacaugggcugaacca

SEQ ID NO: 62091 - RNA, 22 nt, Homo sapiens
cuagcagcauaagaaucaccaa

SEQ ID NO: 62092 - RNA, 22 nt, Homo sapiens
cuaugagucugcagaucuauua

SEQ ID NO: 62093 - RNA, 22 nt, Homo sapiens
cuauggcucugguuauggcugu

SEQ ID NO: 62094 - RNA, 22 nt, Homo sapiens
cuauucacaauggugaagauau

SEQ ID NO: 62095 - RNA, 22 nt, Homo sapiens
cuauucacaggcaauauguaca

SEQ ID NO: 62096 - RNA, 22 nt, Homo sapiens
cucacaguucuaaaggcaagaa

SEQ ID NO: 62097 - RNA, 20 nt, Homo sapiens
cucaccagguguaggcugag

SEQ ID NO: 62098 - RNA, 22 nt, Homo sapiens
cucacugcauuucaguuuuguu

SEQ ID NO: 62099 - RNA, 20 nt, Homo sapiens
cucagugcacccccauaaaa

SEQ ID NO: 62100 - RNA, 22 nt, Homo sapiens
cucaguuuugccuuguuuaagg

SEQ ID NO: 62101 - RNA, 22 nt, Homo sapiens
cucauggagaaccucugcuagg

SEQ ID NO: 62102 - RNA, 19 nt, Homo sapiens
cucauggagaaggagaaua

SEQ ID NO: 62103 - RNA, 22 nt, Homo sapiens
cucauggauggucuggcagcca

SEQ ID NO: 62104 - RNA, 22 nt, Homo sapiens
cucauugcaaucucugccuccc

SEQ ID NO: 62105 - RNA, 22 nt, Homo sapiens
cuccacugagcaggugggaggc

SEQ ID NO: 62106 - RNA, 23 nt, Homo sapiens
cuccaugagccguccagggccug

SEQ ID NO: 62107 - RNA, 22 nt, Homo sapiens
cucccuuugcugaauguuuuuc

SEQ ID NO: 62108 - RNA, 22 nt, Homo sapiens
cucuuuaguaagcaguugauga

SEQ ID NO: 62109 - RNA, 22 nt, Homo sapiens
cucuuuggaugccuuaggguua

SEQ ID NO: 62110 - RNA, 22 nt, Homo sapiens
cucuuuuguuuagcugagaggg

SEQ ID NO: 62111 - RNA, 22 nt, Homo sapiens
cugaaagagcauguaacacagu

SEQ ID NO: 62112 - RNA, 22 nt, Homo sapiens
cugaagugugaaagucuuuuuu

SEQ ID NO: 62113 - RNA, 22 nt, Homo sapiens
cugacaagugaucacagcagca

SEQ ID NO: 62114 - RNA, 22 nt, Homo sapiens
cugaccauagacuacucugggc

SEQ ID NO: 62115 - RNA, 22 nt, Homo sapiens
cugacugugcaugcccagcccc

SEQ ID NO: 62116 - RNA, 22 nt, Homo sapiens
cugagagaggagcuaaaacugc

SEQ ID NO: 62117 - RNA, 22 nt, Homo sapiens
cugagaucaagucuugcucugu

SEQ ID NO: 62118 - RNA, 22 nt, Homo sapiens
cugagauggagucucgcauugu

SEQ ID NO: 62119 - RNA, 22 nt, Homo sapiens
cugagcuaugccuggaaaggca

SEQ ID NO: 62120 - RNA, 22 nt, Homo sapiens
uauggcccuuaaguauugguug

SEQ ID NO: 62121 - RNA, 22 nt, Homo sapiens
uauggccugcguccagugguau

SEQ ID NO: 62122 - RNA, 22 nt, Homo sapiens
uauggcuaugggaacugggagu

SEQ ID NO: 62123 - RNA, 22 nt, Homo sapiens
uauguuaucaaaaagcuaagga

SEQ ID NO: 62124 - RNA, 22 nt, Homo sapiens
uauuacagaccauaucgccggg

SEQ ID NO: 62125 - RNA, 22 nt, Homo sapiens
uauucacuguaucauugauggg

SEQ ID NO: 62126 - RNA, 22 nt, Homo sapiens
uauugaacuggaucagaaggcc

SEQ ID NO: 62127 - RNA, 22 nt, Homo sapiens
uauugacuugaugagggagggu

SEQ ID NO: 62128 - RNA, 22 nt, Homo sapiens
uauugacuuuuuuguuaggagg

SEQ ID NO: 62129 - RNA, 22 nt, Homo sapiens
uauugcaaauggugaucccagg

SEQ ID NO: 62130 - RNA, 22 nt, Homo sapiens
uauugcacgccagccugagcaa

SEQ ID NO: 62131 - RNA, 22 nt, Homo sapiens
uauugcagauacccaggaaguu

SEQ ID NO: 62132 - RNA, 22 nt, Homo sapiens
uauugcauguugagcaguaccu

SEQ ID NO: 62133 - RNA, 22 nt, Homo sapiens
uauugcuggauguauuacaugu

SEQ ID NO: 62134 - RNA, 22 nt, Homo sapiens
uauugcuuaugaugcugaauua

SEQ ID NO: 62135 - RNA, 22 nt, Homo sapiens
uauugcuugaggaaaugguaau

SEQ ID NO: 62136 - RNA, 18 nt, Homo sapiens
uauugcuugguuuggaga

SEQ ID NO: 62137 - RNA, 22 nt, Homo sapiens
uauuguacauguuauagauuuu

SEQ ID NO: 62138 - RNA, 22 nt, Homo sapiens
uauugucaccaucccuguuuua

SEQ ID NO: 62139 - RNA, 22 nt, Homo sapiens
uauuguccacuuugcacugugu

SEQ ID NO: 62140 - RNA, 22 nt, Homo sapiens
uauuguuuuucccaggagucua

SEQ ID NO: 62141 - RNA, 22 nt, Homo sapiens
uauuugauuaacaagagccuaa

SEQ ID NO: 62142 - RNA, 20 nt, Homo sapiens
uauuugguuauuuccauggu

SEQ ID NO: 62143 - RNA, 22 nt, Homo sapiens
ucaaagugagcuccuucucacu

SEQ ID NO: 62144 - RNA, 22 nt, Homo sapiens
ucaaaugauucagaagccaccu

SEQ ID NO: 62145 - RNA, 22 nt, Homo sapiens
ucaaauguucccuguacuggcc

SEQ ID NO: 62146 - RNA, 22 nt, Homo sapiens
ucaacauugcugucaggcaucu

SEQ ID NO: 62147 - RNA, 21 nt, Homo sapiens
ucaacccuugcgucaccaagc

SEQ ID NO: 62148 - RNA, 22 nt, Homo sapiens
ucaacguauuuauauagcagag

SEQ ID NO: 62149 - RNA, 22 nt, Homo sapiens
ucaagcaauucuccucucagcc

SEQ ID NO: 62150 - RNA, 22 nt, Homo sapiens
ucaaggcacuagcugagcugca

SEQ ID NO: 62151 - RNA, 20 nt, Homo sapiens
ucaaggcaggaacuguacau

SEQ ID NO: 62152 - RNA, 23 nt, Homo sapiens
ucaagugaugguggccacaaggg

SEQ ID NO: 62153 - RNA, 22 nt, Homo sapiens
ucaaugcaugugacaaagagua

SEQ ID NO: 62154 - RNA, 19 nt, Homo sapiens
ucaauucugucaauggcuu

SEQ ID NO: 62155 - RNA, 22 nt, Homo sapiens
ucacaagugagaggaauuagau

SEQ ID NO: 62156 - RNA, 22 nt, Homo sapiens
ucacaauggcugaacuaauuua

SEQ ID NO: 62157 - RNA, 22 nt, Homo sapiens
ucacaccauucuucuacuucag

SEQ ID NO: 62158 - RNA, 22 nt, Homo sapiens
ucacacugucuugguuacucuu

SEQ ID NO: 62159 - RNA, 22 nt, Homo sapiens
ucacagacugagccaaauagag

SEQ ID NO: 62160 - RNA, 21 nt, Homo sapiens
ucacagccuaggaccugaaga

SEQ ID NO: 62161 - RNA, 22 nt, Homo sapiens
ucacagcuaaaaugaaaguagu

SEQ ID NO: 62162 - RNA, 22 nt, Homo sapiens
ucacaguagcaaauguuagaaa

SEQ ID NO: 62163 - RNA, 22 nt, Homo sapiens
ucacaguaucaugggggacaga

SEQ ID NO: 62164 - RNA, 22 nt, Homo sapiens
ucacagucggugacuucuugcu

SEQ ID NO: 62165 - RNA, 22 nt, Homo sapiens
ucacagugcaggaucaguuaau

SEQ ID NO: 62166 - RNA, 23 nt, Homo sapiens
ucacaguuacuuuugcaucaacc

SEQ ID NO: 62167 - RNA, 22 nt, Homo sapiens
ucacaguucagcauggcugagg

SEQ ID NO: 62168 - RNA, 22 nt, Homo sapiens
ucacaguugauugaaacacagc

SEQ ID NO: 62169 - RNA, 22 nt, Homo sapiens
agugcauaugucuuuuuggaag

SEQ ID NO: 62170 - RNA, 22 nt, Homo sapiens
aguugcaagucuugaguaaaga

SEQ ID NO: 62171 - RNA, 22 nt, Homo sapiens
aguuggcacugagcugugauug

SEQ ID NO: 62172 - RNA, 22 nt, Homo sapiens
auaaaagcaggucuaggucagg

SEQ ID NO: 62173 - RNA, 17 nt, Homo sapiens
auaaacucaucauuuuu

SEQ ID NO: 62174 - RNA, 22 nt, Homo sapiens
auaacagcauuauugcauacgu

SEQ ID NO: 62175 - RNA, 22 nt, Homo sapiens
auaagguuagcucugagaaagu

SEQ ID NO: 62176 - RNA, 22 nt, Homo sapiens
auaauagcugaucauuuagaag

SEQ ID NO: 62177 - RNA, 22 nt, Homo sapiens
auaauugcuaagugaagauggu

SEQ ID NO: 62178 - RNA, 22 nt, Homo sapiens
auacacgugcagaacaugcagg

SEQ ID NO: 62179 - RNA, 19 nt, Homo sapiens
auacacguguauacauaca

SEQ ID NO: 62180 - RNA, 22 nt, Homo sapiens
auacagguauacaaugcauaau

SEQ ID NO: 62181 - RNA, 22 nt, Homo sapiens
auacaguaucuucuggcaagca

SEQ ID NO: 62182 - RNA, 22 nt, Homo sapiens
auacagucuguuagauuuccuc

SEQ ID NO: 62183 - RNA, 22 nt, Homo sapiens
auacagugaauaucuggggcag

SEQ ID NO: 62184 - RNA, 22 nt, Homo sapiens
auacauguucaagggcauauau

SEQ ID NO: 62185 - RNA, 20 nt, Homo sapiens
auaccacagacuggguaguu

SEQ ID NO: 62186 - RNA, 22 nt, Homo sapiens
auacugguuuuugucaugugga

SEQ ID NO: 62187 - RNA, 22 nt, Homo sapiens
auagaucauugucauuuuagau

SEQ ID NO: 62188 - RNA, 22 nt, Homo sapiens
auagcaaugccccaauccuugg

SEQ ID NO: 62189 - RNA, 22 nt, Homo sapiens
auagcaauuugggaaucagacu

SEQ ID NO: 62190 - RNA, 22 nt, Homo sapiens
auagcauaucccacaugucaga

SEQ ID NO: 62191 - RNA, 22 nt, Homo sapiens
auagugcugcaauaaccauggg

SEQ ID NO: 62192 - RNA, 22 nt, Homo sapiens
auaucaacaucgugucauuagu

SEQ ID NO: 62193 - RNA, 22 nt, Homo sapiens
auaucagugucuuacuguuuuu

SEQ ID NO: 62194 - RNA, 22 nt, Homo sapiens
auaucugcauugccauuuaugu

SEQ ID NO: 62195 - RNA, 22 nt, Homo sapiens
auaugcaaauccauagagacag

SEQ ID NO: 62196 - RNA, 20 nt, Homo sapiens
auaugcagacacauacauac

SEQ ID NO: 62197 - RNA, 22 nt, Homo sapiens
auaugcauacauguaugcagga

SEQ ID NO: 62198 - RNA, 22 nt, Homo sapiens
auaugcuaauuuuuagucgagc

SEQ ID NO: 62199 - RNA, 22 nt, Homo sapiens
auaugguacuuaugcucaaacu

SEQ ID NO: 62200 - RNA, 22 nt, Homo sapiens
auauguauuuuaacguguaagg

SEQ ID NO: 62201 - RNA, 22 nt, Homo sapiens
auaugucuauuauuagggcagg

SEQ ID NO: 62202 - RNA, 22 nt, Homo sapiens
auauuacuggccauaucgcagg

SEQ ID NO: 62203 - RNA, 22 nt, Homo sapiens
auauuacuggcuauaucgcaag

SEQ ID NO: 62204 - RNA, 22 nt, Homo sapiens
aucaaauugucauuuuaaggau

SEQ ID NO: 62205 - RNA, 22 nt, Homo sapiens
aucacagaacuuugagcagaga

SEQ ID NO: 62206 - RNA, 22 nt, Homo sapiens
aucacaggcaaaauuccuucuc

SEQ ID NO: 62207 - RNA, 22 nt, Homo sapiens
aucacagguacuauggcugaca

SEQ ID NO: 62208 - RNA, 22 nt, Homo sapiens
aucacauggccagguaguaauc

SEQ ID NO: 62209 - RNA, 20 nt, Homo sapiens
aucacuggagaaggaaaccu

SEQ ID NO: 62210 - RNA, 22 nt, Homo sapiens
aucacuggucaugagagaagua

SEQ ID NO: 62211 - RNA, 21 nt, Homo sapiens
aucagagacccaggcuuccuc

SEQ ID NO: 62212 - RNA, 20 nt, Homo sapiens
aucagagccggugaaagggc

SEQ ID NO: 62213 - RNA, 22 nt, Homo sapiens
aucagaguugucagggagcuuu

SEQ ID NO: 62214 - RNA, 19 nt, Homo sapiens
aucagcacaagugugcuuu

SEQ ID NO: 62215 - RNA, 22 nt, Homo sapiens
ucaugugaggauaacaauagug

SEQ ID NO: 62216 - RNA, 22 nt, Homo sapiens
uccaauguaaucaucauugaau

SEQ ID NO: 62217 - RNA, 22 nt, Homo sapiens
uccacaauggcugaacuagauu

SEQ ID NO: 62218 - RNA, 22 nt, Homo sapiens
uccacugagcuagaccacuugg

SEQ ID NO: 62219 - RNA, 22 nt, Homo sapiens
uccagguacucagggggcugag

SEQ ID NO: 62220 - RNA, 20 nt, Homo sapiens
uccaguuuuggagacauucu

SEQ ID NO: 62221 - RNA, 22 nt, Homo sapiens
uccaugaggcuacaguaaucuc

SEQ ID NO: 62222 - RNA, 22 nt, Homo sapiens
ucccaagaugagaugggggcug

SEQ ID NO: 62223 - RNA, 22 nt, Homo sapiens
uccccaguaggcaauuaacacc

SEQ ID NO: 62224 - RNA, 22 nt, Homo sapiens
ucccugacagggucugagcuuu

SEQ ID NO: 62225 - RNA, 22 nt, Homo sapiens
ucccugagcaaaguuuucugua

SEQ ID NO: 62226 - RNA, 22 nt, Homo sapiens
uccugauacgguugcaguucuc

SEQ ID NO: 62227 - RNA, 22 nt, Homo sapiens
uccuuugguuauaggcaccucu

SEQ ID NO: 62228 - RNA, 22 nt, Homo sapiens
ucgcagcacgagcaugcaaggu

SEQ ID NO: 62229 - RNA, 22 nt, Homo sapiens
ucuaaaacuagauugugaugau

SEQ ID NO: 62230 - RNA, 22 nt, Homo sapiens
ucuaagaauucauuuauaagcc

SEQ ID NO: 62231 - RNA, 22 nt, Homo sapiens
ucuauguuuuugcuaguagugu

SEQ ID NO: 62232 - RNA, 22 nt, Homo sapiens
ucuauugguaggggcugaggca

SEQ ID NO: 62233 - RNA, 22 nt, Homo sapiens
ucuauugguugaaauugcuuuu

SEQ ID NO: 62234 - RNA, 22 nt, Homo sapiens
ucucaagaugguagaugggaau

SEQ ID NO: 62235 - RNA, 22 nt, Homo sapiens
ucucaguggcuuccucacuuuu

SEQ ID NO: 62236 - RNA, 20 nt, Homo sapiens
ucucauagagguagagaaua

SEQ ID NO: 62237 - RNA, 22 nt, Homo sapiens
ucucauggagguagagaguaaa

SEQ ID NO: 62238 - RNA, 22 nt, Homo sapiens
ucucauggcucacccugcauag

SEQ ID NO: 62239 - RNA, 23 nt, Homo sapiens
ucucauuccuugaaaauaaugac

SEQ ID NO: 62240 - RNA, 22 nt, Homo sapiens
ucucauugauucuggggugaug

SEQ ID NO: 62241 - RNA, 22 nt, Homo sapiens
ucucugaaacucuugacauccu

SEQ ID NO: 62242 - RNA, 19 nt, Homo sapiens
ucugacagccccagucaac

SEQ ID NO: 62243 - RNA, 22 nt, Homo sapiens
ucugagcaauaaacaacauauu

SEQ ID NO: 62244 - RNA, 22 nt, Homo sapiens
ucugccuuuucaugugggaugg

SEQ ID NO: 62245 - RNA, 22 nt, Homo sapiens
ucuggcacugaugugggaugcu

SEQ ID NO: 62246 - RNA, 21 nt, Homo sapiens
ucuggccccuccaaaucucau

SEQ ID NO: 62247 - RNA, 22 nt, Homo sapiens
ucuggccccucucaaaucucau

SEQ ID NO: 62248 - RNA, 22 nt, Homo sapiens
ucuggccuacaucauuuuuccg

SEQ ID NO: 62249 - RNA, 22 nt, Homo sapiens
ucugguguuauucauguaguuu

SEQ ID NO: 62250 - RNA, 22 nt, Homo sapiens
ucugucuuguccucacccuaga

SEQ ID NO: 62251 - RNA, 22 nt, Homo sapiens
ucuugaacuucauaggucuaga

SEQ ID NO: 62252 - RNA, 22 nt, Homo sapiens
ucuugcauuuuuaaauagugcu

SEQ ID NO: 62253 - RNA, 22 nt, Homo sapiens
ucuuggguuuguccuucuccua

SEQ ID NO: 62254 - RNA, 20 nt, Homo sapiens
ucuuucgguuaccaggcagu

SEQ ID NO: 62255 - RNA, 22 nt, Homo sapiens
ucuuugagugcccugagucccu

SEQ ID NO: 62256 - RNA, 22 nt, Homo sapiens
ucuuugaguuauugugcagacu

SEQ ID NO: 62257 - RNA, 22 nt, Homo sapiens
ucuuugauguucugaaagaugg

SEQ ID NO: 62258 - RNA, 22 nt, Homo sapiens
ucuuuggaggcgaucuguuuga

SEQ ID NO: 62259 - RNA, 22 nt, Homo sapiens
ucuuuggguagauauguagcug

SEQ ID NO: 62260 - RNA, 18 nt, Homo sapiens
ugaaacacauuuuuuccu

SEQ ID NO: 62261 - RNA, 22 nt, Homo sapiens
auggaaggagaauggucuuuga

SEQ ID NO: 62262 - RNA, 22 nt, Homo sapiens
auggagagaauuauucucucag

SEQ ID NO: 62263 - RNA, 22 nt, Homo sapiens
auggagcaaaacagauuuggga

SEQ ID NO: 62264 - RNA, 22 nt, Homo sapiens
auggagguguggggagugaguu

SEQ ID NO: 62265 - RNA, 22 nt, Homo sapiens
auggauagucucacucacauac

SEQ ID NO: 62266 - RNA, 22 nt, Homo sapiens
auggauguucuagggaugugau

SEQ ID NO: 62267 - RNA, 22 nt, Homo sapiens
auggcaauguaagucagaaaaa

SEQ ID NO: 62268 - RNA, 22 nt, Homo sapiens
auggcaguguaugauuauauua

SEQ ID NO: 62269 - RNA, 22 nt, Homo sapiens
auggcaucgucaccuuuucagu

SEQ ID NO: 62270 - RNA, 23 nt, Homo sapiens
auggcccuggugggagugucuuu

SEQ ID NO: 62271 - RNA, 22 nt, Homo sapiens
auggccugaugcaccuguccca

SEQ ID NO: 62272 - RNA, 22 nt, Homo sapiens
auggcuagauuguaugguaguu

SEQ ID NO: 62273 - RNA, 22 nt, Homo sapiens
auggcuuuaagagugucugaau

SEQ ID NO: 62274 - RNA, 22 nt, Homo sapiens
auggcuuuuauuguguugaggu

SEQ ID NO: 62275 - RNA, 22 nt, Homo sapiens
auggcuuuuuaaaucauguugu

SEQ ID NO: 62276 - RNA, 22 nt, Homo sapiens
augggcaaauguuggaaauucc

SEQ ID NO: 62277 - RNA, 18 nt, Homo sapiens
auggguguuggaaaauga

SEQ ID NO: 62278 - RNA, 22 nt, Homo sapiens
auggucuuuguuucuaauucug

SEQ ID NO: 62279 - RNA, 22 nt, Homo sapiens
augguguauugauuauugcugu

SEQ ID NO: 62280 - RNA, 22 nt, Homo sapiens
augguuuuacugcaaaauggga

SEQ ID NO: 62281 - RNA, 22 nt, Homo sapiens
auguaaacagaugugcagcuug

SEQ ID NO: 62282 - RNA, 21 nt, Homo sapiens
auguaacugggaaugugagag

SEQ ID NO: 62283 - RNA, 22 nt, Homo sapiens
auguagauaucaagaggcauau

SEQ ID NO: 62284 - RNA, 22 nt, Homo sapiens
augucauagaagccugugaacc

SEQ ID NO: 62285 - RNA, 22 nt, Homo sapiens
augugcaaaguuaagaucccag

SEQ ID NO: 62286 - RNA, 22 nt, Homo sapiens
augugcacaacgugcagguuug

SEQ ID NO: 62287 - RNA, 21 nt, Homo sapiens
augugcacuaugucauuuaau

SEQ ID NO: 62288 - RNA, 22 nt, Homo sapiens
augugcagauguuacaaauugu

SEQ ID NO: 62289 - RNA, 22 nt, Homo sapiens
augugcuuaaaaaugcagagaa

SEQ ID NO: 62290 - RNA, 22 nt, Homo sapiens
augugggaggacuuggcuguug

SEQ ID NO: 62291 - RNA, 22 nt, Homo sapiens
auguuauguuaaugauaaugga

SEQ ID NO: 62292 - RNA, 22 nt, Homo sapiens
auuaagugcuugccagugcugg

SEQ ID NO: 62293 - RNA, 22 nt, Homo sapiens
auuaucacaguuuugcauaugg

SEQ ID NO: 62294 - RNA, 22 nt, Homo sapiens
auuauuagucggccagcuguua

SEQ ID NO: 62295 - RNA, 22 nt, Homo sapiens
auucaaggagucuucgucccaa

SEQ ID NO: 62296 - RNA, 22 nt, Homo sapiens
auucaagggauuucaggaggcu

SEQ ID NO: 62297 - RNA, 22 nt, Homo sapiens
auucagaggggcagcugucuug

SEQ ID NO: 62298 - RNA, 22 nt, Homo sapiens
auucaucagggauauuggucug

SEQ ID NO: 62299 - RNA, 22 nt, Homo sapiens
auuccauagugucuguggcaga

SEQ ID NO: 62300 - RNA, 22 nt, Homo sapiens
auugaacacagaguagcuuucc

SEQ ID NO: 62301 - RNA, 16 nt, Homo sapiens
auugacaguggguguu

SEQ ID NO: 62302 - RNA, 22 nt, Homo sapiens
auugaggcaggaggaccaucua

SEQ ID NO: 62303 - RNA, 18 nt, Homo sapiens
auugcacaccagccuggg

SEQ ID NO: 62304 - RNA, 22 nt, Homo sapiens
auugcacuccagccuugugaca

SEQ ID NO: 62305 - RNA, 22 nt, Homo sapiens
auugcaguuucaacuccagggc

SEQ ID NO: 62306 - RNA, 22 nt, Homo sapiens
auugcccauaaggauauuguca

SEQ ID NO: 62307 - RNA, 22 nt, Homo sapiens
auugcuuuuacugggagcuuug

SEQ ID NO: 62308 - RNA, 22 nt, Homo sapiens
auuggcaauccauauauuuucu

SEQ ID NO: 62309 - RNA, 22 nt, Homo sapiens
auuggcuuuauacauaagaaua

SEQ ID NO: 62310 - RNA, 22 nt, Homo sapiens
uaaaccuagcauuuugcauaug

SEQ ID NO: 62311 - RNA, 22 nt, Homo sapiens
uaaacugucuuuggagcuuugc

SEQ ID NO: 62312 - RNA, 22 nt, Homo sapiens
uaaagcuacaguauaugguauu

SEQ ID NO: 62313 - RNA, 21 nt, Homo sapiens
uaaagcuuagcuauaguggcu

SEQ ID NO: 62314 - RNA, 21 nt, Homo sapiens
uaaaggcuccaauuauacccc

SEQ ID NO: 62315 - RNA, 22 nt, Homo sapiens
uaaauggauauugccaucuccu

SEQ ID NO: 62316 - RNA, 22 nt, Homo sapiens
uaacaccuugcucugucaauaa

SEQ ID NO: 62317 - RNA, 22 nt, Homo sapiens
uaacaggcuacucuugcauugc

SEQ ID NO: 62318 - RNA, 23 nt, Homo sapiens
uaacauugcaugauuaccugcau

SEQ ID NO: 62319 - RNA, 22 nt, Homo sapiens
uaacauugcuggacuaccugcu

SEQ ID NO: 62320 - RNA, 18 nt, Homo sapiens
uaacuggugugagauggu

SEQ ID NO: 62321 - RNA, 22 nt, Homo sapiens
uaagaauucuguccgguauacu

SEQ ID NO: 62322 - RNA, 23 nt, Homo sapiens
uaagacacuaacuuuaugcuuug

SEQ ID NO: 62323 - RNA, 22 nt, Homo sapiens
uaagacugccccagacagcaag

SEQ ID NO: 62324 - RNA, 22 nt, Homo sapiens
uaagagagcuccaucuuuuccu

SEQ ID NO: 62325 - RNA, 20 nt, Homo sapiens
uaagcauaguugucaggguc

SEQ ID NO: 62326 - RNA, 22 nt, Homo sapiens
uaagccaccgugccuggccuaa

SEQ ID NO: 62327 - RNA, 22 nt, Homo sapiens
uaaggaaccagaaguggguagc

SEQ ID NO: 62328 - RNA, 22 nt, Homo sapiens
uaaggaacucugauaucuggaa

SEQ ID NO: 62329 - RNA, 22 nt, Homo sapiens
uaaggcaaaccuuggcugcagu

SEQ ID NO: 62330 - RNA, 22 nt, Homo sapiens
uaaggcacccuucugaguagag

SEQ ID NO: 62331 - RNA, 22 nt, Homo sapiens
uaaggcccgugaguuucauauc

SEQ ID NO: 62332 - RNA, 22 nt, Homo sapiens
uaaguaauuuguauuuuaccca

SEQ ID NO: 62333 - RNA, 22 nt, Homo sapiens
uaauacauucaaggugguaguu

SEQ ID NO: 62334 - RNA, 21 nt, Homo sapiens
uaauggcaugaucucggcuca

SEQ ID NO: 62335 - RNA, 22 nt, Homo sapiens
uacaaaucuagguuuguuacug

SEQ ID NO: 62336 - RNA, 22 nt, Homo sapiens
uacaagcaggaaaugguauaug

SEQ ID NO: 62337 - RNA, 22 nt, Homo sapiens
uacaaguauuuuuauuagugcc

SEQ ID NO: 62338 - RNA, 23 nt, Homo sapiens
uacagcugcagaaucaggcuaag

SEQ ID NO: 62339 - RNA, 22 nt, Homo sapiens
uacagguauagauguguguucu

SEQ ID NO: 62340 - RNA, 22 nt, Homo sapiens
uacaguguuuugguauuccaca

SEQ ID NO: 62341 - RNA, 22 nt, Homo sapiens
uacauacuguaugguucuguuu

SEQ ID NO: 62342 - RNA, 22 nt, Homo sapiens
uccccugagaacuugcuagaaa

SEQ ID NO: 62343 - RNA, 20 nt, Homo sapiens
ucccuaagagccuuuccuuc

SEQ ID NO: 62344 - RNA, 22 nt, Homo sapiens
ucccuacuggggcacugccuag

SEQ ID NO: 62345 - RNA, 22 nt, Homo sapiens
ucccuacugggguacugccuag

SEQ ID NO: 62346 - RNA, 22 nt, Homo sapiens
ucccugaaaauuagcauuuuaa

SEQ ID NO: 62347 - RNA, 19 nt, Homo sapiens
ucccugagucuuagcuuga

SEQ ID NO: 62348 - RNA, 22 nt, Homo sapiens
uccuucacucuacaucuuuguu

SEQ ID NO: 62349 - RNA, 22 nt, Homo sapiens
uccuugagucuuugcucagaug

SEQ ID NO: 62350 - RNA, 22 nt, Homo sapiens
uccuuuggguagcuguucagau

SEQ ID NO: 62351 - RNA, 22 nt, Homo sapiens
ucgagcaauugucaugucucag

SEQ ID NO: 62352 - RNA, 17 nt, Homo sapiens
ucuaauaauaugcauuu

SEQ ID NO: 62353 - RNA, 22 nt, Homo sapiens
ucuaauguaaccugcaaauauu

SEQ ID NO: 62354 - RNA, 22 nt, Homo sapiens
ucuacccugugagggacacagu

SEQ ID NO: 62355 - RNA, 22 nt, Homo sapiens
ucuagaugaaguauaaaguagu

SEQ ID NO: 62356 - RNA, 22 nt, Homo sapiens
ucuauggauaaaaugcccucau

SEQ ID NO: 62357 - RNA, 22 nt, Homo sapiens
ucucaaguggucgcaguuagau

SEQ ID NO: 62358 - RNA, 22 nt, Homo sapiens
ucucacagaguugaacuuucuu

SEQ ID NO: 62359 - RNA, 19 nt, Homo sapiens
ucucacagcucuacuaugu

SEQ ID NO: 62360 - RNA, 22 nt, Homo sapiens
ucucagugaauguggaaaaagc

SEQ ID NO: 62361 - RNA, 22 nt, Homo sapiens
ucucaguggugcuggcagggga

SEQ ID NO: 62362 - RNA, 22 nt, Homo sapiens
ucucagugugguaaaaguuuuu

SEQ ID NO: 62363 - RNA, 19 nt, Homo sapiens
ucucaguguuggucaggug

SEQ ID NO: 62364 - RNA, 20 nt, Homo sapiens
ucucccaaacagcaggcccu

SEQ ID NO: 62365 - RNA, 22 nt, Homo sapiens
ucucuagagagccugguguuca

SEQ ID NO: 62366 - RNA, 22 nt, Homo sapiens
ucucugagaaaaguuucuccca

SEQ ID NO: 62367 - RNA, 22 nt, Homo sapiens
ucucuguuuagagccagcaauu

SEQ ID NO: 62368 - RNA, 22 nt, Homo sapiens
ucugagaucaugucugugcugu

SEQ ID NO: 62369 - RNA, 22 nt, Homo sapiens
ucugagaugagacuuugaauuu

SEQ ID NO: 62370 - RNA, 22 nt, Homo sapiens
ucugagcaauagauguggauau

SEQ ID NO: 62371 - RNA, 21 nt, Homo sapiens
ucugagucauucaguggccug

SEQ ID NO: 62372 - RNA, 22 nt, Homo sapiens
ucugccuacugagcacacagug

SEQ ID NO: 62373 - RNA, 22 nt, Homo sapiens
ucuggaauguaaaguuuauggg

SEQ ID NO: 62374 - RNA, 20 nt, Homo sapiens
ucuggccccuccaaaucuca

SEQ ID NO: 62375 - RNA, 20 nt, Homo sapiens
ucuggccccucuaaaucuca

SEQ ID NO: 62376 - RNA, 22 nt, Homo sapiens
ucuggccuagaacaauuaauua

SEQ ID NO: 62377 - RNA, 22 nt, Homo sapiens
ucuggccuccuaugagaaucga

SEQ ID NO: 62378 - RNA, 16 nt, Homo sapiens
ucuggcucuacaguuc

SEQ ID NO: 62379 - RNA, 17 nt, Homo sapiens
ucuggcuuucacaccug

SEQ ID NO: 62380 - RNA, 22 nt, Homo sapiens
ucugucacugaaucccugucac

SEQ ID NO: 62381 - RNA, 19 nt, Homo sapiens
ucugucacuggggguauuc

SEQ ID NO: 62382 - RNA, 22 nt, Homo sapiens
ucugugcauuguaacaacuaaa

SEQ ID NO: 62383 - RNA, 18 nt, Homo sapiens
ucugugguguaaauacgu

SEQ ID NO: 62384 - RNA, 22 nt, Homo sapiens
ucuguuguuguuuuaagagaca

SEQ ID NO: 62385 - RNA, 22 nt, Homo sapiens
ucuugcaguucccaaauucaca

SEQ ID NO: 62386 - RNA, 22 nt, Homo sapiens
ucuuggccaugaauggcaaggc

SEQ ID NO: 62387 - RNA, 20 nt, Homo sapiens
ucuugggaauguagccuagg

SEQ ID NO: 62388 - RNA, 22 nt, Homo sapiens
ucuuucacuuagcaugauguuu

SEQ ID NO: 62389 - RNA, 19 nt, Homo sapiens
ucuuugcuuuucuaagagg

SEQ ID NO: 62390 - RNA, 22 nt, Homo sapiens
ucuuuggcugugaagaauaaug

SEQ ID NO: 62391 - RNA, 21 nt, Homo sapiens
ucuuuggucaccaguuuucau

SEQ ID NO: 62392 - RNA, 22 nt, Homo sapiens
ucuuuguguaggucaaucuggc

SEQ ID NO: 62393 - RNA, 22 nt, Homo sapiens
ucuuuugguuucuagaggccgc

SEQ ID NO: 62394 - RNA, 22 nt, Homo sapiens
ugaaaguuauauugugaaauuc

SEQ ID NO: 62395 - RNA, 22 nt, Homo sapiens
ugaaauacuuuggcucuuuguu

SEQ ID NO: 62396 - RNA, 22 nt, Homo sapiens
ugaaauaguuaaguugccuagu

SEQ ID NO: 62397 - RNA, 22 nt, Homo sapiens
ugaaaugcagaacuuuaggucu

SEQ ID NO: 62398 - RNA, 22 nt, Homo sapiens
ugaaaugcugucuaggggaaau

SEQ ID NO: 62399 - RNA, 22 nt, Homo sapiens
ugaaaugucuuuaggaggcuuc

SEQ ID NO: 62400 - RNA, 21 nt, Homo sapiens
ugaacacuggacugagugucc

SEQ ID NO: 62401 - RNA, 22 nt, Homo sapiens
ugaacagcaccuccuagaguug

SEQ ID NO: 62402 - RNA, 22 nt, Homo sapiens
ugaagcuaugacuauugagcau

SEQ ID NO: 62403 - RNA, 22 nt, Homo sapiens
ugaagugaagacucacagaagg

SEQ ID NO: 62404 - RNA, 22 nt, Homo sapiens
ugaauacugugcaaaggauuug

SEQ ID NO: 62405 - RNA, 22 nt, Homo sapiens
aacuggccugagaugaaaagug

SEQ ID NO: 62406 - RNA, 22 nt, Homo sapiens
aacuggccuggcgugcagaggg

SEQ ID NO: 62407 - RNA, 22 nt, Homo sapiens
aagagaugaagguccugacugu

SEQ ID NO: 62408 - RNA, 22 nt, Homo sapiens
aagaggccuaggaaucuguauu

SEQ ID NO: 62409 - RNA, 22 nt, Homo sapiens
aagagugcucgugggacucagc

SEQ ID NO: 62410 - RNA, 22 nt, Homo sapiens
aagagugucuuugugcuggccc

SEQ ID NO: 62411 - RNA, 22 nt, Homo sapiens
aagaugcagucauacuggagga

SEQ ID NO: 62412 - RNA, 21 nt, Homo sapiens
aagcacauugaguguguguga

SEQ ID NO: 62413 - RNA, 22 nt, Homo sapiens
aagcaccguugccuccccugca

SEQ ID NO: 62414 - RNA, 22 nt, Homo sapiens
aagcuccauuucugccaugaga

SEQ ID NO: 62415 - RNA, 22 nt, Homo sapiens
aagcugccuugugaaggcauuc

SEQ ID NO: 62416 - RNA, 22 nt, Homo sapiens
aagcuggauuucgcauccuguu

SEQ ID NO: 62417 - RNA, 22 nt, Homo sapiens
aagcuguauuguguugcuauaa

SEQ ID NO: 62418 - RNA, 22 nt, Homo sapiens
aagcuguguguaagcucucaca

SEQ ID NO: 62419 - RNA, 22 nt, Homo sapiens
aagcuuucaacuguuugccauu

SEQ ID NO: 62420 - RNA, 22 nt, Homo sapiens
aaggagcaguggacggguccua

SEQ ID NO: 62421 - RNA, 22 nt, Homo sapiens
aaggauuguaacaccaagguua

SEQ ID NO: 62422 - RNA, 22 nt, Homo sapiens
aaggcaagaagagaaccaucgg

SEQ ID NO: 62423 - RNA, 22 nt, Homo sapiens
aaggcuguuguguaauaggauu

SEQ ID NO: 62424 - RNA, 22 nt, Homo sapiens
aagguacuggaaagaggaaugg

SEQ ID NO: 62425 - RNA, 22 nt, Homo sapiens
aagguagguuccaaaauaccua

SEQ ID NO: 62426 - RNA, 22 nt, Homo sapiens
aaggugcuguaagcauccaugu

SEQ ID NO: 62427 - RNA, 22 nt, Homo sapiens
aaguauuagugaggauauggaa

SEQ ID NO: 62428 - RNA, 22 nt, Homo sapiens
aagucacugagacuuguggcug

SEQ ID NO: 62429 - RNA, 22 nt, Homo sapiens
aagugcuuacagggaacaugau

SEQ ID NO: 62430 - RNA, 22 nt, Homo sapiens
aagugcuuuacacaugcaugau

SEQ ID NO: 62431 - RNA, 22 nt, Homo sapiens
aagugcuuuuuagauaugguuu

SEQ ID NO: 62432 - RNA, 22 nt, Homo sapiens
aauaagcugagagaauucuaca

SEQ ID NO: 62433 - RNA, 22 nt, Homo sapiens
aauaauggcaccaaagcacaag

SEQ ID NO: 62434 - RNA, 22 nt, Homo sapiens
aauacagcacacagaugggucu

SEQ ID NO: 62435 - RNA, 22 nt, Homo sapiens
aaucccuuuguccagucucuuu

SEQ ID NO: 62436 - RNA, 22 nt, Homo sapiens
aaucuguagaaggugcacauuc

SEQ ID NO: 62437 - RNA, 22 nt, Homo sapiens
aaugacagccagauucuucucu

SEQ ID NO: 62438 - RNA, 22 nt, Homo sapiens
aauggcaagagccacagaggcg

SEQ ID NO: 62439 - RNA, 22 nt, Homo sapiens
aaugucaucuucaguuguacag

SEQ ID NO: 62440 - RNA, 22 nt, Homo sapiens
aaugucaugaguccaaccagaa

SEQ ID NO: 62441 - RNA, 22 nt, Homo sapiens
aaugugcuucuggcugugguca

SEQ ID NO: 62442 - RNA, 22 nt, Homo sapiens
aauuacucgugucuuuacugcu

SEQ ID NO: 62443 - RNA, 22 nt, Homo sapiens
aauugaccuaaucugauuacug

SEQ ID NO: 62444 - RNA, 23 nt, Homo sapiens
aauugcuuuugaggacuuaguug

SEQ ID NO: 62445 - RNA, 22 nt, Homo sapiens
aauuguacucccaucauuccua

SEQ ID NO: 62446 - RNA, 21 nt, Homo sapiens
acaaagcuggagggagacugc

SEQ ID NO: 62447 - RNA, 22 nt, Homo sapiens
acaaaguauggaauguuggugu

SEQ ID NO: 62448 - RNA, 22 nt, Homo sapiens
acaagcacaaauuuaauccugu

SEQ ID NO: 62449 - RNA, 22 nt, Homo sapiens
acacaaugguaaguguuugugu

SEQ ID NO: 62450 - RNA, 22 nt, Homo sapiens
acacaguaaauauugucuccuc

SEQ ID NO: 62451 - RNA, 22 nt, Homo sapiens
acacaugugcguagacucuuua

SEQ ID NO: 62452 - RNA, 22 nt, Homo sapiens
acacgugcagauuuauauaaau

SEQ ID NO: 62453 - RNA, 22 nt, Homo sapiens
acacuggaggagagcuguugcu

SEQ ID NO: 62454 - RNA, 20 nt, Homo sapiens
acacuggcuuugagauuuag

SEQ ID NO: 62455 - RNA, 22 nt, Homo sapiens
acagcacugccaagugacccau

SEQ ID NO: 62456 - RNA, 22 nt, Homo sapiens
acagccauuccagccaaauacu

SEQ ID NO: 62457 - RNA, 22 nt, Homo sapiens
acaggguuauuguaauaaugua

SEQ ID NO: 62458 - RNA, 22 nt, Homo sapiens
acagguacacagaauauccaga

SEQ ID NO: 62459 - RNA, 22 nt, Homo sapiens
acaguagaaaacaauggauuug

SEQ ID NO: 62460 - RNA, 20 nt, Homo sapiens
acaguagaagggauuucaaa

SEQ ID NO: 62461 - RNA, 22 nt, Homo sapiens
acaguagugggcuacagaauca

SEQ ID NO: 62462 - RNA, 22 nt, Homo sapiens
acagucacaauuuguaccuuuu

SEQ ID NO: 62463 - RNA, 22 nt, Homo sapiens
acagucauagcagccuuuguua

SEQ ID NO: 62464 - RNA, 18 nt, Homo sapiens
acagugcuggcaugagau

SEQ ID NO: 62465 - RNA, 18 nt, Homo sapiens
acagugcugucacugcuu

SEQ ID NO: 62466 - RNA, 22 nt, Homo sapiens
acaguggugcgaucucggcuca

SEQ ID NO: 62467 - RNA, 22 nt, Homo sapiens
acaguguuccuuuguugugacu

SEQ ID NO: 62468 - RNA, 22 nt, Homo sapiens
acauaaagaagcaggacauugu

SEQ ID NO: 62469 - RNA, 22 nt, Homo sapiens
acauacacuagggauguggugu

SEQ ID NO: 62470 - RNA, 22 nt, Homo sapiens
acauccauuugcuuuauuugcu

SEQ ID NO: 62471 - RNA, 22 nt, Homo sapiens
acaugccucccugguccgcugu

SEQ ID NO: 62472 - RNA, 22 nt, Homo sapiens
acauugcauauggcacccucuu

SEQ ID NO: 62473 - RNA, 22 nt, Homo sapiens
accaccacucccgcauucuaaa

SEQ ID NO: 62474 - RNA, 22 nt, Homo sapiens
accauugcacuccuuucugggc

SEQ ID NO: 62475 - RNA, 22 nt, Homo sapiens
uuaaaagcuaucuccaagguca

SEQ ID NO: 62476 - RNA, 22 nt, Homo sapiens
uuaaagccauaccugagagagu

SEQ ID NO: 62477 - RNA, 20 nt, Homo sapiens
uuaaaucuagugcagacuca

SEQ ID NO: 62478 - RNA, 22 nt, Homo sapiens
uuaaaugcuagaauuuucuuug

SEQ ID NO: 62479 - RNA, 22 nt, Homo sapiens
uuaagaagugauuuuccucauu

SEQ ID NO: 62480 - RNA, 22 nt, Homo sapiens
uuaagaugcauuuugaaguuaa

SEQ ID NO: 62481 - RNA, 22 nt, Homo sapiens
uuaagcaaagguaacaugagaa

SEQ ID NO: 62482 - RNA, 22 nt, Homo sapiens
uuaaggaaggagucuuaaaugg

SEQ ID NO: 62483 - RNA, 22 nt, Homo sapiens
uuaauccugccuuauuucagua

SEQ ID NO: 62484 - RNA, 22 nt, Homo sapiens
uuacagucuuaggcagugcuuu

SEQ ID NO: 62485 - RNA, 22 nt, Homo sapiens
uuaccacagugccugucuaaug

SEQ ID NO: 62486 - RNA, 22 nt, Homo sapiens
uuagaacagugcucaccacaaa

SEQ ID NO: 62487 - RNA, 22 nt, Homo sapiens
uuagaacuagaggaguuugagu

SEQ ID NO: 62488 - RNA, 23 nt, Homo sapiens
uuagaucuuuaaggaaucuccac

SEQ ID NO: 62489 - RNA, 22 nt, Homo sapiens
uuagaugaagucacagaaccca

SEQ ID NO: 62490 - RNA, 22 nt, Homo sapiens
uuagcagcacaaaagcagacua

SEQ ID NO: 62491 - RNA, 22 nt, Homo sapiens
uuagcagcaucccuggccugua

SEQ ID NO: 62492 - RNA, 22 nt, Homo sapiens
uuagcagcucuggugacaaggu

SEQ ID NO: 62493 - RNA, 22 nt, Homo sapiens
uuagggaggacaguuacaacag

SEQ ID NO: 62494 - RNA, 22 nt, Homo sapiens
uuagggaggcucaggacaagag

SEQ ID NO: 62495 - RNA, 22 nt, Homo sapiens
uuaguagagacgagcguuccac

SEQ ID NO: 62496 - RNA, 22 nt, Homo sapiens
uuaguaguagcugcaugucagu

SEQ ID NO: 62497 - RNA, 20 nt, Homo sapiens
uuaguucauuuagaagguuu

SEQ ID NO: 62498 - RNA, 22 nt, Homo sapiens
uuauaacagagacuccugugcu

SEQ ID NO: 62499 - RNA, 22 nt, Homo sapiens
uuauaacucugcagccugguau

SEQ ID NO: 62500 - RNA, 21 nt, Homo sapiens
uuauaguggcaugauuuauaa

SEQ ID NO: 62501 - RNA, 22 nt, Homo sapiens
uuauauguuacucccucuagca

SEQ ID NO: 62502 - RNA, 18 nt, Homo sapiens
ucuuuggcugaacuguag

SEQ ID NO: 62503 - RNA, 22 nt, Homo sapiens
ucuuuggguguauuucacagcc

SEQ ID NO: 62504 - RNA, 22 nt, Homo sapiens
ucuuugguaugugcaugugcuu

SEQ ID NO: 62505 - RNA, 22 nt, Homo sapiens
ucuuuguguucaggagccacgu

SEQ ID NO: 62506 - RNA, 22 nt, Homo sapiens
ugaaacacaccuccucuccauc

SEQ ID NO: 62507 - RNA, 22 nt, Homo sapiens
ugaaagacugaagaauaggcau

SEQ ID NO: 62508 - RNA, 22 nt, Homo sapiens
ugaacacaucuccugguaccug

SEQ ID NO: 62509 - RNA, 22 nt, Homo sapiens
ugaaggaguauggauaagucgu

SEQ ID NO: 62510 - RNA, 22 nt, Homo sapiens
ugaaggcaggagggagaaaagu

SEQ ID NO: 62511 - RNA, 22 nt, Homo sapiens
ugaaggccgggcaugguggcuc

SEQ ID NO: 62512 - RNA, 22 nt, Homo sapiens
ugaaugcaucuagaaauuuauu

SEQ ID NO: 62513 - RNA, 22 nt, Homo sapiens
ugaaugguaaagaaaagcacug

SEQ ID NO: 62514 - RNA, 20 nt, Homo sapiens
ugacaaggugcaaagaauca

SEQ ID NO: 62515 - RNA, 22 nt, Homo sapiens
ugacagcaucaggauuggagag

SEQ ID NO: 62516 - RNA, 22 nt, Homo sapiens
ugacaggauggagaucgguauu

SEQ ID NO: 62517 - RNA, 22 nt, Homo sapiens
ugacagugaauaagucucuuaa

SEQ ID NO: 62518 - RNA, 18 nt, Homo sapiens
ugacaguuucuuuauauu

SEQ ID NO: 62519 - RNA, 22 nt, Homo sapiens
ugacaugagauuugggaggggc

SEQ ID NO: 62520 - RNA, 22 nt, Homo sapiens
ugacaugaugagcaauaauggc

SEQ ID NO: 62521 - RNA, 22 nt, Homo sapiens
ugacauggagagagaagccuuu

SEQ ID NO: 62522 - RNA, 19 nt, Homo sapiens
ugaccagggacagaaacca

SEQ ID NO: 62523 - RNA, 22 nt, Homo sapiens
ugacuaaaacugaguuucauua

SEQ ID NO: 62524 - RNA, 22 nt, Homo sapiens
ugacuacaccacacgguuaagg

SEQ ID NO: 62525 - RNA, 22 nt, Homo sapiens
ugacuacaggucaggaagcugu

SEQ ID NO: 62526 - RNA, 22 nt, Homo sapiens
ugacuacauaaguaaucucaaa

SEQ ID NO: 62527 - RNA, 22 nt, Homo sapiens
ugacuauaguuuucuugacaca

SEQ ID NO: 62528 - RNA, 22 nt, Homo sapiens
ugacucagauagguguguauuc

SEQ ID NO: 62529 - RNA, 22 nt, Homo sapiens
ugacugucuagauagagcuugg

SEQ ID NO: 62530 - RNA, 22 nt, Homo sapiens
ugacuucagacugaaaugauuc

SEQ ID NO: 62531 - RNA, 22 nt, Homo sapiens
ugacuucauuugguaauugggu

SEQ ID NO: 62532 - RNA, 22 nt, Homo sapiens
ugacuucauuuuuggccaugag

SEQ ID NO: 62533 - RNA, 21 nt, Homo sapiens
ugagaacaacaggucaagcag

SEQ ID NO: 62534 - RNA, 20 nt, Homo sapiens
ugagaacaugugguauuugg

SEQ ID NO: 62535 - RNA, 22 nt, Homo sapiens
ugagaagcauaccagugucugu

SEQ ID NO: 62536 - RNA, 22 nt, Homo sapiens
ugagacaaucucaucucaguga

SEQ ID NO: 62537 - RNA, 22 nt, Homo sapiens
ugagacaugugaauauuuguac

SEQ ID NO: 62538 - RNA, 22 nt, Homo sapiens
ugagacggagucucacucuguu

SEQ ID NO: 62539 - RNA, 22 nt, Homo sapiens
ugagacggagucucgcucuguc

SEQ ID NO: 62540 - RNA, 22 nt, Homo sapiens
ugagacggagucuugcuaaguu

SEQ ID NO: 62541 - RNA, 22 nt, Homo sapiens
ugagacggaguuauuuauaaua

SEQ ID NO: 62542 - RNA, 22 nt, Homo sapiens
ugagacugaguuucacuuuugu

SEQ ID NO: 62543 - RNA, 22 nt, Homo sapiens
ugagagcuuugaugcacuguuu

SEQ ID NO: 62544 - RNA, 22 nt, Homo sapiens
ugagagcuuuuuugccugguga

SEQ ID NO: 62545 - RNA, 22 nt, Homo sapiens
ugagaggugaauggcaggcuca

SEQ ID NO: 62546 - RNA, 22 nt, Homo sapiens
ugagauaaucaugugauuucau

SEQ ID NO: 62547 - RNA, 22 nt, Homo sapiens
ugagaucaagauguuagggacu

SEQ ID NO: 62548 - RNA, 22 nt, Homo sapiens
ugagaucaaggugggcccuggg

SEQ ID NO: 62549 - RNA, 22 nt, Homo sapiens
ugagaucgaguaucgcugucac

SEQ ID NO: 62550 - RNA, 21 nt, Homo sapiens
ugagaugauccugcaugcaug

SEQ ID NO: 62551 - RNA, 22 nt, Homo sapiens
ugagaugcaaaaugagaauugu

SEQ ID NO: 62552 - RNA, 22 nt, Homo sapiens
ugagauggagucuugucgccua

SEQ ID NO: 62553 - RNA, 22 nt, Homo sapiens
ugagauggaguuucacuuuugu

SEQ ID NO: 62554 - RNA, 22 nt, Homo sapiens
ugagauggcuuuauugcugaau

SEQ ID NO: 62555 - RNA, 22 nt, Homo sapiens
ugagauguguccagaucuaguu

SEQ ID NO: 62556 - RNA, 22 nt, Homo sapiens
ugagcacauuuacaucaguucc

SEQ ID NO: 62557 - RNA, 22 nt, Homo sapiens
ugagcagaaagcugcaaggucg

SEQ ID NO: 62558 - RNA, 22 nt, Homo sapiens
ugagcagagggagaaguaaauu

SEQ ID NO: 62559 - RNA, 22 nt, Homo sapiens
ugagcagaguuguuucuccuga

SEQ ID NO: 62560 - RNA, 22 nt, Homo sapiens
ugagcauuguguuugacuguga

SEQ ID NO: 62561 - RNA, 22 nt, Homo sapiens
ugagccaaguucacaccauugc

SEQ ID NO: 62562 - RNA, 20 nt, Homo sapiens
ugagcucaauuguugcaagu

SEQ ID NO: 62563 - RNA, 22 nt, Homo sapiens
ugagcugagaucaugcuauugu

SEQ ID NO: 62564 - RNA, 22 nt, Homo sapiens
ugaggcaagauacugauuucau

SEQ ID NO: 62565 - RNA, 22 nt, Homo sapiens
ugaggcuagucagaucagauga

SEQ ID NO: 62566 - RNA, 22 nt, Homo sapiens
ugagguagaggugaacuugacc

SEQ ID NO: 62567 - RNA, 20 nt, Homo sapiens
ugaggucaggaguuacagac

SEQ ID NO: 62568 - RNA, 22 nt, Homo sapiens
ugagguugaaggacauuuuuau

SEQ ID NO: 62569 - RNA, 22 nt, Homo sapiens
ugagguuggggucagggcuagc

SEQ ID NO: 62570 - RNA, 22 nt, Homo sapiens
uugagauggaguguugcucugu

SEQ ID NO: 62571 - RNA, 22 nt, Homo sapiens
uugagauggaguuucacucucg

SEQ ID NO: 62572 - RNA, 22 nt, Homo sapiens
uugagauggaguuucacucugu

SEQ ID NO: 62573 - RNA, 22 nt, Homo sapiens
uugagauuauuguguuccuuua

SEQ ID NO: 62574 - RNA, 22 nt, Homo sapiens
uugagcacaggaguuugagacc

SEQ ID NO: 62575 - RNA, 22 nt, Homo sapiens
uugagcaccaugccuggccaug

SEQ ID NO: 62576 - RNA, 22 nt, Homo sapiens
uugaggaguacugauuagguau

SEQ ID NO: 62577 - RNA, 22 nt, Homo sapiens
uugaggcuuuugaccucaugug

SEQ ID NO: 62578 - RNA, 22 nt, Homo sapiens
uugagguaguacuuauuauugg

SEQ ID NO: 62579 - RNA, 20 nt, Homo sapiens
uugaggugugaggggcagag

SEQ ID NO: 62580 - RNA, 22 nt, Homo sapiens
uugaguagauaccuaggaauag

SEQ ID NO: 62581 - RNA, 22 nt, Homo sapiens
uugaguaguaagaagaugauag

SEQ ID NO: 62582 - RNA, 22 nt, Homo sapiens
uugaguccccacacuggguccc

SEQ ID NO: 62583 - RNA, 22 nt, Homo sapiens
uugaguuugaguauucuaaagc

SEQ ID NO: 62584 - RNA, 22 nt, Homo sapiens
uugauaguuuaauuaaugcuag

SEQ ID NO: 62585 - RNA, 22 nt, Homo sapiens
uugauauauugcaugggcuacu

SEQ ID NO: 62586 - RNA, 22 nt, Homo sapiens
uugaucaauagaauacaacaga

SEQ ID NO: 62587 - RNA, 22 nt, Homo sapiens
uugcaaaguuugccuccuguag

SEQ ID NO: 62588 - RNA, 22 nt, Homo sapiens
uugcaagaaaucagagccuucc

SEQ ID NO: 62589 - RNA, 22 nt, Homo sapiens
uugcaagauguuaacauuggag

SEQ ID NO: 62590 - RNA, 22 nt, Homo sapiens
uugcacaauccugugagugagu

SEQ ID NO: 62591 - RNA, 22 nt, Homo sapiens
uugcacagugguuuagagccug

SEQ ID NO: 62592 - RNA, 22 nt, Homo sapiens
uugcacaguguguacagcacca

SEQ ID NO: 62593 - RNA, 22 nt, Homo sapiens
uugcacauggcaggugcucaau

SEQ ID NO: 62594 - RNA, 22 nt, Homo sapiens
ugcagugugaaagagccugaca

SEQ ID NO: 62595 - RNA, 22 nt, Homo sapiens
ugcagugugcuggggucuccau

SEQ ID NO: 62596 - RNA, 22 nt, Homo sapiens
ugcauauguugagaugcauauu

SEQ ID NO: 62597 - RNA, 22 nt, Homo sapiens
ugcauauucgaguuauuuuggg

SEQ ID NO: 62598 - RNA, 20 nt, Homo sapiens
ugcauguccucacuuacuug

SEQ ID NO: 62599 - RNA, 22 nt, Homo sapiens
ugcauuaucagauguuugcuuu

SEQ ID NO: 62600 - RNA, 21 nt, Homo sapiens
ugcauuguugcugagagcagg

SEQ ID NO: 62601 - RNA, 22 nt, Homo sapiens
ugccagaugcaguguucaacaa

SEQ ID NO: 62602 - RNA, 22 nt, Homo sapiens
ugccaggaugaggucaauguuu

SEQ ID NO: 62603 - RNA, 22 nt, Homo sapiens
ugcugcaaacaugagaggaagu

SEQ ID NO: 62604 - RNA, 22 nt, Homo sapiens
ugcugguauuuggaccagccug

SEQ ID NO: 62605 - RNA, 21 nt, Homo sapiens
ugcuuacugaauguuaauuuc

SEQ ID NO: 62606 - RNA, 22 nt, Homo sapiens
ugcuuguguucagguaaccuuu

SEQ ID NO: 62607 - RNA, 22 nt, Homo sapiens
ugcuuuguugaaaaucauuugg

SEQ ID NO: 62608 - RNA, 22 nt, Homo sapiens
uggaaaguacugagguccaccu

SEQ ID NO: 62609 - RNA, 22 nt, Homo sapiens
uggaaaguacuugaguuuguau

SEQ ID NO: 62610 - RNA, 22 nt, Homo sapiens
uggaacugauauugauggaaaa

SEQ ID NO: 62611 - RNA, 22 nt, Homo sapiens
uggaagacaaguguuagcaugg

SEQ ID NO: 62612 - RNA, 22 nt, Homo sapiens
uggaagacacauaccugauaac

SEQ ID NO: 62613 - RNA, 22 nt, Homo sapiens
uggaagaugggaccucaguuuu

SEQ ID NO: 62614 - RNA, 22 nt, Homo sapiens
uggaaguagauagauuguguca

SEQ ID NO: 62615 - RNA, 22 nt, Homo sapiens
uggaaguauagauaauugaaag

SEQ ID NO: 62616 - RNA, 22 nt, Homo sapiens
uggaagugucugugcccagcuc

SEQ ID NO: 62617 - RNA, 21 nt, Homo sapiens
uggaaugaauggccaacaugg

SEQ ID NO: 62618 - RNA, 22 nt, Homo sapiens
uggaauguagcguugacacgag

SEQ ID NO: 62619 - RNA, 22 nt, Homo sapiens
uggaauguauaucguuuuuugu

SEQ ID NO: 62620 - RNA, 21 nt, Homo sapiens
uggaauguucugacuucaggg

SEQ ID NO: 62621 - RNA, 22 nt, Homo sapiens
uggacaugaagggcacaggagg

SEQ ID NO: 62622 - RNA, 21 nt, Homo sapiens
uggaccccuacuucucaccau

SEQ ID NO: 62623 - RNA, 21 nt, Homo sapiens
uggaccccuuccuuacaucau

SEQ ID NO: 62624 - RNA, 21 nt, Homo sapiens
uggaccccuuucuuacaccgu

SEQ ID NO: 62625 - RNA, 22 nt, Homo sapiens
uggagacaaagauagaaaagca

SEQ ID NO: 62626 - RNA, 22 nt, Homo sapiens
uggagagugagggccuccuuaa

SEQ ID NO: 62627 - RNA, 22 nt, Homo sapiens
uggagauguuuaaaauccacug

SEQ ID NO: 62628 - RNA, 22 nt, Homo sapiens
uggagugagaacuucaaugaug

SEQ ID NO: 62629 - RNA, 22 nt, Homo sapiens
uggaguguagaagccagccucc

SEQ ID NO: 62630 - RNA, 22 nt, Homo sapiens
uggaguguguugcagaugaagg

SEQ ID NO: 62631 - RNA, 20 nt, Homo sapiens
uggaguuugaguucuuggag

SEQ ID NO: 62632 - RNA, 22 nt, Homo sapiens
uggauagauacuauccaggacu

SEQ ID NO: 62633 - RNA, 22 nt, Homo sapiens
uggauauguuuauuacccugaa

SEQ ID NO: 62634 - RNA, 22 nt, Homo sapiens
uggcaaaaaucacaaguaccuu

SEQ ID NO: 62635 - RNA, 22 nt, Homo sapiens
uggcaagaagagcaugagacca

SEQ ID NO: 62636 - RNA, 22 nt, Homo sapiens
uggcaagagggaugcaagguuu

SEQ ID NO: 62637 - RNA, 22 nt, Homo sapiens
uggcaagugggaccuaguuaaa

SEQ ID NO: 62638 - RNA, 22 nt, Homo sapiens
uggcagacaaauuugagcauau

SEQ ID NO: 62639 - RNA, 22 nt, Homo sapiens
uggcaguuuugauguggagaga

SEQ ID NO: 62640 - RNA, 22 nt, Homo sapiens
uggcauauaauauagaagacua

SEQ ID NO: 62641 - RNA, 19 nt, Homo sapiens
uggcuagaggccaggcguu

SEQ ID NO: 62642 - RNA, 20 nt, Homo sapiens
uggcuucuuaauugcaggca

SEQ ID NO: 62643 - RNA, 22 nt, Homo sapiens
ugggaagauucuguguuuuucc

SEQ ID NO: 62644 - RNA, 22 nt, Homo sapiens
ugggaucauucaaugacgaaau

SEQ ID NO: 62645 - RNA, 22 nt, Homo sapiens
ugggcauuguuccuaguuaucu

SEQ ID NO: 62646 - RNA, 22 nt, Homo sapiens
uggguagauaucauaguugccc

SEQ ID NO: 62647 - RNA, 22 nt, Homo sapiens
uggguucccugucuguccuuga

SEQ ID NO: 62648 - RNA, 22 nt, Homo sapiens
ugguaaaaugucauuuaccaga

SEQ ID NO: 62649 - RNA, 22 nt, Homo sapiens
ugguaagaucugugagccaggc

SEQ ID NO: 62650 - RNA, 22 nt, Homo sapiens
ugguaauguaauuuggagaagg

SEQ ID NO: 62651 - RNA, 22 nt, Homo sapiens
uggucagaaaauuacuugauau

SEQ ID NO: 62652 - RNA, 22 nt, Homo sapiens
uggucauggggcagcugacacu

SEQ ID NO: 62653 - RNA, 22 nt, Homo sapiens
ugguccacuaacccucaguauc

SEQ ID NO: 62654 - RNA, 22 nt, Homo sapiens
ugguccuuuccauuggagacac

SEQ ID NO: 62655 - RNA, 22 nt, Homo sapiens
uggucuucuggccuccagaacc

SEQ ID NO: 62656 - RNA, 22 nt, Homo sapiens
uggucuuuucaacaaaugguau

SEQ ID NO: 62657 - RNA, 22 nt, Homo sapiens
uggugagaaaugagaugcuuuu

SEQ ID NO: 62658 - RNA, 17 nt, Homo sapiens
uggugcuugaaaguugc

SEQ ID NO: 62659 - RNA, 22 nt, Homo sapiens
uguaaaaagcccagccgcugag

SEQ ID NO: 62660 - RNA, 23 nt, Homo sapiens
uguaaaagcauuugucagccugg

SEQ ID NO: 62661 - RNA, 22 nt, Homo sapiens
uguaaaccauauauguauguag

SEQ ID NO: 62662 - RNA, 22 nt, Homo sapiens
uguacaaauuucugugguggug

SEQ ID NO: 62663 - RNA, 19 nt, Homo sapiens
uguacacuguaaaccugug

SEQ ID NO: 62664 - RNA, 22 nt, Homo sapiens
uguagauaucuaucaggucaau

SEQ ID NO: 62665 - RNA, 23 nt, Homo sapiens
uuugugcuaauuuaugggcucuu

SEQ ID NO: 62666 - RNA, 22 nt, Homo sapiens
uuugugcuauguuauauauucu

SEQ ID NO: 62667 - RNA, 22 nt, Homo sapiens
uuuguucaccucaaggauggga

SEQ ID NO: 62668 - RNA, 22 nt, Homo sapiens
uuuguuugaagucgagacaacu

SEQ ID NO: 62669 - RNA, 22 nt, Homo sapiens
uuuuacacuucgguugugugca

SEQ ID NO: 62670 - RNA, 22 nt, Homo sapiens
uuuugcucuugguaaugaaaga

SEQ ID NO: 62671 - RNA, 19 nt, Homo sapiens
uuuugcucuuuauaccuau

SEQ ID NO: 62672 - RNA, 22 nt, Homo sapiens
uuuuggacuucaauuugacacu

SEQ ID NO: 62673 - RNA, 22 nt, Homo sapiens
uuuuggacuugcuccccugucc

SEQ ID NO: 62674 - RNA, 22 nt, Homo sapiens
uuuuguacaacagcucugggga

SEQ ID NO: 62675 - RNA, 22 nt, Homo sapiens
uuuugucccaugggcuguuccc

SEQ ID NO: 62676 - RNA, 22 nt, Homo sapiens
ugugguuuuuuucuccaauagg

SEQ ID NO: 62677 - RNA, 22 nt, Homo sapiens
ugugucuuguuuauagcuuucu

SEQ ID NO: 62678 - RNA, 21 nt, Homo sapiens
uguuaacaugcagauuacugg

SEQ ID NO: 62679 - RNA, 22 nt, Homo sapiens
uguuauguuuuagagguuucaa

SEQ ID NO: 62680 - RNA, 22 nt, Homo sapiens
uguuauuuuguguuagggcaca

SEQ ID NO: 62681 - RNA, 22 nt, Homo sapiens
uguuggcauugcugcugacccu

SEQ ID NO: 62682 - RNA, 22 nt, Homo sapiens
uuaaaguaauugaaauggccuu

SEQ ID NO: 62683 - RNA, 22 nt, Homo sapiens
uuaaaguguuuucaaaauguca

SEQ ID NO: 62684 - RNA, 22 nt, Homo sapiens
uuaagagcauggugccagguug

SEQ ID NO: 62685 - RNA, 23 nt, Homo sapiens
uuaagcaacggcugcuuuucaga

SEQ ID NO: 62686 - RNA, 22 nt, Homo sapiens
uuaaggccccgcccauucaggc

SEQ ID NO: 62687 - RNA, 22 nt, Homo sapiens
uuaaggcuuuaaguaaacacag

SEQ ID NO: 62688 - RNA, 22 nt, Homo sapiens
uuaagggaggagcuucaagaug

SEQ ID NO: 62689 - RNA, 21 nt, Homo sapiens
uuaaguaauuacccaacucuc

SEQ ID NO: 62690 - RNA, 19 nt, Homo sapiens
uuaaguaguuagagggucu

SEQ ID NO: 62691 - RNA, 22 nt, Homo sapiens
uuaagucacacuagacaacuga

SEQ ID NO: 62692 - RNA, 22 nt, Homo sapiens
uuaagugcucaguuacucaguu

SEQ ID NO: 62693 - RNA, 19 nt, Homo sapiens
uuaagugugauaucucagu

SEQ ID NO: 62694 - RNA, 22 nt, Homo sapiens
uuaaugcuuggggaguaguucu

SEQ ID NO: 62695 - RNA, 22 nt, Homo sapiens
uuacaacugucuuacugguuau

SEQ ID NO: 62696 - RNA, 17 nt, Homo sapiens
uuacaggugcugagagu

SEQ ID NO: 62697 - RNA, 22 nt, Homo sapiens
uuacagucucaagagugcugca

SEQ ID NO: 62698 - RNA, 21 nt, Homo sapiens
uuacaguugguugugaggugg

SEQ ID NO: 62699 - RNA, 22 nt, Homo sapiens
uuacauugcuucaaauucagug

SEQ ID NO: 62700 - RNA, 22 nt, Homo sapiens
uuagaacaguguuugccucgcu

SEQ ID NO: 62701 - RNA, 22 nt, Homo sapiens
uuagauuauugagcauccacug

SEQ ID NO: 62702 - RNA, 22 nt, Homo sapiens
uuagcaauugauucucauaagc

SEQ ID NO: 62703 - RNA, 22 nt, Homo sapiens
uuagcagugugaaaaaagacua

SEQ ID NO: 62704 - RNA, 22 nt, Homo sapiens
uuaggcuaguugauauaguuug

SEQ ID NO: 62705 - RNA, 22 nt, Homo sapiens
uuagggaguaaucuaaaaaugg

SEQ ID NO: 62706 - RNA, 22 nt, Homo sapiens
uuagguauuaggaaauaugcuu

SEQ ID NO: 62707 - RNA, 22 nt, Homo sapiens
uuaggugcauggaaguguuuuc

SEQ ID NO: 62708 - RNA, 22 nt, Homo sapiens
uuaguaguagugcuguaauuuu

SEQ ID NO: 62709 - RNA, 22 nt, Homo sapiens
uuagugaaugcaccacuucuga

SEQ ID NO: 62710 - RNA, 22 nt, Homo sapiens
uuaucaaacccuaggagguggu

SEQ ID NO: 62711 - RNA, 22 nt, Homo sapiens
uuaucagcagcaugaaacugga

SEQ ID NO: 62712 - RNA, 22 nt, Homo sapiens
uuaucagcagugcgaaaacaga

SEQ ID NO: 62713 - RNA, 22 nt, Homo sapiens
uuaucauagugcaguuuucuga

SEQ ID NO: 62714 - RNA, 22 nt, Homo sapiens
uuauccugucaguaaauauuuu

SEQ ID NO: 62715 - RNA, 22 nt, Homo sapiens
uuaugaaguagguuaagagcag

SEQ ID NO: 62716 - RNA, 22 nt, Homo sapiens
uuaugcuguuuucuggagauuu

SEQ ID NO: 62717 - RNA, 22 nt, Homo sapiens
uuaugucauuuuuggauguuaa

SEQ ID NO: 62718 - RNA, 20 nt, Homo sapiens
uuaugucguuucuugcuuau

SEQ ID NO: 62719 - RNA, 22 nt, Homo sapiens
uuauuugguugcugacuuggaa

SEQ ID NO: 62720 - RNA, 23 nt, Homo sapiens
uucaaaggaugcuuuauggaauu

SEQ ID NO: 62721 - RNA, 22 nt, Homo sapiens
uucaaaggauuuagauuagcua

SEQ ID NO: 62722 - RNA, 22 nt, Homo sapiens
uucaaaguguugguuuugggcu

SEQ ID NO: 62723 - RNA, 22 nt, Homo sapiens
uucaaaucuuuggcucccacua

SEQ ID NO: 62724 - RNA, 22 nt, Homo sapiens
uucaaauguucuuucaccaccc

SEQ ID NO: 62725 - RNA, 22 nt, Homo sapiens
uucaacagugauggccuuugua

SEQ ID NO: 62726 - RNA, 22 nt, Homo sapiens
uucaacugcuucagccucccaa

SEQ ID NO: 62727 - RNA, 22 nt, Homo sapiens
uucaagaauuaaaguggcuuuu

SEQ ID NO: 62728 - RNA, 22 nt, Homo sapiens
uucaagcuauggugaucuuuuc

SEQ ID NO: 62729 - RNA, 22 nt, Homo sapiens
uucaagcugggcaaauaagggg

SEQ ID NO: 62730 - RNA, 22 nt, Homo sapiens
uucaaggacuaaggauuuuugg

SEQ ID NO: 62731 - RNA, 22 nt, Homo sapiens
uucaaguaguucucaugccuca

SEQ ID NO: 62732 - RNA, 22 nt, Homo sapiens
uucaauacuguugauccuuaug

SEQ ID NO: 62733 - RNA, 22 nt, Homo sapiens
uucacaauuaaaugugguuauu

SEQ ID NO: 62734 - RNA, 22 nt, Homo sapiens
uucacacuagccacucugguag

SEQ ID NO: 62735 - RNA, 22 nt, Homo sapiens
uucacagucacccuucuccaug

SEQ ID NO: 62736 - RNA, 20 nt, Homo sapiens
uucacugggcucucuguugg

SEQ ID NO: 62737 - RNA, 22 nt, Homo sapiens
uucacuguagccucagccucuu

SEQ ID NO: 62738 - RNA, 22 nt, Homo sapiens
uucagagugaggcucucggaac

SEQ ID NO: 62739 - RNA, 22 nt, Homo sapiens
uucagagugguaugaagugaug

SEQ ID NO: 62740 - RNA, 20 nt, Homo sapiens
uucagcaaaggaaugggagu

SEQ ID NO: 62741 - RNA, 22 nt, Homo sapiens
uucagcaggccaggcccugacu

SEQ ID NO: 62742 - RNA, 22 nt, Homo sapiens
uucagugucauuaacacaguag

SEQ ID NO: 62743 - RNA, 22 nt, Homo sapiens
uucauagaggacauuacuggag

SEQ ID NO: 62744 - RNA, 22 nt, Homo sapiens
uucauccccuccaaaucucaug

SEQ ID NO: 62745 - RNA, 21 nt, Homo sapiens
uucaucuggccguauuccagg

SEQ ID NO: 62746 - RNA, 22 nt, Homo sapiens
uucauggaauauugaccauuuu

SEQ ID NO: 62747 - RNA, 22 nt, Homo sapiens
uucauggacucaauaguuucgc

SEQ ID NO: 62748 - RNA, 22 nt, Homo sapiens
uucauggaguuuaaauuguagu

SEQ ID NO: 62749 - RNA, 22 nt, Homo sapiens
ucuuuuggguauggagccauca

SEQ ID NO: 62750 - RNA, 22 nt, Homo sapiens
ugaaacacacauugcccuuuau

SEQ ID NO: 62751 - RNA, 22 nt, Homo sapiens
ugaaagacacagaaguugccca

SEQ ID NO: 62752 - RNA, 22 nt, Homo sapiens
ugaaagcuacaggaaaguauuu

SEQ ID NO: 62753 - RNA, 22 nt, Homo sapiens
ugaaagguuuaauucugugaga

SEQ ID NO: 62754 - RNA, 22 nt, Homo sapiens
ugaaauacuuaauuucuccaug

SEQ ID NO: 62755 - RNA, 22 nt, Homo sapiens
ugaaaucuaaaauguuccaaga

SEQ ID NO: 62756 - RNA, 22 nt, Homo sapiens
ugaaaugcuaauucguagcuaa

SEQ ID NO: 62757 - RNA, 22 nt, Homo sapiens
ugaaauuuuuuauucguuggcu

SEQ ID NO: 62758 - RNA, 22 nt, Homo sapiens
ugaacacagccugccucugcca

SEQ ID NO: 62759 - RNA, 22 nt, Homo sapiens
ugaacagucaucucucuuguau

SEQ ID NO: 62760 - RNA, 22 nt, Homo sapiens
ugaagacauuuuugggugugua

SEQ ID NO: 62761 - RNA, 22 nt, Homo sapiens
ugaaggacauaaggcagaguga

SEQ ID NO: 62762 - RNA, 22 nt, Homo sapiens
ugaagugaaugguaaguaugcc

SEQ ID NO: 62763 - RNA, 22 nt, Homo sapiens
ugaaugguuuuuagagaacaau

SEQ ID NO: 62764 - RNA, 22 nt, Homo sapiens
ugacaagcucccucugcaccuu

SEQ ID NO: 62765 - RNA, 22 nt, Homo sapiens
ugacacagugggggauccuuuu

SEQ ID NO: 62766 - RNA, 22 nt, Homo sapiens
ugacagcugaggcccagaguac

SEQ ID NO: 62767 - RNA, 22 nt, Homo sapiens
ugacaggucuaauuuacugaca

SEQ ID NO: 62768 - RNA, 22 nt, Homo sapiens
ugacagucaccaggacccacag

SEQ ID NO: 62769 - RNA, 23 nt, Homo sapiens
ugacagucucccgauggcuaggc

SEQ ID NO: 62770 - RNA, 22 nt, Homo sapiens
ugacaugaagucucccucuguu

SEQ ID NO: 62771 - RNA, 22 nt, Homo sapiens
ugacauggugcucuuucaggca

SEQ ID NO: 62772 - RNA, 22 nt, Homo sapiens
ugacauguugcauuauauuucc

SEQ ID NO: 62773 - RNA, 21 nt, Homo sapiens
ugacauguugguuugcugcac

SEQ ID NO: 62774 - RNA, 21 nt, Homo sapiens
ugacauuauuucaugucagua

SEQ ID NO: 62775 - RNA, 22 nt, Homo sapiens
ugacccuguggcagcgucuaag

SEQ ID NO: 62776 - RNA, 22 nt, Homo sapiens
ugaccuguuugaaauugccaau

SEQ ID NO: 62777 - RNA, 22 nt, Homo sapiens
ugacuacagauuugcugccaga

SEQ ID NO: 62778 - RNA, 22 nt, Homo sapiens
ugacuaggaggcuggaggauga

SEQ ID NO: 62779 - RNA, 22 nt, Homo sapiens
ugacuagggcucuaaacagcuc

SEQ ID NO: 62780 - RNA, 22 nt, Homo sapiens
ugacugguguuuaaugagucaa

SEQ ID NO: 62781 - RNA, 18 nt, Homo sapiens
ugacuguccagguggacc

SEQ ID NO: 62782 - RNA, 22 nt, Homo sapiens
ugacugugcagcuccaucaggg

SEQ ID NO: 62783 - RNA, 22 nt, Homo sapiens
ugacuugaaguuaccauaugca

SEQ ID NO: 62784 - RNA, 23 nt, Homo sapiens
ugacuuguccagugauaguucgu

SEQ ID NO: 62785 - RNA, 22 nt, Homo sapiens
ugagaauauuuuccaugucuca

SEQ ID NO: 62786 - RNA, 22 nt, Homo sapiens
ugagaauguagggcucucccag

SEQ ID NO: 62787 - RNA, 22 nt, Homo sapiens
ugagacaugugaacuguaguuc

SEQ ID NO: 62788 - RNA, 22 nt, Homo sapiens
ugagaccuuucauuucucagug

SEQ ID NO: 62789 - RNA, 22 nt, Homo sapiens
ugagacggagucucgcucucua

SEQ ID NO: 62790 - RNA, 22 nt, Homo sapiens
ugagacggagucuugcccuguc

SEQ ID NO: 62791 - RNA, 22 nt, Homo sapiens
ugagacggaguuuugcucuugu

SEQ ID NO: 62792 - RNA, 22 nt, Homo sapiens
ugagagaugaacucugauaugu

SEQ ID NO: 62793 - RNA, 22 nt, Homo sapiens
ugagauaaagcauguacugugu

SEQ ID NO: 62794 - RNA, 22 nt, Homo sapiens
ugagaucaacugagucagagca

SEQ ID NO: 62795 - RNA, 22 nt, Homo sapiens
ugagaucagaaggauuucucug

SEQ ID NO: 62796 - RNA, 22 nt, Homo sapiens
ugagaucgaguuucgcucuugu

SEQ ID NO: 62797 - RNA, 22 nt, Homo sapiens
ugagaugaucaaaguauaggcu

SEQ ID NO: 62798 - RNA, 21 nt, Homo sapiens
ugagaugcaaucaccagggag

SEQ ID NO: 62799 - RNA, 22 nt, Homo sapiens
ugagauggaguuucgcucuugu

SEQ ID NO: 62800 - RNA, 22 nt, Homo sapiens
ugagaugguaaauuuuuguugu

SEQ ID NO: 62801 - RNA, 22 nt, Homo sapiens
ugagauuaaucuuuaaguaaga

SEQ ID NO: 62802 - RNA, 22 nt, Homo sapiens
ugagauuacguucggcccacuu

SEQ ID NO: 62803 - RNA, 22 nt, Homo sapiens
ugagcacagagccugggguggc

SEQ ID NO: 62804 - RNA, 22 nt, Homo sapiens
ugagcacaggugcgcgguuacu

SEQ ID NO: 62805 - RNA, 22 nt, Homo sapiens
ugagcagaaguuuugauuggcg

SEQ ID NO: 62806 - RNA, 22 nt, Homo sapiens
ugagcccauuguccugguuuau

SEQ ID NO: 62807 - RNA, 22 nt, Homo sapiens
ugagcuagggccuggaauaggg

SEQ ID NO: 62808 - RNA, 22 nt, Homo sapiens
ugagcugagaucuuaccacugc

SEQ ID NO: 62809 - RNA, 22 nt, Homo sapiens
ugaggcaaggcugaaugaaggc

SEQ ID NO: 62810 - RNA, 22 nt, Homo sapiens
ugaggcacucccuagcggggug

SEQ ID NO: 62811 - RNA, 22 nt, Homo sapiens
ugaggcuaggauaggcugauuc

SEQ ID NO: 62812 - RNA, 22 nt, Homo sapiens
ugaggguauagccagcccuuag

SEQ ID NO: 62813 - RNA, 22 nt, Homo sapiens
ugagguauuuuguuaugcagcc

SEQ ID NO: 62814 - RNA, 22 nt, Homo sapiens
ugaggucauguucugucagguu

SEQ ID NO: 62815 - RNA, 20 nt, Homo sapiens
ugaggucugagaaagaauga

SEQ ID NO: 62816 - RNA, 22 nt, Homo sapiens
ugaguagucagugggcaggaag

SEQ ID NO: 62817 - RNA, 22 nt, Homo sapiens
ugagugaacgcugagaccaaau

SEQ ID NO: 62818 - RNA, 22 nt, Homo sapiens
ugagugaaugugaaggcuaggg

SEQ ID NO: 62819 - RNA, 22 nt, Homo sapiens
ugaguguccaaguaaggugaaa

SEQ ID NO: 62820 - RNA, 22 nt, Homo sapiens
ugauaacauugggggaagcuga

SEQ ID NO: 62821 - RNA, 22 nt, Homo sapiens
ugauaugaaguucaaaccaggu

SEQ ID NO: 62822 - RNA, 22 nt, Homo sapiens
ugauauguguaaacaauguaua

SEQ ID NO: 62823 - RNA, 22 nt, Homo sapiens
ugaucaaagugcuggaauuaca

SEQ ID NO: 62824 - RNA, 22 nt, Homo sapiens
ugaugacccugcaguucucaag

SEQ ID NO: 62825 - RNA, 20 nt, Homo sapiens
ugaugcaaaucuuuaaaagu

SEQ ID NO: 62826 - RNA, 22 nt, Homo sapiens
ugaugguccauaguucauggua

SEQ ID NO: 62827 - RNA, 22 nt, Homo sapiens
ugauuuguccauguggcacgug

SEQ ID NO: 62828 - RNA, 18 nt, Homo sapiens
ugcaaacauguguguguu

SEQ ID NO: 62829 - RNA, 22 nt, Homo sapiens
ugcaaagucgaaacugcaguuu

SEQ ID NO: 62830 - RNA, 22 nt, Homo sapiens
ugcaaaugcugcuauuucucuu

SEQ ID NO: 62831 - RNA, 22 nt, Homo sapiens
ugcaaauguuauuuugguuucu

SEQ ID NO: 62832 - RNA, 22 nt, Homo sapiens
ugcaagaaacauauuccacaag

SEQ ID NO: 62833 - RNA, 22 nt, Homo sapiens
uguccauuuuuaugcuuauggu

SEQ ID NO: 62834 - RNA, 22 nt, Homo sapiens
ugucccguuuucgaggcugcag

SEQ ID NO: 62835 - RNA, 22 nt, Homo sapiens
ugucccugagccuggauuccug

SEQ ID NO: 62836 - RNA, 22 nt, Homo sapiens
ugucuaaagaauggcagacuca

SEQ ID NO: 62837 - RNA, 22 nt, Homo sapiens
ugucuagaaaagccugccuucu

SEQ ID NO: 62838 - RNA, 22 nt, Homo sapiens
ugucuuguagacugaaggcuuc

SEQ ID NO: 62839 - RNA, 22 nt, Homo sapiens
ugugaaaucagauagccuuuuu

SEQ ID NO: 62840 - RNA, 22 nt, Homo sapiens
ccagcaccauuuauuaaauagg

SEQ ID NO: 62841 - RNA, 22 nt, Homo sapiens
ccagugucugacagacacggcg

SEQ ID NO: 62842 - RNA, 19 nt, Homo sapiens
ccauggcaaugaucugaug

SEQ ID NO: 62843 - RNA, 22 nt, Homo sapiens
ccauggcaauggucagucuauu

SEQ ID NO: 62844 - RNA, 22 nt, Homo sapiens
ccauggcuucugcauucuguca

SEQ ID NO: 62845 - RNA, 22 nt, Homo sapiens
ccauuucacucuuccugaagga

SEQ ID NO: 62846 - RNA, 22 nt, Homo sapiens
cccagaguucuuaaauacugag

SEQ ID NO: 62847 - RNA, 22 nt, Homo sapiens
cccagugugcugggugacagcu

SEQ ID NO: 62848 - RNA, 22 nt, Homo sapiens
cccauuguuaaguugaguaucu

SEQ ID NO: 62849 - RNA, 20 nt, Homo sapiens
ccccaguuuuucuauuagcu

SEQ ID NO: 62850 - RNA, 17 nt, Homo sapiens
cccuaguagcugggacu

SEQ ID NO: 62851 - RNA, 23 nt, Homo sapiens
cccucagaagugcagggagagaa

SEQ ID NO: 62852 - RNA, 22 nt, Homo sapiens
cccugaagauacagaguuuggg

SEQ ID NO: 62853 - RNA, 22 nt, Homo sapiens
cccugagagcagggucuuucuc

SEQ ID NO: 62854 - RNA, 22 nt, Homo sapiens
ccucauugcuaucccaggcuga

SEQ ID NO: 62855 - RNA, 22 nt, Homo sapiens
ccugagacugauugacucacaa

SEQ ID NO: 62856 - RNA, 22 nt, Homo sapiens
ccugaugacacgggagauguac

SEQ ID NO: 62857 - RNA, 22 nt, Homo sapiens
ccugcauaguucaccgcugaua

SEQ ID NO: 62858 - RNA, 22 nt, Homo sapiens
ccuggaaugaagcuuauauugc

SEQ ID NO: 62859 - RNA, 22 nt, Homo sapiens
ccuggaucauugucauucccaa

SEQ ID NO: 62860 - RNA, 22 nt, Homo sapiens
ccuggcaagagacugaagauag

SEQ ID NO: 62861 - RNA, 22 nt, Homo sapiens
ccuguagcauccaagaagcugc

SEQ ID NO: 62862 - RNA, 22 nt, Homo sapiens
ccuucacaggcacugguucaga

SEQ ID NO: 62863 - RNA, 22 nt, Homo sapiens
ccuucauugcaucuuuaagaga

SEQ ID NO: 62864 - RNA, 22 nt, Homo sapiens
ccuuggcacuuugccacagugc

SEQ ID NO: 62865 - RNA, 22 nt, Homo sapiens
ccuuuuugaguugccagaguuc

SEQ ID NO: 62866 - RNA, 21 nt, Homo sapiens
cgucauggagauguguuguac

SEQ ID NO: 62867 - RNA, 22 nt, Homo sapiens
cuaaaguagccaggacugcagg

SEQ ID NO: 62868 - RNA, 22 nt, Homo sapiens
cuaacacagagguuuauuucuc

SEQ ID NO: 62869 - RNA, 22 nt, Homo sapiens
cuaaggaaggacugaaaggaca

SEQ ID NO: 62870 - RNA, 22 nt, Homo sapiens
cuacagguaugaaagggaguau

SEQ ID NO: 62871 - RNA, 22 nt, Homo sapiens
cuacaguuauguuuuaaaugug

SEQ ID NO: 62872 - RNA, 22 nt, Homo sapiens
cuacauuguagguauucaaacu

SEQ ID NO: 62873 - RNA, 22 nt, Homo sapiens
cuagcacauuuaucuuuauaca

SEQ ID NO: 62874 - RNA, 22 nt, Homo sapiens
cuagccuggagugcaguggugc

SEQ ID NO: 62875 - RNA, 18 nt, Homo sapiens
cuaguguuucuugaauca

SEQ ID NO: 62876 - RNA, 22 nt, Homo sapiens
cuaugguuucuccauaucauca

SEQ ID NO: 62877 - RNA, 19 nt, Homo sapiens
cuauugcacauagcugaag

SEQ ID NO: 62878 - RNA, 21 nt, Homo sapiens
cucaaaguacugauauuacag

SEQ ID NO: 62879 - RNA, 22 nt, Homo sapiens
cucaaagucaagggaaagcagg

SEQ ID NO: 62880 - RNA, 22 nt, Homo sapiens
cucaaagugcugggacuggcug

SEQ ID NO: 62881 - RNA, 22 nt, Homo sapiens
cucaaagugcugggauuggcca

SEQ ID NO: 62882 - RNA, 20 nt, Homo sapiens
cucacagacagcuucuuucu

SEQ ID NO: 62883 - RNA, 22 nt, Homo sapiens
cucacagucagaagggacuugc

SEQ ID NO: 62884 - RNA, 22 nt, Homo sapiens
cucacggcccugcgcacuggca

SEQ ID NO: 62885 - RNA, 22 nt, Homo sapiens
cucacugugguguccuuaggua

SEQ ID NO: 62886 - RNA, 22 nt, Homo sapiens
cucagcuacuugggaagcugag

SEQ ID NO: 62887 - RNA, 22 nt, Homo sapiens
cucaggguacuucuccuuugcu

SEQ ID NO: 62888 - RNA, 22 nt, Homo sapiens
cucaguagaaaauacauggacu

SEQ ID NO: 62889 - RNA, 21 nt, Homo sapiens
cucauauugcuuuuccauggu

SEQ ID NO: 62890 - RNA, 22 nt, Homo sapiens
cucauggaauacuucacagcca

SEQ ID NO: 62891 - RNA, 22 nt, Homo sapiens
cucauggagaacaucugcuagg

SEQ ID NO: 62892 - RNA, 22 nt, Homo sapiens
cucauggagauagagaauagaa

SEQ ID NO: 62893 - RNA, 22 nt, Homo sapiens
cucauuaguuguuuuaagauga

SEQ ID NO: 62894 - RNA, 22 nt, Homo sapiens
cucauugcaaucuccaccuccc

SEQ ID NO: 62895 - RNA, 22 nt, Homo sapiens
cucauuggcuacugaggcuugu

SEQ ID NO: 62896 - RNA, 22 nt, Homo sapiens
cuccaggugucauccaccuccu

SEQ ID NO: 62897 - RNA, 22 nt, Homo sapiens
cuccagugcaaagucaugauca

SEQ ID NO: 62898 - RNA, 22 nt, Homo sapiens
cuccauuuaguccuuuuagaag

SEQ ID NO: 62899 - RNA, 22 nt, Homo sapiens
cuccauuuaucugaaauuuuau

SEQ ID NO: 62900 - RNA, 22 nt, Homo sapiens
cucccagugacccaggaacagg

SEQ ID NO: 62901 - RNA, 20 nt, Homo sapiens
cucccugacaaauguggaaa

SEQ ID NO: 62902 - RNA, 22 nt, Homo sapiens
cucgcuccauuucggugaucaa

SEQ ID NO: 62903 - RNA, 22 nt, Homo sapiens
cucucugagccccagacaccuu

SEQ ID NO: 62904 - RNA, 22 nt, Homo sapiens
cucuuagauuagccauccuaau

SEQ ID NO: 62905 - RNA, 22 nt, Homo sapiens
cucuuugcuucuggcaucauug

SEQ ID NO: 62906 - RNA, 22 nt, Homo sapiens
cugaaauggaaugugugcacag

SEQ ID NO: 62907 - RNA, 22 nt, Homo sapiens
cugacaagauucaucacucagu

SEQ ID NO: 62908 - RNA, 22 nt, Homo sapiens
cugacaugcagccacugcaccu

SEQ ID NO: 62909 - RNA, 22 nt, Homo sapiens
cugacuaguuuuaaugcagauu

SEQ ID NO: 62910 - RNA, 22 nt, Homo sapiens
cugagaauguaaaugaagcuuu

SEQ ID NO: 62911 - RNA, 22 nt, Homo sapiens
cugagauaggacucugcuggcu

SEQ ID NO: 62912 - RNA, 22 nt, Homo sapiens
cugagaucaugggucagguggu

SEQ ID NO: 62913 - RNA, 22 nt, Homo sapiens
cugagaucguggggcugcuguc

SEQ ID NO: 62914 - RNA, 22 nt, Homo sapiens
cugagaucugaaccaggagugu

SEQ ID NO: 62915 - RNA, 22 nt, Homo sapiens
cugagaucuuauuagaaaugca

SEQ ID NO: 62916 - RNA, 22 nt, Homo sapiens
cugagcaaaguucuauuuaugg

SEQ ID NO: 62917 - RNA, 22 nt, Homo sapiens
cugagcaagucauuuuguuaaa

SEQ ID NO: 62918 - RNA, 22 nt, Homo sapiens
cugaggacaucagggaagcauc

SEQ ID NO: 62919 - RNA, 22 nt, Homo sapiens
cugagguaggugaucagugcuu

SEQ ID NO: 62920 - RNA, 22 nt, Homo sapiens
cugagguuaggaguuugagacc

SEQ ID NO: 62921 - RNA, 20 nt, Homo sapiens
cugagguugggguccuuccc

SEQ ID NO: 62922 - RNA, 22 nt, Homo sapiens
cugaguauuugaggccgaagga

SEQ ID NO: 62923 - RNA, 18 nt, Homo sapiens
cugagucauuccuggguc

SEQ ID NO: 62924 - RNA, 22 nt, Homo sapiens
cugaucuguagcagccaccaca

SEQ ID NO: 62925 - RNA, 22 nt, Homo sapiens
cugauugucaucaauauuauua

SEQ ID NO: 62926 - RNA, 19 nt, Homo sapiens
cugcaagguaauaggucag

SEQ ID NO: 62927 - RNA, 21 nt, Homo sapiens
cugcauccauuucugagugau

SEQ ID NO: 62928 - RNA, 19 nt, Homo sapiens
cugcaugagacaguugguu

SEQ ID NO: 62929 - RNA, 18 nt, Homo sapiens
cugccagugugcucuccg

SEQ ID NO: 62930 - RNA, 22 nt, Homo sapiens
cugccuaaagaaaaagacguug

SEQ ID NO: 62931 - RNA, 20 nt, Homo sapiens
cugcuccccuacaaaucuca

SEQ ID NO: 62932 - RNA, 22 nt, Homo sapiens
cuggacaaaucuggaaagaacc

SEQ ID NO: 62933 - RNA, 22 nt, Homo sapiens
cuggaguaugaaccauguauca

SEQ ID NO: 62934 - RNA, 18 nt, Homo sapiens
cuggaugucgaguguguu

SEQ ID NO: 62935 - RNA, 22 nt, Homo sapiens
cuggcaucuaaauacuugaugu

SEQ ID NO: 62936 - RNA, 22 nt, Homo sapiens
cuggcugagugguaaguagagg

SEQ ID NO: 62937 - RNA, 22 nt, Homo sapiens
cuggguacccuuuaaacaggaa

SEQ ID NO: 62938 - RNA, 22 nt, Homo sapiens
cugguaugcuucauaugcaaac

SEQ ID NO: 62939 - RNA, 22 nt, Homo sapiens
cuguaaaguucucauuguagcc

SEQ ID NO: 62940 - RNA, 19 nt, Homo sapiens
cugugcauuucuguggaag

SEQ ID NO: 62941 - RNA, 22 nt, Homo sapiens
cugugcuugauuauaugagugu

SEQ ID NO: 62942 - RNA, 22 nt, Homo sapiens
cuguguaguacuagauugagca

SEQ ID NO: 62943 - RNA, 22 nt, Homo sapiens
cuguuugguaaggaugccucag

SEQ ID NO: 62944 - RNA, 22 nt, Homo sapiens
cuuagcaaugucguguacucac

SEQ ID NO: 62945 - RNA, 22 nt, Homo sapiens
cuuagguuaugauaaauuuagu

SEQ ID NO: 62946 - RNA, 22 nt, Homo sapiens
cuugcagaggcccuggggagag

SEQ ID NO: 62947 - RNA, 22 nt, Homo sapiens
cuuggcuuguuguccccugcuc

SEQ ID NO: 62948 - RNA, 22 nt, Homo sapiens
cuuguucuccuaagaugaaugc

SEQ ID NO: 62949 - RNA, 22 nt, Homo sapiens
cuuuaguuaaaauugggguugu

SEQ ID NO: 62950 - RNA, 22 nt, Homo sapiens
cuuuccauuguuggagcauaaa

SEQ ID NO: 62951 - RNA, 22 nt, Homo sapiens
cuuugaugagaaaauacuuugu

SEQ ID NO: 62952 - RNA, 22 nt, Homo sapiens
cuuuggagaaaaguucuugggc

SEQ ID NO: 62953 - RNA, 22 nt, Homo sapiens
cuuuggcauuagccuguauaga

SEQ ID NO: 62954 - RNA, 23 nt, Homo sapiens
cuuuggucucugguugacuucag

SEQ ID NO: 62955 - RNA, 20 nt, Homo sapiens
cuuuguccuccugcugugcu

SEQ ID NO: 62956 - RNA, 22 nt, Homo sapiens
cuuuuacacugcuggugggaau

SEQ ID NO: 62957 - RNA, 22 nt, Homo sapiens
gaaagcugguauagauacauua

SEQ ID NO: 62958 - RNA, 23 nt, Homo sapiens
gaaaugucuuagugaaauugcuu

SEQ ID NO: 62959 - RNA, 22 nt, Homo sapiens
gaaauguugauagugggcauug

SEQ ID NO: 62960 - RNA, 22 nt, Homo sapiens
gaacacaucuuugguuagagga

SEQ ID NO: 62961 - RNA, 22 nt, Homo sapiens
gaacuuucuacauuaccucuuu

SEQ ID NO: 62962 - RNA, 22 nt, Homo sapiens
gaaguaggugcuguuauuaucu

SEQ ID NO: 62963 - RNA, 22 nt, Homo sapiens
gaagugcaguggcacagucaug

SEQ ID NO: 62964 - RNA, 19 nt, Homo sapiens
gaaguguuuguucuccaug

SEQ ID NO: 62965 - RNA, 22 nt, Homo sapiens
gaaucauuggguugauucaaga

SEQ ID NO: 62966 - RNA, 22 nt, Homo sapiens
gaaugauacuguuaacgaaaga

SEQ ID NO: 62967 - RNA, 22 nt, Homo sapiens
gaaugcagcagugacagggcug

SEQ ID NO: 62968 - RNA, 20 nt, Homo sapiens
gaaugguuucgggguucuug

SEQ ID NO: 62969 - RNA, 22 nt, Homo sapiens
gacaguguggcgauuccucaag

SEQ ID NO: 62970 - RNA, 20 nt, Homo sapiens
gacauguugguuugcugcac

SEQ ID NO: 62971 - RNA, 22 nt, Homo sapiens
gacauguuuucaagauuuauaa

SEQ ID NO: 62972 - RNA, 22 nt, Homo sapiens
gaccaaagaggcaggcauuaga

SEQ ID NO: 62973 - RNA, 22 nt, Homo sapiens
gacuucaucauacuaugugugg

SEQ ID NO: 62974 - RNA, 22 nt, Homo sapiens
gagaacagagauaauuuuacuu

SEQ ID NO: 62975 - RNA, 22 nt, Homo sapiens
gagaacauuuaagccacucagg

SEQ ID NO: 62976 - RNA, 23 nt, Homo sapiens
gagaccagcuucagaaagcacga

SEQ ID NO: 62977 - RNA, 22 nt, Homo sapiens
gagacggagucacgcccuguca

SEQ ID NO: 62978 - RNA, 22 nt, Homo sapiens
gagacugagucucacucuguca

SEQ ID NO: 62979 - RNA, 22 nt, Homo sapiens
gagacugaguuuugcucuuguu

SEQ ID NO: 62980 - RNA, 22 nt, Homo sapiens
gagauaaauaggucacaguucu

SEQ ID NO: 62981 - RNA, 21 nt, Homo sapiens
gagauagguaccgaagcuuag

SEQ ID NO: 62982 - RNA, 22 nt, Homo sapiens
gagauggagacuuggccuuaaa

SEQ ID NO: 62983 - RNA, 22 nt, Homo sapiens
gagauggagucuuuuucuguca

SEQ ID NO: 62984 - RNA, 22 nt, Homo sapiens
gagauggaguuucacuucgcuc

SEQ ID NO: 62985 - RNA, 22 nt, Homo sapiens
gagauuaauacacaucaaaugc

SEQ ID NO: 62986 - RNA, 22 nt, Homo sapiens
gagcaaaaguauguauugguua

SEQ ID NO: 62987 - RNA, 22 nt, Homo sapiens
gagcaacaguggcagugguggg

SEQ ID NO: 62988 - RNA, 22 nt, Homo sapiens
gagcaaugagcugccugcugag

SEQ ID NO: 62989 - RNA, 22 nt, Homo sapiens
gagcagacaugaggaccgcugg

SEQ ID NO: 62990 - RNA, 22 nt, Homo sapiens
gagccuguaggaggagaggugg

SEQ ID NO: 62991 - RNA, 22 nt, Homo sapiens
gagcucauuaaaguaggaccua

SEQ ID NO: 62992 - RNA, 22 nt, Homo sapiens
gagcuguuuuucacuagaccaa

SEQ ID NO: 62993 - RNA, 22 nt, Homo sapiens
gagcuuguagugugaaugguau

SEQ ID NO: 62994 - RNA, 22 nt, Homo sapiens
gagcuuguggucuucguguuau

SEQ ID NO: 62995 - RNA, 22 nt, Homo sapiens
gaggaaguagcuacugucuuuc

SEQ ID NO: 62996 - RNA, 22 nt, Homo sapiens
gaggaaguuuacaaagcaucug

SEQ ID NO: 62997 - RNA, 22 nt, Homo sapiens
gaggagauauucugcuggaugg

SEQ ID NO: 62998 - RNA, 22 nt, Homo sapiens
gaggaucucuugagcccagaag

SEQ ID NO: 62999 - RNA, 22 nt, Homo sapiens
aaaagcauucagagugcugggc

SEQ ID NO: 63000 - RNA, 22 nt, Homo sapiens
aaaagcuuagaugggcuuguau

SEQ ID NO: 63001 - RNA, 22 nt, Homo sapiens
aaaaggcuagcuaguaacagaa

SEQ ID NO: 63002 - RNA, 22 nt, Homo sapiens
aaaaugcugauauugggcccca

SEQ ID NO: 63003 - RNA, 22 nt, Homo sapiens
aaacccauauaccagcugugcu

SEQ ID NO: 63004 - RNA, 22 nt, Homo sapiens
aaagcuaagguagcauuggaga

SEQ ID NO: 63005 - RNA, 22 nt, Homo sapiens
aaagcuaccagauucuguugga

SEQ ID NO: 63006 - RNA, 22 nt, Homo sapiens
aaaggcacugaucuuauccagu

SEQ ID NO: 63007 - RNA, 22 nt, Homo sapiens
aaaggcuucggaucagaaggua

SEQ ID NO: 63008 - RNA, 22 nt, Homo sapiens
aaagggcuugaauacucuuuuu

SEQ ID NO: 63009 - RNA, 17 nt, Homo sapiens
aaaguccuuugcuaucu

SEQ ID NO: 63010 - RNA, 22 nt, Homo sapiens
aaagugauguccaggcuuucag

SEQ ID NO: 63011 - RNA, 22 nt, Homo sapiens
aaagugauugcgguuuuugcca

SEQ ID NO: 63012 - RNA, 22 nt, Homo sapiens
aaagugauuguaguuuuugcca

SEQ ID NO: 63013 - RNA, 22 nt, Homo sapiens
aaagugcugggaucacacugaa

SEQ ID NO: 63014 - RNA, 22 nt, Homo sapiens
aaaguucuugcugaaggauuau

SEQ ID NO: 63015 - RNA, 22 nt, Homo sapiens
aaaugacuuuuuaugcagagua

SEQ ID NO: 63016 - RNA, 22 nt, Homo sapiens
aaaugcaccacucuggugcagg

SEQ ID NO: 63017 - RNA, 22 nt, Homo sapiens
aaaugcuguuccaggaccuauc

SEQ ID NO: 63018 - RNA, 22 nt, Homo sapiens
aaauggcacaguaagggcauuu

SEQ ID NO: 63019 - RNA, 22 nt, Homo sapiens
aaauugcaguuaggaugauggu

SEQ ID NO: 63020 - RNA, 23 nt, Homo sapiens
aaauuugccuauuauuccuaugg

SEQ ID NO: 63021 - RNA, 22 nt, Homo sapiens
aacagagcuggugacuccaggu

SEQ ID NO: 63022 - RNA, 22 nt, Homo sapiens
aacagucuccaguuguauccau

SEQ ID NO: 63023 - RNA, 22 nt, Homo sapiens
aacauugaacuuggcacaccca

SEQ ID NO: 63024 - RNA, 22 nt, Homo sapiens
aaccacauggcucaguggacau

SEQ ID NO: 63025 - RNA, 22 nt, Homo sapiens
aaccugaagaaaauauuugcug

SEQ ID NO: 63026 - RNA, 22 nt, Homo sapiens
aacugguauugaauuuaggaag

SEQ ID NO: 63027 - RNA, 22 nt, Homo sapiens
aagacuguaauccaucuugagu

SEQ ID NO: 63028 - RNA, 22 nt, Homo sapiens
aagagagcuaugugcauaauua

SEQ ID NO: 63029 - RNA, 22 nt, Homo sapiens
aagccacuguaccugucucuua

SEQ ID NO: 63030 - RNA, 22 nt, Homo sapiens
aaggaaguaauuugguuuauag

SEQ ID NO: 63031 - RNA, 22 nt, Homo sapiens
aaggaguagaggaauagcaaug

SEQ ID NO: 63032 - RNA, 22 nt, Homo sapiens
aaggcaagagaaaauuucgagu

SEQ ID NO: 63033 - RNA, 22 nt, Homo sapiens
aaggcaagauacugguugcuga

SEQ ID NO: 63034 - RNA, 22 nt, Homo sapiens
aaggcaugcaaagaacauuuua

SEQ ID NO: 63035 - RNA, 22 nt, Homo sapiens
aagggaauguuguggcugguuu

SEQ ID NO: 63036 - RNA, 22 nt, Homo sapiens
aagggaauguugugguugguuu

SEQ ID NO: 63037 - RNA, 22 nt, Homo sapiens
aagguauuuuugucuauaucuu

SEQ ID NO: 63038 - RNA, 22 nt, Homo sapiens
aaggucauugugguuuuugcca

SEQ ID NO: 63039 - RNA, 22 nt, Homo sapiens
aaguaaacauuuuguacaauaa

SEQ ID NO: 63040 - RNA, 22 nt, Homo sapiens
aaguacuguuuaaauugcagaa

SEQ ID NO: 63041 - RNA, 19 nt, Homo sapiens
aaguaguugugacagaugc

SEQ ID NO: 63042 - RNA, 22 nt, Homo sapiens
aaguaucaggaauaguuauugg

SEQ ID NO: 63043 - RNA, 22 nt, Homo sapiens
aaguauuaugaguccuuguuuu

SEQ ID NO: 63044 - RNA, 22 nt, Homo sapiens
aagugacauugugcccauuuga

SEQ ID NO: 63045 - RNA, 22 nt, Homo sapiens
aagugagugacaaaaacugggc

SEQ ID NO: 63046 - RNA, 22 nt, Homo sapiens
aagugcuuaggauagugugugg

SEQ ID NO: 63047 - RNA, 22 nt, Homo sapiens
aaguggcauugaggaaaaaaau

SEQ ID NO: 63048 - RNA, 22 nt, Homo sapiens
aagugguguuugggagcuggac

SEQ ID NO: 63049 - RNA, 22 nt, Homo sapiens
aauaaagcagcuuuuugggacu

SEQ ID NO: 63050 - RNA, 21 nt, Homo sapiens
aauacucuagguuaagagagc

SEQ ID NO: 63051 - RNA, 22 nt, Homo sapiens
aauagcuguuuuuaauuccugc

SEQ ID NO: 63052 - RNA, 22 nt, Homo sapiens
aauauagcuauguacaugucca

SEQ ID NO: 63053 - RNA, 21 nt, Homo sapiens
aaucacaguuguucugccuuc

SEQ ID NO: 63054 - RNA, 22 nt, Homo sapiens
aaucagcacacugugcuuucca

SEQ ID NO: 63055 - RNA, 22 nt, Homo sapiens
aaucucaacacuuugggaggcu

SEQ ID NO: 63056 - RNA, 22 nt, Homo sapiens
aaugcacauauauuuccuuauu

SEQ ID NO: 63057 - RNA, 22 nt, Homo sapiens
aaugcuaucuggaacauuguug

SEQ ID NO: 63058 - RNA, 22 nt, Homo sapiens
aauggcacuuuauaaauguuaa

SEQ ID NO: 63059 - RNA, 22 nt, Homo sapiens
aauggcaucuacguuaaauguc

SEQ ID NO: 63060 - RNA, 22 nt, Homo sapiens
aaugugcuguucagaggagucc

SEQ ID NO: 63061 - RNA, 22 nt, Homo sapiens
aauugcauaugcaguagaucua

SEQ ID NO: 63062 - RNA, 22 nt, Homo sapiens
aauugcuuuuauuuagggccag

SEQ ID NO: 63063 - RNA, 22 nt, Homo sapiens
acaaagugccuccuuuuagagu

SEQ ID NO: 63064 - RNA, 22 nt, Homo sapiens
acaccaugucuguuucugguuu

SEQ ID NO: 63065 - RNA, 22 nt, Homo sapiens
acacuguaacucuuugagggca

SEQ ID NO: 63066 - RNA, 22 nt, Homo sapiens
acacuguagcugagggcaugcg

SEQ ID NO: 63067 - RNA, 22 nt, Homo sapiens
acacuguuuuguggagaaugua

SEQ ID NO: 63068 - RNA, 22 nt, Homo sapiens
acagcagugccccacucuacug

SEQ ID NO: 63069 - RNA, 22 nt, Homo sapiens
acagguacaagggauuaggaug

SEQ ID NO: 63070 - RNA, 22 nt, Homo sapiens
acaguacuguuguuugcugcca

SEQ ID NO: 63071 - RNA, 22 nt, Homo sapiens
acagugcuucugauaugaugcc

SEQ ID NO: 63072 - RNA, 23 nt, Homo sapiens
acaguggugugaucuuggcucag

SEQ ID NO: 63073 - RNA, 22 nt, Homo sapiens
acagugucaugucguguucccc

SEQ ID NO: 63074 - RNA, 17 nt, Homo sapiens
acagugucuaugaaaug

SEQ ID NO: 63075 - RNA, 22 nt, Homo sapiens
acaguguguguguucaccuaga

SEQ ID NO: 63076 - RNA, 22 nt, Homo sapiens
acauaugaguacaugugccaug

SEQ ID NO: 63077 - RNA, 22 nt, Homo sapiens
acauggcuuaugaauuuggaga

SEQ ID NO: 63078 - RNA, 22 nt, Homo sapiens
acaugguacugauuuacgaaau

SEQ ID NO: 63079 - RNA, 23 nt, Homo sapiens
acauguauagacuuuuuuuccuu

SEQ ID NO: 63080 - RNA, 22 nt, Homo sapiens
acauugcagauguguuuaaugu

SEQ ID NO: 63081 - RNA, 17 nt, Homo sapiens
accagugcaugugcuuu

SEQ ID NO: 63082 - RNA, 22 nt, Homo sapiens
accaguuuuuuauacaucuucu

SEQ ID NO: 63083 - RNA, 22 nt, Homo sapiens
acccagaagucauucaggaaca

SEQ ID NO: 63084 - RNA, 22 nt, Homo sapiens
acccagaguuccuugucuuuca

SEQ ID NO: 63085 - RNA, 22 nt, Homo sapiens
acccaguagucauucaggagca

SEQ ID NO: 63086 - RNA, 22 nt, Homo sapiens
acccugacacgauucuucacuu

SEQ ID NO: 63087 - RNA, 22 nt, Homo sapiens
acccuguaggacuauucuaauc

SEQ ID NO: 63088 - RNA, 22 nt, Homo sapiens
acccugucacucccaucaauuu

SEQ ID NO: 63089 - RNA, 22 nt, Homo sapiens
acccuuaagcacuaguucagcu

SEQ ID NO: 63090 - RNA, 22 nt, Homo sapiens
accuggguguauguucaguuug

SEQ ID NO: 63091 - RNA, 22 nt, Homo sapiens
acuaaggcacaauuuucucaua

SEQ ID NO: 63092 - RNA, 22 nt, Homo sapiens
acuacuucuaaguuuuggaaga

SEQ ID NO: 63093 - RNA, 22 nt, Homo sapiens
acucacagcaaccuccgccucc

SEQ ID NO: 63094 - RNA, 22 nt, Homo sapiens
acugagacugagaauguuucuu

SEQ ID NO: 63095 - RNA, 21 nt, Homo sapiens
acugagagaucuggggcacau

SEQ ID NO: 63096 - RNA, 22 nt, Homo sapiens
acugagucauugggugcccaga

SEQ ID NO: 63097 - RNA, 20 nt, Homo sapiens
acugcacuccaggcugccca

SEQ ID NO: 63098 - RNA, 22 nt, Homo sapiens
acugcacugucaaccuccuggg

SEQ ID NO: 63099 - RNA, 22 nt, Homo sapiens
acugcauaaauauguguaauau

SEQ ID NO: 63100 - RNA, 22 nt, Homo sapiens
acuggcuguuaggaauuaccuc

SEQ ID NO: 63101 - RNA, 22 nt, Homo sapiens
acuguguguuugucuagcacag

SEQ ID NO: 63102 - RNA, 22 nt, Homo sapiens
acuugacacuuauauuacucac

SEQ ID NO: 63103 - RNA, 22 nt, Homo sapiens
acuuugcuuagagggcauuaaa

SEQ ID NO: 63104 - RNA, 22 nt, Homo sapiens
acuuuuguuauacagugugaua

SEQ ID NO: 63105 - RNA, 22 nt, Homo sapiens
agaaacacagguggaauugcuu

SEQ ID NO: 63106 - RNA, 22 nt, Homo sapiens
agaacccuuugaaauguguuug

SEQ ID NO: 63107 - RNA, 22 nt, Homo sapiens
agaaugugaacaucuugaaagu

SEQ ID NO: 63108 - RNA, 21 nt, Homo sapiens
agagaacugaaacaugugacu

SEQ ID NO: 63109 - RNA, 22 nt, Homo sapiens
agagaacugauucagggaaaau

SEQ ID NO: 63110 - RNA, 22 nt, Homo sapiens
agagauaauuagguuaaaugag

SEQ ID NO: 63111 - RNA, 22 nt, Homo sapiens
agagauacauucugagaagugc

SEQ ID NO: 63112 - RNA, 22 nt, Homo sapiens
agagauuauccuggcuucucug

SEQ ID NO: 63113 - RNA, 22 nt, Homo sapiens
agagccacauuaaauaugggaa

SEQ ID NO: 63114 - RNA, 22 nt, Homo sapiens
agagguaagcaguggcaagugc

SEQ ID NO: 63115 - RNA, 22 nt, Homo sapiens
agagguagaagauaggcuacag

SEQ ID NO: 63116 - RNA, 23 nt, Homo sapiens
agagguuuaaucaggcaguugcu

SEQ ID NO: 63117 - RNA, 22 nt, Homo sapiens
agagugaagcuuuuuauauucu

SEQ ID NO: 63118 - RNA, 22 nt, Homo sapiens
agagugcaauggcaccaucucg

SEQ ID NO: 63119 - RNA, 20 nt, Homo sapiens
agagugcuggacugaggagc

SEQ ID NO: 63120 - RNA, 22 nt, Homo sapiens
agaugauguuuacugagcauca

SEQ ID NO: 63121 - RNA, 18 nt, Homo sapiens
auguuauguuuguagaag

SEQ ID NO: 63122 - RNA, 20 nt, Homo sapiens
auuagacuugccuuauccuu

SEQ ID NO: 63123 - RNA, 20 nt, Homo sapiens
auuagagcuacauggcuaca

SEQ ID NO: 63124 - RNA, 22 nt, Homo sapiens
auuauugacucauagaaaggau

SEQ ID NO: 63125 - RNA, 22 nt, Homo sapiens
auucaaagugcauguucccacu

SEQ ID NO: 63126 - RNA, 22 nt, Homo sapiens
auucacagcuuuaaaaggcgug

SEQ ID NO: 63127 - RNA, 23 nt, Homo sapiens
auugaacacuuucauaugugagg

SEQ ID NO: 63128 - RNA, 22 nt, Homo sapiens
auugaauuugguuugcuaagaa

SEQ ID NO: 63129 - RNA, 22 nt, Homo sapiens
auugcaaagcguagacucuaaa

SEQ ID NO: 63130 - RNA, 22 nt, Homo sapiens
auugcaacuuccgccuccuggg

SEQ ID NO: 63131 - RNA, 22 nt, Homo sapiens
auugcacacagaaucaggguaa

SEQ ID NO: 63132 - RNA, 22 nt, Homo sapiens
auugcacuccagccuggcaaua

SEQ ID NO: 63133 - RNA, 23 nt, Homo sapiens
auugcagucuugaacuccugggc

SEQ ID NO: 63134 - RNA, 22 nt, Homo sapiens
auugcccaggcuggagugcagu

SEQ ID NO: 63135 - RNA, 22 nt, Homo sapiens
auugcuaacugaaauaagacca

SEQ ID NO: 63136 - RNA, 22 nt, Homo sapiens
auuggcaauggcaaagcagagu

SEQ ID NO: 63137 - RNA, 22 nt, Homo sapiens
auuguacuagguccuagggcuu

SEQ ID NO: 63138 - RNA, 22 nt, Homo sapiens
auuguacuccagccuguggagc

SEQ ID NO: 63139 - RNA, 22 nt, Homo sapiens
auuguacucuagccucugggca

SEQ ID NO: 63140 - RNA, 22 nt, Homo sapiens
auuguacuuaagccugggugaa

SEQ ID NO: 63141 - RNA, 22 nt, Homo sapiens
auuguguuugaaugaggcucca

SEQ ID NO: 63142 - RNA, 22 nt, Homo sapiens
auuuaacuggucuaggggccca

SEQ ID NO: 63143 - RNA, 15 nt, Homo sapiens
auuucacuuagcaug

SEQ ID NO: 63144 - RNA, 21 nt, Homo sapiens
auuugguggcugugugacacu

SEQ ID NO: 63145 - RNA, 22 nt, Homo sapiens
auuugucacuauguggcuaaua

SEQ ID NO: 63146 - RNA, 22 nt, Homo sapiens
caaaggcuguuauaggccagga

SEQ ID NO: 63147 - RNA, 22 nt, Homo sapiens
caaaguaauugcuguuuugcca

SEQ ID NO: 63148 - RNA, 22 nt, Homo sapiens
caaauugcuugucuguagugga

SEQ ID NO: 63149 - RNA, 22 nt, Homo sapiens
caagagagcugaugguuuuaaa

SEQ ID NO: 63150 - RNA, 22 nt, Homo sapiens
caagugcucuaggauccugagu

SEQ ID NO: 63151 - RNA, 22 nt, Homo sapiens
caagugcuugaugaaugaucaa

SEQ ID NO: 63152 - RNA, 21 nt, Homo sapiens
caauggcacaaucucugcuca

SEQ ID NO: 63153 - RNA, 22 nt, Homo sapiens
caauggcacgaucucgucucac

SEQ ID NO: 63154 - RNA, 22 nt, Homo sapiens
caaugguccccauuggcaggaa

SEQ ID NO: 63155 - RNA, 22 nt, Homo sapiens
cacagaauucauuggauuaccu

SEQ ID NO: 63156 - RNA, 21 nt, Homo sapiens
cacauggaggcagagagugua

SEQ ID NO: 63157 - RNA, 16 nt, Homo sapiens
cacauugcugcauggc

SEQ ID NO: 63158 - RNA, 22 nt, Homo sapiens
caccagguggcugaggccauga

SEQ ID NO: 63159 - RNA, 22 nt, Homo sapiens
caccaguuuuucagugauucaa

SEQ ID NO: 63160 - RNA, 22 nt, Homo sapiens
cacugcauccuugaccuucugg

SEQ ID NO: 63161 - RNA, 22 nt, Homo sapiens
cacugcauuacucaugagcaug

SEQ ID NO: 63162 - RNA, 22 nt, Homo sapiens
cacugcgaccucugccuaccgg

SEQ ID NO: 63163 - RNA, 22 nt, Homo sapiens
cacuggguuagaacaugcuccu

SEQ ID NO: 63164 - RNA, 18 nt, Homo sapiens
cacuuggcuuugccccuc

SEQ ID NO: 63165 - RNA, 21 nt, Homo sapiens
cagagaucaucucuguuuuaa

SEQ ID NO: 63166 - RNA, 20 nt, Homo sapiens
cagagcaaagcaguccuggc

SEQ ID NO: 63167 - RNA, 22 nt, Homo sapiens
cagcaaaucauccuauuugagc

SEQ ID NO: 63168 - RNA, 22 nt, Homo sapiens
cagcccguaaucccagcacuuu

SEQ ID NO: 63169 - RNA, 22 nt, Homo sapiens
cagcuguuguuaugucugcagg

SEQ ID NO: 63170 - RNA, 22 nt, Homo sapiens
cagcuguuguuccagucuuuua

SEQ ID NO: 63171 - RNA, 22 nt, Homo sapiens
cagguauagucacuugcccaag

SEQ ID NO: 63172 - RNA, 22 nt, Homo sapiens
caggugaaugccucuccuucug

SEQ ID NO: 63173 - RNA, 22 nt, Homo sapiens
caggugcauuggcugacaccug

SEQ ID NO: 63174 - RNA, 22 nt, Homo sapiens
cagugcaaagccucugcccaga

SEQ ID NO: 63175 - RNA, 23 nt, Homo sapiens
cagugcaugacuguauaugcaaa

SEQ ID NO: 63176 - RNA, 20 nt, Homo sapiens
cagugcauugcuucugauuu

SEQ ID NO: 63177 - RNA, 22 nt, Homo sapiens
caguugcacuagccccguuuca

SEQ ID NO: 63178 - RNA, 22 nt, Homo sapiens
cauaaagauggaggaggccagg

SEQ ID NO: 63179 - RNA, 22 nt, Homo sapiens
aaaagugguguuguuucuaaau

SEQ ID NO: 63180 - RNA, 22 nt, Homo sapiens
aaacaccacgcggucccucgga

SEQ ID NO: 63181 - RNA, 18 nt, Homo sapiens
aaacagugucucuuucug

SEQ ID NO: 63182 - RNA, 22 nt, Homo sapiens
aaacugucuucugacaguuucc

SEQ ID NO: 63183 - RNA, 22 nt, Homo sapiens
aaagcacuggagucaucaucua

SEQ ID NO: 63184 - RNA, 22 nt, Homo sapiens
aaagcuacaggaccugcucauu

SEQ ID NO: 63185 - RNA, 22 nt, Homo sapiens
aaaguaauugcaguuuuugcaa

SEQ ID NO: 63186 - RNA, 22 nt, Homo sapiens
aaagugcugagaguucuaacuu

SEQ ID NO: 63187 - RNA, 22 nt, Homo sapiens
aaagugcuuacuaaguugccaa

SEQ ID NO: 63188 - RNA, 22 nt, Homo sapiens
aaagugcuuccuuuuugagggu

SEQ ID NO: 63189 - RNA, 22 nt, Homo sapiens
aaagugucuguuccuagcauga

SEQ ID NO: 63190 - RNA, 19 nt, Homo sapiens
aaaguucuucccuuuggag

SEQ ID NO: 63191 - RNA, 22 nt, Homo sapiens
aaaugcacagaaaggaugugga

SEQ ID NO: 63192 - RNA, 22 nt, Homo sapiens
aaaugcagauuccuaggcccca

SEQ ID NO: 63193 - RNA, 22 nt, Homo sapiens
aaaugcaugaggugggaagaaa

SEQ ID NO: 63194 - RNA, 22 nt, Homo sapiens
aaaugcugucaaauuguguucu

SEQ ID NO: 63195 - RNA, 21 nt, Homo sapiens
agaaaaucuuaugggaaacau

SEQ ID NO: 63196 - RNA, 22 nt, Homo sapiens
agaauaauguccccccaaggga

SEQ ID NO: 63197 - RNA, 22 nt, Homo sapiens
agaaugucaguauuggcuaaaa

SEQ ID NO: 63198 - RNA, 22 nt, Homo sapiens
agaauucugucauguuuauauu

SEQ ID NO: 63199 - RNA, 22 nt, Homo sapiens
agacaagauggcuugagguuca

SEQ ID NO: 63200 - RNA, 22 nt, Homo sapiens
agagaacuggcuucaccauucu

SEQ ID NO: 63201 - RNA, 22 nt, Homo sapiens
agagacauugcuccaacucacc

SEQ ID NO: 63202 - RNA, 22 nt, Homo sapiens
agagaucaauaugaaggaaaug

SEQ ID NO: 63203 - RNA, 22 nt, Homo sapiens
agagaugaagauggggcucccg

SEQ ID NO: 63204 - RNA, 22 nt, Homo sapiens
agagaugauuaacauuuuggua

SEQ ID NO: 63205 - RNA, 22 nt, Homo sapiens
agagcaauguuaucagucucug

SEQ ID NO: 63206 - RNA, 22 nt, Homo sapiens
agagcaccauuuagcaagguga

SEQ ID NO: 63207 - RNA, 22 nt, Homo sapiens
agagcacugcugcaggguucug

SEQ ID NO: 63208 - RNA, 22 nt, Homo sapiens
agagguuuugcacugguucuuu

SEQ ID NO: 63209 - RNA, 22 nt, Homo sapiens
agaguacugacguuugcaaauu

SEQ ID NO: 63210 - RNA, 22 nt, Homo sapiens
agaguaguaggaugaauggacu

SEQ ID NO: 63211 - RNA, 22 nt, Homo sapiens
agagugcaaagguuggggcugg

SEQ ID NO: 63212 - RNA, 22 nt, Homo sapiens
agaugauguuucuggcacauga

SEQ ID NO: 63213 - RNA, 23 nt, Homo sapiens
agaugcauucuuguaggauauau

SEQ ID NO: 63214 - RNA, 23 nt, Homo sapiens
agauggcauuucaguucuuuagg

SEQ ID NO: 63215 - RNA, 22 nt, Homo sapiens
agcaacaucagcagcaggaaaa

SEQ ID NO: 63216 - RNA, 22 nt, Homo sapiens
agcaagaugaaguugagcuagg

SEQ ID NO: 63217 - RNA, 22 nt, Homo sapiens
agcaccaauaaucagaguucuu

SEQ ID NO: 63218 - RNA, 22 nt, Homo sapiens
agcaccacauacuacagagaua

SEQ ID NO: 63219 - RNA, 22 nt, Homo sapiens
agcaccagaaucugaguuauuc

SEQ ID NO: 63220 - RNA, 22 nt, Homo sapiens
agcaccauugcacuccagccug

SEQ ID NO: 63221 - RNA, 21 nt, Homo sapiens
agcagaguggcagcucuuuug

SEQ ID NO: 63222 - RNA, 22 nt, Homo sapiens
agcagcauauuuuuauaaugua

SEQ ID NO: 63223 - RNA, 22 nt, Homo sapiens
agcagcaucgggaaguuggcca

SEQ ID NO: 63224 - RNA, 22 nt, Homo sapiens
agcagcauuaguggaaucuugu

SEQ ID NO: 63225 - RNA, 20 nt, Homo sapiens
agcagccacagauuccucag

SEQ ID NO: 63226 - RNA, 22 nt, Homo sapiens
agcaggauuguuacaauaguaa

SEQ ID NO: 63227 - RNA, 22 nt, Homo sapiens
agcaguagugaaaguagacuua

SEQ ID NO: 63228 - RNA, 22 nt, Homo sapiens
agcagugucauuuucuggugag

SEQ ID NO: 63229 - RNA, 22 nt, Homo sapiens
agcccauguggcugaggcuucu

SEQ ID NO: 63230 - RNA, 22 nt, Homo sapiens
agcccuuagauggcuccuucca

SEQ ID NO: 63231 - RNA, 20 nt, Homo sapiens
agcuaguauuuccaugguua

SEQ ID NO: 63232 - RNA, 21 nt, Homo sapiens
agcuccacucguucccaaagc

SEQ ID NO: 63233 - RNA, 22 nt, Homo sapiens
aaguagcuggaugcaguggcac

SEQ ID NO: 63234 - RNA, 22 nt, Homo sapiens
aaguauuagcuaauugugcuua

SEQ ID NO: 63235 - RNA, 22 nt, Homo sapiens
aagucaugaagaggaaaggaca

SEQ ID NO: 63236 - RNA, 22 nt, Homo sapiens
aaguccaugaagucuugugggu

SEQ ID NO: 63237 - RNA, 22 nt, Homo sapiens
aaguccccugacagaggggagg

SEQ ID NO: 63238 - RNA, 22 nt, Homo sapiens
aagugacuagacuaugaaaccu

SEQ ID NO: 63239 - RNA, 22 nt, Homo sapiens
aagugagaugcaguggaguucc

SEQ ID NO: 63240 - RNA, 22 nt, Homo sapiens
aagugauguuauugggugacuc

SEQ ID NO: 63241 - RNA, 22 nt, Homo sapiens
aagugcuguaugggagccuagg

SEQ ID NO: 63242 - RNA, 22 nt, Homo sapiens
aagugcuuccuuucagaggguu

SEQ ID NO: 63243 - RNA, 22 nt, Homo sapiens
aagugguguuuguauuuaugca

SEQ ID NO: 63244 - RNA, 22 nt, Homo sapiens
aagugucuuaccgggagggagu

SEQ ID NO: 63245 - RNA, 21 nt, Homo sapiens
aauaaagcaaccuuaugccau

SEQ ID NO: 63246 - RNA, 22 nt, Homo sapiens
aauaaagccugucucuuuagag

SEQ ID NO: 63247 - RNA, 22 nt, Homo sapiens
aauaaagcuuugagcuuugcug

SEQ ID NO: 63248 - RNA, 22 nt, Homo sapiens
aauaaguugagaugaggucaua

SEQ ID NO: 63249 - RNA, 22 nt, Homo sapiens
aauacugaaaguauuuucaaau

SEQ ID NO: 63250 - RNA, 22 nt, Homo sapiens
aauacuuccaaaucuagucauu

SEQ ID NO: 63251 - RNA, 22 nt, Homo sapiens
aauagcuguccuuagaagugug

SEQ ID NO: 63252 - RNA, 23 nt, Homo sapiens
aauaucacaguggguguacaccc

SEQ ID NO: 63253 - RNA, 22 nt, Homo sapiens
aauaucacaguuggguguacac

SEQ ID NO: 63254 - RNA, 19 nt, Homo sapiens
aauauugacaguggugucu

SEQ ID NO: 63255 - RNA, 22 nt, Homo sapiens
aauauugucaaaauggauucca

SEQ ID NO: 63256 - RNA, 22 nt, Homo sapiens
aaucaacauuguuuuaagucaa

SEQ ID NO: 63257 - RNA, 22 nt, Homo sapiens
aaucacuaugccaugaaguaca

SEQ ID NO: 63258 - RNA, 22 nt, Homo sapiens
aaucacuuugcuacaaggcagu

SEQ ID NO: 63259 - RNA, 22 nt, Homo sapiens
aauccugucuugccauccaaua

SEQ ID NO: 63260 - RNA, 22 nt, Homo sapiens
aaucucagagauaucugugucc

SEQ ID NO: 63261 - RNA, 22 nt, Homo sapiens
aaugacacugagcaucuuucau

SEQ ID NO: 63262 - RNA, 22 nt, Homo sapiens
aaugacugugauauuuuucuuc

SEQ ID NO: 63263 - RNA, 22 nt, Homo sapiens
aaugauauguuauguuuagguu

SEQ ID NO: 63264 - RNA, 22 nt, Homo sapiens
aaugcuguguuauuucaugacc

SEQ ID NO: 63265 - RNA, 22 nt, Homo sapiens
aaugcuguucuuugcuuaaguu

SEQ ID NO: 63266 - RNA, 22 nt, Homo sapiens
aauggcauugguccuuuuggau

SEQ ID NO: 63267 - RNA, 22 nt, Homo sapiens
aaugugcacuuggagccuugcu

SEQ ID NO: 63268 - RNA, 22 nt, Homo sapiens
aaugugcuuugaaaagagcuga

SEQ ID NO: 63269 - RNA, 22 nt, Homo sapiens
aauuaggcuagaauguuauuaa

SEQ ID NO: 63270 - RNA, 22 nt, Homo sapiens
aauuaguugucgugagaguggu

SEQ ID NO: 63271 - RNA, 22 nt, Homo sapiens
aauugcaauggacaaugcagca

SEQ ID NO: 63272 - RNA, 22 nt, Homo sapiens
aauugcaccaucuagaucaaga

SEQ ID NO: 63273 - RNA, 20 nt, Homo sapiens
acaaaugcauucugugacau

SEQ ID NO: 63274 - RNA, 22 nt, Homo sapiens
acaagacuucuuguauucuagu

SEQ ID NO: 63275 - RNA, 22 nt, Homo sapiens
acaccaucuccuuauuucucuu

SEQ ID NO: 63276 - RNA, 22 nt, Homo sapiens
acaccauugcauuccagccugg

SEQ ID NO: 63277 - RNA, 22 nt, Homo sapiens
acacuguacuuauguuuugcag

SEQ ID NO: 63278 - RNA, 22 nt, Homo sapiens
acacuguauccuucuguccuuu

SEQ ID NO: 63279 - RNA, 20 nt, Homo sapiens
acacugugcuaaggauuuuc

SEQ ID NO: 63280 - RNA, 23 nt, Homo sapiens
acacuugcugaguaaaucaaaua

SEQ ID NO: 63281 - RNA, 20 nt, Homo sapiens
acagcauagccuuuuaaagc

SEQ ID NO: 63282 - RNA, 21 nt, Homo sapiens
acaguaguaauaguguagcca

SEQ ID NO: 63283 - RNA, 22 nt, Homo sapiens
acagugcuuucaauguucagua

SEQ ID NO: 63284 - RNA, 22 nt, Homo sapiens
acaguguagugacugccaacuu

SEQ ID NO: 63285 - RNA, 18 nt, Homo sapiens
acagugucauggcucaau

SEQ ID NO: 63286 - RNA, 19 nt, Homo sapiens
acagugucucuauaaugau

SEQ ID NO: 63287 - RNA, 22 nt, Homo sapiens
auagcagugugaaaauguacua

SEQ ID NO: 63288 - RNA, 22 nt, Homo sapiens
auagccuguaggccuuaaggug

SEQ ID NO: 63289 - RNA, 22 nt, Homo sapiens
auagguauguaauacaaaugaa

SEQ ID NO: 63290 - RNA, 22 nt, Homo sapiens
auagugaacuuugugagaacaa

SEQ ID NO: 63291 - RNA, 22 nt, Homo sapiens
auaucacagguguuuaccugau

SEQ ID NO: 63292 - RNA, 22 nt, Homo sapiens
auaucccagugaugauugauag

SEQ ID NO: 63293 - RNA, 22 nt, Homo sapiens
auaugcacaguggaguacuauu

SEQ ID NO: 63294 - RNA, 22 nt, Homo sapiens
auaugccacugaacuguaccca

SEQ ID NO: 63295 - RNA, 19 nt, Homo sapiens
auaugggguuugaacugug

SEQ ID NO: 63296 - RNA, 22 nt, Homo sapiens
auauguucucauucauaugugg

SEQ ID NO: 63297 - RNA, 22 nt, Homo sapiens
auauugguuaaauauuauguga

SEQ ID NO: 63298 - RNA, 19 nt, Homo sapiens
aucaaacugcucuuugagg

SEQ ID NO: 63299 - RNA, 22 nt, Homo sapiens
aucaaagcagcauggcccaguc

SEQ ID NO: 63300 - RNA, 22 nt, Homo sapiens
aucaaagccaugcucaguuuuc

SEQ ID NO: 63301 - RNA, 22 nt, Homo sapiens
aucaaagugaaauauuaguuau

SEQ ID NO: 63302 - RNA, 22 nt, Homo sapiens
aucaaaguuucccagaaguugu

SEQ ID NO: 63303 - RNA, 22 nt, Homo sapiens
aucaaaucuccagaaccugucu

SEQ ID NO: 63304 - RNA, 22 nt, Homo sapiens
aucaaguaaucugaguaagagu

SEQ ID NO: 63305 - RNA, 22 nt, Homo sapiens
aucaaguaguuauacguaaagg

SEQ ID NO: 63306 - RNA, 22 nt, Homo sapiens
aucacagugaaaacagucaauu

SEQ ID NO: 63307 - RNA, 22 nt, Homo sapiens
aucacaguggcucacaagagcc

SEQ ID NO: 63308 - RNA, 19 nt, Homo sapiens
aucaccauuauuuggaaca

SEQ ID NO: 63309 - RNA, 22 nt, Homo sapiens
aucaccugagcaguauacacug

SEQ ID NO: 63310 - RNA, 22 nt, Homo sapiens
aucacugugauuucuacugugc

SEQ ID NO: 63311 - RNA, 22 nt, Homo sapiens
aucagauuccagaggcagcacc

SEQ ID NO: 63312 - RNA, 22 nt, Homo sapiens
aucagcagcaugaaaacaggcu

SEQ ID NO: 63313 - RNA, 22 nt, Homo sapiens
aucagcagcaugaaaagcaacu

SEQ ID NO: 63314 - RNA, 22 nt, Homo sapiens
aucagcauucccaaaugaugug

SEQ ID NO: 63315 - RNA, 22 nt, Homo sapiens
aucagugaaagugaaaucuccg

SEQ ID NO: 63316 - RNA, 22 nt, Homo sapiens
aucagugcauaguauuuaauga

SEQ ID NO: 63317 - RNA, 22 nt, Homo sapiens
aucccagaaacucggguuucuc

SEQ ID NO: 63318 - RNA, 22 nt, Homo sapiens
aucccugugacgagcaucccua

SEQ ID NO: 63319 - RNA, 22 nt, Homo sapiens
aucucagagaaaauuacuaaga

SEQ ID NO: 63320 - RNA, 22 nt, Homo sapiens
aucuuuaguggcuguuuucaga

SEQ ID NO: 63321 - RNA, 22 nt, Homo sapiens
augaaaacaugauuugccuguu

SEQ ID NO: 63322 - RNA, 22 nt, Homo sapiens
augaaaguguguggaaacuuga

SEQ ID NO: 63323 - RNA, 22 nt, Homo sapiens
augaaaucuuuccugugaggau

SEQ ID NO: 63324 - RNA, 22 nt, Homo sapiens
augaacagagccuugagaaccu

SEQ ID NO: 63325 - RNA, 22 nt, Homo sapiens
augacauuccacagccguagag

SEQ ID NO: 63326 - RNA, 22 nt, Homo sapiens
augaccauuucaauugauaugg

SEQ ID NO: 63327 - RNA, 22 nt, Homo sapiens
augacuuuucugaaaaccacca

SEQ ID NO: 63328 - RNA, 22 nt, Homo sapiens
agcaucacaugggcugcuuggg

SEQ ID NO: 63329 - RNA, 22 nt, Homo sapiens
agcaucauuugauguucccgag

SEQ ID NO: 63330 - RNA, 22 nt, Homo sapiens
agcauuaguugugaagccuuua

SEQ ID NO: 63331 - RNA, 21 nt, Homo sapiens
agccugugggucauaguugcc

SEQ ID NO: 63332 - RNA, 22 nt, Homo sapiens
agccuguguugaauuauagaaa

SEQ ID NO: 63333 - RNA, 22 nt, Homo sapiens
agcggcuguuccccuggucuau

SEQ ID NO: 63334 - RNA, 21 nt, Homo sapiens
agcuaaauuggaaauuucugu

SEQ ID NO: 63335 - RNA, 22 nt, Homo sapiens
agcuccaugauaguaugucugu

SEQ ID NO: 63336 - RNA, 22 nt, Homo sapiens
agcugcacaaauggaugugagg

SEQ ID NO: 63337 - RNA, 22 nt, Homo sapiens
agcugcauucguaucauauugu

SEQ ID NO: 63338 - RNA, 22 nt, Homo sapiens
agcugccagucuuguaaggccu

SEQ ID NO: 63339 - RNA, 22 nt, Homo sapiens
agcuggucucaggugcccugcu

SEQ ID NO: 63340 - RNA, 22 nt, Homo sapiens
agcugguuuaauaugcugucug

SEQ ID NO: 63341 - RNA, 22 nt, Homo sapiens
agcuguuguuuuaagauacuaa

SEQ ID NO: 63342 - RNA, 22 nt, Homo sapiens
agcuugugcuguaugaagggcc

SEQ ID NO: 63343 - RNA, 22 nt, Homo sapiens
agcuuguguuuuucuaaguauc

SEQ ID NO: 63344 - RNA, 22 nt, Homo sapiens
aggaaaucuuagcugaggggau

SEQ ID NO: 63345 - RNA, 22 nt, Homo sapiens
aggacacugauagucuuuggca

SEQ ID NO: 63346 - RNA, 22 nt, Homo sapiens
aggaccccucaucagcaccagu

SEQ ID NO: 63347 - RNA, 21 nt, Homo sapiens
aggagcauucaugacgagguu

SEQ ID NO: 63348 - RNA, 22 nt, Homo sapiens
aggaggauugcuuucaucuuuu

SEQ ID NO: 63349 - RNA, 22 nt, Homo sapiens
aggagguaggaauugugcuagg

SEQ ID NO: 63350 - RNA, 22 nt, Homo sapiens
aggagguagggugugaaacagc

SEQ ID NO: 63351 - RNA, 21 nt, Homo sapiens
aggcaaaugaagcagccgcuc

SEQ ID NO: 63352 - RNA, 21 nt, Homo sapiens
aggcaagauuacuuacgagca

SEQ ID NO: 63353 - RNA, 22 nt, Homo sapiens
aggcagucugaguuuugaaagg

SEQ ID NO: 63354 - RNA, 22 nt, Homo sapiens
aggcaugaaauacaugcauuga

SEQ ID NO: 63355 - RNA, 22 nt, Homo sapiens
aggcaugauggcuccagaucau

SEQ ID NO: 63356 - RNA, 22 nt, Homo sapiens
aggcaugauuguauuuugcucu

SEQ ID NO: 63357 - RNA, 22 nt, Homo sapiens
aggccaguuuuuggagggaaac

SEQ ID NO: 63358 - RNA, 22 nt, Homo sapiens
aggcugguauuuacaaaagcuc

SEQ ID NO: 63359 - RNA, 22 nt, Homo sapiens
agggaagugugcuaugcauuua

SEQ ID NO: 63360 - RNA, 22 nt, Homo sapiens
agggaauguaaguuuuaugaga

SEQ ID NO: 63361 - RNA, 22 nt, Homo sapiens
agggccuuuguagauguacuca

SEQ ID NO: 63362 - RNA, 22 nt, Homo sapiens
aggguuuuuauuuauguggcau

SEQ ID NO: 63363 - RNA, 20 nt, Homo sapiens
agguacacugacaugccuuc

SEQ ID NO: 63364 - RNA, 20 nt, Homo sapiens
agguagauagaugauagaua

SEQ ID NO: 63365 - RNA, 20 nt, Homo sapiens
agguaguuauacaaaugugu

SEQ ID NO: 63366 - RNA, 22 nt, Homo sapiens
agguauauuggacagauguaaa

SEQ ID NO: 63367 - RNA, 22 nt, Homo sapiens
agguauuuucaacuuagaaugg

SEQ ID NO: 63368 - RNA, 22 nt, Homo sapiens
agguauuuuuuauccuccagca

SEQ ID NO: 63369 - RNA, 22 nt, Homo sapiens
aggugcucuuccuguaggucac

SEQ ID NO: 63370 - RNA, 21 nt, Homo sapiens
agguuguguuuccucuuacuu

SEQ ID NO: 63371 - RNA, 22 nt, Homo sapiens
aguaaauuucugugcuuucaua

SEQ ID NO: 63372 - RNA, 22 nt, Homo sapiens
aguaacauuucuaguagagagu

SEQ ID NO: 63373 - RNA, 22 nt, Homo sapiens
aguacacuguuaaaaagaagug

SEQ ID NO: 63374 - RNA, 22 nt, Homo sapiens
aguacaucuggcuggauagaua

SEQ ID NO: 63375 - RNA, 17 nt, Homo sapiens
aguacugucccauccuu

SEQ ID NO: 63376 - RNA, 22 nt, Homo sapiens
aguaucaagccacacaugguca

SEQ ID NO: 63377 - RNA, 22 nt, Homo sapiens
aguccagguuuuguaauggcaa

SEQ ID NO: 63378 - RNA, 22 nt, Homo sapiens
agugcagugguuaggagccagg

SEQ ID NO: 63379 - RNA, 22 nt, Homo sapiens
auuccaguggguuuacauccca

SEQ ID NO: 63380 - RNA, 22 nt, Homo sapiens
auuccauaguacagugaugagu

SEQ ID NO: 63381 - RNA, 22 nt, Homo sapiens
auucccuuggucaacggaugca

SEQ ID NO: 63382 - RNA, 18 nt, Homo sapiens
auucuacaggccuuuuga

SEQ ID NO: 63383 - RNA, 22 nt, Homo sapiens
auugaacuuacuaucuaaacua

SEQ ID NO: 63384 - RNA, 22 nt, Homo sapiens
auugaacuuuugucacugacau

SEQ ID NO: 63385 - RNA, 21 nt, Homo sapiens
auugagcacaugaaacauggc

SEQ ID NO: 63386 - RNA, 22 nt, Homo sapiens
auugcaacaguguugagaggug

SEQ ID NO: 63387 - RNA, 22 nt, Homo sapiens
auugcacaucugcacuacagcc

SEQ ID NO: 63388 - RNA, 22 nt, Homo sapiens
auugcaccacugcccuccagcc

SEQ ID NO: 63389 - RNA, 22 nt, Homo sapiens
auugcacuggggguuagaauuu

SEQ ID NO: 63390 - RNA, 22 nt, Homo sapiens
auugcagaaaugacagagcgcc

SEQ ID NO: 63391 - RNA, 22 nt, Homo sapiens
auugcaugucauguuuagugua

SEQ ID NO: 63392 - RNA, 22 nt, Homo sapiens
auugcuauuauuugaccauugu

SEQ ID NO: 63393 - RNA, 22 nt, Homo sapiens
auuggggaaugguggcuuuagu

SEQ ID NO: 63394 - RNA, 22 nt, Homo sapiens
auuguacuccagccugggcaaa

SEQ ID NO: 63395 - RNA, 22 nt, Homo sapiens
auuguacuccagccugggcagc

SEQ ID NO: 63396 - RNA, 22 nt, Homo sapiens
auuguacuccagccugggcuaa

SEQ ID NO: 63397 - RNA, 22 nt, Homo sapiens
auuucacugagacaugugccca

SEQ ID NO: 63398 - RNA, 22 nt, Homo sapiens
auuuuugguuucaccugcacgc

SEQ ID NO: 63399 - RNA, 22 nt, Homo sapiens
caaagucuauucuacccuuacc

SEQ ID NO: 63400 - RNA, 22 nt, Homo sapiens
caaagucuucucauuaugucuu

SEQ ID NO: 63401 - RNA, 22 nt, Homo sapiens
caaagugcuggccgggcgcagu

SEQ ID NO: 63402 - RNA, 22 nt, Homo sapiens
caaagugcugggaugggccagg

SEQ ID NO: 63403 - RNA, 22 nt, Homo sapiens
caaauccucaccucaucaugaa

SEQ ID NO: 63404 - RNA, 22 nt, Homo sapiens
caacaguaaagcauuuuuaagu

SEQ ID NO: 63405 - RNA, 22 nt, Homo sapiens
caaggcacagccccuacuuccu

SEQ ID NO: 63406 - RNA, 22 nt, Homo sapiens
caaggugcugagacaggagccc

SEQ ID NO: 63407 - RNA, 22 nt, Homo sapiens
caaguguuggcuuguauacaaa

SEQ ID NO: 63408 - RNA, 22 nt, Homo sapiens
caaguguuuccuuaaauacuug

SEQ ID NO: 63409 - RNA, 21 nt, Homo sapiens
caauggcacgaucuuggcuca

SEQ ID NO: 63410 - RNA, 22 nt, Homo sapiens
cacagcgacuuccgccuaccgg

SEQ ID NO: 63411 - RNA, 22 nt, Homo sapiens
cacagcuagucaaugguagaca

SEQ ID NO: 63412 - RNA, 22 nt, Homo sapiens
cacaguagaauagagcacuagg

SEQ ID NO: 63413 - RNA, 22 nt, Homo sapiens
cacaguguuacugguaugaagu

SEQ ID NO: 63414 - RNA, 22 nt, Homo sapiens
cacaguguuccagcuauuugaa

SEQ ID NO: 63415 - RNA, 22 nt, Homo sapiens
cacauagucccugcuaaucuuc

SEQ ID NO: 63416 - RNA, 22 nt, Homo sapiens
cacauugcaggaaaguucauua

SEQ ID NO: 63417 - RNA, 22 nt, Homo sapiens
caccacauuccauugaucaggc

SEQ ID NO: 63418 - RNA, 22 nt, Homo sapiens
caccaggugcccagcacggcca

SEQ ID NO: 63419 - RNA, 19 nt, Homo sapiens
caccagugcaugcuacuau

SEQ ID NO: 63420 - RNA, 19 nt, Homo sapiens
caccgccugcccccugcug

SEQ ID NO: 63421 - RNA, 22 nt, Homo sapiens
caccugagcgggaugcucgccu

SEQ ID NO: 63422 - RNA, 21 nt, Homo sapiens
cacugcaucacaggacagcau

SEQ ID NO: 63423 - RNA, 22 nt, Homo sapiens
aucagcaguguaaaaacggacu

SEQ ID NO: 63424 - RNA, 22 nt, Homo sapiens
aucauguaguaagacacauuua

SEQ ID NO: 63425 - RNA, 22 nt, Homo sapiens
auccacagugucaauguuguga

SEQ ID NO: 63426 - RNA, 22 nt, Homo sapiens
aucccuugacguggagucucug

SEQ ID NO: 63427 - RNA, 22 nt, Homo sapiens
auccucugagagaguuucauaa

SEQ ID NO: 63428 - RNA, 22 nt, Homo sapiens
auccugagacuuugcugaaguu

SEQ ID NO: 63429 - RNA, 22 nt, Homo sapiens
aucgcaccauugcacuccagca

SEQ ID NO: 63430 - RNA, 22 nt, Homo sapiens
aucuagagaggcagucuggccg

SEQ ID NO: 63431 - RNA, 20 nt, Homo sapiens
aucucugggcaaaggaaaau

SEQ ID NO: 63432 - RNA, 22 nt, Homo sapiens
aucugcacaucuguguuuuugu

SEQ ID NO: 63433 - RNA, 22 nt, Homo sapiens
aucugcauucccauguuuauug

SEQ ID NO: 63434 - RNA, 19 nt, Homo sapiens
aucuggaguuccuggggcu

SEQ ID NO: 63435 - RNA, 22 nt, Homo sapiens
aucuggcguuuacuuccuuccu

SEQ ID NO: 63436 - RNA, 22 nt, Homo sapiens
aucugggguuggcaaaguuugg

SEQ ID NO: 63437 - RNA, 22 nt, Homo sapiens
aucuugcauuugcuaaaaugca

SEQ ID NO: 63438 - RNA, 22 nt, Homo sapiens
aucuuuggcgggaauaucacag

SEQ ID NO: 63439 - RNA, 22 nt, Homo sapiens
aucuuuggucaucacagcuaga

SEQ ID NO: 63440 - RNA, 22 nt, Homo sapiens
aucuuuggugaguucuuugguc

SEQ ID NO: 63441 - RNA, 22 nt, Homo sapiens
aucuuuggugcaugauacuuug

SEQ ID NO: 63442 - RNA, 22 nt, Homo sapiens
augaaagugauaaaugucucua

SEQ ID NO: 63443 - RNA, 20 nt, Homo sapiens
augaaggcaggugugaguuu

SEQ ID NO: 63444 - RNA, 22 nt, Homo sapiens
augaauuuucugauguugggua

SEQ ID NO: 63445 - RNA, 23 nt, Homo sapiens
augacacuguccuugaccauuuc

SEQ ID NO: 63446 - RNA, 22 nt, Homo sapiens
augacuggauaauggacacaca

SEQ ID NO: 63447 - RNA, 22 nt, Homo sapiens
augagagcaacaccuucacuug

SEQ ID NO: 63448 - RNA, 18 nt, Homo sapiens
augagagccgauuccugg

SEQ ID NO: 63449 - RNA, 22 nt, Homo sapiens
augagagcuaacuguggguaca

SEQ ID NO: 63450 - RNA, 22 nt, Homo sapiens
augagauauguuaaaaguuaaa

SEQ ID NO: 63451 - RNA, 19 nt, Homo sapiens
augagcaauaguuuuaauc

SEQ ID NO: 63452 - RNA, 17 nt, Homo sapiens
augagcucaucauuuuu

SEQ ID NO: 63453 - RNA, 22 nt, Homo sapiens
augagcuguuuggaagacacuu

SEQ ID NO: 63454 - RNA, 22 nt, Homo sapiens
augaggagauauuaaauaccau

SEQ ID NO: 63455 - RNA, 22 nt, Homo sapiens
augaggagguaugauuuucuga

SEQ ID NO: 63456 - RNA, 22 nt, Homo sapiens
augaggcaggaaaggcguaucu

SEQ ID NO: 63457 - RNA, 22 nt, Homo sapiens
augagggcggacgcccuggaga

SEQ ID NO: 63458 - RNA, 22 nt, Homo sapiens
augagguaauaaguccuuggaa

SEQ ID NO: 63459 - RNA, 22 nt, Homo sapiens
augagguccuagccaacuuuuu

SEQ ID NO: 63460 - RNA, 22 nt, Homo sapiens
augaucacaccacugcacucca

SEQ ID NO: 63461 - RNA, 22 nt, Homo sapiens
augaucaucugaaagcuuuuac

SEQ ID NO: 63462 - RNA, 22 nt, Homo sapiens
augauguccacagggguguuca

SEQ ID NO: 63463 - RNA, 22 nt, Homo sapiens
augcaaaucuuaaguaugugug

SEQ ID NO: 63464 - RNA, 22 nt, Homo sapiens
augcacaguccagcccaugugg

SEQ ID NO: 63465 - RNA, 22 nt, Homo sapiens
augcacuguauaggaucuugcg

SEQ ID NO: 63466 - RNA, 22 nt, Homo sapiens
augcagagaaaucuaaaauaug

SEQ ID NO: 63467 - RNA, 22 nt, Homo sapiens
augcauaugucuuuauaguggc

SEQ ID NO: 63468 - RNA, 18 nt, Homo sapiens
augcauauuuuaaguugu

SEQ ID NO: 63469 - RNA, 22 nt, Homo sapiens
augccacuguccuccugccuag

SEQ ID NO: 63470 - RNA, 22 nt, Homo sapiens
augcuguuuugaauucucuaga

SEQ ID NO: 63471 - RNA, 22 nt, Homo sapiens
ccaguuuucucacuguugcagu

SEQ ID NO: 63472 - RNA, 22 nt, Homo sapiens
ccaguuuuucauuuauacuagu

SEQ ID NO: 63473 - RNA, 22 nt, Homo sapiens
ccauugaacaugaaggaaugug

SEQ ID NO: 63474 - RNA, 22 nt, Homo sapiens
cccacaguggccucauauccuu

SEQ ID NO: 63475 - RNA, 22 nt, Homo sapiens
cccagagacagaaugauaaacu

SEQ ID NO: 63476 - RNA, 22 nt, Homo sapiens
ccccagguuucaauaaagccca

SEQ ID NO: 63477 - RNA, 22 nt, Homo sapiens
ccccaguguguaaaggccuugc

SEQ ID NO: 63478 - RNA, 22 nt, Homo sapiens
ccccauuugaacuccuucaacu

SEQ ID NO: 63479 - RNA, 22 nt, Homo sapiens
cccugaagacuccaccgucaug

SEQ ID NO: 63480 - RNA, 19 nt, Homo sapiens
cccuggcacauggaaaaug

SEQ ID NO: 63481 - RNA, 22 nt, Homo sapiens
ccucauggagaacaucugcuag

SEQ ID NO: 63482 - RNA, 21 nt, Homo sapiens
ccucuuugagggaagaaaggg

SEQ ID NO: 63483 - RNA, 21 nt, Homo sapiens
ccugaagaagugaccucugag

SEQ ID NO: 63484 - RNA, 21 nt, Homo sapiens
ccugaugaccucugagaguua

SEQ ID NO: 63485 - RNA, 22 nt, Homo sapiens
cgccgggggaugggcaccagcg

SEQ ID NO: 63486 - RNA, 22 nt, Homo sapiens
cuaaaguauugagugguaaaga

SEQ ID NO: 63487 - RNA, 22 nt, Homo sapiens
cuaacuaugucucaggaugucc

SEQ ID NO: 63488 - RNA, 21 nt, Homo sapiens
cuaaggaaagcuaugaacccu

SEQ ID NO: 63489 - RNA, 18 nt, Homo sapiens
cuaauacuauucaacaag

SEQ ID NO: 63490 - RNA, 22 nt, Homo sapiens
cuacaguucucaggaguuggcc

SEQ ID NO: 63491 - RNA, 22 nt, Homo sapiens
cuagacacugacguuccuccga

SEQ ID NO: 63492 - RNA, 22 nt, Homo sapiens
cuagaggcacagccuaggcacu

SEQ ID NO: 63493 - RNA, 22 nt, Homo sapiens
cuaggcuuuucuuggauccagg

SEQ ID NO: 63494 - RNA, 22 nt, Homo sapiens
cuaguaaugucugucuuaugga

SEQ ID NO: 63495 - RNA, 22 nt, Homo sapiens
cuaugcauuuuggaggagggaa

SEQ ID NO: 63496 - RNA, 22 nt, Homo sapiens
cucaaguaauccucccgccuug

SEQ ID NO: 63497 - RNA, 22 nt, Homo sapiens
cucacaaccuuaugaagcauga

SEQ ID NO: 63498 - RNA, 22 nt, Homo sapiens
cucacagugacacgaaccccca

SEQ ID NO: 63499 - RNA, 22 nt, Homo sapiens
cucaccuugugauccuccugcc

SEQ ID NO: 63500 - RNA, 22 nt, Homo sapiens
cuccaggugagguuaagggacu

SEQ ID NO: 63501 - RNA, 22 nt, Homo sapiens
cucucaagaugcugggauuaca

SEQ ID NO: 63502 - RNA, 22 nt, Homo sapiens
cucugauggagauauacaagga

SEQ ID NO: 63503 - RNA, 22 nt, Homo sapiens
cucugcuuaaugucccacuuga

SEQ ID NO: 63504 - RNA, 22 nt, Homo sapiens
cucugguuuuucuuccauuaag

SEQ ID NO: 63505 - RNA, 19 nt, Homo sapiens
cucuuuggugucucuucuu

SEQ ID NO: 63506 - RNA, 22 nt, Homo sapiens
cugaauguucuggauggaagag

SEQ ID NO: 63507 - RNA, 22 nt, Homo sapiens
cugacaucuucaagugaggaga

SEQ ID NO: 63508 - RNA, 22 nt, Homo sapiens
cugagcaaaaugaagacacgau

SEQ ID NO: 63509 - RNA, 22 nt, Homo sapiens
cugagcaaagaagugauaauga

SEQ ID NO: 63510 - RNA, 22 nt, Homo sapiens
cugagcaauauagugagaucuu

SEQ ID NO: 63511 - RNA, 22 nt, Homo sapiens
cugagcuagaccacuuggcucc

SEQ ID NO: 63512 - RNA, 22 nt, Homo sapiens
cugagguacugggggccaggau

SEQ ID NO: 63513 - RNA, 22 nt, Homo sapiens
cugaggugauauauacauauuu

SEQ ID NO: 63514 - RNA, 22 nt, Homo sapiens
cugaggugggagaaucacauaa

SEQ ID NO: 63515 - RNA, 22 nt, Homo sapiens
cugaucuggaggugucugggga

SEQ ID NO: 63516 - RNA, 22 nt, Homo sapiens
cugcaauguuugaaauggcaaa

SEQ ID NO: 63517 - RNA, 22 nt, Homo sapiens
cugcagguaggggcagcuuugg

SEQ ID NO: 63518 - RNA, 21 nt, Homo sapiens
ggcaagaaacacaaucaagua

SEQ ID NO: 63519 - RNA, 22 nt, Homo sapiens
ggcaagaacuucacucacuuuu

SEQ ID NO: 63520 - RNA, 22 nt, Homo sapiens
ggcaagaggagauucugcuccc

SEQ ID NO: 63521 - RNA, 22 nt, Homo sapiens
ggcaagaucuuggcucacugaa

SEQ ID NO: 63522 - RNA, 22 nt, Homo sapiens
ggcaaggaggggcacuuucacu

SEQ ID NO: 63523 - RNA, 22 nt, Homo sapiens
ggcaaguugcuauucuuuaaug

SEQ ID NO: 63524 - RNA, 22 nt, Homo sapiens
ggcaccauuuuacuccuucccu

SEQ ID NO: 63525 - RNA, 22 nt, Homo sapiens
ggcacugugaugugagggggua

SEQ ID NO: 63526 - RNA, 22 nt, Homo sapiens
ggcagaauugcugaggaugcua

SEQ ID NO: 63527 - RNA, 22 nt, Homo sapiens
ggcagcucaggccccgcgcuga

SEQ ID NO: 63528 - RNA, 22 nt, Homo sapiens
ggcagcuguguccuucguaagg

SEQ ID NO: 63529 - RNA, 22 nt, Homo sapiens
ggcaugaugcgcacgccuguag

SEQ ID NO: 63530 - RNA, 22 nt, Homo sapiens
gggaagugugcagaguucucuu

SEQ ID NO: 63531 - RNA, 22 nt, Homo sapiens
gggagcaaaaaugaugcccaag

SEQ ID NO: 63532 - RNA, 19 nt, Homo sapiens
gggaggaugcgucuucagg

SEQ ID NO: 63533 - RNA, 22 nt, Homo sapiens
gggagugucuaaccuguuaaca

SEQ ID NO: 63534 - RNA, 22 nt, Homo sapiens
gggaguguguaggacccagugu

SEQ ID NO: 63535 - RNA, 22 nt, Homo sapiens
gggaugaagaagaauaguucgu

SEQ ID NO: 63536 - RNA, 22 nt, Homo sapiens
gggaugaauuagguauguuuau

SEQ ID NO: 63537 - RNA, 22 nt, Homo sapiens
gggauguaaaagugggcacauu

SEQ ID NO: 63538 - RNA, 22 nt, Homo sapiens
gggguauguaagugagugagug

SEQ ID NO: 63539 - RNA, 22 nt, Homo sapiens
gguaaacauaagagagcugacu

SEQ ID NO: 63540 - RNA, 22 nt, Homo sapiens
gguaacaguggggcuaugcuua

SEQ ID NO: 63541 - RNA, 22 nt, Homo sapiens
gguagacucuguaagugaucau

SEQ ID NO: 63542 - RNA, 22 nt, Homo sapiens
ggucagugcauucuaaaggcaa

SEQ ID NO: 63543 - RNA, 22 nt, Homo sapiens
ggucaguguuaucaccgaagga

SEQ ID NO: 63544 - RNA, 22 nt, Homo sapiens
ggucauggauaagauccagaag

SEQ ID NO: 63545 - RNA, 22 nt, Homo sapiens
ggucauggauugucuuuucuug

SEQ ID NO: 63546 - RNA, 22 nt, Homo sapiens
ggugaggaaaguugaguuucua

SEQ ID NO: 63547 - RNA, 22 nt, Homo sapiens
guacacaacaugcagguuuguu

SEQ ID NO: 63548 - RNA, 22 nt, Homo sapiens
guagaugcauggauuuacuucu

SEQ ID NO: 63549 - RNA, 22 nt, Homo sapiens
guagguaaguacuucuggugag

SEQ ID NO: 63550 - RNA, 22 nt, Homo sapiens
guagugcaguuugagaaucagu

SEQ ID NO: 63551 - RNA, 22 nt, Homo sapiens
guaguuuaucagaaagaauagg

SEQ ID NO: 63552 - RNA, 22 nt, Homo sapiens
guauuguacuacaagcucuuua

SEQ ID NO: 63553 - RNA, 22 nt, Homo sapiens
guauuugauuauagcaugcuua

SEQ ID NO: 63554 - RNA, 22 nt, Homo sapiens
uaucugguuauugcugcugauu

SEQ ID NO: 63555 - RNA, 22 nt, Homo sapiens
uaugaacacuuuugggaggcau

SEQ ID NO: 63556 - RNA, 20 nt, Homo sapiens
uaugacaaagccuagugagu

SEQ ID NO: 63557 - RNA, 22 nt, Homo sapiens
uaugacuuguuuucuggucugc

SEQ ID NO: 63558 - RNA, 19 nt, Homo sapiens
uaugagcuaugacaugcau

SEQ ID NO: 63559 - RNA, 22 nt, Homo sapiens
uaugccuuuugguucaagcaac

SEQ ID NO: 63560 - RNA, 22 nt, Homo sapiens
uaugcuuauugucucauccacu

SEQ ID NO: 63561 - RNA, 22 nt, Homo sapiens
uauggcaaugcauaggaaggaa

SEQ ID NO: 63562 - RNA, 22 nt, Homo sapiens
uaugucaugggguuuuugagau

SEQ ID NO: 63563 - RNA, 22 nt, Homo sapiens
uaugucuucuuuagagaaaugu

SEQ ID NO: 63564 - RNA, 20 nt, Homo sapiens
uauuacagaguaauggugga

SEQ ID NO: 63565 - RNA, 22 nt, Homo sapiens
uauuacauccauaggcucugcu

SEQ ID NO: 63566 - RNA, 22 nt, Homo sapiens
uauucaagccaaauucaagcca

SEQ ID NO: 63567 - RNA, 18 nt, Homo sapiens
uauuccucuuccucuauc

SEQ ID NO: 63568 - RNA, 22 nt, Homo sapiens
uauuccuuuugcauuuccacau

SEQ ID NO: 63569 - RNA, 22 nt, Homo sapiens
uauugcaauuggcagagugcua

SEQ ID NO: 63570 - RNA, 20 nt, Homo sapiens
uauugcacuccagucugggc

SEQ ID NO: 63571 - RNA, 22 nt, Homo sapiens
uauugcagugagauccaucugg

SEQ ID NO: 63572 - RNA, 22 nt, Homo sapiens
uauugcugaugcugaagggaag

SEQ ID NO: 63573 - RNA, 22 nt, Homo sapiens
uauuguacauauccucccuuca

SEQ ID NO: 63574 - RNA, 22 nt, Homo sapiens
uauuucaguugcguuucccgag

SEQ ID NO: 63575 - RNA, 22 nt, Homo sapiens
uauuugauugacuuuagcagga

SEQ ID NO: 63576 - RNA, 22 nt, Homo sapiens
uauuugguuauaugaguaaguu

SEQ ID NO: 63577 - RNA, 22 nt, Homo sapiens
ucaaaguaaagccucaggaugg

SEQ ID NO: 63578 - RNA, 22 nt, Homo sapiens
ucaaaguauucuucugagaacc

SEQ ID NO: 63579 - RNA, 22 nt, Homo sapiens
ucaacugcuugagaucacaaau

SEQ ID NO: 63580 - RNA, 22 nt, Homo sapiens
ucaagcaauucuccugccucag

SEQ ID NO: 63581 - RNA, 22 nt, Homo sapiens
ucaaggcacauuugacauuuuc

SEQ ID NO: 63582 - RNA, 22 nt, Homo sapiens
ucaagguacguugccucagauu

SEQ ID NO: 63583 - RNA, 22 nt, Homo sapiens
ucaaguacuuauuugauaauua

SEQ ID NO: 63584 - RNA, 22 nt, Homo sapiens
ucaauugcuuaugaagauacau

SEQ ID NO: 63585 - RNA, 18 nt, Homo sapiens
ucacaaccacagugcugu

SEQ ID NO: 63586 - RNA, 23 nt, Homo sapiens
ucacacuuaagagaaaugcagcu

SEQ ID NO: 63587 - RNA, 22 nt, Homo sapiens
ucacagccuaguuuuauacauu

SEQ ID NO: 63588 - RNA, 22 nt, Homo sapiens
ucacaguccuguuuaggagagg

SEQ ID NO: 63589 - RNA, 22 nt, Homo sapiens
ucacagugaguggaguggggug

SEQ ID NO: 63590 - RNA, 22 nt, Homo sapiens
ucacaucucagguuucuugaca

SEQ ID NO: 63591 - RNA, 22 nt, Homo sapiens
ucacaugaagauuuuaguauac

SEQ ID NO: 63592 - RNA, 22 nt, Homo sapiens
ucacauggauuaacucauuuau

SEQ ID NO: 63593 - RNA, 22 nt, Homo sapiens
ucacauggggaagggacuagcu

SEQ ID NO: 63594 - RNA, 22 nt, Homo sapiens
ucacauuaagcuguuauuucuu

SEQ ID NO: 63595 - RNA, 22 nt, Homo sapiens
ucacauucaauuguaauccccg

SEQ ID NO: 63596 - RNA, 22 nt, Homo sapiens
ucaccuggagaagauggaucau

SEQ ID NO: 63597 - RNA, 22 nt, Homo sapiens
ucaccuggagccuucacauucu

SEQ ID NO: 63598 - RNA, 22 nt, Homo sapiens
ucaccuggggcacagcugaaga

SEQ ID NO: 63599 - RNA, 22 nt, Homo sapiens
ucaccuguagcuaagaccuaau

SEQ ID NO: 63600 - RNA, 22 nt, Homo sapiens
ucacugugguuggaaggcuuaa

SEQ ID NO: 63601 - RNA, 22 nt, Homo sapiens
ucacuguguauguauaugcagg

SEQ ID NO: 63602 - RNA, 22 nt, Homo sapiens
ucagacacugcccuccaccugu

SEQ ID NO: 63603 - RNA, 22 nt, Homo sapiens
ucagaguagaaacacuuccaua

SEQ ID NO: 63604 - RNA, 22 nt, Homo sapiens
ucagagugcagggaguagcagc

SEQ ID NO: 63605 - RNA, 22 nt, Homo sapiens
ucagaugaucugguaagaacuu

SEQ ID NO: 63606 - RNA, 22 nt, Homo sapiens
ucagauguuucuuuaacgcaug

SEQ ID NO: 63607 - RNA, 22 nt, Homo sapiens
ucagauguuuuguuuaucugcu

SEQ ID NO: 63608 - RNA, 22 nt, Homo sapiens
ucagcaaugaccuaagcaaaua

SEQ ID NO: 63609 - RNA, 22 nt, Homo sapiens
ucagcagugagagaccucaccc

SEQ ID NO: 63610 - RNA, 22 nt, Homo sapiens
ucagcagugccccacucuacug

SEQ ID NO: 63611 - RNA, 22 nt, Homo sapiens
ucaggcacucagcuuagagucu

SEQ ID NO: 63612 - RNA, 22 nt, Homo sapiens
ucagguagcauuuuggaaacag

SEQ ID NO: 63613 - RNA, 22 nt, Homo sapiens
ugaauauguuaaauaauguucu

SEQ ID NO: 63614 - RNA, 22 nt, Homo sapiens
ugaauauguuucuaaaagugca

SEQ ID NO: 63615 - RNA, 22 nt, Homo sapiens
ugaauguuguugguugagauau

SEQ ID NO: 63616 - RNA, 23 nt, Homo sapiens
ugacaaccucaugcuuugucaug

SEQ ID NO: 63617 - RNA, 22 nt, Homo sapiens
ugacaagauauggucuuaucaa

SEQ ID NO: 63618 - RNA, 19 nt, Homo sapiens
ugacacuguuggugggagg

SEQ ID NO: 63619 - RNA, 22 nt, Homo sapiens
ugacagaggucuuuuaauagcu

SEQ ID NO: 63620 - RNA, 22 nt, Homo sapiens
ugacagcugaagauguugaacc

SEQ ID NO: 63621 - RNA, 23 nt, Homo sapiens
ugacagugcuugaaauugcucuu

SEQ ID NO: 63622 - RNA, 22 nt, Homo sapiens
ugacaguguccucauucccaac

SEQ ID NO: 63623 - RNA, 22 nt, Homo sapiens
ugacaugaagaaaaacagauuu

SEQ ID NO: 63624 - RNA, 22 nt, Homo sapiens
ugacaugaaggcaccucugucc

SEQ ID NO: 63625 - RNA, 22 nt, Homo sapiens
ugacaugauguuccuacacugu

SEQ ID NO: 63626 - RNA, 22 nt, Homo sapiens
ugacaugauuguauauuuagaa

SEQ ID NO: 63627 - RNA, 22 nt, Homo sapiens
ugacauggaagauguucaugau

SEQ ID NO: 63628 - RNA, 22 nt, Homo sapiens
ugacauggagggugcggcugca

SEQ ID NO: 63629 - RNA, 22 nt, Homo sapiens
ugacauggagguggaggaagau

SEQ ID NO: 63630 - RNA, 22 nt, Homo sapiens
ugacauguccaggugguccugu

SEQ ID NO: 63631 - RNA, 22 nt, Homo sapiens
ugaccacagaaagugagggagc

SEQ ID NO: 63632 - RNA, 22 nt, Homo sapiens
ugacuacaaccuccaccucccg

SEQ ID NO: 63633 - RNA, 22 nt, Homo sapiens
ugacuacacacaauuugucaag

SEQ ID NO: 63634 - RNA, 22 nt, Homo sapiens
ugacuauaguaaucacuucaca

SEQ ID NO: 63635 - RNA, 22 nt, Homo sapiens
ugacuauaucucuguauaaacu

SEQ ID NO: 63636 - RNA, 22 nt, Homo sapiens
ugacuggagaccucaguagggu

SEQ ID NO: 63637 - RNA, 22 nt, Homo sapiens
ugacuuaugcaacucugaugug

SEQ ID NO: 63638 - RNA, 22 nt, Homo sapiens
ugacuugaggcucgcacaaguu

SEQ ID NO: 63639 - RNA, 22 nt, Homo sapiens
ugacuuuagaauuuuauccaga

SEQ ID NO: 63640 - RNA, 22 nt, Homo sapiens
ugagaacaugcacuugagguug

SEQ ID NO: 63641 - RNA, 19 nt, Homo sapiens
ugagaaccucuacagaguc

SEQ ID NO: 63642 - RNA, 22 nt, Homo sapiens
ugagaagacaucuuugcuuugu

SEQ ID NO: 63643 - RNA, 22 nt, Homo sapiens
ugagaagugacgcagcaggguu

SEQ ID NO: 63644 - RNA, 22 nt, Homo sapiens
uacauacuucacagacuuuaaa

SEQ ID NO: 63645 - RNA, 22 nt, Homo sapiens
uacauaguaagcacuaugccaa

SEQ ID NO: 63646 - RNA, 22 nt, Homo sapiens
uacauugcacuuuauuagauac

SEQ ID NO: 63647 - RNA, 22 nt, Homo sapiens
uaccagcauuucucuuuaagua

SEQ ID NO: 63648 - RNA, 22 nt, Homo sapiens
uacucacauucuguuucuugcu

SEQ ID NO: 63649 - RNA, 22 nt, Homo sapiens
uacucugcagagaugcauaaca

SEQ ID NO: 63650 - RNA, 22 nt, Homo sapiens
uacucugcaguaauuccagccc

SEQ ID NO: 63651 - RNA, 22 nt, Homo sapiens
uacugcacuccagccuggguga

SEQ ID NO: 63652 - RNA, 21 nt, Homo sapiens
uacuggagauacagucugcaa

SEQ ID NO: 63653 - RNA, 22 nt, Homo sapiens
uacuggccuugaacucuggugu

SEQ ID NO: 63654 - RNA, 22 nt, Homo sapiens
uagaacauuccaggugauguug

SEQ ID NO: 63655 - RNA, 18 nt, Homo sapiens
uagaauauaggucauucu

SEQ ID NO: 63656 - RNA, 20 nt, Homo sapiens
uagacagcuagauuagauag

SEQ ID NO: 63657 - RNA, 22 nt, Homo sapiens
uagagcacauuaucauuuccaa

SEQ ID NO: 63658 - RNA, 22 nt, Homo sapiens
uagaggaaggauuggaaacgca

SEQ ID NO: 63659 - RNA, 22 nt, Homo sapiens
uagagguagccuacuacacacc

SEQ ID NO: 63660 - RNA, 22 nt, Homo sapiens
uagagguagguguaugaacuag

SEQ ID NO: 63661 - RNA, 22 nt, Homo sapiens
uagaucauauacuugccaugac

SEQ ID NO: 63662 - RNA, 19 nt, Homo sapiens
uagcacagggucccagacu

SEQ ID NO: 63663 - RNA, 20 nt, Homo sapiens
uagcacaucuggcuguagag

SEQ ID NO: 63664 - RNA, 22 nt, Homo sapiens
uagcagcaaagcaggaucugcu

SEQ ID NO: 63665 - RNA, 22 nt, Homo sapiens
uagcagcaccccacucuacugg

SEQ ID NO: 63666 - RNA, 22 nt, Homo sapiens
uagcagccaggaagggcuggcu

SEQ ID NO: 63667 - RNA, 22 nt, Homo sapiens
uagcaguauggagcgaggccca

SEQ ID NO: 63668 - RNA, 22 nt, Homo sapiens
uagcuccagugggguuacugcu

SEQ ID NO: 63669 - RNA, 17 nt, Homo sapiens
uagcucuauuucuagcc

SEQ ID NO: 63670 - RNA, 22 nt, Homo sapiens
uagcugagacuacaguaggugc

SEQ ID NO: 63671 - RNA, 22 nt, Homo sapiens
uagcugcacuuacaagugagaa

SEQ ID NO: 63672 - RNA, 18 nt, Homo sapiens
uaggaacauugauuggag

SEQ ID NO: 63673 - RNA, 22 nt, Homo sapiens
uaggaaguuucuugauuacuua

SEQ ID NO: 63674 - RNA, 19 nt, Homo sapiens
uaggacccugguggccccc

SEQ ID NO: 63675 - RNA, 22 nt, Homo sapiens
uaggcaaaugcaagaguagaac

SEQ ID NO: 63676 - RNA, 22 nt, Homo sapiens
uaggcaguuuuccuuucacagu

SEQ ID NO: 63677 - RNA, 22 nt, Homo sapiens
uagggaguuuuggggugcagaa

SEQ ID NO: 63678 - RNA, 22 nt, Homo sapiens
uaggggcacacuucgguuagca

SEQ ID NO: 63679 - RNA, 22 nt, Homo sapiens
uaggguaguaauaguuguuuca

SEQ ID NO: 63680 - RNA, 22 nt, Homo sapiens
uagguacuuaagaucucagcua

SEQ ID NO: 63681 - RNA, 22 nt, Homo sapiens
uagguaguuacacagcaaugua

SEQ ID NO: 63682 - RNA, 22 nt, Homo sapiens
uaggucaguuuuggcuuggcuu

SEQ ID NO: 63683 - RNA, 22 nt, Homo sapiens
uagguugucaucagucuccacu

SEQ ID NO: 63684 - RNA, 22 nt, Homo sapiens
uaguaacacauugaacgaucgc

SEQ ID NO: 63685 - RNA, 18 nt, Homo sapiens
uaguacuguucucaugau

SEQ ID NO: 63686 - RNA, 22 nt, Homo sapiens
uaguccauuuucaugcugcuau

SEQ ID NO: 63687 - RNA, 20 nt, Homo sapiens
uauagcaauuuuuuucuccu

SEQ ID NO: 63688 - RNA, 22 nt, Homo sapiens
uauagcacugagaauguaauuc

SEQ ID NO: 63689 - RNA, 22 nt, Homo sapiens
uauagcuugauuauggugaugg

SEQ ID NO: 63690 - RNA, 22 nt, Homo sapiens
uauaugcaacauaguguaugug

SEQ ID NO: 63691 - RNA, 22 nt, Homo sapiens
uaucacaggucaggaaccuugu

SEQ ID NO: 63692 - RNA, 20 nt, Homo sapiens
uaucacauggggagaaaccu

SEQ ID NO: 63693 - RNA, 22 nt, Homo sapiens
uaucaccuugcaggagcuauga

SEQ ID NO: 63694 - RNA, 22 nt, Homo sapiens
uaucagaguuacacugaagacu

SEQ ID NO: 63695 - RNA, 22 nt, Homo sapiens
uaucagcacaguggguucaugg

SEQ ID NO: 63696 - RNA, 21 nt, Homo sapiens
uaucccagucacaucuaccca

SEQ ID NO: 63697 - RNA, 23 nt, Homo sapiens
uaucucaaugcacagagaggaaa

SEQ ID NO: 63698 - RNA, 18 nt, Homo sapiens
uaucucauuucuuagguc

SEQ ID NO: 63699 - RNA, 22 nt, Homo sapiens
uaucucuguggguagugcugaa

SEQ ID NO: 63700 - RNA, 22 nt, Homo sapiens
uaucucuuuucauguguaaaug

SEQ ID NO: 63701 - RNA, 20 nt, Homo sapiens
uaugaaacaguguagagcaa

SEQ ID NO: 63702 - RNA, 22 nt, Homo sapiens
uaugaagccaggauuuauuauu

SEQ ID NO: 63703 - RNA, 22 nt, Homo sapiens
uaugcacacguguccaugugca

SEQ ID NO: 63704 - RNA, 22 nt, Homo sapiens
uaugcacuauagcauauguggu

SEQ ID NO: 63705 - RNA, 22 nt, Homo sapiens
uaugcuuauaaacauuugucag

SEQ ID NO: 63706 - RNA, 19 nt, Homo sapiens
uaugggauuuuuagggugu

SEQ ID NO: 63707 - RNA, 22 nt, Homo sapiens
uaugucacagguuuuggugaaa

SEQ ID NO: 63708 - RNA, 22 nt, Homo sapiens
aacauagucaugggguaauguu

SEQ ID NO: 63709 - RNA, 22 nt, Homo sapiens
aacauguuuagcagauaccugu

SEQ ID NO: 63710 - RNA, 22 nt, Homo sapiens
aaccuacauucuuaacuguugc

SEQ ID NO: 63711 - RNA, 22 nt, Homo sapiens
aacuugcacuugauugagagcu

SEQ ID NO: 63712 - RNA, 22 nt, Homo sapiens
aagagcgcugauaacauguuug

SEQ ID NO: 63713 - RNA, 23 nt, Homo sapiens
aagagguaugacuaugaagugga

SEQ ID NO: 63714 - RNA, 22 nt, Homo sapiens
aagaguuaguaaaauuuccucu

SEQ ID NO: 63715 - RNA, 22 nt, Homo sapiens
aagaugcagaagcccagauguu

SEQ ID NO: 63716 - RNA, 22 nt, Homo sapiens
aagaugguauuucauuaguuuu

SEQ ID NO: 63717 - RNA, 22 nt, Homo sapiens
aagcaaacaucagcuugguuaa

SEQ ID NO: 63718 - RNA, 22 nt, Homo sapiens
aagcaucacauaauggaucaug

SEQ ID NO: 63719 - RNA, 22 nt, Homo sapiens
aagcaucauuuggaauuugaga

SEQ ID NO: 63720 - RNA, 22 nt, Homo sapiens
aagcauccagcauggaacugaa

SEQ ID NO: 63721 - RNA, 22 nt, Homo sapiens
aagcaugguuuccaggggucac

SEQ ID NO: 63722 - RNA, 20 nt, Homo sapiens
aagcugaguguuuuuuuaau

SEQ ID NO: 63723 - RNA, 22 nt, Homo sapiens
aagcugugucuugucagcuacc

SEQ ID NO: 63724 - RNA, 23 nt, Homo sapiens
aaggacacugaacacuucccagc

SEQ ID NO: 63725 - RNA, 22 nt, Homo sapiens
aaggcaacgugaguuguugauu

SEQ ID NO: 63726 - RNA, 22 nt, Homo sapiens
aaggcaagaaaauggauucucc

SEQ ID NO: 63727 - RNA, 22 nt, Homo sapiens
aaggcaagaaugcgugcuuuca

SEQ ID NO: 63728 - RNA, 22 nt, Homo sapiens
aaggcacugaacuuaaauucug

SEQ ID NO: 63729 - RNA, 22 nt, Homo sapiens
aaggcauggugacuauuuaggc

SEQ ID NO: 63730 - RNA, 22 nt, Homo sapiens
aaggcuagagaagaagggcauc

SEQ ID NO: 63731 - RNA, 22 nt, Homo sapiens
aaggcuguucauuuagcacagu

SEQ ID NO: 63732 - RNA, 22 nt, Homo sapiens
aagggaauguuguggcugguug

SEQ ID NO: 63733 - RNA, 22 nt, Homo sapiens
aaguaaacauugagagacaaga

SEQ ID NO: 63734 - RNA, 22 nt, Homo sapiens
aaguaaauauccgguaguccca

SEQ ID NO: 63735 - RNA, 22 nt, Homo sapiens
aaguaaaucuuaugucagggag

SEQ ID NO: 63736 - RNA, 22 nt, Homo sapiens
aaguaauugagguuuuugcugu

SEQ ID NO: 63737 - RNA, 22 nt, Homo sapiens
aaguagugcuugugcucaucuc

SEQ ID NO: 63738 - RNA, 22 nt, Homo sapiens
aagucaaggagagaagcuucag

SEQ ID NO: 63739 - RNA, 22 nt, Homo sapiens
aagucaaggagagaggcgucag

SEQ ID NO: 63740 - RNA, 22 nt, Homo sapiens
aagugcucuugaaacugucuua

SEQ ID NO: 63741 - RNA, 22 nt, Homo sapiens
aaguuguuggaguuccauuguu

SEQ ID NO: 63742 - RNA, 22 nt, Homo sapiens
aauaaagcaggguccuugcacu

SEQ ID NO: 63743 - RNA, 22 nt, Homo sapiens
uuucauggacgcaaugccuuuu

SEQ ID NO: 63744 - RNA, 22 nt, Homo sapiens
uuuccaagaugcuuacuuucuc

SEQ ID NO: 63745 - RNA, 22 nt, Homo sapiens
uuuccaguuguucuagaaagcu

SEQ ID NO: 63746 - RNA, 22 nt, Homo sapiens
uuucccuuuagcuuagugauuu

SEQ ID NO: 63747 - RNA, 22 nt, Homo sapiens
uuuccuguagggggcaaggccu

SEQ ID NO: 63748 - RNA, 23 nt, Homo sapiens
uuucuugggcaugcuaugucagu

SEQ ID NO: 63749 - RNA, 22 nt, Homo sapiens
uuucuugguuguauuuagacuu

SEQ ID NO: 63750 - RNA, 20 nt, Homo sapiens
uuugaauguaaagcauguca

SEQ ID NO: 63751 - RNA, 22 nt, Homo sapiens
uuugacuaccaggaauguucuu

SEQ ID NO: 63752 - RNA, 22 nt, Homo sapiens
uuugacuagaguguuuuacaac

SEQ ID NO: 63753 - RNA, 22 nt, Homo sapiens
uuugagaucuuuagaaucaggc

SEQ ID NO: 63754 - RNA, 22 nt, Homo sapiens
uuugcacauauuugggcaaaag

SEQ ID NO: 63755 - RNA, 22 nt, Homo sapiens
uuugcacuggagauucaauggg

SEQ ID NO: 63756 - RNA, 23 nt, Homo sapiens
uuugcacuugcuccuucuauggc

SEQ ID NO: 63757 - RNA, 22 nt, Homo sapiens
uuugcaucuuagaaaguucucc

SEQ ID NO: 63758 - RNA, 22 nt, Homo sapiens
uuugcaugcuccuuaugagaau

SEQ ID NO: 63759 - RNA, 22 nt, Homo sapiens
uuugccaaucagaggcaucuug

SEQ ID NO: 63760 - RNA, 22 nt, Homo sapiens
uuugccaaugggaauuuuccua

SEQ ID NO: 63761 - RNA, 22 nt, Homo sapiens
uuuggacuucuagccuccagag

SEQ ID NO: 63762 - RNA, 21 nt, Homo sapiens
uuuggcauuaugucaccagag

SEQ ID NO: 63763 - RNA, 22 nt, Homo sapiens
uggauggugauuggaucaugga

SEQ ID NO: 63764 - RNA, 22 nt, Homo sapiens
uggcaaagugugacgugggggu

SEQ ID NO: 63765 - RNA, 21 nt, Homo sapiens
uggcaacauggauggauucug

SEQ ID NO: 63766 - RNA, 22 nt, Homo sapiens
uggcaagaacaacaauuacuuu

SEQ ID NO: 63767 - RNA, 22 nt, Homo sapiens
uggcaagaaccacaauuacuuu

SEQ ID NO: 63768 - RNA, 22 nt, Homo sapiens
uggcaagaacgaaauguagggu

SEQ ID NO: 63769 - RNA, 22 nt, Homo sapiens
uggcaagagcaaaauguacagu

SEQ ID NO: 63770 - RNA, 22 nt, Homo sapiens
uggcaccauccaggugucucua

SEQ ID NO: 63771 - RNA, 22 nt, Homo sapiens
uggcaggugcacuggcuuugaa

SEQ ID NO: 63772 - RNA, 22 nt, Homo sapiens
uggcaugaagaccccauccuuu

SEQ ID NO: 63773 - RNA, 22 nt, Homo sapiens
uggccaguguuuuuccugggcu

SEQ ID NO: 63774 - RNA, 22 nt, Homo sapiens
uggcgagaaaccauaugcuuuc

SEQ ID NO: 63775 - RNA, 22 nt, Homo sapiens
uggcgagaugcucgugugcaga

SEQ ID NO: 63776 - RNA, 22 nt, Homo sapiens
uggcuguuuauuucacgugggu

SEQ ID NO: 63777 - RNA, 18 nt, Homo sapiens
ugggaagaaauucuucuc

SEQ ID NO: 63778 - RNA, 22 nt, Homo sapiens
ugggaagaagguuuacuugcca

SEQ ID NO: 63779 - RNA, 22 nt, Homo sapiens
ugggaagagggagcgauuuugg

SEQ ID NO: 63780 - RNA, 22 nt, Homo sapiens
ugggagcauugcauuagaagcc

SEQ ID NO: 63781 - RNA, 21 nt, Homo sapiens
ugggccccuuccuuacaucau

SEQ ID NO: 63782 - RNA, 22 nt, Homo sapiens
uggggugugagggagaaagaaa

SEQ ID NO: 63783 - RNA, 22 nt, Homo sapiens
ugguaugucuagauggggaagu

SEQ ID NO: 63784 - RNA, 22 nt, Homo sapiens
uggucaguugaguccuugccaa

SEQ ID NO: 63785 - RNA, 22 nt, Homo sapiens
uggucaguugugccucaauucc

SEQ ID NO: 63786 - RNA, 22 nt, Homo sapiens
uggucaugaggugaggcuucuc

SEQ ID NO: 63787 - RNA, 22 nt, Homo sapiens
uggugagaaaagaugucuuugu

SEQ ID NO: 63788 - RNA, 21 nt, Homo sapiens
ugguucaguucguuacgugug

SEQ ID NO: 63789 - RNA, 22 nt, Homo sapiens
uguaauuuaaaugauccuugga

SEQ ID NO: 63790 - RNA, 22 nt, Homo sapiens
uguacaaaacaagaugggggua

SEQ ID NO: 63791 - RNA, 22 nt, Homo sapiens
uguagcaaaucgauacuauugg

SEQ ID NO: 63792 - RNA, 22 nt, Homo sapiens
uguauacugucuaauauguugu

SEQ ID NO: 63793 - RNA, 22 nt, Homo sapiens
uguauauguuuguacauauguc

SEQ ID NO: 63794 - RNA, 22 nt, Homo sapiens
uguaugucugcucuuuggaacu

SEQ ID NO: 63795 - RNA, 22 nt, Homo sapiens
uguauuuguuguuaaauggaga

SEQ ID NO: 63796 - RNA, 22 nt, Homo sapiens
ugucaaauucuggguuaaaaca

SEQ ID NO: 63797 - RNA, 22 nt, Homo sapiens
ugucacagagauuuugguaugu

SEQ ID NO: 63798 - RNA, 22 nt, Homo sapiens
ugucacccuuuauccauuuccu

SEQ ID NO: 63799 - RNA, 22 nt, Homo sapiens
ugucacugugcagucaugcauu

SEQ ID NO: 63800 - RNA, 18 nt, Homo sapiens
ugucagaguggauuguaa

SEQ ID NO: 63801 - RNA, 22 nt, Homo sapiens
ugucaguuucccuccucuuccu

SEQ ID NO: 63802 - RNA, 22 nt, Homo sapiens
ugucaguuuuaacuagggaaua

SEQ ID NO: 63803 - RNA, 22 nt, Homo sapiens
ugucauacaguaacaugguugg

SEQ ID NO: 63804 - RNA, 22 nt, Homo sapiens
ugucauggucacaggcauuuca

SEQ ID NO: 63805 - RNA, 22 nt, Homo sapiens
ugucauggugcucugggcccug

SEQ ID NO: 63806 - RNA, 22 nt, Homo sapiens
ugucaugucaacuauggaauuu

SEQ ID NO: 63807 - RNA, 22 nt, Homo sapiens
ugucauguugagaaacuuggau

SEQ ID NO: 63808 - RNA, 21 nt, Homo sapiens
ugucuagaccucauccuacag

SEQ ID NO: 63809 - RNA, 22 nt, Homo sapiens
ugucucaguucccuucucugga

SEQ ID NO: 63810 - RNA, 22 nt, Homo sapiens
ugugacaaauuuaguggacugu

SEQ ID NO: 63811 - RNA, 22 nt, Homo sapiens
ugugacagcacagcaucucuuu

SEQ ID NO: 63812 - RNA, 19 nt, Homo sapiens
ugugacugguugucucgcu

SEQ ID NO: 63813 - RNA, 22 nt, Homo sapiens
ugugagcuauggaguuguagag

SEQ ID NO: 63814 - RNA, 20 nt, Homo sapiens
ugugauuauuuaguugcaug

SEQ ID NO: 63815 - RNA, 22 nt, Homo sapiens
ugugauuauuuauagacaguca

SEQ ID NO: 63816 - RNA, 22 nt, Homo sapiens
ugugcaaaaguaauugcgguuu

SEQ ID NO: 63817 - RNA, 22 nt, Homo sapiens
ugugcaaauuagcacaacccga

SEQ ID NO: 63818 - RNA, 18 nt, Homo sapiens
ugugcaauauuaaccacc

SEQ ID NO: 63819 - RNA, 22 nt, Homo sapiens
ugugcacaugauauaucacaua

SEQ ID NO: 63820 - RNA, 22 nt, Homo sapiens
ugugccuacugugggagcguca

SEQ ID NO: 63821 - RNA, 22 nt, Homo sapiens
uguggcuucuuugguucaguau

SEQ ID NO: 63822 - RNA, 22 nt, Homo sapiens
ugugguagugcuuaccugcagu

SEQ ID NO: 63823 - RNA, 22 nt, Homo sapiens
ugugguuuuucacauuuagaga

SEQ ID NO: 63824 - RNA, 22 nt, Homo sapiens
uguuaagaugucaauuuuccac

SEQ ID NO: 63825 - RNA, 22 nt, Homo sapiens
uguucaauucccaccuaugagu

SEQ ID NO: 63826 - RNA, 22 nt, Homo sapiens
uguucuugagccuuuagaccua

SEQ ID NO: 63827 - RNA, 22 nt, Homo sapiens
uguugcauuugucaaggucaag

SEQ ID NO: 63828 - RNA, 22 nt, Homo sapiens
uguuggacuuacuuggcagauu

SEQ ID NO: 63829 - RNA, 21 nt, Homo sapiens
uguuuuugcuguguaucucuc

SEQ ID NO: 63830 - RNA, 22 nt, Homo sapiens
ugagguuggguaauuuaugaag

SEQ ID NO: 63831 - RNA, 22 nt, Homo sapiens
ugagguugucagugucauucuu

SEQ ID NO: 63832 - RNA, 22 nt, Homo sapiens
ugaguaguauucuaugguaugu

SEQ ID NO: 63833 - RNA, 22 nt, Homo sapiens
ugagucagucucacucugcugc

SEQ ID NO: 63834 - RNA, 22 nt, Homo sapiens
ugagugaaagaagcacuaagga

SEQ ID NO: 63835 - RNA, 22 nt, Homo sapiens
ugagugaggcugggcagucccu

SEQ ID NO: 63836 - RNA, 18 nt, Homo sapiens
ugaguucauuagacuucc

SEQ ID NO: 63837 - RNA, 22 nt, Homo sapiens
ugaguugagauaagguuacauu

SEQ ID NO: 63838 - RNA, 22 nt, Homo sapiens
ugauaauguuaggcuuuauuca

SEQ ID NO: 63839 - RNA, 22 nt, Homo sapiens
ugauagaucugggcaaaguaaa

SEQ ID NO: 63840 - RNA, 22 nt, Homo sapiens
ugauaucugaucauccuugaua

SEQ ID NO: 63841 - RNA, 22 nt, Homo sapiens
ugauauuuuugauccuuaaguu

SEQ ID NO: 63842 - RNA, 22 nt, Homo sapiens
ugauggccuguucuccauaugu

SEQ ID NO: 63843 - RNA, 22 nt, Homo sapiens
ugaugucuugagauggagcuua

SEQ ID NO: 63844 - RNA, 22 nt, Homo sapiens
ugauuagagcccaagcuuugaa

SEQ ID NO: 63845 - RNA, 22 nt, Homo sapiens
ugcaaauguuaggugucauuau

SEQ ID NO: 63846 - RNA, 22 nt, Homo sapiens
ugcaagaaucagccuaucauua

SEQ ID NO: 63847 - RNA, 21 nt, Homo sapiens
ugcaagaaucaggaagcugcc

SEQ ID NO: 63848 - RNA, 22 nt, Homo sapiens
ugcaagacuaaaccuuccccuc

SEQ ID NO: 63849 - RNA, 22 nt, Homo sapiens
ugcaagaggagacuguacucag

SEQ ID NO: 63850 - RNA, 22 nt, Homo sapiens
ugcacaaccucacccccgcucu

SEQ ID NO: 63851 - RNA, 22 nt, Homo sapiens
ugcaccacugcaccccagucug

SEQ ID NO: 63852 - RNA, 22 nt, Homo sapiens
ugcaccacugcuagccugggua

SEQ ID NO: 63853 - RNA, 22 nt, Homo sapiens
ugcagcacaguagguuugcaau

SEQ ID NO: 63854 - RNA, 18 nt, Homo sapiens
ugcagcaucaguacccag

SEQ ID NO: 63855 - RNA, 18 nt, Homo sapiens
ugcagcuuugugauuggc

SEQ ID NO: 63856 - RNA, 17 nt, Homo sapiens
uuaugagacuucuuagc

SEQ ID NO: 63857 - RNA, 22 nt, Homo sapiens
uuaugguuuuucugugagaugg

SEQ ID NO: 63858 - RNA, 22 nt, Homo sapiens
uuauguaaaucaaucuggaauc

SEQ ID NO: 63859 - RNA, 22 nt, Homo sapiens
uuauguguuuaauguuucugaa

SEQ ID NO: 63860 - RNA, 16 nt, Homo sapiens
uuauugcauucuucuc

SEQ ID NO: 63861 - RNA, 22 nt, Homo sapiens
uucaaaguaaagggauggagac

SEQ ID NO: 63862 - RNA, 22 nt, Homo sapiens
uucaaaguuggaggacaaacug

SEQ ID NO: 63863 - RNA, 22 nt, Homo sapiens
uucaagauggcaccagugagug

SEQ ID NO: 63864 - RNA, 22 nt, Homo sapiens
uucaaguaagaaagacaucagg

SEQ ID NO: 63865 - RNA, 20 nt, Homo sapiens
uucaagugauucucaugccu

SEQ ID NO: 63866 - RNA, 22 nt, Homo sapiens
uucaauuaauauuauacucuca

SEQ ID NO: 63867 - RNA, 22 nt, Homo sapiens
uucacagaaaaaggcgaugagg

SEQ ID NO: 63868 - RNA, 23 nt, Homo sapiens
uucaccguguuggccaggcuggu

SEQ ID NO: 63869 - RNA, 22 nt, Homo sapiens
uucacuggagcccaggaguugg

SEQ ID NO: 63870 - RNA, 22 nt, Homo sapiens
uucagacugggugaagagggua

SEQ ID NO: 63871 - RNA, 22 nt, Homo sapiens
uucagaguggacagaaauuaag

SEQ ID NO: 63872 - RNA, 22 nt, Homo sapiens
uucagcaaugacagccuauaua

SEQ ID NO: 63873 - RNA, 22 nt, Homo sapiens
uucagcuacuuggaaacagcaa

SEQ ID NO: 63874 - RNA, 22 nt, Homo sapiens
uucaggcaccauggucauugau

SEQ ID NO: 63875 - RNA, 22 nt, Homo sapiens
uucaggcaccauugucauugau

SEQ ID NO: 63876 - RNA, 22 nt, Homo sapiens
uucaggcuccgugccagcuccg

SEQ ID NO: 63877 - RNA, 22 nt, Homo sapiens
uucagguacugggggaguaugg

SEQ ID NO: 63878 - RNA, 22 nt, Homo sapiens
uucaucacagucuccgaugccc

SEQ ID NO: 63879 - RNA, 22 nt, Homo sapiens
uucaucagggguauuggccaau

SEQ ID NO: 63880 - RNA, 22 nt, Homo sapiens
uucauggaacaaguggguucaa

SEQ ID NO: 63881 - RNA, 22 nt, Homo sapiens
uucauggaguugagaaggcuaa

SEQ ID NO: 63882 - RNA, 23 nt, Homo sapiens
uuccaccauugacuaguuacaua

SEQ ID NO: 63883 - RNA, 22 nt, Homo sapiens
uuccagaugggaguucuauucu

SEQ ID NO: 63884 - RNA, 22 nt, Homo sapiens
uuccaggugggcgugggccugg

SEQ ID NO: 63885 - RNA, 22 nt, Homo sapiens
uuccaguggaguaaauggacaa

SEQ ID NO: 63886 - RNA, 22 nt, Homo sapiens
uucccuagaacacauggaggga

SEQ ID NO: 63887 - RNA, 22 nt, Homo sapiens
uucccucagaaacacacagccc

SEQ ID NO: 63888 - RNA, 22 nt, Homo sapiens
uucccuuugaaacuaaacuugc

SEQ ID NO: 63889 - RNA, 22 nt, Homo sapiens
uucccuuuguuaaauuggaaga

SEQ ID NO: 63890 - RNA, 22 nt, Homo sapiens
uuccuuguagcaaaugcgauga

SEQ ID NO: 63891 - RNA, 22 nt, Homo sapiens
uucuaaguaauuuugcaugccu

SEQ ID NO: 63892 - RNA, 23 nt, Homo sapiens
uucuaucaggcccaggagcccug

SEQ ID NO: 63893 - RNA, 22 nt, Homo sapiens
uucuccugguggacccuaaacg

SEQ ID NO: 63894 - RNA, 23 nt, Homo sapiens
uucugccacugaaaaugccucag

SEQ ID NO: 63895 - RNA, 22 nt, Homo sapiens
uucuggcuaugggauacuaaau

SEQ ID NO: 63896 - RNA, 22 nt, Homo sapiens
uucuggcuuuuaaagaaauguu

SEQ ID NO: 63897 - RNA, 22 nt, Homo sapiens
uucugugcuuguggaugaagug

SEQ ID NO: 63898 - RNA, 22 nt, Homo sapiens
uucugugguugaaaggagagau

SEQ ID NO: 63899 - RNA, 22 nt, Homo sapiens
uucugugguuucauuuaccugu

SEQ ID NO: 63900 - RNA, 22 nt, Homo sapiens
uucuucaggcauucccagaagc

SEQ ID NO: 63901 - RNA, 20 nt, Homo sapiens
uucuugaguuaacaaguuac

SEQ ID NO: 63902 - RNA, 22 nt, Homo sapiens
uugaaagacaucaccuacugcu

SEQ ID NO: 63903 - RNA, 22 nt, Homo sapiens
uugaagacuaauuuagauaaug

SEQ ID NO: 63904 - RNA, 23 nt, Homo sapiens
uugaauguuuccccucccaaauu

SEQ ID NO: 63905 - RNA, 22 nt, Homo sapiens
uugacauauuugugcuuaagaa

SEQ ID NO: 63906 - RNA, 22 nt, Homo sapiens
uugacuacaccaugccaggaac

SEQ ID NO: 63907 - RNA, 23 nt, Homo sapiens
uugacuguggguacaaugugaua

SEQ ID NO: 63908 - RNA, 22 nt, Homo sapiens
uugagacgaagucucacucuug

SEQ ID NO: 63909 - RNA, 22 nt, Homo sapiens
uugagagaaaaaauuuauuggu

SEQ ID NO: 63910 - RNA, 22 nt, Homo sapiens
uugagagcugaugaaagauaaa

SEQ ID NO: 63911 - RNA, 22 nt, Homo sapiens
uugagaguggaggcuauaucuu

SEQ ID NO: 63912 - RNA, 22 nt, Homo sapiens
uugagauaggaacucacuaugc

SEQ ID NO: 63913 - RNA, 22 nt, Homo sapiens
uugagauauccauaaaugggaa

SEQ ID NO: 63914 - RNA, 22 nt, Homo sapiens
uugagaucaugcuacugcacuc

SEQ ID NO: 63915 - RNA, 22 nt, Homo sapiens
uugagauccuuuugcucaucag

SEQ ID NO: 63916 - RNA, 22 nt, Homo sapiens
uugagaucuacuacuguaggag

SEQ ID NO: 63917 - RNA, 22 nt, Homo sapiens
uugagaugauggauaugcuaau

SEQ ID NO: 63918 - RNA, 22 nt, Homo sapiens
uugagauggagucucacucuug

SEQ ID NO: 63919 - RNA, 22 nt, Homo sapiens
uugagauggagucucgcucuuu

SEQ ID NO: 63920 - RNA, 22 nt, Homo sapiens
uugagauggagucucgcugugu

SEQ ID NO: 63921 - RNA, 22 nt, Homo sapiens
uugagauggagucuugcacugu

SEQ ID NO: 63922 - RNA, 22 nt, Homo sapiens
uugagauggagucuugcgcugu

SEQ ID NO: 63923 - RNA, 22 nt, Homo sapiens
uugagauggagucuugcucucu

SEQ ID NO: 63924 - RNA, 22 nt, Homo sapiens
uugagauggagucuuguucucu

SEQ ID NO: 63925 - RNA, 22 nt, Homo sapiens
uguagauauucuuucaguuuuu

SEQ ID NO: 63926 - RNA, 22 nt, Homo sapiens
uguauaguugagucaaguuuca

SEQ ID NO: 63927 - RNA, 22 nt, Homo sapiens
uguauguugauguuauauucug

SEQ ID NO: 63928 - RNA, 22 nt, Homo sapiens
ugucacauccaagaaggugcag

SEQ ID NO: 63929 - RNA, 22 nt, Homo sapiens
ugucaccuugcucauccucgga

SEQ ID NO: 63930 - RNA, 22 nt, Homo sapiens
ugucaggaguuuuagaaucuua

SEQ ID NO: 63931 - RNA, 22 nt, Homo sapiens
ugucauauagaauguucuauga

SEQ ID NO: 63932 - RNA, 22 nt, Homo sapiens
ugucaucauuggaaucugccuc

SEQ ID NO: 63933 - RNA, 22 nt, Homo sapiens
ugucauguauauaccacuucca

SEQ ID NO: 63934 - RNA, 22 nt, Homo sapiens
uguccaaauugaaucaucuggu

SEQ ID NO: 63935 - RNA, 22 nt, Homo sapiens
ugucuugagagaggacaugacu

SEQ ID NO: 63936 - RNA, 22 nt, Homo sapiens
ugucuuggacuugaaucucauu

SEQ ID NO: 63937 - RNA, 22 nt, Homo sapiens
ugucuuguagacaauguauagu

SEQ ID NO: 63938 - RNA, 22 nt, Homo sapiens
ugugaagauggacuaauauagu

SEQ ID NO: 63939 - RNA, 22 nt, Homo sapiens
ugugacaguguuacauuucaug

SEQ ID NO: 63940 - RNA, 22 nt, Homo sapiens
ugugaucaugugugccuuaguc

SEQ ID NO: 63941 - RNA, 22 nt, Homo sapiens
ugugcaaaaacaauugcgguuu

SEQ ID NO: 63942 - RNA, 22 nt, Homo sapiens
ugugccacugcacucuggccug

SEQ ID NO: 63943 - RNA, 22 nt, Homo sapiens
ugugccacugcacucugggcaa

SEQ ID NO: 63944 - RNA, 22 nt, Homo sapiens
ugugcguguaagagaucuaggu

SEQ ID NO: 63945 - RNA, 22 nt, Homo sapiens
ugugcuauguuauucacauggg

SEQ ID NO: 63946 - RNA, 22 nt, Homo sapiens
uguggaguguaugugacagaga

SEQ ID NO: 63947 - RNA, 22 nt, Homo sapiens
uguggccuuuguuucaguuggg

SEQ ID NO: 63948 - RNA, 22 nt, Homo sapiens
uugcacauugcaccuuuuguau

SEQ ID NO: 63949 - RNA, 22 nt, Homo sapiens
uugcacugagauuuugcuuaca

SEQ ID NO: 63950 - RNA, 22 nt, Homo sapiens
uugcagagccccugcaaggguc

SEQ ID NO: 63951 - RNA, 19 nt, Homo sapiens
uugcaguauccuauauguu

SEQ ID NO: 63952 - RNA, 22 nt, Homo sapiens
uugcaugcuccuuaugagaauc

SEQ ID NO: 63953 - RNA, 22 nt, Homo sapiens
uugcauuagugugguacauuug

SEQ ID NO: 63954 - RNA, 22 nt, Homo sapiens
uugccuauucacucugaugaua

SEQ ID NO: 63955 - RNA, 22 nt, Homo sapiens
uuggaaaguuguuguaguuauu

SEQ ID NO: 63956 - RNA, 22 nt, Homo sapiens
uuggaagacaaugcugauucuc

SEQ ID NO: 63957 - RNA, 22 nt, Homo sapiens
uuggaaugcacacugagccugc

SEQ ID NO: 63958 - RNA, 22 nt, Homo sapiens
uuggaauguauggcaucuugcg

SEQ ID NO: 63959 - RNA, 22 nt, Homo sapiens
uuggacuucuaacugacaugga

SEQ ID NO: 63960 - RNA, 22 nt, Homo sapiens
uuggagagugauauucagaugc

SEQ ID NO: 63961 - RNA, 22 nt, Homo sapiens
uuggagcacuggggcacugaca

SEQ ID NO: 63962 - RNA, 22 nt, Homo sapiens
uuggauauucaguuuuuccauc

SEQ ID NO: 63963 - RNA, 20 nt, Homo sapiens
uuggcauuuagacaagaguu

SEQ ID NO: 63964 - RNA, 22 nt, Homo sapiens
uugggaaugcuaaaccucuauu

SEQ ID NO: 63965 - RNA, 22 nt, Homo sapiens
uugggacuggaaggaguaaggg

SEQ ID NO: 63966 - RNA, 22 nt, Homo sapiens
uugguaaaaugaccacagacau

SEQ ID NO: 63967 - RNA, 22 nt, Homo sapiens
uuggucagcucaauggagaggg

SEQ ID NO: 63968 - RNA, 19 nt, Homo sapiens
uuggucccuuuggguucuu

SEQ ID NO: 63969 - RNA, 22 nt, Homo sapiens
uuguaaagucugucucagucag

SEQ ID NO: 63970 - RNA, 23 nt, Homo sapiens
uuguaacuggagaguaacauucc

SEQ ID NO: 63971 - RNA, 22 nt, Homo sapiens
uugucacuauaaauaagcauuu

SEQ ID NO: 63972 - RNA, 22 nt, Homo sapiens
uugucaguguucacucaaagcu

SEQ ID NO: 63973 - RNA, 22 nt, Homo sapiens
uuguccccaucugcugccagaa

SEQ ID NO: 63974 - RNA, 22 nt, Homo sapiens
uugucuagugaauacauuaaug

SEQ ID NO: 63975 - RNA, 22 nt, Homo sapiens
uugugaagaaaccagaaaaguu

SEQ ID NO: 63976 - RNA, 22 nt, Homo sapiens
uugugacacagcugggccuaua

SEQ ID NO: 63977 - RNA, 22 nt, Homo sapiens
uuguuauguaucucaagauaaa

SEQ ID NO: 63978 - RNA, 17 nt, Homo sapiens
uuguucccauuaaaaag

SEQ ID NO: 63979 - RNA, 22 nt, Homo sapiens
uuuaaaguuagaaggaaagggc

SEQ ID NO: 63980 - RNA, 22 nt, Homo sapiens
uuuaugagguagagugguuuau

SEQ ID NO: 63981 - RNA, 22 nt, Homo sapiens
uuuauugcucuaaaguugccau

SEQ ID NO: 63982 - RNA, 22 nt, Homo sapiens
uuucaacuaauuuuuuggugag

SEQ ID NO: 63983 - RNA, 19 nt, Homo sapiens
uuucaauguaaggauggag

SEQ ID NO: 63984 - RNA, 19 nt, Homo sapiens
uuucacacucgccuacuuc

SEQ ID NO: 63985 - RNA, 22 nt, Homo sapiens
uuucagguauuuaagggccguu

SEQ ID NO: 63986 - RNA, 22 nt, Homo sapiens
uuucaguguggcaggcauagcu

SEQ ID NO: 63987 - RNA, 19 nt, Homo sapiens
uuucauguuuuuggugaga

SEQ ID NO: 63988 - RNA, 22 nt, Homo sapiens
uuuccagguggccaacauuuua

SEQ ID NO: 63989 - RNA, 22 nt, Homo sapiens
uuucccugaaggcucugaaguc

SEQ ID NO: 63990 - RNA, 22 nt, Homo sapiens
uuucccuuugcuuugucagcca

SEQ ID NO: 63991 - RNA, 22 nt, Homo sapiens
uuucuacagggcuugccaggua

SEQ ID NO: 63992 - RNA, 22 nt, Homo sapiens
uuucugaggccucaccagaagc

SEQ ID NO: 63993 - RNA, 21 nt, Homo sapiens
uuucugggggagcauggcagg

SEQ ID NO: 63994 - RNA, 22 nt, Homo sapiens
uuucuuggagcucuuagggucg

SEQ ID NO: 63995 - RNA, 22 nt, Homo sapiens
uuugaaccauuugaagaaugau

SEQ ID NO: 63996 - RNA, 22 nt, Homo sapiens
uuugaagugugaugccuugaug

SEQ ID NO: 63997 - RNA, 22 nt, Homo sapiens
uuugacuuuuagaauaugaguu

SEQ ID NO: 63998 - RNA, 22 nt, Homo sapiens
uuugagaaugcuaccagagaag

SEQ ID NO: 63999 - RNA, 22 nt, Homo sapiens
uuugagcaugcagauugccagg

SEQ ID NO: 64000 - RNA, 16 nt, Homo sapiens
uuugcaagaucagaag

SEQ ID NO: 64001 - RNA, 22 nt, Homo sapiens
uuugcaagaugaaaaaguucua

SEQ ID NO: 64002 - RNA, 22 nt, Homo sapiens
uuugcacuuuaauauaauguga

SEQ ID NO: 64003 - RNA, 22 nt, Homo sapiens
uuugcacuuuuguaauaugguu

SEQ ID NO: 64004 - RNA, 22 nt, Homo sapiens
uuugcaguuuauuccuggggcu

SEQ ID NO: 64005 - RNA, 22 nt, Homo sapiens
uuugcuuaguaaauguagaaaa

SEQ ID NO: 64006 - RNA, 22 nt, Homo sapiens
uuugcuucacuguuuggcaaaa

SEQ ID NO: 64007 - RNA, 22 nt, Homo sapiens
uuuggcaaagaucaacauguua

SEQ ID NO: 64008 - RNA, 22 nt, Homo sapiens
uuuggcacuguaaauuucucuu

SEQ ID NO: 64009 - RNA, 22 nt, Homo sapiens
uuuggcagaaaacuaaaaggua

SEQ ID NO: 64010 - RNA, 22 nt, Homo sapiens
uuugggcuuuuaaucuagagca

SEQ ID NO: 64011 - RNA, 22 nt, Homo sapiens
uuuggucuuuuauuuaaagcag

SEQ ID NO: 64012 - RNA, 22 nt, Homo sapiens
uuugguguauaaaaaugcuagu

SEQ ID NO: 64013 - RNA, 22 nt, Homo sapiens
uuugguugucacaacuggggga

SEQ ID NO: 64014 - RNA, 22 nt, Homo sapiens
uuuguacacuguugguaggauu

SEQ ID NO: 64015 - RNA, 22 nt, Homo sapiens
uuuguacucccuuuagauaaaa

SEQ ID NO: 64016 - RNA, 22 nt, Homo sapiens
uuuguacuucauugguucuacu

SEQ ID NO: 64017 - RNA, 21 nt, Homo sapiens
uuuguaguagcaugauuuaua

SEQ ID NO: 64018 - RNA, 22 nt, Homo sapiens
uuugucacccugaauguaagau

SEQ ID NO: 64019 - RNA, 22 nt, Homo sapiens
uuugugaggugauggauauguc

SEQ ID NO: 64020 - RNA, 22 nt, Homo sapiens
ugagaucuuugcuguccucacc

SEQ ID NO: 64021 - RNA, 22 nt, Homo sapiens
ugagaugagggcugcacucaaa

SEQ ID NO: 64022 - RNA, 22 nt, Homo sapiens
ugagaugaugggauaagagggc

SEQ ID NO: 64023 - RNA, 20 nt, Homo sapiens
ugagaugcauugggauguuu

SEQ ID NO: 64024 - RNA, 22 nt, Homo sapiens
ugagauggaguuucgcccuugu

SEQ ID NO: 64025 - RNA, 22 nt, Homo sapiens
ugagauggaucuuggauuugaa

SEQ ID NO: 64026 - RNA, 22 nt, Homo sapiens
ugagauggguucugguccccug

SEQ ID NO: 64027 - RNA, 21 nt, Homo sapiens
ugagaugugaccagggcauca

SEQ ID NO: 64028 - RNA, 22 nt, Homo sapiens
ugagauguuccaaugacuauua

SEQ ID NO: 64029 - RNA, 22 nt, Homo sapiens
ugagcaauaaaguuacacaguu

SEQ ID NO: 64030 - RNA, 22 nt, Homo sapiens
ugagcagagaagugcccugcgc

SEQ ID NO: 64031 - RNA, 22 nt, Homo sapiens
ugagcucaguauuucauaaaca

SEQ ID NO: 64032 - RNA, 22 nt, Homo sapiens
ugagcugguacuaauauuauca

SEQ ID NO: 64033 - RNA, 20 nt, Homo sapiens
ugagcuuguaaacacuguuu

SEQ ID NO: 64034 - RNA, 18 nt, Homo sapiens
ugaggaaaggguuugcua

SEQ ID NO: 64035 - RNA, 22 nt, Homo sapiens
ugaggacugagaggcacugugg

SEQ ID NO: 64036 - RNA, 22 nt, Homo sapiens
ugaggaguauguucuguagacc

SEQ ID NO: 64037 - RNA, 22 nt, Homo sapiens
ugaggagugaacuauuucugau

SEQ ID NO: 64038 - RNA, 22 nt, Homo sapiens
ugaggauaguguugaaggcagg

SEQ ID NO: 64039 - RNA, 22 nt, Homo sapiens
ugagguaacagaagcgagcauu

SEQ ID NO: 64040 - RNA, 22 nt, Homo sapiens
ugagguaugacuuauuauucuu

SEQ ID NO: 64041 - RNA, 21 nt, Homo sapiens
ugaggucaugaugcugcuucc

SEQ ID NO: 64042 - RNA, 22 nt, Homo sapiens
ugagguugguauuacugucucu

SEQ ID NO: 64043 - RNA, 22 nt, Homo sapiens
ugagguuguccacuauaaucca

SEQ ID NO: 64044 - RNA, 22 nt, Homo sapiens
ugaguagaacuccuggagaugu

SEQ ID NO: 64045 - RNA, 23 nt, Homo sapiens
ugaguagguccacguaugugagu

SEQ ID NO: 64046 - RNA, 19 nt, Homo sapiens
ugaguauauuguauucauu

SEQ ID NO: 64047 - RNA, 22 nt, Homo sapiens
ugagugagguucuacucuguga

SEQ ID NO: 64048 - RNA, 22 nt, Homo sapiens
ugaguuccuuucccaguccagu

SEQ ID NO: 64049 - RNA, 22 nt, Homo sapiens
ugaguucuuccuaucucugccu

SEQ ID NO: 64050 - RNA, 23 nt, Homo sapiens
ugauaacagcauaugaagauucu

SEQ ID NO: 64051 - RNA, 22 nt, Homo sapiens
ugauaagaaauuguucauguag

SEQ ID NO: 64052 - RNA, 22 nt, Homo sapiens
ugauaugaaagggaaauaagug

SEQ ID NO: 64053 - RNA, 22 nt, Homo sapiens
ugauaugucccucgacaucagg

SEQ ID NO: 64054 - RNA, 22 nt, Homo sapiens
ugauaugugaguauaugguuau

SEQ ID NO: 64055 - RNA, 17 nt, Homo sapiens
ugauauuuucccagaua

SEQ ID NO: 64056 - RNA, 20 nt, Homo sapiens
ugauauuuucugagcaggaa

SEQ ID NO: 64057 - RNA, 22 nt, Homo sapiens
ugaucucagcucacugguugaa

SEQ ID NO: 64058 - RNA, 22 nt, Homo sapiens
ugaucuguccaccucagcuucc

SEQ ID NO: 64059 - RNA, 22 nt, Homo sapiens
ugaugaaguauaggaagggcuu

SEQ ID NO: 64060 - RNA, 21 nt, Homo sapiens
ugaugcuuuucuuaaccuugc

SEQ ID NO: 64061 - RNA, 22 nt, Homo sapiens
ugaugucuugcaggcacgagau

SEQ ID NO: 64062 - RNA, 22 nt, Homo sapiens
ugauguugacuguaggcagaga

SEQ ID NO: 64063 - RNA, 22 nt, Homo sapiens
caggcagucuggggguguaucc

SEQ ID NO: 64064 - RNA, 22 nt, Homo sapiens
caggcagugggagacaaaacug

SEQ ID NO: 64065 - RNA, 22 nt, Homo sapiens
cagggcaugugggucuauuggc

SEQ ID NO: 64066 - RNA, 22 nt, Homo sapiens
caggguccccuaccuuuugaug

SEQ ID NO: 64067 - RNA, 22 nt, Homo sapiens
caguaaauaucugagcgagguc

SEQ ID NO: 64068 - RNA, 20 nt, Homo sapiens
cagugcacuuucccacuggu

SEQ ID NO: 64069 - RNA, 22 nt, Homo sapiens
cagugcauagaugugccacauu

SEQ ID NO: 64070 - RNA, 22 nt, Homo sapiens
cagugcauccauguucagcagu

SEQ ID NO: 64071 - RNA, 22 nt, Homo sapiens
caguggacuaaauggggaauau

SEQ ID NO: 64072 - RNA, 22 nt, Homo sapiens
caguggauuggauggauaaugc

SEQ ID NO: 64073 - RNA, 22 nt, Homo sapiens
cagugguuuucaacccugguug

SEQ ID NO: 64074 - RNA, 22 nt, Homo sapiens
caguuacuugacacaaccaauu

SEQ ID NO: 64075 - RNA, 22 nt, Homo sapiens
caucaaaguggagggaaggacc

SEQ ID NO: 64076 - RNA, 22 nt, Homo sapiens
caugaaagacugaggaauugga

SEQ ID NO: 64077 - RNA, 22 nt, Homo sapiens
cauggcacugagcagguaugca

SEQ ID NO: 64078 - RNA, 22 nt, Homo sapiens
cauggcacuguaugaaaugugc

SEQ ID NO: 64079 - RNA, 22 nt, Homo sapiens
cauggcaucuguguggccucca

SEQ ID NO: 64080 - RNA, 22 nt, Homo sapiens
cauggcuacugcagauguaggg

SEQ ID NO: 64081 - RNA, 22 nt, Homo sapiens
cauggcucuuguuuacucccag

SEQ ID NO: 64082 - RNA, 19 nt, Homo sapiens
cauggcuuauaauuuuaau

SEQ ID NO: 64083 - RNA, 22 nt, Homo sapiens
cauggcuuguauaagauucuca

SEQ ID NO: 64084 - RNA, 22 nt, Homo sapiens
caugucuuuuaaacauucaacu

SEQ ID NO: 64085 - RNA, 22 nt, Homo sapiens
caugugcaugcuuucuuaugug

SEQ ID NO: 64086 - RNA, 20 nt, Homo sapiens
cauuccacuuuccugucagu

SEQ ID NO: 64087 - RNA, 22 nt, Homo sapiens
cauugcaacuucugccucccag

SEQ ID NO: 64088 - RNA, 22 nt, Homo sapiens
cauugcaaugaggucuugcagu

SEQ ID NO: 64089 - RNA, 22 nt, Homo sapiens
cauugcacuccagccucggcaa

SEQ ID NO: 64090 - RNA, 22 nt, Homo sapiens
cauugcacuccagccugaccaa

SEQ ID NO: 64091 - RNA, 22 nt, Homo sapiens
cauugcacuccagccuggcaac

SEQ ID NO: 64092 - RNA, 20 nt, Homo sapiens
cauugcacuccagcuugggc

SEQ ID NO: 64093 - RNA, 22 nt, Homo sapiens
cauugcacugcauucugggcaa

SEQ ID NO: 64094 - RNA, 20 nt, Homo sapiens
cauugcccuccagccugggc

SEQ ID NO: 64095 - RNA, 22 nt, Homo sapiens
cauugcccuccagccugggcaa

SEQ ID NO: 64096 - RNA, 22 nt, Homo sapiens
cauuugcacugagacucagcuu

SEQ ID NO: 64097 - RNA, 19 nt, Homo sapiens
ccacaaugguugaacuaga

SEQ ID NO: 64098 - RNA, 22 nt, Homo sapiens
ccacagucuaugcaacaagguc

SEQ ID NO: 64099 - RNA, 22 nt, Homo sapiens
ccacccuggagaauuugagguc

SEQ ID NO: 64100 - RNA, 22 nt, Homo sapiens
ccacuguuuaaauggcugagga

SEQ ID NO: 64101 - RNA, 22 nt, Homo sapiens
ccaggguugcuuuagauucuga

SEQ ID NO: 64102 - RNA, 22 nt, Homo sapiens
ccagguuucuagaauaauuccu

SEQ ID NO: 64103 - RNA, 22 nt, Homo sapiens
ccaguauugaacacaaugaaag

SEQ ID NO: 64104 - RNA, 22 nt, Homo sapiens
ccagugcauggaucccaggggg

SEQ ID NO: 64105 - RNA, 22 nt, Homo sapiens
ccagugcugugcaguguaugag

SEQ ID NO: 64106 - RNA, 20 nt, Homo sapiens
ccaguguuauuuauguucua

SEQ ID NO: 64107 - RNA, 22 nt, Homo sapiens
ccaguguucuggaaggcugagu

SEQ ID NO: 64108 - RNA, 19 nt, Homo sapiens
ccaguguugccagagcuga

SEQ ID NO: 64109 - RNA, 22 nt, Homo sapiens
ccaguuuucaagauaaugguuu

SEQ ID NO: 64110 - RNA, 22 nt, Homo sapiens
ccaguuuuuggcaaugaugaau

SEQ ID NO: 64111 - RNA, 22 nt, Homo sapiens
cccagcguucggcauggcugag

SEQ ID NO: 64112 - RNA, 22 nt, Homo sapiens
cccaguguuacgugacagccug

SEQ ID NO: 64113 - RNA, 22 nt, Homo sapiens
cccaguuuugcuucucaugagg

SEQ ID NO: 64114 - RNA, 22 nt, Homo sapiens
ccccagugguugcaacagcaga

SEQ ID NO: 64115 - RNA, 21 nt, Homo sapiens
uggaugccuaggcagaaguuu

SEQ ID NO: 64116 - RNA, 22 nt, Homo sapiens
uggauguaauugauucauguug

SEQ ID NO: 64117 - RNA, 22 nt, Homo sapiens
uggcaacaucuggggacauguu

SEQ ID NO: 64118 - RNA, 19 nt, Homo sapiens
uggcaaugucagcagagau

SEQ ID NO: 64119 - RNA, 20 nt, Homo sapiens
uggcaccugacagauagcca

SEQ ID NO: 64120 - RNA, 22 nt, Homo sapiens
uggcaccugacuccgagaugca

SEQ ID NO: 64121 - RNA, 22 nt, Homo sapiens
uggcaugaaguguguuuuaucu

SEQ ID NO: 64122 - RNA, 22 nt, Homo sapiens
uggcaugauccuagauucaaca

SEQ ID NO: 64123 - RNA, 22 nt, Homo sapiens
uggcauggaguggauggcccca

SEQ ID NO: 64124 - RNA, 22 nt, Homo sapiens
uggcaugggguaguagcgcugg

SEQ ID NO: 64125 - RNA, 20 nt, Homo sapiens
uggcauguugguaugcaccc

SEQ ID NO: 64126 - RNA, 22 nt, Homo sapiens
uggccaguuuuuaauugggucu

SEQ ID NO: 64127 - RNA, 22 nt, Homo sapiens
uggcuacagaaaguacuaguga

SEQ ID NO: 64128 - RNA, 21 nt, Homo sapiens
uggcuuauuugaaucuggcuu

SEQ ID NO: 64129 - RNA, 22 nt, Homo sapiens
ugggaucauuaugcauagugua

SEQ ID NO: 64130 - RNA, 22 nt, Homo sapiens
uggguaaaucuguuuggggcuc

SEQ ID NO: 64131 - RNA, 23 nt, Homo sapiens
ugggucaguuuuucugacaucau

SEQ ID NO: 64132 - RNA, 22 nt, Homo sapiens
uggguccccuacucuuuccaca

SEQ ID NO: 64133 - RNA, 22 nt, Homo sapiens
ugggugugaccgcucaaggggg

SEQ ID NO: 64134 - RNA, 23 nt, Homo sapiens
uggguucccuaagcgcaugcugc

SEQ ID NO: 64135 - RNA, 22 nt, Homo sapiens
ugguaucuaagaugcacguugu

SEQ ID NO: 64136 - RNA, 22 nt, Homo sapiens
ugguauguguucuaaaauuaug

SEQ ID NO: 64137 - RNA, 22 nt, Homo sapiens
ugguauuuaauauaugagaguu

SEQ ID NO: 64138 - RNA, 21 nt, Homo sapiens
uggucaguuuucucacuagga

SEQ ID NO: 64139 - RNA, 22 nt, Homo sapiens
uggucauggaaauagaaugcac

SEQ ID NO: 64140 - RNA, 20 nt, Homo sapiens
uguaaaggagauugcagcug

SEQ ID NO: 64141 - RNA, 22 nt, Homo sapiens
uguaacaguaguuacuauucuu

SEQ ID NO: 64142 - RNA, 22 nt, Homo sapiens
uguaagcagcagagacuauccu

SEQ ID NO: 64143 - RNA, 22 nt, Homo sapiens
uguagauaucauuagugcugug

SEQ ID NO: 64144 - RNA, 21 nt, Homo sapiens
uguauauguuuauacacacac

SEQ ID NO: 64145 - RNA, 20 nt, Homo sapiens
ugucaagaaacauuacuuau

SEQ ID NO: 64146 - RNA, 20 nt, Homo sapiens
ugucaaggaauucccaaauc

SEQ ID NO: 64147 - RNA, 22 nt, Homo sapiens
ugucagaaucuagaggcugcua

SEQ ID NO: 64148 - RNA, 22 nt, Homo sapiens
ugucagcacaacucagguuccu

SEQ ID NO: 64149 - RNA, 22 nt, Homo sapiens
ugucaggagcaaugauaaauuu

SEQ ID NO: 64150 - RNA, 22 nt, Homo sapiens
ugucaguguacuguaagaauua

SEQ ID NO: 64151 - RNA, 22 nt, Homo sapiens
ugucaucuagguuuuaagccuu

SEQ ID NO: 64152 - RNA, 22 nt, Homo sapiens
ugucauggauucugagucuggg

SEQ ID NO: 64153 - RNA, 22 nt, Homo sapiens
ugucauggcauuuguaaacugc

SEQ ID NO: 64154 - RNA, 22 nt, Homo sapiens
ugucaugguagcaaggacgagg

SEQ ID NO: 64155 - RNA, 22 nt, Homo sapiens
cugaaucauugcauuaucaagg

SEQ ID NO: 64156 - RNA, 22 nt, Homo sapiens
cugagaagaaacagguaaggac

SEQ ID NO: 64157 - RNA, 22 nt, Homo sapiens
cugagaaugaugauuuccaguu

SEQ ID NO: 64158 - RNA, 22 nt, Homo sapiens
cugagacacucuuaucugcaua

SEQ ID NO: 64159 - RNA, 22 nt, Homo sapiens
cugagauacacuaauagucucu

SEQ ID NO: 64160 - RNA, 18 nt, Homo sapiens
cugagcacugcuuuauga

SEQ ID NO: 64161 - RNA, 22 nt, Homo sapiens
cugaggucugaauccagguauc

SEQ ID NO: 64162 - RNA, 22 nt, Homo sapiens
cugaucuguuauacuuuucuau

SEQ ID NO: 64163 - RNA, 22 nt, Homo sapiens
cugaugaaguauuuguucugga

SEQ ID NO: 64164 - RNA, 22 nt, Homo sapiens
cugauugucuauuuaguucacu

SEQ ID NO: 64165 - RNA, 19 nt, Homo sapiens
cugcacugagaaaaggagg

SEQ ID NO: 64166 - RNA, 22 nt, Homo sapiens
cugcauaaucaucucucugcau

SEQ ID NO: 64167 - RNA, 22 nt, Homo sapiens
cuggaaacaucuuaggaaugca

SEQ ID NO: 64168 - RNA, 22 nt, Homo sapiens
cuggagcaaaggugacucuugu

SEQ ID NO: 64169 - RNA, 22 nt, Homo sapiens
cuggaguuugaggcugcaguga

SEQ ID NO: 64170 - RNA, 22 nt, Homo sapiens
cuggcaagagugaaccagcugu

SEQ ID NO: 64171 - RNA, 22 nt, Homo sapiens
cuggcccaguucugcguuuugc

SEQ ID NO: 64172 - RNA, 22 nt, Homo sapiens
cugggaugauguaaauaggcua

SEQ ID NO: 64173 - RNA, 22 nt, Homo sapiens
cuggugugugacuuuucauuau

SEQ ID NO: 64174 - RNA, 22 nt, Homo sapiens
cugucacaguuuuggaggccag

SEQ ID NO: 64175 - RNA, 22 nt, Homo sapiens
cugucagugggaguucaggcuu

SEQ ID NO: 64176 - RNA, 22 nt, Homo sapiens
cuguccugcagagucagaauga

SEQ ID NO: 64177 - RNA, 22 nt, Homo sapiens
cugucuagagggcacaugaugc

SEQ ID NO: 64178 - RNA, 22 nt, Homo sapiens
cugugcauuggaugucucccug

SEQ ID NO: 64179 - RNA, 22 nt, Homo sapiens
cuguucaaauuguuugugaagu

SEQ ID NO: 64180 - RNA, 22 nt, Homo sapiens
cuguuugaggguuugcuuucag

SEQ ID NO: 64181 - RNA, 22 nt, Homo sapiens
cuuccagcuggguucagucagu

SEQ ID NO: 64182 - RNA, 20 nt, Homo sapiens
cuuccaguggccccaucuuu

SEQ ID NO: 64183 - RNA, 22 nt, Homo sapiens
cuugaacaaagagauuccauua

SEQ ID NO: 64184 - RNA, 20 nt, Homo sapiens
cuugaagacuaugcugcuga

SEQ ID NO: 64185 - RNA, 22 nt, Homo sapiens
cuugaauguaaauaauguacag

SEQ ID NO: 64186 - RNA, 22 nt, Homo sapiens
cuugcacauuacagaucugcau

SEQ ID NO: 64187 - RNA, 22 nt, Homo sapiens
cuuggcuccgacuccccuccaa

SEQ ID NO: 64188 - RNA, 22 nt, Homo sapiens
cuuggcuugguaucaaauaacc

SEQ ID NO: 64189 - RNA, 22 nt, Homo sapiens
cuugguuacauuuuccuagaaa

SEQ ID NO: 64190 - RNA, 22 nt, Homo sapiens
cuugucuugcacacgguugcca

SEQ ID NO: 64191 - RNA, 23 nt, Homo sapiens
cuuuguccccacccaaaucucau

SEQ ID NO: 64192 - RNA, 22 nt, Homo sapiens
cuuuuguggaucuucuguugcu

SEQ ID NO: 64193 - RNA, 20 nt, Homo sapiens
gaaacaucuauccucuccuu

SEQ ID NO: 64194 - RNA, 22 nt, Homo sapiens
gaaagauuuccugagcuagaaa

SEQ ID NO: 64195 - RNA, 22 nt, Homo sapiens
gaaagauuuuaacugggagacu

SEQ ID NO: 64196 - RNA, 22 nt, Homo sapiens
gaaagguaggaacagggugcag

SEQ ID NO: 64197 - RNA, 22 nt, Homo sapiens
gaaaguaauuaacgauuguugc

SEQ ID NO: 64198 - RNA, 21 nt, Homo sapiens
gaaauacugccuuaggagcug

SEQ ID NO: 64199 - RNA, 22 nt, Homo sapiens
gaaaugcucagggguuuuccag

SEQ ID NO: 64200 - RNA, 22 nt, Homo sapiens
gaaaugucugagauguggcuca

SEQ ID NO: 64201 - RNA, 22 nt, Homo sapiens
gaacccuggaggcggagguugc

SEQ ID NO: 64202 - RNA, 22 nt, Homo sapiens
gaacuguuucuggugaaagagu

SEQ ID NO: 64203 - RNA, 22 nt, Homo sapiens
gaagaaguacaagacaaauuuu

SEQ ID NO: 64204 - RNA, 22 nt, Homo sapiens
gaaguaauaaauggauucuuaa

SEQ ID NO: 64205 - RNA, 23 nt, Homo sapiens
gaaguaauaaauggauucuuaac

SEQ ID NO: 64206 - RNA, 22 nt, Homo sapiens
gaaguaguaaaauuuauugcag

SEQ ID NO: 64207 - RNA, 19 nt, Homo sapiens
gaaguguuguccuccagua

SEQ ID NO: 64208 - RNA, 17 nt, Homo sapiens
gaaguguuucagcagcu

SEQ ID NO: 64209 - RNA, 22 nt, Homo sapiens
gaaucauuguuucuaaguuugu

SEQ ID NO: 64210 - RNA, 22 nt, Homo sapiens
uagaaagcaugaccuucagaua

SEQ ID NO: 64211 - RNA, 22 nt, Homo sapiens
uagaacaauugcuggauccgaa

SEQ ID NO: 64212 - RNA, 22 nt, Homo sapiens
uagaagcacuaucccuccuagu

SEQ ID NO: 64213 - RNA, 22 nt, Homo sapiens
uagaauguaaauuccaagggca

SEQ ID NO: 64214 - RNA, 21 nt, Homo sapiens
uagagcaacacacgcccucuc

SEQ ID NO: 64215 - RNA, 22 nt, Homo sapiens
uagaggaaugaauuuggccaga

SEQ ID NO: 64216 - RNA, 21 nt, Homo sapiens
uagaugguguucuagagagaa

SEQ ID NO: 64217 - RNA, 22 nt, Homo sapiens
uagauucaucuguuccuuuuga

SEQ ID NO: 64218 - RNA, 20 nt, Homo sapiens
uagcagcagacagagggagg

SEQ ID NO: 64219 - RNA, 22 nt, Homo sapiens
uagcagcaucucuggcuucuac

SEQ ID NO: 64220 - RNA, 22 nt, Homo sapiens
uagcagucucagaaugcauggu

SEQ ID NO: 64221 - RNA, 22 nt, Homo sapiens
uaggacacucucuccaccagua

SEQ ID NO: 64222 - RNA, 22 nt, Homo sapiens
uaggcagccagcuguggauuga

SEQ ID NO: 64223 - RNA, 22 nt, Homo sapiens
uagggaguguccuuucgggaaa

SEQ ID NO: 64224 - RNA, 22 nt, Homo sapiens
uagggcuuuuccaagcugccac

SEQ ID NO: 64225 - RNA, 22 nt, Homo sapiens
uagguagugugugcaugagagg

SEQ ID NO: 64226 - RNA, 22 nt, Homo sapiens
uagguauguauauacacacaca

SEQ ID NO: 64227 - RNA, 20 nt, Homo sapiens
uagguuuucacagaauugcc

SEQ ID NO: 64228 - RNA, 22 nt, Homo sapiens
uaguaggacaggauuucaguua

SEQ ID NO: 64229 - RNA, 22 nt, Homo sapiens
uaguagugucccugacuaucac

SEQ ID NO: 64230 - RNA, 22 nt, Homo sapiens
uagugcugugauaaacauauau

SEQ ID NO: 64231 - RNA, 22 nt, Homo sapiens
uagugcugugauuaacauaaug

SEQ ID NO: 64232 - RNA, 22 nt, Homo sapiens
uaguucauuuuucuugcuuaga

SEQ ID NO: 64233 - RNA, 22 nt, Homo sapiens
uaguuguugcagguaggaugua

SEQ ID NO: 64234 - RNA, 22 nt, Homo sapiens
uauaaccauuucuucucucuuc

SEQ ID NO: 64235 - RNA, 22 nt, Homo sapiens
uauacaguaggcacucaguggc

SEQ ID NO: 64236 - RNA, 22 nt, Homo sapiens
uauacugucuuuguaugccuag

SEQ ID NO: 64237 - RNA, 22 nt, Homo sapiens
uauaugcacucagguguaugug

SEQ ID NO: 64238 - RNA, 23 nt, Homo sapiens
uauaugugucuaggagcuauggu

SEQ ID NO: 64239 - RNA, 22 nt, Homo sapiens
uaucaaggccacucauuuuaug

SEQ ID NO: 64240 - RNA, 22 nt, Homo sapiens
uaucacaguugcauauuuaagg

SEQ ID NO: 64241 - RNA, 22 nt, Homo sapiens
uaucaccauguccguuuuaaaa

SEQ ID NO: 64242 - RNA, 22 nt, Homo sapiens
uaucaccuugcaguggaugcua

SEQ ID NO: 64243 - RNA, 22 nt, Homo sapiens
uaucagugaaucuuauuuugcc

SEQ ID NO: 64244 - RNA, 22 nt, Homo sapiens
uaucaucauguuuuugcugugu

SEQ ID NO: 64245 - RNA, 22 nt, Homo sapiens
uaucccuuagagcggggugguu

SEQ ID NO: 64246 - RNA, 23 nt, Homo sapiens
uaucccuugccuuaugaugugag

SEQ ID NO: 64247 - RNA, 22 nt, Homo sapiens
uaucucagaguguacaagauua

SEQ ID NO: 64248 - RNA, 22 nt, Homo sapiens
ugucaugguguuaauuuuccug

SEQ ID NO: 64249 - RNA, 20 nt, Homo sapiens
ugucauuaagcacugugcca

SEQ ID NO: 64250 - RNA, 22 nt, Homo sapiens
ugucauucaggaaauucuaagu

SEQ ID NO: 64251 - RNA, 22 nt, Homo sapiens
uguccaaaucagagguaccaaa

SEQ ID NO: 64252 - RNA, 19 nt, Homo sapiens
ugucccagccauagaggca

SEQ ID NO: 64253 - RNA, 22 nt, Homo sapiens
uguccugcagagguguuugccu

SEQ ID NO: 64254 - RNA, 22 nt, Homo sapiens
ugucuagaucugaauguaauug

SEQ ID NO: 64255 - RNA, 21 nt, Homo sapiens
ugugaaaucuaggcagagguu

SEQ ID NO: 64256 - RNA, 22 nt, Homo sapiens
ugugacacugaauggcagaacu

SEQ ID NO: 64257 - RNA, 19 nt, Homo sapiens
ugugagcauuagcauuuag

SEQ ID NO: 64258 - RNA, 22 nt, Homo sapiens
ugugauaguuggcuaaagcagu

SEQ ID NO: 64259 - RNA, 22 nt, Homo sapiens
ugugcaaauguuaaacuaacuu

SEQ ID NO: 64260 - RNA, 22 nt, Homo sapiens
ugugcacauugugcagguugau

SEQ ID NO: 64261 - RNA, 22 nt, Homo sapiens
ugugcaccucuucacacaggga

SEQ ID NO: 64262 - RNA, 22 nt, Homo sapiens
ugugcacuggaccuugucuucu

SEQ ID NO: 64263 - RNA, 22 nt, Homo sapiens
ugugccacuccaaccuggguga

SEQ ID NO: 64264 - RNA, 22 nt, Homo sapiens
ugugccacuccaggaggcuguu

SEQ ID NO: 64265 - RNA, 22 nt, Homo sapiens
ugugcgugugccuguaagaauu

SEQ ID NO: 64266 - RNA, 22 nt, Homo sapiens
ugugcuaauacauacagugcua

SEQ ID NO: 64267 - RNA, 22 nt, Homo sapiens
ugugcugaucgggcacgguguc

SEQ ID NO: 64268 - RNA, 22 nt, Homo sapiens
uguggaaauuguuguauuuaau

SEQ ID NO: 64269 - RNA, 21 nt, Homo sapiens
uguggcaauggccucacagau

SEQ ID NO: 64270 - RNA, 22 nt, Homo sapiens
uguggcacuguguccagagaaa

SEQ ID NO: 64271 - RNA, 22 nt, Homo sapiens
uguggcuuuacagcaugguuca

SEQ ID NO: 64272 - RNA, 22 nt, Homo sapiens
uguggcuuuguaaccauggguc

SEQ ID NO: 64273 - RNA, 22 nt, Homo sapiens
uguggcuuuuucuuggcugagg

SEQ ID NO: 64274 - RNA, 22 nt, Homo sapiens
ugugucuugaauuuuguaugua

SEQ ID NO: 64275 - RNA, 22 nt, Homo sapiens
uguuacagcagcacaaaaugga

SEQ ID NO: 64276 - RNA, 22 nt, Homo sapiens
uguuacagugacuaauguuuua

SEQ ID NO: 64277 - RNA, 22 nt, Homo sapiens
uguuaguuguucauguuaagag

SEQ ID NO: 64278 - RNA, 22 nt, Homo sapiens
uguuauugagguuacuuauaag

SEQ ID NO: 64279 - RNA, 22 nt, Homo sapiens
uguucacaguguuucuuugaga

SEQ ID NO: 64280 - RNA, 22 nt, Homo sapiens
uguucuugaguugggaguacaa

SEQ ID NO: 64281 - RNA, 19 nt, Homo sapiens
uguugcacauaucaauaug

SEQ ID NO: 64282 - RNA, 22 nt, Homo sapiens
uuaaaaguauaggccuggcaua

SEQ ID NO: 64283 - RNA, 22 nt, Homo sapiens
uuaaagugcuguuuuugccggg

SEQ ID NO: 64284 - RNA, 22 nt, Homo sapiens
uuaaaguguuugcagacaggug

SEQ ID NO: 64285 - RNA, 22 nt, Homo sapiens
uuaaaugcacauacuugagaaa

SEQ ID NO: 64286 - RNA, 22 nt, Homo sapiens
uuaaaugucuguagaugugcug

SEQ ID NO: 64287 - RNA, 22 nt, Homo sapiens
uuaagcaguggauuagaauuuu

SEQ ID NO: 64288 - RNA, 22 nt, Homo sapiens
uuaaggaaagcauuuaauucag

SEQ ID NO: 64289 - RNA, 22 nt, Homo sapiens
uuaaggcagugcaucuggaguu

SEQ ID NO: 64290 - RNA, 22 nt, Homo sapiens
uuaagguuuuuguagcaaggau

SEQ ID NO: 64291 - RNA, 22 nt, Homo sapiens
uuaaguaaucagagaagagaac

SEQ ID NO: 64292 - RNA, 22 nt, Homo sapiens
uuaaguacuucccuguuggaca

SEQ ID NO: 64293 - RNA, 22 nt, Homo sapiens
uuaagugguagguggugcccaa

SEQ ID NO: 64294 - RNA, 22 nt, Homo sapiens
uuaauaccgucacauggcugaa

SEQ ID NO: 64295 - RNA, 22 nt, Homo sapiens
uuaaucugucuaugauuuuggu

SEQ ID NO: 64296 - RNA, 22 nt, Homo sapiens
uuaauguaauugauugauugac

SEQ ID NO: 64297 - RNA, 21 nt, Homo sapiens
uuacaauggcuccuugaaggu

SEQ ID NO: 64298 - RNA, 22 nt, Homo sapiens
uuacacguaauaguaagccugg

SEQ ID NO: 64299 - RNA, 22 nt, Homo sapiens
uuacaggacuaagcagcuuugc

SEQ ID NO: 64300 - RNA, 22 nt, Homo sapiens
uuacaguucugguggagaggua

SEQ ID NO: 64301 - RNA, 22 nt, Homo sapiens
uuacauaguguguggguucggg

SEQ ID NO: 64302 - RNA, 22 nt, Homo sapiens
uuacaucaucacauuaguuugc

SEQ ID NO: 64303 - RNA, 19 nt, Homo sapiens
uuacauccauugcauuuca

SEQ ID NO: 64304 - RNA, 22 nt, Homo sapiens
uuacauguggugugaagaagag

SEQ ID NO: 64305 - RNA, 22 nt, Homo sapiens
uucauugcugcuuaucuccaga

SEQ ID NO: 64306 - RNA, 22 nt, Homo sapiens
uuccacaaugguugaacuagcu

SEQ ID NO: 64307 - RNA, 22 nt, Homo sapiens
uuccacaaugguugaacuaguu

SEQ ID NO: 64308 - RNA, 22 nt, Homo sapiens
uuccaugagaugcaucaaagcu

SEQ ID NO: 64309 - RNA, 22 nt, Homo sapiens
uucccaguaaacucuaucccuc

SEQ ID NO: 64310 - RNA, 22 nt, Homo sapiens
uucccugaaguguuacucuaga

SEQ ID NO: 64311 - RNA, 22 nt, Homo sapiens
uucccugagcaucuguugagcc

SEQ ID NO: 64312 - RNA, 22 nt, Homo sapiens
uucccuuucugaaaaucucauu

SEQ ID NO: 64313 - RNA, 22 nt, Homo sapiens
uucccuuucuuaaagaguuagg

SEQ ID NO: 64314 - RNA, 22 nt, Homo sapiens
uucccuuugugcauaggauuug

SEQ ID NO: 64315 - RNA, 22 nt, Homo sapiens
uucccuuuuuucuaguagguag

SEQ ID NO: 64316 - RNA, 22 nt, Homo sapiens
uuccugaggccuccccagaagc

SEQ ID NO: 64317 - RNA, 22 nt, Homo sapiens
uuccuugguucagggaaggucc

SEQ ID NO: 64318 - RNA, 22 nt, Homo sapiens
uucuacaugggucgucggugag

SEQ ID NO: 64319 - RNA, 22 nt, Homo sapiens
uucuagcaauggcagagugucu

SEQ ID NO: 64320 - RNA, 21 nt, Homo sapiens
uucucaggguguguccuaccc

SEQ ID NO: 64321 - RNA, 22 nt, Homo sapiens
uucucagugaaguuuagaacau

SEQ ID NO: 64322 - RNA, 17 nt, Homo sapiens
uucucaguucugaucuc

SEQ ID NO: 64323 - RNA, 22 nt, Homo sapiens
uucugcacaucgaucacaagau

SEQ ID NO: 64324 - RNA, 22 nt, Homo sapiens
uucuggcuuauaaacgugacuu

SEQ ID NO: 64325 - RNA, 22 nt, Homo sapiens
uucuugcugaauugugcccuuc

SEQ ID NO: 64326 - RNA, 22 nt, Homo sapiens
agucaaaugcuuauguauaaag

SEQ ID NO: 64327 - RNA, 22 nt, Homo sapiens
agucaagugguuucugaguugg

SEQ ID NO: 64328 - RNA, 22 nt, Homo sapiens
agucacagguucuugggauuag

SEQ ID NO: 64329 - RNA, 22 nt, Homo sapiens
agucacaugcauuuucuucaau

SEQ ID NO: 64330 - RNA, 22 nt, Homo sapiens
agucacaugccagcacacccag

SEQ ID NO: 64331 - RNA, 22 nt, Homo sapiens
agucaguguguauugauggcac

SEQ ID NO: 64332 - RNA, 22 nt, Homo sapiens
agucugguguucucacacuagu

SEQ ID NO: 64333 - RNA, 23 nt, Homo sapiens
agucuguguuuacaggcucucug

SEQ ID NO: 64334 - RNA, 21 nt, Homo sapiens
agugagucauuuggaaagcaa

SEQ ID NO: 64335 - RNA, 22 nt, Homo sapiens
agugcacuccagccugggcaac

SEQ ID NO: 64336 - RNA, 22 nt, Homo sapiens
agugguuugaucacagcucacu

SEQ ID NO: 64337 - RNA, 22 nt, Homo sapiens
agugguuuuaaguagagcauac

SEQ ID NO: 64338 - RNA, 22 nt, Homo sapiens
aguguuuuuacaagcacucugg

SEQ ID NO: 64339 - RNA, 22 nt, Homo sapiens
aguuuugguugaguuacuagca

SEQ ID NO: 64340 - RNA, 18 nt, Homo sapiens
auaaacucaucauuuuua

SEQ ID NO: 64341 - RNA, 22 nt, Homo sapiens
auaaaguagaggugaggugcau

SEQ ID NO: 64342 - RNA, 22 nt, Homo sapiens
auaaaguucugcuggcauauau

SEQ ID NO: 64343 - RNA, 22 nt, Homo sapiens
auaaaugcuuccagucauuaaa

SEQ ID NO: 64344 - RNA, 18 nt, Homo sapiens
auaaccuggugcuuucaa

SEQ ID NO: 64345 - RNA, 22 nt, Homo sapiens
auaagagcaggcuucuggccag

SEQ ID NO: 64346 - RNA, 22 nt, Homo sapiens
auaagugcuuguugaauaauag

SEQ ID NO: 64347 - RNA, 22 nt, Homo sapiens
auaauacugggaagaugagcau

SEQ ID NO: 64348 - RNA, 22 nt, Homo sapiens
auaauaguguuuagauuuggga

SEQ ID NO: 64349 - RNA, 22 nt, Homo sapiens
auacaagugccauguuggugug

SEQ ID NO: 64350 - RNA, 22 nt, Homo sapiens
auacaugugugagcgaagaugu

SEQ ID NO: 64351 - RNA, 22 nt, Homo sapiens
auacauguuucauguuggugug

SEQ ID NO: 64352 - RNA, 20 nt, Homo sapiens
auacccaguagcacaacagc

SEQ ID NO: 64353 - RNA, 22 nt, Homo sapiens
auacuagucaagaauguaugag

SEQ ID NO: 64354 - RNA, 22 nt, Homo sapiens
auacuaugagauaauaaagacu

SEQ ID NO: 64355 - RNA, 22 nt, Homo sapiens
auacuguacugaaguacccauu

SEQ ID NO: 64356 - RNA, 22 nt, Homo sapiens
auagcagaagaagggacaauuc

SEQ ID NO: 64357 - RNA, 22 nt, Homo sapiens
auagcagcuugucagggcagac

SEQ ID NO: 64358 - RNA, 22 nt, Homo sapiens
auauaccuaggcuacaugguuu

SEQ ID NO: 64359 - RNA, 22 nt, Homo sapiens
auaucacaaacaagucuguacu

SEQ ID NO: 64360 - RNA, 22 nt, Homo sapiens
auaucccaguguguaaacacug

SEQ ID NO: 64361 - RNA, 22 nt, Homo sapiens
auaugcacgugcauacacacuu

SEQ ID NO: 64362 - RNA, 22 nt, Homo sapiens
auaugcacuauacacacguaua

SEQ ID NO: 64363 - RNA, 22 nt, Homo sapiens
auauggcauucagaacuguaua

SEQ ID NO: 64364 - RNA, 22 nt, Homo sapiens
auauuagcacuaaugucacgau

SEQ ID NO: 64365 - RNA, 22 nt, Homo sapiens
auauucaagugaggauggcuaa

SEQ ID NO: 64366 - RNA, 18 nt, Homo sapiens
auauugcauuggauggau

SEQ ID NO: 64367 - RNA, 22 nt, Homo sapiens
aucaaaugcuggcagagugccu

SEQ ID NO: 64368 - RNA, 22 nt, Homo sapiens
auggaguuuacuuaguguaaua

SEQ ID NO: 64369 - RNA, 22 nt, Homo sapiens
auggauauuuuuugaacauaga

SEQ ID NO: 64370 - RNA, 18 nt, Homo sapiens
auggcagaacaauuuaca

SEQ ID NO: 64371 - RNA, 22 nt, Homo sapiens
auggcagagucagaaagucagg

SEQ ID NO: 64372 - RNA, 22 nt, Homo sapiens
auggcagcccucuuuauccaug

SEQ ID NO: 64373 - RNA, 22 nt, Homo sapiens
auggcccaguuugcuaucccua

SEQ ID NO: 64374 - RNA, 22 nt, Homo sapiens
auggcccuguguggagcugcug

SEQ ID NO: 64375 - RNA, 22 nt, Homo sapiens
auggccuuuuuaucucaccaag

SEQ ID NO: 64376 - RNA, 22 nt, Homo sapiens
auggcuagaaccuguauauuca

SEQ ID NO: 64377 - RNA, 22 nt, Homo sapiens
auggcucaauucuuucccugaa

SEQ ID NO: 64378 - RNA, 22 nt, Homo sapiens
auggcuuguuaugcauuaguac

SEQ ID NO: 64379 - RNA, 22 nt, Homo sapiens
auggcuuugggcugcucugccc

SEQ ID NO: 64380 - RNA, 22 nt, Homo sapiens
auggcuuuguguucagagcuga

SEQ ID NO: 64381 - RNA, 22 nt, Homo sapiens
augggaaaaucagaaggccugg

SEQ ID NO: 64382 - RNA, 22 nt, Homo sapiens
augggauaguaucaguggaaua

SEQ ID NO: 64383 - RNA, 22 nt, Homo sapiens
augguauuuugugauaccuugu

SEQ ID NO: 64384 - RNA, 22 nt, Homo sapiens
auggucccuguuccaugcuccu

SEQ ID NO: 64385 - RNA, 22 nt, Homo sapiens
auguaacaguauuuggagaugu

SEQ ID NO: 64386 - RNA, 22 nt, Homo sapiens
auguaauguuaaauugcuaauu

SEQ ID NO: 64387 - RNA, 22 nt, Homo sapiens
auguaguagcagaaaauauuuu

SEQ ID NO: 64388 - RNA, 22 nt, Homo sapiens
auguagugugauuuucacuaga

SEQ ID NO: 64389 - RNA, 22 nt, Homo sapiens
auguauggcagguuugggguuu

SEQ ID NO: 64390 - RNA, 22 nt, Homo sapiens
augucaacauagacaguagagu

SEQ ID NO: 64391 - RNA, 22 nt, Homo sapiens
augucaaggugaagaaagauca

SEQ ID NO: 64392 - RNA, 22 nt, Homo sapiens
augucacugcacuccugccugg

SEQ ID NO: 64393 - RNA, 22 nt, Homo sapiens
augucauagauaaggaagugga

SEQ ID NO: 64394 - RNA, 22 nt, Homo sapiens
augugaacugaauuaauucaca

SEQ ID NO: 64395 - RNA, 22 nt, Homo sapiens
augugcaaagcacuguucagca

SEQ ID NO: 64396 - RNA, 22 nt, Homo sapiens
augugcaaauuuccaaacucuu

SEQ ID NO: 64397 - RNA, 22 nt, Homo sapiens
augugcaagaucauuaaagcuc

SEQ ID NO: 64398 - RNA, 22 nt, Homo sapiens
augugcacauucugguaaauau

SEQ ID NO: 64399 - RNA, 20 nt, Homo sapiens
augugcaguguggcaaccaa

SEQ ID NO: 64400 - RNA, 22 nt, Homo sapiens
augugcuaguaucaaacgagac

SEQ ID NO: 64401 - RNA, 22 nt, Homo sapiens
augugcuuauagguguauguuu

SEQ ID NO: 64402 - RNA, 18 nt, Homo sapiens
auguggcuuuugaaggcu

SEQ ID NO: 64403 - RNA, 22 nt, Homo sapiens
auguggugguagccaggacagg

SEQ ID NO: 64404 - RNA, 19 nt, Homo sapiens
augugguuagcaugacugc

SEQ ID NO: 64405 - RNA, 23 nt, Homo sapiens
augugugcuuggagagcaggaug

SEQ ID NO: 64406 - RNA, 22 nt, Homo sapiens
auguuauguucuucucuguaua

SEQ ID NO: 64407 - RNA, 22 nt, Homo sapiens
uugacugggccagacagagauc

SEQ ID NO: 64408 - RNA, 22 nt, Homo sapiens
uugacuucagagcugauucaag

SEQ ID NO: 64409 - RNA, 22 nt, Homo sapiens
uugagaaucuuugcuaaaggaa

SEQ ID NO: 64410 - RNA, 22 nt, Homo sapiens
uugagaucuugauauguuugaa

SEQ ID NO: 64411 - RNA, 22 nt, Homo sapiens
aaguaaacauuuuguacaauaa

SEQ ID NO: 64412 - RNA, 19 nt, Homo sapiens
aaguacuugucuuuugaag

SEQ ID NO: 64413 - RNA, 22 nt, Homo sapiens
aaguagcuggaugcaguggcac

SEQ ID NO: 64414 - RNA, 22 nt, Homo sapiens
aaguaguuaggaacauucucuc

SEQ ID NO: 64415 - RNA, 22 nt, Homo sapiens
aaguauguaucaagucauacuu

SEQ ID NO: 64416 - RNA, 22 nt, Homo sapiens
aaguauuagcuaauugugcuua

SEQ ID NO: 64417 - RNA, 22 nt, Homo sapiens
aaguauuagugaggauauggaa

SEQ ID NO: 64418 - RNA, 22 nt, Homo sapiens
aagucaaggagagaggcgucag

SEQ ID NO: 64419 - RNA, 22 nt, Homo sapiens
aagucacugagacuuguggcug

SEQ ID NO: 64420 - RNA, 22 nt, Homo sapiens
aagucauggaggaguaugugag

SEQ ID NO: 64421 - RNA, 22 nt, Homo sapiens
aagugaguaauacgucaguugu

SEQ ID NO: 64422 - RNA, 22 nt, Homo sapiens
aagugagugacaaaaacugggc

SEQ ID NO: 64423 - RNA, 22 nt, Homo sapiens
aagugcacuguaagugcaggau

SEQ ID NO: 64424 - RNA, 22 nt, Homo sapiens
aagugccauguggaugggcccu

SEQ ID NO: 64425 - RNA, 22 nt, Homo sapiens
cuugcacuugaaauuccaguuu

SEQ ID NO: 64426 - RNA, 22 nt, Homo sapiens
cuugcagagcccauggauguca

SEQ ID NO: 64427 - RNA, 22 nt, Homo sapiens
cuugccuaaucugcaugauuuu

SEQ ID NO: 64428 - RNA, 20 nt, Homo sapiens
cuugcuccccuuguucuaga

SEQ ID NO: 64429 - RNA, 22 nt, Homo sapiens
cuuggcacucuguggaguuagg

SEQ ID NO: 64430 - RNA, 22 nt, Homo sapiens
cuuggcauuguguugauagaag

SEQ ID NO: 64431 - RNA, 20 nt, Homo sapiens
cuuggcuuucuugguguuaa

SEQ ID NO: 64432 - RNA, 22 nt, Homo sapiens
cuugggauauguguuacucugu

SEQ ID NO: 64433 - RNA, 22 nt, Homo sapiens
cuugggcagugugcauguguau

SEQ ID NO: 64434 - RNA, 22 nt, Homo sapiens
cuugggccccacccaaaucuua

SEQ ID NO: 64435 - RNA, 22 nt, Homo sapiens
cuuggguugauugauaaugcca

SEQ ID NO: 64436 - RNA, 22 nt, Homo sapiens
cuuguacacuguuggugggaau

SEQ ID NO: 64437 - RNA, 22 nt, Homo sapiens
cuuguacuacuuaggaucugga

SEQ ID NO: 64438 - RNA, 21 nt, Homo sapiens
cuugucuugcuuagaauagac

SEQ ID NO: 64439 - RNA, 22 nt, Homo sapiens
cuuguggugcuuuuacgugggc

SEQ ID NO: 64440 - RNA, 22 nt, Homo sapiens
cuuguuguggaggggagugcag

SEQ ID NO: 64441 - RNA, 17 nt, Homo sapiens
cuuguugugguaguuug

SEQ ID NO: 64442 - RNA, 22 nt, Homo sapiens
cuuuacacauccuaaccagugu

SEQ ID NO: 64443 - RNA, 22 nt, Homo sapiens
cuuuacaguuggacucacgagg

SEQ ID NO: 64444 - RNA, 22 nt, Homo sapiens
cuuuaguuaaaauugggguugu

SEQ ID NO: 64445 - RNA, 22 nt, Homo sapiens
cuuucacacuguuggugggaau

SEQ ID NO: 64446 - RNA, 22 nt, Homo sapiens
cuuugcuaauccaacccucauc

SEQ ID NO: 64447 - RNA, 22 nt, Homo sapiens
cuuuggagaaaaguucuugggc

SEQ ID NO: 64448 - RNA, 20 nt, Homo sapiens
cuuuggcaaugagaacaggg

SEQ ID NO: 64449 - RNA, 22 nt, Homo sapiens
cuuuggcaaugucauuuucaau

SEQ ID NO: 64450 - RNA, 22 nt, Homo sapiens
cuuuggcacuuccuaagugcca

SEQ ID NO: 64451 - RNA, 23 nt, Homo sapiens
cuuugguaggaaauuugaauuau

SEQ ID NO: 64452 - RNA, 23 nt, Homo sapiens
cuuuggucucugguugacuucag

SEQ ID NO: 64453 - RNA, 19 nt, Homo sapiens
cuuugguugagcguguugg

SEQ ID NO: 64454 - RNA, 22 nt, Homo sapiens
cuuuguguaggugccucuggcu

SEQ ID NO: 64455 - RNA, 22 nt, Homo sapiens
cuuuuacacugguggugggaau

SEQ ID NO: 64456 - RNA, 22 nt, Homo sapiens
cuuuuacacuguuagugggaau

SEQ ID NO: 64457 - RNA, 20 nt, Homo sapiens
cuuuuagcagcagcaagaga

SEQ ID NO: 64458 - RNA, 21 nt, Homo sapiens
cuuuugcacuccagccugggu

SEQ ID NO: 64459 - RNA, 22 nt, Homo sapiens
cuuuuggugguucugaugcagg

SEQ ID NO: 64460 - RNA, 21 nt, Homo sapiens
cuuuuuacucguucauaugca

SEQ ID NO: 64461 - RNA, 22 nt, Homo sapiens
cuuuuugcaaauacaacucuga

SEQ ID NO: 64462 - RNA, 22 nt, Homo sapiens
gaaaacugcuucucuggguuuc

SEQ ID NO: 64463 - RNA, 22 nt, Homo sapiens
gaaagugcugcaaggccaugca

SEQ ID NO: 64464 - RNA, 18 nt, Homo sapiens
gaaaugccucuugcuuac

SEQ ID NO: 64465 - RNA, 22 nt, Homo sapiens
gaacacaucuuugguuagagga

SEQ ID NO: 64466 - RNA, 22 nt, Homo sapiens
gaaccagcagacuuugacaggu

SEQ ID NO: 64467 - RNA, 22 nt, Homo sapiens
gaacuggcuuagugaaacuucc

SEQ ID NO: 64468 - RNA, 22 nt, Homo sapiens
gaacugggguuggguugcgaua

SEQ ID NO: 64469 - RNA, 22 nt, Homo sapiens
gaacuguuucuggugaaagagu

SEQ ID NO: 64470 - RNA, 22 nt, Homo sapiens
gaagauucaaccaaaccagaac

SEQ ID NO: 64471 - RNA, 22 nt, Homo sapiens
gaagcauugauccacaggcgug

SEQ ID NO: 64472 - RNA, 22 nt, Homo sapiens
gaagguacgcuuaggaaaugau

SEQ ID NO: 64473 - RNA, 23 nt, Homo sapiens
gaaguaauaaauggauucuuaac

SEQ ID NO: 64474 - RNA, 22 nt, Homo sapiens
gaaguaggugcuguuauuaucu

SEQ ID NO: 64475 - RNA, 22 nt, Homo sapiens
gaaguaguaaaauuuauugcag

SEQ ID NO: 64476 - RNA, 22 nt, Homo sapiens
gaauaaacuagagaggacugag

SEQ ID NO: 64477 - RNA, 22 nt, Homo sapiens
gaauagugcugcaauaaacaua

SEQ ID NO: 64478 - RNA, 22 nt, Homo sapiens
gaauagugcugcgauaaacaua

SEQ ID NO: 64479 - RNA, 22 nt, Homo sapiens
gaaucacagauuaugaguaucu

SEQ ID NO: 64480 - RNA, 22 nt, Homo sapiens
gaaucacaguuauuagagcagc

SEQ ID NO: 64481 - RNA, 22 nt, Homo sapiens
gaaucacugugguaucccaugc

SEQ ID NO: 64482 - RNA, 22 nt, Homo sapiens
gaaucccuugcauuaucccuuu

SEQ ID NO: 64483 - RNA, 22 nt, Homo sapiens
gaaugcagcagugacagggcug

SEQ ID NO: 64484 - RNA, 22 nt, Homo sapiens
gaaugcuaagcaugugggaguu

SEQ ID NO: 64485 - RNA, 22 nt, Homo sapiens
gaaugcuaccagcaucuagugg

SEQ ID NO: 64486 - RNA, 22 nt, Homo sapiens
gaaugguaaacuuccaugacug

SEQ ID NO: 64487 - RNA, 20 nt, Homo sapiens
gacaaaccuagaugguacag

SEQ ID NO: 64488 - RNA, 22 nt, Homo sapiens
gacaccugguguggaacuggag

SEQ ID NO: 64489 - RNA, 22 nt, Homo sapiens
aagaugauguucuuuuucuuag

SEQ ID NO: 64490 - RNA, 22 nt, Homo sapiens
aagaugauguuguguuuucacu

SEQ ID NO: 64491 - RNA, 22 nt, Homo sapiens
aagaugcagaagcccagauguu

SEQ ID NO: 64492 - RNA, 22 nt, Homo sapiens
aagaugcagucauacuggagua

SEQ ID NO: 64493 - RNA, 20 nt, Homo sapiens
aagcaagcauuugcaaucau

SEQ ID NO: 64494 - RNA, 22 nt, Homo sapiens
aagcauccagcauggaacugaa

SEQ ID NO: 64495 - RNA, 22 nt, Homo sapiens
aagccacuguaccugucucuua

SEQ ID NO: 64496 - RNA, 22 nt, Homo sapiens
aagcgguguugaauuuuguuga

SEQ ID NO: 64497 - RNA, 22 nt, Homo sapiens
aagcuaggguuaauuuauuauu

SEQ ID NO: 64498 - RNA, 22 nt, Homo sapiens
aagcuccauuucugccaugaga

SEQ ID NO: 64499 - RNA, 22 nt, Homo sapiens
aagcuggagugcaguggugcaa

SEQ ID NO: 64500 - RNA, 22 nt, Homo sapiens
aagcuggcauucauucguucuu

SEQ ID NO: 64501 - RNA, 22 nt, Homo sapiens
aagcuggcuuucauugagugcu

SEQ ID NO: 64502 - RNA, 22 nt, Homo sapiens
aagcugguuuuauaucugugag

SEQ ID NO: 64503 - RNA, 22 nt, Homo sapiens
aagcuguguguaagcucucaca

SEQ ID NO: 64504 - RNA, 22 nt, Homo sapiens
aagcuguugguggauguaccau

SEQ ID NO: 64505 - RNA, 22 nt, Homo sapiens
aagcuuucaacuguuugccauu

SEQ ID NO: 64506 - RNA, 22 nt, Homo sapiens
aaggaagcuagcaggaauuggu

SEQ ID NO: 64507 - RNA, 22 nt, Homo sapiens
aaggaauucaaauuuucucugg

SEQ ID NO: 64508 - RNA, 23 nt, Homo sapiens
aaggacacugaacacuucccagc

SEQ ID NO: 64509 - RNA, 22 nt, Homo sapiens
aaggagcagagagcccuguuuc

SEQ ID NO: 64510 - RNA, 22 nt, Homo sapiens
aaggagcaguggacggguccua

SEQ ID NO: 64511 - RNA, 22 nt, Homo sapiens
aaggaguagacaacauggcgcc

SEQ ID NO: 64512 - RNA, 22 nt, Homo sapiens
aaggaguagaggaauagcaaug

SEQ ID NO: 64513 - RNA, 22 nt, Homo sapiens
aaggauuguaaaguugacaaau

SEQ ID NO: 64514 - RNA, 22 nt, Homo sapiens
aaggcaagagaaaauuucgagu

SEQ ID NO: 64515 - RNA, 22 nt, Homo sapiens
aaggcaguggcagaagauguca

SEQ ID NO: 64516 - RNA, 22 nt, Homo sapiens
aaggcaugcaaagaacauuuua

SEQ ID NO: 64517 - RNA, 22 nt, Homo sapiens
aaggcauucucaaacuaguucu

SEQ ID NO: 64518 - RNA, 22 nt, Homo sapiens
aaggcuguucauuuagcacagu

SEQ ID NO: 64519 - RNA, 22 nt, Homo sapiens
aaggcuguuguguaauaggauu

SEQ ID NO: 64520 - RNA, 22 nt, Homo sapiens
aagggaaugcgcugccuguguu

SEQ ID NO: 64521 - RNA, 22 nt, Homo sapiens
aagggaauguuguagcugguuu

SEQ ID NO: 64522 - RNA, 22 nt, Homo sapiens
aagguacuggaaagaggaaugg

SEQ ID NO: 64523 - RNA, 22 nt, Homo sapiens
aagguagcugagugaagugguu

SEQ ID NO: 64524 - RNA, 22 nt, Homo sapiens
aaggucauugugguuuuugcca

SEQ ID NO: 64525 - RNA, 22 nt, Homo sapiens
aaggugcuguaagcauccaugu

SEQ ID NO: 64526 - RNA, 22 nt, Homo sapiens
aaggugguuuucucuuggaguc

SEQ ID NO: 64527 - RNA, 22 nt, Homo sapiens
aagguucuugcuugcaugacug

SEQ ID NO: 64528 - RNA, 22 nt, Homo sapiens
aaguaaaucuuaugucagggag

SEQ ID NO: 64529 - RNA, 22 nt, Homo sapiens
aaguaauugagguuuuugcugu

SEQ ID NO: 64530 - RNA, 22 nt, Homo sapiens
aaguagcagaggcaagacuuga

SEQ ID NO: 64531 - RNA, 22 nt, Homo sapiens
aaguauuaugaguccuuguuuu

SEQ ID NO: 64532 - RNA, 23 nt, Homo sapiens
aagucauggaaucaaaugaggug

SEQ ID NO: 64533 - RNA, 22 nt, Homo sapiens
aagugaaugaugugaaguguaa

SEQ ID NO: 64534 - RNA, 22 nt, Homo sapiens
aagugaauguuugguagcagug

SEQ ID NO: 64535 - RNA, 22 nt, Homo sapiens
aagugaccuaacaaugaaggcc

SEQ ID NO: 64536 - RNA, 22 nt, Homo sapiens
aagugagaugcaguggaguucc

SEQ ID NO: 64537 - RNA, 23 nt, Homo sapiens
aagugagcuccaauugggugaga

SEQ ID NO: 64538 - RNA, 20 nt, Homo sapiens
aagugaguguuaaacugaac

SEQ ID NO: 64539 - RNA, 22 nt, Homo sapiens
aagugcaaauucccaggcucug

SEQ ID NO: 64540 - RNA, 22 nt, Homo sapiens
aagugcuuccuuucagaggguu

SEQ ID NO: 64541 - RNA, 22 nt, Homo sapiens
aagugcuuuacacaugcaugau

SEQ ID NO: 64542 - RNA, 22 nt, Homo sapiens
aagugcuuuguacagggguuga

SEQ ID NO: 64543 - RNA, 22 nt, Homo sapiens
aaguggcauugaggaaaaaaau

SEQ ID NO: 64544 - RNA, 22 nt, Homo sapiens
aaguggccuagagcgaccauuu

SEQ ID NO: 64545 - RNA, 19 nt, Homo sapiens
aagugguuuaaacuuguau

SEQ ID NO: 64546 - RNA, 22 nt, Homo sapiens
aaguguaaguuaauguuuaggu

SEQ ID NO: 64547 - RNA, 22 nt, Homo sapiens
aaguugcuuuagguaagucaau

SEQ ID NO: 64548 - RNA, 22 nt, Homo sapiens
aauaaagcagcuuuuugggacu

SEQ ID NO: 64549 - RNA, 22 nt, Homo sapiens
aauaaagccugucucuuuagag

SEQ ID NO: 64550 - RNA, 22 nt, Homo sapiens
aauaaagucugaagugugcuua

SEQ ID NO: 64551 - RNA, 22 nt, Homo sapiens
aauaaugucacaggggguuagc

SEQ ID NO: 64552 - RNA, 21 nt, Homo sapiens
aauacucuagguuaagagagc

SEQ ID NO: 64553 - RNA, 22 nt, Homo sapiens
aauacugaaaguauuuucaaau

SEQ ID NO: 64554 - RNA, 22 nt, Homo sapiens
aauacuuccaaaucuagucauu

SEQ ID NO: 64555 - RNA, 22 nt, Homo sapiens
aauagcacugcuaugguuugaa

SEQ ID NO: 64556 - RNA, 22 nt, Homo sapiens
aauagcacuguagauggaggaa

SEQ ID NO: 64557 - RNA, 23 nt, Homo sapiens
aauaucacaguggguguacaccc

SEQ ID NO: 64558 - RNA, 22 nt, Homo sapiens
aauaucacaguuggguguacac

SEQ ID NO: 64559 - RNA, 22 nt, Homo sapiens
aauaucuguguauagauggggg

SEQ ID NO: 64560 - RNA, 22 nt, Homo sapiens
aaucacagccagcuuccgcuau

SEQ ID NO: 64561 - RNA, 22 nt, Homo sapiens
aaucacaguuaguaagggagaa

SEQ ID NO: 64562 - RNA, 22 nt, Homo sapiens
aaucacauuaaugcucccucag

SEQ ID NO: 64563 - RNA, 22 nt, Homo sapiens
aacauugaacuuggcacaccca

SEQ ID NO: 64564 - RNA, 19 nt, Homo sapiens
aaccgggagugcacauguu

SEQ ID NO: 64565 - RNA, 22 nt, Homo sapiens
aaccuacauucuuaacuguugc

SEQ ID NO: 64566 - RNA, 15 nt, Homo sapiens
aaccuggaggagcuu

SEQ ID NO: 64567 - RNA, 22 nt, Homo sapiens
aacuacaucucuuugaggcagg

SEQ ID NO: 64568 - RNA, 22 nt, Homo sapiens
aacuccauuuuagacccuagau

SEQ ID NO: 64569 - RNA, 22 nt, Homo sapiens
aacugcacauauuuguaugggu

SEQ ID NO: 64570 - RNA, 22 nt, Homo sapiens
aacugcucuuaccagauggguc

SEQ ID NO: 64571 - RNA, 22 nt, Homo sapiens
aacuggccugagaugaaaagug

SEQ ID NO: 64572 - RNA, 22 nt, Homo sapiens
aacugggcaagcauuacauggu

SEQ ID NO: 64573 - RNA, 19 nt, Homo sapiens
aacuggugugagaugauau

SEQ ID NO: 64574 - RNA, 22 nt, Homo sapiens
aacuugcacuugauugagagcu

SEQ ID NO: 64575 - RNA, 22 nt, Homo sapiens
aagagaugaagguccugacugu

SEQ ID NO: 64576 - RNA, 22 nt, Homo sapiens
aagagcauuauuuaguaauuuc

SEQ ID NO: 64577 - RNA, 22 nt, Homo sapiens
aagagcgcugauaacauguuug

SEQ ID NO: 64578 - RNA, 22 nt, Homo sapiens
aagaggccuaggaaucuguauu

SEQ ID NO: 64579 - RNA, 22 nt, Homo sapiens
aagaggcuguaggauaaugccu

SEQ ID NO: 64580 - RNA, 22 nt, Homo sapiens
aagucaguuugggagaagcuau

SEQ ID NO: 64581 - RNA, 22 nt, Homo sapiens
aagucauggagaagguggaggu

SEQ ID NO: 64582 - RNA, 22 nt, Homo sapiens
aaguccaugaagucuugugggu

SEQ ID NO: 64583 - RNA, 22 nt, Homo sapiens
aaguccccugacagaggggagg

SEQ ID NO: 64584 - RNA, 22 nt, Homo sapiens
aagugaaugugcuggaauagcu

SEQ ID NO: 64585 - RNA, 22 nt, Homo sapiens
aagugaauucauuguguuauau

SEQ ID NO: 64586 - RNA, 22 nt, Homo sapiens
aagugacuagacuaugaaaccu

SEQ ID NO: 64587 - RNA, 22 nt, Homo sapiens
aagugauguuauugggugacuc

SEQ ID NO: 64588 - RNA, 20 nt, Homo sapiens
aagugcaucguugugucugc

SEQ ID NO: 64589 - RNA, 22 nt, Homo sapiens
aagugcauguauuaguguaguc

SEQ ID NO: 64590 - RNA, 20 nt, Homo sapiens
aagugcuauuucuuuugugg

SEQ ID NO: 64591 - RNA, 21 nt, Homo sapiens
aagugcucugggacucuaaau

SEQ ID NO: 64592 - RNA, 22 nt, Homo sapiens
aagugcugggauuggccgggca

SEQ ID NO: 64593 - RNA, 22 nt, Homo sapiens
aagugcuguccuaccuuuggga

SEQ ID NO: 64594 - RNA, 22 nt, Homo sapiens
aagugcuuaggauagugugugg

SEQ ID NO: 64595 - RNA, 22 nt, Homo sapiens
aagugcuuuuuagauaugguuu

SEQ ID NO: 64596 - RNA, 22 nt, Homo sapiens
aaguggaauguuuguggcacaa

SEQ ID NO: 64597 - RNA, 17 nt, Homo sapiens
aaguggcuuguucacca

SEQ ID NO: 64598 - RNA, 23 nt, Homo sapiens
aagugguuuugaacccggacccu

SEQ ID NO: 64599 - RNA, 22 nt, Homo sapiens
aagugguuuuuacaaagacaga

SEQ ID NO: 64600 - RNA, 22 nt, Homo sapiens
aaguugguguaugagacagaag

SEQ ID NO: 64601 - RNA, 22 nt, Homo sapiens
aaguuguuggaguuccauuguu

SEQ ID NO: 64602 - RNA, 22 nt, Homo sapiens
aauaaagcauggcuacuccaua

SEQ ID NO: 64603 - RNA, 22 nt, Homo sapiens
aauaaagcuuugagcuuugcug

SEQ ID NO: 64604 - RNA, 22 nt, Homo sapiens
aauaaaguaggaggugaggaaa

SEQ ID NO: 64605 - RNA, 22 nt, Homo sapiens
aauaagaaguggaagggaccgg

SEQ ID NO: 64606 - RNA, 22 nt, Homo sapiens
aauaauggcaccaaagcacaag

SEQ ID NO: 64607 - RNA, 22 nt, Homo sapiens
aauacugcuuugauguaagcua

SEQ ID NO: 64608 - RNA, 22 nt, Homo sapiens
aauacuggcacugaagaccaug

SEQ ID NO: 64609 - RNA, 22 nt, Homo sapiens
aauagugcugcaaaaacauacg

SEQ ID NO: 64610 - RNA, 22 nt, Homo sapiens
aauaucacaggguguacacuca

SEQ ID NO: 64611 - RNA, 22 nt, Homo sapiens
aauaugguuuuaugaagcaauu

SEQ ID NO: 64612 - RNA, 22 nt, Homo sapiens
aauauguccaguguuuugggag

SEQ ID NO: 64613 - RNA, 22 nt, Homo sapiens
aauauguccuugaaauggugcu

SEQ ID NO: 64614 - RNA, 22 nt, Homo sapiens
aauaugucugcuaauuguuucu

SEQ ID NO: 64615 - RNA, 22 nt, Homo sapiens
aaucacaggucuuggcugcaug

SEQ ID NO: 64616 - RNA, 22 nt, Homo sapiens
aaucacaguguucuugugaggg

SEQ ID NO: 64617 - RNA, 21 nt, Homo sapiens
aaucacugucuguuuccccuu

SEQ ID NO: 64618 - RNA, 22 nt, Homo sapiens
aaucagagcccucugagcuuca

SEQ ID NO: 64619 - RNA, 22 nt, Homo sapiens
aauccaugugcuuuaccauuuu

SEQ ID NO: 64620 - RNA, 22 nt, Homo sapiens
aauccauuugccgucuauccau

SEQ ID NO: 64621 - RNA, 22 nt, Homo sapiens
aaucccauuucucuguguuuuu

SEQ ID NO: 64622 - RNA, 22 nt, Homo sapiens
aauccuguagauucuaauuccu

SEQ ID NO: 64623 - RNA, 22 nt, Homo sapiens
aaucgcuuuugguaggcaagga

SEQ ID NO: 64624 - RNA, 22 nt, Homo sapiens
aaucucagcauuuugggcugag

SEQ ID NO: 64625 - RNA, 22 nt, Homo sapiens
aaucugucuagacaaggagucu

SEQ ID NO: 64626 - RNA, 23 nt, Homo sapiens
aaucugucuuuguuauagggguc

SEQ ID NO: 64627 - RNA, 22 nt, Homo sapiens
aaugacucugccuaaauuucac

SEQ ID NO: 64628 - RNA, 22 nt, Homo sapiens
aaugaucaauguuugaggugau

SEQ ID NO: 64629 - RNA, 22 nt, Homo sapiens
aaugcaagauguuaauuauagg

SEQ ID NO: 64630 - RNA, 22 nt, Homo sapiens
aaugcacuccagccugggcgac

SEQ ID NO: 64631 - RNA, 22 nt, Homo sapiens
aaugcuaucuggaacauuguug

SEQ ID NO: 64632 - RNA, 22 nt, Homo sapiens
aaugcuguguuauuucaugacc

SEQ ID NO: 64633 - RNA, 22 nt, Homo sapiens
aauggcaagagccacagaggcg

SEQ ID NO: 64634 - RNA, 22 nt, Homo sapiens
aauggcacacaccuggucuaac

SEQ ID NO: 64635 - RNA, 22 nt, Homo sapiens
aauggcacaccuagcccuaacc

SEQ ID NO: 64636 - RNA, 22 nt, Homo sapiens
aauggcagaugaaauugucauu

SEQ ID NO: 64637 - RNA, 22 nt, Homo sapiens
aauggcaucuacguuaaauguc

SEQ ID NO: 64638 - RNA, 20 nt, Homo sapiens
aauggcauguuggacaacug

SEQ ID NO: 64639 - RNA, 22 nt, Homo sapiens
aauggcucuuccuggaguugug

SEQ ID NO: 64640 - RNA, 18 nt, Homo sapiens
aaugggacuacaaagcca

SEQ ID NO: 64641 - RNA, 22 nt, Homo sapiens
aauggguaguacugugguaaca

SEQ ID NO: 64642 - RNA, 22 nt, Homo sapiens
aaugucacugugguccuccagu

SEQ ID NO: 64643 - RNA, 22 nt, Homo sapiens
aaugucaucuucaguuguacag

SEQ ID NO: 64644 - RNA, 22 nt, Homo sapiens
aauuaguuggcugggugcggug

SEQ ID NO: 64645 - RNA, 22 nt, Homo sapiens
aauugaccuaaucugauuacug

SEQ ID NO: 64646 - RNA, 22 nt, Homo sapiens
aauugcacuacugcacucccac

SEQ ID NO: 64647 - RNA, 22 nt, Homo sapiens
aauugcauaaaauucaacucug

SEQ ID NO: 64648 - RNA, 22 nt, Homo sapiens
aauugccucaagugaucauggc

SEQ ID NO: 64649 - RNA, 22 nt, Homo sapiens
aauugcuucuguauuuuggaca

SEQ ID NO: 64650 - RNA, 23 nt, Homo sapiens
aauugcuuuugaggacuuaguug

SEQ ID NO: 64651 - RNA, 22 nt, Homo sapiens
aauuguacucccauaauucccu

SEQ ID NO: 64652 - RNA, 22 nt, Homo sapiens
acaaagcuagggaauccaucuu

SEQ ID NO: 64653 - RNA, 22 nt, Homo sapiens
acaaaguauggaauguuggugu

SEQ ID NO: 64654 - RNA, 22 nt, Homo sapiens
acaacaguuuuaucaccccaga

SEQ ID NO: 64655 - RNA, 22 nt, Homo sapiens
acaaccauuguaagggcuuugg

SEQ ID NO: 64656 - RNA, 22 nt, Homo sapiens
acaagcacaaaugcauagaugg

SEQ ID NO: 64657 - RNA, 22 nt, Homo sapiens
acaagcacaaauuuaauccugu

SEQ ID NO: 64658 - RNA, 22 nt, Homo sapiens
acacaguaagcacaguguagau

SEQ ID NO: 64659 - RNA, 22 nt, Homo sapiens
acacauuagcaagugcuguuau

SEQ ID NO: 64660 - RNA, 22 nt, Homo sapiens
acaccaucuccuuauuucucuu

SEQ ID NO: 64661 - RNA, 20 nt, Homo sapiens
acacuggaguaucaaggccc

SEQ ID NO: 64662 - RNA, 22 nt, Homo sapiens
acacuggaguuaaaggugauuu

SEQ ID NO: 64663 - RNA, 22 nt, Homo sapiens
acacuguacuuauguuuugcag

SEQ ID NO: 64664 - RNA, 22 nt, Homo sapiens
acacuguagcugagggcaugcg

SEQ ID NO: 64665 - RNA, 22 nt, Homo sapiens
acacuguauccuucuguccuuu

SEQ ID NO: 64666 - RNA, 22 nt, Homo sapiens
acacugucucuugcugaccaug

SEQ ID NO: 64667 - RNA, 22 nt, Homo sapiens
acacuguuuuaguuauuauagc

SEQ ID NO: 64668 - RNA, 23 nt, Homo sapiens
acacuugcugaguaaaucaaaua

SEQ ID NO: 64669 - RNA, 22 nt, Homo sapiens
acagagcaaugagcuacggucu

SEQ ID NO: 64670 - RNA, 19 nt, Homo sapiens
acagauagaauguucuaca

SEQ ID NO: 64671 - RNA, 22 nt, Homo sapiens
acagauagcacuaagggaucug

SEQ ID NO: 64672 - RNA, 22 nt, Homo sapiens
acagaucagagauauuuagguu

SEQ ID NO: 64673 - RNA, 22 nt, Homo sapiens
acagcacugccaagugacccau

SEQ ID NO: 64674 - RNA, 22 nt, Homo sapiens
acagcagugccccacucuacug

SEQ ID NO: 64675 - RNA, 22 nt, Homo sapiens
acugcacuccagccucgcaaca

SEQ ID NO: 64676 - RNA, 22 nt, Homo sapiens
acugcacuccagccucggggac

SEQ ID NO: 64677 - RNA, 22 nt, Homo sapiens
acugcacuccagccugcccaac

SEQ ID NO: 64678 - RNA, 22 nt, Homo sapiens
acugcacuccagccugccgaca

SEQ ID NO: 64679 - RNA, 22 nt, Homo sapiens
acugcacuccagccugcugaca

SEQ ID NO: 64680 - RNA, 22 nt, Homo sapiens
acugcacuccagccugcuggca

SEQ ID NO: 64681 - RNA, 22 nt, Homo sapiens
acugcacuccagccuggacgaa

SEQ ID NO: 64682 - RNA, 22 nt, Homo sapiens
acugcacuccagccuggacgac

SEQ ID NO: 64683 - RNA, 22 nt, Homo sapiens
acugcacuccagccuguugaca

SEQ ID NO: 64684 - RNA, 22 nt, Homo sapiens
acugcacuccagccuugagagc

SEQ ID NO: 64685 - RNA, 22 nt, Homo sapiens
acugcacuccagccuugauggc

SEQ ID NO: 64686 - RNA, 22 nt, Homo sapiens
acugcacuccagccuuggagac

SEQ ID NO: 64687 - RNA, 20 nt, Homo sapiens
acugcacuccaggcugccca

SEQ ID NO: 64688 - RNA, 22 nt, Homo sapiens
acugcacuccaguuugggcagc

SEQ ID NO: 64689 - RNA, 18 nt, Homo sapiens
acugcacuccauccuagg

SEQ ID NO: 64690 - RNA, 22 nt, Homo sapiens
acugcacuccuccuugggugac

SEQ ID NO: 64691 - RNA, 22 nt, Homo sapiens
acugcacugcagccuggccaac

SEQ ID NO: 64692 - RNA, 22 nt, Homo sapiens
acugcacuguccuagaguccuc

SEQ ID NO: 64693 - RNA, 22 nt, Homo sapiens
acugcacuucaaccucauugac

SEQ ID NO: 64694 - RNA, 22 nt, Homo sapiens
acugcacuucagccuguugaca

SEQ ID NO: 64695 - RNA, 22 nt, Homo sapiens
acugcauuugguaaagucaaga

SEQ ID NO: 64696 - RNA, 22 nt, Homo sapiens
acugcauuugucugucucaauu

SEQ ID NO: 64697 - RNA, 18 nt, Homo sapiens
acuggauguaaagggucc

SEQ ID NO: 64698 - RNA, 22 nt, Homo sapiens
acuggcauagggcgggcacagu

SEQ ID NO: 64699 - RNA, 22 nt, Homo sapiens
acuggcuuauuucacuuagcau

SEQ ID NO: 64700 - RNA, 22 nt, Homo sapiens
acugggauauuauugguaauau

SEQ ID NO: 64701 - RNA, 22 nt, Homo sapiens
acuguacucuacccugggcaac

SEQ ID NO: 64702 - RNA, 22 nt, Homo sapiens
acugugcuguuuuaauuauuga

SEQ ID NO: 64703 - RNA, 22 nt, Homo sapiens
acuguguguuugucuagcacag

SEQ ID NO: 64704 - RNA, 22 nt, Homo sapiens
acuuauuguggcugacccaaac

SEQ ID NO: 64705 - RNA, 22 nt, Homo sapiens
acuuugcuuagagggcauuaaa

SEQ ID NO: 64706 - RNA, 22 nt, Homo sapiens
acuuugcuuaucccaggcacug

SEQ ID NO: 64707 - RNA, 22 nt, Homo sapiens
acuuugguuuauagaauuuagg

SEQ ID NO: 64708 - RNA, 22 nt, Homo sapiens
agaaacacagguggaauugcuu

SEQ ID NO: 64709 - RNA, 22 nt, Homo sapiens
agaaagcgcuucccuuugcugg

SEQ ID NO: 64710 - RNA, 22 nt, Homo sapiens
agaacacugaguucagggucag

SEQ ID NO: 64711 - RNA, 22 nt, Homo sapiens
agaaccaaucccacauggauac

SEQ ID NO: 64712 - RNA, 22 nt, Homo sapiens
agaacuguccauucagcaugaa

SEQ ID NO: 64713 - RNA, 19 nt, Homo sapiens
agaagugcauggucuagag

SEQ ID NO: 64714 - RNA, 22 nt, Homo sapiens
agaauaauguccccccaaggga

SEQ ID NO: 64715 - RNA, 22 nt, Homo sapiens
agaauucugucauguuuauauu

SEQ ID NO: 64716 - RNA, 22 nt, Homo sapiens
agacaagauggcuugagguuca

SEQ ID NO: 64717 - RNA, 22 nt, Homo sapiens
agacacuguugaaaaggcccca

SEQ ID NO: 64718 - RNA, 22 nt, Homo sapiens
agacuagagggaaaugaguugg

SEQ ID NO: 64719 - RNA, 23 nt, Homo sapiens
agacugaaguaucugagacucag

SEQ ID NO: 64720 - RNA, 22 nt, Homo sapiens
agacuuagagagucuauucuau

SEQ ID NO: 64721 - RNA, 21 nt, Homo sapiens
agagaacugaaacaugugacu

SEQ ID NO: 64722 - RNA, 22 nt, Homo sapiens
agagaacugauuggaugugggc

SEQ ID NO: 64723 - RNA, 22 nt, Homo sapiens
agagagguggguggagccccca

SEQ ID NO: 64724 - RNA, 22 nt, Homo sapiens
agagauaaagauuuuaauuuug

SEQ ID NO: 64725 - RNA, 22 nt, Homo sapiens
agagauacauucugagaagugc

SEQ ID NO: 64726 - RNA, 22 nt, Homo sapiens
agagaucaauaugaaggaaaug

SEQ ID NO: 64727 - RNA, 22 nt, Homo sapiens
agagaucacugaaucacggggg

SEQ ID NO: 64728 - RNA, 20 nt, Homo sapiens
agagaucaguaauucaucaa

SEQ ID NO: 64729 - RNA, 22 nt, Homo sapiens
agagcaaugacaugcuaugugg

SEQ ID NO: 64730 - RNA, 22 nt, Homo sapiens
agagcacuguggguccaaauau

SEQ ID NO: 64731 - RNA, 22 nt, Homo sapiens
agagcuguguuuuaacuuuuua

SEQ ID NO: 64732 - RNA, 22 nt, Homo sapiens
agagguauacauuugagagcca

SEQ ID NO: 64733 - RNA, 22 nt, Homo sapiens
agaggucuuaucaaacaugcuu

SEQ ID NO: 64734 - RNA, 22 nt, Homo sapiens
agagguuuaauugauucacagu

SEQ ID NO: 64735 - RNA, 22 nt, Homo sapiens
agagguuuugcccucgagauaa

SEQ ID NO: 64736 - RNA, 22 nt, Homo sapiens
agagguuuuggggcugagagcu

SEQ ID NO: 64737 - RNA, 22 nt, Homo sapiens
agaguaguaggaugaauggacu

SEQ ID NO: 64738 - RNA, 22 nt, Homo sapiens
agaguauacaugugagugagau

SEQ ID NO: 64739 - RNA, 22 nt, Homo sapiens
agaguauagcaacuuaguaaaa

SEQ ID NO: 64740 - RNA, 22 nt, Homo sapiens
agagugcuauagauuagauuuc

SEQ ID NO: 64741 - RNA, 22 nt, Homo sapiens
agagugcuuuauuagauguagc

SEQ ID NO: 64742 - RNA, 22 nt, Homo sapiens
agauauuuguuaggucugucag

SEQ ID NO: 64743 - RNA, 22 nt, Homo sapiens
agaucaauugcugauucgcucu

SEQ ID NO: 64744 - RNA, 23 nt, Homo sapiens
agauggcauuucaguucuuuagg

SEQ ID NO: 64745 - RNA, 18 nt, Homo sapiens
agaugguguugcuucugu

SEQ ID NO: 64746 - RNA, 22 nt, Homo sapiens
agaugguguuggcugaguguau

SEQ ID NO: 64747 - RNA, 22 nt, Homo sapiens
agauucauccaaguuguugcau

SEQ ID NO: 64748 - RNA, 22 nt, Homo sapiens
agcaaaucuaugaauguauauu

SEQ ID NO: 64749 - RNA, 22 nt, Homo sapiens
agcaacauagugagacccccau

SEQ ID NO: 64750 - RNA, 22 nt, Homo sapiens
agcaaccagaggagaugaggcu

SEQ ID NO: 64751 - RNA, 22 nt, Homo sapiens
agcaagauugauggccugcagg

SEQ ID NO: 64752 - RNA, 22 nt, Homo sapiens
agcacacuggguggcuuaaaca

SEQ ID NO: 64753 - RNA, 22 nt, Homo sapiens
agcacaguuaaaugaggcuucu

SEQ ID NO: 64754 - RNA, 22 nt, Homo sapiens
agcacauuaguaucuaagaaca

SEQ ID NO: 64755 - RNA, 22 nt, Homo sapiens
aaugcacauaaaauccuccagg

SEQ ID NO: 64756 - RNA, 22 nt, Homo sapiens
aaugcacauauauuuccuuauu

SEQ ID NO: 64757 - RNA, 22 nt, Homo sapiens
aaugcuguucuuugcuuaaguu

SEQ ID NO: 64758 - RNA, 22 nt, Homo sapiens
aauggagcuguuuggaugacuu

SEQ ID NO: 64759 - RNA, 22 nt, Homo sapiens
aauggcaaauguuuucuguuga

SEQ ID NO: 64760 - RNA, 22 nt, Homo sapiens
aauggcacuuuauaaauguuaa

SEQ ID NO: 64761 - RNA, 22 nt, Homo sapiens
aauggcauuugccagggcaaag

SEQ ID NO: 64762 - RNA, 22 nt, Homo sapiens
aauggcucuguuggcccaagac

SEQ ID NO: 64763 - RNA, 22 nt, Homo sapiens
aauggcucuuuaggcaauagau

SEQ ID NO: 64764 - RNA, 22 nt, Homo sapiens
aauggcuucuuauugugguuca

SEQ ID NO: 64765 - RNA, 22 nt, Homo sapiens
aauggcuuucagcuuuucccca

SEQ ID NO: 64766 - RNA, 19 nt, Homo sapiens
aauggcuuuuccuguuccc

SEQ ID NO: 64767 - RNA, 22 nt, Homo sapiens
aaugggacugacgccucccaga

SEQ ID NO: 64768 - RNA, 22 nt, Homo sapiens
aaugugcacuauuagggugaua

SEQ ID NO: 64769 - RNA, 22 nt, Homo sapiens
aaauugcuuuugaagacuuagu

SEQ ID NO: 64770 - RNA, 22 nt, Homo sapiens
aacaccuugcagggauuaugac

SEQ ID NO: 64771 - RNA, 22 nt, Homo sapiens
aacacggcccgcagagcaagcu

SEQ ID NO: 64772 - RNA, 22 nt, Homo sapiens
aacacuaucugccuuacaggga

SEQ ID NO: 64773 - RNA, 22 nt, Homo sapiens
aacaggguggugccugguccau

SEQ ID NO: 64774 - RNA, 22 nt, Homo sapiens
aacaggguguuugcaguuucuu

SEQ ID NO: 64775 - RNA, 22 nt, Homo sapiens
aacagucaauugcugaugaccu

SEQ ID NO: 64776 - RNA, 22 nt, Homo sapiens
aacagucuccaguuguauccau

SEQ ID NO: 64777 - RNA, 22 nt, Homo sapiens
aacagugcauucagggauauau

SEQ ID NO: 64778 - RNA, 22 nt, Homo sapiens
aacagugccugucauuuaguag

SEQ ID NO: 64779 - RNA, 22 nt, Homo sapiens
aacagugcuguuauaaauguac

SEQ ID NO: 64780 - RNA, 22 nt, Homo sapiens
aacaguguuuuggguuuucugg

SEQ ID NO: 64781 - RNA, 22 nt, Homo sapiens
aacauagucaugggguaauguu

SEQ ID NO: 64782 - RNA, 20 nt, Homo sapiens
aaccccuauagagaaaccau

SEQ ID NO: 64783 - RNA, 22 nt, Homo sapiens
aacccugacacaagcagaauuu

SEQ ID NO: 64784 - RNA, 22 nt, Homo sapiens
aaccugaagaaaauauuugcug

SEQ ID NO: 64785 - RNA, 22 nt, Homo sapiens
aaccuuuagucagcucuuagga

SEQ ID NO: 64786 - RNA, 22 nt, Homo sapiens
aacugcauuuucugauugugug

SEQ ID NO: 64787 - RNA, 22 nt, Homo sapiens
aacuggccuggcgugcagaggg

SEQ ID NO: 64788 - RNA, 22 nt, Homo sapiens
aacugguauugaauuuaggaag

SEQ ID NO: 64789 - RNA, 22 nt, Homo sapiens
aacuggucuuuggaggaggagg

SEQ ID NO: 64790 - RNA, 19 nt, Homo sapiens
aacuggugugagaugguau

SEQ ID NO: 64791 - RNA, 22 nt, Homo sapiens
aagagcauuggauggggagauu

SEQ ID NO: 64792 - RNA, 20 nt, Homo sapiens
aagagcucaccagaauaucu

SEQ ID NO: 64793 - RNA, 22 nt, Homo sapiens
aagagguagaagcuugccuucu

SEQ ID NO: 64794 - RNA, 22 nt, Homo sapiens
aagagguagcagucacaaaaga

SEQ ID NO: 64795 - RNA, 22 nt, Homo sapiens
aagagguuguaccuaaaguguu

SEQ ID NO: 64796 - RNA, 22 nt, Homo sapiens
aagaucauucagggaaggcuga

SEQ ID NO: 64797 - RNA, 22 nt, Homo sapiens
auagguuauuagagcaaagcuu

SEQ ID NO: 64798 - RNA, 22 nt, Homo sapiens
auaguauaguugaggauggcau

SEQ ID NO: 64799 - RNA, 22 nt, Homo sapiens
auagugcagugaugaaccuagg

SEQ ID NO: 64800 - RNA, 22 nt, Homo sapiens
auagugcugcaaaaaacauacg

SEQ ID NO: 64801 - RNA, 22 nt, Homo sapiens
auagugcugcaacaaauauacg

SEQ ID NO: 64802 - RNA, 22 nt, Homo sapiens
auagugcugcaauaaacacacg

SEQ ID NO: 64803 - RNA, 22 nt, Homo sapiens
auagugcugcaaucaacauaca

SEQ ID NO: 64804 - RNA, 22 nt, Homo sapiens
auauaccuaggcuacaugguuu

SEQ ID NO: 64805 - RNA, 22 nt, Homo sapiens
auauagcaaugaaagagaugaa

SEQ ID NO: 64806 - RNA, 22 nt, Homo sapiens
auaucaacaucgugucauuagu

SEQ ID NO: 64807 - RNA, 22 nt, Homo sapiens
auaucaacaugguaggguuggu

SEQ ID NO: 64808 - RNA, 22 nt, Homo sapiens
acagccauuccagccaaauacu

SEQ ID NO: 64809 - RNA, 22 nt, Homo sapiens
acaggugaaguauuacacuaag

SEQ ID NO: 64810 - RNA, 22 nt, Homo sapiens
acaguagcgcaaucucggcuca

SEQ ID NO: 64811 - RNA, 23 nt, Homo sapiens
acagucuaguuugaagucaggua

SEQ ID NO: 64812 - RNA, 17 nt, Homo sapiens
acagugcuuugcuuucc

SEQ ID NO: 64813 - RNA, 22 nt, Homo sapiens
acaguguacaauagccuuuuaa

SEQ ID NO: 64814 - RNA, 22 nt, Homo sapiens
acaguguagugacugccaacuu

SEQ ID NO: 64815 - RNA, 22 nt, Homo sapiens
acagugucaugucguguucccc

SEQ ID NO: 64816 - RNA, 17 nt, Homo sapiens
acagugucuaugaaaug

SEQ ID NO: 64817 - RNA, 18 nt, Homo sapiens
acagugucuuacaccugu

SEQ ID NO: 64818 - RNA, 18 nt, Homo sapiens
acaguguguaaggguucu

SEQ ID NO: 64819 - RNA, 22 nt, Homo sapiens
acaguuaugugagggccaccag

SEQ ID NO: 64820 - RNA, 22 nt, Homo sapiens
acauauaaggagacuagggcau

SEQ ID NO: 64821 - RNA, 21 nt, Homo sapiens
acaucagaguugugaagguag

SEQ ID NO: 64822 - RNA, 22 nt, Homo sapiens
acaucuguacaguggguguggu

SEQ ID NO: 64823 - RNA, 17 nt, Homo sapiens
acaugagacuggauucu

SEQ ID NO: 64824 - RNA, 22 nt, Homo sapiens
acaugcauccaugugaagagac

SEQ ID NO: 64825 - RNA, 22 nt, Homo sapiens
acaugcauggcaugcauuguac

SEQ ID NO: 64826 - RNA, 22 nt, Homo sapiens
acaugccucccugguccgcugu

SEQ ID NO: 64827 - RNA, 22 nt, Homo sapiens
acaugguacugauuuacgaaau

SEQ ID NO: 64828 - RNA, 22 nt, Homo sapiens
acauguagacaacggacaaagu

SEQ ID NO: 64829 - RNA, 23 nt, Homo sapiens
acauguauagacuuuuuuuccuu

SEQ ID NO: 64830 - RNA, 22 nt, Homo sapiens
acauucagcuguuguuucaaug

SEQ ID NO: 64831 - RNA, 18 nt, Homo sapiens
acauucagcuugaagaua

SEQ ID NO: 64832 - RNA, 22 nt, Homo sapiens
acauugcagauguguuuaaugu

SEQ ID NO: 64833 - RNA, 19 nt, Homo sapiens
acauugcauuuguaggcuu

SEQ ID NO: 64834 - RNA, 22 nt, Homo sapiens
acauugcucuuaccaaguuugu

SEQ ID NO: 64835 - RNA, 22 nt, Homo sapiens
accagucucagguaugucuuua

SEQ ID NO: 64836 - RNA, 17 nt, Homo sapiens
accagugcaugugcuuu

SEQ ID NO: 64837 - RNA, 22 nt, Homo sapiens
accaguguuuaccaaguagcau

SEQ ID NO: 64838 - RNA, 22 nt, Homo sapiens
accaguuuuuuauacaucuucu

SEQ ID NO: 64839 - RNA, 22 nt, Homo sapiens
accauugcacuccagcccaggc

SEQ ID NO: 64840 - RNA, 22 nt, Homo sapiens
acccaguagccagauguagcug

SEQ ID NO: 64841 - RNA, 22 nt, Homo sapiens
accccauuugcacugagcccuu

SEQ ID NO: 64842 - RNA, 21 nt, Homo sapiens
acccccacaccuccuuaguuc

SEQ ID NO: 64843 - RNA, 22 nt, Homo sapiens
accccguagagucugcagcuac

SEQ ID NO: 64844 - RNA, 22 nt, Homo sapiens
acccgcccagguguggccggga

SEQ ID NO: 64845 - RNA, 22 nt, Homo sapiens
acccggagagcaggcgagaagg

SEQ ID NO: 64846 - RNA, 22 nt, Homo sapiens
acccuacauaguagauccuaca

SEQ ID NO: 64847 - RNA, 22 nt, Homo sapiens
acccuggaggucuacagugcag

SEQ ID NO: 64848 - RNA, 22 nt, Homo sapiens
acccuggaguaguaggaaucug

SEQ ID NO: 64849 - RNA, 22 nt, Homo sapiens
acccugguagcuaugaagucuu

SEQ ID NO: 64850 - RNA, 22 nt, Homo sapiens
acccugucaaaauggaccaauc

SEQ ID NO: 64851 - RNA, 22 nt, Homo sapiens
acccugucacucccaucaauuu

SEQ ID NO: 64852 - RNA, 19 nt, Homo sapiens
acccuguccccaccuuuac

SEQ ID NO: 64853 - RNA, 22 nt, Homo sapiens
acccugugagagaguuaauauu

SEQ ID NO: 64854 - RNA, 22 nt, Homo sapiens
acccuguugguggaucagauug

SEQ ID NO: 64855 - RNA, 22 nt, Homo sapiens
acccuguugucagaauguggau

SEQ ID NO: 64856 - RNA, 22 nt, Homo sapiens
acccuuuagguuggaugaggau

SEQ ID NO: 64857 - RNA, 22 nt, Homo sapiens
accugggugcugaugggcuuua

SEQ ID NO: 64858 - RNA, 22 nt, Homo sapiens
accugguuuucucacaguggcu

SEQ ID NO: 64859 - RNA, 22 nt, Homo sapiens
accuguagcagacuuaauauuu

SEQ ID NO: 64860 - RNA, 23 nt, Homo sapiens
accugugguuauuuuacucuucc

SEQ ID NO: 64861 - RNA, 22 nt, Homo sapiens
accuuguagcaaaccuaacaua

SEQ ID NO: 64862 - RNA, 22 nt, Homo sapiens
acggcaguguggugcggucagg

SEQ ID NO: 64863 - RNA, 22 nt, Homo sapiens
acgugguaguacaguauuuuaa

SEQ ID NO: 64864 - RNA, 22 nt, Homo sapiens
acuacauaugacaucuucuuua

SEQ ID NO: 64865 - RNA, 22 nt, Homo sapiens
acuacuucuaaguuuuggaaga

SEQ ID NO: 64866 - RNA, 22 nt, Homo sapiens
acucagagugggccccuagaua

SEQ ID NO: 64867 - RNA, 22 nt, Homo sapiens
acucauugcucauaccuuaucu

SEQ ID NO: 64868 - RNA, 22 nt, Homo sapiens
acuccauuucauuuuagcucuu

SEQ ID NO: 64869 - RNA, 18 nt, Homo sapiens
acucuguauguggagugg

SEQ ID NO: 64870 - RNA, 22 nt, Homo sapiens
acugaauguaaacacggagugu

SEQ ID NO: 64871 - RNA, 22 nt, Homo sapiens
acugacaugaucaggcauguuc

SEQ ID NO: 64872 - RNA, 19 nt, Homo sapiens
acugagcuaccugggggca

SEQ ID NO: 64873 - RNA, 22 nt, Homo sapiens
acugagucauugggugcccaga

SEQ ID NO: 64874 - RNA, 22 nt, Homo sapiens
acugaucaauguuaaggcuuau

SEQ ID NO: 64875 - RNA, 21 nt, Homo sapiens
acugauguuugaaauucgcug

SEQ ID NO: 64876 - RNA, 23 nt, Homo sapiens
acugcaauuacguuugcaccaac

SEQ ID NO: 64877 - RNA, 22 nt, Homo sapiens
acugcacuccacccuuggcagc

SEQ ID NO: 64878 - RNA, 18 nt, Homo sapiens
acugcacuccaccuuggg

SEQ ID NO: 64879 - RNA, 22 nt, Homo sapiens
acugcacuccaccuugggcaac

SEQ ID NO: 64880 - RNA, 22 nt, Homo sapiens
acugcacuccagacucugucuc

SEQ ID NO: 64881 - RNA, 22 nt, Homo sapiens
acugcacuccagccucggugac

SEQ ID NO: 64882 - RNA, 22 nt, Homo sapiens
acugcacuccagccucguggac

SEQ ID NO: 64883 - RNA, 22 nt, Homo sapiens
acugcacuccagccugagccug

SEQ ID NO: 64884 - RNA, 22 nt, Homo sapiens
acugcacuccagccugcugggu

SEQ ID NO: 64885 - RNA, 22 nt, Homo sapiens
acugcacuccagccugugagac

SEQ ID NO: 64886 - RNA, 20 nt, Homo sapiens
acugcacuccagccuuccag

SEQ ID NO: 64887 - RNA, 22 nt, Homo sapiens
acugcacuccagccuucggaca

SEQ ID NO: 64888 - RNA, 22 nt, Homo sapiens
acugcacuccagccuuggccac

SEQ ID NO: 64889 - RNA, 22 nt, Homo sapiens
acugcacuccagccuuugcgau

SEQ ID NO: 64890 - RNA, 22 nt, Homo sapiens
acugcacuccagcuuuggugac

SEQ ID NO: 64891 - RNA, 22 nt, Homo sapiens
acugcacucccgcccgggugac

SEQ ID NO: 64892 - RNA, 22 nt, Homo sapiens
acugcacucuagcauggguaau

SEQ ID NO: 64893 - RNA, 22 nt, Homo sapiens
acugcacuuauccuccaauguu

SEQ ID NO: 64894 - RNA, 20 nt, Homo sapiens
acugcacuucagccugcugg

SEQ ID NO: 64895 - RNA, 22 nt, Homo sapiens
acugcauaaauauguguaauau

SEQ ID NO: 64896 - RNA, 22 nt, Homo sapiens
acugccuaaugacuuauguuuu

SEQ ID NO: 64897 - RNA, 22 nt, Homo sapiens
acuggacuuaaugaugaauugu

SEQ ID NO: 64898 - RNA, 22 nt, Homo sapiens
acuggaguuuguucaagaaaua

SEQ ID NO: 64899 - RNA, 22 nt, Homo sapiens
acuggcucugcuuuacaaacag

SEQ ID NO: 64900 - RNA, 22 nt, Homo sapiens
acuggcuuaaggaugggccacu

SEQ ID NO: 64901 - RNA, 22 nt, Homo sapiens
acuguacuacagccugggugac

SEQ ID NO: 64902 - RNA, 22 nt, Homo sapiens
acuguacuccauccugggugac

SEQ ID NO: 64903 - RNA, 22 nt, Homo sapiens
aaugugcacuuggagccuugcu

SEQ ID NO: 64904 - RNA, 22 nt, Homo sapiens
aaugugcuguucagaggagucc

SEQ ID NO: 64905 - RNA, 22 nt, Homo sapiens
aauguguuuugaaaucaggaag

SEQ ID NO: 64906 - RNA, 22 nt, Homo sapiens
aauuacucgugucuuuacugcu

SEQ ID NO: 64907 - RNA, 22 nt, Homo sapiens
aauuaguaaccuaauuccaucu

SEQ ID NO: 64908 - RNA, 22 nt, Homo sapiens
aauuaguugaaagucugcuuuu

SEQ ID NO: 64909 - RNA, 22 nt, Homo sapiens
aauucacuucuuuuaggcaggg

SEQ ID NO: 64910 - RNA, 22 nt, Homo sapiens
aauucugugagauggugcagau

SEQ ID NO: 64911 - RNA, 22 nt, Homo sapiens
aauugaaugcagaugccaggga

SEQ ID NO: 64912 - RNA, 23 nt, Homo sapiens
aauugcacauuccuugcuggcag

SEQ ID NO: 64913 - RNA, 22 nt, Homo sapiens
aauugcaccaucuagaucaaga

SEQ ID NO: 64914 - RNA, 22 nt, Homo sapiens
aauugcaucuguucuuugccag

SEQ ID NO: 64915 - RNA, 21 nt, Homo sapiens
acaaagcuggagggagacugc

SEQ ID NO: 64916 - RNA, 22 nt, Homo sapiens
acaaaguaggcagugggcugga

SEQ ID NO: 64917 - RNA, 22 nt, Homo sapiens
acaaaguguuuucugaaggccu

SEQ ID NO: 64918 - RNA, 22 nt, Homo sapiens
acaagacuucuuguauucuagu

SEQ ID NO: 64919 - RNA, 22 nt, Homo sapiens
acaagugaauacaggauucucu

SEQ ID NO: 64920 - RNA, 22 nt, Homo sapiens
acacaguaaauauguauugaau

SEQ ID NO: 64921 - RNA, 22 nt, Homo sapiens
acacaguaaauauugucuccuc

SEQ ID NO: 64922 - RNA, 22 nt, Homo sapiens
acaccaguacuuuauacaagca

SEQ ID NO: 64923 - RNA, 22 nt, Homo sapiens
acacucuaguguucuuaaucag

SEQ ID NO: 64924 - RNA, 22 nt, Homo sapiens
acacugcugaguaaauaauuuu

SEQ ID NO: 64925 - RNA, 20 nt, Homo sapiens
acacuggcuuugagauuuag

SEQ ID NO: 64926 - RNA, 22 nt, Homo sapiens
acacugucugaugaaaguaguu

SEQ ID NO: 64927 - RNA, 22 nt, Homo sapiens
acacuguugacauuuuguagug

SEQ ID NO: 64928 - RNA, 22 nt, Homo sapiens
acacuguuggugggaguguaaa

SEQ ID NO: 64929 - RNA, 22 nt, Homo sapiens
acacuguuuuguggagaaugua

SEQ ID NO: 64930 - RNA, 22 nt, Homo sapiens
acacuugcuugcaauagccucc

SEQ ID NO: 64931 - RNA, 22 nt, Homo sapiens
acagauagacauauauagcuca

SEQ ID NO: 64932 - RNA, 22 nt, Homo sapiens
acagauugcugggccccagccc

SEQ ID NO: 64933 - RNA, 20 nt, Homo sapiens
acagcauagccuuuuaaagc

SEQ ID NO: 64934 - RNA, 22 nt, Homo sapiens
acaggagugggauuugaguccu

SEQ ID NO: 64935 - RNA, 22 nt, Homo sapiens
acaggguuauuguaauaaugua

SEQ ID NO: 64936 - RNA, 21 nt, Homo sapiens
acaguacuugagaucuuuuga

SEQ ID NO: 64937 - RNA, 22 nt, Homo sapiens
acaguacuuuuggauuugugaa

SEQ ID NO: 64938 - RNA, 22 nt, Homo sapiens
acaguagaaaacaauggauuug

SEQ ID NO: 64939 - RNA, 23 nt, Homo sapiens
acaguauguggauguggcuaagu

SEQ ID NO: 64940 - RNA, 22 nt, Homo sapiens
acagucuggagaaugggugcuc

SEQ ID NO: 64941 - RNA, 22 nt, Homo sapiens
acagugacagaaagcugauuau

SEQ ID NO: 64942 - RNA, 18 nt, Homo sapiens
acagugcugucacugcuu

SEQ ID NO: 64943 - RNA, 19 nt, Homo sapiens
acagugcuuugucagaagc

SEQ ID NO: 64944 - RNA, 22 nt, Homo sapiens
acaguggugcgaucucggcuca

SEQ ID NO: 64945 - RNA, 23 nt, Homo sapiens
acaguggugugaucuuggcucag

SEQ ID NO: 64946 - RNA, 19 nt, Homo sapiens
acagugucucuauaaugau

SEQ ID NO: 64947 - RNA, 22 nt, Homo sapiens
acaguguuacuugauaguguau

SEQ ID NO: 64948 - RNA, 22 nt, Homo sapiens
acauacacuagggauguggugu

SEQ ID NO: 64949 - RNA, 22 nt, Homo sapiens
acauagaguaguggugaggaug

SEQ ID NO: 64950 - RNA, 22 nt, Homo sapiens
acaucaggcuugugaugauuac

SEQ ID NO: 64951 - RNA, 22 nt, Homo sapiens
acauccauuugcuuuauuugcu

SEQ ID NO: 64952 - RNA, 22 nt, Homo sapiens
acaugacauugggguggggaua

SEQ ID NO: 64953 - RNA, 22 nt, Homo sapiens
acaugcaucauuaggugguuua

SEQ ID NO: 64954 - RNA, 19 nt, Homo sapiens
acauggauuuugugcaaac

SEQ ID NO: 64955 - RNA, 22 nt, Homo sapiens
acauguaauugauuuuguguua

SEQ ID NO: 64956 - RNA, 22 nt, Homo sapiens
acauugcauauggcacccucuu

SEQ ID NO: 64957 - RNA, 22 nt, Homo sapiens
accacagugcuuccugcucacg

SEQ ID NO: 64958 - RNA, 22 nt, Homo sapiens
accaguagaaucaguggauucu

SEQ ID NO: 64959 - RNA, 22 nt, Homo sapiens
accaucuagauuuguguaggua

SEQ ID NO: 64960 - RNA, 22 nt, Homo sapiens
accauugcacuccagcccgggc

SEQ ID NO: 64961 - RNA, 22 nt, Homo sapiens
accauugcacuucagccuaggc

SEQ ID NO: 64962 - RNA, 22 nt, Homo sapiens
acccagaguuccuugucuuuca

SEQ ID NO: 64963 - RNA, 17 nt, Homo sapiens
acccagucuuuuugcac

SEQ ID NO: 64964 - RNA, 22 nt, Homo sapiens
acccaguguucaacauucacau

SEQ ID NO: 64965 - RNA, 22 nt, Homo sapiens
acccaguguucagacuaccugu

SEQ ID NO: 64966 - RNA, 22 nt, Homo sapiens
accccgagacugccaagaaucc

SEQ ID NO: 64967 - RNA, 23 nt, Homo sapiens
accccuacaggcuuguguccugc

SEQ ID NO: 64968 - RNA, 22 nt, Homo sapiens
acccgggaggcaggagucauag

SEQ ID NO: 64969 - RNA, 22 nt, Homo sapiens
acccgugcucacugccucugcc

SEQ ID NO: 64970 - RNA, 22 nt, Homo sapiens
acccgugcugaauauguaggug

SEQ ID NO: 64971 - RNA, 22 nt, Homo sapiens
acccucaagggacugacagaau

SEQ ID NO: 64972 - RNA, 20 nt, Homo sapiens
acccucuaggaugauuucuu

SEQ ID NO: 64973 - RNA, 22 nt, Homo sapiens
acccugcuaaacagcccccugc

SEQ ID NO: 64974 - RNA, 22 nt, Homo sapiens
acccuggagagugcuguaguaa

SEQ ID NO: 64975 - RNA, 22 nt, Homo sapiens
acccuguaacauacaagugguu

SEQ ID NO: 64976 - RNA, 22 nt, Homo sapiens
acccuguaguuagaaacuuuca

SEQ ID NO: 64977 - RNA, 22 nt, Homo sapiens
acccugucauccacauggugcu

SEQ ID NO: 64978 - RNA, 22 nt, Homo sapiens
acccugugaauauuuaaacuuc

SEQ ID NO: 64979 - RNA, 22 nt, Homo sapiens
acccuguugagcaacuggccau

SEQ ID NO: 64980 - RNA, 18 nt, Homo sapiens
acccuucagcacugggcc

SEQ ID NO: 64981 - RNA, 23 nt, Homo sapiens
accugauguuucuguggggagcc

SEQ ID NO: 64982 - RNA, 22 nt, Homo sapiens
accugcacagccgaacauagac

SEQ ID NO: 64983 - RNA, 22 nt, Homo sapiens
accuggacacuuugggcuccuc

SEQ ID NO: 64984 - RNA, 22 nt, Homo sapiens
accugguuuuaacauuguauua

SEQ ID NO: 64985 - RNA, 22 nt, Homo sapiens
accuugcacugagccgagauug

SEQ ID NO: 64986 - RNA, 22 nt, Homo sapiens
accuuguaucuguuaggauugc

SEQ ID NO: 64987 - RNA, 22 nt, Homo sapiens
acgugcaugcacacacaugcgc

SEQ ID NO: 64988 - RNA, 22 nt, Homo sapiens
acuauacuguaacuguauucag

SEQ ID NO: 64989 - RNA, 22 nt, Homo sapiens
acuaugagacgaaugcaucagu

SEQ ID NO: 64990 - RNA, 22 nt, Homo sapiens
acuccauuuccagagcagcccc

SEQ ID NO: 64991 - RNA, 22 nt, Homo sapiens
acuccauuuggacucugggagg

SEQ ID NO: 64992 - RNA, 22 nt, Homo sapiens
acucuguugucuggccuuccug

SEQ ID NO: 64993 - RNA, 19 nt, Homo sapiens
acugcacuccaaccuccug

SEQ ID NO: 64994 - RNA, 22 nt, Homo sapiens
acugcacuccaaccuguugggc

SEQ ID NO: 64995 - RNA, 22 nt, Homo sapiens
acugcacuccaaccuuggugac

SEQ ID NO: 64996 - RNA, 22 nt, Homo sapiens
acugcacuccagcccaggugac

SEQ ID NO: 64997 - RNA, 22 nt, Homo sapiens
acugcacuccagccuaggcgac

SEQ ID NO: 64998 - RNA, 22 nt, Homo sapiens
uuaugguacaugugcacaaugu

SEQ ID NO: 64999 - RNA, 22 nt, Homo sapiens
uuaugguuuauuagcaggguua

SEQ ID NO: 65000 - RNA, 22 nt, Homo sapiens
uuaugguuuucucucacgcagg

SEQ ID NO: 65001 - RNA, 22 nt, Homo sapiens
uuauguaggcuauagcucugca

SEQ ID NO: 65002 - RNA, 22 nt, Homo sapiens
uuaugucacuguucagucuccc

SEQ ID NO: 65003 - RNA, 22 nt, Homo sapiens
uuaugucuuuuguguucagcua

SEQ ID NO: 65004 - RNA, 22 nt, Homo sapiens
uuaugugccuuuuugccauuca

SEQ ID NO: 65005 - RNA, 22 nt, Homo sapiens
uuauguguuuaauguuucugaa

SEQ ID NO: 65006 - RNA, 22 nt, Homo sapiens
uuauucauuaacagggaccaaa

SEQ ID NO: 65007 - RNA, 22 nt, Homo sapiens
uuauucauuaauugcuaagguu

SEQ ID NO: 65008 - RNA, 22 nt, Homo sapiens
uuauugaguaaaaagaaugguu

SEQ ID NO: 65009 - RNA, 22 nt, Homo sapiens
uuauugcuccagaggcugauuu

SEQ ID NO: 65010 - RNA, 22 nt, Homo sapiens
uuauugcuuaugauuagguguu

SEQ ID NO: 65011 - RNA, 22 nt, Homo sapiens
uucaaaaccucugcuuaagccc

SEQ ID NO: 65012 - RNA, 22 nt, Homo sapiens
uucaaaggauuuagauuagcua

SEQ ID NO: 65013 - RNA, 23 nt, Homo sapiens
uucaaauguucucugguugucag

SEQ ID NO: 65014 - RNA, 22 nt, Homo sapiens
uucaacagugauggccuuugua

SEQ ID NO: 65015 - RNA, 22 nt, Homo sapiens
uucaacugcuucagccucccaa

SEQ ID NO: 65016 - RNA, 22 nt, Homo sapiens
uucaagcuauggugaucuuuuc

SEQ ID NO: 65017 - RNA, 22 nt, Homo sapiens
uucaagucaacaagcacuugag

SEQ ID NO: 65018 - RNA, 22 nt, Homo sapiens
uucaagucaaggaaagaggucu

SEQ ID NO: 65019 - RNA, 22 nt, Homo sapiens
uucaagucaauuuuugaaugac

SEQ ID NO: 65020 - RNA, 22 nt, Homo sapiens
uucaagucuuggcuuugccacc

SEQ ID NO: 65021 - RNA, 22 nt, Homo sapiens
uucaagugaacaaaaugaggag

SEQ ID NO: 65022 - RNA, 22 nt, Homo sapiens
uucacacugggccuacucugug

SEQ ID NO: 65023 - RNA, 22 nt, Homo sapiens
uucacagccgcaccccaucacu

SEQ ID NO: 65024 - RNA, 22 nt, Homo sapiens
uucacagcuuaauaaggcucag

SEQ ID NO: 65025 - RNA, 22 nt, Homo sapiens
uucacagugugaucuaugggca

SEQ ID NO: 65026 - RNA, 22 nt, Homo sapiens
uucacaguguguacaccagggg

SEQ ID NO: 65027 - RNA, 16 nt, Homo sapiens
uucacauggcagcagg

SEQ ID NO: 65028 - RNA, 22 nt, Homo sapiens
uucaccagggaagucucaacuc

SEQ ID NO: 65029 - RNA, 21 nt, Homo sapiens
uucaccauggcuccacacucu

SEQ ID NO: 65030 - RNA, 22 nt, Homo sapiens
uucaccuggaguucaggauaag

SEQ ID NO: 65031 - RNA, 22 nt, Homo sapiens
uucaccuggguuggccaucauu

SEQ ID NO: 65032 - RNA, 23 nt, Homo sapiens
uucaccugguuauuaauagccuc

SEQ ID NO: 65033 - RNA, 22 nt, Homo sapiens
uucaccuugggucccacuugcu

SEQ ID NO: 65034 - RNA, 22 nt, Homo sapiens
uucacugcacuccagccugggu

SEQ ID NO: 65035 - RNA, 22 nt, Homo sapiens
uucacugcauuucagccugggc

SEQ ID NO: 65036 - RNA, 22 nt, Homo sapiens
uucacuggagcccaggaguugg

SEQ ID NO: 65037 - RNA, 22 nt, Homo sapiens
uucacuguaaaaugaagagggu

SEQ ID NO: 65038 - RNA, 22 nt, Homo sapiens
uucacuguagcuuggauguuua

SEQ ID NO: 65039 - RNA, 22 nt, Homo sapiens
uucacuguuaagcaguuaaacu

SEQ ID NO: 65040 - RNA, 22 nt, Homo sapiens
uucagcaaugacagccuauaua

SEQ ID NO: 65041 - RNA, 22 nt, Homo sapiens
uucagcacaguguggaucauuc

SEQ ID NO: 65042 - RNA, 22 nt, Homo sapiens
uucaggcaccauugucauugau

SEQ ID NO: 65043 - RNA, 22 nt, Homo sapiens
uucagguucauuugcugcuauu

SEQ ID NO: 65044 - RNA, 22 nt, Homo sapiens
uucaguacacguguucucauuu

SEQ ID NO: 65045 - RNA, 23 nt, Homo sapiens
uucaguauugaaugauggcgcug

SEQ ID NO: 65046 - RNA, 22 nt, Homo sapiens
uucaguauugcaccuggagucc

SEQ ID NO: 65047 - RNA, 20 nt, Homo sapiens
uucagugcagguaacaaucc

SEQ ID NO: 65048 - RNA, 22 nt, Homo sapiens
uucaguggagaggcugaguggu

SEQ ID NO: 65049 - RNA, 22 nt, Homo sapiens
uucaguugcaucaguugaccag

SEQ ID NO: 65050 - RNA, 22 nt, Homo sapiens
uucauagaggacauuacuggag

SEQ ID NO: 65051 - RNA, 18 nt, Homo sapiens
uucauaguagcaugauuu

SEQ ID NO: 65052 - RNA, 22 nt, Homo sapiens
uucauaguauuuuucuccaaau

SEQ ID NO: 65053 - RNA, 22 nt, Homo sapiens
uucauagucacauucgaugucu

SEQ ID NO: 65054 - RNA, 21 nt, Homo sapiens
uucauaugcacugagugccca

SEQ ID NO: 65055 - RNA, 18 nt, Homo sapiens
uucauauguugaaccaga

SEQ ID NO: 65056 - RNA, 19 nt, Homo sapiens
ugaaugacaucuaaagucc

SEQ ID NO: 65057 - RNA, 22 nt, Homo sapiens
ugaaugcuaaaggaaaacagua

SEQ ID NO: 65058 - RNA, 22 nt, Homo sapiens
ugaauggauccaauucuuagua

SEQ ID NO: 65059 - RNA, 22 nt, Homo sapiens
ugaaugguaauuuaguaggcac

SEQ ID NO: 65060 - RNA, 23 nt, Homo sapiens
ugaauguuuauucucggugcaga

SEQ ID NO: 65061 - RNA, 22 nt, Homo sapiens
ugaauguuugcuuacuuccaua

SEQ ID NO: 65062 - RNA, 22 nt, Homo sapiens
ugacaagaaagcgucuucuuuu

SEQ ID NO: 65063 - RNA, 22 nt, Homo sapiens
ugacaagaguagagagggugcc

SEQ ID NO: 65064 - RNA, 22 nt, Homo sapiens
ugacacuugcccuuagaaacau

SEQ ID NO: 65065 - RNA, 23 nt, Homo sapiens
ugacagaccuucuggaagaaguc

SEQ ID NO: 65066 - RNA, 22 nt, Homo sapiens
ugacagguuggaauuaugggag

SEQ ID NO: 65067 - RNA, 22 nt, Homo sapiens
ugacaucaccaccuccgucauc

SEQ ID NO: 65068 - RNA, 20 nt, Homo sapiens
ugacaucagcaauguaauaa

SEQ ID NO: 65069 - RNA, 18 nt, Homo sapiens
ugacaucauuuagaaagg

SEQ ID NO: 65070 - RNA, 22 nt, Homo sapiens
ugacaucugcuugugcccagga

SEQ ID NO: 65071 - RNA, 19 nt, Homo sapiens
ugacaugaaacccaagauc

SEQ ID NO: 65072 - RNA, 22 nt, Homo sapiens
ugacaugaugagcaauaauggc

SEQ ID NO: 65073 - RNA, 22 nt, Homo sapiens
ugacauguugcauuauauuucc

SEQ ID NO: 65074 - RNA, 21 nt, Homo sapiens
ugacauguuggugugcugcac

SEQ ID NO: 65075 - RNA, 21 nt, Homo sapiens
ugacauguugguguucugcac

SEQ ID NO: 65076 - RNA, 22 nt, Homo sapiens
uugcuacauugauugccucuuu

SEQ ID NO: 65077 - RNA, 22 nt, Homo sapiens
uugcuacuuggauguacaugug

SEQ ID NO: 65078 - RNA, 22 nt, Homo sapiens
uugcuauguugcccagucugga

SEQ ID NO: 65079 - RNA, 22 nt, Homo sapiens
uugcuccccaggaaaggaagca

SEQ ID NO: 65080 - RNA, 22 nt, Homo sapiens
uugcugagucuuucuagguugc

SEQ ID NO: 65081 - RNA, 22 nt, Homo sapiens
uugcuggugguucgagcaacac

SEQ ID NO: 65082 - RNA, 22 nt, Homo sapiens
uugcuuagagccaaucuugauu

SEQ ID NO: 65083 - RNA, 22 nt, Homo sapiens
uugcuucauucaacauugaggg

SEQ ID NO: 65084 - RNA, 22 nt, Homo sapiens
uugcuuuguugucuggggaaua

SEQ ID NO: 65085 - RNA, 22 nt, Homo sapiens
uuggaaacauuuaugguaacag

SEQ ID NO: 65086 - RNA, 22 nt, Homo sapiens
uuggaaagagguguuuaugacu

SEQ ID NO: 65087 - RNA, 22 nt, Homo sapiens
uuggaacacauguuuuucuacc

SEQ ID NO: 65088 - RNA, 22 nt, Homo sapiens
uuggaaugcaacagaaggauaa

SEQ ID NO: 65089 - RNA, 22 nt, Homo sapiens
uuggaaugugacugauaauauu

SEQ ID NO: 65090 - RNA, 22 nt, Homo sapiens
uuggaauuuauuuggaugggag

SEQ ID NO: 65091 - RNA, 22 nt, Homo sapiens
uuggaauuuuaaaauaggcaac

SEQ ID NO: 65092 - RNA, 19 nt, Homo sapiens
uuggaauuuuagaguuuga

SEQ ID NO: 65093 - RNA, 22 nt, Homo sapiens
uuggacaagauugcagagaauu

SEQ ID NO: 65094 - RNA, 22 nt, Homo sapiens
uuggacagaugguuacauuuuu

SEQ ID NO: 65095 - RNA, 22 nt, Homo sapiens
uuggaccacuugauuucugguc

SEQ ID NO: 65096 - RNA, 22 nt, Homo sapiens
uuggacucccuccccagcuuca

SEQ ID NO: 65097 - RNA, 22 nt, Homo sapiens
uuggagagagaggacucccggc

SEQ ID NO: 65098 - RNA, 22 nt, Homo sapiens
uuggagagugauauucagaugc

SEQ ID NO: 65099 - RNA, 22 nt, Homo sapiens
uuggagugugcucauaacugcu

SEQ ID NO: 65100 - RNA, 22 nt, Homo sapiens
uuggaguguucugguccgggcu

SEQ ID NO: 65101 - RNA, 22 nt, Homo sapiens
uuggauauucaguuuuuccauc

SEQ ID NO: 65102 - RNA, 22 nt, Homo sapiens
uuggauuguuucuagauugggg

SEQ ID NO: 65103 - RNA, 22 nt, Homo sapiens
uuggcaaauagguuuuauugca

SEQ ID NO: 65104 - RNA, 22 nt, Homo sapiens
uuggcaauauuuacugaaguug

SEQ ID NO: 65105 - RNA, 21 nt, Homo sapiens
uuggcacucuucucuccuuau

SEQ ID NO: 65106 - RNA, 22 nt, Homo sapiens
uuggcacugagcaagaacaggg

SEQ ID NO: 65107 - RNA, 22 nt, Homo sapiens
uuggcagaguuaauuuguugag

SEQ ID NO: 65108 - RNA, 22 nt, Homo sapiens
uuggcagugguucugacggacc

SEQ ID NO: 65109 - RNA, 22 nt, Homo sapiens
uuggcauugaguuucaaaucau

SEQ ID NO: 65110 - RNA, 20 nt, Homo sapiens
uuggcauuuagacaagaguu

SEQ ID NO: 65111 - RNA, 22 nt, Homo sapiens
uuggcccugcugaccauucccu

SEQ ID NO: 65112 - RNA, 22 nt, Homo sapiens
uuggccuccuggucauauccag

SEQ ID NO: 65113 - RNA, 22 nt, Homo sapiens
uuggcuauagauacauggauua

SEQ ID NO: 65114 - RNA, 22 nt, Homo sapiens
uuggcuguguuccucaaggagu

SEQ ID NO: 65115 - RNA, 22 nt, Homo sapiens
uuggcuguguuuauaugcugga

SEQ ID NO: 65116 - RNA, 22 nt, Homo sapiens
uugggacuggaaggaguaaggg

SEQ ID NO: 65117 - RNA, 22 nt, Homo sapiens
uugggagugucucuggacugca

SEQ ID NO: 65118 - RNA, 23 nt, Homo sapiens
uugggcaaaucacugagggcaga

SEQ ID NO: 65119 - RNA, 22 nt, Homo sapiens
uugggcauugggcuaaacuccc

SEQ ID NO: 65120 - RNA, 22 nt, Homo sapiens
uugggguagaauugcaacauau

SEQ ID NO: 65121 - RNA, 22 nt, Homo sapiens
uugguaggcuggccucucucag

SEQ ID NO: 65122 - RNA, 22 nt, Homo sapiens
uugguaguuucugucuuuagau

SEQ ID NO: 65123 - RNA, 22 nt, Homo sapiens
uuggucacugacauguuugaaa

SEQ ID NO: 65124 - RNA, 22 nt, Homo sapiens
uuggucaucucccuccuuuuag

SEQ ID NO: 65125 - RNA, 22 nt, Homo sapiens
uugguccccacuccccugccaa

SEQ ID NO: 65126 - RNA, 19 nt, Homo sapiens
uuggucccuuuggguucuu

SEQ ID NO: 65127 - RNA, 22 nt, Homo sapiens
uugguuaucaucauuucagcaa

SEQ ID NO: 65128 - RNA, 21 nt, Homo sapiens
uugguucccucugacaggucu

SEQ ID NO: 65129 - RNA, 22 nt, Homo sapiens
uugguuccuuagccuaggacua

SEQ ID NO: 65130 - RNA, 22 nt, Homo sapiens
uuguaaacaucuguacauugcu

SEQ ID NO: 65131 - RNA, 22 nt, Homo sapiens
uuguaacaguuuauugacucga

SEQ ID NO: 65132 - RNA, 22 nt, Homo sapiens
uuguaauguuaggguguccaug

SEQ ID NO: 65133 - RNA, 22 nt, Homo sapiens
uuguacuccagccugggugaca

SEQ ID NO: 65134 - RNA, 20 nt, Homo sapiens
uuguacuccugggcucaagc

SEQ ID NO: 65135 - RNA, 22 nt, Homo sapiens
uuguauacucuauuuuagcagu

SEQ ID NO: 65136 - RNA, 22 nt, Homo sapiens
uuguauguugaaugaugguaua

SEQ ID NO: 65137 - RNA, 22 nt, Homo sapiens
uuguauguuucugugcacauga

SEQ ID NO: 65138 - RNA, 22 nt, Homo sapiens
uugucaaacucauucuccaucc

SEQ ID NO: 65139 - RNA, 22 nt, Homo sapiens
uugucaccucuaaaucucauau

SEQ ID NO: 65140 - RNA, 22 nt, Homo sapiens
uugucacugcacuccagucugg

SEQ ID NO: 65141 - RNA, 22 nt, Homo sapiens
ucuuugguaggaguaggaggcc

SEQ ID NO: 65142 - RNA, 22 nt, Homo sapiens
ucuuugguauugugaauagugu

SEQ ID NO: 65143 - RNA, 21 nt, Homo sapiens
ucuuuggucaccaguuuucau

SEQ ID NO: 65144 - RNA, 22 nt, Homo sapiens
ucuuuuggguauggagccauca

SEQ ID NO: 65145 - RNA, 22 nt, Homo sapiens
ucuuuugguuucuagaggccgc

SEQ ID NO: 65146 - RNA, 22 nt, Homo sapiens
ugaaacacaccuccucuccauc

SEQ ID NO: 65147 - RNA, 22 nt, Homo sapiens
ugaaagacacagaaguugccca

SEQ ID NO: 65148 - RNA, 22 nt, Homo sapiens
ugaaagcuacaggaaaguauuu

SEQ ID NO: 65149 - RNA, 22 nt, Homo sapiens
ugaaagguuuaauucugugaga

SEQ ID NO: 65150 - RNA, 22 nt, Homo sapiens
ugaaauaguuaaguugccuagu

SEQ ID NO: 65151 - RNA, 20 nt, Homo sapiens
ugaaaucuucacuaagucuc

SEQ ID NO: 65152 - RNA, 22 nt, Homo sapiens
ugaaaugaucaguuugguuacu

SEQ ID NO: 65153 - RNA, 22 nt, Homo sapiens
ugaaaugauuauaugguguuug

SEQ ID NO: 65154 - RNA, 22 nt, Homo sapiens
ugaaaugccuugagauuuugac

SEQ ID NO: 65155 - RNA, 22 nt, Homo sapiens
ugaaaugcuaauucguagcuaa

SEQ ID NO: 65156 - RNA, 22 nt, Homo sapiens
ugaaauggaaagaguguagacu

SEQ ID NO: 65157 - RNA, 22 nt, Homo sapiens
ugaaauguaaguugucuagucu

SEQ ID NO: 65158 - RNA, 22 nt, Homo sapiens
ugaaauguguuaucugggccug

SEQ ID NO: 65159 - RNA, 22 nt, Homo sapiens
ugaaauguuaaacaaguggcuc

SEQ ID NO: 65160 - RNA, 22 nt, Homo sapiens
ugaaauguugggugauggaauc

SEQ ID NO: 65161 - RNA, 22 nt, Homo sapiens
ugaacacaucuccugguaccug

SEQ ID NO: 65162 - RNA, 21 nt, Homo sapiens
ugaacacuggacugagugucc

SEQ ID NO: 65163 - RNA, 22 nt, Homo sapiens
ugaacacuggauaaggagucag

SEQ ID NO: 65164 - RNA, 22 nt, Homo sapiens
ugaacagcaccuccuagaguug

SEQ ID NO: 65165 - RNA, 22 nt, Homo sapiens
ugaacagcuaucuugucagugu

SEQ ID NO: 65166 - RNA, 22 nt, Homo sapiens
ugaacagucaucucucuuguau

SEQ ID NO: 65167 - RNA, 22 nt, Homo sapiens
ugaacuaguaguuuacuugaug

SEQ ID NO: 65168 - RNA, 22 nt, Homo sapiens
ugaagacucaguuugagggaca

SEQ ID NO: 65169 - RNA, 22 nt, Homo sapiens
ugaagagucuaaaucugucuuc

SEQ ID NO: 65170 - RNA, 22 nt, Homo sapiens
ugaagaucuuaggagcugaggg

SEQ ID NO: 65171 - RNA, 22 nt, Homo sapiens
ugaagcuaggauuaauuuucau

SEQ ID NO: 65172 - RNA, 22 nt, Homo sapiens
ugaagcuaugacuauugagcau

SEQ ID NO: 65173 - RNA, 20 nt, Homo sapiens
ugaaggaggucauuuauacc

SEQ ID NO: 65174 - RNA, 22 nt, Homo sapiens
ugaagggcauuguuuugccaaa

SEQ ID NO: 65175 - RNA, 22 nt, Homo sapiens
ugaagugcugugggccaggcgu

SEQ ID NO: 65176 - RNA, 18 nt, Homo sapiens
ugaauacagcguugggaa

SEQ ID NO: 65177 - RNA, 22 nt, Homo sapiens
ugaauagacacuaaagacugua

SEQ ID NO: 65178 - RNA, 22 nt, Homo sapiens
ugaauaggcaguuaaguuuaug

SEQ ID NO: 65179 - RNA, 22 nt, Homo sapiens
ugaauaguaauguguuuggucu

SEQ ID NO: 65180 - RNA, 18 nt, Homo sapiens
ugaauaguguccccauga

SEQ ID NO: 65181 - RNA, 22 nt, Homo sapiens
ugugauuauuuaaauaggacag

SEQ ID NO: 65182 - RNA, 22 nt, Homo sapiens
ugugauuauuuauagacaguca

SEQ ID NO: 65183 - RNA, 22 nt, Homo sapiens
ugugcaaaaguaauugcgguuu

SEQ ID NO: 65184 - RNA, 22 nt, Homo sapiens
ugugcaaauguuaaacuaacuu

SEQ ID NO: 65185 - RNA, 22 nt, Homo sapiens
ugugcaauucgauggagcucau

SEQ ID NO: 65186 - RNA, 22 nt, Homo sapiens
ugugcaguuuuagcguauuuua

SEQ ID NO: 65187 - RNA, 22 nt, Homo sapiens
ugugcaguuuugagugaauuuc

SEQ ID NO: 65188 - RNA, 22 nt, Homo sapiens
ugugcauaugucuuuauaguag

SEQ ID NO: 65189 - RNA, 22 nt, Homo sapiens
uuaugcuguuuucuggagauuu

SEQ ID NO: 65190 - RNA, 22 nt, Homo sapiens
uuaugcuuauugguguacggua

SEQ ID NO: 65191 - RNA, 22 nt, Homo sapiens
uuaugguuuuuagcagaguaau

SEQ ID NO: 65192 - RNA, 22 nt, Homo sapiens
uuauguccuuuaacuucaucac

SEQ ID NO: 65193 - RNA, 22 nt, Homo sapiens
uuauuagcacccuaccaugugg

SEQ ID NO: 65194 - RNA, 22 nt, Homo sapiens
uuauuagguuagugcaaaaguu

SEQ ID NO: 65195 - RNA, 16 nt, Homo sapiens
uuauugcauucuucuc

SEQ ID NO: 65196 - RNA, 22 nt, Homo sapiens
uuauugcuaaaucaugaccaca

SEQ ID NO: 65197 - RNA, 17 nt, Homo sapiens
uuauugcuauaagcuga

SEQ ID NO: 65198 - RNA, 22 nt, Homo sapiens
uuauuugguugcugacuuggaa

SEQ ID NO: 65199 - RNA, 22 nt, Homo sapiens
uucaaaggauagauuaagauca

SEQ ID NO: 65200 - RNA, 23 nt, Homo sapiens
uucaaaggaugcuuuauggaauu

SEQ ID NO: 65201 - RNA, 22 nt, Homo sapiens
uucaaaguaaaaauguguucac

SEQ ID NO: 65202 - RNA, 22 nt, Homo sapiens
uucaaaguaaagggauggagac

SEQ ID NO: 65203 - RNA, 22 nt, Homo sapiens
uucaaaucuucguuuugccaua

SEQ ID NO: 65204 - RNA, 22 nt, Homo sapiens
uucaagaauuaaaguggcuuuu

SEQ ID NO: 65205 - RNA, 22 nt, Homo sapiens
uucaagauggccccagugagcc

SEQ ID NO: 65206 - RNA, 22 nt, Homo sapiens
uucaagcuacaguggcaggguu

SEQ ID NO: 65207 - RNA, 22 nt, Homo sapiens
ugacauuacagucacuugcugu

SEQ ID NO: 65208 - RNA, 21 nt, Homo sapiens
ugacauuauuucaugucagua

SEQ ID NO: 65209 - RNA, 18 nt, Homo sapiens
ugacauugagcugagaaa

SEQ ID NO: 65210 - RNA, 22 nt, Homo sapiens
ugaccacagaaagugagggagc

SEQ ID NO: 65211 - RNA, 22 nt, Homo sapiens
ugacccuguggcagcgucuaag

SEQ ID NO: 65212 - RNA, 22 nt, Homo sapiens
ugaccuguuugaaauugccaau

SEQ ID NO: 65213 - RNA, 22 nt, Homo sapiens
ugacggaggcauuggaagcuug

SEQ ID NO: 65214 - RNA, 22 nt, Homo sapiens
ugacuacaccacacgguuaagg

SEQ ID NO: 65215 - RNA, 22 nt, Homo sapiens
ugacuacagauuugcugccaga

SEQ ID NO: 65216 - RNA, 22 nt, Homo sapiens
ugacuagacuugcaagguugca

SEQ ID NO: 65217 - RNA, 22 nt, Homo sapiens
ugacuagggcucuaaacagcuc

SEQ ID NO: 65218 - RNA, 22 nt, Homo sapiens
ugacuaggggcccuggcuucuu

SEQ ID NO: 65219 - RNA, 22 nt, Homo sapiens
ugacuaguuuugcuguuguuau

SEQ ID NO: 65220 - RNA, 22 nt, Homo sapiens
ugacuauaguaaucacuucaca

SEQ ID NO: 65221 - RNA, 22 nt, Homo sapiens
ugacuauugauuuagacgugcu

SEQ ID NO: 65222 - RNA, 22 nt, Homo sapiens
ugacucagauagguguguauuc

SEQ ID NO: 65223 - RNA, 22 nt, Homo sapiens
ugacucgaggcgccuccagucc

SEQ ID NO: 65224 - RNA, 22 nt, Homo sapiens
ugacugaguaguauuccacuau

SEQ ID NO: 65225 - RNA, 23 nt, Homo sapiens
ugacugaguauauguuuggugcu

SEQ ID NO: 65226 - RNA, 22 nt, Homo sapiens
ugacuggaacuuuagugagucu

SEQ ID NO: 65227 - RNA, 22 nt, Homo sapiens
ugacuggagaccucaguagggu

SEQ ID NO: 65228 - RNA, 22 nt, Homo sapiens
ugacuucagacugaaaugauuc

SEQ ID NO: 65229 - RNA, 22 nt, Homo sapiens
ugacuucauuugguaauugggu

SEQ ID NO: 65230 - RNA, 22 nt, Homo sapiens
ugacuugaacuucuaugucacc

SEQ ID NO: 65231 - RNA, 22 nt, Homo sapiens
ugacuugaggcucgcacaaguu

SEQ ID NO: 65232 - RNA, 23 nt, Homo sapiens
ugacuuguccagugauaguucgu

SEQ ID NO: 65233 - RNA, 22 nt, Homo sapiens
ugacuuuagaauuuuauccaga

SEQ ID NO: 65234 - RNA, 22 nt, Homo sapiens
ugagaacagauggcuuuauuau

SEQ ID NO: 65235 - RNA, 22 nt, Homo sapiens
ugagaacaugcacuugagguug

SEQ ID NO: 65236 - RNA, 16 nt, Homo sapiens
ugagaacaugcagcau

SEQ ID NO: 65237 - RNA, 22 nt, Homo sapiens
ugagaacauggagaacccccca

SEQ ID NO: 65238 - RNA, 16 nt, Homo sapiens
ugagaacaugugauau

SEQ ID NO: 65239 - RNA, 22 nt, Homo sapiens
ugagaacauuccucuuccuggc

SEQ ID NO: 65240 - RNA, 22 nt, Homo sapiens
ugagaacugccuguauuuaucu

SEQ ID NO: 65241 - RNA, 22 nt, Homo sapiens
ugagaacuguuuugguuugggu

SEQ ID NO: 65242 - RNA, 22 nt, Homo sapiens
ugagaagaugaacuccuugguc

SEQ ID NO: 65243 - RNA, 22 nt, Homo sapiens
ugagaagugacgcagcaggguu

SEQ ID NO: 65244 - RNA, 22 nt, Homo sapiens
ugagaauauuugaagauguuag

SEQ ID NO: 65245 - RNA, 22 nt, Homo sapiens
ugagaauguagggcucucccag

SEQ ID NO: 65246 - RNA, 21 nt, Homo sapiens
ugagacaauccuggucaauau

SEQ ID NO: 65247 - RNA, 22 nt, Homo sapiens
ugagacaaucucaucucaguga

SEQ ID NO: 65248 - RNA, 22 nt, Homo sapiens
ugagaccaacagauuccaguuc

SEQ ID NO: 65249 - RNA, 22 nt, Homo sapiens
ugagaccuuucauuucucagug

SEQ ID NO: 65250 - RNA, 22 nt, Homo sapiens
ugagacgaagucucguucugua

SEQ ID NO: 65251 - RNA, 22 nt, Homo sapiens
ugagacgaagucuugcucuguu

SEQ ID NO: 65252 - RNA, 22 nt, Homo sapiens
ugagacggaguuauuuauaaua

SEQ ID NO: 65253 - RNA, 22 nt, Homo sapiens
ugagacgucuucucuucuucaa

SEQ ID NO: 65254 - RNA, 22 nt, Homo sapiens
ugagacugagucucccucuguc

SEQ ID NO: 65255 - RNA, 22 nt, Homo sapiens
ugagacugagucuugcucuauu

SEQ ID NO: 65256 - RNA, 22 nt, Homo sapiens
ugagacugguuaauugauaaag

SEQ ID NO: 65257 - RNA, 22 nt, Homo sapiens
ugagagacauuuguuguagagu

SEQ ID NO: 65258 - RNA, 22 nt, Homo sapiens
ugagagaugaacuauucuugaa

SEQ ID NO: 65259 - RNA, 22 nt, Homo sapiens
ugagagaugaacucugauaugu

SEQ ID NO: 65260 - RNA, 22 nt, Homo sapiens
ugagagcugguuguuuaaagga

SEQ ID NO: 65261 - RNA, 22 nt, Homo sapiens
ugagagcuuugaugcacuguuu

SEQ ID NO: 65262 - RNA, 22 nt, Homo sapiens
ugagaggugauaaagcaagggu

SEQ ID NO: 65263 - RNA, 21 nt, Homo sapiens
ugagaguaguguauuauucuc

SEQ ID NO: 65264 - RNA, 22 nt, Homo sapiens
ugagagucacugaccugguaua

SEQ ID NO: 65265 - RNA, 22 nt, Homo sapiens
ugagauaacuaaaaacauuuug

SEQ ID NO: 65266 - RNA, 22 nt, Homo sapiens
ugagauaaggaaauugaggcuc

SEQ ID NO: 65267 - RNA, 22 nt, Homo sapiens
ugagauaaucaugugauuucau

SEQ ID NO: 65268 - RNA, 22 nt, Homo sapiens
ugagauaaucaugugguuuuug

SEQ ID NO: 65269 - RNA, 18 nt, Homo sapiens
ugagauacuagaauaggu

SEQ ID NO: 65270 - RNA, 22 nt, Homo sapiens
ugagauagaaaacauaggagaa

SEQ ID NO: 65271 - RNA, 22 nt, Homo sapiens
ugagauagcauaagggacagaa

SEQ ID NO: 65272 - RNA, 22 nt, Homo sapiens
ugagauagggucucacucuguc

SEQ ID NO: 65273 - RNA, 22 nt, Homo sapiens
ugagauaguacuuuuuuaaagg

SEQ ID NO: 65274 - RNA, 22 nt, Homo sapiens
ugagaucaaggugggcccuggg

SEQ ID NO: 65275 - RNA, 22 nt, Homo sapiens
ugagaucagaaggauuucucug

SEQ ID NO: 65276 - RNA, 18 nt, Homo sapiens
ugagaucagcaucaaggg

SEQ ID NO: 65277 - RNA, 22 nt, Homo sapiens
ugagaucaguuguuauaauucu

SEQ ID NO: 65278 - RNA, 22 nt, Homo sapiens
ugagaucaugccacugcacuuc

SEQ ID NO: 65279 - RNA, 20 nt, Homo sapiens
ugagauccacgugaaguaug

SEQ ID NO: 65280 - RNA, 19 nt, Homo sapiens
ugagauccacugaagauuc

SEQ ID NO: 65281 - RNA, 22 nt, Homo sapiens
ugagauccugagaguugggacu

SEQ ID NO: 65282 - RNA, 22 nt, Homo sapiens
ugagauccugugacuacacuga

SEQ ID NO: 65283 - RNA, 22 nt, Homo sapiens
ugagaucgaguaucgcugucac

SEQ ID NO: 65284 - RNA, 22 nt, Homo sapiens
ugagaucgaguuucgcucuugu

SEQ ID NO: 65285 - RNA, 22 nt, Homo sapiens
ugagaucucauuaugguuuuaa

SEQ ID NO: 65286 - RNA, 22 nt, Homo sapiens
ugagaucuguaaagucugacau

SEQ ID NO: 65287 - RNA, 22 nt, Homo sapiens
ugagaucuuaccuuccugccuu

SEQ ID NO: 65288 - RNA, 22 nt, Homo sapiens
ugagaucuuggaggcuuuguga

SEQ ID NO: 65289 - RNA, 22 nt, Homo sapiens
ugagaucuuugcuguccucacc

SEQ ID NO: 65290 - RNA, 22 nt, Homo sapiens
ugagaugaaagcagaaagacuu

SEQ ID NO: 65291 - RNA, 19 nt, Homo sapiens
ugagaugaagacagggguu

SEQ ID NO: 65292 - RNA, 22 nt, Homo sapiens
ugagaugaagcuagaagaaugg

SEQ ID NO: 65293 - RNA, 22 nt, Homo sapiens
ugagaugaagugauguaaaaca

SEQ ID NO: 65294 - RNA, 22 nt, Homo sapiens
ugagaugagaaucaguucuaau

SEQ ID NO: 65295 - RNA, 21 nt, Homo sapiens
ugagaugauccugcaugcaug

SEQ ID NO: 65296 - RNA, 22 nt, Homo sapiens
ugagaugaugggauaagagggc

SEQ ID NO: 65297 - RNA, 22 nt, Homo sapiens
ugagaugauuuaauggagccca

SEQ ID NO: 65298 - RNA, 21 nt, Homo sapiens
ugagaugcaaucaccagggag

SEQ ID NO: 65299 - RNA, 22 nt, Homo sapiens
ugagaugcuuguaaauucauuu

SEQ ID NO: 65300 - RNA, 22 nt, Homo sapiens
ugagauggaguuucgcccuugu

SEQ ID NO: 65301 - RNA, 22 nt, Homo sapiens
ugagauggaguuucgcuuuugu

SEQ ID NO: 65302 - RNA, 22 nt, Homo sapiens
uucugaguggcuuucaacacug

SEQ ID NO: 65303 - RNA, 22 nt, Homo sapiens
uucuggccuccauuuuucuccu

SEQ ID NO: 65304 - RNA, 22 nt, Homo sapiens
uucuggcuuuuaaagaaauguu

SEQ ID NO: 65305 - RNA, 22 nt, Homo sapiens
uucugugcugaaucaaagacug

SEQ ID NO: 65306 - RNA, 22 nt, Homo sapiens
uucugugguagaaaucucaaau

SEQ ID NO: 65307 - RNA, 22 nt, Homo sapiens
uucugugguugaaaggagagau

SEQ ID NO: 65308 - RNA, 22 nt, Homo sapiens
uucugugguuucauuuaccugu

SEQ ID NO: 65309 - RNA, 22 nt, Homo sapiens
uucuuagucauguaauagucca

SEQ ID NO: 65310 - RNA, 22 nt, Homo sapiens
uucuuaguggcaccacuuuuuu

SEQ ID NO: 65311 - RNA, 21 nt, Homo sapiens
uucuucaggcagaaggauuau

SEQ ID NO: 65312 - RNA, 22 nt, Homo sapiens
uucuucaggcauucccagaagc

SEQ ID NO: 65313 - RNA, 22 nt, Homo sapiens
uucuucaggccacaaaaauggu

SEQ ID NO: 65314 - RNA, 22 nt, Homo sapiens
uucuugaggcaugccgcuggga

SEQ ID NO: 65315 - RNA, 22 nt, Homo sapiens
ugagauggguucugguccccug

SEQ ID NO: 65316 - RNA, 22 nt, Homo sapiens
ugagauguagauauggauuaga

SEQ ID NO: 65317 - RNA, 23 nt, Homo sapiens
ugagaugucugauugcgaggguc

SEQ ID NO: 65318 - RNA, 22 nt, Homo sapiens
ugagauguuuguuucagugccu

SEQ ID NO: 65319 - RNA, 22 nt, Homo sapiens
ugagauuaaucuuuaaguaaga

SEQ ID NO: 65320 - RNA, 22 nt, Homo sapiens
ugagauuauauuucuuaacaga

SEQ ID NO: 65321 - RNA, 22 nt, Homo sapiens
ugagauucucugauuguagguc

SEQ ID NO: 65322 - RNA, 22 nt, Homo sapiens
ugagauuguuagaucaaauggu

SEQ ID NO: 65323 - RNA, 22 nt, Homo sapiens
ugagcagagaagugcccugcgc

SEQ ID NO: 65324 - RNA, 22 nt, Homo sapiens
ugagcagagaucacggcauugu

SEQ ID NO: 65325 - RNA, 22 nt, Homo sapiens
ugagcagugaguguggugcagg

SEQ ID NO: 65326 - RNA, 22 nt, Homo sapiens
ugagcaucucuaaaaggagcaa

SEQ ID NO: 65327 - RNA, 22 nt, Homo sapiens
ugagcauuguguuugacuguga

SEQ ID NO: 65328 - RNA, 22 nt, Homo sapiens
ugagccauggcaccuugucuaa

SEQ ID NO: 65329 - RNA, 22 nt, Homo sapiens
ugagccaugguuagcuucucau

SEQ ID NO: 65330 - RNA, 20 nt, Homo sapiens
ugagccccuggacucaagcg

SEQ ID NO: 65331 - RNA, 20 nt, Homo sapiens
ugagcuauauauguccuuga

SEQ ID NO: 65332 - RNA, 22 nt, Homo sapiens
ugagcuauguucuucuuguuuu

SEQ ID NO: 65333 - RNA, 22 nt, Homo sapiens
ugagcucaguauuucauaaaca

SEQ ID NO: 65334 - RNA, 22 nt, Homo sapiens
ugagcuccuucauaaaaaggca

SEQ ID NO: 65335 - RNA, 22 nt, Homo sapiens
ugagcugagaucuuaccacugc

SEQ ID NO: 65336 - RNA, 18 nt, Homo sapiens
ugaggaaaggguuugcua

SEQ ID NO: 65337 - RNA, 22 nt, Homo sapiens
ugaggaacuagcuacccuaaua

SEQ ID NO: 65338 - RNA, 22 nt, Homo sapiens
ugaggaaugaccccgugugguc

SEQ ID NO: 65339 - RNA, 22 nt, Homo sapiens
ugaggagugaacuauuucugau

SEQ ID NO: 65340 - RNA, 22 nt, Homo sapiens
ugaggaguguauuucauucgcu

SEQ ID NO: 65341 - RNA, 22 nt, Homo sapiens
ugaggauaguguugaaggcagg

SEQ ID NO: 65342 - RNA, 22 nt, Homo sapiens
ugaggaucucuaggaauuuauc

SEQ ID NO: 65343 - RNA, 22 nt, Homo sapiens
ugaggcaagauacugauuucau

SEQ ID NO: 65344 - RNA, 22 nt, Homo sapiens
ugaggcuaggauaggcugauuc

SEQ ID NO: 65345 - RNA, 22 nt, Homo sapiens
ugagggaugcguacccuaugcc

SEQ ID NO: 65346 - RNA, 22 nt, Homo sapiens
ugagguaauagauaauauuuuu

SEQ ID NO: 65347 - RNA, 22 nt, Homo sapiens
ugagguacaacauggacugaag

SEQ ID NO: 65348 - RNA, 22 nt, Homo sapiens
ugagguagaggugaacuugacc

SEQ ID NO: 65349 - RNA, 22 nt, Homo sapiens
ugagguagguaccauuaucacu

SEQ ID NO: 65350 - RNA, 22 nt, Homo sapiens
ugaggucauguucugucagguu

SEQ ID NO: 65351 - RNA, 20 nt, Homo sapiens
ugaggucugagaaagaauga

SEQ ID NO: 65352 - RNA, 22 nt, Homo sapiens
ugaggugagauggcuaccccaa

SEQ ID NO: 65353 - RNA, 22 nt, Homo sapiens
ugaggugaggguaucaaaugcu

SEQ ID NO: 65354 - RNA, 22 nt, Homo sapiens
ugagguguuugugcaccaucug

SEQ ID NO: 65355 - RNA, 22 nt, Homo sapiens
ugagguuggguaauuuaugaag

SEQ ID NO: 65356 - RNA, 22 nt, Homo sapiens
ugaguacuacuaguuacugcua

SEQ ID NO: 65357 - RNA, 22 nt, Homo sapiens
ugaguagaaauaaacgcaaacu

SEQ ID NO: 65358 - RNA, 22 nt, Homo sapiens
ugaguagaacuccuggagaugu

SEQ ID NO: 65359 - RNA, 22 nt, Homo sapiens
ugaguagugccacaauaagcau

SEQ ID NO: 65360 - RNA, 22 nt, Homo sapiens
ugagucaauggaggcucagagc

SEQ ID NO: 65361 - RNA, 23 nt, Homo sapiens
ugagucacuuugcuggggucucu

SEQ ID NO: 65362 - RNA, 22 nt, Homo sapiens
ugagucauuuccuuaugcuacu

SEQ ID NO: 65363 - RNA, 22 nt, Homo sapiens
ugagucuguucucacauugcua

SEQ ID NO: 65364 - RNA, 22 nt, Homo sapiens
ugagugaaggggcucuguugug

SEQ ID NO: 65365 - RNA, 21 nt, Homo sapiens
ugagugcugagugaggguuga

SEQ ID NO: 65366 - RNA, 22 nt, Homo sapiens
ugaguguguaugugcauacaca

SEQ ID NO: 65367 - RNA, 22 nt, Homo sapiens
ugaguuagguguuuuaaauaua

SEQ ID NO: 65368 - RNA, 22 nt, Homo sapiens
ugaguuaguguggugcuuggaa

SEQ ID NO: 65369 - RNA, 22 nt, Homo sapiens
ugaguuauuaguagaggcuaug

SEQ ID NO: 65370 - RNA, 22 nt, Homo sapiens
ugaguucaauguuaaugaagca

SEQ ID NO: 65371 - RNA, 22 nt, Homo sapiens
ugaguucaugcuuguaguucua

SEQ ID NO: 65372 - RNA, 20 nt, Homo sapiens
ugaguuccuuguucagaagc

SEQ ID NO: 65373 - RNA, 22 nt, Homo sapiens
ugaguucuuuuacauuuugaau

SEQ ID NO: 65374 - RNA, 22 nt, Homo sapiens
ugaguucuuuuagggauauugc

SEQ ID NO: 65375 - RNA, 22 nt, Homo sapiens
ugaguuguagcuauaguuucuu

SEQ ID NO: 65376 - RNA, 22 nt, Homo sapiens
ugaguuuaucuaaagaccuggg

SEQ ID NO: 65377 - RNA, 23 nt, Homo sapiens
ugauaacagcauaugaagauucu

SEQ ID NO: 65378 - RNA, 22 nt, Homo sapiens
ugauaagugagauagcaaguga

SEQ ID NO: 65379 - RNA, 22 nt, Homo sapiens
ugauaggucacucaacagugag

SEQ ID NO: 65380 - RNA, 22 nt, Homo sapiens
ugauagugccuuuuauaucucu

SEQ ID NO: 65381 - RNA, 22 nt, Homo sapiens
ugauaucugaucauccuugaua

SEQ ID NO: 65382 - RNA, 22 nt, Homo sapiens
ugauaugaaucaaucacucuuc

SEQ ID NO: 65383 - RNA, 22 nt, Homo sapiens
ugauaugacagcucugcugcca

SEQ ID NO: 65384 - RNA, 20 nt, Homo sapiens
ugauaugguuuggcuguguu

SEQ ID NO: 65385 - RNA, 22 nt, Homo sapiens
ugauauguagguggcaagcaua

SEQ ID NO: 65386 - RNA, 22 nt, Homo sapiens
ugauauguaugugaccuagaaa

SEQ ID NO: 65387 - RNA, 22 nt, Homo sapiens
ugauaugugaguauaugguuau

SEQ ID NO: 65388 - RNA, 22 nt, Homo sapiens
ugauauguguaaacaauguaua

SEQ ID NO: 65389 - RNA, 17 nt, Homo sapiens
ugauauuuucccagaua

SEQ ID NO: 65390 - RNA, 22 nt, Homo sapiens
ugaucaaagugcuggaauuaca

SEQ ID NO: 65391 - RNA, 22 nt, Homo sapiens
ugaucacagcuugacuaaagga

SEQ ID NO: 65392 - RNA, 21 nt, Homo sapiens
ugaucacaugaaaaccaugca

SEQ ID NO: 65393 - RNA, 22 nt, Homo sapiens
ugauccagugcucaguuggagu

SEQ ID NO: 65394 - RNA, 22 nt, Homo sapiens
ugaucucagcucacugguugaa

SEQ ID NO: 65395 - RNA, 22 nt, Homo sapiens
ugaucuguccaccucagcuucc

SEQ ID NO: 65396 - RNA, 22 nt, Homo sapiens
ugaucuguguaacauaggaguc

SEQ ID NO: 65397 - RNA, 22 nt, Homo sapiens
ugaucuguguauauugaaccag

SEQ ID NO: 65398 - RNA, 22 nt, Homo sapiens
uuugcuugaggucuagcuaccc

SEQ ID NO: 65399 - RNA, 22 nt, Homo sapiens
uuuggauagugugguccuuuua

SEQ ID NO: 65400 - RNA, 22 nt, Homo sapiens
uuuggcaaagaucaacauguua

SEQ ID NO: 65401 - RNA, 20 nt, Homo sapiens
uuuggcaauaggguuuuugu

SEQ ID NO: 65402 - RNA, 22 nt, Homo sapiens
uuuggcaauuugacuguauagg

SEQ ID NO: 65403 - RNA, 22 nt, Homo sapiens
uuuggcagaaaacaagaaucug

SEQ ID NO: 65404 - RNA, 22 nt, Homo sapiens
uuuggcagaugacccucaaguu

SEQ ID NO: 65405 - RNA, 22 nt, Homo sapiens
uuuggcccugagggauggcaua

SEQ ID NO: 65406 - RNA, 18 nt, Homo sapiens
uuuggcuguucaugacuc

SEQ ID NO: 65407 - RNA, 22 nt, Homo sapiens
uuugggaaugguuugucuccca

SEQ ID NO: 65408 - RNA, 22 nt, Homo sapiens
uuuggguuaguuuuccaaucuu

SEQ ID NO: 65409 - RNA, 18 nt, Homo sapiens
uuugguccuuuauaaaca

SEQ ID NO: 65410 - RNA, 22 nt, Homo sapiens
uuugguguauaaaaaugcuagu

SEQ ID NO: 65411 - RNA, 22 nt, Homo sapiens
uuugguuauauauauacacucu

SEQ ID NO: 65412 - RNA, 22 nt, Homo sapiens
uuuguaauaccugaggcugggu

SEQ ID NO: 65413 - RNA, 22 nt, Homo sapiens
uuuguacacgugggugaauugu

SEQ ID NO: 65414 - RNA, 22 nt, Homo sapiens
uuuguacacuguugguaggauu

SEQ ID NO: 65415 - RNA, 22 nt, Homo sapiens
uuuguacacuguuggugguuau

SEQ ID NO: 65416 - RNA, 23 nt, Homo sapiens
uuuguacuaugucaguuuagaua

SEQ ID NO: 65417 - RNA, 22 nt, Homo sapiens
uuuguacucccuuuagauaaaa

SEQ ID NO: 65418 - RNA, 22 nt, Homo sapiens
uuuguacuccuuggccagcuuc

SEQ ID NO: 65419 - RNA, 22 nt, Homo sapiens
uuuguacuugguguucuggaaa

SEQ ID NO: 65420 - RNA, 21 nt, Homo sapiens
uuuguaguagcaugauuuaua

SEQ ID NO: 65421 - RNA, 23 nt, Homo sapiens
uuuguaguagcaugauuuauaau

SEQ ID NO: 65422 - RNA, 19 nt, Homo sapiens
uuuguauguuuccaguaau

SEQ ID NO: 65423 - RNA, 22 nt, Homo sapiens
uuugucaauaacuaccaacagg

SEQ ID NO: 65424 - RNA, 22 nt, Homo sapiens
uuugucauagcagcaggaaugg

SEQ ID NO: 65425 - RNA, 21 nt, Homo sapiens
uuuguccaccuguguucacca

SEQ ID NO: 65426 - RNA, 22 nt, Homo sapiens
uuugucccccguaguucauaua

SEQ ID NO: 65427 - RNA, 22 nt, Homo sapiens
uuugucccucucaccaacgggg

SEQ ID NO: 65428 - RNA, 22 nt, Homo sapiens
uuuguccugccaugguuuauuu

SEQ ID NO: 65429 - RNA, 22 nt, Homo sapiens
uuugugauugcacacucaagau

SEQ ID NO: 65430 - RNA, 22 nt, Homo sapiens
uuugugcaaacuaggauugcga

SEQ ID NO: 65431 - RNA, 18 nt, Homo sapiens
uuugugcuccacaaagga

SEQ ID NO: 65432 - RNA, 22 nt, Homo sapiens
uuugugcuccuaugagaaucua

SEQ ID NO: 65433 - RNA, 22 nt, Homo sapiens
uuugugcugcaauuaauuuccc

SEQ ID NO: 65434 - RNA, 21 nt, Homo sapiens
uuuguguccccacccaaaucu

SEQ ID NO: 65435 - RNA, 22 nt, Homo sapiens
uuuuagcagccaugacaaagau

SEQ ID NO: 65436 - RNA, 22 nt, Homo sapiens
uuuuagcuuuucccaggacucc

SEQ ID NO: 65437 - RNA, 22 nt, Homo sapiens
uuuuaguugcucagguauucuc

SEQ ID NO: 65438 - RNA, 20 nt, Homo sapiens
uuuugaacuuggcaaccugu

SEQ ID NO: 65439 - RNA, 22 nt, Homo sapiens
uuuugcacauugauuugguauc

SEQ ID NO: 65440 - RNA, 22 nt, Homo sapiens
uuuugcucuucauagguccugu

SEQ ID NO: 65441 - RNA, 19 nt, Homo sapiens
uuuugcucuuuauaccuau

SEQ ID NO: 65442 - RNA, 17 nt, Homo sapiens
uuuuggauuagaaaucc

SEQ ID NO: 65443 - RNA, 22 nt, Homo sapiens
uuuuggcacuuugucugauucu

SEQ ID NO: 65444 - RNA, 22 nt, Homo sapiens
uuuuggcuagaaauauaccucc

SEQ ID NO: 65445 - RNA, 22 nt, Homo sapiens
uuuugguauauacggggguccu

SEQ ID NO: 65446 - RNA, 22 nt, Homo sapiens
uuuugguuaggauggguggcau

SEQ ID NO: 65447 - RNA, 22 nt, Homo sapiens
uuuugguuguuggguaagagua

SEQ ID NO: 65448 - RNA, 22 nt, Homo sapiens
uuuuguacgccuguguccauca

SEQ ID NO: 65449 - RNA, 22 nt, Homo sapiens
uuuugugcauggcccaguggua

SEQ ID NO: 65450 - RNA, 21 nt, Homo sapiens
uuuugugcaugugcagccugc

SEQ ID NO: 65451 - RNA, 22 nt, Homo sapiens
uuuuuauggccaauccucagaa

SEQ ID NO: 65452 - RNA, 22 nt, Homo sapiens
uuuuugagaauuggugaaacac

SEQ ID NO: 65453 - RNA, 22 nt, Homo sapiens
uuuuugagguauaguguggcua

SEQ ID NO: 65454 - RNA, 22 nt, Homo sapiens
uuuuuggguaaugauuaucaau

SEQ ID NO: 65455 - RNA, 22 nt, Homo sapiens
uuuuugguugguaggcuauuaa

SEQ ID NO: 65456 - RNA, 22 nt, Homo sapiens
uuuuuuaguuagcugggcauga

SEQ ID NO: 65457 - RNA, 22 nt, Homo sapiens
uucaucacagucuccgaugccc

SEQ ID NO: 65458 - RNA, 22 nt, Homo sapiens
uucaucagcuguagaugucaug

SEQ ID NO: 65459 - RNA, 22 nt, Homo sapiens
uucaucaggaauauugaccugu

SEQ ID NO: 65460 - RNA, 21 nt, Homo sapiens
uucaucuggccguauuccagg

SEQ ID NO: 65461 - RNA, 20 nt, Homo sapiens
uucaugggagcaaagaggcc

SEQ ID NO: 65462 - RNA, 22 nt, Homo sapiens
uucauguaauauauuucaggcc

SEQ ID NO: 65463 - RNA, 22 nt, Homo sapiens
uucaugucuuggcuguuagagu

SEQ ID NO: 65464 - RNA, 22 nt, Homo sapiens
uucauugcugcuuaucuccaga

SEQ ID NO: 65465 - RNA, 22 nt, Homo sapiens
uuccaauguuccguguugcagu

SEQ ID NO: 65466 - RNA, 22 nt, Homo sapiens
uuccacagggauuugcauugau

SEQ ID NO: 65467 - RNA, 22 nt, Homo sapiens
uuccaguggacuacuucauccu

SEQ ID NO: 65468 - RNA, 22 nt, Homo sapiens
uuccaguggaguaaauggacaa

SEQ ID NO: 65469 - RNA, 22 nt, Homo sapiens
uuccaugagaugcaucaaagcu

SEQ ID NO: 65470 - RNA, 22 nt, Homo sapiens
uuccauguaguugagcaguuuu

SEQ ID NO: 65471 - RNA, 22 nt, Homo sapiens
uuccauugugucaucuuggugg

SEQ ID NO: 65472 - RNA, 22 nt, Homo sapiens
uucccagagaaaaggguuucuu

SEQ ID NO: 65473 - RNA, 22 nt, Homo sapiens
uucccagagccugggagugagg

SEQ ID NO: 65474 - RNA, 22 nt, Homo sapiens
uucccagucaaacgaaggacuu

SEQ ID NO: 65475 - RNA, 22 nt, Homo sapiens
uucccaguuggggaaagcgacc

SEQ ID NO: 65476 - RNA, 22 nt, Homo sapiens
uuccccgugaaacuuucucauu

SEQ ID NO: 65477 - RNA, 22 nt, Homo sapiens
uucccugagcaucuguugagcc

SEQ ID NO: 65478 - RNA, 22 nt, Homo sapiens
uucccugugggcuggugcucca

SEQ ID NO: 65479 - RNA, 23 nt, Homo sapiens
uucccuuagaagaaggggagaaa

SEQ ID NO: 65480 - RNA, 22 nt, Homo sapiens
uuccgcuguaguuguugguacc

SEQ ID NO: 65481 - RNA, 22 nt, Homo sapiens
uuccuacugugcaaaguugcaa

SEQ ID NO: 65482 - RNA, 22 nt, Homo sapiens
uuccucuagacugucgguuucu

SEQ ID NO: 65483 - RNA, 22 nt, Homo sapiens
uuccugagagggcugggugcag

SEQ ID NO: 65484 - RNA, 22 nt, Homo sapiens
uuccugagccuuguaucuagua

SEQ ID NO: 65485 - RNA, 22 nt, Homo sapiens
uuccugucuuccaagagagauu

SEQ ID NO: 65486 - RNA, 22 nt, Homo sapiens
uuccuuaguuauuugguccccu

SEQ ID NO: 65487 - RNA, 22 nt, Homo sapiens
uuccuugagucuuuuuccugag

SEQ ID NO: 65488 - RNA, 22 nt, Homo sapiens
uuccuugguucagggaaggucc

SEQ ID NO: 65489 - RNA, 22 nt, Homo sapiens
uuccuugugacuaguagugacc

SEQ ID NO: 65490 - RNA, 22 nt, Homo sapiens
uucgcagcucaguucaacuagg

SEQ ID NO: 65491 - RNA, 21 nt, Homo sapiens
uucggcaauaugaaccaaugu

SEQ ID NO: 65492 - RNA, 22 nt, Homo sapiens
uucgucaugagacagaugcuga

SEQ ID NO: 65493 - RNA, 22 nt, Homo sapiens
uucuaaacaucuuacaaugcau

SEQ ID NO: 65494 - RNA, 21 nt, Homo sapiens
uucuaaguaaauguuggacau

SEQ ID NO: 65495 - RNA, 22 nt, Homo sapiens
uucuaaguaauuuugcaugccu

SEQ ID NO: 65496 - RNA, 22 nt, Homo sapiens
uucuacaugggucgucggugag

SEQ ID NO: 65497 - RNA, 21 nt, Homo sapiens
uucuacuccggcguuguuuuu

SEQ ID NO: 65498 - RNA, 20 nt, Homo sapiens
uucuaguacuucuguuucca

SEQ ID NO: 65499 - RNA, 21 nt, Homo sapiens
uucucagaggcaggggauaaa

SEQ ID NO: 65500 - RNA, 22 nt, Homo sapiens
uucucagcccccugacagucag

SEQ ID NO: 65501 - RNA, 22 nt, Homo sapiens
uucucagugaaguuuagaacau

SEQ ID NO: 65502 - RNA, 22 nt, Homo sapiens
uucucagugcuaucuuuuaugc

SEQ ID NO: 65503 - RNA, 22 nt, Homo sapiens
uucuccugguggacccuaaacg

SEQ ID NO: 65504 - RNA, 22 nt, Homo sapiens
uucucgcuuuuuccaccuguau

SEQ ID NO: 65505 - RNA, 22 nt, Homo sapiens
uucucugggacauaggucgggu

SEQ ID NO: 65506 - RNA, 22 nt, Homo sapiens
uucugcuugaucuaguguguug

SEQ ID NO: 65507 - RNA, 22 nt, Homo sapiens
uucuggccccucccaaucucau

SEQ ID NO: 65508 - RNA, 22 nt, Homo sapiens
uuguauguaaccauuuggcaaa

SEQ ID NO: 65509 - RNA, 22 nt, Homo sapiens
uuguaugucuucauuugaaaaa

SEQ ID NO: 65510 - RNA, 22 nt, Homo sapiens
uuguauguuguuugucagagaa

SEQ ID NO: 65511 - RNA, 22 nt, Homo sapiens
uugucaaugggugagugcagag

SEQ ID NO: 65512 - RNA, 22 nt, Homo sapiens
uugucacauggggcggcugccc

SEQ ID NO: 65513 - RNA, 22 nt, Homo sapiens
uugucaguguucacucaaagcu

SEQ ID NO: 65514 - RNA, 22 nt, Homo sapiens
uuguccccacccaaaugucauc

SEQ ID NO: 65515 - RNA, 16 nt, Homo sapiens
uugucccuucccaaau

SEQ ID NO: 65516 - RNA, 22 nt, Homo sapiens
uuguccuugagauaguuugcug

SEQ ID NO: 65517 - RNA, 22 nt, Homo sapiens
uugucucacuggaguuuaguaa

SEQ ID NO: 65518 - RNA, 19 nt, Homo sapiens
uugucuuagaguugucauu

SEQ ID NO: 65519 - RNA, 22 nt, Homo sapiens
uugugaaaaaccucucguggaa

SEQ ID NO: 65520 - RNA, 22 nt, Homo sapiens
uugugaagaugugaagcaagca

SEQ ID NO: 65521 - RNA, 22 nt, Homo sapiens
uugugaauggugccacaauaaa

SEQ ID NO: 65522 - RNA, 22 nt, Homo sapiens
uugugaauggugccgcgauaaa

SEQ ID NO: 65523 - RNA, 22 nt, Homo sapiens
uugugaguggugccgcaauaaa

SEQ ID NO: 65524 - RNA, 22 nt, Homo sapiens
uugugaucuucagaaaguggcu

SEQ ID NO: 65525 - RNA, 22 nt, Homo sapiens
uugugcaaaguugugguuucug

SEQ ID NO: 65526 - RNA, 22 nt, Homo sapiens
uugugcuucaucaccuagcaga

SEQ ID NO: 65527 - RNA, 18 nt, Homo sapiens
uuguggccccuacaaauu

SEQ ID NO: 65528 - RNA, 16 nt, Homo sapiens
uuguggcuuuugcaca

SEQ ID NO: 65529 - RNA, 22 nt, Homo sapiens
uugugggaggugauuagaucau

SEQ ID NO: 65530 - RNA, 22 nt, Homo sapiens
uugugguaggaguugccauguu

SEQ ID NO: 65531 - RNA, 22 nt, Homo sapiens
uugugguaggaugaagagauga

SEQ ID NO: 65532 - RNA, 22 nt, Homo sapiens
uugugguugauacacguaggaa

SEQ ID NO: 65533 - RNA, 22 nt, Homo sapiens
uugugguuuuaucuaccuuugg

SEQ ID NO: 65534 - RNA, 22 nt, Homo sapiens
uugugguuuucagcuuauauau

SEQ ID NO: 65535 - RNA, 22 nt, Homo sapiens
uugugguuuuuaaaacuaggug

SEQ ID NO: 65536 - RNA, 22 nt, Homo sapiens
uuguguacuacaguaugccaca

SEQ ID NO: 65537 - RNA, 22 nt, Homo sapiens
uuguguaguaccucucacauug

SEQ ID NO: 65538 - RNA, 19 nt, Homo sapiens
uuguguccccacaaaauuc

SEQ ID NO: 65539 - RNA, 22 nt, Homo sapiens
uuguguccccacccaaaucuca

SEQ ID NO: 65540 - RNA, 22 nt, Homo sapiens
uugugucccugcggcugaggag

SEQ ID NO: 65541 - RNA, 23 nt, Homo sapiens
uuguucccuuccacucagucucc

SEQ ID NO: 65542 - RNA, 22 nt, Homo sapiens
uuguugcacugcuuuccuggcc

SEQ ID NO: 65543 - RNA, 22 nt, Homo sapiens
uuguuugguuagaugggcaagu

SEQ ID NO: 65544 - RNA, 22 nt, Homo sapiens
uuuaaacugucuuggguuugga

SEQ ID NO: 65545 - RNA, 20 nt, Homo sapiens
uuuaagacaugcugaauuga

SEQ ID NO: 65546 - RNA, 22 nt, Homo sapiens
uuuaaguguuuguuccugaaaa

SEQ ID NO: 65547 - RNA, 22 nt, Homo sapiens
uuuaaugcaucccaaaauguag

SEQ ID NO: 65548 - RNA, 18 nt, Homo sapiens
uuuacaguagaaggacuu

SEQ ID NO: 65549 - RNA, 22 nt, Homo sapiens
uuuacagucucauagguggaag

SEQ ID NO: 65550 - RNA, 22 nt, Homo sapiens
uuuacaguuuucuaggcuacca

SEQ ID NO: 65551 - RNA, 22 nt, Homo sapiens
uuuacugucuucagucccucug

SEQ ID NO: 65552 - RNA, 21 nt, Homo sapiens
uuuacuguggacccauugcuu

SEQ ID NO: 65553 - RNA, 22 nt, Homo sapiens
uuuacugugggguuucuuagag

SEQ ID NO: 65554 - RNA, 22 nt, Homo sapiens
uuuagcaauggagggugacuuu

SEQ ID NO: 65555 - RNA, 22 nt, Homo sapiens
uuuaggcaauauauucaugucu

SEQ ID NO: 65556 - RNA, 22 nt, Homo sapiens
uuuagggcaggccuggugguga

SEQ ID NO: 65557 - RNA, 23 nt, Homo sapiens
uuuaguccccuaugagcuggugu

SEQ ID NO: 65558 - RNA, 22 nt, Homo sapiens
uuuaucaggccuuuggaaaaau

SEQ ID NO: 65559 - RNA, 22 nt, Homo sapiens
uuuauccagccucuagcaaggu

SEQ ID NO: 65560 - RNA, 22 nt, Homo sapiens
uuuaucuguuuaaaacuguuca

SEQ ID NO: 65561 - RNA, 22 nt, Homo sapiens
uuuauggcaugcucccucucaa

SEQ ID NO: 65562 - RNA, 22 nt, Homo sapiens
uuuaugguuuucugggagauug

SEQ ID NO: 65563 - RNA, 22 nt, Homo sapiens
uuucaacuaauuuuuuggugag

SEQ ID NO: 65564 - RNA, 22 nt, Homo sapiens
uuucaagugcugucuuagcugu

SEQ ID NO: 65565 - RNA, 19 nt, Homo sapiens
uuucaauguaaggauggag

SEQ ID NO: 65566 - RNA, 19 nt, Homo sapiens
uuucacacucgccuacuuc

SEQ ID NO: 65567 - RNA, 21 nt, Homo sapiens
uuucacugugaguuuuucugu

SEQ ID NO: 65568 - RNA, 17 nt, Homo sapiens
uuucagaguggaagugu

SEQ ID NO: 65569 - RNA, 22 nt, Homo sapiens
uuucagcguggggugcugaaga

SEQ ID NO: 65570 - RNA, 22 nt, Homo sapiens
uuucaguguggcaggcauagcu

SEQ ID NO: 65571 - RNA, 22 nt, Homo sapiens
uuucaucagccagggucagucu

SEQ ID NO: 65572 - RNA, 23 nt, Homo sapiens
uuucauggggauuuacucauucc

SEQ ID NO: 65573 - RNA, 22 nt, Homo sapiens
uuucccugaaggcucugaaguc

SEQ ID NO: 65574 - RNA, 16 nt, Homo sapiens
uuucccuuugguguuu

SEQ ID NO: 65575 - RNA, 22 nt, Homo sapiens
uuucuacagggcuugccaggua

SEQ ID NO: 65576 - RNA, 22 nt, Homo sapiens
uuucugggggugcugauggaaa

SEQ ID NO: 65577 - RNA, 22 nt, Homo sapiens
uuugaaaguaauuugguuggug

SEQ ID NO: 65578 - RNA, 22 nt, Homo sapiens
uuugaagcaauugugaauggga

SEQ ID NO: 65579 - RNA, 22 nt, Homo sapiens
uuugaaugcaacaaaugcggga

SEQ ID NO: 65580 - RNA, 20 nt, Homo sapiens
uuugaauguaaagcauguca

SEQ ID NO: 65581 - RNA, 22 nt, Homo sapiens
uuugacuacugaugguguacgc

SEQ ID NO: 65582 - RNA, 18 nt, Homo sapiens
uuugacugguguccuuau

SEQ ID NO: 65583 - RNA, 22 nt, Homo sapiens
uuugacuuuuagaauaugaguu

SEQ ID NO: 65584 - RNA, 22 nt, Homo sapiens
uuugagaucuuuagaaucaggc

SEQ ID NO: 65585 - RNA, 22 nt, Homo sapiens
uuugagcaagaggugacauuau

SEQ ID NO: 65586 - RNA, 22 nt, Homo sapiens
uuugagcaggcuaaucaauaua

SEQ ID NO: 65587 - RNA, 22 nt, Homo sapiens
uuugagcaugcagauugccagg

SEQ ID NO: 65588 - RNA, 22 nt, Homo sapiens
uuugagcauggaaauggcauga

SEQ ID NO: 65589 - RNA, 22 nt, Homo sapiens
uuugaguaggcuuauauuuugg

SEQ ID NO: 65590 - RNA, 22 nt, Homo sapiens
uuugaguuugaggugcugauga

SEQ ID NO: 65591 - RNA, 22 nt, Homo sapiens
uuugauguugagacuauaaagc

SEQ ID NO: 65592 - RNA, 22 nt, Homo sapiens
uuugauguugauacuaccuuca

SEQ ID NO: 65593 - RNA, 22 nt, Homo sapiens
uuugauuguacuaaaauuguac

SEQ ID NO: 65594 - RNA, 22 nt, Homo sapiens
uuugcaccuuccuaguggcuga

SEQ ID NO: 65595 - RNA, 22 nt, Homo sapiens
uuugcacuucugagugugacau

SEQ ID NO: 65596 - RNA, 23 nt, Homo sapiens
uuugcacuugcuccuucuauggc

SEQ ID NO: 65597 - RNA, 22 nt, Homo sapiens
uuugcaguguaguuggccagca

SEQ ID NO: 65598 - RNA, 22 nt, Homo sapiens
uuugcaucuuagaaaguucucc

SEQ ID NO: 65599 - RNA, 22 nt, Homo sapiens
uuugccaauauuuuacugagga

SEQ ID NO: 65600 - RNA, 22 nt, Homo sapiens
uuugccaaugggaauuuuccua

SEQ ID NO: 65601 - RNA, 18 nt, Homo sapiens
uuugccacuucccagaaa

SEQ ID NO: 65602 - RNA, 22 nt, Homo sapiens
ugggcggagacgugcagccgcc

SEQ ID NO: 65603 - RNA, 22 nt, Homo sapiens
uggggcuuuuucuuguauucuc

SEQ ID NO: 65604 - RNA, 22 nt, Homo sapiens
ugggguaggcuguauacucugu

SEQ ID NO: 65605 - RNA, 22 nt, Homo sapiens
uggggucguaggugcccgccag

SEQ ID NO: 65606 - RNA, 22 nt, Homo sapiens
uggguaauggagaaauaaaucu

SEQ ID NO: 65607 - RNA, 22 nt, Homo sapiens
uggguagagcacugggggcgag

SEQ ID NO: 65608 - RNA, 22 nt, Homo sapiens
uggguaguuuuucagcucuugc

SEQ ID NO: 65609 - RNA, 23 nt, Homo sapiens
ugggucaguuuuucugacaucau

SEQ ID NO: 65610 - RNA, 22 nt, Homo sapiens
uggguucccugucuguccuuga

SEQ ID NO: 65611 - RNA, 22 nt, Homo sapiens
ugguaaaaugucauuuaccaga

SEQ ID NO: 65612 - RNA, 23 nt, Homo sapiens
ugguaacauguuguggcagggga

SEQ ID NO: 65613 - RNA, 22 nt, Homo sapiens
ugguacuguccuucuagauucc

SEQ ID NO: 65614 - RNA, 22 nt, Homo sapiens
ugguacugucucuauuuuguag

SEQ ID NO: 65615 - RNA, 22 nt, Homo sapiens
ugguagugugagucuaaauugg

SEQ ID NO: 65616 - RNA, 22 nt, Homo sapiens
ugguaucauuuuaucugcucua

SEQ ID NO: 65617 - RNA, 22 nt, Homo sapiens
ugguauguaugauuaacaugga

SEQ ID NO: 65618 - RNA, 22 nt, Homo sapiens
ugguauguguucuaaaauuaug

SEQ ID NO: 65619 - RNA, 20 nt, Homo sapiens
uggucaccuucaggagguuc

SEQ ID NO: 65620 - RNA, 21 nt, Homo sapiens
uggucccauaagauuacaaug

SEQ ID NO: 65621 - RNA, 22 nt, Homo sapiens
ugguccccaauacuucuauaga

SEQ ID NO: 65622 - RNA, 20 nt, Homo sapiens
ugguccccaccaaaucucau

SEQ ID NO: 65623 - RNA, 23 nt, Homo sapiens
uggucccguguucuggcuuuagg

SEQ ID NO: 65624 - RNA, 22 nt, Homo sapiens
ugguccuuuccauuggagacac

SEQ ID NO: 65625 - RNA, 22 nt, Homo sapiens
uggucuuuucaacaaaugguau

SEQ ID NO: 65626 - RNA, 22 nt, Homo sapiens
uggugcaaauguaauugugguu

SEQ ID NO: 65627 - RNA, 22 nt, Homo sapiens
uggugccgugguccuggggcca

SEQ ID NO: 65628 - RNA, 22 nt, Homo sapiens
ugguucaguugcacaggcuguu

SEQ ID NO: 65629 - RNA, 22 nt, Homo sapiens
ugguugaucccaucacccaggu

SEQ ID NO: 65630 - RNA, 22 nt, Homo sapiens
uguaaacauguauguguuuaug

SEQ ID NO: 65631 - RNA, 23 nt, Homo sapiens
uguaaagcuaugaauuauucuuu

SEQ ID NO: 65632 - RNA, 20 nt, Homo sapiens
uguaaaggagauugcagcug

SEQ ID NO: 65633 - RNA, 21 nt, Homo sapiens
uguaacugcaaaccucagauu

SEQ ID NO: 65634 - RNA, 22 nt, Homo sapiens
uguaaggcaguuagagcaaauu

SEQ ID NO: 65635 - RNA, 20 nt, Homo sapiens
uguaaucuaaguuuuaagcc

SEQ ID NO: 65636 - RNA, 19 nt, Homo sapiens
uguacacuguaaaccugug

SEQ ID NO: 65637 - RNA, 22 nt, Homo sapiens
uguacaugggacaggaggagag

SEQ ID NO: 65638 - RNA, 22 nt, Homo sapiens
uguacuagaaauuaaggcaggg

SEQ ID NO: 65639 - RNA, 22 nt, Homo sapiens
uguagacaccaaagacagcaua

SEQ ID NO: 65640 - RNA, 21 nt, Homo sapiens
uguagcagcaugauucauagu

SEQ ID NO: 65641 - RNA, 22 nt, Homo sapiens
uguagcagccauaaacacagug

SEQ ID NO: 65642 - RNA, 20 nt, Homo sapiens
uguagguguacaguaaggag

SEQ ID NO: 65643 - RNA, 22 nt, Homo sapiens
uguagucauuuggaguccagcu

SEQ ID NO: 65644 - RNA, 22 nt, Homo sapiens
uguauacauauguauguuuugu

SEQ ID NO: 65645 - RNA, 22 nt, Homo sapiens
uguaugcuuuugagagauauuu

SEQ ID NO: 65646 - RNA, 22 nt, Homo sapiens
uguauguugauguuauauucug

SEQ ID NO: 65647 - RNA, 22 nt, Homo sapiens
uguauguugggucaaaguacau

SEQ ID NO: 65648 - RNA, 22 nt, Homo sapiens
ugucaaaugcagugauauuuga

SEQ ID NO: 65649 - RNA, 19 nt, Homo sapiens
ugucaaaugucuccugggg

SEQ ID NO: 65650 - RNA, 21 nt, Homo sapiens
ugucaagaugacugcugcggc

SEQ ID NO: 65651 - RNA, 22 nt, Homo sapiens
ugucacaguuuguacuuuauag

SEQ ID NO: 65652 - RNA, 22 nt, Homo sapiens
ugucacauccaagaaggugcag

SEQ ID NO: 65653 - RNA, 18 nt, Homo sapiens
ugucacuggauaaugguc

SEQ ID NO: 65654 - RNA, 22 nt, Homo sapiens
ugucacugugcagucaugcauu

SEQ ID NO: 65655 - RNA, 18 nt, Homo sapiens
ugucagaguggauuguaa

SEQ ID NO: 65656 - RNA, 22 nt, Homo sapiens
ugucagcacaacucagguuccu

SEQ ID NO: 65657 - RNA, 22 nt, Homo sapiens
ugucaggaugcuccuuuuggcu

SEQ ID NO: 65658 - RNA, 22 nt, Homo sapiens
ugucaguguacuguaagaauua

SEQ ID NO: 65659 - RNA, 22 nt, Homo sapiens
ugucaguuucccuccucuuccu

SEQ ID NO: 65660 - RNA, 22 nt, Homo sapiens
ugucauagauugcuuggaaaaa

SEQ ID NO: 65661 - RNA, 22 nt, Homo sapiens
ugucauggugcucugggcccug

SEQ ID NO: 65662 - RNA, 22 nt, Homo sapiens
ugucauguaaagaguaaauggu

SEQ ID NO: 65663 - RNA, 22 nt, Homo sapiens
ugucauguagaaauuguccauu

SEQ ID NO: 65664 - RNA, 22 nt, Homo sapiens
ugucauguugguguacugcacc

SEQ ID NO: 65665 - RNA, 22 nt, Homo sapiens
ugucauuggacuucuuucaugg

SEQ ID NO: 65666 - RNA, 22 nt, Homo sapiens
uguccaaaucagagguaccaaa

SEQ ID NO: 65667 - RNA, 22 nt, Homo sapiens
ugucccaguuggguauugaauu

SEQ ID NO: 65668 - RNA, 22 nt, Homo sapiens
uguccguuuuguuucaggcuca

SEQ ID NO: 65669 - RNA, 22 nt, Homo sapiens
uguccuagagggaugucacccc

SEQ ID NO: 65670 - RNA, 22 nt, Homo sapiens
uguccugaagcuuuguuaugua

SEQ ID NO: 65671 - RNA, 22 nt, Homo sapiens
uguccuguaggaggcagaacaa

SEQ ID NO: 65672 - RNA, 22 nt, Homo sapiens
ugucuagaaaagccugccuucu

SEQ ID NO: 65673 - RNA, 22 nt, Homo sapiens
ugucucagugauuggcuuucug

SEQ ID NO: 65674 - RNA, 22 nt, Homo sapiens
ugucucccuucccauuaggaag

SEQ ID NO: 65675 - RNA, 22 nt, Homo sapiens
ugucuggaaggguggccuccug

SEQ ID NO: 65676 - RNA, 18 nt, Homo sapiens
ugucuuagagcuugaccc

SEQ ID NO: 65677 - RNA, 22 nt, Homo sapiens
ugucuuggaugaggauuaacag

SEQ ID NO: 65678 - RNA, 21 nt, Homo sapiens
ugugaaaucuaggcagagguu

SEQ ID NO: 65679 - RNA, 22 nt, Homo sapiens
ugugaacaaaauuuguugcaua

SEQ ID NO: 65680 - RNA, 22 nt, Homo sapiens
ugugaacagaauuagucaccua

SEQ ID NO: 65681 - RNA, 22 nt, Homo sapiens
ugugaacaugacagugggcuag

SEQ ID NO: 65682 - RNA, 22 nt, Homo sapiens
ugugaagauggacuaauauagu

SEQ ID NO: 65683 - RNA, 22 nt, Homo sapiens
ugugaaugaagaaugcuaaccu

SEQ ID NO: 65684 - RNA, 22 nt, Homo sapiens
ugugaauggugcugcaaugaac

SEQ ID NO: 65685 - RNA, 22 nt, Homo sapiens
ugugaauguaagaaaauccaac

SEQ ID NO: 65686 - RNA, 22 nt, Homo sapiens
ugugacagcacgguucaacugc

SEQ ID NO: 65687 - RNA, 22 nt, Homo sapiens
ugugacaguuaguuugguguua

SEQ ID NO: 65688 - RNA, 22 nt, Homo sapiens
ugugacuaguggugaaugacgc

SEQ ID NO: 65689 - RNA, 19 nt, Homo sapiens
ugugacugggccagccuag

SEQ ID NO: 65690 - RNA, 22 nt, Homo sapiens
ugugacugguugucccacuuuc

SEQ ID NO: 65691 - RNA, 22 nt, Homo sapiens
ugugagacugguucugaaccca

SEQ ID NO: 65692 - RNA, 22 nt, Homo sapiens
ugugaguguguacuaguuauca

SEQ ID NO: 65693 - RNA, 22 nt, Homo sapiens
ugugauaguuggcuaaagcagu

SEQ ID NO: 65694 - RNA, 17 nt, Homo sapiens
ugugaucaucacccuug

SEQ ID NO: 65695 - RNA, 22 nt, Homo sapiens
ugugauggaguuucauggacug

SEQ ID NO: 65696 - RNA, 19 nt, Homo sapiens
ugugauaguugaaccugcc

SEQ ID NO: 65697 - RNA, 22 nt, Homo sapiens
ugugaucaauuagugaugucug

SEQ ID NO: 65698 - RNA, 19 nt, Homo sapiens
ugcaaagucuuuuccuauu

SEQ ID NO: 65699 - RNA, 22 nt, Homo sapiens
ugcaaaugcugcuauuucucuu

SEQ ID NO: 65700 - RNA, 22 nt, Homo sapiens
ugcaaauguuaguaacaccacu

SEQ ID NO: 65701 - RNA, 22 nt, Homo sapiens
ugcaaauuauugggccccaacu

SEQ ID NO: 65702 - RNA, 19 nt, Homo sapiens
ugcaaauucuaaaaacuga

SEQ ID NO: 65703 - RNA, 22 nt, Homo sapiens
ugcaaccauuguuaagugugca

SEQ ID NO: 65704 - RNA, 22 nt, Homo sapiens
ugcaagaugagauuuuggaugg

SEQ ID NO: 65705 - RNA, 22 nt, Homo sapiens
ugcaaguaauuggcgaggaguu

SEQ ID NO: 65706 - RNA, 22 nt, Homo sapiens
ugcaauauccucuacuauaggu

SEQ ID NO: 65707 - RNA, 22 nt, Homo sapiens
ugcaaucaucgcuguuggccac

SEQ ID NO: 65708 - RNA, 18 nt, Homo sapiens
ugcaauggagaugcagcc

SEQ ID NO: 65709 - RNA, 22 nt, Homo sapiens
ugcaaugucuucugaggggagc

SEQ ID NO: 65710 - RNA, 22 nt, Homo sapiens
ugcaaugugaaauaagcacauc

SEQ ID NO: 65711 - RNA, 17 nt, Homo sapiens
ugcaauuuaagcuagau

SEQ ID NO: 65712 - RNA, 22 nt, Homo sapiens
ugcacaaccucacccccgcucu

SEQ ID NO: 65713 - RNA, 22 nt, Homo sapiens
ugcaccaauucuaaacaguucu

SEQ ID NO: 65714 - RNA, 22 nt, Homo sapiens
ugcaccacacuccauccugggc

SEQ ID NO: 65715 - RNA, 23 nt, Homo sapiens
ugcaccacuacacacucuugggu

SEQ ID NO: 65716 - RNA, 22 nt, Homo sapiens
ugcaccacuacacuccaggcug

SEQ ID NO: 65717 - RNA, 22 nt, Homo sapiens
ugcaccacugcacugccugggu

SEQ ID NO: 65718 - RNA, 22 nt, Homo sapiens
ugcaccacugcacuucagccug

SEQ ID NO: 65719 - RNA, 22 nt, Homo sapiens
ugcaccacugcuagccugggua

SEQ ID NO: 65720 - RNA, 18 nt, Homo sapiens
ugcaccaguuuacacuuc

SEQ ID NO: 65721 - RNA, 22 nt, Homo sapiens
ugcaccauggcacuccaggcug

SEQ ID NO: 65722 - RNA, 22 nt, Homo sapiens
ugcagagucuguccugccugcc

SEQ ID NO: 65723 - RNA, 19 nt, Homo sapiens
ugcagcaauguaaaagaca

SEQ ID NO: 65724 - RNA, 23 nt, Homo sapiens
ugcagcacacugaugggucuuga

SEQ ID NO: 65725 - RNA, 18 nt, Homo sapiens
ugcagcaucaguacccag

SEQ ID NO: 65726 - RNA, 22 nt, Homo sapiens
ugcagcauguaggcacguuauu

SEQ ID NO: 65727 - RNA, 22 nt, Homo sapiens
ugcagcucagcugcggaguuuu

SEQ ID NO: 65728 - RNA, 22 nt, Homo sapiens
ugcaggauguucaguaauuucc

SEQ ID NO: 65729 - RNA, 22 nt, Homo sapiens
ugcaggguccauugucccaagu

SEQ ID NO: 65730 - RNA, 22 nt, Homo sapiens
ugcaguacugucagacuucuua

SEQ ID NO: 65731 - RNA, 22 nt, Homo sapiens
ugcaguacuuugaaauauacug

SEQ ID NO: 65732 - RNA, 22 nt, Homo sapiens
ugcagugucaauaauaauuagu

SEQ ID NO: 65733 - RNA, 22 nt, Homo sapiens
ugcagugugauuuucuggcuga

SEQ ID NO: 65734 - RNA, 21 nt, Homo sapiens
ugcagugugguugcccugcug

SEQ ID NO: 65735 - RNA, 22 nt, Homo sapiens
ugcaguuuaggaacugguaaca

SEQ ID NO: 65736 - RNA, 22 nt, Homo sapiens
ugcauaauuccuugcaccagaa

SEQ ID NO: 65737 - RNA, 18 nt, Homo sapiens
ugcauacuaucugauuuu

SEQ ID NO: 65738 - RNA, 22 nt, Homo sapiens
ugcauagaauguucuguaaaua

SEQ ID NO: 65739 - RNA, 22 nt, Homo sapiens
ugcauagcaaaauaggauuaga

SEQ ID NO: 65740 - RNA, 22 nt, Homo sapiens
ugcauauguucaaaguauucug

SEQ ID NO: 65741 - RNA, 22 nt, Homo sapiens
ugcauauucgaguuauuuuggg

SEQ ID NO: 65742 - RNA, 22 nt, Homo sapiens
ugcauccauucuagacucaucu

SEQ ID NO: 65743 - RNA, 22 nt, Homo sapiens
ugcauggagauauacaguuuuu

SEQ ID NO: 65744 - RNA, 20 nt, Homo sapiens
ugcauguccucacuuacuug

SEQ ID NO: 65745 - RNA, 22 nt, Homo sapiens
ugcauuaucagauguuugcuuu

SEQ ID NO: 65746 - RNA, 22 nt, Homo sapiens
ugcauuguggaucuaaaugcau

SEQ ID NO: 65747 - RNA, 22 nt, Homo sapiens
ugccaacaugccuggcuguuuu

SEQ ID NO: 65748 - RNA, 20 nt, Homo sapiens
ugccaagaaaugaggguauu

SEQ ID NO: 65749 - RNA, 22 nt, Homo sapiens
ugccagaugugcccucuccacc

SEQ ID NO: 65750 - RNA, 22 nt, Homo sapiens
ugccauagagauuuguggaacu

SEQ ID NO: 65751 - RNA, 22 nt, Homo sapiens
ugccaugaaguaauggcaaaaa

SEQ ID NO: 65752 - RNA, 19 nt, Homo sapiens
ugccauguaacaggaaaau

SEQ ID NO: 65753 - RNA, 22 nt, Homo sapiens
ugccauugcacuccagccuggg

SEQ ID NO: 65754 - RNA, 22 nt, Homo sapiens
ugcccaguggacagaaagucau

SEQ ID NO: 65755 - RNA, 21 nt, Homo sapiens
ugcccaguggcuuggggucag

SEQ ID NO: 65756 - RNA, 22 nt, Homo sapiens
ugccuacagaaggggcucagca

SEQ ID NO: 65757 - RNA, 18 nt, Homo sapiens
ugccuacugggcucaagc

SEQ ID NO: 65758 - RNA, 22 nt, Homo sapiens
ugccuagaaacacuauuucucc

SEQ ID NO: 65759 - RNA, 22 nt, Homo sapiens
ugccuagucuauugagagucuu

SEQ ID NO: 65760 - RNA, 22 nt, Homo sapiens
ugccuaguguguugagaguuuu

SEQ ID NO: 65761 - RNA, 16 nt, Homo sapiens
ugccuuauuccagcuc

SEQ ID NO: 65762 - RNA, 22 nt, Homo sapiens
ugcgcacugcagauuugaacuc

SEQ ID NO: 65763 - RNA, 22 nt, Homo sapiens
ugcuacccuucgucucucuggu

SEQ ID NO: 65764 - RNA, 22 nt, Homo sapiens
ugcuagaugcuguagggauuua

SEQ ID NO: 65765 - RNA, 22 nt, Homo sapiens
ugcuaugucuucucucacagag

SEQ ID NO: 65766 - RNA, 16 nt, Homo sapiens
ugcuauguuggccagg

SEQ ID NO: 65767 - RNA, 22 nt, Homo sapiens
ugcugaguguuaccggacaccg

SEQ ID NO: 65768 - RNA, 19 nt, Homo sapiens
ugcugcauugugaccuugc

SEQ ID NO: 65769 - RNA, 22 nt, Homo sapiens
ugcuggugauucagauucaaau

SEQ ID NO: 65770 - RNA, 22 nt, Homo sapiens
ugcugguuuucaucaucagugg

SEQ ID NO: 65771 - RNA, 22 nt, Homo sapiens
ugcuuaggcuaacaaaaauagc

SEQ ID NO: 65772 - RNA, 22 nt, Homo sapiens
uggaaauaaaugugccaagauc

SEQ ID NO: 65773 - RNA, 22 nt, Homo sapiens
uggaagacucuagucucuugag

SEQ ID NO: 65774 - RNA, 22 nt, Homo sapiens
uggaagacuuuagaggcuuaua

SEQ ID NO: 65775 - RNA, 22 nt, Homo sapiens
uggaagcauagcagcgugugug

SEQ ID NO: 65776 - RNA, 22 nt, Homo sapiens
uggaagccuagauucuuuucuu

SEQ ID NO: 65777 - RNA, 20 nt, Homo sapiens
uggaaggcaucugcauuauu

SEQ ID NO: 65778 - RNA, 22 nt, Homo sapiens
uggaaguaaccaugaauggaau

SEQ ID NO: 65779 - RNA, 22 nt, Homo sapiens
uggaaguauagauaauugaaag

SEQ ID NO: 65780 - RNA, 23 nt, Homo sapiens
uggaaguauggaggaggcagaau

SEQ ID NO: 65781 - RNA, 22 nt, Homo sapiens
uggaagucuauggcauuugagu

SEQ ID NO: 65782 - RNA, 22 nt, Homo sapiens
uggaagugaacaaccaaggcag

SEQ ID NO: 65783 - RNA, 22 nt, Homo sapiens
uggaaguuaaauuaguugauga

SEQ ID NO: 65784 - RNA, 22 nt, Homo sapiens
uggaauacaugucgcugagcug

SEQ ID NO: 65785 - RNA, 22 nt, Homo sapiens
ugggagcauugcauuagaagcc

SEQ ID NO: 65786 - RNA, 22 nt, Homo sapiens
ugggaucagcugggcucucugu

SEQ ID NO: 65787 - RNA, 22 nt, Homo sapiens
ugggaugaaaauagcuucuucc

SEQ ID NO: 65788 - RNA, 22 nt, Homo sapiens
ugggaugaugcuugagaauauc

SEQ ID NO: 65789 - RNA, 22 nt, Homo sapiens
ugggcaguauggucauuuucgu

SEQ ID NO: 65790 - RNA, 22 nt, Homo sapiens
uggggcaaugaacauuuuugca

SEQ ID NO: 65791 - RNA, 22 nt, Homo sapiens
ugggguaggccugguuaugugc

SEQ ID NO: 65792 - RNA, 22 nt, Homo sapiens
uggguagaugaauccauuccaa

SEQ ID NO: 65793 - RNA, 22 nt, Homo sapiens
uggguaggaccagaaaugcacu

SEQ ID NO: 65794 - RNA, 19 nt, Homo sapiens
uggguagugaugagacaua

SEQ ID NO: 65795 - RNA, 21 nt, Homo sapiens
uggguaguuuucaaggccccg

SEQ ID NO: 65796 - RNA, 22 nt, Homo sapiens
ugggucaguagcauguaugucu

SEQ ID NO: 65797 - RNA, 22 nt, Homo sapiens
uggguccccuacucuuuccaca

SEQ ID NO: 65798 - RNA, 22 nt, Homo sapiens
ugggugugaccgcucaaggggg

SEQ ID NO: 65799 - RNA, 23 nt, Homo sapiens
uggguucccuaagcgcaugcugc

SEQ ID NO: 65800 - RNA, 22 nt, Homo sapiens
ugguaaacaacaggagaacuug

SEQ ID NO: 65801 - RNA, 22 nt, Homo sapiens
ugguaagaucagaacuggaguc

SEQ ID NO: 65802 - RNA, 22 nt, Homo sapiens
ugguaauguaauuuggagaagg

SEQ ID NO: 65803 - RNA, 22 nt, Homo sapiens
ugguagguuuauaaagaauuua

SEQ ID NO: 65804 - RNA, 22 nt, Homo sapiens
ugguaguuucuguaucucacag

SEQ ID NO: 65805 - RNA, 22 nt, Homo sapiens
ugguaugucuagauggggaagu

SEQ ID NO: 65806 - RNA, 22 nt, Homo sapiens
uggucaaaucugaugugagaaa

SEQ ID NO: 65807 - RNA, 22 nt, Homo sapiens
uggucaccugaauuaugcaugu

SEQ ID NO: 65808 - RNA, 22 nt, Homo sapiens
uggucagaaaauuacuugauau

SEQ ID NO: 65809 - RNA, 21 nt, Homo sapiens
uggucaguuuucucacuagga

SEQ ID NO: 65810 - RNA, 21 nt, Homo sapiens
uggucccauaagauuauaaug

SEQ ID NO: 65811 - RNA, 22 nt, Homo sapiens
ugguccucugcuuccagaauuc

SEQ ID NO: 65812 - RNA, 22 nt, Homo sapiens
uggucguggagucccuggcuuc

SEQ ID NO: 65813 - RNA, 22 nt, Homo sapiens
uggucuccuuuguacccugggc

SEQ ID NO: 65814 - RNA, 22 nt, Homo sapiens
uggucucuuugcuuuagucauc

SEQ ID NO: 65815 - RNA, 22 nt, Homo sapiens
uggugagaaacuagauauuuuu

SEQ ID NO: 65816 - RNA, 22 nt, Homo sapiens
uggugcaaugaagugaucucaa

SEQ ID NO: 65817 - RNA, 22 nt, Homo sapiens
ugguggcuuuucguagguucac

SEQ ID NO: 65818 - RNA, 22 nt, Homo sapiens
ugguguccugucucugcgcuug

SEQ ID NO: 65819 - RNA, 22 nt, Homo sapiens
ugguuagucuguguguauauau

SEQ ID NO: 65820 - RNA, 21 nt, Homo sapiens
ugguucaguucguuacgugug

SEQ ID NO: 65821 - RNA, 23 nt, Homo sapiens
ugguuuguaagagauggacugga

SEQ ID NO: 65822 - RNA, 22 nt, Homo sapiens
uguaaaaagcccagccgcugag

SEQ ID NO: 65823 - RNA, 23 nt, Homo sapiens
uguaaaagcauuugucagccugg

SEQ ID NO: 65824 - RNA, 22 nt, Homo sapiens
uguaaaccauauauguauguag

SEQ ID NO: 65825 - RNA, 22 nt, Homo sapiens
uguaaaccucugaguacaagcu

SEQ ID NO: 65826 - RNA, 22 nt, Homo sapiens
uguaaacuaugagcugauuauu

SEQ ID NO: 65827 - RNA, 22 nt, Homo sapiens
uguaacacacacuguuuacucc

SEQ ID NO: 65828 - RNA, 22 nt, Homo sapiens
uguaacaggaggaaaaugugaa

SEQ ID NO: 65829 - RNA, 22 nt, Homo sapiens
uguaaccauccagagucccagg

SEQ ID NO: 65830 - RNA, 22 nt, Homo sapiens
uguaacugcuuagaagguuuua

SEQ ID NO: 65831 - RNA, 22 nt, Homo sapiens
uguaagcagcagagacuauccu

SEQ ID NO: 65832 - RNA, 22 nt, Homo sapiens
uguaauaguaggcucacauuug

SEQ ID NO: 65833 - RNA, 22 nt, Homo sapiens
uguaauguuucaucauuauuaa

SEQ ID NO: 65834 - RNA, 22 nt, Homo sapiens
uguaauguuugguagguuaggu

SEQ ID NO: 65835 - RNA, 22 nt, Homo sapiens
uguacaaaacaagaugggggua

SEQ ID NO: 65836 - RNA, 22 nt, Homo sapiens
uguacaaauuucugugguggug

SEQ ID NO: 65837 - RNA, 20 nt, Homo sapiens
uguacacaguguacccacau

SEQ ID NO: 65838 - RNA, 22 nt, Homo sapiens
uguacacauaugugggguacau

SEQ ID NO: 65839 - RNA, 19 nt, Homo sapiens
uguaccagcaagucuuuuc

SEQ ID NO: 65840 - RNA, 22 nt, Homo sapiens
uguagauaucauuagugcugug

SEQ ID NO: 65841 - RNA, 22 nt, Homo sapiens
uguagcaaaucgauacuauugg

SEQ ID NO: 65842 - RNA, 18 nt, Homo sapiens
uguagcaccuuucuugug

SEQ ID NO: 65843 - RNA, 21 nt, Homo sapiens
uguagcagcauaauuuauaau

SEQ ID NO: 65844 - RNA, 22 nt, Homo sapiens
uguagguguacauacaugguua

SEQ ID NO: 65845 - RNA, 22 nt, Homo sapiens
uguauagaucugauucaucucc

SEQ ID NO: 65846 - RNA, 22 nt, Homo sapiens
uguauaggcaaauuuccucaug

SEQ ID NO: 65847 - RNA, 21 nt, Homo sapiens
uguauauguuuauacacacac

SEQ ID NO: 65848 - RNA, 22 nt, Homo sapiens
uguauauguuuguacauauguc

SEQ ID NO: 65849 - RNA, 22 nt, Homo sapiens
uguaugaguuguuuauaaauuu

SEQ ID NO: 65850 - RNA, 22 nt, Homo sapiens
uguauguaauugaaguuaaguu

SEQ ID NO: 65851 - RNA, 22 nt, Homo sapiens
uguaugucugcucuuuggaacu

SEQ ID NO: 65852 - RNA, 22 nt, Homo sapiens
uguauguuuaaggccaguggaa

SEQ ID NO: 65853 - RNA, 16 nt, Homo sapiens
uguauugcuaaaaaga

SEQ ID NO: 65854 - RNA, 22 nt, Homo sapiens
uguauugcuugaagagugaauu

SEQ ID NO: 65855 - RNA, 22 nt, Homo sapiens
uuaacagcacuacguggggauc

SEQ ID NO: 65856 - RNA, 22 nt, Homo sapiens
uuaacagucacuuagcucauuu

SEQ ID NO: 65857 - RNA, 22 nt, Homo sapiens
uuaagaagugauuuuccucauu

SEQ ID NO: 65858 - RNA, 22 nt, Homo sapiens
uuaagagugggaguuggccaca

SEQ ID NO: 65859 - RNA, 22 nt, Homo sapiens
uuaagcaguggauuagaauuuu

SEQ ID NO: 65860 - RNA, 22 nt, Homo sapiens
uuaagccacucaagagauagag

SEQ ID NO: 65861 - RNA, 22 nt, Homo sapiens
uuaaggaguagugucugguauu

SEQ ID NO: 65862 - RNA, 18 nt, Homo sapiens
uuaaggcaggacuuuaag

SEQ ID NO: 65863 - RNA, 22 nt, Homo sapiens
uuaaggcagugcaucuggaguu

SEQ ID NO: 65864 - RNA, 22 nt, Homo sapiens
uuaaggcauucuuugucuucau

SEQ ID NO: 65865 - RNA, 22 nt, Homo sapiens
uuaaggccccgcccauucaggc

SEQ ID NO: 65866 - RNA, 22 nt, Homo sapiens
uuaaggcuccuguuggcuuuua

SEQ ID NO: 65867 - RNA, 22 nt, Homo sapiens
uuaaggguuuuagaauuuucca

SEQ ID NO: 65868 - RNA, 22 nt, Homo sapiens
uuaaggugaaguucucagaugc

SEQ ID NO: 65869 - RNA, 22 nt, Homo sapiens
uuaaguacuucccuguuggaca

SEQ ID NO: 65870 - RNA, 22 nt, Homo sapiens
uuaaguagcugggcaugguggu

SEQ ID NO: 65871 - RNA, 19 nt, Homo sapiens
uuaaguaguuagagggucu

SEQ ID NO: 65872 - RNA, 22 nt, Homo sapiens
uuaagugaauuaucuaacaugu

SEQ ID NO: 65873 - RNA, 19 nt, Homo sapiens
uuaagugugauaucucagu

SEQ ID NO: 65874 - RNA, 22 nt, Homo sapiens
uuaaguuaggcuucagcagucu

SEQ ID NO: 65875 - RNA, 22 nt, Homo sapiens
uuaauaccgucacauggcugaa

SEQ ID NO: 65876 - RNA, 22 nt, Homo sapiens
uuaauacugcuuaacuuuagga

SEQ ID NO: 65877 - RNA, 22 nt, Homo sapiens
uucuugcacugaucccauaagc

SEQ ID NO: 65878 - RNA, 22 nt, Homo sapiens
uucuugguguaguaguugaaaa

SEQ ID NO: 65879 - RNA, 22 nt, Homo sapiens
uucuugguugcucacacccauc

SEQ ID NO: 65880 - RNA, 22 nt, Homo sapiens
uucuugguuuaucgcuuuaaaa

SEQ ID NO: 65881 - RNA, 22 nt, Homo sapiens
uucuuuaguucacuugcuccag

SEQ ID NO: 65882 - RNA, 22 nt, Homo sapiens
uucuuugcaugaucucaaaguc

SEQ ID NO: 65883 - RNA, 22 nt, Homo sapiens
uucuuugguacaagggccgacc

SEQ ID NO: 65884 - RNA, 19 nt, Homo sapiens
uucuuuguugugggggcug

SEQ ID NO: 65885 - RNA, 22 nt, Homo sapiens
uugaaaucuuccacagcccaag

SEQ ID NO: 65886 - RNA, 22 nt, Homo sapiens
uugaacuagaaccugcaaauuu

SEQ ID NO: 65887 - RNA, 22 nt, Homo sapiens
uugaacugguaguuggaaaucu

SEQ ID NO: 65888 - RNA, 22 nt, Homo sapiens
uugaagacuaaguuaucaggau

SEQ ID NO: 65889 - RNA, 22 nt, Homo sapiens
uugaagacuaauuuagauaaug

SEQ ID NO: 65890 - RNA, 22 nt, Homo sapiens
uugaagacuaccuaccauacuu

SEQ ID NO: 65891 - RNA, 22 nt, Homo sapiens
uugaagacuauaugauucuuca

SEQ ID NO: 65892 - RNA, 22 nt, Homo sapiens
uugaagguaauugguuuuauga

SEQ ID NO: 65893 - RNA, 22 nt, Homo sapiens
uugaagguaggaugugcuauca

SEQ ID NO: 65894 - RNA, 22 nt, Homo sapiens
uugaaguaguacuuuauuauag

SEQ ID NO: 65895 - RNA, 22 nt, Homo sapiens
uugaaguauagaguuuaagaac

SEQ ID NO: 65896 - RNA, 22 nt, Homo sapiens
uugaauagaaguguugaaagug

SEQ ID NO: 65897 - RNA, 22 nt, Homo sapiens
uugaauagacagccagcuuuaa

SEQ ID NO: 65898 - RNA, 17 nt, Homo sapiens
uugaaugcauuacuugg

SEQ ID NO: 65899 - RNA, 22 nt, Homo sapiens
uugaauguaugcuggguuuacu

SEQ ID NO: 65900 - RNA, 22 nt, Homo sapiens
uugaaugucuauuaaguuguuu

SEQ ID NO: 65901 - RNA, 23 nt, Homo sapiens
uugaauguuuccccucccaaauu

SEQ ID NO: 65902 - RNA, 22 nt, Homo sapiens
uugacaaugcacugugcuaagu

SEQ ID NO: 65903 - RNA, 22 nt, Homo sapiens
uugacacuuuguaagaaagggg

SEQ ID NO: 65904 - RNA, 22 nt, Homo sapiens
uugacaggaugcucagggccca

SEQ ID NO: 65905 - RNA, 22 nt, Homo sapiens
uugacaguugggcagggaaguu

SEQ ID NO: 65906 - RNA, 22 nt, Homo sapiens
uugacauaaucauuucacagug

SEQ ID NO: 65907 - RNA, 22 nt, Homo sapiens
uugacauaguuucugaaauaga

SEQ ID NO: 65908 - RNA, 22 nt, Homo sapiens
uugaccaaagaagagucauugc

SEQ ID NO: 65909 - RNA, 22 nt, Homo sapiens
uugaccacugggcacaguaagu

SEQ ID NO: 65910 - RNA, 22 nt, Homo sapiens
uugaccccuucuaauagccuca

SEQ ID NO: 65911 - RNA, 22 nt, Homo sapiens
uugaccucaucacuucccaaag

SEQ ID NO: 65912 - RNA, 22 nt, Homo sapiens
uugaccuggagaguacuuugac

SEQ ID NO: 65913 - RNA, 22 nt, Homo sapiens
uugacguaggaggauguugaga

SEQ ID NO: 65914 - RNA, 22 nt, Homo sapiens
uugacuuagacauucaguugga

SEQ ID NO: 65915 - RNA, 22 nt, Homo sapiens
uugagaaucuuucgaauguucu

SEQ ID NO: 65916 - RNA, 22 nt, Homo sapiens
uugagacggaguuuugcucuug

SEQ ID NO: 65917 - RNA, 22 nt, Homo sapiens
uugagagaaaaaauuuauuggu

SEQ ID NO: 65918 - RNA, 22 nt, Homo sapiens
uugagagcugaugaaagauaaa

SEQ ID NO: 65919 - RNA, 17 nt, Homo sapiens
uugagaguauaucuuac

SEQ ID NO: 65920 - RNA, 22 nt, Homo sapiens
uugagauaggagcuguuguucu

SEQ ID NO: 65921 - RNA, 22 nt, Homo sapiens
uugagaucuacuacuguaggag

SEQ ID NO: 65922 - RNA, 20 nt, Homo sapiens
uugagaucuguaucugguuu

SEQ ID NO: 65923 - RNA, 22 nt, Homo sapiens
uugagaucuugauauguuugaa

SEQ ID NO: 65924 - RNA, 22 nt, Homo sapiens
uugagauggaaucucgcuuugu

SEQ ID NO: 65925 - RNA, 22 nt, Homo sapiens
uugagauggagcuucacucuug

SEQ ID NO: 65926 - RNA, 22 nt, Homo sapiens
uugagauggagucucacuccuu

SEQ ID NO: 65927 - RNA, 22 nt, Homo sapiens
uugagauggagucucacucugc

SEQ ID NO: 65928 - RNA, 22 nt, Homo sapiens
uugagauggagucucacucugu

SEQ ID NO: 65929 - RNA, 22 nt, Homo sapiens
uugagauggagucucacucuuu

SEQ ID NO: 65930 - RNA, 22 nt, Homo sapiens
uugagauggagucucgcugugu

SEQ ID NO: 65931 - RNA, 22 nt, Homo sapiens
uugagauggaguuucgcucuug

SEQ ID NO: 65932 - RNA, 22 nt, Homo sapiens
uugagauggugccacuguacuc

SEQ ID NO: 65933 - RNA, 22 nt, Homo sapiens
uugagauguggcaguuuaugag

SEQ ID NO: 65934 - RNA, 22 nt, Homo sapiens
uugagauguggguuggugacuu

SEQ ID NO: 65935 - RNA, 21 nt, Homo sapiens
uugagcaacuaggguuauagg

SEQ ID NO: 65936 - RNA, 22 nt, Homo sapiens
uugagcaauccuccugccaugu

SEQ ID NO: 65937 - RNA, 22 nt, Homo sapiens
uugagcaaugucacugaggcuu

SEQ ID NO: 65938 - RNA, 22 nt, Homo sapiens
uugagcuauguacagaugcugu

SEQ ID NO: 65939 - RNA, 22 nt, Homo sapiens
uugagcucaucuucagggguga

SEQ ID NO: 65940 - RNA, 22 nt, Homo sapiens
uugaggaggcagucucuccauu

SEQ ID NO: 65941 - RNA, 22 nt, Homo sapiens
uugaggaggcagucugcccauu

SEQ ID NO: 65942 - RNA, 22 nt, Homo sapiens
uugaggaguacugauuagguau

SEQ ID NO: 65943 - RNA, 22 nt, Homo sapiens
uugaggaucauuguuuucggag

SEQ ID NO: 65944 - RNA, 22 nt, Homo sapiens
uugaggccugauaacacacuga

SEQ ID NO: 65945 - RNA, 22 nt, Homo sapiens
uugagggaagccagaggucugc

SEQ ID NO: 65946 - RNA, 22 nt, Homo sapiens
uugagggagcauuuguuuugag

SEQ ID NO: 65947 - RNA, 21 nt, Homo sapiens
uugagguaaaauccuauggga

SEQ ID NO: 65948 - RNA, 22 nt, Homo sapiens
uugaggucuuugagcaaacgca

SEQ ID NO: 65949 - RNA, 22 nt, Homo sapiens
uugagguguauuguacagcaca

SEQ ID NO: 65950 - RNA, 22 nt, Homo sapiens
uugaguaguaagaagaugauag

SEQ ID NO: 65951 - RNA, 22 nt, Homo sapiens
uugaguaguaagugguucaccg

SEQ ID NO: 65952 - RNA, 22 nt, Homo sapiens
uugagugaaggcuguguucuug

SEQ ID NO: 65953 - RNA, 22 nt, Homo sapiens
uugagugaaugaaugauuaaau

SEQ ID NO: 65954 - RNA, 22 nt, Homo sapiens
uugauaacauucugcauccuau

SEQ ID NO: 65955 - RNA, 22 nt, Homo sapiens
uugauagacaucugaguuguug

SEQ ID NO: 65956 - RNA, 22 nt, Homo sapiens
uugauauggcugcuuaccauaa

SEQ ID NO: 65957 - RNA, 22 nt, Homo sapiens
uugauauguggaauauuuaucu

SEQ ID NO: 65958 - RNA, 22 nt, Homo sapiens
uugauauguguauagcaugugg

SEQ ID NO: 65959 - RNA, 22 nt, Homo sapiens
uugauauuaaguacugaagugg

SEQ ID NO: 65960 - RNA, 22 nt, Homo sapiens
uugaucuguguuagaagcuaag

SEQ ID NO: 65961 - RNA, 22 nt, Homo sapiens
uugauguugaggacauaaaccu

SEQ ID NO: 65962 - RNA, 22 nt, Homo sapiens
uggcauggucugcccaaguuuc

SEQ ID NO: 65963 - RNA, 22 nt, Homo sapiens
uggcaugucagguuucuggguu

SEQ ID NO: 65964 - RNA, 22 nt, Homo sapiens
uggcauguuggguguugacucc

SEQ ID NO: 65965 - RNA, 22 nt, Homo sapiens
uggcauuguccaauaaaauuuu

SEQ ID NO: 65966 - RNA, 22 nt, Homo sapiens
uggcauuuuguuuuagaauuag

SEQ ID NO: 65967 - RNA, 22 nt, Homo sapiens
uggccaagagcacagauauugg

SEQ ID NO: 65968 - RNA, 23 nt, Homo sapiens
uggccagaaacuucuuuucaucc

SEQ ID NO: 65969 - RNA, 22 nt, Homo sapiens
uggccagugucuauugguuucc

SEQ ID NO: 65970 - RNA, 22 nt, Homo sapiens
uggccaguguuuuuccugggcu

SEQ ID NO: 65971 - RNA, 22 nt, Homo sapiens
uggccuguaacccucucauagg

SEQ ID NO: 65972 - RNA, 22 nt, Homo sapiens
uggcgagaaucacauucuaauu

SEQ ID NO: 65973 - RNA, 22 nt, Homo sapiens
uggcgagcugaaauuauaaaag

SEQ ID NO: 65974 - RNA, 20 nt, Homo sapiens
uggcuaaaugaaugauagca

SEQ ID NO: 65975 - RNA, 22 nt, Homo sapiens
uggcuacugaccugcuaggggg

SEQ ID NO: 65976 - RNA, 22 nt, Homo sapiens
uggcucauuucuaaacccagcu

SEQ ID NO: 65977 - RNA, 22 nt, Homo sapiens
uggcucuguuuguuaacuagac

SEQ ID NO: 65978 - RNA, 22 nt, Homo sapiens
uggcucuuucuagacuuaauua

SEQ ID NO: 65979 - RNA, 22 nt, Homo sapiens
uggcuguuuauuucacaugggu

SEQ ID NO: 65980 - RNA, 22 nt, Homo sapiens
uggcuguuuauuucaccugggc

SEQ ID NO: 65981 - RNA, 22 nt, Homo sapiens
uggcuguuuauuucaccugggu

SEQ ID NO: 65982 - RNA, 20 nt, Homo sapiens
uggcuucuuaauugcaggca

SEQ ID NO: 65983 - RNA, 22 nt, Homo sapiens
uggcuuuuaucuacucucaacu

SEQ ID NO: 65984 - RNA, 22 nt, Homo sapiens
uggcuuuuccaggcauuacgau

SEQ ID NO: 65985 - RNA, 22 nt, Homo sapiens
ugggaaauguagccuagcugug

SEQ ID NO: 65986 - RNA, 22 nt, Homo sapiens
ugggaacugaggugaaaagaca

SEQ ID NO: 65987 - RNA, 22 nt, Homo sapiens
ugggaagaagguuuacuugcca

SEQ ID NO: 65988 - RNA, 22 nt, Homo sapiens
ugggaagagggagcgauuuugg

SEQ ID NO: 65989 - RNA, 22 nt, Homo sapiens
ugggaagauucuguguuuuucc

SEQ ID NO: 65990 - RNA, 22 nt, Homo sapiens
ucuuugguuguuuagggugcau

SEQ ID NO: 65991 - RNA, 22 nt, Homo sapiens
ucuuugguuucugucucuguaa

SEQ ID NO: 65992 - RNA, 22 nt, Homo sapiens
ucuuuguugcauaggcuuguuc

SEQ ID NO: 65993 - RNA, 22 nt, Homo sapiens
ucuuuguuuucugauccugaag

SEQ ID NO: 65994 - RNA, 22 nt, Homo sapiens
ucuuuugugagucagccucucc

SEQ ID NO: 65995 - RNA, 22 nt, Homo sapiens
ucuuuuguucuauucaggccuu

SEQ ID NO: 65996 - RNA, 22 nt, Homo sapiens
ugaaaagucuaagauuaagguu

SEQ ID NO: 65997 - RNA, 22 nt, Homo sapiens
ugaaacacacagagaagggaga

SEQ ID NO: 65998 - RNA, 20 nt, Homo sapiens
ugaaacacauggacuggggu

SEQ ID NO: 65999 - RNA, 22 nt, Homo sapiens
ugaaagguauagguucuggagg

SEQ ID NO: 66000 - RNA, 22 nt, Homo sapiens
ugaaaguaauugcaguuuuuac

SEQ ID NO: 66001 - RNA, 22 nt, Homo sapiens
ugaaaguuauauugugaaauuc

SEQ ID NO: 66002 - RNA, 22 nt, Homo sapiens
ugaaauacuuaauuucuccaug

SEQ ID NO: 66003 - RNA, 22 nt, Homo sapiens
ugaaauacuuuggcucuuuguu

SEQ ID NO: 66004 - RNA, 22 nt, Homo sapiens
ugaaaucuaaaauguuccaaga

SEQ ID NO: 66005 - RNA, 22 nt, Homo sapiens
ugaaaugccuuuaaugaauuua

SEQ ID NO: 66006 - RNA, 22 nt, Homo sapiens
ugaaaugcugucuaggggaaau

SEQ ID NO: 66007 - RNA, 22 nt, Homo sapiens
ugaaaugucuuuaggaggcuuc

SEQ ID NO: 66008 - RNA, 16 nt, Homo sapiens
ugaacagagaggauuc

SEQ ID NO: 66009 - RNA, 21 nt, Homo sapiens
ugaaccccugcucucaagaaa

SEQ ID NO: 66010 - RNA, 22 nt, Homo sapiens
ugaacugagacuagacuuguuc

SEQ ID NO: 66011 - RNA, 20 nt, Homo sapiens
ugaacugguuacuuucuguc

SEQ ID NO: 66012 - RNA, 22 nt, Homo sapiens
ugaagacauuuuugggugugua

SEQ ID NO: 66013 - RNA, 22 nt, Homo sapiens
ugaagacucauacuugaaucag

SEQ ID NO: 66014 - RNA, 22 nt, Homo sapiens
ugaagcuuguuucuguaccuuu

SEQ ID NO: 66015 - RNA, 22 nt, Homo sapiens
ugaaggacauaaggcagaguga

SEQ ID NO: 66016 - RNA, 22 nt, Homo sapiens
ugaaggacauucuaugguagau

SEQ ID NO: 66017 - RNA, 22 nt, Homo sapiens
ugaaggaguauggauaagucgu

SEQ ID NO: 66018 - RNA, 22 nt, Homo sapiens
ugaaggccgggcaugguggcuc

SEQ ID NO: 66019 - RNA, 22 nt, Homo sapiens
ugaaguguuuauuuuggccuuc

SEQ ID NO: 66020 - RNA, 22 nt, Homo sapiens
ugaaguguuuuuucaggcaugu

SEQ ID NO: 66021 - RNA, 22 nt, Homo sapiens
ugaauacugugcaaaggauuug

SEQ ID NO: 66022 - RNA, 22 nt, Homo sapiens
ugaauaguuugacagaacucuu

SEQ ID NO: 66023 - RNA, 22 nt, Homo sapiens
ugaauauagacagggguagaga

SEQ ID NO: 66024 - RNA, 22 nt, Homo sapiens
ugaauauguuucuaaaagugca

SEQ ID NO: 66025 - RNA, 22 nt, Homo sapiens
ugaaugcaucauguagggcuca

SEQ ID NO: 66026 - RNA, 22 nt, Homo sapiens
ugaaugcuucaugucugggcug

SEQ ID NO: 66027 - RNA, 21 nt, Homo sapiens
ugaaugcuuuaaauauuagaa

SEQ ID NO: 66028 - RNA, 22 nt, Homo sapiens
ugaauguaagaugucugcuggu

SEQ ID NO: 66029 - RNA, 22 nt, Homo sapiens
ugaauguacuuaacacuggauu

SEQ ID NO: 66030 - RNA, 21 nt, Homo sapiens
ugaaugucuaggcagaaguuu

SEQ ID NO: 66031 - RNA, 22 nt, Homo sapiens
ugaaugugauggguuucaugug

SEQ ID NO: 66032 - RNA, 22 nt, Homo sapiens
ugaauguuugcagcuuauacca

SEQ ID NO: 66033 - RNA, 23 nt, Homo sapiens
ugacaaccucaugcuuugucaug

SEQ ID NO: 66034 - RNA, 20 nt, Homo sapiens
ugacaaggugcaaagaauca

SEQ ID NO: 66035 - RNA, 18 nt, Homo sapiens
ugacaaugcuaguccugg

SEQ ID NO: 66036 - RNA, 22 nt, Homo sapiens
ugacacagcaagauggaaccau

SEQ ID NO: 66037 - RNA, 18 nt, Homo sapiens
ugacagcacaugugggga

SEQ ID NO: 66038 - RNA, 23 nt, Homo sapiens
ugacagucucccgauggcuaggc

SEQ ID NO: 66039 - RNA, 22 nt, Homo sapiens
ugacagugaauaagucucuuaa

SEQ ID NO: 66040 - RNA, 23 nt, Homo sapiens
ugacagugcuugaaauugcucuu

SEQ ID NO: 66041 - RNA, 22 nt, Homo sapiens
ugacaguguccuccuccugaga

SEQ ID NO: 66042 - RNA, 22 nt, Homo sapiens
ugacagugugagacuuugucuc

SEQ ID NO: 66043 - RNA, 22 nt, Homo sapiens
ugacaugaaggcaccucugucc

SEQ ID NO: 66044 - RNA, 22 nt, Homo sapiens
ugacaugaagucucccucuguu

SEQ ID NO: 66045 - RNA, 22 nt, Homo sapiens
ugacauggagguggaggaagau

SEQ ID NO: 66046 - RNA, 22 nt, Homo sapiens
ugacauggugcucuuucaggca

SEQ ID NO: 66047 - RNA, 22 nt, Homo sapiens
ugaccacugucuaagauaggug

SEQ ID NO: 66048 - RNA, 22 nt, Homo sapiens
ugaccucugauagcaguaggug

SEQ ID NO: 66049 - RNA, 22 nt, Homo sapiens
ugacuaaaacugaguuucauua

SEQ ID NO: 66050 - RNA, 22 nt, Homo sapiens
ugacuagagcaauuggaaacaa

SEQ ID NO: 66051 - RNA, 22 nt, Homo sapiens
ugacuagcagagugagaaacuc

SEQ ID NO: 66052 - RNA, 22 nt, Homo sapiens
ugacuagcgauccccuuucuag

SEQ ID NO: 66053 - RNA, 22 nt, Homo sapiens
ugacuauaggauaacaugcauu

SEQ ID NO: 66054 - RNA, 22 nt, Homo sapiens
ugacuauaucucuguauaaacu

SEQ ID NO: 66055 - RNA, 22 nt, Homo sapiens
ugacucaagagccugacucauc

SEQ ID NO: 66056 - RNA, 22 nt, Homo sapiens
ugacucaguuucucagguagua

SEQ ID NO: 66057 - RNA, 22 nt, Homo sapiens
ugacuggaaacaguguuauuug

SEQ ID NO: 66058 - RNA, 22 nt, Homo sapiens
ugcacuguggucugagagacag

SEQ ID NO: 66059 - RNA, 22 nt, Homo sapiens
ugcagauucguuuugaggggua

SEQ ID NO: 66060 - RNA, 22 nt, Homo sapiens
ugcagcacugaacuucugggcu

SEQ ID NO: 66061 - RNA, 22 nt, Homo sapiens
ugcagcauugcacuccagccug

SEQ ID NO: 66062 - RNA, 23 nt, Homo sapiens
ugcagcuacauguggccaugugc

SEQ ID NO: 66063 - RNA, 22 nt, Homo sapiens
ugcagcucaaauuccuaacaag

SEQ ID NO: 66064 - RNA, 18 nt, Homo sapiens
ugcagcuuugugauuggc

SEQ ID NO: 66065 - RNA, 22 nt, Homo sapiens
ugcagguacuugacaacuuggg

SEQ ID NO: 66066 - RNA, 22 nt, Homo sapiens
ugcagguaggcaguaucauuua

SEQ ID NO: 66067 - RNA, 22 nt, Homo sapiens
ugcaguacauucagcauccucu

SEQ ID NO: 66068 - RNA, 22 nt, Homo sapiens
ugcaguaggcccagcgggaggc

SEQ ID NO: 66069 - RNA, 22 nt, Homo sapiens
ugcaguagugugaucuuggcuc

SEQ ID NO: 66070 - RNA, 22 nt, Homo sapiens
ugcagugcaugacuguguuaug

SEQ ID NO: 66071 - RNA, 20 nt, Homo sapiens
ugcaguguccucacuuguca

SEQ ID NO: 66072 - RNA, 22 nt, Homo sapiens
ugcagugugcuggggucuccau

SEQ ID NO: 66073 - RNA, 21 nt, Homo sapiens
ugcauacuucucagaugauua

SEQ ID NO: 66074 - RNA, 22 nt, Homo sapiens
ugcauagcauauauuguagagu

SEQ ID NO: 66075 - RNA, 17 nt, Homo sapiens
ugcauagugggaggaga

SEQ ID NO: 66076 - RNA, 21 nt, Homo sapiens
ugcauaucucuaaugaccagu

SEQ ID NO: 66077 - RNA, 22 nt, Homo sapiens
ugcauaucuucuuuugagaaau

SEQ ID NO: 66078 - RNA, 22 nt, Homo sapiens
ugcauaucuuguggaauaucuc

SEQ ID NO: 66079 - RNA, 22 nt, Homo sapiens
ugcauauguauacaugugccau

SEQ ID NO: 66080 - RNA, 18 nt, Homo sapiens
ugcauauguugaaccagc

SEQ ID NO: 66081 - RNA, 22 nt, Homo sapiens
ugcauauguugaaccagccuug

SEQ ID NO: 66082 - RNA, 22 nt, Homo sapiens
ugcauauucaaggcaggccauu

SEQ ID NO: 66083 - RNA, 22 nt, Homo sapiens
ugcaugcaucuuuuauaguagc

SEQ ID NO: 66084 - RNA, 22 nt, Homo sapiens
ugcauggaagggagggaaagag

SEQ ID NO: 66085 - RNA, 22 nt, Homo sapiens
ugcauggaggagcuccccgcag

SEQ ID NO: 66086 - RNA, 21 nt, Homo sapiens
ugcaugguagucacaugauuc

SEQ ID NO: 66087 - RNA, 22 nt, Homo sapiens
ugcauuaguaaguaauuuuaau

SEQ ID NO: 66088 - RNA, 22 nt, Homo sapiens
ugcauugcacuugcaugagaua

SEQ ID NO: 66089 - RNA, 22 nt, Homo sapiens
ugcauuguaggauguuuagcag

SEQ ID NO: 66090 - RNA, 22 nt, Homo sapiens
ugcauuguauuguugacucgcc

SEQ ID NO: 66091 - RNA, 19 nt, Homo sapiens
ugccaagaaagucagcuua

SEQ ID NO: 66092 - RNA, 22 nt, Homo sapiens
ugccaaggagucagucccuaga

SEQ ID NO: 66093 - RNA, 22 nt, Homo sapiens
ugccagaugcuggugugagggg

SEQ ID NO: 66094 - RNA, 22 nt, Homo sapiens
ugccaguauuuuacugaggauu

SEQ ID NO: 66095 - RNA, 22 nt, Homo sapiens
ugccaguauuuuauugaggauu

SEQ ID NO: 66096 - RNA, 22 nt, Homo sapiens
ugccaguauuuuguugaggauu

SEQ ID NO: 66097 - RNA, 22 nt, Homo sapiens
ugccauagagacucaacagccu

SEQ ID NO: 66098 - RNA, 22 nt, Homo sapiens
ugccaucauuaauauuaggcau

SEQ ID NO: 66099 - RNA, 19 nt, Homo sapiens
ugccauguagcacaugguc

SEQ ID NO: 66100 - RNA, 22 nt, Homo sapiens
ugccaugucauagguuaagccu

SEQ ID NO: 66101 - RNA, 22 nt, Homo sapiens
ugcccuuugucagaugaguagg

SEQ ID NO: 66102 - RNA, 22 nt, Homo sapiens
ugccuacugaauuuaccuggcu

SEQ ID NO: 66103 - RNA, 23 nt, Homo sapiens
ugccuagaugcugcccugggaca

SEQ ID NO: 66104 - RNA, 22 nt, Homo sapiens
ugccuaggcuggaaugcaaugg

SEQ ID NO: 66105 - RNA, 22 nt, Homo sapiens
ugccuaggcuggaguguagugg

SEQ ID NO: 66106 - RNA, 22 nt, Homo sapiens
ugccuaguggccuuaugaguau

SEQ ID NO: 66107 - RNA, 22 nt, Homo sapiens
ugccugagcccagcccuguagu

SEQ ID NO: 66108 - RNA, 22 nt, Homo sapiens
ugccuuauuccaacugagcucu

SEQ ID NO: 66109 - RNA, 22 nt, Homo sapiens
ugcgccauugaacuccuccugg

SEQ ID NO: 66110 - RNA, 22 nt, Homo sapiens
ugcgccauugcacuccagucuu

SEQ ID NO: 66111 - RNA, 22 nt, Homo sapiens
ugcguucauuuggccaguggcg

SEQ ID NO: 66112 - RNA, 22 nt, Homo sapiens
ugcuagagaaauauauuugggg

SEQ ID NO: 66113 - RNA, 22 nt, Homo sapiens
ugcuagaugaaguuugaguuuu

SEQ ID NO: 66114 - RNA, 18 nt, Homo sapiens
ugcuaugagauuauuuua

SEQ ID NO: 66115 - RNA, 22 nt, Homo sapiens
ugcuauguaacacauuaccuuu

SEQ ID NO: 66116 - RNA, 22 nt, Homo sapiens
ugcuaugucagccaggcugguc

SEQ ID NO: 66117 - RNA, 21 nt, Homo sapiens
ugcuccauuuucuagccugaa

SEQ ID NO: 66118 - RNA, 23 nt, Homo sapiens
ugcucgguguugacagucacauc

SEQ ID NO: 66119 - RNA, 22 nt, Homo sapiens
ugcugcacaguucuuaagauua

SEQ ID NO: 66120 - RNA, 21 nt, Homo sapiens
ugcugcacuucuuuugcugug

SEQ ID NO: 66121 - RNA, 22 nt, Homo sapiens
ugcugcuguuguuguuacuagc

SEQ ID NO: 66122 - RNA, 22 nt, Homo sapiens
ucuguggucagcauccgccacu

SEQ ID NO: 66123 - RNA, 22 nt, Homo sapiens
ucugugguucaaaccagcaacu

SEQ ID NO: 66124 - RNA, 22 nt, Homo sapiens
ucugugguuguugcauggaaug

SEQ ID NO: 66125 - RNA, 22 nt, Homo sapiens
ucuguguugaucacacugggag

SEQ ID NO: 66126 - RNA, 22 nt, Homo sapiens
ucuuagugcggcugcugcagcc

SEQ ID NO: 66127 - RNA, 22 nt, Homo sapiens
ucuuaguuugggguggggauag

SEQ ID NO: 66128 - RNA, 22 nt, Homo sapiens
ucuucagucauauuggccugga

SEQ ID NO: 66129 - RNA, 22 nt, Homo sapiens
ucuugcacacaguaaguguuuu

SEQ ID NO: 66130 - RNA, 19 nt, Homo sapiens
ucuugcacaugugaacuca

SEQ ID NO: 66131 - RNA, 22 nt, Homo sapiens
ucuugcaguucccaaauucaca

SEQ ID NO: 66132 - RNA, 22 nt, Homo sapiens
ucuugccacuucauccccuuuc

SEQ ID NO: 66133 - RNA, 22 nt, Homo sapiens
ucuugguaaugucacauuuccu

SEQ ID NO: 66134 - RNA, 23 nt, Homo sapiens
ucuuguacuuugagugagcaugg

SEQ ID NO: 66135 - RNA, 17 nt, Homo sapiens
ucuugugguucuugaau

SEQ ID NO: 66136 - RNA, 22 nt, Homo sapiens
ucuuuagguguuauaguucaag

SEQ ID NO: 66137 - RNA, 19 nt, Homo sapiens
ucuuuagucacauuuuuau

SEQ ID NO: 66138 - RNA, 15 nt, Homo sapiens
ucuuuaguuuuucuu

SEQ ID NO: 66139 - RNA, 22 nt, Homo sapiens
ucuuucacuuagcaugauguuu

SEQ ID NO: 66140 - RNA, 22 nt, Homo sapiens
ucuuugaguuauugugcagacu

SEQ ID NO: 66141 - RNA, 22 nt, Homo sapiens
ucuuugauuaugcagauggguu

SEQ ID NO: 66142 - RNA, 22 nt, Homo sapiens
ucuuugauuuuguuacuaagac

SEQ ID NO: 66143 - RNA, 19 nt, Homo sapiens
ucuuugcuuuucuaagagg

SEQ ID NO: 66144 - RNA, 22 nt, Homo sapiens
ucuuuggauggaaauuggaguc

SEQ ID NO: 66145 - RNA, 22 nt, Homo sapiens
ucuuuggcugugaagaauaaug

SEQ ID NO: 66146 - RNA, 22 nt, Homo sapiens
ucuuuggguguauuucacagcc

SEQ ID NO: 66147 - RNA, 22 nt, Homo sapiens
ucuuugguaugugcaugugcuu

SEQ ID NO: 66148 - RNA, 22 nt, Homo sapiens
ucuuuggucagaaagauuacac

SEQ ID NO: 66149 - RNA, 22 nt, Homo sapiens
ucuuuggucuacuuucauaugu

SEQ ID NO: 66150 - RNA, 22 nt, Homo sapiens
ucuuuggugaauggucauccag

SEQ ID NO: 66151 - RNA, 22 nt, Homo sapiens
ucuuugguucugugcagccuau

SEQ ID NO: 66152 - RNA, 22 nt, Homo sapiens
uaccugagcccucugcugaguu

SEQ ID NO: 66153 - RNA, 22 nt, Homo sapiens
uaccuguagcucuucuaggcug

SEQ ID NO: 66154 - RNA, 23 nt, Homo sapiens
uacuacacuuuucccaagguuuu

SEQ ID NO: 66155 - RNA, 22 nt, Homo sapiens
uacuagaggaauugcuauaacu

SEQ ID NO: 66156 - RNA, 22 nt, Homo sapiens
uacuagaguagugcagagggga

SEQ ID NO: 66157 - RNA, 23 nt, Homo sapiens
uacuaguaagcguguucuuugca

SEQ ID NO: 66158 - RNA, 22 nt, Homo sapiens
uacucaguagacacucauaugu

SEQ ID NO: 66159 - RNA, 22 nt, Homo sapiens
uacucagugacugguggaucaa

SEQ ID NO: 66160 - RNA, 22 nt, Homo sapiens
uacucugcaguaauuccagccc

SEQ ID NO: 66161 - RNA, 22 nt, Homo sapiens
uacugagagaggaauauugaaa

SEQ ID NO: 66162 - RNA, 22 nt, Homo sapiens
uacugcacuccacccuggguga

SEQ ID NO: 66163 - RNA, 19 nt, Homo sapiens
uacugcacuccagucuggg

SEQ ID NO: 66164 - RNA, 22 nt, Homo sapiens
uacugcacucuagccuggguga

SEQ ID NO: 66165 - RNA, 22 nt, Homo sapiens
uacugcacuggaggccucagau

SEQ ID NO: 66166 - RNA, 22 nt, Homo sapiens
uacugcauucuccgccuccggg

SEQ ID NO: 66167 - RNA, 22 nt, Homo sapiens
uacugcauuucacuguuaaaga

SEQ ID NO: 66168 - RNA, 22 nt, Homo sapiens
uacugcuuaaaagucaauuacu

SEQ ID NO: 66169 - RNA, 22 nt, Homo sapiens
uacugguuuuauauauuucucc

SEQ ID NO: 66170 - RNA, 22 nt, Homo sapiens
uacugguuuuggugggcaggug

SEQ ID NO: 66171 - RNA, 22 nt, Homo sapiens
uacuguacugcaguucugcaaa

SEQ ID NO: 66172 - RNA, 22 nt, Homo sapiens
uacuguguaguuagaccucaga

SEQ ID NO: 66173 - RNA, 22 nt, Homo sapiens
uacuuuguagagugugagaauu

SEQ ID NO: 66174 - RNA, 22 nt, Homo sapiens
uagaagcuacucuucuuguggc

SEQ ID NO: 66175 - RNA, 18 nt, Homo sapiens
uagaauauaggucauucu

SEQ ID NO: 66176 - RNA, 22 nt, Homo sapiens
uagaaugaaacaagcugugccu

SEQ ID NO: 66177 - RNA, 22 nt, Homo sapiens
uagaaugcauuagguugcccag

SEQ ID NO: 66178 - RNA, 22 nt, Homo sapiens
uagaauguaacaguuaaaagca

SEQ ID NO: 66179 - RNA, 22 nt, Homo sapiens
uagaauguaacuuccaugucau

SEQ ID NO: 66180 - RNA, 22 nt, Homo sapiens
uagacacuagauaugugacuga

SEQ ID NO: 66181 - RNA, 22 nt, Homo sapiens
uagaccaauuggcauauaguaa

SEQ ID NO: 66182 - RNA, 22 nt, Homo sapiens
uagaccauucuauuuccuaugc

SEQ ID NO: 66183 - RNA, 22 nt, Homo sapiens
uagacccauuacguaguuucca

SEQ ID NO: 66184 - RNA, 22 nt, Homo sapiens
uagacugguuuagcacugaaua

SEQ ID NO: 66185 - RNA, 20 nt, Homo sapiens
uagagagauauggggguucc

SEQ ID NO: 66186 - RNA, 22 nt, Homo sapiens
uagagccauugcagauguuuga

SEQ ID NO: 66187 - RNA, 22 nt, Homo sapiens
uagagcuacagcccucacuguc

SEQ ID NO: 66188 - RNA, 22 nt, Homo sapiens
uagagcuugacacuuuccaugg

SEQ ID NO: 66189 - RNA, 22 nt, Homo sapiens
uagagguagagugacuucccca

SEQ ID NO: 66190 - RNA, 22 nt, Homo sapiens
uagagguagccuacuacacacc

SEQ ID NO: 66191 - RNA, 22 nt, Homo sapiens
uagagguaggucuucgagucuc

SEQ ID NO: 66192 - RNA, 22 nt, Homo sapiens
uagagguauuaacaguagaaga

SEQ ID NO: 66193 - RNA, 22 nt, Homo sapiens
uagaguaguggcgugaucucgg

SEQ ID NO: 66194 - RNA, 22 nt, Homo sapiens
uagauaguaaagccauuagcuu

SEQ ID NO: 66195 - RNA, 22 nt, Homo sapiens
uagaucaacuuugguaagagaa

SEQ ID NO: 66196 - RNA, 22 nt, Homo sapiens
uagaucauauacuugccaugac

SEQ ID NO: 66197 - RNA, 22 nt, Homo sapiens
uagaucuuuaaaaggugcuaga

SEQ ID NO: 66198 - RNA, 21 nt, Homo sapiens
uagaugguguucuagagagaa

SEQ ID NO: 66199 - RNA, 19 nt, Homo sapiens
uagaugucuuugcauagau

SEQ ID NO: 66200 - RNA, 22 nt, Homo sapiens
uagauuaucauucauacaggga

SEQ ID NO: 66201 - RNA, 22 nt, Homo sapiens
uagauuaucccugauuugucca

SEQ ID NO: 66202 - RNA, 22 nt, Homo sapiens
uauuugguagcuauuuugcagu

SEQ ID NO: 66203 - RNA, 22 nt, Homo sapiens
uauuugguuacuugaauagcua

SEQ ID NO: 66204 - RNA, 20 nt, Homo sapiens
uauuugguuauuuccauggu

SEQ ID NO: 66205 - RNA, 22 nt, Homo sapiens
ucaaagacacacaaggagaagg

SEQ ID NO: 66206 - RNA, 22 nt, Homo sapiens
ucaaaguaaagccucaggaugg

SEQ ID NO: 66207 - RNA, 22 nt, Homo sapiens
ucaaagugcuauggcucagguu

SEQ ID NO: 66208 - RNA, 22 nt, Homo sapiens
ucaaaugguccacgugaacauu

SEQ ID NO: 66209 - RNA, 21 nt, Homo sapiens
ucaaauugaaauuaggucauu

SEQ ID NO: 66210 - RNA, 22 nt, Homo sapiens
ucaacacaguuaaauggggaaa

SEQ ID NO: 66211 - RNA, 22 nt, Homo sapiens
ucaacaggucaauugcauagaa

SEQ ID NO: 66212 - RNA, 21 nt, Homo sapiens
ucaacccuugcgucaccaagc

SEQ ID NO: 66213 - RNA, 22 nt, Homo sapiens
ucaacguauuuauauagcagag

SEQ ID NO: 66214 - RNA, 22 nt, Homo sapiens
ucaacugcuugagaucacaaau

SEQ ID NO: 66215 - RNA, 22 nt, Homo sapiens
ucaaggacuacauggggugaaa

SEQ ID NO: 66216 - RNA, 20 nt, Homo sapiens
ucaaggcacgaauaaaaguu

SEQ ID NO: 66217 - RNA, 22 nt, Homo sapiens
ucaaguaauacucccaucuugg

SEQ ID NO: 66218 - RNA, 22 nt, Homo sapiens
ucaaugcaaccuccaccucugg

SEQ ID NO: 66219 - RNA, 22 nt, Homo sapiens
ucaauguaucuccaagaauuga

SEQ ID NO: 66220 - RNA, 22 nt, Homo sapiens
ucaauugcaucaacaguguaca

SEQ ID NO: 66221 - RNA, 22 nt, Homo sapiens
ucacaaggcaggaaugaaaggg

SEQ ID NO: 66222 - RNA, 22 nt, Homo sapiens
ucacaauucucaauuugugaaa

SEQ ID NO: 66223 - RNA, 22 nt, Homo sapiens
ucacacugcaucuguuggaauu

SEQ ID NO: 66224 - RNA, 22 nt, Homo sapiens
ucacagacauugaggggaccuu

SEQ ID NO: 66225 - RNA, 22 nt, Homo sapiens
ucacagaggagaagaccuuuaa

SEQ ID NO: 66226 - RNA, 22 nt, Homo sapiens
ucacagauaaauaaagaugauu

SEQ ID NO: 66227 - RNA, 22 nt, Homo sapiens
ucacagaugcuugacccauuuc

SEQ ID NO: 66228 - RNA, 21 nt, Homo sapiens
ucacagccuaggaccugaaga

SEQ ID NO: 66229 - RNA, 22 nt, Homo sapiens
ucacagccuaguuuuauacauu

SEQ ID NO: 66230 - RNA, 22 nt, Homo sapiens
ucacaguaaauccagaagaaau

SEQ ID NO: 66231 - RNA, 22 nt, Homo sapiens
ucacaguagcaaauguuagaaa

SEQ ID NO: 66232 - RNA, 22 nt, Homo sapiens
ucacaguaucaugggggacaga

SEQ ID NO: 66233 - RNA, 22 nt, Homo sapiens
ucacagucaaaguaaucauaga

SEQ ID NO: 66234 - RNA, 20 nt, Homo sapiens
ucacagucacacauaauccu

SEQ ID NO: 66235 - RNA, 22 nt, Homo sapiens
uaaaugcuugagaugauggaua

SEQ ID NO: 66236 - RNA, 22 nt, Homo sapiens
uaaauggauauugccaucuccu

SEQ ID NO: 66237 - RNA, 21 nt, Homo sapiens
uaaaugucauacaaagcaaug

SEQ ID NO: 66238 - RNA, 22 nt, Homo sapiens
uaacaagagagucagucagucc

SEQ ID NO: 66239 - RNA, 16 nt, Homo sapiens
uaacacaguucccacc

SEQ ID NO: 66240 - RNA, 22 nt, Homo sapiens
uaacaccuugcucugucaauaa

SEQ ID NO: 66241 - RNA, 22 nt, Homo sapiens
uaacagcauuugugucuaguag

SEQ ID NO: 66242 - RNA, 22 nt, Homo sapiens
uaacagucuccucaagguguug

SEQ ID NO: 66243 - RNA, 18 nt, Homo sapiens
uaacagucucucaggauc

SEQ ID NO: 66244 - RNA, 22 nt, Homo sapiens
uaacauagucauauacuugcuu

SEQ ID NO: 66245 - RNA, 23 nt, Homo sapiens
uaacauguuuuuaagggaagcuu

SEQ ID NO: 66246 - RNA, 23 nt, Homo sapiens
uaacauugcaugauuaccugcau

SEQ ID NO: 66247 - RNA, 22 nt, Homo sapiens
uaacccuuaguaucuguggguu

SEQ ID NO: 66248 - RNA, 22 nt, Homo sapiens
uaacucugccuagugacauggu

SEQ ID NO: 66249 - RNA, 22 nt, Homo sapiens
uaacugcaaccucugccugcug

SEQ ID NO: 66250 - RNA, 22 nt, Homo sapiens
uaacugucucaggccaugggcg

SEQ ID NO: 66251 - RNA, 22 nt, Homo sapiens
uaacuucaucauaagucaagaa

SEQ ID NO: 66252 - RNA, 22 nt, Homo sapiens
uaagaauucuguccgguauacu

SEQ ID NO: 66253 - RNA, 23 nt, Homo sapiens
uaagacacuaacuuuaugcuuug

SEQ ID NO: 66254 - RNA, 22 nt, Homo sapiens
uaagacacuuaaaauguuacau

SEQ ID NO: 66255 - RNA, 22 nt, Homo sapiens
uaagacuguguaauuuaugaag

SEQ ID NO: 66256 - RNA, 22 nt, Homo sapiens
uaagacuuuuugggaauauaga

SEQ ID NO: 66257 - RNA, 18 nt, Homo sapiens
uaagaugcagccuauucc

SEQ ID NO: 66258 - RNA, 22 nt, Homo sapiens
uaagcuguguggacuaugccuc

SEQ ID NO: 66259 - RNA, 22 nt, Homo sapiens
uaaggaguagaauaguaaggca

SEQ ID NO: 66260 - RNA, 22 nt, Homo sapiens
uaaggcaaucagucaugguguu

SEQ ID NO: 66261 - RNA, 22 nt, Homo sapiens
uaaggcacccuucugaguagag

SEQ ID NO: 66262 - RNA, 22 nt, Homo sapiens
uaaggcacuacuuuaggcuuuc

SEQ ID NO: 66263 - RNA, 18 nt, Homo sapiens
uaaggcacuauaggcauu

SEQ ID NO: 66264 - RNA, 22 nt, Homo sapiens
uaaggcccauucuaugaagcag

SEQ ID NO: 66265 - RNA, 22 nt, Homo sapiens
uaaggcccgugaguuucauauc

SEQ ID NO: 66266 - RNA, 22 nt, Homo sapiens
uaaggcuuaugguaaaguccug

SEQ ID NO: 66267 - RNA, 22 nt, Homo sapiens
uaaggcuugcuucagucuugaa

SEQ ID NO: 66268 - RNA, 22 nt, Homo sapiens
uaagggacauguguugccuaag

SEQ ID NO: 66269 - RNA, 22 nt, Homo sapiens
uaagguccuuaaauguguaacc

SEQ ID NO: 66270 - RNA, 22 nt, Homo sapiens
uaagguuacaaaggacuucaua

SEQ ID NO: 66271 - RNA, 22 nt, Homo sapiens
uaaguaauugugguuuuugcca

SEQ ID NO: 66272 - RNA, 22 nt, Homo sapiens
uaaguauuuuaauuccuggcau

SEQ ID NO: 66273 - RNA, 23 nt, Homo sapiens
uaagucacacagauuaauuuauu

SEQ ID NO: 66274 - RNA, 22 nt, Homo sapiens
uaagucacuccagguuaaagug

SEQ ID NO: 66275 - RNA, 22 nt, Homo sapiens
uaagugaauguuggcuacugaa

SEQ ID NO: 66276 - RNA, 22 nt, Homo sapiens
uaagugaauuucacuacugagu

SEQ ID NO: 66277 - RNA, 22 nt, Homo sapiens
uaagugcaugauuacaugcaua

SEQ ID NO: 66278 - RNA, 20 nt, Homo sapiens
uaagugcuugaugaaugaac

SEQ ID NO: 66279 - RNA, 20 nt, Homo sapiens
uaagugcuuuauauugauua

SEQ ID NO: 66280 - RNA, 22 nt, Homo sapiens
uaaguguaaugucugaaguuug

SEQ ID NO: 66281 - RNA, 22 nt, Homo sapiens
uaaguugcagguugugauucca

SEQ ID NO: 66282 - RNA, 22 nt, Homo sapiens
gccauugcacucuagccuaggu

SEQ ID NO: 66283 - RNA, 22 nt, Homo sapiens
gcccacuguuaaauuuguuuua

SEQ ID NO: 66284 - RNA, 22 nt, Homo sapiens
gcccuguaguauaguuugaagu

SEQ ID NO: 66285 - RNA, 22 nt, Homo sapiens
gcccuuugugucuggcuggggu

SEQ ID NO: 66286 - RNA, 22 nt, Homo sapiens
gccuagagacuugguaucuugc

SEQ ID NO: 66287 - RNA, 22 nt, Homo sapiens
gccuagauccaaauauggugca

SEQ ID NO: 66288 - RNA, 22 nt, Homo sapiens
gccuagggacaaaccguccgac

SEQ ID NO: 66289 - RNA, 22 nt, Homo sapiens
gccuaguguuaauguguguuca

SEQ ID NO: 66290 - RNA, 22 nt, Homo sapiens
gccucaguuguggccagggauu

SEQ ID NO: 66291 - RNA, 22 nt, Homo sapiens
gccuuuggugacaggcaugugu

SEQ ID NO: 66292 - RNA, 22 nt, Homo sapiens
gcguugcacuccagccugggua

SEQ ID NO: 66293 - RNA, 22 nt, Homo sapiens
gcuaaaugcaugaggcgaugug

SEQ ID NO: 66294 - RNA, 22 nt, Homo sapiens
gcuaaggcagggcaaucauuug

SEQ ID NO: 66295 - RNA, 22 nt, Homo sapiens
gcuagcacauugucaccucuca

SEQ ID NO: 66296 - RNA, 22 nt, Homo sapiens
gcuaugucuguugcucuugggc

SEQ ID NO: 66297 - RNA, 22 nt, Homo sapiens
gcucaugagacaagcaggagua

SEQ ID NO: 66298 - RNA, 22 nt, Homo sapiens
gcuccauuuuccauuucucuaa

SEQ ID NO: 66299 - RNA, 22 nt, Homo sapiens
gcugacacugggcuauagaucu

SEQ ID NO: 66300 - RNA, 22 nt, Homo sapiens
gcugagcuaugccauauaugcc

SEQ ID NO: 66301 - RNA, 22 nt, Homo sapiens
gcugagguucaagaagguuaaa

SEQ ID NO: 66302 - RNA, 22 nt, Homo sapiens
gcugcuguggcagauuggauuc

SEQ ID NO: 66303 - RNA, 22 nt, Homo sapiens
gcugcuguuauucaucagaacu

SEQ ID NO: 66304 - RNA, 22 nt, Homo sapiens
gcugcuguuuaguuucuccugg

SEQ ID NO: 66305 - RNA, 22 nt, Homo sapiens
gcugcuguuucucuuucagcau

SEQ ID NO: 66306 - RNA, 22 nt, Homo sapiens
gcugcuuuugaugacaaaaaca

SEQ ID NO: 66307 - RNA, 22 nt, Homo sapiens
gcuggaauuaacauagaugugc

SEQ ID NO: 66308 - RNA, 22 nt, Homo sapiens
gcuggauguuucaauacaaaua

SEQ ID NO: 66309 - RNA, 22 nt, Homo sapiens
gcugguauuacaggcaugagcc

SEQ ID NO: 66310 - RNA, 22 nt, Homo sapiens
gcuggugaaggcugaaaagugg

SEQ ID NO: 66311 - RNA, 22 nt, Homo sapiens
gcugguguugugaaucaggccg

SEQ ID NO: 66312 - RNA, 19 nt, Homo sapiens
gcugguuguccacucucuc

SEQ ID NO: 66313 - RNA, 22 nt, Homo sapiens
gcuguguugugcccagcaucau

SEQ ID NO: 66314 - RNA, 22 nt, Homo sapiens
guagcaugcaauauuauagaga

SEQ ID NO: 66315 - RNA, 22 nt, Homo sapiens
guaggcacuggcucagcuuauc

SEQ ID NO: 66316 - RNA, 22 nt, Homo sapiens
guagggcaggcugagaaauaua

SEQ ID NO: 66317 - RNA, 22 nt, Homo sapiens
guaguuuaucagaaagaauagg

SEQ ID NO: 66318 - RNA, 22 nt, Homo sapiens
guauacuucugaaaauagcuau

SEQ ID NO: 66319 - RNA, 22 nt, Homo sapiens
guauagaucguagaccaauaaa

SEQ ID NO: 66320 - RNA, 22 nt, Homo sapiens
guauaugccucaguuauagcac

SEQ ID NO: 66321 - RNA, 22 nt, Homo sapiens
guauccugaaguucucagcacu

SEQ ID NO: 66322 - RNA, 22 nt, Homo sapiens
guauggaagucaguuuguuggc

SEQ ID NO: 66323 - RNA, 22 nt, Homo sapiens
guaugugacuggaacaguagga

SEQ ID NO: 66324 - RNA, 22 nt, Homo sapiens
guauuagguuggggcaaaagua

SEQ ID NO: 66325 - RNA, 22 nt, Homo sapiens
guauugacuaucaaucaugugc

SEQ ID NO: 66326 - RNA, 22 nt, Homo sapiens
guauugcuugagcccaggaguu

SEQ ID NO: 66327 - RNA, 19 nt, Homo sapiens
guauuugacuuucuuguuu

SEQ ID NO: 66328 - RNA, 22 nt, Homo sapiens
guauuuggugaugccuccaaac

SEQ ID NO: 66329 - RNA, 22 nt, Homo sapiens
guauuuguugcagcagcacuau

SEQ ID NO: 66330 - RNA, 19 nt, Homo sapiens
gucaaagucgguauucaaa

SEQ ID NO: 66331 - RNA, 22 nt, Homo sapiens
gucaaagugauuguaauuaggu

SEQ ID NO: 66332 - RNA, 22 nt, Homo sapiens
gucaagagaacuuucuaucacu

SEQ ID NO: 66333 - RNA, 22 nt, Homo sapiens
gucacagcuggcauugucugca

SEQ ID NO: 66334 - RNA, 22 nt, Homo sapiens
gucacaguggccagugauguuc

SEQ ID NO: 66335 - RNA, 22 nt, Homo sapiens
gucaccauugagucauuuccuc

SEQ ID NO: 66336 - RNA, 22 nt, Homo sapiens
gucacugagcagaaggaagcga

SEQ ID NO: 66337 - RNA, 22 nt, Homo sapiens
gucacuggcugucuuguaugau

SEQ ID NO: 66338 - RNA, 21 nt, Homo sapiens
gucacuggggcuggauaauuc

SEQ ID NO: 66339 - RNA, 22 nt, Homo sapiens
gucacugugaggaggggccagg

SEQ ID NO: 66340 - RNA, 22 nt, Homo sapiens
gucacuguuuccuauuauauuu

SEQ ID NO: 66341 - RNA, 22 nt, Homo sapiens
gucagaaucucagaugacaacg

SEQ ID NO: 66342 - RNA, 22 nt, Homo sapiens
gucagauaauuugcauccaucu

SEQ ID NO: 66343 - RNA, 22 nt, Homo sapiens
gucagcaaaguucuccugcaga

SEQ ID NO: 66344 - RNA, 22 nt, Homo sapiens
gucagcuuguccagagacucug

SEQ ID NO: 66345 - RNA, 22 nt, Homo sapiens
gucaggaccucgguggcauucu

SEQ ID NO: 66346 - RNA, 22 nt, Homo sapiens
gucaggaugauuuggggaggug

SEQ ID NO: 66347 - RNA, 22 nt, Homo sapiens
gucagugauugauuuaaagacg

SEQ ID NO: 66348 - RNA, 22 nt, Homo sapiens
gucagugcauguaaacauaaaa

SEQ ID NO: 66349 - RNA, 22 nt, Homo sapiens
gucagugcuuuaguucaggaug

SEQ ID NO: 66350 - RNA, 22 nt, Homo sapiens
gucaucaucaguccucugugca

SEQ ID NO: 66351 - RNA, 22 nt, Homo sapiens
gucaugcaggguucgccagccc

SEQ ID NO: 66352 - RNA, 22 nt, Homo sapiens
gucaugggguacuacacauggg

SEQ ID NO: 66353 - RNA, 22 nt, Homo sapiens
gucauggguuaaagguggauac

SEQ ID NO: 66354 - RNA, 22 nt, Homo sapiens
gucaugucugcacauaguaaaa

SEQ ID NO: 66355 - RNA, 22 nt, Homo sapiens
gucauucauucagcaagcacug

SEQ ID NO: 66356 - RNA, 22 nt, Homo sapiens
gucauugcuuaucugcugacgu

SEQ ID NO: 66357 - RNA, 22 nt, Homo sapiens
guccaugagaugaauccacaca

SEQ ID NO: 66358 - RNA, 22 nt, Homo sapiens
guccauuuguuuccagagcacu

SEQ ID NO: 66359 - RNA, 22 nt, Homo sapiens
gucccaguggaaccuccaagcu

SEQ ID NO: 66360 - RNA, 22 nt, Homo sapiens
gucccugugucuuuauguggcc

SEQ ID NO: 66361 - RNA, 22 nt, Homo sapiens
gucguggagucucuggcuugua

SEQ ID NO: 66362 - RNA, 22 nt, Homo sapiens
gucuagaacuucugaccuuagg

SEQ ID NO: 66363 - RNA, 22 nt, Homo sapiens
cucuuggguagauuuugcagag

SEQ ID NO: 66364 - RNA, 22 nt, Homo sapiens
cucuuugcuucuggcaucauug

SEQ ID NO: 66365 - RNA, 22 nt, Homo sapiens
cucuuuggaugccuuaggguua

SEQ ID NO: 66366 - RNA, 19 nt, Homo sapiens
cucuuuggugucucuucuu

SEQ ID NO: 66367 - RNA, 19 nt, Homo sapiens
cugaaacacagagagggcu

SEQ ID NO: 66368 - RNA, 22 nt, Homo sapiens
cugaaagagcauguaacacagu

SEQ ID NO: 66369 - RNA, 22 nt, Homo sapiens
cugaaagguauacgcuuguuau

SEQ ID NO: 66370 - RNA, 22 nt, Homo sapiens
cugaaauguccaucgacugaug

SEQ ID NO: 66371 - RNA, 22 nt, Homo sapiens
cugaagugcuugccacauaaaa

SEQ ID NO: 66372 - RNA, 22 nt, Homo sapiens
cugaagugugaaagucuuuuuu

SEQ ID NO: 66373 - RNA, 22 nt, Homo sapiens
cugaauagagcacacugauggg

SEQ ID NO: 66374 - RNA, 22 nt, Homo sapiens
cugaaucauugguuaugaguac

SEQ ID NO: 66375 - RNA, 22 nt, Homo sapiens
cugaauguucuggauggaagag

SEQ ID NO: 66376 - RNA, 22 nt, Homo sapiens
cugaauguuuucuucuauucug

SEQ ID NO: 66377 - RNA, 22 nt, Homo sapiens
cugacacuucaaaacugccaau

SEQ ID NO: 66378 - RNA, 22 nt, Homo sapiens
cugacagaugacugccacugua

SEQ ID NO: 66379 - RNA, 22 nt, Homo sapiens
cugacaugcagccacugcaccu

SEQ ID NO: 66380 - RNA, 22 nt, Homo sapiens
cugacauggggauccaccuuag

SEQ ID NO: 66381 - RNA, 22 nt, Homo sapiens
cugaccauagacuacucugggc

SEQ ID NO: 66382 - RNA, 22 nt, Homo sapiens
cugacuuuagaacccaaaaagu

SEQ ID NO: 66383 - RNA, 22 nt, Homo sapiens
cugagacuggugauuuaugaag

SEQ ID NO: 66384 - RNA, 22 nt, Homo sapiens
cugagagugguauguuuaagug

SEQ ID NO: 66385 - RNA, 22 nt, Homo sapiens
cugagauacacuaauagucucu

SEQ ID NO: 66386 - RNA, 22 nt, Homo sapiens
cugagaucguggggcugcuguc

SEQ ID NO: 66387 - RNA, 22 nt, Homo sapiens
cugagauuuuuagauccuggcg

SEQ ID NO: 66388 - RNA, 22 nt, Homo sapiens
cugagcaagucauuuuguuaaa

SEQ ID NO: 66389 - RNA, 22 nt, Homo sapiens
cugagcaauauagugagaucuu

SEQ ID NO: 66390 - RNA, 22 nt, Homo sapiens
cuucugauugaaaauggaguag

SEQ ID NO: 66391 - RNA, 22 nt, Homo sapiens
cuucuugagggccugcugggaa

SEQ ID NO: 66392 - RNA, 22 nt, Homo sapiens
cuucuugcuguguccucacaug

SEQ ID NO: 66393 - RNA, 22 nt, Homo sapiens
cuugaacaaagagauuccauua

SEQ ID NO: 66394 - RNA, 22 nt, Homo sapiens
cuugacaaugcuucaggcugaa

SEQ ID NO: 66395 - RNA, 23 nt, Homo sapiens
cuugagacaaaugcgugugugca

SEQ ID NO: 66396 - RNA, 22 nt, Homo sapiens
cuugcacuagugcagaggcgcu

SEQ ID NO: 66397 - RNA, 22 nt, Homo sapiens
cuugcacucagaagauucaguu

SEQ ID NO: 66398 - RNA, 22 nt, Homo sapiens
cuugcauagaguuauugcccuu

SEQ ID NO: 66399 - RNA, 22 nt, Homo sapiens
cuugcauuuuggagaaugcuga

SEQ ID NO: 66400 - RNA, 22 nt, Homo sapiens
cuuggacaccucaugcccaccu

SEQ ID NO: 66401 - RNA, 22 nt, Homo sapiens
cuuggcacgugauagguguuga

SEQ ID NO: 66402 - RNA, 22 nt, Homo sapiens
cuuggcaugaagaauaauuuuu

SEQ ID NO: 66403 - RNA, 22 nt, Homo sapiens
cuuggcuccgacuccccuccaa

SEQ ID NO: 66404 - RNA, 22 nt, Homo sapiens
cuuggcuucuuuauguggcuau

SEQ ID NO: 66405 - RNA, 22 nt, Homo sapiens
cuuggguaagucauuaaaauua

SEQ ID NO: 66406 - RNA, 22 nt, Homo sapiens
cuugguacucugugucccagcu

SEQ ID NO: 66407 - RNA, 22 nt, Homo sapiens
cuugguuacauuuuccuagaaa

SEQ ID NO: 66408 - RNA, 18 nt, Homo sapiens
cuugucaaaucuuuccuc

SEQ ID NO: 66409 - RNA, 19 nt, Homo sapiens
cuugugccugaagcuuggg

SEQ ID NO: 66410 - RNA, 22 nt, Homo sapiens
cuuuagcaaggauauggggaug

SEQ ID NO: 66411 - RNA, 22 nt, Homo sapiens
cuuuagcaauugauuaugccau

SEQ ID NO: 66412 - RNA, 22 nt, Homo sapiens
cuuuaguugucuccucaagggu

SEQ ID NO: 66413 - RNA, 22 nt, Homo sapiens
cuuugauuauaaaaggguguuu

SEQ ID NO: 66414 - RNA, 22 nt, Homo sapiens
cuuugcaaauggccuuuccaag

SEQ ID NO: 66415 - RNA, 22 nt, Homo sapiens
cuuugcacaucucugcuuuccc

SEQ ID NO: 66416 - RNA, 22 nt, Homo sapiens
cuuugcguugaacaaagccaua

SEQ ID NO: 66417 - RNA, 22 nt, Homo sapiens
cuuuggcauuagccuguauaga

SEQ ID NO: 66418 - RNA, 22 nt, Homo sapiens
cuuugggaccgcgguuuauacu

SEQ ID NO: 66419 - RNA, 21 nt, Homo sapiens
cuuugguagaguuuuuagggu

SEQ ID NO: 66420 - RNA, 22 nt, Homo sapiens
cuuuggucaaaauaaguaaguu

SEQ ID NO: 66421 - RNA, 20 nt, Homo sapiens
cuuuggugagucaacuccuu

SEQ ID NO: 66422 - RNA, 22 nt, Homo sapiens
cuuugguggagucuuuagguuc

SEQ ID NO: 66423 - RNA, 22 nt, Homo sapiens
cuuugguuaauaggauauggca

SEQ ID NO: 66424 - RNA, 23 nt, Homo sapiens
cuuuguccccacccaaaucucau

SEQ ID NO: 66425 - RNA, 20 nt, Homo sapiens
cuuuguccuccugcugugcu

SEQ ID NO: 66426 - RNA, 22 nt, Homo sapiens
cuuuguguggacauuucaggca

SEQ ID NO: 66427 - RNA, 22 nt, Homo sapiens
cuuuuacacugcuggugggaau

SEQ ID NO: 66428 - RNA, 22 nt, Homo sapiens
cuuuuacacuguuggcaggauu

SEQ ID NO: 66429 - RNA, 22 nt, Homo sapiens
cuuuuacacuguuggugggaau

SEQ ID NO: 66430 - RNA, 23 nt, Homo sapiens
cuuuugcaaugugaucuugccac

SEQ ID NO: 66431 - RNA, 22 nt, Homo sapiens
cuuuugcugggucagcgguggu

SEQ ID NO: 66432 - RNA, 22 nt, Homo sapiens
cuuuuggcuuagaauugucuug

SEQ ID NO: 66433 - RNA, 22 nt, Homo sapiens
cuuuuggugugaagaagcucuu

SEQ ID NO: 66434 - RNA, 22 nt, Homo sapiens
cuuuugugauucuucaguuacu

SEQ ID NO: 66435 - RNA, 22 nt, Homo sapiens
gaaaauccauccccagggagua

SEQ ID NO: 66436 - RNA, 22 nt, Homo sapiens
gaaagacuuucugcuguggaua

SEQ ID NO: 66437 - RNA, 22 nt, Homo sapiens
gaaagauuuccugagcuagaaa

SEQ ID NO: 66438 - RNA, 22 nt, Homo sapiens
gaaagauuuuaacugggagacu

SEQ ID NO: 66439 - RNA, 22 nt, Homo sapiens
gaaagcugguauagauacauua

SEQ ID NO: 66440 - RNA, 22 nt, Homo sapiens
gaaagguaggaacagggugcag

SEQ ID NO: 66441 - RNA, 22 nt, Homo sapiens
gaaaguaauuaacgauuguugc

SEQ ID NO: 66442 - RNA, 22 nt, Homo sapiens
gaaaucucuacuauuuugaucu

SEQ ID NO: 66443 - RNA, 22 nt, Homo sapiens
gaaaugucugagauguggcuca

SEQ ID NO: 66444 - RNA, 22 nt, Homo sapiens
gaaauguugauagugggcauug

SEQ ID NO: 66445 - RNA, 22 nt, Homo sapiens
gaacccuggaggcggagguugc

SEQ ID NO: 66446 - RNA, 22 nt, Homo sapiens
gaagacauuuacaugggagacc

SEQ ID NO: 66447 - RNA, 22 nt, Homo sapiens
gaagagacagguucccacaaaa

SEQ ID NO: 66448 - RNA, 22 nt, Homo sapiens
gaaggagcuuaucugccauuuc

SEQ ID NO: 66449 - RNA, 22 nt, Homo sapiens
gaagguaguuuauagauguggu

SEQ ID NO: 66450 - RNA, 22 nt, Homo sapiens
gaaggugcuuggugaaugcauu

SEQ ID NO: 66451 - RNA, 19 nt, Homo sapiens
gaaguguuuguucuccaug

SEQ ID NO: 66452 - RNA, 22 nt, Homo sapiens
gaauacugacuauuucaucugg

SEQ ID NO: 66453 - RNA, 22 nt, Homo sapiens
gaauacuguccaagagugaugg

SEQ ID NO: 66454 - RNA, 22 nt, Homo sapiens
gaauagugcugcaagaaacaua

SEQ ID NO: 66455 - RNA, 22 nt, Homo sapiens
gaauagugcugcaguaaacaua

SEQ ID NO: 66456 - RNA, 22 nt, Homo sapiens
gaaucaauugaucuaugugucu

SEQ ID NO: 66457 - RNA, 22 nt, Homo sapiens
gaaugauacuguuaacgaaaga

SEQ ID NO: 66458 - RNA, 20 nt, Homo sapiens
gaaugguuucgggguucuug

SEQ ID NO: 66459 - RNA, 22 nt, Homo sapiens
gaauguuuacuuuguuuaauac

SEQ ID NO: 66460 - RNA, 22 nt, Homo sapiens
gaauucugucgcuuacuagaug

SEQ ID NO: 66461 - RNA, 22 nt, Homo sapiens
gaauugcacaaaaacugcuugu

SEQ ID NO: 66462 - RNA, 22 nt, Homo sapiens
gaauuguacugcaaucagggga

SEQ ID NO: 66463 - RNA, 22 nt, Homo sapiens
ccuccauuugugucaggaaguc

SEQ ID NO: 66464 - RNA, 22 nt, Homo sapiens
ccugagacuugagggggcuucu

SEQ ID NO: 66465 - RNA, 22 nt, Homo sapiens
ccugagaucauacuguuaguaa

SEQ ID NO: 66466 - RNA, 22 nt, Homo sapiens
ccugaugacacgggagauguac

SEQ ID NO: 66467 - RNA, 22 nt, Homo sapiens
ccugaugacuaaugguuuugag

SEQ ID NO: 66468 - RNA, 23 nt, Homo sapiens
ccuguagaaugucugugauacuu

SEQ ID NO: 66469 - RNA, 22 nt, Homo sapiens
ccugucuugaagagauccuccu

SEQ ID NO: 66470 - RNA, 22 nt, Homo sapiens
ccugugguuaaccagcuagaug

SEQ ID NO: 66471 - RNA, 22 nt, Homo sapiens
ccuguguuaugguuucuaaugu

SEQ ID NO: 66472 - RNA, 18 nt, Homo sapiens
ccuuaguuauagagaguc

SEQ ID NO: 66473 - RNA, 22 nt, Homo sapiens
ccuucauccuccagcaggcuag

SEQ ID NO: 66474 - RNA, 21 nt, Homo sapiens
ccuugagaacaucaauuugcu

SEQ ID NO: 66475 - RNA, 22 nt, Homo sapiens
ccuuggcaauggcuggggcuga

SEQ ID NO: 66476 - RNA, 22 nt, Homo sapiens
ccuugguugugcuucaacuucu

SEQ ID NO: 66477 - RNA, 19 nt, Homo sapiens
ccuuugguuuccaugacau

SEQ ID NO: 66478 - RNA, 22 nt, Homo sapiens
ccuuuuugaguugccagaguuc

SEQ ID NO: 66479 - RNA, 22 nt, Homo sapiens
cgacuggccuagacuaguguuu

SEQ ID NO: 66480 - RNA, 22 nt, Homo sapiens
cgcaguguuugugucccugggu

SEQ ID NO: 66481 - RNA, 22 nt, Homo sapiens
cgccugagcugaggaagcugca

SEQ ID NO: 66482 - RNA, 22 nt, Homo sapiens
cgcuggugaucuagacccccaa

SEQ ID NO: 66483 - RNA, 22 nt, Homo sapiens
cgugaauguuuuggucuuucac

SEQ ID NO: 66484 - RNA, 22 nt, Homo sapiens
cuaaagauagugacaugauuug

SEQ ID NO: 66485 - RNA, 22 nt, Homo sapiens
cuaaaugcacugucaaaggaag

SEQ ID NO: 66486 - RNA, 22 nt, Homo sapiens
cuaagcaccuuaguggggaauc

SEQ ID NO: 66487 - RNA, 22 nt, Homo sapiens
cuaaggaaggacugaaaggaca

SEQ ID NO: 66488 - RNA, 22 nt, Homo sapiens
cuaagggaggaagcugugcagg

SEQ ID NO: 66489 - RNA, 22 nt, Homo sapiens
cuaagguacuguuaacauugua

SEQ ID NO: 66490 - RNA, 18 nt, Homo sapiens
cuaauacuauucaacaag

SEQ ID NO: 66491 - RNA, 22 nt, Homo sapiens
cuaauccugugguagcacucaa

SEQ ID NO: 66492 - RNA, 22 nt, Homo sapiens
cuaaucuagccuuauaaguauu

SEQ ID NO: 66493 - RNA, 22 nt, Homo sapiens
cuaaugcagucaggagaaggaa

SEQ ID NO: 66494 - RNA, 22 nt, Homo sapiens
cuaauucuguaccuggcacaua

SEQ ID NO: 66495 - RNA, 22 nt, Homo sapiens
cuacaguguauuuauggagggu

SEQ ID NO: 66496 - RNA, 22 nt, Homo sapiens
cuacaguucuuaauuaaguagu

SEQ ID NO: 66497 - RNA, 22 nt, Homo sapiens
cuacauuguagguauucaaacu

SEQ ID NO: 66498 - RNA, 22 nt, Homo sapiens
cuacucuggagagugacaauca

SEQ ID NO: 66499 - RNA, 22 nt, Homo sapiens
cuacucugugguguauuugcau

SEQ ID NO: 66500 - RNA, 22 nt, Homo sapiens
cuacugauuaaaagaacagguc

SEQ ID NO: 66501 - RNA, 22 nt, Homo sapiens
cuagagagaagcugugugaccu

SEQ ID NO: 66502 - RNA, 22 nt, Homo sapiens
cuagaggcacagccuaggcacu

SEQ ID NO: 66503 - RNA, 22 nt, Homo sapiens
cuagaguacuuaccacagcaug

SEQ ID NO: 66504 - RNA, 22 nt, Homo sapiens
cuagaguagaguuuccuuagga

SEQ ID NO: 66505 - RNA, 22 nt, Homo sapiens
cuagcagacacuuccagagagu

SEQ ID NO: 66506 - RNA, 22 nt, Homo sapiens
cuagcccagugcuccuggauca

SEQ ID NO: 66507 - RNA, 22 nt, Homo sapiens
cuagcccugagauaaaugucau

SEQ ID NO: 66508 - RNA, 22 nt, Homo sapiens
cuaggugcaugagccguacagu

SEQ ID NO: 66509 - RNA, 22 nt, Homo sapiens
cuaguaaugucugucuuaugga

SEQ ID NO: 66510 - RNA, 22 nt, Homo sapiens
cuagugcaguuccccugucuua

SEQ ID NO: 66511 - RNA, 22 nt, Homo sapiens
cuauauacugccugcugauuag

SEQ ID NO: 66512 - RNA, 22 nt, Homo sapiens
cuauaugucuguuuugguacca

SEQ ID NO: 66513 - RNA, 21 nt, Homo sapiens
cuaucucaguguuuacauuug

SEQ ID NO: 66514 - RNA, 22 nt, Homo sapiens
cuaucugcacaggguggaaauu

SEQ ID NO: 66515 - RNA, 19 nt, Homo sapiens
cuaugaccaugugauuuuu

SEQ ID NO: 66516 - RNA, 22 nt, Homo sapiens
cuaugcuuucugggcccugggu

SEQ ID NO: 66517 - RNA, 22 nt, Homo sapiens
cuauggcagccacggccuggag

SEQ ID NO: 66518 - RNA, 22 nt, Homo sapiens
cuauggugauagaaaucagaau

SEQ ID NO: 66519 - RNA, 22 nt, Homo sapiens
cuaugguuucucaaacuccuga

SEQ ID NO: 66520 - RNA, 22 nt, Homo sapiens
cuauuugcauucagaggcaugu

SEQ ID NO: 66521 - RNA, 22 nt, Homo sapiens
cuauuugguuggugaaaaaagu

SEQ ID NO: 66522 - RNA, 21 nt, Homo sapiens
cucaaaguacugauauuacag

SEQ ID NO: 66523 - RNA, 22 nt, Homo sapiens
cucaaaguacuuugguuauugu

SEQ ID NO: 66524 - RNA, 22 nt, Homo sapiens
cucaaagugcuaagauuaggcu

SEQ ID NO: 66525 - RNA, 18 nt, Homo sapiens
cucaaccucaugcagggc

SEQ ID NO: 66526 - RNA, 22 nt, Homo sapiens
cucacagucucucccuaauuuu

SEQ ID NO: 66527 - RNA, 22 nt, Homo sapiens
cucaccuugugauccacccacc

SEQ ID NO: 66528 - RNA, 22 nt, Homo sapiens
cucaccuugugauccacccgcc

SEQ ID NO: 66529 - RNA, 22 nt, Homo sapiens
cucacggugcaggcuucuggga

SEQ ID NO: 66530 - RNA, 22 nt, Homo sapiens
cucacuaggaaguaaaguuugu

SEQ ID NO: 66531 - RNA, 22 nt, Homo sapiens
cucacugcauuucaguuuuguu

SEQ ID NO: 66532 - RNA, 22 nt, Homo sapiens
cucacugggaccacucugaagu

SEQ ID NO: 66533 - RNA, 22 nt, Homo sapiens
cucagaguacuuuucccacuuc

SEQ ID NO: 66534 - RNA, 22 nt, Homo sapiens
cucagugaagggcaagaggcaa

SEQ ID NO: 66535 - RNA, 22 nt, Homo sapiens
cucagugucuggcacacagaaa

SEQ ID NO: 66536 - RNA, 22 nt, Homo sapiens
cucaguguucccauucuaccuu

SEQ ID NO: 66537 - RNA, 21 nt, Homo sapiens
cucauauugcuuuuccauggu

SEQ ID NO: 66538 - RNA, 22 nt, Homo sapiens
cucauggagaacaucugcuagg

SEQ ID NO: 66539 - RNA, 22 nt, Homo sapiens
cucauggagaaccucugcuagg

SEQ ID NO: 66540 - RNA, 22 nt, Homo sapiens
cucauuggcuacugaggcuugu

SEQ ID NO: 66541 - RNA, 22 nt, Homo sapiens
cucauuggucagacgcgucggu

SEQ ID NO: 66542 - RNA, 22 nt, Homo sapiens
cuccaggugagguuaagggacu

SEQ ID NO: 66543 - RNA, 22 nt, Homo sapiens
cuccagugcaaagucaugauca

SEQ ID NO: 66544 - RNA, 22 nt, Homo sapiens
cuccaguuucagaaucccaugu

SEQ ID NO: 66545 - RNA, 22 nt, Homo sapiens
cuccauuuaguccuuuuagaag

SEQ ID NO: 66546 - RNA, 22 nt, Homo sapiens
cucccagagccaguuauaggcu

SEQ ID NO: 66547 - RNA, 22 nt, Homo sapiens
cucccauugcaaacaacagaag

SEQ ID NO: 66548 - RNA, 22 nt, Homo sapiens
cuccccuuuaguuucuuaauaa

SEQ ID NO: 66549 - RNA, 23 nt, Homo sapiens
cucccugaacaugacacaccaga

SEQ ID NO: 66550 - RNA, 22 nt, Homo sapiens
cuccuggugauuggagugugaa

SEQ ID NO: 66551 - RNA, 22 nt, Homo sapiens
cuccuugauuagaguauagagu

SEQ ID NO: 66552 - RNA, 22 nt, Homo sapiens
cucucugagccccagacaccuu

SEQ ID NO: 66553 - RNA, 20 nt, Homo sapiens
cucugguugugaauugucuu

SEQ ID NO: 66554 - RNA, 22 nt, Homo sapiens
cucugguuucgcaggaaauaga

SEQ ID NO: 66555 - RNA, 21 nt, Homo sapiens
cucugguuugcauuggauuau

SEQ ID NO: 66556 - RNA, 15 nt, Homo sapiens
cucugguuuuucuuc

SEQ ID NO: 66557 - RNA, 22 nt, Homo sapiens
cucuuagauuagccauccuaau

SEQ ID NO: 66558 - RNA, 22 nt, Homo sapiens
guaagugauagaauuaggauuc

SEQ ID NO: 66559 - RNA, 22 nt, Homo sapiens
guaaucucaccuacuugggagg

SEQ ID NO: 66560 - RNA, 19 nt, Homo sapiens
guaaucucaguacuuuggu

SEQ ID NO: 66561 - RNA, 22 nt, Homo sapiens
guacacauacauauaugugugu

SEQ ID NO: 66562 - RNA, 22 nt, Homo sapiens
guacacguggcuguguaggagu

SEQ ID NO: 66563 - RNA, 22 nt, Homo sapiens
guacaggugcaggaugggcagg

SEQ ID NO: 66564 - RNA, 22 nt, Homo sapiens
guacaguaguaaaagugaauga

SEQ ID NO: 66565 - RNA, 22 nt, Homo sapiens
guacaguggguguagggaccag

SEQ ID NO: 66566 - RNA, 22 nt, Homo sapiens
guacauggaaugaaauucaaaa

SEQ ID NO: 66567 - RNA, 22 nt, Homo sapiens
guacauguaugcaugcaugcau

SEQ ID NO: 66568 - RNA, 22 nt, Homo sapiens
guaccacaguugcucacggguu

SEQ ID NO: 66569 - RNA, 22 nt, Homo sapiens
guacccaguagauaguuuuuca

SEQ ID NO: 66570 - RNA, 22 nt, Homo sapiens
guaccuguauguucauuucaca

SEQ ID NO: 66571 - RNA, 22 nt, Homo sapiens
guagaaagcauuucagauuugc

SEQ ID NO: 66572 - RNA, 22 nt, Homo sapiens
guagaaaguuugcugucacaug

SEQ ID NO: 66573 - RNA, 22 nt, Homo sapiens
guagaagcacagggccuguauu

SEQ ID NO: 66574 - RNA, 22 nt, Homo sapiens
guagaccauuuaucuggggagu

SEQ ID NO: 66575 - RNA, 22 nt, Homo sapiens
guagagugcugggcacuggcuc

SEQ ID NO: 66576 - RNA, 22 nt, Homo sapiens
guagcagaacauguuccuugua

SEQ ID NO: 66577 - RNA, 22 nt, Homo sapiens
guagcagcuacuaaguugcugu

SEQ ID NO: 66578 - RNA, 22 nt, Homo sapiens
guagugcaguuugagaaucagu

SEQ ID NO: 66579 - RNA, 23 nt, Homo sapiens
guaguuugaugcaauccacuugu

SEQ ID NO: 66580 - RNA, 22 nt, Homo sapiens
guauagcaaugccccacaccug

SEQ ID NO: 66581 - RNA, 22 nt, Homo sapiens
guauagcacauaauacuugaug

SEQ ID NO: 66582 - RNA, 21 nt, Homo sapiens
cccagguucucugaggguaga

SEQ ID NO: 66583 - RNA, 18 nt, Homo sapiens
cccagugacuuauggccu

SEQ ID NO: 66584 - RNA, 22 nt, Homo sapiens
cccagugguuacauaaggagua

SEQ ID NO: 66585 - RNA, 22 nt, Homo sapiens
cccagugugaacuuggcauuuu

SEQ ID NO: 66586 - RNA, 22 nt, Homo sapiens
cccagugugcugggugacagcu

SEQ ID NO: 66587 - RNA, 22 nt, Homo sapiens
cccaguguuacgugacagccug

SEQ ID NO: 66588 - RNA, 21 nt, Homo sapiens
augguacugucucuggagaua

SEQ ID NO: 66589 - RNA, 22 nt, Homo sapiens
augguauuuaacagucuuucua

SEQ ID NO: 66590 - RNA, 22 nt, Homo sapiens
auggucccauucauucacguau

SEQ ID NO: 66591 - RNA, 22 nt, Homo sapiens
auggucuuuauuguguugagug

SEQ ID NO: 66592 - RNA, 22 nt, Homo sapiens
auggucuuuucccuggauuaua

SEQ ID NO: 66593 - RNA, 22 nt, Homo sapiens
auggucuuuuuguuaugagaga

SEQ ID NO: 66594 - RNA, 22 nt, Homo sapiens
auggugugugaauuaaauguua

SEQ ID NO: 66595 - RNA, 22 nt, Homo sapiens
augguugguuaaaucuguguau

SEQ ID NO: 66596 - RNA, 22 nt, Homo sapiens
augguuuauuuguaagcagagu

SEQ ID NO: 66597 - RNA, 22 nt, Homo sapiens
auguaaacuacagauuuugggu

SEQ ID NO: 66598 - RNA, 20 nt, Homo sapiens
auguaauguaugauauguac

SEQ ID NO: 66599 - RNA, 22 nt, Homo sapiens
auguaguagauauuuauggaaa

SEQ ID NO: 66600 - RNA, 22 nt, Homo sapiens
auguauacauagauacgugugu

SEQ ID NO: 66601 - RNA, 22 nt, Homo sapiens
auguaugagaguuccagcugau

SEQ ID NO: 66602 - RNA, 22 nt, Homo sapiens
auguccaugagcacauguauca

SEQ ID NO: 66603 - RNA, 22 nt, Homo sapiens
auguccauggaaucuguagcaa

SEQ ID NO: 66604 - RNA, 22 nt, Homo sapiens
auguccuggacccagacaaagc

SEQ ID NO: 66605 - RNA, 22 nt, Homo sapiens
augucuagagugauacugaagc

SEQ ID NO: 66606 - RNA, 22 nt, Homo sapiens
augucuggcagaagacuucuca

SEQ ID NO: 66607 - RNA, 22 nt, Homo sapiens
augucugguagccaccuggagg

SEQ ID NO: 66608 - RNA, 22 nt, Homo sapiens
augucuuucauagagacccaga

SEQ ID NO: 66609 - RNA, 22 nt, Homo sapiens
augugaaugugaucggauaguc

SEQ ID NO: 66610 - RNA, 22 nt, Homo sapiens
augugacagugguuuuaagcgu

SEQ ID NO: 66611 - RNA, 22 nt, Homo sapiens
augugaccaucucuccacuaau

SEQ ID NO: 66612 - RNA, 22 nt, Homo sapiens
augugacuugugaaaaguucag

SEQ ID NO: 66613 - RNA, 22 nt, Homo sapiens
augugcaagaucauuaaagcuc

SEQ ID NO: 66614 - RNA, 20 nt, Homo sapiens
augugcuaauauuaauaugu

SEQ ID NO: 66615 - RNA, 22 nt, Homo sapiens
augugcuaguaucaaacgagac

SEQ ID NO: 66616 - RNA, 22 nt, Homo sapiens
auguggaaauguauaugugucu

SEQ ID NO: 66617 - RNA, 22 nt, Homo sapiens
augugggaggaauguguuucca

SEQ ID NO: 66618 - RNA, 22 nt, Homo sapiens
auguggugguagccaggacagg

SEQ ID NO: 66619 - RNA, 22 nt, Homo sapiens
auguuacggaguuuuuauccag

SEQ ID NO: 66620 - RNA, 22 nt, Homo sapiens
auguuagcaucaauauucauca

SEQ ID NO: 66621 - RNA, 22 nt, Homo sapiens
auguuauguuaaugauaaugga

SEQ ID NO: 66622 - RNA, 22 nt, Homo sapiens
auguugcaguuuaauuauccua

SEQ ID NO: 66623 - RNA, 22 nt, Homo sapiens
auguugcuugaaggcauuuugu

SEQ ID NO: 66624 - RNA, 22 nt, Homo sapiens
auguuugguaagaauauuguua

SEQ ID NO: 66625 - RNA, 22 nt, Homo sapiens
auuaaggaguggguucauggug

SEQ ID NO: 66626 - RNA, 22 nt, Homo sapiens
auuaaucaggcaaugcuugcua

SEQ ID NO: 66627 - RNA, 21 nt, Homo sapiens
auuaaugcucugguuagaggc

SEQ ID NO: 66628 - RNA, 22 nt, Homo sapiens
auuacaugucuauccaugaaca

SEQ ID NO: 66629 - RNA, 20 nt, Homo sapiens
auuagacuugccuuauccuu

SEQ ID NO: 66630 - RNA, 22 nt, Homo sapiens
auuagguauuuucuggacaggg

SEQ ID NO: 66631 - RNA, 22 nt, Homo sapiens
auuagguuggugcaaaaguaau

SEQ ID NO: 66632 - RNA, 22 nt, Homo sapiens
auuauaguguauacuugaaauu

SEQ ID NO: 66633 - RNA, 22 nt, Homo sapiens
auuauaugucaucacagacacc

SEQ ID NO: 66634 - RNA, 22 nt, Homo sapiens
auucaacuaauuauugaagaug

SEQ ID NO: 66635 - RNA, 22 nt, Homo sapiens
auucaaggacuggauugcggga

SEQ ID NO: 66636 - RNA, 23 nt, Homo sapiens
auucaaguagugagagugguuau

SEQ ID NO: 66637 - RNA, 22 nt, Homo sapiens
auucaccauggaccaggggccu

SEQ ID NO: 66638 - RNA, 22 nt, Homo sapiens
auucacuguggcuuucucugau

SEQ ID NO: 66639 - RNA, 22 nt, Homo sapiens
auucagaggggcagcugucuug

SEQ ID NO: 66640 - RNA, 20 nt, Homo sapiens
auucauggaggagcaauugg

SEQ ID NO: 66641 - RNA, 22 nt, Homo sapiens
auuccauaguacagugaugagu

SEQ ID NO: 66642 - RNA, 22 nt, Homo sapiens
auuccauuuguuaucacacccg

SEQ ID NO: 66643 - RNA, 22 nt, Homo sapiens
auugaauuugguuugcuaagaa

SEQ ID NO: 66644 - RNA, 22 nt, Homo sapiens
auugacacugauuuuucuuuaa

SEQ ID NO: 66645 - RNA, 22 nt, Homo sapiens
auugagcuuuuuaaaauauagu

SEQ ID NO: 66646 - RNA, 22 nt, Homo sapiens
auugaggcaggaggaccaucua

SEQ ID NO: 66647 - RNA, 22 nt, Homo sapiens
auugaggcauguaccaaugguc

SEQ ID NO: 66648 - RNA, 22 nt, Homo sapiens
auugaguaacaauuuuguucaa

SEQ ID NO: 66649 - RNA, 22 nt, Homo sapiens
auugagucauuucaaauccaag

SEQ ID NO: 66650 - RNA, 23 nt, Homo sapiens
auugauagugccuuugugcuaau

SEQ ID NO: 66651 - RNA, 22 nt, Homo sapiens
auugcaaucuccgccuccgggg

SEQ ID NO: 66652 - RNA, 22 nt, Homo sapiens
auugcaauuaguccauagaguu

SEQ ID NO: 66653 - RNA, 22 nt, Homo sapiens
auugcacaaagagggaaacuga

SEQ ID NO: 66654 - RNA, 22 nt, Homo sapiens
auugcacacagaaucaggguaa

SEQ ID NO: 66655 - RNA, 22 nt, Homo sapiens
auugcacuccacccugggcaac

SEQ ID NO: 66656 - RNA, 22 nt, Homo sapiens
auugcacuccagccccggggac

SEQ ID NO: 66657 - RNA, 22 nt, Homo sapiens
auugcacuccagccuagucaac

SEQ ID NO: 66658 - RNA, 22 nt, Homo sapiens
auugcacuccagccugagcaaa

SEQ ID NO: 66659 - RNA, 22 nt, Homo sapiens
auugcacuccagccuggcagca

SEQ ID NO: 66660 - RNA, 22 nt, Homo sapiens
auugcacuccagccuggccgag

SEQ ID NO: 66661 - RNA, 22 nt, Homo sapiens
auugcacuccagccugggcuag

SEQ ID NO: 66662 - RNA, 22 nt, Homo sapiens
auugcacucuaaccuaggugac

SEQ ID NO: 66663 - RNA, 22 nt, Homo sapiens
auugcacugcagccugggcaac

SEQ ID NO: 66664 - RNA, 22 nt, Homo sapiens
auugcauugugaucuucccaga

SEQ ID NO: 66665 - RNA, 22 nt, Homo sapiens
auugcauuuucagguuggucug

SEQ ID NO: 66666 - RNA, 22 nt, Homo sapiens
auugcccaggcuggagugcagu

SEQ ID NO: 66667 - RNA, 22 nt, Homo sapiens
auugcccauaaggauauuguca

SEQ ID NO: 66668 - RNA, 22 nt, Homo sapiens
auugccuaugauugagguacua

SEQ ID NO: 66669 - RNA, 22 nt, Homo sapiens
auugcuaauaugcuucaggcaa

SEQ ID NO: 66670 - RNA, 22 nt, Homo sapiens
auugcugagacauugcuaaucu

SEQ ID NO: 66671 - RNA, 22 nt, Homo sapiens
auugcuuuuacugggagcuuug

SEQ ID NO: 66672 - RNA, 22 nt, Homo sapiens
auuggacagcauuucuagacuu

SEQ ID NO: 66673 - RNA, 22 nt, Homo sapiens
auuggcaauccauauauuuucu

SEQ ID NO: 66674 - RNA, 22 nt, Homo sapiens
auuggcauauccacgacaaugc

SEQ ID NO: 66675 - RNA, 22 nt, Homo sapiens
auuggccaaugggacgucagca

SEQ ID NO: 66676 - RNA, 22 nt, Homo sapiens
auggcuuuucacagaggguucu

SEQ ID NO: 66677 - RNA, 22 nt, Homo sapiens
auggcuuuuccugucuugcaug

SEQ ID NO: 66678 - RNA, 22 nt, Homo sapiens
auggcuuuugcccuaaauggau

SEQ ID NO: 66679 - RNA, 22 nt, Homo sapiens
auggcuuuuuaaaucauguugu

SEQ ID NO: 66680 - RNA, 22 nt, Homo sapiens
augggcacugauguauucugug

SEQ ID NO: 66681 - RNA, 22 nt, Homo sapiens
augggguaggcuuugcugcagu

SEQ ID NO: 66682 - RNA, 22 nt, Homo sapiens
augggguagguagcucggggaa

SEQ ID NO: 66683 - RNA, 22 nt, Homo sapiens
augggugaguaugaguugacuu

SEQ ID NO: 66684 - RNA, 18 nt, Homo sapiens
auggguguuggaaaauga

SEQ ID NO: 66685 - RNA, 22 nt, Homo sapiens
augguacuagaguaagaauugu

SEQ ID NO: 66686 - RNA, 22 nt, Homo sapiens
augguacuccagagaagcagaa

SEQ ID NO: 66687 - RNA, 22 nt, Homo sapiens
augguagacucucgggucaugg

SEQ ID NO: 66688 - RNA, 20 nt, Homo sapiens
augguaguagcaccuuuaca

SEQ ID NO: 66689 - RNA, 22 nt, Homo sapiens
augguaucauuacuguuuuauu

SEQ ID NO: 66690 - RNA, 22 nt, Homo sapiens
augguauuuugugauaccuugu

SEQ ID NO: 66691 - RNA, 22 nt, Homo sapiens
auggucuuuguuucuaauucug

SEQ ID NO: 66692 - RNA, 22 nt, Homo sapiens
augguguauugauuauugcugu

SEQ ID NO: 66693 - RNA, 22 nt, Homo sapiens
augguguccuguuuccccagga

SEQ ID NO: 66694 - RNA, 22 nt, Homo sapiens
augguuuuacugcaaaauggga

SEQ ID NO: 66695 - RNA, 22 nt, Homo sapiens
auguaaacagaugugcagcuug

SEQ ID NO: 66696 - RNA, 22 nt, Homo sapiens
auguaacuaucugagccauggg

SEQ ID NO: 66697 - RNA, 21 nt, Homo sapiens
auguaacugggaaugugagag

SEQ ID NO: 66698 - RNA, 21 nt, Homo sapiens
auguaaugaagaagccacugg

SEQ ID NO: 66699 - RNA, 22 nt, Homo sapiens
auguaauugagguuuuugccau

SEQ ID NO: 66700 - RNA, 22 nt, Homo sapiens
auguaguagcagaaaauauuuu

SEQ ID NO: 66701 - RNA, 22 nt, Homo sapiens
auguauggagauauuuuugguu

SEQ ID NO: 66702 - RNA, 22 nt, Homo sapiens
auguauggaguuuaggggaugg

SEQ ID NO: 66703 - RNA, 22 nt, Homo sapiens
augucacagguccuagccaagu

SEQ ID NO: 66704 - RNA, 22 nt, Homo sapiens
augucacugcacuccugccugg

SEQ ID NO: 66705 - RNA, 20 nt, Homo sapiens
augucagaguguggguacgg

SEQ ID NO: 66706 - RNA, 22 nt, Homo sapiens
augugaacaucauagaaugcac

SEQ ID NO: 66707 - RNA, 22 nt, Homo sapiens
augugaacugaauuaauucaca

SEQ ID NO: 66708 - RNA, 22 nt, Homo sapiens
augugacagcaacccccagccc

SEQ ID NO: 66709 - RNA, 22 nt, Homo sapiens
augugacuggaucauggggacg

SEQ ID NO: 66710 - RNA, 22 nt, Homo sapiens
augugcaauguguacguagccc

SEQ ID NO: 66711 - RNA, 18 nt, Homo sapiens
augugcaauuuuguauuu

SEQ ID NO: 66712 - RNA, 22 nt, Homo sapiens
augugcacaacgugcagguuug

SEQ ID NO: 66713 - RNA, 22 nt, Homo sapiens
augugcauaugaagcacagaca

SEQ ID NO: 66714 - RNA, 22 nt, Homo sapiens
augugccauucucauggcgcuu

SEQ ID NO: 66715 - RNA, 22 nt, Homo sapiens
augugcuuaaaaaugcagagaa

SEQ ID NO: 66716 - RNA, 22 nt, Homo sapiens
augugcuuauagguguauguuu

SEQ ID NO: 66717 - RNA, 22 nt, Homo sapiens
augugcuugagggaaaucaguu

SEQ ID NO: 66718 - RNA, 22 nt, Homo sapiens
augugcuuuuuaaacagaugcu

SEQ ID NO: 66719 - RNA, 22 nt, Homo sapiens
auguggcauuucucauucauuu

SEQ ID NO: 66720 - RNA, 22 nt, Homo sapiens
augugguaguuauagugauaag

SEQ ID NO: 66721 - RNA, 19 nt, Homo sapiens
augugguuagcaugacugc

SEQ ID NO: 66722 - RNA, 23 nt, Homo sapiens
augugguuuuagguguugaacug

SEQ ID NO: 66723 - RNA, 22 nt, Homo sapiens
auguguauuaccucgauuguga

SEQ ID NO: 66724 - RNA, 22 nt, Homo sapiens
augugucaaaucuaggccaaag

SEQ ID NO: 66725 - RNA, 23 nt, Homo sapiens
augugugcuuggagagcaggaug

SEQ ID NO: 66726 - RNA, 22 nt, Homo sapiens
auguuauguucuucucuguaua

SEQ ID NO: 66727 - RNA, 18 nt, Homo sapiens
auguuauguuuguagaag

SEQ ID NO: 66728 - RNA, 22 nt, Homo sapiens
auguuguaguaugagucaaaau

SEQ ID NO: 66729 - RNA, 22 nt, Homo sapiens
auguuuagagagggugucaaau

SEQ ID NO: 66730 - RNA, 22 nt, Homo sapiens
auuaaauguuggacguauacau

SEQ ID NO: 66731 - RNA, 22 nt, Homo sapiens
auuaagagcacauguucugggu

SEQ ID NO: 66732 - RNA, 23 nt, Homo sapiens
auuaagguuacuacaguaugagg

SEQ ID NO: 66733 - RNA, 22 nt, Homo sapiens
auuaagugaaugaaguuguucc

SEQ ID NO: 66734 - RNA, 22 nt, Homo sapiens
auuaaguugugccugaaaacuu

SEQ ID NO: 66735 - RNA, 22 nt, Homo sapiens
auuaauguaauuaguaaaguug

SEQ ID NO: 66736 - RNA, 22 nt, Homo sapiens
auuacauagucaaggugucuca

SEQ ID NO: 66737 - RNA, 22 nt, Homo sapiens
auuagguuggugcaaaacuuuc

SEQ ID NO: 66738 - RNA, 22 nt, Homo sapiens
auuagguuguugcaaaaguaau

SEQ ID NO: 66739 - RNA, 22 nt, Homo sapiens
auuauauguguaugugcauacc

SEQ ID NO: 66740 - RNA, 22 nt, Homo sapiens
auuauguuguauuuccuugcag

SEQ ID NO: 66741 - RNA, 22 nt, Homo sapiens
auuauuagucggccagcuguua

SEQ ID NO: 66742 - RNA, 22 nt, Homo sapiens
auucaaggagucuucgucccaa

SEQ ID NO: 66743 - RNA, 22 nt, Homo sapiens
auucaagggauuucaggaggcu

SEQ ID NO: 66744 - RNA, 20 nt, Homo sapiens
auucaaguaugccuugagaa

SEQ ID NO: 66745 - RNA, 22 nt, Homo sapiens
auucaagucaucucuccgcauu

SEQ ID NO: 66746 - RNA, 22 nt, Homo sapiens
auucaagugaugcagcuguuuu

SEQ ID NO: 66747 - RNA, 22 nt, Homo sapiens
auucacagcuuuaaaaggcgug

SEQ ID NO: 66748 - RNA, 22 nt, Homo sapiens
auucacugugcuuggccaaauu

SEQ ID NO: 66749 - RNA, 22 nt, Homo sapiens
auucaucagggauacuggccug

SEQ ID NO: 66750 - RNA, 22 nt, Homo sapiens
auucaugggagcuacuuuaaaa

SEQ ID NO: 66751 - RNA, 20 nt, Homo sapiens
auucauggugguacguuguc

SEQ ID NO: 66752 - RNA, 22 nt, Homo sapiens
auuccacagccgauaccaugac

SEQ ID NO: 66753 - RNA, 22 nt, Homo sapiens
auuccacuuagugacucauuug

SEQ ID NO: 66754 - RNA, 22 nt, Homo sapiens
auuccagauggaguugaggguu

SEQ ID NO: 66755 - RNA, 22 nt, Homo sapiens
auuccaguggguuuacauccca

SEQ ID NO: 66756 - RNA, 22 nt, Homo sapiens
auuccaguuguaagguuuuuca

SEQ ID NO: 66757 - RNA, 22 nt, Homo sapiens
auuccaguuugugagaagcugu

SEQ ID NO: 66758 - RNA, 22 nt, Homo sapiens
auuccauuuguguggaauggcu

SEQ ID NO: 66759 - RNA, 22 nt, Homo sapiens
auucccuguagaauaaggaugg

SEQ ID NO: 66760 - RNA, 22 nt, Homo sapiens
auugaacuuacuaucuaaacua

SEQ ID NO: 66761 - RNA, 22 nt, Homo sapiens
auugaacuuuugucacugacau

SEQ ID NO: 66762 - RNA, 22 nt, Homo sapiens
auugagacaaauuuguaugcag

SEQ ID NO: 66763 - RNA, 22 nt, Homo sapiens
auugagcaauuccuaugugcuu

SEQ ID NO: 66764 - RNA, 22 nt, Homo sapiens
auugagguauaauugcuaugca

SEQ ID NO: 66765 - RNA, 22 nt, Homo sapiens
auugauaguuuaauaggaauug

SEQ ID NO: 66766 - RNA, 19 nt, Homo sapiens
auugauuaaguuugcuguc

SEQ ID NO: 66767 - RNA, 21 nt, Homo sapiens
auugcacaauauacccaugua

SEQ ID NO: 66768 - RNA, 18 nt, Homo sapiens
auugcacaccagccuggg

SEQ ID NO: 66769 - RNA, 22 nt, Homo sapiens
auugcacuccagccuggcaaua

SEQ ID NO: 66770 - RNA, 22 nt, Homo sapiens
auugcacuccagccuggccaac

SEQ ID NO: 66771 - RNA, 22 nt, Homo sapiens
cucccagugacccaggaacagg

SEQ ID NO: 66772 - RNA, 22 nt, Homo sapiens
cuccuaaccagggcuguuaguc

SEQ ID NO: 66773 - RNA, 22 nt, Homo sapiens
cuccuguagccccaucaucuuu

SEQ ID NO: 66774 - RNA, 20 nt, Homo sapiens
cuccuucauuccuuuggacc

SEQ ID NO: 66775 - RNA, 22 nt, Homo sapiens
cucgcuccauuucggugaucaa

SEQ ID NO: 66776 - RNA, 22 nt, Homo sapiens
cucucaagaugcugggauuaca

SEQ ID NO: 66777 - RNA, 22 nt, Homo sapiens
cucucuguuugucuguuauugg

SEQ ID NO: 66778 - RNA, 22 nt, Homo sapiens
cucugacagugguuagcacugu

SEQ ID NO: 66779 - RNA, 22 nt, Homo sapiens
cucugagccugagguuccuacu

SEQ ID NO: 66780 - RNA, 22 nt, Homo sapiens
cucugagguuauucguaauauu

SEQ ID NO: 66781 - RNA, 22 nt, Homo sapiens
cucugcuuaaugucccacuuga

SEQ ID NO: 66782 - RNA, 22 nt, Homo sapiens
cucuggauauuccugucuaaaa

SEQ ID NO: 66783 - RNA, 22 nt, Homo sapiens
cucuuacaguguguggugaaag

SEQ ID NO: 66784 - RNA, 22 nt, Homo sapiens
cucuuuaguaagcaguugauga

SEQ ID NO: 66785 - RNA, 22 nt, Homo sapiens
cucuuugaguuccuccuggugu

SEQ ID NO: 66786 - RNA, 22 nt, Homo sapiens
cugaaagagcauuugaaugggu

SEQ ID NO: 66787 - RNA, 22 nt, Homo sapiens
cugaaaucagccaguuaguuuc

SEQ ID NO: 66788 - RNA, 22 nt, Homo sapiens
cugaaucauugcauuaucaagg

SEQ ID NO: 66789 - RNA, 22 nt, Homo sapiens
cugaauguucuauagaagccgc

SEQ ID NO: 66790 - RNA, 22 nt, Homo sapiens
cugacaagugaucacagcagca

SEQ ID NO: 66791 - RNA, 22 nt, Homo sapiens
cugacaucuucaagugaggaga

SEQ ID NO: 66792 - RNA, 22 nt, Homo sapiens
cugagaacaucauucagauauu

SEQ ID NO: 66793 - RNA, 22 nt, Homo sapiens
cugagaagaaacagguaaggac

SEQ ID NO: 66794 - RNA, 22 nt, Homo sapiens
cugagacacucuuaucugcaua

SEQ ID NO: 66795 - RNA, 22 nt, Homo sapiens
cugagacuggguaauguauaaa

SEQ ID NO: 66796 - RNA, 22 nt, Homo sapiens
cugagaucaugggucagguggu

SEQ ID NO: 66797 - RNA, 22 nt, Homo sapiens
cugagauuaagauauugggagu

SEQ ID NO: 66798 - RNA, 22 nt, Homo sapiens
cugagcaucauggcagaaucuu

SEQ ID NO: 66799 - RNA, 22 nt, Homo sapiens
cugagcuagaccauuuggcucc

SEQ ID NO: 66800 - RNA, 22 nt, Homo sapiens
cugaggaaguucuuuaacaguu

SEQ ID NO: 66801 - RNA, 22 nt, Homo sapiens
cugaggauauucagccucugug

SEQ ID NO: 66802 - RNA, 22 nt, Homo sapiens
cugaggcacggcgaccuuaagu

SEQ ID NO: 66803 - RNA, 22 nt, Homo sapiens
cugagguaauuuuccagauaau

SEQ ID NO: 66804 - RNA, 20 nt, Homo sapiens
cugagguacgaggguuaaau

SEQ ID NO: 66805 - RNA, 22 nt, Homo sapiens
cugagguaggugaucagugcuu

SEQ ID NO: 66806 - RNA, 22 nt, Homo sapiens
cugaggugauauauacauauuu

SEQ ID NO: 66807 - RNA, 22 nt, Homo sapiens
cugaguauaacugaccuuauga

SEQ ID NO: 66808 - RNA, 22 nt, Homo sapiens
cugaguauuugaggccgaagga

SEQ ID NO: 66809 - RNA, 22 nt, Homo sapiens
cugauacugagaccuuggguua

SEQ ID NO: 66810 - RNA, 22 nt, Homo sapiens
cugauaugaugggugauuuuca

SEQ ID NO: 66811 - RNA, 21 nt, Homo sapiens
cugaucacaggugagcugccu

SEQ ID NO: 66812 - RNA, 22 nt, Homo sapiens
cugaucuaugaacacaggauau

SEQ ID NO: 66813 - RNA, 22 nt, Homo sapiens
cugaucuguuauacuuuucuau

SEQ ID NO: 66814 - RNA, 22 nt, Homo sapiens
cugcaagaaucguaguauuuga

SEQ ID NO: 66815 - RNA, 19 nt, Homo sapiens
cugcaagguaauaggucag

SEQ ID NO: 66816 - RNA, 20 nt, Homo sapiens
cugcacauccacucuacuuc

SEQ ID NO: 66817 - RNA, 22 nt, Homo sapiens
cugcagaucuuggggcuugcca

SEQ ID NO: 66818 - RNA, 22 nt, Homo sapiens
cugcaguaaacuuucccauuca

SEQ ID NO: 66819 - RNA, 22 nt, Homo sapiens
cugcauuagucuguuuaguguu

SEQ ID NO: 66820 - RNA, 22 nt, Homo sapiens
cugcccguaauccucuccccag

SEQ ID NO: 66821 - RNA, 20 nt, Homo sapiens
cugcuccccuacaaaucuca

SEQ ID NO: 66822 - RNA, 22 nt, Homo sapiens
cuggaaaguagacaaucuaaaa

SEQ ID NO: 66823 - RNA, 22 nt, Homo sapiens
cuggaagaaaaucacgccaucu

SEQ ID NO: 66824 - RNA, 22 nt, Homo sapiens
cuggaagcacaacgcauuuauu

SEQ ID NO: 66825 - RNA, 22 nt, Homo sapiens
cuggaauauuagcuggucuuaa

SEQ ID NO: 66826 - RNA, 22 nt, Homo sapiens
cuggaaucuauggauaacaucg

SEQ ID NO: 66827 - RNA, 22 nt, Homo sapiens
cuggaauucaaaaucugaauuu

SEQ ID NO: 66828 - RNA, 22 nt, Homo sapiens
cuggaguaugauguuagcguug

SEQ ID NO: 66829 - RNA, 22 nt, Homo sapiens
cuggagucugacugacacaagg

SEQ ID NO: 66830 - RNA, 20 nt, Homo sapiens
cuggaucaucaguaaaguua

SEQ ID NO: 66831 - RNA, 22 nt, Homo sapiens
cuggcaaaaagagggcaauaau

SEQ ID NO: 66832 - RNA, 22 nt, Homo sapiens
cuggcaaauaguagagccagga

SEQ ID NO: 66833 - RNA, 22 nt, Homo sapiens
cuggcaucuaaauacuugaugu

SEQ ID NO: 66834 - RNA, 22 nt, Homo sapiens
cuggcgagacagcuccaucacu

SEQ ID NO: 66835 - RNA, 22 nt, Homo sapiens
cuggcuaagugcuugagugugc

SEQ ID NO: 66836 - RNA, 22 nt, Homo sapiens
cuggcucuguuagaagaaccag

SEQ ID NO: 66837 - RNA, 22 nt, Homo sapiens
cugguaguguuuauaaggguau

SEQ ID NO: 66838 - RNA, 22 nt, Homo sapiens
cugguaugcuucauaugcaaac

SEQ ID NO: 66839 - RNA, 22 nt, Homo sapiens
cuggucaagagcaaaggccagg

SEQ ID NO: 66840 - RNA, 22 nt, Homo sapiens
cuggucaugggggcacccucug

SEQ ID NO: 66841 - RNA, 22 nt, Homo sapiens
cuggugauugguuucauucagu

SEQ ID NO: 66842 - RNA, 22 nt, Homo sapiens
cugguuguucuggaugggcagg

SEQ ID NO: 66843 - RNA, 22 nt, Homo sapiens
cuguaaagaucacagagcuggu

SEQ ID NO: 66844 - RNA, 22 nt, Homo sapiens
cuguaaaguaagagguaaguua

SEQ ID NO: 66845 - RNA, 22 nt, Homo sapiens
cuguaacagaauaaauuuguuu

SEQ ID NO: 66846 - RNA, 22 nt, Homo sapiens
cuguaagcauuauaaagagaua

SEQ ID NO: 66847 - RNA, 22 nt, Homo sapiens
cuguaguuagcagaugaugaau

SEQ ID NO: 66848 - RNA, 22 nt, Homo sapiens
cugucucagugaauugguuuua

SEQ ID NO: 66849 - RNA, 22 nt, Homo sapiens
cugucuggaggccugcaaauaa

SEQ ID NO: 66850 - RNA, 22 nt, Homo sapiens
cugucuggaguccuucgugugc

SEQ ID NO: 66851 - RNA, 22 nt, Homo sapiens
cugugaagaaagucauugguag

SEQ ID NO: 66852 - RNA, 22 nt, Homo sapiens
cugugauuauauaguuaaggua

SEQ ID NO: 66853 - RNA, 22 nt, Homo sapiens
cugugcaaagcgcucucggggu

SEQ ID NO: 66854 - RNA, 22 nt, Homo sapiens
cugugcauucuuaaaucaggaa

SEQ ID NO: 66855 - RNA, 22 nt, Homo sapiens
cugugcauuggaugucucccug

SEQ ID NO: 66856 - RNA, 19 nt, Homo sapiens
cuguggucauuauuuugcu

SEQ ID NO: 66857 - RNA, 22 nt, Homo sapiens
cuguucaaauuguuugugaagu

SEQ ID NO: 66858 - RNA, 22 nt, Homo sapiens
cuguugguguuuaaucacugca

SEQ ID NO: 66859 - RNA, 22 nt, Homo sapiens
cuguugguuaaauuccaugcag

SEQ ID NO: 66860 - RNA, 22 nt, Homo sapiens
cuguuugauuaagugguggaaa

SEQ ID NO: 66861 - RNA, 22 nt, Homo sapiens
cuuaaagcgaauauugguggua

SEQ ID NO: 66862 - RNA, 22 nt, Homo sapiens
cuuaaggccagauaauuucuau

SEQ ID NO: 66863 - RNA, 22 nt, Homo sapiens
cuuagcaugucagcaccggguu

SEQ ID NO: 66864 - RNA, 19 nt, Homo sapiens
cuuaggugaccaguuccca

SEQ ID NO: 66865 - RNA, 22 nt, Homo sapiens
cuucaaguaauucugauggcua

SEQ ID NO: 66866 - RNA, 22 nt, Homo sapiens
auugcacuccagccuggggaac

SEQ ID NO: 66867 - RNA, 22 nt, Homo sapiens
auugcacuccagccugggggac

SEQ ID NO: 66868 - RNA, 22 nt, Homo sapiens
auugcacuccagccuggugaca

SEQ ID NO: 66869 - RNA, 22 nt, Homo sapiens
auugcacuccagccuugugaca

SEQ ID NO: 66870 - RNA, 22 nt, Homo sapiens
auugcacuccagcuugggugac

SEQ ID NO: 66871 - RNA, 22 nt, Homo sapiens
auugcacuccagucugggcaac

SEQ ID NO: 66872 - RNA, 22 nt, Homo sapiens
auugcacuccauccuaggugac

SEQ ID NO: 66873 - RNA, 18 nt, Homo sapiens
auugcacuccugccuggg

SEQ ID NO: 66874 - RNA, 22 nt, Homo sapiens
auugcagcuugcagggugugua

SEQ ID NO: 66875 - RNA, 23 nt, Homo sapiens
auugcagucuugaacuccugggc

SEQ ID NO: 66876 - RNA, 20 nt, Homo sapiens
auuuggcauaguuuaagcaa

SEQ ID NO: 66877 - RNA, 22 nt, Homo sapiens
auuuggccuuuguaugcaguau

SEQ ID NO: 66878 - RNA, 21 nt, Homo sapiens
auuugguggcugugugacacu

SEQ ID NO: 66879 - RNA, 22 nt, Homo sapiens
auuugucacuuaacagccauua

SEQ ID NO: 66880 - RNA, 18 nt, Homo sapiens
auuuuugcaguccacaug

SEQ ID NO: 66881 - RNA, 22 nt, Homo sapiens
auuuuugguugucagcacuagg

SEQ ID NO: 66882 - RNA, 22 nt, Homo sapiens
caaagcacuuggcuuggaagau

SEQ ID NO: 66883 - RNA, 22 nt, Homo sapiens
caaaggcuguuauaggccagga

SEQ ID NO: 66884 - RNA, 22 nt, Homo sapiens
caaaggugcuuuccagguccaa

SEQ ID NO: 66885 - RNA, 22 nt, Homo sapiens
caaagugcugaaagaggccagg

SEQ ID NO: 66886 - RNA, 22 nt, Homo sapiens
caaauugcuugucuguagugga

SEQ ID NO: 66887 - RNA, 22 nt, Homo sapiens
caaauugcuuguggaggauaau

SEQ ID NO: 66888 - RNA, 20 nt, Homo sapiens
caaauugcuuucuugguuuu

SEQ ID NO: 66889 - RNA, 22 nt, Homo sapiens
caaccaguagcugaguucaaaa

SEQ ID NO: 66890 - RNA, 19 nt, Homo sapiens
caacccugcagagaaagga

SEQ ID NO: 66891 - RNA, 22 nt, Homo sapiens
caagugaauaguugcucucaga

SEQ ID NO: 66892 - RNA, 22 nt, Homo sapiens
caaguguuggcuuguauacaaa

SEQ ID NO: 66893 - RNA, 22 nt, Homo sapiens
caaucugucuuuuagggggcca

SEQ ID NO: 66894 - RNA, 21 nt, Homo sapiens
caaugacacuguagcugugcu

SEQ ID NO: 66895 - RNA, 22 nt, Homo sapiens
caaugcagcuuuuggagagaaa

SEQ ID NO: 66896 - RNA, 21 nt, Homo sapiens
caauggcacgaucuuggcuca

SEQ ID NO: 66897 - RNA, 22 nt, Homo sapiens
caaugguccccauuggcaggaa

SEQ ID NO: 66898 - RNA, 22 nt, Homo sapiens
cacaaaguagauuagucuucca

SEQ ID NO: 66899 - RNA, 22 nt, Homo sapiens
cacaaccuccgccuccuggguu

SEQ ID NO: 66900 - RNA, 22 nt, Homo sapiens
cacaaugucugguaggccacuu

SEQ ID NO: 66901 - RNA, 22 nt, Homo sapiens
cacagagugagacccugucucu

SEQ ID NO: 66902 - RNA, 22 nt, Homo sapiens
cacagggcuaacauuuuugccc

SEQ ID NO: 66903 - RNA, 22 nt, Homo sapiens
cacauagucccugcuaaucuuc

SEQ ID NO: 66904 - RNA, 21 nt, Homo sapiens
cacauggaggcagagagugua

SEQ ID NO: 66905 - RNA, 22 nt, Homo sapiens
cacauugaauuucugaugacaa

SEQ ID NO: 66906 - RNA, 22 nt, Homo sapiens
cacauugcaggaaaguucauua

SEQ ID NO: 66907 - RNA, 22 nt, Homo sapiens
caccaggugcccagcacggcca

SEQ ID NO: 66908 - RNA, 23 nt, Homo sapiens
caccaguagaaugugugggaggg

SEQ ID NO: 66909 - RNA, 19 nt, Homo sapiens
caccagugcaugcuacuau

SEQ ID NO: 66910 - RNA, 22 nt, Homo sapiens
caccaguuuuucagugauucaa

SEQ ID NO: 66911 - RNA, 22 nt, Homo sapiens
cacccuaucagauguccagaga

SEQ ID NO: 66912 - RNA, 22 nt, Homo sapiens
cacccuuagaguuggaaguggg

SEQ ID NO: 66913 - RNA, 22 nt, Homo sapiens
caccgagguuggagugcagugg

SEQ ID NO: 66914 - RNA, 22 nt, Homo sapiens
caccgagugugccaucuucuca

SEQ ID NO: 66915 - RNA, 22 nt, Homo sapiens
caccuguagucccagcugaggc

SEQ ID NO: 66916 - RNA, 22 nt, Homo sapiens
cacgugcuuucuuuucauuuag

SEQ ID NO: 66917 - RNA, 22 nt, Homo sapiens
cacuaccucuacaggcagcugg

SEQ ID NO: 66918 - RNA, 22 nt, Homo sapiens
cacuagagaauagguaguucug

SEQ ID NO: 66919 - RNA, 22 nt, Homo sapiens
cacuaggcuggagugcaguggc

SEQ ID NO: 66920 - RNA, 18 nt, Homo sapiens
cacugagcccuucacucu

SEQ ID NO: 66921 - RNA, 22 nt, Homo sapiens
cacugcacuccagccuaagagg

SEQ ID NO: 66922 - RNA, 22 nt, Homo sapiens
cacugcacuccaguuuggauga

SEQ ID NO: 66923 - RNA, 21 nt, Homo sapiens
cacugcacuugccuucugggu

SEQ ID NO: 66924 - RNA, 22 nt, Homo sapiens
cacugcaguggaagauuaagaa

SEQ ID NO: 66925 - RNA, 22 nt, Homo sapiens
cacugcauuacucaugagcaug

SEQ ID NO: 66926 - RNA, 22 nt, Homo sapiens
cacugcauucuccaccucccag

SEQ ID NO: 66927 - RNA, 22 nt, Homo sapiens
cacugcgaccuccaccucccgg

SEQ ID NO: 66928 - RNA, 22 nt, Homo sapiens
cacugggccaucacuuaauauu

SEQ ID NO: 66929 - RNA, 22 nt, Homo sapiens
cagaaguauugguaugcucugu

SEQ ID NO: 66930 - RNA, 22 nt, Homo sapiens
cagagaacugaguuauuuucuu

SEQ ID NO: 66931 - RNA, 22 nt, Homo sapiens
cagagaaugucuuuuuuaacca

SEQ ID NO: 66932 - RNA, 22 nt, Homo sapiens
cagagagcuugcccuuguauau

SEQ ID NO: 66933 - RNA, 22 nt, Homo sapiens
cagagguaagcaagucagcauu

SEQ ID NO: 66934 - RNA, 22 nt, Homo sapiens
cagagguauugcaaaagccuag

SEQ ID NO: 66935 - RNA, 22 nt, Homo sapiens
cagagugcauguuuagaugagu

SEQ ID NO: 66936 - RNA, 22 nt, Homo sapiens
cagauacucauggaacuggguu

SEQ ID NO: 66937 - RNA, 22 nt, Homo sapiens
cagauaguuguagguguguggc

SEQ ID NO: 66938 - RNA, 22 nt, Homo sapiens
cagcaaaucauccuauuugagc

SEQ ID NO: 66939 - RNA, 22 nt, Homo sapiens
cagcacauagcaguugcucagu

SEQ ID NO: 66940 - RNA, 22 nt, Homo sapiens
cagcccuacacagacugacuca

SEQ ID NO: 66941 - RNA, 22 nt, Homo sapiens
cagccgggugagguggcuuguu

SEQ ID NO: 66942 - RNA, 22 nt, Homo sapiens
cagccggguggcuccuagggua

SEQ ID NO: 66943 - RNA, 22 nt, Homo sapiens
cagcuaguuuuugguuuacagu

SEQ ID NO: 66944 - RNA, 23 nt, Homo sapiens
cagcucauuuggguccccuuguc

SEQ ID NO: 66945 - RNA, 22 nt, Homo sapiens
cagcuggugcugcaccaguggg

SEQ ID NO: 66946 - RNA, 22 nt, Homo sapiens
cagcuguuguuaugucugcagg

SEQ ID NO: 66947 - RNA, 23 nt, Homo sapiens
cagcuucauugaacauaacuccu

SEQ ID NO: 66948 - RNA, 22 nt, Homo sapiens
cagcuugugguauugcugguug

SEQ ID NO: 66949 - RNA, 22 nt, Homo sapiens
caggaaugugaggguucccugc

SEQ ID NO: 66950 - RNA, 22 nt, Homo sapiens
caggcaaggugaaguguacugg

SEQ ID NO: 66951 - RNA, 22 nt, Homo sapiens
caggcauuguccaugcugaagg

SEQ ID NO: 66952 - RNA, 22 nt, Homo sapiens
cagggaauguuauuuaauagca

SEQ ID NO: 66953 - RNA, 22 nt, Homo sapiens
cagguaagaugcuuucucuuau

SEQ ID NO: 66954 - RNA, 22 nt, Homo sapiens
cagguacaugcaugugugugca

SEQ ID NO: 66955 - RNA, 23 nt, Homo sapiens
cagguaguucuuuauaguagugu

SEQ ID NO: 66956 - RNA, 22 nt, Homo sapiens
cagguauagucacuugcccaag

SEQ ID NO: 66957 - RNA, 22 nt, Homo sapiens
caggugguauuugguuuucugu

SEQ ID NO: 66958 - RNA, 22 nt, Homo sapiens
caguacaauguggaaaaggagu

SEQ ID NO: 66959 - RNA, 22 nt, Homo sapiens
caguagcaugccucagaaugag

SEQ ID NO: 66960 - RNA, 22 nt, Homo sapiens
uuugggccucugauuucuuugg

SEQ ID NO: 66961 - RNA, 22 nt, Homo sapiens
uuugggcuuuuaaucuagagca

SEQ ID NO: 66962 - RNA, 22 nt, Homo sapiens
uuugguaauguuucauugcaga

SEQ ID NO: 66963 - RNA, 22 nt, Homo sapiens
uuuggucuuuuguaaguuaucu

SEQ ID NO: 66964 - RNA, 22 nt, Homo sapiens
uuugguuauuugaaacuagcau

SEQ ID NO: 66965 - RNA, 22 nt, Homo sapiens
uuugguugucacaacuggggga

SEQ ID NO: 66966 - RNA, 22 nt, Homo sapiens
uuugguuuuuguuaucacucau

SEQ ID NO: 66967 - RNA, 18 nt, Homo sapiens
uuuguacuuuuucuaaug

SEQ ID NO: 66968 - RNA, 22 nt, Homo sapiens
uuuguagcucacucugagcuga

SEQ ID NO: 66969 - RNA, 22 nt, Homo sapiens
uuugucccuuugcaguggcaca

SEQ ID NO: 66970 - RNA, 19 nt, Homo sapiens
uuuguccugcccuuucuca

SEQ ID NO: 66971 - RNA, 22 nt, Homo sapiens
uuugucuccuaagacucugugg

SEQ ID NO: 66972 - RNA, 22 nt, Homo sapiens
uuugugacuugcuucucagaau

SEQ ID NO: 66973 - RNA, 22 nt, Homo sapiens
uuugugagguggauagauugca

SEQ ID NO: 66974 - RNA, 23 nt, Homo sapiens
uuugugcuaauuuaugggcucuu

SEQ ID NO: 66975 - RNA, 22 nt, Homo sapiens
uuugugcuauguuauauauucu

SEQ ID NO: 66976 - RNA, 22 nt, Homo sapiens
uuugugcuccucucaguaugug

SEQ ID NO: 66977 - RNA, 22 nt, Homo sapiens
uuugugcuccugugagaaucua

SEQ ID NO: 66978 - RNA, 22 nt, Homo sapiens
uuugugcuccuguugagaaucu

SEQ ID NO: 66979 - RNA, 21 nt, Homo sapiens
uuugugguuacugugugagcu

SEQ ID NO: 66980 - RNA, 22 nt, Homo sapiens
uuuguucuucguuccugagcca

SEQ ID NO: 66981 - RNA, 22 nt, Homo sapiens
uuuuacacuucgguugugugca

SEQ ID NO: 66982 - RNA, 22 nt, Homo sapiens
uuuuacagaggagguugcugau

SEQ ID NO: 66983 - RNA, 20 nt, Homo sapiens
uuuuagcuuuuauugaaagc

SEQ ID NO: 66984 - RNA, 22 nt, Homo sapiens
uuuuauguuuguucccugccaa

SEQ ID NO: 66985 - RNA, 22 nt, Homo sapiens
uuuucacggugucccagagagu

SEQ ID NO: 66986 - RNA, 22 nt, Homo sapiens
uuuucaguggccauaguggaga

SEQ ID NO: 66987 - RNA, 19 nt, Homo sapiens
uuuuccccuuucuuaagac

SEQ ID NO: 66988 - RNA, 22 nt, Homo sapiens
uuuugcaaauuccaguggccau

SEQ ID NO: 66989 - RNA, 22 nt, Homo sapiens
uuuugcacuguuuuaucugaca

SEQ ID NO: 66990 - RNA, 22 nt, Homo sapiens
uuuugcaggcauuggaaguuua

SEQ ID NO: 66991 - RNA, 18 nt, Homo sapiens
uuuugcuuaacugcgcca

SEQ ID NO: 66992 - RNA, 19 nt, Homo sapiens
uuuuggaaaugugaacagc

SEQ ID NO: 66993 - RNA, 22 nt, Homo sapiens
uuuuggacuucaauuugacacu

SEQ ID NO: 66994 - RNA, 22 nt, Homo sapiens
uuuuggcucugucuguaucuuu

SEQ ID NO: 66995 - RNA, 22 nt, Homo sapiens
uuuuggcucuugguaggucaga

SEQ ID NO: 66996 - RNA, 21 nt, Homo sapiens
uuuuggucauucaggaagaaa

SEQ ID NO: 66997 - RNA, 22 nt, Homo sapiens
uuuuggucuccaguuucugcug

SEQ ID NO: 66998 - RNA, 22 nt, Homo sapiens
uuuuggugguuaugugucaaug

SEQ ID NO: 66999 - RNA, 22 nt, Homo sapiens
uuuugguguauuguauaaggua

SEQ ID NO: 67000 - RNA, 22 nt, Homo sapiens
uuuugguucaauuaauuugcua

SEQ ID NO: 67001 - RNA, 22 nt, Homo sapiens
uuuuucacuuaaguuaggcuca

SEQ ID NO: 67002 - RNA, 22 nt, Homo sapiens
uuuuugauuaauggguagacca

SEQ ID NO: 67003 - RNA, 22 nt, Homo sapiens
uuuuuggaggagguuagaucau

SEQ ID NO: 67004 - RNA, 22 nt, Homo sapiens
uuuuugugguauauugcaacaa

SEQ ID NO: 67005 - RNA, 22 nt, Homo sapiens
uuuuuugcuguaugcaaacauc

SEQ ID NO: 67006 - RNA, 22 nt, Homo sapiens
ugagacuguuuuggggaacuuc

SEQ ID NO: 67007 - RNA, 22 nt, Homo sapiens
ugagagaugauaaaauguuugu

SEQ ID NO: 67008 - RNA, 22 nt, Homo sapiens
ugagagcugcauucuugaaagc

SEQ ID NO: 67009 - RNA, 22 nt, Homo sapiens
ugagaggugaauggcaggcuca

SEQ ID NO: 67010 - RNA, 22 nt, Homo sapiens
ugagaguagggguugggauugg

SEQ ID NO: 67011 - RNA, 22 nt, Homo sapiens
ugagagucauacaaauaaaaau

SEQ ID NO: 67012 - RNA, 21 nt, Homo sapiens
ugagauaauauguuucugaug

SEQ ID NO: 67013 - RNA, 22 nt, Homo sapiens
ugagauaguuguagauguacau

SEQ ID NO: 67014 - RNA, 22 nt, Homo sapiens
ugagauaucauuucacacccag

SEQ ID NO: 67015 - RNA, 22 nt, Homo sapiens
ugagaucacgccacugcacucc

SEQ ID NO: 67016 - RNA, 22 nt, Homo sapiens
ugagaucacuaagagguaaugg

SEQ ID NO: 67017 - RNA, 23 nt, Homo sapiens
ugagaucuacagaucucagaucu

SEQ ID NO: 67018 - RNA, 22 nt, Homo sapiens
ugagaucugucuuuauaguauu

SEQ ID NO: 67019 - RNA, 22 nt, Homo sapiens
ugagaugacgacacaccucagu

SEQ ID NO: 67020 - RNA, 22 nt, Homo sapiens
ugagaugagggaagccuaggca

SEQ ID NO: 67021 - RNA, 22 nt, Homo sapiens
ugagaugaggucucacucuguu

SEQ ID NO: 67022 - RNA, 22 nt, Homo sapiens
ugagaugaggucucgcucuguc

SEQ ID NO: 67023 - RNA, 22 nt, Homo sapiens
ugagaugauagauauguuaauu

SEQ ID NO: 67024 - RNA, 22 nt, Homo sapiens
ugagaugaucaaaguauaggcu

SEQ ID NO: 67025 - RNA, 22 nt, Homo sapiens
ugagaugcauauucuggcuccu

SEQ ID NO: 67026 - RNA, 22 nt, Homo sapiens
ugagaugcucgccggccagcau

SEQ ID NO: 67027 - RNA, 22 nt, Homo sapiens
ugagauggaguuucgcucuugu

SEQ ID NO: 67028 - RNA, 22 nt, Homo sapiens
ugagauggaucuuggauuugaa

SEQ ID NO: 67029 - RNA, 22 nt, Homo sapiens
ugagauggguaauuaaauggug

SEQ ID NO: 67030 - RNA, 22 nt, Homo sapiens
ugagauguaaucucgcucuguc

SEQ ID NO: 67031 - RNA, 22 nt, Homo sapiens
ugagaugugaagaucacaugaa

SEQ ID NO: 67032 - RNA, 22 nt, Homo sapiens
ugagaugugaucaccugaaggg

SEQ ID NO: 67033 - RNA, 22 nt, Homo sapiens
ugagauguggcuagagagguug

SEQ ID NO: 67034 - RNA, 22 nt, Homo sapiens
ugagauguuccaaugacuauua

SEQ ID NO: 67035 - RNA, 22 nt, Homo sapiens
ugagauguuuagauuguugucu

SEQ ID NO: 67036 - RNA, 23 nt, Homo sapiens
ugagauuacccagaaagaguaua

SEQ ID NO: 67037 - RNA, 23 nt, Homo sapiens
ugagauuauaaucuuuuacuucu

SEQ ID NO: 67038 - RNA, 22 nt, Homo sapiens
ugagauuaucuguacauaggag

SEQ ID NO: 67039 - RNA, 22 nt, Homo sapiens
ugagauuaucuugaucuugaaa

SEQ ID NO: 67040 - RNA, 20 nt, Homo sapiens
ugagauuggugugguauaag

SEQ ID NO: 67041 - RNA, 22 nt, Homo sapiens
ugauacugugcauuagaggcua

SEQ ID NO: 67042 - RNA, 22 nt, Homo sapiens
ugauagaucugggcaaaguaaa

SEQ ID NO: 67043 - RNA, 22 nt, Homo sapiens
ugauaggucuguuuugaaaagg

SEQ ID NO: 67044 - RNA, 22 nt, Homo sapiens
ugauaugaaagggaaauaagug

SEQ ID NO: 67045 - RNA, 22 nt, Homo sapiens
ugauaugaaguuagcuggcugu

SEQ ID NO: 67046 - RNA, 22 nt, Homo sapiens
ugauaugaaguucaaaccaggu

SEQ ID NO: 67047 - RNA, 22 nt, Homo sapiens
ugauaugcuuugaacucucugg

SEQ ID NO: 67048 - RNA, 21 nt, Homo sapiens
ugauaugguagaagagagaca

SEQ ID NO: 67049 - RNA, 21 nt, Homo sapiens
ugauaugguuuggauaugugu

SEQ ID NO: 67050 - RNA, 22 nt, Homo sapiens
ugauauguggauucagcucaaa

SEQ ID NO: 67051 - RNA, 22 nt, Homo sapiens
ugauauguggcuauugagauug

SEQ ID NO: 67052 - RNA, 22 nt, Homo sapiens
ugaucucauuagcaccuuuagc

SEQ ID NO: 67053 - RNA, 22 nt, Homo sapiens
ugaucugucacuuaucacauuu

SEQ ID NO: 67054 - RNA, 22 nt, Homo sapiens
ugaucugucucggguuaucagu

SEQ ID NO: 67055 - RNA, 22 nt, Homo sapiens
ugaugaaguauaggaagggcuu

SEQ ID NO: 67056 - RNA, 22 nt, Homo sapiens
ugaugacucuguggccccaggc

SEQ ID NO: 67057 - RNA, 21 nt, Homo sapiens
ugaugcuuuucuuaaccuugc

SEQ ID NO: 67058 - RNA, 22 nt, Homo sapiens
ugauggcaauggcauucauuuu

SEQ ID NO: 67059 - RNA, 22 nt, Homo sapiens
ugauggcacagugaguuccagg

SEQ ID NO: 67060 - RNA, 22 nt, Homo sapiens
ugauggcauuucauguuuguaa

SEQ ID NO: 67061 - RNA, 22 nt, Homo sapiens
ugaugguaguucagucaaugua

SEQ ID NO: 67062 - RNA, 22 nt, Homo sapiens
ugaugguccauaguucauggua

SEQ ID NO: 67063 - RNA, 22 nt, Homo sapiens
ugaugguuuuaaaaagaggagu

SEQ ID NO: 67064 - RNA, 22 nt, Homo sapiens
ugaugucuugagauggagcuua

SEQ ID NO: 67065 - RNA, 22 nt, Homo sapiens
ugaugucuugcaggcacgagau

SEQ ID NO: 67066 - RNA, 21 nt, Homo sapiens
ugauguugaccuaaguaguga

SEQ ID NO: 67067 - RNA, 22 nt, Homo sapiens
ugauuagaggaaugguagauua

SEQ ID NO: 67068 - RNA, 20 nt, Homo sapiens
ugauugaccagagcaguuuu

SEQ ID NO: 67069 - RNA, 22 nt, Homo sapiens
ugauuuguuucaggaguuuucu

SEQ ID NO: 67070 - RNA, 19 nt, Homo sapiens
ugcaaagucagugaagggu

SEQ ID NO: 67071 - RNA, 22 nt, Homo sapiens
ugcaaaugucaaggguuagugu

SEQ ID NO: 67072 - RNA, 22 nt, Homo sapiens
ugcaaauguuauuuugguuucu

SEQ ID NO: 67073 - RNA, 22 nt, Homo sapiens
ugcaacacauugccccugcucu

SEQ ID NO: 67074 - RNA, 22 nt, Homo sapiens
ugcaacauguguaccacucugu

SEQ ID NO: 67075 - RNA, 21 nt, Homo sapiens
ugcaagaaucaggaagcugcc

SEQ ID NO: 67076 - RNA, 22 nt, Homo sapiens
ugcaagacacuguccugggcau

SEQ ID NO: 67077 - RNA, 22 nt, Homo sapiens
uaucugguuauugcugcugauu

SEQ ID NO: 67078 - RNA, 20 nt, Homo sapiens
uaugaaacaguguagagcaa

SEQ ID NO: 67079 - RNA, 22 nt, Homo sapiens
uaugacauaguccuuaacccuc

SEQ ID NO: 67080 - RNA, 22 nt, Homo sapiens
uaugaccuuggacaaguuacuu

SEQ ID NO: 67081 - RNA, 22 nt, Homo sapiens
uaugacugagacuuaaauugug

SEQ ID NO: 67082 - RNA, 22 nt, Homo sapiens
uaugacuuguuuucuggucugc

SEQ ID NO: 67083 - RNA, 20 nt, Homo sapiens
uaugagacugggagaaguuc

SEQ ID NO: 67084 - RNA, 22 nt, Homo sapiens
uaugagcacauauguaucuaug

SEQ ID NO: 67085 - RNA, 22 nt, Homo sapiens
uaugaggaguauaacccgguga

SEQ ID NO: 67086 - RNA, 21 nt, Homo sapiens
uaugagucugcaagaaccaca

SEQ ID NO: 67087 - RNA, 22 nt, Homo sapiens
uaugaucauuauguuauugcag

SEQ ID NO: 67088 - RNA, 22 nt, Homo sapiens
uaugaugcuguuuagaaucucu

SEQ ID NO: 67089 - RNA, 22 nt, Homo sapiens
uaugcacacacguguuuaugug

SEQ ID NO: 67090 - RNA, 22 nt, Homo sapiens
uaugcacacucucccaggaggg

SEQ ID NO: 67091 - RNA, 22 nt, Homo sapiens
uaugcacaugugccugggugug

SEQ ID NO: 67092 - RNA, 22 nt, Homo sapiens
uaugcacuaggcacuguguuug

SEQ ID NO: 67093 - RNA, 19 nt, Homo sapiens
uaugcuauuuauuagaagu

SEQ ID NO: 67094 - RNA, 22 nt, Homo sapiens
uauggauuugccuauucuguau

SEQ ID NO: 67095 - RNA, 22 nt, Homo sapiens
uauggauuuucagauucuuauc

SEQ ID NO: 67096 - RNA, 22 nt, Homo sapiens
uauggauuuuggaauauguggg

SEQ ID NO: 67097 - RNA, 22 nt, Homo sapiens
uauggauuuuuuugacaagagc

SEQ ID NO: 67098 - RNA, 22 nt, Homo sapiens
uauggcacacguuuaccuaugu

SEQ ID NO: 67099 - RNA, 22 nt, Homo sapiens
uauggcauuauuuugauagaca

SEQ ID NO: 67100 - RNA, 22 nt, Homo sapiens
uauggcauuguuggugaugaua

SEQ ID NO: 67101 - RNA, 22 nt, Homo sapiens
uauggccugcguccagugguau

SEQ ID NO: 67102 - RNA, 22 nt, Homo sapiens
uauggcuacuacgaauaaugcu

SEQ ID NO: 67103 - RNA, 22 nt, Homo sapiens
uauggcucuauuuccuugucua

SEQ ID NO: 67104 - RNA, 22 nt, Homo sapiens
uauggcuucuuauucuuucccg

SEQ ID NO: 67105 - RNA, 22 nt, Homo sapiens
uauggcuuucuacuugaguucu

SEQ ID NO: 67106 - RNA, 22 nt, Homo sapiens
uauggcuuuucacuuaaguccu

SEQ ID NO: 67107 - RNA, 22 nt, Homo sapiens
uauggguuuauuucuggucuca

SEQ ID NO: 67108 - RNA, 21 nt, Homo sapiens
uaugguuucuaauucugcagg

SEQ ID NO: 67109 - RNA, 20 nt, Homo sapiens
uaugguuuuagguauagcau

SEQ ID NO: 67110 - RNA, 17 nt, Homo sapiens
uauguaguacuuauaaa

SEQ ID NO: 67111 - RNA, 22 nt, Homo sapiens
uaugucacagguuuuggugaaa

SEQ ID NO: 67112 - RNA, 22 nt, Homo sapiens
uaugucacuugguuuggugcua

SEQ ID NO: 67113 - RNA, 22 nt, Homo sapiens
uaugucaugggguuuuugagau

SEQ ID NO: 67114 - RNA, 22 nt, Homo sapiens
uauguuaucaaaaagcuaagga

SEQ ID NO: 67115 - RNA, 22 nt, Homo sapiens
uauuacagaccauaucgccggg

SEQ ID NO: 67116 - RNA, 22 nt, Homo sapiens
uauuaguuuucuguggauuaca

SEQ ID NO: 67117 - RNA, 22 nt, Homo sapiens
uauuauagugauaggucuacug

SEQ ID NO: 67118 - RNA, 22 nt, Homo sapiens
uauucaagccaaauucaagcca

SEQ ID NO: 67119 - RNA, 22 nt, Homo sapiens
uauucacaggugugggacaaag

SEQ ID NO: 67120 - RNA, 22 nt, Homo sapiens
uauuccacaauaugauuuuuaa

SEQ ID NO: 67121 - RNA, 22 nt, Homo sapiens
uauuccacucuguuggagguaa

SEQ ID NO: 67122 - RNA, 22 nt, Homo sapiens
uauugaacuggaucagaaggcc

SEQ ID NO: 67123 - RNA, 17 nt, Homo sapiens
uauugaccuuuguaugu

SEQ ID NO: 67124 - RNA, 22 nt, Homo sapiens
uauugacuugagaagggauuag

SEQ ID NO: 67125 - RNA, 22 nt, Homo sapiens
uauugauuuucaguguucagcu

SEQ ID NO: 67126 - RNA, 22 nt, Homo sapiens
uauugcaacagaagaaagaguc

SEQ ID NO: 67127 - RNA, 23 nt, Homo sapiens
uauugcacuaugguaacccuuuu

SEQ ID NO: 67128 - RNA, 20 nt, Homo sapiens
uauugccuaaauaccagaau

SEQ ID NO: 67129 - RNA, 22 nt, Homo sapiens
uauugccucuuuuguaaaagug

SEQ ID NO: 67130 - RNA, 22 nt, Homo sapiens
uauugcucaugcauuuaauuuc

SEQ ID NO: 67131 - RNA, 22 nt, Homo sapiens
uauugcugaaaaugcuaaugau

SEQ ID NO: 67132 - RNA, 22 nt, Homo sapiens
uauugcugaugcugaagggaag

SEQ ID NO: 67133 - RNA, 22 nt, Homo sapiens
uauugcuggauguauuacaugu

SEQ ID NO: 67134 - RNA, 22 nt, Homo sapiens
uauugcuggcacauaguagguc

SEQ ID NO: 67135 - RNA, 22 nt, Homo sapiens
uauugcuuuacucucuuauccu

SEQ ID NO: 67136 - RNA, 22 nt, Homo sapiens
uauuguccaauaggauguuccu

SEQ ID NO: 67137 - RNA, 22 nt, Homo sapiens
uauuguuuuucccaggagucua

SEQ ID NO: 67138 - RNA, 22 nt, Homo sapiens
uauuucccuuaacuuuccugca

SEQ ID NO: 67139 - RNA, 22 nt, Homo sapiens
uauuugauuaacaagagccuaa

SEQ ID NO: 67140 - RNA, 22 nt, Homo sapiens
uauuugauugacuuuagcagga

SEQ ID NO: 67141 - RNA, 22 nt, Homo sapiens
uauuuguccccuccaaaaguca

SEQ ID NO: 67142 - RNA, 22 nt, Homo sapiens
ucaaacauccccaccagggacu

SEQ ID NO: 67143 - RNA, 20 nt, Homo sapiens
ucaaagacauggcugucaga

SEQ ID NO: 67144 - RNA, 22 nt, Homo sapiens
ucaaaguauucuucugagaacc

SEQ ID NO: 67145 - RNA, 22 nt, Homo sapiens
ucaaauguucccuguacuggcc

SEQ ID NO: 67146 - RNA, 20 nt, Homo sapiens
ucaaauucuuggccuccagc

SEQ ID NO: 67147 - RNA, 22 nt, Homo sapiens
ucaacagugggcacuguaaaug

SEQ ID NO: 67148 - RNA, 22 nt, Homo sapiens
ucaagcaauucgccugucucag

SEQ ID NO: 67149 - RNA, 22 nt, Homo sapiens
ucaagcaauucuccucucagcc

SEQ ID NO: 67150 - RNA, 22 nt, Homo sapiens
ucaagcaauucugcugccucag

SEQ ID NO: 67151 - RNA, 18 nt, Homo sapiens
ucaagcaauugucaugcc

SEQ ID NO: 67152 - RNA, 22 nt, Homo sapiens
ucaaggcacauuugacauuuuc

SEQ ID NO: 67153 - RNA, 22 nt, Homo sapiens
ucaaggcacuagcugagcugca

SEQ ID NO: 67154 - RNA, 20 nt, Homo sapiens
ucaaggcaggaacuguacau

SEQ ID NO: 67155 - RNA, 22 nt, Homo sapiens
aucagauuccagaggcagcacc

SEQ ID NO: 67156 - RNA, 22 nt, Homo sapiens
aucagcagcaugaaaacaggcu

SEQ ID NO: 67157 - RNA, 22 nt, Homo sapiens
aucagcaugcagaagucggggg

SEQ ID NO: 67158 - RNA, 22 nt, Homo sapiens
aucaggaaccuuuuuggugugu

SEQ ID NO: 67159 - RNA, 18 nt, Homo sapiens
aucagggugaagagagga

SEQ ID NO: 67160 - RNA, 22 nt, Homo sapiens
aucagugaaagugaaaucuccg

SEQ ID NO: 67161 - RNA, 22 nt, Homo sapiens
aucagugauugauuuaaagacg

SEQ ID NO: 67162 - RNA, 22 nt, Homo sapiens
aucauaucauuggugaacagug

SEQ ID NO: 67163 - RNA, 22 nt, Homo sapiens
aucaucacaguuguguguaaug

SEQ ID NO: 67164 - RNA, 22 nt, Homo sapiens
auccaagagacugaugacuucc

SEQ ID NO: 67165 - RNA, 22 nt, Homo sapiens
auccaguuuuaggagauuucua

SEQ ID NO: 67166 - RNA, 22 nt, Homo sapiens
aucccaguucagccucugacac

SEQ ID NO: 67167 - RNA, 20 nt, Homo sapiens
aucccauuccugaagauacu

SEQ ID NO: 67168 - RNA, 22 nt, Homo sapiens
auccccuugcagugaccggggc

SEQ ID NO: 67169 - RNA, 22 nt, Homo sapiens
aucccugagccugacucucaga

SEQ ID NO: 67170 - RNA, 22 nt, Homo sapiens
aucccuguguccagcaccugug

SEQ ID NO: 67171 - RNA, 22 nt, Homo sapiens
aucccuugacguggagucucug

SEQ ID NO: 67172 - RNA, 22 nt, Homo sapiens
aucccuuucugauacuuucccu

SEQ ID NO: 67173 - RNA, 22 nt, Homo sapiens
auccuacaguccauucuuugug

SEQ ID NO: 67174 - RNA, 22 nt, Homo sapiens
auccuagguuagagaacaaaac

SEQ ID NO: 67175 - RNA, 22 nt, Homo sapiens
auccucugagagaguuucauaa

SEQ ID NO: 67176 - RNA, 22 nt, Homo sapiens
auccucugagaucuaggcagag

SEQ ID NO: 67177 - RNA, 22 nt, Homo sapiens
auccugaugacacagugcugca

SEQ ID NO: 67178 - RNA, 22 nt, Homo sapiens
auccuguaggcuaguagacagu

SEQ ID NO: 67179 - RNA, 22 nt, Homo sapiens
auccuguagucucacagcccca

SEQ ID NO: 67180 - RNA, 21 nt, Homo sapiens
auccuucuuuuucaaccugug

SEQ ID NO: 67181 - RNA, 22 nt, Homo sapiens
auccuugagaaaauaaaugacc

SEQ ID NO: 67182 - RNA, 22 nt, Homo sapiens
aucgcugagaaagggacuuuca

SEQ ID NO: 67183 - RNA, 22 nt, Homo sapiens
aucuaaucaucgcaaccuucaa

SEQ ID NO: 67184 - RNA, 22 nt, Homo sapiens
aucuagagacauaguaaagaau

SEQ ID NO: 67185 - RNA, 22 nt, Homo sapiens
aucucaguuaaugacccuaugc

SEQ ID NO: 67186 - RNA, 22 nt, Homo sapiens
aucucauuccuucugggcugau

SEQ ID NO: 67187 - RNA, 20 nt, Homo sapiens
aucucugggcaaaggaaaau

SEQ ID NO: 67188 - RNA, 22 nt, Homo sapiens
aucugcaaagcugggcugagac

SEQ ID NO: 67189 - RNA, 22 nt, Homo sapiens
aucugcaaauaaugaagauugg

SEQ ID NO: 67190 - RNA, 22 nt, Homo sapiens
auugucauuuucugagaaguaa

SEQ ID NO: 67191 - RNA, 22 nt, Homo sapiens
auuguccuacuaggguuccagu

SEQ ID NO: 67192 - RNA, 22 nt, Homo sapiens
auuguguuugaaugaggcucca

SEQ ID NO: 67193 - RNA, 22 nt, Homo sapiens
ccugagacgaauggagugaaca

SEQ ID NO: 67194 - RNA, 22 nt, Homo sapiens
ccugagguagaguuuauauuga

SEQ ID NO: 67195 - RNA, 21 nt, Homo sapiens
ccugaguacaacccacuccac

SEQ ID NO: 67196 - RNA, 22 nt, Homo sapiens
ccugcauaguucaccgcugaua

SEQ ID NO: 67197 - RNA, 22 nt, Homo sapiens
ccuggaaugaagcuuauauugc

SEQ ID NO: 67198 - RNA, 22 nt, Homo sapiens
ccuggcacugagcaguguucua

SEQ ID NO: 67199 - RNA, 22 nt, Homo sapiens
ccuggguuacaggugugagcca

SEQ ID NO: 67200 - RNA, 22 nt, Homo sapiens
ccugguguuuugauggucgggu

SEQ ID NO: 67201 - RNA, 22 nt, Homo sapiens
ccugucuugauuaaauuacuua

SEQ ID NO: 67202 - RNA, 22 nt, Homo sapiens
ccuucauugcaucuuuaagaga

SEQ ID NO: 67203 - RNA, 22 nt, Homo sapiens
ccuucuuuuguaaggcugaaua

SEQ ID NO: 67204 - RNA, 22 nt, Homo sapiens
ccuugcacuucccaagugaggc

SEQ ID NO: 67205 - RNA, 22 nt, Homo sapiens
ccuugcacuucccaggugaggc

SEQ ID NO: 67206 - RNA, 22 nt, Homo sapiens
ccuugguaauguguuuuauucu

SEQ ID NO: 67207 - RNA, 22 nt, Homo sapiens
ccuugguggccacaagacauug

SEQ ID NO: 67208 - RNA, 21 nt, Homo sapiens
ccuugguuaucuucccauuca

SEQ ID NO: 67209 - RNA, 22 nt, Homo sapiens
ccuuuguggggcgguggguaau

SEQ ID NO: 67210 - RNA, 22 nt, Homo sapiens
ccuuuguuaguuugcugagaau

SEQ ID NO: 67211 - RNA, 22 nt, Homo sapiens
cgaggaguaucuuugugguguu

SEQ ID NO: 67212 - RNA, 21 nt, Homo sapiens
cgauaacagcccuuucccaaa

SEQ ID NO: 67213 - RNA, 22 nt, Homo sapiens
cgcuggugucuaagcgacagcu

SEQ ID NO: 67214 - RNA, 22 nt, Homo sapiens
cggugcaauucuccugucucag

SEQ ID NO: 67215 - RNA, 21 nt, Homo sapiens
cgucauggagauguguuguac

SEQ ID NO: 67216 - RNA, 20 nt, Homo sapiens
cguugcacuccagccugggc

SEQ ID NO: 67217 - RNA, 22 nt, Homo sapiens
cuaaaggaaucugagccccuga

SEQ ID NO: 67218 - RNA, 19 nt, Homo sapiens
cuaaaugggucccuagugg

SEQ ID NO: 67219 - RNA, 22 nt, Homo sapiens
cuaacacagggcaagucaggcu

SEQ ID NO: 67220 - RNA, 22 nt, Homo sapiens
cuaaggcaguagccugaauaau

SEQ ID NO: 67221 - RNA, 22 nt, Homo sapiens
cuaagugaacugucacugagaa

SEQ ID NO: 67222 - RNA, 22 nt, Homo sapiens
cuaagugaguauaauuuuaaga

SEQ ID NO: 67223 - RNA, 22 nt, Homo sapiens
cuacagcacugagcugugugca

SEQ ID NO: 67224 - RNA, 22 nt, Homo sapiens
cuacaguagagaggauguagaa

SEQ ID NO: 67225 - RNA, 22 nt, Homo sapiens
cuacagugggucuguaguccuu

SEQ ID NO: 67226 - RNA, 22 nt, Homo sapiens
cuacaguuauguuuuaaaugug

SEQ ID NO: 67227 - RNA, 22 nt, Homo sapiens
cuacaguucucaggaguuggcc

SEQ ID NO: 67228 - RNA, 23 nt, Homo sapiens
cuacuagucaagucuuuuccagu

SEQ ID NO: 67229 - RNA, 22 nt, Homo sapiens
cuacugcacaucaucugaguua

SEQ ID NO: 67230 - RNA, 22 nt, Homo sapiens
cuagaagguaagagcuggaugc

SEQ ID NO: 67231 - RNA, 22 nt, Homo sapiens
cuagaauguauaaaaccaagcu

SEQ ID NO: 67232 - RNA, 22 nt, Homo sapiens
cuagacuagacccaaauugaag

SEQ ID NO: 67233 - RNA, 22 nt, Homo sapiens
cugaauguuucacucugaaaug

SEQ ID NO: 67234 - RNA, 22 nt, Homo sapiens
cugacaagauucaucacucagu

SEQ ID NO: 67235 - RNA, 22 nt, Homo sapiens
cugacagucucauugauuugcu

SEQ ID NO: 67236 - RNA, 17 nt, Homo sapiens
cugaccucauuguguac

SEQ ID NO: 67237 - RNA, 22 nt, Homo sapiens
cugaccucugucaaagacaccc

SEQ ID NO: 67238 - RNA, 22 nt, Homo sapiens
cugacuaguuuuaaugcagauu

SEQ ID NO: 67239 - RNA, 22 nt, Homo sapiens
cugacugaggaucaguucauca

SEQ ID NO: 67240 - RNA, 22 nt, Homo sapiens
cugacuuauguggacuauuuca

SEQ ID NO: 67241 - RNA, 22 nt, Homo sapiens
cugagaaugaugauuuccaguu

SEQ ID NO: 67242 - RNA, 22 nt, Homo sapiens
cugagaauguaaaugaagcuuu

SEQ ID NO: 67243 - RNA, 22 nt, Homo sapiens
cugagaguugaugaaauauggu

SEQ ID NO: 67244 - RNA, 22 nt, Homo sapiens
cugagcaaaguucuauuuaugg

SEQ ID NO: 67245 - RNA, 22 nt, Homo sapiens
cugagcuagaccacuuggcucc

SEQ ID NO: 67246 - RNA, 22 nt, Homo sapiens
cugagcuaugccuggaaaggca

SEQ ID NO: 67247 - RNA, 22 nt, Homo sapiens
cugaggguagaaggaucacuug

SEQ ID NO: 67248 - RNA, 22 nt, Homo sapiens
cugagguauuuaggugaaagaa

SEQ ID NO: 67249 - RNA, 22 nt, Homo sapiens
cugaggucugaauccagguauc

SEQ ID NO: 67250 - RNA, 22 nt, Homo sapiens
cugaggugggagaaucacauaa

SEQ ID NO: 67251 - RNA, 22 nt, Homo sapiens
cugagguuaggaguuugagacc

SEQ ID NO: 67252 - RNA, 20 nt, Homo sapiens
cugauacagccugagcucuc

SEQ ID NO: 67253 - RNA, 22 nt, Homo sapiens
cugauacucuccuuuuagagag

SEQ ID NO: 67254 - RNA, 22 nt, Homo sapiens
cugauaguucucuuuagaguuu

SEQ ID NO: 67255 - RNA, 22 nt, Homo sapiens
cugauauuuuucuggcuugugu

SEQ ID NO: 67256 - RNA, 22 nt, Homo sapiens
cugaucuguagcagccaccaca

SEQ ID NO: 67257 - RNA, 22 nt, Homo sapiens
cugauguagguggucugugauc

SEQ ID NO: 67258 - RNA, 22 nt, Homo sapiens
cugauugucaucaauauuauua

SEQ ID NO: 67259 - RNA, 22 nt, Homo sapiens
cugauugugcagagguguaauu

SEQ ID NO: 67260 - RNA, 22 nt, Homo sapiens
cugcagguaggggcagcuuugg

SEQ ID NO: 67261 - RNA, 21 nt, Homo sapiens
cugcauccauuucugagugau

SEQ ID NO: 67262 - RNA, 22 nt, Homo sapiens
cugcauuggguuaugcauuuuu

SEQ ID NO: 67263 - RNA, 22 nt, Homo sapiens
cugcauuugaugacguauggug

SEQ ID NO: 67264 - RNA, 22 nt, Homo sapiens
cugccacugacaccucaaggac

SEQ ID NO: 67265 - RNA, 22 nt, Homo sapiens
cuggaaacaucuuaggaaugca

SEQ ID NO: 67266 - RNA, 22 nt, Homo sapiens
cuggaaagaaucaggcuaaacu

SEQ ID NO: 67267 - RNA, 22 nt, Homo sapiens
cuggaaggaaaaacaaccacag

SEQ ID NO: 67268 - RNA, 22 nt, Homo sapiens
cuggaaucuagaaaagguaagg

SEQ ID NO: 67269 - RNA, 22 nt, Homo sapiens
cuggaaugugagccccaaaaag

SEQ ID NO: 67270 - RNA, 22 nt, Homo sapiens
cuggaauguuccuaaagauuca

SEQ ID NO: 67271 - RNA, 22 nt, Homo sapiens
cuggagauauuggaagaaagaa

SEQ ID NO: 67272 - RNA, 22 nt, Homo sapiens
cuggagaucuugacauugaagu

SEQ ID NO: 67273 - RNA, 22 nt, Homo sapiens
cuggagcaaaggugacucuugu

SEQ ID NO: 67274 - RNA, 22 nt, Homo sapiens
cuggauagucaggagauauaua

SEQ ID NO: 67275 - RNA, 22 nt, Homo sapiens
cuggauauguugcaacauuucc

SEQ ID NO: 67276 - RNA, 18 nt, Homo sapiens
cuggaugucgaguguguu

SEQ ID NO: 67277 - RNA, 22 nt, Homo sapiens
cuggcaccauacacuguuguug

SEQ ID NO: 67278 - RNA, 22 nt, Homo sapiens
cuggcacccuugcuuaggaaga

SEQ ID NO: 67279 - RNA, 22 nt, Homo sapiens
cuggcucugagguguuuagggc

SEQ ID NO: 67280 - RNA, 22 nt, Homo sapiens
cuggcucugggcuaaagaaaua

SEQ ID NO: 67281 - RNA, 22 nt, Homo sapiens
cuggcugagugguaaguagagg

SEQ ID NO: 67282 - RNA, 22 nt, Homo sapiens
cugggaugugacuguugccccc

SEQ ID NO: 67283 - RNA, 22 nt, Homo sapiens
cuggguacccuuuaaacaggaa

SEQ ID NO: 67284 - RNA, 22 nt, Homo sapiens
uaaguggaagaugucaaucaua

SEQ ID NO: 67285 - RNA, 23 nt, Homo sapiens
uaaguucaucucuaauaggugga

SEQ ID NO: 67286 - RNA, 22 nt, Homo sapiens
uaaguucauucaugaaacuuag

SEQ ID NO: 67287 - RNA, 22 nt, Homo sapiens
uaaguuguagaacguuuucuua

SEQ ID NO: 67288 - RNA, 22 nt, Homo sapiens
uaaguuguugacauuaggggaa

SEQ ID NO: 67289 - RNA, 18 nt, Homo sapiens
uaauaacugugaccuuga

SEQ ID NO: 67290 - RNA, 22 nt, Homo sapiens
uaauacucuucucauuuuacag

SEQ ID NO: 67291 - RNA, 22 nt, Homo sapiens
uaauagagucauuauuauuguu

SEQ ID NO: 67292 - RNA, 22 nt, Homo sapiens
uaauaguuucagaaguuguuuu

SEQ ID NO: 67293 - RNA, 22 nt, Homo sapiens
uaauauguauacagacagauac

SEQ ID NO: 67294 - RNA, 22 nt, Homo sapiens
uaauccugucuugaccaucagg

SEQ ID NO: 67295 - RNA, 22 nt, Homo sapiens
uaaugcacucgaaucauggaau

SEQ ID NO: 67296 - RNA, 22 nt, Homo sapiens
uaaugugaauagugcuguaaug

SEQ ID NO: 67297 - RNA, 22 nt, Homo sapiens
uaauucacauaaagcacuuaga

SEQ ID NO: 67298 - RNA, 22 nt, Homo sapiens
uaauugaaugcagacaccaggg

SEQ ID NO: 67299 - RNA, 22 nt, Homo sapiens
uacaaagcuuugaugugucuuu

SEQ ID NO: 67300 - RNA, 22 nt, Homo sapiens
uacaaagugggaaacgaagguu

SEQ ID NO: 67301 - RNA, 22 nt, Homo sapiens
uacaagcaggaaaugguauaug

SEQ ID NO: 67302 - RNA, 21 nt, Homo sapiens
uacaagcuguagcacaugcca

SEQ ID NO: 67303 - RNA, 22 nt, Homo sapiens
uacaaguaauaagggaagaauu

SEQ ID NO: 67304 - RNA, 22 nt, Homo sapiens
uacaaguggguuugugcaggag

SEQ ID NO: 67305 - RNA, 22 nt, Homo sapiens
uacaauagugacaaaucagcau

SEQ ID NO: 67306 - RNA, 20 nt, Homo sapiens
uacacguguagcauucucua

SEQ ID NO: 67307 - RNA, 22 nt, Homo sapiens
uacagaguauccauuugaguuc

SEQ ID NO: 67308 - RNA, 23 nt, Homo sapiens
uacagcacacugaugggucuuga

SEQ ID NO: 67309 - RNA, 23 nt, Homo sapiens
uacagcugcagaaucaggcuaag

SEQ ID NO: 67310 - RNA, 22 nt, Homo sapiens
uacaggacuauagaacuuuccc

SEQ ID NO: 67311 - RNA, 19 nt, Homo sapiens
uacaggacugagcugaggu

SEQ ID NO: 67312 - RNA, 22 nt, Homo sapiens
uacagguaugugucuauauaca

SEQ ID NO: 67313 - RNA, 22 nt, Homo sapiens
uacaggugcuuauguggacaua

SEQ ID NO: 67314 - RNA, 19 nt, Homo sapiens
uacaguacacaacaccuuu

SEQ ID NO: 67315 - RNA, 22 nt, Homo sapiens
uacagucacauuccugaccaua

SEQ ID NO: 67316 - RNA, 22 nt, Homo sapiens
uacaguggaaguuaaccccauu

SEQ ID NO: 67317 - RNA, 22 nt, Homo sapiens
uacauagucuucuuuugguuau

SEQ ID NO: 67318 - RNA, 22 nt, Homo sapiens
uacaucagccugaaagagcucg

SEQ ID NO: 67319 - RNA, 19 nt, Homo sapiens
uacaugcagcaggcacgca

SEQ ID NO: 67320 - RNA, 22 nt, Homo sapiens
uacaugugccauguugguuugc

SEQ ID NO: 67321 - RNA, 22 nt, Homo sapiens
uacauugucauauucucucucu

SEQ ID NO: 67322 - RNA, 22 nt, Homo sapiens
uaccacauuguagagggcauuc

SEQ ID NO: 67323 - RNA, 22 nt, Homo sapiens
uaccacccuuuuuccagaagcc

SEQ ID NO: 67324 - RNA, 19 nt, Homo sapiens
uaccagcacaguguuugag

SEQ ID NO: 67325 - RNA, 22 nt, Homo sapiens
uaccagcauuucucuuuaagua

SEQ ID NO: 67326 - RNA, 22 nt, Homo sapiens
uaccaguaaugguucuagagga

SEQ ID NO: 67327 - RNA, 22 nt, Homo sapiens
uaccaugaagguggagagagaa

SEQ ID NO: 67328 - RNA, 22 nt, Homo sapiens
uaccauguaucugggaugcuuu

SEQ ID NO: 67329 - RNA, 19 nt, Homo sapiens
uacccagaagcagcauugu

SEQ ID NO: 67330 - RNA, 22 nt, Homo sapiens
uacccgucuacuuugaacaaaa

SEQ ID NO: 67331 - RNA, 19 nt, Homo sapiens
uacccuaguauauacagaa

SEQ ID NO: 67332 - RNA, 22 nt, Homo sapiens
uaccuaguaggugguuuuucag

SEQ ID NO: 67333 - RNA, 22 nt, Homo sapiens
uaccuguagacuacagcuucag

SEQ ID NO: 67334 - RNA, 22 nt, Homo sapiens
uacguguauuguuuucacaaga

SEQ ID NO: 67335 - RNA, 22 nt, Homo sapiens
uacuacagccugagcgacugag

SEQ ID NO: 67336 - RNA, 22 nt, Homo sapiens
uacuagaggcgggguuucgcca

SEQ ID NO: 67337 - RNA, 22 nt, Homo sapiens
uacuauugcaucggugauuagg

SEQ ID NO: 67338 - RNA, 22 nt, Homo sapiens
uacucaauugcagucaccuggc

SEQ ID NO: 67339 - RNA, 22 nt, Homo sapiens
uacucugcagccauaaaacaga

SEQ ID NO: 67340 - RNA, 19 nt, Homo sapiens
uacugcaccucaaccuggg

SEQ ID NO: 67341 - RNA, 22 nt, Homo sapiens
uacugcacuccaaccugagaga

SEQ ID NO: 67342 - RNA, 22 nt, Homo sapiens
uacugcacuccagccuugccaa

SEQ ID NO: 67343 - RNA, 20 nt, Homo sapiens
uacugcacuccauccugggu

SEQ ID NO: 67344 - RNA, 18 nt, Homo sapiens
uacugcacucuccagccu

SEQ ID NO: 67345 - RNA, 22 nt, Homo sapiens
uacugcagucagacuccugggc

SEQ ID NO: 67346 - RNA, 23 nt, Homo sapiens
uacugcauccuccgccucuaggg

SEQ ID NO: 67347 - RNA, 22 nt, Homo sapiens
uacugcaucuacuuagagccag

SEQ ID NO: 67348 - RNA, 22 nt, Homo sapiens
uacugcuaccuccagcuucugg

SEQ ID NO: 67349 - RNA, 22 nt, Homo sapiens
uacugcuuaagggcaugggccc

SEQ ID NO: 67350 - RNA, 21 nt, Homo sapiens
uacuggagauacagucugcaa

SEQ ID NO: 67351 - RNA, 19 nt, Homo sapiens
uacuggcucgggaauuuuc

SEQ ID NO: 67352 - RNA, 22 nt, Homo sapiens
uacuuagagauuccaggaacuc

SEQ ID NO: 67353 - RNA, 21 nt, Homo sapiens
uacuugagacagggucuugcu

SEQ ID NO: 67354 - RNA, 22 nt, Homo sapiens
uagaaagcaugaccuucagaua

SEQ ID NO: 67355 - RNA, 20 nt, Homo sapiens
uagaaaguagaguggugguu

SEQ ID NO: 67356 - RNA, 22 nt, Homo sapiens
uagaagcacuaucccuccuagu

SEQ ID NO: 67357 - RNA, 22 nt, Homo sapiens
uagaagcugagaauguccucag

SEQ ID NO: 67358 - RNA, 22 nt, Homo sapiens
uagaaguaggcuacgugucugg

SEQ ID NO: 67359 - RNA, 22 nt, Homo sapiens
uagaaucuaacucgcaugaaaa

SEQ ID NO: 67360 - RNA, 22 nt, Homo sapiens
uagaauguauaauauuuuacuu

SEQ ID NO: 67361 - RNA, 22 nt, Homo sapiens
uagaaugucagcuucuugaggg

SEQ ID NO: 67362 - RNA, 23 nt, Homo sapiens
uagaauguuuuuccauguuucuu

SEQ ID NO: 67363 - RNA, 21 nt, Homo sapiens
uagagagcaauaccuccagag

SEQ ID NO: 67364 - RNA, 22 nt, Homo sapiens
uagagauaucaauuucauggug

SEQ ID NO: 67365 - RNA, 22 nt, Homo sapiens
uagagaucuuauauuuuaugac

SEQ ID NO: 67366 - RNA, 22 nt, Homo sapiens
uagagcacaagguagauuucua

SEQ ID NO: 67367 - RNA, 22 nt, Homo sapiens
uagagcacauuaucauuuccaa

SEQ ID NO: 67368 - RNA, 22 nt, Homo sapiens
uagagcuaguugcucacugcuu

SEQ ID NO: 67369 - RNA, 21 nt, Homo sapiens
uagagcuuggcacagaguaga

SEQ ID NO: 67370 - RNA, 22 nt, Homo sapiens
uagaggaaggauuggaaacgca

SEQ ID NO: 67371 - RNA, 22 nt, Homo sapiens
uagagguagguguaugaacuag

SEQ ID NO: 67372 - RNA, 22 nt, Homo sapiens
uagagguauaccaaaaaggcau

SEQ ID NO: 67373 - RNA, 22 nt, Homo sapiens
uagagguucuaagauucucaga

SEQ ID NO: 67374 - RNA, 22 nt, Homo sapiens
uagagugcugucaaagacuugu

SEQ ID NO: 67375 - RNA, 22 nt, Homo sapiens
uagauaauuagaggguuuuaag

SEQ ID NO: 67376 - RNA, 23 nt, Homo sapiens
uagaucaucaaguuuacugugcu

SEQ ID NO: 67377 - RNA, 22 nt, Homo sapiens
guaauaacuguggaaaaagguu

SEQ ID NO: 67378 - RNA, 22 nt, Homo sapiens
guaauacuggacaggguaucag

SEQ ID NO: 67379 - RNA, 22 nt, Homo sapiens
guaaucucagcuacucaggagg

SEQ ID NO: 67380 - RNA, 22 nt, Homo sapiens
guaaucucagcuacucgggagg

SEQ ID NO: 67381 - RNA, 22 nt, Homo sapiens
guacaaguaagaaaauugccca

SEQ ID NO: 67382 - RNA, 22 nt, Homo sapiens
guacaagugcaguuucguuaca

SEQ ID NO: 67383 - RNA, 16 nt, Homo sapiens
guacacaguaaguaug

SEQ ID NO: 67384 - RNA, 17 nt, Homo sapiens
guacacuucuucuguga

SEQ ID NO: 67385 - RNA, 22 nt, Homo sapiens
guacaguuuagugcuuugagaa

SEQ ID NO: 67386 - RNA, 22 nt, Homo sapiens
guacaugcauaguuuauuucug

SEQ ID NO: 67387 - RNA, 22 nt, Homo sapiens
guacaugcaugcaugggugugc

SEQ ID NO: 67388 - RNA, 22 nt, Homo sapiens
guacaugugcacagugugcagg

SEQ ID NO: 67389 - RNA, 22 nt, Homo sapiens
guaccucaguuggaaaugcaga

SEQ ID NO: 67390 - RNA, 17 nt, Homo sapiens
guacucagugaccaugg

SEQ ID NO: 67391 - RNA, 22 nt, Homo sapiens
guacugagagacaguuacuguu

SEQ ID NO: 67392 - RNA, 22 nt, Homo sapiens
guagaugcauggauuuacuucu

SEQ ID NO: 67393 - RNA, 22 nt, Homo sapiens
guagcagaauaucagauaauuu

SEQ ID NO: 67394 - RNA, 22 nt, Homo sapiens
guagcagccacacuugauaacu

SEQ ID NO: 67395 - RNA, 22 nt, Homo sapiens
guagcaucauuugcaauuucau

SEQ ID NO: 67396 - RNA, 18 nt, Homo sapiens
guaggucaguaccaagca

SEQ ID NO: 67397 - RNA, 22 nt, Homo sapiens
guaguaccauuaggauauuucu

SEQ ID NO: 67398 - RNA, 22 nt, Homo sapiens
guauaaguugacucaaucuuug

SEQ ID NO: 67399 - RNA, 22 nt, Homo sapiens
guauacacccugugauauuauu

SEQ ID NO: 67400 - RNA, 22 nt, Homo sapiens
guauacaugucaaaacucacau

SEQ ID NO: 67401 - RNA, 22 nt, Homo sapiens
guauaggcuuucaccacgccau

SEQ ID NO: 67402 - RNA, 22 nt, Homo sapiens
guaucacacuuauugaccugca

SEQ ID NO: 67403 - RNA, 22 nt, Homo sapiens
guaucaucauguuggccaggcu

SEQ ID NO: 67404 - RNA, 22 nt, Homo sapiens
guaucccuugcuaucugaaucu

SEQ ID NO: 67405 - RNA, 22 nt, Homo sapiens
guaugaaaaucggagauugggu

SEQ ID NO: 67406 - RNA, 22 nt, Homo sapiens
guaugaguuuucugaugugugg

SEQ ID NO: 67407 - RNA, 22 nt, Homo sapiens
guaugauacuguaacagugggu

SEQ ID NO: 67408 - RNA, 22 nt, Homo sapiens
guaugcacauauguguauguau

SEQ ID NO: 67409 - RNA, 21 nt, Homo sapiens
guaugguugaagugacaagcc

SEQ ID NO: 67410 - RNA, 22 nt, Homo sapiens
guaugguugaagugacaagcca

SEQ ID NO: 67411 - RNA, 22 nt, Homo sapiens
guaugguuguaugaggacccau

SEQ ID NO: 67412 - RNA, 22 nt, Homo sapiens
guaugguuuauagggaaauugu

SEQ ID NO: 67413 - RNA, 22 nt, Homo sapiens
guauuagaugguauuugaagau

SEQ ID NO: 67414 - RNA, 22 nt, Homo sapiens
guauuagguuggugcaaaauaa

SEQ ID NO: 67415 - RNA, 22 nt, Homo sapiens
guauuagguuggugcaaaauug

SEQ ID NO: 67416 - RNA, 22 nt, Homo sapiens
guauuaguuuccuguugcugcu

SEQ ID NO: 67417 - RNA, 18 nt, Homo sapiens
guauuccagccugaguga

SEQ ID NO: 67418 - RNA, 22 nt, Homo sapiens
guauugacauuuuuaaggaacu

SEQ ID NO: 67419 - RNA, 22 nt, Homo sapiens
guauuguacuacaagcucuuua

SEQ ID NO: 67420 - RNA, 22 nt, Homo sapiens
gucaagauuuguaggacagaga

SEQ ID NO: 67421 - RNA, 22 nt, Homo sapiens
gucaaguaaauguuaugguuau

SEQ ID NO: 67422 - RNA, 22 nt, Homo sapiens
gucaagugaagcagugggagua

SEQ ID NO: 67423 - RNA, 22 nt, Homo sapiens
gucaauguaucuagcuguauua

SEQ ID NO: 67424 - RNA, 22 nt, Homo sapiens
gucacaggaaacuaauaugcgc

SEQ ID NO: 67425 - RNA, 22 nt, Homo sapiens
gucacugccugaggcugaugca

SEQ ID NO: 67426 - RNA, 20 nt, Homo sapiens
gucacuggcccagggcuugu

SEQ ID NO: 67427 - RNA, 22 nt, Homo sapiens
gucacugggugcugcgccuguc

SEQ ID NO: 67428 - RNA, 22 nt, Homo sapiens
gucagcaucaccaugucuauga

SEQ ID NO: 67429 - RNA, 22 nt, Homo sapiens
gucagucugucccugccuggcg

SEQ ID NO: 67430 - RNA, 22 nt, Homo sapiens
gucaguggagaaaaggacaugu

SEQ ID NO: 67431 - RNA, 22 nt, Homo sapiens
gucaguggauacugucucuguc

SEQ ID NO: 67432 - RNA, 18 nt, Homo sapiens
gucauagaaugaugguuc

SEQ ID NO: 67433 - RNA, 22 nt, Homo sapiens
gucauauaggguuuaccuguau

SEQ ID NO: 67434 - RNA, 22 nt, Homo sapiens
gucaucaggacgggucaucugc

SEQ ID NO: 67435 - RNA, 22 nt, Homo sapiens
gucauggaaaucuacauuguua

SEQ ID NO: 67436 - RNA, 22 nt, Homo sapiens
gucauggacaguuugcuaauug

SEQ ID NO: 67437 - RNA, 22 nt, Homo sapiens
gucaugucuugaaauucaguuu

SEQ ID NO: 67438 - RNA, 22 nt, Homo sapiens
gucauugucaauugacaauugu

SEQ ID NO: 67439 - RNA, 22 nt, Homo sapiens
gucauuguguggacauggagaa

SEQ ID NO: 67440 - RNA, 21 nt, Homo sapiens
guccaaaacaguguccaaugc

SEQ ID NO: 67441 - RNA, 22 nt, Homo sapiens
guccaagacuaggaguuggcag

SEQ ID NO: 67442 - RNA, 22 nt, Homo sapiens
guccagagaagucauuacuuca

SEQ ID NO: 67443 - RNA, 22 nt, Homo sapiens
guccaguuguuuucugagguug

SEQ ID NO: 67444 - RNA, 18 nt, Homo sapiens
guccauuuguugguacac

SEQ ID NO: 67445 - RNA, 22 nt, Homo sapiens
gucccagagauauugugucuuu

SEQ ID NO: 67446 - RNA, 22 nt, Homo sapiens
gucccugaggaacauccagggc

SEQ ID NO: 67447 - RNA, 22 nt, Homo sapiens
guccuugaggcuuugacugugg

SEQ ID NO: 67448 - RNA, 22 nt, Homo sapiens
gucuaguuuuaauacauuaaga

SEQ ID NO: 67449 - RNA, 22 nt, Homo sapiens
gucuaugguucaggguggagug

SEQ ID NO: 67450 - RNA, 22 nt, Homo sapiens
gucucagugcgaaucucaaaga

SEQ ID NO: 67451 - RNA, 22 nt, Homo sapiens
gucucugagaugucaacaccua

SEQ ID NO: 67452 - RNA, 22 nt, Homo sapiens
gucucugguugcuuuuguacca

SEQ ID NO: 67453 - RNA, 20 nt, Homo sapiens
ucaguauauuguuuccacag

SEQ ID NO: 67454 - RNA, 22 nt, Homo sapiens
ucagucauucacucacucggac

SEQ ID NO: 67455 - RNA, 22 nt, Homo sapiens
ucagucauugauggaguagguc

SEQ ID NO: 67456 - RNA, 22 nt, Homo sapiens
ucaguccccucgcugagucuac

SEQ ID NO: 67457 - RNA, 22 nt, Homo sapiens
ucagucuuuuuuuggcaagcau

SEQ ID NO: 67458 - RNA, 22 nt, Homo sapiens
ucagugaauguuggccacuacu

SEQ ID NO: 67459 - RNA, 22 nt, Homo sapiens
ucagugauugcuuucauggaaa

SEQ ID NO: 67460 - RNA, 22 nt, Homo sapiens
ucagugauugguuauuuuaggc

SEQ ID NO: 67461 - RNA, 21 nt, Homo sapiens
ucagugcaauucuauggggaa

SEQ ID NO: 67462 - RNA, 22 nt, Homo sapiens
ucagugcaggaauuuccuuaga

SEQ ID NO: 67463 - RNA, 19 nt, Homo sapiens
ucagugcuauguaauguag

SEQ ID NO: 67464 - RNA, 22 nt, Homo sapiens
ucagugcuguaccaucuaagga

SEQ ID NO: 67465 - RNA, 22 nt, Homo sapiens
ucaguggagccucacucugugg

SEQ ID NO: 67466 - RNA, 22 nt, Homo sapiens
ucagugggcuauguaauuaacu

SEQ ID NO: 67467 - RNA, 22 nt, Homo sapiens
ucaguguugauggcugcugacu

SEQ ID NO: 67468 - RNA, 22 nt, Homo sapiens
ucaguguuuuauccuccagagc

SEQ ID NO: 67469 - RNA, 21 nt, Homo sapiens
ucaguuacugagagagaagug

SEQ ID NO: 67470 - RNA, 22 nt, Homo sapiens
ucauacgucuccuugugccacc

SEQ ID NO: 67471 - RNA, 22 nt, Homo sapiens
ucauacuguugugaaacaaaac

SEQ ID NO: 67472 - RNA, 22 nt, Homo sapiens
ucauaggucacuguaaccucgu

SEQ ID NO: 67473 - RNA, 16 nt, Homo sapiens
ucauaguaucucuucu

SEQ ID NO: 67474 - RNA, 22 nt, Homo sapiens
ucauagucuaagguucuuuugc

SEQ ID NO: 67475 - RNA, 22 nt, Homo sapiens
ucauauugcgguucauugacuu

SEQ ID NO: 67476 - RNA, 16 nt, Homo sapiens
ucaucacagucucugg

SEQ ID NO: 67477 - RNA, 22 nt, Homo sapiens
ucaucagaaucccuuagggaug

SEQ ID NO: 67478 - RNA, 22 nt, Homo sapiens
ucaucagaguuuacaagcucag

SEQ ID NO: 67479 - RNA, 22 nt, Homo sapiens
ucaucaguuuuuuauaugugau

SEQ ID NO: 67480 - RNA, 22 nt, Homo sapiens
ucauccauacaguuagcaaagg

SEQ ID NO: 67481 - RNA, 22 nt, Homo sapiens
ucaucuggcgaaugugaagagu

SEQ ID NO: 67482 - RNA, 22 nt, Homo sapiens
ucaugaccaugguauagaccac

SEQ ID NO: 67483 - RNA, 22 nt, Homo sapiens
ucaugagacacacuggaaagga

SEQ ID NO: 67484 - RNA, 23 nt, Homo sapiens
ucaugaggccauucaaauccauu

SEQ ID NO: 67485 - RNA, 22 nt, Homo sapiens
ucaugcaaugagucaggaggca

SEQ ID NO: 67486 - RNA, 20 nt, Homo sapiens
ucaugccacugcgcuccagc

SEQ ID NO: 67487 - RNA, 22 nt, Homo sapiens
ucauggcauuguuaaggguuuu

SEQ ID NO: 67488 - RNA, 19 nt, Homo sapiens
ucauggcuuuuucagcugu

SEQ ID NO: 67489 - RNA, 22 nt, Homo sapiens
ucaugguuuuauaacccucuug

SEQ ID NO: 67490 - RNA, 22 nt, Homo sapiens
ucauguauuaucauuagugggu

SEQ ID NO: 67491 - RNA, 23 nt, Homo sapiens
ucauguauucccuguaaugggua

SEQ ID NO: 67492 - RNA, 22 nt, Homo sapiens
ucaugucuuguuguauuuauuu

SEQ ID NO: 67493 - RNA, 22 nt, Homo sapiens
ucaugugagcaaguugggcuca

SEQ ID NO: 67494 - RNA, 22 nt, Homo sapiens
ucauugcacuucuuuaguugca

SEQ ID NO: 67495 - RNA, 22 nt, Homo sapiens
ucauugcauguuaauuaaacag

SEQ ID NO: 67496 - RNA, 22 nt, Homo sapiens
ucauugcuuauuuguuggugga

SEQ ID NO: 67497 - RNA, 22 nt, Homo sapiens
ucauuggaugucugaaaugauu

SEQ ID NO: 67498 - RNA, 22 nt, Homo sapiens
ucauugguucuggguguuguug

SEQ ID NO: 67499 - RNA, 22 nt, Homo sapiens
ucauugguugcguaauuugauu

SEQ ID NO: 67500 - RNA, 19 nt, Homo sapiens
uccaccgcgugcaccucua

SEQ ID NO: 67501 - RNA, 22 nt, Homo sapiens
uccacuuuugugcugaauugga

SEQ ID NO: 67502 - RNA, 22 nt, Homo sapiens
uccagcuuuuucuaauucugug

SEQ ID NO: 67503 - RNA, 22 nt, Homo sapiens
uccagguuuugugaguuuaaau

SEQ ID NO: 67504 - RNA, 22 nt, Homo sapiens
uccaguacaggucucucauuuc

SEQ ID NO: 67505 - RNA, 22 nt, Homo sapiens
uccagugugcaggcaaguuuga

SEQ ID NO: 67506 - RNA, 20 nt, Homo sapiens
uccaguuuuggagacauucu

SEQ ID NO: 67507 - RNA, 22 nt, Homo sapiens
uccauaguugcacucuggagcc

SEQ ID NO: 67508 - RNA, 19 nt, Homo sapiens
uccaugagcccacagugau

SEQ ID NO: 67509 - RNA, 22 nt, Homo sapiens
uccaugaggcuacaguaaucuc

SEQ ID NO: 67510 - RNA, 22 nt, Homo sapiens
uccauguagaagacaggggaga

SEQ ID NO: 67511 - RNA, 22 nt, Homo sapiens
uccauuuguagguagugagaca

SEQ ID NO: 67512 - RNA, 18 nt, Homo sapiens
uccauuuguaugggaugg

SEQ ID NO: 67513 - RNA, 22 nt, Homo sapiens
uccauuugucuauguuucuguu

SEQ ID NO: 67514 - RNA, 16 nt, Homo sapiens
ucccaccauugcuugu

SEQ ID NO: 67515 - RNA, 22 nt, Homo sapiens
ucccagugcuaugcaaaagccu

SEQ ID NO: 67516 - RNA, 22 nt, Homo sapiens
ucccaguguguagcuugucucu

SEQ ID NO: 67517 - RNA, 22 nt, Homo sapiens
ucccuacugggguacugccuag

SEQ ID NO: 67518 - RNA, 22 nt, Homo sapiens
ucccugaaucucagguucugua

SEQ ID NO: 67519 - RNA, 22 nt, Homo sapiens
ucccugacagggucugagcuuu

SEQ ID NO: 67520 - RNA, 18 nt, Homo sapiens
ucccugacucaaauucuu

SEQ ID NO: 67521 - RNA, 22 nt, Homo sapiens
ucccuguagugccuagaucaga

SEQ ID NO: 67522 - RNA, 22 nt, Homo sapiens
ucccuguguccugggggcaccu

SEQ ID NO: 67523 - RNA, 22 nt, Homo sapiens
ucccuguguuccuuuugaauug

SEQ ID NO: 67524 - RNA, 22 nt, Homo sapiens
ucccuguuguuucauaauuuua

SEQ ID NO: 67525 - RNA, 22 nt, Homo sapiens
ucccuuucuggaguuucccaag

SEQ ID NO: 67526 - RNA, 22 nt, Homo sapiens
uccgcagugucccucagaguga

SEQ ID NO: 67527 - RNA, 22 nt, Homo sapiens
uccugcauucugaaauacaagu

SEQ ID NO: 67528 - RNA, 22 nt, Homo sapiens
uccuggcuccacuguuuauucc

SEQ ID NO: 67529 - RNA, 22 nt, Homo sapiens
uccuucauuugucaacucuagu

SEQ ID NO: 67530 - RNA, 22 nt, Homo sapiens
uccuuggucaaaaagaaagugu

SEQ ID NO: 67531 - RNA, 22 nt, Homo sapiens
uccuuuagacugaauccugaga

SEQ ID NO: 67532 - RNA, 22 nt, Homo sapiens
uccuuuaguuaauaaagacaag

SEQ ID NO: 67533 - RNA, 22 nt, Homo sapiens
uccuuuggcuaacuuucuaagu

SEQ ID NO: 67534 - RNA, 22 nt, Homo sapiens
uccuuuggucaguauucuuuug

SEQ ID NO: 67535 - RNA, 22 nt, Homo sapiens
uccuuugguggagucuuuaggg

SEQ ID NO: 67536 - RNA, 22 nt, Homo sapiens
uccuuugguuauaggcaccucu

SEQ ID NO: 67537 - RNA, 22 nt, Homo sapiens
uccuuugguucuugucacccca

SEQ ID NO: 67538 - RNA, 22 nt, Homo sapiens
ucgagcaauugucaugucucag

SEQ ID NO: 67539 - RNA, 20 nt, Homo sapiens
ucgcaccacuauacuccagc

SEQ ID NO: 67540 - RNA, 23 nt, Homo sapiens
ucgcagcauucaauaccaggcag

SEQ ID NO: 67541 - RNA, 22 nt, Homo sapiens
ucgcagcucacuggagccucga

SEQ ID NO: 67542 - RNA, 22 nt, Homo sapiens
ucgcugcgaccuccaccucccg

SEQ ID NO: 67543 - RNA, 22 nt, Homo sapiens
ucgcugggaaccagagguaaag

SEQ ID NO: 67544 - RNA, 22 nt, Homo sapiens
ucggcucagugcaagcucugcc

SEQ ID NO: 67545 - RNA, 22 nt, Homo sapiens
ucgguauuuuagaauugagacu

SEQ ID NO: 67546 - RNA, 22 nt, Homo sapiens
ucgugccacugcacuccagccu

SEQ ID NO: 67547 - RNA, 22 nt, Homo sapiens
ucgugcugugucaucuuguggc

SEQ ID NO: 67548 - RNA, 21 nt, Homo sapiens
ucugagucauucaguggccug

SEQ ID NO: 67549 - RNA, 22 nt, Homo sapiens
ucugaguggcagaaugagcuga

SEQ ID NO: 67550 - RNA, 22 nt, Homo sapiens
ucugauggaguugccagggaga

SEQ ID NO: 67551 - RNA, 22 nt, Homo sapiens
ucugcaagucuaaacuagccau

SEQ ID NO: 67552 - RNA, 22 nt, Homo sapiens
ucugcauauucuagggcaccaa

SEQ ID NO: 67553 - RNA, 22 nt, Homo sapiens
ucugccuacugguuggaggaac

SEQ ID NO: 67554 - RNA, 22 nt, Homo sapiens
ucugccuuuucaugugggaugg

SEQ ID NO: 67555 - RNA, 22 nt, Homo sapiens
ucuggcaagagccgagggcagu

SEQ ID NO: 67556 - RNA, 22 nt, Homo sapiens
ucuggcaagauauccauugcuu

SEQ ID NO: 67557 - RNA, 22 nt, Homo sapiens
ucuggcacucagaggccuugcu

SEQ ID NO: 67558 - RNA, 22 nt, Homo sapiens
ucuggcacugaugugggaugcu

SEQ ID NO: 67559 - RNA, 21 nt, Homo sapiens
ucuggcccccucaaaucucau

SEQ ID NO: 67560 - RNA, 22 nt, Homo sapiens
ucuggcuccacacuuuauuaac

SEQ ID NO: 67561 - RNA, 18 nt, Homo sapiens
ucuggcuucuuuguucca

SEQ ID NO: 67562 - RNA, 22 nt, Homo sapiens
ucuggcuugugaacugucuucu

SEQ ID NO: 67563 - RNA, 22 nt, Homo sapiens
ucuggcuuuagcaugugggaag

SEQ ID NO: 67564 - RNA, 22 nt, Homo sapiens
ucuggcuuucuuuacuuaaugu

SEQ ID NO: 67565 - RNA, 22 nt, Homo sapiens
ucuggcuuugugaguugccaga

SEQ ID NO: 67566 - RNA, 22 nt, Homo sapiens
ucuggcuuuuaacaucuauaaa

SEQ ID NO: 67567 - RNA, 22 nt, Homo sapiens
ucugggguuuccacuuuuacuu

SEQ ID NO: 67568 - RNA, 22 nt, Homo sapiens
ucuggguuuuuacaauguuuac

SEQ ID NO: 67569 - RNA, 22 nt, Homo sapiens
ucugguggugaugagagacagu

SEQ ID NO: 67570 - RNA, 22 nt, Homo sapiens
ucugguguuacugagccuccca

SEQ ID NO: 67571 - RNA, 23 nt, Homo sapiens
ucugguguugucaaaugcugguu

SEQ ID NO: 67572 - RNA, 22 nt, Homo sapiens
ucuguacugccaaguuucuuua

SEQ ID NO: 67573 - RNA, 22 nt, Homo sapiens
ucuguaguuaacagcuucagcu

SEQ ID NO: 67574 - RNA, 22 nt, Homo sapiens
ucugugaaugugaccuuauuug

SEQ ID NO: 67575 - RNA, 22 nt, Homo sapiens
ucugugcauuguaacaacuaaa

SEQ ID NO: 67576 - RNA, 19 nt, Homo sapiens
ucugugcuugucccccugu

SEQ ID NO: 67577 - RNA, 22 nt, Homo sapiens
ucugugguaagaaacgcauguc

SEQ ID NO: 67578 - RNA, 18 nt, Homo sapiens
ucugugguguaaauacgu

SEQ ID NO: 67579 - RNA, 22 nt, Homo sapiens
ucugugguucaggcuggagugc

SEQ ID NO: 67580 - RNA, 21 nt, Homo sapiens
ucuguguugaucucacuggga

SEQ ID NO: 67581 - RNA, 22 nt, Homo sapiens
ucuguguuuagacccaggguag

SEQ ID NO: 67582 - RNA, 22 nt, Homo sapiens
ucuguguuugguuggcaauuuc

SEQ ID NO: 67583 - RNA, 22 nt, Homo sapiens
ucuuaggauacugaagucgguu

SEQ ID NO: 67584 - RNA, 22 nt, Homo sapiens
ucuuagguaagaaauuuuaaca

SEQ ID NO: 67585 - RNA, 22 nt, Homo sapiens
ucuugcuuguuguucccuucau

SEQ ID NO: 67586 - RNA, 22 nt, Homo sapiens
ucuugcuuuugcagagcuucuc

SEQ ID NO: 67587 - RNA, 22 nt, Homo sapiens
ucuuggcauggcugaagauucc

SEQ ID NO: 67588 - RNA, 22 nt, Homo sapiens
ucuuggccaugaauggcaaggc

SEQ ID NO: 67589 - RNA, 21 nt, Homo sapiens
ucuuggguugaauucucccag

SEQ ID NO: 67590 - RNA, 22 nt, Homo sapiens
ucuuggguuguuggcuucuccu

SEQ ID NO: 67591 - RNA, 21 nt, Homo sapiens
ucuugguauguauuuaggagg

SEQ ID NO: 67592 - RNA, 23 nt, Homo sapiens
ucuugguuauagaaaaauaguug

SEQ ID NO: 67593 - RNA, 22 nt, Homo sapiens
ucuuuaguaauuucuguaaggc

SEQ ID NO: 67594 - RNA, 22 nt, Homo sapiens
ucuuuaguuaagggacauuuua

SEQ ID NO: 67595 - RNA, 22 nt, Homo sapiens
ucuuugaguggagcgaggcaga

SEQ ID NO: 67596 - RNA, 22 nt, Homo sapiens
ucuuugaguguauacuuagauu

SEQ ID NO: 67597 - RNA, 22 nt, Homo sapiens
ucuuugccuaacccaaggucau

SEQ ID NO: 67598 - RNA, 22 nt, Homo sapiens
ucuuugguagaagcuauuuuau

SEQ ID NO: 67599 - RNA, 22 nt, Homo sapiens
ucuuugguucuguuuauguaau

SEQ ID NO: 67600 - RNA, 22 nt, Homo sapiens
ucuuugguugcacugcaggugu

SEQ ID NO: 67601 - RNA, 22 nt, Homo sapiens
ucuuugucuacauccuguuaaa

SEQ ID NO: 67602 - RNA, 22 nt, Homo sapiens
ucuuuguguaggucaaucuggc

SEQ ID NO: 67603 - RNA, 22 nt, Homo sapiens
ucuuuguuagaacccucuccuu

SEQ ID NO: 67604 - RNA, 22 nt, Homo sapiens
ucuuuuugagucaguuucggua

SEQ ID NO: 67605 - RNA, 20 nt, Homo sapiens
ucuuuuuguggccccagagu

SEQ ID NO: 67606 - RNA, 22 nt, Homo sapiens
ugaaaaguuguugaaggcuuca

SEQ ID NO: 67607 - RNA, 18 nt, Homo sapiens
ugaaacacauuuuuuccu

SEQ ID NO: 67608 - RNA, 22 nt, Homo sapiens
ugaaacugcagugggcuuggca

SEQ ID NO: 67609 - RNA, 22 nt, Homo sapiens
ugaaagacugaaagcuuuucuu

SEQ ID NO: 67610 - RNA, 21 nt, Homo sapiens
ugaaaugcaugugcacauuaa

SEQ ID NO: 67611 - RNA, 22 nt, Homo sapiens
ugaaauuauucuuaccaaggug

SEQ ID NO: 67612 - RNA, 22 nt, Homo sapiens
ugaaauuguuugcaaggauagg

SEQ ID NO: 67613 - RNA, 22 nt, Homo sapiens
ugucaugaaauauguuuuucua

SEQ ID NO: 67614 - RNA, 22 nt, Homo sapiens
ugucaugaacucacauucuggg

SEQ ID NO: 67615 - RNA, 22 nt, Homo sapiens
ugucaugagucuccuccaucuu

SEQ ID NO: 67616 - RNA, 21 nt, Homo sapiens
ugucaugcagagacccuggag

SEQ ID NO: 67617 - RNA, 22 nt, Homo sapiens
ugucauggggaaaauaacagac

SEQ ID NO: 67618 - RNA, 22 nt, Homo sapiens
ugucaugguguuaauuuuccug

SEQ ID NO: 67619 - RNA, 22 nt, Homo sapiens
ugucauguauauaccacuucca

SEQ ID NO: 67620 - RNA, 22 nt, Homo sapiens
ugucaugucuuuguguaucaau

SEQ ID NO: 67621 - RNA, 22 nt, Homo sapiens
ugucauguugagaaacuuggau

SEQ ID NO: 67622 - RNA, 20 nt, Homo sapiens
ugucauuaagcacugugcca

SEQ ID NO: 67623 - RNA, 22 nt, Homo sapiens
ugucauucaggaaauucuaagu

SEQ ID NO: 67624 - RNA, 21 nt, Homo sapiens
uguccagcuuuuggaauauaa

SEQ ID NO: 67625 - RNA, 22 nt, Homo sapiens
uguccaguguuccucagaagaa

SEQ ID NO: 67626 - RNA, 20 nt, Homo sapiens
ugucccaaccccauggguuc

SEQ ID NO: 67627 - RNA, 22 nt, Homo sapiens
ugucccguuuucgaggcugcag

SEQ ID NO: 67628 - RNA, 22 nt, Homo sapiens
ugucccugagccuggauuccug

SEQ ID NO: 67629 - RNA, 19 nt, Homo sapiens
uguccuagaggaguucaca

SEQ ID NO: 67630 - RNA, 22 nt, Homo sapiens
ugucuaaagaauggcagacuca

SEQ ID NO: 67631 - RNA, 22 nt, Homo sapiens
ugucuacugaugauguaguuaa

SEQ ID NO: 67632 - RNA, 20 nt, Homo sapiens
ugucuauggggguucucugc

SEQ ID NO: 67633 - RNA, 22 nt, Homo sapiens
ugucucaguuacggcaauucca

SEQ ID NO: 67634 - RNA, 22 nt, Homo sapiens
ugucugagacuguuuuacuuuc

SEQ ID NO: 67635 - RNA, 22 nt, Homo sapiens
ugucuugagagaggacaugacu

SEQ ID NO: 67636 - RNA, 22 nt, Homo sapiens
ugucuuggagaauccuggguuu

SEQ ID NO: 67637 - RNA, 22 nt, Homo sapiens
ugucuuuguuaguuguccuagu

SEQ ID NO: 67638 - RNA, 22 nt, Homo sapiens
ugugaaauguuaucccgucgug

SEQ ID NO: 67639 - RNA, 19 nt, Homo sapiens
ugugaacaucacagagugu

SEQ ID NO: 67640 - RNA, 22 nt, Homo sapiens
ugugaagaaagucauugguagc

SEQ ID NO: 67641 - RNA, 22 nt, Homo sapiens
ugugacaaauuuaguggacugu

SEQ ID NO: 67642 - RNA, 23 nt, Homo sapiens
ugugacacuuccgucaguucauu

SEQ ID NO: 67643 - RNA, 22 nt, Homo sapiens
ugugacagguagguaauuuuug

SEQ ID NO: 67644 - RNA, 22 nt, Homo sapiens
ugugacagguauccuguguucu

SEQ ID NO: 67645 - RNA, 22 nt, Homo sapiens
ugugacucugcauuuuggguuc

SEQ ID NO: 67646 - RNA, 19 nt, Homo sapiens
ugugacugguugucucgcu

SEQ ID NO: 67647 - RNA, 22 nt, Homo sapiens
ugugagacugacagggcagggu

SEQ ID NO: 67648 - RNA, 19 nt, Homo sapiens
ugugagcauuagcauuuag

SEQ ID NO: 67649 - RNA, 22 nt, Homo sapiens
ugugauagagaaugguggagaa

SEQ ID NO: 67650 - RNA, 22 nt, Homo sapiens
ugugauaguugcuguucugggc

SEQ ID NO: 67651 - RNA, 22 nt, Homo sapiens
ugugaucaugguauuaaucugc

SEQ ID NO: 67652 - RNA, 22 nt, Homo sapiens
ugugaucaugugugccuuaguc

SEQ ID NO: 67653 - RNA, 22 nt, Homo sapiens
uuagaacuagaggaguuugagu

SEQ ID NO: 67654 - RNA, 22 nt, Homo sapiens
uuagauaguacugaaugguucu

SEQ ID NO: 67655 - RNA, 22 nt, Homo sapiens
uuagaugaagucacagaaccca

SEQ ID NO: 67656 - RNA, 22 nt, Homo sapiens
uuagcaauugauucucauaagc

SEQ ID NO: 67657 - RNA, 22 nt, Homo sapiens
uuagcagcaccccacucuacug

SEQ ID NO: 67658 - RNA, 22 nt, Homo sapiens
uuagcagcaugaaaauggacug

SEQ ID NO: 67659 - RNA, 22 nt, Homo sapiens
uuagcagugugagcacagacua

SEQ ID NO: 67660 - RNA, 21 nt, Homo sapiens
uuagcauccauguucaucaac

SEQ ID NO: 67661 - RNA, 22 nt, Homo sapiens
uuagcccagugggugcuucucu

SEQ ID NO: 67662 - RNA, 21 nt, Homo sapiens
uuagccuguaagcacuuugca

SEQ ID NO: 67663 - RNA, 22 nt, Homo sapiens
uuaggcaaugcucucaaauuug

SEQ ID NO: 67664 - RNA, 21 nt, Homo sapiens
uuaggcagugucagaggugag

SEQ ID NO: 67665 - RNA, 22 nt, Homo sapiens
uuaggcaguuuauugauuuuca

SEQ ID NO: 67666 - RNA, 22 nt, Homo sapiens
uuaggcuaguugauauaguuug

SEQ ID NO: 67667 - RNA, 22 nt, Homo sapiens
uuaggcucuuuaucaguuaacu

SEQ ID NO: 67668 - RNA, 22 nt, Homo sapiens
uuaggcucuuugaggugcccag

SEQ ID NO: 67669 - RNA, 22 nt, Homo sapiens
uuagggaggagucccucuuuuu

SEQ ID NO: 67670 - RNA, 22 nt, Homo sapiens
uuagggcaggcaugagagaacu

SEQ ID NO: 67671 - RNA, 22 nt, Homo sapiens
uuagguauuaggaaauaugcuu

SEQ ID NO: 67672 - RNA, 22 nt, Homo sapiens
uuagguauuuuguuaugucagc

SEQ ID NO: 67673 - RNA, 22 nt, Homo sapiens
uuagguuauuacugacaauaau

SEQ ID NO: 67674 - RNA, 22 nt, Homo sapiens
uuaguagcacagaguaucagca

SEQ ID NO: 67675 - RNA, 22 nt, Homo sapiens
uuaguaguagcugcaugucagu

SEQ ID NO: 67676 - RNA, 22 nt, Homo sapiens
uuaguaguaguuugcauuuacc

SEQ ID NO: 67677 - RNA, 22 nt, Homo sapiens
uuagugaaugcaccacuucuga

SEQ ID NO: 67678 - RNA, 22 nt, Homo sapiens
uuagugcaaacucuucaaugcu

SEQ ID NO: 67679 - RNA, 21 nt, Homo sapiens
uuagugcucaguuugacaaaa

SEQ ID NO: 67680 - RNA, 22 nt, Homo sapiens
uuauacucgucugaaugauucu

SEQ ID NO: 67681 - RNA, 22 nt, Homo sapiens
uuauagcagugcccaacuccug

SEQ ID NO: 67682 - RNA, 22 nt, Homo sapiens
uuauauguuucuuagggacaga

SEQ ID NO: 67683 - RNA, 22 nt, Homo sapiens
uuauauguuuguacuuaggccu

SEQ ID NO: 67684 - RNA, 22 nt, Homo sapiens
uuaucaaacccuaggagguggu

SEQ ID NO: 67685 - RNA, 22 nt, Homo sapiens
uuaucagcagcaugaaaauaga

SEQ ID NO: 67686 - RNA, 22 nt, Homo sapiens
uuaucauagugcaguuuucuga

SEQ ID NO: 67687 - RNA, 21 nt, Homo sapiens
uuaucccagugucucugcagg

SEQ ID NO: 67688 - RNA, 22 nt, Homo sapiens
uuauccucuagacauagguuua

SEQ ID NO: 67689 - RNA, 22 nt, Homo sapiens
uuaugacaggcucaggagcccc

SEQ ID NO: 67690 - RNA, 22 nt, Homo sapiens
uuaugacauugacaguuuuuag

SEQ ID NO: 67691 - RNA, 22 nt, Homo sapiens
uuaugcagcaaagugcuugaaa

SEQ ID NO: 67692 - RNA, 22 nt, Homo sapiens
uuauggauuuauauucuguagu

SEQ ID NO: 67693 - RNA, 22 nt, Homo sapiens
uuaugggucuuggaaugcaaua

SEQ ID NO: 67694 - RNA, 22 nt, Homo sapiens
uuaugguuguuaucuugguucg

SEQ ID NO: 67695 - RNA, 22 nt, Homo sapiens
uuauguaaaucaaucuggaauc

SEQ ID NO: 67696 - RNA, 22 nt, Homo sapiens
uuaugucauuuuuggauguuaa

SEQ ID NO: 67697 - RNA, 20 nt, Homo sapiens
uuaugucguuucuugcuuau

SEQ ID NO: 67698 - RNA, 22 nt, Homo sapiens
uuaugucuuugagcaaugcugu

SEQ ID NO: 67699 - RNA, 22 nt, Homo sapiens
uuauuacuccuauuuuguagau

SEQ ID NO: 67700 - RNA, 22 nt, Homo sapiens
uuauuagguuaaccuauagcua

SEQ ID NO: 67701 - RNA, 22 nt, Homo sapiens
uuauuagguugguggaaaagua

SEQ ID NO: 67702 - RNA, 22 nt, Homo sapiens
uuauuauguuggugcaaaggua

SEQ ID NO: 67703 - RNA, 22 nt, Homo sapiens
uuauucagcaccugcuguguuc

SEQ ID NO: 67704 - RNA, 22 nt, Homo sapiens
uuauucugucuuuggucucaau

SEQ ID NO: 67705 - RNA, 22 nt, Homo sapiens
uuauugcacuccagccugggua

SEQ ID NO: 67706 - RNA, 22 nt, Homo sapiens
uugagguaauaaacagccauuc

SEQ ID NO: 67707 - RNA, 22 nt, Homo sapiens
uugagguauugauaaaacauuu

SEQ ID NO: 67708 - RNA, 22 nt, Homo sapiens
uugagguauuuugucaacugua

SEQ ID NO: 67709 - RNA, 22 nt, Homo sapiens
uugagguggugucuugcucugu

SEQ ID NO: 67710 - RNA, 20 nt, Homo sapiens
uugaggugugaggggcagag

SEQ ID NO: 67711 - RNA, 22 nt, Homo sapiens
uugaguaguaaggauauuaucu

SEQ ID NO: 67712 - RNA, 20 nt, Homo sapiens
uugaguauugccagggaggc

SEQ ID NO: 67713 - RNA, 22 nt, Homo sapiens
uugaguauuugcagucugaaca

SEQ ID NO: 67714 - RNA, 21 nt, Homo sapiens
uugaguugaagcaaggaggga

SEQ ID NO: 67715 - RNA, 22 nt, Homo sapiens
uugaguuuaucuaaagaccugg

SEQ ID NO: 67716 - RNA, 22 nt, Homo sapiens
uugauaagaaaaauauaccaga

SEQ ID NO: 67717 - RNA, 22 nt, Homo sapiens
uugauacuagagucuuucugac

SEQ ID NO: 67718 - RNA, 22 nt, Homo sapiens
uugauagacacauauccaugug

SEQ ID NO: 67719 - RNA, 22 nt, Homo sapiens
uugauaguuuuaaaauuaaucu

SEQ ID NO: 67720 - RNA, 22 nt, Homo sapiens
uugauaucugaugccuauggaa

SEQ ID NO: 67721 - RNA, 22 nt, Homo sapiens
uugauaugacuaucuuuuaugu

SEQ ID NO: 67722 - RNA, 22 nt, Homo sapiens
uugauauguaguuggacuugau

SEQ ID NO: 67723 - RNA, 22 nt, Homo sapiens
uugauauucugagaagcugaag

SEQ ID NO: 67724 - RNA, 22 nt, Homo sapiens
uugaucacuguacuaugacuau

SEQ ID NO: 67725 - RNA, 22 nt, Homo sapiens
uugaucaucagcuuugucaucu

SEQ ID NO: 67726 - RNA, 22 nt, Homo sapiens
uugaucuaugugucuguuuuua

SEQ ID NO: 67727 - RNA, 22 nt, Homo sapiens
uugaucuggagagaggcccgug

SEQ ID NO: 67728 - RNA, 22 nt, Homo sapiens
uugauuagauccaguugauuga

SEQ ID NO: 67729 - RNA, 22 nt, Homo sapiens
uugauugacaugucucuguuca

SEQ ID NO: 67730 - RNA, 22 nt, Homo sapiens
uugauuuguagaaugccccaac

SEQ ID NO: 67731 - RNA, 18 nt, Homo sapiens
uugcaaauucuucccugu

SEQ ID NO: 67732 - RNA, 22 nt, Homo sapiens
uugcaagaaaugcagauucuca

SEQ ID NO: 67733 - RNA, 22 nt, Homo sapiens
uugcaaguggagcuuccagggc

SEQ ID NO: 67734 - RNA, 22 nt, Homo sapiens
uugcacaauccugugagugagu

SEQ ID NO: 67735 - RNA, 22 nt, Homo sapiens
uugcacagugguuuagagccug

SEQ ID NO: 67736 - RNA, 22 nt, Homo sapiens
uugcacaguguguacagcacca

SEQ ID NO: 67737 - RNA, 22 nt, Homo sapiens
uugcacuauaggaaaauguguc

SEQ ID NO: 67738 - RNA, 22 nt, Homo sapiens
uugcacuugcugaggagugauu

SEQ ID NO: 67739 - RNA, 22 nt, Homo sapiens
uugcagagaaauuucugguuua

SEQ ID NO: 67740 - RNA, 22 nt, Homo sapiens
uugcagaucccacacucacccu

SEQ ID NO: 67741 - RNA, 22 nt, Homo sapiens
uugcaucagcaggcauaauugg

SEQ ID NO: 67742 - RNA, 22 nt, Homo sapiens
uugcaucagcuccugauguacu

SEQ ID NO: 67743 - RNA, 22 nt, Homo sapiens
uugccacuucucuugccccauu

SEQ ID NO: 67744 - RNA, 22 nt, Homo sapiens
uugccauggaguagaauugaag

SEQ ID NO: 67745 - RNA, 22 nt, Homo sapiens
uugccuaggcuggauugcagug

SEQ ID NO: 67746 - RNA, 22 nt, Homo sapiens
uugccuaguuuaggucugugcu

SEQ ID NO: 67747 - RNA, 22 nt, Homo sapiens
uugcuagucucuguuucaggau

SEQ ID NO: 67748 - RNA, 22 nt, Homo sapiens
uugcucaccugagaagaauaga

SEQ ID NO: 67749 - RNA, 22 nt, Homo sapiens
uugcuccucugccaggaccugu

SEQ ID NO: 67750 - RNA, 20 nt, Homo sapiens
uugcugguguuagaggaggc

SEQ ID NO: 67751 - RNA, 22 nt, Homo sapiens
uugcuuaggcuggagugcagug

SEQ ID NO: 67752 - RNA, 22 nt, Homo sapiens
uuggaaaguuguuguaguuauu

SEQ ID NO: 67753 - RNA, 20 nt, Homo sapiens
uuggaaaugugaauugggag

SEQ ID NO: 67754 - RNA, 22 nt, Homo sapiens
uuggaacuguucguauugaaau

SEQ ID NO: 67755 - RNA, 22 nt, Homo sapiens
uuggaagauuacuuaguuuucu

SEQ ID NO: 67756 - RNA, 22 nt, Homo sapiens
uuggaagcacauuguuuaauua

SEQ ID NO: 67757 - RNA, 22 nt, Homo sapiens
uuggaaguguguauguauagcu

SEQ ID NO: 67758 - RNA, 22 nt, Homo sapiens
uuggaauacucaaaagguuggg

SEQ ID NO: 67759 - RNA, 22 nt, Homo sapiens
uuggaauauaaccuguuucuaa

SEQ ID NO: 67760 - RNA, 22 nt, Homo sapiens
uuggaauguacucuagccuaug

SEQ ID NO: 67761 - RNA, 22 nt, Homo sapiens
uuggaauuaaccuggugcugga

SEQ ID NO: 67762 - RNA, 22 nt, Homo sapiens
uuggaauuaagagauauuuucu

SEQ ID NO: 67763 - RNA, 22 nt, Homo sapiens
uuggaauuuuacuucuguaaga

SEQ ID NO: 67764 - RNA, 18 nt, Homo sapiens
uuggacggagagucaaau

SEQ ID NO: 67765 - RNA, 22 nt, Homo sapiens
uuggacuaagaacuuaaaauaa

SEQ ID NO: 67766 - RNA, 22 nt, Homo sapiens
uuggacuucucaaggcaauaaa

SEQ ID NO: 67767 - RNA, 22 nt, Homo sapiens
uuggagagaaaggcaguuccug

SEQ ID NO: 67768 - RNA, 22 nt, Homo sapiens
uuggagucaucucuguacugua

SEQ ID NO: 67769 - RNA, 22 nt, Homo sapiens
uuggauccauccugucuucucu

SEQ ID NO: 67770 - RNA, 22 nt, Homo sapiens
uuggauggucuuuauauaguau

SEQ ID NO: 67771 - RNA, 22 nt, Homo sapiens
uuggcaaagugucuggcauuua

SEQ ID NO: 67772 - RNA, 22 nt, Homo sapiens
uuggcaacauagugagaccccc

SEQ ID NO: 67773 - RNA, 22 nt, Homo sapiens
uuggcaagcuguuaauuauaaa

SEQ ID NO: 67774 - RNA, 22 nt, Homo sapiens
uuggcaaguccccaccucucuc

SEQ ID NO: 67775 - RNA, 22 nt, Homo sapiens
uuggcaaguuucugucagcaaa

SEQ ID NO: 67776 - RNA, 22 nt, Homo sapiens
uuggcaaucaauucugacgucu

SEQ ID NO: 67777 - RNA, 22 nt, Homo sapiens
uuggcacuugauaauauucugg

SEQ ID NO: 67778 - RNA, 22 nt, Homo sapiens
uuggcagcacgcaguccagagg

SEQ ID NO: 67779 - RNA, 22 nt, Homo sapiens
uuggcaguaucuacuacagcua

SEQ ID NO: 67780 - RNA, 22 nt, Homo sapiens
uuggcagugcccgaugcugggg

SEQ ID NO: 67781 - RNA, 22 nt, Homo sapiens
uuggcauagaggcucucaagcu

SEQ ID NO: 67782 - RNA, 22 nt, Homo sapiens
uuggcauuuuuagucaugggaa

SEQ ID NO: 67783 - RNA, 22 nt, Homo sapiens
uuggccaauggugauucccggc

SEQ ID NO: 67784 - RNA, 19 nt, Homo sapiens
uuggcccugguucucuucu

SEQ ID NO: 67785 - RNA, 21 nt, Homo sapiens
uuggccuggaggccugaaugu

SEQ ID NO: 67786 - RNA, 21 nt, Homo sapiens
uuggcuacugcuucagaggga

SEQ ID NO: 67787 - RNA, 22 nt, Homo sapiens
uuggcucugcgucucgcggacg

SEQ ID NO: 67788 - RNA, 22 nt, Homo sapiens
uuggcucuggcugggcuccagc

SEQ ID NO: 67789 - RNA, 22 nt, Homo sapiens
uuggcuuggagaguugaaaugu

SEQ ID NO: 67790 - RNA, 22 nt, Homo sapiens
uuggcuuguaaaaugaaaagcu

SEQ ID NO: 67791 - RNA, 22 nt, Homo sapiens
uuggcuuuuaugcagcuuaggu

SEQ ID NO: 67792 - RNA, 22 nt, Homo sapiens
uugggaaugcuaaaccucuauu

SEQ ID NO: 67793 - RNA, 22 nt, Homo sapiens
uugggaauguccuaauaucucg

SEQ ID NO: 67794 - RNA, 22 nt, Homo sapiens
uugggauggaaauuuguacccc

SEQ ID NO: 67795 - RNA, 17 nt, Homo sapiens
uugggcaagguagguga

SEQ ID NO: 67796 - RNA, 22 nt, Homo sapiens
uugggcaaguggcaugaccaug

SEQ ID NO: 67797 - RNA, 22 nt, Homo sapiens
uugggccacuuuaguuuccuua

SEQ ID NO: 67798 - RNA, 22 nt, Homo sapiens
uugggguaggaauauggaauga

SEQ ID NO: 67799 - RNA, 22 nt, Homo sapiens
uuggguaguauagaagcaacaa

SEQ ID NO: 67800 - RNA, 22 nt, Homo sapiens
uugguaaaaugaccacagacau

SEQ ID NO: 67801 - RNA, 22 nt, Homo sapiens
uugguaaucccuagugucuaga

SEQ ID NO: 67802 - RNA, 22 nt, Homo sapiens
uugguauguaauuuauauugua

SEQ ID NO: 67803 - RNA, 22 nt, Homo sapiens
uuuccuguaggaaggaaauaga

SEQ ID NO: 67804 - RNA, 22 nt, Homo sapiens
uuucucaguguuucaggguagg

SEQ ID NO: 67805 - RNA, 22 nt, Homo sapiens
uuucugaggccucaccagaagc

SEQ ID NO: 67806 - RNA, 21 nt, Homo sapiens
uuucugggggagcauggcagg

SEQ ID NO: 67807 - RNA, 22 nt, Homo sapiens
uuucugguuaauuucuaagagc

SEQ ID NO: 67808 - RNA, 23 nt, Homo sapiens
uuucuugggcaugcuaugucagu

SEQ ID NO: 67809 - RNA, 22 nt, Homo sapiens
uuucuugguuguauuuagacuu

SEQ ID NO: 67810 - RNA, 22 nt, Homo sapiens
uuugaaguguggcacugaguuu

SEQ ID NO: 67811 - RNA, 22 nt, Homo sapiens
uuugaauggaaguuuugugaaa

SEQ ID NO: 67812 - RNA, 22 nt, Homo sapiens
uuugacuaccaggaauguucuu

SEQ ID NO: 67813 - RNA, 22 nt, Homo sapiens
uuugacuagaguguuuuacaac

SEQ ID NO: 67814 - RNA, 22 nt, Homo sapiens
uuugagauaucuuccaucagua

SEQ ID NO: 67815 - RNA, 22 nt, Homo sapiens
uuugagcuugacucagcuggag

SEQ ID NO: 67816 - RNA, 23 nt, Homo sapiens
uuugagugugauaaacacuguca

SEQ ID NO: 67817 - RNA, 22 nt, Homo sapiens
uuugagugugauaucgauugga

SEQ ID NO: 67818 - RNA, 22 nt, Homo sapiens
uuugcaagaugaaaaaguucua

SEQ ID NO: 67819 - RNA, 22 nt, Homo sapiens
uuugcacuugaaaacacucuca

SEQ ID NO: 67820 - RNA, 22 nt, Homo sapiens
uuugcacuuuuguaauaugguu

SEQ ID NO: 67821 - RNA, 20 nt, Homo sapiens
uuugcagaaucuaagaagag

SEQ ID NO: 67822 - RNA, 22 nt, Homo sapiens
uuugcagagacuuguuaggaau

SEQ ID NO: 67823 - RNA, 22 nt, Homo sapiens
uuugcagagucuuucgcugggc

SEQ ID NO: 67824 - RNA, 22 nt, Homo sapiens
uuugcagugucagcuucugugu

SEQ ID NO: 67825 - RNA, 22 nt, Homo sapiens
uuugcaugcuccuuaugagaau

SEQ ID NO: 67826 - RNA, 22 nt, Homo sapiens
uuugccaauauuuuauugagga

SEQ ID NO: 67827 - RNA, 22 nt, Homo sapiens
uuugccaaucagaggcaucuug

SEQ ID NO: 67828 - RNA, 22 nt, Homo sapiens
uuugccacugcaggcuguuuaa

SEQ ID NO: 67829 - RNA, 23 nt, Homo sapiens
uuugccacuuauuagcugggagg

SEQ ID NO: 67830 - RNA, 22 nt, Homo sapiens
uuugccuguagacacuuacccu

SEQ ID NO: 67831 - RNA, 22 nt, Homo sapiens
uuugcuaaucaacacuggccug

SEQ ID NO: 67832 - RNA, 22 nt, Homo sapiens
uuugcuauagugaauagugcug

SEQ ID NO: 67833 - RNA, 22 nt, Homo sapiens
uuugcuuaaaucuuaaucagau

SEQ ID NO: 67834 - RNA, 22 nt, Homo sapiens
uuuggacuucuagccuccagag

SEQ ID NO: 67835 - RNA, 22 nt, Homo sapiens
uuuggcaacguuggaucccuca

SEQ ID NO: 67836 - RNA, 22 nt, Homo sapiens
uuuggcacuauagguaaauuug

SEQ ID NO: 67837 - RNA, 22 nt, Homo sapiens
uuuggcaguuauuuacucagug

SEQ ID NO: 67838 - RNA, 22 nt, Homo sapiens
uuuggcaugggcuauuugcuuu

SEQ ID NO: 67839 - RNA, 22 nt, Homo sapiens
uuuggcauuagagagacuugca

SEQ ID NO: 67840 - RNA, 22 nt, Homo sapiens
uuuggcauuagauaauugugua

SEQ ID NO: 67841 - RNA, 22 nt, Homo sapiens
uuuggcauuuuacuacucaaau

SEQ ID NO: 67842 - RNA, 22 nt, Homo sapiens
uuuggccauaauuuuaauuggc

SEQ ID NO: 67843 - RNA, 22 nt, Homo sapiens
uuuggccauguuggucaggcug

SEQ ID NO: 67844 - RNA, 22 nt, Homo sapiens
uuuggcuguuucuggacuaaga

SEQ ID NO: 67845 - RNA, 22 nt, Homo sapiens
uuuggcuuugagaagcagugga

SEQ ID NO: 67846 - RNA, 22 nt, Homo sapiens
uuuggcuuuuguaauaacugcc

SEQ ID NO: 67847 - RNA, 22 nt, Homo sapiens
uuugggccaugcuucccgguca

SEQ ID NO: 67848 - RNA, 22 nt, Homo sapiens
uggcuacugacugaugauuaua

SEQ ID NO: 67849 - RNA, 22 nt, Homo sapiens
uggcuacuguacuugagcuauu

SEQ ID NO: 67850 - RNA, 22 nt, Homo sapiens
uggcuagaccugcauaacagcu

SEQ ID NO: 67851 - RNA, 19 nt, Homo sapiens
uggcuagaggccaggcguu

SEQ ID NO: 67852 - RNA, 22 nt, Homo sapiens
uggcuagaugagauguacugca

SEQ ID NO: 67853 - RNA, 20 nt, Homo sapiens
uggcucuuugcugcuaaagu

SEQ ID NO: 67854 - RNA, 22 nt, Homo sapiens
uggcuguguccucucccaaauc

SEQ ID NO: 67855 - RNA, 22 nt, Homo sapiens
uggcuguuuauuucacgugggu

SEQ ID NO: 67856 - RNA, 22 nt, Homo sapiens
uggcuugauggcacaagguuuc

SEQ ID NO: 67857 - RNA, 22 nt, Homo sapiens
uggcuuuguaagguuucauuuu

SEQ ID NO: 67858 - RNA, 22 nt, Homo sapiens
uggcuuuuauuauguugaggua

SEQ ID NO: 67859 - RNA, 22 nt, Homo sapiens
ugggaaacauccagcacauacu

SEQ ID NO: 67860 - RNA, 20 nt, Homo sapiens
ugggaaauguccaggacaua

SEQ ID NO: 67861 - RNA, 22 nt, Homo sapiens
ugggaacaugaagguuaaagag

SEQ ID NO: 67862 - RNA, 18 nt, Homo sapiens
ugggaagaaauucuucuc

SEQ ID NO: 67863 - RNA, 22 nt, Homo sapiens
ugggaaugaaauuacauagcuu

SEQ ID NO: 67864 - RNA, 19 nt, Homo sapiens
ugggaauguaaauuaguuc

SEQ ID NO: 67865 - RNA, 22 nt, Homo sapiens
ugggagacuacauuuuuaacaa

SEQ ID NO: 67866 - RNA, 22 nt, Homo sapiens
ugggauauaaaaaacgcuauuc

SEQ ID NO: 67867 - RNA, 22 nt, Homo sapiens
ugggaucgucaagugaggcucg

SEQ ID NO: 67868 - RNA, 22 nt, Homo sapiens
ugggaucuuuccuauuagcgag

SEQ ID NO: 67869 - RNA, 22 nt, Homo sapiens
ugggcaaauugugagggaggua

SEQ ID NO: 67870 - RNA, 22 nt, Homo sapiens
ugggcauggaguggccuuaugu

SEQ ID NO: 67871 - RNA, 22 nt, Homo sapiens
ugggcauuguuccuaguuaucu

SEQ ID NO: 67872 - RNA, 22 nt, Homo sapiens
ugggccgcugcaggaugguccc

SEQ ID NO: 67873 - RNA, 22 nt, Homo sapiens
ugggguagaauagaauugauau

SEQ ID NO: 67874 - RNA, 22 nt, Homo sapiens
uggggugugagggagaaagaaa

SEQ ID NO: 67875 - RNA, 22 nt, Homo sapiens
uggguaaaucucuguucagggc

SEQ ID NO: 67876 - RNA, 22 nt, Homo sapiens
uggguagagaaucaggaucuua

SEQ ID NO: 67877 - RNA, 22 nt, Homo sapiens
uggguagucauuggaggguuuu

SEQ ID NO: 67878 - RNA, 22 nt, Homo sapiens
uggguaguguaaagcacuccag

SEQ ID NO: 67879 - RNA, 22 nt, Homo sapiens
uggguagugucagcugauccau

SEQ ID NO: 67880 - RNA, 23 nt, Homo sapiens
uggguucauucuugaagucagug

SEQ ID NO: 67881 - RNA, 22 nt, Homo sapiens
ugguaagaggcccugaguuugu

SEQ ID NO: 67882 - RNA, 22 nt, Homo sapiens
ugguaagaucugugagccaggc

SEQ ID NO: 67883 - RNA, 22 nt, Homo sapiens
ugguaccuuuuaaugacuaauu

SEQ ID NO: 67884 - RNA, 17 nt, Homo sapiens
ugguagguuuuucuggc

SEQ ID NO: 67885 - RNA, 22 nt, Homo sapiens
ugguaucuaagaugcacguugu

SEQ ID NO: 67886 - RNA, 22 nt, Homo sapiens
ugggaucauucaaugacgaaau

SEQ ID NO: 67887 - RNA, 22 nt, Homo sapiens
ugggauccaugugguuuaagca

SEQ ID NO: 67888 - RNA, 22 nt, Homo sapiens
ugggaugauguuaaacguacuc

SEQ ID NO: 67889 - RNA, 22 nt, Homo sapiens
ugggaugugagucuucgcuuuc

SEQ ID NO: 67890 - RNA, 23 nt, Homo sapiens
ugggauguuuuuggaaacuucug

SEQ ID NO: 67891 - RNA, 22 nt, Homo sapiens
aaaagucuguagugaaagguga

SEQ ID NO: 67892 - RNA, 22 nt, Homo sapiens
aaaagugguguuguuucuaaau

SEQ ID NO: 67893 - RNA, 22 nt, Homo sapiens
aaacaccacgcggucccucgga

SEQ ID NO: 67894 - RNA, 22 nt, Homo sapiens
aaacucuguagcagagacagau

SEQ ID NO: 67895 - RNA, 18 nt, Homo sapiens
aaacugcuuccuuggccu

SEQ ID NO: 67896 - RNA, 22 nt, Homo sapiens
aaacugcuuuccaugguggcug

SEQ ID NO: 67897 - RNA, 21 nt, Homo sapiens
aaacuggcccaauuguuccau

SEQ ID NO: 67898 - RNA, 22 nt, Homo sapiens
aaacugucuucugacaguuucc

SEQ ID NO: 67899 - RNA, 22 nt, Homo sapiens
aaacuugucuaauuauaagcau

SEQ ID NO: 67900 - RNA, 22 nt, Homo sapiens
aaagcuaccagauucuguugga

SEQ ID NO: 67901 - RNA, 22 nt, Homo sapiens
aaaggauucuaauggaaaugcu

SEQ ID NO: 67902 - RNA, 22 nt, Homo sapiens
aaaguaguagcaguuucugcca

SEQ ID NO: 67903 - RNA, 17 nt, Homo sapiens
aaaguccuuugcuaucu

SEQ ID NO: 67904 - RNA, 22 nt, Homo sapiens
aaagugcaguauuugggcagaa

SEQ ID NO: 67905 - RNA, 22 nt, Homo sapiens
aaagugccugacucauaguuag

SEQ ID NO: 67906 - RNA, 22 nt, Homo sapiens
aaagugccuucuauuuuaguga

SEQ ID NO: 67907 - RNA, 22 nt, Homo sapiens
aaagugcugggauuggcugggc

SEQ ID NO: 67908 - RNA, 22 nt, Homo sapiens
aaagugcuucucuuuggugggu

SEQ ID NO: 67909 - RNA, 22 nt, Homo sapiens
aaaguggacuaagugaauauga

SEQ ID NO: 67910 - RNA, 22 nt, Homo sapiens
aaaguggugggauuccaggcau

SEQ ID NO: 67911 - RNA, 22 nt, Homo sapiens
aaaguucuguugauagugcuga

SEQ ID NO: 67912 - RNA, 22 nt, Homo sapiens
aaauaacugucagguucuggaa

SEQ ID NO: 67913 - RNA, 22 nt, Homo sapiens
aaauccaucucuuggggcauug

SEQ ID NO: 67914 - RNA, 22 nt, Homo sapiens
aaaucccuugcucucucagacc

SEQ ID NO: 67915 - RNA, 22 nt, Homo sapiens
aaaugacuuuuuaugcagagua

SEQ ID NO: 67916 - RNA, 22 nt, Homo sapiens
aaaugcaccacucuggugcagg

SEQ ID NO: 67917 - RNA, 22 nt, Homo sapiens
aaaugcagauuccuaggcccca

SEQ ID NO: 67918 - RNA, 22 nt, Homo sapiens
aaaugcagcacucaagugggaa

SEQ ID NO: 67919 - RNA, 22 nt, Homo sapiens
aaaugcagucuuuguucugggc

SEQ ID NO: 67920 - RNA, 22 nt, Homo sapiens
aaaugcauggacagcuggucuu

SEQ ID NO: 67921 - RNA, 22 nt, Homo sapiens
aaaugcauugagggaaaaggca

SEQ ID NO: 67922 - RNA, 22 nt, Homo sapiens
aaaugccucccauucuacugac

SEQ ID NO: 67923 - RNA, 22 nt, Homo sapiens
aaaugcucucuacacguuucug

SEQ ID NO: 67924 - RNA, 22 nt, Homo sapiens
aaaugcucuguggguaguaaug

SEQ ID NO: 67925 - RNA, 18 nt, Homo sapiens
aaaugcucuucuggaaua

SEQ ID NO: 67926 - RNA, 20 nt, Homo sapiens
aaaugcuguaauguuuggga

SEQ ID NO: 67927 - RNA, 22 nt, Homo sapiens
aaaugcugucugugagccucau

SEQ ID NO: 67928 - RNA, 22 nt, Homo sapiens
aaauggcacaguaagggcauuu

SEQ ID NO: 67929 - RNA, 22 nt, Homo sapiens
aaauggcaccggcucuucccuc

SEQ ID NO: 67930 - RNA, 22 nt, Homo sapiens
aaauggcuuuuugggcaaggug

SEQ ID NO: 67931 - RNA, 22 nt, Homo sapiens
aaaugguguuaguagaucuuua

SEQ ID NO: 67932 - RNA, 19 nt, Homo sapiens
aaaugugcacuguuuucca

SEQ ID NO: 67933 - RNA, 22 nt, Homo sapiens
aaauucaugucaccucuaggua

SEQ ID NO: 67934 - RNA, 22 nt, Homo sapiens
aaauuguccuacugguuugagu

SEQ ID NO: 67935 - RNA, 23 nt, Homo sapiens
aaauuugccuauuauuccuaugg

SEQ ID NO: 67936 - RNA, 22 nt, Homo sapiens
aacaccaucccuuugaugcuuu

SEQ ID NO: 67937 - RNA, 22 nt, Homo sapiens
aacagaauccucuuuuccuggg

SEQ ID NO: 67938 - RNA, 22 nt, Homo sapiens
aacaggcuccuaggggugcacc

SEQ ID NO: 67939 - RNA, 22 nt, Homo sapiens
aacagugcauuccuguccauau

SEQ ID NO: 67940 - RNA, 22 nt, Homo sapiens
aacauguuuagcagauaccugu

SEQ ID NO: 67941 - RNA, 22 nt, Homo sapiens
aaccacauggcucaguggacau

SEQ ID NO: 67942 - RNA, 22 nt, Homo sapiens
aacccugagucaugagucuaga

SEQ ID NO: 67943 - RNA, 22 nt, Homo sapiens
aaccuguggauuuugguaucug

SEQ ID NO: 67944 - RNA, 22 nt, Homo sapiens
aaccuucauuccuuucccugcc

SEQ ID NO: 67945 - RNA, 22 nt, Homo sapiens
aacuaugucaaauaaaaugagg

SEQ ID NO: 67946 - RNA, 22 nt, Homo sapiens
aacucacauucuuucuugguac

SEQ ID NO: 67947 - RNA, 22 nt, Homo sapiens
aacuggcauagccagacuucuc

SEQ ID NO: 67948 - RNA, 22 nt, Homo sapiens
aacuggcauaugaacuuguucu

SEQ ID NO: 67949 - RNA, 22 nt, Homo sapiens
aacuggcauguuuuaaggcuua

SEQ ID NO: 67950 - RNA, 22 nt, Homo sapiens
aacugguauuucccaugaauuu

SEQ ID NO: 67951 - RNA, 22 nt, Homo sapiens
aacuggucuuaugcaagcacua

SEQ ID NO: 67952 - RNA, 20 nt, Homo sapiens
aagacacuguccccacugga

SEQ ID NO: 67953 - RNA, 22 nt, Homo sapiens
aagacuguaauccaucuugagu

SEQ ID NO: 67954 - RNA, 22 nt, Homo sapiens
aagagaacugacaguaccuggg

SEQ ID NO: 67955 - RNA, 22 nt, Homo sapiens
aagagcucauccauaguuguca

SEQ ID NO: 67956 - RNA, 22 nt, Homo sapiens
aagagcucucuguagcauguga

SEQ ID NO: 67957 - RNA, 22 nt, Homo sapiens
aagauagcuaagcuucuucuaa

SEQ ID NO: 67958 - RNA, 22 nt, Homo sapiens
aagauauguuaguuauaaacuc

SEQ ID NO: 67959 - RNA, 22 nt, Homo sapiens
aagcaaacaucagcuugguuaa

SEQ ID NO: 67960 - RNA, 22 nt, Homo sapiens
aagcaacacaucugccccgguu

SEQ ID NO: 67961 - RNA, 22 nt, Homo sapiens
aagcacaauuucaccuucuugu

SEQ ID NO: 67962 - RNA, 22 nt, Homo sapiens
aagcagauguguugaaaguacu

SEQ ID NO: 67963 - RNA, 22 nt, Homo sapiens
aagcaucauuuggaauuugaga

SEQ ID NO: 67964 - RNA, 22 nt, Homo sapiens
aagcaugguuuccaggggucac

SEQ ID NO: 67965 - RNA, 22 nt, Homo sapiens
aagcuacuuuggugguuccuua

SEQ ID NO: 67966 - RNA, 22 nt, Homo sapiens
aagcuaguguuccagugaacag

SEQ ID NO: 67967 - RNA, 22 nt, Homo sapiens
aagcugccuugugaaggcauuc

SEQ ID NO: 67968 - RNA, 22 nt, Homo sapiens
aagcuggauuucgcauccuguu

SEQ ID NO: 67969 - RNA, 22 nt, Homo sapiens
aagcuguauuguguugcuauaa

SEQ ID NO: 67970 - RNA, 22 nt, Homo sapiens
aagcuguugguggaucuaccau

SEQ ID NO: 67971 - RNA, 22 nt, Homo sapiens
aaggaaguaauuugguuuauag

SEQ ID NO: 67972 - RNA, 22 nt, Homo sapiens
aaggaauacuggugguugcuau

SEQ ID NO: 67973 - RNA, 22 nt, Homo sapiens
aaggagugugauucuucaguuu

SEQ ID NO: 67974 - RNA, 22 nt, Homo sapiens
aaggcaagguggauaaugaagc

SEQ ID NO: 67975 - RNA, 22 nt, Homo sapiens
aaggcagugugcacauaacacu

SEQ ID NO: 67976 - RNA, 22 nt, Homo sapiens
aaggcaugcaguacguuucuau

SEQ ID NO: 67977 - RNA, 22 nt, Homo sapiens
aaggcgguguggauccuacagc

SEQ ID NO: 67978 - RNA, 22 nt, Homo sapiens
aaggcucuuucaacguaaauua

SEQ ID NO: 67979 - RNA, 20 nt, Homo sapiens
aaggcuuucgaguuccaggg

SEQ ID NO: 67980 - RNA, 22 nt, Homo sapiens
aaggcuuuuugcugacguccuu

SEQ ID NO: 67981 - RNA, 22 nt, Homo sapiens
aagggaaugcuuccaguuugug

SEQ ID NO: 67982 - RNA, 17 nt, Homo sapiens
aaggugcuucgaccucc

SEQ ID NO: 67983 - RNA, 22 nt, Homo sapiens
aagguggaguugacaauuuuca

SEQ ID NO: 67984 - RNA, 22 nt, Homo sapiens
aagguuguauuuaauauacugu

SEQ ID NO: 67985 - RNA, 22 nt, Homo sapiens
aaguaaacauugagagacaaga

SEQ ID NO: 67986 - RNA, 22 nt, Homo sapiens
ugacaggauggagaucgguauu

SEQ ID NO: 67987 - RNA, 22 nt, Homo sapiens
ugacaggucuaauuuacugaca

SEQ ID NO: 67988 - RNA, 22 nt, Homo sapiens
ugacaguaaacagucuugauua

SEQ ID NO: 67989 - RNA, 22 nt, Homo sapiens
ugacagucaccaggacccacag

SEQ ID NO: 67990 - RNA, 22 nt, Homo sapiens
ugacagugaacagguuaccacu

SEQ ID NO: 67991 - RNA, 22 nt, Homo sapiens
ugacaguguccucauucccaac

SEQ ID NO: 67992 - RNA, 20 nt, Homo sapiens
ugacaguuaagggauagaag

SEQ ID NO: 67993 - RNA, 22 nt, Homo sapiens
ugacaguuuccagggcugucuc

SEQ ID NO: 67994 - RNA, 18 nt, Homo sapiens
ugacaguuucuuuauauu

SEQ ID NO: 67995 - RNA, 22 nt, Homo sapiens
ugacauagcuauuaagugaugc

SEQ ID NO: 67996 - RNA, 22 nt, Homo sapiens
ugacaucguugccauguuaugc

SEQ ID NO: 67997 - RNA, 22 nt, Homo sapiens
ugacaugauuguauauuuagaa

SEQ ID NO: 67998 - RNA, 22 nt, Homo sapiens
ugacauggaagauguucaugau

SEQ ID NO: 67999 - RNA, 22 nt, Homo sapiens
ugacauggaaguagguauacau

SEQ ID NO: 68000 - RNA, 22 nt, Homo sapiens
ugacauggagggugcggcugca

SEQ ID NO: 68001 - RNA, 23 nt, Homo sapiens
ugacauguaauucaguccagcag

SEQ ID NO: 68002 - RNA, 22 nt, Homo sapiens
ugacauguagagaacuucucau

SEQ ID NO: 68003 - RNA, 22 nt, Homo sapiens
ugacauguauuagcucagugcu

SEQ ID NO: 68004 - RNA, 22 nt, Homo sapiens
ugaccaaugacauugaagagcu

SEQ ID NO: 68005 - RNA, 17 nt, Homo sapiens
ugaccacugauucuacu

SEQ ID NO: 68006 - RNA, 22 nt, Homo sapiens
ugaccagaaaacaaauuaguuu

SEQ ID NO: 68007 - RNA, 22 nt, Homo sapiens
ugacccauagaaauguggauaa

SEQ ID NO: 68008 - RNA, 22 nt, Homo sapiens
ugacggaggacaccugcggaau

SEQ ID NO: 68009 - RNA, 22 nt, Homo sapiens
ugacuaagaugaggucuggaua

SEQ ID NO: 68010 - RNA, 22 nt, Homo sapiens
ugacuaaggaaggauuaugugc

SEQ ID NO: 68011 - RNA, 22 nt, Homo sapiens
ugacuacaaccuccaccucccg

SEQ ID NO: 68012 - RNA, 22 nt, Homo sapiens
ugacuacacacaauuugucaag

SEQ ID NO: 68013 - RNA, 22 nt, Homo sapiens
ugacuaggaggcuggaggauga

SEQ ID NO: 68014 - RNA, 22 nt, Homo sapiens
ugacuagggacauucuuccacg

SEQ ID NO: 68015 - RNA, 22 nt, Homo sapiens
ugacuagucauaggcauggggg

SEQ ID NO: 68016 - RNA, 22 nt, Homo sapiens
ugacuagugcccuuugcugccu

SEQ ID NO: 68017 - RNA, 19 nt, Homo sapiens
ugacuauagccugaucagu

SEQ ID NO: 68018 - RNA, 22 nt, Homo sapiens
ugacuccagagacugugcuguc

SEQ ID NO: 68019 - RNA, 20 nt, Homo sapiens
ugacuggauacccuuuggcu

SEQ ID NO: 68020 - RNA, 22 nt, Homo sapiens
ugacugguguuuaaugagucaa

SEQ ID NO: 68021 - RNA, 18 nt, Homo sapiens
ugacuguccagguggacc

SEQ ID NO: 68022 - RNA, 22 nt, Homo sapiens
ugacuucauuuuuggccaugag

SEQ ID NO: 68023 - RNA, 22 nt, Homo sapiens
ugacuugaaguuaccauaugca

SEQ ID NO: 68024 - RNA, 22 nt, Homo sapiens
ugacuugaucacccccuaaggg

SEQ ID NO: 68025 - RNA, 17 nt, Homo sapiens
ugagaacaugugguauu

SEQ ID NO: 68026 - RNA, 20 nt, Homo sapiens
ugagaacaugugguauuugg

SEQ ID NO: 68027 - RNA, 18 nt, Homo sapiens
ugagaacauguguacaca

SEQ ID NO: 68028 - RNA, 19 nt, Homo sapiens
ugagaaccucuacagaguc

SEQ ID NO: 68029 - RNA, 22 nt, Homo sapiens
ugagaacuaaugaagaauuuau

SEQ ID NO: 68030 - RNA, 22 nt, Homo sapiens
ugagaacuagagaacaagguga

SEQ ID NO: 68031 - RNA, 22 nt, Homo sapiens
ugagaagacaucuuugcuuugu

SEQ ID NO: 68032 - RNA, 22 nt, Homo sapiens
ugagacauauuauacugcuuuu

SEQ ID NO: 68033 - RNA, 22 nt, Homo sapiens
ugagacaucacaaaauccucaa

SEQ ID NO: 68034 - RNA, 22 nt, Homo sapiens
ugagacaucucuccugagacag

SEQ ID NO: 68035 - RNA, 22 nt, Homo sapiens
ugagacaucugagauuuuaagc

SEQ ID NO: 68036 - RNA, 22 nt, Homo sapiens
ugagacaugugaacuguaguuc

SEQ ID NO: 68037 - RNA, 22 nt, Homo sapiens
ugagacggagucucgcucuguc

SEQ ID NO: 68038 - RNA, 22 nt, Homo sapiens
ugagacggagucuugcuaaguu

SEQ ID NO: 68039 - RNA, 22 nt, Homo sapiens
ugagacggaguuuugcucuugu

SEQ ID NO: 68040 - RNA, 22 nt, Homo sapiens
ugagacugaaauuaggaaacug

SEQ ID NO: 68041 - RNA, 22 nt, Homo sapiens
ugagacugagucucgcucuauu

SEQ ID NO: 68042 - RNA, 22 nt, Homo sapiens
ugagacugagucuugcucuugu

SEQ ID NO: 68043 - RNA, 22 nt, Homo sapiens
ugagacugaguuucacuuuugu

SEQ ID NO: 68044 - RNA, 22 nt, Homo sapiens
ugagacugaguuuccaucuugu

SEQ ID NO: 68045 - RNA, 22 nt, Homo sapiens
ugagacugaguuuugcucguug

SEQ ID NO: 68046 - RNA, 22 nt, Homo sapiens
ugagacugaguuuugcucuugu

SEQ ID NO: 68047 - RNA, 22 nt, Homo sapiens
ugcaagacaucguauuuugguc

SEQ ID NO: 68048 - RNA, 22 nt, Homo sapiens
ugcaagacuaaaccuuccccuc

SEQ ID NO: 68049 - RNA, 22 nt, Homo sapiens
ugcaagauaggcaguuugcacu

SEQ ID NO: 68050 - RNA, 22 nt, Homo sapiens
ugcaagaugauuucaauugaua

SEQ ID NO: 68051 - RNA, 22 nt, Homo sapiens
ugcaagcacacccagggauugu

SEQ ID NO: 68052 - RNA, 22 nt, Homo sapiens
ugcaagucaucuguccuucaga

SEQ ID NO: 68053 - RNA, 22 nt, Homo sapiens
ugcaaucauuuggaggagaaga

SEQ ID NO: 68054 - RNA, 22 nt, Homo sapiens
ugcaccacuguacuccagucug

SEQ ID NO: 68055 - RNA, 22 nt, Homo sapiens
ugcaccauugcauacuuaauua

SEQ ID NO: 68056 - RNA, 22 nt, Homo sapiens
ugcagaaucccuucagauccga

SEQ ID NO: 68057 - RNA, 22 nt, Homo sapiens
ugcagagaaacauuuuguauuu

SEQ ID NO: 68058 - RNA, 17 nt, Homo sapiens
ugcagcacacugauggg

SEQ ID NO: 68059 - RNA, 20 nt, Homo sapiens
ugcagcacgggcccuuucca

SEQ ID NO: 68060 - RNA, 22 nt, Homo sapiens
ugcagcacuguucacaauagcc

SEQ ID NO: 68061 - RNA, 22 nt, Homo sapiens
ugcaguguucuuuagaggaaau

SEQ ID NO: 68062 - RNA, 22 nt, Homo sapiens
ugcauacacaagcauacaugua

SEQ ID NO: 68063 - RNA, 22 nt, Homo sapiens
ugcauacugaaauauuuuagag

SEQ ID NO: 68064 - RNA, 22 nt, Homo sapiens
ugcauacuguaugcgugcauac

SEQ ID NO: 68065 - RNA, 17 nt, Homo sapiens
ugcauaggcaggcucag

SEQ ID NO: 68066 - RNA, 22 nt, Homo sapiens
ugcauaugucuuuauaguagca

SEQ ID NO: 68067 - RNA, 22 nt, Homo sapiens
ugcauauucuaggauuuuguau

SEQ ID NO: 68068 - RNA, 21 nt, Homo sapiens
ugcauauuggaacuuucucuc

SEQ ID NO: 68069 - RNA, 22 nt, Homo sapiens
ugcaucacaguacuccagccug

SEQ ID NO: 68070 - RNA, 22 nt, Homo sapiens
ugcauggauguuugaacacacu

SEQ ID NO: 68071 - RNA, 21 nt, Homo sapiens
ugcauuggagaauguuucuca

SEQ ID NO: 68072 - RNA, 19 nt, Homo sapiens
ugcauugucugggaaaugg

SEQ ID NO: 68073 - RNA, 22 nt, Homo sapiens
ugccaaaaugggcuuuauaccg

SEQ ID NO: 68074 - RNA, 22 nt, Homo sapiens
ugccaagaacauuuucuguuuu

SEQ ID NO: 68075 - RNA, 22 nt, Homo sapiens
ugccaagauuucaggaauuaag

SEQ ID NO: 68076 - RNA, 22 nt, Homo sapiens
ugccaguauuuuauuaagaauu

SEQ ID NO: 68077 - RNA, 22 nt, Homo sapiens
ugccaguauuuuauugaagauu

SEQ ID NO: 68078 - RNA, 22 nt, Homo sapiens
ugccaguauuuuauugagcauu

SEQ ID NO: 68079 - RNA, 22 nt, Homo sapiens
ugccaguauuuuguugaagauu

SEQ ID NO: 68080 - RNA, 20 nt, Homo sapiens
ugccagugugucaauuuaua

SEQ ID NO: 68081 - RNA, 22 nt, Homo sapiens
ugccaguguugccuuucacuag

SEQ ID NO: 68082 - RNA, 22 nt, Homo sapiens
ugccaguguuuuguugaagauu

SEQ ID NO: 68083 - RNA, 22 nt, Homo sapiens
ugccauagcaaugguaagcuga

SEQ ID NO: 68084 - RNA, 22 nt, Homo sapiens
ugccaugaagaucccugaaaug

SEQ ID NO: 68085 - RNA, 22 nt, Homo sapiens
ugccuacucucugccaggaaug

SEQ ID NO: 68086 - RNA, 22 nt, Homo sapiens
ugccuacuuugcaucugucagg

SEQ ID NO: 68087 - RNA, 23 nt, Homo sapiens
ugccuagaccaucagccugaggu

SEQ ID NO: 68088 - RNA, 22 nt, Homo sapiens
ugccuaggcccaguccucagaa

SEQ ID NO: 68089 - RNA, 22 nt, Homo sapiens
ugccuaggcuggagugcagugg

SEQ ID NO: 68090 - RNA, 22 nt, Homo sapiens
ugccuaguagaaggugaacaug

SEQ ID NO: 68091 - RNA, 22 nt, Homo sapiens
ugccuaguggaaggagagcaaa

SEQ ID NO: 68092 - RNA, 22 nt, Homo sapiens
ugccugagccagguuuuaggag

SEQ ID NO: 68093 - RNA, 22 nt, Homo sapiens
ugccuggagagcuccuacauau

SEQ ID NO: 68094 - RNA, 22 nt, Homo sapiens
ugccuucuguuaaacgaggaug

SEQ ID NO: 68095 - RNA, 21 nt, Homo sapiens
ugccuuuguaguaggugucuu

SEQ ID NO: 68096 - RNA, 22 nt, Homo sapiens
ugcgaucuuuuuccuuguuccu

SEQ ID NO: 68097 - RNA, 22 nt, Homo sapiens
ugcgccauugcacucuagccug

SEQ ID NO: 68098 - RNA, 22 nt, Homo sapiens
ugcuauagcuauaucaucuccu

SEQ ID NO: 68099 - RNA, 22 nt, Homo sapiens
ugcuaucauugauuagugaugu

SEQ ID NO: 68100 - RNA, 21 nt, Homo sapiens
ugcuauguuguccaggcuggc

SEQ ID NO: 68101 - RNA, 22 nt, Homo sapiens
ugcucaguuuaaaacuuuugag

SEQ ID NO: 68102 - RNA, 21 nt, Homo sapiens
ugcucaugaguaaugcaguga

SEQ ID NO: 68103 - RNA, 18 nt, Homo sapiens
ugcuccccugggugagca

SEQ ID NO: 68104 - RNA, 23 nt, Homo sapiens
ugcugagaccuagauccuaaaga

SEQ ID NO: 68105 - RNA, 22 nt, Homo sapiens
ugcugcaaacaggcaucugugg

SEQ ID NO: 68106 - RNA, 18 nt, Homo sapiens
auugcccucauggggcuu

SEQ ID NO: 68107 - RNA, 23 nt, Homo sapiens
auugcccuugaaggcuaaacucu

SEQ ID NO: 68108 - RNA, 22 nt, Homo sapiens
auugcucaaaucaguacuugag

SEQ ID NO: 68109 - RNA, 22 nt, Homo sapiens
auugcucacacaaagccuguuu

SEQ ID NO: 68110 - RNA, 22 nt, Homo sapiens
auugcuuacuaaucaucuucag

SEQ ID NO: 68111 - RNA, 22 nt, Homo sapiens
auugcuucugauuuuaaaugag

SEQ ID NO: 68112 - RNA, 22 nt, Homo sapiens
auuggcaauagcuuucuuacua

SEQ ID NO: 68113 - RNA, 22 nt, Homo sapiens
auuggcaaucgucuccauuuuu

SEQ ID NO: 68114 - RNA, 22 nt, Homo sapiens
auuggccccguuuuaaauguca

SEQ ID NO: 68115 - RNA, 22 nt, Homo sapiens
auuggcuuuauacauaagaaua

SEQ ID NO: 68116 - RNA, 22 nt, Homo sapiens
auuggggaaugguggcuuuagu

SEQ ID NO: 68117 - RNA, 22 nt, Homo sapiens
auuggguuaaaggauaugaaca

SEQ ID NO: 68118 - RNA, 22 nt, Homo sapiens
auuggucuugaaaccagagaga

SEQ ID NO: 68119 - RNA, 18 nt, Homo sapiens
auuguaagauguauggga

SEQ ID NO: 68120 - RNA, 22 nt, Homo sapiens
auuguacuccagccugggcagc

SEQ ID NO: 68121 - RNA, 22 nt, Homo sapiens
auuguacuccagccugggcuaa

SEQ ID NO: 68122 - RNA, 22 nt, Homo sapiens
auuguacuccagccuguggagc

SEQ ID NO: 68123 - RNA, 22 nt, Homo sapiens
auuguacucuagccucugggca

SEQ ID NO: 68124 - RNA, 22 nt, Homo sapiens
auuguacuuaagccugggugaa

SEQ ID NO: 68125 - RNA, 22 nt, Homo sapiens
auugucauuuauaacuguguag

SEQ ID NO: 68126 - RNA, 22 nt, Homo sapiens
gacacugucuucugcucuuaaa

SEQ ID NO: 68127 - RNA, 18 nt, Homo sapiens
gacagugugaagauuccu

SEQ ID NO: 68128 - RNA, 22 nt, Homo sapiens
gacagugugauacuuagucuca

SEQ ID NO: 68129 - RNA, 18 nt, Homo sapiens
gacaguguggcgauuccu

SEQ ID NO: 68130 - RNA, 22 nt, Homo sapiens
gacaguguggcgauuccucaag

SEQ ID NO: 68131 - RNA, 17 nt, Homo sapiens
gacauaggaaaaggaga

SEQ ID NO: 68132 - RNA, 19 nt, Homo sapiens
gacaugagauuuggugggg

SEQ ID NO: 68133 - RNA, 20 nt, Homo sapiens
gacauggaggaggauuauua

SEQ ID NO: 68134 - RNA, 22 nt, Homo sapiens
gacauguaaggcucucucuguu

SEQ ID NO: 68135 - RNA, 22 nt, Homo sapiens
gacccuuagaaugugaucuuau

SEQ ID NO: 68136 - RNA, 22 nt, Homo sapiens
gaccuuguagaaucucaugauu

SEQ ID NO: 68137 - RNA, 22 nt, Homo sapiens
gacuacaacuucuauuauucag

SEQ ID NO: 68138 - RNA, 21 nt, Homo sapiens
gacuacaccaggaugcuaguu

SEQ ID NO: 68139 - RNA, 22 nt, Homo sapiens
gacuauguuaccuuacacauca

SEQ ID NO: 68140 - RNA, 22 nt, Homo sapiens
gacugcagugcagcuguuaggc

SEQ ID NO: 68141 - RNA, 22 nt, Homo sapiens
gacuggccuauaauggcgaauu

SEQ ID NO: 68142 - RNA, 22 nt, Homo sapiens
gacuggcuguuuucuuuauuau

SEQ ID NO: 68143 - RNA, 22 nt, Homo sapiens
gacuucaucauacuaugugugg

SEQ ID NO: 68144 - RNA, 20 nt, Homo sapiens
gacuugagagugggagagua

SEQ ID NO: 68145 - RNA, 22 nt, Homo sapiens
gacuuugguagaggaaaaaucu

SEQ ID NO: 68146 - RNA, 22 nt, Homo sapiens
gagaacuaaugauguacuaggc

SEQ ID NO: 68147 - RNA, 22 nt, Homo sapiens
gagaacugacauuaucguguau

SEQ ID NO: 68148 - RNA, 22 nt, Homo sapiens
gagaacugagugugcuggcgga

SEQ ID NO: 68149 - RNA, 22 nt, Homo sapiens
gagaacuggcugauucaaggac

SEQ ID NO: 68150 - RNA, 22 nt, Homo sapiens
gagaagugcgucguuugaugau

SEQ ID NO: 68151 - RNA, 21 nt, Homo sapiens
gagaaucaucauggcugcaua

SEQ ID NO: 68152 - RNA, 22 nt, Homo sapiens
gagaaugaugauuuccaauuuc

SEQ ID NO: 68153 - RNA, 22 nt, Homo sapiens
gagacggagucucgcucugucg

SEQ ID NO: 68154 - RNA, 22 nt, Homo sapiens
gagacggagucuugcucuguug

SEQ ID NO: 68155 - RNA, 22 nt, Homo sapiens
gagacugaguuuugcucuuguu

SEQ ID NO: 68156 - RNA, 22 nt, Homo sapiens
gagagcaugugcuggcaucagu

SEQ ID NO: 68157 - RNA, 22 nt, Homo sapiens
cuagauuguuuccauaaugaca

SEQ ID NO: 68158 - RNA, 22 nt, Homo sapiens
cuagcagaacaauacaauucgg

SEQ ID NO: 68159 - RNA, 22 nt, Homo sapiens
cuagcagcauaagaaucaccaa

SEQ ID NO: 68160 - RNA, 22 nt, Homo sapiens
cuagccuggagugcaguggugc

SEQ ID NO: 68161 - RNA, 22 nt, Homo sapiens
cuagcuccauauaaagcaggau

SEQ ID NO: 68162 - RNA, 22 nt, Homo sapiens
cuagcuuuuuaugacaaucuug

SEQ ID NO: 68163 - RNA, 22 nt, Homo sapiens
cuagguagcuuuucugucaugu

SEQ ID NO: 68164 - RNA, 22 nt, Homo sapiens
cuagguuauacucugaaauggu

SEQ ID NO: 68165 - RNA, 22 nt, Homo sapiens
cuagucacaggaguugaaggau

SEQ ID NO: 68166 - RNA, 22 nt, Homo sapiens
cuagucacauuuucaucaaaua

SEQ ID NO: 68167 - RNA, 18 nt, Homo sapiens
cuaguguuucuugaauca

SEQ ID NO: 68168 - RNA, 18 nt, Homo sapiens
cuaugccacuuuauauca

SEQ ID NO: 68169 - RNA, 22 nt, Homo sapiens
cuaugcuucuuaaauuaguuau

SEQ ID NO: 68170 - RNA, 22 nt, Homo sapiens
cuauggcucugguuauggcugu

SEQ ID NO: 68171 - RNA, 22 nt, Homo sapiens
cuauggguuauaauucauuagu

SEQ ID NO: 68172 - RNA, 22 nt, Homo sapiens
cuauguaccuggaacuguauua

SEQ ID NO: 68173 - RNA, 22 nt, Homo sapiens
cuauucacaauggugaagauau

SEQ ID NO: 68174 - RNA, 22 nt, Homo sapiens
cucaaagucaagggaaagcagg

SEQ ID NO: 68175 - RNA, 22 nt, Homo sapiens
cucaaagugcugggacuggcug

SEQ ID NO: 68176 - RNA, 22 nt, Homo sapiens
cucaaaugguccagcuaguggu

SEQ ID NO: 68177 - RNA, 22 nt, Homo sapiens
cucacaaccuuaugaagcauga

SEQ ID NO: 68178 - RNA, 18 nt, Homo sapiens
cucacacccuaaucagga

SEQ ID NO: 68179 - RNA, 20 nt, Homo sapiens
cucacagacagcuucuuucu

SEQ ID NO: 68180 - RNA, 22 nt, Homo sapiens
cucacaguucuaaaggcaagaa

SEQ ID NO: 68181 - RNA, 22 nt, Homo sapiens
cucaccuugugauccuccugcc

SEQ ID NO: 68182 - RNA, 22 nt, Homo sapiens
cucacuaguaaggcuguuuagu

SEQ ID NO: 68183 - RNA, 17 nt, Homo sapiens
cucacugagaacagcua

SEQ ID NO: 68184 - RNA, 22 nt, Homo sapiens
cucagcuacuugagaggcuuag

SEQ ID NO: 68185 - RNA, 22 nt, Homo sapiens
cucagcuacuugggaagcugag

SEQ ID NO: 68186 - RNA, 22 nt, Homo sapiens
cucaguagaaaauacauggacu

SEQ ID NO: 68187 - RNA, 22 nt, Homo sapiens
cucagucuaugauacuuugcua

SEQ ID NO: 68188 - RNA, 20 nt, Homo sapiens
cucagugcacccccauaaaa

SEQ ID NO: 68189 - RNA, 22 nt, Homo sapiens
cucaguggauuagauaaugcac

SEQ ID NO: 68190 - RNA, 22 nt, Homo sapiens
cucauggagauagagaauagaa

SEQ ID NO: 68191 - RNA, 22 nt, Homo sapiens
cucauggauggucuggcagcca

SEQ ID NO: 68192 - RNA, 22 nt, Homo sapiens
cucauugcaaucucugccuccc

SEQ ID NO: 68193 - RNA, 22 nt, Homo sapiens
cuccacgugaaugccaaguauu

SEQ ID NO: 68194 - RNA, 22 nt, Homo sapiens
cuccaguacagagagguuccuc

SEQ ID NO: 68195 - RNA, 22 nt, Homo sapiens
cuccaugagauuguugaaguag

SEQ ID NO: 68196 - RNA, 22 nt, Homo sapiens
cuccauuuaucugaaauuuuau

SEQ ID NO: 68197 - RNA, 22 nt, Homo sapiens
cucgagagaaaaugcuucacug

SEQ ID NO: 68198 - RNA, 17 nt, Homo sapiens
cucucugguuuaaagca

SEQ ID NO: 68199 - RNA, 22 nt, Homo sapiens
cucugauggagauauacaagga

SEQ ID NO: 68200 - RNA, 22 nt, Homo sapiens
cucugguggaagcagggggcaa

SEQ ID NO: 68201 - RNA, 22 nt, Homo sapiens
cucugguuaaggcugaacuaua

SEQ ID NO: 68202 - RNA, 22 nt, Homo sapiens
cucugguucugcagugcacccu

SEQ ID NO: 68203 - RNA, 22 nt, Homo sapiens
cucugguuuuucuuccauuaag

SEQ ID NO: 68204 - RNA, 22 nt, Homo sapiens
cucuuugaggugagcugcccau

SEQ ID NO: 68205 - RNA, 22 nt, Homo sapiens
cucuuuuguuuagcugagaggg

SEQ ID NO: 68206 - RNA, 22 nt, Homo sapiens
cugaaaagcaucugcauagcug

SEQ ID NO: 68207 - RNA, 22 nt, Homo sapiens
cugaaaguuauucaggggcaag

SEQ ID NO: 68208 - RNA, 22 nt, Homo sapiens
cugaaaugaauuauuuucuuuc

SEQ ID NO: 68209 - RNA, 22 nt, Homo sapiens
cugaaauggaaugugugcacag

SEQ ID NO: 68210 - RNA, 22 nt, Homo sapiens
cugaaggcagguagaauagaga

SEQ ID NO: 68211 - RNA, 20 nt, Homo sapiens
cugaaugucaaggcagaggu

SEQ ID NO: 68212 - RNA, 21 nt, Homo sapiens
gagaggauucgccagccucuu

SEQ ID NO: 68213 - RNA, 22 nt, Homo sapiens
gagagugcuuuggguguaggcc

SEQ ID NO: 68214 - RNA, 22 nt, Homo sapiens
gagauauguuggcagcugguau

SEQ ID NO: 68215 - RNA, 22 nt, Homo sapiens
gagauauucugguuuacuaaau

SEQ ID NO: 68216 - RNA, 22 nt, Homo sapiens
gagaucaaugggauggaauuga

SEQ ID NO: 68217 - RNA, 22 nt, Homo sapiens
gagaucuuggccaaguuucuua

SEQ ID NO: 68218 - RNA, 22 nt, Homo sapiens
gagaugaucaugugguuuuguc

SEQ ID NO: 68219 - RNA, 22 nt, Homo sapiens
gagaugaugagauguucacagu

SEQ ID NO: 68220 - RNA, 22 nt, Homo sapiens
gagauggagucuuuuucuguca

SEQ ID NO: 68221 - RNA, 22 nt, Homo sapiens
gagaugguguuccacugccagu

SEQ ID NO: 68222 - RNA, 22 nt, Homo sapiens
gagauguagucuugcccuguca

SEQ ID NO: 68223 - RNA, 22 nt, Homo sapiens
gagauucaucuagguccagaga

SEQ ID NO: 68224 - RNA, 22 nt, Homo sapiens
gagcaaugagcugccugcugag

SEQ ID NO: 68225 - RNA, 22 nt, Homo sapiens
gagcacauguggagagucuggg

SEQ ID NO: 68226 - RNA, 22 nt, Homo sapiens
gagcacugaauacugugguggu

SEQ ID NO: 68227 - RNA, 22 nt, Homo sapiens
gagcaucaauggcaugugggaa

SEQ ID NO: 68228 - RNA, 22 nt, Homo sapiens
gagccauggagaaaacagcuau

SEQ ID NO: 68229 - RNA, 22 nt, Homo sapiens
gagcccauuucacuuguccagc

SEQ ID NO: 68230 - RNA, 22 nt, Homo sapiens
gagccuguaggaggagaggugg

SEQ ID NO: 68231 - RNA, 22 nt, Homo sapiens
gagcuagaauauuuuguauagu

SEQ ID NO: 68232 - RNA, 22 nt, Homo sapiens
gagcuagggucaugcuacugca

SEQ ID NO: 68233 - RNA, 22 nt, Homo sapiens
gagcuagugcuuaugcaccacu

SEQ ID NO: 68234 - RNA, 22 nt, Homo sapiens
gagcuguuuuucacuagaccaa

SEQ ID NO: 68235 - RNA, 22 nt, Homo sapiens
gaggaaguuuacaaagcaucug

SEQ ID NO: 68236 - RNA, 22 nt, Homo sapiens
gaggacauuaugcuaaguggaa

SEQ ID NO: 68237 - RNA, 22 nt, Homo sapiens
gaggaucucuugagcccagaag

SEQ ID NO: 68238 - RNA, 22 nt, Homo sapiens
gaggcaauaugagggaggcuuc

SEQ ID NO: 68239 - RNA, 22 nt, Homo sapiens
gaggcacucuguacaaaucugc

SEQ ID NO: 68240 - RNA, 22 nt, Homo sapiens
gaggcaguguguccguucucgg

SEQ ID NO: 68241 - RNA, 22 nt, Homo sapiens
gaggcuagauggggaugugucc

SEQ ID NO: 68242 - RNA, 22 nt, Homo sapiens
gaggguguuguguugcuuaaua

SEQ ID NO: 68243 - RNA, 22 nt, Homo sapiens
gagguaagaaagucaguccuuc

SEQ ID NO: 68244 - RNA, 22 nt, Homo sapiens
gagguaaguaagaauggcaagc

SEQ ID NO: 68245 - RNA, 22 nt, Homo sapiens
gagguagaauguuuuucagcug

SEQ ID NO: 68246 - RNA, 22 nt, Homo sapiens
gagguaggaauaaacauuugaa

SEQ ID NO: 68247 - RNA, 22 nt, Homo sapiens
gagguaggaggauugcuuaagg

SEQ ID NO: 68248 - RNA, 21 nt, Homo sapiens
gagguagggauuaaagaccuc

SEQ ID NO: 68249 - RNA, 22 nt, Homo sapiens
gagguagguacaauugccacca

SEQ ID NO: 68250 - RNA, 22 nt, Homo sapiens
gagguaugugggcagacauuua

SEQ ID NO: 68251 - RNA, 22 nt, Homo sapiens
gaggucaggacauuuuugcuuu

SEQ ID NO: 68252 - RNA, 22 nt, Homo sapiens
gaggucaugucgggccccagga

SEQ ID NO: 68253 - RNA, 22 nt, Homo sapiens
gaggucuuacauuuuaauauuu

SEQ ID NO: 68254 - RNA, 22 nt, Homo sapiens
gaggugaaggucucaauaaaua

SEQ ID NO: 68255 - RNA, 22 nt, Homo sapiens
gagguuauuggggugcuugugu

SEQ ID NO: 68256 - RNA, 22 nt, Homo sapiens
gagugcaauggugccaucucgg

SEQ ID NO: 68257 - RNA, 21 nt, Homo sapiens
gaguggcuuuuguuucaccag

SEQ ID NO: 68258 - RNA, 22 nt, Homo sapiens
gaguucaaaucucagcucuguu

SEQ ID NO: 68259 - RNA, 22 nt, Homo sapiens
gaguucauuuugaaaccuugau

SEQ ID NO: 68260 - RNA, 19 nt, Homo sapiens
gaguugggguuuacuguaa

SEQ ID NO: 68261 - RNA, 22 nt, Homo sapiens
gaguuguuuuaaggcacugacu

SEQ ID NO: 68262 - RNA, 22 nt, Homo sapiens
gaguuuguaaacuauucacuaa

SEQ ID NO: 68263 - RNA, 22 nt, Homo sapiens
gaguuuguacuaauuuguugua

SEQ ID NO: 68264 - RNA, 22 nt, Homo sapiens
gauaaauccagauucugaugua

SEQ ID NO: 68265 - RNA, 22 nt, Homo sapiens
gauaagagaugauuuugccaug

SEQ ID NO: 68266 - RNA, 22 nt, Homo sapiens
gauaauucuagcagauacaggc

SEQ ID NO: 68267 - RNA, 22 nt, Homo sapiens
gauacaguaugcaugugguauu

SEQ ID NO: 68268 - RNA, 22 nt, Homo sapiens
gauacuguauccuaaaagcuuu

SEQ ID NO: 68269 - RNA, 22 nt, Homo sapiens
gauagaccauccaggauguuug

SEQ ID NO: 68270 - RNA, 22 nt, Homo sapiens
gauagguagaagauguuuucau

SEQ ID NO: 68271 - RNA, 22 nt, Homo sapiens
gauagguucuaagcagguguug

SEQ ID NO: 68272 - RNA, 22 nt, Homo sapiens
gauagugaaccaagggguaauu

SEQ ID NO: 68273 - RNA, 22 nt, Homo sapiens
gauauguuagggggagaaguua

SEQ ID NO: 68274 - RNA, 22 nt, Homo sapiens
gauauguucugagaaaugcauu

SEQ ID NO: 68275 - RNA, 22 nt, Homo sapiens
gauauguuucuucaauaccuag

SEQ ID NO: 68276 - RNA, 17 nt, Homo sapiens
gaucacagucgucuccu

SEQ ID NO: 68277 - RNA, 22 nt, Homo sapiens
gaucacaguuccucacgggcau

SEQ ID NO: 68278 - RNA, 22 nt, Homo sapiens
gaucacaugggagaaugagagu

SEQ ID NO: 68279 - RNA, 22 nt, Homo sapiens
gaucacuuugaugccaggaacu

SEQ ID NO: 68280 - RNA, 22 nt, Homo sapiens
gaucuguguuuguaugcauaag

SEQ ID NO: 68281 - RNA, 19 nt, Homo sapiens
gaucuguugaucaaugugu

SEQ ID NO: 68282 - RNA, 22 nt, Homo sapiens
gaugaacugucuuacuacucac

SEQ ID NO: 68283 - RNA, 22 nt, Homo sapiens
gaugacagugaguaaccccaac

SEQ ID NO: 68284 - RNA, 22 nt, Homo sapiens
gaugacuaagaauuuuauaauu

SEQ ID NO: 68285 - RNA, 22 nt, Homo sapiens
gaugagguaggccugcuuugaa

SEQ ID NO: 68286 - RNA, 22 nt, Homo sapiens
gaugaucaugaccuacagaugg

SEQ ID NO: 68287 - RNA, 22 nt, Homo sapiens
gaugaugcuagguguuagggcu

SEQ ID NO: 68288 - RNA, 22 nt, Homo sapiens
gaugauguuacucuuuuuccuu

SEQ ID NO: 68289 - RNA, 19 nt, Homo sapiens
gaugcaaugcacugagguc

SEQ ID NO: 68290 - RNA, 22 nt, Homo sapiens
gaugccuuuuuguccucaguua

SEQ ID NO: 68291 - RNA, 22 nt, Homo sapiens
gauggaguaauguaaucuugag

SEQ ID NO: 68292 - RNA, 22 nt, Homo sapiens
gauggauuuuuuaggcagagcu

SEQ ID NO: 68293 - RNA, 22 nt, Homo sapiens
gauggcacuuaagagcaagagc

SEQ ID NO: 68294 - RNA, 22 nt, Homo sapiens
gauggcuacugauuaaauauag

SEQ ID NO: 68295 - RNA, 22 nt, Homo sapiens
gauggcucugcaggugagggua

SEQ ID NO: 68296 - RNA, 22 nt, Homo sapiens
gaugguguuuugauaggaauug

SEQ ID NO: 68297 - RNA, 22 nt, Homo sapiens
gaugguuuuucuccgauuuaua

SEQ ID NO: 68298 - RNA, 22 nt, Homo sapiens
gauguaggugcauuugcacgug

SEQ ID NO: 68299 - RNA, 22 nt, Homo sapiens
gauguguuuuaggaucucagca

SEQ ID NO: 68300 - RNA, 22 nt, Homo sapiens
gauuagcacuucaguuacagua

SEQ ID NO: 68301 - RNA, 22 nt, Homo sapiens
gauuagucccauuuuacaggug

SEQ ID NO: 68302 - RNA, 22 nt, Homo sapiens
gauuccacuuucugucucuaug

SEQ ID NO: 68303 - RNA, 22 nt, Homo sapiens
gauugguugaaaguagaauacu

SEQ ID NO: 68304 - RNA, 22 nt, Homo sapiens
gauuuguuggccugugagcuag

SEQ ID NO: 68305 - RNA, 22 nt, Homo sapiens
gcaaaauugagaagggaauaua

SEQ ID NO: 68306 - RNA, 22 nt, Homo sapiens
gcaaagaaugcagauuugccuc

SEQ ID NO: 68307 - RNA, 22 nt, Homo sapiens
gcaaaguguuuuuaggaagucu

SEQ ID NO: 68308 - RNA, 23 nt, Homo sapiens
gcaaauaucguagagugucccug

SEQ ID NO: 68309 - RNA, 22 nt, Homo sapiens
gcacauggccccaucgugccga

SEQ ID NO: 68310 - RNA, 22 nt, Homo sapiens
gcaccacugcacucucagcuug

SEQ ID NO: 68311 - RNA, 22 nt, Homo sapiens
gcacccugucaaaauggaccaa

SEQ ID NO: 68312 - RNA, 22 nt, Homo sapiens
gcacgugcacccacaugcacgu

SEQ ID NO: 68313 - RNA, 22 nt, Homo sapiens
gcacugggccacauuuauuuuc

SEQ ID NO: 68314 - RNA, 22 nt, Homo sapiens
gcagaauugacucuguuuuuuc

SEQ ID NO: 68315 - RNA, 23 nt, Homo sapiens
gcagcaaugucacagggguccgg

SEQ ID NO: 68316 - RNA, 22 nt, Homo sapiens
gcagcacaugacuguauguaua

SEQ ID NO: 68317 - RNA, 20 nt, Homo sapiens
gcagcaccauauuucuaaga

SEQ ID NO: 68318 - RNA, 22 nt, Homo sapiens
gcaggauuggagccucucugaa

SEQ ID NO: 68319 - RNA, 22 nt, Homo sapiens
gcagguguuaugcaaacaacug

SEQ ID NO: 68320 - RNA, 22 nt, Homo sapiens
gcaguacuuuauguccuaauua

SEQ ID NO: 68321 - RNA, 20 nt, Homo sapiens
gcaguacuuuuaguucuaag

SEQ ID NO: 68322 - RNA, 23 nt, Homo sapiens
gcagucauuuggaaaagguugaa

SEQ ID NO: 68323 - RNA, 22 nt, Homo sapiens
gcagugaugugaucauagcuca

SEQ ID NO: 68324 - RNA, 22 nt, Homo sapiens
gucucuuguuaucauuucugag

SEQ ID NO: 68325 - RNA, 22 nt, Homo sapiens
gucuggcaauggcagacuggca

SEQ ID NO: 68326 - RNA, 22 nt, Homo sapiens
gucuggcacagggaaaguacaa

SEQ ID NO: 68327 - RNA, 23 nt, Homo sapiens
gucuggucccugguuggaaacca

SEQ ID NO: 68328 - RNA, 22 nt, Homo sapiens
gucugguuuuuuauauccucac

SEQ ID NO: 68329 - RNA, 20 nt, Homo sapiens
gucugucuccgaguagaauu

SEQ ID NO: 68330 - RNA, 22 nt, Homo sapiens
gucugucuuuugucuuugaaau

SEQ ID NO: 68331 - RNA, 22 nt, Homo sapiens
gucuguuugauccagaucaaaa

SEQ ID NO: 68332 - RNA, 22 nt, Homo sapiens
gucuguuuggggaccuguggcc

SEQ ID NO: 68333 - RNA, 21 nt, Homo sapiens
gucuuacagccagaugccucu

SEQ ID NO: 68334 - RNA, 22 nt, Homo sapiens
gucuuuggaaagacaaaguuca

SEQ ID NO: 68335 - RNA, 22 nt, Homo sapiens
gucuuuguuuggucuguaucag

SEQ ID NO: 68336 - RNA, 22 nt, Homo sapiens
gugaaacuggguggugagagac

SEQ ID NO: 68337 - RNA, 22 nt, Homo sapiens
gugaaagacagcauuaauggcu

SEQ ID NO: 68338 - RNA, 22 nt, Homo sapiens
gugaaagacauauaugguuuga

SEQ ID NO: 68339 - RNA, 22 nt, Homo sapiens
gugaaauacauaaucccaagug

SEQ ID NO: 68340 - RNA, 22 nt, Homo sapiens
gugaacaagcaaaggcaggagg

SEQ ID NO: 68341 - RNA, 22 nt, Homo sapiens
gugaacagcagaugagugagug

SEQ ID NO: 68342 - RNA, 22 nt, Homo sapiens
gugaagaucccuguccuguucc

SEQ ID NO: 68343 - RNA, 22 nt, Homo sapiens
uagauuaucucaccacucgagu

SEQ ID NO: 68344 - RNA, 22 nt, Homo sapiens
uagauuaucuuaaggagcauca

SEQ ID NO: 68345 - RNA, 22 nt, Homo sapiens
uagcaaaucaauggaauugaag

SEQ ID NO: 68346 - RNA, 22 nt, Homo sapiens
uagcacagggaauugguucucu

SEQ ID NO: 68347 - RNA, 17 nt, Homo sapiens
uagcacagugccuggua

SEQ ID NO: 68348 - RNA, 19 nt, Homo sapiens
uagcacuacagaguuuagc

SEQ ID NO: 68349 - RNA, 22 nt, Homo sapiens
uagcacuaucuauugcaugcaa

SEQ ID NO: 68350 - RNA, 22 nt, Homo sapiens
uagcacuauuuauugaaaagga

SEQ ID NO: 68351 - RNA, 23 nt, Homo sapiens
uagcacuuuuuacauauggacau

SEQ ID NO: 68352 - RNA, 22 nt, Homo sapiens
uagcagcaaagcaggaucugcu

SEQ ID NO: 68353 - RNA, 22 nt, Homo sapiens
uagcagcaccccacucuacugg

SEQ ID NO: 68354 - RNA, 22 nt, Homo sapiens
uagcagcaucucuggcuucuac

SEQ ID NO: 68355 - RNA, 20 nt, Homo sapiens
uagcaggugucaggugauau

SEQ ID NO: 68356 - RNA, 22 nt, Homo sapiens
uagcaguaagaaacugacauug

SEQ ID NO: 68357 - RNA, 22 nt, Homo sapiens
uagcaguaccccaguauccugg

SEQ ID NO: 68358 - RNA, 22 nt, Homo sapiens
uagcaguauacguacugggucc

SEQ ID NO: 68359 - RNA, 22 nt, Homo sapiens
uagcaguauaugagagcuauug

SEQ ID NO: 68360 - RNA, 22 nt, Homo sapiens
uagcaguauggagcgaggccca

SEQ ID NO: 68361 - RNA, 22 nt, Homo sapiens
uagcagugugaaaacagacuaa

SEQ ID NO: 68362 - RNA, 22 nt, Homo sapiens
uagcaucaauucauguuaugau

SEQ ID NO: 68363 - RNA, 22 nt, Homo sapiens
uagcaugacacuuguugaaugc

SEQ ID NO: 68364 - RNA, 22 nt, Homo sapiens
uagcauggaggcggccauagug

SEQ ID NO: 68365 - RNA, 22 nt, Homo sapiens
uagcauggagucaugcacggcu

SEQ ID NO: 68366 - RNA, 22 nt, Homo sapiens
uagcaugucagucgccacacgu

SEQ ID NO: 68367 - RNA, 20 nt, Homo sapiens
uagccggguguugugucaug

SEQ ID NO: 68368 - RNA, 22 nt, Homo sapiens
uagccucacaaagugcuuaaga

SEQ ID NO: 68369 - RNA, 21 nt, Homo sapiens
uagcuacacugugauucaugg

SEQ ID NO: 68370 - RNA, 21 nt, Homo sapiens
uagcugcacccaggccuccuu

SEQ ID NO: 68371 - RNA, 22 nt, Homo sapiens
uagcugguauuaggaguugugu

SEQ ID NO: 68372 - RNA, 22 nt, Homo sapiens
uagcuguuggugggaagucaga

SEQ ID NO: 68373 - RNA, 17 nt, Homo sapiens
uagcuucacauuaggaa

SEQ ID NO: 68374 - RNA, 22 nt, Homo sapiens
uaggaaguacaucucagaaucu

SEQ ID NO: 68375 - RNA, 22 nt, Homo sapiens
uaggaaguuuucuugcugggcc

SEQ ID NO: 68376 - RNA, 22 nt, Homo sapiens
uaggacacucucuccaccagua

SEQ ID NO: 68377 - RNA, 22 nt, Homo sapiens
uaggacauugcccuuguggaga

SEQ ID NO: 68378 - RNA, 22 nt, Homo sapiens
uaggacuuuucuugagagugac

SEQ ID NO: 68379 - RNA, 20 nt, Homo sapiens
uaggagcaaugagaguagaa

SEQ ID NO: 68380 - RNA, 22 nt, Homo sapiens
uaggcaaaugcaagaguagaac

SEQ ID NO: 68381 - RNA, 22 nt, Homo sapiens
uaggcaauggagauagaggaug

SEQ ID NO: 68382 - RNA, 22 nt, Homo sapiens
uaggccuuuuuaugucaauauc

SEQ ID NO: 68383 - RNA, 22 nt, Homo sapiens
uaggcuguguggccguggggcu

SEQ ID NO: 68384 - RNA, 22 nt, Homo sapiens
uaggcuuuucugggaugugggc

SEQ ID NO: 68385 - RNA, 22 nt, Homo sapiens
uaggcuuuuggacccugucucu

SEQ ID NO: 68386 - RNA, 22 nt, Homo sapiens
uagggcaugugggaaguuauaa

SEQ ID NO: 68387 - RNA, 22 nt, Homo sapiens
uagggcauugaacugaauucuu

SEQ ID NO: 68388 - RNA, 22 nt, Homo sapiens
uagggcuuuaguuugcuugugu

SEQ ID NO: 68389 - RNA, 22 nt, Homo sapiens
uagguaagauguuaacagcuga

SEQ ID NO: 68390 - RNA, 22 nt, Homo sapiens
uagguaaguaauauacagauga

SEQ ID NO: 68391 - RNA, 22 nt, Homo sapiens
uagguaaguaugugugaugggg

SEQ ID NO: 68392 - RNA, 22 nt, Homo sapiens
uagguacuuuacauguuaucuc

SEQ ID NO: 68393 - RNA, 22 nt, Homo sapiens
uagguagaacccagaaaucuga

SEQ ID NO: 68394 - RNA, 22 nt, Homo sapiens
uagguagauuuaaagauuuucu

SEQ ID NO: 68395 - RNA, 22 nt, Homo sapiens
uagguagcuuuggcguuucuug

SEQ ID NO: 68396 - RNA, 22 nt, Homo sapiens
uagguaggacguaguccuuuug

SEQ ID NO: 68397 - RNA, 22 nt, Homo sapiens
uagguaguuacacagcaaugua

SEQ ID NO: 68398 - RNA, 22 nt, Homo sapiens
uaggucuuuuaugaaauauauu

SEQ ID NO: 68399 - RNA, 22 nt, Homo sapiens
uaggugauugaagguggaaugu

SEQ ID NO: 68400 - RNA, 22 nt, Homo sapiens
uaggugguuugaaauacucaag

SEQ ID NO: 68401 - RNA, 22 nt, Homo sapiens
uagguuaucucaaguguaauuu

SEQ ID NO: 68402 - RNA, 23 nt, Homo sapiens
uagguuauuugguaaauauaugu

SEQ ID NO: 68403 - RNA, 22 nt, Homo sapiens
uaguaaacagcucugccacaau

SEQ ID NO: 68404 - RNA, 22 nt, Homo sapiens
uaguaaacauuuuucuaucauu

SEQ ID NO: 68405 - RNA, 23 nt, Homo sapiens
uaguaccauauuguuggcagcac

SEQ ID NO: 68406 - RNA, 18 nt, Homo sapiens
uaguacuguucucaugau

SEQ ID NO: 68407 - RNA, 22 nt, Homo sapiens
uaguagagauggggcacaugcc

SEQ ID NO: 68408 - RNA, 22 nt, Homo sapiens
uaguaucauugaaacggcuugu

SEQ ID NO: 68409 - RNA, 22 nt, Homo sapiens
uagucagcaauguucauguucu

SEQ ID NO: 68410 - RNA, 20 nt, Homo sapiens
uagucaugagauucuccaag

SEQ ID NO: 68411 - RNA, 22 nt, Homo sapiens
uagugaaugucacuggcuguug

SEQ ID NO: 68412 - RNA, 22 nt, Homo sapiens
uagugaauguuggcuauuaaua

SEQ ID NO: 68413 - RNA, 22 nt, Homo sapiens
uagugcaguggcuccaucucag

SEQ ID NO: 68414 - RNA, 22 nt, Homo sapiens
uagugcugugauauuuuuggcc

SEQ ID NO: 68415 - RNA, 22 nt, Homo sapiens
uagugguaguagcaguaauauu

SEQ ID NO: 68416 - RNA, 22 nt, Homo sapiens
uaguuaguagacucugauuauu

SEQ ID NO: 68417 - RNA, 22 nt, Homo sapiens
uauaagacuagcagcugaauug

SEQ ID NO: 68418 - RNA, 22 nt, Homo sapiens
uauacacgugugcauauauaca

SEQ ID NO: 68419 - RNA, 22 nt, Homo sapiens
uauacuguuuucuauaguggcu

SEQ ID NO: 68420 - RNA, 22 nt, Homo sapiens
uauagagguagguuaauuggaa

SEQ ID NO: 68421 - RNA, 22 nt, Homo sapiens
uauagcaaugugccacucucug

SEQ ID NO: 68422 - RNA, 22 nt, Homo sapiens
uauagcauuuugauccuguaga

SEQ ID NO: 68423 - RNA, 22 nt, Homo sapiens
uauagcuaugggauguauuugc

SEQ ID NO: 68424 - RNA, 22 nt, Homo sapiens
uauagcuauuguuaauggaacu

SEQ ID NO: 68425 - RNA, 22 nt, Homo sapiens
uauagcuuaaaguuuagauccu

SEQ ID NO: 68426 - RNA, 22 nt, Homo sapiens
uauaggacuugguguaguuucu

SEQ ID NO: 68427 - RNA, 21 nt, Homo sapiens
uauaguaguaugauuuacaau

SEQ ID NO: 68428 - RNA, 22 nt, Homo sapiens
uauaugucugagacugggggau

SEQ ID NO: 68429 - RNA, 22 nt, Homo sapiens
uauaugucuucuuguaauuggc

SEQ ID NO: 68430 - RNA, 22 nt, Homo sapiens
uauaugucuuuguuauguugag

SEQ ID NO: 68431 - RNA, 22 nt, Homo sapiens
uaucaaggccacucauuuuaug

SEQ ID NO: 68432 - RNA, 22 nt, Homo sapiens
uaucacacaucaugguaaaucu

SEQ ID NO: 68433 - RNA, 22 nt, Homo sapiens
uaucacagaggguauccuagag

SEQ ID NO: 68434 - RNA, 22 nt, Homo sapiens
uaucacagcgggguguacaccc

SEQ ID NO: 68435 - RNA, 20 nt, Homo sapiens
uaucacaggucagaaacccu

SEQ ID NO: 68436 - RNA, 22 nt, Homo sapiens
uaucacaguaucuagcacagug

SEQ ID NO: 68437 - RNA, 22 nt, Homo sapiens
uaucacagugcuggaguauucc

SEQ ID NO: 68438 - RNA, 22 nt, Homo sapiens
uagaugauucacuuuacuucca

SEQ ID NO: 68439 - RNA, 22 nt, Homo sapiens
uagauuaucuaugaggcuucca

SEQ ID NO: 68440 - RNA, 22 nt, Homo sapiens
uaucaccacccugggaaacaua

SEQ ID NO: 68441 - RNA, 22 nt, Homo sapiens
uaucaccauguccguuuuaaaa

SEQ ID NO: 68442 - RNA, 22 nt, Homo sapiens
uaucaccuugagagaccuuauc

SEQ ID NO: 68443 - RNA, 19 nt, Homo sapiens
uaucacuucccuggaaaca

SEQ ID NO: 68444 - RNA, 21 nt, Homo sapiens
uaucagagacauugagaggca

SEQ ID NO: 68445 - RNA, 22 nt, Homo sapiens
uaucagagcugucagccuaccu

SEQ ID NO: 68446 - RNA, 22 nt, Homo sapiens
uaucauagucacuuccaguuug

SEQ ID NO: 68447 - RNA, 22 nt, Homo sapiens
uaucauuguguuauuucuucca

SEQ ID NO: 68448 - RNA, 21 nt, Homo sapiens
uauccacuugcaacagagaag

SEQ ID NO: 68449 - RNA, 23 nt, Homo sapiens
uaucccuugccuuaugaugugag

SEQ ID NO: 68450 - RNA, 20 nt, Homo sapiens
uaucuacuugcaaaugccau

SEQ ID NO: 68451 - RNA, 22 nt, Homo sapiens
uaucucagaugagacuuguaac

SEQ ID NO: 68452 - RNA, 20 nt, Homo sapiens
uaucucaguuuguccuaaac

SEQ ID NO: 68453 - RNA, 21 nt, Homo sapiens
uaucucaguuuuccuuugugg

SEQ ID NO: 68454 - RNA, 22 nt, Homo sapiens
uaucucauccuccuugauccca

SEQ ID NO: 68455 - RNA, 22 nt, Homo sapiens
uaucugcacauacacuuauagc

SEQ ID NO: 68456 - RNA, 22 nt, Homo sapiens
uaucugcaucccauuuuuauca

SEQ ID NO: 68457 - RNA, 22 nt, Homo sapiens
ucaaguaagaagugggcauaaa

SEQ ID NO: 68458 - RNA, 22 nt, Homo sapiens
ucaaguacuuugcauagugccg

SEQ ID NO: 68459 - RNA, 22 nt, Homo sapiens
ucaagugauucuugugccuuag

SEQ ID NO: 68460 - RNA, 22 nt, Homo sapiens
ucaauugcuuaugaagauacau

SEQ ID NO: 68461 - RNA, 20 nt, Homo sapiens
ucacaagccaagaucacguc

SEQ ID NO: 68462 - RNA, 22 nt, Homo sapiens
ucacaagcuccugccuuugcuu

SEQ ID NO: 68463 - RNA, 22 nt, Homo sapiens
ucacaaguguauagacaugucc

SEQ ID NO: 68464 - RNA, 22 nt, Homo sapiens
ucacaauguaaaugaggguugg

SEQ ID NO: 68465 - RNA, 22 nt, Homo sapiens
ucacacugaaacuaggguguga

SEQ ID NO: 68466 - RNA, 19 nt, Homo sapiens
ucacacuguggcuucuuua

SEQ ID NO: 68467 - RNA, 22 nt, Homo sapiens
ucacagaugaggcgagaggcag

SEQ ID NO: 68468 - RNA, 22 nt, Homo sapiens
ucacaggguguuauuagaauua

SEQ ID NO: 68469 - RNA, 18 nt, Homo sapiens
ucacagguaauuaggauu

SEQ ID NO: 68470 - RNA, 22 nt, Homo sapiens
ucacaguagggaacugacaaag

SEQ ID NO: 68471 - RNA, 22 nt, Homo sapiens
ucacagucacugucacguugaa

SEQ ID NO: 68472 - RNA, 22 nt, Homo sapiens
ucacagucggugacuucuugcu

SEQ ID NO: 68473 - RNA, 22 nt, Homo sapiens
ucacagucuccucuagggaggg

SEQ ID NO: 68474 - RNA, 22 nt, Homo sapiens
ucacagugcaggaucaguuaau

SEQ ID NO: 68475 - RNA, 22 nt, Homo sapiens
ucacaguguuaaaccuuucuuu

SEQ ID NO: 68476 - RNA, 23 nt, Homo sapiens
ucacaguuacuuuugcaucaacc

SEQ ID NO: 68477 - RNA, 22 nt, Homo sapiens
ucacauagcauaaugucugcaa

SEQ ID NO: 68478 - RNA, 20 nt, Homo sapiens
ucacauccucucccaacaug

SEQ ID NO: 68479 - RNA, 22 nt, Homo sapiens
ucacauggaaaaguccaguaaa

SEQ ID NO: 68480 - RNA, 22 nt, Homo sapiens
ucacauggcagagaagaagcuc

SEQ ID NO: 68481 - RNA, 18 nt, Homo sapiens
ucacauggccgagagaga

SEQ ID NO: 68482 - RNA, 22 nt, Homo sapiens
ucacauggggaagggacuagcu

SEQ ID NO: 68483 - RNA, 22 nt, Homo sapiens
ucacaugugaagauugggagua

SEQ ID NO: 68484 - RNA, 22 nt, Homo sapiens
ucacaugugacauauauauuug

SEQ ID NO: 68485 - RNA, 22 nt, Homo sapiens
ucacaugugcguuuuggcaugu

SEQ ID NO: 68486 - RNA, 22 nt, Homo sapiens
ucacauuaagcuguuauuucuu

SEQ ID NO: 68487 - RNA, 22 nt, Homo sapiens
ucacauucaauuguaauccccg

SEQ ID NO: 68488 - RNA, 22 nt, Homo sapiens
ucacauuguacaaacagguaag

SEQ ID NO: 68489 - RNA, 22 nt, Homo sapiens
ucacauuguauauguaccuauc

SEQ ID NO: 68490 - RNA, 22 nt, Homo sapiens
ucaccaccugcugaucauagag

SEQ ID NO: 68491 - RNA, 22 nt, Homo sapiens
ucaccaguacuccaaauugagg

SEQ ID NO: 68492 - RNA, 20 nt, Homo sapiens
ucacccugacaucugcccag

SEQ ID NO: 68493 - RNA, 22 nt, Homo sapiens
ucacccuguguuuugcguuugc

SEQ ID NO: 68494 - RNA, 22 nt, Homo sapiens
ucaccggcagacguggccugau

SEQ ID NO: 68495 - RNA, 22 nt, Homo sapiens
ucaccucgugaucugcccacuu

SEQ ID NO: 68496 - RNA, 21 nt, Homo sapiens
ucaccuguugcgaugaagcug

SEQ ID NO: 68497 - RNA, 18 nt, Homo sapiens
ucacggggagcagcagcc

SEQ ID NO: 68498 - RNA, 22 nt, Homo sapiens
ucacgugguucauaaggcagaa

SEQ ID NO: 68499 - RNA, 23 nt, Homo sapiens
ucacuagaguccuggaguuugag

SEQ ID NO: 68500 - RNA, 22 nt, Homo sapiens
ucacuagaucaagggagagaaa

SEQ ID NO: 68501 - RNA, 22 nt, Homo sapiens
ucacuaggcuggagugcagugg

SEQ ID NO: 68502 - RNA, 22 nt, Homo sapiens
ucacuauagaaaacagugugga

SEQ ID NO: 68503 - RNA, 22 nt, Homo sapiens
ucacugaaaccuccaccucucg

SEQ ID NO: 68504 - RNA, 22 nt, Homo sapiens
ucacugagcacaggagaugugc

SEQ ID NO: 68505 - RNA, 20 nt, Homo sapiens
ucacugagugguccacagua

SEQ ID NO: 68506 - RNA, 22 nt, Homo sapiens
ucacugcacuagguaaugccac

SEQ ID NO: 68507 - RNA, 20 nt, Homo sapiens
ucacuggagcucauuugauu

SEQ ID NO: 68508 - RNA, 22 nt, Homo sapiens
ucacuggaggagaggaagugga

SEQ ID NO: 68509 - RNA, 22 nt, Homo sapiens
ucacugggagaccaaagccauc

SEQ ID NO: 68510 - RNA, 22 nt, Homo sapiens
ucacugggagcauuugagccuu

SEQ ID NO: 68511 - RNA, 22 nt, Homo sapiens
ucacuggucuaaguggaggggg

SEQ ID NO: 68512 - RNA, 18 nt, Homo sapiens
ucacugugugucuugggu

SEQ ID NO: 68513 - RNA, 22 nt, Homo sapiens
ucacuuggccgcagccuucucu

SEQ ID NO: 68514 - RNA, 22 nt, Homo sapiens
ucacuuggugaacacauuaugu

SEQ ID NO: 68515 - RNA, 22 nt, Homo sapiens
ucacuugguggcaaaguuuaug

SEQ ID NO: 68516 - RNA, 22 nt, Homo sapiens
ucacuuuggguacuauggaaau

SEQ ID NO: 68517 - RNA, 22 nt, Homo sapiens
ucagaacugauacuagaacuuu

SEQ ID NO: 68518 - RNA, 21 nt, Homo sapiens
ucagaagcucccagggaggac

SEQ ID NO: 68519 - RNA, 22 nt, Homo sapiens
ucagaauguaacuuuaguugga

SEQ ID NO: 68520 - RNA, 22 nt, Homo sapiens
ucagagcaaagacacuuuauca

SEQ ID NO: 68521 - RNA, 22 nt, Homo sapiens
ucagaguagagcgacuucuccu

SEQ ID NO: 68522 - RNA, 22 nt, Homo sapiens
ucagagucuagaucacucacug

SEQ ID NO: 68523 - RNA, 22 nt, Homo sapiens
ucagagugcagggaguagcagc

SEQ ID NO: 68524 - RNA, 22 nt, Homo sapiens
ucagagugguuguaccauuuga

SEQ ID NO: 68525 - RNA, 22 nt, Homo sapiens
ucagaucaguuccacaagaacu

SEQ ID NO: 68526 - RNA, 22 nt, Homo sapiens
ucagaucauauucuucgcugcu

SEQ ID NO: 68527 - RNA, 22 nt, Homo sapiens
ucagaugaucugguaagaacuu

SEQ ID NO: 68528 - RNA, 22 nt, Homo sapiens
ucagaugauucuguuguugugu

SEQ ID NO: 68529 - RNA, 20 nt, Homo sapiens
ucagcagucuggagcagagg

SEQ ID NO: 68530 - RNA, 22 nt, Homo sapiens
ucagcagugccccacucuacug

SEQ ID NO: 68531 - RNA, 22 nt, Homo sapiens
ucagcaucacaggcagugagug

SEQ ID NO: 68532 - RNA, 21 nt, Homo sapiens
ucaggaccucuaguuagccag

SEQ ID NO: 68533 - RNA, 22 nt, Homo sapiens
ucaggcaugcagcaaugcagug

SEQ ID NO: 68534 - RNA, 21 nt, Homo sapiens
ucagggaccugcuguacugau

SEQ ID NO: 68535 - RNA, 22 nt, Homo sapiens
ucagggacgcuugacacaagcc

SEQ ID NO: 68536 - RNA, 22 nt, Homo sapiens
ucaggguacuuguggccaaagu

SEQ ID NO: 68537 - RNA, 20 nt, Homo sapiens
ucagguagaucuuugagguc

SEQ ID NO: 68538 - RNA, 22 nt, Homo sapiens
ucagguagcauuuuggaaacag

SEQ ID NO: 68539 - RNA, 22 nt, Homo sapiens
ucagguagugccaugauugauu

SEQ ID NO: 68540 - RNA, 22 nt, Homo sapiens
ucagguaucucuauagcaaugu

SEQ ID NO: 68541 - RNA, 22 nt, Homo sapiens
ucagguauuuuaucacaugaag

SEQ ID NO: 68542 - RNA, 22 nt, Homo sapiens
ucaggugcaguggcucugaccu

SEQ ID NO: 68543 - RNA, 22 nt, Homo sapiens
ucagguugcuaaguauaauauu

SEQ ID NO: 68544 - RNA, 22 nt, Homo sapiens
ucaguaaucuuagcugugcaga

SEQ ID NO: 68545 - RNA, 22 nt, Homo sapiens
ucaguacgugggcaguuccuuc

SEQ ID NO: 68546 - RNA, 23 nt, Homo sapiens
ucaguacuccacuuucaauagug

SEQ ID NO: 68547 - RNA, 22 nt, Homo sapiens
ucaguacuuuggagcucacaua

SEQ ID NO: 68548 - RNA, 22 nt, Homo sapiens
ucaguagcauugcuuauacagu

SEQ ID NO: 68549 - RNA, 23 nt, Homo sapiens
ucaguagucauugggaaagugug

SEQ ID NO: 68550 - RNA, 22 nt, Homo sapiens
ucaguaguuccaguggguauuu

SEQ ID NO: 68551 - RNA, 22 nt, Homo sapiens
ucaguauaugaaucuggggcag

SEQ ID NO: 68552 - RNA, 22 nt, Homo sapiens
agcaccacaauuuccugccuaa

SEQ ID NO: 68553 - RNA, 17 nt, Homo sapiens
agcaccacacucucuug

SEQ ID NO: 68554 - RNA, 22 nt, Homo sapiens
agcaccaugggcugaguaagug

SEQ ID NO: 68555 - RNA, 22 nt, Homo sapiens
agcaccguucaaacccagguua

SEQ ID NO: 68556 - RNA, 23 nt, Homo sapiens
agcaccuuuccuccacuaucugc

SEQ ID NO: 68557 - RNA, 22 nt, Homo sapiens
agcacgaaaccaaauucuguga

SEQ ID NO: 68558 - RNA, 22 nt, Homo sapiens
agcagcaauuuuguaugguuua

SEQ ID NO: 68559 - RNA, 22 nt, Homo sapiens
agcagcauauuuuuauaaugua

SEQ ID NO: 68560 - RNA, 22 nt, Homo sapiens
agcagcauuaugauauaucuua

SEQ ID NO: 68561 - RNA, 22 nt, Homo sapiens
agcagcucaugccuuugggagg

SEQ ID NO: 68562 - RNA, 22 nt, Homo sapiens
agcagcuuugcauggccuguga

SEQ ID NO: 68563 - RNA, 21 nt, Homo sapiens
agcagcuuugguugaagcaga

SEQ ID NO: 68564 - RNA, 22 nt, Homo sapiens
agcagguguccacaauguuugc

SEQ ID NO: 68565 - RNA, 22 nt, Homo sapiens
agcaguagaauuccugcaucac

SEQ ID NO: 68566 - RNA, 22 nt, Homo sapiens
agcaguagugaaaguagacuua

SEQ ID NO: 68567 - RNA, 22 nt, Homo sapiens
aagagguagucugucccuuagc

SEQ ID NO: 68568 - RNA, 22 nt, Homo sapiens
aagaguaguaguggcacucucu

SEQ ID NO: 68569 - RNA, 22 nt, Homo sapiens
aagagugcucgugggacucagc

SEQ ID NO: 68570 - RNA, 22 nt, Homo sapiens
aagaguuaguaaaauuuccucu

SEQ ID NO: 68571 - RNA, 22 nt, Homo sapiens
aagauaguaaacauuuucugcu

SEQ ID NO: 68572 - RNA, 19 nt, Homo sapiens
aagaugauguuugggcuaa

SEQ ID NO: 68573 - RNA, 22 nt, Homo sapiens
aagaugcagucauacuggagga

SEQ ID NO: 68574 - RNA, 22 nt, Homo sapiens
aagaugguauuucauuaguuuu

SEQ ID NO: 68575 - RNA, 22 nt, Homo sapiens
aagcaccaauaggagauuuguc

SEQ ID NO: 68576 - RNA, 22 nt, Homo sapiens
aagcagacauguucauuuugaa

SEQ ID NO: 68577 - RNA, 20 nt, Homo sapiens
aagcagacauuuggaugaaa

SEQ ID NO: 68578 - RNA, 22 nt, Homo sapiens
aagcaguguggacuaaugggaa

SEQ ID NO: 68579 - RNA, 20 nt, Homo sapiens
aagcauggguuuuaggguca

SEQ ID NO: 68580 - RNA, 21 nt, Homo sapiens
aagcaugguguaucuuuccau

SEQ ID NO: 68581 - RNA, 22 nt, Homo sapiens
aagccagugugacaggaaacuu

SEQ ID NO: 68582 - RNA, 22 nt, Homo sapiens
aagcucauugagaucuauggcu

SEQ ID NO: 68583 - RNA, 22 nt, Homo sapiens
aagcucuuguugaaucuuguca

SEQ ID NO: 68584 - RNA, 22 nt, Homo sapiens
aagcugcauuuucuagaugcuu

SEQ ID NO: 68585 - RNA, 22 nt, Homo sapiens
aagcugguguguauuauucacu

SEQ ID NO: 68586 - RNA, 22 nt, Homo sapiens
aagcugugucuugucagcuacc

SEQ ID NO: 68587 - RNA, 22 nt, Homo sapiens
aagcuguuguucauccugaauu

SEQ ID NO: 68588 - RNA, 22 nt, Homo sapiens
aaggaguagaauagaugcaccu

SEQ ID NO: 68589 - RNA, 22 nt, Homo sapiens
aaggaguaucuguuuucucacc

SEQ ID NO: 68590 - RNA, 22 nt, Homo sapiens
aaggaguauugaaugaccaagu

SEQ ID NO: 68591 - RNA, 22 nt, Homo sapiens
aaggcaagaagagaaccaucgg

SEQ ID NO: 68592 - RNA, 22 nt, Homo sapiens
aaggcaagaaugcgugcuuuca

SEQ ID NO: 68593 - RNA, 22 nt, Homo sapiens
aaggcaagauacugguugcuga

SEQ ID NO: 68594 - RNA, 22 nt, Homo sapiens
aaggcaauuuguugugaggauu

SEQ ID NO: 68595 - RNA, 22 nt, Homo sapiens
aaggcauggugacuauuuaggc

SEQ ID NO: 68596 - RNA, 22 nt, Homo sapiens
aaggcuagagaagaagggcauc

SEQ ID NO: 68597 - RNA, 22 nt, Homo sapiens
aagggaaugugguagcugguuu

SEQ ID NO: 68598 - RNA, 22 nt, Homo sapiens
aagggaauguuguggcugguug

SEQ ID NO: 68599 - RNA, 22 nt, Homo sapiens
aagggaauguuguggcugguuu

SEQ ID NO: 68600 - RNA, 22 nt, Homo sapiens
aagguaguuagaaaauauaacu

SEQ ID NO: 68601 - RNA, 22 nt, Homo sapiens
aagguaguuuucuuuaaugcug

SEQ ID NO: 68602 - RNA, 22 nt, Homo sapiens
aagguauuuuugucuauaucuu

SEQ ID NO: 68603 - RNA, 22 nt, Homo sapiens
aaggugcucucuuauguagaaa

SEQ ID NO: 68604 - RNA, 18 nt, Homo sapiens
aaggugcuucuguucuga

SEQ ID NO: 68605 - RNA, 21 nt, Homo sapiens
aagguuuuuagugcuugacuu

SEQ ID NO: 68606 - RNA, 22 nt, Homo sapiens
aaguaagcauccaauaaauguu

SEQ ID NO: 68607 - RNA, 19 nt, Homo sapiens
aaguaguugugacagaugc

SEQ ID NO: 68608 - RNA, 22 nt, Homo sapiens
aaguauuaagacuaagaggcuu

SEQ ID NO: 68609 - RNA, 22 nt, Homo sapiens
aagucaaggagagaagcuucag

SEQ ID NO: 68610 - RNA, 22 nt, Homo sapiens
aagucaugaagaggaaaggaca

SEQ ID NO: 68611 - RNA, 19 nt, Homo sapiens
aagugaaugcuuuguucac

SEQ ID NO: 68612 - RNA, 22 nt, Homo sapiens
aagugacauugugcccauuuga

SEQ ID NO: 68613 - RNA, 22 nt, Homo sapiens
aagugcaaaucuguggcugaaa

SEQ ID NO: 68614 - RNA, 22 nt, Homo sapiens
aagugcucuugaaacugccuua

SEQ ID NO: 68615 - RNA, 22 nt, Homo sapiens
aagugcucuugaaacugucuua

SEQ ID NO: 68616 - RNA, 22 nt, Homo sapiens
aagugcuguaugggagccuagg

SEQ ID NO: 68617 - RNA, 22 nt, Homo sapiens
aagugcuuacagggaacaugau

SEQ ID NO: 68618 - RNA, 22 nt, Homo sapiens
aagugcuucagaagacaauauu

SEQ ID NO: 68619 - RNA, 22 nt, Homo sapiens
aagugguagggucaggauugga

SEQ ID NO: 68620 - RNA, 22 nt, Homo sapiens
aagugguguuugggagcuggac

SEQ ID NO: 68621 - RNA, 22 nt, Homo sapiens
aagugguguuuguauuuaugca

SEQ ID NO: 68622 - RNA, 22 nt, Homo sapiens
aaguguaugaaacaguccaugg

SEQ ID NO: 68623 - RNA, 22 nt, Homo sapiens
aagugucagaguugcuaaugac

SEQ ID NO: 68624 - RNA, 22 nt, Homo sapiens
aagugucuuaccgggagggagu

SEQ ID NO: 68625 - RNA, 22 nt, Homo sapiens
aaguuguaguuagagaguugcu

SEQ ID NO: 68626 - RNA, 22 nt, Homo sapiens
aauaaagcugaauccuuccuga

SEQ ID NO: 68627 - RNA, 20 nt, Homo sapiens
aauaacagccccagggaggu

SEQ ID NO: 68628 - RNA, 22 nt, Homo sapiens
aauaagcugagagaauucuaca

SEQ ID NO: 68629 - RNA, 19 nt, Homo sapiens
aauaaugccagaugucugu

SEQ ID NO: 68630 - RNA, 22 nt, Homo sapiens
aauacucuauaagggaagcugu

SEQ ID NO: 68631 - RNA, 22 nt, Homo sapiens
aauagagucaggguuucaccau

SEQ ID NO: 68632 - RNA, 22 nt, Homo sapiens
aauagcauugaaucuaccaauu

SEQ ID NO: 68633 - RNA, 22 nt, Homo sapiens
aauaguggcuuggacuaaauau

SEQ ID NO: 68634 - RNA, 22 nt, Homo sapiens
aauauagcuauguacaugucca

SEQ ID NO: 68635 - RNA, 22 nt, Homo sapiens
aauaucacaguggguguacacc

SEQ ID NO: 68636 - RNA, 22 nt, Homo sapiens
aauaugucuugaaauuggguaa

SEQ ID NO: 68637 - RNA, 22 nt, Homo sapiens
aaucaacauuguuuuaagucaa

SEQ ID NO: 68638 - RNA, 22 nt, Homo sapiens
aaucacacuugauguugagcaa

SEQ ID NO: 68639 - RNA, 21 nt, Homo sapiens
aaucacaguuguucugccuuc

SEQ ID NO: 68640 - RNA, 22 nt, Homo sapiens
aaucagcacacugugcuuucca

SEQ ID NO: 68641 - RNA, 22 nt, Homo sapiens
aaucccugagcuagacacaaag

SEQ ID NO: 68642 - RNA, 22 nt, Homo sapiens
aaucugucuuuuguuauugagg

SEQ ID NO: 68643 - RNA, 22 nt, Homo sapiens
aaugaaguuagauguugagaag

SEQ ID NO: 68644 - RNA, 22 nt, Homo sapiens
aaugacacugagcaucuuucau

SEQ ID NO: 68645 - RNA, 22 nt, Homo sapiens
aaugacagccagauucuucucu

SEQ ID NO: 68646 - RNA, 22 nt, Homo sapiens
aaugacuaagaugguacauuuu

SEQ ID NO: 68647 - RNA, 22 nt, Homo sapiens
aaugauacuguguacaagggca

SEQ ID NO: 68648 - RNA, 22 nt, Homo sapiens
aaaagcauucagagugcugggc

SEQ ID NO: 68649 - RNA, 22 nt, Homo sapiens
aaaaugcugauauugggcccca

SEQ ID NO: 68650 - RNA, 22 nt, Homo sapiens
aaacugaucugaaggccaggcu

SEQ ID NO: 68651 - RNA, 22 nt, Homo sapiens
aaagaagucagccuguccuuug

SEQ ID NO: 68652 - RNA, 22 nt, Homo sapiens
aaagcacugaauaaauuugcuu

SEQ ID NO: 68653 - RNA, 22 nt, Homo sapiens
aaagcagcaggugguuuucaau

SEQ ID NO: 68654 - RNA, 22 nt, Homo sapiens
aaagcaucacuuuuccuacuuu

SEQ ID NO: 68655 - RNA, 22 nt, Homo sapiens
aaaggaccacauauaugguggc

SEQ ID NO: 68656 - RNA, 22 nt, Homo sapiens
aaaggcacugaucuuauccagu

SEQ ID NO: 68657 - RNA, 22 nt, Homo sapiens
aaaggcaucauuaguaccaagu

SEQ ID NO: 68658 - RNA, 20 nt, Homo sapiens
aaaggcugugagaacgagau

SEQ ID NO: 68659 - RNA, 22 nt, Homo sapiens
augagaauguaaguuaaugaaa

SEQ ID NO: 68660 - RNA, 22 nt, Homo sapiens
augagacauuaaaguguguuug

SEQ ID NO: 68661 - RNA, 22 nt, Homo sapiens
augagagcuaacuguggguaca

SEQ ID NO: 68662 - RNA, 22 nt, Homo sapiens
augagagugagagcagccccuu

SEQ ID NO: 68663 - RNA, 22 nt, Homo sapiens
augagauacuacaaaugaguuu

SEQ ID NO: 68664 - RNA, 22 nt, Homo sapiens
augagauuauguaaagagacca

SEQ ID NO: 68665 - RNA, 22 nt, Homo sapiens
augagcacuuguuuugggcaca

SEQ ID NO: 68666 - RNA, 22 nt, Homo sapiens
augagcagaagagauacacugu

SEQ ID NO: 68667 - RNA, 22 nt, Homo sapiens
augagcuaauauggguaaguug

SEQ ID NO: 68668 - RNA, 22 nt, Homo sapiens
augagcugauuuccuuaccaua

SEQ ID NO: 68669 - RNA, 22 nt, Homo sapiens
augagcuguuuggaagacacuu

SEQ ID NO: 68670 - RNA, 22 nt, Homo sapiens
augaggaaggagccuuugucug

SEQ ID NO: 68671 - RNA, 22 nt, Homo sapiens
augaggauagguuucuauuagg

SEQ ID NO: 68672 - RNA, 22 nt, Homo sapiens
augagggaagcucacgugucca

SEQ ID NO: 68673 - RNA, 22 nt, Homo sapiens
augagggagggcaccugaccuu

SEQ ID NO: 68674 - RNA, 22 nt, Homo sapiens
augagggagggguggugccgca

SEQ ID NO: 68675 - RNA, 22 nt, Homo sapiens
augagguaauaaguccuuggaa

SEQ ID NO: 68676 - RNA, 22 nt, Homo sapiens
augaggugggagaaucacuuga

SEQ ID NO: 68677 - RNA, 20 nt, Homo sapiens
augagguguaugacacugaa

SEQ ID NO: 68678 - RNA, 22 nt, Homo sapiens
augagguguuuauuguauccug

SEQ ID NO: 68679 - RNA, 22 nt, Homo sapiens
augaguaugagaauacauuaag

SEQ ID NO: 68680 - RNA, 19 nt, Homo sapiens
augagucugcaagaaccag

SEQ ID NO: 68681 - RNA, 22 nt, Homo sapiens
augauagguuuagguuuagaca

SEQ ID NO: 68682 - RNA, 22 nt, Homo sapiens
augauaucuuguuuuucaugca

SEQ ID NO: 68683 - RNA, 22 nt, Homo sapiens
augauguaggccauggguuucu

SEQ ID NO: 68684 - RNA, 22 nt, Homo sapiens
augauguguguuuaagaugucu

SEQ ID NO: 68685 - RNA, 22 nt, Homo sapiens
augauugaccaucugcugggcu

SEQ ID NO: 68686 - RNA, 20 nt, Homo sapiens
augcaaacccugcuuugugg

SEQ ID NO: 68687 - RNA, 22 nt, Homo sapiens
augcaaaucuuaaguaugugug

SEQ ID NO: 68688 - RNA, 22 nt, Homo sapiens
augcaagaaauaucucuuuuuc

SEQ ID NO: 68689 - RNA, 22 nt, Homo sapiens
augcaaggaugguuagauauau

SEQ ID NO: 68690 - RNA, 19 nt, Homo sapiens
augcaaugucacaggcugc

SEQ ID NO: 68691 - RNA, 22 nt, Homo sapiens
augcacauauguacugcccuau

SEQ ID NO: 68692 - RNA, 22 nt, Homo sapiens
augcacaugcgaaaacuugugu

SEQ ID NO: 68693 - RNA, 19 nt, Homo sapiens
augcacgugaaaugcauuu

SEQ ID NO: 68694 - RNA, 22 nt, Homo sapiens
augcacuguauaggaucuugcg

SEQ ID NO: 68695 - RNA, 22 nt, Homo sapiens
augcacuguuguuauuggauaa

SEQ ID NO: 68696 - RNA, 22 nt, Homo sapiens
augcacuuggcaggaugauucc

SEQ ID NO: 68697 - RNA, 22 nt, Homo sapiens
augcagacacaaguuauaguaa

SEQ ID NO: 68698 - RNA, 22 nt, Homo sapiens
augcagauauuuuugugguugc

SEQ ID NO: 68699 - RNA, 22 nt, Homo sapiens
augcaugucaaauuuguagguu

SEQ ID NO: 68700 - RNA, 22 nt, Homo sapiens
augccaagagacaaagggaauc

SEQ ID NO: 68701 - RNA, 20 nt, Homo sapiens
augccacugagcagugguga

SEQ ID NO: 68702 - RNA, 22 nt, Homo sapiens
augccacugcacucuagccugg

SEQ ID NO: 68703 - RNA, 22 nt, Homo sapiens
augccacugcacuucagccugg

SEQ ID NO: 68704 - RNA, 22 nt, Homo sapiens
augccacuucucuaagucaugu

SEQ ID NO: 68705 - RNA, 22 nt, Homo sapiens
augccaguguccagaguggguu

SEQ ID NO: 68706 - RNA, 22 nt, Homo sapiens
augccauugcacuccagccuag

SEQ ID NO: 68707 - RNA, 22 nt, Homo sapiens
augccauugcacuccagccugg

SEQ ID NO: 68708 - RNA, 22 nt, Homo sapiens
augccucugacaauuggauucu

SEQ ID NO: 68709 - RNA, 19 nt, Homo sapiens
augccuggagaugguuaua

SEQ ID NO: 68710 - RNA, 22 nt, Homo sapiens
augcuacugaccccuacuuaca

SEQ ID NO: 68711 - RNA, 22 nt, Homo sapiens
augcuggugguucacaugcgca

SEQ ID NO: 68712 - RNA, 19 nt, Homo sapiens
augcugguguugcucaaac

SEQ ID NO: 68713 - RNA, 22 nt, Homo sapiens
auggaacauaacuauuugggga

SEQ ID NO: 68714 - RNA, 22 nt, Homo sapiens
auggaacuggagaucauuaugu

SEQ ID NO: 68715 - RNA, 22 nt, Homo sapiens
auggaacuggagaugguuauau

SEQ ID NO: 68716 - RNA, 22 nt, Homo sapiens
auggaagaaacgauuuucugga

SEQ ID NO: 68717 - RNA, 22 nt, Homo sapiens
auggaaugguugggucauaagg

SEQ ID NO: 68718 - RNA, 22 nt, Homo sapiens
auggaauguauagucauguagg

SEQ ID NO: 68719 - RNA, 21 nt, Homo sapiens
auggacaugguuaggcuuugu

SEQ ID NO: 68720 - RNA, 22 nt, Homo sapiens
auggacguagauucucaaggau

SEQ ID NO: 68721 - RNA, 22 nt, Homo sapiens
auggagaugaauaucaucuguu

SEQ ID NO: 68722 - RNA, 22 nt, Homo sapiens
auggagaugugcgaacugagua

SEQ ID NO: 68723 - RNA, 22 nt, Homo sapiens
auggagcaaaacagauuuggga

SEQ ID NO: 68724 - RNA, 22 nt, Homo sapiens
auggaguguggaacugggaauc

SEQ ID NO: 68725 - RNA, 22 nt, Homo sapiens
auggauauugccuaggguagua

SEQ ID NO: 68726 - RNA, 22 nt, Homo sapiens
auggaucauauucuugaggagg

SEQ ID NO: 68727 - RNA, 22 nt, Homo sapiens
auggauguucuagggaugugau

SEQ ID NO: 68728 - RNA, 22 nt, Homo sapiens
auggcaaaauguuccuaguggu

SEQ ID NO: 68729 - RNA, 22 nt, Homo sapiens
auggcaauaugaugcacuguuu

SEQ ID NO: 68730 - RNA, 22 nt, Homo sapiens
auggcaccauguuaugauaaua

SEQ ID NO: 68731 - RNA, 22 nt, Homo sapiens
auggcacuaaugggaguuuacu

SEQ ID NO: 68732 - RNA, 22 nt, Homo sapiens
auggcacugaagcguauugaca

SEQ ID NO: 68733 - RNA, 22 nt, Homo sapiens
auggcagagucagaaagucagg

SEQ ID NO: 68734 - RNA, 22 nt, Homo sapiens
auggcaucgucaccuuuucagu

SEQ ID NO: 68735 - RNA, 22 nt, Homo sapiens
auggcauggugaagucuuugga

SEQ ID NO: 68736 - RNA, 22 nt, Homo sapiens
auggcauuuuuagggcugggug

SEQ ID NO: 68737 - RNA, 22 nt, Homo sapiens
auggcccugaguucaauauauu

SEQ ID NO: 68738 - RNA, 22 nt, Homo sapiens
auggcccugggaaaggaggcau

SEQ ID NO: 68739 - RNA, 22 nt, Homo sapiens
auggccuaugaccguuauguug

SEQ ID NO: 68740 - RNA, 22 nt, Homo sapiens
auggccuuucuggcacauuucc

SEQ ID NO: 68741 - RNA, 22 nt, Homo sapiens
auggcucaauucuuucccugaa

SEQ ID NO: 68742 - RNA, 22 nt, Homo sapiens
auggcucaguguguaucuauca

SEQ ID NO: 68743 - RNA, 22 nt, Homo sapiens
auggcucuuauuauuugaggua

SEQ ID NO: 68744 - RNA, 22 nt, Homo sapiens
auggcucuuauuauuuugaggu

SEQ ID NO: 68745 - RNA, 22 nt, Homo sapiens
auggcugugaaaugguaggugg

SEQ ID NO: 68746 - RNA, 22 nt, Homo sapiens
auggcuugugacccaugcuuca

SEQ ID NO: 68747 - RNA, 22 nt, Homo sapiens
auggcuugugggaacuuuuaaa

SEQ ID NO: 68748 - RNA, 22 nt, Homo sapiens
auggcuuguuaugcauuaguac

SEQ ID NO: 68749 - RNA, 22 nt, Homo sapiens
auggcuuuuauuguguugaggu

SEQ ID NO: 68750 - RNA, 22 nt, Homo sapiens
auggcuuuugaccugguaggau

SEQ ID NO: 68751 - RNA, 22 nt, Homo sapiens
cagcaucauucaucugggguaa

SEQ ID NO: 68752 - RNA, 22 nt, Homo sapiens
cagcgaggucugcgucacauug

SEQ ID NO: 68753 - RNA, 22 nt, Homo sapiens
cagcuaaauuguuaaauccaag

SEQ ID NO: 68754 - RNA, 22 nt, Homo sapiens
cagcugcuuuggaaaauauuuu

SEQ ID NO: 68755 - RNA, 22 nt, Homo sapiens
cagcugguguuacaaaccagag

SEQ ID NO: 68756 - RNA, 22 nt, Homo sapiens
caggaccucuugccuggaagcc

SEQ ID NO: 68757 - RNA, 22 nt, Homo sapiens
caggcauuguauuguaaucccc

SEQ ID NO: 68758 - RNA, 22 nt, Homo sapiens
caggcuuuuccacacauggguu

SEQ ID NO: 68759 - RNA, 20 nt, Homo sapiens
cagggcaaugaggagguaaa

SEQ ID NO: 68760 - RNA, 22 nt, Homo sapiens
cagguacuucugggcugagcag

SEQ ID NO: 68761 - RNA, 19 nt, Homo sapiens
cagguagugugcugacaug

SEQ ID NO: 68762 - RNA, 22 nt, Homo sapiens
caggugcauuggcugacaccug

SEQ ID NO: 68763 - RNA, 22 nt, Homo sapiens
caguacaauguugauuagaagu

SEQ ID NO: 68764 - RNA, 20 nt, Homo sapiens
cagucaugaagaacugugag

SEQ ID NO: 68765 - RNA, 22 nt, Homo sapiens
cagugacacugaaaaguucggg

SEQ ID NO: 68766 - RNA, 23 nt, Homo sapiens
cagugcaugacuguauaugcaaa

SEQ ID NO: 68767 - RNA, 22 nt, Homo sapiens
cagugcuuuaucaaguccucca

SEQ ID NO: 68768 - RNA, 22 nt, Homo sapiens
caguggaugaacaagaagugau

SEQ ID NO: 68769 - RNA, 22 nt, Homo sapiens
caguggaugauguuuucugugg

SEQ ID NO: 68770 - RNA, 22 nt, Homo sapiens
caguggauuggauggauaaugc

SEQ ID NO: 68771 - RNA, 22 nt, Homo sapiens
cagugguuuucucaguucagca

SEQ ID NO: 68772 - RNA, 22 nt, Homo sapiens
cauaaagauggaggaggccagg

SEQ ID NO: 68773 - RNA, 22 nt, Homo sapiens
cauacaugugcuugucuuaugc

SEQ ID NO: 68774 - RNA, 22 nt, Homo sapiens
cauagguugggcguuugauuuu

SEQ ID NO: 68775 - RNA, 22 nt, Homo sapiens
caucacaguacuaaucgucaua

SEQ ID NO: 68776 - RNA, 22 nt, Homo sapiens
caucacuuugccuccgucucua

SEQ ID NO: 68777 - RNA, 22 nt, Homo sapiens
caucacuuuuccuuuuacagau

SEQ ID NO: 68778 - RNA, 22 nt, Homo sapiens
caucagcaauguaugaggguuc

SEQ ID NO: 68779 - RNA, 22 nt, Homo sapiens
caucccauucgaggggcacagc

SEQ ID NO: 68780 - RNA, 22 nt, Homo sapiens
caucccugaaccccagaaaucu

SEQ ID NO: 68781 - RNA, 22 nt, Homo sapiens
caucccugucgucaagucucug

SEQ ID NO: 68782 - RNA, 22 nt, Homo sapiens
caucucauugaauugcugagca

SEQ ID NO: 68783 - RNA, 22 nt, Homo sapiens
caugaaagacugaggaauugga

SEQ ID NO: 68784 - RNA, 22 nt, Homo sapiens
caugccauugcucuccugggug

SEQ ID NO: 68785 - RNA, 22 nt, Homo sapiens
cauggcaucuguguggccucca

SEQ ID NO: 68786 - RNA, 22 nt, Homo sapiens
cauggcauuucaagauuuacca

SEQ ID NO: 68787 - RNA, 22 nt, Homo sapiens
cauggcccuggguccauaggaa

SEQ ID NO: 68788 - RNA, 22 nt, Homo sapiens
cauggcucuuugcugcuaaagu

SEQ ID NO: 68789 - RNA, 23 nt, Homo sapiens
cauggcuguuaacacuguuugag

SEQ ID NO: 68790 - RNA, 22 nt, Homo sapiens
cauggcuuguauaagauucuca

SEQ ID NO: 68791 - RNA, 22 nt, Homo sapiens
cauggcuuuauuuucagcuucu

SEQ ID NO: 68792 - RNA, 22 nt, Homo sapiens
caugggcacugacuugcauucg

SEQ ID NO: 68793 - RNA, 22 nt, Homo sapiens
cauggguuuucucaaguaguca

SEQ ID NO: 68794 - RNA, 22 nt, Homo sapiens
caugguacugccacagaagagu

SEQ ID NO: 68795 - RNA, 22 nt, Homo sapiens
caugguguuaggcacugggaau

SEQ ID NO: 68796 - RNA, 22 nt, Homo sapiens
cauguaacaucccgcuguagga

SEQ ID NO: 68797 - RNA, 22 nt, Homo sapiens
cauguaguagaaggagccagac

SEQ ID NO: 68798 - RNA, 22 nt, Homo sapiens
cauguauagauuccauaguggu

SEQ ID NO: 68799 - RNA, 22 nt, Homo sapiens
caugucuuuuauucugugugau

SEQ ID NO: 68800 - RNA, 20 nt, Homo sapiens
cauuacacuccaaccugggu

SEQ ID NO: 68801 - RNA, 20 nt, Homo sapiens
cauuccacuuuccugucagu

SEQ ID NO: 68802 - RNA, 22 nt, Homo sapiens
cauugcacacauuuaccuaugu

SEQ ID NO: 68803 - RNA, 22 nt, Homo sapiens
cauugcacuccacuccugaaca

SEQ ID NO: 68804 - RNA, 22 nt, Homo sapiens
cauugcacuccagcccagguga

SEQ ID NO: 68805 - RNA, 22 nt, Homo sapiens
cauugcacuccagccuaggcaa

SEQ ID NO: 68806 - RNA, 22 nt, Homo sapiens
cauugcacuccagccucggcaa

SEQ ID NO: 68807 - RNA, 22 nt, Homo sapiens
cauugcacuccagccugccugg

SEQ ID NO: 68808 - RNA, 22 nt, Homo sapiens
cauugcacuccaucuugggcaa

SEQ ID NO: 68809 - RNA, 22 nt, Homo sapiens
cauugcaguaagagugggcucu

SEQ ID NO: 68810 - RNA, 22 nt, Homo sapiens
cauugcaguuuuugguguaucu

SEQ ID NO: 68811 - RNA, 22 nt, Homo sapiens
cauugcaugcauauggcuuggu

SEQ ID NO: 68812 - RNA, 22 nt, Homo sapiens
cauugcauuccagucugggcaa

SEQ ID NO: 68813 - RNA, 22 nt, Homo sapiens
cauugcuaaaagucauauauaa

SEQ ID NO: 68814 - RNA, 22 nt, Homo sapiens
cauuggugauuagugaaugaac

SEQ ID NO: 68815 - RNA, 22 nt, Homo sapiens
cauugguuuauagauggggaaa

SEQ ID NO: 68816 - RNA, 22 nt, Homo sapiens
cauugucccucaaugacuauga

SEQ ID NO: 68817 - RNA, 22 nt, Homo sapiens
cauuuugguuaaauagguagcu

SEQ ID NO: 68818 - RNA, 22 nt, Homo sapiens
ccaagccucaguuucccucugu

SEQ ID NO: 68819 - RNA, 22 nt, Homo sapiens
ccaaguguucucauuguucaau

SEQ ID NO: 68820 - RNA, 19 nt, Homo sapiens
ccacaaugguugaacuaga

SEQ ID NO: 68821 - RNA, 23 nt, Homo sapiens
ccacaaugguugaacuagauuac

SEQ ID NO: 68822 - RNA, 22 nt, Homo sapiens
ccacaguugaaauuuugacugu

SEQ ID NO: 68823 - RNA, 22 nt, Homo sapiens
ccacauuaccuugcuugcucca

SEQ ID NO: 68824 - RNA, 22 nt, Homo sapiens
ccacccuggagaauuugagguc

SEQ ID NO: 68825 - RNA, 22 nt, Homo sapiens
ccacccuuccacacccugggua

SEQ ID NO: 68826 - RNA, 22 nt, Homo sapiens
ccagaguuucugauucagcagg

SEQ ID NO: 68827 - RNA, 22 nt, Homo sapiens
ccaggguugagacccacugacu

SEQ ID NO: 68828 - RNA, 22 nt, Homo sapiens
ccagguuucuagaauaauuccu

SEQ ID NO: 68829 - RNA, 22 nt, Homo sapiens
ccaguauuuuauugaggguuuu

SEQ ID NO: 68830 - RNA, 22 nt, Homo sapiens
ccagugauggcugccucauuug

SEQ ID NO: 68831 - RNA, 22 nt, Homo sapiens
ccagugauuguauggugaaggu

SEQ ID NO: 68832 - RNA, 22 nt, Homo sapiens
ccagugguugggccggagacgg

SEQ ID NO: 68833 - RNA, 22 nt, Homo sapiens
ccaguguauuuuugggaccugc

SEQ ID NO: 68834 - RNA, 19 nt, Homo sapiens
ccaguguucugauugcacu

SEQ ID NO: 68835 - RNA, 22 nt, Homo sapiens
ccaguguuuggauuagggaugc

SEQ ID NO: 68836 - RNA, 22 nt, Homo sapiens
ccaguucaaugauauggaaacu

SEQ ID NO: 68837 - RNA, 17 nt, Homo sapiens
ccaguuuucccucagug

SEQ ID NO: 68838 - RNA, 22 nt, Homo sapiens
ccaguuuuuggcaaugaugaau

SEQ ID NO: 68839 - RNA, 22 nt, Homo sapiens
ccaucacaggccucagugggaa

SEQ ID NO: 68840 - RNA, 22 nt, Homo sapiens
ccaucacgugcaguggccccac

SEQ ID NO: 68841 - RNA, 22 nt, Homo sapiens
ccaugaacuagaauagaacaug

SEQ ID NO: 68842 - RNA, 19 nt, Homo sapiens
ccauggcaaugaucugaug

SEQ ID NO: 68843 - RNA, 21 nt, Homo sapiens
ccaugggacggaaugaauaca

SEQ ID NO: 68844 - RNA, 18 nt, Homo sapiens
ccauucaacagauuuguc

SEQ ID NO: 68845 - RNA, 22 nt, Homo sapiens
ccauugcacuccagccucggca

SEQ ID NO: 68846 - RNA, 18 nt, Homo sapiens
augagagccgauuccugg

SEQ ID NO: 68847 - RNA, 22 nt, Homo sapiens
augagaucaaauuuaagcuguu

SEQ ID NO: 68848 - RNA, 22 nt, Homo sapiens
augagaucugugaacaccuguc

SEQ ID NO: 68849 - RNA, 22 nt, Homo sapiens
augagaugaggaauggcccucc

SEQ ID NO: 68850 - RNA, 22 nt, Homo sapiens
augagaugauaggcguucuaac

SEQ ID NO: 68851 - RNA, 17 nt, Homo sapiens
agucaguaguuuguauu

SEQ ID NO: 68852 - RNA, 20 nt, Homo sapiens
agucaguuuauuuucucucu

SEQ ID NO: 68853 - RNA, 22 nt, Homo sapiens
agucauaggagagauaucacug

SEQ ID NO: 68854 - RNA, 22 nt, Homo sapiens
agucauggaucacaguagccuc

SEQ ID NO: 68855 - RNA, 22 nt, Homo sapiens
agucaugguaguaaauuuggac

SEQ ID NO: 68856 - RNA, 19 nt, Homo sapiens
agucaugugaggacccuug

SEQ ID NO: 68857 - RNA, 22 nt, Homo sapiens
agugaaaucugaagaaggucau

SEQ ID NO: 68858 - RNA, 22 nt, Homo sapiens
agugagcugcagucuggggucc

SEQ ID NO: 68859 - RNA, 21 nt, Homo sapiens
agugagucauuuggaaagcaa

SEQ ID NO: 68860 - RNA, 22 nt, Homo sapiens
agugauauguuugccuugaggg

SEQ ID NO: 68861 - RNA, 22 nt, Homo sapiens
agugaucauuugaauugaugau

SEQ ID NO: 68862 - RNA, 22 nt, Homo sapiens
agugauguggaguuuggaugga

SEQ ID NO: 68863 - RNA, 22 nt, Homo sapiens
agugcaauggugccaucauagc

SEQ ID NO: 68864 - RNA, 22 nt, Homo sapiens
agugcaguggcauggucauaac

SEQ ID NO: 68865 - RNA, 22 nt, Homo sapiens
agugcaguggcucaaaaugccu

SEQ ID NO: 68866 - RNA, 22 nt, Homo sapiens
agugcauugcaucucugcuuca

SEQ ID NO: 68867 - RNA, 22 nt, Homo sapiens
agugcauuugcaucucaauaua

SEQ ID NO: 68868 - RNA, 22 nt, Homo sapiens
aguggcaaugugauguccugaa

SEQ ID NO: 68869 - RNA, 22 nt, Homo sapiens
aguggcacuauucucagaguca

SEQ ID NO: 68870 - RNA, 22 nt, Homo sapiens
agugggccccuagaggugaggu

SEQ ID NO: 68871 - RNA, 19 nt, Homo sapiens
agugggcuagaaaucaggg

SEQ ID NO: 68872 - RNA, 22 nt, Homo sapiens
agugguauaauauuauuuugaa

SEQ ID NO: 68873 - RNA, 22 nt, Homo sapiens
agugguguugccuguugaccua

SEQ ID NO: 68874 - RNA, 22 nt, Homo sapiens
agugguuuuaaguagagcauac

SEQ ID NO: 68875 - RNA, 22 nt, Homo sapiens
aguguuuuucaugggauacuuu

SEQ ID NO: 68876 - RNA, 22 nt, Homo sapiens
aguucaaugcucuuucuacuau

SEQ ID NO: 68877 - RNA, 22 nt, Homo sapiens
aguuggccccuacugggaggug

SEQ ID NO: 68878 - RNA, 19 nt, Homo sapiens
auaaacuagaacugucccc

SEQ ID NO: 68879 - RNA, 18 nt, Homo sapiens
auaaacucaucauuuuua

SEQ ID NO: 68880 - RNA, 22 nt, Homo sapiens
auaaagcaagucucuggccuca

SEQ ID NO: 68881 - RNA, 22 nt, Homo sapiens
auaaagccaggagacguaauug

SEQ ID NO: 68882 - RNA, 22 nt, Homo sapiens
auaaagcuauuccucucuuuuu

SEQ ID NO: 68883 - RNA, 22 nt, Homo sapiens
auaaaugcaaugguauuuuuga

SEQ ID NO: 68884 - RNA, 22 nt, Homo sapiens
auaaaugcauugagaacugcug

SEQ ID NO: 68885 - RNA, 22 nt, Homo sapiens
auaacagcugcaaggcaaaagc

SEQ ID NO: 68886 - RNA, 22 nt, Homo sapiens
auaacucuguuuuuuucaugca

SEQ ID NO: 68887 - RNA, 22 nt, Homo sapiens
auaagaagugaaccagacgucu

SEQ ID NO: 68888 - RNA, 22 nt, Homo sapiens
auaagaguaguacauaugagac

SEQ ID NO: 68889 - RNA, 22 nt, Homo sapiens
auaagaugaaggaagccauauc

SEQ ID NO: 68890 - RNA, 23 nt, Homo sapiens
auaagccuuuucuuucugcccca

SEQ ID NO: 68891 - RNA, 22 nt, Homo sapiens
auaaggaguaucauauuaaaac

SEQ ID NO: 68892 - RNA, 22 nt, Homo sapiens
auaaggcuaaggacuugaguua

SEQ ID NO: 68893 - RNA, 22 nt, Homo sapiens
auaaguauuuggacuuuacugu

SEQ ID NO: 68894 - RNA, 19 nt, Homo sapiens
auaagugaaucacgggggc

SEQ ID NO: 68895 - RNA, 22 nt, Homo sapiens
auaauaccugccucagagaguu

SEQ ID NO: 68896 - RNA, 22 nt, Homo sapiens
auaauacugggaagaugagcau

SEQ ID NO: 68897 - RNA, 22 nt, Homo sapiens
auaauaguguuuagauuuggga

SEQ ID NO: 68898 - RNA, 22 nt, Homo sapiens
auaauaucagguugugaugaug

SEQ ID NO: 68899 - RNA, 22 nt, Homo sapiens
auaaugcuuuucuagguugcau

SEQ ID NO: 68900 - RNA, 22 nt, Homo sapiens
auaauguuuauccagaggaguu

SEQ ID NO: 68901 - RNA, 19 nt, Homo sapiens
auaauuagcagugaggaca

SEQ ID NO: 68902 - RNA, 22 nt, Homo sapiens
auaauugcaacacagggcuuug

SEQ ID NO: 68903 - RNA, 22 nt, Homo sapiens
auacaagcaguccaacuccaua

SEQ ID NO: 68904 - RNA, 22 nt, Homo sapiens
auacacgugcagaacaugcagg

SEQ ID NO: 68905 - RNA, 22 nt, Homo sapiens
auacacguguauauguguaucu

SEQ ID NO: 68906 - RNA, 22 nt, Homo sapiens
auacacuagggcuccugcagaa

SEQ ID NO: 68907 - RNA, 22 nt, Homo sapiens
auacagcuaaaauauuaaguua

SEQ ID NO: 68908 - RNA, 22 nt, Homo sapiens
auacaguaaugucuuaggcugu

SEQ ID NO: 68909 - RNA, 22 nt, Homo sapiens
auacagugaauaucuggggcag

SEQ ID NO: 68910 - RNA, 22 nt, Homo sapiens
auacaucugccauguuggugug

SEQ ID NO: 68911 - RNA, 22 nt, Homo sapiens
auacaugcauuugcacgagagu

SEQ ID NO: 68912 - RNA, 22 nt, Homo sapiens
auacaugugugagcgaagaugu

SEQ ID NO: 68913 - RNA, 22 nt, Homo sapiens
auacauguucaagggcauauau

SEQ ID NO: 68914 - RNA, 16 nt, Homo sapiens
auaccacagugacaca

SEQ ID NO: 68915 - RNA, 22 nt, Homo sapiens
auacccaguaguggaauugcua

SEQ ID NO: 68916 - RNA, 22 nt, Homo sapiens
auaccugguagucuugcuacac

SEQ ID NO: 68917 - RNA, 22 nt, Homo sapiens
auaccuuguagugcuauuugau

SEQ ID NO: 68918 - RNA, 22 nt, Homo sapiens
auacuaugagauaauaaagacu

SEQ ID NO: 68919 - RNA, 22 nt, Homo sapiens
auagaagcuauguauaggggcc

SEQ ID NO: 68920 - RNA, 20 nt, Homo sapiens
auagaccauugguagguagg

SEQ ID NO: 68921 - RNA, 23 nt, Homo sapiens
auagagcuaggaugcagacagau

SEQ ID NO: 68922 - RNA, 22 nt, Homo sapiens
auagagugcuucaucaguagua

SEQ ID NO: 68923 - RNA, 22 nt, Homo sapiens
auagaucauugucauuuuagau

SEQ ID NO: 68924 - RNA, 22 nt, Homo sapiens
auagauucauuugaggagauuu

SEQ ID NO: 68925 - RNA, 22 nt, Homo sapiens
auagcaaugcaagaauggcuua

SEQ ID NO: 68926 - RNA, 22 nt, Homo sapiens
auagcagcaccccacuaccuca

SEQ ID NO: 68927 - RNA, 22 nt, Homo sapiens
auagcagcagcuaguagugaua

SEQ ID NO: 68928 - RNA, 22 nt, Homo sapiens
auagcagcauauguaauguuga

SEQ ID NO: 68929 - RNA, 22 nt, Homo sapiens
auagcagugccccaaacuccug

SEQ ID NO: 68930 - RNA, 22 nt, Homo sapiens
auagcagugucccacuccuugg

SEQ ID NO: 68931 - RNA, 22 nt, Homo sapiens
auagcagugugagaaugaacua

SEQ ID NO: 68932 - RNA, 22 nt, Homo sapiens
auagcauagucagcuucgcuga

SEQ ID NO: 68933 - RNA, 19 nt, Homo sapiens
auagggcuagcauauacug

SEQ ID NO: 68934 - RNA, 22 nt, Homo sapiens
auagguauguaauacaaaugaa

SEQ ID NO: 68935 - RNA, 22 nt, Homo sapiens
agccuguguugaauuauagaaa

SEQ ID NO: 68936 - RNA, 22 nt, Homo sapiens
agcgccauugcacuccagccuu

SEQ ID NO: 68937 - RNA, 22 nt, Homo sapiens
agcuacguuggggaaguucuca

SEQ ID NO: 68938 - RNA, 23 nt, Homo sapiens
agcuagagaggcuggggauacag

SEQ ID NO: 68939 - RNA, 22 nt, Homo sapiens
agcuaugucugaugccugauua

SEQ ID NO: 68940 - RNA, 22 nt, Homo sapiens
agcucacagccuagcacuguga

SEQ ID NO: 68941 - RNA, 22 nt, Homo sapiens
agcucauugcaaccuccgccuc

SEQ ID NO: 68942 - RNA, 20 nt, Homo sapiens
agcuccauuccugaaggcug

SEQ ID NO: 68943 - RNA, 22 nt, Homo sapiens
agcuccuuucugcagguagguu

SEQ ID NO: 68944 - RNA, 22 nt, Homo sapiens
agcuccuuugcuuuuuccagga

SEQ ID NO: 68945 - RNA, 22 nt, Homo sapiens
agcugauggucuuguaugaugu

SEQ ID NO: 68946 - RNA, 22 nt, Homo sapiens
acugcacuccagccucggcaau

SEQ ID NO: 68947 - RNA, 22 nt, Homo sapiens
acugcacuccagccucgugaca

SEQ ID NO: 68948 - RNA, 22 nt, Homo sapiens
acugcacuccagccugaugaaa

SEQ ID NO: 68949 - RNA, 22 nt, Homo sapiens
acugcacuccagccuuagugac

SEQ ID NO: 68950 - RNA, 22 nt, Homo sapiens
acugcacuccagccuucgugac

SEQ ID NO: 68951 - RNA, 22 nt, Homo sapiens
acugcacuccagccuugcgaca

SEQ ID NO: 68952 - RNA, 22 nt, Homo sapiens
acugcacuccagccuugugaca

SEQ ID NO: 68953 - RNA, 22 nt, Homo sapiens
acugcacuccagcuccagggug

SEQ ID NO: 68954 - RNA, 22 nt, Homo sapiens
acugcacuccagcuugggugac

SEQ ID NO: 68955 - RNA, 22 nt, Homo sapiens
acugcacuccaucuuagguggc

SEQ ID NO: 68956 - RNA, 22 nt, Homo sapiens
acugcacuccggccucgugaca

SEQ ID NO: 68957 - RNA, 22 nt, Homo sapiens
acugcacuccggccuggcaaca

SEQ ID NO: 68958 - RNA, 22 nt, Homo sapiens
acugcacucuagccccugcgac

SEQ ID NO: 68959 - RNA, 22 nt, Homo sapiens
acugcacucuagcuugggugac

SEQ ID NO: 68960 - RNA, 22 nt, Homo sapiens
acugcacuucagccuuggcuac

SEQ ID NO: 68961 - RNA, 22 nt, Homo sapiens
acugcacuucagccuugggaaa

SEQ ID NO: 68962 - RNA, 22 nt, Homo sapiens
acugcacuucagccuuggggac

SEQ ID NO: 68963 - RNA, 22 nt, Homo sapiens
acugcauuugucccuuuugaac

SEQ ID NO: 68964 - RNA, 18 nt, Homo sapiens
acuggaauuaaacuuuuu

SEQ ID NO: 68965 - RNA, 21 nt, Homo sapiens
acuggaccccuuccauacacc

SEQ ID NO: 68966 - RNA, 22 nt, Homo sapiens
acuggcaauggcagaaauaguu

SEQ ID NO: 68967 - RNA, 20 nt, Homo sapiens
acuggcacugguaggugugg

SEQ ID NO: 68968 - RNA, 22 nt, Homo sapiens
acuggcuuuugagaaaaacacu

SEQ ID NO: 68969 - RNA, 22 nt, Homo sapiens
acugguguaugggaggucccaa

SEQ ID NO: 68970 - RNA, 22 nt, Homo sapiens
acuguacuccagccugggcaac

SEQ ID NO: 68971 - RNA, 19 nt, Homo sapiens
acuguacuccagucugggc

SEQ ID NO: 68972 - RNA, 22 nt, Homo sapiens
acuguauagauggaguugauuu

SEQ ID NO: 68973 - RNA, 22 nt, Homo sapiens
acuuaguauggggcuuuugaga

SEQ ID NO: 68974 - RNA, 22 nt, Homo sapiens
acuugacacuuauauuacucac

SEQ ID NO: 68975 - RNA, 21 nt, Homo sapiens
acuuucuguggcaguccauuc

SEQ ID NO: 68976 - RNA, 22 nt, Homo sapiens
acuuuuguuauacagugugaua

SEQ ID NO: 68977 - RNA, 21 nt, Homo sapiens
agaaaaucuuaugggaaacau

SEQ ID NO: 68978 - RNA, 22 nt, Homo sapiens
agaaacauucucuugccuccuu

SEQ ID NO: 68979 - RNA, 22 nt, Homo sapiens
agaaaugcagcaugaggcggca

SEQ ID NO: 68980 - RNA, 22 nt, Homo sapiens
agaaauguuuacucacccccuu

SEQ ID NO: 68981 - RNA, 22 nt, Homo sapiens
agaaauguuuauucaaacccgu

SEQ ID NO: 68982 - RNA, 22 nt, Homo sapiens
agaagaacauagggugacugaa

SEQ ID NO: 68983 - RNA, 22 nt, Homo sapiens
agaagacuauucuggguugggc

SEQ ID NO: 68984 - RNA, 22 nt, Homo sapiens
agaauguaaacagaauagagga

SEQ ID NO: 68985 - RNA, 22 nt, Homo sapiens
agaauguauauucuguaguugu

SEQ ID NO: 68986 - RNA, 22 nt, Homo sapiens
agaaugucagcuggauucagcu

SEQ ID NO: 68987 - RNA, 22 nt, Homo sapiens
agaaugugaacaucuugaaagu

SEQ ID NO: 68988 - RNA, 22 nt, Homo sapiens
agacacugaaauguauugaaga

SEQ ID NO: 68989 - RNA, 20 nt, Homo sapiens
agacagcugcagcccacauc

SEQ ID NO: 68990 - RNA, 22 nt, Homo sapiens
agacaguauuggcaaagugugu

SEQ ID NO: 68991 - RNA, 22 nt, Homo sapiens
agacaucauuugauggugggag

SEQ ID NO: 68992 - RNA, 22 nt, Homo sapiens
agacuagaaaucauuuguugag

SEQ ID NO: 68993 - RNA, 22 nt, Homo sapiens
agacucauuuccauagucagcu

SEQ ID NO: 68994 - RNA, 22 nt, Homo sapiens
agacucauuuuuaucgagcaug

SEQ ID NO: 68995 - RNA, 22 nt, Homo sapiens
agagacauugcuccaacucacc

SEQ ID NO: 68996 - RNA, 22 nt, Homo sapiens
agagagcuuuaacuacccauuu

SEQ ID NO: 68997 - RNA, 22 nt, Homo sapiens
agagagcuuuugguugcccuaa

SEQ ID NO: 68998 - RNA, 22 nt, Homo sapiens
agagaugauuaacauuuuggua

SEQ ID NO: 68999 - RNA, 22 nt, Homo sapiens
agagauuauccuggcuucucug

SEQ ID NO: 69000 - RNA, 22 nt, Homo sapiens
agagcaauguuaucagucucug

SEQ ID NO: 69001 - RNA, 22 nt, Homo sapiens
agagcaccauuuagcaagguga

SEQ ID NO: 69002 - RNA, 18 nt, Homo sapiens
agagcuaugaacauaugc

SEQ ID NO: 69003 - RNA, 23 nt, Homo sapiens
agagguuuaaucaggcaguugcu

SEQ ID NO: 69004 - RNA, 22 nt, Homo sapiens
agaguacaggcaaguuagucau

SEQ ID NO: 69005 - RNA, 15 nt, Homo sapiens
agaguagagacgccc

SEQ ID NO: 69006 - RNA, 22 nt, Homo sapiens
agaguaguuucuauauucuuca

SEQ ID NO: 69007 - RNA, 18 nt, Homo sapiens
agaguaucauuuccccca

SEQ ID NO: 69008 - RNA, 19 nt, Homo sapiens
agaguauugaauuugcccu

SEQ ID NO: 69009 - RNA, 22 nt, Homo sapiens
agagucacaugaggcccuucau

SEQ ID NO: 69010 - RNA, 21 nt, Homo sapiens
agagucaucucuaucuguacc

SEQ ID NO: 69011 - RNA, 22 nt, Homo sapiens
agagugcaaagguuggggcugg

SEQ ID NO: 69012 - RNA, 22 nt, Homo sapiens
agagugcuaaggaaguaauuua

SEQ ID NO: 69013 - RNA, 20 nt, Homo sapiens
agagugcuggacugaggagc

SEQ ID NO: 69014 - RNA, 22 nt, Homo sapiens
agauacaucuaugugucugugu

SEQ ID NO: 69015 - RNA, 22 nt, Homo sapiens
agaucacagucuuugguuuuag

SEQ ID NO: 69016 - RNA, 22 nt, Homo sapiens
agaucacucagguuucucccug

SEQ ID NO: 69017 - RNA, 22 nt, Homo sapiens
agaucauaugcaguaaugaacu

SEQ ID NO: 69018 - RNA, 20 nt, Homo sapiens
agaugcaugcacauaaacac

SEQ ID NO: 69019 - RNA, 18 nt, Homo sapiens
agaugcaugcucacuaca

SEQ ID NO: 69020 - RNA, 22 nt, Homo sapiens
agaugcauugguggcauauuca

SEQ ID NO: 69021 - RNA, 22 nt, Homo sapiens
agaugcauuuuuauuggaauac

SEQ ID NO: 69022 - RNA, 22 nt, Homo sapiens
agaugccuaugaagagaaauua

SEQ ID NO: 69023 - RNA, 22 nt, Homo sapiens
agaugccucauguucuagguuc

SEQ ID NO: 69024 - RNA, 22 nt, Homo sapiens
agauggguuuucacauguuggc

SEQ ID NO: 69025 - RNA, 22 nt, Homo sapiens
agauggugugcuaggaaaugua

SEQ ID NO: 69026 - RNA, 22 nt, Homo sapiens
agaugguuuuguucacagcucu

SEQ ID NO: 69027 - RNA, 22 nt, Homo sapiens
agcaacauugagacugcaguug

SEQ ID NO: 69028 - RNA, 22 nt, Homo sapiens
agcaagaugaaguugagcuagg

SEQ ID NO: 69029 - RNA, 22 nt, Homo sapiens
agcacagccuuguguuuucuug

SEQ ID NO: 69030 - RNA, 22 nt, Homo sapiens
agcacagugaaugguuuacuca

SEQ ID NO: 69031 - RNA, 22 nt, Homo sapiens
auugcaugucauguuuagugua

SEQ ID NO: 69032 - RNA, 22 nt, Homo sapiens
auugccacaucucagaggcaga

SEQ ID NO: 69033 - RNA, 22 nt, Homo sapiens
auugccuaacauagauguucag

SEQ ID NO: 69034 - RNA, 22 nt, Homo sapiens
aguauguagugcaaucagucag

SEQ ID NO: 69035 - RNA, 20 nt, Homo sapiens
aguauucacuuuuuucaugg

SEQ ID NO: 69036 - RNA, 22 nt, Homo sapiens
agucaaaugcuuauguauaaag

SEQ ID NO: 69037 - RNA, 22 nt, Homo sapiens
agucaacaucaugaaguggaaa

SEQ ID NO: 69038 - RNA, 22 nt, Homo sapiens
agucaagaugagauuugggugg

SEQ ID NO: 69039 - RNA, 22 nt, Homo sapiens
agucacagugaccuugucugac

SEQ ID NO: 69040 - RNA, 22 nt, Homo sapiens
agucagugcauaagaaugaagu

SEQ ID NO: 69041 - RNA, 22 nt, Homo sapiens
agucaguggaguaaauguaauu

SEQ ID NO: 69042 - RNA, 22 nt, Homo sapiens
agucagugucuguaaggagaac

SEQ ID NO: 69043 - RNA, 21 nt, Homo sapiens
agucauaggaguacauaaugc

SEQ ID NO: 69044 - RNA, 22 nt, Homo sapiens
agucauuguugagaugguguca

SEQ ID NO: 69045 - RNA, 22 nt, Homo sapiens
aguccaguguuaugaucaguag

SEQ ID NO: 69046 - RNA, 22 nt, Homo sapiens
agucgguguuacugacagaaug

SEQ ID NO: 69047 - RNA, 23 nt, Homo sapiens
agucuguguuuacaggcucucug

SEQ ID NO: 69048 - RNA, 22 nt, Homo sapiens
agugaaaugucaccuuuuagga

SEQ ID NO: 69049 - RNA, 17 nt, Homo sapiens
agugagaucauggcuua

SEQ ID NO: 69050 - RNA, 22 nt, Homo sapiens
agugagcuguuuuuacuuucug

SEQ ID NO: 69051 - RNA, 22 nt, Homo sapiens
agugauuuuaacuuccagcaau

SEQ ID NO: 69052 - RNA, 22 nt, Homo sapiens
agugcacuccagccugggcaac

SEQ ID NO: 69053 - RNA, 22 nt, Homo sapiens
agugccaaaucgagggcucuga

SEQ ID NO: 69054 - RNA, 22 nt, Homo sapiens
agugccacugcacucuagccug

SEQ ID NO: 69055 - RNA, 22 nt, Homo sapiens
agugccuauugauggaaagaua

SEQ ID NO: 69056 - RNA, 22 nt, Homo sapiens
aguggaaucuguuauacuaacu

SEQ ID NO: 69057 - RNA, 22 nt, Homo sapiens
aguggauguuguggccugggag

SEQ ID NO: 69058 - RNA, 22 nt, Homo sapiens
aguggcacaauuuugacucccc

SEQ ID NO: 69059 - RNA, 22 nt, Homo sapiens
aguggcuuuuuaguggcagaug

SEQ ID NO: 69060 - RNA, 22 nt, Homo sapiens
aguggguguuccauuggauaaa

SEQ ID NO: 69061 - RNA, 23 nt, Homo sapiens
aguggucuccugggcccagcugu

SEQ ID NO: 69062 - RNA, 22 nt, Homo sapiens
agugguuugaucacagcucacu

SEQ ID NO: 69063 - RNA, 19 nt, Homo sapiens
agugucauggucauuauuu

SEQ ID NO: 69064 - RNA, 22 nt, Homo sapiens
aguguuuuuaucaugaaagggu

SEQ ID NO: 69065 - RNA, 22 nt, Homo sapiens
aguuaguguugugauaaaucca

SEQ ID NO: 69066 - RNA, 22 nt, Homo sapiens
aguucaaaucgagccuggccau

SEQ ID NO: 69067 - RNA, 22 nt, Homo sapiens
aguucaauggguuuucacucau

SEQ ID NO: 69068 - RNA, 21 nt, Homo sapiens
aguucacauggcuccuguguu

SEQ ID NO: 69069 - RNA, 22 nt, Homo sapiens
aguugcaagucuugaguaaaga

SEQ ID NO: 69070 - RNA, 22 nt, Homo sapiens
auaaacagcuuauccucuauuc

SEQ ID NO: 69071 - RNA, 22 nt, Homo sapiens
auaaaccuacauuuucacuucu

SEQ ID NO: 69072 - RNA, 22 nt, Homo sapiens
auaaagcaaauaggacuauugc

SEQ ID NO: 69073 - RNA, 22 nt, Homo sapiens
auaaagguaagcacuauccuga

SEQ ID NO: 69074 - RNA, 22 nt, Homo sapiens
auaaauaguaguugugguggcc

SEQ ID NO: 69075 - RNA, 22 nt, Homo sapiens
auaaaugcuuagaucuguauau

SEQ ID NO: 69076 - RNA, 22 nt, Homo sapiens
auaaaugcuuccagucauuaaa

SEQ ID NO: 69077 - RNA, 20 nt, Homo sapiens
auaaauguauagguguacau

SEQ ID NO: 69078 - RNA, 22 nt, Homo sapiens
auaacagcauuauugcauacgu

SEQ ID NO: 69079 - RNA, 22 nt, Homo sapiens
auaacaggaaauacagggcuuu

SEQ ID NO: 69080 - RNA, 18 nt, Homo sapiens
auaaccuggugcuuucaa

SEQ ID NO: 69081 - RNA, 22 nt, Homo sapiens
auaagagcaggcuucuggccag

SEQ ID NO: 69082 - RNA, 22 nt, Homo sapiens
auaagcuaagaguuucugggcu

SEQ ID NO: 69083 - RNA, 22 nt, Homo sapiens
auaaggcugguauagacauuca

SEQ ID NO: 69084 - RNA, 22 nt, Homo sapiens
auaaguagaaugauggucaaaa

SEQ ID NO: 69085 - RNA, 22 nt, Homo sapiens
auaagugagugauucaguguua

SEQ ID NO: 69086 - RNA, 22 nt, Homo sapiens
auaauagguaguaauggauuga

SEQ ID NO: 69087 - RNA, 22 nt, Homo sapiens
auaauagguugauugacauugc

SEQ ID NO: 69088 - RNA, 22 nt, Homo sapiens
auaaucacacccagguuaaaug

SEQ ID NO: 69089 - RNA, 22 nt, Homo sapiens
auaaucaugucugaaaccuuug

SEQ ID NO: 69090 - RNA, 23 nt, Homo sapiens
auaaugcaaguggugguaaucug

SEQ ID NO: 69091 - RNA, 22 nt, Homo sapiens
auaaugcuggaacuagagggca

SEQ ID NO: 69092 - RNA, 22 nt, Homo sapiens
auacaagugccauguuggugug

SEQ ID NO: 69093 - RNA, 22 nt, Homo sapiens
auacacauuccugggccucacc

SEQ ID NO: 69094 - RNA, 22 nt, Homo sapiens
auacacgugccauguugguaug

SEQ ID NO: 69095 - RNA, 22 nt, Homo sapiens
auacacgugccauguuggugug

SEQ ID NO: 69096 - RNA, 22 nt, Homo sapiens
auacagacacagucagaggggu

SEQ ID NO: 69097 - RNA, 22 nt, Homo sapiens
auacagguauacaaugcauaau

SEQ ID NO: 69098 - RNA, 22 nt, Homo sapiens
auacaguauggagggcccagcu

SEQ ID NO: 69099 - RNA, 22 nt, Homo sapiens
auacaguguauguauaguacau

SEQ ID NO: 69100 - RNA, 22 nt, Homo sapiens
auacaguguucugggaagaagu

SEQ ID NO: 69101 - RNA, 22 nt, Homo sapiens
auacaugugccauggugguuug

SEQ ID NO: 69102 - RNA, 22 nt, Homo sapiens
auacaugugccauguugguuug

SEQ ID NO: 69103 - RNA, 22 nt, Homo sapiens
auacaugugucauguugguuug

SEQ ID NO: 69104 - RNA, 22 nt, Homo sapiens
auacauguuucauguuggugug

SEQ ID NO: 69105 - RNA, 22 nt, Homo sapiens
auacccauacauauuggugacu

SEQ ID NO: 69106 - RNA, 22 nt, Homo sapiens
auacuguacugaaguacccauu

SEQ ID NO: 69107 - RNA, 22 nt, Homo sapiens
auacugucucuugcuccugccc

SEQ ID NO: 69108 - RNA, 21 nt, Homo sapiens
auacuugcauccuuggagaga

SEQ ID NO: 69109 - RNA, 22 nt, Homo sapiens
auagaaucaucugugcacuagu

SEQ ID NO: 69110 - RNA, 22 nt, Homo sapiens
auagaauguauuaguaaauuug

SEQ ID NO: 69111 - RNA, 22 nt, Homo sapiens
auagacugaguggcuuaaacca

SEQ ID NO: 69112 - RNA, 22 nt, Homo sapiens
auagagguagacagaggggaaa

SEQ ID NO: 69113 - RNA, 22 nt, Homo sapiens
auagcaagaugauugauccauu

SEQ ID NO: 69114 - RNA, 22 nt, Homo sapiens
auagcaaugccccaauccuugg

SEQ ID NO: 69115 - RNA, 22 nt, Homo sapiens
auagcagaccaccucucccacu

SEQ ID NO: 69116 - RNA, 22 nt, Homo sapiens
auagcagcaccucacucuacug

SEQ ID NO: 69117 - RNA, 22 nt, Homo sapiens
auagcagcuugucagggcagac

SEQ ID NO: 69118 - RNA, 22 nt, Homo sapiens
auagcagugugaaaauguacua

SEQ ID NO: 69119 - RNA, 22 nt, Homo sapiens
auagccucauucuucagaugag

SEQ ID NO: 69120 - RNA, 22 nt, Homo sapiens
auagccuguaggccuuaaggug

SEQ ID NO: 69121 - RNA, 22 nt, Homo sapiens
auaggagcacgaacucuagugu

SEQ ID NO: 69122 - RNA, 22 nt, Homo sapiens
auaggagcagaaaccguauuuu

SEQ ID NO: 69123 - RNA, 22 nt, Homo sapiens
auaggagugugaacccuaucgu

SEQ ID NO: 69124 - RNA, 22 nt, Homo sapiens
auaggagugugcacagaguagg

SEQ ID NO: 69125 - RNA, 22 nt, Homo sapiens
auagguagcauagcaggaauau

SEQ ID NO: 69126 - RNA, 22 nt, Homo sapiens
auaguagagagggcaaaaugcu

SEQ ID NO: 69127 - RNA, 22 nt, Homo sapiens
augacgagaugguguuuggcuu

SEQ ID NO: 69128 - RNA, 22 nt, Homo sapiens
uuguccaagucccauuuguuga

SEQ ID NO: 69129 - RNA, 22 nt, Homo sapiens
uugucccauggggucuuccuuu

SEQ ID NO: 69130 - RNA, 19 nt, Homo sapiens
uuguccccucuaaaucuca

SEQ ID NO: 69131 - RNA, 22 nt, Homo sapiens
uuguccuugagauaguuugcag

SEQ ID NO: 69132 - RNA, 21 nt, Homo sapiens
uugucuagagaaauauaucuc

SEQ ID NO: 69133 - RNA, 22 nt, Homo sapiens
uugugaauggugccucaguaaa

SEQ ID NO: 69134 - RNA, 22 nt, Homo sapiens
uugugagggagcuaagaugagu

SEQ ID NO: 69135 - RNA, 22 nt, Homo sapiens
uugugcauaucagagguuugcu

SEQ ID NO: 69136 - RNA, 20 nt, Homo sapiens
uugugcauugggccauuggg

SEQ ID NO: 69137 - RNA, 21 nt, Homo sapiens
uugugccaaacccuggaggga

SEQ ID NO: 69138 - RNA, 22 nt, Homo sapiens
uugugccugguacauggagaaa

SEQ ID NO: 69139 - RNA, 22 nt, Homo sapiens
uugugcuuaauaaaaaguggua

SEQ ID NO: 69140 - RNA, 22 nt, Homo sapiens
uugugcuugauuugccuagcug

SEQ ID NO: 69141 - RNA, 22 nt, Homo sapiens
uugugcuugcuguguucuaugc

SEQ ID NO: 69142 - RNA, 22 nt, Homo sapiens
uugugcuuguaacuacauucag

SEQ ID NO: 69143 - RNA, 22 nt, Homo sapiens
uugugcuuuacuuacuaccaga

SEQ ID NO: 69144 - RNA, 22 nt, Homo sapiens
uuguggcuuaucucauuuagcg

SEQ ID NO: 69145 - RNA, 19 nt, Homo sapiens
uugugggaggacagagggg

SEQ ID NO: 69146 - RNA, 22 nt, Homo sapiens
uugugguaaucugugacagcag

SEQ ID NO: 69147 - RNA, 22 nt, Homo sapiens
uugugguaggcauguaagauga

SEQ ID NO: 69148 - RNA, 22 nt, Homo sapiens
uugugguuauagagucucccug

SEQ ID NO: 69149 - RNA, 22 nt, Homo sapiens
uugugguugacuaaauuuguaa

SEQ ID NO: 69150 - RNA, 22 nt, Homo sapiens
uugugucaaauggcaauuagca

SEQ ID NO: 69151 - RNA, 22 nt, Homo sapiens
uugugucccuacccaaaucuca

SEQ ID NO: 69152 - RNA, 22 nt, Homo sapiens
uugugucccugcccaaaucuca

SEQ ID NO: 69153 - RNA, 22 nt, Homo sapiens
uuguguuuuuaguagggaaggg

SEQ ID NO: 69154 - RNA, 22 nt, Homo sapiens
uuguuaagaugcagauucugga

SEQ ID NO: 69155 - RNA, 22 nt, Homo sapiens
uuguuaugggguggcuugaaag

SEQ ID NO: 69156 - RNA, 22 nt, Homo sapiens
uuguucccuucuggcuuuuaug

SEQ ID NO: 69157 - RNA, 22 nt, Homo sapiens
uuguuuuggagaugagcuaaaa

SEQ ID NO: 69158 - RNA, 21 nt, Homo sapiens
uuuccuggagcguauggcuuc

SEQ ID NO: 69159 - RNA, 15 nt, Homo sapiens
uuucuacugcacuuc

SEQ ID NO: 69160 - RNA, 22 nt, Homo sapiens
uuucuauguugaccagucuaga

SEQ ID NO: 69161 - RNA, 16 nt, Homo sapiens
uuucuauguuuuacua

SEQ ID NO: 69162 - RNA, 17 nt, Homo sapiens
uuucucagcccucuucu

SEQ ID NO: 69163 - RNA, 20 nt, Homo sapiens
uuucuccccuauaaaucuca

SEQ ID NO: 69164 - RNA, 22 nt, Homo sapiens
uuucugagaccaaaacuuguaa

SEQ ID NO: 69165 - RNA, 22 nt, Homo sapiens
uuucugcuugagagaauugcug

SEQ ID NO: 69166 - RNA, 22 nt, Homo sapiens
uuucugugguccucuugaaggu

SEQ ID NO: 69167 - RNA, 22 nt, Homo sapiens
uuugaaccauuugaagaaugau

SEQ ID NO: 69168 - RNA, 22 nt, Homo sapiens
uuugaagacuacugggagugaa

SEQ ID NO: 69169 - RNA, 22 nt, Homo sapiens
uuugaagcuaaggugcuugguu

SEQ ID NO: 69170 - RNA, 19 nt, Homo sapiens
uuugaauauaaugcagcua

SEQ ID NO: 69171 - RNA, 22 nt, Homo sapiens
uuugaauguaaugagcaggaag

SEQ ID NO: 69172 - RNA, 22 nt, Homo sapiens
uuugacuguggagucgaugcuu

SEQ ID NO: 69173 - RNA, 22 nt, Homo sapiens
uuugagcauguaguuuaacccu

SEQ ID NO: 69174 - RNA, 21 nt, Homo sapiens
uuugaucauuaaaagugaauc

SEQ ID NO: 69175 - RNA, 22 nt, Homo sapiens
uuugauguccaccucagcccac

SEQ ID NO: 69176 - RNA, 16 nt, Homo sapiens
uuugcaagaucagaag

SEQ ID NO: 69177 - RNA, 22 nt, Homo sapiens
uuugcaauguugugauggugaa

SEQ ID NO: 69178 - RNA, 22 nt, Homo sapiens
uuugcacauauuugggcaaaag

SEQ ID NO: 69179 - RNA, 22 nt, Homo sapiens
uuugcacuggagauucaauggg

SEQ ID NO: 69180 - RNA, 22 nt, Homo sapiens
uuugcaguuuauuccuggggcu

SEQ ID NO: 69181 - RNA, 22 nt, Homo sapiens
uuugcauaauaagauuagggug

SEQ ID NO: 69182 - RNA, 22 nt, Homo sapiens
uuugcauauguugaaccagccu

SEQ ID NO: 69183 - RNA, 22 nt, Homo sapiens
uuugcaucuuuugcuuccugga

SEQ ID NO: 69184 - RNA, 22 nt, Homo sapiens
uuugccuuugugauauggucua

SEQ ID NO: 69185 - RNA, 22 nt, Homo sapiens
uuuggcacuguaaauuucucuu

SEQ ID NO: 69186 - RNA, 22 nt, Homo sapiens
uuuggcauauuuuaagcugguu

SEQ ID NO: 69187 - RNA, 22 nt, Homo sapiens
uuuggcauuaagaugcuguauc

SEQ ID NO: 69188 - RNA, 23 nt, Homo sapiens
uuuggcauuccagaaauuuucau

SEQ ID NO: 69189 - RNA, 22 nt, Homo sapiens
uuuggcauuuaaauaugcaugg

SEQ ID NO: 69190 - RNA, 22 nt, Homo sapiens
uuuggcauuugaguuuguagga

SEQ ID NO: 69191 - RNA, 22 nt, Homo sapiens
uuuggcucugugucccacccaa

SEQ ID NO: 69192 - RNA, 22 nt, Homo sapiens
uuuggcuuaagauugacugcaa

SEQ ID NO: 69193 - RNA, 21 nt, Homo sapiens
uuuggcuucucugcugcagcc

SEQ ID NO: 69194 - RNA, 22 nt, Homo sapiens
uuugggaaaugaaguugguaga

SEQ ID NO: 69195 - RNA, 22 nt, Homo sapiens
uuuggguuuuauguaacagcua

SEQ ID NO: 69196 - RNA, 22 nt, Homo sapiens
uuuggucacugccgccgccagc

SEQ ID NO: 69197 - RNA, 22 nt, Homo sapiens
uuuggucagcugcgggucagcu

SEQ ID NO: 69198 - RNA, 22 nt, Homo sapiens
uuuggucccaaugugauaaggu

SEQ ID NO: 69199 - RNA, 22 nt, Homo sapiens
uuugguccuccuacagggcagg

SEQ ID NO: 69200 - RNA, 22 nt, Homo sapiens
uuugguugccucuaugagccug

SEQ ID NO: 69201 - RNA, 22 nt, Homo sapiens
uuuguaauccuauuccaaagga

SEQ ID NO: 69202 - RNA, 22 nt, Homo sapiens
uuuguacugagccaagauggua

SEQ ID NO: 69203 - RNA, 22 nt, Homo sapiens
uuuguacuucauugguucuacu

SEQ ID NO: 69204 - RNA, 22 nt, Homo sapiens
uuuguacuugaaacccagggcc

SEQ ID NO: 69205 - RNA, 22 nt, Homo sapiens
uuugugaaugucauaagcucca

SEQ ID NO: 69206 - RNA, 22 nt, Homo sapiens
uuugugacucauggucuagugc

SEQ ID NO: 69207 - RNA, 22 nt, Homo sapiens
uuugugcaugaagagggggugc

SEQ ID NO: 69208 - RNA, 22 nt, Homo sapiens
uuugugcuaacuuuaacucuua

SEQ ID NO: 69209 - RNA, 22 nt, Homo sapiens
uuugugcuaaugcuagauuacu

SEQ ID NO: 69210 - RNA, 22 nt, Homo sapiens
uuuguggaaugcccuuauuuau

SEQ ID NO: 69211 - RNA, 22 nt, Homo sapiens
uuuguguccccacccaaaucuc

SEQ ID NO: 69212 - RNA, 22 nt, Homo sapiens
uuugugucccucuaaaauuuau

SEQ ID NO: 69213 - RNA, 22 nt, Homo sapiens
uuugugugugauuauaaaaggu

SEQ ID NO: 69214 - RNA, 22 nt, Homo sapiens
uuuguucaccucaaggauggga

SEQ ID NO: 69215 - RNA, 22 nt, Homo sapiens
uuuguuugaagucgagacaacu

SEQ ID NO: 69216 - RNA, 22 nt, Homo sapiens
uuuuaagcuacaagagacauau

SEQ ID NO: 69217 - RNA, 22 nt, Homo sapiens
uuuuacacaucaccgcucgugu

SEQ ID NO: 69218 - RNA, 20 nt, Homo sapiens
uuuuagcacuuguuauggug

SEQ ID NO: 69219 - RNA, 22 nt, Homo sapiens
uuuuaguggaauauuuacaguu

SEQ ID NO: 69220 - RNA, 22 nt, Homo sapiens
uuuucaguuuuccagguagccg

SEQ ID NO: 69221 - RNA, 23 nt, Homo sapiens
uuuugcaauaagucacuggaaua

SEQ ID NO: 69222 - RNA, 22 nt, Homo sapiens
uuuugcaauauguuccugaaua

SEQ ID NO: 69223 - RNA, 22 nt, Homo sapiens
uuuugcaccauccuaauaguau

SEQ ID NO: 69224 - RNA, 22 nt, Homo sapiens
uuuugcaggucaggggcagaga

SEQ ID NO: 69225 - RNA, 22 nt, Homo sapiens
uuuugcaguuacagagagugag

SEQ ID NO: 69226 - RNA, 22 nt, Homo sapiens
uuuugccggcauguugggcuuc

SEQ ID NO: 69227 - RNA, 22 nt, Homo sapiens
uuuugcucuucggaagagcuug

SEQ ID NO: 69228 - RNA, 22 nt, Homo sapiens
uuuugcucuugguaaugaaaga

SEQ ID NO: 69229 - RNA, 22 nt, Homo sapiens
uuuugcuugugaauagccacau

SEQ ID NO: 69230 - RNA, 22 nt, Homo sapiens
uuuugcuuuuccucggucccac

SEQ ID NO: 69231 - RNA, 22 nt, Homo sapiens
uuuuggcuuaaagagaauguau

SEQ ID NO: 69232 - RNA, 20 nt, Homo sapiens
uuuuggcuuaaagcagucug

SEQ ID NO: 69233 - RNA, 22 nt, Homo sapiens
uuuuggcuuuuccucagcaagc

SEQ ID NO: 69234 - RNA, 22 nt, Homo sapiens
uuuugggggugauucacacagu

SEQ ID NO: 69235 - RNA, 22 nt, Homo sapiens
uuuugguauaugcaggggucuu

SEQ ID NO: 69236 - RNA, 22 nt, Homo sapiens
uuuugguguacaauucuaugga

SEQ ID NO: 69237 - RNA, 22 nt, Homo sapiens
uuuuguacaacagcucugggga

SEQ ID NO: 69238 - RNA, 19 nt, Homo sapiens
uuuuguacucugugacuug

SEQ ID NO: 69239 - RNA, 22 nt, Homo sapiens
uuuugucccaugggcuguuccc

SEQ ID NO: 69240 - RNA, 22 nt, Homo sapiens
uuuugugacuauuguaaauggg

SEQ ID NO: 69241 - RNA, 16 nt, Homo sapiens
uuuuugcagaaaugac

SEQ ID NO: 69242 - RNA, 22 nt, Homo sapiens
uuaauagcaaagaguuuagacu

SEQ ID NO: 69243 - RNA, 22 nt, Homo sapiens
uuaaucacagugucuuccuuca

SEQ ID NO: 69244 - RNA, 22 nt, Homo sapiens
uuaaucucaggaguuugggacc

SEQ ID NO: 69245 - RNA, 22 nt, Homo sapiens
uuaaucuguucucuguauucua

SEQ ID NO: 69246 - RNA, 22 nt, Homo sapiens
uuaaugaacuuuauuuuguaga

SEQ ID NO: 69247 - RNA, 22 nt, Homo sapiens
uuaauggagaguuucauuggug

SEQ ID NO: 69248 - RNA, 22 nt, Homo sapiens
uuaauuguccaaguucaucucu

SEQ ID NO: 69249 - RNA, 22 nt, Homo sapiens
uuacaacugucuuacugguuau

SEQ ID NO: 69250 - RNA, 22 nt, Homo sapiens
uuacaaguggcaucucucugga

SEQ ID NO: 69251 - RNA, 22 nt, Homo sapiens
uuacacaguugguaggggcaga

SEQ ID NO: 69252 - RNA, 22 nt, Homo sapiens
uuacacguaauaucacggugug

SEQ ID NO: 69253 - RNA, 22 nt, Homo sapiens
uuacagauggcacacucaaggg

SEQ ID NO: 69254 - RNA, 22 nt, Homo sapiens
uuacagguggagaaguaaggcu

SEQ ID NO: 69255 - RNA, 22 nt, Homo sapiens
uuacaguaugaguaagaguucu

SEQ ID NO: 69256 - RNA, 22 nt, Homo sapiens
uuacaguauugcaaggacuagg

SEQ ID NO: 69257 - RNA, 23 nt, Homo sapiens
uuacaguggcaugaucucugcuc

SEQ ID NO: 69258 - RNA, 22 nt, Homo sapiens
uuacaguggugaccuuguauug

SEQ ID NO: 69259 - RNA, 22 nt, Homo sapiens
uuacaguguuuguucuguuacu

SEQ ID NO: 69260 - RNA, 22 nt, Homo sapiens
uuacaucaucacauuaguuugc

SEQ ID NO: 69261 - RNA, 22 nt, Homo sapiens
uuacaugcaugacaaggugcca

SEQ ID NO: 69262 - RNA, 22 nt, Homo sapiens
uuacaugucuugguaagguuag

SEQ ID NO: 69263 - RNA, 22 nt, Homo sapiens
uuacauguggugugaagaagag

SEQ ID NO: 69264 - RNA, 22 nt, Homo sapiens
uuaccagagaagacgaggggga

SEQ ID NO: 69265 - RNA, 22 nt, Homo sapiens
uuacccauuagagaauuuaaga

SEQ ID NO: 69266 - RNA, 22 nt, Homo sapiens
uuacccuuugcauuaccaacaa

SEQ ID NO: 69267 - RNA, 22 nt, Homo sapiens
uuaccucagaccugcucugugu

SEQ ID NO: 69268 - RNA, 22 nt, Homo sapiens
uuaccuuuuuaagacagguuag

SEQ ID NO: 69269 - RNA, 20 nt, Homo sapiens
uuacuauguaguauuggcuc

SEQ ID NO: 69270 - RNA, 22 nt, Homo sapiens
uuacugcauaauuccugggaag

SEQ ID NO: 69271 - RNA, 22 nt, Homo sapiens
uuacugcucuuuugucaugagu

SEQ ID NO: 69272 - RNA, 22 nt, Homo sapiens
uuacuguacugcucuuaaccug

SEQ ID NO: 69273 - RNA, 22 nt, Homo sapiens
uuacuguagugucauaucguau

SEQ ID NO: 69274 - RNA, 22 nt, Homo sapiens
uuacuugagaugaguuggacaa

SEQ ID NO: 69275 - RNA, 22 nt, Homo sapiens
uuagagcacugaucugcucuuu

SEQ ID NO: 69276 - RNA, 17 nt, Homo sapiens
uuagagguagacucauu

SEQ ID NO: 69277 - RNA, 22 nt, Homo sapiens
uuagaguacaggggaaucaagg

SEQ ID NO: 69278 - RNA, 20 nt, Homo sapiens
uuagaguaguaugauuuaua

SEQ ID NO: 69279 - RNA, 22 nt, Homo sapiens
uuagaguguagcaggaagaggc

SEQ ID NO: 69280 - RNA, 22 nt, Homo sapiens
uuagauaguacuuagggaaaua

SEQ ID NO: 69281 - RNA, 23 nt, Homo sapiens
uuagaucuuuaaggaaucuccac

SEQ ID NO: 69282 - RNA, 22 nt, Homo sapiens
uuagauguuuagaagugggcca

SEQ ID NO: 69283 - RNA, 22 nt, Homo sapiens
uuagauuauugagcauccacug

SEQ ID NO: 69284 - RNA, 22 nt, Homo sapiens
uuagauuauugguguuuugcaa

SEQ ID NO: 69285 - RNA, 22 nt, Homo sapiens
uuagcacaguucauucauguua

SEQ ID NO: 69286 - RNA, 22 nt, Homo sapiens
uuagcacugagaauggcuugcu

SEQ ID NO: 69287 - RNA, 22 nt, Homo sapiens
uuagcacuugggaguauuuauu

SEQ ID NO: 69288 - RNA, 22 nt, Homo sapiens
uuagcagcaucccuggccugua

SEQ ID NO: 69289 - RNA, 22 nt, Homo sapiens
uuagcagcaugagaauggacua

SEQ ID NO: 69290 - RNA, 20 nt, Homo sapiens
uuagcagcaugauuuauaau

SEQ ID NO: 69291 - RNA, 22 nt, Homo sapiens
uuagcagcucuaauaacugcua

SEQ ID NO: 69292 - RNA, 22 nt, Homo sapiens
uuagcagcucuggugacaaggu

SEQ ID NO: 69293 - RNA, 22 nt, Homo sapiens
uuagccggguguguuggcgggc

SEQ ID NO: 69294 - RNA, 22 nt, Homo sapiens
uuaggacacuguggguggguca

SEQ ID NO: 69295 - RNA, 22 nt, Homo sapiens
uuaggcaggauaguuacauauu

SEQ ID NO: 69296 - RNA, 22 nt, Homo sapiens
uuaggcuaguuucuuaaacucu

SEQ ID NO: 69297 - RNA, 22 nt, Homo sapiens
uuagggaggacaguuacaacag

SEQ ID NO: 69298 - RNA, 22 nt, Homo sapiens
uuagggaggcucaggacaagag

SEQ ID NO: 69299 - RNA, 22 nt, Homo sapiens
uuaggucaucgcuguccuucag

SEQ ID NO: 69300 - RNA, 22 nt, Homo sapiens
uuaguagagacgagcguuccac

SEQ ID NO: 69301 - RNA, 22 nt, Homo sapiens
uuaguaguugugauagguaccu

SEQ ID NO: 69302 - RNA, 22 nt, Homo sapiens
uuaguaguuugaguggggguua

SEQ ID NO: 69303 - RNA, 22 nt, Homo sapiens
uuaguaguuugauaggaauagc

SEQ ID NO: 69304 - RNA, 22 nt, Homo sapiens
uuaguccacuggaacuguuaua

SEQ ID NO: 69305 - RNA, 22 nt, Homo sapiens
uuagugcugaguggaauguucu

SEQ ID NO: 69306 - RNA, 22 nt, Homo sapiens
uuaguugcauucaugugagagu

SEQ ID NO: 69307 - RNA, 22 nt, Homo sapiens
uuauaacagagacuccugugcu

SEQ ID NO: 69308 - RNA, 22 nt, Homo sapiens
uuauaacucugcagccugguau

SEQ ID NO: 69309 - RNA, 18 nt, Homo sapiens
uuauacuccccaggcaau

SEQ ID NO: 69310 - RNA, 22 nt, Homo sapiens
uuauagcacuaagaagguaaua

SEQ ID NO: 69311 - RNA, 22 nt, Homo sapiens
uuauagcagugcaggaacagac

SEQ ID NO: 69312 - RNA, 20 nt, Homo sapiens
uuauagcuacaucuugacug

SEQ ID NO: 69313 - RNA, 22 nt, Homo sapiens
uuauauguuagacauggugggu

SEQ ID NO: 69314 - RNA, 22 nt, Homo sapiens
uuaucacauugacugauuugca

SEQ ID NO: 69315 - RNA, 22 nt, Homo sapiens
uuauccugucaguaaauauuuu

SEQ ID NO: 69316 - RNA, 17 nt, Homo sapiens
uuaugagacuucuuagc

SEQ ID NO: 69317 - RNA, 22 nt, Homo sapiens
uuaugcaucuuccacacucauu

SEQ ID NO: 69318 - RNA, 22 nt, Homo sapiens
uuaugccagugauuauaagggc

SEQ ID NO: 69319 - RNA, 22 nt, Homo sapiens
uuagguaauauauugcugcuuu

SEQ ID NO: 69320 - RNA, 22 nt, Homo sapiens
uuagguagucucugucagaggg

SEQ ID NO: 69321 - RNA, 22 nt, Homo sapiens
uuaggugguacacagccccagu

SEQ ID NO: 69322 - RNA, 23 nt, Homo sapiens
uuaguaaacucaaugacaccaca

SEQ ID NO: 69323 - RNA, 22 nt, Homo sapiens
uuagucaaguguacugugaaug

SEQ ID NO: 69324 - RNA, 20 nt, Homo sapiens
uuagucuccucugcccuguc

SEQ ID NO: 69325 - RNA, 22 nt, Homo sapiens
uuagugcuuacgaugagcuaag

SEQ ID NO: 69326 - RNA, 22 nt, Homo sapiens
uuaguucauugugacuggacuc

SEQ ID NO: 69327 - RNA, 20 nt, Homo sapiens
uuaguucauuuagaagguuu

SEQ ID NO: 69328 - RNA, 22 nt, Homo sapiens
uuauaaacaugaagauuugggg

SEQ ID NO: 69329 - RNA, 22 nt, Homo sapiens
uuauacuacuauaaagagguag

SEQ ID NO: 69330 - RNA, 22 nt, Homo sapiens
uuauagcuaacaucugugaaaa

SEQ ID NO: 69331 - RNA, 22 nt, Homo sapiens
uuauagguuucuacaggacuau

SEQ ID NO: 69332 - RNA, 21 nt, Homo sapiens
uuauaguggcaugauuuauaa

SEQ ID NO: 69333 - RNA, 18 nt, Homo sapiens
uuauaugcauguguagga

SEQ ID NO: 69334 - RNA, 22 nt, Homo sapiens
uuauauguuacucccucuagca

SEQ ID NO: 69335 - RNA, 22 nt, Homo sapiens
uuauauguuucuguuuggaggc

SEQ ID NO: 69336 - RNA, 22 nt, Homo sapiens
uuaucagcagcaugaaacugga

SEQ ID NO: 69337 - RNA, 22 nt, Homo sapiens
uuaucucagugaacugagugga

SEQ ID NO: 69338 - RNA, 22 nt, Homo sapiens
uuaugaaguagguuaagagcag

SEQ ID NO: 69339 - RNA, 22 nt, Homo sapiens
uuaugcuugugugaauuuuccc

SEQ ID NO: 69340 - RNA, 22 nt, Homo sapiens
uuauggcucuuggggaaguaga

SEQ ID NO: 69341 - RNA, 23 nt, Homo sapiens
uuauggcuuuuauuauguugagg

SEQ ID NO: 69342 - RNA, 22 nt, Homo sapiens
uuaugguuuuucugugagaugg

SEQ ID NO: 69343 - RNA, 22 nt, Homo sapiens
uuauuagagauauuugguuagg

SEQ ID NO: 69344 - RNA, 22 nt, Homo sapiens
uuauugcucauuugggcauucu

SEQ ID NO: 69345 - RNA, 22 nt, Homo sapiens
uucaaauguucuuucaccaccc

SEQ ID NO: 69346 - RNA, 23 nt, Homo sapiens
uucaacagguagacccucccugc

SEQ ID NO: 69347 - RNA, 22 nt, Homo sapiens
uucaagauggcaccagugagug

SEQ ID NO: 69348 - RNA, 20 nt, Homo sapiens
uucaagugauucucaugccu

SEQ ID NO: 69349 - RNA, 22 nt, Homo sapiens
uucaagugguucagaagucuga

SEQ ID NO: 69350 - RNA, 22 nt, Homo sapiens
uucaaguguucaggagcuacag

SEQ ID NO: 69351 - RNA, 22 nt, Homo sapiens
uucacagaaaaaggcgaugagg

SEQ ID NO: 69352 - RNA, 22 nt, Homo sapiens
uucacagacaacuggucccuua

SEQ ID NO: 69353 - RNA, 22 nt, Homo sapiens
uucacagaguuauuuuuaugcu

SEQ ID NO: 69354 - RNA, 20 nt, Homo sapiens
uucacaggcagcuucuuucu

SEQ ID NO: 69355 - RNA, 22 nt, Homo sapiens
uucacaguguuucucacgguua

SEQ ID NO: 69356 - RNA, 22 nt, Homo sapiens
uucacaugacagggugaagcau

SEQ ID NO: 69357 - RNA, 22 nt, Homo sapiens
uucacaugguugccuuuugauc

SEQ ID NO: 69358 - RNA, 23 nt, Homo sapiens
uucaccguguuggccaggcuggu

SEQ ID NO: 69359 - RNA, 22 nt, Homo sapiens
uucacgguguucacgggggucc

SEQ ID NO: 69360 - RNA, 20 nt, Homo sapiens
uucacugggcucucuguugg

SEQ ID NO: 69361 - RNA, 22 nt, Homo sapiens
uucacugggugugguggcucac

SEQ ID NO: 69362 - RNA, 21 nt, Homo sapiens
uucacuggucuauuucccuuu

SEQ ID NO: 69363 - RNA, 22 nt, Homo sapiens
uucacugugaacucauauucag

SEQ ID NO: 69364 - RNA, 22 nt, Homo sapiens
uucacugugaauaaaggcuccc

SEQ ID NO: 69365 - RNA, 22 nt, Homo sapiens
uucacugugcuuaaauucugcu

SEQ ID NO: 69366 - RNA, 22 nt, Homo sapiens
uucagacugggugaagagggua

SEQ ID NO: 69367 - RNA, 22 nt, Homo sapiens
uucagagcauugguuuuuugaa

SEQ ID NO: 69368 - RNA, 22 nt, Homo sapiens
uucagaguggacagaaauuaag

SEQ ID NO: 69369 - RNA, 22 nt, Homo sapiens
uucagcaguggccaguggaaau

SEQ ID NO: 69370 - RNA, 19 nt, Homo sapiens
uucagcagugucugcucuu

SEQ ID NO: 69371 - RNA, 22 nt, Homo sapiens
uucaggcaccauggucauugau

SEQ ID NO: 69372 - RNA, 22 nt, Homo sapiens
uucaggcuccugugagaaucua

SEQ ID NO: 69373 - RNA, 22 nt, Homo sapiens
uucaggcuuuuauuuacugaua

SEQ ID NO: 69374 - RNA, 22 nt, Homo sapiens
uucagggacuuuagacaagaga

SEQ ID NO: 69375 - RNA, 22 nt, Homo sapiens
uucagggagaaggcaaacguug

SEQ ID NO: 69376 - RNA, 22 nt, Homo sapiens
uucaggguggagaguaugaggu

SEQ ID NO: 69377 - RNA, 22 nt, Homo sapiens
uucagguaauuaugguuugucu

SEQ ID NO: 69378 - RNA, 22 nt, Homo sapiens
uucagguacuauaggcuguugg

SEQ ID NO: 69379 - RNA, 22 nt, Homo sapiens
uucagguaucccuugucuauag

SEQ ID NO: 69380 - RNA, 22 nt, Homo sapiens
uucaguaaauguucuuacuaua

SEQ ID NO: 69381 - RNA, 22 nt, Homo sapiens
uucaguagucaaaagauaaggg

SEQ ID NO: 69382 - RNA, 22 nt, Homo sapiens
uucagugagacgaaaacaacaa

SEQ ID NO: 69383 - RNA, 22 nt, Homo sapiens
uucaguggacuuaguagugcuu

SEQ ID NO: 69384 - RNA, 21 nt, Homo sapiens
uucauaaggcuucucuccugu

SEQ ID NO: 69385 - RNA, 19 nt, Homo sapiens
uucauacagugagagcagc

SEQ ID NO: 69386 - RNA, 22 nt, Homo sapiens
uucauaguaacaguaacuaugg

SEQ ID NO: 69387 - RNA, 21 nt, Homo sapiens
uucaucagccagaaaucaagc

SEQ ID NO: 69388 - RNA, 23 nt, Homo sapiens
uucaucagggauauuggccugaa

SEQ ID NO: 69389 - RNA, 22 nt, Homo sapiens
uucaucagggguauuggccaau

SEQ ID NO: 69390 - RNA, 22 nt, Homo sapiens
uucaugcaucuguagugguuaa

SEQ ID NO: 69391 - RNA, 22 nt, Homo sapiens
uucauggacucaauaguuucgc

SEQ ID NO: 69392 - RNA, 22 nt, Homo sapiens
uucauggaguugagaaggcuaa

SEQ ID NO: 69393 - RNA, 22 nt, Homo sapiens
uucauggaugcauuugaggggu

SEQ ID NO: 69394 - RNA, 22 nt, Homo sapiens
uucauggguuaauuuguucgau

SEQ ID NO: 69395 - RNA, 22 nt, Homo sapiens
uucauguaauauuucacagcuu

SEQ ID NO: 69396 - RNA, 22 nt, Homo sapiens
uucauguaaucaaggcagcuaa

SEQ ID NO: 69397 - RNA, 22 nt, Homo sapiens
uucauguagucaucauccugcu

SEQ ID NO: 69398 - RNA, 22 nt, Homo sapiens
uuccacaaugguugaacuaguu

SEQ ID NO: 69399 - RNA, 16 nt, Homo sapiens
uuccacagucgaggug

SEQ ID NO: 69400 - RNA, 22 nt, Homo sapiens
uuccaggugggcgugggccugg

SEQ ID NO: 69401 - RNA, 22 nt, Homo sapiens
uuccaguaauagcacagcauug

SEQ ID NO: 69402 - RNA, 22 nt, Homo sapiens
uuccaguauuugggcaagcgca

SEQ ID NO: 69403 - RNA, 22 nt, Homo sapiens
ucacacugaauuugaagcaaug

SEQ ID NO: 69404 - RNA, 22 nt, Homo sapiens
ucacacuguuuugauuauuaua

SEQ ID NO: 69405 - RNA, 23 nt, Homo sapiens
ucacacuuaagagaaaugcagcu

SEQ ID NO: 69406 - RNA, 22 nt, Homo sapiens
ucacagcuaaaaugaaaguagu

SEQ ID NO: 69407 - RNA, 22 nt, Homo sapiens
ucacaguagagcuucuuucaga

SEQ ID NO: 69408 - RNA, 22 nt, Homo sapiens
ucacaguccuguuuaggagagg

SEQ ID NO: 69409 - RNA, 22 nt, Homo sapiens
ucacagugaguggaguggggug

SEQ ID NO: 69410 - RNA, 23 nt, Homo sapiens
ucacaguggcugcuuaauuguga

SEQ ID NO: 69411 - RNA, 17 nt, Homo sapiens
ucacaguguuaggauga

SEQ ID NO: 69412 - RNA, 22 nt, Homo sapiens
ucacauagcugaguaaaaugga

SEQ ID NO: 69413 - RNA, 22 nt, Homo sapiens
ucacaugcacaucucuggaacc

SEQ ID NO: 69414 - RNA, 21 nt, Homo sapiens
ucacauggccagaguaggaac

SEQ ID NO: 69415 - RNA, 22 nt, Homo sapiens
ucaccaguaauaaagagccugc

SEQ ID NO: 69416 - RNA, 22 nt, Homo sapiens
ucaccagugucagggaacugcu

SEQ ID NO: 69417 - RNA, 22 nt, Homo sapiens
ucacccacacaggagacaggga

SEQ ID NO: 69418 - RNA, 22 nt, Homo sapiens
ucaccuagacucgaucauguag

SEQ ID NO: 69419 - RNA, 22 nt, Homo sapiens
ucaccuggagagcuugcuaaua

SEQ ID NO: 69420 - RNA, 22 nt, Homo sapiens
ucaccuggggaucuuguuuaca

SEQ ID NO: 69421 - RNA, 22 nt, Homo sapiens
ucaccuggggcacagcugaaga

SEQ ID NO: 69422 - RNA, 21 nt, Homo sapiens
ucaccuguagcugcauguucu

SEQ ID NO: 69423 - RNA, 18 nt, Homo sapiens
ucaccuugaugcuggguc

SEQ ID NO: 69424 - RNA, 22 nt, Homo sapiens
ucaccuugcacaguuguguggg

SEQ ID NO: 69425 - RNA, 19 nt, Homo sapiens
ucaccuugcccugcacaca

SEQ ID NO: 69426 - RNA, 18 nt, Homo sapiens
ucaccuugcuuuuagaac

SEQ ID NO: 69427 - RNA, 18 nt, Homo sapiens
ucaccuugugagagagag

SEQ ID NO: 69428 - RNA, 22 nt, Homo sapiens
ucacgcugcugcaaccagccug

SEQ ID NO: 69429 - RNA, 23 nt, Homo sapiens
ucacggagaccugcaagaccaau

SEQ ID NO: 69430 - RNA, 22 nt, Homo sapiens
ucacgugcucuuguguguucug

SEQ ID NO: 69431 - RNA, 22 nt, Homo sapiens
ucacuagggagaaacugaggcu

SEQ ID NO: 69432 - RNA, 21 nt, Homo sapiens
ucacuaguaaaaggugaacug

SEQ ID NO: 69433 - RNA, 22 nt, Homo sapiens
ucacugaggucugagcuuuaug

SEQ ID NO: 69434 - RNA, 22 nt, Homo sapiens
ucacugcacucuccgccuugcg

SEQ ID NO: 69435 - RNA, 22 nt, Homo sapiens
ucacugcgaccuccgccucccg

SEQ ID NO: 69436 - RNA, 19 nt, Homo sapiens
ucacuggacagcacacuca

SEQ ID NO: 69437 - RNA, 22 nt, Homo sapiens
ucacuggacucuagccugggug

SEQ ID NO: 69438 - RNA, 22 nt, Homo sapiens
ucacuggagauagcaaucuggu

SEQ ID NO: 69439 - RNA, 22 nt, Homo sapiens
ucacugugcacauaugauaggu

SEQ ID NO: 69440 - RNA, 22 nt, Homo sapiens
ucacuguggaacucaaaaagcu

SEQ ID NO: 69441 - RNA, 22 nt, Homo sapiens
ugaauauguuaaauaauguucu

SEQ ID NO: 69442 - RNA, 22 nt, Homo sapiens
ugaauauguuaauuagcaucau

SEQ ID NO: 69443 - RNA, 22 nt, Homo sapiens
ugaaugauuuuaaaagccucuc

SEQ ID NO: 69444 - RNA, 22 nt, Homo sapiens
ugaaugcaucuagaaauuuauu

SEQ ID NO: 69445 - RNA, 22 nt, Homo sapiens
ugaaugguaaagaaaagcacug

SEQ ID NO: 69446 - RNA, 22 nt, Homo sapiens
ugaauguaacuaaaggacuuuu

SEQ ID NO: 69447 - RNA, 20 nt, Homo sapiens
ugaauguaauuacagaugua

SEQ ID NO: 69448 - RNA, 22 nt, Homo sapiens
ugaauguauuuauuaccauuca

SEQ ID NO: 69449 - RNA, 22 nt, Homo sapiens
ugaauguccugacgcugcaguu

SEQ ID NO: 69450 - RNA, 22 nt, Homo sapiens
ugaauguuguugguugagauau

SEQ ID NO: 69451 - RNA, 22 nt, Homo sapiens
ugaauucaucucacagaguuaa

SEQ ID NO: 69452 - RNA, 22 nt, Homo sapiens
ugaauucuguccaaaauaacug

SEQ ID NO: 69453 - RNA, 22 nt, Homo sapiens
ugaauugucucucacuggguuc

SEQ ID NO: 69454 - RNA, 22 nt, Homo sapiens
ugaauuguuuacgagaugugag

SEQ ID NO: 69455 - RNA, 22 nt, Homo sapiens
ugacaacugauuaacuccuuua

SEQ ID NO: 69456 - RNA, 22 nt, Homo sapiens
ugacaagagaccccuccgcagg

SEQ ID NO: 69457 - RNA, 23 nt, Homo sapiens
ugacaagagcgagacuuggucuc

SEQ ID NO: 69458 - RNA, 22 nt, Homo sapiens
ugacaagggaaaugcaaaaugu

SEQ ID NO: 69459 - RNA, 22 nt, Homo sapiens
ugacaaguaaacagucagcacc

SEQ ID NO: 69460 - RNA, 20 nt, Homo sapiens
ugacaagugagaauuauggg

SEQ ID NO: 69461 - RNA, 19 nt, Homo sapiens
ugacacuguuggugggagg

SEQ ID NO: 69462 - RNA, 21 nt, Homo sapiens
ugacagaaaauugaguuugcu

SEQ ID NO: 69463 - RNA, 22 nt, Homo sapiens
ugacagagaagcauugaguuca

SEQ ID NO: 69464 - RNA, 22 nt, Homo sapiens
ugacagagcaggacuucaucuc

SEQ ID NO: 69465 - RNA, 22 nt, Homo sapiens
ugacagaggucuuuuaauagcu

SEQ ID NO: 69466 - RNA, 22 nt, Homo sapiens
ugacagcugaagauguugaacc

SEQ ID NO: 69467 - RNA, 22 nt, Homo sapiens
ugacagguugauaggugcagca

SEQ ID NO: 69468 - RNA, 22 nt, Homo sapiens
ugacaguaucuacagcuucuua

SEQ ID NO: 69469 - RNA, 22 nt, Homo sapiens
ugacagugugagauccugucuc

SEQ ID NO: 69470 - RNA, 22 nt, Homo sapiens
ugacaugaagaaaaacagauuu

SEQ ID NO: 69471 - RNA, 22 nt, Homo sapiens
ugacaugagauuugggaggggc

SEQ ID NO: 69472 - RNA, 22 nt, Homo sapiens
ugacaugauguuccuacacugu

SEQ ID NO: 69473 - RNA, 22 nt, Homo sapiens
ugacauggagagagaagccuuu

SEQ ID NO: 69474 - RNA, 22 nt, Homo sapiens
ugacauguauaucuuacgcuau

SEQ ID NO: 69475 - RNA, 22 nt, Homo sapiens
ugacauguccaggugguccugu

SEQ ID NO: 69476 - RNA, 21 nt, Homo sapiens
ugacauguugguuugcugcac

SEQ ID NO: 69477 - RNA, 22 nt, Homo sapiens
ugacauugggagugaagugaag

SEQ ID NO: 69478 - RNA, 19 nt, Homo sapiens
ugaccagggacagaaacca

SEQ ID NO: 69479 - RNA, 22 nt, Homo sapiens
ugacuacaggucaggaagcugu

SEQ ID NO: 69480 - RNA, 22 nt, Homo sapiens
ugacuacauaaguaaucucaaa

SEQ ID NO: 69481 - RNA, 22 nt, Homo sapiens
ugacuagagacagaaacuaaaa

SEQ ID NO: 69482 - RNA, 21 nt, Homo sapiens
ugacuagauuccagauuggcc

SEQ ID NO: 69483 - RNA, 22 nt, Homo sapiens
ugacuaggaaauuagaacuuuu

SEQ ID NO: 69484 - RNA, 22 nt, Homo sapiens
ugacuauaguuuucuugacaca

SEQ ID NO: 69485 - RNA, 22 nt, Homo sapiens
ugacucaguuguuagucuucau

SEQ ID NO: 69486 - RNA, 22 nt, Homo sapiens
ugacucuagagcugccuguggc

SEQ ID NO: 69487 - RNA, 22 nt, Homo sapiens
ugacuggagucuugcucugucg

SEQ ID NO: 69488 - RNA, 22 nt, Homo sapiens
ugacugucuagauagagcuugg

SEQ ID NO: 69489 - RNA, 22 nt, Homo sapiens
ugacugugcagcuccaucaggg

SEQ ID NO: 69490 - RNA, 22 nt, Homo sapiens
ugacuuaugcaacucugaugug

SEQ ID NO: 69491 - RNA, 22 nt, Homo sapiens
ugacuugaaacgugaacagauc

SEQ ID NO: 69492 - RNA, 20 nt, Homo sapiens
ugacuuguccgagguccccc

SEQ ID NO: 69493 - RNA, 21 nt, Homo sapiens
ugagaacaacaggucaagcag

SEQ ID NO: 69494 - RNA, 16 nt, Homo sapiens
ugagaacaugugacau

SEQ ID NO: 69495 - RNA, 22 nt, Homo sapiens
ugagaaccucugugugcccacu

SEQ ID NO: 69496 - RNA, 22 nt, Homo sapiens
ugagaacggauacuaagggcug

SEQ ID NO: 69497 - RNA, 22 nt, Homo sapiens
ugagaacuaaaaugugguauau

SEQ ID NO: 69498 - RNA, 22 nt, Homo sapiens
ugagaacugcagggagcugcau

SEQ ID NO: 69499 - RNA, 22 nt, Homo sapiens
ugauaggagauuuucaucugua

SEQ ID NO: 69500 - RNA, 22 nt, Homo sapiens
ugauagucauucaauuuagcca

SEQ ID NO: 69501 - RNA, 22 nt, Homo sapiens
ugauagucuuugcuggugaccu

SEQ ID NO: 69502 - RNA, 22 nt, Homo sapiens
ugauaguguccugugccacauu

SEQ ID NO: 69503 - RNA, 22 nt, Homo sapiens
ugauaucucuugccuccaaaug

SEQ ID NO: 69504 - RNA, 22 nt, Homo sapiens
ugauaucugaauagauacacaa

SEQ ID NO: 69505 - RNA, 22 nt, Homo sapiens
ugauaugaucgcccuagcuuga

SEQ ID NO: 69506 - RNA, 20 nt, Homo sapiens
ugauauuucuggaaguggag

SEQ ID NO: 69507 - RNA, 20 nt, Homo sapiens
ugauauuuucugagcaggaa

SEQ ID NO: 69508 - RNA, 22 nt, Homo sapiens
ugauccuguccuuaugauguua

SEQ ID NO: 69509 - RNA, 22 nt, Homo sapiens
ugaucuuuuuaauguccauggg

SEQ ID NO: 69510 - RNA, 22 nt, Homo sapiens
ugaugcugaguggcuauuugaa

SEQ ID NO: 69511 - RNA, 22 nt, Homo sapiens
ugaugcugaugccugccagaag

SEQ ID NO: 69512 - RNA, 22 nt, Homo sapiens
ugauguauuauuaagaccuggc

SEQ ID NO: 69513 - RNA, 23 nt, Homo sapiens
ugauguccacuuagggucuaggu

SEQ ID NO: 69514 - RNA, 22 nt, Homo sapiens
ugauuagagcccaagcuuugaa

SEQ ID NO: 69515 - RNA, 18 nt, Homo sapiens
ugauugacuuauuuaggu

SEQ ID NO: 69516 - RNA, 22 nt, Homo sapiens
ugauuggagaacaaacugcaua

SEQ ID NO: 69517 - RNA, 22 nt, Homo sapiens
ugauuguucuguccccaggggc

SEQ ID NO: 69518 - RNA, 22 nt, Homo sapiens
ugauuuccaugagaacaugccu

SEQ ID NO: 69519 - RNA, 22 nt, Homo sapiens
ugauuugucucucagcccuacu

SEQ ID NO: 69520 - RNA, 22 nt, Homo sapiens
ugcaaagucgaaacugcaguuu

SEQ ID NO: 69521 - RNA, 22 nt, Homo sapiens
ugcaaaucuuguguaguuguga

SEQ ID NO: 69522 - RNA, 22 nt, Homo sapiens
ugcaagaaucagccuaucauua

SEQ ID NO: 69523 - RNA, 22 nt, Homo sapiens
ugcaagacugcaguuacuuuug

SEQ ID NO: 69524 - RNA, 22 nt, Homo sapiens
ugcaagaggagacuguacucag

SEQ ID NO: 69525 - RNA, 22 nt, Homo sapiens
ugcaaguaauuccagcuacuga

SEQ ID NO: 69526 - RNA, 22 nt, Homo sapiens
ugcaauagcuucaggagaaggg

SEQ ID NO: 69527 - RNA, 22 nt, Homo sapiens
ugcacaguccagugcccacuga

SEQ ID NO: 69528 - RNA, 22 nt, Homo sapiens
ugcaccacugcacuccagcuug

SEQ ID NO: 69529 - RNA, 22 nt, Homo sapiens
ugcaccacugcacuccaggcug

SEQ ID NO: 69530 - RNA, 22 nt, Homo sapiens
ugcaccaucuugcuucuguggu

SEQ ID NO: 69531 - RNA, 22 nt, Homo sapiens
ugcaccauuacacuccaggcug

SEQ ID NO: 69532 - RNA, 22 nt, Homo sapiens
ugcaccauugcauuccagccug

SEQ ID NO: 69533 - RNA, 17 nt, Homo sapiens
ugcaccauuugauuuuu

SEQ ID NO: 69534 - RNA, 22 nt, Homo sapiens
ucacugugguuuugaugugcau

SEQ ID NO: 69535 - RNA, 22 nt, Homo sapiens
ucacuuuguuuuuggauaaguu

SEQ ID NO: 69536 - RNA, 22 nt, Homo sapiens
ucagacacuguggccuuuggac

SEQ ID NO: 69537 - RNA, 22 nt, Homo sapiens
ucagaguagaaacacuuccaua

SEQ ID NO: 69538 - RNA, 18 nt, Homo sapiens
ucagagugcagacuauac

SEQ ID NO: 69539 - RNA, 19 nt, Homo sapiens
ucagaugcauuagggguua

SEQ ID NO: 69540 - RNA, 22 nt, Homo sapiens
ucagauguuucuuuaacgcaug

SEQ ID NO: 69541 - RNA, 22 nt, Homo sapiens
ucagauguuuuguuuaucugcu

SEQ ID NO: 69542 - RNA, 22 nt, Homo sapiens
ucagauugaugcauacuuaaau

SEQ ID NO: 69543 - RNA, 19 nt, Homo sapiens
ucagcaguaaucaacuuca

SEQ ID NO: 69544 - RNA, 22 nt, Homo sapiens
ucagcaguggacagaaugguag

SEQ ID NO: 69545 - RNA, 22 nt, Homo sapiens
ucagcagugugaaaacaaacua

SEQ ID NO: 69546 - RNA, 22 nt, Homo sapiens
ucagcagugugaaaauggacua

SEQ ID NO: 69547 - RNA, 22 nt, Homo sapiens
ucagcgcauggucgugcggcau

SEQ ID NO: 69548 - RNA, 20 nt, Homo sapiens
ucaggcuccgcauuaacuua

SEQ ID NO: 69549 - RNA, 22 nt, Homo sapiens
ucaggcuuuucccagagugaug

SEQ ID NO: 69550 - RNA, 20 nt, Homo sapiens
ucagguagggcuucaacauu

SEQ ID NO: 69551 - RNA, 22 nt, Homo sapiens
ucagguaucuuuauagcgaugc

SEQ ID NO: 69552 - RNA, 22 nt, Homo sapiens
ucagguaugucuuuaacagcag

SEQ ID NO: 69553 - RNA, 22 nt, Homo sapiens
ucagguauuucuuuuagcugug

SEQ ID NO: 69554 - RNA, 22 nt, Homo sapiens
ucaguaccugagagugggcaga

SEQ ID NO: 69555 - RNA, 22 nt, Homo sapiens
ucaguaguaaauggauuuggaa

SEQ ID NO: 69556 - RNA, 22 nt, Homo sapiens
ucaguaguuuuuuuacuaggug

SEQ ID NO: 69557 - RNA, 22 nt, Homo sapiens
ucagucuuuuaccauuaaguau

SEQ ID NO: 69558 - RNA, 23 nt, Homo sapiens
ucagugaaggaacaacuaaauag

SEQ ID NO: 69559 - RNA, 22 nt, Homo sapiens
ucagugaauacauguacucaug

SEQ ID NO: 69560 - RNA, 22 nt, Homo sapiens
ucagugaauauauaacagcgau

SEQ ID NO: 69561 - RNA, 22 nt, Homo sapiens
ucagugcaggaaucucuagcca

SEQ ID NO: 69562 - RNA, 22 nt, Homo sapiens
ucagugccauugccauaugagu

SEQ ID NO: 69563 - RNA, 22 nt, Homo sapiens
ucagugccucaguuuuuaaaga

SEQ ID NO: 69564 - RNA, 22 nt, Homo sapiens
ucagugguuaaaagauucuaga

SEQ ID NO: 69565 - RNA, 22 nt, Homo sapiens
ucagugucugcauucuuauugu

SEQ ID NO: 69566 - RNA, 22 nt, Homo sapiens
ucaguguuuggaaucucaauuu

SEQ ID NO: 69567 - RNA, 21 nt, Homo sapiens
ucauaagcucaacaucuguag

SEQ ID NO: 69568 - RNA, 22 nt, Homo sapiens
ucauacaggccaccagggaagu

SEQ ID NO: 69569 - RNA, 22 nt, Homo sapiens
ucauacuguccaauucuagugg

SEQ ID NO: 69570 - RNA, 20 nt, Homo sapiens
ucauacuguggaguaccagg

SEQ ID NO: 69571 - RNA, 22 nt, Homo sapiens
ucauacuguuaaaugguuuagu

SEQ ID NO: 69572 - RNA, 22 nt, Homo sapiens
ucauagaucaaguaauaagaca

SEQ ID NO: 69573 - RNA, 22 nt, Homo sapiens
ucauaucauuagaucuacugua

SEQ ID NO: 69574 - RNA, 21 nt, Homo sapiens
ucaucaagcuguagacaugau

SEQ ID NO: 69575 - RNA, 22 nt, Homo sapiens
ucaucaggaaacuuaugcagug

SEQ ID NO: 69576 - RNA, 22 nt, Homo sapiens
ucaucaggcucauucaagcuga

SEQ ID NO: 69577 - RNA, 22 nt, Homo sapiens
ucaucaguggggaugugguuga

SEQ ID NO: 69578 - RNA, 22 nt, Homo sapiens
ucaucucaguuucuugccguac

SEQ ID NO: 69579 - RNA, 22 nt, Homo sapiens
ucaugggagcccccaucaugag

SEQ ID NO: 69580 - RNA, 22 nt, Homo sapiens
ucauggggugcuuugcuagauu

SEQ ID NO: 69581 - RNA, 22 nt, Homo sapiens
ucauggguuuugguccaagcaa

SEQ ID NO: 69582 - RNA, 23 nt, Homo sapiens
ucaugguagcaccaacaauaacu

SEQ ID NO: 69583 - RNA, 22 nt, Homo sapiens
ucauguaauuuugugucuauga

SEQ ID NO: 69584 - RNA, 22 nt, Homo sapiens
ucaugugaggauaacaauagug

SEQ ID NO: 69585 - RNA, 19 nt, Homo sapiens
ucaugugcauacauuuggg

SEQ ID NO: 69586 - RNA, 22 nt, Homo sapiens
ucauuagagaucuuggggaaaa

SEQ ID NO: 69587 - RNA, 22 nt, Homo sapiens
ucauucacucccuugaaguuag

SEQ ID NO: 69588 - RNA, 22 nt, Homo sapiens
ucauucauuugcucacuccaca

SEQ ID NO: 69589 - RNA, 22 nt, Homo sapiens
ucauuggcuaagcuuguuacac

SEQ ID NO: 69590 - RNA, 22 nt, Homo sapiens
ucauugguagcuugaaggggau

SEQ ID NO: 69591 - RNA, 22 nt, Homo sapiens
uccaagaugcuggcagcuacag

SEQ ID NO: 69592 - RNA, 22 nt, Homo sapiens
uccacagugguggaauuguuca

SEQ ID NO: 69593 - RNA, 22 nt, Homo sapiens
uccacagugguugaacuaguuu

SEQ ID NO: 69594 - RNA, 22 nt, Homo sapiens
uccacguggucuaucuguccuu

SEQ ID NO: 69595 - RNA, 22 nt, Homo sapiens
aaaguaauugcaguuuuugcaa

SEQ ID NO: 69596 - RNA, 20 nt, Homo sapiens
aaaguaggcuaauaccaaaa

SEQ ID NO: 69597 - RNA, 22 nt, Homo sapiens
aaagucuguuuugucagagacu

SEQ ID NO: 69598 - RNA, 18 nt, Homo sapiens
aaagugaugucauucuuu

SEQ ID NO: 69599 - RNA, 22 nt, Homo sapiens
aaagugauugcgguuuuugcca

SEQ ID NO: 69600 - RNA, 22 nt, Homo sapiens
aaagugcaguauuugggcagga

SEQ ID NO: 69601 - RNA, 22 nt, Homo sapiens
aaagugcugggauuuuaggcau

SEQ ID NO: 69602 - RNA, 22 nt, Homo sapiens
aaagugcuuacuaaguugccaa

SEQ ID NO: 69603 - RNA, 19 nt, Homo sapiens
aaaguguuuuaaagaggau

SEQ ID NO: 69604 - RNA, 21 nt, Homo sapiens
aaaugcacauuacugcuggug

SEQ ID NO: 69605 - RNA, 22 nt, Homo sapiens
aaaugcacgcuacccagcuaga

SEQ ID NO: 69606 - RNA, 23 nt, Homo sapiens
aaaugcucucaggugccaguaga

SEQ ID NO: 69607 - RNA, 22 nt, Homo sapiens
aaaugcucuuuaugaaguugga

SEQ ID NO: 69608 - RNA, 22 nt, Homo sapiens
aaaugcugucaaauuguguucu

SEQ ID NO: 69609 - RNA, 22 nt, Homo sapiens
aaaugcuguuccaggaccuauc

SEQ ID NO: 69610 - RNA, 21 nt, Homo sapiens
aaaugugcuuuaguacccuca

SEQ ID NO: 69611 - RNA, 18 nt, Homo sapiens
aaauucugucccuucuuc

SEQ ID NO: 69612 - RNA, 22 nt, Homo sapiens
aaauugcacaaguggugauuug

SEQ ID NO: 69613 - RNA, 22 nt, Homo sapiens
aaauugcauugagcugcuuauu

SEQ ID NO: 69614 - RNA, 22 nt, Homo sapiens
aaauuguccuauugguuuaagc

SEQ ID NO: 69615 - RNA, 22 nt, Homo sapiens
aacaccauucucuguaacaaga

SEQ ID NO: 69616 - RNA, 22 nt, Homo sapiens
aacaccguagaaacacaaggga

SEQ ID NO: 69617 - RNA, 22 nt, Homo sapiens
aacacuguuuccagucaugauc

SEQ ID NO: 69618 - RNA, 22 nt, Homo sapiens
aacagauugcugagccccaccc

SEQ ID NO: 69619 - RNA, 20 nt, Homo sapiens
aacagcacugucugaagcuu

SEQ ID NO: 69620 - RNA, 21 nt, Homo sapiens
aacagugcuuaguagauguuc

SEQ ID NO: 69621 - RNA, 22 nt, Homo sapiens
aacaucaaccaugaggguugga

SEQ ID NO: 69622 - RNA, 22 nt, Homo sapiens
aaccuauaguauugaaaucaag

SEQ ID NO: 69623 - RNA, 22 nt, Homo sapiens
aaccuguaaccauaugaucagu

SEQ ID NO: 69624 - RNA, 22 nt, Homo sapiens
aacucugucuccuucaaguuca

SEQ ID NO: 69625 - RNA, 22 nt, Homo sapiens
aacugcacuaggacagguuuuu

SEQ ID NO: 69626 - RNA, 22 nt, Homo sapiens
aacugccucugacauaggcagg

SEQ ID NO: 69627 - RNA, 22 nt, Homo sapiens
aacugcucuaauguggugggag

SEQ ID NO: 69628 - RNA, 22 nt, Homo sapiens
aacugcuguuuggguacuggug

SEQ ID NO: 69629 - RNA, 22 nt, Homo sapiens
aacuggcacuacaucaagagcu

SEQ ID NO: 69630 - RNA, 22 nt, Homo sapiens
aacuggcauauucugguugcgg

SEQ ID NO: 69631 - RNA, 22 nt, Homo sapiens
aacuggccuccuugggaaauua

SEQ ID NO: 69632 - RNA, 21 nt, Homo sapiens
aacuggugugagaugguaugu

SEQ ID NO: 69633 - RNA, 21 nt, Homo sapiens
aagaaagcuggacuugccgcu

SEQ ID NO: 69634 - RNA, 22 nt, Homo sapiens
aagaccuaugcaggaagaaaug

SEQ ID NO: 69635 - RNA, 22 nt, Homo sapiens
aagagagccagcugguauauuu

SEQ ID NO: 69636 - RNA, 22 nt, Homo sapiens
aagagagcuaugugcauaauua

SEQ ID NO: 69637 - RNA, 18 nt, Homo sapiens
aagagcucagcacagguu

SEQ ID NO: 69638 - RNA, 22 nt, Homo sapiens
aagagguaauaacaaagcuucu

SEQ ID NO: 69639 - RNA, 22 nt, Homo sapiens
aagagguaggaaauggucauuu

SEQ ID NO: 69640 - RNA, 23 nt, Homo sapiens
aagagguaugacuaugaagugga

SEQ ID NO: 69641 - RNA, 22 nt, Homo sapiens
aagagguuauagaguguauacu

SEQ ID NO: 69642 - RNA, 22 nt, Homo sapiens
aagagguuuaacugacucacag

SEQ ID NO: 69643 - RNA, 22 nt, Homo sapiens
aagagugucuuugugcuggccc

SEQ ID NO: 69644 - RNA, 22 nt, Homo sapiens
aagaucaucauagagggcauga

SEQ ID NO: 69645 - RNA, 21 nt, Homo sapiens
aagcacauugaguguguguga

SEQ ID NO: 69646 - RNA, 22 nt, Homo sapiens
aagcacccagccucacgccugc

SEQ ID NO: 69647 - RNA, 22 nt, Homo sapiens
aagcacccuuugucuggacaug

SEQ ID NO: 69648 - RNA, 22 nt, Homo sapiens
aagcaccguugccuccccugca

SEQ ID NO: 69649 - RNA, 22 nt, Homo sapiens
aagcaggugaugagugggugug

SEQ ID NO: 69650 - RNA, 22 nt, Homo sapiens
aagcaggugucugugucuguaa

SEQ ID NO: 69651 - RNA, 22 nt, Homo sapiens
aagcaggugugggaggaaaugg

SEQ ID NO: 69652 - RNA, 22 nt, Homo sapiens
aagcaucacauaauggaucaug

SEQ ID NO: 69653 - RNA, 22 nt, Homo sapiens
aagcaucacuggaggcagccau

SEQ ID NO: 69654 - RNA, 23 nt, Homo sapiens
aagcaugcacagcuguuuguggu

SEQ ID NO: 69655 - RNA, 22 nt, Homo sapiens
aagcccauuguaaguugaggag

SEQ ID NO: 69656 - RNA, 22 nt, Homo sapiens
aagcuacauuuuauuuauguca

SEQ ID NO: 69657 - RNA, 22 nt, Homo sapiens
aagcuaccauuuguauauaaag

SEQ ID NO: 69658 - RNA, 20 nt, Homo sapiens
aagcugaguguuuuuuuaau

SEQ ID NO: 69659 - RNA, 22 nt, Homo sapiens
aagcugccaggcaugguggcug

SEQ ID NO: 69660 - RNA, 22 nt, Homo sapiens
aagcugccuugcugaggagaaa

SEQ ID NO: 69661 - RNA, 22 nt, Homo sapiens
aagcuggagugcaguggugcga

SEQ ID NO: 69662 - RNA, 22 nt, Homo sapiens
aagcuggauuuaguguggagca

SEQ ID NO: 69663 - RNA, 22 nt, Homo sapiens
aagcuggcauucaugagauuac

SEQ ID NO: 69664 - RNA, 22 nt, Homo sapiens
aagcugguguugcugcucuguu

SEQ ID NO: 69665 - RNA, 22 nt, Homo sapiens
aaggaacuggaauauuuugaac

SEQ ID NO: 69666 - RNA, 22 nt, Homo sapiens
aaggagcuaagagaucauacau

SEQ ID NO: 69667 - RNA, 22 nt, Homo sapiens
aaggagcuuaagugacuuguac

SEQ ID NO: 69668 - RNA, 22 nt, Homo sapiens
aaggaguguggugaucuugggc

SEQ ID NO: 69669 - RNA, 22 nt, Homo sapiens
aaggauuguaacaccaagguua

SEQ ID NO: 69670 - RNA, 22 nt, Homo sapiens
aaggcaacgugaguuguugauu

SEQ ID NO: 69671 - RNA, 22 nt, Homo sapiens
acgcagcacauucacagcuaug

SEQ ID NO: 69672 - RNA, 20 nt, Homo sapiens
acuaaaucucauuuuaugca

SEQ ID NO: 69673 - RNA, 22 nt, Homo sapiens
acuacaugugaugucaguauau

SEQ ID NO: 69674 - RNA, 22 nt, Homo sapiens
acuagagaugcauuuguaguuu

SEQ ID NO: 69675 - RNA, 22 nt, Homo sapiens
acuauacugaagcaaauuaaca

SEQ ID NO: 69676 - RNA, 22 nt, Homo sapiens
acucacagcaaccuccgccucc

SEQ ID NO: 69677 - RNA, 22 nt, Homo sapiens
acucagagaacauucccagucu

SEQ ID NO: 69678 - RNA, 22 nt, Homo sapiens
acucagagagaacugucauuug

SEQ ID NO: 69679 - RNA, 22 nt, Homo sapiens
acuccacuuucaccacagcgga

SEQ ID NO: 69680 - RNA, 22 nt, Homo sapiens
acucuguauaaacauugcugua

SEQ ID NO: 69681 - RNA, 22 nt, Homo sapiens
acucugucuaguuguaaaauuu

SEQ ID NO: 69682 - RNA, 22 nt, Homo sapiens
acugagacugagaauguuucuu

SEQ ID NO: 69683 - RNA, 21 nt, Homo sapiens
acugagagaucuggggcacau

SEQ ID NO: 69684 - RNA, 22 nt, Homo sapiens
acugaguguugauuuagauuaa

SEQ ID NO: 69685 - RNA, 22 nt, Homo sapiens
acugcaauuacuguuguaccaa

SEQ ID NO: 69686 - RNA, 20 nt, Homo sapiens
acugcacuccaaccuuugug

SEQ ID NO: 69687 - RNA, 22 nt, Homo sapiens
acugcacuccagcccgggugac

SEQ ID NO: 69688 - RNA, 22 nt, Homo sapiens
acugcacuccagccucccgucu

SEQ ID NO: 69689 - RNA, 22 nt, Homo sapiens
uccccugagaccccucagcacu

SEQ ID NO: 69690 - RNA, 22 nt, Homo sapiens
uccccugagucaccugcuucuc

SEQ ID NO: 69691 - RNA, 22 nt, Homo sapiens
uccccugauaccaaccaccaug

SEQ ID NO: 69692 - RNA, 19 nt, Homo sapiens
uccccuguggauaccaaga

SEQ ID NO: 69693 - RNA, 20 nt, Homo sapiens
ucccucaaacuuuuccacug

SEQ ID NO: 69694 - RNA, 18 nt, Homo sapiens
ucccucagaauuauagaa

SEQ ID NO: 69695 - RNA, 22 nt, Homo sapiens
ucccugagguccuggauuauug

SEQ ID NO: 69696 - RNA, 17 nt, Homo sapiens
ucccuguuuuuucaguc

SEQ ID NO: 69697 - RNA, 22 nt, Homo sapiens
uccucauggagaaccucugcua

SEQ ID NO: 69698 - RNA, 22 nt, Homo sapiens
uccugagaauagaguugcaugu

SEQ ID NO: 69699 - RNA, 22 nt, Homo sapiens
uccugagacugaggagcuuugg

SEQ ID NO: 69700 - RNA, 22 nt, Homo sapiens
uccugagucagcauccguuugu

SEQ ID NO: 69701 - RNA, 22 nt, Homo sapiens
uccuugagaggacagagccaua

SEQ ID NO: 69702 - RNA, 22 nt, Homo sapiens
uccuugagccucccagacucag

SEQ ID NO: 69703 - RNA, 22 nt, Homo sapiens
uccuugagccuuaaauuauaaa

SEQ ID NO: 69704 - RNA, 22 nt, Homo sapiens
uccuugcacuaacuuaaggagg

SEQ ID NO: 69705 - RNA, 22 nt, Homo sapiens
uccuuggugacauuucuugucu

SEQ ID NO: 69706 - RNA, 21 nt, Homo sapiens
uccuuggugaugcccugcagu

SEQ ID NO: 69707 - RNA, 23 nt, Homo sapiens
uccuugguuggcgcccuaugugu

SEQ ID NO: 69708 - RNA, 22 nt, Homo sapiens
uccuuuggguagcuguucagau

SEQ ID NO: 69709 - RNA, 22 nt, Homo sapiens
uccuuuguuacaguuggcucug

SEQ ID NO: 69710 - RNA, 18 nt, Homo sapiens
uccuuuugggguaggaga

SEQ ID NO: 69711 - RNA, 22 nt, Homo sapiens
ucgacacugaccuaguucagca

SEQ ID NO: 69712 - RNA, 22 nt, Homo sapiens
ucgcaccauugcacuccagcca

SEQ ID NO: 69713 - RNA, 22 nt, Homo sapiens
ucgcaguuaauaaugaugugcg

SEQ ID NO: 69714 - RNA, 19 nt, Homo sapiens
ucgcgccauucuccugccu

SEQ ID NO: 69715 - RNA, 22 nt, Homo sapiens
ucgcugggaagacugaaguguc

SEQ ID NO: 69716 - RNA, 23 nt, Homo sapiens
ucgguccccuuggcugcccucgg

SEQ ID NO: 69717 - RNA, 22 nt, Homo sapiens
ucuacagccaguucaggaagaa

SEQ ID NO: 69718 - RNA, 22 nt, Homo sapiens
ucuacccugugagggacacagu

SEQ ID NO: 69719 - RNA, 22 nt, Homo sapiens
ucuagccuaugaagcuugucca

SEQ ID NO: 69720 - RNA, 15 nt, Homo sapiens
ucuaguuuugaagac

SEQ ID NO: 69721 - RNA, 22 nt, Homo sapiens
ucuauugguaggggcugaggca

SEQ ID NO: 69722 - RNA, 22 nt, Homo sapiens
ucuauuugggguaccuguggua

SEQ ID NO: 69723 - RNA, 22 nt, Homo sapiens
ucucaaccuccacacuacaaua

SEQ ID NO: 69724 - RNA, 22 nt, Homo sapiens
ucucaauggguuguagacaaag

SEQ ID NO: 69725 - RNA, 22 nt, Homo sapiens
ucucacacugaauguguguggg

SEQ ID NO: 69726 - RNA, 22 nt, Homo sapiens
ucucacagaguugaacuuucuu

SEQ ID NO: 69727 - RNA, 18 nt, Homo sapiens
ucucacagcaaucuguca

SEQ ID NO: 69728 - RNA, 22 nt, Homo sapiens
ucucacauuucacagggauggg

SEQ ID NO: 69729 - RNA, 22 nt, Homo sapiens
ucucagcacaaacaaaauugcu

SEQ ID NO: 69730 - RNA, 22 nt, Homo sapiens
ucucaguggcacccccaacacc

SEQ ID NO: 69731 - RNA, 22 nt, Homo sapiens
ucucaguggcuuccucacuuuu

SEQ ID NO: 69732 - RNA, 22 nt, Homo sapiens
ucucaguggugcuggcagggga

SEQ ID NO: 69733 - RNA, 22 nt, Homo sapiens
gugucuccugccuucaugcagc

SEQ ID NO: 69734 - RNA, 22 nt, Homo sapiens
gugugacagcuauagacaugau

SEQ ID NO: 69735 - RNA, 22 nt, Homo sapiens
gugugcaacuuucauuaauauu

SEQ ID NO: 69736 - RNA, 22 nt, Homo sapiens
gugugcaauuuugugggaggca

SEQ ID NO: 69737 - RNA, 22 nt, Homo sapiens
gugugcacaaucuggcaugugc

SEQ ID NO: 69738 - RNA, 22 nt, Homo sapiens
gugugcauaugucuuuauagua

SEQ ID NO: 69739 - RNA, 20 nt, Homo sapiens
gugugcauuucagauuuugg

SEQ ID NO: 69740 - RNA, 22 nt, Homo sapiens
gugugcucaucacaugcaauag

SEQ ID NO: 69741 - RNA, 21 nt, Homo sapiens
gugugcuugagugaugggauu

SEQ ID NO: 69742 - RNA, 22 nt, Homo sapiens
gugugguaggauugguuacuca

SEQ ID NO: 69743 - RNA, 23 nt, Homo sapiens
gugugguaggcuauaccaucuag

SEQ ID NO: 69744 - RNA, 22 nt, Homo sapiens
gugugguauuauaacuagguau

SEQ ID NO: 69745 - RNA, 22 nt, Homo sapiens
guguguaaauggcagugagcuc

SEQ ID NO: 69746 - RNA, 22 nt, Homo sapiens
guguugcacauucuguggaugu

SEQ ID NO: 69747 - RNA, 22 nt, Homo sapiens
guguuugauugcaaauaaucua

SEQ ID NO: 69748 - RNA, 20 nt, Homo sapiens
guuaaggcagcauuacucuu

SEQ ID NO: 69749 - RNA, 22 nt, Homo sapiens
guuaagggaagccuggguaaga

SEQ ID NO: 69750 - RNA, 22 nt, Homo sapiens
guuagugcuuauuaaauaguau

SEQ ID NO: 69751 - RNA, 22 nt, Homo sapiens
guuauccugucuuuacauacaa

SEQ ID NO: 69752 - RNA, 22 nt, Homo sapiens
guuauguaucuugauugggugg

SEQ ID NO: 69753 - RNA, 22 nt, Homo sapiens
guucaagcaauucugcugccuc

SEQ ID NO: 69754 - RNA, 22 nt, Homo sapiens
guucaagugauucuacugccuc

SEQ ID NO: 69755 - RNA, 22 nt, Homo sapiens
guucacaguucagccuguaaca

SEQ ID NO: 69756 - RNA, 22 nt, Homo sapiens
guucagucacgugcccaaguuc

SEQ ID NO: 69757 - RNA, 22 nt, Homo sapiens
guucaguuuuaaagggaaauug

SEQ ID NO: 69758 - RNA, 22 nt, Homo sapiens
guucaucagggacacugguuug

SEQ ID NO: 69759 - RNA, 22 nt, Homo sapiens
guucaucagggauauuggcuua

SEQ ID NO: 69760 - RNA, 20 nt, Homo sapiens
guucauguaauuaguucagg

SEQ ID NO: 69761 - RNA, 22 nt, Homo sapiens
guucucacuggacugugaaaau

SEQ ID NO: 69762 - RNA, 22 nt, Homo sapiens
guucuggagauaaagccaaggu

SEQ ID NO: 69763 - RNA, 22 nt, Homo sapiens
guugaaauccuaacccccuagu

SEQ ID NO: 69764 - RNA, 22 nt, Homo sapiens
guugaacaauagauucauauca

SEQ ID NO: 69765 - RNA, 17 nt, Homo sapiens
guugaguuugagucaag

SEQ ID NO: 69766 - RNA, 22 nt, Homo sapiens
guugcaauugauguaugucuga

SEQ ID NO: 69767 - RNA, 22 nt, Homo sapiens
guugcacagucuuuccuggacu

SEQ ID NO: 69768 - RNA, 22 nt, Homo sapiens
guugcaugucugggaggccagc

SEQ ID NO: 69769 - RNA, 22 nt, Homo sapiens
guuggaauguauugcuacuucu

SEQ ID NO: 69770 - RNA, 22 nt, Homo sapiens
guuggaguuaagcaguaaugaa

SEQ ID NO: 69771 - RNA, 22 nt, Homo sapiens
guuggcuuuuuaaggaaauugc

SEQ ID NO: 69772 - RNA, 22 nt, Homo sapiens
guuggucaaugugauuaggcca

SEQ ID NO: 69773 - RNA, 22 nt, Homo sapiens
guuggucucguauaaaucaagg

SEQ ID NO: 69774 - RNA, 22 nt, Homo sapiens
guuguggagucuucuguucugg

SEQ ID NO: 69775 - RNA, 22 nt, Homo sapiens
guuuggauauuaggcaagagua

SEQ ID NO: 69776 - RNA, 22 nt, Homo sapiens
guuuggauuuucuaauuucugu

SEQ ID NO: 69777 - RNA, 22 nt, Homo sapiens
guuuggcucuuguuucugucaa

SEQ ID NO: 69778 - RNA, 17 nt, Homo sapiens
guuuggguacuggguaa

SEQ ID NO: 69779 - RNA, 15 nt, Homo sapiens
guuuuuggauacaau

SEQ ID NO: 69780 - RNA, 22 nt, Homo sapiens
uaaacacucacuucauagccau

SEQ ID NO: 69781 - RNA, 22 nt, Homo sapiens
uaaaccacguuuacauuugaga

SEQ ID NO: 69782 - RNA, 22 nt, Homo sapiens
uaaagauaaggcucgcuuggau

SEQ ID NO: 69783 - RNA, 22 nt, Homo sapiens
uaaagaugcugggaaggcuagg

SEQ ID NO: 69784 - RNA, 22 nt, Homo sapiens
uaaagcacuuuuuucugcaugg

SEQ ID NO: 69785 - RNA, 22 nt, Homo sapiens
ucacagucugcgugaugagaca

SEQ ID NO: 69786 - RNA, 22 nt, Homo sapiens
ucacaguucagcauggcugagg

SEQ ID NO: 69787 - RNA, 22 nt, Homo sapiens
ucacaugaagauuuuaguauac

SEQ ID NO: 69788 - RNA, 22 nt, Homo sapiens
ucacauggaggugauaguugaa

SEQ ID NO: 69789 - RNA, 22 nt, Homo sapiens
ucacaugucagccguggggaag

SEQ ID NO: 69790 - RNA, 22 nt, Homo sapiens
ucacauguguaaauugguguaa

SEQ ID NO: 69791 - RNA, 22 nt, Homo sapiens
ucaccaccugcugauuguagag

SEQ ID NO: 69792 - RNA, 16 nt, Homo sapiens
ucaccccuagagaucc

SEQ ID NO: 69793 - RNA, 22 nt, Homo sapiens
ucacccugacaugcggccgaac

SEQ ID NO: 69794 - RNA, 22 nt, Homo sapiens
ucaccuggagacaugaagacug

SEQ ID NO: 69795 - RNA, 22 nt, Homo sapiens
ucacgguggaaucccagauccc

SEQ ID NO: 69796 - RNA, 19 nt, Homo sapiens
ucacgugcagcagccacac

SEQ ID NO: 69797 - RNA, 22 nt, Homo sapiens
ucacuaaagaaaauggcaugga

SEQ ID NO: 69798 - RNA, 22 nt, Homo sapiens
ucacuagggaucacuuuacccg

SEQ ID NO: 69799 - RNA, 20 nt, Homo sapiens
ucacuauggagcucuuucuu

SEQ ID NO: 69800 - RNA, 22 nt, Homo sapiens
ucacucagaccuggugauaugc

SEQ ID NO: 69801 - RNA, 22 nt, Homo sapiens
ucacugaaaccacugccuccug

SEQ ID NO: 69802 - RNA, 22 nt, Homo sapiens
ucacugaaaccgccuccaccuc

SEQ ID NO: 69803 - RNA, 22 nt, Homo sapiens
ucacugaaaccuccgccuucug

SEQ ID NO: 69804 - RNA, 22 nt, Homo sapiens
ucacugaaacuguccuggguua

SEQ ID NO: 69805 - RNA, 22 nt, Homo sapiens
ucacugagaaugauguuucuga

SEQ ID NO: 69806 - RNA, 21 nt, Homo sapiens
ucacugagcaucaugguuuca

SEQ ID NO: 69807 - RNA, 22 nt, Homo sapiens
ucacugagcuagaucacuugac

SEQ ID NO: 69808 - RNA, 20 nt, Homo sapiens
ucacugaguaucuacgauua

SEQ ID NO: 69809 - RNA, 22 nt, Homo sapiens
ucacugcacuccagccuuuaug

SEQ ID NO: 69810 - RNA, 22 nt, Homo sapiens
ucacugcacuucaggcuuucuc

SEQ ID NO: 69811 - RNA, 22 nt, Homo sapiens
ucacugcgaccuccaccucccg

SEQ ID NO: 69812 - RNA, 22 nt, Homo sapiens
ucacugcgaccuccaccuccug

SEQ ID NO: 69813 - RNA, 22 nt, Homo sapiens
ucacuggacagaaauaaaggug

SEQ ID NO: 69814 - RNA, 22 nt, Homo sapiens
ucacuggcaaauauauccguug

SEQ ID NO: 69815 - RNA, 20 nt, Homo sapiens
ucacuggguucuugaagucu

SEQ ID NO: 69816 - RNA, 22 nt, Homo sapiens
ucacugugagaguuuauccugu

SEQ ID NO: 69817 - RNA, 22 nt, Homo sapiens
ucacugugcaugaaggaugcug

SEQ ID NO: 69818 - RNA, 22 nt, Homo sapiens
ucacugugguuugggaaagugc

SEQ ID NO: 69819 - RNA, 22 nt, Homo sapiens
ucacuguguauguauaugcagg

SEQ ID NO: 69820 - RNA, 22 nt, Homo sapiens
ucacuguugaugggcaugcagg

SEQ ID NO: 69821 - RNA, 22 nt, Homo sapiens
ucagaaccuccuagcaguguuc

SEQ ID NO: 69822 - RNA, 22 nt, Homo sapiens
ucagaaccucugauuuauacuu

SEQ ID NO: 69823 - RNA, 22 nt, Homo sapiens
ucagaacugaacaaaccagucu

SEQ ID NO: 69824 - RNA, 22 nt, Homo sapiens
ucagacacugagcaaacgacua

SEQ ID NO: 69825 - RNA, 22 nt, Homo sapiens
ucagaguagcugucugaggugc

SEQ ID NO: 69826 - RNA, 22 nt, Homo sapiens
ucagaguaguuccuggcagaaa

SEQ ID NO: 69827 - RNA, 22 nt, Homo sapiens
ucagaguggagucugcagccuu

SEQ ID NO: 69828 - RNA, 22 nt, Homo sapiens
ucagaguggccucucuugaaga

SEQ ID NO: 69829 - RNA, 22 nt, Homo sapiens
ucagaucauuaagguagguuua

SEQ ID NO: 69830 - RNA, 22 nt, Homo sapiens
ucagaugauuccguugacgaga

SEQ ID NO: 69831 - RNA, 22 nt, Homo sapiens
ucagauguuugagaaguauacu

SEQ ID NO: 69832 - RNA, 22 nt, Homo sapiens
ucagcaccauguaacaauugau

SEQ ID NO: 69833 - RNA, 22 nt, Homo sapiens
ucagcagucacuccuaugacaa

SEQ ID NO: 69834 - RNA, 22 nt, Homo sapiens
ucagcagugagagaccucaccc

SEQ ID NO: 69835 - RNA, 22 nt, Homo sapiens
ucagcaucacgugggcucccgu

SEQ ID NO: 69836 - RNA, 16 nt, Homo sapiens
ucagcgagggagccag

SEQ ID NO: 69837 - RNA, 21 nt, Homo sapiens
ucagcucaucacugccuggag

SEQ ID NO: 69838 - RNA, 22 nt, Homo sapiens
ucaggcacuaguaagaaaaagg

SEQ ID NO: 69839 - RNA, 22 nt, Homo sapiens
ucaggcacucagcuuagagucu

SEQ ID NO: 69840 - RNA, 21 nt, Homo sapiens
ucaggcuuuuugagugccaau

SEQ ID NO: 69841 - RNA, 22 nt, Homo sapiens
ucagguaaucuauuugucuuuu

SEQ ID NO: 69842 - RNA, 23 nt, Homo sapiens
ucagguaguuucagaggaccuug

SEQ ID NO: 69843 - RNA, 22 nt, Homo sapiens
ucagguaucuucauagcaaugc

SEQ ID NO: 69844 - RNA, 22 nt, Homo sapiens
ucagguccuuacugugcucccu

SEQ ID NO: 69845 - RNA, 22 nt, Homo sapiens
ucaggugcagagaagaaauggg

SEQ ID NO: 69846 - RNA, 22 nt, Homo sapiens
ucaggugcaguggcucaugcuu

SEQ ID NO: 69847 - RNA, 23 nt, Homo sapiens
ucaguacucuauaagugccagcu

SEQ ID NO: 69848 - RNA, 19 nt, Homo sapiens
ucaguagugcacauaagcc

SEQ ID NO: 69849 - RNA, 22 nt, Homo sapiens
ucagucauguuuaccagacgua

SEQ ID NO: 69850 - RNA, 22 nt, Homo sapiens
ucagucauucaauuguugaaug

SEQ ID NO: 69851 - RNA, 23 nt, Homo sapiens
ugacuggagacuguugauccuuu

SEQ ID NO: 69852 - RNA, 23 nt, Homo sapiens
ugacuuaggccucaacuaugacu

SEQ ID NO: 69853 - RNA, 22 nt, Homo sapiens
ugacuugagcuggagccugccu

SEQ ID NO: 69854 - RNA, 22 nt, Homo sapiens
ugacuugaguaacuggcucagg

SEQ ID NO: 69855 - RNA, 22 nt, Homo sapiens
ugacuugauacauguuuuugaa

SEQ ID NO: 69856 - RNA, 22 nt, Homo sapiens
ugacuugaucauuacacauucu

SEQ ID NO: 69857 - RNA, 22 nt, Homo sapiens
ugacuugauccauggggcucca

SEQ ID NO: 69858 - RNA, 22 nt, Homo sapiens
ugagaacagcagcuugggacac

SEQ ID NO: 69859 - RNA, 22 nt, Homo sapiens
ugagaacaugugauauuuggug

SEQ ID NO: 69860 - RNA, 20 nt, Homo sapiens
ugagaacauguggcauuugg

SEQ ID NO: 69861 - RNA, 19 nt, Homo sapiens
ugagaacaugugguauuug

SEQ ID NO: 69862 - RNA, 22 nt, Homo sapiens
ugagaacucaugaaucuuucca

SEQ ID NO: 69863 - RNA, 22 nt, Homo sapiens
ugagaacucaugggucugcugg

SEQ ID NO: 69864 - RNA, 22 nt, Homo sapiens
ugagaacuuugucuuuuacucu

SEQ ID NO: 69865 - RNA, 22 nt, Homo sapiens
ugagaagcauaccagugucugu

SEQ ID NO: 69866 - RNA, 22 nt, Homo sapiens
ugagaaugacugggcaugcugc

SEQ ID NO: 69867 - RNA, 22 nt, Homo sapiens
ugagaaugaugauugguaaacc

SEQ ID NO: 69868 - RNA, 22 nt, Homo sapiens
ugagaaugcagaaucucgugca

SEQ ID NO: 69869 - RNA, 22 nt, Homo sapiens
ugagacaaaguuguuggauguu

SEQ ID NO: 69870 - RNA, 22 nt, Homo sapiens
ugagacacuucccagaucccuu

SEQ ID NO: 69871 - RNA, 22 nt, Homo sapiens
ugagacaugugaauauuuguac

SEQ ID NO: 69872 - RNA, 23 nt, Homo sapiens
ugagacauuggaaaguuaggcag

SEQ ID NO: 69873 - RNA, 22 nt, Homo sapiens
ugagacggagucucacucuguu

SEQ ID NO: 69874 - RNA, 22 nt, Homo sapiens
ugagacggagucucgcucucua

SEQ ID NO: 69875 - RNA, 22 nt, Homo sapiens
ugagacggagucucgcuguguc

SEQ ID NO: 69876 - RNA, 22 nt, Homo sapiens
ugagacggagucuggcacuguc

SEQ ID NO: 69877 - RNA, 22 nt, Homo sapiens
ugagacggagucuugcccuguc

SEQ ID NO: 69878 - RNA, 22 nt, Homo sapiens
ucauugcacucccagacacccu

SEQ ID NO: 69879 - RNA, 22 nt, Homo sapiens
ucauugguagcucauggaaccg

SEQ ID NO: 69880 - RNA, 18 nt, Homo sapiens
ucauuggugagcaccucc

SEQ ID NO: 69881 - RNA, 21 nt, Homo sapiens
ucauugguuggcugcccugua

SEQ ID NO: 69882 - RNA, 22 nt, Homo sapiens
ucauuguccaacuucuuucagu

SEQ ID NO: 69883 - RNA, 22 nt, Homo sapiens
uccaauguaaucaucauugaau

SEQ ID NO: 69884 - RNA, 22 nt, Homo sapiens
uccacaauggagaagaguauga

SEQ ID NO: 69885 - RNA, 22 nt, Homo sapiens
uccacaauggcugaacuagauu

SEQ ID NO: 69886 - RNA, 22 nt, Homo sapiens
uccacaguaaggacccugccuu

SEQ ID NO: 69887 - RNA, 22 nt, Homo sapiens
uccacaguggugaggugcagca

SEQ ID NO: 69888 - RNA, 20 nt, Homo sapiens
uccacugagcgucacggcag

SEQ ID NO: 69889 - RNA, 22 nt, Homo sapiens
uccaguguuccucagucacccc

SEQ ID NO: 69890 - RNA, 22 nt, Homo sapiens
uccaguuuucuuuccuagggcu

SEQ ID NO: 69891 - RNA, 22 nt, Homo sapiens
uccauaguacuagaaacugacc

SEQ ID NO: 69892 - RNA, 22 nt, Homo sapiens
uccauagugagcagucaaugua

SEQ ID NO: 69893 - RNA, 22 nt, Homo sapiens
uccaugagaauaguuaggcucu

SEQ ID NO: 69894 - RNA, 22 nt, Homo sapiens
uccaugaguccauuagaaaaaa

SEQ ID NO: 69895 - RNA, 22 nt, Homo sapiens
uccauggagacacauuuuauau

SEQ ID NO: 69896 - RNA, 22 nt, Homo sapiens
uccauugucuagauguaacaca

SEQ ID NO: 69897 - RNA, 22 nt, Homo sapiens
uccauuuguucagcuucaggaa

SEQ ID NO: 69898 - RNA, 22 nt, Homo sapiens
ucccaagaugagaugggggcug

SEQ ID NO: 69899 - RNA, 22 nt, Homo sapiens
ucccaguauucauuuacagaag

SEQ ID NO: 69900 - RNA, 22 nt, Homo sapiens
ucccauugucucugaccuugcc

SEQ ID NO: 69901 - RNA, 22 nt, Homo sapiens
uccccgaggcuggagugcagug

SEQ ID NO: 69902 - RNA, 22 nt, Homo sapiens
uccccggaugacggccgcuuca

SEQ ID NO: 69903 - RNA, 22 nt, Homo sapiens
uccccgucacacgcaggcuuac

SEQ ID NO: 69904 - RNA, 22 nt, Homo sapiens
ucccgaggacaucugggggcaa

SEQ ID NO: 69905 - RNA, 20 nt, Homo sapiens
ucccuaagagccuuuccuuc

SEQ ID NO: 69906 - RNA, 22 nt, Homo sapiens
ucccuagacuccugccuuucag

SEQ ID NO: 69907 - RNA, 22 nt, Homo sapiens
ucccugaaaaauuggcuuaaca

SEQ ID NO: 69908 - RNA, 22 nt, Homo sapiens
ucccugaaaauuagcauuuuaa

SEQ ID NO: 69909 - RNA, 22 nt, Homo sapiens
ucccugaaagcugagauuggaa

SEQ ID NO: 69910 - RNA, 22 nt, Homo sapiens
ucccugacagucacagagcuac

SEQ ID NO: 69911 - RNA, 22 nt, Homo sapiens
ucccugaguaucuaauguguuu

SEQ ID NO: 69912 - RNA, 22 nt, Homo sapiens
ucccugagugauugaaaauaaa

SEQ ID NO: 69913 - RNA, 22 nt, Homo sapiens
ucccuggagcaagagaagaagg

SEQ ID NO: 69914 - RNA, 19 nt, Homo sapiens
ucccuguagaccacagugc

SEQ ID NO: 69915 - RNA, 22 nt, Homo sapiens
ucccuuaaugaugaacaaugag

SEQ ID NO: 69916 - RNA, 18 nt, Homo sapiens
ucccuuuguagaugaccc

SEQ ID NO: 69917 - RNA, 19 nt, Homo sapiens
ucccuuuguauggacauac

SEQ ID NO: 69918 - RNA, 22 nt, Homo sapiens
uccgaguguuagagagcugugu

SEQ ID NO: 69919 - RNA, 22 nt, Homo sapiens
uccucaguggauuggauggugc

SEQ ID NO: 69920 - RNA, 22 nt, Homo sapiens
uccucugaacuccagacccaua

SEQ ID NO: 69921 - RNA, 22 nt, Homo sapiens
uccugagagcagacccucuaua

SEQ ID NO: 69922 - RNA, 22 nt, Homo sapiens
uccugauacgguugcaguucuc

SEQ ID NO: 69923 - RNA, 22 nt, Homo sapiens
uccugcauucauccugguguug

SEQ ID NO: 69924 - RNA, 22 nt, Homo sapiens
uccugcauucugacuugcuuuc

SEQ ID NO: 69925 - RNA, 22 nt, Homo sapiens
uccuguaaucccagcuaccaga

SEQ ID NO: 69926 - RNA, 22 nt, Homo sapiens
uccuucacucuacaucuuuguu

SEQ ID NO: 69927 - RNA, 22 nt, Homo sapiens
uccuucaguccaguggguuuug

SEQ ID NO: 69928 - RNA, 22 nt, Homo sapiens
uccuucaugcaucaauguaucc

SEQ ID NO: 69929 - RNA, 22 nt, Homo sapiens
uccuugaaacaggaagaauuca

SEQ ID NO: 69930 - RNA, 22 nt, Homo sapiens
uccuugagucuuugcucagaug

SEQ ID NO: 69931 - RNA, 22 nt, Homo sapiens
uccuuggucauggaagagacag

SEQ ID NO: 69932 - RNA, 22 nt, Homo sapiens
uccuugguugauccugugcaga

SEQ ID NO: 69933 - RNA, 22 nt, Homo sapiens
ucgcgccauucuccugccucag

SEQ ID NO: 69934 - RNA, 22 nt, Homo sapiens
ucguucuugucaguuuauaaag

SEQ ID NO: 69935 - RNA, 22 nt, Homo sapiens
ucuaaaacuagauugugaugau

SEQ ID NO: 69936 - RNA, 19 nt, Homo sapiens
ucuaaaucucuugauagac

SEQ ID NO: 69937 - RNA, 22 nt, Homo sapiens
ucuaaggcaccuagagucauca

SEQ ID NO: 69938 - RNA, 22 nt, Homo sapiens
ucuaaguaguagcuggucagaa

SEQ ID NO: 69939 - RNA, 17 nt, Homo sapiens
ucuaauaauaugcauuu

SEQ ID NO: 69940 - RNA, 22 nt, Homo sapiens
ucuaaugcucugagaacagugc

SEQ ID NO: 69941 - RNA, 18 nt, Homo sapiens
ucuagacacugugucuau

SEQ ID NO: 69942 - RNA, 22 nt, Homo sapiens
ucuagaugaaguauaaaguagu

SEQ ID NO: 69943 - RNA, 22 nt, Homo sapiens
ucuaguaaugagaggcaggaga

SEQ ID NO: 69944 - RNA, 22 nt, Homo sapiens
ucuaucacagccccacacucuc

SEQ ID NO: 69945 - RNA, 22 nt, Homo sapiens
ucucaagaugguagaugggaau

SEQ ID NO: 69946 - RNA, 22 nt, Homo sapiens
ucucaaguggucgcaguuagau

SEQ ID NO: 69947 - RNA, 22 nt, Homo sapiens
ugaguauagaucaguucaagug

SEQ ID NO: 69948 - RNA, 19 nt, Homo sapiens
ugaguaucuuuacacaucu

SEQ ID NO: 69949 - RNA, 22 nt, Homo sapiens
ugagucagucucacucugcugc

SEQ ID NO: 69950 - RNA, 22 nt, Homo sapiens
ugagucauguaauaaugcugcu

SEQ ID NO: 69951 - RNA, 22 nt, Homo sapiens
ugagugaaagaagcacuaagga

SEQ ID NO: 69952 - RNA, 22 nt, Homo sapiens
ugagugagguucuacucuguga

SEQ ID NO: 69953 - RNA, 22 nt, Homo sapiens
ugagugccuggagggcagggac

SEQ ID NO: 69954 - RNA, 22 nt, Homo sapiens
ugaguuccuuucccaguccagu

SEQ ID NO: 69955 - RNA, 22 nt, Homo sapiens
ugauaacauugggggaagcuga

SEQ ID NO: 69956 - RNA, 22 nt, Homo sapiens
ugauaacugaucuggauuugua

SEQ ID NO: 69957 - RNA, 22 nt, Homo sapiens
ugauaguugucagugggggacc

SEQ ID NO: 69958 - RNA, 22 nt, Homo sapiens
ugauauauugaaugaugaaaca

SEQ ID NO: 69959 - RNA, 18 nt, Homo sapiens
ugauaucaaugauagcca

SEQ ID NO: 69960 - RNA, 18 nt, Homo sapiens
ugauaucaucacaauuga

SEQ ID NO: 69961 - RNA, 23 nt, Homo sapiens
ugauaugccuaggaguauauuuu

SEQ ID NO: 69962 - RNA, 22 nt, Homo sapiens
ugauauguaacuacuccuuaua

SEQ ID NO: 69963 - RNA, 22 nt, Homo sapiens
ugauaugucacuugaucauggu

SEQ ID NO: 69964 - RNA, 22 nt, Homo sapiens
ugauaugucccucgacaucagg

SEQ ID NO: 69965 - RNA, 22 nt, Homo sapiens
ugauauguuagaaucuugcaag

SEQ ID NO: 69966 - RNA, 22 nt, Homo sapiens
ugauauuuuugauccuuaaguu

SEQ ID NO: 69967 - RNA, 22 nt, Homo sapiens
ugauccccucacauuauuauau

SEQ ID NO: 69968 - RNA, 22 nt, Homo sapiens
ugaugacacugauuucuucaau

SEQ ID NO: 69969 - RNA, 20 nt, Homo sapiens
ugaugcaaaucuuuaaaagu

SEQ ID NO: 69970 - RNA, 21 nt, Homo sapiens
ugaugcaauccgcuaggucgc

SEQ ID NO: 69971 - RNA, 20 nt, Homo sapiens
ucuggccccucuaaaucuca

SEQ ID NO: 69972 - RNA, 22 nt, Homo sapiens
ucuggccccucucaaaucucau

SEQ ID NO: 69973 - RNA, 22 nt, Homo sapiens
ucuggcuccaaagucuauuuuu

SEQ ID NO: 69974 - RNA, 23 nt, Homo sapiens
ucuggcuuugggaugcucaaggg

SEQ ID NO: 69975 - RNA, 22 nt, Homo sapiens
ucugguguuauucauguaguuu

SEQ ID NO: 69976 - RNA, 19 nt, Homo sapiens
ucuguaguuagggcuacag

SEQ ID NO: 69977 - RNA, 22 nt, Homo sapiens
ucugucacugaaucccugucac

SEQ ID NO: 69978 - RNA, 22 nt, Homo sapiens
ucugucacugguggacgaucac

SEQ ID NO: 69979 - RNA, 22 nt, Homo sapiens
ucugucuugugguuugagugcc

SEQ ID NO: 69980 - RNA, 22 nt, Homo sapiens
ucugugaaugaacacuugaaaa

SEQ ID NO: 69981 - RNA, 22 nt, Homo sapiens
ucuguguugaugcucauuaauu

SEQ ID NO: 69982 - RNA, 22 nt, Homo sapiens
ucuguugguucuuugaggagga

SEQ ID NO: 69983 - RNA, 22 nt, Homo sapiens
ucuguuguuaucauaauauuga

SEQ ID NO: 69984 - RNA, 22 nt, Homo sapiens
ucuguuguuguuuuaagagaca

SEQ ID NO: 69985 - RNA, 22 nt, Homo sapiens
ucuuaguuggaaugggauaagg

SEQ ID NO: 69986 - RNA, 22 nt, Homo sapiens
ucuuaguuuagauuagcaauuc

SEQ ID NO: 69987 - RNA, 22 nt, Homo sapiens
ucuucaugcuugaaauaauagc

SEQ ID NO: 69988 - RNA, 22 nt, Homo sapiens
ucuucuagcggaacccucuugu

SEQ ID NO: 69989 - RNA, 20 nt, Homo sapiens
ucuugaacuuagucaacagg

SEQ ID NO: 69990 - RNA, 22 nt, Homo sapiens
ucuugaacuucauaggucuaga

SEQ ID NO: 69991 - RNA, 22 nt, Homo sapiens
ucuugcaauuuccuuaguggug

SEQ ID NO: 69992 - RNA, 22 nt, Homo sapiens
ucuugcauuuuuaaauagugcu

SEQ ID NO: 69993 - RNA, 22 nt, Homo sapiens
ucuuggcaaagaauuuuuggcu

SEQ ID NO: 69994 - RNA, 22 nt, Homo sapiens
ucuuggguggauucauucuuuc

SEQ ID NO: 69995 - RNA, 22 nt, Homo sapiens
ucuuggguuugccuugcugcug

SEQ ID NO: 69996 - RNA, 22 nt, Homo sapiens
ucuuggguuuguccuucuccua

SEQ ID NO: 69997 - RNA, 22 nt, Homo sapiens
ucuugguuaggggaaauaggca

SEQ ID NO: 69998 - RNA, 20 nt, Homo sapiens
ucuugguuggaggucuuuua

SEQ ID NO: 69999 - RNA, 22 nt, Homo sapiens
ucuugguuuauugugguaugaa

SEQ ID NO: 70000 - RNA, 19 nt, Homo sapiens
ucuuugaggcaucgcccuc

SEQ ID NO: 70001 - RNA, 22 nt, Homo sapiens
ucuuugagugcccugagucccu

SEQ ID NO: 70002 - RNA, 22 nt, Homo sapiens
ucuuuggaggcgaucuguuuga

SEQ ID NO: 70003 - RNA, 18 nt, Homo sapiens
ucuuuggcugaacuguag

SEQ ID NO: 70004 - RNA, 22 nt, Homo sapiens
ucuuugggauauucugaaaggg

SEQ ID NO: 70005 - RNA, 22 nt, Homo sapiens
ucuuuggguagauauguagcug

SEQ ID NO: 70006 - RNA, 22 nt, Homo sapiens
ucuuugguaauggaugucugau

SEQ ID NO: 70007 - RNA, 19 nt, Homo sapiens
ucuuugguacgugcuuuga

SEQ ID NO: 70008 - RNA, 22 nt, Homo sapiens
ucuuugguauuuguggggaauu

SEQ ID NO: 70009 - RNA, 22 nt, Homo sapiens
ucuuuggucaucaugggaagca

SEQ ID NO: 70010 - RNA, 22 nt, Homo sapiens
ucuuugguuagguuuaguugau

SEQ ID NO: 70011 - RNA, 22 nt, Homo sapiens
ucuuuguguucaggagccacgu

SEQ ID NO: 70012 - RNA, 22 nt, Homo sapiens
ucuuuguucaggagccaacucc

SEQ ID NO: 70013 - RNA, 22 nt, Homo sapiens
ucuuuguuggaguccaaggaua

SEQ ID NO: 70014 - RNA, 22 nt, Homo sapiens
ucuuuugggccucuugucagac

SEQ ID NO: 70015 - RNA, 22 nt, Homo sapiens
ucuuuuguaaaaugaggaggug

SEQ ID NO: 70016 - RNA, 22 nt, Homo sapiens
ugaaacacacauugcccuuuau

SEQ ID NO: 70017 - RNA, 22 nt, Homo sapiens
ugaaacauacacucugaugggg

SEQ ID NO: 70018 - RNA, 22 nt, Homo sapiens
ugaaagacugaagaauaggcau

SEQ ID NO: 70019 - RNA, 22 nt, Homo sapiens
ugaaagcuacagucuccuagga

SEQ ID NO: 70020 - RNA, 22 nt, Homo sapiens
ugaaaucauguaguuauugcaa

SEQ ID NO: 70021 - RNA, 22 nt, Homo sapiens
ugaaaucuuugaugguggcauu

SEQ ID NO: 70022 - RNA, 22 nt, Homo sapiens
ugaaaugcagaacuuuaggucu

SEQ ID NO: 70023 - RNA, 22 nt, Homo sapiens
ugaaauggaagaagucccuuuu

SEQ ID NO: 70024 - RNA, 22 nt, Homo sapiens
ugaaauggugcggucugcagca

SEQ ID NO: 70025 - RNA, 22 nt, Homo sapiens
ugaaaugguuaugugaggagau

SEQ ID NO: 70026 - RNA, 22 nt, Homo sapiens
ugaaauuuuuuauucguuggcu

SEQ ID NO: 70027 - RNA, 22 nt, Homo sapiens
ugaacacagccugccucugcca

SEQ ID NO: 70028 - RNA, 22 nt, Homo sapiens
ugaacagcacguuuauucagaa

SEQ ID NO: 70029 - RNA, 22 nt, Homo sapiens
ugaacucagcauccagggccaa

SEQ ID NO: 70030 - RNA, 22 nt, Homo sapiens
ugaacucauccuuucuuauggc

SEQ ID NO: 70031 - RNA, 22 nt, Homo sapiens
ugaacuguugggggaaauucag

SEQ ID NO: 70032 - RNA, 22 nt, Homo sapiens
ugaagacucaauuauuaugaac

SEQ ID NO: 70033 - RNA, 22 nt, Homo sapiens
ugaagaucauacugguggaggg

SEQ ID NO: 70034 - RNA, 21 nt, Homo sapiens
ugaaguagcauaggaugucaa

SEQ ID NO: 70035 - RNA, 22 nt, Homo sapiens
ugaaguaggcauaaguuaagcu

SEQ ID NO: 70036 - RNA, 22 nt, Homo sapiens
ugaagugaagacucacagaagg

SEQ ID NO: 70037 - RNA, 21 nt, Homo sapiens
ugaaguguaaccgugcagggc

SEQ ID NO: 70038 - RNA, 22 nt, Homo sapiens
ugaauacuucaaaaaaauagcu

SEQ ID NO: 70039 - RNA, 22 nt, Homo sapiens
ugaauacuucguucaaagauaa

SEQ ID NO: 70040 - RNA, 22 nt, Homo sapiens
ugaauagaaguggcaggaguag

SEQ ID NO: 70041 - RNA, 22 nt, Homo sapiens
ugaauagacagucacugccucc

SEQ ID NO: 70042 - RNA, 22 nt, Homo sapiens
ugaauagagcugcaguggacau

SEQ ID NO: 70043 - RNA, 22 nt, Homo sapiens
ugaauagugucacaauaaacau

SEQ ID NO: 70044 - RNA, 22 nt, Homo sapiens
ugaauauuugcuacucacucuu

SEQ ID NO: 70045 - RNA, 22 nt, Homo sapiens
ugaaucauuucuugucuucagu

SEQ ID NO: 70046 - RNA, 22 nt, Homo sapiens
uggaaucuacuaaagcaaaauc

SEQ ID NO: 70047 - RNA, 21 nt, Homo sapiens
uggaaucuauuauuccaguuu

SEQ ID NO: 70048 - RNA, 22 nt, Homo sapiens
uggaaucuuaggugaaggcuuu

SEQ ID NO: 70049 - RNA, 19 nt, Homo sapiens
uggaauggauuuaaaugug

SEQ ID NO: 70050 - RNA, 22 nt, Homo sapiens
uggaaugguaucuuguuggggu

SEQ ID NO: 70051 - RNA, 22 nt, Homo sapiens
uggaaugguuggugugauuuua

SEQ ID NO: 70052 - RNA, 22 nt, Homo sapiens
uggaauguauaucguuuuuugu

SEQ ID NO: 70053 - RNA, 17 nt, Homo sapiens
uggaaugucuaagccug

SEQ ID NO: 70054 - RNA, 22 nt, Homo sapiens
uagguaguuagcauacuacaca

SEQ ID NO: 70055 - RNA, 22 nt, Homo sapiens
uagguaguugugggcuugaaug

SEQ ID NO: 70056 - RNA, 22 nt, Homo sapiens
uaggugauccauuuguauuuua

SEQ ID NO: 70057 - RNA, 22 nt, Homo sapiens
uagguuaucaaauugguaggca

SEQ ID NO: 70058 - RNA, 22 nt, Homo sapiens
uagguuguccaucucuagaagc

SEQ ID NO: 70059 - RNA, 22 nt, Homo sapiens
uaguaaacaccucagguaauuc

SEQ ID NO: 70060 - RNA, 22 nt, Homo sapiens
uaguaaacauaguucuuuugcu

SEQ ID NO: 70061 - RNA, 22 nt, Homo sapiens
uaguacccuugaagcagacaua

SEQ ID NO: 70062 - RNA, 22 nt, Homo sapiens
uaguagcaccucucaugagcuu

SEQ ID NO: 70063 - RNA, 22 nt, Homo sapiens
uaguagugucccugacuaucac

SEQ ID NO: 70064 - RNA, 22 nt, Homo sapiens
uagucaaaucugaaggaaauuu

SEQ ID NO: 70065 - RNA, 22 nt, Homo sapiens
uagucccauaugauuuagugaa

SEQ ID NO: 70066 - RNA, 22 nt, Homo sapiens
uagugcacuacuugugggaaug

SEQ ID NO: 70067 - RNA, 22 nt, Homo sapiens
uagugcauguugaguucccgac

SEQ ID NO: 70068 - RNA, 22 nt, Homo sapiens
uagugcugugauuaacauaaug

SEQ ID NO: 70069 - RNA, 20 nt, Homo sapiens
uaguggcaugcaccuguagc

SEQ ID NO: 70070 - RNA, 22 nt, Homo sapiens
uaguugcauuggcugcuaugcu

SEQ ID NO: 70071 - RNA, 20 nt, Homo sapiens
uaguuggugauacagugcau

SEQ ID NO: 70072 - RNA, 22 nt, Homo sapiens
uauaacaaugcaagaauggccu

SEQ ID NO: 70073 - RNA, 22 nt, Homo sapiens
uauaaccauuucuucucucuuc

SEQ ID NO: 70074 - RNA, 23 nt, Homo sapiens
uauaacuuuuaauuuacuggccu

SEQ ID NO: 70075 - RNA, 22 nt, Homo sapiens
uauacagcaaguuacugugcug

SEQ ID NO: 70076 - RNA, 22 nt, Homo sapiens
uauacaguaggcacucaguggc

SEQ ID NO: 70077 - RNA, 22 nt, Homo sapiens
uauacaugugccauguuggugu

SEQ ID NO: 70078 - RNA, 22 nt, Homo sapiens
uauacaugugggcaucaggaga

SEQ ID NO: 70079 - RNA, 22 nt, Homo sapiens
uauagcacaucuguguguacau

SEQ ID NO: 70080 - RNA, 22 nt, Homo sapiens
uauagcacugaaagaggugauu

SEQ ID NO: 70081 - RNA, 21 nt, Homo sapiens
uauagcagcacgauuuauaau

SEQ ID NO: 70082 - RNA, 22 nt, Homo sapiens
uauagcagugaguauugacuaa

SEQ ID NO: 70083 - RNA, 22 nt, Homo sapiens
uauagcaguguaagaaucgagu

SEQ ID NO: 70084 - RNA, 22 nt, Homo sapiens
uauagcuagucacugcuggauu

SEQ ID NO: 70085 - RNA, 22 nt, Homo sapiens
uauagcuugaaggaauggucau

SEQ ID NO: 70086 - RNA, 22 nt, Homo sapiens
uauagcuuuuuagggaauuugg

SEQ ID NO: 70087 - RNA, 22 nt, Homo sapiens
uauaguguuuucaaaaguaugu

SEQ ID NO: 70088 - RNA, 22 nt, Homo sapiens
uauauagcuaugucuguccauu

SEQ ID NO: 70089 - RNA, 22 nt, Homo sapiens
uauaucuagagcggaccaggcu

SEQ ID NO: 70090 - RNA, 22 nt, Homo sapiens
uauaugcaacauaguguaugug

SEQ ID NO: 70091 - RNA, 22 nt, Homo sapiens
uauaugcucugggauccugaaa

SEQ ID NO: 70092 - RNA, 22 nt, Homo sapiens
uauauguuuucauaaggcuaga

SEQ ID NO: 70093 - RNA, 19 nt, Homo sapiens
uaucaaguaugcacuguac

SEQ ID NO: 70094 - RNA, 22 nt, Homo sapiens
uaucaaguguuagggagaugug

SEQ ID NO: 70095 - RNA, 22 nt, Homo sapiens
uaucaaguuggaagagaaguaa

SEQ ID NO: 70096 - RNA, 22 nt, Homo sapiens
uaucacaggucaggaaccuugu

SEQ ID NO: 70097 - RNA, 22 nt, Homo sapiens
uaucacaggucaggaaucuugc

SEQ ID NO: 70098 - RNA, 21 nt, Homo sapiens
uaucacaguagaauaggaucu

SEQ ID NO: 70099 - RNA, 20 nt, Homo sapiens
uaucacaguucaggaacucu

SEQ ID NO: 70100 - RNA, 20 nt, Homo sapiens
uaucacauggggagaaaccu

SEQ ID NO: 70101 - RNA, 22 nt, Homo sapiens
uaucaccuugguagucuugggg

SEQ ID NO: 70102 - RNA, 22 nt, Homo sapiens
uaucagaucccaauuucuggcc

SEQ ID NO: 70103 - RNA, 22 nt, Homo sapiens
uaucagauugcugccaucugcu

SEQ ID NO: 70104 - RNA, 22 nt, Homo sapiens
uaucagcagcaggggcugcaga

SEQ ID NO: 70105 - RNA, 22 nt, Homo sapiens
uaucaguauggauucauggauu

SEQ ID NO: 70106 - RNA, 22 nt, Homo sapiens
uaucagugaaucuuauuuugcc

SEQ ID NO: 70107 - RNA, 22 nt, Homo sapiens
uaucaucauuggcaggugagaa

SEQ ID NO: 70108 - RNA, 22 nt, Homo sapiens
uccacugagcuagaccacuugg

SEQ ID NO: 70109 - RNA, 17 nt, Homo sapiens
uccagauuucaauugaa

SEQ ID NO: 70110 - RNA, 22 nt, Homo sapiens
uccagguuuggcuuuauaacuu

SEQ ID NO: 70111 - RNA, 22 nt, Homo sapiens
uccagugcauucagacacuugg

SEQ ID NO: 70112 - RNA, 22 nt, Homo sapiens
uccaguguuauaauaugcgucu

SEQ ID NO: 70113 - RNA, 22 nt, Homo sapiens
uccaguuauccuguggggagga

SEQ ID NO: 70114 - RNA, 22 nt, Homo sapiens
uccaguuuuguuaacauauggu

SEQ ID NO: 70115 - RNA, 22 nt, Homo sapiens
uccauguagaugcuauguuguc

SEQ ID NO: 70116 - RNA, 22 nt, Homo sapiens
uccauguaguugagcggcuuug

SEQ ID NO: 70117 - RNA, 22 nt, Homo sapiens
uccauuuguuguaggguauagu

SEQ ID NO: 70118 - RNA, 23 nt, Homo sapiens
ucccaagauggaccagaccaagg

SEQ ID NO: 70119 - RNA, 22 nt, Homo sapiens
ucccacugucuucucgugcucg

SEQ ID NO: 70120 - RNA, 22 nt, Homo sapiens
ucccagaaacgcauauguucau

SEQ ID NO: 70121 - RNA, 22 nt, Homo sapiens
ucccagucuagagccggauugg

SEQ ID NO: 70122 - RNA, 22 nt, Homo sapiens
ucccaguggucuugaaacaggg

SEQ ID NO: 70123 - RNA, 22 nt, Homo sapiens
ucccaguuuuucugaauaguca

SEQ ID NO: 70124 - RNA, 22 nt, Homo sapiens
ucccauguagcuaggauuacag

SEQ ID NO: 70125 - RNA, 22 nt, Homo sapiens
uccccaguaggcaauuaacacc

SEQ ID NO: 70126 - RNA, 23 nt, Homo sapiens
uccccgggagcaccagcuuguug

SEQ ID NO: 70127 - RNA, 22 nt, Homo sapiens
uccccuuuguaagauggaaacg

SEQ ID NO: 70128 - RNA, 22 nt, Homo sapiens
ucccuacuggggcacugccuag

SEQ ID NO: 70129 - RNA, 22 nt, Homo sapiens
ucccuagagaagugauuuuuga

SEQ ID NO: 70130 - RNA, 22 nt, Homo sapiens
ucccugaacacauguugagaag

SEQ ID NO: 70131 - RNA, 22 nt, Homo sapiens
ucccugaagcugcagcaacaca

SEQ ID NO: 70132 - RNA, 22 nt, Homo sapiens
ucccugagcaaaguuuucugua

SEQ ID NO: 70133 - RNA, 19 nt, Homo sapiens
ucccugagucuuagcuuga

SEQ ID NO: 70134 - RNA, 22 nt, Homo sapiens
ucccuggacagccuugccuggg

SEQ ID NO: 70135 - RNA, 22 nt, Homo sapiens
ucccugguguuaguuuguucuu

SEQ ID NO: 70136 - RNA, 22 nt, Homo sapiens
ucccuguuaggcacagauuuau

SEQ ID NO: 70137 - RNA, 22 nt, Homo sapiens
ucccuuagccaaauccccagcc

SEQ ID NO: 70138 - RNA, 22 nt, Homo sapiens
ucccuugagccuggcuucucac

SEQ ID NO: 70139 - RNA, 22 nt, Homo sapiens
ucccuugguaauucuguuccuu

SEQ ID NO: 70140 - RNA, 22 nt, Homo sapiens
ucccuuuguccaacggauccac

SEQ ID NO: 70141 - RNA, 22 nt, Homo sapiens
uccuacaugcaguacauucaaa

SEQ ID NO: 70142 - RNA, 22 nt, Homo sapiens
uaucugguuuuguuacagguuc

SEQ ID NO: 70143 - RNA, 22 nt, Homo sapiens
uaugaaacucuaagauucacau

SEQ ID NO: 70144 - RNA, 22 nt, Homo sapiens
uaugaaagcuacuucucacaau

SEQ ID NO: 70145 - RNA, 22 nt, Homo sapiens
uaugaaccuguuaucuagguuu

SEQ ID NO: 70146 - RNA, 22 nt, Homo sapiens
uaugaaucugagagaucuggaa

SEQ ID NO: 70147 - RNA, 20 nt, Homo sapiens
uaugaccugucuuuucucuc

SEQ ID NO: 70148 - RNA, 22 nt, Homo sapiens
uaugacucagaaggcacacaca

SEQ ID NO: 70149 - RNA, 22 nt, Homo sapiens
uaugacuuuggaaaaauuacuu

SEQ ID NO: 70150 - RNA, 22 nt, Homo sapiens
uaugagacugugagugagaaau

SEQ ID NO: 70151 - RNA, 22 nt, Homo sapiens
uaugagaugaggccacugggua

SEQ ID NO: 70152 - RNA, 22 nt, Homo sapiens
uaugagguagguaugacuauca

SEQ ID NO: 70153 - RNA, 22 nt, Homo sapiens
uaugaucacuacagcagggaug

SEQ ID NO: 70154 - RNA, 22 nt, Homo sapiens
uaugaugcugagguuuggagug

SEQ ID NO: 70155 - RNA, 22 nt, Homo sapiens
uaugauuuuugggagaggucaa

SEQ ID NO: 70156 - RNA, 22 nt, Homo sapiens
uaugcacuauggaaguagcuca

SEQ ID NO: 70157 - RNA, 22 nt, Homo sapiens
uaugccuuucucacuaagcuua

SEQ ID NO: 70158 - RNA, 22 nt, Homo sapiens
uaugccuuuuggcucaagaaac

SEQ ID NO: 70159 - RNA, 22 nt, Homo sapiens
uaugcuuauaaacauuugucag

SEQ ID NO: 70160 - RNA, 22 nt, Homo sapiens
uaugcuuguuuauuuaagaaac

SEQ ID NO: 70161 - RNA, 22 nt, Homo sapiens
uauggcacuaguacuggaaagc

SEQ ID NO: 70162 - RNA, 22 nt, Homo sapiens
uauggcauuuuguaagggcuug

SEQ ID NO: 70163 - RNA, 22 nt, Homo sapiens
uauggcccuuaaguauugguug

SEQ ID NO: 70164 - RNA, 22 nt, Homo sapiens
uauggcucuguaauuuuagaug

SEQ ID NO: 70165 - RNA, 22 nt, Homo sapiens
uauggcugcuuucacacuacaa

SEQ ID NO: 70166 - RNA, 22 nt, Homo sapiens
uauggcuucuauaaggaagcuu

SEQ ID NO: 70167 - RNA, 22 nt, Homo sapiens
uauggcuuuuauuauguuguag

SEQ ID NO: 70168 - RNA, 22 nt, Homo sapiens
uaugggauuucauuaagugucu

SEQ ID NO: 70169 - RNA, 19 nt, Homo sapiens
uaugggauuuuuagggugu

SEQ ID NO: 70170 - RNA, 22 nt, Homo sapiens
uaugggcuuuguuuuguacuag

SEQ ID NO: 70171 - RNA, 22 nt, Homo sapiens
uauggguuucagagggugauag

SEQ ID NO: 70172 - RNA, 22 nt, Homo sapiens
uauggguuuuucauaaauaggu

SEQ ID NO: 70173 - RNA, 22 nt, Homo sapiens
uauggguuuuugucuguuuacu

SEQ ID NO: 70174 - RNA, 22 nt, Homo sapiens
uaugguuuuaagguuaaggacu

SEQ ID NO: 70175 - RNA, 19 nt, Homo sapiens
uauguaguuuucucaauau

SEQ ID NO: 70176 - RNA, 22 nt, Homo sapiens
uaugucauggguaaagugcccu

SEQ ID NO: 70177 - RNA, 23 nt, Homo sapiens
uaugucuauucuaaugccagcac

SEQ ID NO: 70178 - RNA, 22 nt, Homo sapiens
uaugucuggaguuacugagcug

SEQ ID NO: 70179 - RNA, 22 nt, Homo sapiens
uaugucuucuuuagagaaaugu

SEQ ID NO: 70180 - RNA, 22 nt, Homo sapiens
uaugucuuuugcuugcaaauag

SEQ ID NO: 70181 - RNA, 22 nt, Homo sapiens
uaugugcacaugcccuggugac

SEQ ID NO: 70182 - RNA, 22 nt, Homo sapiens
uaugugguuaauaggaauuugu

SEQ ID NO: 70183 - RNA, 22 nt, Homo sapiens
uauuagugucuuuugguuagaa

SEQ ID NO: 70184 - RNA, 22 nt, Homo sapiens
uauuaguuguaugauucccaag

SEQ ID NO: 70185 - RNA, 22 nt, Homo sapiens
uauuauuguccuucuauaccca

SEQ ID NO: 70186 - RNA, 22 nt, Homo sapiens
uauuccauuugggucaggauga

SEQ ID NO: 70187 - RNA, 22 nt, Homo sapiens
uauugaacgugggauauugaag

SEQ ID NO: 70188 - RNA, 22 nt, Homo sapiens
uauugacauuacagugggucuu

SEQ ID NO: 70189 - RNA, 22 nt, Homo sapiens
uauugauuaauugugauuaggc

SEQ ID NO: 70190 - RNA, 22 nt, Homo sapiens
uauugcaaauggugaucccagg

SEQ ID NO: 70191 - RNA, 22 nt, Homo sapiens
uauugcacgccagccugagcaa

SEQ ID NO: 70192 - RNA, 22 nt, Homo sapiens
uauugcagauacccaggaaguu

SEQ ID NO: 70193 - RNA, 22 nt, Homo sapiens
uauugcagugagauccaucugg

SEQ ID NO: 70194 - RNA, 22 nt, Homo sapiens
uauugcauguugagcaguaccu

SEQ ID NO: 70195 - RNA, 22 nt, Homo sapiens
uauugcauuugagguugguuga

SEQ ID NO: 70196 - RNA, 22 nt, Homo sapiens
uauugccugucuccaaaaauca

SEQ ID NO: 70197 - RNA, 22 nt, Homo sapiens
uauugcuaacaucccuuaugua

SEQ ID NO: 70198 - RNA, 22 nt, Homo sapiens
uauugcuacuuugccuuccaaa

SEQ ID NO: 70199 - RNA, 22 nt, Homo sapiens
uauugcuggcucugucuucauu

SEQ ID NO: 70200 - RNA, 18 nt, Homo sapiens
uauugcuugguuuggaga

SEQ ID NO: 70201 - RNA, 22 nt, Homo sapiens
uauuguacauguuauagauuuu

SEQ ID NO: 70202 - RNA, 22 nt, Homo sapiens
uauugugcauguugaauaacua

SEQ ID NO: 70203 - RNA, 22 nt, Homo sapiens
uauuguuaaagauguuaaugau

SEQ ID NO: 70204 - RNA, 22 nt, Homo sapiens
ugcugguauuauguuauccaga

SEQ ID NO: 70205 - RNA, 22 nt, Homo sapiens
ugcuggugauuaaauccugaag

SEQ ID NO: 70206 - RNA, 22 nt, Homo sapiens
ugcuggugucaucaaggcuuug

SEQ ID NO: 70207 - RNA, 22 nt, Homo sapiens
ugcugguguggucuagccgcuu

SEQ ID NO: 70208 - RNA, 22 nt, Homo sapiens
ugcuguuguuugaugaaguaau

SEQ ID NO: 70209 - RNA, 22 nt, Homo sapiens
ugcuuagucuugcuuuagcuau

SEQ ID NO: 70210 - RNA, 22 nt, Homo sapiens
ugcuuaguguugacccucugcc

SEQ ID NO: 70211 - RNA, 22 nt, Homo sapiens
ugcuucauuggccaccaggaag

SEQ ID NO: 70212 - RNA, 22 nt, Homo sapiens
ugcuuguguucagguaaccuuu

SEQ ID NO: 70213 - RNA, 22 nt, Homo sapiens
uggaaauaaaauagaguuugcc

SEQ ID NO: 70214 - RNA, 22 nt, Homo sapiens
uggaaaucuaaguuuggauuga

SEQ ID NO: 70215 - RNA, 22 nt, Homo sapiens
uggaaauuaacagggauugucc

SEQ ID NO: 70216 - RNA, 20 nt, Homo sapiens
uggaaauuaaccuuucaggu

SEQ ID NO: 70217 - RNA, 22 nt, Homo sapiens
uggaacacaucuaaggaagcag

SEQ ID NO: 70218 - RNA, 22 nt, Homo sapiens
uggaacaccaggcuggcguggc

SEQ ID NO: 70219 - RNA, 22 nt, Homo sapiens
uggaagacacauaccugauaac

SEQ ID NO: 70220 - RNA, 23 nt, Homo sapiens
uggaagacuccucucuuggcugc

SEQ ID NO: 70221 - RNA, 22 nt, Homo sapiens
uggaagaugggaccucaguuuu

SEQ ID NO: 70222 - RNA, 22 nt, Homo sapiens
uggaaguagauagauuguguca

SEQ ID NO: 70223 - RNA, 22 nt, Homo sapiens
uggaagucaugcugcaagaaca

SEQ ID NO: 70224 - RNA, 21 nt, Homo sapiens
uggaaguguacaauuauaccc

SEQ ID NO: 70225 - RNA, 22 nt, Homo sapiens
uggaagugucugugcccagcuc

SEQ ID NO: 70226 - RNA, 22 nt, Homo sapiens
uggaauacuauucugugcugga

SEQ ID NO: 70227 - RNA, 22 nt, Homo sapiens
uggaauaucaugagaguuuguu

SEQ ID NO: 70228 - RNA, 20 nt, Homo sapiens
uggaaucuaggcggagguuu

SEQ ID NO: 70229 - RNA, 21 nt, Homo sapiens
uggaaucuauagaggcaguag

SEQ ID NO: 70230 - RNA, 19 nt, Homo sapiens
uggaaugaaauguuagggg

SEQ ID NO: 70231 - RNA, 22 nt, Homo sapiens
uggaaugcuaagcaugugggag

SEQ ID NO: 70232 - RNA, 22 nt, Homo sapiens
uggaaugcucuccccacggacu

SEQ ID NO: 70233 - RNA, 22 nt, Homo sapiens
uggaauggagagagggugcacg

SEQ ID NO: 70234 - RNA, 22 nt, Homo sapiens
uggaauguggacucuuaugggg

SEQ ID NO: 70235 - RNA, 22 nt, Homo sapiens
uccuacugucuucggggcacug

SEQ ID NO: 70236 - RNA, 22 nt, Homo sapiens
uccugagacucacaggcucccc

SEQ ID NO: 70237 - RNA, 21 nt, Homo sapiens
uccugagagaggaguaacucu

SEQ ID NO: 70238 - RNA, 20 nt, Homo sapiens
uccugagauucccaguucuc

SEQ ID NO: 70239 - RNA, 22 nt, Homo sapiens
uccuugagccugggaguuauag

SEQ ID NO: 70240 - RNA, 22 nt, Homo sapiens
uccuugagucugaacuuuggau

SEQ ID NO: 70241 - RNA, 19 nt, Homo sapiens
uccuugauugcaccacugc

SEQ ID NO: 70242 - RNA, 22 nt, Homo sapiens
ucgcagcacgagcaugcaaggu

SEQ ID NO: 70243 - RNA, 22 nt, Homo sapiens
ucgcauggucuccaggcagcuc

SEQ ID NO: 70244 - RNA, 22 nt, Homo sapiens
ucgcauuucccucuguagcuuc

SEQ ID NO: 70245 - RNA, 22 nt, Homo sapiens
ucgugcaaacguaauugugguu

SEQ ID NO: 70246 - RNA, 22 nt, Homo sapiens
ucuaaaguacuacuacuguugg

SEQ ID NO: 70247 - RNA, 20 nt, Homo sapiens
ucuaccuguagguaauuggu

SEQ ID NO: 70248 - RNA, 22 nt, Homo sapiens
ucuaucacagugauguuccaga

SEQ ID NO: 70249 - RNA, 22 nt, Homo sapiens
ucuauggauaaaaugcccucau

SEQ ID NO: 70250 - RNA, 22 nt, Homo sapiens
ucuaugguuuauuuccaagugu

SEQ ID NO: 70251 - RNA, 22 nt, Homo sapiens
ucuauguuuuugcuaguagugu

SEQ ID NO: 70252 - RNA, 22 nt, Homo sapiens
ucuauugguugaaauugcuuuu

SEQ ID NO: 70253 - RNA, 22 nt, Homo sapiens
ucucaaccucccaaguagcugg

SEQ ID NO: 70254 - RNA, 22 nt, Homo sapiens
ucucaaguaacugggacaauaa

SEQ ID NO: 70255 - RNA, 22 nt, Homo sapiens
ucucacaccccucucauauacc

SEQ ID NO: 70256 - RNA, 22 nt, Homo sapiens
ucucacagaguugaauguuucu

SEQ ID NO: 70257 - RNA, 19 nt, Homo sapiens
ucucacagcucuacuaugu

SEQ ID NO: 70258 - RNA, 22 nt, Homo sapiens
ucucacaggguuauugaggggg

SEQ ID NO: 70259 - RNA, 22 nt, Homo sapiens
ucucagcacagucagggcgccu

SEQ ID NO: 70260 - RNA, 22 nt, Homo sapiens
ucucagcggacaggccggccag

SEQ ID NO: 70261 - RNA, 22 nt, Homo sapiens
ucucagugaaauaaauuauuuu

SEQ ID NO: 70262 - RNA, 22 nt, Homo sapiens
ucucagugacugcugggucccc

SEQ ID NO: 70263 - RNA, 22 nt, Homo sapiens
ucucaguuuucuggggaagaaa

SEQ ID NO: 70264 - RNA, 22 nt, Homo sapiens
ucucauagaggcagagaguaaa

SEQ ID NO: 70265 - RNA, 22 nt, Homo sapiens
ucucauuggucugagucaccug

SEQ ID NO: 70266 - RNA, 22 nt, Homo sapiens
ucuccauuguccagaugaggaa

SEQ ID NO: 70267 - RNA, 22 nt, Homo sapiens
ucuccauuuguaaggguuucuc

SEQ ID NO: 70268 - RNA, 17 nt, Homo sapiens
ucucccaucccuuucuc

SEQ ID NO: 70269 - RNA, 22 nt, Homo sapiens
ucucugagaccacuccaaacuc

SEQ ID NO: 70270 - RNA, 22 nt, Homo sapiens
ucucugguuuguggaaucuuag

SEQ ID NO: 70271 - RNA, 22 nt, Homo sapiens
ucucuguuuagagccagcaauu

SEQ ID NO: 70272 - RNA, 22 nt, Homo sapiens
ucucuguuugucuguuacuggu

SEQ ID NO: 70273 - RNA, 22 nt, Homo sapiens
ucucuugguugaacaguuugga

SEQ ID NO: 70274 - RNA, 22 nt, Homo sapiens
ucugacacagugauuaguaaau

SEQ ID NO: 70275 - RNA, 22 nt, Homo sapiens
ucugacagugagagaaaucuga

SEQ ID NO: 70276 - RNA, 22 nt, Homo sapiens
ucugacuagacaagcaguguac

SEQ ID NO: 70277 - RNA, 22 nt, Homo sapiens
ucugagacuguuucuaacaagc

SEQ ID NO: 70278 - RNA, 22 nt, Homo sapiens
ucugagaugagacuuugaauuu

SEQ ID NO: 70279 - RNA, 22 nt, Homo sapiens
ucugagcaauagauguggauau

SEQ ID NO: 70280 - RNA, 22 nt, Homo sapiens
ucugagcaugcaucuugccugg

SEQ ID NO: 70281 - RNA, 23 nt, Homo sapiens
ucuggaucauucguagugccagc

SEQ ID NO: 70282 - RNA, 22 nt, Homo sapiens
ucuggccccucccaaaucucau

SEQ ID NO: 70283 - RNA, 15 nt, Homo sapiens
ucuggcucugucacu

SEQ ID NO: 70284 - RNA, 22 nt, Homo sapiens
ucuggcuuauuucacuuagcau

SEQ ID NO: 70285 - RNA, 22 nt, Homo sapiens
ucuggcuucugacuuaggggac

SEQ ID NO: 70286 - RNA, 17 nt, Homo sapiens
ucuggcuuucacaccug

SEQ ID NO: 70287 - RNA, 22 nt, Homo sapiens
ucuggucccugcacauauuuuc

SEQ ID NO: 70288 - RNA, 22 nt, Homo sapiens
ucuggugugcucuggacuugca

SEQ ID NO: 70289 - RNA, 22 nt, Homo sapiens
ucugguuccugcauucauucaa

SEQ ID NO: 70290 - RNA, 22 nt, Homo sapiens
ucuguaacauccaccuucuggg

SEQ ID NO: 70291 - RNA, 22 nt, Homo sapiens
ucuguacuuccguaccuaaagu

SEQ ID NO: 70292 - RNA, 22 nt, Homo sapiens
ucugucaaaucuuauguuguag

SEQ ID NO: 70293 - RNA, 22 nt, Homo sapiens
ucugucuuguccucacccuaga

SEQ ID NO: 70294 - RNA, 22 nt, Homo sapiens
ucugucuuugccuaaguuuguc

SEQ ID NO: 70295 - RNA, 22 nt, Homo sapiens
ucugucuuugucaggaccagag

SEQ ID NO: 70296 - RNA, 22 nt, Homo sapiens
ucugugaaaucauuuccuguaa

SEQ ID NO: 70297 - RNA, 22 nt, Homo sapiens
ucugugcauuacacuuuucuca

SEQ ID NO: 70298 - RNA, 22 nt, Homo sapiens
ucugugcauuuucuuuuagacu

SEQ ID NO: 70299 - RNA, 22 nt, Homo sapiens
ucugugcuugucauaugcuuug

SEQ ID NO: 70300 - RNA, 22 nt, Homo sapiens
uauagcacugagaauguaauuc

SEQ ID NO: 70301 - RNA, 21 nt, Homo sapiens
uauagcagcacgauuuauagu

SEQ ID NO: 70302 - RNA, 22 nt, Homo sapiens
uauagcuagugauuguguguau

SEQ ID NO: 70303 - RNA, 22 nt, Homo sapiens
uauagcuugauuauggugaugg

SEQ ID NO: 70304 - RNA, 22 nt, Homo sapiens
uauaucuguccauggcccugcu

SEQ ID NO: 70305 - RNA, 21 nt, Homo sapiens
uauaugacuuacuauugccuc

SEQ ID NO: 70306 - RNA, 22 nt, Homo sapiens
uauaugcacucagguguaugug

SEQ ID NO: 70307 - RNA, 23 nt, Homo sapiens
uauaugugucuaggagcuauggu

SEQ ID NO: 70308 - RNA, 22 nt, Homo sapiens
uaucaaacccaaggaggggguu

SEQ ID NO: 70309 - RNA, 22 nt, Homo sapiens
uaucacacgccuugcuucauuu

SEQ ID NO: 70310 - RNA, 22 nt, Homo sapiens
uaucacacuguuggauuugauu

SEQ ID NO: 70311 - RNA, 22 nt, Homo sapiens
uaucacagauucuccaggguuu

SEQ ID NO: 70312 - RNA, 22 nt, Homo sapiens
uaucacagcaaggacccauuau

SEQ ID NO: 70313 - RNA, 22 nt, Homo sapiens
uaucacaguagaacucuuucca

SEQ ID NO: 70314 - RNA, 22 nt, Homo sapiens
uaucaccuugcaguggaugcua

SEQ ID NO: 70315 - RNA, 22 nt, Homo sapiens
uaucacuguuguuuguuuaagg

SEQ ID NO: 70316 - RNA, 22 nt, Homo sapiens
uaucauagacaaucaguuauug

SEQ ID NO: 70317 - RNA, 22 nt, Homo sapiens
uaucaugucuguguguaccuag

SEQ ID NO: 70318 - RNA, 22 nt, Homo sapiens
uaucauugccucaaucuguauu

SEQ ID NO: 70319 - RNA, 22 nt, Homo sapiens
uaucccaauguaauaucacaaa

SEQ ID NO: 70320 - RNA, 21 nt, Homo sapiens
uaucccagucacaucuaccca

SEQ ID NO: 70321 - RNA, 22 nt, Homo sapiens
uaucccuguggacuucccaaca

SEQ ID NO: 70322 - RNA, 22 nt, Homo sapiens
uaucccuuagagcggggugguu

SEQ ID NO: 70323 - RNA, 22 nt, Homo sapiens
uauccuagugggguuucaguca

SEQ ID NO: 70324 - RNA, 22 nt, Homo sapiens
uauccuguagcucauccaccgc

SEQ ID NO: 70325 - RNA, 22 nt, Homo sapiens
uaucguaguguuggaaaacaag

SEQ ID NO: 70326 - RNA, 22 nt, Homo sapiens
uaucucagagaaucagauuuac

SEQ ID NO: 70327 - RNA, 22 nt, Homo sapiens
uaucucagaguguacaagauua

SEQ ID NO: 70328 - RNA, 18 nt, Homo sapiens
uaucucauuucuuagguc

SEQ ID NO: 70329 - RNA, 22 nt, Homo sapiens
uaucuuggaguuugacaaccaa

SEQ ID NO: 70330 - RNA, 22 nt, Homo sapiens
uaugaaucuggcuacuccaggg

SEQ ID NO: 70331 - RNA, 20 nt, Homo sapiens
uaugacaaagccuagugagu

SEQ ID NO: 70332 - RNA, 20 nt, Homo sapiens
uaugacacugucauaaaaau

SEQ ID NO: 70333 - RNA, 22 nt, Homo sapiens
uaugacuguuugcucauucagg

SEQ ID NO: 70334 - RNA, 22 nt, Homo sapiens
uaugacuuuugaauacagaugg

SEQ ID NO: 70335 - RNA, 22 nt, Homo sapiens
uaugagacugguuaauuuuugu

SEQ ID NO: 70336 - RNA, 22 nt, Homo sapiens
uaugagagcugguagguagaga

SEQ ID NO: 70337 - RNA, 22 nt, Homo sapiens
uaugagcaaaaugaggguuagu

SEQ ID NO: 70338 - RNA, 22 nt, Homo sapiens
uaugcacuauagcauauguggu

SEQ ID NO: 70339 - RNA, 22 nt, Homo sapiens
uaugcccauuuaaauugaacaa

SEQ ID NO: 70340 - RNA, 23 nt, Homo sapiens
uaugccuguuucaaacaaacuuu

SEQ ID NO: 70341 - RNA, 19 nt, Homo sapiens
uaugcuagagagggaagcu

SEQ ID NO: 70342 - RNA, 22 nt, Homo sapiens
uaugcuguuucugauuuaggga

SEQ ID NO: 70343 - RNA, 22 nt, Homo sapiens
auugcaguuagaacagaagucu

SEQ ID NO: 70344 - RNA, 22 nt, Homo sapiens
auugcaguuucaacuccagggc

SEQ ID NO: 70345 - RNA, 22 nt, Homo sapiens
auugcuaacugaaauaagacca

SEQ ID NO: 70346 - RNA, 22 nt, Homo sapiens
auugcuauuauuugaccauugu

SEQ ID NO: 70347 - RNA, 22 nt, Homo sapiens
auugcucagucagggagcucgg

SEQ ID NO: 70348 - RNA, 22 nt, Homo sapiens
auugcuuaagucccuguauuag

SEQ ID NO: 70349 - RNA, 22 nt, Homo sapiens
auuggaacugaaauaauaacuu

SEQ ID NO: 70350 - RNA, 22 nt, Homo sapiens
auuggaguuguacgcacgcuca

SEQ ID NO: 70351 - RNA, 22 nt, Homo sapiens
auuggauagucuuuaucuguug

SEQ ID NO: 70352 - RNA, 22 nt, Homo sapiens
auuggcaagauagcauaugagg

SEQ ID NO: 70353 - RNA, 22 nt, Homo sapiens
auuggcaauggcaaagcagagu

SEQ ID NO: 70354 - RNA, 22 nt, Homo sapiens
auuggcaauguacauaucuugc

SEQ ID NO: 70355 - RNA, 22 nt, Homo sapiens
auuggcagaaaucuuuauagua

SEQ ID NO: 70356 - RNA, 22 nt, Homo sapiens
auuggugaccugcggcaguaug

SEQ ID NO: 70357 - RNA, 22 nt, Homo sapiens
auuguaauuuuagagaaagugg

SEQ ID NO: 70358 - RNA, 22 nt, Homo sapiens
auuguaccccaauguacaauau

SEQ ID NO: 70359 - RNA, 22 nt, Homo sapiens
auuguacuccagccuuggggac

SEQ ID NO: 70360 - RNA, 22 nt, Homo sapiens
auuguacugccccccuguugcu

SEQ ID NO: 70361 - RNA, 22 nt, Homo sapiens
auuguacuuauugccagaauuu

SEQ ID NO: 70362 - RNA, 21 nt, Homo sapiens
auuguauguaaaccaaaugag

SEQ ID NO: 70363 - RNA, 22 nt, Homo sapiens
auugucacugugcuccaccagu

SEQ ID NO: 70364 - RNA, 22 nt, Homo sapiens
auugucacuuaaaagugcaugu

SEQ ID NO: 70365 - RNA, 20 nt, Homo sapiens
auuguccuugauuacacaga

SEQ ID NO: 70366 - RNA, 22 nt, Homo sapiens
auugugcuaaaguaauaaguca

SEQ ID NO: 70367 - RNA, 22 nt, Homo sapiens
auugugucuuguagagagauau

SEQ ID NO: 70368 - RNA, 22 nt, Homo sapiens
auuguucuuguguccuuuuccu

SEQ ID NO: 70369 - RNA, 22 nt, Homo sapiens
auuuagcaauggagguagugua

SEQ ID NO: 70370 - RNA, 22 nt, Homo sapiens
auuuaugguuaauauaggaagu

SEQ ID NO: 70371 - RNA, 19 nt, Homo sapiens
auuuccuggagcuggucuc

SEQ ID NO: 70372 - RNA, 22 nt, Homo sapiens
auuuccuguaggggcuugcgaa

SEQ ID NO: 70373 - RNA, 19 nt, Homo sapiens
auuugaucaucaggcacag

SEQ ID NO: 70374 - RNA, 20 nt, Homo sapiens
auuugcauuauggagcaccc

SEQ ID NO: 70375 - RNA, 22 nt, Homo sapiens
auuuggcaguauaaugcuuugg

SEQ ID NO: 70376 - RNA, 22 nt, Homo sapiens
auuuggguuuuacaucaggcua

SEQ ID NO: 70377 - RNA, 22 nt, Homo sapiens
auuugguaauauuuaaggacuu

SEQ ID NO: 70378 - RNA, 22 nt, Homo sapiens
auuuguccugccuuuuccuccu

SEQ ID NO: 70379 - RNA, 22 nt, Homo sapiens
auuuuuggauauagggaaggau

SEQ ID NO: 70380 - RNA, 22 nt, Homo sapiens
caaaggcuucugaaacugcaga

SEQ ID NO: 70381 - RNA, 22 nt, Homo sapiens
caaagucuauucuacccuuacc

SEQ ID NO: 70382 - RNA, 22 nt, Homo sapiens
caaagucuucucauuaugucuu

SEQ ID NO: 70383 - RNA, 22 nt, Homo sapiens
caaagugcuggaauuggccggg

SEQ ID NO: 70384 - RNA, 22 nt, Homo sapiens
caaagugcugggacuggccggg

SEQ ID NO: 70385 - RNA, 22 nt, Homo sapiens
caaagugcugggaugggccagg

SEQ ID NO: 70386 - RNA, 19 nt, Homo sapiens
caaaguguucuucuuugcc

SEQ ID NO: 70387 - RNA, 22 nt, Homo sapiens
caaaugacaucauuucauucaa

SEQ ID NO: 70388 - RNA, 22 nt, Homo sapiens
caaaugaucugcuggccucagc

SEQ ID NO: 70389 - RNA, 22 nt, Homo sapiens
caacacagugaaacccgucucu

SEQ ID NO: 70390 - RNA, 22 nt, Homo sapiens
caacugcucacuccuggguuca

SEQ ID NO: 70391 - RNA, 22 nt, Homo sapiens
caagaggcuguguauaaagcca

SEQ ID NO: 70392 - RNA, 22 nt, Homo sapiens
caaggugcugagacaggagccc

SEQ ID NO: 70393 - RNA, 23 nt, Homo sapiens
caauacugaccucacguuaauag

SEQ ID NO: 70394 - RNA, 22 nt, Homo sapiens
caauacuguuaccugaaauagg

SEQ ID NO: 70395 - RNA, 22 nt, Homo sapiens
caaugcauuauucucccacuuc

SEQ ID NO: 70396 - RNA, 22 nt, Homo sapiens
caaugguacuagauaucuucag

SEQ ID NO: 70397 - RNA, 22 nt, Homo sapiens
caaugguuuuuuaguauaagua

SEQ ID NO: 70398 - RNA, 22 nt, Homo sapiens
caauugcacucuuagguguaca

SEQ ID NO: 70399 - RNA, 22 nt, Homo sapiens
cacacugucuucaauggguggu

SEQ ID NO: 70400 - RNA, 22 nt, Homo sapiens
cacacugucuucauuacuguag

SEQ ID NO: 70401 - RNA, 22 nt, Homo sapiens
cacacugucuuucagaaugguu

SEQ ID NO: 70402 - RNA, 22 nt, Homo sapiens
cacagaauucauuggauuaccu

SEQ ID NO: 70403 - RNA, 22 nt, Homo sapiens
cacagcgacuuccgccuaccgg

SEQ ID NO: 70404 - RNA, 22 nt, Homo sapiens
cacaggccugucucuuucuaac

SEQ ID NO: 70405 - RNA, 22 nt, Homo sapiens
cacagugaaugucaucauugcc

SEQ ID NO: 70406 - RNA, 22 nt, Homo sapiens
cacaguguuccagcuauuugaa

SEQ ID NO: 70407 - RNA, 22 nt, Homo sapiens
cacauagcuagucaguagugaa

SEQ ID NO: 70408 - RNA, 22 nt, Homo sapiens
cacauguucaggagcacuuaga

SEQ ID NO: 70409 - RNA, 22 nt, Homo sapiens
caccacauuccauugaucaggc

SEQ ID NO: 70410 - RNA, 22 nt, Homo sapiens
caccagguuggagugcaguggu

SEQ ID NO: 70411 - RNA, 22 nt, Homo sapiens
cacccaguaagcaugaggcccu

SEQ ID NO: 70412 - RNA, 22 nt, Homo sapiens
caccgagugacaguagccauca

SEQ ID NO: 70413 - RNA, 22 nt, Homo sapiens
caccgguuaaucuguuuuuucu

SEQ ID NO: 70414 - RNA, 22 nt, Homo sapiens
caccuguacauggcaguguccu

SEQ ID NO: 70415 - RNA, 22 nt, Homo sapiens
caccuugugauccacccgccuu

SEQ ID NO: 70416 - RNA, 22 nt, Homo sapiens
cacugaaugugagguuggggag

SEQ ID NO: 70417 - RNA, 22 nt, Homo sapiens
cacugcacuccagcuuugguga

SEQ ID NO: 70418 - RNA, 22 nt, Homo sapiens
cacugcacuccagucugacgac

SEQ ID NO: 70419 - RNA, 22 nt, Homo sapiens
cacugcacuccagucuggcgac

SEQ ID NO: 70420 - RNA, 22 nt, Homo sapiens
cacugcaguaaauugcgucggu

SEQ ID NO: 70421 - RNA, 22 nt, Homo sapiens
cacugcauccuccaccugccag

SEQ ID NO: 70422 - RNA, 22 nt, Homo sapiens
cacugcauccuccauauccugg

SEQ ID NO: 70423 - RNA, 22 nt, Homo sapiens
cacugcauccuugaccuucugg

SEQ ID NO: 70424 - RNA, 22 nt, Homo sapiens
cacugcauggucuagcuggguu

SEQ ID NO: 70425 - RNA, 23 nt, Homo sapiens
cacugggcagcagguguucccag

SEQ ID NO: 70426 - RNA, 17 nt, Homo sapiens
cacugggugcaagagga

SEQ ID NO: 70427 - RNA, 22 nt, Homo sapiens
cacuggguuagaacaugcuccu

SEQ ID NO: 70428 - RNA, 22 nt, Homo sapiens
auuggcuuuugaaagucugcga

SEQ ID NO: 70429 - RNA, 22 nt, Homo sapiens
auuguacauacaccggugugua

SEQ ID NO: 70430 - RNA, 22 nt, Homo sapiens
auuguacuccagccuaggcaac

SEQ ID NO: 70431 - RNA, 22 nt, Homo sapiens
auuguacuccagccugggcaag

SEQ ID NO: 70432 - RNA, 22 nt, Homo sapiens
auuguguagucuuacugcuugc

SEQ ID NO: 70433 - RNA, 22 nt, Homo sapiens
auuguucuuacaugcugucauc

SEQ ID NO: 70434 - RNA, 15 nt, Homo sapiens
auuucacuuagcaug

SEQ ID NO: 70435 - RNA, 22 nt, Homo sapiens
auuucacuucgcaugguguccg

SEQ ID NO: 70436 - RNA, 22 nt, Homo sapiens
auuugacacugagagccucagu

SEQ ID NO: 70437 - RNA, 22 nt, Homo sapiens
auuuggcaacguagggaggcau

SEQ ID NO: 70438 - RNA, 22 nt, Homo sapiens
auuuggcaauuuugaagaugcc

SEQ ID NO: 70439 - RNA, 18 nt, Homo sapiens
cugagcacugcuuuauga

SEQ ID NO: 70440 - RNA, 22 nt, Homo sapiens
cugagcaugacaucaugugacu

SEQ ID NO: 70441 - RNA, 22 nt, Homo sapiens
cugagcuaguagcauuguguca

SEQ ID NO: 70442 - RNA, 22 nt, Homo sapiens
cugagcucauuucuuuugcuac

SEQ ID NO: 70443 - RNA, 22 nt, Homo sapiens
cugaggacaucagggaagcauc

SEQ ID NO: 70444 - RNA, 22 nt, Homo sapiens
cugagguaauuuguugccagua

SEQ ID NO: 70445 - RNA, 22 nt, Homo sapiens
cugagguacccacuucaucuca

SEQ ID NO: 70446 - RNA, 22 nt, Homo sapiens
cugagguacugggggccaggau

SEQ ID NO: 70447 - RNA, 22 nt, Homo sapiens
cugagguaggcccugagaauau

SEQ ID NO: 70448 - RNA, 22 nt, Homo sapiens
cugagguauaucccauuagaag

SEQ ID NO: 70449 - RNA, 20 nt, Homo sapiens
cugaggugggagaaucgcuu

SEQ ID NO: 70450 - RNA, 22 nt, Homo sapiens
cugaggugggaggauuggcuug

SEQ ID NO: 70451 - RNA, 22 nt, Homo sapiens
cugaggugggaguuuuucucau

SEQ ID NO: 70452 - RNA, 20 nt, Homo sapiens
cugagguugggguccuuccc

SEQ ID NO: 70453 - RNA, 22 nt, Homo sapiens
cugagugcaagugauccuccca

SEQ ID NO: 70454 - RNA, 22 nt, Homo sapiens
cugauaaguuuuucuuuauaag

SEQ ID NO: 70455 - RNA, 22 nt, Homo sapiens
cugauacugaaagcuguugguu

SEQ ID NO: 70456 - RNA, 22 nt, Homo sapiens
cugaucuggaggugucugggga

SEQ ID NO: 70457 - RNA, 22 nt, Homo sapiens
cugaugaaguauuuguucugga

SEQ ID NO: 70458 - RNA, 22 nt, Homo sapiens
cugaugguuuuacacaagggca

SEQ ID NO: 70459 - RNA, 22 nt, Homo sapiens
cugauuguagagccccagggcu

SEQ ID NO: 70460 - RNA, 22 nt, Homo sapiens
cugauugucuauuuaguucacu

SEQ ID NO: 70461 - RNA, 22 nt, Homo sapiens
cugauuguuugccucuaaaauc

SEQ ID NO: 70462 - RNA, 22 nt, Homo sapiens
cugcaaauacuugugggauuuu

SEQ ID NO: 70463 - RNA, 21 nt, Homo sapiens
cugcaaaugcugcugccugau

SEQ ID NO: 70464 - RNA, 22 nt, Homo sapiens
cugcaagaugcauaggaauuuu

SEQ ID NO: 70465 - RNA, 22 nt, Homo sapiens
cugcaauguuugaaauggcaaa

SEQ ID NO: 70466 - RNA, 19 nt, Homo sapiens
cugcacugagaaaaggagg

SEQ ID NO: 70467 - RNA, 22 nt, Homo sapiens
cugcacugagacccucuuugcu

SEQ ID NO: 70468 - RNA, 22 nt, Homo sapiens
cugcaguaaccacuguaggugu

SEQ ID NO: 70469 - RNA, 22 nt, Homo sapiens
cugcagucaucugaagauuuug

SEQ ID NO: 70470 - RNA, 22 nt, Homo sapiens
cugccaguuugauucgggccac

SEQ ID NO: 70471 - RNA, 22 nt, Homo sapiens
cugccuaaagaaaaagacguug

SEQ ID NO: 70472 - RNA, 22 nt, Homo sapiens
cugccuagaucugaaccuggcu

SEQ ID NO: 70473 - RNA, 22 nt, Homo sapiens
cugccuagauguuguagggggu

SEQ ID NO: 70474 - RNA, 22 nt, Homo sapiens
cugcuaagagaaugagacuuag

SEQ ID NO: 70475 - RNA, 22 nt, Homo sapiens
cugcuauauugguucaggcuug

SEQ ID NO: 70476 - RNA, 22 nt, Homo sapiens
cugcuggucuuuaaggucuagg

SEQ ID NO: 70477 - RNA, 22 nt, Homo sapiens
cugcuguuguuaacuuuuggag

SEQ ID NO: 70478 - RNA, 22 nt, Homo sapiens
cuggaaagcaaagggugcauug

SEQ ID NO: 70479 - RNA, 22 nt, Homo sapiens
cuggaauuacaggguugagcua

SEQ ID NO: 70480 - RNA, 22 nt, Homo sapiens
cuggacguugaggcugcaguga

SEQ ID NO: 70481 - RNA, 22 nt, Homo sapiens
cuggagauuaaccaauugccau

SEQ ID NO: 70482 - RNA, 22 nt, Homo sapiens
cuggagcauugguggauuuguu

SEQ ID NO: 70483 - RNA, 22 nt, Homo sapiens
cuggaguaugaaccauguauca

SEQ ID NO: 70484 - RNA, 22 nt, Homo sapiens
cuggauauuaacauugaugaaa

SEQ ID NO: 70485 - RNA, 22 nt, Homo sapiens
cuggauggugagauaaagaaaa

SEQ ID NO: 70486 - RNA, 19 nt, Homo sapiens
cuggcaaaugcuuuggcca

SEQ ID NO: 70487 - RNA, 22 nt, Homo sapiens
cuggcaaauguuuucuguaaag

SEQ ID NO: 70488 - RNA, 22 nt, Homo sapiens
cuggcaagaggauaaaguccua

SEQ ID NO: 70489 - RNA, 22 nt, Homo sapiens
cuggcaauaggcagugucccaa

SEQ ID NO: 70490 - RNA, 22 nt, Homo sapiens
cuggcacagugucagaaacaca

SEQ ID NO: 70491 - RNA, 22 nt, Homo sapiens
cuggccagagacauucauuaaa

SEQ ID NO: 70492 - RNA, 22 nt, Homo sapiens
cugggaugauguaaauaggcua

SEQ ID NO: 70493 - RNA, 22 nt, Homo sapiens
cugggucaguuucugauuauug

SEQ ID NO: 70494 - RNA, 22 nt, Homo sapiens
cugguaugugugacugcauuga

SEQ ID NO: 70495 - RNA, 22 nt, Homo sapiens
cuggugagaugucuuuccucuu

SEQ ID NO: 70496 - RNA, 22 nt, Homo sapiens
cugguuuguaaaguuccugaga

SEQ ID NO: 70497 - RNA, 22 nt, Homo sapiens
cuguaaaguucucauuguagcc

SEQ ID NO: 70498 - RNA, 22 nt, Homo sapiens
cuguaaggcacuaagcauaugu

SEQ ID NO: 70499 - RNA, 22 nt, Homo sapiens
cuguagacauuaggccugcacu

SEQ ID NO: 70500 - RNA, 22 nt, Homo sapiens
cugucacugggaggggcagcag

SEQ ID NO: 70501 - RNA, 22 nt, Homo sapiens
cugucacuggggcacauguccc

SEQ ID NO: 70502 - RNA, 22 nt, Homo sapiens
cuguccugcagagucagaauga

SEQ ID NO: 70503 - RNA, 22 nt, Homo sapiens
cugugacugcagggcauauuug

SEQ ID NO: 70504 - RNA, 17 nt, Homo sapiens
cugugaugaucuugucu

SEQ ID NO: 70505 - RNA, 22 nt, Homo sapiens
cugugcauguaugcgugaguuc

SEQ ID NO: 70506 - RNA, 22 nt, Homo sapiens
cugugcauguuguccaauucuu

SEQ ID NO: 70507 - RNA, 22 nt, Homo sapiens
gugacaguggagacuuacuuca

SEQ ID NO: 70508 - RNA, 22 nt, Homo sapiens
gugaccaaagauagcucaaguu

SEQ ID NO: 70509 - RNA, 22 nt, Homo sapiens
gugaccauuugacauauccuug

SEQ ID NO: 70510 - RNA, 22 nt, Homo sapiens
gugaccucauuacggggccugc

SEQ ID NO: 70511 - RNA, 20 nt, Homo sapiens
gugacugagcacgggcacag

SEQ ID NO: 70512 - RNA, 22 nt, Homo sapiens
gugacugcauccauccaggcuu

SEQ ID NO: 70513 - RNA, 22 nt, Homo sapiens
gugacuggacucugaagaaaau

SEQ ID NO: 70514 - RNA, 22 nt, Homo sapiens
gugagaacugcuggggccacag

SEQ ID NO: 70515 - RNA, 22 nt, Homo sapiens
gugagaacugugucuuauaaac

SEQ ID NO: 70516 - RNA, 22 nt, Homo sapiens
gugagaauauuuuaaauacuaa

SEQ ID NO: 70517 - RNA, 22 nt, Homo sapiens
gugagaaucaaacuacauaaau

SEQ ID NO: 70518 - RNA, 22 nt, Homo sapiens
gugagagaaugacuauguguuu

SEQ ID NO: 70519 - RNA, 16 nt, Homo sapiens
gugagagaugacaaac

SEQ ID NO: 70520 - RNA, 22 nt, Homo sapiens
gugagaugguaucucauugugg

SEQ ID NO: 70521 - RNA, 22 nt, Homo sapiens
gugagauuagcugagauccuug

SEQ ID NO: 70522 - RNA, 19 nt, Homo sapiens
gugagcacagacaauacaa

SEQ ID NO: 70523 - RNA, 22 nt, Homo sapiens
gugagcauucaaggaaggagcu

SEQ ID NO: 70524 - RNA, 22 nt, Homo sapiens
gugagcuccucucuauguguca

SEQ ID NO: 70525 - RNA, 22 nt, Homo sapiens
gugagguacgugucaagaacca

SEQ ID NO: 70526 - RNA, 22 nt, Homo sapiens
gugagguagagcaugugaaaga

SEQ ID NO: 70527 - RNA, 22 nt, Homo sapiens
gugagguauacugggaucacua

SEQ ID NO: 70528 - RNA, 22 nt, Homo sapiens
gugaggucagggcuguggacag

SEQ ID NO: 70529 - RNA, 22 nt, Homo sapiens
gugaggugguacaauauuaacu

SEQ ID NO: 70530 - RNA, 22 nt, Homo sapiens
gugagucaaucugagggguuca

SEQ ID NO: 70531 - RNA, 22 nt, Homo sapiens
gugauacugaugacuuagagaa

SEQ ID NO: 70532 - RNA, 22 nt, Homo sapiens
gugauagguugucacugucacu

SEQ ID NO: 70533 - RNA, 22 nt, Homo sapiens
gugauaucacuguaucacucca

SEQ ID NO: 70534 - RNA, 22 nt, Homo sapiens
gugauaucugagccugccccag

SEQ ID NO: 70535 - RNA, 22 nt, Homo sapiens
cuuguaccccugagucccauaa

SEQ ID NO: 70536 - RNA, 19 nt, Homo sapiens
cuuguacucggcgcaguug

SEQ ID NO: 70537 - RNA, 22 nt, Homo sapiens
cuugugauugcacggcugccug

SEQ ID NO: 70538 - RNA, 22 nt, Homo sapiens
cuuguguuacauauuuaagaga

SEQ ID NO: 70539 - RNA, 22 nt, Homo sapiens
cuuguucuccuaagaugaaugc

SEQ ID NO: 70540 - RNA, 22 nt, Homo sapiens
cuuuaugagguuggauggaucu

SEQ ID NO: 70541 - RNA, 21 nt, Homo sapiens
cuuuaugcuguguuagaaaag

SEQ ID NO: 70542 - RNA, 22 nt, Homo sapiens
cuuuccauuguuggagcauaaa

SEQ ID NO: 70543 - RNA, 22 nt, Homo sapiens
cuuucucagugagacccgagau

SEQ ID NO: 70544 - RNA, 22 nt, Homo sapiens
cuuugaugagaaaauacuuugu

SEQ ID NO: 70545 - RNA, 22 nt, Homo sapiens
cuuugcaaaacauugagaccuc

SEQ ID NO: 70546 - RNA, 21 nt, Homo sapiens
cuuugcacugcuccucagcuc

SEQ ID NO: 70547 - RNA, 22 nt, Homo sapiens
cuuuggccauagcuaaaugauu

SEQ ID NO: 70548 - RNA, 21 nt, Homo sapiens
cuuugguuucugacuugcaua

SEQ ID NO: 70549 - RNA, 22 nt, Homo sapiens
cuuuguaugucaugacaacugu

SEQ ID NO: 70550 - RNA, 22 nt, Homo sapiens
cuuuguccuucaagguguguca

SEQ ID NO: 70551 - RNA, 22 nt, Homo sapiens
cuuugugugggccaagggcugg

SEQ ID NO: 70552 - RNA, 22 nt, Homo sapiens
cuuuugugauuccucaguuacu

SEQ ID NO: 70553 - RNA, 22 nt, Homo sapiens
cuuuugugauucuucaguugcu

SEQ ID NO: 70554 - RNA, 22 nt, Homo sapiens
cuuuuguggaucuucuguugcu

SEQ ID NO: 70555 - RNA, 22 nt, Homo sapiens
cuuuuugcuagagucuaggguc

SEQ ID NO: 70556 - RNA, 22 nt, Homo sapiens
cuuuuugcugcagcaauacugg

SEQ ID NO: 70557 - RNA, 20 nt, Homo sapiens
cuuuuugcugugcugggagc

SEQ ID NO: 70558 - RNA, 22 nt, Homo sapiens
cuuuuugguagagcaggugugc

SEQ ID NO: 70559 - RNA, 22 nt, Homo sapiens
gaaacugcauuucuaacaagcu

SEQ ID NO: 70560 - RNA, 22 nt, Homo sapiens
gaaagcuaaugacuuuggguga

SEQ ID NO: 70561 - RNA, 22 nt, Homo sapiens
gaaagugcugcuugacugggau

SEQ ID NO: 70562 - RNA, 22 nt, Homo sapiens
gaaaguguugagauuacaggca

SEQ ID NO: 70563 - RNA, 22 nt, Homo sapiens
gaaaugcucagggguuuuccag

SEQ ID NO: 70564 - RNA, 22 nt, Homo sapiens
gaaaugcucauuuuggauccuu

SEQ ID NO: 70565 - RNA, 22 nt, Homo sapiens
gaaauggaucagagcaagcuuu

SEQ ID NO: 70566 - RNA, 20 nt, Homo sapiens
gaacugguguauguuuaacu

SEQ ID NO: 70567 - RNA, 22 nt, Homo sapiens
gaagaaguacaagacaaauuuu

SEQ ID NO: 70568 - RNA, 18 nt, Homo sapiens
gaagaaguaggcauggca

SEQ ID NO: 70569 - RNA, 22 nt, Homo sapiens
gaagauaucuaguaccauuguc

SEQ ID NO: 70570 - RNA, 22 nt, Homo sapiens
gaagcagcauucugguuuuugg

SEQ ID NO: 70571 - RNA, 22 nt, Homo sapiens
gaaggcaugcugcauggccaga

SEQ ID NO: 70572 - RNA, 22 nt, Homo sapiens
gaagugcuuuuggacuaacagu

SEQ ID NO: 70573 - RNA, 17 nt, Homo sapiens
gaaguguuucagcagcu

SEQ ID NO: 70574 - RNA, 22 nt, Homo sapiens
gaauagugcugcagcaaacaua

SEQ ID NO: 70575 - RNA, 22 nt, Homo sapiens
gaaucauuggguugauucaaga

SEQ ID NO: 70576 - RNA, 22 nt, Homo sapiens
gaaugcuaaguuuccucccuau

SEQ ID NO: 70577 - RNA, 22 nt, Homo sapiens
gaaugcuaaguuuccucccugu

SEQ ID NO: 70578 - RNA, 22 nt, Homo sapiens
gaauggaacugacuauagcuga

SEQ ID NO: 70579 - RNA, 22 nt, Homo sapiens
gaaugugcuguuggcugggcgu

SEQ ID NO: 70580 - RNA, 22 nt, Homo sapiens
gacacagugaagucucuacuug

SEQ ID NO: 70581 - RNA, 22 nt, Homo sapiens
gacagacacaauugauccauga

SEQ ID NO: 70582 - RNA, 22 nt, Homo sapiens
gacagagcaagacccuauuuaa

SEQ ID NO: 70583 - RNA, 18 nt, Homo sapiens
gacaguguggcaauuccu

SEQ ID NO: 70584 - RNA, 18 nt, Homo sapiens
gacaguguggugauuccu

SEQ ID NO: 70585 - RNA, 22 nt, Homo sapiens
gacauagcuagauaaccucaug

SEQ ID NO: 70586 - RNA, 22 nt, Homo sapiens
gacauguuucucucuguuuacu

SEQ ID NO: 70587 - RNA, 22 nt, Homo sapiens
gaccaaagaggcaggcauuaga

SEQ ID NO: 70588 - RNA, 22 nt, Homo sapiens
gaccacauuccacacaggcuuu

SEQ ID NO: 70589 - RNA, 22 nt, Homo sapiens
gacccauagaagcgagcuugug

SEQ ID NO: 70590 - RNA, 22 nt, Homo sapiens
gaccccuagagauaggaggaac

SEQ ID NO: 70591 - RNA, 22 nt, Homo sapiens
gaccugagagguacauguauuu

SEQ ID NO: 70592 - RNA, 22 nt, Homo sapiens
gaccuggugguccacccgccuu

SEQ ID NO: 70593 - RNA, 22 nt, Homo sapiens
gacuagggaccaugagcaaucc

SEQ ID NO: 70594 - RNA, 22 nt, Homo sapiens
gacuaguuaggucucucacaga

SEQ ID NO: 70595 - RNA, 22 nt, Homo sapiens
gacucuguagacaaucacaucu

SEQ ID NO: 70596 - RNA, 22 nt, Homo sapiens
gacugaguaagcagaagcaauu

SEQ ID NO: 70597 - RNA, 22 nt, Homo sapiens
gacuuagagauguuguauuugg

SEQ ID NO: 70598 - RNA, 20 nt, Homo sapiens
gacuucagaagcuucagagu

SEQ ID NO: 70599 - RNA, 18 nt, Homo sapiens
gacuuggaguuuacagug

SEQ ID NO: 70600 - RNA, 23 nt, Homo sapiens
cuguggugaggcccuagaaucug

SEQ ID NO: 70601 - RNA, 22 nt, Homo sapiens
cugugguguaacucuuggggcg

SEQ ID NO: 70602 - RNA, 22 nt, Homo sapiens
cuguucaggaggcauuuggugg

SEQ ID NO: 70603 - RNA, 22 nt, Homo sapiens
cuguugcaguuauggcugcagg

SEQ ID NO: 70604 - RNA, 19 nt, Homo sapiens
cuguuguacuccaggcauu

SEQ ID NO: 70605 - RNA, 22 nt, Homo sapiens
cuguuugguaaggaugccucag

SEQ ID NO: 70606 - RNA, 22 nt, Homo sapiens
cuguuugguuaucuuuuccugu

SEQ ID NO: 70607 - RNA, 18 nt, Homo sapiens
cuuaacauugggaugaua

SEQ ID NO: 70608 - RNA, 22 nt, Homo sapiens
cuuaagcauugacuuuggacag

SEQ ID NO: 70609 - RNA, 21 nt, Homo sapiens
cuuaagccacuaaguuuugga

SEQ ID NO: 70610 - RNA, 22 nt, Homo sapiens
cuuaaguaguuguggaaugaau

SEQ ID NO: 70611 - RNA, 22 nt, Homo sapiens
cuuaggguacuuuggugcauca

SEQ ID NO: 70612 - RNA, 20 nt, Homo sapiens
cuucacagaaguggaaucau

SEQ ID NO: 70613 - RNA, 22 nt, Homo sapiens
cuucacggugccuacuuguguc

SEQ ID NO: 70614 - RNA, 22 nt, Homo sapiens
cuucaguucuguaaggacagca

SEQ ID NO: 70615 - RNA, 22 nt, Homo sapiens
cuucaugggagaaccacaggua

SEQ ID NO: 70616 - RNA, 22 nt, Homo sapiens
cuuccaaguggggcacgugcca

SEQ ID NO: 70617 - RNA, 22 nt, Homo sapiens
cuuccaguggcagccgggcaug

SEQ ID NO: 70618 - RNA, 20 nt, Homo sapiens
cuuccaguggccccaucuuu

SEQ ID NO: 70619 - RNA, 22 nt, Homo sapiens
cuuccauauucuaggacaggcu

SEQ ID NO: 70620 - RNA, 22 nt, Homo sapiens
cuucggugaguagauggguuaa

SEQ ID NO: 70621 - RNA, 22 nt, Homo sapiens
cuucucagugcucaucuuauuu

SEQ ID NO: 70622 - RNA, 22 nt, Homo sapiens
guauaguaguacaaaaguuuuu

SEQ ID NO: 70623 - RNA, 22 nt, Homo sapiens
guaugaccucgcuuuauugcag

SEQ ID NO: 70624 - RNA, 22 nt, Homo sapiens
guaugguacuuuaugguuagug

SEQ ID NO: 70625 - RNA, 22 nt, Homo sapiens
guaugucuugucuauggcugcu

SEQ ID NO: 70626 - RNA, 22 nt, Homo sapiens
guauuaguuaucuacugcugug

SEQ ID NO: 70627 - RNA, 22 nt, Homo sapiens
guauugaguaaauguuuauugg

SEQ ID NO: 70628 - RNA, 22 nt, Homo sapiens
guauugccacuuuugaacaguu

SEQ ID NO: 70629 - RNA, 22 nt, Homo sapiens
guauugccugugugccagccac

SEQ ID NO: 70630 - RNA, 22 nt, Homo sapiens
guauuugauuauagcaugcuua

SEQ ID NO: 70631 - RNA, 19 nt, Homo sapiens
guauuugguaaacucucca

SEQ ID NO: 70632 - RNA, 22 nt, Homo sapiens
guauuuuguuagggugugguau

SEQ ID NO: 70633 - RNA, 22 nt, Homo sapiens
gucaaagucuauuggcuaauuc

SEQ ID NO: 70634 - RNA, 22 nt, Homo sapiens
gucaaaugcacagaaccauuaa

SEQ ID NO: 70635 - RNA, 22 nt, Homo sapiens
gucaacauauuaauuauguucu

SEQ ID NO: 70636 - RNA, 22 nt, Homo sapiens
gucaagugaagaccugacucuu

SEQ ID NO: 70637 - RNA, 22 nt, Homo sapiens
gucacagaaaaagauaugccaa

SEQ ID NO: 70638 - RNA, 22 nt, Homo sapiens
gucacagaggcuaagaccccac

SEQ ID NO: 70639 - RNA, 22 nt, Homo sapiens
gucacagcacuuuuaguaagug

SEQ ID NO: 70640 - RNA, 22 nt, Homo sapiens
gucacauugaugcccauggugg

SEQ ID NO: 70641 - RNA, 22 nt, Homo sapiens
gucacggaauguaaguggaagu

SEQ ID NO: 70642 - RNA, 22 nt, Homo sapiens
gucacugagcaauagaaaguuu

SEQ ID NO: 70643 - RNA, 22 nt, Homo sapiens
gucacugucuacuguaauagcc

SEQ ID NO: 70644 - RNA, 22 nt, Homo sapiens
gucacugugacggcaguuacau

SEQ ID NO: 70645 - RNA, 22 nt, Homo sapiens
gucagagcacugaguugugggc

SEQ ID NO: 70646 - RNA, 22 nt, Homo sapiens
gucagcaaagaggaauaguuug

SEQ ID NO: 70647 - RNA, 22 nt, Homo sapiens
gucagcuuuuccuuacuuuagg

SEQ ID NO: 70648 - RNA, 22 nt, Homo sapiens
gucagggagggauagaugauua

SEQ ID NO: 70649 - RNA, 22 nt, Homo sapiens
gucagggagucucuaucagugg

SEQ ID NO: 70650 - RNA, 22 nt, Homo sapiens
gucagguaccugaaagcagcca

SEQ ID NO: 70651 - RNA, 22 nt, Homo sapiens
gucagguauguuccaaaggcgg

SEQ ID NO: 70652 - RNA, 22 nt, Homo sapiens
gucaggugcuuacgcggagauc

SEQ ID NO: 70653 - RNA, 22 nt, Homo sapiens
gucagugccugucccaggcuuu

SEQ ID NO: 70654 - RNA, 22 nt, Homo sapiens
gucagugucuuaacagagauua

SEQ ID NO: 70655 - RNA, 22 nt, Homo sapiens
gucagugucuuugcagcucaga

SEQ ID NO: 70656 - RNA, 22 nt, Homo sapiens
gucaguucuugugguugcauuc

SEQ ID NO: 70657 - RNA, 22 nt, Homo sapiens
gucaguuugguuaaucauucca

SEQ ID NO: 70658 - RNA, 22 nt, Homo sapiens
gucauaugcucggaaaauguua

SEQ ID NO: 70659 - RNA, 22 nt, Homo sapiens
gucaugaaguuuugaaugaaau

SEQ ID NO: 70660 - RNA, 22 nt, Homo sapiens
gucauugagucagggaguaucu

SEQ ID NO: 70661 - RNA, 22 nt, Homo sapiens
gucauugcacuccagccuggac

SEQ ID NO: 70662 - RNA, 22 nt, Homo sapiens
gucauugguucuguuuauguga

SEQ ID NO: 70663 - RNA, 22 nt, Homo sapiens
guccaaagugggagaggugggg

SEQ ID NO: 70664 - RNA, 22 nt, Homo sapiens
gucccugcgauugugggauccu

SEQ ID NO: 70665 - RNA, 22 nt, Homo sapiens
guccugaagaccuuccucugga

SEQ ID NO: 70666 - RNA, 22 nt, Homo sapiens
gucgugcagaccucacagcauu

SEQ ID NO: 70667 - RNA, 22 nt, Homo sapiens
gucguggagcucacagugugcc

SEQ ID NO: 70668 - RNA, 22 nt, Homo sapiens
gucucacaggcaugaugccagc

SEQ ID NO: 70669 - RNA, 22 nt, Homo sapiens
gucuccggcuguccuuugaggu

SEQ ID NO: 70670 - RNA, 22 nt, Homo sapiens
gucuggagacuugggucaucaa

SEQ ID NO: 70671 - RNA, 22 nt, Homo sapiens
gucuggcuccugucuaaucacu

SEQ ID NO: 70672 - RNA, 22 nt, Homo sapiens
gucuggcuccuucuacuacaug

SEQ ID NO: 70673 - RNA, 22 nt, Homo sapiens
gucuggguuuguuuguacuugc

SEQ ID NO: 70674 - RNA, 22 nt, Homo sapiens
gucugguugacagcauguggcc

SEQ ID NO: 70675 - RNA, 22 nt, Homo sapiens
gucuuccagccuccaucuuucu

SEQ ID NO: 70676 - RNA, 22 nt, Homo sapiens
gucuugaaggcugaguaccugu

SEQ ID NO: 70677 - RNA, 22 nt, Homo sapiens
gucuuggagaacucagcuuggc

SEQ ID NO: 70678 - RNA, 22 nt, Homo sapiens
gucuuggcaugugcagcuggga

SEQ ID NO: 70679 - RNA, 20 nt, Homo sapiens
gucuuguagcucaaguuauu

SEQ ID NO: 70680 - RNA, 22 nt, Homo sapiens
gucuuugcauguauguucauga

SEQ ID NO: 70681 - RNA, 22 nt, Homo sapiens
gucuuugcuuuuaaccagaggu

SEQ ID NO: 70682 - RNA, 22 nt, Homo sapiens
gucuuuugcuagccagagagcu

SEQ ID NO: 70683 - RNA, 22 nt, Homo sapiens
gugaaagcaucugacugugcca

SEQ ID NO: 70684 - RNA, 22 nt, Homo sapiens
gugaaauauuuaacguccaggu

SEQ ID NO: 70685 - RNA, 17 nt, Homo sapiens
gugaaaucaucauuuuu

SEQ ID NO: 70686 - RNA, 22 nt, Homo sapiens
gugaaaugaaacgcuaugucuu

SEQ ID NO: 70687 - RNA, 22 nt, Homo sapiens
gugaacaauguuuuauccuggg

SEQ ID NO: 70688 - RNA, 22 nt, Homo sapiens
gugaaguuuuugugaggccuaa

SEQ ID NO: 70689 - RNA, 22 nt, Homo sapiens
gugaaugaaugggugaauacau

SEQ ID NO: 70690 - RNA, 22 nt, Homo sapiens
gugaauguaaagucaugugacu

SEQ ID NO: 70691 - RNA, 22 nt, Homo sapiens
gugaauugagagaacuguguua

SEQ ID NO: 70692 - RNA, 20 nt, Homo sapiens
gugacacucguuaaccucug

SEQ ID NO: 70693 - RNA, 22 nt, Homo sapiens
auagugcuguauuaaacauacg

SEQ ID NO: 70694 - RNA, 22 nt, Homo sapiens
auagugcugugaugaacauaca

SEQ ID NO: 70695 - RNA, 22 nt, Homo sapiens
auagugcuuuuuagaaccugga

SEQ ID NO: 70696 - RNA, 19 nt, Homo sapiens
auaguguaggaaaacagcu

SEQ ID NO: 70697 - RNA, 23 nt, Homo sapiens
auauaguagaugugcaguaacau

SEQ ID NO: 70698 - RNA, 22 nt, Homo sapiens
auauaguguuuuuugguacgcu

SEQ ID NO: 70699 - RNA, 22 nt, Homo sapiens
auauaugcacacgugugcauau

SEQ ID NO: 70700 - RNA, 22 nt, Homo sapiens
auaucacaaacaagucuguacu

SEQ ID NO: 70701 - RNA, 22 nt, Homo sapiens
auaucacaggaaaggaagauac

SEQ ID NO: 70702 - RNA, 22 nt, Homo sapiens
auaucccagugaugauugauag

SEQ ID NO: 70703 - RNA, 22 nt, Homo sapiens
auauccuggagcauuuuugcaa

SEQ ID NO: 70704 - RNA, 17 nt, Homo sapiens
auaugaauuuuggagau

SEQ ID NO: 70705 - RNA, 22 nt, Homo sapiens
auaugcaaauccauagagacag

SEQ ID NO: 70706 - RNA, 22 nt, Homo sapiens
auaugcacuauacacacguaua

SEQ ID NO: 70707 - RNA, 22 nt, Homo sapiens
auaugccacugaacuguaccca

SEQ ID NO: 70708 - RNA, 22 nt, Homo sapiens
auaugcuaauuuuuagucgagc

SEQ ID NO: 70709 - RNA, 22 nt, Homo sapiens
auaugucuauuauuagggcagg

SEQ ID NO: 70710 - RNA, 21 nt, Homo sapiens
auaugugcuguggaagucagc

SEQ ID NO: 70711 - RNA, 22 nt, Homo sapiens
auauguucucauucauaugugg

SEQ ID NO: 70712 - RNA, 18 nt, Homo sapiens
auauugcauuggauggau

SEQ ID NO: 70713 - RNA, 18 nt, Homo sapiens
auauugccuucagacuag

SEQ ID NO: 70714 - RNA, 22 nt, Homo sapiens
auauugcuccuaauaccacggu

SEQ ID NO: 70715 - RNA, 22 nt, Homo sapiens
auauugcuuagugaugaagucu

SEQ ID NO: 70716 - RNA, 22 nt, Homo sapiens
aucaaaugcuggcagagugccu

SEQ ID NO: 70717 - RNA, 22 nt, Homo sapiens
aucaaauugucauuuuaaggau

SEQ ID NO: 70718 - RNA, 22 nt, Homo sapiens
aucaagguaggacuugaacccu

SEQ ID NO: 70719 - RNA, 22 nt, Homo sapiens
aucacaauuguacguaggagcc

SEQ ID NO: 70720 - RNA, 22 nt, Homo sapiens
aucacagauauggguuuaaauc

SEQ ID NO: 70721 - RNA, 22 nt, Homo sapiens
aucacagguacuauggcugaca

SEQ ID NO: 70722 - RNA, 22 nt, Homo sapiens
aucacaggucaaaucauuauuu

SEQ ID NO: 70723 - RNA, 22 nt, Homo sapiens
aucacaguuaagaggugaugaa

SEQ ID NO: 70724 - RNA, 22 nt, Homo sapiens
aucacauggccagguaguaauc

SEQ ID NO: 70725 - RNA, 22 nt, Homo sapiens
aucacauuuauaguggcacgca

SEQ ID NO: 70726 - RNA, 22 nt, Homo sapiens
aucaccagaugcuucaagcaga

SEQ ID NO: 70727 - RNA, 22 nt, Homo sapiens
aucaccuggaguagcccguccc

SEQ ID NO: 70728 - RNA, 22 nt, Homo sapiens
aucacuagaucauagguaaaca

SEQ ID NO: 70729 - RNA, 20 nt, Homo sapiens
aucacuggagaaggaaaccu

SEQ ID NO: 70730 - RNA, 22 nt, Homo sapiens
aucacugggauggaacugcuga

SEQ ID NO: 70731 - RNA, 22 nt, Homo sapiens
aucacuguaaguuuacacuuug

SEQ ID NO: 70732 - RNA, 22 nt, Homo sapiens
aucacuguccacucaucuuucu

SEQ ID NO: 70733 - RNA, 23 nt, Homo sapiens
aucacuguuaacaauuucuuccu

SEQ ID NO: 70734 - RNA, 22 nt, Homo sapiens
aucagaaucucuagugggacca

SEQ ID NO: 70735 - RNA, 20 nt, Homo sapiens
aucagagacuaggauugcca

SEQ ID NO: 70736 - RNA, 22 nt, Homo sapiens
aucagagugaaacaugggagau

SEQ ID NO: 70737 - RNA, 22 nt, Homo sapiens
aucagauggcuaaaacagaaga

SEQ ID NO: 70738 - RNA, 22 nt, Homo sapiens
aucagauguuuguauaggagua

SEQ ID NO: 70739 - RNA, 22 nt, Homo sapiens
aucagcacugaucauacagcuu

SEQ ID NO: 70740 - RNA, 22 nt, Homo sapiens
aucagcagcaugaaaacggacu

SEQ ID NO: 70741 - RNA, 22 nt, Homo sapiens
aucagcauucccaaaugaugug

SEQ ID NO: 70742 - RNA, 23 nt, Homo sapiens
aucagguuguagaauguguuugc

SEQ ID NO: 70743 - RNA, 22 nt, Homo sapiens
aucagugagugguuagugaaug

SEQ ID NO: 70744 - RNA, 22 nt, Homo sapiens
aucagugcagugggaacuagaa

SEQ ID NO: 70745 - RNA, 22 nt, Homo sapiens
aucagugcauguuuguugagcu

SEQ ID NO: 70746 - RNA, 22 nt, Homo sapiens
aucauacuguuuugauuacugu

SEQ ID NO: 70747 - RNA, 22 nt, Homo sapiens
aucauagcucacugcagccucg

SEQ ID NO: 70748 - RNA, 22 nt, Homo sapiens
aucauauccuagauauaacuuc

SEQ ID NO: 70749 - RNA, 22 nt, Homo sapiens
aucaucaugcacuacagccugg

SEQ ID NO: 70750 - RNA, 22 nt, Homo sapiens
aucauuaguuguggaauucuug

SEQ ID NO: 70751 - RNA, 22 nt, Homo sapiens
aucauugugcaucuucauucca

SEQ ID NO: 70752 - RNA, 22 nt, Homo sapiens
auccaucagacggcaggcguug

SEQ ID NO: 70753 - RNA, 22 nt, Homo sapiens
auccauugcucaagagaaguca

SEQ ID NO: 70754 - RNA, 22 nt, Homo sapiens
aucccaguaaaaauggcuucua

SEQ ID NO: 70755 - RNA, 22 nt, Homo sapiens
aucccgagacuuugcugaaguu

SEQ ID NO: 70756 - RNA, 22 nt, Homo sapiens
aucccugugauccaaucacuuc

SEQ ID NO: 70757 - RNA, 22 nt, Homo sapiens
aucccuuccuagcacuuggugu

SEQ ID NO: 70758 - RNA, 22 nt, Homo sapiens
auccuguagagaugagggugga

SEQ ID NO: 70759 - RNA, 21 nt, Homo sapiens
aucucacuugaauguaaaagc

SEQ ID NO: 70760 - RNA, 16 nt, Homo sapiens
aucucagaccugcuga

SEQ ID NO: 70761 - RNA, 19 nt, Homo sapiens
aucuggaguuccuggggcu

SEQ ID NO: 70762 - RNA, 22 nt, Homo sapiens
aucugggguuggcaaaguuugg

SEQ ID NO: 70763 - RNA, 22 nt, Homo sapiens
aucugguguggcugugauccuc

SEQ ID NO: 70764 - RNA, 21 nt, Homo sapiens
aucuugguauagucuuauugg

SEQ ID NO: 70765 - RNA, 22 nt, Homo sapiens
aucuuguguugaauggugcaga

SEQ ID NO: 70766 - RNA, 22 nt, Homo sapiens
aucuuuaguggcuguuuucaga

SEQ ID NO: 70767 - RNA, 22 nt, Homo sapiens
augaaagguugucuuaagccau

SEQ ID NO: 70768 - RNA, 17 nt, Homo sapiens
augaacucaucauuuuu

SEQ ID NO: 70769 - RNA, 22 nt, Homo sapiens
augaagagaaaguggaucuugg

SEQ ID NO: 70770 - RNA, 20 nt, Homo sapiens
augaagugaaguuagggaac

SEQ ID NO: 70771 - RNA, 22 nt, Homo sapiens
augaaugcacugcggguggaug

SEQ ID NO: 70772 - RNA, 22 nt, Homo sapiens
augaauguaaagaaugugggaa

SEQ ID NO: 70773 - RNA, 20 nt, Homo sapiens
augaauguccuugauggcau

SEQ ID NO: 70774 - RNA, 22 nt, Homo sapiens
augacaguaugacuccaaaagu

SEQ ID NO: 70775 - RNA, 22 nt, Homo sapiens
augacagugagugagcucucac

SEQ ID NO: 70776 - RNA, 22 nt, Homo sapiens
augacauagaagcaauccccua

SEQ ID NO: 70777 - RNA, 22 nt, Homo sapiens
augacauuccacagccguagag

SEQ ID NO: 70778 - RNA, 22 nt, Homo sapiens
augacauugaugcucuggcugg

SEQ ID NO: 70779 - RNA, 22 nt, Homo sapiens
augaccaaagaaaugcuauagg

SEQ ID NO: 70780 - RNA, 22 nt, Homo sapiens
augaccaugauccuugccgacc

SEQ ID NO: 70781 - RNA, 22 nt, Homo sapiens
augaccuuggggaaccaugucu

SEQ ID NO: 70782 - RNA, 22 nt, Homo sapiens
augacugaguagcauuccauua

SEQ ID NO: 70783 - RNA, 22 nt, Homo sapiens
augacugucagggcagucauug

SEQ ID NO: 70784 - RNA, 17 nt, Homo sapiens
augacuucuucagugug

SEQ ID NO: 70785 - RNA, 22 nt, Homo sapiens
augagaacugucaaugagagcu

SEQ ID NO: 70786 - RNA, 22 nt, Homo sapiens
augagagcaacaccuucacuug

SEQ ID NO: 70787 - RNA, 22 nt, Homo sapiens
agcagugugaaaauggacuaau

SEQ ID NO: 70788 - RNA, 22 nt, Homo sapiens
agcagugugagaauggacuaau

SEQ ID NO: 70789 - RNA, 22 nt, Homo sapiens
agcaucacguagacuuuaccau

SEQ ID NO: 70790 - RNA, 18 nt, Homo sapiens
agcaucacugaucauccu

SEQ ID NO: 70791 - RNA, 22 nt, Homo sapiens
agcaucauaccaaucugguccu

SEQ ID NO: 70792 - RNA, 22 nt, Homo sapiens
agcauggucacuuugggcccca

SEQ ID NO: 70793 - RNA, 17 nt, Homo sapiens
agcauguguuugagauu

SEQ ID NO: 70794 - RNA, 20 nt, Homo sapiens
agcauugguuagaacaguag

SEQ ID NO: 70795 - RNA, 22 nt, Homo sapiens
agcccagagacuguguaaauuu

SEQ ID NO: 70796 - RNA, 17 nt, Homo sapiens
agccccauuagcuaguu

SEQ ID NO: 70797 - RNA, 23 nt, Homo sapiens
agcccugugacucgaacgaggag

SEQ ID NO: 70798 - RNA, 22 nt, Homo sapiens
agccuagagagccacuuugaga

SEQ ID NO: 70799 - RNA, 22 nt, Homo sapiens
agcgccacugcacuccagccug

SEQ ID NO: 70800 - RNA, 22 nt, Homo sapiens
agcuacaucuugcucugggaug

SEQ ID NO: 70801 - RNA, 22 nt, Homo sapiens
agcuaguauuuuguuaaggauu

SEQ ID NO: 70802 - RNA, 19 nt, Homo sapiens
agcuagugcucagcuguca

SEQ ID NO: 70803 - RNA, 22 nt, Homo sapiens
agcuauauugaggaugccauuc

SEQ ID NO: 70804 - RNA, 21 nt, Homo sapiens
agcuccacucguucccaaagc

SEQ ID NO: 70805 - RNA, 22 nt, Homo sapiens
agcuccaucuucagggguucag

SEQ ID NO: 70806 - RNA, 22 nt, Homo sapiens
agcuccaugauaguaugucugu

SEQ ID NO: 70807 - RNA, 22 nt, Homo sapiens
agcuccauuguaaucaccuggu

SEQ ID NO: 70808 - RNA, 22 nt, Homo sapiens
agcuccuacuguuacaucauug

SEQ ID NO: 70809 - RNA, 22 nt, Homo sapiens
agcugauuuuaaguccuugucc

SEQ ID NO: 70810 - RNA, 22 nt, Homo sapiens
agcugcaauguuuaguauaaua

SEQ ID NO: 70811 - RNA, 22 nt, Homo sapiens
agcugcacugguauaggagaaa

SEQ ID NO: 70812 - RNA, 22 nt, Homo sapiens
agcugccagucuuguaaggccu

SEQ ID NO: 70813 - RNA, 21 nt, Homo sapiens
agcugcguuuaggcauuuucc

SEQ ID NO: 70814 - RNA, 22 nt, Homo sapiens
agcugguaguuuucuaguguuu

SEQ ID NO: 70815 - RNA, 22 nt, Homo sapiens
agcugguauuuguuagggaguu

SEQ ID NO: 70816 - RNA, 22 nt, Homo sapiens
agcuggucugauacuuaccucc

SEQ ID NO: 70817 - RNA, 22 nt, Homo sapiens
agcuggucuuggggaagaguag

SEQ ID NO: 70818 - RNA, 22 nt, Homo sapiens
agcugguuuaauaugcugucug

SEQ ID NO: 70819 - RNA, 22 nt, Homo sapiens
agcuguaguuuauucauguuaa

SEQ ID NO: 70820 - RNA, 20 nt, Homo sapiens
agcuguuguuaugagguuua

SEQ ID NO: 70821 - RNA, 22 nt, Homo sapiens
agcuguuguuuuaagauacuaa

SEQ ID NO: 70822 - RNA, 22 nt, Homo sapiens
agcuguuuuugugggcauguga

SEQ ID NO: 70823 - RNA, 22 nt, Homo sapiens
agcuuaugcuuggaagagauga

SEQ ID NO: 70824 - RNA, 22 nt, Homo sapiens
agcuucacaaugcagagggcag

SEQ ID NO: 70825 - RNA, 22 nt, Homo sapiens
agcuucauuguuaugaauguca

SEQ ID NO: 70826 - RNA, 22 nt, Homo sapiens
agcuuguauuuguagccuguug

SEQ ID NO: 70827 - RNA, 22 nt, Homo sapiens
agcuuguccuccacccacacug

SEQ ID NO: 70828 - RNA, 22 nt, Homo sapiens
agcuugugauucuccaucaugu

SEQ ID NO: 70829 - RNA, 22 nt, Homo sapiens
agcuuguuuuauagaaagucaa

SEQ ID NO: 70830 - RNA, 19 nt, Homo sapiens
agcuuuggcuaacuuucuc

SEQ ID NO: 70831 - RNA, 22 nt, Homo sapiens
aggaaauguuggucccauuucu

SEQ ID NO: 70832 - RNA, 16 nt, Homo sapiens
aggaagacuuagagau

SEQ ID NO: 70833 - RNA, 22 nt, Homo sapiens
aggaagcuagcauuuguucagu

SEQ ID NO: 70834 - RNA, 22 nt, Homo sapiens
aggaagugugcaauuaauuucu

SEQ ID NO: 70835 - RNA, 22 nt, Homo sapiens
aggaaucuaagguaucagguua

SEQ ID NO: 70836 - RNA, 22 nt, Homo sapiens
aggaauggaaacuuuugauggu

SEQ ID NO: 70837 - RNA, 22 nt, Homo sapiens
aggacacugauguaugcugugg

SEQ ID NO: 70838 - RNA, 20 nt, Homo sapiens
aggacuacagaggguaggau

SEQ ID NO: 70839 - RNA, 21 nt, Homo sapiens
aggagcauucaugacgagguu

SEQ ID NO: 70840 - RNA, 21 nt, Homo sapiens
aggagcauuguugugguggag

SEQ ID NO: 70841 - RNA, 22 nt, Homo sapiens
aggcagucucugccggcugagg

SEQ ID NO: 70842 - RNA, 22 nt, Homo sapiens
aggcaugauuguauuuugcucu

SEQ ID NO: 70843 - RNA, 22 nt, Homo sapiens
aggcaugugugcagacugucug

SEQ ID NO: 70844 - RNA, 22 nt, Homo sapiens
aggcugguauuuacaaaagcuc

SEQ ID NO: 70845 - RNA, 21 nt, Homo sapiens
aggcuguuguuuugggaugga

SEQ ID NO: 70846 - RNA, 22 nt, Homo sapiens
aggcuuuauuacagggucucag

SEQ ID NO: 70847 - RNA, 22 nt, Homo sapiens
aggcuuuuggagaacacugcac

SEQ ID NO: 70848 - RNA, 22 nt, Homo sapiens
agggagcaaaguggucuuucuc

SEQ ID NO: 70849 - RNA, 22 nt, Homo sapiens
agguaauuuucccagagggaaa

SEQ ID NO: 70850 - RNA, 22 nt, Homo sapiens
agguacuugagauucugaacug

SEQ ID NO: 70851 - RNA, 22 nt, Homo sapiens
agguacuuucccaaccauacug

SEQ ID NO: 70852 - RNA, 20 nt, Homo sapiens
agguagauagaugauagaua

SEQ ID NO: 70853 - RNA, 22 nt, Homo sapiens
agguagucuuuuccuauuguca

SEQ ID NO: 70854 - RNA, 22 nt, Homo sapiens
agguaguguuauuugcagcuga

SEQ ID NO: 70855 - RNA, 22 nt, Homo sapiens
agguauguuuuaugguccauaa

SEQ ID NO: 70856 - RNA, 21 nt, Homo sapiens
aggucaguaagaaugcagcac

SEQ ID NO: 70857 - RNA, 22 nt, Homo sapiens
agguccauuauuuucauucaug

SEQ ID NO: 70858 - RNA, 22 nt, Homo sapiens
aggugacugguuuaucuggcag

SEQ ID NO: 70859 - RNA, 22 nt, Homo sapiens
aggugguauuuaaaauuauuug

SEQ ID NO: 70860 - RNA, 22 nt, Homo sapiens
aggugguuuuaggcagagacau

SEQ ID NO: 70861 - RNA, 22 nt, Homo sapiens
aggugguuuuucaacacacacu

SEQ ID NO: 70862 - RNA, 22 nt, Homo sapiens
agguuaucccgcauuauuuggu

SEQ ID NO: 70863 - RNA, 22 nt, Homo sapiens
agguuaugauuauagagcgagg

SEQ ID NO: 70864 - RNA, 21 nt, Homo sapiens
agguuguguuuccucuuacuu

SEQ ID NO: 70865 - RNA, 22 nt, Homo sapiens
aguaacacaccugcauggugug

SEQ ID NO: 70866 - RNA, 22 nt, Homo sapiens
aguaaucaucugagggcagaaa

SEQ ID NO: 70867 - RNA, 22 nt, Homo sapiens
aguacaucuggcuggauagaua

SEQ ID NO: 70868 - RNA, 22 nt, Homo sapiens
aguaccacgugaugccauuuuc

SEQ ID NO: 70869 - RNA, 22 nt, Homo sapiens
uuccaguguguucauccucaga

SEQ ID NO: 70870 - RNA, 22 nt, Homo sapiens
uuccaguguuugacucaccuuu

SEQ ID NO: 70871 - RNA, 22 nt, Homo sapiens
uuccaguuuuauggguauagag

SEQ ID NO: 70872 - RNA, 22 nt, Homo sapiens
uuccauaggcuagaucaaccag

SEQ ID NO: 70873 - RNA, 22 nt, Homo sapiens
uuccauguaguugaacgguuuu

SEQ ID NO: 70874 - RNA, 22 nt, Homo sapiens
uuccaugugggcuugucaagua

SEQ ID NO: 70875 - RNA, 22 nt, Homo sapiens
uuccauguugauacgugaaguu

SEQ ID NO: 70876 - RNA, 22 nt, Homo sapiens
uuccauuuguucggugucgcca

SEQ ID NO: 70877 - RNA, 22 nt, Homo sapiens
uucccaguaaacucuaucccuc

SEQ ID NO: 70878 - RNA, 22 nt, Homo sapiens
uucccagugguuagcucugguc

SEQ ID NO: 70879 - RNA, 22 nt, Homo sapiens
uucccguacugguguugccuau

SEQ ID NO: 70880 - RNA, 22 nt, Homo sapiens
uucccguugcugugcuccugcc

SEQ ID NO: 70881 - RNA, 20 nt, Homo sapiens
uucccucagccuugagggua

SEQ ID NO: 70882 - RNA, 22 nt, Homo sapiens
uucccugugguauagaagccgu

SEQ ID NO: 70883 - RNA, 22 nt, Homo sapiens
uucccuuugaauuggaaaggug

SEQ ID NO: 70884 - RNA, 22 nt, Homo sapiens
uucccuuugugcauaggauuug

SEQ ID NO: 70885 - RNA, 22 nt, Homo sapiens
uggaauguuauggcuuuaaucu

SEQ ID NO: 70886 - RNA, 21 nt, Homo sapiens
uggaauguucugacuucaggg

SEQ ID NO: 70887 - RNA, 22 nt, Homo sapiens
uggaauguuuaucaaaacagua

SEQ ID NO: 70888 - RNA, 22 nt, Homo sapiens
uggaauuuacuuauuuaggggc

SEQ ID NO: 70889 - RNA, 22 nt, Homo sapiens
uggacaagauagguucuauauu

SEQ ID NO: 70890 - RNA, 22 nt, Homo sapiens
uggacacuggagauucgucagu

SEQ ID NO: 70891 - RNA, 22 nt, Homo sapiens
uggacauguacauauguguaug

SEQ ID NO: 70892 - RNA, 19 nt, Homo sapiens
uggaccccuuccuuacacc

SEQ ID NO: 70893 - RNA, 21 nt, Homo sapiens
uggaccccuuccuuacaucau

SEQ ID NO: 70894 - RNA, 22 nt, Homo sapiens
uggacuaaagaaacauuccgug

SEQ ID NO: 70895 - RNA, 22 nt, Homo sapiens
uggagaacugaugucuccaaga

SEQ ID NO: 70896 - RNA, 22 nt, Homo sapiens
uggagagucauuuauaguauuu

SEQ ID NO: 70897 - RNA, 22 nt, Homo sapiens
uggagagugauaaguaaaugga

SEQ ID NO: 70898 - RNA, 18 nt, Homo sapiens
uggagauaagaagaacuu

SEQ ID NO: 70899 - RNA, 22 nt, Homo sapiens
uggagauccuucauuuuggugu

SEQ ID NO: 70900 - RNA, 22 nt, Homo sapiens
uggagauguuuaaaauccacug

SEQ ID NO: 70901 - RNA, 22 nt, Homo sapiens
uggagcccuaguuccucauaac

SEQ ID NO: 70902 - RNA, 22 nt, Homo sapiens
uggaggacugcagaacugaggc

SEQ ID NO: 70903 - RNA, 22 nt, Homo sapiens
uggagggcuagucauuucuuuu

SEQ ID NO: 70904 - RNA, 22 nt, Homo sapiens
uggagguaggacgaagaacucu

SEQ ID NO: 70905 - RNA, 22 nt, Homo sapiens
uggaguauuauguaauuucaau

SEQ ID NO: 70906 - RNA, 22 nt, Homo sapiens
uggagucuugcucuguugccca

SEQ ID NO: 70907 - RNA, 22 nt, Homo sapiens
uggagugaaaacacacuaaucu

SEQ ID NO: 70908 - RNA, 22 nt, Homo sapiens
uggagugagaacuucaaugaug

SEQ ID NO: 70909 - RNA, 22 nt, Homo sapiens
uggagugauaugguuauauggg

SEQ ID NO: 70910 - RNA, 20 nt, Homo sapiens
uggagugcuguguugagaag

SEQ ID NO: 70911 - RNA, 22 nt, Homo sapiens
uggaguguaaauuaguucagcc

SEQ ID NO: 70912 - RNA, 22 nt, Homo sapiens
uggaguguagaagccagccucc

SEQ ID NO: 70913 - RNA, 22 nt, Homo sapiens
uggagugucaguuuccagaguu

SEQ ID NO: 70914 - RNA, 22 nt, Homo sapiens
uggaguguuggggcaggaucuc

SEQ ID NO: 70915 - RNA, 22 nt, Homo sapiens
uggaguuugacaugccuuuggg

SEQ ID NO: 70916 - RNA, 22 nt, Homo sapiens
uggauaguaaagucagauuccc

SEQ ID NO: 70917 - RNA, 22 nt, Homo sapiens
uggauaguuuacugaagagugg

SEQ ID NO: 70918 - RNA, 22 nt, Homo sapiens
uggauccaucacgccucuuccc

SEQ ID NO: 70919 - RNA, 22 nt, Homo sapiens
uggaucuguucuauuuaucuga

SEQ ID NO: 70920 - RNA, 22 nt, Homo sapiens
uggauggugauuggaucaugga

SEQ ID NO: 70921 - RNA, 22 nt, Homo sapiens
uggauguaauugauucauguug

SEQ ID NO: 70922 - RNA, 22 nt, Homo sapiens
uggauguauacaugcaggucac

SEQ ID NO: 70923 - RNA, 19 nt, Homo sapiens
uggauuguuagagcagugu

SEQ ID NO: 70924 - RNA, 22 nt, Homo sapiens
uggauuguuucucuugguauga

SEQ ID NO: 70925 - RNA, 22 nt, Homo sapiens
uggcaaaaaaccgcaguugccu

SEQ ID NO: 70926 - RNA, 22 nt, Homo sapiens
uggcaaauagcaauaggagggu

SEQ ID NO: 70927 - RNA, 22 nt, Homo sapiens
uggcaaauauuuuguuuuguaa

SEQ ID NO: 70928 - RNA, 22 nt, Homo sapiens
uggcaaauguaguacccaauag

SEQ ID NO: 70929 - RNA, 21 nt, Homo sapiens
uggcaacauggauggauucug

SEQ ID NO: 70930 - RNA, 22 nt, Homo sapiens
uggcaacuugcaaccucauucu

SEQ ID NO: 70931 - RNA, 22 nt, Homo sapiens
uggcaagauuguuccgguuugg

SEQ ID NO: 70932 - RNA, 22 nt, Homo sapiens
uggcaauaauucagugugggcu

SEQ ID NO: 70933 - RNA, 18 nt, Homo sapiens
uggcaauaugguucuacc

SEQ ID NO: 70934 - RNA, 22 nt, Homo sapiens
uggcagcgugaaagacuuuuuc

SEQ ID NO: 70935 - RNA, 22 nt, Homo sapiens
uggcaguuuacagcuuuaggag

SEQ ID NO: 70936 - RNA, 22 nt, Homo sapiens
uggcaguuucacauggcucaac

SEQ ID NO: 70937 - RNA, 22 nt, Homo sapiens
uggcaguuucauaugguucaac

SEQ ID NO: 70938 - RNA, 22 nt, Homo sapiens
uggcaguuuugauguggagaga

SEQ ID NO: 70939 - RNA, 22 nt, Homo sapiens
uggcaguuuuugccuucaauac

SEQ ID NO: 70940 - RNA, 20 nt, Homo sapiens
uggcaugaaauuuuccaagc

SEQ ID NO: 70941 - RNA, 22 nt, Homo sapiens
uggcaugaagaccccauccuuu

SEQ ID NO: 70942 - RNA, 22 nt, Homo sapiens
uggcaugaaguguguuuuaucu

SEQ ID NO: 70943 - RNA, 22 nt, Homo sapiens
uggcaugauccuagauucaaca

SEQ ID NO: 70944 - RNA, 22 nt, Homo sapiens
uggcaugauguguucauugaaa

SEQ ID NO: 70945 - RNA, 22 nt, Homo sapiens
uggcaugcauuguggguaauua

SEQ ID NO: 70946 - RNA, 22 nt, Homo sapiens
uggcauggaacuacuuugaaac

SEQ ID NO: 70947 - RNA, 22 nt, Homo sapiens
uggcaugggguaguagcgcugg

SEQ ID NO: 70948 - RNA, 22 nt, Homo sapiens
uggcauguaaugcagaaguugc

SEQ ID NO: 70949 - RNA, 22 nt, Homo sapiens
uggcauguauuuuguguauuaa

SEQ ID NO: 70950 - RNA, 22 nt, Homo sapiens
uggcaugucguuuuucauagga

SEQ ID NO: 70951 - RNA, 22 nt, Homo sapiens
uggcaugugugaagugcccagc

SEQ ID NO: 70952 - RNA, 23 nt, Homo sapiens
uggcauuuuaguuagcuucagug

SEQ ID NO: 70953 - RNA, 22 nt, Homo sapiens
uggcauuuugugugaauuagaa

SEQ ID NO: 70954 - RNA, 23 nt, Homo sapiens
uggcauuuuuggcaaugccuucu

SEQ ID NO: 70955 - RNA, 22 nt, Homo sapiens
uggccaguugaagacaaugcuc

SEQ ID NO: 70956 - RNA, 22 nt, Homo sapiens
uggcccccucccaaaucucaua

SEQ ID NO: 70957 - RNA, 22 nt, Homo sapiens
uggccuuuuccaagaacuacua

SEQ ID NO: 70958 - RNA, 22 nt, Homo sapiens
uggcgagaaaccauaugcuuuc

SEQ ID NO: 70959 - RNA, 22 nt, Homo sapiens
uggcgagaugcucgugugcaga

SEQ ID NO: 70960 - RNA, 19 nt, Homo sapiens
uggcuagagcagauauccu

SEQ ID NO: 70961 - RNA, 22 nt, Homo sapiens
uggcuagauauccagaguucug

SEQ ID NO: 70962 - RNA, 21 nt, Homo sapiens
uggcuauuucuguggcauaca

SEQ ID NO: 70963 - RNA, 22 nt, Homo sapiens
uggcuccguuguacaggcugga

SEQ ID NO: 70964 - RNA, 22 nt, Homo sapiens
uggcuguuguuacuaacaguuc

SEQ ID NO: 70965 - RNA, 22 nt, Homo sapiens
uggcuuuuguuauuuggaagcu

SEQ ID NO: 70966 - RNA, 22 nt, Homo sapiens
ugggaagaugcugcuucuuccu

SEQ ID NO: 70967 - RNA, 22 nt, Homo sapiens
ugggaagcugcugaacuacagu

SEQ ID NO: 70968 - RNA, 22 nt, Homo sapiens
ugggaauaugauacaggucuuu

SEQ ID NO: 70969 - RNA, 22 nt, Homo sapiens
ugggaccccuacucuuuccaca

SEQ ID NO: 70970 - RNA, 22 nt, Homo sapiens
ugggaucagucuggaauauuga

SEQ ID NO: 70971 - RNA, 22 nt, Homo sapiens
ugggaucaugagcaccgcuucc

SEQ ID NO: 70972 - RNA, 22 nt, Homo sapiens
ugggaucauuaugcauagugua

SEQ ID NO: 70973 - RNA, 22 nt, Homo sapiens
ugggaugaauacaaugggauca

SEQ ID NO: 70974 - RNA, 22 nt, Homo sapiens
ugggaugaugaaaaggcuuucu

SEQ ID NO: 70975 - RNA, 22 nt, Homo sapiens
ugggauguagccuucuauuuuc

SEQ ID NO: 70976 - RNA, 22 nt, Homo sapiens
ugggcaaaacuaagagcugugg

SEQ ID NO: 70977 - RNA, 19 nt, Homo sapiens
uuugccuaggcacauggcc

SEQ ID NO: 70978 - RNA, 22 nt, Homo sapiens
ugggcaaaugcuuuuuagucaa

SEQ ID NO: 70979 - RNA, 22 nt, Homo sapiens
ugggcuagaugcuuugggguca

SEQ ID NO: 70980 - RNA, 22 nt, Homo sapiens
uggguagauaucauaguugccc

SEQ ID NO: 70981 - RNA, 22 nt, Homo sapiens
uggguaggcccucauuggacag

SEQ ID NO: 70982 - RNA, 22 nt, Homo sapiens
uggguaguuucuuacaacucug

SEQ ID NO: 70983 - RNA, 19 nt, Homo sapiens
uggguaguuuucuggcugg

SEQ ID NO: 70984 - RNA, 22 nt, Homo sapiens
ugggugaguaucuauuauucag

SEQ ID NO: 70985 - RNA, 22 nt, Homo sapiens
ugguaagaaaaccauuauuagc

SEQ ID NO: 70986 - RNA, 22 nt, Homo sapiens
ugguaaguuuaacaugcauccc

SEQ ID NO: 70987 - RNA, 20 nt, Homo sapiens
ugguaauguaagagaggaga

SEQ ID NO: 70988 - RNA, 22 nt, Homo sapiens
ugguacuucaugcucacagaua

SEQ ID NO: 70989 - RNA, 22 nt, Homo sapiens
ugguauguauacuagcgacacu

SEQ ID NO: 70990 - RNA, 22 nt, Homo sapiens
ugguaugucuuucuuccuguag

SEQ ID NO: 70991 - RNA, 22 nt, Homo sapiens
uggucaaaugccaaucuguagu

SEQ ID NO: 70992 - RNA, 22 nt, Homo sapiens
uggucagaugcugaguggaucu

SEQ ID NO: 70993 - RNA, 22 nt, Homo sapiens
uggucaugaggugaggcuucuc

SEQ ID NO: 70994 - RNA, 22 nt, Homo sapiens
uggucauggaaauagaaugcac

SEQ ID NO: 70995 - RNA, 22 nt, Homo sapiens
ugguccacuaacccucaguauc

SEQ ID NO: 70996 - RNA, 20 nt, Homo sapiens
ugguccccugagucuggcuu

SEQ ID NO: 70997 - RNA, 21 nt, Homo sapiens
uggucccuucagaucggauuu

SEQ ID NO: 70998 - RNA, 22 nt, Homo sapiens
uggucuggagagucccgcccag

SEQ ID NO: 70999 - RNA, 22 nt, Homo sapiens
uggugagaaaugagaugcuuuu

SEQ ID NO: 71000 - RNA, 22 nt, Homo sapiens
uggugcuugaugaggguggagc

SEQ ID NO: 71001 - RNA, 15 nt, Homo sapiens
uggugguguugagac

SEQ ID NO: 71002 - RNA, 20 nt, Homo sapiens
uggugguuuuaugugguuua

SEQ ID NO: 71003 - RNA, 20 nt, Homo sapiens
ugguguuugaacagugaaug

SEQ ID NO: 71004 - RNA, 18 nt, Homo sapiens
uguaaacuaccucaaccu

SEQ ID NO: 71005 - RNA, 22 nt, Homo sapiens
uguaaacuuuugagauugacuu

SEQ ID NO: 71006 - RNA, 22 nt, Homo sapiens
uguaaagaaagcuguuguugua

SEQ ID NO: 71007 - RNA, 22 nt, Homo sapiens
uguaaaucuauuuuuaguguuu

SEQ ID NO: 71008 - RNA, 22 nt, Homo sapiens
uguaaaucuuucacaguugaug

SEQ ID NO: 71009 - RNA, 20 nt, Homo sapiens
uguaacaaucuggauguugc

SEQ ID NO: 71010 - RNA, 20 nt, Homo sapiens
uguaacacauggagaacucu

SEQ ID NO: 71011 - RNA, 22 nt, Homo sapiens
uguaacaguaguuacuauucuu

SEQ ID NO: 71012 - RNA, 22 nt, Homo sapiens
uguaagcauuauauaauuguug

SEQ ID NO: 71013 - RNA, 22 nt, Homo sapiens
uguaagcauugggcaugcaguc

SEQ ID NO: 71014 - RNA, 22 nt, Homo sapiens
uguaauggcagacuccggugga

SEQ ID NO: 71015 - RNA, 22 nt, Homo sapiens
uguaauuuaaaugauccuugga

SEQ ID NO: 71016 - RNA, 22 nt, Homo sapiens
uguagauaucuaucaggucaau

SEQ ID NO: 71017 - RNA, 22 nt, Homo sapiens
uguagcaaauaaaagucuggau

SEQ ID NO: 71018 - RNA, 22 nt, Homo sapiens
uguagcuuuugagauuuauauu

SEQ ID NO: 71019 - RNA, 22 nt, Homo sapiens
uguagggagagggaguugcacc

SEQ ID NO: 71020 - RNA, 22 nt, Homo sapiens
uguagguagggucuguuuuuga

SEQ ID NO: 71021 - RNA, 22 nt, Homo sapiens
uguauaacucacauugaaguuu

SEQ ID NO: 71022 - RNA, 23 nt, Homo sapiens
uguauacacccugugcaucuggg

SEQ ID NO: 71023 - RNA, 22 nt, Homo sapiens
uguauacauguguguucacgca

SEQ ID NO: 71024 - RNA, 22 nt, Homo sapiens
uguauacugucuaauauguugu

SEQ ID NO: 71025 - RNA, 22 nt, Homo sapiens
uguaugagagugaaagcauuuc

SEQ ID NO: 71026 - RNA, 22 nt, Homo sapiens
uguauguagugaccagggccag

SEQ ID NO: 71027 - RNA, 22 nt, Homo sapiens
ugucaagaugguuugauguugu

SEQ ID NO: 71028 - RNA, 21 nt, Homo sapiens
ugucaagugggaaaacaugua

SEQ ID NO: 71029 - RNA, 22 nt, Homo sapiens
ugucaaguugugguucaauuuu

SEQ ID NO: 71030 - RNA, 22 nt, Homo sapiens
ugucaaugggaauuuguuuuag

SEQ ID NO: 71031 - RNA, 22 nt, Homo sapiens
ugucacagagauuuugguaugu

SEQ ID NO: 71032 - RNA, 22 nt, Homo sapiens
ugucaccauuuguaggugagga

SEQ ID NO: 71033 - RNA, 22 nt, Homo sapiens
ugucacccuuuauccauuuccu

SEQ ID NO: 71034 - RNA, 22 nt, Homo sapiens
ugucagaaucugagacgacaac

SEQ ID NO: 71035 - RNA, 22 nt, Homo sapiens
ugucagggaggcucggccgcac

SEQ ID NO: 71036 - RNA, 22 nt, Homo sapiens
ugucaguggacugugaaaggca

SEQ ID NO: 71037 - RNA, 22 nt, Homo sapiens
ugucaguggucuggaugcagcc

SEQ ID NO: 71038 - RNA, 22 nt, Homo sapiens
ugucaguuucaguguuagccuu

SEQ ID NO: 71039 - RNA, 22 nt, Homo sapiens
ugucaguuucuugagauggaac

SEQ ID NO: 71040 - RNA, 22 nt, Homo sapiens
ugucaguuuuaacuagggaaua

SEQ ID NO: 71041 - RNA, 22 nt, Homo sapiens
ugucauauagaauguucuauga

SEQ ID NO: 71042 - RNA, 22 nt, Homo sapiens
ugucaucuagguauuaagcccc

SEQ ID NO: 71043 - RNA, 22 nt, Homo sapiens
ugucaucuagguuuuaagccuu

SEQ ID NO: 71044 - RNA, 22 nt, Homo sapiens
ugucauggcauuuguaaacugc

SEQ ID NO: 71045 - RNA, 22 nt, Homo sapiens
ugucaugguagcaaggacgagg

SEQ ID NO: 71046 - RNA, 22 nt, Homo sapiens
ugucauggucacaggcauuuca

SEQ ID NO: 71047 - RNA, 22 nt, Homo sapiens
ugucauguggcuaacgauucau

SEQ ID NO: 71048 - RNA, 22 nt, Homo sapiens
ugucauguuucuacugaccaaa

SEQ ID NO: 71049 - RNA, 22 nt, Homo sapiens
uguccauuuuuaugcuuauggu

SEQ ID NO: 71050 - RNA, 21 nt, Homo sapiens
ugucgugcaggaucuguggga

SEQ ID NO: 71051 - RNA, 21 nt, Homo sapiens
ugucuagaccucauccuacag

SEQ ID NO: 71052 - RNA, 22 nt, Homo sapiens
ugucucggagaucucucaaagu

SEQ ID NO: 71053 - RNA, 21 nt, Homo sapiens
ugucugagagaggagaucuac

SEQ ID NO: 71054 - RNA, 22 nt, Homo sapiens
ugucuggaguccauagaagugu

SEQ ID NO: 71055 - RNA, 22 nt, Homo sapiens
ugucuguuugcgaaauugcuuc

SEQ ID NO: 71056 - RNA, 16 nt, Homo sapiens
ugucuguuugggcaca

SEQ ID NO: 71057 - RNA, 22 nt, Homo sapiens
ugucuuagagauaaagaaugaa

SEQ ID NO: 71058 - RNA, 22 nt, Homo sapiens
ugucuuggacuugaaucucauu

SEQ ID NO: 71059 - RNA, 21 nt, Homo sapiens
ugucuuggagccagacgccag

SEQ ID NO: 71060 - RNA, 22 nt, Homo sapiens
ugugaaacauggauagaacugg

SEQ ID NO: 71061 - RNA, 22 nt, Homo sapiens
ugugaacacagaggcuauggca

SEQ ID NO: 71062 - RNA, 22 nt, Homo sapiens
ugugaacagcuccaaaugugga

SEQ ID NO: 71063 - RNA, 21 nt, Homo sapiens
ugugaacauguuggguggcau

SEQ ID NO: 71064 - RNA, 22 nt, Homo sapiens
ugugaaccucuggccaagauga

SEQ ID NO: 71065 - RNA, 19 nt, Homo sapiens
ugugaagaaaugcugcaag

SEQ ID NO: 71066 - RNA, 22 nt, Homo sapiens
ugugaauggugcuuccuagaug

SEQ ID NO: 71067 - RNA, 22 nt, Homo sapiens
ugugacacugaauggcagaacu

SEQ ID NO: 71068 - RNA, 22 nt, Homo sapiens
ugugacagcacagcaucucuuu

SEQ ID NO: 71069 - RNA, 22 nt, Homo sapiens
ugugacaguguuacauuucaug

SEQ ID NO: 71070 - RNA, 18 nt, Homo sapiens
ugugacauugagcauguc

SEQ ID NO: 71071 - RNA, 22 nt, Homo sapiens
ugugagaaaugcagaaucucag

SEQ ID NO: 71072 - RNA, 22 nt, Homo sapiens
ugugagaucucagaauugaacu

SEQ ID NO: 71073 - RNA, 22 nt, Homo sapiens
ugugaugguuuagcauuuucuu

SEQ ID NO: 71074 - RNA, 20 nt, Homo sapiens
ugugauuauuuaguugcaug

SEQ ID NO: 71075 - RNA, 17 nt, Homo sapiens
ugugauugaagucaucc

SEQ ID NO: 71076 - RNA, 22 nt, Homo sapiens
ugugauugauauauuuacagaa

SEQ ID NO: 71077 - RNA, 22 nt, Homo sapiens
ugugcaaaaacaauugcgguuu

SEQ ID NO: 71078 - RNA, 22 nt, Homo sapiens
ugugcaaggcucucaaccugug

SEQ ID NO: 71079 - RNA, 18 nt, Homo sapiens
ugugcaauauuaaccacc

SEQ ID NO: 71080 - RNA, 22 nt, Homo sapiens
ugugcaaucagcuucauuacau

SEQ ID NO: 71081 - RNA, 22 nt, Homo sapiens
ugugcacaaugugcagguuuga

SEQ ID NO: 71082 - RNA, 22 nt, Homo sapiens
ugugcacaaugugcagguuugu

SEQ ID NO: 71083 - RNA, 22 nt, Homo sapiens
ugugcaccucuucacacaggga

SEQ ID NO: 71084 - RNA, 22 nt, Homo sapiens
ugugcauauaaguguguauaua

SEQ ID NO: 71085 - RNA, 22 nt, Homo sapiens
ugugcaugacagcauacaaacg

SEQ ID NO: 71086 - RNA, 22 nt, Homo sapiens
ugugccacuccagcucuagcuu

SEQ ID NO: 71087 - RNA, 22 nt, Homo sapiens
ugugccuacugauagagccaag

SEQ ID NO: 71088 - RNA, 22 nt, Homo sapiens
ugugcgcaucggggccugcuuc

SEQ ID NO: 71089 - RNA, 22 nt, Homo sapiens
ugugcugaucgggcacgguguc

SEQ ID NO: 71090 - RNA, 22 nt, Homo sapiens
ugugcuugaaauucaguuuuga

SEQ ID NO: 71091 - RNA, 22 nt, Homo sapiens
uguggaaauuguuguauuuaau

SEQ ID NO: 71092 - RNA, 20 nt, Homo sapiens
uguggcacuguaucucucag

SEQ ID NO: 71093 - RNA, 22 nt, Homo sapiens
uguggccccuagcuacuagaga

SEQ ID NO: 71094 - RNA, 22 nt, Homo sapiens
uguggccuuuguuucaguuggg

SEQ ID NO: 71095 - RNA, 22 nt, Homo sapiens
uguguaaauauauacacacgug

SEQ ID NO: 71096 - RNA, 22 nt, Homo sapiens
uguguagagaaauauuacuuau

SEQ ID NO: 71097 - RNA, 22 nt, Homo sapiens
ugugucacugcacuccagcgug

SEQ ID NO: 71098 - RNA, 22 nt, Homo sapiens
ugugucuacugagaugaucaug

SEQ ID NO: 71099 - RNA, 22 nt, Homo sapiens
ugugucuuguuuuuucccaggc

SEQ ID NO: 71100 - RNA, 22 nt, Homo sapiens
ugugucuuuuaucacacaaugu

SEQ ID NO: 71101 - RNA, 22 nt, Homo sapiens
uguuaagaugucaauuuuccac

SEQ ID NO: 71102 - RNA, 22 nt, Homo sapiens
uguuaagauguguuuuguggcu

SEQ ID NO: 71103 - RNA, 22 nt, Homo sapiens
uguuacagcagcacaaaaugga

SEQ ID NO: 71104 - RNA, 22 nt, Homo sapiens
uguuauugagguuacuuauaag

SEQ ID NO: 71105 - RNA, 22 nt, Homo sapiens
uguugcaccugccuugcuuuag

SEQ ID NO: 71106 - RNA, 22 nt, Homo sapiens
uguugcacuccagccuggguga

SEQ ID NO: 71107 - RNA, 20 nt, Homo sapiens
uguugcacucuagccugggu

SEQ ID NO: 71108 - RNA, 22 nt, Homo sapiens
uguuggacuuacuuggcagauu

SEQ ID NO: 71109 - RNA, 22 nt, Homo sapiens
uguuggcauugcugcugacccu

SEQ ID NO: 71110 - RNA, 22 nt, Homo sapiens
uguuuaguuaagacauagaauu

SEQ ID NO: 71111 - RNA, 22 nt, Homo sapiens
uguuugguggucucuucacaug

SEQ ID NO: 71112 - RNA, 22 nt, Homo sapiens
uguuuuggagguccucacuaga

SEQ ID NO: 71113 - RNA, 22 nt, Homo sapiens
uguuuuggaguggacuuugcau

SEQ ID NO: 71114 - RNA, 22 nt, Homo sapiens
uuaaaccugucuucucacuaau

SEQ ID NO: 71115 - RNA, 22 nt, Homo sapiens
uuaaaggcauguacacuagagu

SEQ ID NO: 71116 - RNA, 22 nt, Homo sapiens
uuaaagugcuguuuuugccggg

SEQ ID NO: 71117 - RNA, 22 nt, Homo sapiens
uuaaauacagcaugguguuucu

SEQ ID NO: 71118 - RNA, 20 nt, Homo sapiens
uuaaaucuagugcagacuca

SEQ ID NO: 71119 - RNA, 22 nt, Homo sapiens
uuaaaugcacauacuugagaaa

SEQ ID NO: 71120 - RNA, 21 nt, Homo sapiens
uuaacagacaagugucuuccc

SEQ ID NO: 71121 - RNA, 22 nt, Homo sapiens
uuaagacaccaaucauuggauu

SEQ ID NO: 71122 - RNA, 22 nt, Homo sapiens
uuaagagcauggugccagguug

SEQ ID NO: 71123 - RNA, 22 nt, Homo sapiens
uuaagcaaagguaacaugagaa

SEQ ID NO: 71124 - RNA, 22 nt, Homo sapiens
uuaagcaguaguuaaggagagg

SEQ ID NO: 71125 - RNA, 22 nt, Homo sapiens
uuaagccaggugugguggcaca

SEQ ID NO: 71126 - RNA, 22 nt, Homo sapiens
uuaaggaaggagucuuaaaugg

SEQ ID NO: 71127 - RNA, 22 nt, Homo sapiens
uuaaggcuuucccuauguaaaa

SEQ ID NO: 71128 - RNA, 22 nt, Homo sapiens
uuaagggaggagcuucaagaug

SEQ ID NO: 71129 - RNA, 19 nt, Homo sapiens
uuaagguacuuagaugugu

SEQ ID NO: 71130 - RNA, 21 nt, Homo sapiens
uuaaguaauuacccaacucuc

SEQ ID NO: 71131 - RNA, 22 nt, Homo sapiens
uuaaguagaugaaugugaaugu

SEQ ID NO: 71132 - RNA, 22 nt, Homo sapiens
uuaauccugccuuauuucagua

SEQ ID NO: 71133 - RNA, 22 nt, Homo sapiens
uuaaucugucuaugauuuuggu

SEQ ID NO: 71134 - RNA, 22 nt, Homo sapiens
uuaauguaauugauugauugac

SEQ ID NO: 71135 - RNA, 22 nt, Homo sapiens
uuaauguaucuaucacaucaca

SEQ ID NO: 71136 - RNA, 22 nt, Homo sapiens
uuaaugugaaucaggaugcauu

SEQ ID NO: 71137 - RNA, 22 nt, Homo sapiens
uuaauuguaucuauagauguca

SEQ ID NO: 71138 - RNA, 22 nt, Homo sapiens
uuacaaccucagcagugcaaag

SEQ ID NO: 71139 - RNA, 21 nt, Homo sapiens
uuacaauggcuccuugaaggu

SEQ ID NO: 71140 - RNA, 22 nt, Homo sapiens
uuacagauggauggcagcuggc

SEQ ID NO: 71141 - RNA, 22 nt, Homo sapiens
uuacagucaaguuacauuucuc

SEQ ID NO: 71142 - RNA, 22 nt, Homo sapiens
uuacagucaccugggggacaua

SEQ ID NO: 71143 - RNA, 22 nt, Homo sapiens
uuacagucucaagagugcugca

SEQ ID NO: 71144 - RNA, 20 nt, Homo sapiens
uuacagugggaccuuccuga

SEQ ID NO: 71145 - RNA, 22 nt, Homo sapiens
uuacaguucugguggagaggua

SEQ ID NO: 71146 - RNA, 22 nt, Homo sapiens
uuacauguuguggguuguggcc

SEQ ID NO: 71147 - RNA, 22 nt, Homo sapiens
uuaccagucugauuccuguuag

SEQ ID NO: 71148 - RNA, 22 nt, Homo sapiens
uuaccaguggugcuguaaacuu

SEQ ID NO: 71149 - RNA, 22 nt, Homo sapiens
uuaccucuguggcucucggacu

SEQ ID NO: 71150 - RNA, 22 nt, Homo sapiens
uuaccuguguuuugggcccaga

SEQ ID NO: 71151 - RNA, 22 nt, Homo sapiens
uuacguaguuuuggagaucaua

SEQ ID NO: 71152 - RNA, 22 nt, Homo sapiens
uuacuacucucuaugaccaguu

SEQ ID NO: 71153 - RNA, 22 nt, Homo sapiens
uuacuagaaacagggcuucgcc

SEQ ID NO: 71154 - RNA, 22 nt, Homo sapiens
uuacugcuagcugugugcucuu

SEQ ID NO: 71155 - RNA, 22 nt, Homo sapiens
uuacuggcuuucacugguguua

SEQ ID NO: 71156 - RNA, 22 nt, Homo sapiens
uuacuguauagaaucaucuuga

SEQ ID NO: 71157 - RNA, 22 nt, Homo sapiens
uuagacacacauacauuuaucu

SEQ ID NO: 71158 - RNA, 17 nt, Homo sapiens
uuagacagacauccugc

SEQ ID NO: 71159 - RNA, 22 nt, Homo sapiens
uuagacaguggugcacugcacu

SEQ ID NO: 71160 - RNA, 22 nt, Homo sapiens
uuagacucauuuuggucaagga

SEQ ID NO: 71161 - RNA, 19 nt, Homo sapiens
uuagagaucaucugcuuca

SEQ ID NO: 71162 - RNA, 22 nt, Homo sapiens
uuagaugaaugucucuuaaaca

SEQ ID NO: 71163 - RNA, 18 nt, Homo sapiens
uuagaugguuuuaaaacu

SEQ ID NO: 71164 - RNA, 22 nt, Homo sapiens
uuagauguuugacugggccuua

SEQ ID NO: 71165 - RNA, 22 nt, Homo sapiens
uuagcaauagccugcaucugca

SEQ ID NO: 71166 - RNA, 22 nt, Homo sapiens
uuugcugagucauuccaugcug

SEQ ID NO: 71167 - RNA, 22 nt, Homo sapiens
uuugcuuaguaaauguagaaaa

SEQ ID NO: 71168 - RNA, 22 nt, Homo sapiens
uuugcuucacuguuuggcaaaa

SEQ ID NO: 71169 - RNA, 22 nt, Homo sapiens
uuguccacugcuagccucugca

SEQ ID NO: 71170 - RNA, 22 nt, Homo sapiens
uuguccauggacagcaccacag

SEQ ID NO: 71171 - RNA, 22 nt, Homo sapiens
uuguccccaucugcugccagaa

SEQ ID NO: 71172 - RNA, 22 nt, Homo sapiens
uuguccccuuccaaaucucaug

SEQ ID NO: 71173 - RNA, 22 nt, Homo sapiens
uuguccucuccaaaucucaugu

SEQ ID NO: 71174 - RNA, 22 nt, Homo sapiens
uuguccuggagguucuugcaag

SEQ ID NO: 71175 - RNA, 22 nt, Homo sapiens
uugucuccuagacgaccaggcg

SEQ ID NO: 71176 - RNA, 22 nt, Homo sapiens
uugugaaaucuaggcagagguu

SEQ ID NO: 71177 - RNA, 22 nt, Homo sapiens
uugugaaugaugccgcaauaaa

SEQ ID NO: 71178 - RNA, 22 nt, Homo sapiens
uugugaaugaugucgcaauaaa

SEQ ID NO: 71179 - RNA, 22 nt, Homo sapiens
uugugaauggugccgcaguaaa

SEQ ID NO: 71180 - RNA, 22 nt, Homo sapiens
uugugaucauugucaaauagug

SEQ ID NO: 71181 - RNA, 22 nt, Homo sapiens
uugugcaaaaguaauugcgguu

SEQ ID NO: 71182 - RNA, 22 nt, Homo sapiens
uugugcaugaugcauacauggu

SEQ ID NO: 71183 - RNA, 22 nt, Homo sapiens
uugugccacugaagcccuccag

SEQ ID NO: 71184 - RNA, 22 nt, Homo sapiens
uugugccccuucucagucgggc

SEQ ID NO: 71185 - RNA, 22 nt, Homo sapiens
uugugcuccugugagaaucuag

SEQ ID NO: 71186 - RNA, 22 nt, Homo sapiens
uugugcuuaaugaguguaaggu

SEQ ID NO: 71187 - RNA, 22 nt, Homo sapiens
uugugcuuuuuaaauagcuucc

SEQ ID NO: 71188 - RNA, 22 nt, Homo sapiens
uugugguagugaaugagucuca

SEQ ID NO: 71189 - RNA, 22 nt, Homo sapiens
uugugguugaugaagacugucu

SEQ ID NO: 71190 - RNA, 22 nt, Homo sapiens
uuguguccccacucaaauuaca

SEQ ID NO: 71191 - RNA, 23 nt, Homo sapiens
uugugucccuacccaaaucucau

SEQ ID NO: 71192 - RNA, 22 nt, Homo sapiens
uuguuauguuaaacuacugaaa

SEQ ID NO: 71193 - RNA, 17 nt, Homo sapiens
uuguucccauuaaaaag

SEQ ID NO: 71194 - RNA, 22 nt, Homo sapiens
uuguuuagagacuggaauuaaa

SEQ ID NO: 71195 - RNA, 22 nt, Homo sapiens
uuuaaagcacggaguuuguggc

SEQ ID NO: 71196 - RNA, 22 nt, Homo sapiens
uuuaaagcaugacgagaagaag

SEQ ID NO: 71197 - RNA, 22 nt, Homo sapiens
uuuaaagcuaaaauauguuuau

SEQ ID NO: 71198 - RNA, 22 nt, Homo sapiens
uuuaaagcuccaagcaugucug

SEQ ID NO: 71199 - RNA, 22 nt, Homo sapiens
uuuaaaguuagaaggaaagggc

SEQ ID NO: 71200 - RNA, 22 nt, Homo sapiens
uuuaagccaggugcaguggcuc

SEQ ID NO: 71201 - RNA, 23 nt, Homo sapiens
uuuaagcuucauguccuaacauc

SEQ ID NO: 71202 - RNA, 22 nt, Homo sapiens
uuuaagguauguggugaaaauu

SEQ ID NO: 71203 - RNA, 22 nt, Homo sapiens
uuuaauagcagggacuuccggg

SEQ ID NO: 71204 - RNA, 19 nt, Homo sapiens
uuuagaucuuuuaugcagc

SEQ ID NO: 71205 - RNA, 22 nt, Homo sapiens
uuuagcagcaaagagcuguguu

SEQ ID NO: 71206 - RNA, 22 nt, Homo sapiens
uuuagguacgcaccggcucagu

SEQ ID NO: 71207 - RNA, 21 nt, Homo sapiens
uuuagguagcuuuucugggag

SEQ ID NO: 71208 - RNA, 22 nt, Homo sapiens
uuuagguagucaaagguuaguc

SEQ ID NO: 71209 - RNA, 22 nt, Homo sapiens
uuuagguauuugguauagcagu

SEQ ID NO: 71210 - RNA, 22 nt, Homo sapiens
uuuaguacugcuuuaugugugu

SEQ ID NO: 71211 - RNA, 23 nt, Homo sapiens
uuuauacguugucauuuaucagg

SEQ ID NO: 71212 - RNA, 22 nt, Homo sapiens
uuuaugagguagagugguuuau

SEQ ID NO: 71213 - RNA, 22 nt, Homo sapiens
uuuauugcucuaaaguugccau

SEQ ID NO: 71214 - RNA, 22 nt, Homo sapiens
uuucacagcugucuuccgucuc

SEQ ID NO: 71215 - RNA, 22 nt, Homo sapiens
uuucacaguguucucccccaga

SEQ ID NO: 71216 - RNA, 22 nt, Homo sapiens
uuucacguuggggaguugagug

SEQ ID NO: 71217 - RNA, 22 nt, Homo sapiens
uuucaggcaagggugacccuga

SEQ ID NO: 71218 - RNA, 22 nt, Homo sapiens
uuucaggcagggagcuucagug

SEQ ID NO: 71219 - RNA, 22 nt, Homo sapiens
uuucagguauuuaagggccguu

SEQ ID NO: 71220 - RNA, 20 nt, Homo sapiens
uuucaguacuuucuacuggc

SEQ ID NO: 71221 - RNA, 22 nt, Homo sapiens
uuucaguagagacacgguuuug

SEQ ID NO: 71222 - RNA, 22 nt, Homo sapiens
uuucauagccuuugucgucuga

SEQ ID NO: 71223 - RNA, 22 nt, Homo sapiens
uuucauggacgcaaugccuuuu

SEQ ID NO: 71224 - RNA, 22 nt, Homo sapiens
uuucauggaggcauuuuagauu

SEQ ID NO: 71225 - RNA, 22 nt, Homo sapiens
uuuccagguggccaacauuuua

SEQ ID NO: 71226 - RNA, 22 nt, Homo sapiens
uuuccaguuggaagaaggggga

SEQ ID NO: 71227 - RNA, 22 nt, Homo sapiens
uuuccaguuuggaggaugcauu

SEQ ID NO: 71228 - RNA, 22 nt, Homo sapiens
uuuccauguuggugaaaugagg

SEQ ID NO: 71229 - RNA, 22 nt, Homo sapiens
uuucccagugguacaguuuaua

SEQ ID NO: 71230 - RNA, 22 nt, Homo sapiens
uuucccauuguucugcucugug

SEQ ID NO: 71231 - RNA, 22 nt, Homo sapiens
uuucccuuuagcuuagugauuu

SEQ ID NO: 71232 - RNA, 22 nt, Homo sapiens
uugagggagcacagauucuuau

SEQ ID NO: 71233 - RNA, 22 nt, Homo sapiens
uugagggagccuguuagucccg

SEQ ID NO: 71234 - RNA, 22 nt, Homo sapiens
uugagggaggcagggcuugucu

SEQ ID NO: 71235 - RNA, 22 nt, Homo sapiens
uugagguaggaggagcuuggau

SEQ ID NO: 71236 - RNA, 22 nt, Homo sapiens
uugagguauaaagguagguugu

SEQ ID NO: 71237 - RNA, 20 nt, Homo sapiens
uugaggucaggaguuuggga

SEQ ID NO: 71238 - RNA, 22 nt, Homo sapiens
uugaggugaagggcagagcagc

SEQ ID NO: 71239 - RNA, 22 nt, Homo sapiens
uugaggugaauuugcaggaugc

SEQ ID NO: 71240 - RNA, 22 nt, Homo sapiens
uugaggugggaggaucacuuga

SEQ ID NO: 71241 - RNA, 22 nt, Homo sapiens
uugagguuggaggccuugccug

SEQ ID NO: 71242 - RNA, 22 nt, Homo sapiens
uugaguccauucgaugcugauu

SEQ ID NO: 71243 - RNA, 22 nt, Homo sapiens
uugaguccccacacuggguccc

SEQ ID NO: 71244 - RNA, 22 nt, Homo sapiens
uugaguuugaguauucuaaagc

SEQ ID NO: 71245 - RNA, 22 nt, Homo sapiens
uugauagaucagggauuugauu

SEQ ID NO: 71246 - RNA, 22 nt, Homo sapiens
uugauagguuuuauguauaguu

SEQ ID NO: 71247 - RNA, 22 nt, Homo sapiens
uugauaguaccauugggaaauu

SEQ ID NO: 71248 - RNA, 22 nt, Homo sapiens
uugauaguguccucuuuggcag

SEQ ID NO: 71249 - RNA, 22 nt, Homo sapiens
uugauaguuuaauuaaugcuag

SEQ ID NO: 71250 - RNA, 22 nt, Homo sapiens
uugauaugaauggcuguuugug

SEQ ID NO: 71251 - RNA, 22 nt, Homo sapiens
uugauaugcuugucaguccauu

SEQ ID NO: 71252 - RNA, 22 nt, Homo sapiens
uugauauguuguuggauucacu

SEQ ID NO: 71253 - RNA, 22 nt, Homo sapiens
uugauauucuuucuggauccca

SEQ ID NO: 71254 - RNA, 22 nt, Homo sapiens
uugaucaauagaauacaacaga

SEQ ID NO: 71255 - RNA, 22 nt, Homo sapiens
uugauccucugagaaucuaucg

SEQ ID NO: 71256 - RNA, 22 nt, Homo sapiens
uugaugauguuucugccuugcc

SEQ ID NO: 71257 - RNA, 22 nt, Homo sapiens
uugauguguuuccaggauuugu

SEQ ID NO: 71258 - RNA, 22 nt, Homo sapiens
uugcaaaguuugccuccuguag

SEQ ID NO: 71259 - RNA, 21 nt, Homo sapiens
uugcaaaugcugcugccugau

SEQ ID NO: 71260 - RNA, 22 nt, Homo sapiens
uugcaaugugaugugauuugga

SEQ ID NO: 71261 - RNA, 22 nt, Homo sapiens
uugcacagugcuuucuuugccc

SEQ ID NO: 71262 - RNA, 22 nt, Homo sapiens
uugcacauggcaggugcucaau

SEQ ID NO: 71263 - RNA, 22 nt, Homo sapiens
uugcacauguugaaccagcaaa

SEQ ID NO: 71264 - RNA, 22 nt, Homo sapiens
uugcacauuuuuucuggcagaa

SEQ ID NO: 71265 - RNA, 22 nt, Homo sapiens
uugcaccacugcguuccagccu

SEQ ID NO: 71266 - RNA, 22 nt, Homo sapiens
uugcaccuugaagccaauagca

SEQ ID NO: 71267 - RNA, 22 nt, Homo sapiens
uugcacuccagcucuaggugac

SEQ ID NO: 71268 - RNA, 22 nt, Homo sapiens
uugcacucuccagccucggcaa

SEQ ID NO: 71269 - RNA, 22 nt, Homo sapiens
uugcacucugaagaccuacugu

SEQ ID NO: 71270 - RNA, 22 nt, Homo sapiens
uugcacuguaauuuauuuaugu

SEQ ID NO: 71271 - RNA, 22 nt, Homo sapiens
uugcacuucauguaggccaaag

SEQ ID NO: 71272 - RNA, 20 nt, Homo sapiens
uugcagagcccaacccugga

SEQ ID NO: 71273 - RNA, 22 nt, Homo sapiens
uugcaguaguaacuccuuaccu

SEQ ID NO: 71274 - RNA, 22 nt, Homo sapiens
uugcauagaggugaguauagua

SEQ ID NO: 71275 - RNA, 19 nt, Homo sapiens
uugcauauguugaaccagg

SEQ ID NO: 71276 - RNA, 22 nt, Homo sapiens
uugcaugucauaacugauggaa

SEQ ID NO: 71277 - RNA, 22 nt, Homo sapiens
uugcaugucugcuucuccuccu

SEQ ID NO: 71278 - RNA, 22 nt, Homo sapiens
uugccgggugcaguggcucaug

SEQ ID NO: 71279 - RNA, 22 nt, Homo sapiens
uugccugagaagccaagaauaa

SEQ ID NO: 71280 - RNA, 22 nt, Homo sapiens
uugccuuuguuggaaacaagug

SEQ ID NO: 71281 - RNA, 22 nt, Homo sapiens
uugcuagaugaaaaugguaccu

SEQ ID NO: 71282 - RNA, 22 nt, Homo sapiens
uugcuaguguuugguugauggu

SEQ ID NO: 71283 - RNA, 22 nt, Homo sapiens
uugcuuuguuacugcaguuucc

SEQ ID NO: 71284 - RNA, 22 nt, Homo sapiens
uuggaaacgucaccuuuuccuu

SEQ ID NO: 71285 - RNA, 22 nt, Homo sapiens
uuggaaauauguuaagugucau

SEQ ID NO: 71286 - RNA, 22 nt, Homo sapiens
uuggaaauguguuugcauucag

SEQ ID NO: 71287 - RNA, 22 nt, Homo sapiens
uuggaagacaaugcugauucuc

SEQ ID NO: 71288 - RNA, 22 nt, Homo sapiens
uuggaagagaagggagauaaac

SEQ ID NO: 71289 - RNA, 22 nt, Homo sapiens
uuggaaggcuccuaaugaaugg

SEQ ID NO: 71290 - RNA, 22 nt, Homo sapiens
uuggaaggcugaauggccucuc

SEQ ID NO: 71291 - RNA, 22 nt, Homo sapiens
uuggaauauuauuauugggcag

SEQ ID NO: 71292 - RNA, 22 nt, Homo sapiens
uuggaauguauggcaucuugcg

SEQ ID NO: 71293 - RNA, 22 nt, Homo sapiens
uuggacugagaguuccaccauu

SEQ ID NO: 71294 - RNA, 22 nt, Homo sapiens
uuggacugggauggccgaggcu

SEQ ID NO: 71295 - RNA, 22 nt, Homo sapiens
uuggacuuuaagauagagaugu

SEQ ID NO: 71296 - RNA, 22 nt, Homo sapiens
uuggacuuuuauucugcaggca

SEQ ID NO: 71297 - RNA, 22 nt, Homo sapiens
uuggagcacuggggcacugaca

SEQ ID NO: 71298 - RNA, 22 nt, Homo sapiens
uuggagugugucuuauuccauu

SEQ ID NO: 71299 - RNA, 22 nt, Homo sapiens
uuggauaguuuaugaaaaaugg

SEQ ID NO: 71300 - RNA, 22 nt, Homo sapiens
uuggaugauaaagaagccuaag

SEQ ID NO: 71301 - RNA, 22 nt, Homo sapiens
uuggauuauaaacugagauuug

SEQ ID NO: 71302 - RNA, 22 nt, Homo sapiens
uuggauuuugguggcaacucau

SEQ ID NO: 71303 - RNA, 22 nt, Homo sapiens
uuggcaaagaggaaugccacuu

SEQ ID NO: 71304 - RNA, 22 nt, Homo sapiens
uuggcaagaaccuucuuccaag

SEQ ID NO: 71305 - RNA, 22 nt, Homo sapiens
uuggcaauucagauucuuuuau

SEQ ID NO: 71306 - RNA, 22 nt, Homo sapiens
uuggcagcauuccagccaagca

SEQ ID NO: 71307 - RNA, 22 nt, Homo sapiens
uuggcagucugaggcacagacu

SEQ ID NO: 71308 - RNA, 22 nt, Homo sapiens
uuggcauaguugcacuuacuag

SEQ ID NO: 71309 - RNA, 22 nt, Homo sapiens
uuggcauugccaaacugucaac

SEQ ID NO: 71310 - RNA, 22 nt, Homo sapiens
uuggcauuuauucuaaggucaa

SEQ ID NO: 71311 - RNA, 22 nt, Homo sapiens
uuggccagugucuuuuuuuccu

SEQ ID NO: 71312 - RNA, 22 nt, Homo sapiens
uuggccauaugacuugcuuugg

SEQ ID NO: 71313 - RNA, 22 nt, Homo sapiens
uuggccccuccaaaucucaugu

SEQ ID NO: 71314 - RNA, 22 nt, Homo sapiens
uuggccccuuucauccacagcu

SEQ ID NO: 71315 - RNA, 23 nt, Homo sapiens
uuggccuccuugugucuagggcu

SEQ ID NO: 71316 - RNA, 22 nt, Homo sapiens
uuggccuuuucaaugccucuuu

SEQ ID NO: 71317 - RNA, 22 nt, Homo sapiens
uuggcgugaaacagccuuacau

SEQ ID NO: 71318 - RNA, 22 nt, Homo sapiens
uuggcuguguuucccuacaaau

SEQ ID NO: 71319 - RNA, 22 nt, Homo sapiens
uuggcuucuggacuauugugca

SEQ ID NO: 71320 - RNA, 22 nt, Homo sapiens
uugggauaaucacaaaguaaaa

SEQ ID NO: 71321 - RNA, 23 nt, Homo sapiens
uugggcaaaucacuaacgucucc

SEQ ID NO: 71322 - RNA, 22 nt, Homo sapiens
uugggcaauaggaagcaggugg

SEQ ID NO: 71323 - RNA, 22 nt, Homo sapiens
uugggcauugcuauaaauucuu

SEQ ID NO: 71324 - RNA, 22 nt, Homo sapiens
uugggcuugagggugcccaguc

SEQ ID NO: 71325 - RNA, 22 nt, Homo sapiens
uuggggcacggccucuguugcc

SEQ ID NO: 71326 - RNA, 22 nt, Homo sapiens
uuggguagugaguuccuccagg

SEQ ID NO: 71327 - RNA, 18 nt, Homo sapiens
uugcacuccugccugggu

SEQ ID NO: 71328 - RNA, 22 nt, Homo sapiens
uugcacucuagccugggugaca

SEQ ID NO: 71329 - RNA, 22 nt, Homo sapiens
uugcagagccccacacugggcu

SEQ ID NO: 71330 - RNA, 22 nt, Homo sapiens
uugcagagccccugcaaggguc

SEQ ID NO: 71331 - RNA, 22 nt, Homo sapiens
uugcagagucaguuauuuugcc

SEQ ID NO: 71332 - RNA, 22 nt, Homo sapiens
uugcagcaaagagggaggggca

SEQ ID NO: 71333 - RNA, 22 nt, Homo sapiens
uugcagcaacauggaugaaacu

SEQ ID NO: 71334 - RNA, 22 nt, Homo sapiens
uugcagcauucugguuccuggu

SEQ ID NO: 71335 - RNA, 22 nt, Homo sapiens
uugcaggcaugagccaccgugc

SEQ ID NO: 71336 - RNA, 22 nt, Homo sapiens
uugcaguacuucuggcuuuaca

SEQ ID NO: 71337 - RNA, 22 nt, Homo sapiens
uugcaguagucugaaagcaaua

SEQ ID NO: 71338 - RNA, 22 nt, Homo sapiens
uugcagugugacgacuauauuu

SEQ ID NO: 71339 - RNA, 22 nt, Homo sapiens
uugcauaaguugaaccagccuu

SEQ ID NO: 71340 - RNA, 22 nt, Homo sapiens
uugcauagacaauauuaaucuu

SEQ ID NO: 71341 - RNA, 22 nt, Homo sapiens
uugcauagaccgaugucuugga

SEQ ID NO: 71342 - RNA, 22 nt, Homo sapiens
uugcauauguugaaccaagcgu

SEQ ID NO: 71343 - RNA, 22 nt, Homo sapiens
uugcauauguugaaccagccuu

SEQ ID NO: 71344 - RNA, 22 nt, Homo sapiens
uugcauauucucugaggcagga

SEQ ID NO: 71345 - RNA, 18 nt, Homo sapiens
uugcaucauuuuguuguu

SEQ ID NO: 71346 - RNA, 22 nt, Homo sapiens
uugcaugcuccuuaugagaauc

SEQ ID NO: 71347 - RNA, 22 nt, Homo sapiens
uugcauuagugugguacauuug

SEQ ID NO: 71348 - RNA, 22 nt, Homo sapiens
uugcauugacacaugaagcuca

SEQ ID NO: 71349 - RNA, 22 nt, Homo sapiens
uugcauuuucuaggagggcaaa

SEQ ID NO: 71350 - RNA, 22 nt, Homo sapiens
uugccaacauggugaacuccca

SEQ ID NO: 71351 - RNA, 22 nt, Homo sapiens
uugccaauauuuuacugagaag

SEQ ID NO: 71352 - RNA, 22 nt, Homo sapiens
uugccauagugcugccagauau

SEQ ID NO: 71353 - RNA, 22 nt, Homo sapiens
uugccaucaucucuuacucagu

SEQ ID NO: 71354 - RNA, 22 nt, Homo sapiens
uugcccuuuagguaacuauaua

SEQ ID NO: 71355 - RNA, 22 nt, Homo sapiens
uugccuaggcuggagugcagua

SEQ ID NO: 71356 - RNA, 18 nt, Homo sapiens
uugccuauucacucugau

SEQ ID NO: 71357 - RNA, 22 nt, Homo sapiens
uugccuauucacucugaugaua

SEQ ID NO: 71358 - RNA, 22 nt, Homo sapiens
uugcgcuuuuccuauguugccc

SEQ ID NO: 71359 - RNA, 22 nt, Homo sapiens
uugcuaagucaagagaaaugau

SEQ ID NO: 71360 - RNA, 22 nt, Homo sapiens
uuuguacuucauacaauaacuc

SEQ ID NO: 71361 - RNA, 22 nt, Homo sapiens
uuuguacuugaagaaucuuuau

SEQ ID NO: 71362 - RNA, 22 nt, Homo sapiens
uuuguagcuacaaagugagaug

SEQ ID NO: 71363 - RNA, 20 nt, Homo sapiens
uuuguaucucuggguacugg

SEQ ID NO: 71364 - RNA, 22 nt, Homo sapiens
uuuguauguuggagauuggaga

SEQ ID NO: 71365 - RNA, 22 nt, Homo sapiens
uuugucacccugaauguaagau

SEQ ID NO: 71366 - RNA, 22 nt, Homo sapiens
uuugucacucuuggagguuguu

SEQ ID NO: 71367 - RNA, 22 nt, Homo sapiens
uuuguccccgcccagaucucau

SEQ ID NO: 71368 - RNA, 22 nt, Homo sapiens
uuugugacacaaacacauauau

SEQ ID NO: 71369 - RNA, 23 nt, Homo sapiens
uuugugacacucuccaucuccag

SEQ ID NO: 71370 - RNA, 22 nt, Homo sapiens
uuugugaggugauggauauguc

SEQ ID NO: 71371 - RNA, 22 nt, Homo sapiens
uuuguggaaugcucauguguag

SEQ ID NO: 71372 - RNA, 22 nt, Homo sapiens
uuuguguccccacccaaacauc

SEQ ID NO: 71373 - RNA, 23 nt, Homo sapiens
uuuguguccccacccaaaucuca

SEQ ID NO: 71374 - RNA, 22 nt, Homo sapiens
uuuguguccccacccacaucuc

SEQ ID NO: 71375 - RNA, 22 nt, Homo sapiens
uuuguguggccuuggccuggca

SEQ ID NO: 71376 - RNA, 16 nt, Homo sapiens
uuugugugugacgaga

SEQ ID NO: 71377 - RNA, 22 nt, Homo sapiens
uuuuaacagccaggggacggcc

SEQ ID NO: 71378 - RNA, 22 nt, Homo sapiens
uuuuacacuguugguuggaaug

SEQ ID NO: 71379 - RNA, 22 nt, Homo sapiens
uuuuagcaaagagacugguggc

SEQ ID NO: 71380 - RNA, 22 nt, Homo sapiens
uuuuaguggacaaagguauuua

SEQ ID NO: 71381 - RNA, 22 nt, Homo sapiens
uuuuaugggcuauuugcauuag

SEQ ID NO: 71382 - RNA, 22 nt, Homo sapiens
uuuuccagugggacucccauua

SEQ ID NO: 71383 - RNA, 21 nt, Homo sapiens
uuuugcacacuaugcagcuuu

SEQ ID NO: 71384 - RNA, 22 nt, Homo sapiens
uuuugcacuagaaccagagguu

SEQ ID NO: 71385 - RNA, 20 nt, Homo sapiens
uuuugcacuccuacuaaggu

SEQ ID NO: 71386 - RNA, 22 nt, Homo sapiens
uuuugcauuggcugaggagugu

SEQ ID NO: 71387 - RNA, 22 nt, Homo sapiens
uuuugcuccuggcaaacucaua

SEQ ID NO: 71388 - RNA, 20 nt, Homo sapiens
uuuuggacuaaaggcauccc

SEQ ID NO: 71389 - RNA, 22 nt, Homo sapiens
uuuuggacuugcuccccugucc

SEQ ID NO: 71390 - RNA, 22 nt, Homo sapiens
uuuugguaaugaacuuaggaag

SEQ ID NO: 71391 - RNA, 22 nt, Homo sapiens
uuuugguauacacaaggguccu

SEQ ID NO: 71392 - RNA, 22 nt, Homo sapiens
uuuugguuuuauccagggucuc

SEQ ID NO: 71393 - RNA, 18 nt, Homo sapiens
uuuuugaggcacagggga

SEQ ID NO: 71394 - RNA, 22 nt, Homo sapiens
uuuuugaguaaauauaaauugu

SEQ ID NO: 71395 - RNA, 22 nt, Homo sapiens
uuuuugaguagcuggagagcag

SEQ ID NO: 71396 - RNA, 22 nt, Homo sapiens
uuuuuggauaaugguacaugua

SEQ ID NO: 71397 - RNA, 21 nt, Homo sapiens
uuuuugggcuuucauaguguu

SEQ ID NO: 71398 - RNA, 21 nt, Homo sapiens
uuuuugguggucauggauaga

SEQ ID NO: 71399 - RNA, 23 nt, Homo sapiens
uuuuuguguuucauggaaauagg

SEQ ID NO: 71400 - RNA, 22 nt, Homo sapiens
uuuuuugguaauugaacaauga

SEQ ID NO: 71401 - RNA, 22 nt, Homo sapiens
auaucaaggccauuuucuaaau

SEQ ID NO: 71402 - RNA, 22 nt, Homo sapiens
auauccaugccauagguuuuga

SEQ ID NO: 71403 - RNA, 22 nt, Homo sapiens
auaucccaguguguaaacacug

SEQ ID NO: 71404 - RNA, 22 nt, Homo sapiens
auaugacuuuccucuacuuccu

SEQ ID NO: 71405 - RNA, 22 nt, Homo sapiens
auaugcacgugcauacacacuu

SEQ ID NO: 71406 - RNA, 20 nt, Homo sapiens
auaugcagacacauacauac

SEQ ID NO: 71407 - RNA, 22 nt, Homo sapiens
auaugcauacauguaugcagga

SEQ ID NO: 71408 - RNA, 22 nt, Homo sapiens
auaugcauacccucaccaacua

SEQ ID NO: 71409 - RNA, 22 nt, Homo sapiens
auauggcauucagaacuguaua

SEQ ID NO: 71410 - RNA, 22 nt, Homo sapiens
auauggcuaugugagcauacca

SEQ ID NO: 71411 - RNA, 22 nt, Homo sapiens
auauggcuuuuauuauguugag

SEQ ID NO: 71412 - RNA, 19 nt, Homo sapiens
auaugggguuugaacugug

SEQ ID NO: 71413 - RNA, 20 nt, Homo sapiens
auaugguugugagugauuuu

SEQ ID NO: 71414 - RNA, 22 nt, Homo sapiens
auaugguuuuuggaagcauauc

SEQ ID NO: 71415 - RNA, 22 nt, Homo sapiens
auauguauuuuaacguguaagg

SEQ ID NO: 71416 - RNA, 22 nt, Homo sapiens
auaugugacuucaugcaaggcu

SEQ ID NO: 71417 - RNA, 22 nt, Homo sapiens
auauuacuggcuauaucgcaag

SEQ ID NO: 71418 - RNA, 22 nt, Homo sapiens
auauuagcacuaaugucacgau

SEQ ID NO: 71419 - RNA, 22 nt, Homo sapiens
auauucaagugaggauggcuaa

SEQ ID NO: 71420 - RNA, 22 nt, Homo sapiens
auauuggccuaaaauucucuuu

SEQ ID NO: 71421 - RNA, 22 nt, Homo sapiens
auauuguuggcugcuggcugau

SEQ ID NO: 71422 - RNA, 19 nt, Homo sapiens
aucaaacugcucuuugagg

SEQ ID NO: 71423 - RNA, 22 nt, Homo sapiens
aucaaagcagcauggcccaguc

SEQ ID NO: 71424 - RNA, 22 nt, Homo sapiens
aucaaaguaggcauauguuuuu

SEQ ID NO: 71425 - RNA, 22 nt, Homo sapiens
aucaaaucuccagaaccugucu

SEQ ID NO: 71426 - RNA, 22 nt, Homo sapiens
aucaagcuacacccuuuggaaa

SEQ ID NO: 71427 - RNA, 22 nt, Homo sapiens
aucaagcugcuuguuugaaucu

SEQ ID NO: 71428 - RNA, 22 nt, Homo sapiens
aucaagcuugacuccuuaaagg

SEQ ID NO: 71429 - RNA, 22 nt, Homo sapiens
aucaaguaaucugaguaagagu

SEQ ID NO: 71430 - RNA, 22 nt, Homo sapiens
aucaaguaguuauacguaaagg

SEQ ID NO: 71431 - RNA, 22 nt, Homo sapiens
aucacacucaccuucuguccuu

SEQ ID NO: 71432 - RNA, 22 nt, Homo sapiens
aucacagaacuuugagcagaga

SEQ ID NO: 71433 - RNA, 22 nt, Homo sapiens
aucacagugaaaacagucaauu

SEQ ID NO: 71434 - RNA, 19 nt, Homo sapiens
aucaccagucuuuccacug

SEQ ID NO: 71435 - RNA, 22 nt, Homo sapiens
aucacuggucaugagagaagua

SEQ ID NO: 71436 - RNA, 16 nt, Homo sapiens
aucacuugcuucuuuu

SEQ ID NO: 71437 - RNA, 22 nt, Homo sapiens
aucagaaucucuagaggacugu

SEQ ID NO: 71438 - RNA, 22 nt, Homo sapiens
aucagaaucucuugagaguguu

SEQ ID NO: 71439 - RNA, 22 nt, Homo sapiens
aucagaguugucagggagcuuu

SEQ ID NO: 71440 - RNA, 22 nt, Homo sapiens
aucagauuccacauuuuaucag

SEQ ID NO: 71441 - RNA, 19 nt, Homo sapiens
aucagcacaagugugcuuu

SEQ ID NO: 71442 - RNA, 22 nt, Homo sapiens
aucagcagcaugaaaagcaacu

SEQ ID NO: 71443 - RNA, 22 nt, Homo sapiens
aucagcaguguaaaaacggacu

SEQ ID NO: 71444 - RNA, 22 nt, Homo sapiens
aucagucuguuggaauaucgcu

SEQ ID NO: 71445 - RNA, 21 nt, Homo sapiens
aucauaugcucacuccuagaa

SEQ ID NO: 71446 - RNA, 22 nt, Homo sapiens
aucauccugucaggagcuguga

SEQ ID NO: 71447 - RNA, 22 nt, Homo sapiens
aucaugcacaugcauagguaug

SEQ ID NO: 71448 - RNA, 22 nt, Homo sapiens
aucauggaguauuugcaagucu

SEQ ID NO: 71449 - RNA, 22 nt, Homo sapiens
aucaugucuucccagugauucu

SEQ ID NO: 71450 - RNA, 22 nt, Homo sapiens
aucauguuuauguguaggauau

SEQ ID NO: 71451 - RNA, 18 nt, Homo sapiens
aucauugcacugucuugc

SEQ ID NO: 71452 - RNA, 23 nt, Homo sapiens
auccacauucuaguccuuuaugc

SEQ ID NO: 71453 - RNA, 22 nt, Homo sapiens
auccauguggauaaauguguau

SEQ ID NO: 71454 - RNA, 22 nt, Homo sapiens
aucccagaaacucggguuucuc

SEQ ID NO: 71455 - RNA, 22 nt, Homo sapiens
auccccugcacggggugucauu

SEQ ID NO: 71456 - RNA, 22 nt, Homo sapiens
aucccuagaaaaaucagcacau

SEQ ID NO: 71457 - RNA, 22 nt, Homo sapiens
aucccugagaacuuuuaauguu

SEQ ID NO: 71458 - RNA, 22 nt, Homo sapiens
aucccugaggaauuucugcacu

SEQ ID NO: 71459 - RNA, 22 nt, Homo sapiens
aucccuguaguaauauucuagc

SEQ ID NO: 71460 - RNA, 22 nt, Homo sapiens
aucccugugacgagcaucccua

SEQ ID NO: 71461 - RNA, 22 nt, Homo sapiens
auccguugcaagggaagaauga

SEQ ID NO: 71462 - RNA, 22 nt, Homo sapiens
auccugagacuuugcugaaguu

SEQ ID NO: 71463 - RNA, 22 nt, Homo sapiens
auccuuuagacuguccaguuga

SEQ ID NO: 71464 - RNA, 22 nt, Homo sapiens
aucgcacuccauccugggcaac

SEQ ID NO: 71465 - RNA, 20 nt, Homo sapiens
aucguggccugaggagauac

SEQ ID NO: 71466 - RNA, 22 nt, Homo sapiens
aucuacagccagucugguuugu

SEQ ID NO: 71467 - RNA, 22 nt, Homo sapiens
aucucagagaaaauuacuaaga

SEQ ID NO: 71468 - RNA, 22 nt, Homo sapiens
aucucaguuaauuccaucuuuc

SEQ ID NO: 71469 - RNA, 22 nt, Homo sapiens
aucucaguucaggcuggccaca

SEQ ID NO: 71470 - RNA, 22 nt, Homo sapiens
aucucauggagguagagaguaa

SEQ ID NO: 71471 - RNA, 22 nt, Homo sapiens
aucuccaggugccagcugcgcc

SEQ ID NO: 71472 - RNA, 22 nt, Homo sapiens
aucucugagauguucugauuuu

SEQ ID NO: 71473 - RNA, 22 nt, Homo sapiens
aucucuugccagucagaauggu

SEQ ID NO: 71474 - RNA, 22 nt, Homo sapiens
aucugcacaucuguguuuuugu

SEQ ID NO: 71475 - RNA, 22 nt, Homo sapiens
aucuggcuucuuuuaguccaca

SEQ ID NO: 71476 - RNA, 22 nt, Homo sapiens
aucugguguuuccuucacauug

SEQ ID NO: 71477 - RNA, 22 nt, Homo sapiens
aucugguguuuuucucccucgu

SEQ ID NO: 71478 - RNA, 22 nt, Homo sapiens
aucuugggugggaacugagaau

SEQ ID NO: 71479 - RNA, 22 nt, Homo sapiens
aucuuugauuagacugauggau

SEQ ID NO: 71480 - RNA, 22 nt, Homo sapiens
aucuuugauuguagguacaaug

SEQ ID NO: 71481 - RNA, 22 nt, Homo sapiens
aucuuugcugagaugcauggca

SEQ ID NO: 71482 - RNA, 22 nt, Homo sapiens
aucuuuggauacuugauauagu

SEQ ID NO: 71483 - RNA, 22 nt, Homo sapiens
augaaaagcauaaacgcugaag

SEQ ID NO: 71484 - RNA, 22 nt, Homo sapiens
augaaacuggcuaauuuuugua

SEQ ID NO: 71485 - RNA, 23 nt, Homo sapiens
augaaagcccuugcaaaugcugg

SEQ ID NO: 71486 - RNA, 22 nt, Homo sapiens
augaaagguauguuuucuguga

SEQ ID NO: 71487 - RNA, 22 nt, Homo sapiens
augaaagucaauccccaagugu

SEQ ID NO: 71488 - RNA, 22 nt, Homo sapiens
augaaaucuuuggcagaucuua

SEQ ID NO: 71489 - RNA, 22 nt, Homo sapiens
augaaauugcuaucgcaguacu

SEQ ID NO: 71490 - RNA, 22 nt, Homo sapiens
augaacacuccaauuguacucc

SEQ ID NO: 71491 - RNA, 22 nt, Homo sapiens
augaacucaucauuuuuauggc

SEQ ID NO: 71492 - RNA, 18 nt, Homo sapiens
augaacucaucauuuuuu

SEQ ID NO: 71493 - RNA, 22 nt, Homo sapiens
augaacucaucauuuuuuaugg

SEQ ID NO: 71494 - RNA, 22 nt, Homo sapiens
augaagaucucugccuuguguc

SEQ ID NO: 71495 - RNA, 22 nt, Homo sapiens
augaagauguugccuuuuuaau

SEQ ID NO: 71496 - RNA, 20 nt, Homo sapiens
agcugcagauauaaauccgc

SEQ ID NO: 71497 - RNA, 22 nt, Homo sapiens
agcugcauucguaucauauugu

SEQ ID NO: 71498 - RNA, 16 nt, Homo sapiens
agcuggaauuacaggc

SEQ ID NO: 71499 - RNA, 22 nt, Homo sapiens
agcuggauuguuuaccuggggc

SEQ ID NO: 71500 - RNA, 22 nt, Homo sapiens
agcuggcuguagcugcaagucu

SEQ ID NO: 71501 - RNA, 22 nt, Homo sapiens
agcuggcuguggagaaaccccu

SEQ ID NO: 71502 - RNA, 23 nt, Homo sapiens
agcugguacuagaggcuugcgcc

SEQ ID NO: 71503 - RNA, 22 nt, Homo sapiens
agcugguaugaaaaucucccca

SEQ ID NO: 71504 - RNA, 22 nt, Homo sapiens
agcugguauuuugucaaggaua

SEQ ID NO: 71505 - RNA, 22 nt, Homo sapiens
agcugguauuuugucgaggacu

SEQ ID NO: 71506 - RNA, 22 nt, Homo sapiens
agcuggucuacguguguaugag

SEQ ID NO: 71507 - RNA, 22 nt, Homo sapiens
agcugguucuuugccuuguaga

SEQ ID NO: 71508 - RNA, 21 nt, Homo sapiens
agcugguuuccacagugugcu

SEQ ID NO: 71509 - RNA, 22 nt, Homo sapiens
agcuguguugucugaagucaga

SEQ ID NO: 71510 - RNA, 22 nt, Homo sapiens
agcuguuguacacuuuaccuuu

SEQ ID NO: 71511 - RNA, 22 nt, Homo sapiens
agcuguuguuaauuaacucauu

SEQ ID NO: 71512 - RNA, 22 nt, Homo sapiens
agcuugucuuauacuacuucau

SEQ ID NO: 71513 - RNA, 22 nt, Homo sapiens
agcuugugauuuagagugagag

SEQ ID NO: 71514 - RNA, 22 nt, Homo sapiens
agcuuguguuuuucuaaguauc

SEQ ID NO: 71515 - RNA, 22 nt, Homo sapiens
agcuuguuuucccauaacuaga

SEQ ID NO: 71516 - RNA, 22 nt, Homo sapiens
agcuuuggauaccugcuguucc

SEQ ID NO: 71517 - RNA, 22 nt, Homo sapiens
aggaacuguaacuaugucucug

SEQ ID NO: 71518 - RNA, 22 nt, Homo sapiens
aggaagguaaacuaacuugccu

SEQ ID NO: 71519 - RNA, 23 nt, Homo sapiens
aggaauggaaaaccaaguaucau

SEQ ID NO: 71520 - RNA, 22 nt, Homo sapiens
aggaauuuaauguaugauaaua

SEQ ID NO: 71521 - RNA, 22 nt, Homo sapiens
aggaccaugguauugcuuuggg

SEQ ID NO: 71522 - RNA, 22 nt, Homo sapiens
aggagcacaggacuuugauuau

SEQ ID NO: 71523 - RNA, 18 nt, Homo sapiens
aggagcauagugcuauga

SEQ ID NO: 71524 - RNA, 22 nt, Homo sapiens
aggaggauugcuuucaucuuuu

SEQ ID NO: 71525 - RNA, 22 nt, Homo sapiens
aggagguaggaauugugcuagg

SEQ ID NO: 71526 - RNA, 22 nt, Homo sapiens
aggauacugguaugggcugaau

SEQ ID NO: 71527 - RNA, 22 nt, Homo sapiens
aggcaaaugccagcaaucacac

SEQ ID NO: 71528 - RNA, 22 nt, Homo sapiens
aggcaacaugguaaaacccugu

SEQ ID NO: 71529 - RNA, 16 nt, Homo sapiens
aggcaagaauugaggu

SEQ ID NO: 71530 - RNA, 21 nt, Homo sapiens
aggcaagguguuauuauugaa

SEQ ID NO: 71531 - RNA, 22 nt, Homo sapiens
aggcaagugauagcugcguaau

SEQ ID NO: 71532 - RNA, 22 nt, Homo sapiens
aggcaaguugcucaaaugcaaa

SEQ ID NO: 71533 - RNA, 22 nt, Homo sapiens
aggcacacaacccuggaccuga

SEQ ID NO: 71534 - RNA, 22 nt, Homo sapiens
aggcacgguggcucacaccugu

SEQ ID NO: 71535 - RNA, 22 nt, Homo sapiens
aggcaugaaauacaugcauuga

SEQ ID NO: 71536 - RNA, 22 nt, Homo sapiens
aggcaugauggcuccagaucau

SEQ ID NO: 71537 - RNA, 22 nt, Homo sapiens
aggcauggagacuaaaauuaua

SEQ ID NO: 71538 - RNA, 22 nt, Homo sapiens
aggcauguggcucuguucugac

SEQ ID NO: 71539 - RNA, 22 nt, Homo sapiens
aggcauguugcuucgggcuuug

SEQ ID NO: 71540 - RNA, 22 nt, Homo sapiens
aggccaguuuuuggagggaaac

SEQ ID NO: 71541 - RNA, 22 nt, Homo sapiens
aggcuagacuuugagaauuuuu

SEQ ID NO: 71542 - RNA, 22 nt, Homo sapiens
aggcuuauuaagauucccuuau

SEQ ID NO: 71543 - RNA, 22 nt, Homo sapiens
agggcaagacuuguuaagaaca

SEQ ID NO: 71544 - RNA, 23 nt, Homo sapiens
agggcacuauagauguuauucua

SEQ ID NO: 71545 - RNA, 22 nt, Homo sapiens
agggccuuuguagauguacuca

SEQ ID NO: 71546 - RNA, 22 nt, Homo sapiens
agggcuuaucuguguagaguuc

SEQ ID NO: 71547 - RNA, 22 nt, Homo sapiens
agggcuuuugagcugagauggu

SEQ ID NO: 71548 - RNA, 22 nt, Homo sapiens
agguaaguauguuauuacuuuu

SEQ ID NO: 71549 - RNA, 22 nt, Homo sapiens
agguaagucucuaauuaugaau

SEQ ID NO: 71550 - RNA, 22 nt, Homo sapiens
agguagguugagaugggcauca

SEQ ID NO: 71551 - RNA, 22 nt, Homo sapiens
agguauguauguaugggagaaa

SEQ ID NO: 71552 - RNA, 22 nt, Homo sapiens
aggucaccucaggaaauacuga

SEQ ID NO: 71553 - RNA, 22 nt, Homo sapiens
aggugcucuuccuguaggucac

SEQ ID NO: 71554 - RNA, 22 nt, Homo sapiens
aggugcugacaggauagguuuc

SEQ ID NO: 71555 - RNA, 22 nt, Homo sapiens
aggugcuugaaucuaugagcuc

SEQ ID NO: 71556 - RNA, 22 nt, Homo sapiens
aggugguauuucaaaguggcag

SEQ ID NO: 71557 - RNA, 22 nt, Homo sapiens
aggugguguuggguuccagccc

SEQ ID NO: 71558 - RNA, 22 nt, Homo sapiens
aggugguuuugaugagcaggua

SEQ ID NO: 71559 - RNA, 21 nt, Homo sapiens
aggugucuuggguucccuggc

SEQ ID NO: 71560 - RNA, 22 nt, Homo sapiens
agguguuguugaggagauuuca

SEQ ID NO: 71561 - RNA, 23 nt, Homo sapiens
agguuaugauuauagagcgagga

SEQ ID NO: 71562 - RNA, 22 nt, Homo sapiens
agguucccuuuuggccugggau

SEQ ID NO: 71563 - RNA, 22 nt, Homo sapiens
aguaaacuucagaguucuuccu

SEQ ID NO: 71564 - RNA, 22 nt, Homo sapiens
aguaccauuagauuaggaugac

SEQ ID NO: 71565 - RNA, 22 nt, Homo sapiens
aguaccauuugacaugggaccc

SEQ ID NO: 71566 - RNA, 17 nt, Homo sapiens
aguacugucccauccuu

SEQ ID NO: 71567 - RNA, 21 nt, Homo sapiens
aguagcacugugucuuacaaa

SEQ ID NO: 71568 - RNA, 22 nt, Homo sapiens
aguagcauuggggggcauccuc

SEQ ID NO: 71569 - RNA, 22 nt, Homo sapiens
aguagguguugguagagguuuc

SEQ ID NO: 71570 - RNA, 22 nt, Homo sapiens
aguauguuuugaaaccaagaag

SEQ ID NO: 71571 - RNA, 22 nt, Homo sapiens
aguauuuguuggaauaccuguu

SEQ ID NO: 71572 - RNA, 22 nt, Homo sapiens
agucaagaaucucagcaucuuu

SEQ ID NO: 71573 - RNA, 22 nt, Homo sapiens
agucaagauggcaagguaaggc

SEQ ID NO: 71574 - RNA, 22 nt, Homo sapiens
agucacaugccagcacacccag

SEQ ID NO: 71575 - RNA, 22 nt, Homo sapiens
agucagauuggcauuuguuggg

SEQ ID NO: 71576 - RNA, 23 nt, Homo sapiens
agucaguaugcuccuuggauccc

SEQ ID NO: 71577 - RNA, 22 nt, Homo sapiens
agucaguguguauugauggcac

SEQ ID NO: 71578 - RNA, 22 nt, Homo sapiens
agucauggcagaaggcaccucu

SEQ ID NO: 71579 - RNA, 22 nt, Homo sapiens
aguccagguuuuguaauggcaa

SEQ ID NO: 71580 - RNA, 22 nt, Homo sapiens
aguccauuugaugaugauucca

SEQ ID NO: 71581 - RNA, 22 nt, Homo sapiens
agugaacaaagaagugcagaua

SEQ ID NO: 71582 - RNA, 22 nt, Homo sapiens
agugaauguuggaaaguuauuu

SEQ ID NO: 71583 - RNA, 22 nt, Homo sapiens
agugacuagaauaugaauuuua

SEQ ID NO: 71584 - RNA, 22 nt, Homo sapiens
agugauggagccaggauuuaau

SEQ ID NO: 71585 - RNA, 22 nt, Homo sapiens
agugcaauaaggauguagaacu

SEQ ID NO: 71586 - RNA, 22 nt, Homo sapiens
agugcaaugauccggugcuggg

SEQ ID NO: 71587 - RNA, 19 nt, Homo sapiens
agugcaauugccuuugugc

SEQ ID NO: 71588 - RNA, 22 nt, Homo sapiens
agugcacugcccgcuuccuguc

SEQ ID NO: 71589 - RNA, 22 nt, Homo sapiens
agugcaguggcacaaucuuggc

SEQ ID NO: 71590 - RNA, 22 nt, Homo sapiens
agugcagugguuaggagccagg

SEQ ID NO: 71591 - RNA, 18 nt, Homo sapiens
aaaaagugcucaggccua

SEQ ID NO: 71592 - RNA, 22 nt, Homo sapiens
aaaagcuuagaugggcuuguau

SEQ ID NO: 71593 - RNA, 22 nt, Homo sapiens
acacuggaggagagcuguugcu

SEQ ID NO: 71594 - RNA, 22 nt, Homo sapiens
acacuguccaguuaggcuacau

SEQ ID NO: 71595 - RNA, 22 nt, Homo sapiens
acacuuucuagacaagggaaua

SEQ ID NO: 71596 - RNA, 22 nt, Homo sapiens
acacuuucuggagcugcacaua

SEQ ID NO: 71597 - RNA, 22 nt, Homo sapiens
acagaaccauucacuccccugg

SEQ ID NO: 71598 - RNA, 22 nt, Homo sapiens
acagaauucucagaacugggag

SEQ ID NO: 71599 - RNA, 20 nt, Homo sapiens
acagcacugguuucaagcaa

SEQ ID NO: 71600 - RNA, 22 nt, Homo sapiens
acaguacuguuguuugcugcca

SEQ ID NO: 71601 - RNA, 22 nt, Homo sapiens
acaguauaaugcuguagggaga

SEQ ID NO: 71602 - RNA, 22 nt, Homo sapiens
acaguaugcuuuaaacuuuguu

SEQ ID NO: 71603 - RNA, 20 nt, Homo sapiens
acaguauguuuggaugcaua

SEQ ID NO: 71604 - RNA, 19 nt, Homo sapiens
acaguauugugcacagguu

SEQ ID NO: 71605 - RNA, 22 nt, Homo sapiens
acagucacaauuuguaccuuuu

SEQ ID NO: 71606 - RNA, 22 nt, Homo sapiens
acagucauagcagccuuuguua

SEQ ID NO: 71607 - RNA, 18 nt, Homo sapiens
acagugcuggcaugagau

SEQ ID NO: 71608 - RNA, 22 nt, Homo sapiens
acagugcugucugcuuuggcua

SEQ ID NO: 71609 - RNA, 22 nt, Homo sapiens
acagugcuguggucaugggucu

SEQ ID NO: 71610 - RNA, 22 nt, Homo sapiens
acagugcuguuguguuuucacg

SEQ ID NO: 71611 - RNA, 22 nt, Homo sapiens
acagugcuuggcacacaguaau

SEQ ID NO: 71612 - RNA, 22 nt, Homo sapiens
acaguggaauguaggguuugag

SEQ ID NO: 71613 - RNA, 22 nt, Homo sapiens
acagugucugacacguaggaag

SEQ ID NO: 71614 - RNA, 22 nt, Homo sapiens
acaguguuccuuuguugugacu

SEQ ID NO: 71615 - RNA, 22 nt, Homo sapiens
acauaaagaagcaggacauugu

SEQ ID NO: 71616 - RNA, 22 nt, Homo sapiens
acauagaguagcuaccuguaga

SEQ ID NO: 71617 - RNA, 22 nt, Homo sapiens
acaucacuguuugauugauuga

SEQ ID NO: 71618 - RNA, 22 nt, Homo sapiens
acaucccuuucccacccuucac

SEQ ID NO: 71619 - RNA, 22 nt, Homo sapiens
acaugagacuggguuuguaggg

SEQ ID NO: 71620 - RNA, 22 nt, Homo sapiens
acauguauauaaugcauagcga

SEQ ID NO: 71621 - RNA, 22 nt, Homo sapiens
accaccauugcacugaacuuuc

SEQ ID NO: 71622 - RNA, 22 nt, Homo sapiens
accacuguuucaagaagcuugu

SEQ ID NO: 71623 - RNA, 22 nt, Homo sapiens
accaugcaguccaauaugcaca

SEQ ID NO: 71624 - RNA, 22 nt, Homo sapiens
accauugcacuccuuucugggc

SEQ ID NO: 71625 - RNA, 22 nt, Homo sapiens
acccagaagucauucaggaaca

SEQ ID NO: 71626 - RNA, 22 nt, Homo sapiens
acccaguagucauucaggagca

SEQ ID NO: 71627 - RNA, 22 nt, Homo sapiens
acccaguguugggcagaacugu

SEQ ID NO: 71628 - RNA, 22 nt, Homo sapiens
acccauacacacauauuuaugu

SEQ ID NO: 71629 - RNA, 22 nt, Homo sapiens
accccugagaucgaaucaugcu

SEQ ID NO: 71630 - RNA, 22 nt, Homo sapiens
acccugaagccaugaguggaac

SEQ ID NO: 71631 - RNA, 22 nt, Homo sapiens
acccuggauucguggccuugaa

SEQ ID NO: 71632 - RNA, 22 nt, Homo sapiens
acccuguaggugcuggcagaga

SEQ ID NO: 71633 - RNA, 22 nt, Homo sapiens
acccugucaaaacggaccaauc

SEQ ID NO: 71634 - RNA, 22 nt, Homo sapiens
acccugucaaaauagaccaauc

SEQ ID NO: 71635 - RNA, 22 nt, Homo sapiens
acccuugaguguguuucaggca

SEQ ID NO: 71636 - RNA, 22 nt, Homo sapiens
accgaguguucucccgcagcgg

SEQ ID NO: 71637 - RNA, 22 nt, Homo sapiens
accgggcugagcgcaggccccg

SEQ ID NO: 71638 - RNA, 22 nt, Homo sapiens
accugagauuacaggugcuggc

SEQ ID NO: 71639 - RNA, 16 nt, Homo sapiens
accuguacagcaugug

SEQ ID NO: 71640 - RNA, 19 nt, Homo sapiens
accuguagaaaguacaaca

SEQ ID NO: 71641 - RNA, 22 nt, Homo sapiens
accugugguuacagucugucuc

SEQ ID NO: 71642 - RNA, 23 nt, Homo sapiens
accuucauucauucagcugaagu

SEQ ID NO: 71643 - RNA, 18 nt, Homo sapiens
accuucauuccuuugccu

SEQ ID NO: 71644 - RNA, 22 nt, Homo sapiens
accuucauuguugccaugucca

SEQ ID NO: 71645 - RNA, 22 nt, Homo sapiens
acggcacugguggaaguguagc

SEQ ID NO: 71646 - RNA, 22 nt, Homo sapiens
acuaaggcacaauuuucucaua

SEQ ID NO: 71647 - RNA, 22 nt, Homo sapiens
acuacugucagacugccacuga

SEQ ID NO: 71648 - RNA, 22 nt, Homo sapiens
acuagaugauuauguuccauug

SEQ ID NO: 71649 - RNA, 22 nt, Homo sapiens
acucagagauuagcacauguuu

SEQ ID NO: 71650 - RNA, 22 nt, Homo sapiens
acucuguaagcaagcuggggaa

SEQ ID NO: 71651 - RNA, 22 nt, Homo sapiens
acugagaucuuuaaauaaauaa

SEQ ID NO: 71652 - RNA, 23 nt, Homo sapiens
acugagcaauguuuacauacuug

SEQ ID NO: 71653 - RNA, 22 nt, Homo sapiens
acugagccuuuaaaugacuuca

SEQ ID NO: 71654 - RNA, 20 nt, Homo sapiens
acugauauguuccuguucuc

SEQ ID NO: 71655 - RNA, 22 nt, Homo sapiens
acugcaaugucgaauagagaug

SEQ ID NO: 71656 - RNA, 21 nt, Homo sapiens
acugcacuccaaccucaacag

SEQ ID NO: 71657 - RNA, 22 nt, Homo sapiens
acugcacuccagccucaugaca

SEQ ID NO: 71658 - RNA, 22 nt, Homo sapiens
acugcacuccagccuccugaca

SEQ ID NO: 71659 - RNA, 22 nt, Homo sapiens
acugcacuccagccuccugggu

SEQ ID NO: 71660 - RNA, 22 nt, Homo sapiens
acugcacuccagccugcuggau

SEQ ID NO: 71661 - RNA, 22 nt, Homo sapiens
acugcacuccagccuggaccac

SEQ ID NO: 71662 - RNA, 22 nt, Homo sapiens
acugcacuccagccuggcggac

SEQ ID NO: 71663 - RNA, 22 nt, Homo sapiens
acugcacuccagccugugcgua

SEQ ID NO: 71664 - RNA, 22 nt, Homo sapiens
acugcacuccagccuucaggac

SEQ ID NO: 71665 - RNA, 22 nt, Homo sapiens
acugcacuccagccuuggcaac

SEQ ID NO: 71666 - RNA, 22 nt, Homo sapiens
acugcacuccagccuuggcggc

SEQ ID NO: 71667 - RNA, 22 nt, Homo sapiens
acugcacuccagcuuuggguga

SEQ ID NO: 71668 - RNA, 20 nt, Homo sapiens
acugcacuccagucucuggg

SEQ ID NO: 71669 - RNA, 22 nt, Homo sapiens
acugcacuccaguuccgggcaa

SEQ ID NO: 71670 - RNA, 19 nt, Homo sapiens
acugcacuccuccuugggu

SEQ ID NO: 71671 - RNA, 22 nt, Homo sapiens
acugcacucuagccuuggcaac

SEQ ID NO: 71672 - RNA, 22 nt, Homo sapiens
acugcacugucaaccuccuggg

SEQ ID NO: 71673 - RNA, 22 nt, Homo sapiens
acugcacuucagccuugugaca

SEQ ID NO: 71674 - RNA, 20 nt, Homo sapiens
acugcauuuaguccucagga

SEQ ID NO: 71675 - RNA, 22 nt, Homo sapiens
acuggauguuagggauuuuauu

SEQ ID NO: 71676 - RNA, 22 nt, Homo sapiens
acuggcuguuaggaauuaccuc

SEQ ID NO: 71677 - RNA, 20 nt, Homo sapiens
acugggcuaccgaaguaagg

SEQ ID NO: 71678 - RNA, 22 nt, Homo sapiens
acugggucaaaguagaaaacua

SEQ ID NO: 71679 - RNA, 22 nt, Homo sapiens
acuggguuaauuugaagguuga

SEQ ID NO: 71680 - RNA, 22 nt, Homo sapiens
acugguuguuuaacugaauuga

SEQ ID NO: 71681 - RNA, 22 nt, Homo sapiens
acuguacuccagccugggugac

SEQ ID NO: 71682 - RNA, 22 nt, Homo sapiens
acuguacugucuggggcagucu

SEQ ID NO: 71683 - RNA, 22 nt, Homo sapiens
acuucauucucuggaucagaau

SEQ ID NO: 71684 - RNA, 22 nt, Homo sapiens
acuuggcaaaguuuuaaacagc

SEQ ID NO: 71685 - RNA, 22 nt, Homo sapiens
acuuugguuaucauacuuucag

SEQ ID NO: 71686 - RNA, 22 nt, Homo sapiens
acuuuguguuacccagcaagga

SEQ ID NO: 71687 - RNA, 22 nt, Homo sapiens
acuuuguuauggcaacccuaag

SEQ ID NO: 71688 - RNA, 22 nt, Homo sapiens
augagugugaccugccaagaga

SEQ ID NO: 71689 - RNA, 19 nt, Homo sapiens
augaguuaggggaaauuuc

SEQ ID NO: 71690 - RNA, 22 nt, Homo sapiens
augauaaguuauuagaagaaga

SEQ ID NO: 71691 - RNA, 22 nt, Homo sapiens
augauacuguucuaagauuuuu

SEQ ID NO: 71692 - RNA, 22 nt, Homo sapiens
augauagucuugagaagcauuu

SEQ ID NO: 71693 - RNA, 22 nt, Homo sapiens
augauauggucacccuuaugaa

SEQ ID NO: 71694 - RNA, 22 nt, Homo sapiens
augaucacuguggaaauucagc

SEQ ID NO: 71695 - RNA, 22 nt, Homo sapiens
augaucaucugaaagcuuuuac

SEQ ID NO: 71696 - RNA, 22 nt, Homo sapiens
augaucauggaagugcacccau

SEQ ID NO: 71697 - RNA, 22 nt, Homo sapiens
augaucuagaguaggaaacaga

SEQ ID NO: 71698 - RNA, 22 nt, Homo sapiens
augaucuguuuggugaucuugu

SEQ ID NO: 71699 - RNA, 22 nt, Homo sapiens
augaugaaguaagugcuuagga

SEQ ID NO: 71700 - RNA, 22 nt, Homo sapiens
augaugucauuuuaauuucuaa

SEQ ID NO: 71701 - RNA, 19 nt, Homo sapiens
augauugucuauggaggaa

SEQ ID NO: 71702 - RNA, 22 nt, Homo sapiens
augauuguucucacucaagaga

SEQ ID NO: 71703 - RNA, 22 nt, Homo sapiens
augcaacugcacuccagccugg

SEQ ID NO: 71704 - RNA, 22 nt, Homo sapiens
augcagcugaggguaguggagc

SEQ ID NO: 71705 - RNA, 22 nt, Homo sapiens
augcauagcaucugcaaauguu

SEQ ID NO: 71706 - RNA, 22 nt, Homo sapiens
augcauauuccugggccucacu

SEQ ID NO: 71707 - RNA, 22 nt, Homo sapiens
augcauauuuuaccuagaagag

SEQ ID NO: 71708 - RNA, 22 nt, Homo sapiens
augcauggcagagucaggguac

SEQ ID NO: 71709 - RNA, 22 nt, Homo sapiens
augccaagaugagcacgcgucu

SEQ ID NO: 71710 - RNA, 22 nt, Homo sapiens
augccacugcacuccaaccugg

SEQ ID NO: 71711 - RNA, 22 nt, Homo sapiens
augccacugcacuucagcuugg

SEQ ID NO: 71712 - RNA, 22 nt, Homo sapiens
augccacugcgcucuagccugg

SEQ ID NO: 71713 - RNA, 22 nt, Homo sapiens
augccacuguccuccugccuag

SEQ ID NO: 71714 - RNA, 22 nt, Homo sapiens
augccagggagaauuguucaag

SEQ ID NO: 71715 - RNA, 22 nt, Homo sapiens
augccuagagucaguggaggug

SEQ ID NO: 71716 - RNA, 22 nt, Homo sapiens
augcuacugauaagcaaucauu

SEQ ID NO: 71717 - RNA, 22 nt, Homo sapiens
augcuacuggacaauggugacu

SEQ ID NO: 71718 - RNA, 22 nt, Homo sapiens
augcuaugugugacuucuuaug

SEQ ID NO: 71719 - RNA, 22 nt, Homo sapiens
auggaaacauaagaguauagau

SEQ ID NO: 71720 - RNA, 20 nt, Homo sapiens
auggaacugugagccaauua

SEQ ID NO: 71721 - RNA, 22 nt, Homo sapiens
auggaagaaaguuggguucuug

SEQ ID NO: 71722 - RNA, 22 nt, Homo sapiens
auggaagucucuguuaaguuuc

SEQ ID NO: 71723 - RNA, 22 nt, Homo sapiens
auggaauguggaaugguaagua

SEQ ID NO: 71724 - RNA, 22 nt, Homo sapiens
auggacagacacuggccuucug

SEQ ID NO: 71725 - RNA, 22 nt, Homo sapiens
auggacauuaaagcgauguaga

SEQ ID NO: 71726 - RNA, 20 nt, Homo sapiens
auggaccuggauuaacagca

SEQ ID NO: 71727 - RNA, 22 nt, Homo sapiens
auggagaugaacuuggguaaag

SEQ ID NO: 71728 - RNA, 22 nt, Homo sapiens
auggagguguggggagugaguu

SEQ ID NO: 71729 - RNA, 22 nt, Homo sapiens
auggaguguaauauugagagcu

SEQ ID NO: 71730 - RNA, 22 nt, Homo sapiens
auggaguuuacuuaguguaaua

SEQ ID NO: 71731 - RNA, 22 nt, Homo sapiens
auggaguuugaacaauuuccug

SEQ ID NO: 71732 - RNA, 22 nt, Homo sapiens
auggauuuuaggauacaguuga

SEQ ID NO: 71733 - RNA, 22 nt, Homo sapiens
auggcaagaagagcaauuauuu

SEQ ID NO: 71734 - RNA, 22 nt, Homo sapiens
auggcaauaauagcuaccauuu

SEQ ID NO: 71735 - RNA, 22 nt, Homo sapiens
auggcaaugcgauggugacuga

SEQ ID NO: 71736 - RNA, 22 nt, Homo sapiens
auggcacagacucuuggucaag

SEQ ID NO: 71737 - RNA, 22 nt, Homo sapiens
auggcacugauggaaguaccuu

SEQ ID NO: 71738 - RNA, 22 nt, Homo sapiens
auggcacuguguauuuuucugu

SEQ ID NO: 71739 - RNA, 22 nt, Homo sapiens
auggcagcccucuuuauccaug

SEQ ID NO: 71740 - RNA, 22 nt, Homo sapiens
auggcagcugguuuuacccuag

SEQ ID NO: 71741 - RNA, 22 nt, Homo sapiens
auggcaguguaugauuauauua

SEQ ID NO: 71742 - RNA, 22 nt, Homo sapiens
auggcagugucuagggguguuu

SEQ ID NO: 71743 - RNA, 22 nt, Homo sapiens
auggcaguuuggucucugugcu

SEQ ID NO: 71744 - RNA, 22 nt, Homo sapiens
auggcauggugcaggguuuaag

SEQ ID NO: 71745 - RNA, 22 nt, Homo sapiens
auggccauuacuaagaauguuu

SEQ ID NO: 71746 - RNA, 22 nt, Homo sapiens
auggcccccuguuugugaacau

SEQ ID NO: 71747 - RNA, 20 nt, Homo sapiens
auggcccugcugggaguguc

SEQ ID NO: 71748 - RNA, 23 nt, Homo sapiens
auggcccuggugggagugucuuu

SEQ ID NO: 71749 - RNA, 22 nt, Homo sapiens
auggcccuguguggagcugcug

SEQ ID NO: 71750 - RNA, 22 nt, Homo sapiens
auggccgggugcgguggcucac

SEQ ID NO: 71751 - RNA, 22 nt, Homo sapiens
auggccuuuuuaucucaccaag

SEQ ID NO: 71752 - RNA, 22 nt, Homo sapiens
auggcguguggcuuggaggcug

SEQ ID NO: 71753 - RNA, 22 nt, Homo sapiens
auggcuagaaccuguauauuca

SEQ ID NO: 71754 - RNA, 22 nt, Homo sapiens
auggcuagauuguaugguaguu

SEQ ID NO: 71755 - RNA, 22 nt, Homo sapiens
caucaaaguggagggaaggacc

SEQ ID NO: 71756 - RNA, 21 nt, Homo sapiens
caucaaauugucauggugggu

SEQ ID NO: 71757 - RNA, 22 nt, Homo sapiens
caucacacuuggauguaagaca

SEQ ID NO: 71758 - RNA, 23 nt, Homo sapiens
caucacagagccuuccuugacuc

SEQ ID NO: 71759 - RNA, 21 nt, Homo sapiens
caucacauuacucaaaguccu

SEQ ID NO: 71760 - RNA, 20 nt, Homo sapiens
caucaccuggcaggauuugu

SEQ ID NO: 71761 - RNA, 22 nt, Homo sapiens
caucagagugagauauaagauc

SEQ ID NO: 71762 - RNA, 22 nt, Homo sapiens
caucagauugagaucaucuaag

SEQ ID NO: 71763 - RNA, 22 nt, Homo sapiens
caucaggugaggauucaaugca

SEQ ID NO: 71764 - RNA, 22 nt, Homo sapiens
caucgcacuccagccugggcaa

SEQ ID NO: 71765 - RNA, 22 nt, Homo sapiens
caugaacacugugcggcuuccu

SEQ ID NO: 71766 - RNA, 23 nt, Homo sapiens
caugaacuaguuugcagccauga

SEQ ID NO: 71767 - RNA, 22 nt, Homo sapiens
caugacacauguuuaccuaugu

SEQ ID NO: 71768 - RNA, 22 nt, Homo sapiens
caugacacuggcauguuucuuu

SEQ ID NO: 71769 - RNA, 22 nt, Homo sapiens
caugaugcuagguauggaugaa

SEQ ID NO: 71770 - RNA, 22 nt, Homo sapiens
caugcacugagagggucucggc

SEQ ID NO: 71771 - RNA, 22 nt, Homo sapiens
caugcagcacacaugucugugc

SEQ ID NO: 71772 - RNA, 22 nt, Homo sapiens
caugcauagccauucauucguu

SEQ ID NO: 71773 - RNA, 22 nt, Homo sapiens
caugcauuggucuauuauguga

SEQ ID NO: 71774 - RNA, 22 nt, Homo sapiens
caugccacugcacgccauccug

SEQ ID NO: 71775 - RNA, 22 nt, Homo sapiens
caugccacuguggacaaagaca

SEQ ID NO: 71776 - RNA, 22 nt, Homo sapiens
cauggcacauauauaucuaggu

SEQ ID NO: 71777 - RNA, 22 nt, Homo sapiens
cauggcacugagcagguaugca

SEQ ID NO: 71778 - RNA, 22 nt, Homo sapiens
cauggcuacugcagauguaggg

SEQ ID NO: 71779 - RNA, 22 nt, Homo sapiens
caugggacugucuuggcuauac

SEQ ID NO: 71780 - RNA, 22 nt, Homo sapiens
caugugcaugagcacauacgug

SEQ ID NO: 71781 - RNA, 22 nt, Homo sapiens
cauuacacuuguaagguuuuuc

SEQ ID NO: 71782 - RNA, 22 nt, Homo sapiens
cauuccacuggauaaacaaggu

SEQ ID NO: 71783 - RNA, 22 nt, Homo sapiens
cauugcaaugaggucuugcagu

SEQ ID NO: 71784 - RNA, 22 nt, Homo sapiens
cauugcacuccaccuuggguaa

SEQ ID NO: 71785 - RNA, 22 nt, Homo sapiens
cauugcacuccagccuggccaa

SEQ ID NO: 71786 - RNA, 22 nt, Homo sapiens
cauugcacuccagccuugguga

SEQ ID NO: 71787 - RNA, 22 nt, Homo sapiens
cauugcacuccagcucugggcg

SEQ ID NO: 71788 - RNA, 20 nt, Homo sapiens
cauugcacuccagcuugggc

SEQ ID NO: 71789 - RNA, 22 nt, Homo sapiens
cauugcacuccagcuugggcaa

SEQ ID NO: 71790 - RNA, 22 nt, Homo sapiens
cauugcacucuagucuggguga

SEQ ID NO: 71791 - RNA, 22 nt, Homo sapiens
cauugcacuuagacaacuuuug

SEQ ID NO: 71792 - RNA, 22 nt, Homo sapiens
cauugcaguggaguggggaaga

SEQ ID NO: 71793 - RNA, 20 nt, Homo sapiens
cauugcccuccagccugggc

SEQ ID NO: 71794 - RNA, 22 nt, Homo sapiens
cauugggugagaacaugcuccu

SEQ ID NO: 71795 - RNA, 22 nt, Homo sapiens
cauugguuuuucaggaguauau

SEQ ID NO: 71796 - RNA, 22 nt, Homo sapiens
cauuugguggcuacagaguaac

SEQ ID NO: 71797 - RNA, 22 nt, Homo sapiens
cauuuuacuuuccagacgugga

SEQ ID NO: 71798 - RNA, 22 nt, Homo sapiens
ccaaaucucauguugaaaugug

SEQ ID NO: 71799 - RNA, 22 nt, Homo sapiens
ccaaggaauacccucccuuuuu

SEQ ID NO: 71800 - RNA, 22 nt, Homo sapiens
ccaagugcuuaaaauuucauuu

SEQ ID NO: 71801 - RNA, 22 nt, Homo sapiens
ccacaaccuccauauccugggu

SEQ ID NO: 71802 - RNA, 22 nt, Homo sapiens
ccacaguggauuaaaguuacug

SEQ ID NO: 71803 - RNA, 22 nt, Homo sapiens
ccacauuggaaaggaucccccc

SEQ ID NO: 71804 - RNA, 22 nt, Homo sapiens
ccacccuuccauucuuccucuu

SEQ ID NO: 71805 - RNA, 22 nt, Homo sapiens
ccaccuguacuuaagucacuuu

SEQ ID NO: 71806 - RNA, 22 nt, Homo sapiens
ccacugggcaguuuauuaucag

SEQ ID NO: 71807 - RNA, 22 nt, Homo sapiens
ccacugggcuagguguuuugga

SEQ ID NO: 71808 - RNA, 22 nt, Homo sapiens
ccagaauucucauuggaaggaa

SEQ ID NO: 71809 - RNA, 22 nt, Homo sapiens
ccagaguugccucagguuucug

SEQ ID NO: 71810 - RNA, 22 nt, Homo sapiens
ccagauguuuucauucagcaag

SEQ ID NO: 71811 - RNA, 22 nt, Homo sapiens
ccaggguuccacgccuggcugu

SEQ ID NO: 71812 - RNA, 23 nt, Homo sapiens
ccaguauuuauguaaggaagugu

SEQ ID NO: 71813 - RNA, 17 nt, Homo sapiens
ccagugaucccuuuugu

SEQ ID NO: 71814 - RNA, 22 nt, Homo sapiens
ccagugcauggaucccaggggg

SEQ ID NO: 71815 - RNA, 22 nt, Homo sapiens
ccagugcugugcaguguaugag

SEQ ID NO: 71816 - RNA, 21 nt, Homo sapiens
ccagugguuggaaacuauggg

SEQ ID NO: 71817 - RNA, 21 nt, Homo sapiens
ccaguguaaugauagcaggca

SEQ ID NO: 71818 - RNA, 20 nt, Homo sapiens
ccaguguuauuuauguucua

SEQ ID NO: 71819 - RNA, 22 nt, Homo sapiens
ccaguguuuuugaauuccagga

SEQ ID NO: 71820 - RNA, 22 nt, Homo sapiens
ccaguuuucaagauaaugguuu

SEQ ID NO: 71821 - RNA, 22 nt, Homo sapiens
ccaguuuucccagcaccauuaa

SEQ ID NO: 71822 - RNA, 22 nt, Homo sapiens
ccauugaacaugaaggaaugug

SEQ ID NO: 71823 - RNA, 22 nt, Homo sapiens
ccauugcacuccagccuaggca

SEQ ID NO: 71824 - RNA, 22 nt, Homo sapiens
ccauugcacuccauccugggca

SEQ ID NO: 71825 - RNA, 22 nt, Homo sapiens
ccauuugguuauguaucgaaac

SEQ ID NO: 71826 - RNA, 22 nt, Homo sapiens
cccagagacagaaugauaaacu

SEQ ID NO: 71827 - RNA, 19 nt, Homo sapiens
cccagugucagagaagggu

SEQ ID NO: 71828 - RNA, 22 nt, Homo sapiens
cccaguguguuguggauauuua

SEQ ID NO: 71829 - RNA, 22 nt, Homo sapiens
cccaguguuuauuuugagccaa

SEQ ID NO: 71830 - RNA, 22 nt, Homo sapiens
cccauuguuaaguugaguaucu

SEQ ID NO: 71831 - RNA, 22 nt, Homo sapiens
ccccauguucucucugcagcuc

SEQ ID NO: 71832 - RNA, 22 nt, Homo sapiens
ccccauuugaacuccuucaacu

SEQ ID NO: 71833 - RNA, 20 nt, Homo sapiens
ccccguguuuagcauaucau

SEQ ID NO: 71834 - RNA, 19 nt, Homo sapiens
ccccuguggauaccgaggg

SEQ ID NO: 71835 - RNA, 22 nt, Homo sapiens
cccgugucuuggucuagggccu

SEQ ID NO: 71836 - RNA, 22 nt, Homo sapiens
cccucauucauucauccuaugu

SEQ ID NO: 71837 - RNA, 22 nt, Homo sapiens
cccucgagaaaccaucugcuga

SEQ ID NO: 71838 - RNA, 22 nt, Homo sapiens
cccugaagacuccaccgucaug

SEQ ID NO: 71839 - RNA, 22 nt, Homo sapiens
cccugagcagccugaguuuccc

SEQ ID NO: 71840 - RNA, 19 nt, Homo sapiens
cccuggcacauggaaaaug

SEQ ID NO: 71841 - RNA, 22 nt, Homo sapiens
cccuguagcagcauucuuaaau

SEQ ID NO: 71842 - RNA, 22 nt, Homo sapiens
cccuguguuguucaaggaucug

SEQ ID NO: 71843 - RNA, 22 nt, Homo sapiens
cccuuagacuacuaauaugagc

SEQ ID NO: 71844 - RNA, 20 nt, Homo sapiens
ccuaguguucuuaggcugca

SEQ ID NO: 71845 - RNA, 19 nt, Homo sapiens
ccucaaguacuaauauguu

SEQ ID NO: 71846 - RNA, 22 nt, Homo sapiens
ccucaguguuuaucauuauuuu

SEQ ID NO: 71847 - RNA, 22 nt, Homo sapiens
ccucauggagaacuucugcuag

SEQ ID NO: 71848 - RNA, 22 nt, Homo sapiens
ccucuguaguccugcaagagga

SEQ ID NO: 71849 - RNA, 22 nt, Homo sapiens
ccucuuuguugagacuucacca

SEQ ID NO: 71850 - RNA, 16 nt, Homo sapiens
ugugaucuuuuuucuu

SEQ ID NO: 71851 - RNA, 22 nt, Homo sapiens
ugugaugaagaguccaagaaca

SEQ ID NO: 71852 - RNA, 22 nt, Homo sapiens
ugugauguggagggcagaucca

SEQ ID NO: 71853 - RNA, 22 nt, Homo sapiens
ugugauuggccuggcguggguc

SEQ ID NO: 71854 - RNA, 22 nt, Homo sapiens
ugugcacaaccugcagguuugu

SEQ ID NO: 71855 - RNA, 22 nt, Homo sapiens
ugugcacauaacauuuuuuuag

SEQ ID NO: 71856 - RNA, 22 nt, Homo sapiens
ugugcacauugugcagguugau

SEQ ID NO: 71857 - RNA, 23 nt, Homo sapiens
ugugcacauuuacauauauacac

SEQ ID NO: 71858 - RNA, 22 nt, Homo sapiens
ugugcacuggaccuugucuucu

SEQ ID NO: 71859 - RNA, 22 nt, Homo sapiens
ugugcaugaaauuuaccuuuaa

SEQ ID NO: 71860 - RNA, 22 nt, Homo sapiens
ugugccaaaucccauaauaaau

SEQ ID NO: 71861 - RNA, 22 nt, Homo sapiens
ugugccaaucauagggcuuggu

SEQ ID NO: 71862 - RNA, 22 nt, Homo sapiens
ugugccacugcacuccugccug

SEQ ID NO: 71863 - RNA, 22 nt, Homo sapiens
ugugccacugcacuccugggug

SEQ ID NO: 71864 - RNA, 22 nt, Homo sapiens
ugugccacugcacucuggccug

SEQ ID NO: 71865 - RNA, 22 nt, Homo sapiens
ugugccacugcacuucagccug

SEQ ID NO: 71866 - RNA, 22 nt, Homo sapiens
ugugcguguaagagaucuaggu

SEQ ID NO: 71867 - RNA, 22 nt, Homo sapiens
ugugcgugugccuguaagaauu

SEQ ID NO: 71868 - RNA, 22 nt, Homo sapiens
ugugcuugaauuuaguagcuua

SEQ ID NO: 71869 - RNA, 22 nt, Homo sapiens
ugugcuugcuucuucuccuagu

SEQ ID NO: 71870 - RNA, 22 nt, Homo sapiens
ugugcuuguaaaggccagagca

SEQ ID NO: 71871 - RNA, 22 nt, Homo sapiens
uguggaaauggugcuacgaaca

SEQ ID NO: 71872 - RNA, 22 nt, Homo sapiens
uguggaguguaugugacagaga

SEQ ID NO: 71873 - RNA, 22 nt, Homo sapiens
uguggcaaagucuugugaauau

SEQ ID NO: 71874 - RNA, 22 nt, Homo sapiens
uguggcagugcuuuaugaaacc

SEQ ID NO: 71875 - RNA, 22 nt, Homo sapiens
uguggcauugaauaaccuugga

SEQ ID NO: 71876 - RNA, 22 nt, Homo sapiens
uguggcauuuucagaaaggaug

SEQ ID NO: 71877 - RNA, 22 nt, Homo sapiens
uguggcuuuuucuuggcugagg

SEQ ID NO: 71878 - RNA, 22 nt, Homo sapiens
ugugggugguaaaauacaauga

SEQ ID NO: 71879 - RNA, 22 nt, Homo sapiens
ugugguagugcuuaccugcagu

SEQ ID NO: 71880 - RNA, 22 nt, Homo sapiens
ugugguauuagguguaguaucu

SEQ ID NO: 71881 - RNA, 19 nt, Homo sapiens
uguggucauccugggacga

SEQ ID NO: 71882 - RNA, 22 nt, Homo sapiens
ugugguccucugaaggcuuuuc

SEQ ID NO: 71883 - RNA, 22 nt, Homo sapiens
ugugguuuuaguaaaacuaugu

SEQ ID NO: 71884 - RNA, 22 nt, Homo sapiens
uguguaaagcuuguuccagaaa

SEQ ID NO: 71885 - RNA, 22 nt, Homo sapiens
uguguaaauacaagugcuugaa

SEQ ID NO: 71886 - RNA, 22 nt, Homo sapiens
uguguaaauagcuacggaucug

SEQ ID NO: 71887 - RNA, 22 nt, Homo sapiens
uguguacaucucuacacacaug

SEQ ID NO: 71888 - RNA, 22 nt, Homo sapiens
ugugucuuguuuauagcuuucu

SEQ ID NO: 71889 - RNA, 22 nt, Homo sapiens
uguguuuuuauguaaaauggaa

SEQ ID NO: 71890 - RNA, 21 nt, Homo sapiens
uguuaacaugcagauuacugg

SEQ ID NO: 71891 - RNA, 22 nt, Homo sapiens
uguuaacauuuuagagugggaa

SEQ ID NO: 71892 - RNA, 22 nt, Homo sapiens
uguuaaggcagagauaauacau

SEQ ID NO: 71893 - RNA, 22 nt, Homo sapiens
uguuacaguguaggccuugggu

SEQ ID NO: 71894 - RNA, 22 nt, Homo sapiens
uguuagguuggugcaaaaguga

SEQ ID NO: 71895 - RNA, 22 nt, Homo sapiens
uguuaguuguucauguuaagag

SEQ ID NO: 71896 - RNA, 22 nt, Homo sapiens
uguuauguauggagugauccca

SEQ ID NO: 71897 - RNA, 22 nt, Homo sapiens
uguuauguuuuagagguuucaa

SEQ ID NO: 71898 - RNA, 22 nt, Homo sapiens
uguucacaguguuucuuugaga

SEQ ID NO: 71899 - RNA, 22 nt, Homo sapiens
uguucaugaguucucauuuuua

SEQ ID NO: 71900 - RNA, 22 nt, Homo sapiens
uguucuggagaguuuagucugg

SEQ ID NO: 71901 - RNA, 22 nt, Homo sapiens
uguucuugaguugggaguacaa

SEQ ID NO: 71902 - RNA, 22 nt, Homo sapiens
uguugcacacacugaaauacac

SEQ ID NO: 71903 - RNA, 22 nt, Homo sapiens
uguugcacuccauccugggcga

SEQ ID NO: 71904 - RNA, 22 nt, Homo sapiens
uguugcacugguaauguacuga

SEQ ID NO: 71905 - RNA, 22 nt, Homo sapiens
uguugccacuguuauuaaccua

SEQ ID NO: 71906 - RNA, 22 nt, Homo sapiens
uguugcuuaagccacccagucu

SEQ ID NO: 71907 - RNA, 18 nt, Homo sapiens
uguugguguucacucacu

SEQ ID NO: 71908 - RNA, 22 nt, Homo sapiens
uguuucuacugucucuguagua

SEQ ID NO: 71909 - RNA, 22 nt, Homo sapiens
uguuuuggaggccagaagucca

SEQ ID NO: 71910 - RNA, 22 nt, Homo sapiens
uguuuuguuagcacucugggaa

SEQ ID NO: 71911 - RNA, 22 nt, Homo sapiens
uuaaaggcaugguuagacaugg

SEQ ID NO: 71912 - RNA, 22 nt, Homo sapiens
uuaaaguauaguuccucugguu

SEQ ID NO: 71913 - RNA, 22 nt, Homo sapiens
uuaaaugcuagaauuuucuuug

SEQ ID NO: 71914 - RNA, 22 nt, Homo sapiens
uuaacacugccauugauacugu

SEQ ID NO: 71915 - RNA, 22 nt, Homo sapiens
uuaacagcacaugcugucccuu

SEQ ID NO: 71916 - RNA, 22 nt, Homo sapiens
uuaacaguugcaugagacugag

SEQ ID NO: 71917 - RNA, 22 nt, Homo sapiens
uuaagaucagugcaaacuggag

SEQ ID NO: 71918 - RNA, 22 nt, Homo sapiens
uuaagaugcauuuugaaguuaa

SEQ ID NO: 71919 - RNA, 22 nt, Homo sapiens
uuaaggcagugucuaugccagu

SEQ ID NO: 71920 - RNA, 22 nt, Homo sapiens
uuaaggcuuuaaguaaacacag

SEQ ID NO: 71921 - RNA, 22 nt, Homo sapiens
uuaagguuuuuguagcaaggau

SEQ ID NO: 71922 - RNA, 22 nt, Homo sapiens
uuaagucacacuagacaacuga

SEQ ID NO: 71923 - RNA, 23 nt, Homo sapiens
uuaagugcuuuucugaaacucuu

SEQ ID NO: 71924 - RNA, 22 nt, Homo sapiens
uuaaucaggccguuuccuaaga

SEQ ID NO: 71925 - RNA, 21 nt, Homo sapiens
uuaaugcuaugcagaaaaucu

SEQ ID NO: 71926 - RNA, 22 nt, Homo sapiens
uuaauucugucugcccucaucc

SEQ ID NO: 71927 - RNA, 22 nt, Homo sapiens
uuaauuguccauuauucuguuc

SEQ ID NO: 71928 - RNA, 22 nt, Homo sapiens
uuacaagaugucuguccaacac

SEQ ID NO: 71929 - RNA, 19 nt, Homo sapiens
uuacacaaccuaguggggc

SEQ ID NO: 71930 - RNA, 22 nt, Homo sapiens
uuacaccuguaauccagcacuu

SEQ ID NO: 71931 - RNA, 22 nt, Homo sapiens
uuacagcagugccccacuccca

SEQ ID NO: 71932 - RNA, 22 nt, Homo sapiens
uuacagcugggugugucuggua

SEQ ID NO: 71933 - RNA, 22 nt, Homo sapiens
uuacaggacuaagcagcuuugc

SEQ ID NO: 71934 - RNA, 22 nt, Homo sapiens
uuacaguagaugaggguauaau

SEQ ID NO: 71935 - RNA, 22 nt, Homo sapiens
uuacauaguguguggguucggg

SEQ ID NO: 71936 - RNA, 19 nt, Homo sapiens
uuacauccauugcauuuca

SEQ ID NO: 71937 - RNA, 22 nt, Homo sapiens
uuacaugagacugucgcuaguu

SEQ ID NO: 71938 - RNA, 22 nt, Homo sapiens
uuacauguuuauggggguacau

SEQ ID NO: 71939 - RNA, 22 nt, Homo sapiens
uuacauugcuucaaauucagug

SEQ ID NO: 71940 - RNA, 22 nt, Homo sapiens
uuaccacagugccugucuaaug

SEQ ID NO: 71941 - RNA, 18 nt, Homo sapiens
uuaccagcauaccuacac

SEQ ID NO: 71942 - RNA, 22 nt, Homo sapiens
uuaccagucuagggcucaguuu

SEQ ID NO: 71943 - RNA, 22 nt, Homo sapiens
uuacccuuuaacccuuuaaagu

SEQ ID NO: 71944 - RNA, 22 nt, Homo sapiens
uuaccuugcacugagucugaaa

SEQ ID NO: 71945 - RNA, 22 nt, Homo sapiens
uuacuagaacauuuagggaacu

SEQ ID NO: 71946 - RNA, 22 nt, Homo sapiens
uuagaaaguagaaaagcugguu

SEQ ID NO: 71947 - RNA, 22 nt, Homo sapiens
uucauuggauguuacacugugu

SEQ ID NO: 71948 - RNA, 22 nt, Homo sapiens
uuccacaauggcugaacuaguu

SEQ ID NO: 71949 - RNA, 22 nt, Homo sapiens
uuccacaaugguugaacuagcu

SEQ ID NO: 71950 - RNA, 22 nt, Homo sapiens
uuccagagucaccuuucugucg

SEQ ID NO: 71951 - RNA, 22 nt, Homo sapiens
uuccagaugggaguucuauucu

SEQ ID NO: 71952 - RNA, 20 nt, Homo sapiens
uuccagcacauuagggaagc

SEQ ID NO: 71953 - RNA, 21 nt, Homo sapiens
uuccagugagccuagaugccu

SEQ ID NO: 71954 - RNA, 22 nt, Homo sapiens
uuccagugggacgagaugugga

SEQ ID NO: 71955 - RNA, 22 nt, Homo sapiens
uuccaguugugagcuauccggg

SEQ ID NO: 71956 - RNA, 22 nt, Homo sapiens
uucccaguggaacauguaguca

SEQ ID NO: 71957 - RNA, 22 nt, Homo sapiens
uucccucagaaacacacagccc

SEQ ID NO: 71958 - RNA, 22 nt, Homo sapiens
uucccugaaauauucacuuuca

SEQ ID NO: 71959 - RNA, 22 nt, Homo sapiens
uucccugugugcagaugggugu

SEQ ID NO: 71960 - RNA, 22 nt, Homo sapiens
uucccuuucugaaaaucucauu

SEQ ID NO: 71961 - RNA, 22 nt, Homo sapiens
uucccuuucugccuugaaucuu

SEQ ID NO: 71962 - RNA, 22 nt, Homo sapiens
uucccuuucuuaaagaguuagg

SEQ ID NO: 71963 - RNA, 22 nt, Homo sapiens
uuccguguaguugagcaguuuu

SEQ ID NO: 71964 - RNA, 22 nt, Homo sapiens
uuccuacugcccauuaaaaugg

SEQ ID NO: 71965 - RNA, 22 nt, Homo sapiens
uuccuagagauuagcaagcugc

SEQ ID NO: 71966 - RNA, 22 nt, Homo sapiens
uuccugagaucagaauucaaau

SEQ ID NO: 71967 - RNA, 22 nt, Homo sapiens
uuccuguagcgauuuuaguaau

SEQ ID NO: 71968 - RNA, 22 nt, Homo sapiens
uuccugugacuguguggcaccc

SEQ ID NO: 71969 - RNA, 22 nt, Homo sapiens
uuccuugagaaaggcacaaguu

SEQ ID NO: 71970 - RNA, 22 nt, Homo sapiens
uuccuuguagcaaaugcgauga

SEQ ID NO: 71971 - RNA, 22 nt, Homo sapiens
uucuaaguaagucuguggggaa

SEQ ID NO: 71972 - RNA, 22 nt, Homo sapiens
uucuagcacuuugggagacuga

SEQ ID NO: 71973 - RNA, 22 nt, Homo sapiens
uucuaugguuuaauaguuuggg

SEQ ID NO: 71974 - RNA, 22 nt, Homo sapiens
uucucaauggaugugggaccag

SEQ ID NO: 71975 - RNA, 22 nt, Homo sapiens
uucucaauggcaacuuguugcu

SEQ ID NO: 71976 - RNA, 22 nt, Homo sapiens
uucucacaguacagggagcucu

SEQ ID NO: 71977 - RNA, 22 nt, Homo sapiens
uucucagugaacuccagcuugu

SEQ ID NO: 71978 - RNA, 22 nt, Homo sapiens
uucucuguggauugggugagag

SEQ ID NO: 71979 - RNA, 22 nt, Homo sapiens
uucugacuggugugagauggua

SEQ ID NO: 71980 - RNA, 22 nt, Homo sapiens
uucugauggaguaguccacaga

SEQ ID NO: 71981 - RNA, 22 nt, Homo sapiens
uucugcacaucgaucacaagau

SEQ ID NO: 71982 - RNA, 23 nt, Homo sapiens
uucugccacugaaaaugccucag

SEQ ID NO: 71983 - RNA, 22 nt, Homo sapiens
uucugcuagucugucagaucuu

SEQ ID NO: 71984 - RNA, 22 nt, Homo sapiens
uucuggcucaggucaacacuuc

SEQ ID NO: 71985 - RNA, 22 nt, Homo sapiens
uucugguuaauacuugcaaaaa

SEQ ID NO: 71986 - RNA, 22 nt, Homo sapiens
uucuucaguuacaacaaggggg

SEQ ID NO: 71987 - RNA, 22 nt, Homo sapiens
uucuuccagccuugaggggccc

SEQ ID NO: 71988 - RNA, 22 nt, Homo sapiens
uucuugcugaauugugcccuuc

SEQ ID NO: 71989 - RNA, 18 nt, Homo sapiens
uucuuguguugauauuuu

SEQ ID NO: 71990 - RNA, 22 nt, Homo sapiens
uucuuugcuuggaagcggggga

SEQ ID NO: 71991 - RNA, 22 nt, Homo sapiens
uucuuuggaaacaguacuaauu

SEQ ID NO: 71992 - RNA, 22 nt, Homo sapiens
uugaaagcuaucagagauucca

SEQ ID NO: 71993 - RNA, 22 nt, Homo sapiens
uugaaagucauggcacaggcaa

SEQ ID NO: 71994 - RNA, 22 nt, Homo sapiens
uugaaagucuaggcuuacagua

SEQ ID NO: 71995 - RNA, 22 nt, Homo sapiens
uugaaauguguaagcuccgaaa

SEQ ID NO: 71996 - RNA, 22 nt, Homo sapiens
uugaaauguuuagaaguuugga

SEQ ID NO: 71997 - RNA, 22 nt, Homo sapiens
uugguauguguuucauacucaa

SEQ ID NO: 71998 - RNA, 22 nt, Homo sapiens
uuggucaaaucugaugggagaa

SEQ ID NO: 71999 - RNA, 22 nt, Homo sapiens
uuggucagcuagauuauucccu

SEQ ID NO: 72000 - RNA, 22 nt, Homo sapiens
uuggucaggagccucccucuuu

SEQ ID NO: 72001 - RNA, 22 nt, Homo sapiens
uugguccacugugaaauuggga

SEQ ID NO: 72002 - RNA, 22 nt, Homo sapiens
uugguccauuacauugaugaca

SEQ ID NO: 72003 - RNA, 22 nt, Homo sapiens
uugguccccuucaaccagcugu

SEQ ID NO: 72004 - RNA, 22 nt, Homo sapiens
uugguccucccaugcucaagag

SEQ ID NO: 72005 - RNA, 22 nt, Homo sapiens
uuggucucaucaagagcagcuu

SEQ ID NO: 72006 - RNA, 21 nt, Homo sapiens
uuggucuucucugugauucuu

SEQ ID NO: 72007 - RNA, 22 nt, Homo sapiens
uugguuaccuucagaaaugagu

SEQ ID NO: 72008 - RNA, 22 nt, Homo sapiens
uugguucucuuagccaucuuaa

SEQ ID NO: 72009 - RNA, 22 nt, Homo sapiens
uugguuuccuuccugcuuaacu

SEQ ID NO: 72010 - RNA, 22 nt, Homo sapiens
uuguaaagaucauaugcuguuc

SEQ ID NO: 72011 - RNA, 22 nt, Homo sapiens
uuguaacaugcuuucacuucag

SEQ ID NO: 72012 - RNA, 22 nt, Homo sapiens
uuguaauguuaccaaauggugu

SEQ ID NO: 72013 - RNA, 22 nt, Homo sapiens
uuguacaggaguguaagcuuca

SEQ ID NO: 72014 - RNA, 22 nt, Homo sapiens
uuguacuggguuuucuggaauu

SEQ ID NO: 72015 - RNA, 22 nt, Homo sapiens
uuguacuuuuaguagagacggg

SEQ ID NO: 72016 - RNA, 22 nt, Homo sapiens
uuguagaucuucaguugcuaca

SEQ ID NO: 72017 - RNA, 22 nt, Homo sapiens
uuguagcaaauauauuuuggaa

SEQ ID NO: 72018 - RNA, 22 nt, Homo sapiens
uuguagcaaauguguaaacaaa

SEQ ID NO: 72019 - RNA, 21 nt, Homo sapiens
uuguagcagcauaaucccaga

SEQ ID NO: 72020 - RNA, 22 nt, Homo sapiens
uuguagcuuuuuaaugugcugc

SEQ ID NO: 72021 - RNA, 22 nt, Homo sapiens
uuguauaguucuauguguuuug

SEQ ID NO: 72022 - RNA, 22 nt, Homo sapiens
uuguauccaucuuucaggcaac

SEQ ID NO: 72023 - RNA, 21 nt, Homo sapiens
uuguaugguugaacuugauac

SEQ ID NO: 72024 - RNA, 22 nt, Homo sapiens
uuguauguuuguucuuucagau

SEQ ID NO: 72025 - RNA, 22 nt, Homo sapiens
uugucaacaugaaacuguguuu

SEQ ID NO: 72026 - RNA, 21 nt, Homo sapiens
uuguccccacccaaaucucau

SEQ ID NO: 72027 - RNA, 23 nt, Homo sapiens
uuguccccuccaaagcucauguu

SEQ ID NO: 72028 - RNA, 22 nt, Homo sapiens
uuguccuccacauuugaucagu

SEQ ID NO: 72029 - RNA, 22 nt, Homo sapiens
uugucuagugaauacauuaaug

SEQ ID NO: 72030 - RNA, 22 nt, Homo sapiens
uugucuugcagcuuaggcauca

SEQ ID NO: 72031 - RNA, 22 nt, Homo sapiens
uugugaagaaaccagaaaaguu

SEQ ID NO: 72032 - RNA, 22 nt, Homo sapiens
uugugaaugaugucgcaguaaa

SEQ ID NO: 72033 - RNA, 22 nt, Homo sapiens
uugugaauggaguagcaggauc

SEQ ID NO: 72034 - RNA, 22 nt, Homo sapiens
uugugaauggugccgcaauaaa

SEQ ID NO: 72035 - RNA, 22 nt, Homo sapiens
uugugaauggugcugcaguaaa

SEQ ID NO: 72036 - RNA, 22 nt, Homo sapiens
uugugacacagcugggccuaua

SEQ ID NO: 72037 - RNA, 22 nt, Homo sapiens
uugugauggugcauacugagcu

SEQ ID NO: 72038 - RNA, 22 nt, Homo sapiens
uugugauugagugauccuuguu

SEQ ID NO: 72039 - RNA, 22 nt, Homo sapiens
uugugcauguauauuaguucac

SEQ ID NO: 72040 - RNA, 22 nt, Homo sapiens
uugugccauucuucugccucag

SEQ ID NO: 72041 - RNA, 18 nt, Homo sapiens
uugugccugagaaggugg

SEQ ID NO: 72042 - RNA, 22 nt, Homo sapiens
uugugcuacugaguuggggugg

SEQ ID NO: 72043 - RNA, 22 nt, Homo sapiens
ucguggccugugaguccucccc

SEQ ID NO: 72044 - RNA, 22 nt, Homo sapiens
ucuaagaauucauuuauaagcc

SEQ ID NO: 72045 - RNA, 22 nt, Homo sapiens
ucuaagacuaagggcuagcuuc

SEQ ID NO: 72046 - RNA, 22 nt, Homo sapiens
ucuaauguaaccugcaaauauu

SEQ ID NO: 72047 - RNA, 21 nt, Homo sapiens
ucuaccuacugcucacaggcu

SEQ ID NO: 72048 - RNA, 22 nt, Homo sapiens
ucuagcacuuacuggcugugug

SEQ ID NO: 72049 - RNA, 22 nt, Homo sapiens
ucuauggaguuugaaugagaaa

SEQ ID NO: 72050 - RNA, 22 nt, Homo sapiens
ucucacagccauuucucccucu

SEQ ID NO: 72051 - RNA, 22 nt, Homo sapiens
ucucagugugguaaaaguuuuu

SEQ ID NO: 72052 - RNA, 22 nt, Homo sapiens
ucucaguguuaucuaucugccu

SEQ ID NO: 72053 - RNA, 19 nt, Homo sapiens
ucucaguguuggucaggug

SEQ ID NO: 72054 - RNA, 22 nt, Homo sapiens
ucucaguuuucaagcugucgau

SEQ ID NO: 72055 - RNA, 20 nt, Homo sapiens
ucucauagagguagagaaua

SEQ ID NO: 72056 - RNA, 21 nt, Homo sapiens
ucucauagaguuucacuuucu

SEQ ID NO: 72057 - RNA, 22 nt, Homo sapiens
ucucaugaagauagagaauaga

SEQ ID NO: 72058 - RNA, 22 nt, Homo sapiens
ucucauggagucaggagcagaa

SEQ ID NO: 72059 - RNA, 22 nt, Homo sapiens
ucucauggcucacccugcauag

SEQ ID NO: 72060 - RNA, 21 nt, Homo sapiens
ucucauuacugaugagccaga

SEQ ID NO: 72061 - RNA, 21 nt, Homo sapiens
ucucauugugguuuuaauugg

SEQ ID NO: 72062 - RNA, 22 nt, Homo sapiens
ucuccauugaaauggacauaau

SEQ ID NO: 72063 - RNA, 22 nt, Homo sapiens
ucucccauccaugaacuucugu

SEQ ID NO: 72064 - RNA, 22 nt, Homo sapiens
ucucuagagagccugguguuca

SEQ ID NO: 72065 - RNA, 22 nt, Homo sapiens
ucucugaaacucuugacauccu

SEQ ID NO: 72066 - RNA, 22 nt, Homo sapiens
ucucugagaaaaguuucuccca

SEQ ID NO: 72067 - RNA, 22 nt, Homo sapiens
ucucugguuaugucauuaagca

SEQ ID NO: 72068 - RNA, 22 nt, Homo sapiens
ucucuuggugacuuaaaauguu

SEQ ID NO: 72069 - RNA, 22 nt, Homo sapiens
ucugacaaugaacaaucuauag

SEQ ID NO: 72070 - RNA, 19 nt, Homo sapiens
ucugacagccccagucaac

SEQ ID NO: 72071 - RNA, 22 nt, Homo sapiens
ucugacucugugaugggcccaa

SEQ ID NO: 72072 - RNA, 22 nt, Homo sapiens
ucugagcaauaaacaacauauu

SEQ ID NO: 72073 - RNA, 22 nt, Homo sapiens
ugguauguugucucuuuguucu

SEQ ID NO: 72074 - RNA, 22 nt, Homo sapiens
ugguauguuuauaaguauagga

SEQ ID NO: 72075 - RNA, 22 nt, Homo sapiens
ugguauuuaauauaugagaguu

SEQ ID NO: 72076 - RNA, 22 nt, Homo sapiens
uggucaccuucuugcucugucu

SEQ ID NO: 72077 - RNA, 19 nt, Homo sapiens
uggucaguucugggagcug

SEQ ID NO: 72078 - RNA, 22 nt, Homo sapiens
uggucaguugaguccuugccaa

SEQ ID NO: 72079 - RNA, 22 nt, Homo sapiens
uggucaguugugccucaauucc

SEQ ID NO: 72080 - RNA, 22 nt, Homo sapiens
uggucauggggcagcugacacu

SEQ ID NO: 72081 - RNA, 22 nt, Homo sapiens
ugguccaguucugugauauugc

SEQ ID NO: 72082 - RNA, 22 nt, Homo sapiens
uggucccaugaacuuuagguca

SEQ ID NO: 72083 - RNA, 19 nt, Homo sapiens
uggucccccgcaaucucau

SEQ ID NO: 72084 - RNA, 22 nt, Homo sapiens
uggucccucugaaaauugggug

SEQ ID NO: 72085 - RNA, 22 nt, Homo sapiens
uggucuucuggccuccagaacc

SEQ ID NO: 72086 - RNA, 22 nt, Homo sapiens
uggugagaaaagaugucuuugu

SEQ ID NO: 72087 - RNA, 22 nt, Homo sapiens
uggugcccuguccuucuguggc

SEQ ID NO: 72088 - RNA, 19 nt, Homo sapiens
uggugccuuguucuuggau

SEQ ID NO: 72089 - RNA, 22 nt, Homo sapiens
uggugcuuaaauaaggcuuuca

SEQ ID NO: 72090 - RNA, 17 nt, Homo sapiens
uggugcuugaaaguugc

SEQ ID NO: 72091 - RNA, 20 nt, Homo sapiens
uggugucuuggaaagagcuc

SEQ ID NO: 72092 - RNA, 22 nt, Homo sapiens
ugguguuugagaagcugauguc

SEQ ID NO: 72093 - RNA, 22 nt, Homo sapiens
ugguuaucauagcuaugcuacu

SEQ ID NO: 72094 - RNA, 22 nt, Homo sapiens
ugguuccauauuaauuuuagga

SEQ ID NO: 72095 - RNA, 21 nt, Homo sapiens
ugguugauccuccuagugccu

SEQ ID NO: 72096 - RNA, 22 nt, Homo sapiens
ugguuguuuuaaaugucgucug

SEQ ID NO: 72097 - RNA, 22 nt, Homo sapiens
uguaaacucaguauguuuuacu

SEQ ID NO: 72098 - RNA, 22 nt, Homo sapiens
uguaaaucugguuaauuggaua

SEQ ID NO: 72099 - RNA, 16 nt, Homo sapiens
uguaaauguuuugcau

SEQ ID NO: 72100 - RNA, 22 nt, Homo sapiens
uguaagugugcaauucagugau

SEQ ID NO: 72101 - RNA, 22 nt, Homo sapiens
uguaaugaucaaaucagaguaa

SEQ ID NO: 72102 - RNA, 22 nt, Homo sapiens
uguacccuuagagagugaucga

SEQ ID NO: 72103 - RNA, 22 nt, Homo sapiens
uguacuucaagauuaugguuua

SEQ ID NO: 72104 - RNA, 22 nt, Homo sapiens
uguagacagcacguaguugagu

SEQ ID NO: 72105 - RNA, 22 nt, Homo sapiens
uguagauauucuuucaguuuuu

SEQ ID NO: 72106 - RNA, 22 nt, Homo sapiens
uguagcacauuugaagagaagc

SEQ ID NO: 72107 - RNA, 21 nt, Homo sapiens
uguagcagcaugauuuauaau

SEQ ID NO: 72108 - RNA, 22 nt, Homo sapiens
uguagucauuccuuuuugcuuu

SEQ ID NO: 72109 - RNA, 22 nt, Homo sapiens
uguagucauuugaaggaugucc

SEQ ID NO: 72110 - RNA, 22 nt, Homo sapiens
uguaguuugaaagcucccucug

SEQ ID NO: 72111 - RNA, 21 nt, Homo sapiens
uguauacauauguuaggugca

SEQ ID NO: 72112 - RNA, 21 nt, Homo sapiens
uguauacauggaagaaugguc

SEQ ID NO: 72113 - RNA, 22 nt, Homo sapiens
uguauaguugagucaaguuuca

SEQ ID NO: 72114 - RNA, 22 nt, Homo sapiens
uguaugagagacauggcugcuu

SEQ ID NO: 72115 - RNA, 22 nt, Homo sapiens
uguauguaaagacaggauaaca

SEQ ID NO: 72116 - RNA, 22 nt, Homo sapiens
uguaugucuucuuuagauaagu

SEQ ID NO: 72117 - RNA, 22 nt, Homo sapiens
uguauguuguaagacuuagacc

SEQ ID NO: 72118 - RNA, 22 nt, Homo sapiens
uguauuuguuguuaaauggaga

SEQ ID NO: 72119 - RNA, 22 nt, Homo sapiens
ugucaaagagacaucugcacuc

SEQ ID NO: 72120 - RNA, 22 nt, Homo sapiens
ugucaaauucuggguuaaaaca

SEQ ID NO: 72121 - RNA, 20 nt, Homo sapiens
ugucaagaaacauuacuuau

SEQ ID NO: 72122 - RNA, 22 nt, Homo sapiens
ugucaagaaaucaaggugugag

SEQ ID NO: 72123 - RNA, 20 nt, Homo sapiens
ugucaaggaauucccaaauc

SEQ ID NO: 72124 - RNA, 22 nt, Homo sapiens
ugucacuuugccuucuggacuu

SEQ ID NO: 72125 - RNA, 22 nt, Homo sapiens
ugucaggaguuuuagaaucuua

SEQ ID NO: 72126 - RNA, 21 nt, Homo sapiens
ugucaguuuccagaguucaac

SEQ ID NO: 72127 - RNA, 22 nt, Homo sapiens
ugucauacaguaacaugguugg

SEQ ID NO: 72128 - RNA, 19 nt, Homo sapiens
ugucaucaucuuuucuugc

SEQ ID NO: 72129 - RNA, 22 nt, Homo sapiens
ugucaucauuugagagaagaaa

SEQ ID NO: 72130 - RNA, 22 nt, Homo sapiens
agcuguaguuugguggauguaa

SEQ ID NO: 72131 - RNA, 19 nt, Homo sapiens
agcuguguugccugugaga

SEQ ID NO: 72132 - RNA, 22 nt, Homo sapiens
agcuguuguucucagaggcuuu

SEQ ID NO: 72133 - RNA, 22 nt, Homo sapiens
agcuucauuccaacuuccuucu

SEQ ID NO: 72134 - RNA, 22 nt, Homo sapiens
agcuucauucugaauagguuga

SEQ ID NO: 72135 - RNA, 22 nt, Homo sapiens
agcuugugcuguaugaagggcc

SEQ ID NO: 72136 - RNA, 22 nt, Homo sapiens
agcuuguuuuccugcaacuaga

SEQ ID NO: 72137 - RNA, 22 nt, Homo sapiens
agcuuuuugggcagcuauugac

SEQ ID NO: 72138 - RNA, 22 nt, Homo sapiens
aggaagacauauagaacuaaaa

SEQ ID NO: 72139 - RNA, 22 nt, Homo sapiens
aggaagacugaaauugcuguuc

SEQ ID NO: 72140 - RNA, 23 nt, Homo sapiens
aggaaguaacuaucuuuucuguc

SEQ ID NO: 72141 - RNA, 22 nt, Homo sapiens
aggaaugcuaaguuuuccuccu

SEQ ID NO: 72142 - RNA, 22 nt, Homo sapiens
aggacacugauagucuuuggca

SEQ ID NO: 72143 - RNA, 22 nt, Homo sapiens
aggagaauugguucuucuugau

SEQ ID NO: 72144 - RNA, 22 nt, Homo sapiens
aggagaucagccucccugcaac

SEQ ID NO: 72145 - RNA, 21 nt, Homo sapiens
aggagauguuuguccuuuuag

SEQ ID NO: 72146 - RNA, 21 nt, Homo sapiens
aggagcauucucuugcuuugu

SEQ ID NO: 72147 - RNA, 22 nt, Homo sapiens
aggagguugguaccaucuguuu

SEQ ID NO: 72148 - RNA, 22 nt, Homo sapiens
aggauaguaaugauagagaggc

SEQ ID NO: 72149 - RNA, 21 nt, Homo sapiens
aggauaguagauuaaauauuu

SEQ ID NO: 72150 - RNA, 22 nt, Homo sapiens
aggaucauugacuauuauaagg

SEQ ID NO: 72151 - RNA, 21 nt, Homo sapiens
aggcaagacuuuuagguuugu

SEQ ID NO: 72152 - RNA, 22 nt, Homo sapiens
aggcaagugggagacagcauuu

SEQ ID NO: 72153 - RNA, 22 nt, Homo sapiens
aggcacggugucucaugccugu

SEQ ID NO: 72154 - RNA, 22 nt, Homo sapiens
aggcagcuguuauauacugagu

SEQ ID NO: 72155 - RNA, 22 nt, Homo sapiens
aggcaggugaaagauaguuuua

SEQ ID NO: 72156 - RNA, 22 nt, Homo sapiens
aggcagucugaguuuugaaagg

SEQ ID NO: 72157 - RNA, 20 nt, Homo sapiens
aggcauguugguuugcgugu

SEQ ID NO: 72158 - RNA, 23 nt, Homo sapiens
aggcauuguacaguaauggaaaa

SEQ ID NO: 72159 - RNA, 22 nt, Homo sapiens
aggcauugugcaucgaugauuu

SEQ ID NO: 72160 - RNA, 22 nt, Homo sapiens
aggcuaagaugacuccaccccc

SEQ ID NO: 72161 - RNA, 22 nt, Homo sapiens
aggcuagaaucuuccaucuugg

SEQ ID NO: 72162 - RNA, 22 nt, Homo sapiens
aggcuuguuuuacuaacuggua

SEQ ID NO: 72163 - RNA, 22 nt, Homo sapiens
aggcuuuuggagguggcuuucu

SEQ ID NO: 72164 - RNA, 22 nt, Homo sapiens
aggcuuuuguuuuggucucagg

SEQ ID NO: 72165 - RNA, 22 nt, Homo sapiens
agggaauguaaguuuuaugaga

SEQ ID NO: 72166 - RNA, 22 nt, Homo sapiens
agggcaguguuaggacugucug

SEQ ID NO: 72167 - RNA, 22 nt, Homo sapiens
agggcauuguacaaaucaucau

SEQ ID NO: 72168 - RNA, 22 nt, Homo sapiens
ugggcaagagagcaugacccug

SEQ ID NO: 72169 - RNA, 22 nt, Homo sapiens
ugggcaagugacuuggcuucuc

SEQ ID NO: 72170 - RNA, 22 nt, Homo sapiens
ugggcagugggacagcuuugug

SEQ ID NO: 72171 - RNA, 22 nt, Homo sapiens
ugaacagagaaacacuggccau

SEQ ID NO: 72172 - RNA, 22 nt, Homo sapiens
ugaagcuaacuugauugugaug

SEQ ID NO: 72173 - RNA, 22 nt, Homo sapiens
ugaaggcaggagggagaaaagu

SEQ ID NO: 72174 - RNA, 22 nt, Homo sapiens
ugaaguaauguuuuauucuauu

SEQ ID NO: 72175 - RNA, 22 nt, Homo sapiens
ugaaguagguucucguaucgcc

SEQ ID NO: 72176 - RNA, 19 nt, Homo sapiens
ugaaguauagggcuucuga

SEQ ID NO: 72177 - RNA, 22 nt, Homo sapiens
ugaagugaagcaguaguguggg

SEQ ID NO: 72178 - RNA, 22 nt, Homo sapiens
ugaagugaaugguaaguaugcc

SEQ ID NO: 72179 - RNA, 22 nt, Homo sapiens
ugaagugggaaaugaguauuaa

SEQ ID NO: 72180 - RNA, 22 nt, Homo sapiens
ugaauacagcacacccaugggu

SEQ ID NO: 72181 - RNA, 22 nt, Homo sapiens
ugaauagaaguuuacuccuuuu

SEQ ID NO: 72182 - RNA, 21 nt, Homo sapiens
ugaauauuuggguugugucca

SEQ ID NO: 72183 - RNA, 22 nt, Homo sapiens
ugaaucaugcugcuauaaagac

SEQ ID NO: 72184 - RNA, 22 nt, Homo sapiens
ugaaugcauggggccaagaagg

SEQ ID NO: 72185 - RNA, 22 nt, Homo sapiens
ugaaugguuuuuagagaacaau

SEQ ID NO: 72186 - RNA, 22 nt, Homo sapiens
ugaauguaacuaaaccugugaa

SEQ ID NO: 72187 - RNA, 22 nt, Homo sapiens
ugaauguacacgcguacuuguu

SEQ ID NO: 72188 - RNA, 23 nt, Homo sapiens
ugaauguaucgaaugugggaaag

SEQ ID NO: 72189 - RNA, 22 nt, Homo sapiens
ugaauguccauugauguuuuga

SEQ ID NO: 72190 - RNA, 22 nt, Homo sapiens
ugaauguucuuaaaacccuugu

SEQ ID NO: 72191 - RNA, 16 nt, Homo sapiens
ugaauguuuguggcug

SEQ ID NO: 72192 - RNA, 22 nt, Homo sapiens
ugaauuguuucauucuuuacau

SEQ ID NO: 72193 - RNA, 22 nt, Homo sapiens
ugacaagaacuuuccauaguaa

SEQ ID NO: 72194 - RNA, 22 nt, Homo sapiens
ugacaagacuacauaucccauu

SEQ ID NO: 72195 - RNA, 22 nt, Homo sapiens
ugacaagauauggucuuaucaa

SEQ ID NO: 72196 - RNA, 22 nt, Homo sapiens
ugacaagcucccucugcaccuu

SEQ ID NO: 72197 - RNA, 22 nt, Homo sapiens
ugacaagugauuaaggcauauu

SEQ ID NO: 72198 - RNA, 22 nt, Homo sapiens
ugacacagugggggauccuuuu

SEQ ID NO: 72199 - RNA, 22 nt, Homo sapiens
ugacacauguagacaucuggug

SEQ ID NO: 72200 - RNA, 17 nt, Homo sapiens
ugacagaaacuuguugu

SEQ ID NO: 72201 - RNA, 22 nt, Homo sapiens
ugacagcaucaggauuggagag

SEQ ID NO: 72202 - RNA, 22 nt, Homo sapiens
ugacagcugaggcccagaguac

SEQ ID NO: 72203 - RNA, 22 nt, Homo sapiens
ugacagcuguugaggcauuuau

SEQ ID NO: 72204 - RNA, 22 nt, Homo sapiens
ugacaggagauuaugugauguu

SEQ ID NO: 72205 - RNA, 22 nt, Homo sapiens
ugagcaaaauuuuggacauaga

SEQ ID NO: 72206 - RNA, 22 nt, Homo sapiens
ugagcaauaaaguuacacaguu

SEQ ID NO: 72207 - RNA, 22 nt, Homo sapiens
ugagcacagagccugggguggc

SEQ ID NO: 72208 - RNA, 22 nt, Homo sapiens
ugagcacuguacuuuaucaggu

SEQ ID NO: 72209 - RNA, 22 nt, Homo sapiens
ugagcauauugugauaccuaaa

SEQ ID NO: 72210 - RNA, 22 nt, Homo sapiens
ugagcauauuuaagguaugcua

SEQ ID NO: 72211 - RNA, 22 nt, Homo sapiens
ugagcaucauucacaccuuggu

SEQ ID NO: 72212 - RNA, 22 nt, Homo sapiens
ugagcgaugggaggaagugaua

SEQ ID NO: 72213 - RNA, 17 nt, Homo sapiens
ugagcuaagauuacccc

SEQ ID NO: 72214 - RNA, 22 nt, Homo sapiens
ugagcuaggucuugcucuguca

SEQ ID NO: 72215 - RNA, 22 nt, Homo sapiens
ugagcuaugaucccaccucugu

SEQ ID NO: 72216 - RNA, 22 nt, Homo sapiens
ugagcucagcuuucuuuuucac

SEQ ID NO: 72217 - RNA, 22 nt, Homo sapiens
ugagcugagaaaugcagcagcu

SEQ ID NO: 72218 - RNA, 22 nt, Homo sapiens
ugagcugagaucaugcuauugu

SEQ ID NO: 72219 - RNA, 22 nt, Homo sapiens
ugaggaauguguguuaaagaua

SEQ ID NO: 72220 - RNA, 22 nt, Homo sapiens
ugaggacugagaggcacugugg

SEQ ID NO: 72221 - RNA, 22 nt, Homo sapiens
ugaggagugagaaauugguuuc

SEQ ID NO: 72222 - RNA, 22 nt, Homo sapiens
ugaggcaaggcugaaugaaggc

SEQ ID NO: 72223 - RNA, 22 nt, Homo sapiens
ugaggcacucuagacuuauuca

SEQ ID NO: 72224 - RNA, 22 nt, Homo sapiens
ugaggguauagccagcccuuag

SEQ ID NO: 72225 - RNA, 22 nt, Homo sapiens
ugagguaaaacaaggauuggau

SEQ ID NO: 72226 - RNA, 22 nt, Homo sapiens
ugagguaacagaagcgagcauu

SEQ ID NO: 72227 - RNA, 22 nt, Homo sapiens
ugagguaggugaagaaugcacg

SEQ ID NO: 72228 - RNA, 22 nt, Homo sapiens
ugagguaugugaugucuuuuag

SEQ ID NO: 72229 - RNA, 22 nt, Homo sapiens
ugagguauuuuguuaugcagcc

SEQ ID NO: 72230 - RNA, 22 nt, Homo sapiens
ugaggucacuuguuuuaugcuu

SEQ ID NO: 72231 - RNA, 22 nt, Homo sapiens
ugaggugagggguuaggugcua

SEQ ID NO: 72232 - RNA, 22 nt, Homo sapiens
ugagguguuaacuuuacuuuua

SEQ ID NO: 72233 - RNA, 22 nt, Homo sapiens
ugagguguuauccagaguucuu

SEQ ID NO: 72234 - RNA, 22 nt, Homo sapiens
ugagguugucagugucauucuu

SEQ ID NO: 72235 - RNA, 22 nt, Homo sapiens
ugaguagaacaucaagucauac

SEQ ID NO: 72236 - RNA, 21 nt, Homo sapiens
ugaguagcuagaacuaggggc

SEQ ID NO: 72237 - RNA, 23 nt, Homo sapiens
ugaguagguccacguaugugagu

SEQ ID NO: 72238 - RNA, 23 nt, Homo sapiens
ugaguaggugguuuuccccucac

SEQ ID NO: 72239 - RNA, 22 nt, Homo sapiens
ugaguagugcugcaauaaacau

SEQ ID NO: 72240 - RNA, 22 nt, Homo sapiens
ugaguauguuuaaugugacaau

SEQ ID NO: 72241 - RNA, 22 nt, Homo sapiens
ugagucaauucuaacaauggca

SEQ ID NO: 72242 - RNA, 22 nt, Homo sapiens
ugagugaaugugaaggcuaggg

SEQ ID NO: 72243 - RNA, 22 nt, Homo sapiens
ugaguggagacuguguguagag

SEQ ID NO: 72244 - RNA, 22 nt, Homo sapiens
ugaguggagaucgcaccauugc

SEQ ID NO: 72245 - RNA, 22 nt, Homo sapiens
ugaguguccaccccuuucacag

SEQ ID NO: 72246 - RNA, 22 nt, Homo sapiens
ugagugugacuuagcagaagga

SEQ ID NO: 72247 - RNA, 22 nt, Homo sapiens
ugaguuaaucucuacgauagaa

SEQ ID NO: 72248 - RNA, 17 nt, Homo sapiens
ugaguuaaucuuugugc

SEQ ID NO: 72249 - RNA, 22 nt, Homo sapiens
ugaguuaauuuuuguaucaugu

SEQ ID NO: 72250 - RNA, 22 nt, Homo sapiens
ugaguuaggagaguguggcucu

SEQ ID NO: 72251 - RNA, 22 nt, Homo sapiens
ugaguuagguaauaauaaauau

SEQ ID NO: 72252 - RNA, 22 nt, Homo sapiens
ugaguucaauuguauuuuauua

SEQ ID NO: 72253 - RNA, 18 nt, Homo sapiens
ugaguucauuagacuucc

SEQ ID NO: 72254 - RNA, 22 nt, Homo sapiens
ugaguucuuccuaucucugccu

SEQ ID NO: 72255 - RNA, 22 nt, Homo sapiens
ugaguucuuuguagauucugug

SEQ ID NO: 72256 - RNA, 22 nt, Homo sapiens
ugaguugagauaagguuacauu

SEQ ID NO: 72257 - RNA, 22 nt, Homo sapiens
ugaguuguaggggucaccuggc

SEQ ID NO: 72258 - RNA, 22 nt, Homo sapiens
ugaguuguugcauucuuggugu

SEQ ID NO: 72259 - RNA, 22 nt, Homo sapiens
ugauaacauuucuucugguaca

SEQ ID NO: 72260 - RNA, 22 nt, Homo sapiens
ugauaagaaauuguucauguag

SEQ ID NO: 72261 - RNA, 22 nt, Homo sapiens
ugauaagugaaagugcucuauc

SEQ ID NO: 72262 - RNA, 17 nt, Homo sapiens
ugauaagugugagguga

SEQ ID NO: 72263 - RNA, 22 nt, Homo sapiens
ugauaauuuugucagguuuugg

SEQ ID NO: 72264 - RNA, 22 nt, Homo sapiens
ugauacuggcuucauagaauga

SEQ ID NO: 72265 - RNA, 22 nt, Homo sapiens
ugcugcaaacaugagaggaagu

SEQ ID NO: 72266 - RNA, 22 nt, Homo sapiens
ugcugcacuuauggcucugagg

SEQ ID NO: 72267 - RNA, 22 nt, Homo sapiens
ugcugcauuggggauuaaguuu

SEQ ID NO: 72268 - RNA, 22 nt, Homo sapiens
ugcugcuguuaucauuuuacca

SEQ ID NO: 72269 - RNA, 22 nt, Homo sapiens
ugcuggcguuacucuccaucag

SEQ ID NO: 72270 - RNA, 22 nt, Homo sapiens
ugcugguaguuuaugacuaauu

SEQ ID NO: 72271 - RNA, 22 nt, Homo sapiens
ugcugguauuuggaccagccug

SEQ ID NO: 72272 - RNA, 22 nt, Homo sapiens
ugcugguguuuaggaauaagaa

SEQ ID NO: 72273 - RNA, 22 nt, Homo sapiens
ugcugguuuaaaaugcaaauuc

SEQ ID NO: 72274 - RNA, 22 nt, Homo sapiens
ugcuguguugcuggcuuaaaga

SEQ ID NO: 72275 - RNA, 19 nt, Homo sapiens
ugcuuaguuuuauguguaa

SEQ ID NO: 72276 - RNA, 21 nt, Homo sapiens
ugcuuuggucauacuucuucc

SEQ ID NO: 72277 - RNA, 22 nt, Homo sapiens
ugcuuuguuauauggggauucu

SEQ ID NO: 72278 - RNA, 22 nt, Homo sapiens
ugcuuuguugaaaaucauuugg

SEQ ID NO: 72279 - RNA, 22 nt, Homo sapiens
uggaaaauuaggggagguuaua

SEQ ID NO: 72280 - RNA, 22 nt, Homo sapiens
uggaaaguacugagguccaccu

SEQ ID NO: 72281 - RNA, 22 nt, Homo sapiens
uggaaaguaguucuaaucuaag

SEQ ID NO: 72282 - RNA, 22 nt, Homo sapiens
uggaaauuaagucuuuccugag

SEQ ID NO: 72283 - RNA, 22 nt, Homo sapiens
uggaacacauaaauagcauagu

SEQ ID NO: 72284 - RNA, 23 nt, Homo sapiens
uggaacugaauuucuuagcauuu

SEQ ID NO: 72285 - RNA, 19 nt, Homo sapiens
uggaacugauucaguucug

SEQ ID NO: 72286 - RNA, 22 nt, Homo sapiens
uggaagacauugggugaagggu

SEQ ID NO: 72287 - RNA, 22 nt, Homo sapiens
uggaagacauuuuggaccuugg

SEQ ID NO: 72288 - RNA, 22 nt, Homo sapiens
uggaagauuacuuuuuguugaa

SEQ ID NO: 72289 - RNA, 22 nt, Homo sapiens
uggaagcaugcaaucugugggg

SEQ ID NO: 72290 - RNA, 20 nt, Homo sapiens
uggaagccuggugcuaucuu

SEQ ID NO: 72291 - RNA, 22 nt, Homo sapiens
uggaagguaaguuuugagcauu

SEQ ID NO: 72292 - RNA, 22 nt, Homo sapiens
uggaaggucauuguucauuuga

SEQ ID NO: 72293 - RNA, 20 nt, Homo sapiens
uggaaguaagaauauaggug

SEQ ID NO: 72294 - RNA, 22 nt, Homo sapiens
uggaaucuagagaaaugcaaac

SEQ ID NO: 72295 - RNA, 21 nt, Homo sapiens
uggaaugaauggccaacaugg

SEQ ID NO: 72296 - RNA, 20 nt, Homo sapiens
uggaaugcagccuccuucug

SEQ ID NO: 72297 - RNA, 22 nt, Homo sapiens
uggaaugggauuggaaauuuug

SEQ ID NO: 72298 - RNA, 22 nt, Homo sapiens
uggaaugucagcuacaagaggg

SEQ ID NO: 72299 - RNA, 22 nt, Homo sapiens
uggaaugucuuuuccccaaagc

SEQ ID NO: 72300 - RNA, 22 nt, Homo sapiens
uggaaugugaauaacuuccuuc

SEQ ID NO: 72301 - RNA, 21 nt, Homo sapiens
uggaccccuuccagucaucau

SEQ ID NO: 72302 - RNA, 22 nt, Homo sapiens
aucugcauuagggugaagaccu

SEQ ID NO: 72303 - RNA, 22 nt, Homo sapiens
aucugcauucccauguuuauug

SEQ ID NO: 72304 - RNA, 22 nt, Homo sapiens
aucugguauuacugcaacugua

SEQ ID NO: 72305 - RNA, 22 nt, Homo sapiens
aucuuugauugaagggacccug

SEQ ID NO: 72306 - RNA, 22 nt, Homo sapiens
aucuuuggcgggaauaucacag

SEQ ID NO: 72307 - RNA, 22 nt, Homo sapiens
aucuuuggugcaugauacuuug

SEQ ID NO: 72308 - RNA, 22 nt, Homo sapiens
augaaaacaugauuugccuguu

SEQ ID NO: 72309 - RNA, 22 nt, Homo sapiens
augaaacuggagcgccuggagg

SEQ ID NO: 72310 - RNA, 22 nt, Homo sapiens
augaaagugauaaaugucucua

SEQ ID NO: 72311 - RNA, 22 nt, Homo sapiens
augaaaguguguggaaacuuga

SEQ ID NO: 72312 - RNA, 22 nt, Homo sapiens
augaaaucacugugaugcccua

SEQ ID NO: 72313 - RNA, 22 nt, Homo sapiens
augaaaucuuuccugugaggau

SEQ ID NO: 72314 - RNA, 22 nt, Homo sapiens
augaaauguaugagucuggguu

SEQ ID NO: 72315 - RNA, 22 nt, Homo sapiens
augaacagagccuugagaaccu

SEQ ID NO: 72316 - RNA, 22 nt, Homo sapiens
augaacgugugcauauaagcag

SEQ ID NO: 72317 - RNA, 22 nt, Homo sapiens
augaacuaugugggauguuuua

SEQ ID NO: 72318 - RNA, 18 nt, Homo sapiens
augaacucaucaguucuu

SEQ ID NO: 72319 - RNA, 19 nt, Homo sapiens
augaacucaucauuucuca

SEQ ID NO: 72320 - RNA, 18 nt, Homo sapiens
augaacucaucauuuuua

SEQ ID NO: 72321 - RNA, 23 nt, Homo sapiens
augaacucaucauuuuuuauggc

SEQ ID NO: 72322 - RNA, 22 nt, Homo sapiens
augaaguauuaggacacauuua

SEQ ID NO: 72323 - RNA, 17 nt, Homo sapiens
augaagucaucauuuuu

SEQ ID NO: 72324 - RNA, 22 nt, Homo sapiens
augaauacagcuaugcgugcau

SEQ ID NO: 72325 - RNA, 21 nt, Homo sapiens
augaauguaaagaauguggga

SEQ ID NO: 72326 - RNA, 23 nt, Homo sapiens
augaauguaaagaaugugggaag

SEQ ID NO: 72327 - RNA, 22 nt, Homo sapiens
augaauuuucugauguugggua

SEQ ID NO: 72328 - RNA, 22 nt, Homo sapiens
augacacugcagagauguccca

SEQ ID NO: 72329 - RNA, 22 nt, Homo sapiens
augacagagauaugugaauuuu

SEQ ID NO: 72330 - RNA, 22 nt, Homo sapiens
augacaguguggauuauuguaa

SEQ ID NO: 72331 - RNA, 22 nt, Homo sapiens
augacauagcauggugccugcu

SEQ ID NO: 72332 - RNA, 22 nt, Homo sapiens
augaccagagagugcgcagggu

SEQ ID NO: 72333 - RNA, 22 nt, Homo sapiens
augaccagagguaugauguuug

SEQ ID NO: 72334 - RNA, 21 nt, Homo sapiens
augacccuggguguccuuucc

SEQ ID NO: 72335 - RNA, 22 nt, Homo sapiens
augaccuuguccucagugucau

SEQ ID NO: 72336 - RNA, 22 nt, Homo sapiens
augacguugugggcucucaagc

SEQ ID NO: 72337 - RNA, 22 nt, Homo sapiens
augacuaaaggguuuauguuga

SEQ ID NO: 72338 - RNA, 20 nt, Homo sapiens
augacuagaggacaugguaa

SEQ ID NO: 72339 - RNA, 22 nt, Homo sapiens
augacuauugcacuuuccuggu

SEQ ID NO: 72340 - RNA, 22 nt, Homo sapiens
augacucagaucuguuccuggu

SEQ ID NO: 72341 - RNA, 18 nt, Homo sapiens
augacucuggguguuccu

SEQ ID NO: 72342 - RNA, 22 nt, Homo sapiens
augagaacauaucaagugauug

SEQ ID NO: 72343 - RNA, 22 nt, Homo sapiens
augagacaguucccuuuaucuu

SEQ ID NO: 72344 - RNA, 22 nt, Homo sapiens
augagaccagcagaaaaccugu

SEQ ID NO: 72345 - RNA, 22 nt, Homo sapiens
augagacuagaagagaauaaua

SEQ ID NO: 72346 - RNA, 22 nt, Homo sapiens
augagagcugacuuuaaggcaa

SEQ ID NO: 72347 - RNA, 22 nt, Homo sapiens
augagauaaaccaucucuuaag

SEQ ID NO: 72348 - RNA, 22 nt, Homo sapiens
augagaugcaagauuagauggg

SEQ ID NO: 72349 - RNA, 22 nt, Homo sapiens
augagcaaagagaugagacccu

SEQ ID NO: 72350 - RNA, 22 nt, Homo sapiens
augagcagaugcuccugccucu

SEQ ID NO: 72351 - RNA, 22 nt, Homo sapiens
augagcaucaccagaaucaaua

SEQ ID NO: 72352 - RNA, 22 nt, Homo sapiens
augagcucauaaagagugauuu

SEQ ID NO: 72353 - RNA, 22 nt, Homo sapiens
augagcucauugggugacuggg

SEQ ID NO: 72354 - RNA, 22 nt, Homo sapiens
augaggagguaugauuuucuga

SEQ ID NO: 72355 - RNA, 22 nt, Homo sapiens
augaggcacugcgcccuacuga

SEQ ID NO: 72356 - RNA, 22 nt, Homo sapiens
augaggcaggaaaggcguaucu

SEQ ID NO: 72357 - RNA, 22 nt, Homo sapiens
augaggcuauaauuuuuaugua

SEQ ID NO: 72358 - RNA, 22 nt, Homo sapiens
augagguaguagaaagucaggu

SEQ ID NO: 72359 - RNA, 22 nt, Homo sapiens
augaggugaggucaguaaggua

SEQ ID NO: 72360 - RNA, 22 nt, Homo sapiens
augaggugauuucuguucgggu

SEQ ID NO: 72361 - RNA, 18 nt, Homo sapiens
augagucauuguggaaau

SEQ ID NO: 72362 - RNA, 22 nt, Homo sapiens
augugcaaaguuaagaucccag

SEQ ID NO: 72363 - RNA, 22 nt, Homo sapiens
augugcaaauuuccaaacucuu

SEQ ID NO: 72364 - RNA, 22 nt, Homo sapiens
augugcaacugcuggaacaguc

SEQ ID NO: 72365 - RNA, 22 nt, Homo sapiens
augugcacaugcuuacauguga

SEQ ID NO: 72366 - RNA, 20 nt, Homo sapiens
augugcaguguggcaaccaa

SEQ ID NO: 72367 - RNA, 22 nt, Homo sapiens
augugcaugcuguucugccaga

SEQ ID NO: 72368 - RNA, 22 nt, Homo sapiens
augugcuuuuggugagagauuu

SEQ ID NO: 72369 - RNA, 22 nt, Homo sapiens
auguggcuuuucaacuguguga

SEQ ID NO: 72370 - RNA, 18 nt, Homo sapiens
auguggcuuuugaaggcu

SEQ ID NO: 72371 - RNA, 22 nt, Homo sapiens
auguguaaagcuuuucuuuguu

SEQ ID NO: 72372 - RNA, 22 nt, Homo sapiens
augugugaaucccagaaccugu

SEQ ID NO: 72373 - RNA, 22 nt, Homo sapiens
augugugcuugugacacagccu

SEQ ID NO: 72374 - RNA, 20 nt, Homo sapiens
auguucuggaggacagaagc

SEQ ID NO: 72375 - RNA, 22 nt, Homo sapiens
auuaacaucuagaguuuuggug

SEQ ID NO: 72376 - RNA, 22 nt, Homo sapiens
auuaaguuaggauuuugagaua

SEQ ID NO: 72377 - RNA, 22 nt, Homo sapiens
auuacacuuucuauucaaugag

SEQ ID NO: 72378 - RNA, 22 nt, Homo sapiens
auuacuuugcaccaaccuaaua

SEQ ID NO: 72379 - RNA, 20 nt, Homo sapiens
auuagagcuacauggcuaca

SEQ ID NO: 72380 - RNA, 22 nt, Homo sapiens
auuagguagugagaugcugcug

SEQ ID NO: 72381 - RNA, 22 nt, Homo sapiens
auuagguauuuguccuaaauau

SEQ ID NO: 72382 - RNA, 22 nt, Homo sapiens
auuagguuagugcaaaaguaau

SEQ ID NO: 72383 - RNA, 22 nt, Homo sapiens
auuauuaguuguugaaugaagu

SEQ ID NO: 72384 - RNA, 22 nt, Homo sapiens
auuauugacucauagaaaggau

SEQ ID NO: 72385 - RNA, 22 nt, Homo sapiens
auucaagugaugugauucuucu

SEQ ID NO: 72386 - RNA, 22 nt, Homo sapiens
auucacagggggagaaggguau

SEQ ID NO: 72387 - RNA, 22 nt, Homo sapiens
auucaccauggcuaccaagggu

SEQ ID NO: 72388 - RNA, 22 nt, Homo sapiens
auucacuuuuauagacaggucu

SEQ ID NO: 72389 - RNA, 22 nt, Homo sapiens
auucauagugcuaagguguauc

SEQ ID NO: 72390 - RNA, 22 nt, Homo sapiens
auucaucagggauauugguuga

SEQ ID NO: 72391 - RNA, 22 nt, Homo sapiens
auuccacuuauaugagguaucu

SEQ ID NO: 72392 - RNA, 20 nt, Homo sapiens
auuccacuuauaugaggucc

SEQ ID NO: 72393 - RNA, 22 nt, Homo sapiens
auuccacuuccacuaguuucuc

SEQ ID NO: 72394 - RNA, 22 nt, Homo sapiens
auuccagguggcgccauucaca

SEQ ID NO: 72395 - RNA, 22 nt, Homo sapiens
auucccuuggucaacggaugca

SEQ ID NO: 72396 - RNA, 22 nt, Homo sapiens
auuccuuaggcccuuugguuag

SEQ ID NO: 72397 - RNA, 22 nt, Homo sapiens
auucuauaguccuaggauuggg

SEQ ID NO: 72398 - RNA, 22 nt, Homo sapiens
auucuugcuugaacuuggugca

SEQ ID NO: 72399 - RNA, 22 nt, Homo sapiens
auugaacacagaguagcuuucc

SEQ ID NO: 72400 - RNA, 22 nt, Homo sapiens
auugaacacuucugugugccag

SEQ ID NO: 72401 - RNA, 22 nt, Homo sapiens
auugaacaugccauauguacca

SEQ ID NO: 72402 - RNA, 22 nt, Homo sapiens
auugaacuguuggagagguuuu

SEQ ID NO: 72403 - RNA, 20 nt, Homo sapiens
auugaagacuccggggcaga

SEQ ID NO: 72404 - RNA, 22 nt, Homo sapiens
auugaaucuaaaaugagucucu

SEQ ID NO: 72405 - RNA, 22 nt, Homo sapiens
auugacaguuggccaguaagug

SEQ ID NO: 72406 - RNA, 22 nt, Homo sapiens
auugagcaaggucuccuaguau

SEQ ID NO: 72407 - RNA, 21 nt, Homo sapiens
auugagcacaugaaacauggc

SEQ ID NO: 72408 - RNA, 22 nt, Homo sapiens
auugagcacugacucugugcca

SEQ ID NO: 72409 - RNA, 18 nt, Homo sapiens
auugagcaugacagaccu

SEQ ID NO: 72410 - RNA, 22 nt, Homo sapiens
auugaguaaaaaauagugaugu

SEQ ID NO: 72411 - RNA, 22 nt, Homo sapiens
auugaguaaaugaaaauugccu

SEQ ID NO: 72412 - RNA, 22 nt, Homo sapiens
auugcacaccagucugggcaaa

SEQ ID NO: 72413 - RNA, 22 nt, Homo sapiens
auugcacuccagcccgggugac

SEQ ID NO: 72414 - RNA, 22 nt, Homo sapiens
auugcacuccagcccugcugac

SEQ ID NO: 72415 - RNA, 22 nt, Homo sapiens
auugcacuccagccuagguaac

SEQ ID NO: 72416 - RNA, 22 nt, Homo sapiens
auugcacuccagccucggugac

SEQ ID NO: 72417 - RNA, 22 nt, Homo sapiens
auugcacuccagccugcggaac

SEQ ID NO: 72418 - RNA, 22 nt, Homo sapiens
auugcacuccagccuggaugac

SEQ ID NO: 72419 - RNA, 22 nt, Homo sapiens
auugcacuccagccugggcaac

SEQ ID NO: 72420 - RNA, 22 nt, Homo sapiens
auugcacuccagccugggcagc

SEQ ID NO: 72421 - RNA, 21 nt, Homo sapiens
auugcacuccagccugggcga

SEQ ID NO: 72422 - RNA, 22 nt, Homo sapiens
auugcacuccagccugggugac

SEQ ID NO: 72423 - RNA, 22 nt, Homo sapiens
auugcacuccagccuugacaca

SEQ ID NO: 72424 - RNA, 22 nt, Homo sapiens
auugcacuccagccuugggcaa

SEQ ID NO: 72425 - RNA, 22 nt, Homo sapiens
auugcacuccagccuuggggau

SEQ ID NO: 72426 - RNA, 22 nt, Homo sapiens
auugcacuccagcuuaggcgac

SEQ ID NO: 72427 - RNA, 22 nt, Homo sapiens
auugcacuccggccugggugac

SEQ ID NO: 72428 - RNA, 22 nt, Homo sapiens
auugcacucuagccugggugac

SEQ ID NO: 72429 - RNA, 22 nt, Homo sapiens
auugcacucuagccuuggcgac

SEQ ID NO: 72430 - RNA, 22 nt, Homo sapiens
auugcacucugaucugcacucc

SEQ ID NO: 72431 - RNA, 22 nt, Homo sapiens
auugcacuggggguuagaauuu

SEQ ID NO: 72432 - RNA, 22 nt, Homo sapiens
auugcagaaaugacagagcgcc

SEQ ID NO: 72433 - RNA, 22 nt, Homo sapiens
auugcagauucgcuuuguguug

SEQ ID NO: 72434 - RNA, 20 nt, Homo sapiens
auugcagcaugauuuauaau

SEQ ID NO: 72435 - RNA, 22 nt, Homo sapiens
auugcauaaacacauuucuuau

SEQ ID NO: 72436 - RNA, 21 nt, Homo sapiens
auugcccaaaguggaggggaa

SEQ ID NO: 72437 - RNA, 22 nt, Homo sapiens
auuguuccccggucauuuuugu

SEQ ID NO: 72438 - RNA, 22 nt, Homo sapiens
auuucacugagacaugugccca

SEQ ID NO: 72439 - RNA, 21 nt, Homo sapiens
auuugcacugagcuccugugc

SEQ ID NO: 72440 - RNA, 22 nt, Homo sapiens
auuuggcauagaguaucauucu

SEQ ID NO: 72441 - RNA, 22 nt, Homo sapiens
auuugguagaguucgauaccug

SEQ ID NO: 72442 - RNA, 22 nt, Homo sapiens
auuugguguuguuuggagccua

SEQ ID NO: 72443 - RNA, 22 nt, Homo sapiens
auuugguuauucaguuguucag

SEQ ID NO: 72444 - RNA, 22 nt, Homo sapiens
auuugucaauacacuucuucca

SEQ ID NO: 72445 - RNA, 22 nt, Homo sapiens
auuugucacuauguggcuaaua

SEQ ID NO: 72446 - RNA, 22 nt, Homo sapiens
auuuugcauugcuguaaaggaa

SEQ ID NO: 72447 - RNA, 22 nt, Homo sapiens
auuuuugguugguaggcuauua

SEQ ID NO: 72448 - RNA, 22 nt, Homo sapiens
auuuuugguuucaccugcacgc

SEQ ID NO: 72449 - RNA, 22 nt, Homo sapiens
caaaagugauugcgguuuuugc

SEQ ID NO: 72450 - RNA, 22 nt, Homo sapiens
caaaagugguucuuauccuuuu

SEQ ID NO: 72451 - RNA, 22 nt, Homo sapiens
caaagcuauagcaccagaggga

SEQ ID NO: 72452 - RNA, 22 nt, Homo sapiens
caaaggcuuccacugcauccuu

SEQ ID NO: 72453 - RNA, 22 nt, Homo sapiens
caaaguaauuacgguuuuggcc

SEQ ID NO: 72454 - RNA, 22 nt, Homo sapiens
caaaguaauugcuguuuugcca

SEQ ID NO: 72455 - RNA, 22 nt, Homo sapiens
caaaguaauugugguuuugcca

SEQ ID NO: 72456 - RNA, 22 nt, Homo sapiens
caaagucuucaguugauucuga

SEQ ID NO: 72457 - RNA, 22 nt, Homo sapiens
caaagugcuggccgggcgcagu

SEQ ID NO: 72458 - RNA, 22 nt, Homo sapiens
caacacuguuuauuggauagcc

SEQ ID NO: 72459 - RNA, 22 nt, Homo sapiens
caacauccaccuccuggguuca

SEQ ID NO: 72460 - RNA, 22 nt, Homo sapiens
caagacuguccaacauauuggg

SEQ ID NO: 72461 - RNA, 22 nt, Homo sapiens
caagagagcugaugguuuuaaa

SEQ ID NO: 72462 - RNA, 22 nt, Homo sapiens
caagguacuuuuacaauuuccc

SEQ ID NO: 72463 - RNA, 22 nt, Homo sapiens
caagugcucuaggauccugagu

SEQ ID NO: 72464 - RNA, 22 nt, Homo sapiens
caagugcuugaugaaugaucaa

SEQ ID NO: 72465 - RNA, 22 nt, Homo sapiens
caagugcuuucuuggggauuua

SEQ ID NO: 72466 - RNA, 22 nt, Homo sapiens
caaguguuuccuuaaauacuug

SEQ ID NO: 72467 - RNA, 22 nt, Homo sapiens
caauacuguguugaauaagagu

SEQ ID NO: 72468 - RNA, 19 nt, Homo sapiens
caauacuucuuggcauaca

SEQ ID NO: 72469 - RNA, 21 nt, Homo sapiens
caauggcacaaucucugcuca

SEQ ID NO: 72470 - RNA, 22 nt, Homo sapiens
cacaaugucuaagauguuucua

SEQ ID NO: 72471 - RNA, 22 nt, Homo sapiens
cacaccuacuagggccgugggc

SEQ ID NO: 72472 - RNA, 22 nt, Homo sapiens
cacagcuagucaaugguagaca

SEQ ID NO: 72473 - RNA, 22 nt, Homo sapiens
cacaggaagaggcacggucccu

SEQ ID NO: 72474 - RNA, 23 nt, Homo sapiens
cacagggugaacaccccuaaucc

SEQ ID NO: 72475 - RNA, 22 nt, Homo sapiens
cacagucuugcaauauugagau

SEQ ID NO: 72476 - RNA, 22 nt, Homo sapiens
cacagugaacugguggguuuuu

SEQ ID NO: 72477 - RNA, 22 nt, Homo sapiens
cacaguguuacugguaugaagu

SEQ ID NO: 72478 - RNA, 22 nt, Homo sapiens
cacccagucaucuuggguuuuu

SEQ ID NO: 72479 - RNA, 22 nt, Homo sapiens
cacccgugacgcugucugaaau

SEQ ID NO: 72480 - RNA, 19 nt, Homo sapiens
caccgccugcccccugcug

SEQ ID NO: 72481 - RNA, 22 nt, Homo sapiens
caccggauucauggggaagaag

SEQ ID NO: 72482 - RNA, 22 nt, Homo sapiens
cacucaguuugugguacuuugu

SEQ ID NO: 72483 - RNA, 22 nt, Homo sapiens
cacugcaauuacuuuugcacca

SEQ ID NO: 72484 - RNA, 22 nt, Homo sapiens
cacugcacuccagucccgucuc

SEQ ID NO: 72485 - RNA, 22 nt, Homo sapiens
cacugcacucuucuucugggca

SEQ ID NO: 72486 - RNA, 22 nt, Homo sapiens
cacugcauccuccaccuccugg

SEQ ID NO: 72487 - RNA, 22 nt, Homo sapiens
cacugcgacguccgccucccgg

SEQ ID NO: 72488 - RNA, 21 nt, Homo sapiens
cacugguguugcuauaucaaa

SEQ ID NO: 72489 - RNA, 22 nt, Homo sapiens
cacugugcaaccuccaccuccc

SEQ ID NO: 72490 - RNA, 22 nt, Homo sapiens
cagacagugucccgagucccug

SEQ ID NO: 72491 - RNA, 22 nt, Homo sapiens
cagagaacauucagagcuguag

SEQ ID NO: 72492 - RNA, 22 nt, Homo sapiens
cagaguuaguagccuuugacaa

SEQ ID NO: 72493 - RNA, 22 nt, Homo sapiens
cagauacuggaguccugaaguu

SEQ ID NO: 72494 - RNA, 22 nt, Homo sapiens
cagauacuggccuggagcugug

SEQ ID NO: 72495 - RNA, 22 nt, Homo sapiens
cagaucaucuugagcuuaggaa

SEQ ID NO: 72496 - RNA, 22 nt, Homo sapiens
cagauggucuuaaggcagccuu

SEQ ID NO: 72497 - RNA, 20 nt, Homo sapiens
cagcacgcacaugagacugu

SEQ ID NO: 72498 - RNA, 22 nt, Homo sapiens
cagcagguuuuuaucaguuaag

SEQ ID NO: 72499 - RNA, 20 nt, Homo sapiens
cagcuaccugggaaauuugg

SEQ ID NO: 72500 - RNA, 22 nt, Homo sapiens
cagcucuuguuaaaacuaacua

SEQ ID NO: 72501 - RNA, 22 nt, Homo sapiens
cagcugguggcaagaagacaga

SEQ ID NO: 72502 - RNA, 22 nt, Homo sapiens
cagcuggugggagcuggguucc

SEQ ID NO: 72503 - RNA, 22 nt, Homo sapiens
cagcuguguuauaaacuaccau

SEQ ID NO: 72504 - RNA, 22 nt, Homo sapiens
cagcuguuguugggguauagga

SEQ ID NO: 72505 - RNA, 22 nt, Homo sapiens
caggcaacauggcgaaacucug

SEQ ID NO: 72506 - RNA, 22 nt, Homo sapiens
caggcacgcuugggagacacac

SEQ ID NO: 72507 - RNA, 22 nt, Homo sapiens
caggcagucuggggguguaucc

SEQ ID NO: 72508 - RNA, 22 nt, Homo sapiens
caggcauagucuugaguuuuau

SEQ ID NO: 72509 - RNA, 22 nt, Homo sapiens
cagggcauuggcugguaccugg

SEQ ID NO: 72510 - RNA, 22 nt, Homo sapiens
cagguagucaacgggucuugga

SEQ ID NO: 72511 - RNA, 21 nt, Homo sapiens
cagguagugucugaagccaga

SEQ ID NO: 72512 - RNA, 22 nt, Homo sapiens
cagguaguguguagcacagcag

SEQ ID NO: 72513 - RNA, 22 nt, Homo sapiens
caggugcuuacuuaauagccau

SEQ ID NO: 72514 - RNA, 22 nt, Homo sapiens
caguaguagccccuuagaugga

SEQ ID NO: 72515 - RNA, 22 nt, Homo sapiens
cagugcauagaugugccacauu

SEQ ID NO: 72516 - RNA, 22 nt, Homo sapiens
cagugcauaggaucuaaaauuu

SEQ ID NO: 72517 - RNA, 22 nt, Homo sapiens
cagugcauccauguucagcagu

SEQ ID NO: 72518 - RNA, 22 nt, Homo sapiens
cagugcaugacuguauauuauc

SEQ ID NO: 72519 - RNA, 23 nt, Homo sapiens
cagugcauuguggcauucagcau

SEQ ID NO: 72520 - RNA, 22 nt, Homo sapiens
cagugguuuucaacccugguug

SEQ ID NO: 72521 - RNA, 22 nt, Homo sapiens
caguguaugcuucuauuuuugg

SEQ ID NO: 72522 - RNA, 22 nt, Homo sapiens
caguuacuugacacaaccaauu

SEQ ID NO: 72523 - RNA, 22 nt, Homo sapiens
caguuguuuuaugacauaagau

SEQ ID NO: 72524 - RNA, 21 nt, Homo sapiens
cauaaugcuacuuauuuuaug

SEQ ID NO: 72525 - RNA, 18 nt, Homo sapiens
cauagcacuucagcacau

SEQ ID NO: 72526 - RNA, 22 nt, Homo sapiens
cauaguacuugcauaguacuau

SEQ ID NO: 72527 - RNA, 22 nt, Homo sapiens
cauauaguaggugcucuguguu

SEQ ID NO: 72528 - RNA, 22 nt, Homo sapiens
cauauaguaguacuguuagguu

SEQ ID NO: 72529 - RNA, 22 nt, Homo sapiens
gugaagaugugcaucagaucca

SEQ ID NO: 72530 - RNA, 22 nt, Homo sapiens
gugaagugugaccucagcaucu

SEQ ID NO: 72531 - RNA, 22 nt, Homo sapiens
gugaauagggaauaaugggauc

SEQ ID NO: 72532 - RNA, 22 nt, Homo sapiens
gugaaugcauuaagaaggggga

SEQ ID NO: 72533 - RNA, 22 nt, Homo sapiens
gugaauguuuucuuacauggua

SEQ ID NO: 72534 - RNA, 22 nt, Homo sapiens
gugacagucaaagacaugacuu

SEQ ID NO: 72535 - RNA, 22 nt, Homo sapiens
gugacaucagcuccagguauaa

SEQ ID NO: 72536 - RNA, 22 nt, Homo sapiens
gugacauuauuucagcuacaug

SEQ ID NO: 72537 - RNA, 22 nt, Homo sapiens
gugaccagaugggcaggggugu

SEQ ID NO: 72538 - RNA, 22 nt, Homo sapiens
gugaccucuguugcugucacua

SEQ ID NO: 72539 - RNA, 18 nt, Homo sapiens
gugagaaugacuguucug

SEQ ID NO: 72540 - RNA, 22 nt, Homo sapiens
gugagacugguccugaacccag

SEQ ID NO: 72541 - RNA, 22 nt, Homo sapiens
gugagacugguucugaacccag

SEQ ID NO: 72542 - RNA, 22 nt, Homo sapiens
gugagauggagucuugcuuugu

SEQ ID NO: 72543 - RNA, 22 nt, Homo sapiens
gugagaugugacuucugccucu

SEQ ID NO: 72544 - RNA, 22 nt, Homo sapiens
gugagcaaacuuaccuaagguu

SEQ ID NO: 72545 - RNA, 22 nt, Homo sapiens
gugagcaauugauacuugaagu

SEQ ID NO: 72546 - RNA, 22 nt, Homo sapiens
gugagcacugaaagaaggcaag

SEQ ID NO: 72547 - RNA, 22 nt, Homo sapiens
gugagcagagaucgcgugauug

SEQ ID NO: 72548 - RNA, 22 nt, Homo sapiens
gugagcauauuaguauugcacu

SEQ ID NO: 72549 - RNA, 22 nt, Homo sapiens
gugagcauuacucaugggauca

SEQ ID NO: 72550 - RNA, 22 nt, Homo sapiens
gugagcuccucuucugcugcag

SEQ ID NO: 72551 - RNA, 21 nt, Homo sapiens
gugaggaguuacuggcuuuga

SEQ ID NO: 72552 - RNA, 22 nt, Homo sapiens
gugagguaagaguugcuuugcu

SEQ ID NO: 72553 - RNA, 17 nt, Homo sapiens
gugagguauccucaaaa

SEQ ID NO: 72554 - RNA, 22 nt, Homo sapiens
gugaggucguagucauaggcaa

SEQ ID NO: 72555 - RNA, 17 nt, Homo sapiens
gugagguggguaguauc

SEQ ID NO: 72556 - RNA, 22 nt, Homo sapiens
gugaguggacgugaccaauaaa

SEQ ID NO: 72557 - RNA, 22 nt, Homo sapiens
gugaucaugauccugaagcauu

SEQ ID NO: 72558 - RNA, 21 nt, Homo sapiens
gugaucaugucacugcacucc

SEQ ID NO: 72559 - RNA, 22 nt, Homo sapiens
gugaucauuguauugggguuau

SEQ ID NO: 72560 - RNA, 22 nt, Homo sapiens
gugaucucagcucacuggaacc

SEQ ID NO: 72561 - RNA, 22 nt, Homo sapiens
gugaucuucauggaaggugaaa

SEQ ID NO: 72562 - RNA, 22 nt, Homo sapiens
gugaugacauucagagaugaag

SEQ ID NO: 72563 - RNA, 22 nt, Homo sapiens
gugaugguaguuuguauuucug

SEQ ID NO: 72564 - RNA, 22 nt, Homo sapiens
gugauguguuucaacagcuccu

SEQ ID NO: 72565 - RNA, 22 nt, Homo sapiens
gugauuauuaugcacugcaugc

SEQ ID NO: 72566 - RNA, 22 nt, Homo sapiens
gugauuuaguagaugcuaguua

SEQ ID NO: 72567 - RNA, 22 nt, Homo sapiens
gugcaaacuccaggucucuuca

SEQ ID NO: 72568 - RNA, 22 nt, Homo sapiens
gugcaacaucccuccauaauuu

SEQ ID NO: 72569 - RNA, 22 nt, Homo sapiens
gugcacaaaucuuaaauguaca

SEQ ID NO: 72570 - RNA, 22 nt, Homo sapiens
gugcacaacaugcaguuuuguu

SEQ ID NO: 72571 - RNA, 22 nt, Homo sapiens
gugcacauauggugcauaagug

SEQ ID NO: 72572 - RNA, 21 nt, Homo sapiens
gugcagaugccacagucacuc

SEQ ID NO: 72573 - RNA, 22 nt, Homo sapiens
gugcaguuuacaguuacccagu

SEQ ID NO: 72574 - RNA, 22 nt, Homo sapiens
gugcauacucuggagacauugu

SEQ ID NO: 72575 - RNA, 22 nt, Homo sapiens
gugcccacugucuguccuguag

SEQ ID NO: 72576 - RNA, 22 nt, Homo sapiens
gugcgggaggcgcgccuaggug

SEQ ID NO: 72577 - RNA, 22 nt, Homo sapiens
gugcuaggugcuaggaagauag

SEQ ID NO: 72578 - RNA, 22 nt, Homo sapiens
gugcuauguuauccagcaagau

SEQ ID NO: 72579 - RNA, 21 nt, Homo sapiens
gugcuuguagccucacuucug

SEQ ID NO: 72580 - RNA, 22 nt, Homo sapiens
guggaaaaguaguugcgguuuu

SEQ ID NO: 72581 - RNA, 22 nt, Homo sapiens
guggaaaauuauugcuguuuuu

SEQ ID NO: 72582 - RNA, 22 nt, Homo sapiens
guggaaagaacacaaaauuagg

SEQ ID NO: 72583 - RNA, 22 nt, Homo sapiens
guggaaggucaugaauguucuu

SEQ ID NO: 72584 - RNA, 22 nt, Homo sapiens
guggaagucuuugguauuggua

SEQ ID NO: 72585 - RNA, 22 nt, Homo sapiens
guggaaguguaaaagcucuugg

SEQ ID NO: 72586 - RNA, 22 nt, Homo sapiens
guggaagugucuggggccaggg

SEQ ID NO: 72587 - RNA, 22 nt, Homo sapiens
guggaaugauaucucauugugg

SEQ ID NO: 72588 - RNA, 17 nt, Homo sapiens
guggaaugucaugucaa

SEQ ID NO: 72589 - RNA, 22 nt, Homo sapiens
guggacggagguugcagugagc

SEQ ID NO: 72590 - RNA, 22 nt, Homo sapiens
guggaggacuggauaaagaaaa

SEQ ID NO: 72591 - RNA, 22 nt, Homo sapiens
guggaggagaaagaagcauuuc

SEQ ID NO: 72592 - RNA, 22 nt, Homo sapiens
guggagucaucacucagagugg

SEQ ID NO: 72593 - RNA, 22 nt, Homo sapiens
guggcaagaugacuacucacug

SEQ ID NO: 72594 - RNA, 22 nt, Homo sapiens
guggcaaguguuccaagaggcg

SEQ ID NO: 72595 - RNA, 22 nt, Homo sapiens
guggcacgaugaucugggcuca

SEQ ID NO: 72596 - RNA, 22 nt, Homo sapiens
guggcagaaaagagaagcaaug

SEQ ID NO: 72597 - RNA, 22 nt, Homo sapiens
guggcaugaaagcaucugugau

SEQ ID NO: 72598 - RNA, 23 nt, Homo sapiens
guggccuuuggccaguccgaguc

SEQ ID NO: 72599 - RNA, 22 nt, Homo sapiens
guggcuuguaggggucaaggga

SEQ ID NO: 72600 - RNA, 22 nt, Homo sapiens
guggcuuuauuuagaagcaggg

SEQ ID NO: 72601 - RNA, 22 nt, Homo sapiens
gugggaagcuggaacucccucc

SEQ ID NO: 72602 - RNA, 22 nt, Homo sapiens
gugggauggaaaugggcuucag

SEQ ID NO: 72603 - RNA, 22 nt, Homo sapiens
gugggcaaagcuaguguguaga

SEQ ID NO: 72604 - RNA, 22 nt, Homo sapiens
gugggcaagucacuucaguucu

SEQ ID NO: 72605 - RNA, 22 nt, Homo sapiens
gugggguaggguaggacucaac

SEQ ID NO: 72606 - RNA, 22 nt, Homo sapiens
gugggguaggugacuugaugag

SEQ ID NO: 72607 - RNA, 22 nt, Homo sapiens
guggggucaucucauuugugga

SEQ ID NO: 72608 - RNA, 22 nt, Homo sapiens
guggguaaaucucuguuugagg

SEQ ID NO: 72609 - RNA, 22 nt, Homo sapiens
gugguaaaauggcauagagcua

SEQ ID NO: 72610 - RNA, 22 nt, Homo sapiens
gugguaguagaauuucggaaau

SEQ ID NO: 72611 - RNA, 22 nt, Homo sapiens
aaggcaagaaaauggauucucc

SEQ ID NO: 72612 - RNA, 22 nt, Homo sapiens
aaggcacugaacuuaaauucug

SEQ ID NO: 72613 - RNA, 22 nt, Homo sapiens
aaggcagucacuaaauagugag

SEQ ID NO: 72614 - RNA, 22 nt, Homo sapiens
aaggcaugcugaguccuaaaag

SEQ ID NO: 72615 - RNA, 22 nt, Homo sapiens
aaggcuauuugagaaugugugu

SEQ ID NO: 72616 - RNA, 22 nt, Homo sapiens
aagggaauguugugguugguuu

SEQ ID NO: 72617 - RNA, 22 nt, Homo sapiens
aagggagcugcauaaucuugug

SEQ ID NO: 72618 - RNA, 23 nt, Homo sapiens
aagguaagcuagaaagauguaga

SEQ ID NO: 72619 - RNA, 22 nt, Homo sapiens
aagguagguuccaaaauaccua

SEQ ID NO: 72620 - RNA, 22 nt, Homo sapiens
aagguauuucuaugggaauaga

SEQ ID NO: 72621 - RNA, 21 nt, Homo sapiens
aaggugguggugauugagaug

SEQ ID NO: 72622 - RNA, 22 nt, Homo sapiens
aagguggugucagagagcuuau

SEQ ID NO: 72623 - RNA, 22 nt, Homo sapiens
aaguaaauauccgguaguccca

SEQ ID NO: 72624 - RNA, 22 nt, Homo sapiens
aaguaauggaguuauuuuauga

SEQ ID NO: 72625 - RNA, 22 nt, Homo sapiens
aaguacuguuuaaauugcagaa

SEQ ID NO: 72626 - RNA, 22 nt, Homo sapiens
aaguagugcuugugcucaucuc

SEQ ID NO: 72627 - RNA, 18 nt, Homo sapiens
aaguauagagagcccuua

SEQ ID NO: 72628 - RNA, 22 nt, Homo sapiens
aaguauagcuaugauaaacauu

SEQ ID NO: 72629 - RNA, 22 nt, Homo sapiens
aaguaucaggaauaguuauugg

SEQ ID NO: 72630 - RNA, 22 nt, Homo sapiens
aauuaggcuagaauguuauuaa

SEQ ID NO: 72631 - RNA, 22 nt, Homo sapiens
aauucuguauuguuuagggacu

SEQ ID NO: 72632 - RNA, 22 nt, Homo sapiens
aauugaaucaugugggcagacu

SEQ ID NO: 72633 - RNA, 22 nt, Homo sapiens
aauugcacuggaaguaacugag

SEQ ID NO: 72634 - RNA, 22 nt, Homo sapiens
aauugcauugaauuuguagcuu

SEQ ID NO: 72635 - RNA, 22 nt, Homo sapiens
aauuggcagugcucuugccaca

SEQ ID NO: 72636 - RNA, 22 nt, Homo sapiens
aauuggugaccaagggaaggac

SEQ ID NO: 72637 - RNA, 22 nt, Homo sapiens
aauuugucaccucucucccuuu

SEQ ID NO: 72638 - RNA, 16 nt, Homo sapiens
acaaagcuggcuaucu

SEQ ID NO: 72639 - RNA, 20 nt, Homo sapiens
acaaaugcauucugugacau

SEQ ID NO: 72640 - RNA, 22 nt, Homo sapiens
acaagugcuuuuccuggagaca

SEQ ID NO: 72641 - RNA, 22 nt, Homo sapiens
acaauggaauggaguggaaagu

SEQ ID NO: 72642 - RNA, 22 nt, Homo sapiens
acacaaugguaaguguuugugu

SEQ ID NO: 72643 - RNA, 22 nt, Homo sapiens
acacauuggcaauucuggagca

SEQ ID NO: 72644 - RNA, 22 nt, Homo sapiens
acaccaugucuguuucugguuu

SEQ ID NO: 72645 - RNA, 22 nt, Homo sapiens
acaccauugcauuccagccugg

SEQ ID NO: 72646 - RNA, 22 nt, Homo sapiens
acacgugcguauauguacguau

SEQ ID NO: 72647 - RNA, 22 nt, Homo sapiens
acacguguugaaauuuaauugc

SEQ ID NO: 72648 - RNA, 22 nt, Homo sapiens
acacuacuggguauauguguuu

SEQ ID NO: 72649 - RNA, 22 nt, Homo sapiens
acacucucucauuacuuguuug

SEQ ID NO: 72650 - RNA, 22 nt, Homo sapiens
acacuggguaacauaucuguua

SEQ ID NO: 72651 - RNA, 22 nt, Homo sapiens
acacuguaacucuuugagggca

SEQ ID NO: 72652 - RNA, 22 nt, Homo sapiens
acacugucaugucucacaggca

SEQ ID NO: 72653 - RNA, 20 nt, Homo sapiens
acacugugcuaaggauuuuc

SEQ ID NO: 72654 - RNA, 22 nt, Homo sapiens
acagaacugggcuugcuuuugg

SEQ ID NO: 72655 - RNA, 19 nt, Homo sapiens
acagcugguuuugguuucu

SEQ ID NO: 72656 - RNA, 22 nt, Homo sapiens
acagguacaagggauuaggaug

SEQ ID NO: 72657 - RNA, 22 nt, Homo sapiens
acagguacacagaauauccaga

SEQ ID NO: 72658 - RNA, 22 nt, Homo sapiens
acaguaaugggccccuuuuccu

SEQ ID NO: 72659 - RNA, 22 nt, Homo sapiens
acaguacaugauaaauaaggua

SEQ ID NO: 72660 - RNA, 19 nt, Homo sapiens
acaguaccuggcaugaggu

SEQ ID NO: 72661 - RNA, 22 nt, Homo sapiens
acaguacucugcucuuuugauu

SEQ ID NO: 72662 - RNA, 20 nt, Homo sapiens
acaguagaagggauuucaaa

SEQ ID NO: 72663 - RNA, 21 nt, Homo sapiens
acaguaguaauaguguagcca

SEQ ID NO: 72664 - RNA, 22 nt, Homo sapiens
acaguagugggcuacagaauca

SEQ ID NO: 72665 - RNA, 22 nt, Homo sapiens
acagugcuucugauaugaugcc

SEQ ID NO: 72666 - RNA, 22 nt, Homo sapiens
acagugcuuucaauguucagua

SEQ ID NO: 72667 - RNA, 22 nt, Homo sapiens
acagugcuuuuguuccucuccu

SEQ ID NO: 72668 - RNA, 18 nt, Homo sapiens
acagugucauggcucaau

SEQ ID NO: 72669 - RNA, 22 nt, Homo sapiens
acaguguguguguucaccuaga

SEQ ID NO: 72670 - RNA, 22 nt, Homo sapiens
acauaguagacacugaaaauau

SEQ ID NO: 72671 - RNA, 22 nt, Homo sapiens
acauaugaguacaugugccaug

SEQ ID NO: 72672 - RNA, 22 nt, Homo sapiens
acaucauugggggcuacaggug

SEQ ID NO: 72673 - RNA, 22 nt, Homo sapiens
acaucccaugccuggguacucc

SEQ ID NO: 72674 - RNA, 18 nt, Homo sapiens
acaucccaugcuggggug

SEQ ID NO: 72675 - RNA, 22 nt, Homo sapiens
acaucccuugcucggggccccu

SEQ ID NO: 72676 - RNA, 22 nt, Homo sapiens
acaugcauauguuggaagaaag

SEQ ID NO: 72677 - RNA, 22 nt, Homo sapiens
acauggcacugcgggcuucuug

SEQ ID NO: 72678 - RNA, 22 nt, Homo sapiens
acauggcuuaugaauuuggaga

SEQ ID NO: 72679 - RNA, 21 nt, Homo sapiens
acauguacacauguaugcaca

SEQ ID NO: 72680 - RNA, 22 nt, Homo sapiens
accacaggguaaaguuagauau

SEQ ID NO: 72681 - RNA, 22 nt, Homo sapiens
accaccacucccgcauucuaaa

SEQ ID NO: 72682 - RNA, 19 nt, Homo sapiens
accagauugcauucuugga

SEQ ID NO: 72683 - RNA, 22 nt, Homo sapiens
accauugcacuccaaccugggc

SEQ ID NO: 72684 - RNA, 22 nt, Homo sapiens
accauugcacuccagccugggc

SEQ ID NO: 72685 - RNA, 22 nt, Homo sapiens
accauugcacuccagccuuggc

SEQ ID NO: 72686 - RNA, 22 nt, Homo sapiens
acccacuagaugccaguggcac

SEQ ID NO: 72687 - RNA, 22 nt, Homo sapiens
acccagaauucagucuuaggcc

SEQ ID NO: 72688 - RNA, 22 nt, Homo sapiens
acccaguaacauaugggaggga

SEQ ID NO: 72689 - RNA, 17 nt, Homo sapiens
accccuaccucagaagc

SEQ ID NO: 72690 - RNA, 22 nt, Homo sapiens
accccugugacggguauuugag

SEQ ID NO: 72691 - RNA, 22 nt, Homo sapiens
acccguuacuuagcagaccagg

SEQ ID NO: 72692 - RNA, 22 nt, Homo sapiens
acccucagaccaguuucccugg

SEQ ID NO: 72693 - RNA, 21 nt, Homo sapiens
acccucuaguuuucaacaggc

SEQ ID NO: 72694 - RNA, 22 nt, Homo sapiens
acccugacacgauucuucacuu

SEQ ID NO: 72695 - RNA, 22 nt, Homo sapiens
acccuguaggacuauucuaauc

SEQ ID NO: 72696 - RNA, 22 nt, Homo sapiens
acccugucagcuggccugggca

SEQ ID NO: 72697 - RNA, 22 nt, Homo sapiens
acccuuaagcacuaguucagcu

SEQ ID NO: 72698 - RNA, 22 nt, Homo sapiens
acccuuagguuaaaguugaguc

SEQ ID NO: 72699 - RNA, 22 nt, Homo sapiens
accgaguuagccaggauggucu

SEQ ID NO: 72700 - RNA, 22 nt, Homo sapiens
accucagcccggggaaguugag

SEQ ID NO: 72701 - RNA, 22 nt, Homo sapiens
accugagacuaggcauuuuaua

SEQ ID NO: 72702 - RNA, 21 nt, Homo sapiens
accugauguuucaguuggagu

SEQ ID NO: 72703 - RNA, 22 nt, Homo sapiens
accuggcacuuagcaaaucuga

SEQ ID NO: 72704 - RNA, 22 nt, Homo sapiens
accuggguguauguucaguuug

SEQ ID NO: 72705 - RNA, 22 nt, Homo sapiens
accuguauaacaagugggaaau

SEQ ID NO: 72706 - RNA, 22 nt, Homo sapiens
accuuuacaacuuguuagagua

SEQ ID NO: 72707 - RNA, 22 nt, Homo sapiens
aaucacuaugccaugaaguaca

SEQ ID NO: 72708 - RNA, 17 nt, Homo sapiens
aaucagauuucugagga

SEQ ID NO: 72709 - RNA, 22 nt, Homo sapiens
aaucauauugucugccaagagg

SEQ ID NO: 72710 - RNA, 20 nt, Homo sapiens
aaucuacuugcccauuuagc

SEQ ID NO: 72711 - RNA, 22 nt, Homo sapiens
aaucugauguuaucagcuuaag

SEQ ID NO: 72712 - RNA, 22 nt, Homo sapiens
aaucugguguguggccgggcac

SEQ ID NO: 72713 - RNA, 17 nt, Homo sapiens
aaugagacauuucugcu

SEQ ID NO: 72714 - RNA, 22 nt, Homo sapiens
aaugauauguuauguuuagguu

SEQ ID NO: 72715 - RNA, 22 nt, Homo sapiens
aaugcauaauuuguaugaggua

SEQ ID NO: 72716 - RNA, 22 nt, Homo sapiens
aaugcaucuagaaaggugaauu

SEQ ID NO: 72717 - RNA, 22 nt, Homo sapiens
aaugccaucagagaaaacucuu

SEQ ID NO: 72718 - RNA, 22 nt, Homo sapiens
aaugccuagugugugacaggug

SEQ ID NO: 72719 - RNA, 22 nt, Homo sapiens
aauggcacaagacaugaagaag

SEQ ID NO: 72720 - RNA, 22 nt, Homo sapiens
aauggcaucuagaguggugaau

SEQ ID NO: 72721 - RNA, 22 nt, Homo sapiens
aauggcauugguccuuuuggau

SEQ ID NO: 72722 - RNA, 22 nt, Homo sapiens
aauggccuuuuucauuauacug

SEQ ID NO: 72723 - RNA, 22 nt, Homo sapiens
aaugguuuuaucagcguccaaa

SEQ ID NO: 72724 - RNA, 22 nt, Homo sapiens
aaugucaugaguccaaccagaa

SEQ ID NO: 72725 - RNA, 22 nt, Homo sapiens
aaugugcuuucuuucacacagu

SEQ ID NO: 72726 - RNA, 22 nt, Homo sapiens
aauuacauggcaauugggaaau

SEQ ID NO: 72727 - RNA, 22 nt, Homo sapiens
aauuacuucuacaccaaccuaa

SEQ ID NO: 72728 - RNA, 20 nt, Homo sapiens
ccagcaucauuagauucugg

SEQ ID NO: 72729 - RNA, 22 nt, Homo sapiens
ccagucuuggugucuguagcac

SEQ ID NO: 72730 - RNA, 18 nt, Homo sapiens
ccagugcaaggaaagccc

SEQ ID NO: 72731 - RNA, 22 nt, Homo sapiens
ccagugguucccuguggccuga

SEQ ID NO: 72732 - RNA, 22 nt, Homo sapiens
ccagugucugacagacacggcg

SEQ ID NO: 72733 - RNA, 19 nt, Homo sapiens
ccaguguugccagagcuga

SEQ ID NO: 72734 - RNA, 22 nt, Homo sapiens
ccaguuuucucacuguugcagu

SEQ ID NO: 72735 - RNA, 22 nt, Homo sapiens
ccaguuuuucauuuauacuagu

SEQ ID NO: 72736 - RNA, 22 nt, Homo sapiens
ccaucacacugugauuauuauc

SEQ ID NO: 72737 - RNA, 22 nt, Homo sapiens
ccaucccuuucugagcaguucc

SEQ ID NO: 72738 - RNA, 22 nt, Homo sapiens
ccauggcaauggucagucuauu

SEQ ID NO: 72739 - RNA, 23 nt, Homo sapiens
ccauugcacuccagccucaguga

SEQ ID NO: 72740 - RNA, 22 nt, Homo sapiens
cccagaguucuuaaauacugag

SEQ ID NO: 72741 - RNA, 22 nt, Homo sapiens
cccagugaagagaaccuuacga

SEQ ID NO: 72742 - RNA, 23 nt, Homo sapiens
cccaguuaauccuuaaucuccac

SEQ ID NO: 72743 - RNA, 22 nt, Homo sapiens
ccccagugguugcaacagcaga

SEQ ID NO: 72744 - RNA, 20 nt, Homo sapiens
ccccaguuuuucuauuagcu

SEQ ID NO: 72745 - RNA, 22 nt, Homo sapiens
cccugaagauacagaguuuggg

SEQ ID NO: 72746 - RNA, 22 nt, Homo sapiens
cccugacauucggagauguagu

SEQ ID NO: 72747 - RNA, 22 nt, Homo sapiens
cccugagagcagggucuuucuc

SEQ ID NO: 72748 - RNA, 22 nt, Homo sapiens
cccugagaugcuguuaaucugu

SEQ ID NO: 72749 - RNA, 22 nt, Homo sapiens
cccuggacauucaucauuaugu

SEQ ID NO: 72750 - RNA, 21 nt, Homo sapiens
cccugguguuuggaguuugag

SEQ ID NO: 72751 - RNA, 22 nt, Homo sapiens
cccugugaauauuaccuuauuu

SEQ ID NO: 72752 - RNA, 22 nt, Homo sapiens
cccuugcacuucagagcugcau

SEQ ID NO: 72753 - RNA, 22 nt, Homo sapiens
ccgagguaggaggaucacuuga

SEQ ID NO: 72754 - RNA, 22 nt, Homo sapiens
ccuaaguaauggcaguuuuugc

SEQ ID NO: 72755 - RNA, 21 nt, Homo sapiens
ccuccauuuguauucuugccc

SEQ ID NO: 72756 - RNA, 21 nt, Homo sapiens
ccucuuugagggaagaaaggg

SEQ ID NO: 72757 - RNA, 21 nt, Homo sapiens
ccugaugaccucugagaguua

SEQ ID NO: 72758 - RNA, 19 nt, Homo sapiens
ccugcuguucuuuugcacc

SEQ ID NO: 72759 - RNA, 22 nt, Homo sapiens
ccuggaagaaaggugcuaaaua

SEQ ID NO: 72760 - RNA, 22 nt, Homo sapiens
ccuggaucauugucauucccaa

SEQ ID NO: 72761 - RNA, 22 nt, Homo sapiens
ccuggcaagagacugaagauag

SEQ ID NO: 72762 - RNA, 22 nt, Homo sapiens
ccuggcacugggccccguggcu

SEQ ID NO: 72763 - RNA, 22 nt, Homo sapiens
ccuucacaggcacugguucaga

SEQ ID NO: 72764 - RNA, 22 nt, Homo sapiens
ccuucauucauuaauuuagccc

SEQ ID NO: 72765 - RNA, 22 nt, Homo sapiens
ccuugucacugaguggaaugaa

SEQ ID NO: 72766 - RNA, 22 nt, Homo sapiens
ccuuuguuuaguugaauuguau

SEQ ID NO: 72767 - RNA, 22 nt, Homo sapiens
ccuuuuuguaguggaaguagga

SEQ ID NO: 72768 - RNA, 22 nt, Homo sapiens
cgaguagcacaaugugugugau

SEQ ID NO: 72769 - RNA, 22 nt, Homo sapiens
cgccgggggaugggcaccagcg

SEQ ID NO: 72770 - RNA, 22 nt, Homo sapiens
cggaaugaaaauguccuucagu

SEQ ID NO: 72771 - RNA, 22 nt, Homo sapiens
cgugaggaguauuuuuaggugc

SEQ ID NO: 72772 - RNA, 22 nt, Homo sapiens
cguugcacuccagccugggcaa

SEQ ID NO: 72773 - RNA, 22 nt, Homo sapiens
cuaaaacuuucugagugcagca

SEQ ID NO: 72774 - RNA, 16 nt, Homo sapiens
cuaaaaugucuacuug

SEQ ID NO: 72775 - RNA, 22 nt, Homo sapiens
cuaaaguagccaggacugcagg

SEQ ID NO: 72776 - RNA, 22 nt, Homo sapiens
cuaaaguauugagugguaaaga

SEQ ID NO: 72777 - RNA, 22 nt, Homo sapiens
cuaaagugcugagauuauaggu

SEQ ID NO: 72778 - RNA, 22 nt, Homo sapiens
cuaaagugcuuaaaaucucauu

SEQ ID NO: 72779 - RNA, 22 nt, Homo sapiens
cuaaaguucuucugagagaaca

SEQ ID NO: 72780 - RNA, 22 nt, Homo sapiens
cuaaaugucucuacuaaguuua

SEQ ID NO: 72781 - RNA, 22 nt, Homo sapiens
cuaacuaugucucaggaugucc

SEQ ID NO: 72782 - RNA, 22 nt, Homo sapiens
cuaagauugucuuaguguguug

SEQ ID NO: 72783 - RNA, 17 nt, Homo sapiens
cuaaggcaagagucugc

SEQ ID NO: 72784 - RNA, 22 nt, Homo sapiens
cuaagguaggagaaucacucaa

SEQ ID NO: 72785 - RNA, 22 nt, Homo sapiens
cuaauacaguuguccaagcugg

SEQ ID NO: 72786 - RNA, 20 nt, Homo sapiens
cuaaucaucccagaagaaau

SEQ ID NO: 72787 - RNA, 21 nt, Homo sapiens
cuaaucucacccuuuucuggg

SEQ ID NO: 72788 - RNA, 22 nt, Homo sapiens
cuaaucugugcauagaagaggc

SEQ ID NO: 72789 - RNA, 22 nt, Homo sapiens
cuacacaugcaggcucccugcc

SEQ ID NO: 72790 - RNA, 22 nt, Homo sapiens
cuacagaguaucuaaagaggua

SEQ ID NO: 72791 - RNA, 22 nt, Homo sapiens
cuacaguaugaaaccuuuacuc

SEQ ID NO: 72792 - RNA, 22 nt, Homo sapiens
cuagaacuagaacugcuggggu

SEQ ID NO: 72793 - RNA, 22 nt, Homo sapiens
cuagacacugacguuccuccga

SEQ ID NO: 72794 - RNA, 22 nt, Homo sapiens
cuagauuauccaacuuauuagc

SEQ ID NO: 72795 - RNA, 22 nt, Homo sapiens
cuagcaacauuucagugaguuu

SEQ ID NO: 72796 - RNA, 22 nt, Homo sapiens
cuagcacauaguuauucacuca

SEQ ID NO: 72797 - RNA, 22 nt, Homo sapiens
cuagcagacaugggcugaacca

SEQ ID NO: 72798 - RNA, 22 nt, Homo sapiens
cuagcagcaugagaauggacca

SEQ ID NO: 72799 - RNA, 22 nt, Homo sapiens
cuagcaggcaagauaagauuca

SEQ ID NO: 72800 - RNA, 22 nt, Homo sapiens
cuagcugcacuuccugcuacug

SEQ ID NO: 72801 - RNA, 21 nt, Homo sapiens
cuaggaccaguucuguaauuc

SEQ ID NO: 72802 - RNA, 22 nt, Homo sapiens
cuaggcuuuucuuggauccagg

SEQ ID NO: 72803 - RNA, 22 nt, Homo sapiens
cuauacuguacacugaaugagg

SEQ ID NO: 72804 - RNA, 22 nt, Homo sapiens
cuaucacuguuuugaugcccgg

SEQ ID NO: 72805 - RNA, 22 nt, Homo sapiens
cuaucucaggcccaggcccuug

SEQ ID NO: 72806 - RNA, 22 nt, Homo sapiens
cuaucucauugguuuuugaaag

SEQ ID NO: 72807 - RNA, 22 nt, Homo sapiens
cuauggcuguaaggauaguaac

SEQ ID NO: 72808 - RNA, 22 nt, Homo sapiens
cuauggcuguagucccugugua

SEQ ID NO: 72809 - RNA, 22 nt, Homo sapiens
cuaugucuuucauauuuugggg

SEQ ID NO: 72810 - RNA, 22 nt, Homo sapiens
cuauuagguuggugcaaaagua

SEQ ID NO: 72811 - RNA, 22 nt, Homo sapiens
cuauuagguuggugcaaaaguc

SEQ ID NO: 72812 - RNA, 22 nt, Homo sapiens
cuauucacaggcaauauguaca

SEQ ID NO: 72813 - RNA, 19 nt, Homo sapiens
cuauugcacauagcugaag

SEQ ID NO: 72814 - RNA, 22 nt, Homo sapiens
cucaaagugcugggauuggcca

SEQ ID NO: 72815 - RNA, 19 nt, Homo sapiens
cucaaagugguauuuggag

SEQ ID NO: 72816 - RNA, 18 nt, Homo sapiens
cucacaguaacuuuuaag

SEQ ID NO: 72817 - RNA, 22 nt, Homo sapiens
cucacagugacacgaaccccca

SEQ ID NO: 72818 - RNA, 22 nt, Homo sapiens
cucacaugcucaccugguguuc

SEQ ID NO: 72819 - RNA, 22 nt, Homo sapiens
cucacuggguguaaaacaugua

SEQ ID NO: 72820 - RNA, 22 nt, Homo sapiens
cucagagcacaguuuaugacag

SEQ ID NO: 72821 - RNA, 22 nt, Homo sapiens
cucagauacuugggagguugag

SEQ ID NO: 72822 - RNA, 20 nt, Homo sapiens
cucagauuauucugaagcaa

SEQ ID NO: 72823 - RNA, 20 nt, Homo sapiens
cagucauagacaucagaguc

SEQ ID NO: 72824 - RNA, 22 nt, Homo sapiens
cagugaauuucaggucaagagu

SEQ ID NO: 72825 - RNA, 22 nt, Homo sapiens
cagugcaaagccucugcccaga

SEQ ID NO: 72826 - RNA, 18 nt, Homo sapiens
cagugcaauacaggagag

SEQ ID NO: 72827 - RNA, 20 nt, Homo sapiens
cagugcacuuucccacuggu

SEQ ID NO: 72828 - RNA, 22 nt, Homo sapiens
cagugcauguggcacucuccag

SEQ ID NO: 72829 - RNA, 23 nt, Homo sapiens
cagugguguuagagaaaucuuuu

SEQ ID NO: 72830 - RNA, 22 nt, Homo sapiens
cagugguuuuuagcuugcuggg

SEQ ID NO: 72831 - RNA, 22 nt, Homo sapiens
caguucaugguaggcaccauag

SEQ ID NO: 72832 - RNA, 22 nt, Homo sapiens
caguugcacuagccccguuuca

SEQ ID NO: 72833 - RNA, 22 nt, Homo sapiens
caguugguguacauauauguau

SEQ ID NO: 72834 - RNA, 22 nt, Homo sapiens
cauaaaucuuguugaauagcac

SEQ ID NO: 72835 - RNA, 22 nt, Homo sapiens
cauaaugcuaagagcugccccu

SEQ ID NO: 72836 - RNA, 22 nt, Homo sapiens
cauacaagcuacaaucacaaag

SEQ ID NO: 72837 - RNA, 22 nt, Homo sapiens
cauagcacacauuuaccuaugu

SEQ ID NO: 72838 - RNA, 22 nt, Homo sapiens
cauagcacacguauaccuaugu

SEQ ID NO: 72839 - RNA, 22 nt, Homo sapiens
cauaugguuuuauguucuucau

SEQ ID NO: 72840 - RNA, 22 nt, Homo sapiens
cauauucacuuuacagagcugu

SEQ ID NO: 72841 - RNA, 22 nt, Homo sapiens
caucacagcaaguagggagugg

SEQ ID NO: 72842 - RNA, 22 nt, Homo sapiens
caucacauucugagauacugag

SEQ ID NO: 72843 - RNA, 22 nt, Homo sapiens
caucacuguugguacaaguaau

SEQ ID NO: 72844 - RNA, 22 nt, Homo sapiens
caucauugcacccuauagagaa

SEQ ID NO: 72845 - RNA, 22 nt, Homo sapiens
cauccccugcaccaaccuuuac

SEQ ID NO: 72846 - RNA, 21 nt, Homo sapiens
cauccccugccauuguggucu

SEQ ID NO: 72847 - RNA, 22 nt, Homo sapiens
caucgcacuccagccuggguaa

SEQ ID NO: 72848 - RNA, 22 nt, Homo sapiens
caucgcacuccagcuugggcaa

SEQ ID NO: 72849 - RNA, 22 nt, Homo sapiens
caugaaagugagaaacuccugg

SEQ ID NO: 72850 - RNA, 19 nt, Homo sapiens
caugauacugcucccucuc

SEQ ID NO: 72851 - RNA, 22 nt, Homo sapiens
caugauauugcagaauguuggu

SEQ ID NO: 72852 - RNA, 22 nt, Homo sapiens
cauggagcuaggcuugaucccu

SEQ ID NO: 72853 - RNA, 22 nt, Homo sapiens
cauggauuuuuuugaauggcag

SEQ ID NO: 72854 - RNA, 22 nt, Homo sapiens
cauggcacaucuuuucugacua

SEQ ID NO: 72855 - RNA, 22 nt, Homo sapiens
cauggcacuguaugaaaugugc

SEQ ID NO: 72856 - RNA, 22 nt, Homo sapiens
cauggcauuugcagaguugaaa

SEQ ID NO: 72857 - RNA, 22 nt, Homo sapiens
cauggcucuuguuuacucccag

SEQ ID NO: 72858 - RNA, 19 nt, Homo sapiens
cauggcuuauaauuuuaau

SEQ ID NO: 72859 - RNA, 21 nt, Homo sapiens
caugucacugcacucuagccu

SEQ ID NO: 72860 - RNA, 22 nt, Homo sapiens
caugucacuuccucucugaugg

SEQ ID NO: 72861 - RNA, 22 nt, Homo sapiens
caugucuuuuaaacauucaacu

SEQ ID NO: 72862 - RNA, 22 nt, Homo sapiens
cauuaagcuacuuagaaggugc

SEQ ID NO: 72863 - RNA, 22 nt, Homo sapiens
cauuaguugaagugcagggaga

SEQ ID NO: 72864 - RNA, 22 nt, Homo sapiens
cauugcaacuucugccucccag

SEQ ID NO: 72865 - RNA, 19 nt, Homo sapiens
cauugcacuccacccuggg

SEQ ID NO: 72866 - RNA, 22 nt, Homo sapiens
cauugcacuccagccugaccaa

SEQ ID NO: 72867 - RNA, 22 nt, Homo sapiens
cauugcacuccagccugaggga

SEQ ID NO: 72868 - RNA, 22 nt, Homo sapiens
cauugcacuccagccuggcaac

SEQ ID NO: 72869 - RNA, 22 nt, Homo sapiens
cauugcacuccagccuuggcaa

SEQ ID NO: 72870 - RNA, 22 nt, Homo sapiens
cauugcacuccagucugggcaa

SEQ ID NO: 72871 - RNA, 22 nt, Homo sapiens
cauugcacuccaucccgggaaa

SEQ ID NO: 72872 - RNA, 16 nt, Homo sapiens
cauugcacucuagccu

SEQ ID NO: 72873 - RNA, 22 nt, Homo sapiens
cauugcacucuagccucggcaa

SEQ ID NO: 72874 - RNA, 22 nt, Homo sapiens
cauugcacugcagcccgggcaa

SEQ ID NO: 72875 - RNA, 22 nt, Homo sapiens
cauugcagauccuucaaaugac

SEQ ID NO: 72876 - RNA, 22 nt, Homo sapiens
cauugcauuuucuuuguaccuu

SEQ ID NO: 72877 - RNA, 22 nt, Homo sapiens
cauugcccuccagccugggcaa

SEQ ID NO: 72878 - RNA, 22 nt, Homo sapiens
cauugcuuuuggugguuuagac

SEQ ID NO: 72879 - RNA, 19 nt, Homo sapiens
cauuggacuugcuuuugcc

SEQ ID NO: 72880 - RNA, 22 nt, Homo sapiens
cauuguacauaaguauggagua

SEQ ID NO: 72881 - RNA, 22 nt, Homo sapiens
cauugucccucaaugucuauga

SEQ ID NO: 72882 - RNA, 22 nt, Homo sapiens
cauuguccuccuggggcuauuu

SEQ ID NO: 72883 - RNA, 22 nt, Homo sapiens
ccaaauccauccaaaucauaga

SEQ ID NO: 72884 - RNA, 22 nt, Homo sapiens
ccacaaccucaacagcaucuau

SEQ ID NO: 72885 - RNA, 23 nt, Homo sapiens
ccacacuguuuagaauggcauca

SEQ ID NO: 72886 - RNA, 22 nt, Homo sapiens
ccacagucuaugcaacaagguc

SEQ ID NO: 72887 - RNA, 22 nt, Homo sapiens
ccacugugguaucugauacugg

SEQ ID NO: 72888 - RNA, 22 nt, Homo sapiens
ccagaguggagccuuugcgagg

SEQ ID NO: 72889 - RNA, 22 nt, Homo sapiens
ccagccgggugcaguggcucac

SEQ ID NO: 72890 - RNA, 22 nt, Homo sapiens
ccaggguugcuuuagauucuga

SEQ ID NO: 72891 - RNA, 22 nt, Homo sapiens
ccaguauugaacacaaugaaag

SEQ ID NO: 72892 - RNA, 22 nt, Homo sapiens
ccagugaacugcaagguuuuuc

SEQ ID NO: 72893 - RNA, 22 nt, Homo sapiens
ccaguguucuggaaggcugagu

SEQ ID NO: 72894 - RNA, 20 nt, Homo sapiens
ccaucaguccucucuuguuc

SEQ ID NO: 72895 - RNA, 21 nt, Homo sapiens
ccauggcaaugguaaacugac

SEQ ID NO: 72896 - RNA, 22 nt, Homo sapiens
ccauggcuauucuguaaggguu

SEQ ID NO: 72897 - RNA, 22 nt, Homo sapiens
ccauggcuucugcauucuguca

SEQ ID NO: 72898 - RNA, 22 nt, Homo sapiens
ccauugcacucuggccuaggug

SEQ ID NO: 72899 - RNA, 22 nt, Homo sapiens
ccauugcacuucagccuaggug

SEQ ID NO: 72900 - RNA, 22 nt, Homo sapiens
ccauuucacucuuccugaagga

SEQ ID NO: 72901 - RNA, 22 nt, Homo sapiens
cccacaguggccucauauccuu

SEQ ID NO: 72902 - RNA, 22 nt, Homo sapiens
cccagcguucggcauggcugag

SEQ ID NO: 72903 - RNA, 22 nt, Homo sapiens
cccaguaaucuugccaguuuuc

SEQ ID NO: 72904 - RNA, 22 nt, Homo sapiens
cccaguagagauugccgaauug

SEQ ID NO: 72905 - RNA, 22 nt, Homo sapiens
ccccagguuucaauaaagccca

SEQ ID NO: 72906 - RNA, 22 nt, Homo sapiens
ccccggguucugucugcccuug

SEQ ID NO: 72907 - RNA, 18 nt, Homo sapiens
cccgggugggcuguuccc

SEQ ID NO: 72908 - RNA, 17 nt, Homo sapiens
cccuaguagcugggacu

SEQ ID NO: 72909 - RNA, 23 nt, Homo sapiens
cccucagaagugcagggagagaa

SEQ ID NO: 72910 - RNA, 22 nt, Homo sapiens
cccugaagaaagccuaggacau

SEQ ID NO: 72911 - RNA, 22 nt, Homo sapiens
cccugagaaaacuuuguccuua

SEQ ID NO: 72912 - RNA, 22 nt, Homo sapiens
cccuggacacacacuuuuauuc

SEQ ID NO: 72913 - RNA, 22 nt, Homo sapiens
cccuuagaauuuuguaguuauu

SEQ ID NO: 72914 - RNA, 22 nt, Homo sapiens
cccuucauucaaggguugugag

SEQ ID NO: 72915 - RNA, 22 nt, Homo sapiens
ccggguguuuuguucucucaga

SEQ ID NO: 72916 - RNA, 22 nt, Homo sapiens
ccucacaaccuuuauugaagag

SEQ ID NO: 72917 - RNA, 22 nt, Homo sapiens
ccucauggagaacaucugcuag

SEQ ID NO: 72918 - RNA, 22 nt, Homo sapiens
cucagcaguggauuuaccacca

SEQ ID NO: 72919 - RNA, 22 nt, Homo sapiens
cucaggcacucugauuccagug

SEQ ID NO: 72920 - RNA, 22 nt, Homo sapiens
cucaggguacuucuccuuugcu

SEQ ID NO: 72921 - RNA, 20 nt, Homo sapiens
cucagguauuugaggcugca

SEQ ID NO: 72922 - RNA, 22 nt, Homo sapiens
cucagugguugauuuauuuauc

SEQ ID NO: 72923 - RNA, 22 nt, Homo sapiens
cucagugucuggggccccaggg

SEQ ID NO: 72924 - RNA, 22 nt, Homo sapiens
cucaguguuucagcugcucaga

SEQ ID NO: 72925 - RNA, 22 nt, Homo sapiens
cucaguuuugccuuguuuaagg

SEQ ID NO: 72926 - RNA, 22 nt, Homo sapiens
cucauugcaaucuccaccuccc

SEQ ID NO: 72927 - RNA, 22 nt, Homo sapiens
cuccaggugucauccaccuccu

SEQ ID NO: 72928 - RNA, 22 nt, Homo sapiens
cuccauagucuucgaagaauga

SEQ ID NO: 72929 - RNA, 22 nt, Homo sapiens
cuccauguggcuaacuuuuaaa

SEQ ID NO: 72930 - RNA, 22 nt, Homo sapiens
cuccauuuggaacagauguccu

SEQ ID NO: 72931 - RNA, 20 nt, Homo sapiens
cucccugacaaauguggaaa

SEQ ID NO: 72932 - RNA, 22 nt, Homo sapiens
cucccugagccagggcuuugac

SEQ ID NO: 72933 - RNA, 22 nt, Homo sapiens
cucccuuugcugaauguuuuuc

SEQ ID NO: 72934 - RNA, 22 nt, Homo sapiens
cuccgggugcgucggcgcccug

SEQ ID NO: 72935 - RNA, 20 nt, Homo sapiens
cucuaguaauaaaguuuccc

SEQ ID NO: 72936 - RNA, 22 nt, Homo sapiens
cucucaguguggaggccagaaa

SEQ ID NO: 72937 - RNA, 22 nt, Homo sapiens
cucucaguugucuaauuaguuu

SEQ ID NO: 72938 - RNA, 22 nt, Homo sapiens
cucucugagccauggcugcccu

SEQ ID NO: 72939 - RNA, 21 nt, Homo sapiens
cucucugcuuaugaauaguga

SEQ ID NO: 72940 - RNA, 22 nt, Homo sapiens
cucuuugaugugaaccgugguu

SEQ ID NO: 72941 - RNA, 22 nt, Homo sapiens
cucuuuuguuccuaguuugauc

SEQ ID NO: 72942 - RNA, 22 nt, Homo sapiens
cugaauagucaacgauggacug

SEQ ID NO: 72943 - RNA, 22 nt, Homo sapiens
cugaauguccaggcagagguuu

SEQ ID NO: 72944 - RNA, 22 nt, Homo sapiens
cugacauuguugaucacagcca

SEQ ID NO: 72945 - RNA, 22 nt, Homo sapiens
cugaccuaugauuuggcucaaa

SEQ ID NO: 72946 - RNA, 22 nt, Homo sapiens
cugacguguuuuccagaccuuu

SEQ ID NO: 72947 - RNA, 22 nt, Homo sapiens
cugacucagacacauguauaug

SEQ ID NO: 72948 - RNA, 22 nt, Homo sapiens
cugacugugcaugcccagcccc

SEQ ID NO: 72949 - RNA, 22 nt, Homo sapiens
cugagagaggagcuaaaacugc

SEQ ID NO: 72950 - RNA, 22 nt, Homo sapiens
cugagagaugagaccucucacu

SEQ ID NO: 72951 - RNA, 22 nt, Homo sapiens
cugagauaauuucuagguguca

SEQ ID NO: 72952 - RNA, 22 nt, Homo sapiens
cugagauaggacucugcuggcu

SEQ ID NO: 72953 - RNA, 22 nt, Homo sapiens
cugagaucaagucuugcucugu

SEQ ID NO: 72954 - RNA, 22 nt, Homo sapiens
cugagaucugaaccaggagugu

SEQ ID NO: 72955 - RNA, 22 nt, Homo sapiens
cugagaucuuauuagaaaugca

SEQ ID NO: 72956 - RNA, 22 nt, Homo sapiens
cugagauggagucucgcauugu

SEQ ID NO: 72957 - RNA, 22 nt, Homo sapiens
cugagcaaaaugaagacacgau

SEQ ID NO: 72958 - RNA, 22 nt, Homo sapiens
cugagcaaagaagugauaauga

SEQ ID NO: 72959 - RNA, 22 nt, Homo sapiens
cugagcacugagauccucuagc

SEQ ID NO: 72960 - RNA, 22 nt, Homo sapiens
cugagcccauucuggggagaag

SEQ ID NO: 72961 - RNA, 22 nt, Homo sapiens
cugagguagcucaggguauugc

SEQ ID NO: 72962 - RNA, 22 nt, Homo sapiens
cugaggugggaggauuacuuga

SEQ ID NO: 72963 - RNA, 22 nt, Homo sapiens
cugagguuguucuucucagugg

SEQ ID NO: 72964 - RNA, 18 nt, Homo sapiens
cugagucauuccuggguc

SEQ ID NO: 72965 - RNA, 22 nt, Homo sapiens
cugauauuuuaaaauuggcugg

SEQ ID NO: 72966 - RNA, 22 nt, Homo sapiens
cugauuuguccccagccucaug

SEQ ID NO: 72967 - RNA, 20 nt, Homo sapiens
cugcaaaugcugcugcugau

SEQ ID NO: 72968 - RNA, 22 nt, Homo sapiens
cugcaauggagaaagugagacu

SEQ ID NO: 72969 - RNA, 22 nt, Homo sapiens
cugcauaaucaucucucugcau

SEQ ID NO: 72970 - RNA, 19 nt, Homo sapiens
cugcaugagacaguugguu

SEQ ID NO: 72971 - RNA, 18 nt, Homo sapiens
cugccagugugcucuccg

SEQ ID NO: 72972 - RNA, 22 nt, Homo sapiens
cugcccuuucuauaugauguaa

SEQ ID NO: 72973 - RNA, 22 nt, Homo sapiens
cugccugagaaaauggagggca

SEQ ID NO: 72974 - RNA, 22 nt, Homo sapiens
cuggaaagaaacccuuaauucu

SEQ ID NO: 72975 - RNA, 22 nt, Homo sapiens
cuggaaagcaaguccauugcuc

SEQ ID NO: 72976 - RNA, 18 nt, Homo sapiens
cuggaaggcuacuacagu

SEQ ID NO: 72977 - RNA, 22 nt, Homo sapiens
cuggaaugcagcuuuaggggcu

SEQ ID NO: 72978 - RNA, 22 nt, Homo sapiens
cuggacaaaucuggaaagaacc

SEQ ID NO: 72979 - RNA, 22 nt, Homo sapiens
cuggaggccugaacauaaaugg

SEQ ID NO: 72980 - RNA, 22 nt, Homo sapiens
cuggaguuugaggcugcaguga

SEQ ID NO: 72981 - RNA, 22 nt, Homo sapiens
cuggauagagauugaugaugcu

SEQ ID NO: 72982 - RNA, 20 nt, Homo sapiens
cuggaugucgaggcagaggu

SEQ ID NO: 72983 - RNA, 22 nt, Homo sapiens
cuggcaagagugaaccagcugu

SEQ ID NO: 72984 - RNA, 22 nt, Homo sapiens
cuggcaauaaauuuuuguguug

SEQ ID NO: 72985 - RNA, 22 nt, Homo sapiens
cuggcaccauuuugaucaaagg

SEQ ID NO: 72986 - RNA, 22 nt, Homo sapiens
cuggcagucugccucuucacug

SEQ ID NO: 72987 - RNA, 22 nt, Homo sapiens
cuggcagugcuuguuauccugg

SEQ ID NO: 72988 - RNA, 22 nt, Homo sapiens
cuggcaguguuucuugugggcu

SEQ ID NO: 72989 - RNA, 22 nt, Homo sapiens
cuggcccaguucugcguuuugc

SEQ ID NO: 72990 - RNA, 22 nt, Homo sapiens
cuggcucauuucauuuagcaua

SEQ ID NO: 72991 - RNA, 22 nt, Homo sapiens
cugggaucaguucuagucagaa

SEQ ID NO: 72992 - RNA, 22 nt, Homo sapiens
cugggauggaggagaauuagag

SEQ ID NO: 72993 - RNA, 22 nt, Homo sapiens
cugggcaaugcggcuggauaga

SEQ ID NO: 72994 - RNA, 22 nt, Homo sapiens
cugggguaggacuggcuuuuga

SEQ ID NO: 72995 - RNA, 22 nt, Homo sapiens
cugguaagaaggucuaagucaa

SEQ ID NO: 72996 - RNA, 21 nt, Homo sapiens
cugguccccuuuauguaugug

SEQ ID NO: 72997 - RNA, 22 nt, Homo sapiens
cugguuguuacaaagagccugg

SEQ ID NO: 72998 - RNA, 22 nt, Homo sapiens
cugguuguuacaugcuugccag

SEQ ID NO: 72999 - RNA, 22 nt, Homo sapiens
cuguacucaucccauaugcacu

SEQ ID NO: 73000 - RNA, 22 nt, Homo sapiens
cuguaugugagaaauaauaagu

SEQ ID NO: 73001 - RNA, 19 nt, Homo sapiens
cugucacugaggaagacug

SEQ ID NO: 73002 - RNA, 22 nt, Homo sapiens
cugucaucauuucuaugugcca

SEQ ID NO: 73003 - RNA, 22 nt, Homo sapiens
cugucucagccucuccaguagc

SEQ ID NO: 73004 - RNA, 22 nt, Homo sapiens
cugugcaaguuauaggccaggu

SEQ ID NO: 73005 - RNA, 22 nt, Homo sapiens
cugugcacaucuggcggcccga

SEQ ID NO: 73006 - RNA, 22 nt, Homo sapiens
cugugcauaucuuggacugugu

SEQ ID NO: 73007 - RNA, 22 nt, Homo sapiens
cugugcauggauuuuaagauug

SEQ ID NO: 73008 - RNA, 19 nt, Homo sapiens
cugugcauuucuguggaag

SEQ ID NO: 73009 - RNA, 22 nt, Homo sapiens
cugugcuugagagaugacacag

SEQ ID NO: 73010 - RNA, 23 nt, Homo sapiens
cuguggauaugaguuguaaaugg

SEQ ID NO: 73011 - RNA, 22 nt, Homo sapiens
cuguggauguauugcacagucu

SEQ ID NO: 73012 - RNA, 22 nt, Homo sapiens
cuguggguuuuacuguuuuacu

SEQ ID NO: 73013 - RNA, 22 nt, Homo sapiens
gauuccauugcgaauuuucaga

SEQ ID NO: 73014 - RNA, 22 nt, Homo sapiens
gauuuugguuagggaaggauac

SEQ ID NO: 73015 - RNA, 22 nt, Homo sapiens
gcaaaaaguagugcugguuagg

SEQ ID NO: 73016 - RNA, 21 nt, Homo sapiens
gcaaaggaauugccuaagcuu

SEQ ID NO: 73017 - RNA, 22 nt, Homo sapiens
gcaaaguguuuuccaacuuggu

SEQ ID NO: 73018 - RNA, 22 nt, Homo sapiens
gcaaaucuuauguccucacauu

SEQ ID NO: 73019 - RNA, 22 nt, Homo sapiens
gcaaaugcuaugccauuuuaua

SEQ ID NO: 73020 - RNA, 20 nt, Homo sapiens
gcaaauggaucccacaagcc

SEQ ID NO: 73021 - RNA, 22 nt, Homo sapiens
gcaagacaugucuaagguuuaa

SEQ ID NO: 73022 - RNA, 22 nt, Homo sapiens
gcaagagguaucuuauuuuccc

SEQ ID NO: 73023 - RNA, 22 nt, Homo sapiens
gcaagaugagagcccgggcagu

SEQ ID NO: 73024 - RNA, 22 nt, Homo sapiens
gcaagugucugagguuuuguau

SEQ ID NO: 73025 - RNA, 22 nt, Homo sapiens
gcaaugcugucugugcacagau

SEQ ID NO: 73026 - RNA, 22 nt, Homo sapiens
gcaauguuacugaauguguuuu

SEQ ID NO: 73027 - RNA, 22 nt, Homo sapiens
gcacacguagaagcaugcauca

SEQ ID NO: 73028 - RNA, 22 nt, Homo sapiens
gcacaguaggugguaggacuuu

SEQ ID NO: 73029 - RNA, 22 nt, Homo sapiens
gcacagucaacacuuauucacc

SEQ ID NO: 73030 - RNA, 22 nt, Homo sapiens
gcacaguggcucccgucuauaa

SEQ ID NO: 73031 - RNA, 22 nt, Homo sapiens
gcacaguguuacuugauauauu

SEQ ID NO: 73032 - RNA, 22 nt, Homo sapiens
gagauguuuuguuaucaaagga

SEQ ID NO: 73033 - RNA, 22 nt, Homo sapiens
gagauuaauacacaucaaaugc

SEQ ID NO: 73034 - RNA, 22 nt, Homo sapiens
gagauucuucaauauuuauucu

SEQ ID NO: 73035 - RNA, 22 nt, Homo sapiens
gagauugucaugauuacauugu

SEQ ID NO: 73036 - RNA, 22 nt, Homo sapiens
gagcaccagucccugucagugc

SEQ ID NO: 73037 - RNA, 22 nt, Homo sapiens
gagcagacaugaggaccgcugg

SEQ ID NO: 73038 - RNA, 20 nt, Homo sapiens
gagcaucacaggccucugcu

SEQ ID NO: 73039 - RNA, 22 nt, Homo sapiens
gagcaucauucaacaaaagucu

SEQ ID NO: 73040 - RNA, 22 nt, Homo sapiens
gagcuaguagauuuuaaauauu

SEQ ID NO: 73041 - RNA, 20 nt, Homo sapiens
gagcucaucuucuuuaccac

SEQ ID NO: 73042 - RNA, 22 nt, Homo sapiens
gagcucauuaaaaauguagaau

SEQ ID NO: 73043 - RNA, 22 nt, Homo sapiens
gagcuccuccccuuggcuuuca

SEQ ID NO: 73044 - RNA, 22 nt, Homo sapiens
gagcugaauugcugccauuugc

SEQ ID NO: 73045 - RNA, 22 nt, Homo sapiens
gagcugaucuuuauguaaauuc

SEQ ID NO: 73046 - RNA, 20 nt, Homo sapiens
gagcugguguacugccgggc

SEQ ID NO: 73047 - RNA, 22 nt, Homo sapiens
gagcuuguagugugaaugguau

SEQ ID NO: 73048 - RNA, 22 nt, Homo sapiens
gagcuuguggucuucguguuau

SEQ ID NO: 73049 - RNA, 22 nt, Homo sapiens
gaggcaagaguaguuaaguuag

SEQ ID NO: 73050 - RNA, 22 nt, Homo sapiens
gaggcauuauucccaucuuaca

SEQ ID NO: 73051 - RNA, 22 nt, Homo sapiens
gaggcauugaagauauggaagu

SEQ ID NO: 73052 - RNA, 22 nt, Homo sapiens
gagguaagaguuuuccauuucu

SEQ ID NO: 73053 - RNA, 22 nt, Homo sapiens
gagguaagaugauucguguccu

SEQ ID NO: 73054 - RNA, 22 nt, Homo sapiens
gagguagggucccacuauguug

SEQ ID NO: 73055 - RNA, 22 nt, Homo sapiens
gagguagguuugguuacaaaag

SEQ ID NO: 73056 - RNA, 22 nt, Homo sapiens
gagguauaauugacaagcaaaa

SEQ ID NO: 73057 - RNA, 22 nt, Homo sapiens
gagguauggauaucuggagagg

SEQ ID NO: 73058 - RNA, 22 nt, Homo sapiens
gaggugauaucucauugugguu

SEQ ID NO: 73059 - RNA, 22 nt, Homo sapiens
gagguguaaggacaacagagac

SEQ ID NO: 73060 - RNA, 22 nt, Homo sapiens
gagguguagagauauaccugaa

SEQ ID NO: 73061 - RNA, 22 nt, Homo sapiens
gaguaacagcauaaauuuguga

SEQ ID NO: 73062 - RNA, 22 nt, Homo sapiens
gaguaacauugacaacuucaug

SEQ ID NO: 73063 - RNA, 22 nt, Homo sapiens
gaguagugcugcaauaaacaua

SEQ ID NO: 73064 - RNA, 22 nt, Homo sapiens
gaguagugcuguaauaaacaua

SEQ ID NO: 73065 - RNA, 22 nt, Homo sapiens
gagugcaauggcaagaucuugg

SEQ ID NO: 73066 - RNA, 22 nt, Homo sapiens
gagugcaauggcaugaucuugg

SEQ ID NO: 73067 - RNA, 22 nt, Homo sapiens
gagugcaauggcgcgaucuggg

SEQ ID NO: 73068 - RNA, 22 nt, Homo sapiens
gagugcauaugggccuguguca

SEQ ID NO: 73069 - RNA, 22 nt, Homo sapiens
gagugcaucguggccauuuuaa

SEQ ID NO: 73070 - RNA, 22 nt, Homo sapiens
gagugcugagcccacuuccuug

SEQ ID NO: 73071 - RNA, 18 nt, Homo sapiens
gaguggugcuucccuugu

SEQ ID NO: 73072 - RNA, 22 nt, Homo sapiens
gaguggugguucugaaacuuuu

SEQ ID NO: 73073 - RNA, 22 nt, Homo sapiens
gagugguuuugauuuauagcug

SEQ ID NO: 73074 - RNA, 22 nt, Homo sapiens
gaguuagguugucaaugucuua

SEQ ID NO: 73075 - RNA, 22 nt, Homo sapiens
gaguuccuuugagccugagagg

SEQ ID NO: 73076 - RNA, 22 nt, Homo sapiens
gaguugagagaguuguuauuuc

SEQ ID NO: 73077 - RNA, 22 nt, Homo sapiens
gauaaaucuuggcuagucuaag

SEQ ID NO: 73078 - RNA, 22 nt, Homo sapiens
gauacaccauuuucuagcuauu

SEQ ID NO: 73079 - RNA, 19 nt, Homo sapiens
gauagacaucacagugcca

SEQ ID NO: 73080 - RNA, 22 nt, Homo sapiens
gauaguugugagaacucuuacu

SEQ ID NO: 73081 - RNA, 19 nt, Homo sapiens
gauaucuagggggagguuc

SEQ ID NO: 73082 - RNA, 22 nt, Homo sapiens
gauaugaccauguagaccucag

SEQ ID NO: 73083 - RNA, 22 nt, Homo sapiens
gauauguacagcucucuaggau

SEQ ID NO: 73084 - RNA, 22 nt, Homo sapiens
gauaugucuauuagcuugauug

SEQ ID NO: 73085 - RNA, 19 nt, Homo sapiens
gauauguugagcacccuuu

SEQ ID NO: 73086 - RNA, 22 nt, Homo sapiens
gauauguuguuggauucgguua

SEQ ID NO: 73087 - RNA, 22 nt, Homo sapiens
gauauuacuuccaauauugcaa

SEQ ID NO: 73088 - RNA, 22 nt, Homo sapiens
gauauugacuuauucuauguuu

SEQ ID NO: 73089 - RNA, 22 nt, Homo sapiens
gaucacauggccauuucuagcu

SEQ ID NO: 73090 - RNA, 22 nt, Homo sapiens
gaucuggagguuuuccucauga

SEQ ID NO: 73091 - RNA, 22 nt, Homo sapiens
gaucugucuuuccuuauagucu

SEQ ID NO: 73092 - RNA, 22 nt, Homo sapiens
gaucuguuucaauugucuuagu

SEQ ID NO: 73093 - RNA, 22 nt, Homo sapiens
ggcaaggugcuacagacaguga

SEQ ID NO: 73094 - RNA, 22 nt, Homo sapiens
ggcaaguauguuuuaggaugcu

SEQ ID NO: 73095 - RNA, 22 nt, Homo sapiens
ggcaaguucuaaugauuagaau

SEQ ID NO: 73096 - RNA, 22 nt, Homo sapiens
ggcaaguugcuauucuuuaaug

SEQ ID NO: 73097 - RNA, 22 nt, Homo sapiens
ggcaaugaggcggaccagcagg

SEQ ID NO: 73098 - RNA, 22 nt, Homo sapiens
ggcacaaugucagcucacugca

SEQ ID NO: 73099 - RNA, 22 nt, Homo sapiens
ggcaccacagacgccaggcgug

SEQ ID NO: 73100 - RNA, 22 nt, Homo sapiens
ggcacgguggcucacaccugua

SEQ ID NO: 73101 - RNA, 22 nt, Homo sapiens
ggcagacuguggaguucuuucu

SEQ ID NO: 73102 - RNA, 22 nt, Homo sapiens
ggcagcaugggugccuuuguga

SEQ ID NO: 73103 - RNA, 22 nt, Homo sapiens
ggcagcauugccuuugcaguga

SEQ ID NO: 73104 - RNA, 17 nt, Homo sapiens
ggcaggaauuaauguca

SEQ ID NO: 73105 - RNA, 17 nt, Homo sapiens
ggcaggauccaggaucc

SEQ ID NO: 73106 - RNA, 22 nt, Homo sapiens
ggcagguaaggagugggagccu

SEQ ID NO: 73107 - RNA, 23 nt, Homo sapiens
ggcagguuggucuaggucuauuc

SEQ ID NO: 73108 - RNA, 22 nt, Homo sapiens
ggcaguuuguucuugcuccuuu

SEQ ID NO: 73109 - RNA, 22 nt, Homo sapiens
ggcaguuuguuugugaggucca

SEQ ID NO: 73110 - RNA, 22 nt, Homo sapiens
ggcaugaaguagcccacaggca

SEQ ID NO: 73111 - RNA, 21 nt, Homo sapiens
ggcaugaauggaaaagugaga

SEQ ID NO: 73112 - RNA, 22 nt, Homo sapiens
ggcaugauggcugaggcuucug

SEQ ID NO: 73113 - RNA, 22 nt, Homo sapiens
ggcauguaauuauucaaagugg

SEQ ID NO: 73114 - RNA, 22 nt, Homo sapiens
ggcauguauucuuauuauuccu

SEQ ID NO: 73115 - RNA, 22 nt, Homo sapiens
ggcauugaguggguaggaguca

SEQ ID NO: 73116 - RNA, 22 nt, Homo sapiens
ggcauugugaacauuucccugc

SEQ ID NO: 73117 - RNA, 22 nt, Homo sapiens
ggcauugugauccaccagccuu

SEQ ID NO: 73118 - RNA, 21 nt, Homo sapiens
ggcauugugcccuugcucuag

SEQ ID NO: 73119 - RNA, 23 nt, Homo sapiens
ggcauuguggcucacaucuguaa

SEQ ID NO: 73120 - RNA, 22 nt, Homo sapiens
ggccagaugaucuaugaaggaa

SEQ ID NO: 73121 - RNA, 22 nt, Homo sapiens
ggcccugauacaaguaaggucu

SEQ ID NO: 73122 - RNA, 22 nt, Homo sapiens
ggccggguggccauggcugccc

SEQ ID NO: 73123 - RNA, 22 nt, Homo sapiens
ggcgguguugauggcccccaca

SEQ ID NO: 73124 - RNA, 22 nt, Homo sapiens
ggcuauagauaugugaacacuu

SEQ ID NO: 73125 - RNA, 22 nt, Homo sapiens
ggcucuguugcuaccaauuaag

SEQ ID NO: 73126 - RNA, 22 nt, Homo sapiens
ggcuguguguuaaaauaggcuu

SEQ ID NO: 73127 - RNA, 22 nt, Homo sapiens
gggaacauggaaauucugcucu

SEQ ID NO: 73128 - RNA, 22 nt, Homo sapiens
gggaagugugguuucuuuacag

SEQ ID NO: 73129 - RNA, 20 nt, Homo sapiens
gggaaucguaauagaauauu

SEQ ID NO: 73130 - RNA, 22 nt, Homo sapiens
gggaaugaagagaaccuuccca

SEQ ID NO: 73131 - RNA, 22 nt, Homo sapiens
gggaauggaagacauuaugaug

SEQ ID NO: 73132 - RNA, 22 nt, Homo sapiens
gggaauguagcaaaucugcaau

SEQ ID NO: 73133 - RNA, 22 nt, Homo sapiens
gggaggucauuguucaaugcug

SEQ ID NO: 73134 - RNA, 22 nt, Homo sapiens
gggagugucuaaccuguuaaca

SEQ ID NO: 73135 - RNA, 22 nt, Homo sapiens
gggaugaaguugauguagaaag

SEQ ID NO: 73136 - RNA, 22 nt, Homo sapiens
gggaugaauuagguauguuuau

SEQ ID NO: 73137 - RNA, 23 nt, Homo sapiens
gggauuguaaaauaugagggcag

SEQ ID NO: 73138 - RNA, 22 nt, Homo sapiens
gggauuguaauacugaguuggu

SEQ ID NO: 73139 - RNA, 22 nt, Homo sapiens
gggcaaauuauguaucucucag

SEQ ID NO: 73140 - RNA, 22 nt, Homo sapiens
gggcauaucacuugaggucagg

SEQ ID NO: 73141 - RNA, 23 nt, Homo sapiens
gggcuagaugagagcuuccuggg

SEQ ID NO: 73142 - RNA, 22 nt, Homo sapiens
ggggaguguggacaucacccug

SEQ ID NO: 73143 - RNA, 22 nt, Homo sapiens
gggggagugugguacccagcau

SEQ ID NO: 73144 - RNA, 22 nt, Homo sapiens
gggguaggcuacacugaguucc

SEQ ID NO: 73145 - RNA, 22 nt, Homo sapiens
ggggucauuaaauuccgcuggu

SEQ ID NO: 73146 - RNA, 15 nt, Homo sapiens
ggguccucucccaaa

SEQ ID NO: 73147 - RNA, 22 nt, Homo sapiens
gguagacaucgugcucugugau

SEQ ID NO: 73148 - RNA, 22 nt, Homo sapiens
gguagacucuguaagugaucau

SEQ ID NO: 73149 - RNA, 22 nt, Homo sapiens
gguauguaggucuacgguacaa

SEQ ID NO: 73150 - RNA, 22 nt, Homo sapiens
ggucacauugcuagcauggguu

SEQ ID NO: 73151 - RNA, 22 nt, Homo sapiens
ggucagaaagacaggcauucag

SEQ ID NO: 73152 - RNA, 19 nt, Homo sapiens
ggucagcaaagucuagcug

SEQ ID NO: 73153 - RNA, 22 nt, Homo sapiens
ggucagugcauucuaaaggcaa

SEQ ID NO: 73154 - RNA, 22 nt, Homo sapiens
ggucuagagagagggguggacu

SEQ ID NO: 73155 - RNA, 22 nt, Homo sapiens
ggucugguguugaaauucuuca

SEQ ID NO: 73156 - RNA, 22 nt, Homo sapiens
ggugacagugguuaaaauuugu

SEQ ID NO: 73157 - RNA, 21 nt, Homo sapiens
ggugagaaaggagacauagac

SEQ ID NO: 73158 - RNA, 22 nt, Homo sapiens
ggugagauaucugcugauguuu

SEQ ID NO: 73159 - RNA, 22 nt, Homo sapiens
ggugagguaggaaaaguuagga

SEQ ID NO: 73160 - RNA, 22 nt, Homo sapiens
ggugagguaguaagguacaaua

SEQ ID NO: 73161 - RNA, 22 nt, Homo sapiens
ggugauguuugaguugagacag

SEQ ID NO: 73162 - RNA, 22 nt, Homo sapiens
gguggcaaaucugaguggcgcu

SEQ ID NO: 73163 - RNA, 22 nt, Homo sapiens
gguggucuuccccuggaguucg

SEQ ID NO: 73164 - RNA, 22 nt, Homo sapiens
ggugucaguuggccccuacugg

SEQ ID NO: 73165 - RNA, 22 nt, Homo sapiens
gguguguaaauuacuuaucucu

SEQ ID NO: 73166 - RNA, 20 nt, Homo sapiens
guaaacucucagcauagaug

SEQ ID NO: 73167 - RNA, 22 nt, Homo sapiens
guaaauaccaguuucuggaaca

SEQ ID NO: 73168 - RNA, 22 nt, Homo sapiens
guaaaugcagaugcaugaccuu

SEQ ID NO: 73169 - RNA, 20 nt, Homo sapiens
guaacagcacuuucccaaag

SEQ ID NO: 73170 - RNA, 22 nt, Homo sapiens
guaacguaaugucaaaaucuau

SEQ ID NO: 73171 - RNA, 22 nt, Homo sapiens
guaacugguuuucuucccucuc

SEQ ID NO: 73172 - RNA, 22 nt, Homo sapiens
guaagauaguauguuuaaccca

SEQ ID NO: 73173 - RNA, 22 nt, Homo sapiens
guaagguuguauuucaagaaac

SEQ ID NO: 73174 - RNA, 22 nt, Homo sapiens
guaagucucaugagaucugaug

SEQ ID NO: 73175 - RNA, 22 nt, Homo sapiens
guaaucucagcuacucgggaga

SEQ ID NO: 73176 - RNA, 22 nt, Homo sapiens
guaaucucagcuacuugggagc

SEQ ID NO: 73177 - RNA, 22 nt, Homo sapiens
guaaugaacuugaaagccuguu

SEQ ID NO: 73178 - RNA, 22 nt, Homo sapiens
guaaugcacucccaaagaucca

SEQ ID NO: 73179 - RNA, 19 nt, Homo sapiens
guaaugugcuucaguagca

SEQ ID NO: 73180 - RNA, 22 nt, Homo sapiens
guacacaacaugcagguuuguu

SEQ ID NO: 73181 - RNA, 22 nt, Homo sapiens
guacaggcagcaaacaccauaa

SEQ ID NO: 73182 - RNA, 22 nt, Homo sapiens
guacaguauaguaauaggauuu

SEQ ID NO: 73183 - RNA, 22 nt, Homo sapiens
guacagugcucacaaugagagc

SEQ ID NO: 73184 - RNA, 22 nt, Homo sapiens
guacaguucucuuuguugucag

SEQ ID NO: 73185 - RNA, 22 nt, Homo sapiens
guacauagucacacauauacau

SEQ ID NO: 73186 - RNA, 22 nt, Homo sapiens
guacaugcauacaugcacaucu

SEQ ID NO: 73187 - RNA, 22 nt, Homo sapiens
guacuuuguuauaacccacagg

SEQ ID NO: 73188 - RNA, 21 nt, Homo sapiens
cacuggguucaggcuugugga

SEQ ID NO: 73189 - RNA, 22 nt, Homo sapiens
cacuggucucauggcaugagag

SEQ ID NO: 73190 - RNA, 22 nt, Homo sapiens
cacuuugguucaccugaguuuc

SEQ ID NO: 73191 - RNA, 21 nt, Homo sapiens
cagagaucaucucuguuuuaa

SEQ ID NO: 73192 - RNA, 22 nt, Homo sapiens
cagagaucaugcaacugcucgc

SEQ ID NO: 73193 - RNA, 22 nt, Homo sapiens
cagagcacuaaagguaaaaggc

SEQ ID NO: 73194 - RNA, 22 nt, Homo sapiens
cagagucaagcucuuguuccau

SEQ ID NO: 73195 - RNA, 22 nt, Homo sapiens
cagauacuccuggucucaggag

SEQ ID NO: 73196 - RNA, 22 nt, Homo sapiens
cagcacauuacaaguacuuggu

SEQ ID NO: 73197 - RNA, 22 nt, Homo sapiens
cagcaguuguuucggauuggga

SEQ ID NO: 73198 - RNA, 22 nt, Homo sapiens
cagcccguaaucccagcacuuu

SEQ ID NO: 73199 - RNA, 22 nt, Homo sapiens
cagcuaguaauuuauugaagau

SEQ ID NO: 73200 - RNA, 20 nt, Homo sapiens
cagcuagugguaggagucgg

SEQ ID NO: 73201 - RNA, 22 nt, Homo sapiens
cagcucauugcagucucgaccu

SEQ ID NO: 73202 - RNA, 22 nt, Homo sapiens
cagcugaugucgaaugcacucu

SEQ ID NO: 73203 - RNA, 23 nt, Homo sapiens
cagcuggugauuuuaaguugaag

SEQ ID NO: 73204 - RNA, 22 nt, Homo sapiens
cagcuguuguuccagucuuuua

SEQ ID NO: 73205 - RNA, 22 nt, Homo sapiens
caggcagucuggcucccaagug

SEQ ID NO: 73206 - RNA, 22 nt, Homo sapiens
caggcagugggagacaaaacug

SEQ ID NO: 73207 - RNA, 22 nt, Homo sapiens
cagggcaugugggucuauuggc

SEQ ID NO: 73208 - RNA, 22 nt, Homo sapiens
cagggcauugucuucuuaguac

SEQ ID NO: 73209 - RNA, 22 nt, Homo sapiens
caggguccccuaccuuuugaug

SEQ ID NO: 73210 - RNA, 22 nt, Homo sapiens
cagguacauuuuaaagggcuca

SEQ ID NO: 73211 - RNA, 22 nt, Homo sapiens
cagguaggccaauguuuuccaa

SEQ ID NO: 73212 - RNA, 22 nt, Homo sapiens
cagguaguauuugguuacauaa

SEQ ID NO: 73213 - RNA, 22 nt, Homo sapiens
caggucaucugaguuuaguucu

SEQ ID NO: 73214 - RNA, 22 nt, Homo sapiens
caggugaaugccucuccuucug

SEQ ID NO: 73215 - RNA, 22 nt, Homo sapiens
caguaaauaucugagcgagguc

SEQ ID NO: 73216 - RNA, 19 nt, Homo sapiens
caguaucauugcacauagu

SEQ ID NO: 73217 - RNA, 22 nt, Homo sapiens
cagucacagugacaggaugugg

SEQ ID NO: 73218 - RNA, 22 nt, Homo sapiens
cagucacugggauuauggucau

SEQ ID NO: 73219 - RNA, 22 nt, Homo sapiens
cagugauaggugguuguuggca

SEQ ID NO: 73220 - RNA, 22 nt, Homo sapiens
cagugcaaccuccaucucucgg

SEQ ID NO: 73221 - RNA, 20 nt, Homo sapiens
cagugcaccuggcguguuga

SEQ ID NO: 73222 - RNA, 22 nt, Homo sapiens
cagugcacugggauuauaagug

SEQ ID NO: 73223 - RNA, 20 nt, Homo sapiens
cagugcauugcuucugauuu

SEQ ID NO: 73224 - RNA, 22 nt, Homo sapiens
cagugcuuguuauuguucuauu

SEQ ID NO: 73225 - RNA, 22 nt, Homo sapiens
caguggacuaaauggggaauau

SEQ ID NO: 73226 - RNA, 22 nt, Homo sapiens
cagugucugcauuuggaacuca

SEQ ID NO: 73227 - RNA, 22 nt, Homo sapiens
caguguuuuuaacaggugcccg

SEQ ID NO: 73228 - RNA, 22 nt, Homo sapiens
caguuacuuuugcaccaaccua

SEQ ID NO: 73229 - RNA, 22 nt, Homo sapiens
cauacagcuaguaaguguaaga

SEQ ID NO: 73230 - RNA, 22 nt, Homo sapiens
cauacaguaggcacuauuugua

SEQ ID NO: 73231 - RNA, 22 nt, Homo sapiens
cauagcacugagcucuacccuc

SEQ ID NO: 73232 - RNA, 22 nt, Homo sapiens
cauagcacugcacuucagccug

SEQ ID NO: 73233 - RNA, 19 nt, Homo sapiens
caucacagagucuuccauu

SEQ ID NO: 73234 - RNA, 23 nt, Homo sapiens
caucacauagaggaaagaggaca

SEQ ID NO: 73235 - RNA, 22 nt, Homo sapiens
caucacaucugcaugguaagua

SEQ ID NO: 73236 - RNA, 22 nt, Homo sapiens
caucacaugcuuauuuuccuca

SEQ ID NO: 73237 - RNA, 19 nt, Homo sapiens
caucccugagcugaagugg

SEQ ID NO: 73238 - RNA, 22 nt, Homo sapiens
caugcacugaguccaccucugg

SEQ ID NO: 73239 - RNA, 22 nt, Homo sapiens
caugccacugcacuccaaccug

SEQ ID NO: 73240 - RNA, 19 nt, Homo sapiens
caugccacugcacuugagu

SEQ ID NO: 73241 - RNA, 22 nt, Homo sapiens
cauggcacagagaauguguucu

SEQ ID NO: 73242 - RNA, 22 nt, Homo sapiens
cauggcacuggugggagugucu

SEQ ID NO: 73243 - RNA, 22 nt, Homo sapiens
cauggcccugggcugggcgaac

SEQ ID NO: 73244 - RNA, 22 nt, Homo sapiens
cauggccuuuggaaugugucua

SEQ ID NO: 73245 - RNA, 22 nt, Homo sapiens
cauggcuuuaagcaacaccaag

SEQ ID NO: 73246 - RNA, 22 nt, Homo sapiens
cauggcuuucacaguaaagccu

SEQ ID NO: 73247 - RNA, 22 nt, Homo sapiens
cauggcuuuuauaacaagaaau

SEQ ID NO: 73248 - RNA, 22 nt, Homo sapiens
cauggucaccuuccaaguuauu

SEQ ID NO: 73249 - RNA, 19 nt, Homo sapiens
caugugcacuacuggcuuc

SEQ ID NO: 73250 - RNA, 22 nt, Homo sapiens
caugugcaugcuuucuuaugug

SEQ ID NO: 73251 - RNA, 22 nt, Homo sapiens
cauuccacauguaggacaauuu

SEQ ID NO: 73252 - RNA, 22 nt, Homo sapiens
cauugcaauccagccugggcaa

SEQ ID NO: 73253 - RNA, 22 nt, Homo sapiens
cauugcacuccagcccuggcaa

SEQ ID NO: 73254 - RNA, 22 nt, Homo sapiens
cauugcacuccagccuagccaa

SEQ ID NO: 73255 - RNA, 22 nt, Homo sapiens
cauugcacuccagccugaguga

SEQ ID NO: 73256 - RNA, 22 nt, Homo sapiens
cauugcacuccagccugcacga

SEQ ID NO: 73257 - RNA, 20 nt, Homo sapiens
cauugcacuccagccugcug

SEQ ID NO: 73258 - RNA, 22 nt, Homo sapiens
cauugcacuccagccugcugac

SEQ ID NO: 73259 - RNA, 22 nt, Homo sapiens
cauugcacuccagcuugggcga

SEQ ID NO: 73260 - RNA, 22 nt, Homo sapiens
cauugcacuccauccuuggcaa

SEQ ID NO: 73261 - RNA, 22 nt, Homo sapiens
cauugcacucuaucccgguggg

SEQ ID NO: 73262 - RNA, 22 nt, Homo sapiens
cauugcacucugcauuccaguc

SEQ ID NO: 73263 - RNA, 22 nt, Homo sapiens
cauugcacugcauucugggcaa

SEQ ID NO: 73264 - RNA, 22 nt, Homo sapiens
cauugcacugcuucuugggugu

SEQ ID NO: 73265 - RNA, 22 nt, Homo sapiens
cauugcaugccagccugggcaa

SEQ ID NO: 73266 - RNA, 22 nt, Homo sapiens
cauugguuaguuaacuuuaaga

SEQ ID NO: 73267 - RNA, 22 nt, Homo sapiens
cauugguuccaguuuguccuua

SEQ ID NO: 73268 - RNA, 22 nt, Homo sapiens
cauugguugaacagauuguguu

SEQ ID NO: 73269 - RNA, 22 nt, Homo sapiens
cauugguuggacaguucucucu

SEQ ID NO: 73270 - RNA, 22 nt, Homo sapiens
cauuugcacugagacucagcuu

SEQ ID NO: 73271 - RNA, 22 nt, Homo sapiens
cauuuugcaguuucugucucca

SEQ ID NO: 73272 - RNA, 22 nt, Homo sapiens
ccaaaguauuuucacugauauc

SEQ ID NO: 73273 - RNA, 22 nt, Homo sapiens
ccaaggcacugauucuguacuc

SEQ ID NO: 73274 - RNA, 22 nt, Homo sapiens
ccaaguguuuucauuguuccau

SEQ ID NO: 73275 - RNA, 22 nt, Homo sapiens
ccacacugucuuggugggaaac

SEQ ID NO: 73276 - RNA, 22 nt, Homo sapiens
ccacaguagucuugggaugggc

SEQ ID NO: 73277 - RNA, 22 nt, Homo sapiens
ccaccgggucccagcucugcuc

SEQ ID NO: 73278 - RNA, 22 nt, Homo sapiens
ccacugcacuccagcccggcaa

SEQ ID NO: 73279 - RNA, 22 nt, Homo sapiens
ccacuguuuaaauggcugagga

SEQ ID NO: 73280 - RNA, 22 nt, Homo sapiens
ccagaguucuaggcauuggaaa

SEQ ID NO: 73281 - RNA, 22 nt, Homo sapiens
ccagcaccauuuauuaaauagg

SEQ ID NO: 73282 - RNA, 22 nt, Homo sapiens
ccagcaccauuuguugaauagg

SEQ ID NO: 73283 - RNA, 22 nt, Homo sapiens
cuucaagucuuuggauaauuag

SEQ ID NO: 73284 - RNA, 22 nt, Homo sapiens
cuucaaguguggccaccugacc

SEQ ID NO: 73285 - RNA, 22 nt, Homo sapiens
cuucaugucuucaauggggggg

SEQ ID NO: 73286 - RNA, 22 nt, Homo sapiens
cuuccauaguauuuuuacaaaa

SEQ ID NO: 73287 - RNA, 22 nt, Homo sapiens
cuucuguuaguucugauaacuu

SEQ ID NO: 73288 - RNA, 22 nt, Homo sapiens
cuucuugagacuuaggcuuugg

SEQ ID NO: 73289 - RNA, 21 nt, Homo sapiens
cuucuuggggcagggcagggu

SEQ ID NO: 73290 - RNA, 22 nt, Homo sapiens
cuugacacugcaguuuuccugg

SEQ ID NO: 73291 - RNA, 22 nt, Homo sapiens
cuugacacugucacucaggcca

SEQ ID NO: 73292 - RNA, 22 nt, Homo sapiens
cuugacaucugucaguuccuca

SEQ ID NO: 73293 - RNA, 22 nt, Homo sapiens
cuugaccaauauggugaaaccc

SEQ ID NO: 73294 - RNA, 22 nt, Homo sapiens
cuugagcaaacaaaggugguag

SEQ ID NO: 73295 - RNA, 22 nt, Homo sapiens
cuugagcuugagauccuuucug

SEQ ID NO: 73296 - RNA, 22 nt, Homo sapiens
cuugcagagucauucuaauuuc

SEQ ID NO: 73297 - RNA, 22 nt, Homo sapiens
cuugccuacucacugguuuacu

SEQ ID NO: 73298 - RNA, 22 nt, Homo sapiens
cuuggcacugcucacccuccuu

SEQ ID NO: 73299 - RNA, 22 nt, Homo sapiens
cuuggcuagucaaaccuccccg

SEQ ID NO: 73300 - RNA, 22 nt, Homo sapiens
cuuggcuuguuguccccugcuc

SEQ ID NO: 73301 - RNA, 22 nt, Homo sapiens
cuugucacuguuggcuuuagaa

SEQ ID NO: 73302 - RNA, 22 nt, Homo sapiens
cuugucuugcacacgguugcca

SEQ ID NO: 73303 - RNA, 22 nt, Homo sapiens
cuugugcaugaccccagguggg

SEQ ID NO: 73304 - RNA, 22 nt, Homo sapiens
cuugugccugaucuuagggggc

SEQ ID NO: 73305 - RNA, 22 nt, Homo sapiens
cuuucugaggagaauagagaac

SEQ ID NO: 73306 - RNA, 18 nt, Homo sapiens
cuuugcagcuuccagagg

SEQ ID NO: 73307 - RNA, 22 nt, Homo sapiens
cuuuggauggaaccucucuuuc

SEQ ID NO: 73308 - RNA, 22 nt, Homo sapiens
cuuuggguauucucccuugggg

SEQ ID NO: 73309 - RNA, 22 nt, Homo sapiens
cuuuggucaauugcugcgggga

SEQ ID NO: 73310 - RNA, 22 nt, Homo sapiens
cuuuggucaauugcugugggga

SEQ ID NO: 73311 - RNA, 18 nt, Homo sapiens
cuuugguccccgcacccu

SEQ ID NO: 73312 - RNA, 22 nt, Homo sapiens
cuuuggugagggauaaauuuca

SEQ ID NO: 73313 - RNA, 22 nt, Homo sapiens
cuuuggugauagauaccccaua

SEQ ID NO: 73314 - RNA, 22 nt, Homo sapiens
cuuugguguauuuucagagacc

SEQ ID NO: 73315 - RNA, 22 nt, Homo sapiens
cuuugguucuguuuauaugcug

SEQ ID NO: 73316 - RNA, 22 nt, Homo sapiens
cuuugguugugcucuccacuuu

SEQ ID NO: 73317 - RNA, 22 nt, Homo sapiens
cuuugguuuacuuggugcuagu

SEQ ID NO: 73318 - RNA, 23 nt, Homo sapiens
cuuuguacagcuugacuacuggg

SEQ ID NO: 73319 - RNA, 22 nt, Homo sapiens
cuuugugcccuucugcccauca

SEQ ID NO: 73320 - RNA, 22 nt, Homo sapiens
cuuuguggggucuuuccucaaa

SEQ ID NO: 73321 - RNA, 22 nt, Homo sapiens
cuuuuggcuuaagauugucuug

SEQ ID NO: 73322 - RNA, 22 nt, Homo sapiens
cuuuuggucuaucagagaagca

SEQ ID NO: 73323 - RNA, 20 nt, Homo sapiens
gaaacaucuauccucuccuu

SEQ ID NO: 73324 - RNA, 21 nt, Homo sapiens
gaaauacugccuuaggagcug

SEQ ID NO: 73325 - RNA, 23 nt, Homo sapiens
gaaauguaagugaugccccacag

SEQ ID NO: 73326 - RNA, 22 nt, Homo sapiens
gaaauguauuaaugaguugaaa

SEQ ID NO: 73327 - RNA, 23 nt, Homo sapiens
gaaaugucuuagugaaauugcuu

SEQ ID NO: 73328 - RNA, 22 nt, Homo sapiens
gaaauguuuuucaugugggcaa

SEQ ID NO: 73329 - RNA, 22 nt, Homo sapiens
gaacuguaaagaaauucuaagg

SEQ ID NO: 73330 - RNA, 22 nt, Homo sapiens
gaacuuguguugcuucacaugu

SEQ ID NO: 73331 - RNA, 22 nt, Homo sapiens
gaacuuucuacauuaccucuuu

SEQ ID NO: 73332 - RNA, 22 nt, Homo sapiens
gaagaacuaggugagaucuaga

SEQ ID NO: 73333 - RNA, 22 nt, Homo sapiens
gaagacauuugcugcacguccu

SEQ ID NO: 73334 - RNA, 22 nt, Homo sapiens
gaagaucacacuguagaucuau

SEQ ID NO: 73335 - RNA, 22 nt, Homo sapiens
gaagauguugcuuaccuuggag

SEQ ID NO: 73336 - RNA, 22 nt, Homo sapiens
gaagcgaggugauuagcagaca

SEQ ID NO: 73337 - RNA, 22 nt, Homo sapiens
gaaggcacugugugccacccug

SEQ ID NO: 73338 - RNA, 22 nt, Homo sapiens
gaagguauauucuguuaaugcu

SEQ ID NO: 73339 - RNA, 22 nt, Homo sapiens
gaaguaauaaauggauucuuaa

SEQ ID NO: 73340 - RNA, 23 nt, Homo sapiens
gaaguauagcaugcacauggaaa

SEQ ID NO: 73341 - RNA, 22 nt, Homo sapiens
gaagugcaguggcacagucaug

SEQ ID NO: 73342 - RNA, 22 nt, Homo sapiens
gaagugguaggauugcuuuuga

SEQ ID NO: 73343 - RNA, 19 nt, Homo sapiens
gaaguguuguccuccagua

SEQ ID NO: 73344 - RNA, 17 nt, Homo sapiens
gaaguguuucuucauga

SEQ ID NO: 73345 - RNA, 22 nt, Homo sapiens
gaauagugcugcaaugaacaua

SEQ ID NO: 73346 - RNA, 22 nt, Homo sapiens
gaaucauuguuucuaaguuugu

SEQ ID NO: 73347 - RNA, 22 nt, Homo sapiens
gaaugaauguuuauccuuagau

SEQ ID NO: 73348 - RNA, 22 nt, Homo sapiens
gaaugcaugaggggaucagaug

SEQ ID NO: 73349 - RNA, 21 nt, Homo sapiens
gaauggcaccauuagcauaua

SEQ ID NO: 73350 - RNA, 22 nt, Homo sapiens
gaaugguuuacaaguguaaucu

SEQ ID NO: 73351 - RNA, 22 nt, Homo sapiens
gaaugucuuauugcucguugua

SEQ ID NO: 73352 - RNA, 22 nt, Homo sapiens
gacaagagaacacugcuauauu

SEQ ID NO: 73353 - RNA, 22 nt, Homo sapiens
gacaccauuucaguacuagguu

SEQ ID NO: 73354 - RNA, 22 nt, Homo sapiens
gacacuggguguuuguuggcgu

SEQ ID NO: 73355 - RNA, 22 nt, Homo sapiens
gacagguuuucuguuucugaaa

SEQ ID NO: 73356 - RNA, 22 nt, Homo sapiens
gacauagagccuugacuucauu

SEQ ID NO: 73357 - RNA, 21 nt, Homo sapiens
gacauggcgauacuccgucuc

SEQ ID NO: 73358 - RNA, 22 nt, Homo sapiens
gacauguuuucaagauuuauaa

SEQ ID NO: 73359 - RNA, 22 nt, Homo sapiens
gacauguuuucauguauuugga

SEQ ID NO: 73360 - RNA, 22 nt, Homo sapiens
gacauguuuuuuaagguuuaug

SEQ ID NO: 73361 - RNA, 22 nt, Homo sapiens
gacccucuagagggaagcgcuu

SEQ ID NO: 73362 - RNA, 22 nt, Homo sapiens
gacccucuagauggaagcacug

SEQ ID NO: 73363 - RNA, 22 nt, Homo sapiens
gacccuguugggguuuagggcu

SEQ ID NO: 73364 - RNA, 22 nt, Homo sapiens
gacuagaaauuauuuagugagc

SEQ ID NO: 73365 - RNA, 22 nt, Homo sapiens
gacuagauauuguucuauguca

SEQ ID NO: 73366 - RNA, 22 nt, Homo sapiens
gacuaggagauauguuuucuuc

SEQ ID NO: 73367 - RNA, 22 nt, Homo sapiens
gacucagucuuggauuuuuaau

SEQ ID NO: 73368 - RNA, 18 nt, Homo sapiens
gacucaguuucuaaggca

SEQ ID NO: 73369 - RNA, 19 nt, Homo sapiens
gacuccagaguugugugcu

SEQ ID NO: 73370 - RNA, 18 nt, Homo sapiens
gacuccauuucagccaga

SEQ ID NO: 73371 - RNA, 22 nt, Homo sapiens
gacucgagggcauaagagcuuu

SEQ ID NO: 73372 - RNA, 22 nt, Homo sapiens
gacugaggaagcgcucucuccu

SEQ ID NO: 73373 - RNA, 22 nt, Homo sapiens
gacuggccauugauacagaggu

SEQ ID NO: 73374 - RNA, 22 nt, Homo sapiens
gagaacauuaauaguuaauuuu

SEQ ID NO: 73375 - RNA, 22 nt, Homo sapiens
gagaacauuuaagccacucagg

SEQ ID NO: 73376 - RNA, 22 nt, Homo sapiens
gagaacugagauaagugauauu

SEQ ID NO: 73377 - RNA, 20 nt, Homo sapiens
gagaacugagaugcguuuga

SEQ ID NO: 73378 - RNA, 22 nt, Homo sapiens
gagaaguaaauuuauuugcaaa

SEQ ID NO: 73379 - RNA, 22 nt, Homo sapiens
gagacauguuugccaauaauuu

SEQ ID NO: 73380 - RNA, 23 nt, Homo sapiens
gagaccagcuucagaaagcacga

SEQ ID NO: 73381 - RNA, 22 nt, Homo sapiens
gagacuaaagagcuugcccugg

SEQ ID NO: 73382 - RNA, 22 nt, Homo sapiens
gagacugagucucgcucugccg

SEQ ID NO: 73383 - RNA, 22 nt, Homo sapiens
gagacugagucuugcucuguca

SEQ ID NO: 73384 - RNA, 22 nt, Homo sapiens
gagagugcuuggcaucugcuga

SEQ ID NO: 73385 - RNA, 22 nt, Homo sapiens
gagauacacccagugcagaggc

SEQ ID NO: 73386 - RNA, 22 nt, Homo sapiens
gagauagguauuucauuuaccc

SEQ ID NO: 73387 - RNA, 22 nt, Homo sapiens
gagaucaaugccuauggcuuuc

SEQ ID NO: 73388 - RNA, 22 nt, Homo sapiens
gagaucauguacuagaacaccu

SEQ ID NO: 73389 - RNA, 22 nt, Homo sapiens
gagaucuuuaagaacuacugcu

SEQ ID NO: 73390 - RNA, 22 nt, Homo sapiens
gagaugcaccuugucacguuuc

SEQ ID NO: 73391 - RNA, 22 nt, Homo sapiens
gagauggaguuucacuucgcuc

SEQ ID NO: 73392 - RNA, 22 nt, Homo sapiens
gagauguaagaauuuauuuguu

SEQ ID NO: 73393 - RNA, 22 nt, Homo sapiens
gagaugucuauuucagagaugu

SEQ ID NO: 73394 - RNA, 22 nt, Homo sapiens
gagauuaacauuugaggagcug

SEQ ID NO: 73395 - RNA, 22 nt, Homo sapiens
gagcaguugagagugcuggcca

SEQ ID NO: 73396 - RNA, 22 nt, Homo sapiens
gagcaucaguggccucaucuca

SEQ ID NO: 73397 - RNA, 22 nt, Homo sapiens
gagcuacauggauagucugcau

SEQ ID NO: 73398 - RNA, 21 nt, Homo sapiens
gagcuaggugaggcuguaaug

SEQ ID NO: 73399 - RNA, 22 nt, Homo sapiens
gagcuagguuuugaauccagac

SEQ ID NO: 73400 - RNA, 22 nt, Homo sapiens
gagcuaguguaauauuuugggg

SEQ ID NO: 73401 - RNA, 22 nt, Homo sapiens
gagcugaaguuuccauuuguac

SEQ ID NO: 73402 - RNA, 22 nt, Homo sapiens
gagcugccuugccuaugcaaga

SEQ ID NO: 73403 - RNA, 22 nt, Homo sapiens
gagcuggacuucuuaccuuuuc

SEQ ID NO: 73404 - RNA, 22 nt, Homo sapiens
gagcuuggguuaaaguugccuu

SEQ ID NO: 73405 - RNA, 22 nt, Homo sapiens
gaggaaguaauuuuaggccugu

SEQ ID NO: 73406 - RNA, 22 nt, Homo sapiens
gaggaaguagcuacugucuuuc

SEQ ID NO: 73407 - RNA, 22 nt, Homo sapiens
gaggagauauucugcuggaugg

SEQ ID NO: 73408 - RNA, 22 nt, Homo sapiens
gaggagucagacugugcaaggu

SEQ ID NO: 73409 - RNA, 22 nt, Homo sapiens
gaggcaaguggccaccgagucu

SEQ ID NO: 73410 - RNA, 22 nt, Homo sapiens
gaggcaaugugcccggcccaca

SEQ ID NO: 73411 - RNA, 22 nt, Homo sapiens
gaggcagucuguccauucucag

SEQ ID NO: 73412 - RNA, 22 nt, Homo sapiens
gaggcagucugucccuuagcag

SEQ ID NO: 73413 - RNA, 22 nt, Homo sapiens
gaggcggugugaugucacaugc

SEQ ID NO: 73414 - RNA, 22 nt, Homo sapiens
gagguaaguggauuaugagguc

SEQ ID NO: 73415 - RNA, 21 nt, Homo sapiens
gagguaccucauguaagugga

SEQ ID NO: 73416 - RNA, 22 nt, Homo sapiens
gagguagagacuauguauuaga

SEQ ID NO: 73417 - RNA, 22 nt, Homo sapiens
gagguagagaguuuugauucug

SEQ ID NO: 73418 - RNA, 22 nt, Homo sapiens
gagguaggggccuuaaagaugc

SEQ ID NO: 73419 - RNA, 22 nt, Homo sapiens
gagguaguuaaugcauucacua

SEQ ID NO: 73420 - RNA, 17 nt, Homo sapiens
gagguaguuuacuuuca

SEQ ID NO: 73421 - RNA, 22 nt, Homo sapiens
gaggucauguggcaggcagcca

SEQ ID NO: 73422 - RNA, 22 nt, Homo sapiens
gagguggauacauuaaauaaug

SEQ ID NO: 73423 - RNA, 22 nt, Homo sapiens
gaggugguagguucacagcagc

SEQ ID NO: 73424 - RNA, 22 nt, Homo sapiens
gagguggugguggaggcauagc

SEQ ID NO: 73425 - RNA, 22 nt, Homo sapiens
gagguugggaugagggauacag

SEQ ID NO: 73426 - RNA, 22 nt, Homo sapiens
gaguaaaugucacuguugcugu

SEQ ID NO: 73427 - RNA, 23 nt, Homo sapiens
gaguacauuaaaagcccagacug

SEQ ID NO: 73428 - RNA, 22 nt, Homo sapiens
gaguagugcugcaguaaacaua

SEQ ID NO: 73429 - RNA, 22 nt, Homo sapiens
gaguauuuuacaucguguaauu

SEQ ID NO: 73430 - RNA, 23 nt, Homo sapiens
gagugcaaugacaugaucucgga

SEQ ID NO: 73431 - RNA, 22 nt, Homo sapiens
gagugcaauggcaccgucucgg

SEQ ID NO: 73432 - RNA, 22 nt, Homo sapiens
gagugcaauggcgcgaucucgg

SEQ ID NO: 73433 - RNA, 22 nt, Homo sapiens
gagugcaauggugcuaucucgg

SEQ ID NO: 73434 - RNA, 23 nt, Homo sapiens
gaguggagacucauugauuuccu

SEQ ID NO: 73435 - RNA, 22 nt, Homo sapiens
gagugguucuauauguaauugg

SEQ ID NO: 73436 - RNA, 22 nt, Homo sapiens
gaguuacauuguaauugccgag

SEQ ID NO: 73437 - RNA, 22 nt, Homo sapiens
gaguucaauuuccagcuguucu

SEQ ID NO: 73438 - RNA, 22 nt, Homo sapiens
gaguucauaucuaugagugugc

SEQ ID NO: 73439 - RNA, 22 nt, Homo sapiens
gauaaagauagcaauagggaca

SEQ ID NO: 73440 - RNA, 22 nt, Homo sapiens
gauaaaguauuggguacuaugc

SEQ ID NO: 73441 - RNA, 18 nt, Homo sapiens
gauaacaguggacuaugc

SEQ ID NO: 73442 - RNA, 22 nt, Homo sapiens
gauacuggcuuuauagaaugau

SEQ ID NO: 73443 - RNA, 22 nt, Homo sapiens
gauagcagccauucuuuuuauu

SEQ ID NO: 73444 - RNA, 21 nt, Homo sapiens
gauaugacauggguaaaacca

SEQ ID NO: 73445 - RNA, 22 nt, Homo sapiens
gauaugaguagucgcauugaug

SEQ ID NO: 73446 - RNA, 22 nt, Homo sapiens
gauauguaguaguugaaaaaga

SEQ ID NO: 73447 - RNA, 22 nt, Homo sapiens
gauauguguaucuauguacaug

SEQ ID NO: 73448 - RNA, 22 nt, Homo sapiens
gauauguugaguagaguuuuug

SEQ ID NO: 73449 - RNA, 22 nt, Homo sapiens
gaucacauuguuucauacauau

SEQ ID NO: 73450 - RNA, 22 nt, Homo sapiens
gaucagagugaaccuuguuaug

SEQ ID NO: 73451 - RNA, 22 nt, Homo sapiens
gaucaguuucuggagauacgua

SEQ ID NO: 73452 - RNA, 20 nt, Homo sapiens
gaucaguuuggaguaagugc

SEQ ID NO: 73453 - RNA, 22 nt, Homo sapiens
gaucauggaguuggguucaagg

SEQ ID NO: 73454 - RNA, 22 nt, Homo sapiens
gaucucaguggauacugugaug

SEQ ID NO: 73455 - RNA, 22 nt, Homo sapiens
gaucugagaaagugucauaaca

SEQ ID NO: 73456 - RNA, 22 nt, Homo sapiens
gaucugugugauuggaugcauu

SEQ ID NO: 73457 - RNA, 22 nt, Homo sapiens
gaugacagcugacucccuugcu

SEQ ID NO: 73458 - RNA, 22 nt, Homo sapiens
gaugauguugaauguucucacc

SEQ ID NO: 73459 - RNA, 22 nt, Homo sapiens
gaugcaaauuaagcuugggaca

SEQ ID NO: 73460 - RNA, 22 nt, Homo sapiens
gaugccuauugcuaguccuaaa

SEQ ID NO: 73461 - RNA, 22 nt, Homo sapiens
gauggcacuaagccauguagga

SEQ ID NO: 73462 - RNA, 22 nt, Homo sapiens
gauggcacuguagcaacacaaa

SEQ ID NO: 73463 - RNA, 22 nt, Homo sapiens
gauggcauuucuggaucugaca

SEQ ID NO: 73464 - RNA, 22 nt, Homo sapiens
gauggguuuuuugaagacagca

SEQ ID NO: 73465 - RNA, 22 nt, Homo sapiens
gaugguggucuacccuuucccu

SEQ ID NO: 73466 - RNA, 22 nt, Homo sapiens
gaugguuuucaccugcaugcuu

SEQ ID NO: 73467 - RNA, 22 nt, Homo sapiens
gauguagaaagagugggcugga

SEQ ID NO: 73468 - RNA, 22 nt, Homo sapiens
gauguguuuccaggauuuguuu

SEQ ID NO: 73469 - RNA, 22 nt, Homo sapiens
gauuagaacagaagucagauua

SEQ ID NO: 73470 - RNA, 22 nt, Homo sapiens
gauuagagaaauacugcugcua

SEQ ID NO: 73471 - RNA, 22 nt, Homo sapiens
gauuccacuuacuuagcauucc

SEQ ID NO: 73472 - RNA, 22 nt, Homo sapiens
gauuccacuuucaaauucaaau

SEQ ID NO: 73473 - RNA, 22 nt, Homo sapiens
augaagcuagcugauugcugau

SEQ ID NO: 73474 - RNA, 18 nt, Homo sapiens
augaagucaucacuuuua

SEQ ID NO: 73475 - RNA, 22 nt, Homo sapiens
augaagucguuacuaccaauug

SEQ ID NO: 73476 - RNA, 22 nt, Homo sapiens
augaaguguguguucaagucuu

SEQ ID NO: 73477 - RNA, 22 nt, Homo sapiens
augaauccauuccugccacaga

SEQ ID NO: 73478 - RNA, 22 nt, Homo sapiens
augaaugcaucuaucaaagcau

SEQ ID NO: 73479 - RNA, 22 nt, Homo sapiens
augaaugcuuuuggauguaucu

SEQ ID NO: 73480 - RNA, 22 nt, Homo sapiens
augaaugucuuauuuugagaaa

SEQ ID NO: 73481 - RNA, 22 nt, Homo sapiens
augacaagagccuucuuuccuu

SEQ ID NO: 73482 - RNA, 22 nt, Homo sapiens
augacaagaguguucagggaga

SEQ ID NO: 73483 - RNA, 22 nt, Homo sapiens
augacaaugaaucccuguuuca

SEQ ID NO: 73484 - RNA, 23 nt, Homo sapiens
augacacuguccuugaccauuuc

SEQ ID NO: 73485 - RNA, 22 nt, Homo sapiens
augacauugaaaagcaagugga

SEQ ID NO: 73486 - RNA, 22 nt, Homo sapiens
augaccaaugggcagagcuaga

SEQ ID NO: 73487 - RNA, 22 nt, Homo sapiens
augacccugaccuaagccaauc

SEQ ID NO: 73488 - RNA, 18 nt, Homo sapiens
augaccugcggguuauau

SEQ ID NO: 73489 - RNA, 22 nt, Homo sapiens
augacuagaggagggauggcca

SEQ ID NO: 73490 - RNA, 22 nt, Homo sapiens
augacuggaacagcaauuuaca

SEQ ID NO: 73491 - RNA, 22 nt, Homo sapiens
augacuggauaauggacacaca

SEQ ID NO: 73492 - RNA, 22 nt, Homo sapiens
augacuuuucugaaaaccacca

SEQ ID NO: 73493 - RNA, 19 nt, Homo sapiens
augagaacagacuccauuu

SEQ ID NO: 73494 - RNA, 22 nt, Homo sapiens
augagaaucauuucagcuugua

SEQ ID NO: 73495 - RNA, 22 nt, Homo sapiens
augagaaugaagccuggcgugu

SEQ ID NO: 73496 - RNA, 22 nt, Homo sapiens
augagaaugauucuguuauggu

SEQ ID NO: 73497 - RNA, 22 nt, Homo sapiens
augagacuguucuuccucauug

SEQ ID NO: 73498 - RNA, 22 nt, Homo sapiens
augagauaggaacaaacuuaca

SEQ ID NO: 73499 - RNA, 22 nt, Homo sapiens
augagauauguuaaaaguuaaa

SEQ ID NO: 73500 - RNA, 22 nt, Homo sapiens
augagauauuuuauaagaucau

SEQ ID NO: 73501 - RNA, 22 nt, Homo sapiens
augagaugaauaccgacgaugu

SEQ ID NO: 73502 - RNA, 22 nt, Homo sapiens
augagauuguuuguacuccaca

SEQ ID NO: 73503 - RNA, 22 nt, Homo sapiens
augagcuauggagacagggcca

SEQ ID NO: 73504 - RNA, 22 nt, Homo sapiens
augagcuauggagcucccaccu

SEQ ID NO: 73505 - RNA, 17 nt, Homo sapiens
augagcucaucauuuuu

SEQ ID NO: 73506 - RNA, 20 nt, Homo sapiens
augagcucaucuugaaaacc

SEQ ID NO: 73507 - RNA, 22 nt, Homo sapiens
augagguauccaagcccagaaa

SEQ ID NO: 73508 - RNA, 22 nt, Homo sapiens
augagguccuagccaacuuuuu

SEQ ID NO: 73509 - RNA, 22 nt, Homo sapiens
augaggugaguaaauaaaugaa

SEQ ID NO: 73510 - RNA, 22 nt, Homo sapiens
augaggugauaucuggaaauua

SEQ ID NO: 73511 - RNA, 22 nt, Homo sapiens
augaguaguugcuaaauauuga

SEQ ID NO: 73512 - RNA, 22 nt, Homo sapiens
augagucacuuauuauuggggu

SEQ ID NO: 73513 - RNA, 15 nt, Homo sapiens
augaguuuuauggag

SEQ ID NO: 73514 - RNA, 22 nt, Homo sapiens
augauacuggcuucauagaaug

SEQ ID NO: 73515 - RNA, 22 nt, Homo sapiens
augauauggguugucaguugua

SEQ ID NO: 73516 - RNA, 22 nt, Homo sapiens
augaucacaccacugcacucca

SEQ ID NO: 73517 - RNA, 22 nt, Homo sapiens
augaucauggaaguuuuccugu

SEQ ID NO: 73518 - RNA, 22 nt, Homo sapiens
augaugcaguacuuugggaaca

SEQ ID NO: 73519 - RNA, 22 nt, Homo sapiens
augauggaggccgugauggacg

SEQ ID NO: 73520 - RNA, 22 nt, Homo sapiens
augauuagaacucauuuccagg

SEQ ID NO: 73521 - RNA, 22 nt, Homo sapiens
augauucugaucuagagcuugg

SEQ ID NO: 73522 - RNA, 22 nt, Homo sapiens
augauugugaauaugugguuuu

SEQ ID NO: 73523 - RNA, 22 nt, Homo sapiens
augauuuuuguaucgccugaug

SEQ ID NO: 73524 - RNA, 22 nt, Homo sapiens
augcaaacagcuaucuggcugg

SEQ ID NO: 73525 - RNA, 22 nt, Homo sapiens
augcaaacaucugaagagacau

SEQ ID NO: 73526 - RNA, 22 nt, Homo sapiens
augcaacuugaaauuuuccgga

SEQ ID NO: 73527 - RNA, 22 nt, Homo sapiens
augcaagacaccgauuagcuuu

SEQ ID NO: 73528 - RNA, 22 nt, Homo sapiens
augcaagcacacaagaggaaau

SEQ ID NO: 73529 - RNA, 22 nt, Homo sapiens
augcacaguccagcccaugugg

SEQ ID NO: 73530 - RNA, 22 nt, Homo sapiens
augcacaucagcuccagggacc

SEQ ID NO: 73531 - RNA, 22 nt, Homo sapiens
augcacauggcuaacuuuuuuc

SEQ ID NO: 73532 - RNA, 22 nt, Homo sapiens
augcagagucccagccccuagc

SEQ ID NO: 73533 - RNA, 22 nt, Homo sapiens
augcauaugucuuuauaguggc

SEQ ID NO: 73534 - RNA, 22 nt, Homo sapiens
augcauggagucuuucacaagu

SEQ ID NO: 73535 - RNA, 22 nt, Homo sapiens
augcauggucugaagucaaccu

SEQ ID NO: 73536 - RNA, 19 nt, Homo sapiens
augccacagugaggucaga

SEQ ID NO: 73537 - RNA, 22 nt, Homo sapiens
augcccauuuguuuucugaaag

SEQ ID NO: 73538 - RNA, 22 nt, Homo sapiens
augccuaagacccuguggggga

SEQ ID NO: 73539 - RNA, 19 nt, Homo sapiens
augccucaguuuuguacuu

SEQ ID NO: 73540 - RNA, 22 nt, Homo sapiens
augcuacauucuacaauuaggc

SEQ ID NO: 73541 - RNA, 22 nt, Homo sapiens
augcuggugcuagaaacuggaa

SEQ ID NO: 73542 - RNA, 22 nt, Homo sapiens
augcuguuuuguagcucccucu

SEQ ID NO: 73543 - RNA, 22 nt, Homo sapiens
augcuuguugcagccugagccu

SEQ ID NO: 73544 - RNA, 21 nt, Homo sapiens
auggaaagacugccucuucaa

SEQ ID NO: 73545 - RNA, 22 nt, Homo sapiens
auggaagcugauuagauaguac

SEQ ID NO: 73546 - RNA, 22 nt, Homo sapiens
auggaaggagaauggucuuuga

SEQ ID NO: 73547 - RNA, 22 nt, Homo sapiens
auggacagaaaaaaauagaugu

SEQ ID NO: 73548 - RNA, 22 nt, Homo sapiens
auggacucauugaauuaagucc

SEQ ID NO: 73549 - RNA, 22 nt, Homo sapiens
auggagagaauuauucucucag

SEQ ID NO: 73550 - RNA, 22 nt, Homo sapiens
auggaucuuucugcuuuugaau

SEQ ID NO: 73551 - RNA, 22 nt, Homo sapiens
auggauugucuccuugugccau

SEQ ID NO: 73552 - RNA, 22 nt, Homo sapiens
auggcaaugcgaugaugacuga

SEQ ID NO: 73553 - RNA, 22 nt, Homo sapiens
auggcacuaaguucaacacuua

SEQ ID NO: 73554 - RNA, 22 nt, Homo sapiens
auggcacucaaucaaguugaga

SEQ ID NO: 73555 - RNA, 22 nt, Homo sapiens
auggcacuccagccugggcaac

SEQ ID NO: 73556 - RNA, 22 nt, Homo sapiens
auggcacuguguccugggguca

SEQ ID NO: 73557 - RNA, 22 nt, Homo sapiens
auggcacuuuggacugcuagau

SEQ ID NO: 73558 - RNA, 22 nt, Homo sapiens
auggcagaaucaagccgacagc

SEQ ID NO: 73559 - RNA, 22 nt, Homo sapiens
auggcagcugacacuuccgucu

SEQ ID NO: 73560 - RNA, 22 nt, Homo sapiens
auggcagugagucucuaguauu

SEQ ID NO: 73561 - RNA, 22 nt, Homo sapiens
auggcaguuucagcuauaguuu

SEQ ID NO: 73562 - RNA, 22 nt, Homo sapiens
auggcauugaagaguugucccu

SEQ ID NO: 73563 - RNA, 22 nt, Homo sapiens
auggcccaguuugcuaucccua

SEQ ID NO: 73564 - RNA, 22 nt, Homo sapiens
auggcccugcuaccacuuuucu

SEQ ID NO: 73565 - RNA, 22 nt, Homo sapiens
auggccugaugcaccuguccca

SEQ ID NO: 73566 - RNA, 22 nt, Homo sapiens
auggccuuguauaccuggcaaa

SEQ ID NO: 73567 - RNA, 22 nt, Homo sapiens
auggcucuguuccaugugucuu

SEQ ID NO: 73568 - RNA, 16 nt, Homo sapiens
agcagguguuagguga

SEQ ID NO: 73569 - RNA, 22 nt, Homo sapiens
agcauagugccuugaaaacaau

SEQ ID NO: 73570 - RNA, 22 nt, Homo sapiens
agcaucacacacuacagggaaa

SEQ ID NO: 73571 - RNA, 22 nt, Homo sapiens
agcaucacaugggcugcuuggg

SEQ ID NO: 73572 - RNA, 22 nt, Homo sapiens
agccaguauuuccacagagugg

SEQ ID NO: 73573 - RNA, 21 nt, Homo sapiens
agccaguguuccuuguggcuc

SEQ ID NO: 73574 - RNA, 22 nt, Homo sapiens
agccauacaacguaugcaugua

SEQ ID NO: 73575 - RNA, 22 nt, Homo sapiens
agccuucauucugacaguagga

SEQ ID NO: 73576 - RNA, 22 nt, Homo sapiens
agcggcuguuccccuggucuau

SEQ ID NO: 73577 - RNA, 22 nt, Homo sapiens
agcuaaaucucauguugaauug

SEQ ID NO: 73578 - RNA, 21 nt, Homo sapiens
agcuaaauuggaaauuucugu

SEQ ID NO: 73579 - RNA, 22 nt, Homo sapiens
agcuaacauuuuuccucuucca

SEQ ID NO: 73580 - RNA, 22 nt, Homo sapiens
agcuagcauucauaguuugagg

SEQ ID NO: 73581 - RNA, 22 nt, Homo sapiens
agcuaguggucauucaauccuu

SEQ ID NO: 73582 - RNA, 22 nt, Homo sapiens
agcuagugugauucuuuggggu

SEQ ID NO: 73583 - RNA, 22 nt, Homo sapiens
agcuccuuucugcaggcagguc

SEQ ID NO: 73584 - RNA, 22 nt, Homo sapiens
agcucuuguuaguauuagcagu

SEQ ID NO: 73585 - RNA, 22 nt, Homo sapiens
agcugcacgugguaaauguaaa

SEQ ID NO: 73586 - RNA, 22 nt, Homo sapiens
agcugcauuuacuuuugcacaa

SEQ ID NO: 73587 - RNA, 22 nt, Homo sapiens
agcuggacuugauaaaugaaua

SEQ ID NO: 73588 - RNA, 22 nt, Homo sapiens
agcuggauguauguuaagugaa

SEQ ID NO: 73589 - RNA, 22 nt, Homo sapiens
agcuggauguggaugacccugu

SEQ ID NO: 73590 - RNA, 22 nt, Homo sapiens
agcuggucucaggugcccugcu

SEQ ID NO: 73591 - RNA, 21 nt, Homo sapiens
agcugguuucuucuuacuccu

SEQ ID NO: 73592 - RNA, 22 nt, Homo sapiens
agcugugucuucuuaaagauuu

SEQ ID NO: 73593 - RNA, 20 nt, Homo sapiens
agcuguuguuaaaaaggagg

SEQ ID NO: 73594 - RNA, 20 nt, Homo sapiens
agcuugguuuggaugaucac

SEQ ID NO: 73595 - RNA, 22 nt, Homo sapiens
agcuuguggugaauacugcuag

SEQ ID NO: 73596 - RNA, 21 nt, Homo sapiens
agcuuguguguaucacagugu

SEQ ID NO: 73597 - RNA, 22 nt, Homo sapiens
agcuuguguuugucugccuggg

SEQ ID NO: 73598 - RNA, 22 nt, Homo sapiens
agcuuuuugggaggccuuagga

SEQ ID NO: 73599 - RNA, 22 nt, Homo sapiens
aggaaaucuuagcugaggggau

SEQ ID NO: 73600 - RNA, 21 nt, Homo sapiens
aggaagacuaugaucaauugg

SEQ ID NO: 73601 - RNA, 22 nt, Homo sapiens
aggaaguaauaaguuugguucu

SEQ ID NO: 73602 - RNA, 22 nt, Homo sapiens
aggaagugucuucuuuuaggca

SEQ ID NO: 73603 - RNA, 18 nt, Homo sapiens
aggaaugguaauacuuca

SEQ ID NO: 73604 - RNA, 22 nt, Homo sapiens
aggaaugucaaugguaguuuaa

SEQ ID NO: 73605 - RNA, 22 nt, Homo sapiens
aggaauguuaguacuucuuagu

SEQ ID NO: 73606 - RNA, 22 nt, Homo sapiens
aggacacugagcaugggagguu

SEQ ID NO: 73607 - RNA, 22 nt, Homo sapiens
aggaccauuguguagcagacau

SEQ ID NO: 73608 - RNA, 22 nt, Homo sapiens
aggaccccucaucagcaccagu

SEQ ID NO: 73609 - RNA, 19 nt, Homo sapiens
aggacuaaagacuagaagu

SEQ ID NO: 73610 - RNA, 22 nt, Homo sapiens
aggagaugaagcuuuaucuaaa

SEQ ID NO: 73611 - RNA, 22 nt, Homo sapiens
aggagcacaauggucaugugga

SEQ ID NO: 73612 - RNA, 22 nt, Homo sapiens
aggagcacuggccuuggaguca

SEQ ID NO: 73613 - RNA, 20 nt, Homo sapiens
aggagcauuuacauuggcuc

SEQ ID NO: 73614 - RNA, 23 nt, Homo sapiens
aggagcuuagaaguugccauugc

SEQ ID NO: 73615 - RNA, 22 nt, Homo sapiens
aggagcuuuggggaaaacagau

SEQ ID NO: 73616 - RNA, 22 nt, Homo sapiens
aggagguagaacauugccauuu

SEQ ID NO: 73617 - RNA, 22 nt, Homo sapiens
aggagguagggugugaaacagc

SEQ ID NO: 73618 - RNA, 22 nt, Homo sapiens
aggagguagucugucccuuagc

SEQ ID NO: 73619 - RNA, 22 nt, Homo sapiens
aggaguguguauuaaugaaauu

SEQ ID NO: 73620 - RNA, 22 nt, Homo sapiens
aggauuagagacuucucuaccu

SEQ ID NO: 73621 - RNA, 21 nt, Homo sapiens
aggcaaaugaagcagccgcuc

SEQ ID NO: 73622 - RNA, 22 nt, Homo sapiens
aggcaagaaugcuuguuucacc

SEQ ID NO: 73623 - RNA, 22 nt, Homo sapiens
aggcaagagugacuacgugaaa

SEQ ID NO: 73624 - RNA, 21 nt, Homo sapiens
aggcaagauuacuuacgagca

SEQ ID NO: 73625 - RNA, 22 nt, Homo sapiens
aggcaagcaucuugcucccuuc

SEQ ID NO: 73626 - RNA, 22 nt, Homo sapiens
aggcaaugugagaguuuauuca

SEQ ID NO: 73627 - RNA, 22 nt, Homo sapiens
aggcagaugagguccucagcug

SEQ ID NO: 73628 - RNA, 22 nt, Homo sapiens
aggcaguuucagugagagguga

SEQ ID NO: 73629 - RNA, 22 nt, Homo sapiens
aggcaugaguucagaggguaug

SEQ ID NO: 73630 - RNA, 22 nt, Homo sapiens
aggcaugguggcacauacaugu

SEQ ID NO: 73631 - RNA, 19 nt, Homo sapiens
aggcauugugcucaucugu

SEQ ID NO: 73632 - RNA, 23 nt, Homo sapiens
aggccaguuuuuccugcuugcug

SEQ ID NO: 73633 - RNA, 22 nt, Homo sapiens
aggcuguguggauaauauuggg

SEQ ID NO: 73634 - RNA, 22 nt, Homo sapiens
agggaagugugcuaugcauuua

SEQ ID NO: 73635 - RNA, 22 nt, Homo sapiens
agggcacuguagguccugccuc

SEQ ID NO: 73636 - RNA, 22 nt, Homo sapiens
aggguaguaggcuugggauugg

SEQ ID NO: 73637 - RNA, 22 nt, Homo sapiens
agguaaacauggggacugcuac

SEQ ID NO: 73638 - RNA, 22 nt, Homo sapiens
agguaagaugugacuugguguu

SEQ ID NO: 73639 - RNA, 22 nt, Homo sapiens
agguaauagcacaugauaccuu

SEQ ID NO: 73640 - RNA, 22 nt, Homo sapiens
agguaauuuuaucauuauguga

SEQ ID NO: 73641 - RNA, 22 nt, Homo sapiens
agguagcauagcgggaauauca

SEQ ID NO: 73642 - RNA, 22 nt, Homo sapiens
agguagugugaugcuccuguuu

SEQ ID NO: 73643 - RNA, 20 nt, Homo sapiens
agguaguuauacaaaugugu

SEQ ID NO: 73644 - RNA, 22 nt, Homo sapiens
agguauauuggacagauguaaa

SEQ ID NO: 73645 - RNA, 22 nt, Homo sapiens
agguauguaugucuguacagcg

SEQ ID NO: 73646 - RNA, 22 nt, Homo sapiens
agguauuuucaacuuagaaugg

SEQ ID NO: 73647 - RNA, 22 nt, Homo sapiens
agguccauugguauuauagcau

SEQ ID NO: 73648 - RNA, 22 nt, Homo sapiens
aggugaaugcucacauucuaau

SEQ ID NO: 73649 - RNA, 22 nt, Homo sapiens
aggugaauggauaaacuguggg

SEQ ID NO: 73650 - RNA, 22 nt, Homo sapiens
aggugcuauauuucgaggauag

SEQ ID NO: 73651 - RNA, 22 nt, Homo sapiens
aggugcugagcagagaauccug

SEQ ID NO: 73652 - RNA, 20 nt, Homo sapiens
agguuauuauaauuagaaga

SEQ ID NO: 73653 - RNA, 20 nt, Homo sapiens
agguucaaaucccaaucaug

SEQ ID NO: 73654 - RNA, 22 nt, Homo sapiens
agguuguugcaugcuccuuagg

SEQ ID NO: 73655 - RNA, 22 nt, Homo sapiens
agguuuucagccccagccuagg

SEQ ID NO: 73656 - RNA, 22 nt, Homo sapiens
aguaaagcaucagcuagaugug

SEQ ID NO: 73657 - RNA, 22 nt, Homo sapiens
aguaaagcuacucacugugggc

SEQ ID NO: 73658 - RNA, 22 nt, Homo sapiens
aguaaaucacuaauggcuuccg

SEQ ID NO: 73659 - RNA, 22 nt, Homo sapiens
aguaaauuucugugcuuucaua

SEQ ID NO: 73660 - RNA, 22 nt, Homo sapiens
aguaacaggauccaaagaaugu

SEQ ID NO: 73661 - RNA, 22 nt, Homo sapiens
aguacugucugguuaccugaca

SEQ ID NO: 73662 - RNA, 22 nt, Homo sapiens
aguaucacaggcaaaacagaau

SEQ ID NO: 73663 - RNA, 22 nt, Homo sapiens
agugcauaugucuuuuuggaag

SEQ ID NO: 73664 - RNA, 22 nt, Homo sapiens
agugcauugagacuugugaguu

SEQ ID NO: 73665 - RNA, 22 nt, Homo sapiens
agugcauuuguucugugucagg

SEQ ID NO: 73666 - RNA, 22 nt, Homo sapiens
agugccauggcugcuagauggc

SEQ ID NO: 73667 - RNA, 22 nt, Homo sapiens
agugccuacuauguagaugcug

SEQ ID NO: 73668 - RNA, 23 nt, Homo sapiens
agugccuaguauauaggaggcgc

SEQ ID NO: 73669 - RNA, 22 nt, Homo sapiens
agugcuuaauagauguccagca

SEQ ID NO: 73670 - RNA, 22 nt, Homo sapiens
agugcuuguacaaaccccgagg

SEQ ID NO: 73671 - RNA, 22 nt, Homo sapiens
aguggaauuaagaaacugaauu

SEQ ID NO: 73672 - RNA, 22 nt, Homo sapiens
aguggaguguaaagcgucuuuu

SEQ ID NO: 73673 - RNA, 22 nt, Homo sapiens
aguggauuuuagacugagauuu

SEQ ID NO: 73674 - RNA, 22 nt, Homo sapiens
agugguaguacaggagauaccg

SEQ ID NO: 73675 - RNA, 22 nt, Homo sapiens
aguggugucugaguggccaggg

SEQ ID NO: 73676 - RNA, 20 nt, Homo sapiens
agugguuuucaaauaugucu

SEQ ID NO: 73677 - RNA, 22 nt, Homo sapiens
agugguuuuggaauggaauuca

SEQ ID NO: 73678 - RNA, 22 nt, Homo sapiens
agugucaggagacagguagcug

SEQ ID NO: 73679 - RNA, 22 nt, Homo sapiens
aguguuuuuaacaagaaagggu

SEQ ID NO: 73680 - RNA, 22 nt, Homo sapiens
aguguuuuuacaagcacucugg

SEQ ID NO: 73681 - RNA, 22 nt, Homo sapiens
aguuccauuuauucucgucucu

SEQ ID NO: 73682 - RNA, 22 nt, Homo sapiens
aguuccuacuggcuguaaagaa

SEQ ID NO: 73683 - RNA, 22 nt, Homo sapiens
aguuggugauugauugggucug

SEQ ID NO: 73684 - RNA, 18 nt, Homo sapiens
aguuguuuuauccugccc

SEQ ID NO: 73685 - RNA, 22 nt, Homo sapiens
aguuuuugcugauagcaugcuu

SEQ ID NO: 73686 - RNA, 17 nt, Homo sapiens
auaaacucaucauuuuu

SEQ ID NO: 73687 - RNA, 23 nt, Homo sapiens
auaaacugucaaaagccagcccu

SEQ ID NO: 73688 - RNA, 22 nt, Homo sapiens
auaaagccaugagcuugagaug

SEQ ID NO: 73689 - RNA, 22 nt, Homo sapiens
auaaagguaauaauaguugcau

SEQ ID NO: 73690 - RNA, 22 nt, Homo sapiens
auaaaguucugcuggcauauau

SEQ ID NO: 73691 - RNA, 22 nt, Homo sapiens
auaaaugccuguuguuuuaagc

SEQ ID NO: 73692 - RNA, 22 nt, Homo sapiens
auaaauucauuuaagcuccuua

SEQ ID NO: 73693 - RNA, 22 nt, Homo sapiens
auaacauccuuucuuaucguug

SEQ ID NO: 73694 - RNA, 22 nt, Homo sapiens
auaacauggaguuugucauuua

SEQ ID NO: 73695 - RNA, 22 nt, Homo sapiens
auaagauaguggaagugggauu

SEQ ID NO: 73696 - RNA, 22 nt, Homo sapiens
auaagugcuuguugaauaauag

SEQ ID NO: 73697 - RNA, 22 nt, Homo sapiens
auaauacuuuuauuuugaggaa

SEQ ID NO: 73698 - RNA, 22 nt, Homo sapiens
auaauagcugaucauuuagaag

SEQ ID NO: 73699 - RNA, 22 nt, Homo sapiens
auaaugacuuccaguuccacuc

SEQ ID NO: 73700 - RNA, 22 nt, Homo sapiens
auaauguuugauugagcagaua

SEQ ID NO: 73701 - RNA, 22 nt, Homo sapiens
auaauugcuaagugaagauggu

SEQ ID NO: 73702 - RNA, 22 nt, Homo sapiens
auacaaggaaugaagagauuug

SEQ ID NO: 73703 - RNA, 22 nt, Homo sapiens
auacacgguaggcacauauuua

SEQ ID NO: 73704 - RNA, 22 nt, Homo sapiens
auacacgugccuuguuggugua

SEQ ID NO: 73705 - RNA, 19 nt, Homo sapiens
auacacguguauacauaca

SEQ ID NO: 73706 - RNA, 22 nt, Homo sapiens
auacacuggagcaaaccuggag

SEQ ID NO: 73707 - RNA, 22 nt, Homo sapiens
auacagugaauacuuacagugu

SEQ ID NO: 73708 - RNA, 22 nt, Homo sapiens
auacaugugcaggucagguuac

SEQ ID NO: 73709 - RNA, 22 nt, Homo sapiens
auacaugugccauguucgugug

SEQ ID NO: 73710 - RNA, 19 nt, Homo sapiens
auacccacuagguuacuua

SEQ ID NO: 73711 - RNA, 20 nt, Homo sapiens
auacccaguagcacaacagc

SEQ ID NO: 73712 - RNA, 22 nt, Homo sapiens
auaccuuuuaggggaacguucu

SEQ ID NO: 73713 - RNA, 22 nt, Homo sapiens
auacuagucaagaauguaugag

SEQ ID NO: 73714 - RNA, 22 nt, Homo sapiens
auacuccugucucagcugagau

SEQ ID NO: 73715 - RNA, 22 nt, Homo sapiens
auacugcacauuuagggaggga

SEQ ID NO: 73716 - RNA, 22 nt, Homo sapiens
auacuggcuuuccaauugugau

SEQ ID NO: 73717 - RNA, 22 nt, Homo sapiens
auacuguauaggauuguagccu

SEQ ID NO: 73718 - RNA, 22 nt, Homo sapiens
auacuguuuuacaucauugccu

SEQ ID NO: 73719 - RNA, 21 nt, Homo sapiens
auacuugagacuggguaauuu

SEQ ID NO: 73720 - RNA, 15 nt, Homo sapiens
auagaaugaaaggga

SEQ ID NO: 73721 - RNA, 22 nt, Homo sapiens
auagaauguuugcgccagguga

SEQ ID NO: 73722 - RNA, 22 nt, Homo sapiens
auagaggacugaggugaucuuu

SEQ ID NO: 73723 - RNA, 22 nt, Homo sapiens
auagcaaugccccauucccagu

SEQ ID NO: 73724 - RNA, 22 nt, Homo sapiens
auagcaauuugggaaucagacu

SEQ ID NO: 73725 - RNA, 22 nt, Homo sapiens
auagcacaguguguguacacca

SEQ ID NO: 73726 - RNA, 20 nt, Homo sapiens
auagcaccagacagcccuag

SEQ ID NO: 73727 - RNA, 22 nt, Homo sapiens
auagcacugguuuuucuugguu

SEQ ID NO: 73728 - RNA, 22 nt, Homo sapiens
auagcagaagaagggacaauuc

SEQ ID NO: 73729 - RNA, 22 nt, Homo sapiens
auagcagacauuucaaggcagg

SEQ ID NO: 73730 - RNA, 22 nt, Homo sapiens
auagcagugugaaaacagacua

SEQ ID NO: 73731 - RNA, 22 nt, Homo sapiens
auagcagugugaggacagacua

SEQ ID NO: 73732 - RNA, 22 nt, Homo sapiens
auagcaucauuucuugaaaaga

SEQ ID NO: 73733 - RNA, 22 nt, Homo sapiens
auagccaguagagagcuguuag

SEQ ID NO: 73734 - RNA, 22 nt, Homo sapiens
auagcugcucaggcuuuccuca

SEQ ID NO: 73735 - RNA, 22 nt, Homo sapiens
auaggaguacaaacccuauugg

SEQ ID NO: 73736 - RNA, 22 nt, Homo sapiens
auaggcaagaugagguuuuuau

SEQ ID NO: 73737 - RNA, 22 nt, Homo sapiens
auagggcacgagaugugagccu

SEQ ID NO: 73738 - RNA, 21 nt, Homo sapiens
auagggcuuguugauaguuaa

SEQ ID NO: 73739 - RNA, 22 nt, Homo sapiens
auagguuuucacuguagauucu

SEQ ID NO: 73740 - RNA, 22 nt, Homo sapiens
auaguacuauugcaguguuaua

SEQ ID NO: 73741 - RNA, 22 nt, Homo sapiens
auaguagcaugcacuggugcug

SEQ ID NO: 73742 - RNA, 22 nt, Homo sapiens
auagucaguagucucauaauga

SEQ ID NO: 73743 - RNA, 22 nt, Homo sapiens
auagugaacuuugugagaacaa

SEQ ID NO: 73744 - RNA, 22 nt, Homo sapiens
auagugcugcaauaaacauaug

SEQ ID NO: 73745 - RNA, 22 nt, Homo sapiens
auagugcuuuugaaucuuguug

SEQ ID NO: 73746 - RNA, 22 nt, Homo sapiens
auaguggcaugaucauagcuca

SEQ ID NO: 73747 - RNA, 22 nt, Homo sapiens
auaucacucccaauaucgcagg

SEQ ID NO: 73748 - RNA, 22 nt, Homo sapiens
auaucagugucuuacuguuuuu

SEQ ID NO: 73749 - RNA, 16 nt, Homo sapiens
auaugacuuuaggagg

SEQ ID NO: 73750 - RNA, 22 nt, Homo sapiens
auaugcacaguggaguacuauu

SEQ ID NO: 73751 - RNA, 22 nt, Homo sapiens
auaugcauguacccacacaggc

SEQ ID NO: 73752 - RNA, 20 nt, Homo sapiens
auaugcauguguuuucacuu

SEQ ID NO: 73753 - RNA, 22 nt, Homo sapiens
auaugcuuauuagcaagaaaua

SEQ ID NO: 73754 - RNA, 21 nt, Homo sapiens
auauggaacuggugacguguu

SEQ ID NO: 73755 - RNA, 22 nt, Homo sapiens
auauggucccuguucucaagga

SEQ ID NO: 73756 - RNA, 22 nt, Homo sapiens
auaugguguuugcuauucagcu

SEQ ID NO: 73757 - RNA, 22 nt, Homo sapiens
auauguaguuucagaaguggaa

SEQ ID NO: 73758 - RNA, 22 nt, Homo sapiens
aaaagagcugagagguauucuu

SEQ ID NO: 73759 - RNA, 22 nt, Homo sapiens
aaaaggcuagcuaguaacagaa

SEQ ID NO: 73760 - RNA, 22 nt, Homo sapiens
aaaaguucuuugagccuugaca

SEQ ID NO: 73761 - RNA, 22 nt, Homo sapiens
aaaccacagugugcugcugggg

SEQ ID NO: 73762 - RNA, 22 nt, Homo sapiens
aaaccaccauuacuuuugcacc

SEQ ID NO: 73763 - RNA, 22 nt, Homo sapiens
aaacccauauaccagcugugcu

SEQ ID NO: 73764 - RNA, 15 nt, Homo sapiens
aaacccugucucaag

SEQ ID NO: 73765 - RNA, 22 nt, Homo sapiens
aaacugccuuccuuguaggugc

SEQ ID NO: 73766 - RNA, 23 nt, Homo sapiens
aaagacuagucaggugcaguggu

SEQ ID NO: 73767 - RNA, 22 nt, Homo sapiens
aaagagaucuaugggcacuaug

SEQ ID NO: 73768 - RNA, 22 nt, Homo sapiens
aaagcgcuguuaagaagacuga

SEQ ID NO: 73769 - RNA, 22 nt, Homo sapiens
aaagcuacaggaccugcucauu

SEQ ID NO: 73770 - RNA, 22 nt, Homo sapiens
aaaggcaucugcucggcucccu

SEQ ID NO: 73771 - RNA, 22 nt, Homo sapiens
aaagggcuugaauacucuuuuu

SEQ ID NO: 73772 - RNA, 22 nt, Homo sapiens
aaagggcuuuguaaacuucaag

SEQ ID NO: 73773 - RNA, 19 nt, Homo sapiens
aaagguaguaaccucugau

SEQ ID NO: 73774 - RNA, 22 nt, Homo sapiens
aaaguacucaguucaguuccgu

SEQ ID NO: 73775 - RNA, 22 nt, Homo sapiens
aaaguacugggauuggccgggu

SEQ ID NO: 73776 - RNA, 22 nt, Homo sapiens
aaagucacuggagaaggaauau

SEQ ID NO: 73777 - RNA, 22 nt, Homo sapiens
aaagucuagaggaucaugugug

SEQ ID NO: 73778 - RNA, 22 nt, Homo sapiens
aaagucuguuacagcuauuucu

SEQ ID NO: 73779 - RNA, 22 nt, Homo sapiens
aaagugauguccaggcuuucag

SEQ ID NO: 73780 - RNA, 22 nt, Homo sapiens
aaagugcacuuggaagagggcc

SEQ ID NO: 73781 - RNA, 22 nt, Homo sapiens
aaagugcaguacuucguauauu

SEQ ID NO: 73782 - RNA, 22 nt, Homo sapiens
aaagugcugggaucacacugaa

SEQ ID NO: 73783 - RNA, 22 nt, Homo sapiens
aaagugcuuccuuuuugagggu

SEQ ID NO: 73784 - RNA, 22 nt, Homo sapiens
aaagugucuguuccuagcauga

SEQ ID NO: 73785 - RNA, 22 nt, Homo sapiens
aaaguucugcguuagggcuaaa

SEQ ID NO: 73786 - RNA, 22 nt, Homo sapiens
aaaguucuugcugaaggauuau

SEQ ID NO: 73787 - RNA, 22 nt, Homo sapiens
aaauccauuuguucagcuaugc

SEQ ID NO: 73788 - RNA, 22 nt, Homo sapiens
aaaugcagauucugcuuagguu

SEQ ID NO: 73789 - RNA, 22 nt, Homo sapiens
aaaugcaguugguggggauaug

SEQ ID NO: 73790 - RNA, 22 nt, Homo sapiens
aaaugcaucauuaggugauuuu

SEQ ID NO: 73791 - RNA, 22 nt, Homo sapiens
aaaugcuucuauguggcauguu

SEQ ID NO: 73792 - RNA, 22 nt, Homo sapiens
aaaugcuuucuuggaccauuug

SEQ ID NO: 73793 - RNA, 22 nt, Homo sapiens
aaaugggacugggguccuuuga

SEQ ID NO: 73794 - RNA, 22 nt, Homo sapiens
aaauucaucaaaugguuuguau

SEQ ID NO: 73795 - RNA, 22 nt, Homo sapiens
aguaccauuacucacuuauuuu

SEQ ID NO: 73796 - RNA, 22 nt, Homo sapiens
aguacugucagcaggguguuga

SEQ ID NO: 73797 - RNA, 22 nt, Homo sapiens
aguagcaauggcucugagcuau

SEQ ID NO: 73798 - RNA, 22 nt, Homo sapiens
aguagcacaugccacccugucu

SEQ ID NO: 73799 - RNA, 22 nt, Homo sapiens
aguaucaagccacacaugguca

SEQ ID NO: 73800 - RNA, 22 nt, Homo sapiens
aguaucacaagguguacaccca

SEQ ID NO: 73801 - RNA, 22 nt, Homo sapiens
aguauuaggugaguguauuuca

SEQ ID NO: 73802 - RNA, 22 nt, Homo sapiens
agucaaggaggccuuucagaug

SEQ ID NO: 73803 - RNA, 22 nt, Homo sapiens
agucaagugggguuagauaguu

SEQ ID NO: 73804 - RNA, 22 nt, Homo sapiens
agucaagugguuucugaguugg

SEQ ID NO: 73805 - RNA, 22 nt, Homo sapiens
agucacagguucuugggauuag

SEQ ID NO: 73806 - RNA, 22 nt, Homo sapiens
agucacaugcauuuucuucaau

SEQ ID NO: 73807 - RNA, 22 nt, Homo sapiens
agucacggugguuugcacuugu

SEQ ID NO: 73808 - RNA, 22 nt, Homo sapiens
auagugcuauggcagaccuuga

SEQ ID NO: 73809 - RNA, 22 nt, Homo sapiens
auagugcugcaauaaacauaca

SEQ ID NO: 73810 - RNA, 17 nt, Homo sapiens
auaugucugcuggggga

SEQ ID NO: 73811 - RNA, 22 nt, Homo sapiens
auaugucuguuuagucuguaau

SEQ ID NO: 73812 - RNA, 22 nt, Homo sapiens
auaugucuuaguuaccuugggc

SEQ ID NO: 73813 - RNA, 22 nt, Homo sapiens
auauuacagagaggaccuggga

SEQ ID NO: 73814 - RNA, 22 nt, Homo sapiens
auauuacuggccauaucgcagg

SEQ ID NO: 73815 - RNA, 21 nt, Homo sapiens
auauuacuguuagaggacugc

SEQ ID NO: 73816 - RNA, 22 nt, Homo sapiens
auauucacagguaucagagauu

SEQ ID NO: 73817 - RNA, 22 nt, Homo sapiens
auauucacuauaugcagaacca

SEQ ID NO: 73818 - RNA, 22 nt, Homo sapiens
auauugcuugaggccaggaggu

SEQ ID NO: 73819 - RNA, 22 nt, Homo sapiens
auauugguuaaauauuauguga

SEQ ID NO: 73820 - RNA, 22 nt, Homo sapiens
auauuguacugcuacugguucu

SEQ ID NO: 73821 - RNA, 22 nt, Homo sapiens
aucaaacugcaaggcagcagca

SEQ ID NO: 73822 - RNA, 20 nt, Homo sapiens
aucaaagacuuagaggggga

SEQ ID NO: 73823 - RNA, 22 nt, Homo sapiens
aucaaagccaugcucaguuuuc

SEQ ID NO: 73824 - RNA, 22 nt, Homo sapiens
aucaaaguuucccagaaguugu

SEQ ID NO: 73825 - RNA, 22 nt, Homo sapiens
aucaagccaaagaaaguccuug

SEQ ID NO: 73826 - RNA, 22 nt, Homo sapiens
aucaagcuggcauauguaguuc

SEQ ID NO: 73827 - RNA, 22 nt, Homo sapiens
aucaaguacuguacugaaagug

SEQ ID NO: 73828 - RNA, 22 nt, Homo sapiens
aucacagcccuccucuuggaug

SEQ ID NO: 73829 - RNA, 22 nt, Homo sapiens
aucacaggcaaaauuccuucuc

SEQ ID NO: 73830 - RNA, 22 nt, Homo sapiens
aucacagugagcauaugucuau

SEQ ID NO: 73831 - RNA, 22 nt, Homo sapiens
aucacaguuauaacauccuuuu

SEQ ID NO: 73832 - RNA, 22 nt, Homo sapiens
aucacauggccuagccuaaccu

SEQ ID NO: 73833 - RNA, 19 nt, Homo sapiens
aucaccauuauuuggaaca

SEQ ID NO: 73834 - RNA, 21 nt, Homo sapiens
aucaccgugcaguucuccagg

SEQ ID NO: 73835 - RNA, 22 nt, Homo sapiens
aucacugggcaagauaucauga

SEQ ID NO: 73836 - RNA, 22 nt, Homo sapiens
aucacuguuuugaugcucggac

SEQ ID NO: 73837 - RNA, 22 nt, Homo sapiens
aucacuuugcucuccagugugg

SEQ ID NO: 73838 - RNA, 20 nt, Homo sapiens
aucagagccggugaaagggc

SEQ ID NO: 73839 - RNA, 22 nt, Homo sapiens
aucagagugaauaaugacaaaa

SEQ ID NO: 73840 - RNA, 22 nt, Homo sapiens
aucagauaccuguugggaaaug

SEQ ID NO: 73841 - RNA, 22 nt, Homo sapiens
aucaggcacacauuggaguuug

SEQ ID NO: 73842 - RNA, 22 nt, Homo sapiens
aucagucacugcguuuuuggga

SEQ ID NO: 73843 - RNA, 22 nt, Homo sapiens
aucagugcauaguauuuaauga

SEQ ID NO: 73844 - RNA, 22 nt, Homo sapiens
aucauaucaucugcaaacaaag

SEQ ID NO: 73845 - RNA, 22 nt, Homo sapiens
aucauccagccccagaagggag

SEQ ID NO: 73846 - RNA, 22 nt, Homo sapiens
aucauguaguaagacacauuua

SEQ ID NO: 73847 - RNA, 22 nt, Homo sapiens
aucauugugugaguugauggga

SEQ ID NO: 73848 - RNA, 22 nt, Homo sapiens
auccacagugucaauguuguga

SEQ ID NO: 73849 - RNA, 22 nt, Homo sapiens
auccacaugcaguuggaaacag

SEQ ID NO: 73850 - RNA, 22 nt, Homo sapiens
auccacauucauggaccagucc

SEQ ID NO: 73851 - RNA, 22 nt, Homo sapiens
auccagaugggcuuaauguaau

SEQ ID NO: 73852 - RNA, 22 nt, Homo sapiens
auccaguguuuucuuuugucac

SEQ ID NO: 73853 - RNA, 22 nt, Homo sapiens
auccauugucuaaugcuaagau

SEQ ID NO: 73854 - RNA, 22 nt, Homo sapiens
aucccuguaacuagcagccccu

SEQ ID NO: 73855 - RNA, 22 nt, Homo sapiens
aucccuuucucuggcuaggggg

SEQ ID NO: 73856 - RNA, 22 nt, Homo sapiens
auccucaguggcuuaaguauag

SEQ ID NO: 73857 - RNA, 22 nt, Homo sapiens
auccugaagcuuuacugaauuc

SEQ ID NO: 73858 - RNA, 22 nt, Homo sapiens
auccugagacuuuucugaaguu

SEQ ID NO: 73859 - RNA, 22 nt, Homo sapiens
auccuguacuaagguuuuccca

SEQ ID NO: 73860 - RNA, 21 nt, Homo sapiens
aucgcacaauauaccccugua

SEQ ID NO: 73861 - RNA, 22 nt, Homo sapiens
aucgcaccauugcacuccagca

SEQ ID NO: 73862 - RNA, 22 nt, Homo sapiens
aucgcgccauuguacuccagcc

SEQ ID NO: 73863 - RNA, 22 nt, Homo sapiens
aucgugucuggcccugaaugcu

SEQ ID NO: 73864 - RNA, 22 nt, Homo sapiens
aucuaaaucucauaugggcaca

SEQ ID NO: 73865 - RNA, 22 nt, Homo sapiens
aucuacuugcugggucucugga

SEQ ID NO: 73866 - RNA, 22 nt, Homo sapiens
aucuagagaggcagucuggccg

SEQ ID NO: 73867 - RNA, 22 nt, Homo sapiens
aucucagcaacuaaagauccuu

SEQ ID NO: 73868 - RNA, 22 nt, Homo sapiens
aucugacuuuuaauuugaaaac

SEQ ID NO: 73869 - RNA, 22 nt, Homo sapiens
aucugauggagagcguguggcu

SEQ ID NO: 73870 - RNA, 22 nt, Homo sapiens
aucugcuccuggugaggguuuc

SEQ ID NO: 73871 - RNA, 22 nt, Homo sapiens
aucuggcguuuacuuccuuccu

SEQ ID NO: 73872 - RNA, 22 nt, Homo sapiens
aucuggcuccuuuugacaaugc

SEQ ID NO: 73873 - RNA, 22 nt, Homo sapiens
aucuggguccguucugcuucuc

SEQ ID NO: 73874 - RNA, 22 nt, Homo sapiens
aucugguguauuggugcugggu

SEQ ID NO: 73875 - RNA, 22 nt, Homo sapiens
aucugguguccucgugggaguc

SEQ ID NO: 73876 - RNA, 22 nt, Homo sapiens
aucuguagauucagcacaagcu

SEQ ID NO: 73877 - RNA, 22 nt, Homo sapiens
aucugugaaugaaguuauuuug

SEQ ID NO: 73878 - RNA, 21 nt, Homo sapiens
aucugugagaccuuggggguu

SEQ ID NO: 73879 - RNA, 22 nt, Homo sapiens
aucugugguuguaugcauauua

SEQ ID NO: 73880 - RNA, 22 nt, Homo sapiens
aucuguguuuaaggucccagaa

SEQ ID NO: 73881 - RNA, 22 nt, Homo sapiens
aucuucucuugaagggugggga

SEQ ID NO: 73882 - RNA, 22 nt, Homo sapiens
aucuugcauuugcuaaaaugca

SEQ ID NO: 73883 - RNA, 22 nt, Homo sapiens
aucuuggauuaccugggugggu

SEQ ID NO: 73884 - RNA, 22 nt, Homo sapiens
aucuuguccugagguuuuauug

SEQ ID NO: 73885 - RNA, 22 nt, Homo sapiens
aucuuuggucaucacagcuaga

SEQ ID NO: 73886 - RNA, 22 nt, Homo sapiens
aucuuuggugaguucuuugguc

SEQ ID NO: 73887 - RNA, 22 nt, Homo sapiens
augaaaugcauguuaaguccgu

SEQ ID NO: 73888 - RNA, 22 nt, Homo sapiens
augaacucaucaucuagguuuu

SEQ ID NO: 73889 - RNA, 19 nt, Homo sapiens
augaacucauucuuuuuau

SEQ ID NO: 73890 - RNA, 22 nt, Homo sapiens
augaagacaucgucugggauua

SEQ ID NO: 73891 - RNA, 20 nt, Homo sapiens
augaaggcaggugugaguuu

SEQ ID NO: 73892 - RNA, 22 nt, Homo sapiens
augaagugcaugauaguugguu

SEQ ID NO: 73893 - RNA, 22 nt, Homo sapiens
augaaguuagcucauuucuuuu

SEQ ID NO: 73894 - RNA, 22 nt, Homo sapiens
augaauacugcugcaaugaaca

SEQ ID NO: 73895 - RNA, 22 nt, Homo sapiens
augaauagaguuaauugaguac

SEQ ID NO: 73896 - RNA, 22 nt, Homo sapiens
augaaugcagcacuguuuuucu

SEQ ID NO: 73897 - RNA, 22 nt, Homo sapiens
augaaugcaugaagguugggug

SEQ ID NO: 73898 - RNA, 23 nt, Homo sapiens
augaauguaaggaguguaagaaa

SEQ ID NO: 73899 - RNA, 22 nt, Homo sapiens
augaauucaucugguuuuggga

SEQ ID NO: 73900 - RNA, 22 nt, Homo sapiens
augacagcaucugugaaguugu

SEQ ID NO: 73901 - RNA, 22 nt, Homo sapiens
augacauguauuuccaggauuu

SEQ ID NO: 73902 - RNA, 19 nt, Homo sapiens
augacauuuggggguggac

SEQ ID NO: 73903 - RNA, 22 nt, Homo sapiens
augaccauuucaauugauaugg

SEQ ID NO: 73904 - RNA, 22 nt, Homo sapiens
auugccuagccuggucucaaaa

SEQ ID NO: 73905 - RNA, 22 nt, Homo sapiens
auugccucaauuccaagacugc

SEQ ID NO: 73906 - RNA, 22 nt, Homo sapiens
auugcucuuagaaauauuucuu

SEQ ID NO: 73907 - RNA, 22 nt, Homo sapiens
auugcuuacccuguauuagauc

SEQ ID NO: 73908 - RNA, 16 nt, Homo sapiens
auuggcaagaugccuu

SEQ ID NO: 73909 - RNA, 22 nt, Homo sapiens
auuggcuauuuggugagugauu

SEQ ID NO: 73910 - RNA, 22 nt, Homo sapiens
auuggucuauuaaaccuaaguu

SEQ ID NO: 73911 - RNA, 22 nt, Homo sapiens
auuguacuagguccuagggcuu

SEQ ID NO: 73912 - RNA, 22 nt, Homo sapiens
auuguacuccagccugggcaaa

SEQ ID NO: 73913 - RNA, 22 nt, Homo sapiens
auuguacuccagccugggcgac

SEQ ID NO: 73914 - RNA, 22 nt, Homo sapiens
auuguacuccagccugggcugc

SEQ ID NO: 73915 - RNA, 22 nt, Homo sapiens
auuguacuccagccugggugac

SEQ ID NO: 73916 - RNA, 22 nt, Homo sapiens
auuguaguuugcuauggcaaua

SEQ ID NO: 73917 - RNA, 22 nt, Homo sapiens
auugucacccgggcaguaagca

SEQ ID NO: 73918 - RNA, 22 nt, Homo sapiens
auugucccucuuaaucccagca

SEQ ID NO: 73919 - RNA, 22 nt, Homo sapiens
auugugauggucaaaggaaaua

SEQ ID NO: 73920 - RNA, 22 nt, Homo sapiens
auugugauugcugcuaggccua

SEQ ID NO: 73921 - RNA, 22 nt, Homo sapiens
auuucuacuccuguguccagaa

SEQ ID NO: 73922 - RNA, 22 nt, Homo sapiens
auuuggcagugaagggaucaca

SEQ ID NO: 73923 - RNA, 22 nt, Homo sapiens
auuugggaaugugcauuauacu

SEQ ID NO: 73924 - RNA, 22 nt, Homo sapiens
auuuggguaaugagugcaaggg

SEQ ID NO: 73925 - RNA, 21 nt, Homo sapiens
auuugguguuagaaauaaauu

SEQ ID NO: 73926 - RNA, 22 nt, Homo sapiens
auuugguuauggucauggacac

SEQ ID NO: 73927 - RNA, 22 nt, Homo sapiens
auuugguugggugcgguggcuu

SEQ ID NO: 73928 - RNA, 22 nt, Homo sapiens
auuuugguuacauaguugagcu

SEQ ID NO: 73929 - RNA, 21 nt, Homo sapiens
auuuuugcagagcugguagug

SEQ ID NO: 73930 - RNA, 22 nt, Homo sapiens
caaaccuguaggggccaagagg

SEQ ID NO: 73931 - RNA, 22 nt, Homo sapiens
caaaggauucauuuccaggagu

SEQ ID NO: 73932 - RNA, 22 nt, Homo sapiens
caaagugguuuauacaugauug

SEQ ID NO: 73933 - RNA, 22 nt, Homo sapiens
caaauacuuucauguugucuug

SEQ ID NO: 73934 - RNA, 22 nt, Homo sapiens
caaauccucaccucaucaugaa

SEQ ID NO: 73935 - RNA, 22 nt, Homo sapiens
caaaugcuucuauggacugucu

SEQ ID NO: 73936 - RNA, 22 nt, Homo sapiens
caacaguaaagcauuuuuaagu

SEQ ID NO: 73937 - RNA, 22 nt, Homo sapiens
caacagucagcccauccacaga

SEQ ID NO: 73938 - RNA, 22 nt, Homo sapiens
caacucuguaggauccaggugg

SEQ ID NO: 73939 - RNA, 22 nt, Homo sapiens
caacugguuuuauacaguuuag

SEQ ID NO: 73940 - RNA, 22 nt, Homo sapiens
caagagaccugagugucauucu

SEQ ID NO: 73941 - RNA, 22 nt, Homo sapiens
caagaucauuuaugcuaaaauu

SEQ ID NO: 73942 - RNA, 22 nt, Homo sapiens
caaggaauucucaauagaguua

SEQ ID NO: 73943 - RNA, 22 nt, Homo sapiens
caaggcacagccccuacuuccu

SEQ ID NO: 73944 - RNA, 22 nt, Homo sapiens
caagggguggaaaugguagugu

SEQ ID NO: 73945 - RNA, 22 nt, Homo sapiens
caaguacugggcuauggauauu

SEQ ID NO: 73946 - RNA, 21 nt, Homo sapiens
caagugaugcuucugcuuuaa

SEQ ID NO: 73947 - RNA, 22 nt, Homo sapiens
caagugcuacagagaaaucuuu

SEQ ID NO: 73948 - RNA, 22 nt, Homo sapiens
caauggcaaugaaauagugaga

SEQ ID NO: 73949 - RNA, 22 nt, Homo sapiens
caauggcacgaucucgucucac

SEQ ID NO: 73950 - RNA, 22 nt, Homo sapiens
caauggcacuauuggaaaaggu

SEQ ID NO: 73951 - RNA, 22 nt, Homo sapiens
caaugugcuuggggcacaugag

SEQ ID NO: 73952 - RNA, 22 nt, Homo sapiens
cacacuguuuuccauggggguu

SEQ ID NO: 73953 - RNA, 22 nt, Homo sapiens
cacagcacaggcaugaguguca

SEQ ID NO: 73954 - RNA, 22 nt, Homo sapiens
cacagcuaacaacuguuucuuc

SEQ ID NO: 73955 - RNA, 22 nt, Homo sapiens
cacaggucauccuggaucaagg

SEQ ID NO: 73956 - RNA, 22 nt, Homo sapiens
cacaguagaauagagcacuagg

SEQ ID NO: 73957 - RNA, 22 nt, Homo sapiens
cacagucugggcuuguuuguac

SEQ ID NO: 73958 - RNA, 22 nt, Homo sapiens
cacagugaacaauauccucugu

SEQ ID NO: 73959 - RNA, 22 nt, Homo sapiens
cacaguguucauagccaucagg

SEQ ID NO: 73960 - RNA, 22 nt, Homo sapiens
cacaguugccuaucuccugaag

SEQ ID NO: 73961 - RNA, 22 nt, Homo sapiens
cacauguuugcuacauuuuucu

SEQ ID NO: 73962 - RNA, 22 nt, Homo sapiens
cacauguuuuagcauggcuguu

SEQ ID NO: 73963 - RNA, 16 nt, Homo sapiens
cacauugcugcauggc

SEQ ID NO: 73964 - RNA, 22 nt, Homo sapiens
caccaaccucaguagcaucugu

SEQ ID NO: 73965 - RNA, 22 nt, Homo sapiens
caccacagccauuauugucccc

SEQ ID NO: 73966 - RNA, 22 nt, Homo sapiens
caccacuacaccccaggcuggg

SEQ ID NO: 73967 - RNA, 22 nt, Homo sapiens
caccagcuggcauugaauaccu

SEQ ID NO: 73968 - RNA, 22 nt, Homo sapiens
caccagguggcugaggccauga

SEQ ID NO: 73969 - RNA, 23 nt, Homo sapiens
caccaguauaauuagcuuuuaaa

SEQ ID NO: 73970 - RNA, 22 nt, Homo sapiens
caccauguguucagaaggauug

SEQ ID NO: 73971 - RNA, 22 nt, Homo sapiens
caccccuaccugagucaggagu

SEQ ID NO: 73972 - RNA, 22 nt, Homo sapiens
cacccgugcucccuccagcugc

SEQ ID NO: 73973 - RNA, 22 nt, Homo sapiens
cacccuugcagggacagcuuug

SEQ ID NO: 73974 - RNA, 22 nt, Homo sapiens
caccuagacuggagugcagugg

SEQ ID NO: 73975 - RNA, 22 nt, Homo sapiens
caccugagcgggaugcucgccu

SEQ ID NO: 73976 - RNA, 22 nt, Homo sapiens
cacugcacuccagcuugugggc

SEQ ID NO: 73977 - RNA, 22 nt, Homo sapiens
cacugcacuccaguuucgguaa

SEQ ID NO: 73978 - RNA, 22 nt, Homo sapiens
cacugcaguguaauuaagguug

SEQ ID NO: 73979 - RNA, 21 nt, Homo sapiens
cacugcaucacaggacagcau

SEQ ID NO: 73980 - RNA, 22 nt, Homo sapiens
cacugcauccucugccuggcgg

SEQ ID NO: 73981 - RNA, 22 nt, Homo sapiens
cacugcauggccacccauguua

SEQ ID NO: 73982 - RNA, 22 nt, Homo sapiens
cacugcauuggaugguuccucc

SEQ ID NO: 73983 - RNA, 22 nt, Homo sapiens
cacugcgaccucugccuaccgg

SEQ ID NO: 73984 - RNA, 22 nt, Homo sapiens
cacuggcacuguguuuagaugg

SEQ ID NO: 73985 - RNA, 22 nt, Homo sapiens
cacugggugagauccauguuua

SEQ ID NO: 73986 - RNA, 22 nt, Homo sapiens
cacugggugccauauguuugcu

SEQ ID NO: 73987 - RNA, 22 nt, Homo sapiens
cacuguggauggaacuauguga

SEQ ID NO: 73988 - RNA, 18 nt, Homo sapiens
cacuuggcuuugccccuc

SEQ ID NO: 73989 - RNA, 22 nt, Homo sapiens
cagacaugucuuguggccgugg

SEQ ID NO: 73990 - RNA, 20 nt, Homo sapiens
cagagcaaagcaguccuggc

SEQ ID NO: 73991 - RNA, 22 nt, Homo sapiens
cagagcaaugcuuuugcuuuga

SEQ ID NO: 73992 - RNA, 22 nt, Homo sapiens
cagagcacugauacuggguucu

SEQ ID NO: 73993 - RNA, 22 nt, Homo sapiens
cagauaguuguagauaugcagc

SEQ ID NO: 73994 - RNA, 22 nt, Homo sapiens
cagaugcaugaccugggcuugg

SEQ ID NO: 73995 - RNA, 22 nt, Homo sapiens
cagaugguggucccacagccca

SEQ ID NO: 73996 - RNA, 22 nt, Homo sapiens
cagauguaguauuuuagugaaa

SEQ ID NO: 73997 - RNA, 20 nt, Homo sapiens
cagcaaccugcucucuuccu

SEQ ID NO: 73998 - RNA, 22 nt, Homo sapiens
cagcaagucucuaagaguucau

SEQ ID NO: 73999 - RNA, 22 nt, Homo sapiens
auagugcugccauaaacauacg

SEQ ID NO: 74000 - RNA, 22 nt, Homo sapiens
augacugagacuaacuuacuuu

SEQ ID NO: 74001 - RNA, 22 nt, Homo sapiens
augacuggaacggcacuuuaca

SEQ ID NO: 74002 - RNA, 22 nt, Homo sapiens
augacugucuugcagaggcuau

SEQ ID NO: 74003 - RNA, 19 nt, Homo sapiens
acuuuggugauuagaggga

SEQ ID NO: 74004 - RNA, 21 nt, Homo sapiens
acuuuguugggggcugaggca

SEQ ID NO: 74005 - RNA, 20 nt, Homo sapiens
acuuuuugaugaggucguuu

SEQ ID NO: 74006 - RNA, 22 nt, Homo sapiens
acuuuuugauggggagaacauu

SEQ ID NO: 74007 - RNA, 22 nt, Homo sapiens
agaacccuuugaaauguguuug

SEQ ID NO: 74008 - RNA, 20 nt, Homo sapiens
agaagcauugcucucuucag

SEQ ID NO: 74009 - RNA, 22 nt, Homo sapiens
agaagugcuggguucaggcugg

SEQ ID NO: 74010 - RNA, 22 nt, Homo sapiens
agaauacugucuauucauggua

SEQ ID NO: 74011 - RNA, 22 nt, Homo sapiens
agaaugucaguauuggcuaaaa

SEQ ID NO: 74012 - RNA, 22 nt, Homo sapiens
agaauguuuuagaccaauacaa

SEQ ID NO: 74013 - RNA, 22 nt, Homo sapiens
agacagcuggaguaucauagcu

SEQ ID NO: 74014 - RNA, 22 nt, Homo sapiens
agacagcugguagcacuuccug

SEQ ID NO: 74015 - RNA, 22 nt, Homo sapiens
agacaguguguguauauauggu

SEQ ID NO: 74016 - RNA, 22 nt, Homo sapiens
agaccacuuuagagauuguuca

SEQ ID NO: 74017 - RNA, 20 nt, Homo sapiens
agacuagggagcagaaagcc

SEQ ID NO: 74018 - RNA, 19 nt, Homo sapiens
agacuggcccaggcgggug

SEQ ID NO: 74019 - RNA, 22 nt, Homo sapiens
agacuguaaugcauaauuuacu

SEQ ID NO: 74020 - RNA, 22 nt, Homo sapiens
agagaacuguuuacacguuaau

SEQ ID NO: 74021 - RNA, 22 nt, Homo sapiens
agagauaauuagguuaaaugag

SEQ ID NO: 74022 - RNA, 22 nt, Homo sapiens
agagauaguuuccaacucauac

SEQ ID NO: 74023 - RNA, 22 nt, Homo sapiens
agagaucaacugaauuacugga

SEQ ID NO: 74024 - RNA, 22 nt, Homo sapiens
agagaucauuuuguuucaaauc

SEQ ID NO: 74025 - RNA, 20 nt, Homo sapiens
agagcaaagccgcaccccua

SEQ ID NO: 74026 - RNA, 18 nt, Homo sapiens
agagcacugaguuuuaga

SEQ ID NO: 74027 - RNA, 22 nt, Homo sapiens
agagcacugcugcaggguucug

SEQ ID NO: 74028 - RNA, 22 nt, Homo sapiens
agagccacacucuccuaacuca

SEQ ID NO: 74029 - RNA, 22 nt, Homo sapiens
agagcuaguauuuacggagcau

SEQ ID NO: 74030 - RNA, 21 nt, Homo sapiens
agaggacugaccacagcccua

SEQ ID NO: 74031 - RNA, 22 nt, Homo sapiens
agagguaagaauaguaguugga

SEQ ID NO: 74032 - RNA, 22 nt, Homo sapiens
agagguaagcaguggcaagugc

SEQ ID NO: 74033 - RNA, 22 nt, Homo sapiens
agagguagaagauaggcuacag

SEQ ID NO: 74034 - RNA, 22 nt, Homo sapiens
agagguaugccugggcuggagc

SEQ ID NO: 74035 - RNA, 22 nt, Homo sapiens
agagguauuggaaggaguguca

SEQ ID NO: 74036 - RNA, 22 nt, Homo sapiens
agaguaguuuauuaugcuaagg

SEQ ID NO: 74037 - RNA, 19 nt, Homo sapiens
agaguauuguuacuucucu

SEQ ID NO: 74038 - RNA, 22 nt, Homo sapiens
agagugaagcuuuuuauauucu

SEQ ID NO: 74039 - RNA, 22 nt, Homo sapiens
agagugcaauggcaccaucucg

SEQ ID NO: 74040 - RNA, 23 nt, Homo sapiens
agagugcaauggugccaucucgg

SEQ ID NO: 74041 - RNA, 20 nt, Homo sapiens
agagugcugucuguccugag

SEQ ID NO: 74042 - RNA, 22 nt, Homo sapiens
agauacauuggauaaugguggg

SEQ ID NO: 74043 - RNA, 22 nt, Homo sapiens
agauaugucugcuauuugcugu

SEQ ID NO: 74044 - RNA, 22 nt, Homo sapiens
agaugauguuuacugagcauca

SEQ ID NO: 74045 - RNA, 23 nt, Homo sapiens
agaugcaucuggcugcgaggcaa

SEQ ID NO: 74046 - RNA, 22 nt, Homo sapiens
agaugguauuauagguuucugu

SEQ ID NO: 74047 - RNA, 22 nt, Homo sapiens
agauggugauaaaugugguacc

SEQ ID NO: 74048 - RNA, 22 nt, Homo sapiens
agaugguguuuucucaccagau

SEQ ID NO: 74049 - RNA, 22 nt, Homo sapiens
agauguuguucaucugauuguu

SEQ ID NO: 74050 - RNA, 23 nt, Homo sapiens
agcaaaugcucuagcacuccaac

SEQ ID NO: 74051 - RNA, 22 nt, Homo sapiens
agcaacauagaaauuugggugg

SEQ ID NO: 74052 - RNA, 22 nt, Homo sapiens
agcaacauggaguuugugcgca

SEQ ID NO: 74053 - RNA, 22 nt, Homo sapiens
agcaacauuuuugaccuuucuu

SEQ ID NO: 74054 - RNA, 22 nt, Homo sapiens
agcaaccuugaauagcccuuuc

SEQ ID NO: 74055 - RNA, 22 nt, Homo sapiens
agcaagacauggcuuccaaaug

SEQ ID NO: 74056 - RNA, 22 nt, Homo sapiens
agcaagauccagucgcacagga

SEQ ID NO: 74057 - RNA, 22 nt, Homo sapiens
agcaagauuguucccauuuucu

SEQ ID NO: 74058 - RNA, 22 nt, Homo sapiens
agcaauaugacauugcuacauc

SEQ ID NO: 74059 - RNA, 22 nt, Homo sapiens
agcacagugguuaaguuucuua

SEQ ID NO: 74060 - RNA, 22 nt, Homo sapiens
agcaccacauacuacagagaua

SEQ ID NO: 74061 - RNA, 23 nt, Homo sapiens
agcaccaccccaggucacaagug

SEQ ID NO: 74062 - RNA, 22 nt, Homo sapiens
agcaccauugcacuccagccug

SEQ ID NO: 74063 - RNA, 22 nt, Homo sapiens
agcaccauuguacuccagccug

SEQ ID NO: 74064 - RNA, 22 nt, Homo sapiens
agcagagcauauucauucgggg

SEQ ID NO: 74065 - RNA, 22 nt, Homo sapiens
agcagcaucgggaaguuggcca

SEQ ID NO: 74066 - RNA, 22 nt, Homo sapiens
agcagcaugaggggacuucugc

SEQ ID NO: 74067 - RNA, 22 nt, Homo sapiens
agcagcaugcaaauggacuaau

SEQ ID NO: 74068 - RNA, 22 nt, Homo sapiens
agcagcucaagacuuaaauuug

SEQ ID NO: 74069 - RNA, 22 nt, Homo sapiens
agcaggacaauaugggaucagg

SEQ ID NO: 74070 - RNA, 22 nt, Homo sapiens
agcaggucuuaacuugugaggu

SEQ ID NO: 74071 - RNA, 22 nt, Homo sapiens
agcaguacauaaaaagcauccu

SEQ ID NO: 74072 - RNA, 22 nt, Homo sapiens
agcagugugaaaugauuuaagg

SEQ ID NO: 74073 - RNA, 22 nt, Homo sapiens
agcaguguggccuuagacccgg

SEQ ID NO: 74074 - RNA, 20 nt, Homo sapiens
agcaucacagagccgggugu

SEQ ID NO: 74075 - RNA, 20 nt, Homo sapiens
agcaucagugguaguguugc

SEQ ID NO: 74076 - RNA, 22 nt, Homo sapiens
agcaucauuugauguucccgag

SEQ ID NO: 74077 - RNA, 22 nt, Homo sapiens
agcauuacaugguacagagaag

SEQ ID NO: 74078 - RNA, 22 nt, Homo sapiens
agcauuaguugugaagccuuua

SEQ ID NO: 74079 - RNA, 22 nt, Homo sapiens
agccaagacucuguuccccuug

SEQ ID NO: 74080 - RNA, 19 nt, Homo sapiens
agccaguuuucccagcacc

SEQ ID NO: 74081 - RNA, 22 nt, Homo sapiens
agcccugugauuacuuuuauaa

SEQ ID NO: 74082 - RNA, 22 nt, Homo sapiens
agccgguguccacgaagaagag

SEQ ID NO: 74083 - RNA, 22 nt, Homo sapiens
agccuauccaauaucagugaga

SEQ ID NO: 74084 - RNA, 22 nt, Homo sapiens
agccucauucuacauguuaaug

SEQ ID NO: 74085 - RNA, 23 nt, Homo sapiens
agccugguuucccugcuucuccc

SEQ ID NO: 74086 - RNA, 22 nt, Homo sapiens
agccuguagugagcugugauug

SEQ ID NO: 74087 - RNA, 22 nt, Homo sapiens
agcaccaauaacaguuucuagc

SEQ ID NO: 74088 - RNA, 22 nt, Homo sapiens
agcaccaauaaucagaguucuu

SEQ ID NO: 74089 - RNA, 22 nt, Homo sapiens
agcaccaccguugcucuauccc

SEQ ID NO: 74090 - RNA, 22 nt, Homo sapiens
agcaccagaaucugaguuauuc

SEQ ID NO: 74091 - RNA, 22 nt, Homo sapiens
agcagcacaucccuuucuggcc

SEQ ID NO: 74092 - RNA, 22 nt, Homo sapiens
agcagcaccaaacagacuaaga

SEQ ID NO: 74093 - RNA, 22 nt, Homo sapiens
agcagcauuaguggaaucuugu

SEQ ID NO: 74094 - RNA, 20 nt, Homo sapiens
agcagccacagauuccucag

SEQ ID NO: 74095 - RNA, 22 nt, Homo sapiens
agcagcgacacccuguggugag

SEQ ID NO: 74096 - RNA, 22 nt, Homo sapiens
agcaggauuguuacaauaguaa

SEQ ID NO: 74097 - RNA, 22 nt, Homo sapiens
aaaacgcauccucacaggucug

SEQ ID NO: 74098 - RNA, 22 nt, Homo sapiens
aaacagucuucuccugagggac

SEQ ID NO: 74099 - RNA, 18 nt, Homo sapiens
aaacagugucucuuucug

SEQ ID NO: 74100 - RNA, 22 nt, Homo sapiens
aaacauugaccucauccuggca

SEQ ID NO: 74101 - RNA, 22 nt, Homo sapiens
aaacgugcagagaucaauagca

SEQ ID NO: 74102 - RNA, 20 nt, Homo sapiens
aaacucugucuucuuuauca

SEQ ID NO: 74103 - RNA, 22 nt, Homo sapiens
aaacugucuggaugcuugugga

SEQ ID NO: 74104 - RNA, 22 nt, Homo sapiens
aaagagcugagaccugguggag

SEQ ID NO: 74105 - RNA, 22 nt, Homo sapiens
aaagaguucagguagauuucaa

SEQ ID NO: 74106 - RNA, 22 nt, Homo sapiens
aaagcacuggagucaucaucua

SEQ ID NO: 74107 - RNA, 22 nt, Homo sapiens
aaagcuaagguagcauuggaga

SEQ ID NO: 74108 - RNA, 22 nt, Homo sapiens
aaagcuagagaagcugcuguca

SEQ ID NO: 74109 - RNA, 22 nt, Homo sapiens
aaagcugucaaggcaggaggcu

SEQ ID NO: 74110 - RNA, 22 nt, Homo sapiens
aaaggcacacacuccuuguuau

SEQ ID NO: 74111 - RNA, 22 nt, Homo sapiens
aaaggcacuagaaguuaccuuu

SEQ ID NO: 74112 - RNA, 22 nt, Homo sapiens
aaaggcacugugacuuuauagg

SEQ ID NO: 74113 - RNA, 22 nt, Homo sapiens
aaaggcuucggaucagaaggua

SEQ ID NO: 74114 - RNA, 22 nt, Homo sapiens
aaagggcacugugcuuuggcaa

SEQ ID NO: 74115 - RNA, 22 nt, Homo sapiens
aaagggcuguuucuugacuugg

SEQ ID NO: 74116 - RNA, 22 nt, Homo sapiens
aaagguaguacuucuagaaggg

SEQ ID NO: 74117 - RNA, 19 nt, Homo sapiens
aaaguacucugaugccucu

SEQ ID NO: 74118 - RNA, 22 nt, Homo sapiens
aaagugaauguaucccguaagu

SEQ ID NO: 74119 - RNA, 22 nt, Homo sapiens
aaagugacuuagugccccauuu

SEQ ID NO: 74120 - RNA, 22 nt, Homo sapiens
aaagugauuguaguuuuugcca

SEQ ID NO: 74121 - RNA, 22 nt, Homo sapiens
aaagugcuaggauuaccugggg

SEQ ID NO: 74122 - RNA, 22 nt, Homo sapiens
aaagugcugagacagacuggga

SEQ ID NO: 74123 - RNA, 22 nt, Homo sapiens
aaagugcugagaguucuaacuu

SEQ ID NO: 74124 - RNA, 22 nt, Homo sapiens
aaagugcugagauuguaggcau

SEQ ID NO: 74125 - RNA, 22 nt, Homo sapiens
aaagugcugagucuaggcgggg

SEQ ID NO: 74126 - RNA, 22 nt, Homo sapiens
aaagugcugggauuaggccagg

SEQ ID NO: 74127 - RNA, 22 nt, Homo sapiens
aaagugcugggauuggccgggc

SEQ ID NO: 74128 - RNA, 22 nt, Homo sapiens
aaagugcuguagacugggcgca

SEQ ID NO: 74129 - RNA, 22 nt, Homo sapiens
aaaguggugugaguauguaucu

SEQ ID NO: 74130 - RNA, 22 nt, Homo sapiens
aaagugguuuuucagacuuuga

SEQ ID NO: 74131 - RNA, 22 nt, Homo sapiens
aaaguguguuuccaaccugugg

SEQ ID NO: 74132 - RNA, 22 nt, Homo sapiens
aaaguguuucugcaguagguuu

SEQ ID NO: 74133 - RNA, 19 nt, Homo sapiens
aaaguucuucccuuuggag

SEQ ID NO: 74134 - RNA, 22 nt, Homo sapiens
aaauaguagcugaaugagggaa

SEQ ID NO: 74135 - RNA, 15 nt, Homo sapiens
aaauaugucaguucu

SEQ ID NO: 74136 - RNA, 22 nt, Homo sapiens
aaaugcacaaagauuuugcacu

SEQ ID NO: 74137 - RNA, 22 nt, Homo sapiens
aaaugcacagaaaggaugugga

SEQ ID NO: 74138 - RNA, 22 nt, Homo sapiens
aaaugcauaucaagauugcccu

SEQ ID NO: 74139 - RNA, 22 nt, Homo sapiens
aaaugcaugaauaagcucgugu

SEQ ID NO: 74140 - RNA, 22 nt, Homo sapiens
aaaugcaugaggugggaagaaa

SEQ ID NO: 74141 - RNA, 22 nt, Homo sapiens
aaaugcccuaaaauggagcauc

SEQ ID NO: 74142 - RNA, 22 nt, Homo sapiens
aaaugcugcuuuggccucuucu

SEQ ID NO: 74143 - RNA, 22 nt, Homo sapiens
aaauggauuaaguucacuugcu

SEQ ID NO: 74144 - RNA, 22 nt, Homo sapiens
aaauggcuuugaggguaggaca

SEQ ID NO: 74145 - RNA, 22 nt, Homo sapiens
aaaugucauggaguguuucccc

SEQ ID NO: 74146 - RNA, 22 nt, Homo sapiens
aaauucauuucagcucugggua

SEQ ID NO: 74147 - RNA, 22 nt, Homo sapiens
aaauugcaaugcgaggcagagg

SEQ ID NO: 74148 - RNA, 22 nt, Homo sapiens
aaauugcaguuaggaugauggu

SEQ ID NO: 74149 - RNA, 22 nt, Homo sapiens
aacaccauuuuucugcagccuu

SEQ ID NO: 74150 - RNA, 22 nt, Homo sapiens
aacacuggcugcucgaguucuc

SEQ ID NO: 74151 - RNA, 22 nt, Homo sapiens
aacagaccuagauaguauaguc

SEQ ID NO: 74152 - RNA, 22 nt, Homo sapiens
aacagacugucacauaaaauug

SEQ ID NO: 74153 - RNA, 22 nt, Homo sapiens
aacagagcuggugacuccaggu

SEQ ID NO: 74154 - RNA, 22 nt, Homo sapiens
aacagcacacccgcugcuucca

SEQ ID NO: 74155 - RNA, 22 nt, Homo sapiens
aacagcauaguacccgugauaa

SEQ ID NO: 74156 - RNA, 22 nt, Homo sapiens
aacagcuaguaccaauccacua

SEQ ID NO: 74157 - RNA, 22 nt, Homo sapiens
aacaguaucuaacgagugauga

SEQ ID NO: 74158 - RNA, 21 nt, Homo sapiens
aacagugcugaacagacaccu

SEQ ID NO: 74159 - RNA, 22 nt, Homo sapiens
aacagugcuucauucacacauu

SEQ ID NO: 74160 - RNA, 20 nt, Homo sapiens
aacaguguguaaguuuccuu

SEQ ID NO: 74161 - RNA, 22 nt, Homo sapiens
uuacuugagauggggugucacu

SEQ ID NO: 74162 - RNA, 22 nt, Homo sapiens
uuagaacagugcucaccacaaa

SEQ ID NO: 74163 - RNA, 22 nt, Homo sapiens
uuagaacaguguuugccucgcu

SEQ ID NO: 74164 - RNA, 18 nt, Homo sapiens
uuagagugcauuacuuug

SEQ ID NO: 74165 - RNA, 22 nt, Homo sapiens
uuagaucaacauggaacucuau

SEQ ID NO: 74166 - RNA, 22 nt, Homo sapiens
uuagaugguucaccaugaguag

SEQ ID NO: 74167 - RNA, 22 nt, Homo sapiens
uuagcaccacacacuuuagagg

SEQ ID NO: 74168 - RNA, 22 nt, Homo sapiens
uuagcacuaauucguuggggca

SEQ ID NO: 74169 - RNA, 22 nt, Homo sapiens
uuagcaugucuacuaauuugcu

SEQ ID NO: 74170 - RNA, 22 nt, Homo sapiens
uuagcccaucuugaggaaagua

SEQ ID NO: 74171 - RNA, 22 nt, Homo sapiens
uuaggagacuggauaucucuuu

SEQ ID NO: 74172 - RNA, 22 nt, Homo sapiens
uuaggcuuuguguccccaccca

SEQ ID NO: 74173 - RNA, 22 nt, Homo sapiens
uuaggcuuuuuaaccaguuguu

SEQ ID NO: 74174 - RNA, 22 nt, Homo sapiens
uuagggaguaaucuaaaaaugg

SEQ ID NO: 74175 - RNA, 22 nt, Homo sapiens
uuagguagaauugauuaaguuu

SEQ ID NO: 74176 - RNA, 18 nt, Homo sapiens
uuagguaggucuuugugu

SEQ ID NO: 74177 - RNA, 22 nt, Homo sapiens
uuagguaggugcuuuuuucaca

SEQ ID NO: 74178 - RNA, 22 nt, Homo sapiens
uuaguaguagugcuguaauuuu

SEQ ID NO: 74179 - RNA, 22 nt, Homo sapiens
uuaguaucauccuucugcauuc

SEQ ID NO: 74180 - RNA, 22 nt, Homo sapiens
uuagugaaugggugugauuugu

SEQ ID NO: 74181 - RNA, 22 nt, Homo sapiens
uuaguggaugcugaauaaagaa

SEQ ID NO: 74182 - RNA, 22 nt, Homo sapiens
uuaguucccucauucuugacuu

SEQ ID NO: 74183 - RNA, 22 nt, Homo sapiens
uuaguuuaucagugguuucuga

SEQ ID NO: 74184 - RNA, 20 nt, Homo sapiens
uuauaacuuuuguucugggg

SEQ ID NO: 74185 - RNA, 22 nt, Homo sapiens
uuauacacugugggaguguaaa

SEQ ID NO: 74186 - RNA, 19 nt, Homo sapiens
uuauacuguauuguuuagg

SEQ ID NO: 74187 - RNA, 22 nt, Homo sapiens
uuauagacacguuguaacaaac

SEQ ID NO: 74188 - RNA, 22 nt, Homo sapiens
uuauaggcaggugguguagaug

SEQ ID NO: 74189 - RNA, 22 nt, Homo sapiens
uuauaguuuuucaccuggagaa

SEQ ID NO: 74190 - RNA, 19 nt, Homo sapiens
uuauauaguuucugaggcu

SEQ ID NO: 74191 - RNA, 22 nt, Homo sapiens
uuaucagcagugcgaaaacaga

SEQ ID NO: 74192 - RNA, 22 nt, Homo sapiens
uuaucccacuuucuguuccugu

SEQ ID NO: 74193 - RNA, 22 nt, Homo sapiens
uuaucucaguguuuguaaacaa

SEQ ID NO: 74194 - RNA, 22 nt, Homo sapiens
uuauggcaaugccccacuccua

SEQ ID NO: 74195 - RNA, 22 nt, Homo sapiens
uuauggccauucuuguaggagu

SEQ ID NO: 74196 - RNA, 22 nt, Homo sapiens
uuauggcuauugaugacaauug

SEQ ID NO: 74197 - RNA, 22 nt, Homo sapiens
uuauggcuuugcgguguuagca

SEQ ID NO: 74198 - RNA, 22 nt, Homo sapiens
uacucugcagagaugcauaaca

SEQ ID NO: 74199 - RNA, 22 nt, Homo sapiens
uacugaccugaaggccauggaa

SEQ ID NO: 74200 - RNA, 22 nt, Homo sapiens
uacugaccugucauucagaguu

SEQ ID NO: 74201 - RNA, 20 nt, Homo sapiens
uacugcacuccaaccuaggc

SEQ ID NO: 74202 - RNA, 22 nt, Homo sapiens
uacugcacuccagccuggguga

SEQ ID NO: 74203 - RNA, 22 nt, Homo sapiens
uacugcacuccagcuuaggaga

SEQ ID NO: 74204 - RNA, 22 nt, Homo sapiens
uacugcaguugcagcuugagga

SEQ ID NO: 74205 - RNA, 22 nt, Homo sapiens
uacugcauuccaaucugggcga

SEQ ID NO: 74206 - RNA, 22 nt, Homo sapiens
uacuggccccaaaguagguagu

SEQ ID NO: 74207 - RNA, 22 nt, Homo sapiens
uacuggccuugaacucuggugu

SEQ ID NO: 74208 - RNA, 22 nt, Homo sapiens
uacuuagagacaugcagcacug

SEQ ID NO: 74209 - RNA, 22 nt, Homo sapiens
uacuuuguagauuguuuccuuu

SEQ ID NO: 74210 - RNA, 22 nt, Homo sapiens
uacuuuguuauagcagcaggaa

SEQ ID NO: 74211 - RNA, 22 nt, Homo sapiens
uagaacauuccaggugauguug

SEQ ID NO: 74212 - RNA, 22 nt, Homo sapiens
uagaauggaaggcauguuugcc

SEQ ID NO: 74213 - RNA, 22 nt, Homo sapiens
uagacaacugaaacacugugca

SEQ ID NO: 74214 - RNA, 20 nt, Homo sapiens
uagacagcuagauuagauag

SEQ ID NO: 74215 - RNA, 22 nt, Homo sapiens
uagacccauuguucagagagug

SEQ ID NO: 74216 - RNA, 22 nt, Homo sapiens
uagagagcuguuugaaagcagg

SEQ ID NO: 74217 - RNA, 22 nt, Homo sapiens
uagagcacagugauuagaccua

SEQ ID NO: 74218 - RNA, 22 nt, Homo sapiens
uagagcaugugccauacguaca

SEQ ID NO: 74219 - RNA, 22 nt, Homo sapiens
uagagcuagggacucgcaaugu

SEQ ID NO: 74220 - RNA, 22 nt, Homo sapiens
uagaggaaugaauuuggccaga

SEQ ID NO: 74221 - RNA, 19 nt, Homo sapiens
uagagguuuaagaaaagaa

SEQ ID NO: 74222 - RNA, 22 nt, Homo sapiens
uagaguacucugguaaguucuu

SEQ ID NO: 74223 - RNA, 22 nt, Homo sapiens
uagaguguaaaccacauaguga

SEQ ID NO: 74224 - RNA, 21 nt, Homo sapiens
uagauaguugguucugaaucu

SEQ ID NO: 74225 - RNA, 22 nt, Homo sapiens
uagaucauauucagugcuuacu

SEQ ID NO: 74226 - RNA, 22 nt, Homo sapiens
uagauuauccggcugggacaau

SEQ ID NO: 74227 - RNA, 22 nt, Homo sapiens
uagauuauuggcugauuugauc

SEQ ID NO: 74228 - RNA, 22 nt, Homo sapiens
uagauucaucuguuccuuuuga

SEQ ID NO: 74229 - RNA, 22 nt, Homo sapiens
uagauuguuuaaguggcacaca

SEQ ID NO: 74230 - RNA, 21 nt, Homo sapiens
uagcaaauugcuauuaaggca

SEQ ID NO: 74231 - RNA, 22 nt, Homo sapiens
uagcaaguguuuaagcacuuuu

SEQ ID NO: 74232 - RNA, 22 nt, Homo sapiens
uagcacaugucagguaauuugc

SEQ ID NO: 74233 - RNA, 22 nt, Homo sapiens
uagcacccucuccuaguccugc

SEQ ID NO: 74234 - RNA, 22 nt, Homo sapiens
uagcaccucuuuggccuuucgu

SEQ ID NO: 74235 - RNA, 22 nt, Homo sapiens
uagcacugucuugcaccugugc

SEQ ID NO: 74236 - RNA, 22 nt, Homo sapiens
uagcagaauauaccucuuacuu

SEQ ID NO: 74237 - RNA, 20 nt, Homo sapiens
uauuacagaguaauggugga

SEQ ID NO: 74238 - RNA, 22 nt, Homo sapiens
uauuacauccauaggcucugcu

SEQ ID NO: 74239 - RNA, 22 nt, Homo sapiens
uauuacugucaauaucacagaa

SEQ ID NO: 74240 - RNA, 22 nt, Homo sapiens
uauuacuguuauuccuaucaaa

SEQ ID NO: 74241 - RNA, 22 nt, Homo sapiens
uauuacuugucugugucucaau

SEQ ID NO: 74242 - RNA, 22 nt, Homo sapiens
uauuagguuggugcaaaaguaa

SEQ ID NO: 74243 - RNA, 22 nt, Homo sapiens
uauuagguuggugcaaaaguua

SEQ ID NO: 74244 - RNA, 22 nt, Homo sapiens
uauucaucuuaagcuuuggcuu

SEQ ID NO: 74245 - RNA, 22 nt, Homo sapiens
uauuccacuauuaguccagaug

SEQ ID NO: 74246 - RNA, 22 nt, Homo sapiens
uauuccauuugugaaaggaagu

SEQ ID NO: 74247 - RNA, 18 nt, Homo sapiens
uauuccucuuccucuauc

SEQ ID NO: 74248 - RNA, 22 nt, Homo sapiens
uauugaauuugagcugucucuu

SEQ ID NO: 74249 - RNA, 22 nt, Homo sapiens
uauugacuugaugagggagggu

SEQ ID NO: 74250 - RNA, 22 nt, Homo sapiens
uauugcaauuggcagagugcua

SEQ ID NO: 74251 - RNA, 22 nt, Homo sapiens
uauugcaauuggggaaacuggg

SEQ ID NO: 74252 - RNA, 22 nt, Homo sapiens
uauugcacaugaggagacauug

SEQ ID NO: 74253 - RNA, 20 nt, Homo sapiens
uauugcacuccagucugggc

SEQ ID NO: 74254 - RNA, 22 nt, Homo sapiens
uauugcacuccucaugcauuug

SEQ ID NO: 74255 - RNA, 22 nt, Homo sapiens
uauugcauauuauucuaguggc

SEQ ID NO: 74256 - RNA, 22 nt, Homo sapiens
uauugcuaaaacucaugguugc

SEQ ID NO: 74257 - RNA, 22 nt, Homo sapiens
uauugcucugacugauuggaug

SEQ ID NO: 74258 - RNA, 22 nt, Homo sapiens
uauugcuuaugaugcugaauua

SEQ ID NO: 74259 - RNA, 22 nt, Homo sapiens
uauugcuuuuaacccaaucucu

SEQ ID NO: 74260 - RNA, 22 nt, Homo sapiens
uauuggcucuguuucucugaag

SEQ ID NO: 74261 - RNA, 22 nt, Homo sapiens
uauugggcuucucagaauagag

SEQ ID NO: 74262 - RNA, 22 nt, Homo sapiens
uauuguacauauccucccuuca

SEQ ID NO: 74263 - RNA, 22 nt, Homo sapiens
uauuguccacuuugcacugugu

SEQ ID NO: 74264 - RNA, 22 nt, Homo sapiens
uauuucaguugcguuucccgag

SEQ ID NO: 74265 - RNA, 22 nt, Homo sapiens
uauuuggauagucuggaaaaaa

SEQ ID NO: 74266 - RNA, 22 nt, Homo sapiens
uauuugguuauaugaguaaguu

SEQ ID NO: 74267 - RNA, 22 nt, Homo sapiens
uauuugguuggugcaaaaguaa

SEQ ID NO: 74268 - RNA, 22 nt, Homo sapiens
ucaaacacuccauaucgcgauu

SEQ ID NO: 74269 - RNA, 22 nt, Homo sapiens
ucaaagucuucucaaguaacau

SEQ ID NO: 74270 - RNA, 22 nt, Homo sapiens
ucaaagugagcuccuucucacu

SEQ ID NO: 74271 - RNA, 21 nt, Homo sapiens
ucaaaguguucuuuuguugaa

SEQ ID NO: 74272 - RNA, 18 nt, Homo sapiens
ucaaauacuuugggcagu

SEQ ID NO: 74273 - RNA, 22 nt, Homo sapiens
ucaaaugcucuuugcagagagg

SEQ ID NO: 74274 - RNA, 22 nt, Homo sapiens
ucaaauguuuguuuaaggcuua

SEQ ID NO: 74275 - RNA, 22 nt, Homo sapiens
ucaacagugauggaaaguuaua

SEQ ID NO: 74276 - RNA, 22 nt, Homo sapiens
ucaacauugcugucaggcaucu

SEQ ID NO: 74277 - RNA, 22 nt, Homo sapiens
ucaagaccucacauagaggaga

SEQ ID NO: 74278 - RNA, 19 nt, Homo sapiens
ucaagcuauucuccugccu

SEQ ID NO: 74279 - RNA, 18 nt, Homo sapiens
ucaagcuauugucaugcc

SEQ ID NO: 74280 - RNA, 22 nt, Homo sapiens
ucaaggacucagagagggauua

SEQ ID NO: 74281 - RNA, 21 nt, Homo sapiens
ucaaggaguauacguaugcca

SEQ ID NO: 74282 - RNA, 22 nt, Homo sapiens
ucaaguagugacucgaguuauu

SEQ ID NO: 74283 - RNA, 22 nt, Homo sapiens
ucaagugcauaugcuaacgguu

SEQ ID NO: 74284 - RNA, 22 nt, Homo sapiens
ucaaugaaugaugguugguaug

SEQ ID NO: 74285 - RNA, 22 nt, Homo sapiens
ucaaugcaugugacaaagagua

SEQ ID NO: 74286 - RNA, 18 nt, Homo sapiens
ucaauguggauguucuuu

SEQ ID NO: 74287 - RNA, 19 nt, Homo sapiens
ucaauucugucaauggcuu

SEQ ID NO: 74288 - RNA, 22 nt, Homo sapiens
ucacaaagcuuggccugcuucu

SEQ ID NO: 74289 - RNA, 18 nt, Homo sapiens
ucacaaccacagugcugu

SEQ ID NO: 74290 - RNA, 22 nt, Homo sapiens
ucacaagugagaggaauuagau

SEQ ID NO: 74291 - RNA, 22 nt, Homo sapiens
ucacaauggagacucgggcgga

SEQ ID NO: 74292 - RNA, 22 nt, Homo sapiens
ucacaauggcugaacuaauuua

SEQ ID NO: 74293 - RNA, 22 nt, Homo sapiens
ucacaccauucuucuacuucag

SEQ ID NO: 74294 - RNA, 22 nt, Homo sapiens
uauauaagcugaugagccacaa

SEQ ID NO: 74295 - RNA, 22 nt, Homo sapiens
uauaucacaugcacucauuuuc

SEQ ID NO: 74296 - RNA, 22 nt, Homo sapiens
uauaugcauugugggguacuga

SEQ ID NO: 74297 - RNA, 22 nt, Homo sapiens
uauauguucugugucccuuucg

SEQ ID NO: 74298 - RNA, 22 nt, Homo sapiens
uauauguucuugcacuggaaag

SEQ ID NO: 74299 - RNA, 22 nt, Homo sapiens
uaucaacaggguggccagugua

SEQ ID NO: 74300 - RNA, 22 nt, Homo sapiens
uaucaagaugacaaacuuugcu

SEQ ID NO: 74301 - RNA, 22 nt, Homo sapiens
uaucaagauggauaaggauaga

SEQ ID NO: 74302 - RNA, 22 nt, Homo sapiens
uaucaaucuagggaaacuccaa

SEQ ID NO: 74303 - RNA, 22 nt, Homo sapiens
uaucacaaacuuagcaguuuaa

SEQ ID NO: 74304 - RNA, 22 nt, Homo sapiens
uaucacacuggaagaaguuaag

SEQ ID NO: 74305 - RNA, 23 nt, Homo sapiens
uaucacacuuucucugugccaca

SEQ ID NO: 74306 - RNA, 22 nt, Homo sapiens
uaucacagauauuaugggccaa

SEQ ID NO: 74307 - RNA, 22 nt, Homo sapiens
uaucacagcauugucuauaaua

SEQ ID NO: 74308 - RNA, 22 nt, Homo sapiens
uaucacagguggacugcacacc

SEQ ID NO: 74309 - RNA, 22 nt, Homo sapiens
uaucacaguaaaucugggugca

SEQ ID NO: 74310 - RNA, 22 nt, Homo sapiens
uaucacaguugcauauuuaagg

SEQ ID NO: 74311 - RNA, 21 nt, Homo sapiens
uaucacauuggugauuaaguu

SEQ ID NO: 74312 - RNA, 22 nt, Homo sapiens
uaucacccuuucauuguucuuc

SEQ ID NO: 74313 - RNA, 22 nt, Homo sapiens
uaucaccuugcaggagcuauga

SEQ ID NO: 74314 - RNA, 22 nt, Homo sapiens
uaucacuauucauccuagcucc

SEQ ID NO: 74315 - RNA, 22 nt, Homo sapiens
uaucacugucaggcccucauau

SEQ ID NO: 74316 - RNA, 22 nt, Homo sapiens
uaucacuuugauaguuuaaaug

SEQ ID NO: 74317 - RNA, 22 nt, Homo sapiens
uaucagaguuacacugaagacu

SEQ ID NO: 74318 - RNA, 22 nt, Homo sapiens
uaucagcacaguggguucaugg

SEQ ID NO: 74319 - RNA, 22 nt, Homo sapiens
uaucagcagagucauacuucaa

SEQ ID NO: 74320 - RNA, 22 nt, Homo sapiens
uaucauaguuuggacuuucauu

SEQ ID NO: 74321 - RNA, 22 nt, Homo sapiens
uaucaucauguuuuugcugugu

SEQ ID NO: 74322 - RNA, 22 nt, Homo sapiens
uaucauggggacugcagccuag

SEQ ID NO: 74323 - RNA, 21 nt, Homo sapiens
uaucauggugaaacccugucu

SEQ ID NO: 74324 - RNA, 18 nt, Homo sapiens
uaucauguagggaaguug

SEQ ID NO: 74325 - RNA, 22 nt, Homo sapiens
uaucccaguggauguaccccau

SEQ ID NO: 74326 - RNA, 22 nt, Homo sapiens
uauccugaagcuuuauuuaagu

SEQ ID NO: 74327 - RNA, 22 nt, Homo sapiens
uaucuacauguagguauguaug

SEQ ID NO: 74328 - RNA, 22 nt, Homo sapiens
uaucucaguguacaggaugaua

SEQ ID NO: 74329 - RNA, 22 nt, Homo sapiens
uaucucuguggguagugcugaa

SEQ ID NO: 74330 - RNA, 22 nt, Homo sapiens
uaaggcucuuguuauuuugagg

SEQ ID NO: 74331 - RNA, 22 nt, Homo sapiens
uaaggcuucuuggaauacugca

SEQ ID NO: 74332 - RNA, 22 nt, Homo sapiens
uaaggcuuugucuuaggacuuu

SEQ ID NO: 74333 - RNA, 22 nt, Homo sapiens
uaagguauuuacauuucuguuu

SEQ ID NO: 74334 - RNA, 22 nt, Homo sapiens
uaagguguagacuggucacaag

SEQ ID NO: 74335 - RNA, 22 nt, Homo sapiens
uaaguaaaugaaagguugauuu

SEQ ID NO: 74336 - RNA, 22 nt, Homo sapiens
uaaguaauuguuaauagggaag

SEQ ID NO: 74337 - RNA, 22 nt, Homo sapiens
uaaguacaugcuagauggaaug

SEQ ID NO: 74338 - RNA, 22 nt, Homo sapiens
uaaguacuuuacagacauuauc

SEQ ID NO: 74339 - RNA, 22 nt, Homo sapiens
uaaguagcugggaguacaggca

SEQ ID NO: 74340 - RNA, 22 nt, Homo sapiens
uaaguaguccugauuuaaccuu

SEQ ID NO: 74341 - RNA, 15 nt, Homo sapiens
uaaguaguuggcugu

SEQ ID NO: 74342 - RNA, 22 nt, Homo sapiens
uaaguauuaggccccaggcugg

SEQ ID NO: 74343 - RNA, 22 nt, Homo sapiens
uaagucuuuuuggaguuuauaa

SEQ ID NO: 74344 - RNA, 22 nt, Homo sapiens
uaagugaauuugacagguaaug

SEQ ID NO: 74345 - RNA, 22 nt, Homo sapiens
uaagugcuguguuguuaccuaa

SEQ ID NO: 74346 - RNA, 18 nt, Homo sapiens
uaagugcuuuaaacacau

SEQ ID NO: 74347 - RNA, 22 nt, Homo sapiens
uaaguggugcauuguuaaaugg

SEQ ID NO: 74348 - RNA, 22 nt, Homo sapiens
uaagugguguucauucuuuuga

SEQ ID NO: 74349 - RNA, 22 nt, Homo sapiens
uaaguuagugugagaauuuugc

SEQ ID NO: 74350 - RNA, 20 nt, Homo sapiens
uaaguuguauuugucaugaa

SEQ ID NO: 74351 - RNA, 21 nt, Homo sapiens
uaauaaugucucagacaccua

SEQ ID NO: 74352 - RNA, 22 nt, Homo sapiens
uaauagcaguguuacuaggacu

SEQ ID NO: 74353 - RNA, 22 nt, Homo sapiens
uaauccuagcacuuuggaagac

SEQ ID NO: 74354 - RNA, 22 nt, Homo sapiens
uaauccuggcacuuugggaggc

SEQ ID NO: 74355 - RNA, 22 nt, Homo sapiens
uaaugcacuuuccuccaaggcu

SEQ ID NO: 74356 - RNA, 22 nt, Homo sapiens
uaaugcaucaugguuggcaaac

SEQ ID NO: 74357 - RNA, 19 nt, Homo sapiens
uaaugccacugccuggcau

SEQ ID NO: 74358 - RNA, 22 nt, Homo sapiens
uaaugcuaucugggccaggggu

SEQ ID NO: 74359 - RNA, 21 nt, Homo sapiens
uaauggcaugaucucggcuca

SEQ ID NO: 74360 - RNA, 22 nt, Homo sapiens
uaauucuguauguaucagaguu

SEQ ID NO: 74361 - RNA, 22 nt, Homo sapiens
uacaaaguaacaguuccuguau

SEQ ID NO: 74362 - RNA, 22 nt, Homo sapiens
uacaagcacaggcagcaggcug

SEQ ID NO: 74363 - RNA, 21 nt, Homo sapiens
uacaaugcacaggagagccuc

SEQ ID NO: 74364 - RNA, 16 nt, Homo sapiens
uacaauguagaaaaca

SEQ ID NO: 74365 - RNA, 22 nt, Homo sapiens
uacacagucaaaaauuuccagg

SEQ ID NO: 74366 - RNA, 22 nt, Homo sapiens
uacacaugugaguucuuuucua

SEQ ID NO: 74367 - RNA, 22 nt, Homo sapiens
auggcuguuccugggaguucua

SEQ ID NO: 74368 - RNA, 22 nt, Homo sapiens
auggcuguuuuuuauguuacag

SEQ ID NO: 74369 - RNA, 22 nt, Homo sapiens
auggcuuaagacaaccuuucau

SEQ ID NO: 74370 - RNA, 22 nt, Homo sapiens
auggcuuucaggacguggcgag

SEQ ID NO: 74371 - RNA, 22 nt, Homo sapiens
auggcuuugggcugcucugccc

SEQ ID NO: 74372 - RNA, 22 nt, Homo sapiens
auggcuuuggucucccagugau

SEQ ID NO: 74373 - RNA, 22 nt, Homo sapiens
augggaaaaucagaaggccugg

SEQ ID NO: 74374 - RNA, 21 nt, Homo sapiens
augggacuaacugaugggucu

SEQ ID NO: 74375 - RNA, 22 nt, Homo sapiens
augggagugugguuagagaccu

SEQ ID NO: 74376 - RNA, 22 nt, Homo sapiens
augggauaguaucaguggaaua

SEQ ID NO: 74377 - RNA, 17 nt, Homo sapiens
augggguuguagcccca

SEQ ID NO: 74378 - RNA, 22 nt, Homo sapiens
augguacucucuugucugcaaa

SEQ ID NO: 74379 - RNA, 22 nt, Homo sapiens
augguacuggguaaaagugggg

SEQ ID NO: 74380 - RNA, 22 nt, Homo sapiens
auggucccuguuccaugcuccu

SEQ ID NO: 74381 - RNA, 21 nt, Homo sapiens
auggugagaaaguagugucaa

SEQ ID NO: 74382 - RNA, 22 nt, Homo sapiens
auguaaacauuuggucuaaauu

SEQ ID NO: 74383 - RNA, 22 nt, Homo sapiens
auguaagugugcucaaauguua

SEQ ID NO: 74384 - RNA, 17 nt, Homo sapiens
auguaauccucaucucu

SEQ ID NO: 74385 - RNA, 22 nt, Homo sapiens
auguaauguuaaauugcuaauu

SEQ ID NO: 74386 - RNA, 22 nt, Homo sapiens
auguauacaugcaggucacagg

SEQ ID NO: 74387 - RNA, 22 nt, Homo sapiens
augucaaggugaagaaagauca

SEQ ID NO: 74388 - RNA, 22 nt, Homo sapiens
augucaaggugggugauaguuu

SEQ ID NO: 74389 - RNA, 22 nt, Homo sapiens
augucauagaagccugugaacc

SEQ ID NO: 74390 - RNA, 17 nt, Homo sapiens
augugaauguucaaaua

SEQ ID NO: 74391 - RNA, 22 nt, Homo sapiens
augugacugauggagaauaugu

SEQ ID NO: 74392 - RNA, 22 nt, Homo sapiens
augugacugauguaaucagaca

SEQ ID NO: 74393 - RNA, 22 nt, Homo sapiens
augugacuuuuuccugugccuu

SEQ ID NO: 74394 - RNA, 22 nt, Homo sapiens
augugaugguuaauuuuaugug

SEQ ID NO: 74395 - RNA, 22 nt, Homo sapiens
augugcaaagcacuguucagca

SEQ ID NO: 74396 - RNA, 22 nt, Homo sapiens
augugcaauggugucaccacau

SEQ ID NO: 74397 - RNA, 22 nt, Homo sapiens
augugcacauucugguaaauau

SEQ ID NO: 74398 - RNA, 21 nt, Homo sapiens
augugcacuaugucauuuaau

SEQ ID NO: 74399 - RNA, 22 nt, Homo sapiens
augugcagauguuacaaauugu

SEQ ID NO: 74400 - RNA, 22 nt, Homo sapiens
augugccaauuaggauuccaag

SEQ ID NO: 74401 - RNA, 22 nt, Homo sapiens
augugcuagguacuguuuagca

SEQ ID NO: 74402 - RNA, 22 nt, Homo sapiens
auguggaaagcagcaugauaug

SEQ ID NO: 74403 - RNA, 22 nt, Homo sapiens
auguggauaucuauaucuggau

SEQ ID NO: 74404 - RNA, 22 nt, Homo sapiens
auguggcacuugacuuucucgc

SEQ ID NO: 74405 - RNA, 22 nt, Homo sapiens
auguggcuuuccuagaucuuag

SEQ ID NO: 74406 - RNA, 22 nt, Homo sapiens
augugggaggacuuggcuguug

SEQ ID NO: 74407 - RNA, 22 nt, Homo sapiens
augugguaggcccaugagucau

SEQ ID NO: 74408 - RNA, 22 nt, Homo sapiens
augugugcuugauguaaaaagu

SEQ ID NO: 74409 - RNA, 22 nt, Homo sapiens
auguguucaucacagcacaauu

SEQ ID NO: 74410 - RNA, 22 nt, Homo sapiens
auguuaagauggaacaugggaa

SEQ ID NO: 74411 - RNA, 22 nt, Homo sapiens
auguuagcaucuggcacuaugg

SEQ ID NO: 74412 - RNA, 22 nt, Homo sapiens
auguuugguagugaauauggua

SEQ ID NO: 74413 - RNA, 22 nt, Homo sapiens
auuaaguaaugguuccaauaau

SEQ ID NO: 74414 - RNA, 22 nt, Homo sapiens
auuaagugcuugcagaagucca

SEQ ID NO: 74415 - RNA, 22 nt, Homo sapiens
auuaagugcuugccagugcugg

SEQ ID NO: 74416 - RNA, 22 nt, Homo sapiens
auuacccuuagacuccagagug

SEQ ID NO: 74417 - RNA, 22 nt, Homo sapiens
auuagaugguuauaggugugag

SEQ ID NO: 74418 - RNA, 22 nt, Homo sapiens
auuagguaauauaaucauggca

SEQ ID NO: 74419 - RNA, 22 nt, Homo sapiens
auuagguacugugguuuccaga

SEQ ID NO: 74420 - RNA, 22 nt, Homo sapiens
auuagguuaggcaaacuucugu

SEQ ID NO: 74421 - RNA, 22 nt, Homo sapiens
auuagugaaugugaugucuuga

SEQ ID NO: 74422 - RNA, 22 nt, Homo sapiens
auuaucacaguuuugcauaugg

SEQ ID NO: 74423 - RNA, 22 nt, Homo sapiens
auucaaagugcauguucccacu

SEQ ID NO: 74424 - RNA, 22 nt, Homo sapiens
auucacuguggguccuuuggau

SEQ ID NO: 74425 - RNA, 22 nt, Homo sapiens
auucaucagggauauuggucug

SEQ ID NO: 74426 - RNA, 22 nt, Homo sapiens
auuccacaguuaacacagaccg

SEQ ID NO: 74427 - RNA, 22 nt, Homo sapiens
auuccacuuacaugaaguaccu

SEQ ID NO: 74428 - RNA, 20 nt, Homo sapiens
auuccacuuguuugagguac

SEQ ID NO: 74429 - RNA, 21 nt, Homo sapiens
auuccacuuuuccuucaggga

SEQ ID NO: 74430 - RNA, 23 nt, Homo sapiens
auuccaguggcaauuggagaaac

SEQ ID NO: 74431 - RNA, 22 nt, Homo sapiens
auuccauagugucuguggcaga

SEQ ID NO: 74432 - RNA, 22 nt, Homo sapiens
auucccuuagcugccucagccu

SEQ ID NO: 74433 - RNA, 18 nt, Homo sapiens
auucuacaggccuuuuga

SEQ ID NO: 74434 - RNA, 23 nt, Homo sapiens
auugaacacuuucauaugugagg

SEQ ID NO: 74435 - RNA, 20 nt, Homo sapiens
auugaacucaguauucugaa

SEQ ID NO: 74436 - RNA, 22 nt, Homo sapiens
auugaacuuaaaagacuugcca

SEQ ID NO: 74437 - RNA, 22 nt, Homo sapiens
auugaaugaaauggcagacacu

SEQ ID NO: 74438 - RNA, 16 nt, Homo sapiens
auugacaguggguguu

SEQ ID NO: 74439 - RNA, 19 nt, Homo sapiens
auugacauugggguguuca

SEQ ID NO: 74440 - RNA, 22 nt, Homo sapiens
auugacuugauauauagcugau

SEQ ID NO: 74441 - RNA, 22 nt, Homo sapiens
auugauagaucauaugguaggu

SEQ ID NO: 74442 - RNA, 22 nt, Homo sapiens
auugcaaagcguagacucuaaa

SEQ ID NO: 74443 - RNA, 22 nt, Homo sapiens
auugcaacaguguugagaggug

SEQ ID NO: 74444 - RNA, 22 nt, Homo sapiens
auugcaacuuccgccuccuggg

SEQ ID NO: 74445 - RNA, 22 nt, Homo sapiens
auugcaaugggaaacuaugaaa

SEQ ID NO: 74446 - RNA, 22 nt, Homo sapiens
auugcacaucugcacuacagcc

SEQ ID NO: 74447 - RNA, 22 nt, Homo sapiens
auugcaccacugcccuccagcc

SEQ ID NO: 74448 - RNA, 22 nt, Homo sapiens
auugcaccccagccugggugac

SEQ ID NO: 74449 - RNA, 19 nt, Homo sapiens
auugcacuccaaccugggu

SEQ ID NO: 74450 - RNA, 23 nt, Homo sapiens
auugcacuccagccuaccugggc

SEQ ID NO: 74451 - RNA, 22 nt, Homo sapiens
auugcacuccagccuaggcaac

SEQ ID NO: 74452 - RNA, 22 nt, Homo sapiens
auugcacuccagccugggcgac

SEQ ID NO: 74453 - RNA, 22 nt, Homo sapiens
auugcacuccagccugggugag

SEQ ID NO: 74454 - RNA, 22 nt, Homo sapiens
auugcacuccagucucaccagg

SEQ ID NO: 74455 - RNA, 22 nt, Homo sapiens
auugcacuccauccugggcaau

SEQ ID NO: 74456 - RNA, 23 nt, Homo sapiens
auugcagaaucacagagguagug

SEQ ID NO: 74457 - RNA, 22 nt, Homo sapiens
auugcagcccacccugggugau

SEQ ID NO: 74458 - RNA, 19 nt, Homo sapiens
auugcaguguaaaacuauu

SEQ ID NO: 74459 - RNA, 22 nt, Homo sapiens
ugugccacuccaaccuggguga

SEQ ID NO: 74460 - RNA, 22 nt, Homo sapiens
ugugccacuccaggaggcuguu

SEQ ID NO: 74461 - RNA, 22 nt, Homo sapiens
ugugccacugcacucccgccug

SEQ ID NO: 74462 - RNA, 22 nt, Homo sapiens
ugugccacugcacucugggcaa

SEQ ID NO: 74463 - RNA, 22 nt, Homo sapiens
ugugccuacugugggagcguca

SEQ ID NO: 74464 - RNA, 22 nt, Homo sapiens
ugugccuaguaauguguccaga

SEQ ID NO: 74465 - RNA, 22 nt, Homo sapiens
ugugccugagguuaacauuguu

SEQ ID NO: 74466 - RNA, 22 nt, Homo sapiens
ugugccuucuaagaaggagucu

SEQ ID NO: 74467 - RNA, 22 nt, Homo sapiens
ugugcuaauacauacagugcua

SEQ ID NO: 74468 - RNA, 22 nt, Homo sapiens
uguggcacuguguccagagaaa

SEQ ID NO: 74469 - RNA, 17 nt, Homo sapiens
uguggcucuuaugcuga

SEQ ID NO: 74470 - RNA, 22 nt, Homo sapiens
uguggcuuuacagcaugguuca

SEQ ID NO: 74471 - RNA, 23 nt, Homo sapiens
ugugguauuauuccauuuauagg

SEQ ID NO: 74472 - RNA, 22 nt, Homo sapiens
uguggucaucacuugaagguaa

SEQ ID NO: 74473 - RNA, 22 nt, Homo sapiens
uguguaaauaugauagaggaau

SEQ ID NO: 74474 - RNA, 22 nt, Homo sapiens
uguguaauaccuuugacuauau

SEQ ID NO: 74475 - RNA, 22 nt, Homo sapiens
uguguaauacucuaaugaugca

SEQ ID NO: 74476 - RNA, 22 nt, Homo sapiens
uguguacugcagaguauucugu

SEQ ID NO: 74477 - RNA, 22 nt, Homo sapiens
ugugucacugaggguuagugua

SEQ ID NO: 74478 - RNA, 22 nt, Homo sapiens
ugugucacugcacuccagccug

SEQ ID NO: 74479 - RNA, 22 nt, Homo sapiens
ugugucuccugaaaauucacau

SEQ ID NO: 74480 - RNA, 22 nt, Homo sapiens
ugugucuugaauuuuguaugua

SEQ ID NO: 74481 - RNA, 22 nt, Homo sapiens
ugugucuugagagucucgagaa

SEQ ID NO: 74482 - RNA, 22 nt, Homo sapiens
uguguuugauaaguccauaguu

SEQ ID NO: 74483 - RNA, 22 nt, Homo sapiens
uguuaacauggucucagucugu

SEQ ID NO: 74484 - RNA, 22 nt, Homo sapiens
uguuacagcagaauugaaagag

SEQ ID NO: 74485 - RNA, 22 nt, Homo sapiens
uguuacagcagaauugauugca

SEQ ID NO: 74486 - RNA, 22 nt, Homo sapiens
uguuacagugacuaauguuuua

SEQ ID NO: 74487 - RNA, 22 nt, Homo sapiens
uguuaucauuacguucuuaguu

SEQ ID NO: 74488 - RNA, 22 nt, Homo sapiens
uguuauguucuacuuuuaggug

SEQ ID NO: 74489 - RNA, 22 nt, Homo sapiens
uguuauguuguuugagaaaguc

SEQ ID NO: 74490 - RNA, 22 nt, Homo sapiens
uguuauuuuguguuagggcaca

SEQ ID NO: 74491 - RNA, 22 nt, Homo sapiens
uguucauggauccaguggcuuc

SEQ ID NO: 74492 - RNA, 22 nt, Homo sapiens
uguucuugagccuuuagaccua

SEQ ID NO: 74493 - RNA, 19 nt, Homo sapiens
uguugcacauaucaauaug

SEQ ID NO: 74494 - RNA, 22 nt, Homo sapiens
uguugguuaaaucagguuuuaa

SEQ ID NO: 74495 - RNA, 22 nt, Homo sapiens
uguuugcuguuuucuccaauga

SEQ ID NO: 74496 - RNA, 22 nt, Homo sapiens
uguuugcuuaacguggagccag

SEQ ID NO: 74497 - RNA, 22 nt, Homo sapiens
uguuuguuugagauggagucuc

SEQ ID NO: 74498 - RNA, 22 nt, Homo sapiens
uguuuguuugugauacgguaca

SEQ ID NO: 74499 - RNA, 22 nt, Homo sapiens
uguuuugguugucccuggccag

SEQ ID NO: 74500 - RNA, 21 nt, Homo sapiens
uguuuuugcuguguaucucuc

SEQ ID NO: 74501 - RNA, 22 nt, Homo sapiens
uuaaacucaucacccagguagu

SEQ ID NO: 74502 - RNA, 22 nt, Homo sapiens
uuaaacugcuugaauuggguuu

SEQ ID NO: 74503 - RNA, 22 nt, Homo sapiens
uuaaagcuggcguuacaguuug

SEQ ID NO: 74504 - RNA, 22 nt, Homo sapiens
uuaaaguaauugaaauggccuu

SEQ ID NO: 74505 - RNA, 22 nt, Homo sapiens
uuaaagugaucauaaggauagu

SEQ ID NO: 74506 - RNA, 22 nt, Homo sapiens
uuaaaguguuuucaaaauguca

SEQ ID NO: 74507 - RNA, 22 nt, Homo sapiens
uuaaaugcucacauaaagguag

SEQ ID NO: 74508 - RNA, 22 nt, Homo sapiens
uuaaaugucuguagaugugcug

SEQ ID NO: 74509 - RNA, 22 nt, Homo sapiens
uuaacagugucaaucuguagua

SEQ ID NO: 74510 - RNA, 22 nt, Homo sapiens
uuaacaguuaauucuuuggcaa

SEQ ID NO: 74511 - RNA, 23 nt, Homo sapiens
uuaagcaacggcugcuuuucaga

SEQ ID NO: 74512 - RNA, 22 nt, Homo sapiens
uuaagcuaguuuauucaggaaa

SEQ ID NO: 74513 - RNA, 22 nt, Homo sapiens
uuaagcucauuuccauucuaca

SEQ ID NO: 74514 - RNA, 22 nt, Homo sapiens
uuaagcugaauuuaagcuucgg

SEQ ID NO: 74515 - RNA, 22 nt, Homo sapiens
uuaaggaaagcauuuaauucag

SEQ ID NO: 74516 - RNA, 22 nt, Homo sapiens
uuaaggcuuguacuuguuuucu

SEQ ID NO: 74517 - RNA, 22 nt, Homo sapiens
uuaagguaugugggcauuuugu

SEQ ID NO: 74518 - RNA, 23 nt, Homo sapiens
uuaaggugaugucuuugugccuc

SEQ ID NO: 74519 - RNA, 22 nt, Homo sapiens
uuaaguaaucagagaagagaac

SEQ ID NO: 74520 - RNA, 22 nt, Homo sapiens
uuaagugcucaguuacucaguu

SEQ ID NO: 74521 - RNA, 20 nt, Homo sapiens
uuaagugcuuucugcuuaga

SEQ ID NO: 74522 - RNA, 21 nt, Homo sapiens
uuaagugcuuuguaugcacua

SEQ ID NO: 74523 - RNA, 22 nt, Homo sapiens
uuaagugguagguggugcccaa

SEQ ID NO: 74524 - RNA, 22 nt, Homo sapiens
uuaaguguaaguggugugggac

SEQ ID NO: 74525 - RNA, 22 nt, Homo sapiens
uuaaguuguagcuacaaauaca

SEQ ID NO: 74526 - RNA, 22 nt, Homo sapiens
uuaauacucuucuaaguagucc

SEQ ID NO: 74527 - RNA, 22 nt, Homo sapiens
uuaauagugacucauuuuccac

SEQ ID NO: 74528 - RNA, 22 nt, Homo sapiens
uuaaucacagcugaacucaaac

SEQ ID NO: 74529 - RNA, 22 nt, Homo sapiens
uuaaugacaucauaggugaagu

SEQ ID NO: 74530 - RNA, 22 nt, Homo sapiens
uuaaugcuuggggaguaguucu

SEQ ID NO: 74531 - RNA, 22 nt, Homo sapiens
uuaaugcuuuugggauauuucu

SEQ ID NO: 74532 - RNA, 22 nt, Homo sapiens
uuacacaguaggucccuaguaa

SEQ ID NO: 74533 - RNA, 22 nt, Homo sapiens
uuacacguaauaguaagccugg

SEQ ID NO: 74534 - RNA, 22 nt, Homo sapiens
uuacagcugcuccccaucacuc

SEQ ID NO: 74535 - RNA, 17 nt, Homo sapiens
uuacaggugcugagagu

SEQ ID NO: 74536 - RNA, 22 nt, Homo sapiens
uuacagucuuaggcagugcuuu

SEQ ID NO: 74537 - RNA, 22 nt, Homo sapiens
uuacagugguugcuauugugaa

SEQ ID NO: 74538 - RNA, 19 nt, Homo sapiens
uuacagugugcccuuuuag

SEQ ID NO: 74539 - RNA, 21 nt, Homo sapiens
uuacaguugguugugaggugg

SEQ ID NO: 74540 - RNA, 22 nt, Homo sapiens
uuacaguugugagccaccaugc

SEQ ID NO: 74541 - RNA, 22 nt, Homo sapiens
uuaccagucugauaaacagaaa

SEQ ID NO: 74542 - RNA, 22 nt, Homo sapiens
uuaccugagaaggugacauuug

SEQ ID NO: 74543 - RNA, 22 nt, Homo sapiens
uuacuauguuucaaagugucuc

SEQ ID NO: 74544 - RNA, 20 nt, Homo sapiens
uuacuccuuaaugagguuuu

SEQ ID NO: 74545 - RNA, 22 nt, Homo sapiens
uuacugcuuaagugauucaaca

SEQ ID NO: 74546 - RNA, 22 nt, Homo sapiens
uuagcacaucuuucuauguaag

SEQ ID NO: 74547 - RNA, 22 nt, Homo sapiens
uuagcacauuuccagcacaugg

SEQ ID NO: 74548 - RNA, 22 nt, Homo sapiens
uuagcagcacaaaagcagacua

SEQ ID NO: 74549 - RNA, 22 nt, Homo sapiens
uuagcagccuucaagcuccaag

SEQ ID NO: 74550 - RNA, 22 nt, Homo sapiens
uuagcaguggauggguggagaa

SEQ ID NO: 74551 - RNA, 22 nt, Homo sapiens
uuagcagugugaaaaaagacua

SEQ ID NO: 74552 - RNA, 22 nt, Homo sapiens
uuagcauccauaggagauuggu

SEQ ID NO: 74553 - RNA, 22 nt, Homo sapiens
uuagcucaguuggugagagcgu

SEQ ID NO: 74554 - RNA, 22 nt, Homo sapiens
uuaggacaauguucguuuuuug

SEQ ID NO: 74555 - RNA, 16 nt, Homo sapiens
uuaggcagugugauac

SEQ ID NO: 74556 - RNA, 22 nt, Homo sapiens
uuaggcuuuauugaaaacaaua

SEQ ID NO: 74557 - RNA, 22 nt, Homo sapiens
uucaaggacuaaggauuuuugg

SEQ ID NO: 74558 - RNA, 22 nt, Homo sapiens
uucaaguaagaaagacaucagg

SEQ ID NO: 74559 - RNA, 22 nt, Homo sapiens
uucaaguagguaggaccacagg

SEQ ID NO: 74560 - RNA, 22 nt, Homo sapiens
uucaauaugucauuggcaggca

SEQ ID NO: 74561 - RNA, 21 nt, Homo sapiens
uucacaagggaaguagggggc

SEQ ID NO: 74562 - RNA, 22 nt, Homo sapiens
uucacaaugccuuguugauggu

SEQ ID NO: 74563 - RNA, 22 nt, Homo sapiens
uucacaauuaaaugugguuauu

SEQ ID NO: 74564 - RNA, 22 nt, Homo sapiens
uucacacuagccacucugguag

SEQ ID NO: 74565 - RNA, 22 nt, Homo sapiens
uucacaguacucccuggaauua

SEQ ID NO: 74566 - RNA, 22 nt, Homo sapiens
uucaccaguuuugucacgaaug

SEQ ID NO: 74567 - RNA, 22 nt, Homo sapiens
uucacccugguuguagauggac

SEQ ID NO: 74568 - RNA, 22 nt, Homo sapiens
uucaccuguagcaugcccuugg

SEQ ID NO: 74569 - RNA, 22 nt, Homo sapiens
uucacugugugacccugggcca

SEQ ID NO: 74570 - RNA, 22 nt, Homo sapiens
uucagagugguaugaagugaug

SEQ ID NO: 74571 - RNA, 22 nt, Homo sapiens
uucagaugcacacuguagucua

SEQ ID NO: 74572 - RNA, 20 nt, Homo sapiens
uucagcaaaggaaugggagu

SEQ ID NO: 74573 - RNA, 22 nt, Homo sapiens
uucagcacugaaaauaugucau

SEQ ID NO: 74574 - RNA, 22 nt, Homo sapiens
uucagcuacuuggaaacagcaa

SEQ ID NO: 74575 - RNA, 22 nt, Homo sapiens
uucagcuacuugggaggcugaa

SEQ ID NO: 74576 - RNA, 22 nt, Homo sapiens
uucaggcuccgugccagcuccg

SEQ ID NO: 74577 - RNA, 22 nt, Homo sapiens
uucagggcauuggaguuucuga

SEQ ID NO: 74578 - RNA, 22 nt, Homo sapiens
uucagguaguuuaacuguucca

SEQ ID NO: 74579 - RNA, 22 nt, Homo sapiens
uucaguaguacauucccguguu

SEQ ID NO: 74580 - RNA, 22 nt, Homo sapiens
uucaguccauuuccuuggucac

SEQ ID NO: 74581 - RNA, 22 nt, Homo sapiens
uucagugccuggaagucgugcu

SEQ ID NO: 74582 - RNA, 22 nt, Homo sapiens
uucaguggguggaugaauauga

SEQ ID NO: 74583 - RNA, 22 nt, Homo sapiens
uucagugguuauuugugagauu

SEQ ID NO: 74584 - RNA, 22 nt, Homo sapiens
uucagugucauuaacacaguag

SEQ ID NO: 74585 - RNA, 22 nt, Homo sapiens
uucaguucugcucugaucuuag

SEQ ID NO: 74586 - RNA, 18 nt, Homo sapiens
uucaguuuguaucugggg

SEQ ID NO: 74587 - RNA, 22 nt, Homo sapiens
uucauaguguuuccuuccagug

SEQ ID NO: 74588 - RNA, 22 nt, Homo sapiens
uucauaguuuauacugauauuu

SEQ ID NO: 74589 - RNA, 22 nt, Homo sapiens
uucaucagggagaaauaauuuc

SEQ ID NO: 74590 - RNA, 18 nt, Homo sapiens
uucaucaguccucagcug

SEQ ID NO: 74591 - RNA, 22 nt, Homo sapiens
uucaucaguuauauuggccuga

SEQ ID NO: 74592 - RNA, 22 nt, Homo sapiens
uucauccccuccaaaucucaug

SEQ ID NO: 74593 - RNA, 22 nt, Homo sapiens
uucauggauggaaaugauuuug

SEQ ID NO: 74594 - RNA, 22 nt, Homo sapiens
uucauguaauuccauaagguaa

SEQ ID NO: 74595 - RNA, 22 nt, Homo sapiens
uucauugaaugauuuuuagaag

SEQ ID NO: 74596 - RNA, 22 nt, Homo sapiens
uucauuggacuuguguucuuga

SEQ ID NO: 74597 - RNA, 22 nt, Homo sapiens
uuccaagugggaaacaaaaaug

SEQ ID NO: 74598 - RNA, 22 nt, Homo sapiens
uuccacaaugguugaacuaauu

SEQ ID NO: 74599 - RNA, 22 nt, Homo sapiens
uuccacaggguugaacuaguuu

SEQ ID NO: 74600 - RNA, 23 nt, Homo sapiens
uuccaccauugacuaguuacaua

SEQ ID NO: 74601 - RNA, 22 nt, Homo sapiens
uuccacuuuuuccuugugcucc

SEQ ID NO: 74602 - RNA, 22 nt, Homo sapiens
uuccagcugggggcaacucugc

SEQ ID NO: 74603 - RNA, 22 nt, Homo sapiens
uuccaguuauuauaccucuuaa

SEQ ID NO: 74604 - RNA, 22 nt, Homo sapiens
uuccauagucauagugcugaug

SEQ ID NO: 74605 - RNA, 22 nt, Homo sapiens
uucccagagagggacuucuaau

SEQ ID NO: 74606 - RNA, 22 nt, Homo sapiens
uucccagugccaggcacuggga

SEQ ID NO: 74607 - RNA, 22 nt, Homo sapiens
uucccauuguuggccagcaugu

SEQ ID NO: 74608 - RNA, 22 nt, Homo sapiens
uucccuagaacacauggaggga

SEQ ID NO: 74609 - RNA, 22 nt, Homo sapiens
uucccugaaguguuacucuaga

SEQ ID NO: 74610 - RNA, 22 nt, Homo sapiens
uucccugaguaucuuaccaugg

SEQ ID NO: 74611 - RNA, 22 nt, Homo sapiens
uucccuguaucuucugccaugu

SEQ ID NO: 74612 - RNA, 22 nt, Homo sapiens
uucccugugggaguaggaaagu

SEQ ID NO: 74613 - RNA, 22 nt, Homo sapiens
uucccuugcaggaugaucugga

SEQ ID NO: 74614 - RNA, 22 nt, Homo sapiens
uucccuuugaaacuaaacuugc

SEQ ID NO: 74615 - RNA, 22 nt, Homo sapiens
uucccuuuuuucuaguagguag

SEQ ID NO: 74616 - RNA, 22 nt, Homo sapiens
uuccuaguccugagucucugcg

SEQ ID NO: 74617 - RNA, 19 nt, Homo sapiens
uuccuagugguugggaagu

SEQ ID NO: 74618 - RNA, 22 nt, Homo sapiens
uuccugaggccuccccagaagc

SEQ ID NO: 74619 - RNA, 22 nt, Homo sapiens
uuccuggaggggaaguguccaa

SEQ ID NO: 74620 - RNA, 22 nt, Homo sapiens
uuccugugacccccaagcccac

SEQ ID NO: 74621 - RNA, 22 nt, Homo sapiens
uuccuucaugcuugaaggguau

SEQ ID NO: 74622 - RNA, 22 nt, Homo sapiens
uuccuugagaaaguacaaggcu

SEQ ID NO: 74623 - RNA, 22 nt, Homo sapiens
uuccuuguuuauuuacaggagg

SEQ ID NO: 74624 - RNA, 22 nt, Homo sapiens
uucuacagugacugcagccaua

SEQ ID NO: 74625 - RNA, 22 nt, Homo sapiens
uucuacuucauuaggaggauug

SEQ ID NO: 74626 - RNA, 22 nt, Homo sapiens
uucuagagagaagacuuaagcu

SEQ ID NO: 74627 - RNA, 22 nt, Homo sapiens
uucuaguacucccuggagcugg

SEQ ID NO: 74628 - RNA, 23 nt, Homo sapiens
uucuaucaggcccaggagcccug

SEQ ID NO: 74629 - RNA, 22 nt, Homo sapiens
uucuauggucacagaugcuuga

SEQ ID NO: 74630 - RNA, 21 nt, Homo sapiens
uucuauggucagaauucaaua

SEQ ID NO: 74631 - RNA, 20 nt, Homo sapiens
uucuauggugaugaguccug

SEQ ID NO: 74632 - RNA, 22 nt, Homo sapiens
uucuaugguuaccaggcuaguc

SEQ ID NO: 74633 - RNA, 22 nt, Homo sapiens
uucuauguuugaaaaugccaaa

SEQ ID NO: 74634 - RNA, 22 nt, Homo sapiens
uucuauugguaauauuuucugu

SEQ ID NO: 74635 - RNA, 22 nt, Homo sapiens
uucucaaggagccuucguaacu

SEQ ID NO: 74636 - RNA, 21 nt, Homo sapiens
uucucaggguguguccuaccc

SEQ ID NO: 74637 - RNA, 17 nt, Homo sapiens
uucucaguucugaucuc

SEQ ID NO: 74638 - RNA, 22 nt, Homo sapiens
uucucauggugauggcaaaauc

SEQ ID NO: 74639 - RNA, 22 nt, Homo sapiens
uugguacuacacuucuaaucuu

SEQ ID NO: 74640 - RNA, 22 nt, Homo sapiens
uugguacuagcugaucgcagag

SEQ ID NO: 74641 - RNA, 22 nt, Homo sapiens
uugguaugaaaaggaauuagac

SEQ ID NO: 74642 - RNA, 22 nt, Homo sapiens
uuggucagcucaauggagaggg

SEQ ID NO: 74643 - RNA, 22 nt, Homo sapiens
uuggucaggcuagaguguggug

SEQ ID NO: 74644 - RNA, 21 nt, Homo sapiens
uugguccacaugucauaguua

SEQ ID NO: 74645 - RNA, 23 nt, Homo sapiens
uuggucucccaaaguguugagau

SEQ ID NO: 74646 - RNA, 22 nt, Homo sapiens
uuggucugcucugauguuuucu

SEQ ID NO: 74647 - RNA, 22 nt, Homo sapiens
uuggucuucuaauguaccuguu

SEQ ID NO: 74648 - RNA, 20 nt, Homo sapiens
uuggugaccuacagaugugg

SEQ ID NO: 74649 - RNA, 22 nt, Homo sapiens
uugguuccauuuuaccagcucu

SEQ ID NO: 74650 - RNA, 19 nt, Homo sapiens
uugguugguuauuucuuac

SEQ ID NO: 74651 - RNA, 22 nt, Homo sapiens
uuguaaaguucucucccgaaaa

SEQ ID NO: 74652 - RNA, 22 nt, Homo sapiens
uuguaaaguucuuaggaagcuc

SEQ ID NO: 74653 - RNA, 22 nt, Homo sapiens
uuguaacaguucugcgagcagc

SEQ ID NO: 74654 - RNA, 22 nt, Homo sapiens
uuguaacucugaauacauccua

SEQ ID NO: 74655 - RNA, 23 nt, Homo sapiens
uuguaacuggagaguaacauucc

SEQ ID NO: 74656 - RNA, 22 nt, Homo sapiens
uuguaccacagggcaugaagug

SEQ ID NO: 74657 - RNA, 22 nt, Homo sapiens
uuguacuagaaaauuauucuuu

SEQ ID NO: 74658 - RNA, 22 nt, Homo sapiens
uuguacuagucauauuuugaaa

SEQ ID NO: 74659 - RNA, 22 nt, Homo sapiens
uuguacuauuuuuaucagugau

SEQ ID NO: 74660 - RNA, 22 nt, Homo sapiens
uuguacuucagacaugccaaag

SEQ ID NO: 74661 - RNA, 22 nt, Homo sapiens
uuguaguagucucguucuuuua

SEQ ID NO: 74662 - RNA, 22 nt, Homo sapiens
uuguaguguuuauucugucaac

SEQ ID NO: 74663 - RNA, 22 nt, Homo sapiens
uuguauugucuugaugaguuga

SEQ ID NO: 74664 - RNA, 22 nt, Homo sapiens
uugucacccuacauaacaggga

SEQ ID NO: 74665 - RNA, 22 nt, Homo sapiens
uugucacccucucuuggugucu

SEQ ID NO: 74666 - RNA, 22 nt, Homo sapiens
uugucacuauaaauaagcauuu

SEQ ID NO: 74667 - RNA, 22 nt, Homo sapiens
uugucacucuuccuaggguagg

SEQ ID NO: 74668 - RNA, 22 nt, Homo sapiens
uugucauggucuugauccauua

SEQ ID NO: 74669 - RNA, 22 nt, Homo sapiens
uugucaugguuaauuuuaugua

SEQ ID NO: 74670 - RNA, 22 nt, Homo sapiens
uugucauuuucagaguguuacg

SEQ ID NO: 74671 - RNA, 22 nt, Homo sapiens
uucuggcuaugggauacuaaau

SEQ ID NO: 74672 - RNA, 19 nt, Homo sapiens
uucugguguuuuaagccaa

SEQ ID NO: 74673 - RNA, 22 nt, Homo sapiens
uucuguguuuaggucacggcua

SEQ ID NO: 74674 - RNA, 22 nt, Homo sapiens
uucuucugguuaugaaauuuga

SEQ ID NO: 74675 - RNA, 22 nt, Homo sapiens
uucuugcacuuggcccucauua

SEQ ID NO: 74676 - RNA, 22 nt, Homo sapiens
uucuugguuggcaaccaacagu

SEQ ID NO: 74677 - RNA, 21 nt, Homo sapiens
uucuuugcucaguguuagagu

SEQ ID NO: 74678 - RNA, 22 nt, Homo sapiens
uugaaagaaaggagacugaguu

SEQ ID NO: 74679 - RNA, 22 nt, Homo sapiens
uugaaagacaucaccuacugcu

SEQ ID NO: 74680 - RNA, 22 nt, Homo sapiens
uugaaagcuaucucaaaucgcu

SEQ ID NO: 74681 - RNA, 22 nt, Homo sapiens
uugaaccauucuuuugauagag

SEQ ID NO: 74682 - RNA, 22 nt, Homo sapiens
uugaagagaaccgcggcuuauu

SEQ ID NO: 74683 - RNA, 19 nt, Homo sapiens
uugaaggccgccuugcaga

SEQ ID NO: 74684 - RNA, 22 nt, Homo sapiens
uugaaguagaaagacgaaauuu

SEQ ID NO: 74685 - RNA, 22 nt, Homo sapiens
uugaaguagcauuucaugucua

SEQ ID NO: 74686 - RNA, 22 nt, Homo sapiens
uugaaguaggaaaggaggaggu

SEQ ID NO: 74687 - RNA, 22 nt, Homo sapiens
uugaagugaagaacaauaucac

SEQ ID NO: 74688 - RNA, 22 nt, Homo sapiens
uugaauagaagguuuuuuguuc

SEQ ID NO: 74689 - RNA, 22 nt, Homo sapiens
uugaauaggcucaugcuuauca

SEQ ID NO: 74690 - RNA, 22 nt, Homo sapiens
uugaauagugacuuugauucug

SEQ ID NO: 74691 - RNA, 22 nt, Homo sapiens
uugaauggaauguuggaacuau

SEQ ID NO: 74692 - RNA, 21 nt, Homo sapiens
uugaaugguuuuccuugggag

SEQ ID NO: 74693 - RNA, 22 nt, Homo sapiens
uugaauguacuuguucucacua

SEQ ID NO: 74694 - RNA, 22 nt, Homo sapiens
uugacaaggagccauugcaucu

SEQ ID NO: 74695 - RNA, 22 nt, Homo sapiens
uugacaaggagugggguugaga

SEQ ID NO: 74696 - RNA, 22 nt, Homo sapiens
uugacagaccuuggucauaucc

SEQ ID NO: 74697 - RNA, 20 nt, Homo sapiens
uugacagagggaaaguugcu

SEQ ID NO: 74698 - RNA, 22 nt, Homo sapiens
uugacaguggcuuaaauugguu

SEQ ID NO: 74699 - RNA, 22 nt, Homo sapiens
uugacauauguguguccacaua

SEQ ID NO: 74700 - RNA, 22 nt, Homo sapiens
uugacauguaggcagggaaugg

SEQ ID NO: 74701 - RNA, 22 nt, Homo sapiens
uugaccuauguuucuucaucug

SEQ ID NO: 74702 - RNA, 22 nt, Homo sapiens
uugacuacaccaugccaggaac

SEQ ID NO: 74703 - RNA, 22 nt, Homo sapiens
uugacugggccagacagagauc

SEQ ID NO: 74704 - RNA, 22 nt, Homo sapiens
uugacugugguaauggaagcug

SEQ ID NO: 74705 - RNA, 22 nt, Homo sapiens
uugacuuuuaggaggaaaauga

SEQ ID NO: 74706 - RNA, 21 nt, Homo sapiens
uugagaagaauuagcucuucc

SEQ ID NO: 74707 - RNA, 22 nt, Homo sapiens
uugagaaucuuugcuaaaggaa

SEQ ID NO: 74708 - RNA, 22 nt, Homo sapiens
uugagacgaagucucacucuug

SEQ ID NO: 74709 - RNA, 21 nt, Homo sapiens
uugagacggagucucacucug

SEQ ID NO: 74710 - RNA, 22 nt, Homo sapiens
uugagacggagucuugcucuuu

SEQ ID NO: 74711 - RNA, 22 nt, Homo sapiens
uugagagagaacauuuguuaca

SEQ ID NO: 74712 - RNA, 22 nt, Homo sapiens
uugagauagaauaggaauggga

SEQ ID NO: 74713 - RNA, 22 nt, Homo sapiens
uugagaucuuuuaggccuuugu

SEQ ID NO: 74714 - RNA, 22 nt, Homo sapiens
uugagaugauggauaugcuaau

SEQ ID NO: 74715 - RNA, 21 nt, Homo sapiens
ugggccccuuccuuacaucau

SEQ ID NO: 74716 - RNA, 22 nt, Homo sapiens
uucccuuuguuaaauuggaaga

SEQ ID NO: 74717 - RNA, 22 nt, Homo sapiens
uuccuacuguucaucaggaacc

SEQ ID NO: 74718 - RNA, 19 nt, Homo sapiens
uuccugagaacaagggcuu

SEQ ID NO: 74719 - RNA, 22 nt, Homo sapiens
uuccugcacuugcuugccuaug

SEQ ID NO: 74720 - RNA, 20 nt, Homo sapiens
uuccuuaggcauuggaagaa

SEQ ID NO: 74721 - RNA, 22 nt, Homo sapiens
uuccuugaaacagucaagagaa

SEQ ID NO: 74722 - RNA, 22 nt, Homo sapiens
uucuacaggcuguucaagaagc

SEQ ID NO: 74723 - RNA, 20 nt, Homo sapiens
uucuacagucacaggaagau

SEQ ID NO: 74724 - RNA, 22 nt, Homo sapiens
uucuacuccucauggcagguug

SEQ ID NO: 74725 - RNA, 22 nt, Homo sapiens
uucuagcaauggcagagugucu

SEQ ID NO: 74726 - RNA, 22 nt, Homo sapiens
uucuaugguuuuuaugguguua

SEQ ID NO: 74727 - RNA, 22 nt, Homo sapiens
uucuauguuguuagacccacca

SEQ ID NO: 74728 - RNA, 22 nt, Homo sapiens
uucucaguaauuccagauuuuu

SEQ ID NO: 74729 - RNA, 22 nt, Homo sapiens
uucucaguuccuacuuugguga

SEQ ID NO: 74730 - RNA, 22 nt, Homo sapiens
uucucaguucgguggcagugcu

SEQ ID NO: 74731 - RNA, 22 nt, Homo sapiens
uucucauggaacaucuguacug

SEQ ID NO: 74732 - RNA, 22 nt, Homo sapiens
uucucuaguuacuuuaauggag

SEQ ID NO: 74733 - RNA, 22 nt, Homo sapiens
uucucuggucagaggggagguu

SEQ ID NO: 74734 - RNA, 19 nt, Homo sapiens
uucucugguuguacuaccc

SEQ ID NO: 74735 - RNA, 22 nt, Homo sapiens
uucugagguuauauucucucaa

SEQ ID NO: 74736 - RNA, 22 nt, Homo sapiens
uucugccaaucaacccacaucc

SEQ ID NO: 74737 - RNA, 22 nt, Homo sapiens
uucuggaaaucagcagagggug

SEQ ID NO: 74738 - RNA, 22 nt, Homo sapiens
uucuggcucgauucucugaccg

SEQ ID NO: 74739 - RNA, 22 nt, Homo sapiens
uucuggcuuauaaacgugacuu

SEQ ID NO: 74740 - RNA, 22 nt, Homo sapiens
uucugugcuuguggaugaagug

SEQ ID NO: 74741 - RNA, 22 nt, Homo sapiens
uucuuagguuaaggcugagaga

SEQ ID NO: 74742 - RNA, 22 nt, Homo sapiens
uucuuagucaaguuguauuuca

SEQ ID NO: 74743 - RNA, 20 nt, Homo sapiens
uucuugaguuaacaaguuac

SEQ ID NO: 74744 - RNA, 22 nt, Homo sapiens
uucuugcacuuaacugacauuc

SEQ ID NO: 74745 - RNA, 22 nt, Homo sapiens
uucuugcuguauccucacaugg

SEQ ID NO: 74746 - RNA, 22 nt, Homo sapiens
uucuuuggauaaaguuuuaugc

SEQ ID NO: 74747 - RNA, 23 nt, Homo sapiens
uugaaaagucaguagccucugau

SEQ ID NO: 74748 - RNA, 22 nt, Homo sapiens
uugaaagacagaggggcaaguu

SEQ ID NO: 74749 - RNA, 22 nt, Homo sapiens
uugaaagaugaacuggauugga

SEQ ID NO: 74750 - RNA, 22 nt, Homo sapiens
uugaaaguaaacaucacaaaga

SEQ ID NO: 74751 - RNA, 22 nt, Homo sapiens
uugaaagucauuucuucuaagu

SEQ ID NO: 74752 - RNA, 22 nt, Homo sapiens
uugaaaguguucacaaugguau

SEQ ID NO: 74753 - RNA, 22 nt, Homo sapiens
uugaacuguaagggucugugug

SEQ ID NO: 74754 - RNA, 22 nt, Homo sapiens
uugaaguagguaccguucaauu

SEQ ID NO: 74755 - RNA, 22 nt, Homo sapiens
uugaaguguguauacauugugg

SEQ ID NO: 74756 - RNA, 18 nt, Homo sapiens
uugaauagagccaagcac

SEQ ID NO: 74757 - RNA, 22 nt, Homo sapiens
uugaauagcauguuuagugcau

SEQ ID NO: 74758 - RNA, 22 nt, Homo sapiens
uugaaugaauggaaagaagggu

SEQ ID NO: 74759 - RNA, 18 nt, Homo sapiens
uugaaugcgucccagaga

SEQ ID NO: 74760 - RNA, 22 nt, Homo sapiens
uugacagagaaaagugugacuu

SEQ ID NO: 74761 - RNA, 21 nt, Homo sapiens
uugacagugacagguaaaguu

SEQ ID NO: 74762 - RNA, 20 nt, Homo sapiens
uugacaguggguuguuaaag

SEQ ID NO: 74763 - RNA, 22 nt, Homo sapiens
uugacauugcuguaguguccag

SEQ ID NO: 74764 - RNA, 22 nt, Homo sapiens
uugacuagaccaucuuucuaga

SEQ ID NO: 74765 - RNA, 22 nt, Homo sapiens
uugacuguaagauggcuauuac

SEQ ID NO: 74766 - RNA, 23 nt, Homo sapiens
uugacuguggguacaaugugaua

SEQ ID NO: 74767 - RNA, 22 nt, Homo sapiens
uugacuucagagcugauucaag

SEQ ID NO: 74768 - RNA, 22 nt, Homo sapiens
uugagaagugucuguucauguc

SEQ ID NO: 74769 - RNA, 22 nt, Homo sapiens
uugagacugaacauuuguguac

SEQ ID NO: 74770 - RNA, 22 nt, Homo sapiens
uugagagaaaaggccaugccuu

SEQ ID NO: 74771 - RNA, 22 nt, Homo sapiens
uugagaguggcagagguggaac

SEQ ID NO: 74772 - RNA, 22 nt, Homo sapiens
uugagauacauaauuaugaaug

SEQ ID NO: 74773 - RNA, 22 nt, Homo sapiens
uugagauaggaacucacuaugc

SEQ ID NO: 74774 - RNA, 22 nt, Homo sapiens
uugagaucaugcuacugcacuc

SEQ ID NO: 74775 - RNA, 22 nt, Homo sapiens
uugagauccuuuugcucaucag

SEQ ID NO: 74776 - RNA, 22 nt, Homo sapiens
uugagauggagccucacucugc

SEQ ID NO: 74777 - RNA, 22 nt, Homo sapiens
uugagauggagucucgcucugu

SEQ ID NO: 74778 - RNA, 22 nt, Homo sapiens
uugagauggagucucguucugu

SEQ ID NO: 74779 - RNA, 22 nt, Homo sapiens
uugagauggagucuugcacugu

SEQ ID NO: 74780 - RNA, 22 nt, Homo sapiens
uugagauggauagacauagcau

SEQ ID NO: 74781 - RNA, 22 nt, Homo sapiens
uugagauguaguuucacuccug

SEQ ID NO: 74782 - RNA, 22 nt, Homo sapiens
uugagauguauguauauaaugu

SEQ ID NO: 74783 - RNA, 19 nt, Homo sapiens
uugagaugugaacucacac

SEQ ID NO: 74784 - RNA, 22 nt, Homo sapiens
uugagcacaggaguuugagacc

SEQ ID NO: 74785 - RNA, 22 nt, Homo sapiens
uugagcacauguguuaaggggu

SEQ ID NO: 74786 - RNA, 19 nt, Homo sapiens
uugagcacugccggaguua

SEQ ID NO: 74787 - RNA, 22 nt, Homo sapiens
uugagcauugguauagguuuua

SEQ ID NO: 74788 - RNA, 22 nt, Homo sapiens
uugagcccuggaggcagaggcu

SEQ ID NO: 74789 - RNA, 22 nt, Homo sapiens
uugagcuauauacuucagacuu

SEQ ID NO: 74790 - RNA, 22 nt, Homo sapiens
uugaggaaugugauuucaaaua

SEQ ID NO: 74791 - RNA, 22 nt, Homo sapiens
uugaggacuggaacacaggucu

SEQ ID NO: 74792 - RNA, 22 nt, Homo sapiens
uugaggaggcagucuucccauu

SEQ ID NO: 74793 - RNA, 22 nt, Homo sapiens
uugaggcaaugaggagaagcug

SEQ ID NO: 74794 - RNA, 16 nt, Homo sapiens
uugaggcaugucucag

SEQ ID NO: 74795 - RNA, 22 nt, Homo sapiens
uugagauggagucucacgcauu

SEQ ID NO: 74796 - RNA, 22 nt, Homo sapiens
uugagauggagucucacucuug

SEQ ID NO: 74797 - RNA, 22 nt, Homo sapiens
uugagauggagucucacugugu

SEQ ID NO: 74798 - RNA, 22 nt, Homo sapiens
uugagauggagucucgcucuuu

SEQ ID NO: 74799 - RNA, 22 nt, Homo sapiens
uugagauggagucuugcucucu

SEQ ID NO: 74800 - RNA, 22 nt, Homo sapiens
uugagauggagucuuguucucu

SEQ ID NO: 74801 - RNA, 22 nt, Homo sapiens
uugagauggagucuuguucuuu

SEQ ID NO: 74802 - RNA, 22 nt, Homo sapiens
uugagauggaguguugcucugu

SEQ ID NO: 74803 - RNA, 22 nt, Homo sapiens
uugagauggaguuucacucucg

SEQ ID NO: 74804 - RNA, 22 nt, Homo sapiens
uugagauggaguuucacucuug

SEQ ID NO: 74805 - RNA, 22 nt, Homo sapiens
uugagauggaguuucgcucuuu

SEQ ID NO: 74806 - RNA, 22 nt, Homo sapiens
uugagauguaagauguuaauau

SEQ ID NO: 74807 - RNA, 22 nt, Homo sapiens
uugagcaaaacauuaauauuag

SEQ ID NO: 74808 - RNA, 22 nt, Homo sapiens
uugagcacaguagguuguggcu

SEQ ID NO: 74809 - RNA, 22 nt, Homo sapiens
uugagcaucauguuagcacuca

SEQ ID NO: 74810 - RNA, 22 nt, Homo sapiens
uugagcccuggagguggaggcu

SEQ ID NO: 74811 - RNA, 22 nt, Homo sapiens
uugagcuagggagaucgagguc

SEQ ID NO: 74812 - RNA, 22 nt, Homo sapiens
uugagcucaucaagauagagaa

SEQ ID NO: 74813 - RNA, 21 nt, Homo sapiens
uugagcuuuuaguacagacag

SEQ ID NO: 74814 - RNA, 22 nt, Homo sapiens
uugagcuuuuuacuuguccaau

SEQ ID NO: 74815 - RNA, 22 nt, Homo sapiens
uugaggaagugguuccccagag

SEQ ID NO: 74816 - RNA, 22 nt, Homo sapiens
uugaggaaugucauuuguguuu

SEQ ID NO: 74817 - RNA, 22 nt, Homo sapiens
uugaggacugagacagaccaag

SEQ ID NO: 74818 - RNA, 22 nt, Homo sapiens
uugaggacugcuaagcauuuga

SEQ ID NO: 74819 - RNA, 22 nt, Homo sapiens
uugagggaaacauucacaucau

SEQ ID NO: 74820 - RNA, 22 nt, Homo sapiens
uugagggaggccucaguuuaca

SEQ ID NO: 74821 - RNA, 22 nt, Homo sapiens
uugagguagcuuugauggaggu

SEQ ID NO: 74822 - RNA, 22 nt, Homo sapiens
uugagguaguacuuauuauugg

SEQ ID NO: 74823 - RNA, 22 nt, Homo sapiens
uugaggucagagguucgagacc

SEQ ID NO: 74824 - RNA, 22 nt, Homo sapiens
uugaggucuucaggaucaggcu

SEQ ID NO: 74825 - RNA, 22 nt, Homo sapiens
uugaguagaaguaugucaguau

SEQ ID NO: 74826 - RNA, 22 nt, Homo sapiens
uugaguagauaccuaggaauag

SEQ ID NO: 74827 - RNA, 22 nt, Homo sapiens
uugaguagugugaugcaugucu

SEQ ID NO: 74828 - RNA, 22 nt, Homo sapiens
uugaguauuggacugguaucuu

SEQ ID NO: 74829 - RNA, 22 nt, Homo sapiens
uugauaagaaaugccaguuugg

SEQ ID NO: 74830 - RNA, 22 nt, Homo sapiens
uugauaauguuaacuuugguca

SEQ ID NO: 74831 - RNA, 22 nt, Homo sapiens
uugauaguccuguaucuauuuu

SEQ ID NO: 74832 - RNA, 22 nt, Homo sapiens
uugauauauugcaugggcuacu

SEQ ID NO: 74833 - RNA, 22 nt, Homo sapiens
uugauaugguauaagauuucau

SEQ ID NO: 74834 - RNA, 22 nt, Homo sapiens
uugauauguuguuagauucagu

SEQ ID NO: 74835 - RNA, 22 nt, Homo sapiens
uugauauuacucaguaacagau

SEQ ID NO: 74836 - RNA, 22 nt, Homo sapiens
uugaucaaaucugagugagaau

SEQ ID NO: 74837 - RNA, 22 nt, Homo sapiens
uugaucugugucccugcccaau

SEQ ID NO: 74838 - RNA, 22 nt, Homo sapiens
uugauguaggcauucaaggcua

SEQ ID NO: 74839 - RNA, 22 nt, Homo sapiens
uugauguccaucucuagguaaa

SEQ ID NO: 74840 - RNA, 22 nt, Homo sapiens
uugcaaagaccucuucacuucc

SEQ ID NO: 74841 - RNA, 22 nt, Homo sapiens
uugcaacuuagaaaaaucauuu

SEQ ID NO: 74842 - RNA, 22 nt, Homo sapiens
uugcaagauguucaugggcugu

SEQ ID NO: 74843 - RNA, 22 nt, Homo sapiens
uugcaaggugcagcuuaugcaa

SEQ ID NO: 74844 - RNA, 22 nt, Homo sapiens
uugcaaggugcucgaagggcuc

SEQ ID NO: 74845 - RNA, 22 nt, Homo sapiens
uugcaagugccguaacuaccaa

SEQ ID NO: 74846 - RNA, 22 nt, Homo sapiens
uugcacaauggaauuuaucuuu

SEQ ID NO: 74847 - RNA, 22 nt, Homo sapiens
uugcacagucuagcuccaccuu

SEQ ID NO: 74848 - RNA, 22 nt, Homo sapiens
uugcacauggcuggggaggccu

SEQ ID NO: 74849 - RNA, 22 nt, Homo sapiens
uugcacauugauuuuguaucuu

SEQ ID NO: 74850 - RNA, 22 nt, Homo sapiens
uugcacauugcaccuuuuguau

SEQ ID NO: 74851 - RNA, 22 nt, Homo sapiens
uugcaccacugcacuccacccu

SEQ ID NO: 74852 - RNA, 22 nt, Homo sapiens
uugcacuccagccuggaugaca

SEQ ID NO: 74853 - RNA, 22 nt, Homo sapiens
uugcacuccagccugggugaca

SEQ ID NO: 74854 - RNA, 22 nt, Homo sapiens
uugcacuccagucuggggggca

SEQ ID NO: 74855 - RNA, 22 nt, Homo sapiens
uugcacuccauccuggguugac

SEQ ID NO: 74856 - RNA, 22 nt, Homo sapiens
uugcacuccggccuggguaaca

SEQ ID NO: 74857 - RNA, 22 nt, Homo sapiens
uuuaaggcaggucuggugguga

SEQ ID NO: 74858 - RNA, 22 nt, Homo sapiens
uuuagcaaugcuguggggaagu

SEQ ID NO: 74859 - RNA, 22 nt, Homo sapiens
uuuagcaauucauuuugugucu

SEQ ID NO: 74860 - RNA, 22 nt, Homo sapiens
uuuagcacugugauugacaaaa

SEQ ID NO: 74861 - RNA, 22 nt, Homo sapiens
uuuagcucauucaauuucaguc

SEQ ID NO: 74862 - RNA, 22 nt, Homo sapiens
uuuagguaauauuaaguagcug

SEQ ID NO: 74863 - RNA, 22 nt, Homo sapiens
uuuagguuacauauaauccaaa

SEQ ID NO: 74864 - RNA, 22 nt, Homo sapiens
uuuaguccucugaaaaucuaua

SEQ ID NO: 74865 - RNA, 22 nt, Homo sapiens
uuuaguucauuaaggaaucucc

SEQ ID NO: 74866 - RNA, 22 nt, Homo sapiens
uuucaacaggucuggggugguc

SEQ ID NO: 74867 - RNA, 18 nt, Homo sapiens
uuucaagucuuaggugac

SEQ ID NO: 74868 - RNA, 23 nt, Homo sapiens
uuucacagaaggauuguagggcc

SEQ ID NO: 74869 - RNA, 22 nt, Homo sapiens
uuucacagagggcuucuuucua

SEQ ID NO: 74870 - RNA, 22 nt, Homo sapiens
uuucacagcaauugccuauugu

SEQ ID NO: 74871 - RNA, 23 nt, Homo sapiens
uuucacaguagcuggaucagccu

SEQ ID NO: 74872 - RNA, 22 nt, Homo sapiens
uuucaccguguuggccaggcug

SEQ ID NO: 74873 - RNA, 23 nt, Homo sapiens
uuucaggcaggugaaagaccagc

SEQ ID NO: 74874 - RNA, 22 nt, Homo sapiens
uuucauagaucaugcuuuugga

SEQ ID NO: 74875 - RNA, 22 nt, Homo sapiens
uuucauaguuugcauagggcau

SEQ ID NO: 74876 - RNA, 22 nt, Homo sapiens
uuucaucaagcacagaguagau

SEQ ID NO: 74877 - RNA, 22 nt, Homo sapiens
uuucauggaauauagucauuuu

SEQ ID NO: 74878 - RNA, 22 nt, Homo sapiens
uuucauggcgaggcuucauggg

SEQ ID NO: 74879 - RNA, 19 nt, Homo sapiens
uuucauguuuuuggugaga

SEQ ID NO: 74880 - RNA, 22 nt, Homo sapiens
uuuccaagaugcuuacuuucuc

SEQ ID NO: 74881 - RNA, 19 nt, Homo sapiens
uuuccaguaaucuuaugug

SEQ ID NO: 74882 - RNA, 22 nt, Homo sapiens
uuucccuuacuuaaacuuacuc

SEQ ID NO: 74883 - RNA, 22 nt, Homo sapiens
uuuccuggagaaucuuaacaaa

SEQ ID NO: 74884 - RNA, 22 nt, Homo sapiens
uuuccuguagggggcaaggccu

SEQ ID NO: 74885 - RNA, 22 nt, Homo sapiens
uuucgguuaucuagcuuuauga

SEQ ID NO: 74886 - RNA, 22 nt, Homo sapiens
uuucgugucuggucugugaugg

SEQ ID NO: 74887 - RNA, 22 nt, Homo sapiens
uuucuacagugaacgauuucua

SEQ ID NO: 74888 - RNA, 22 nt, Homo sapiens
uuucuuggagcucuuagggucg

SEQ ID NO: 74889 - RNA, 22 nt, Homo sapiens
uuugaagugugaugccuugaug

SEQ ID NO: 74890 - RNA, 22 nt, Homo sapiens
uuugacaaugugugcuuguauu

SEQ ID NO: 74891 - RNA, 22 nt, Homo sapiens
uuugacacugggagugugggug

SEQ ID NO: 74892 - RNA, 22 nt, Homo sapiens
uuugacucacagccuggcugcc

SEQ ID NO: 74893 - RNA, 22 nt, Homo sapiens
uuugagaaugcuaccagagaag

SEQ ID NO: 74894 - RNA, 22 nt, Homo sapiens
uuugagcauuagggcaaaggca

SEQ ID NO: 74895 - RNA, 22 nt, Homo sapiens
uuugagcuagagucucacucug

SEQ ID NO: 74896 - RNA, 22 nt, Homo sapiens
uuugaggaaaggcauaaguagg

SEQ ID NO: 74897 - RNA, 22 nt, Homo sapiens
uuugagguguauggcaaguuga

SEQ ID NO: 74898 - RNA, 22 nt, Homo sapiens
uuugaugcaucucuacuuuguu

SEQ ID NO: 74899 - RNA, 22 nt, Homo sapiens
uuugauugguguaccugaaagu

SEQ ID NO: 74900 - RNA, 22 nt, Homo sapiens
uuugcaauagguuguggggagg

SEQ ID NO: 74901 - RNA, 22 nt, Homo sapiens
uuugcacucaguaagugggagc

SEQ ID NO: 74902 - RNA, 22 nt, Homo sapiens
uuugcacuuuaauauaauguga

SEQ ID NO: 74903 - RNA, 21 nt, Homo sapiens
uuugcacuuugcaaaucccua

SEQ ID NO: 74904 - RNA, 19 nt, Homo sapiens
uuugcauagugagaauaua

SEQ ID NO: 74905 - RNA, 21 nt, Homo sapiens
uuugcauauguugaaccagcc

SEQ ID NO: 74906 - RNA, 22 nt, Homo sapiens
uuugcugagucugacuucaugg

SEQ ID NO: 74907 - RNA, 22 nt, Homo sapiens
uuugcuuaaaguccuuguggga

SEQ ID NO: 74908 - RNA, 22 nt, Homo sapiens
uuugcuuguguaaaaaucugga

SEQ ID NO: 74909 - RNA, 22 nt, Homo sapiens
uuuggaagaugccacuguauca

SEQ ID NO: 74910 - RNA, 22 nt, Homo sapiens
uuuggaaugaaacagcagagcc

SEQ ID NO: 74911 - RNA, 22 nt, Homo sapiens
uuuggaaugugcacucagauug

SEQ ID NO: 74912 - RNA, 22 nt, Homo sapiens
uuuggcaauaaacuccccuaac

SEQ ID NO: 74913 - RNA, 20 nt, Homo sapiens
uuuggcacugagugguauaa

SEQ ID NO: 74914 - RNA, 22 nt, Homo sapiens
uuuggcagaaaacuaaaaggua

SEQ ID NO: 74915 - RNA, 21 nt, Homo sapiens
uuuggcauuaugucaccagag

SEQ ID NO: 74916 - RNA, 22 nt, Homo sapiens
uuuggcccccagcucaggacau

SEQ ID NO: 74917 - RNA, 22 nt, Homo sapiens
uuuggcuauguuguaucuuucc

SEQ ID NO: 74918 - RNA, 22 nt, Homo sapiens
uuuggcuuuugugauacguaau

SEQ ID NO: 74919 - RNA, 22 nt, Homo sapiens
uuugggaaugaguuuaucauuu

SEQ ID NO: 74920 - RNA, 22 nt, Homo sapiens
uuugggacuguauuaaaugccu

SEQ ID NO: 74921 - RNA, 22 nt, Homo sapiens
uuugggccauggcuuuuccacg

SEQ ID NO: 74922 - RNA, 22 nt, Homo sapiens
uuugggccaugguuuguguaua

SEQ ID NO: 74923 - RNA, 22 nt, Homo sapiens
uuugguccaguguucagguccu

SEQ ID NO: 74924 - RNA, 22 nt, Homo sapiens
uuuggucuuuuauuuaaagcag

SEQ ID NO: 74925 - RNA, 22 nt, Homo sapiens
uuugguguauauguaaacuaug

SEQ ID NO: 74926 - RNA, 22 nt, Homo sapiens
uuugguugcauucacauauuuc

SEQ ID NO: 74927 - RNA, 22 nt, Homo sapiens
uuuguaagaugcauagauugca

SEQ ID NO: 74928 - RNA, 22 nt, Homo sapiens
uuuguacuaugguuuuucacua

SEQ ID NO: 74929 - RNA, 22 nt, Homo sapiens
uugcacauugauuuuguauccu

SEQ ID NO: 74930 - RNA, 22 nt, Homo sapiens
uugcaccccuacuauuugccaa

SEQ ID NO: 74931 - RNA, 22 nt, Homo sapiens
uugcaccuuaugucuguucucu

SEQ ID NO: 74932 - RNA, 22 nt, Homo sapiens
uugcacuauuaguauagauguc

SEQ ID NO: 74933 - RNA, 22 nt, Homo sapiens
uugcacuccagccuuggggaga

SEQ ID NO: 74934 - RNA, 22 nt, Homo sapiens
uugcacuccagcucgggugaca

SEQ ID NO: 74935 - RNA, 22 nt, Homo sapiens
uugcacugagauuuugcuuaca

SEQ ID NO: 74936 - RNA, 22 nt, Homo sapiens
uugcacuuccgccugggugaca

SEQ ID NO: 74937 - RNA, 22 nt, Homo sapiens
uugcagcaaauaggaaugagga

SEQ ID NO: 74938 - RNA, 22 nt, Homo sapiens
uugcaggugguuuaugcaagac

SEQ ID NO: 74939 - RNA, 19 nt, Homo sapiens
uugcaguauccuauauguu

SEQ ID NO: 74940 - RNA, 22 nt, Homo sapiens
uugcagugguuucacuggcaaa

SEQ ID NO: 74941 - RNA, 22 nt, Homo sapiens
uugcauaagugcauucugugau

SEQ ID NO: 74942 - RNA, 22 nt, Homo sapiens
uugcauaauaagagggauacgu

SEQ ID NO: 74943 - RNA, 22 nt, Homo sapiens
uugcauaauaagauuggggggg

SEQ ID NO: 74944 - RNA, 23 nt, Homo sapiens
uugcauagacauccucauagauu

SEQ ID NO: 74945 - RNA, 19 nt, Homo sapiens
uugcauagguugaaccagc

SEQ ID NO: 74946 - RNA, 18 nt, Homo sapiens
uugcauaguguauccaaa

SEQ ID NO: 74947 - RNA, 19 nt, Homo sapiens
uugcauauguugaaccagc

SEQ ID NO: 74948 - RNA, 22 nt, Homo sapiens
uugcaugcacaguucucaauag

SEQ ID NO: 74949 - RNA, 22 nt, Homo sapiens
uugcaugggagcugggugaagc

SEQ ID NO: 74950 - RNA, 22 nt, Homo sapiens
uugcaugggagcugggugaggc

SEQ ID NO: 74951 - RNA, 22 nt, Homo sapiens
uugcaugguggaacuuggagcu

SEQ ID NO: 74952 - RNA, 22 nt, Homo sapiens
uugcaugguuuuuaucugaaau

SEQ ID NO: 74953 - RNA, 22 nt, Homo sapiens
uugcauguacguacagagagag

SEQ ID NO: 74954 - RNA, 23 nt, Homo sapiens
uugcauugcccuccauaguacuc

SEQ ID NO: 74955 - RNA, 22 nt, Homo sapiens
uugccuaggcuggagugcagug

SEQ ID NO: 74956 - RNA, 22 nt, Homo sapiens
uugccuaggcuggaguguggug

SEQ ID NO: 74957 - RNA, 22 nt, Homo sapiens
uugccuaggcuggaguucagug

SEQ ID NO: 74958 - RNA, 21 nt, Homo sapiens
uugccugacacuggaagaaau

SEQ ID NO: 74959 - RNA, 22 nt, Homo sapiens
uugcuagagaugagggaugugu

SEQ ID NO: 74960 - RNA, 22 nt, Homo sapiens
uugcucaggcuagaguucagcu

SEQ ID NO: 74961 - RNA, 22 nt, Homo sapiens
uugcucaggcuggaguacaaug

SEQ ID NO: 74962 - RNA, 22 nt, Homo sapiens
uugcugguuuucauaugagcag

SEQ ID NO: 74963 - RNA, 22 nt, Homo sapiens
uugcuuagucaugaaucacuga

SEQ ID NO: 74964 - RNA, 22 nt, Homo sapiens
uugcuucuuucgucuggcccca

SEQ ID NO: 74965 - RNA, 22 nt, Homo sapiens
uuggaaaaauccaccuugaucu

SEQ ID NO: 74966 - RNA, 22 nt, Homo sapiens
uuggaaacaccuggugagguua

SEQ ID NO: 74967 - RNA, 22 nt, Homo sapiens
uuggaaaccucugcagguguuu

SEQ ID NO: 74968 - RNA, 22 nt, Homo sapiens
uuggaaaugguaaaggguuaau

SEQ ID NO: 74969 - RNA, 22 nt, Homo sapiens
uuggaagacauucugucugcua

SEQ ID NO: 74970 - RNA, 22 nt, Homo sapiens
uuggaagcaugguuauugacgu

SEQ ID NO: 74971 - RNA, 22 nt, Homo sapiens
uuggaagguaaucaaaaguucu

SEQ ID NO: 74972 - RNA, 22 nt, Homo sapiens
uuggaauacuuguuaaagucca

SEQ ID NO: 74973 - RNA, 23 nt, Homo sapiens
uuggaaugagaccuaagaguuuu

SEQ ID NO: 74974 - RNA, 22 nt, Homo sapiens
uuggaaugcacacugagccugc

SEQ ID NO: 74975 - RNA, 22 nt, Homo sapiens
uuggaauuagacaagugguggu

SEQ ID NO: 74976 - RNA, 22 nt, Homo sapiens
uuggacuacagauuacuucauc

SEQ ID NO: 74977 - RNA, 22 nt, Homo sapiens
uuggacuggaacuauaccauug

SEQ ID NO: 74978 - RNA, 22 nt, Homo sapiens
uuggacugugagguuucguggg

SEQ ID NO: 74979 - RNA, 22 nt, Homo sapiens
uuggacuucuaacugacaugga

SEQ ID NO: 74980 - RNA, 22 nt, Homo sapiens
uuggagagucacuaguuagugc

SEQ ID NO: 74981 - RNA, 22 nt, Homo sapiens
uuggagcccuaacucucaguac

SEQ ID NO: 74982 - RNA, 22 nt, Homo sapiens
uuggagugugagagcagccugg

SEQ ID NO: 74983 - RNA, 22 nt, Homo sapiens
uuggauugugaaaguauucucu

SEQ ID NO: 74984 - RNA, 22 nt, Homo sapiens
uuggauuuuaacaaacuaggug

SEQ ID NO: 74985 - RNA, 22 nt, Homo sapiens
uuggcaaaugucacaaaucagg

SEQ ID NO: 74986 - RNA, 22 nt, Homo sapiens
uuggcaagaauguaugccgauc

SEQ ID NO: 74987 - RNA, 22 nt, Homo sapiens
uuggcaauugcuaugauuugaa

SEQ ID NO: 74988 - RNA, 22 nt, Homo sapiens
uuggcacgugguggggcucgga

SEQ ID NO: 74989 - RNA, 22 nt, Homo sapiens
uuggcacugggaaaaugaccac

SEQ ID NO: 74990 - RNA, 22 nt, Homo sapiens
uuggcagaaaaggucggggguu

SEQ ID NO: 74991 - RNA, 22 nt, Homo sapiens
uuggcagaauguuagaaacuua

SEQ ID NO: 74992 - RNA, 20 nt, Homo sapiens
uuggcagagucuuuagggua

SEQ ID NO: 74993 - RNA, 19 nt, Homo sapiens
uuggcagaguugcccccua

SEQ ID NO: 74994 - RNA, 22 nt, Homo sapiens
uuggcagcuguggaaucugggc

SEQ ID NO: 74995 - RNA, 22 nt, Homo sapiens
uuggcauuguggauggaaucau

SEQ ID NO: 74996 - RNA, 22 nt, Homo sapiens
uuggcauuuuggacacccagga

SEQ ID NO: 74997 - RNA, 22 nt, Homo sapiens
uuggccauggagcacuuuucua

SEQ ID NO: 74998 - RNA, 22 nt, Homo sapiens
uuggccccucccaaauuucaug

SEQ ID NO: 74999 - RNA, 22 nt, Homo sapiens
uuggccuuucucuaaauacuuu

SEQ ID NO: 75000 - RNA, 22 nt, Homo sapiens
uuggcuaagaucacgugagaau

SEQ ID NO: 75001 - RNA, 22 nt, Homo sapiens
uuggcuacagauuaugaauuuc

SEQ ID NO: 75002 - RNA, 22 nt, Homo sapiens
uuggcuaugaguccuaugugca

SEQ ID NO: 75003 - RNA, 22 nt, Homo sapiens
uuggcuuaguugaccacagucu

SEQ ID NO: 75004 - RNA, 22 nt, Homo sapiens
uugggacccuguccuguaacaa

SEQ ID NO: 75005 - RNA, 22 nt, Homo sapiens
uugggauggaacuuuucaguga

SEQ ID NO: 75006 - RNA, 22 nt, Homo sapiens
uugggcuuuuagguccuuaaca

SEQ ID NO: 75007 - RNA, 21 nt, Homo sapiens
uuggggaauggagagguuuuc

SEQ ID NO: 75008 - RNA, 22 nt, Homo sapiens
uugggucaguuccuugacuccu

SEQ ID NO: 75009 - RNA, 22 nt, Homo sapiens
uuggguccucugguccuugguu

SEQ ID NO: 75010 - RNA, 22 nt, Homo sapiens
uugguaagguggaugaugaaua

SEQ ID NO: 75011 - RNA, 22 nt, Homo sapiens
uugguaaugggcugguauaacc

SEQ ID NO: 75012 - RNA, 22 nt, Homo sapiens
uugguacuaaaaaguagggugu

SEQ ID NO: 75013 - RNA, 22 nt, Homo sapiens
uuggucaggcuaaucucgaacg

SEQ ID NO: 75014 - RNA, 22 nt, Homo sapiens
uuggucucuuaaucacacuuuu

SEQ ID NO: 75015 - RNA, 20 nt, Homo sapiens
uuggugaccuguuugguauu

SEQ ID NO: 75016 - RNA, 22 nt, Homo sapiens
uugguucaguuuaacgaguaau

SEQ ID NO: 75017 - RNA, 22 nt, Homo sapiens
uugguucucuuuauaugcugga

SEQ ID NO: 75018 - RNA, 22 nt, Homo sapiens
uuguaaagucugucucagucag

SEQ ID NO: 75019 - RNA, 22 nt, Homo sapiens
uuguaagaaucuagcucuuuau

SEQ ID NO: 75020 - RNA, 22 nt, Homo sapiens
uuguaaucaacacaucauuggg

SEQ ID NO: 75021 - RNA, 23 nt, Homo sapiens
uuguacacuaagaaucgcagaug

SEQ ID NO: 75022 - RNA, 22 nt, Homo sapiens
uuguaguagcauuauuuauaau

SEQ ID NO: 75023 - RNA, 22 nt, Homo sapiens
uuguauaggcucaguaagaauc

SEQ ID NO: 75024 - RNA, 22 nt, Homo sapiens
uggaaaguacuugaguuuguau

SEQ ID NO: 75025 - RNA, 22 nt, Homo sapiens
uggaaaguccaagccaaccggg

SEQ ID NO: 75026 - RNA, 19 nt, Homo sapiens
uggaacauaaaaguugguu

SEQ ID NO: 75027 - RNA, 22 nt, Homo sapiens
uggaacugauauugauggaaaa

SEQ ID NO: 75028 - RNA, 20 nt, Homo sapiens
uggaacuuaauugauggaca

SEQ ID NO: 75029 - RNA, 22 nt, Homo sapiens
uggaagacaaguguuagcaugg

SEQ ID NO: 75030 - RNA, 22 nt, Homo sapiens
uggaagacaggcuguauuuuaa

SEQ ID NO: 75031 - RNA, 22 nt, Homo sapiens
uggaagacucaagguggugaau

SEQ ID NO: 75032 - RNA, 22 nt, Homo sapiens
uggaagauggaguuuuaucauu

SEQ ID NO: 75033 - RNA, 22 nt, Homo sapiens
uggaagauucuagaagauucca

SEQ ID NO: 75034 - RNA, 22 nt, Homo sapiens
uggaaggcuucauauguaaaga

SEQ ID NO: 75035 - RNA, 22 nt, Homo sapiens
uggaaguaaucaugagguagca

SEQ ID NO: 75036 - RNA, 22 nt, Homo sapiens
uggaagucauugagguguguua

SEQ ID NO: 75037 - RNA, 22 nt, Homo sapiens
uggaagucuucauuauguauag

SEQ ID NO: 75038 - RNA, 22 nt, Homo sapiens
uggaaguuaaaugacucuuucu

SEQ ID NO: 75039 - RNA, 22 nt, Homo sapiens
uggaauaugagacgggguuguc

SEQ ID NO: 75040 - RNA, 22 nt, Homo sapiens
uggaaucaucaacgaaugaaau

SEQ ID NO: 75041 - RNA, 20 nt, Homo sapiens
uggaaucugaagaucucagu

SEQ ID NO: 75042 - RNA, 22 nt, Homo sapiens
uggaauguaacuugaaacuuuu

SEQ ID NO: 75043 - RNA, 22 nt, Homo sapiens
uggaauguagcguugacacgag

SEQ ID NO: 75044 - RNA, 22 nt, Homo sapiens
uggaaugucuauguuuuugauu

SEQ ID NO: 75045 - RNA, 18 nt, Homo sapiens
uggaauguuuggguuaau

SEQ ID NO: 75046 - RNA, 22 nt, Homo sapiens
uggaauuaauuaaaauauacug

SEQ ID NO: 75047 - RNA, 22 nt, Homo sapiens
uggaauuuagguugauaguaua

SEQ ID NO: 75048 - RNA, 22 nt, Homo sapiens
uggacaagugcccuccaccuca

SEQ ID NO: 75049 - RNA, 22 nt, Homo sapiens
uggacacugguggauauggaau

SEQ ID NO: 75050 - RNA, 22 nt, Homo sapiens
uggacagagagaccggcauuuu

SEQ ID NO: 75051 - RNA, 18 nt, Homo sapiens
uggacagugauuauccau

SEQ ID NO: 75052 - RNA, 22 nt, Homo sapiens
uggaccccugcucgggagcccu

SEQ ID NO: 75053 - RNA, 22 nt, Homo sapiens
uggaccccuucuccuauuaaaa

SEQ ID NO: 75054 - RNA, 22 nt, Homo sapiens
uggacugagauuucagcugcca

SEQ ID NO: 75055 - RNA, 22 nt, Homo sapiens
uggacuguaauuuuauaggcau

SEQ ID NO: 75056 - RNA, 22 nt, Homo sapiens
uggagacaaagauagaaaagca

SEQ ID NO: 75057 - RNA, 22 nt, Homo sapiens
uggagagcaaagaauuuguuag

SEQ ID NO: 75058 - RNA, 19 nt, Homo sapiens
uggagauauccccuucaca

SEQ ID NO: 75059 - RNA, 22 nt, Homo sapiens
uggagcccuaaacuucuaauau

SEQ ID NO: 75060 - RNA, 22 nt, Homo sapiens
uggagguagacauugggaagag

SEQ ID NO: 75061 - RNA, 22 nt, Homo sapiens
uggagguagagaugggaucucc

SEQ ID NO: 75062 - RNA, 22 nt, Homo sapiens
uggagucuugaugauuuucaaa

SEQ ID NO: 75063 - RNA, 21 nt, Homo sapiens
uggagugaagaguuuauugac

SEQ ID NO: 75064 - RNA, 22 nt, Homo sapiens
uggagugcgagggugaaacuuu

SEQ ID NO: 75065 - RNA, 22 nt, Homo sapiens
uggaguguguugcagaugaagg

SEQ ID NO: 75066 - RNA, 20 nt, Homo sapiens
uggaguuguggcaguuugga

SEQ ID NO: 75067 - RNA, 20 nt, Homo sapiens
uggaguuugaguucuuggag

SEQ ID NO: 75068 - RNA, 22 nt, Homo sapiens
uggauagaaauguacuguuuuc

SEQ ID NO: 75069 - RNA, 22 nt, Homo sapiens
uggauauguuuauauguugucu

SEQ ID NO: 75070 - RNA, 22 nt, Homo sapiens
uggaucauucuuucuugcaggg

SEQ ID NO: 75071 - RNA, 22 nt, Homo sapiens
uggaugacuguuauaugcauau

SEQ ID NO: 75072 - RNA, 22 nt, Homo sapiens
uggaugccuaauaaaugcagac

SEQ ID NO: 75073 - RNA, 22 nt, Homo sapiens
uggauguacagucaguauuugu

SEQ ID NO: 75074 - RNA, 21 nt, Homo sapiens
uggauugagaaccccaggagg

SEQ ID NO: 75075 - RNA, 22 nt, Homo sapiens
uggauuuuaauuauucugucau

SEQ ID NO: 75076 - RNA, 22 nt, Homo sapiens
uggcaaaaaaacgcaauuacgu

SEQ ID NO: 75077 - RNA, 22 nt, Homo sapiens
uggcaaaaaucacaaguaccuu

SEQ ID NO: 75078 - RNA, 22 nt, Homo sapiens
uggcaaaauggaauauguuggg

SEQ ID NO: 75079 - RNA, 22 nt, Homo sapiens
uggcaacaucuggggacauguu

SEQ ID NO: 75080 - RNA, 22 nt, Homo sapiens
uggcaagaacaacaauuacuuu

SEQ ID NO: 75081 - RNA, 22 nt, Homo sapiens
uggcaagaaccacaauuacuuu

SEQ ID NO: 75082 - RNA, 22 nt, Homo sapiens
uggcaagaacgaaauguagggu

SEQ ID NO: 75083 - RNA, 22 nt, Homo sapiens
uggcaagagaacaacaucucuc

SEQ ID NO: 75084 - RNA, 22 nt, Homo sapiens
uggcaagagauaugugucuaua

SEQ ID NO: 75085 - RNA, 22 nt, Homo sapiens
uggcaagagcaaaauguacagu

SEQ ID NO: 75086 - RNA, 18 nt, Homo sapiens
uggcaaguuuaguagcac

SEQ ID NO: 75087 - RNA, 22 nt, Homo sapiens
uggcaaguuucaauccgaggga

SEQ ID NO: 75088 - RNA, 22 nt, Homo sapiens
uggcaauaaaaugcaguuacuu

SEQ ID NO: 75089 - RNA, 22 nt, Homo sapiens
uggcacaaugacccuugugggc

SEQ ID NO: 75090 - RNA, 22 nt, Homo sapiens
uggcacuggagauacauuaaua

SEQ ID NO: 75091 - RNA, 22 nt, Homo sapiens
uggcagauagaaaugugguuaa

SEQ ID NO: 75092 - RNA, 22 nt, Homo sapiens
uggcagcgugaauguggcugaa

SEQ ID NO: 75093 - RNA, 17 nt, Homo sapiens
uggcaugaggguguggg

SEQ ID NO: 75094 - RNA, 22 nt, Homo sapiens
uggcaugauauauauucguuug

SEQ ID NO: 75095 - RNA, 22 nt, Homo sapiens
uggcauguguuugaaugaguau

SEQ ID NO: 75096 - RNA, 20 nt, Homo sapiens
uggcauguugguaugcaccc

SEQ ID NO: 75097 - RNA, 18 nt, Homo sapiens
uggccaauggcaaacaga

SEQ ID NO: 75098 - RNA, 22 nt, Homo sapiens
uggccagugucggaggccagga

SEQ ID NO: 75099 - RNA, 22 nt, Homo sapiens
uggccuguaacgcugucucagc

SEQ ID NO: 75100 - RNA, 22 nt, Homo sapiens
uggcggagacauggacuucaga

SEQ ID NO: 75101 - RNA, 22 nt, Homo sapiens
uggcgggaaaguugggagaaga

SEQ ID NO: 75102 - RNA, 22 nt, Homo sapiens
uggcuaaguuaaucaaggagau

SEQ ID NO: 75103 - RNA, 22 nt, Homo sapiens
uggcuacagaaaguacuaguga

SEQ ID NO: 75104 - RNA, 23 nt, Homo sapiens
uggcuagacguccuuuccugaug

SEQ ID NO: 75105 - RNA, 22 nt, Homo sapiens
uggcuguuuauuucaccuggau

SEQ ID NO: 75106 - RNA, 21 nt, Homo sapiens
uggcuguuuucaugcuagaac

SEQ ID NO: 75107 - RNA, 21 nt, Homo sapiens
uggcuuauuugaaucuggcuu

SEQ ID NO: 75108 - RNA, 22 nt, Homo sapiens
uggcuuucuggggcuucuguuc

SEQ ID NO: 75109 - RNA, 22 nt, Homo sapiens
uggcuuuucauccugggacauu

SEQ ID NO: 75110 - RNA, 22 nt, Homo sapiens
uggcuuuuccuugaaucugccu

SEQ ID NO: 75111 - RNA, 20 nt, Homo sapiens
ugggaacaugugguauaugg

SEQ ID NO: 75112 - RNA, 22 nt, Homo sapiens
ugggaagcugcauuuuaacaag

SEQ ID NO: 75113 - RNA, 22 nt, Homo sapiens
ugggagugugcacaauuucagc

SEQ ID NO: 75114 - RNA, 22 nt, Homo sapiens
ugucaaacauuaugaugcucua

SEQ ID NO: 75115 - RNA, 22 nt, Homo sapiens
ugucaacauuuaucaaguuauu

SEQ ID NO: 75116 - RNA, 22 nt, Homo sapiens
ugucaaggaaugucauugguuu

SEQ ID NO: 75117 - RNA, 22 nt, Homo sapiens
ugucaauauguaauaacugaau

SEQ ID NO: 75118 - RNA, 22 nt, Homo sapiens
ugucaccuugcucauccucgga

SEQ ID NO: 75119 - RNA, 22 nt, Homo sapiens
ugucacguugcuuuucuguugu

SEQ ID NO: 75120 - RNA, 22 nt, Homo sapiens
ugucacugugaguuugacugcu

SEQ ID NO: 75121 - RNA, 22 nt, Homo sapiens
ugucagaaucuagaggcugcua

SEQ ID NO: 75122 - RNA, 22 nt, Homo sapiens
ugucaggagcaaugauaaauuu

SEQ ID NO: 75123 - RNA, 22 nt, Homo sapiens
ugucaggaggguccagagaaaa

SEQ ID NO: 75124 - RNA, 22 nt, Homo sapiens
ugucaguguaugagccccggau

SEQ ID NO: 75125 - RNA, 22 nt, Homo sapiens
ugucauagaugauuuuuuucgg

SEQ ID NO: 75126 - RNA, 23 nt, Homo sapiens
ugucaucaagaugaggucacacu

SEQ ID NO: 75127 - RNA, 22 nt, Homo sapiens
ugucaucauuccaucagggcuu

SEQ ID NO: 75128 - RNA, 22 nt, Homo sapiens
ugucaucauuggaaucugccuc

SEQ ID NO: 75129 - RNA, 22 nt, Homo sapiens
ugucauggauucugagucuggg

SEQ ID NO: 75130 - RNA, 22 nt, Homo sapiens
ugucaugucaacuauggaauuu

SEQ ID NO: 75131 - RNA, 22 nt, Homo sapiens
ugucaugugagggaacuuguuc

SEQ ID NO: 75132 - RNA, 22 nt, Homo sapiens
ugucauuguggugcagauauaa

SEQ ID NO: 75133 - RNA, 16 nt, Homo sapiens
uguccaaauaaauaca

SEQ ID NO: 75134 - RNA, 22 nt, Homo sapiens
uguccaaauugaaucaucuggu

SEQ ID NO: 75135 - RNA, 19 nt, Homo sapiens
ugucccagccauagaggca

SEQ ID NO: 75136 - RNA, 18 nt, Homo sapiens
ugucccuuugcuguucau

SEQ ID NO: 75137 - RNA, 22 nt, Homo sapiens
uguccugcagagguguuugccu

SEQ ID NO: 75138 - RNA, 22 nt, Homo sapiens
uguccuggugaugcccaaauuc

SEQ ID NO: 75139 - RNA, 22 nt, Homo sapiens
ugagacggaguuucgcucuugu

SEQ ID NO: 75140 - RNA, 22 nt, Homo sapiens
ugagacugagucucgcucuugu

SEQ ID NO: 75141 - RNA, 22 nt, Homo sapiens
ugagacugaguuucgcucuugu

SEQ ID NO: 75142 - RNA, 22 nt, Homo sapiens
ugagacugaguuucucucuugu

SEQ ID NO: 75143 - RNA, 22 nt, Homo sapiens
ugagacugaguuuugccuuugu

SEQ ID NO: 75144 - RNA, 22 nt, Homo sapiens
ugagagacagacauuaucuuau

SEQ ID NO: 75145 - RNA, 22 nt, Homo sapiens
ugagagacaguuucgucggagg

SEQ ID NO: 75146 - RNA, 22 nt, Homo sapiens
ugagauaaugcaugugaagauc

SEQ ID NO: 75147 - RNA, 22 nt, Homo sapiens
ugagauaauuuacuuguugagg

SEQ ID NO: 75148 - RNA, 22 nt, Homo sapiens
ugagauauugggaguaauguca

SEQ ID NO: 75149 - RNA, 20 nt, Homo sapiens
ugagaucaggauuaaggcua

SEQ ID NO: 75150 - RNA, 22 nt, Homo sapiens
ugagaucgagucucgcucuguc

SEQ ID NO: 75151 - RNA, 22 nt, Homo sapiens
ugagaucugauaggccuggguu

SEQ ID NO: 75152 - RNA, 19 nt, Homo sapiens
ugagaucuuuacuggguuu

SEQ ID NO: 75153 - RNA, 22 nt, Homo sapiens
ugagaucuuuuguggcugagaa

SEQ ID NO: 75154 - RNA, 22 nt, Homo sapiens
ugagaugaacuugauuguuuua

SEQ ID NO: 75155 - RNA, 22 nt, Homo sapiens
ugagaugaagucuugcucuguu

SEQ ID NO: 75156 - RNA, 22 nt, Homo sapiens
ugagaugagucucgcucuguca

SEQ ID NO: 75157 - RNA, 22 nt, Homo sapiens
ugagaugaguugcgcucugucg

SEQ ID NO: 75158 - RNA, 22 nt, Homo sapiens
ugagaugauaucuuauuguaau

SEQ ID NO: 75159 - RNA, 20 nt, Homo sapiens
ugagaugcauugggauguuu

SEQ ID NO: 75160 - RNA, 22 nt, Homo sapiens
ugagaugcuccucuugcaaagc

SEQ ID NO: 75161 - RNA, 22 nt, Homo sapiens
ugagauggagucuugucgccua

SEQ ID NO: 75162 - RNA, 22 nt, Homo sapiens
ugagauggaguuucacuuuugu

SEQ ID NO: 75163 - RNA, 22 nt, Homo sapiens
ugagauggcuuuauugcugaau

SEQ ID NO: 75164 - RNA, 22 nt, Homo sapiens
ugagauguguccagaucuaguu

SEQ ID NO: 75165 - RNA, 21 nt, Homo sapiens
ugagauuaaguuguuuagaag

SEQ ID NO: 75166 - RNA, 22 nt, Homo sapiens
ugagauuacguucggcccacuu

SEQ ID NO: 75167 - RNA, 21 nt, Homo sapiens
ugagauuauauuaacauggua

SEQ ID NO: 75168 - RNA, 22 nt, Homo sapiens
ugagauuaucguaauguaucuc

SEQ ID NO: 75169 - RNA, 22 nt, Homo sapiens
ugagcacaggugcgcgguuacu

SEQ ID NO: 75170 - RNA, 22 nt, Homo sapiens
ugagcacauuuacaucaguucc

SEQ ID NO: 75171 - RNA, 22 nt, Homo sapiens
ugagcagaaagcugcaaggucg

SEQ ID NO: 75172 - RNA, 22 nt, Homo sapiens
ugagcagaaguuuugauuggcg

SEQ ID NO: 75173 - RNA, 22 nt, Homo sapiens
ugagcagagggagaaguaaauu

SEQ ID NO: 75174 - RNA, 22 nt, Homo sapiens
ugagcagaguuguuucuccuga

SEQ ID NO: 75175 - RNA, 22 nt, Homo sapiens
ugagcagugagugugcugcagg

SEQ ID NO: 75176 - RNA, 21 nt, Homo sapiens
ugagcauuaguacaguaggga

SEQ ID NO: 75177 - RNA, 22 nt, Homo sapiens
ugagcauuguuuggacuuggau

SEQ ID NO: 75178 - RNA, 22 nt, Homo sapiens
ugagccaaguucacaccauugc

SEQ ID NO: 75179 - RNA, 22 nt, Homo sapiens
ugagccaaugauuugaauagag

SEQ ID NO: 75180 - RNA, 23 nt, Homo sapiens
ugagccaugggacuccaagggag

SEQ ID NO: 75181 - RNA, 22 nt, Homo sapiens
ugagccaugggguaaaugugau

SEQ ID NO: 75182 - RNA, 22 nt, Homo sapiens
ugagcuaagugccaauauuaau

SEQ ID NO: 75183 - RNA, 22 nt, Homo sapiens
ugagcuagggccuggaauaggg

SEQ ID NO: 75184 - RNA, 17 nt, Homo sapiens
ugagcuaugauccuguc

SEQ ID NO: 75185 - RNA, 22 nt, Homo sapiens
ugagcugagacaauaaguuuuu

SEQ ID NO: 75186 - RNA, 22 nt, Homo sapiens
ugagcugagaucacacuacugu

SEQ ID NO: 75187 - RNA, 22 nt, Homo sapiens
ugagcugagaucgugccauugu

SEQ ID NO: 75188 - RNA, 22 nt, Homo sapiens
ugagcugguacuaauauuauca

SEQ ID NO: 75189 - RNA, 17 nt, Homo sapiens
ugaggcacuaguaucac

SEQ ID NO: 75190 - RNA, 22 nt, Homo sapiens
ugaggcuagucagaucagauga

SEQ ID NO: 75191 - RNA, 17 nt, Homo sapiens
ugagggaugccugguuc

SEQ ID NO: 75192 - RNA, 22 nt, Homo sapiens
ugagguaaugcuguagcuguga

SEQ ID NO: 75193 - RNA, 22 nt, Homo sapiens
ugagguaucauugcccaggcug

SEQ ID NO: 75194 - RNA, 20 nt, Homo sapiens
ugaggucaggaguuacagac

SEQ ID NO: 75195 - RNA, 21 nt, Homo sapiens
ugaggucaugaugcugcuucc

SEQ ID NO: 75196 - RNA, 22 nt, Homo sapiens
ugaggucauucaugugggcgca

SEQ ID NO: 75197 - RNA, 22 nt, Homo sapiens
ugaggugaaguaauauucuaag

SEQ ID NO: 75198 - RNA, 22 nt, Homo sapiens
ugaggugcagcaauccucaugu

SEQ ID NO: 75199 - RNA, 23 nt, Homo sapiens
ugagguguuaagcagacuugucu

SEQ ID NO: 75200 - RNA, 22 nt, Homo sapiens
ugagguugaaggacauuuuuau

SEQ ID NO: 75201 - RNA, 22 nt, Homo sapiens
ugagguuggggucagggcuagc

SEQ ID NO: 75202 - RNA, 22 nt, Homo sapiens
ugagguugguauuacugucucu

SEQ ID NO: 75203 - RNA, 22 nt, Homo sapiens
ugagguuguccacuauaaucca

SEQ ID NO: 75204 - RNA, 22 nt, Homo sapiens
ugaguaauguugaucuuugaua

SEQ ID NO: 75205 - RNA, 20 nt, Homo sapiens
ugaguagaggaguucuauca

SEQ ID NO: 75206 - RNA, 22 nt, Homo sapiens
ugaguagauccaagacuguccu

SEQ ID NO: 75207 - RNA, 22 nt, Homo sapiens
ugaguagcuaauguuuacugag

SEQ ID NO: 75208 - RNA, 22 nt, Homo sapiens
ugaguaguauucuaugguaugu

SEQ ID NO: 75209 - RNA, 22 nt, Homo sapiens
ugaguagucuagaguggaaugu

SEQ ID NO: 75210 - RNA, 22 nt, Homo sapiens
ugaugacauugucacagucuga

SEQ ID NO: 75211 - RNA, 22 nt, Homo sapiens
ugaugaugaaugaucuuuuaca

SEQ ID NO: 75212 - RNA, 22 nt, Homo sapiens
ugaugcuacuaccugggcugaa

SEQ ID NO: 75213 - RNA, 22 nt, Homo sapiens
ugaugguuuuauaagggagagu

SEQ ID NO: 75214 - RNA, 22 nt, Homo sapiens
ugauguaggcauuuaagguuau

SEQ ID NO: 75215 - RNA, 22 nt, Homo sapiens
ugaugugucaucugagagagug

SEQ ID NO: 75216 - RNA, 19 nt, Homo sapiens
ugauuguaagcuuggugag

SEQ ID NO: 75217 - RNA, 22 nt, Homo sapiens
ugauuuguccauguggcacgug

SEQ ID NO: 75218 - RNA, 22 nt, Homo sapiens
ugauuugucugcaggaauagug

SEQ ID NO: 75219 - RNA, 18 nt, Homo sapiens
ugcaaacauguguguguu

SEQ ID NO: 75220 - RNA, 22 nt, Homo sapiens
ugcaaagaaauuuuggugacca

SEQ ID NO: 75221 - RNA, 22 nt, Homo sapiens
ugcaaaguccucauucuuaccc

SEQ ID NO: 75222 - RNA, 22 nt, Homo sapiens
gugauugugaaaacauuaagaa

SEQ ID NO: 75223 - RNA, 21 nt, Homo sapiens
gugcaaacaucauagaaugua

SEQ ID NO: 75224 - RNA, 21 nt, Homo sapiens
gugcaacucccucucccuaca

SEQ ID NO: 75225 - RNA, 22 nt, Homo sapiens
gugcaaugagaaggggcucugg

SEQ ID NO: 75226 - RNA, 22 nt, Homo sapiens
gugcaauucacuguuaugucug

SEQ ID NO: 75227 - RNA, 22 nt, Homo sapiens
gugcacaacgugcaggcuuguu

SEQ ID NO: 75228 - RNA, 22 nt, Homo sapiens
gugcacaacgugcagguuaguu

SEQ ID NO: 75229 - RNA, 22 nt, Homo sapiens
gugcacaaugugcagguuuguu

SEQ ID NO: 75230 - RNA, 22 nt, Homo sapiens
gugcacaugcgugcgcacauau

SEQ ID NO: 75231 - RNA, 23 nt, Homo sapiens
gugcaguggcgagauuucggcuc

SEQ ID NO: 75232 - RNA, 22 nt, Homo sapiens
gugcaguuugaaaguagaaaca

SEQ ID NO: 75233 - RNA, 22 nt, Homo sapiens
gugcaguuuugagugaguuucu

SEQ ID NO: 75234 - RNA, 22 nt, Homo sapiens
gugcauaucugugguuggcuga

SEQ ID NO: 75235 - RNA, 23 nt, Homo sapiens
gugcaugagucuuuauaguagca

SEQ ID NO: 75236 - RNA, 22 nt, Homo sapiens
gugccacugcacuccggccugg

SEQ ID NO: 75237 - RNA, 22 nt, Homo sapiens
gugccuucuagcuaugguuggc

SEQ ID NO: 75238 - RNA, 22 nt, Homo sapiens
gugccuuuucugagcaaugagc

SEQ ID NO: 75239 - RNA, 22 nt, Homo sapiens
gugcucauuuagagagaagcac

SEQ ID NO: 75240 - RNA, 16 nt, Homo sapiens
gugcuguguuguuagg

SEQ ID NO: 75241 - RNA, 22 nt, Homo sapiens
gugcuuauccccauucuggagg

SEQ ID NO: 75242 - RNA, 22 nt, Homo sapiens
guggaagaaaucagguuauuug

SEQ ID NO: 75243 - RNA, 22 nt, Homo sapiens
guggaaugaaaacucucucaca

SEQ ID NO: 75244 - RNA, 22 nt, Homo sapiens
guggacaugaauuuuggaggca

SEQ ID NO: 75245 - RNA, 22 nt, Homo sapiens
guggaguaugaaaacugacuuu

SEQ ID NO: 75246 - RNA, 18 nt, Homo sapiens
guggagugucuuccugga

SEQ ID NO: 75247 - RNA, 22 nt, Homo sapiens
guggcaaggaaaugcugcucac

SEQ ID NO: 75248 - RNA, 22 nt, Homo sapiens
guggcagaacagguaggguucu

SEQ ID NO: 75249 - RNA, 22 nt, Homo sapiens
guggcaugaaagcagauaccac

SEQ ID NO: 75250 - RNA, 22 nt, Homo sapiens
guggcauuucccaaaguauucu

SEQ ID NO: 75251 - RNA, 22 nt, Homo sapiens
guggcuuuaaguacgauugagg

SEQ ID NO: 75252 - RNA, 22 nt, Homo sapiens
gugggagugucccguuuuucca

SEQ ID NO: 75253 - RNA, 22 nt, Homo sapiens
gugggaugaucacaguucacug

SEQ ID NO: 75254 - RNA, 22 nt, Homo sapiens
gugggcucguucguguuagaca

SEQ ID NO: 75255 - RNA, 22 nt, Homo sapiens
gugggguagcaggcuccuaucu

SEQ ID NO: 75256 - RNA, 22 nt, Homo sapiens
guggguaaaucucuguucgagg

SEQ ID NO: 75257 - RNA, 22 nt, Homo sapiens
gugguaggaaagugcaaaugua

SEQ ID NO: 75258 - RNA, 22 nt, Homo sapiens
guggucagaaaucucaguggca

SEQ ID NO: 75259 - RNA, 22 nt, Homo sapiens
gugguguccugcaccuauaguc

SEQ ID NO: 75260 - RNA, 22 nt, Homo sapiens
gugguguuugagcugccaggga

SEQ ID NO: 75261 - RNA, 21 nt, Homo sapiens
gugguucuagagaaacagaau

SEQ ID NO: 75262 - RNA, 22 nt, Homo sapiens
gugguuuuaucccagaaauuaa

SEQ ID NO: 75263 - RNA, 22 nt, Homo sapiens
guguaauacacacauauaugca

SEQ ID NO: 75264 - RNA, 21 nt, Homo sapiens
gugucaugguugacuuuggca

SEQ ID NO: 75265 - RNA, 22 nt, Homo sapiens
gugucccagugugcauacaggu

SEQ ID NO: 75266 - RNA, 22 nt, Homo sapiens
guguccucgaguacacaucagg

SEQ ID NO: 75267 - RNA, 22 nt, Homo sapiens
gugucucagcccagaccuauuu

SEQ ID NO: 75268 - RNA, 22 nt, Homo sapiens
gaugagaucauaaguguggagc

SEQ ID NO: 75269 - RNA, 22 nt, Homo sapiens
gaugagauguucucauggauug

SEQ ID NO: 75270 - RNA, 22 nt, Homo sapiens
gaugaggcuagagacaugugua

SEQ ID NO: 75271 - RNA, 22 nt, Homo sapiens
gaugagguaguguaccuagucu

SEQ ID NO: 75272 - RNA, 22 nt, Homo sapiens
gaugauauuugagucauuagaa

SEQ ID NO: 75273 - RNA, 22 nt, Homo sapiens
gaugauguuugauaaauaauaa

SEQ ID NO: 75274 - RNA, 22 nt, Homo sapiens
gaugcagcuaggauuugugaca

SEQ ID NO: 75275 - RNA, 22 nt, Homo sapiens
gaugcaguaagaaugcauagcg

SEQ ID NO: 75276 - RNA, 22 nt, Homo sapiens
gauggaauuaaaaucagaauca

SEQ ID NO: 75277 - RNA, 22 nt, Homo sapiens
gauggaguugucgccugggcug

SEQ ID NO: 75278 - RNA, 22 nt, Homo sapiens
gauggcagugcagccccuggcu

SEQ ID NO: 75279 - RNA, 22 nt, Homo sapiens
gauggcaucugagaguguuaga

SEQ ID NO: 75280 - RNA, 22 nt, Homo sapiens
gauggcauuucuggaucugccc

SEQ ID NO: 75281 - RNA, 22 nt, Homo sapiens
gauggugucccaggcucaggcu

SEQ ID NO: 75282 - RNA, 22 nt, Homo sapiens
gauguguugggaagauuucaag

SEQ ID NO: 75283 - RNA, 22 nt, Homo sapiens
gauguguuuguuucuggaggag

SEQ ID NO: 75284 - RNA, 22 nt, Homo sapiens
gauguuguuuagccuuugaugu

SEQ ID NO: 75285 - RNA, 20 nt, Homo sapiens
gauuagagagaggcugugca

SEQ ID NO: 75286 - RNA, 22 nt, Homo sapiens
gauuauagaaguaauggguuua

SEQ ID NO: 75287 - RNA, 22 nt, Homo sapiens
gauuccauuuguggcuauuuac

SEQ ID NO: 75288 - RNA, 22 nt, Homo sapiens
gauuggccaaacuaaagaacug

SEQ ID NO: 75289 - RNA, 22 nt, Homo sapiens
gauuugagagaggguguuuaua

SEQ ID NO: 75290 - RNA, 22 nt, Homo sapiens
gauuugguguucuggcucaaga

SEQ ID NO: 75291 - RNA, 22 nt, Homo sapiens
gauuuguauuaaaagugugacg

SEQ ID NO: 75292 - RNA, 22 nt, Homo sapiens
gauuuuccaguggcccugauca

SEQ ID NO: 75293 - RNA, 21 nt, Homo sapiens
gcaaaguggcuaccuugcucc

SEQ ID NO: 75294 - RNA, 20 nt, Homo sapiens
gcaaaguuuagcucccacua

SEQ ID NO: 75295 - RNA, 22 nt, Homo sapiens
gcaaaugcuacaccauuuugua

SEQ ID NO: 75296 - RNA, 20 nt, Homo sapiens
gcaagcaugaagaguagaga

SEQ ID NO: 75297 - RNA, 22 nt, Homo sapiens
gcaagcuugcugggccugacuc

SEQ ID NO: 75298 - RNA, 22 nt, Homo sapiens
gcacaaugccugacgaguccug

SEQ ID NO: 75299 - RNA, 22 nt, Homo sapiens
gcacacuuacacgaaccuagau

SEQ ID NO: 75300 - RNA, 22 nt, Homo sapiens
gcacaggguuacauucuaaggu

SEQ ID NO: 75301 - RNA, 22 nt, Homo sapiens
gcacaguuaaagggucauguga

SEQ ID NO: 75302 - RNA, 22 nt, Homo sapiens
gcacauuacaaguauuagcuca

SEQ ID NO: 75303 - RNA, 22 nt, Homo sapiens
gcaccaugguagaauaauggua

SEQ ID NO: 75304 - RNA, 22 nt, Homo sapiens
gcaccauugacaagaaauaggu

SEQ ID NO: 75305 - RNA, 22 nt, Homo sapiens
gcaccccuuaccgggcuggguu

SEQ ID NO: 75306 - RNA, 22 nt, Homo sapiens
gcacuacugcacuccagucuag

SEQ ID NO: 75307 - RNA, 22 nt, Homo sapiens
gcacugagagaagccccaagua

SEQ ID NO: 75308 - RNA, 19 nt, Homo sapiens
gcagagaugugguagcuug

SEQ ID NO: 75309 - RNA, 22 nt, Homo sapiens
gcagaucuucgcgguaaguguu

SEQ ID NO: 75310 - RNA, 22 nt, Homo sapiens
gcaggaaucuugagaaggauuc

SEQ ID NO: 75311 - RNA, 22 nt, Homo sapiens
gcaggaauuucucugcagaccc

SEQ ID NO: 75312 - RNA, 22 nt, Homo sapiens
gcagguauuagagagccugaaa

SEQ ID NO: 75313 - RNA, 22 nt, Homo sapiens
gcagucaucugaaggcuuaacu

SEQ ID NO: 75314 - RNA, 22 nt, Homo sapiens
gcagugacaugugccaguuuau

SEQ ID NO: 75315 - RNA, 22 nt, Homo sapiens
gcagugcaugacgguauauaua

SEQ ID NO: 75316 - RNA, 22 nt, Homo sapiens
gcaguggugugugccagccuag

SEQ ID NO: 75317 - RNA, 22 nt, Homo sapiens
gcagugugaucacagcuuacug

SEQ ID NO: 75318 - RNA, 22 nt, Homo sapiens
gcaguguucaaaucaugcccau

SEQ ID NO: 75319 - RNA, 22 nt, Homo sapiens
gcaguguucugggcaggaagaa

SEQ ID NO: 75320 - RNA, 22 nt, Homo sapiens
gcaguguuggggccggaggcug

SEQ ID NO: 75321 - RNA, 22 nt, Homo sapiens
gcaguucuguaguugaaauuua

SEQ ID NO: 75322 - RNA, 17 nt, Homo sapiens
gcauauguugaaccagc

SEQ ID NO: 75323 - RNA, 22 nt, Homo sapiens
gcaucacagcuccugugcuggc

SEQ ID NO: 75324 - RNA, 22 nt, Homo sapiens
gcaugcauuuuccuaacuagaa

SEQ ID NO: 75325 - RNA, 22 nt, Homo sapiens
gccaaaaugcugggauuacagg

SEQ ID NO: 75326 - RNA, 22 nt, Homo sapiens
gccaagaagugucuaagcagga

SEQ ID NO: 75327 - RNA, 22 nt, Homo sapiens
gccaagaucugaauaauuaaga

SEQ ID NO: 75328 - RNA, 22 nt, Homo sapiens
gccaguauuuuauugagaauuu

SEQ ID NO: 75329 - RNA, 22 nt, Homo sapiens
gccaguauuuuauugaggauuu

SEQ ID NO: 75330 - RNA, 22 nt, Homo sapiens
gccagugugaugugaucauggc

SEQ ID NO: 75331 - RNA, 22 nt, Homo sapiens
gccauggaggauuuauagaggc

SEQ ID NO: 75332 - RNA, 22 nt, Homo sapiens
gccauugcacuccagccuaggu

SEQ ID NO: 75333 - RNA, 22 nt, Homo sapiens
gccauugcacuccagccucggc

SEQ ID NO: 75334 - RNA, 22 nt, Homo sapiens
cugugcuugauuauaugagugu

SEQ ID NO: 75335 - RNA, 20 nt, Homo sapiens
cugugguagggaccaggaau

SEQ ID NO: 75336 - RNA, 22 nt, Homo sapiens
cugugguauuauuagaaauauc

SEQ ID NO: 75337 - RNA, 22 nt, Homo sapiens
cugugguuacguucuuugugcu

SEQ ID NO: 75338 - RNA, 22 nt, Homo sapiens
cugugguuuaaggaauuuugac

SEQ ID NO: 75339 - RNA, 22 nt, Homo sapiens
cuguguaguacuagauugagca

SEQ ID NO: 75340 - RNA, 22 nt, Homo sapiens
cuguuagguuaaggaauggcaa

SEQ ID NO: 75341 - RNA, 22 nt, Homo sapiens
cuuaaugcuacggcucuguguu

SEQ ID NO: 75342 - RNA, 22 nt, Homo sapiens
cuuagcaaugucguguacucac

SEQ ID NO: 75343 - RNA, 22 nt, Homo sapiens
cuuagguaggugccagguuuuu

SEQ ID NO: 75344 - RNA, 22 nt, Homo sapiens
cuucaaaguuggcuaggagaca

SEQ ID NO: 75345 - RNA, 17 nt, Homo sapiens
cuucaaauaauuucccc

SEQ ID NO: 75346 - RNA, 22 nt, Homo sapiens
cuucacuggagucccuggauuc

SEQ ID NO: 75347 - RNA, 22 nt, Homo sapiens
cuucacuuuguuaaacuccaau

SEQ ID NO: 75348 - RNA, 22 nt, Homo sapiens
cuucaugagacuuuuggaaggc

SEQ ID NO: 75349 - RNA, 18 nt, Homo sapiens
cuucauugcuguuuugcu

SEQ ID NO: 75350 - RNA, 22 nt, Homo sapiens
cuuccagcuggguucagucagu

SEQ ID NO: 75351 - RNA, 22 nt, Homo sapiens
cuuccugaguccugggcucaca

SEQ ID NO: 75352 - RNA, 18 nt, Homo sapiens
cuuccuuagucugguuaa

SEQ ID NO: 75353 - RNA, 22 nt, Homo sapiens
cuugaauguaaauaauguacag

SEQ ID NO: 75354 - RNA, 22 nt, Homo sapiens
cuugaucaaugugguacuugau

SEQ ID NO: 75355 - RNA, 22 nt, Homo sapiens
cuugcacuguuguaagggacuu

SEQ ID NO: 75356 - RNA, 22 nt, Homo sapiens
cuugcagaggcccuggggagag

SEQ ID NO: 75357 - RNA, 19 nt, Homo sapiens
cuugccccauucauccucu

SEQ ID NO: 75358 - RNA, 20 nt, Homo sapiens
cuugccuagcccuuugccuc

SEQ ID NO: 75359 - RNA, 22 nt, Homo sapiens
cuugccuuugucuucaaaggcu

SEQ ID NO: 75360 - RNA, 22 nt, Homo sapiens
cuuggauuauaauggaauauuu

SEQ ID NO: 75361 - RNA, 22 nt, Homo sapiens
cuuggcauugccccuggaauuu

SEQ ID NO: 75362 - RNA, 18 nt, Homo sapiens
cuuggcgaugccaacaua

SEQ ID NO: 75363 - RNA, 22 nt, Homo sapiens
cuuggcuugguaucaaauaacc

SEQ ID NO: 75364 - RNA, 22 nt, Homo sapiens
guucaucagggauacuggccug

SEQ ID NO: 75365 - RNA, 22 nt, Homo sapiens
guucaucagggauacuggccuu

SEQ ID NO: 75366 - RNA, 22 nt, Homo sapiens
guucccaguugaaaugauuagu

SEQ ID NO: 75367 - RNA, 22 nt, Homo sapiens
guugaaaucaucacuuggcaug

SEQ ID NO: 75368 - RNA, 22 nt, Homo sapiens
guugacuaggagcuacuacuac

SEQ ID NO: 75369 - RNA, 22 nt, Homo sapiens
guugagcaaacagcuuaacagu

SEQ ID NO: 75370 - RNA, 22 nt, Homo sapiens
guugagcaagcuuuggagccua

SEQ ID NO: 75371 - RNA, 22 nt, Homo sapiens
guugaggcaggagaauuacuug

SEQ ID NO: 75372 - RNA, 22 nt, Homo sapiens
guugaguuugaccugaacucug

SEQ ID NO: 75373 - RNA, 22 nt, Homo sapiens
guugaucuauguugcuggcagu

SEQ ID NO: 75374 - RNA, 22 nt, Homo sapiens
guugauguugcagucuugagga

SEQ ID NO: 75375 - RNA, 22 nt, Homo sapiens
guugcaaaguaauugugguuuu

SEQ ID NO: 75376 - RNA, 22 nt, Homo sapiens
guugcagcacacaggcugucag

SEQ ID NO: 75377 - RNA, 22 nt, Homo sapiens
guugccuaggcuggagugcagu

SEQ ID NO: 75378 - RNA, 22 nt, Homo sapiens
guugccuaggcuggucuugaac

SEQ ID NO: 75379 - RNA, 22 nt, Homo sapiens
guugcucaggcuggagugcagu

SEQ ID NO: 75380 - RNA, 22 nt, Homo sapiens
guugcugagucccaucaccaga

SEQ ID NO: 75381 - RNA, 22 nt, Homo sapiens
guugcuuauuccuguaauccca

SEQ ID NO: 75382 - RNA, 22 nt, Homo sapiens
guuggaauuaaaaggcaaguau

SEQ ID NO: 75383 - RNA, 22 nt, Homo sapiens
guuggcuguuucccccaaguga

SEQ ID NO: 75384 - RNA, 22 nt, Homo sapiens
guugggcccauagacugccagu

SEQ ID NO: 75385 - RNA, 22 nt, Homo sapiens
guugguuuccuguaacuggaca

SEQ ID NO: 75386 - RNA, 22 nt, Homo sapiens
guuguggcuugugauuaagcac

SEQ ID NO: 75387 - RNA, 22 nt, Homo sapiens
uaaaccuagcauuuugcauaug

SEQ ID NO: 75388 - RNA, 22 nt, Homo sapiens
uaaacugucuugcaguuacaug

SEQ ID NO: 75389 - RNA, 22 nt, Homo sapiens
uaaagagcuuuugaggugucau

SEQ ID NO: 75390 - RNA, 22 nt, Homo sapiens
uaaagcacaaguaaagaauacu

SEQ ID NO: 75391 - RNA, 22 nt, Homo sapiens
uaaagccuagaacuuucagccc

SEQ ID NO: 75392 - RNA, 22 nt, Homo sapiens
uaaagcgaggucuccuacaaga

SEQ ID NO: 75393 - RNA, 21 nt, Homo sapiens
uaaaggcuccaauuauacccc

SEQ ID NO: 75394 - RNA, 22 nt, Homo sapiens
uaaagugcugagaugaggcugg

SEQ ID NO: 75395 - RNA, 22 nt, Homo sapiens
uaaaguguuuguuauuaaaggu

SEQ ID NO: 75396 - RNA, 22 nt, Homo sapiens
uaaaugacugucaguagaugaa

SEQ ID NO: 75397 - RNA, 22 nt, Homo sapiens
uaaauggauaaaugaauaccua

SEQ ID NO: 75398 - RNA, 22 nt, Homo sapiens
uaacaaugucuuaugggcuuaa

SEQ ID NO: 75399 - RNA, 19 nt, Homo sapiens
uaacacaguuguguuugag

SEQ ID NO: 75400 - RNA, 21 nt, Homo sapiens
uaacagcuccacuccauucuc

SEQ ID NO: 75401 - RNA, 22 nt, Homo sapiens
uaacagcucuacagcugcucuu

SEQ ID NO: 75402 - RNA, 22 nt, Homo sapiens
uaacaggcuacucuugcauugc

SEQ ID NO: 75403 - RNA, 22 nt, Homo sapiens
uaacagucaagguuugaccagg

SEQ ID NO: 75404 - RNA, 22 nt, Homo sapiens
uaacaguggucugugguaucug

SEQ ID NO: 75405 - RNA, 22 nt, Homo sapiens
uaacaguguagaggccuauugg

SEQ ID NO: 75406 - RNA, 22 nt, Homo sapiens
uaacauucacaugcugcaaaaa

SEQ ID NO: 75407 - RNA, 22 nt, Homo sapiens
uaacauugucuugcuuaguuuu

SEQ ID NO: 75408 - RNA, 22 nt, Homo sapiens
uaacuaguagauggcugacaua

SEQ ID NO: 75409 - RNA, 22 nt, Homo sapiens
uaacugcaaccuccgccucccg

SEQ ID NO: 75410 - RNA, 20 nt, Homo sapiens
uaacuguggcuucuuuuggc

SEQ ID NO: 75411 - RNA, 18 nt, Homo sapiens
uaacugugggaacuaacu

SEQ ID NO: 75412 - RNA, 20 nt, Homo sapiens
uaagacaugguccacaugcc

SEQ ID NO: 75413 - RNA, 21 nt, Homo sapiens
uaagacugccaguagggcugu

SEQ ID NO: 75414 - RNA, 22 nt, Homo sapiens
uaagaugaaggcucaccuagaa

SEQ ID NO: 75415 - RNA, 22 nt, Homo sapiens
uaagcaguaaaugaagucuugc

SEQ ID NO: 75416 - RNA, 22 nt, Homo sapiens
uaagcaguguggauccaccuug

SEQ ID NO: 75417 - RNA, 22 nt, Homo sapiens
uaagccaccgugccuggccuaa

SEQ ID NO: 75418 - RNA, 16 nt, Homo sapiens
uaagccccacgugcau

SEQ ID NO: 75419 - RNA, 21 nt, Homo sapiens
uaagcuaaacauucaguuaac

SEQ ID NO: 75420 - RNA, 22 nt, Homo sapiens
uaagcuauagugaauaaauugc

SEQ ID NO: 75421 - RNA, 22 nt, Homo sapiens
uaagcucauuccagccaugucc

SEQ ID NO: 75422 - RNA, 22 nt, Homo sapiens
uaaggaacucugauaucuggaa

SEQ ID NO: 75423 - RNA, 22 nt, Homo sapiens
uaaggcauuuuuuugaguugca

SEQ ID NO: 75424 - RNA, 22 nt, Homo sapiens
uaaggcuagcaagaugagaaua

SEQ ID NO: 75425 - RNA, 22 nt, Homo sapiens
uaaggcuaggaauucucugaag

SEQ ID NO: 75426 - RNA, 22 nt, Homo sapiens
gagaacagaagcauuccuaauu

SEQ ID NO: 75427 - RNA, 22 nt, Homo sapiens
gagaacagagauaauuuuacuu

SEQ ID NO: 75428 - RNA, 22 nt, Homo sapiens
gagaacauacggcauuugguuu

SEQ ID NO: 75429 - RNA, 22 nt, Homo sapiens
gagaaccuccagcaagguagua

SEQ ID NO: 75430 - RNA, 22 nt, Homo sapiens
gagaacuaaugguuugauaagg

SEQ ID NO: 75431 - RNA, 22 nt, Homo sapiens
gagaacuggcgugaacugcacg

SEQ ID NO: 75432 - RNA, 22 nt, Homo sapiens
gagaaugaacagacugccucuu

SEQ ID NO: 75433 - RNA, 22 nt, Homo sapiens
gagaaugagauuaugguuacau

SEQ ID NO: 75434 - RNA, 20 nt, Homo sapiens
gagaccugagauucacucaa

SEQ ID NO: 75435 - RNA, 22 nt, Homo sapiens
gagacugagucucacucuguca

SEQ ID NO: 75436 - RNA, 22 nt, Homo sapiens
gagacugagucuugcccuguca

SEQ ID NO: 75437 - RNA, 22 nt, Homo sapiens
gagacugagucuugcucugucg

SEQ ID NO: 75438 - RNA, 22 nt, Homo sapiens
gagagaguacuugauauaauuu

SEQ ID NO: 75439 - RNA, 22 nt, Homo sapiens
gagagguaguuuuuuggucguc

SEQ ID NO: 75440 - RNA, 22 nt, Homo sapiens
gagagugaaguuugcuaccugu

SEQ ID NO: 75441 - RNA, 22 nt, Homo sapiens
gagagugugucagaggcugcga

SEQ ID NO: 75442 - RNA, 22 nt, Homo sapiens
gagauaauagcuauaggaucuu

SEQ ID NO: 75443 - RNA, 22 nt, Homo sapiens
gagauacuugguuucuguuucu

SEQ ID NO: 75444 - RNA, 22 nt, Homo sapiens
gagauaggauucacuuucaugu

SEQ ID NO: 75445 - RNA, 21 nt, Homo sapiens
gagauagguaccgaagcuuag

SEQ ID NO: 75446 - RNA, 22 nt, Homo sapiens
gagaucaaguauucuccacuaa

SEQ ID NO: 75447 - RNA, 22 nt, Homo sapiens
gagaucaucuaaucuggccucu

SEQ ID NO: 75448 - RNA, 22 nt, Homo sapiens
gagaucaugcugguucucucau

SEQ ID NO: 75449 - RNA, 23 nt, Homo sapiens
gagaucauucuggaauuagagug

SEQ ID NO: 75450 - RNA, 22 nt, Homo sapiens
gagaucauugugggccaagcug

SEQ ID NO: 75451 - RNA, 22 nt, Homo sapiens
gagaucuauuccucacccuucu

SEQ ID NO: 75452 - RNA, 22 nt, Homo sapiens
gagaucuucguguggggagaca

SEQ ID NO: 75453 - RNA, 22 nt, Homo sapiens
gagaugaaaucuugcucuguca

SEQ ID NO: 75454 - RNA, 22 nt, Homo sapiens
gagaugaagugucaauaaggau

SEQ ID NO: 75455 - RNA, 22 nt, Homo sapiens
gagaugaaguuaaggaucuuua

SEQ ID NO: 75456 - RNA, 22 nt, Homo sapiens
gagauggagacuuggccuuaaa

SEQ ID NO: 75457 - RNA, 22 nt, Homo sapiens
gagaugugguucaaggguguuu

SEQ ID NO: 75458 - RNA, 20 nt, Homo sapiens
gagauguugaucagggcuau

SEQ ID NO: 75459 - RNA, 22 nt, Homo sapiens
gagauguuuguuucacugucac

SEQ ID NO: 75460 - RNA, 22 nt, Homo sapiens
ggcaacauggugaaacucuguc

SEQ ID NO: 75461 - RNA, 21 nt, Homo sapiens
ggcaagaaacacaaucaagua

SEQ ID NO: 75462 - RNA, 22 nt, Homo sapiens
ggcaagaaagaaaucaucuguc

SEQ ID NO: 75463 - RNA, 22 nt, Homo sapiens
ggcaagaagaacuauaacuuuu

SEQ ID NO: 75464 - RNA, 19 nt, Homo sapiens
ggcaagaguuguucugugu

SEQ ID NO: 75465 - RNA, 22 nt, Homo sapiens
ggcaagauagauaucaguguca

SEQ ID NO: 75466 - RNA, 22 nt, Homo sapiens
ggcaaggauuagauucuccccu

SEQ ID NO: 75467 - RNA, 22 nt, Homo sapiens
ggcaaggugaugaaugucuaca

SEQ ID NO: 75468 - RNA, 22 nt, Homo sapiens
ggcaaugucagcuaaugaugga

SEQ ID NO: 75469 - RNA, 22 nt, Homo sapiens
ggcacaauugcagcaauaaaca

SEQ ID NO: 75470 - RNA, 22 nt, Homo sapiens
ggcacaguuaagugcuaccuaa

SEQ ID NO: 75471 - RNA, 22 nt, Homo sapiens
ggcaccauuuuacuccuucccu

SEQ ID NO: 75472 - RNA, 23 nt, Homo sapiens
ggcacggaauucaaagaggcauu

SEQ ID NO: 75473 - RNA, 19 nt, Homo sapiens
ggcacugugugagugagga

SEQ ID NO: 75474 - RNA, 22 nt, Homo sapiens
ggcacuguugccggccugaauu

SEQ ID NO: 75475 - RNA, 22 nt, Homo sapiens
ggcagcgugcacuuucgccacu

SEQ ID NO: 75476 - RNA, 22 nt, Homo sapiens
ggcagcuguguccuucguaagg

SEQ ID NO: 75477 - RNA, 22 nt, Homo sapiens
ggcaguuuggcaguuucauaaa

SEQ ID NO: 75478 - RNA, 22 nt, Homo sapiens
ggcaugguggugugugccuaua

SEQ ID NO: 75479 - RNA, 22 nt, Homo sapiens
ggcauuguccaauuucugcccu

SEQ ID NO: 75480 - RNA, 22 nt, Homo sapiens
ggccagaugcgguggcucacac

SEQ ID NO: 75481 - RNA, 22 nt, Homo sapiens
ggcccaguugcgggugguaccg

SEQ ID NO: 75482 - RNA, 18 nt, Homo sapiens
ggcggguguuuuauucac

SEQ ID NO: 75483 - RNA, 22 nt, Homo sapiens
ggcgguguccuccaagugcuuc

SEQ ID NO: 75484 - RNA, 22 nt, Homo sapiens
ggcuagaauagggauagaccuu

SEQ ID NO: 75485 - RNA, 22 nt, Homo sapiens
ggcuagagacaaguugcugaga

SEQ ID NO: 75486 - RNA, 22 nt, Homo sapiens
ggcucagugggguccugguucu

SEQ ID NO: 75487 - RNA, 21 nt, Homo sapiens
ggcucuguggucucagguuuc

SEQ ID NO: 75488 - RNA, 22 nt, Homo sapiens
gggaaauguaaagucauaagau

SEQ ID NO: 75489 - RNA, 22 nt, Homo sapiens
gggaagaaggagugguuuacuc

SEQ ID NO: 75490 - RNA, 22 nt, Homo sapiens
gggaagguaaucauuacuugau

SEQ ID NO: 75491 - RNA, 22 nt, Homo sapiens
gggagguaggaguuauuauuuu

SEQ ID NO: 75492 - RNA, 22 nt, Homo sapiens
gggauauguagauuuuuaucuu

SEQ ID NO: 75493 - RNA, 22 nt, Homo sapiens
gggaugaagaagaauaguucgu

SEQ ID NO: 75494 - RNA, 22 nt, Homo sapiens
gggaugaagcccuaggguuggu

SEQ ID NO: 75495 - RNA, 22 nt, Homo sapiens
gggauguaaaagugggcacauu

SEQ ID NO: 75496 - RNA, 22 nt, Homo sapiens
gggauguaugauauauguuggu

SEQ ID NO: 75497 - RNA, 20 nt, Homo sapiens
gggaugugagguacacucuu

SEQ ID NO: 75498 - RNA, 22 nt, Homo sapiens
gggcaaaacuguacugccaagg

SEQ ID NO: 75499 - RNA, 22 nt, Homo sapiens
gggcaacauugaguacccugaa

SEQ ID NO: 75500 - RNA, 18 nt, Homo sapiens
gggcaaguugccuggcuu

SEQ ID NO: 75501 - RNA, 22 nt, Homo sapiens
gggcacgugugugcugugcuca

SEQ ID NO: 75502 - RNA, 22 nt, Homo sapiens
gggcaugauggugcacacaugu

SEQ ID NO: 75503 - RNA, 22 nt, Homo sapiens
gggcaugaugucuuaugccuau

SEQ ID NO: 75504 - RNA, 22 nt, Homo sapiens
gggcauguggacuuguauguuu

SEQ ID NO: 75505 - RNA, 22 nt, Homo sapiens
ggggaauguuaaagaauuugca

SEQ ID NO: 75506 - RNA, 22 nt, Homo sapiens
ggggcauugugucuggguuccu

SEQ ID NO: 75507 - RNA, 22 nt, Homo sapiens
gggguaguuacuguuguucuuu

SEQ ID NO: 75508 - RNA, 22 nt, Homo sapiens
gggucauggaugugaagcuaga

SEQ ID NO: 75509 - RNA, 22 nt, Homo sapiens
ggguucaaaucuuggcucuuac

SEQ ID NO: 75510 - RNA, 22 nt, Homo sapiens
gguaaacauaagagagcugacu

SEQ ID NO: 75511 - RNA, 23 nt, Homo sapiens
gugaucauuguuguggguugaau

SEQ ID NO: 75512 - RNA, 22 nt, Homo sapiens
gugaugcaguacguagaggaga

SEQ ID NO: 75513 - RNA, 22 nt, Homo sapiens
gugaugguccagggaaucucuu

SEQ ID NO: 75514 - RNA, 22 nt, Homo sapiens
gugauuguuaaacugccucucu

SEQ ID NO: 75515 - RNA, 22 nt, Homo sapiens
gugcaaauguuauugagguuuu

SEQ ID NO: 75516 - RNA, 22 nt, Homo sapiens
gugcaaauuccagcucaacucc

SEQ ID NO: 75517 - RNA, 22 nt, Homo sapiens
gugcaagagugacugcaguuuu

SEQ ID NO: 75518 - RNA, 22 nt, Homo sapiens
gugcaagagugauugcaguuuu

SEQ ID NO: 75519 - RNA, 22 nt, Homo sapiens
gugcaaugucaggagaugcagc

SEQ ID NO: 75520 - RNA, 22 nt, Homo sapiens
gugcacaacgugcaaguuuguu

SEQ ID NO: 75521 - RNA, 22 nt, Homo sapiens
gugcacaucgugcagguuuguu

SEQ ID NO: 75522 - RNA, 22 nt, Homo sapiens
gugcaguguuugcauggaauca

SEQ ID NO: 75523 - RNA, 22 nt, Homo sapiens
gugcauacgucuuuauaguagc

SEQ ID NO: 75524 - RNA, 22 nt, Homo sapiens
gugcauaugcaugugcaugcac

SEQ ID NO: 75525 - RNA, 22 nt, Homo sapiens
gugcauguccacuaguccauau

SEQ ID NO: 75526 - RNA, 22 nt, Homo sapiens
gugcaugucuaugcgagucuaa

SEQ ID NO: 75527 - RNA, 22 nt, Homo sapiens
gugcaugucugugacgacccug

SEQ ID NO: 75528 - RNA, 22 nt, Homo sapiens
gugcuuguguuaauauguagcu

SEQ ID NO: 75529 - RNA, 22 nt, Homo sapiens
gugcuuuguuguggcaguggca

SEQ ID NO: 75530 - RNA, 22 nt, Homo sapiens
guggaaaacauaugcuuguuga

SEQ ID NO: 75531 - RNA, 22 nt, Homo sapiens
guggaagaccagacuuuccaac

SEQ ID NO: 75532 - RNA, 22 nt, Homo sapiens
guggaagauaguguguuaaugu

SEQ ID NO: 75533 - RNA, 22 nt, Homo sapiens
guggaagcacaggccuccugga

SEQ ID NO: 75534 - RNA, 22 nt, Homo sapiens
guggaauauaaagcaucgugua

SEQ ID NO: 75535 - RNA, 22 nt, Homo sapiens
guggaaugcaguguugauucaa

SEQ ID NO: 75536 - RNA, 22 nt, Homo sapiens
guggaauuauagagacaucuug

SEQ ID NO: 75537 - RNA, 22 nt, Homo sapiens
guggagacaaaggcugagugag

SEQ ID NO: 75538 - RNA, 22 nt, Homo sapiens
guggagcuguguggccuugggc

SEQ ID NO: 75539 - RNA, 17 nt, Homo sapiens
guggauagaacaaugaa

SEQ ID NO: 75540 - RNA, 22 nt, Homo sapiens
guggcaaacucagcaugcccca

SEQ ID NO: 75541 - RNA, 22 nt, Homo sapiens
guggcaagaauguacaaaaggu

SEQ ID NO: 75542 - RNA, 22 nt, Homo sapiens
guggcagagucagagggaaaug

SEQ ID NO: 75543 - RNA, 22 nt, Homo sapiens
guggcagcacauauagguuguu

SEQ ID NO: 75544 - RNA, 22 nt, Homo sapiens
guggcaguuuuaaauaugaaaa

SEQ ID NO: 75545 - RNA, 21 nt, Homo sapiens
guggccuuuggagcaugucag

SEQ ID NO: 75546 - RNA, 22 nt, Homo sapiens
guggcuauucaccuuuaugaaa

SEQ ID NO: 75547 - RNA, 22 nt, Homo sapiens
gugggauaauuuuuggugcugu

SEQ ID NO: 75548 - RNA, 22 nt, Homo sapiens
gugggauauaaucaguccugua

SEQ ID NO: 75549 - RNA, 22 nt, Homo sapiens
gugggaugaucgcuugagccca

SEQ ID NO: 75550 - RNA, 20 nt, Homo sapiens
gugggcaaauccuuuccucu

SEQ ID NO: 75551 - RNA, 22 nt, Homo sapiens
gugggguaggaggaguacuucc

SEQ ID NO: 75552 - RNA, 22 nt, Homo sapiens
gugggguaggcaauuccuagug

SEQ ID NO: 75553 - RNA, 22 nt, Homo sapiens
gugguacuaucuuugguuucag

SEQ ID NO: 75554 - RNA, 22 nt, Homo sapiens
guggugucuuuuuugauuagga

SEQ ID NO: 75555 - RNA, 22 nt, Homo sapiens
gugguuguuggaguggcaauuu

SEQ ID NO: 75556 - RNA, 22 nt, Homo sapiens
uaauaauguuaggcuuacucaa

SEQ ID NO: 75557 - RNA, 22 nt, Homo sapiens
uaauacuguaauggugguuccg

SEQ ID NO: 75558 - RNA, 22 nt, Homo sapiens
uaauacuugucauaaaggcauu

SEQ ID NO: 75559 - RNA, 22 nt, Homo sapiens
uaauagcucggauaaacaugau

SEQ ID NO: 75560 - RNA, 22 nt, Homo sapiens
uaauaguguuaaugcuagagcu

SEQ ID NO: 75561 - RNA, 22 nt, Homo sapiens
uaauaguuggcacuggagaaag

SEQ ID NO: 75562 - RNA, 22 nt, Homo sapiens
uaauaugugguugcuugggcac

SEQ ID NO: 75563 - RNA, 22 nt, Homo sapiens
uaaucacagagguuuggccuca

SEQ ID NO: 75564 - RNA, 22 nt, Homo sapiens
uaaucucagcuacucaggaggc

SEQ ID NO: 75565 - RNA, 22 nt, Homo sapiens
uaaugcauguaaugggcugaua

SEQ ID NO: 75566 - RNA, 22 nt, Homo sapiens
uaaugcuguggucuaaugggga

SEQ ID NO: 75567 - RNA, 22 nt, Homo sapiens
uaaugcuguggucugguuuaaa

SEQ ID NO: 75568 - RNA, 22 nt, Homo sapiens
uaaugugcuucucuaccauagg

SEQ ID NO: 75569 - RNA, 22 nt, Homo sapiens
uaauugcaguucuguguuauau

SEQ ID NO: 75570 - RNA, 22 nt, Homo sapiens
uaauuggaucucaaaaaagugu

SEQ ID NO: 75571 - RNA, 22 nt, Homo sapiens
uacaaagcuuucugcaaaucau

SEQ ID NO: 75572 - RNA, 22 nt, Homo sapiens
uacaacacugguucgacaugug

SEQ ID NO: 75573 - RNA, 16 nt, Homo sapiens
uacaacagugaguaug

SEQ ID NO: 75574 - RNA, 22 nt, Homo sapiens
uacaagcuaaaauggaagauca

SEQ ID NO: 75575 - RNA, 22 nt, Homo sapiens
uacaagguaucagugaccguaa

SEQ ID NO: 75576 - RNA, 22 nt, Homo sapiens
uacaaguauuuuuauuagugcc

SEQ ID NO: 75577 - RNA, 22 nt, Homo sapiens
uacaccaauuuaaucaaaagca

SEQ ID NO: 75578 - RNA, 21 nt, Homo sapiens
uacacuacugguggaaaugca

SEQ ID NO: 75579 - RNA, 22 nt, Homo sapiens
uacagaauauuucugcccugag

SEQ ID NO: 75580 - RNA, 22 nt, Homo sapiens
uacagcacugugcauagugguu

SEQ ID NO: 75581 - RNA, 22 nt, Homo sapiens
uacaggcagguguucccugguu

SEQ ID NO: 75582 - RNA, 22 nt, Homo sapiens
uacaggugcucuacagacagga

SEQ ID NO: 75583 - RNA, 22 nt, Homo sapiens
uacaguaauguuaaucuuugug

SEQ ID NO: 75584 - RNA, 22 nt, Homo sapiens
uacaguagagaucagcaaacua

SEQ ID NO: 75585 - RNA, 22 nt, Homo sapiens
uacaguaguaucuucauuuguu

SEQ ID NO: 75586 - RNA, 22 nt, Homo sapiens
uacaguauuaugagugauugaa

SEQ ID NO: 75587 - RNA, 22 nt, Homo sapiens
uacagucauaaugccuagugac

SEQ ID NO: 75588 - RNA, 22 nt, Homo sapiens
uacagugggcacuggcgcccug

SEQ ID NO: 75589 - RNA, 22 nt, Homo sapiens
uacauacuguaugguucuguuu

SEQ ID NO: 75590 - RNA, 20 nt, Homo sapiens
uacauaguaaacugagagca

SEQ ID NO: 75591 - RNA, 22 nt, Homo sapiens
uacauaguagauauaggguuua

SEQ ID NO: 75592 - RNA, 19 nt, Homo sapiens
uacauaguauuuaguggca

SEQ ID NO: 75593 - RNA, 22 nt, Homo sapiens
uacaugcaugggcaugugugca

SEQ ID NO: 75594 - RNA, 22 nt, Homo sapiens
uacaugugcacaacgugcaggu

SEQ ID NO: 75595 - RNA, 23 nt, Homo sapiens
uaccacauuccuucuuuccuguu

SEQ ID NO: 75596 - RNA, 22 nt, Homo sapiens
uaccaccauuguaguuuggaaa

SEQ ID NO: 75597 - RNA, 22 nt, Homo sapiens
uacccaguaacaaguauuuugg

SEQ ID NO: 75598 - RNA, 22 nt, Homo sapiens
uacccucuggauacccuuguuc

SEQ ID NO: 75599 - RNA, 22 nt, Homo sapiens
uaccgcagugacauuccuugau

SEQ ID NO: 75600 - RNA, 22 nt, Homo sapiens
uaccuaguaggagggaggugga

SEQ ID NO: 75601 - RNA, 22 nt, Homo sapiens
uaccucagccaaugcccagaag

SEQ ID NO: 75602 - RNA, 22 nt, Homo sapiens
uaccucuguaaguaaagauuca

SEQ ID NO: 75603 - RNA, 22 nt, Homo sapiens
uaccugagacaacuuugaggaa

SEQ ID NO: 75604 - RNA, 22 nt, Homo sapiens
ucaaagugacaaaguugcagca

SEQ ID NO: 75605 - RNA, 22 nt, Homo sapiens
ucaaaucaucuuuuccaaagcu

SEQ ID NO: 75606 - RNA, 22 nt, Homo sapiens
ucaaaugaucugcccgccuugg

SEQ ID NO: 75607 - RNA, 22 nt, Homo sapiens
ucaaaugauucacccaccuuug

SEQ ID NO: 75608 - RNA, 22 nt, Homo sapiens
ucaaaugauucagaagccaccu

SEQ ID NO: 75609 - RNA, 22 nt, Homo sapiens
ucaaaugauucuccugccucag

SEQ ID NO: 75610 - RNA, 22 nt, Homo sapiens
ucaaaugcacguagagaaaaua

SEQ ID NO: 75611 - RNA, 17 nt, Homo sapiens
ucaaaugcucccaguga

SEQ ID NO: 75612 - RNA, 22 nt, Homo sapiens
ucaaaugcuguauuguaguaau

SEQ ID NO: 75613 - RNA, 22 nt, Homo sapiens
ucaaauuccaagucuagguagg

SEQ ID NO: 75614 - RNA, 22 nt, Homo sapiens
ucaagcaauucuccugccucag

SEQ ID NO: 75615 - RNA, 22 nt, Homo sapiens
ucaaggcaguggccuuccuucu

SEQ ID NO: 75616 - RNA, 22 nt, Homo sapiens
ucaagguacguugccucagauu

SEQ ID NO: 75617 - RNA, 22 nt, Homo sapiens
ucaaguacugccuugcucuggc

SEQ ID NO: 75618 - RNA, 22 nt, Homo sapiens
ucaaguacuuauuugauaauua

SEQ ID NO: 75619 - RNA, 22 nt, Homo sapiens
ucaaguaguaacuaacugugac

SEQ ID NO: 75620 - RNA, 23 nt, Homo sapiens
ucaagugaugguggccacaaggg

SEQ ID NO: 75621 - RNA, 22 nt, Homo sapiens
ucaagugcauugauucaguauu

SEQ ID NO: 75622 - RNA, 22 nt, Homo sapiens
ucaaugggcuacacauugagug

SEQ ID NO: 75623 - RNA, 16 nt, Homo sapiens
ucacaaacucuagcag

SEQ ID NO: 75624 - RNA, 21 nt, Homo sapiens
ucacaaugaacagcagcagaa

SEQ ID NO: 75625 - RNA, 22 nt, Homo sapiens
ucacaauucacuacaggcuuga

SEQ ID NO: 75626 - RNA, 22 nt, Homo sapiens
ucacacgugaacucaucacaga

SEQ ID NO: 75627 - RNA, 22 nt, Homo sapiens
ucacacucucaccaacauuugg

SEQ ID NO: 75628 - RNA, 22 nt, Homo sapiens
ucacacugucuugguuacucuu

SEQ ID NO: 75629 - RNA, 22 nt, Homo sapiens
ucacagacugagccaaauagag

SEQ ID NO: 75630 - RNA, 19 nt, Homo sapiens
ucacaggguugacuugagg

SEQ ID NO: 75631 - RNA, 18 nt, Homo sapiens
ucacagguaaaguugaca

SEQ ID NO: 75632 - RNA, 22 nt, Homo sapiens
ucacaguaacuuuguugcuuuu

SEQ ID NO: 75633 - RNA, 22 nt, Homo sapiens
ucacaguagccccucccaucau

SEQ ID NO: 75634 - RNA, 22 nt, Homo sapiens
ucacaguauggggggugguuau

SEQ ID NO: 75635 - RNA, 22 nt, Homo sapiens
ucacaguauucaugaacaugga

SEQ ID NO: 75636 - RNA, 22 nt, Homo sapiens
ucacaguugauugaaacacagc

SEQ ID NO: 75637 - RNA, 22 nt, Homo sapiens
ucacaguuggccuggccuuuua

SEQ ID NO: 75638 - RNA, 22 nt, Homo sapiens
ucacaucucagguuucuugaca

SEQ ID NO: 75639 - RNA, 22 nt, Homo sapiens
ucacaugaauugucuuguucca

SEQ ID NO: 75640 - RNA, 22 nt, Homo sapiens
ucacauggauuaacucauuuau

SEQ ID NO: 75641 - RNA, 22 nt, Homo sapiens
ucacaugggugcaauauaauca

SEQ ID NO: 75642 - RNA, 22 nt, Homo sapiens
ucacauguguaugagcuuugau

SEQ ID NO: 75643 - RNA, 22 nt, Homo sapiens
ucacauuguguagccugcucac

SEQ ID NO: 75644 - RNA, 22 nt, Homo sapiens
ucacauuguuauguaaauguuu

SEQ ID NO: 75645 - RNA, 22 nt, Homo sapiens
ucaccaccuuccaggaccacug

SEQ ID NO: 75646 - RNA, 19 nt, Homo sapiens
ucaccaguacacaauacaa

SEQ ID NO: 75647 - RNA, 22 nt, Homo sapiens
ucaccaguggcacuccagccug

SEQ ID NO: 75648 - RNA, 22 nt, Homo sapiens
ucaccgugaauuaacaacacuu

SEQ ID NO: 75649 - RNA, 22 nt, Homo sapiens
ucaccguguaucauuucauccg

SEQ ID NO: 75650 - RNA, 22 nt, Homo sapiens
ucaccuggagaagauggaucau

SEQ ID NO: 75651 - RNA, 22 nt, Homo sapiens
ucaccuggagccuucacauucu

SEQ ID NO: 75652 - RNA, 22 nt, Homo sapiens
gcacauauguaaauagcugccu

SEQ ID NO: 75653 - RNA, 22 nt, Homo sapiens
gcaccguggaguauggggagga

SEQ ID NO: 75654 - RNA, 17 nt, Homo sapiens
gcacuggcguaucccac

SEQ ID NO: 75655 - RNA, 22 nt, Homo sapiens
gcagaauugguuucuucuaagg

SEQ ID NO: 75656 - RNA, 22 nt, Homo sapiens
gcagagaaacaggucuaaggag

SEQ ID NO: 75657 - RNA, 22 nt, Homo sapiens
gcagcacauggcagaacauauu

SEQ ID NO: 75658 - RNA, 22 nt, Homo sapiens
gcagcagugugggcugaaccua

SEQ ID NO: 75659 - RNA, 22 nt, Homo sapiens
gcagcaucaaaucacacaagau

SEQ ID NO: 75660 - RNA, 22 nt, Homo sapiens
gcaggcaugacauuucacucuu

SEQ ID NO: 75661 - RNA, 22 nt, Homo sapiens
gcaguagugcgaucucagcuca

SEQ ID NO: 75662 - RNA, 22 nt, Homo sapiens
gcagugugugaggaauuugggu

SEQ ID NO: 75663 - RNA, 16 nt, Homo sapiens
gcaguguguuuaauag

SEQ ID NO: 75664 - RNA, 22 nt, Homo sapiens
gcaguguugugauccaggucuu

SEQ ID NO: 75665 - RNA, 17 nt, Homo sapiens
gcauauguugaaccagu

SEQ ID NO: 75666 - RNA, 22 nt, Homo sapiens
gcauauguuuggguguguauau

SEQ ID NO: 75667 - RNA, 22 nt, Homo sapiens
gcauauuuuaaaguguaaccug

SEQ ID NO: 75668 - RNA, 19 nt, Homo sapiens
gcaucauuaguugcuuuuc

SEQ ID NO: 75669 - RNA, 22 nt, Homo sapiens
gcaugacaaugauugcucuuca

SEQ ID NO: 75670 - RNA, 22 nt, Homo sapiens
gcauggauguugauggcugcug

SEQ ID NO: 75671 - RNA, 22 nt, Homo sapiens
gcauggccuuuaaaugucacag

SEQ ID NO: 75672 - RNA, 22 nt, Homo sapiens
gcaugugaauguguaagaaaau

SEQ ID NO: 75673 - RNA, 18 nt, Homo sapiens
gccaacauguaaacaggu

SEQ ID NO: 75674 - RNA, 19 nt, Homo sapiens
gccaccuggugcguguucu

SEQ ID NO: 75675 - RNA, 21 nt, Homo sapiens
gccaguguggcaauuuuucaa

SEQ ID NO: 75676 - RNA, 22 nt, Homo sapiens
gccauugcacuacagccuaggc

SEQ ID NO: 75677 - RNA, 22 nt, Homo sapiens
gccauugcacuccagccuagcg

SEQ ID NO: 75678 - RNA, 22 nt, Homo sapiens
gccauugcacucuagccugagc

SEQ ID NO: 75679 - RNA, 22 nt, Homo sapiens
gcccagauguuuggggucaugg

SEQ ID NO: 75680 - RNA, 22 nt, Homo sapiens
gccccugagacuugccucgggc

SEQ ID NO: 75681 - RNA, 22 nt, Homo sapiens
gcccuacuguuuauacauagga

SEQ ID NO: 75682 - RNA, 22 nt, Homo sapiens
gcccuguugcccaggcuggagu

SEQ ID NO: 75683 - RNA, 22 nt, Homo sapiens
gcccuguugcccugaauacaua

SEQ ID NO: 75684 - RNA, 22 nt, Homo sapiens
gccgagagauuuggaaugggga

SEQ ID NO: 75685 - RNA, 22 nt, Homo sapiens
gccuagagaaguaaauauuauc

SEQ ID NO: 75686 - RNA, 22 nt, Homo sapiens
gccuagagaguuaucaggcugu

SEQ ID NO: 75687 - RNA, 22 nt, Homo sapiens
gccuguagaagaguagaugacc

SEQ ID NO: 75688 - RNA, 22 nt, Homo sapiens
gcgcagugggcugugccaucca

SEQ ID NO: 75689 - RNA, 22 nt, Homo sapiens
gcuaaaucuguaaaaugaggag

SEQ ID NO: 75690 - RNA, 22 nt, Homo sapiens
gcuaaggcaggagcauugcuug

SEQ ID NO: 75691 - RNA, 22 nt, Homo sapiens
gcuagcauucaaaugugcagcc

SEQ ID NO: 75692 - RNA, 22 nt, Homo sapiens
gcuaggagaucugcugcucucu

SEQ ID NO: 75693 - RNA, 22 nt, Homo sapiens
gcuaguguuugccagcguagcc

SEQ ID NO: 75694 - RNA, 22 nt, Homo sapiens
gcucuuuugggguaauucugag

SEQ ID NO: 75695 - RNA, 22 nt, Homo sapiens
gcugaaauguuuaauuugggag

SEQ ID NO: 75696 - RNA, 22 nt, Homo sapiens
gcugacagugguuauacuuaga

SEQ ID NO: 75697 - RNA, 22 nt, Homo sapiens
gcugaguaguauuucauuguau

SEQ ID NO: 75698 - RNA, 22 nt, Homo sapiens
gcugauggugcaguucuagccu

SEQ ID NO: 75699 - RNA, 17 nt, Homo sapiens
gcugcauucauguagaa

SEQ ID NO: 75700 - RNA, 22 nt, Homo sapiens
gcugguguagagugcagaaagg

SEQ ID NO: 75701 - RNA, 22 nt, Homo sapiens
gcugguguucaggcccucaguc

SEQ ID NO: 75702 - RNA, 22 nt, Homo sapiens
gcuguauuguugaaggaaaugu

SEQ ID NO: 75703 - RNA, 16 nt, Homo sapiens
gcuguuguuuuguccu

SEQ ID NO: 75704 - RNA, 22 nt, Homo sapiens
gcuguuugccgccaucgcagac

SEQ ID NO: 75705 - RNA, 19 nt, Homo sapiens
gcuuguccacgugagauaa

SEQ ID NO: 75706 - RNA, 22 nt, Homo sapiens
gcuuugcaauggcauugaccau

SEQ ID NO: 75707 - RNA, 22 nt, Homo sapiens
gcuuugguucaaccaggcaauu

SEQ ID NO: 75708 - RNA, 22 nt, Homo sapiens
gcuuuugcaggaaaggaagaau

SEQ ID NO: 75709 - RNA, 21 nt, Homo sapiens
gcuuuuucggaagucuuuggc

SEQ ID NO: 75710 - RNA, 22 nt, Homo sapiens
ggaaagacaccuuacuauguua

SEQ ID NO: 75711 - RNA, 23 nt, Homo sapiens
ggaaauguuuaagggguugggag

SEQ ID NO: 75712 - RNA, 22 nt, Homo sapiens
ggaagaauaaugggccuuagag

SEQ ID NO: 75713 - RNA, 17 nt, Homo sapiens
ggaagccuuugguuuaa

SEQ ID NO: 75714 - RNA, 22 nt, Homo sapiens
ggaagugcuguguggaagucug

SEQ ID NO: 75715 - RNA, 22 nt, Homo sapiens
ggaagugugaguaggauuugga

SEQ ID NO: 75716 - RNA, 22 nt, Homo sapiens
ggaaucugaaccaugggaaugg

SEQ ID NO: 75717 - RNA, 22 nt, Homo sapiens
ggaaugcagugagcauuagaua

SEQ ID NO: 75718 - RNA, 22 nt, Homo sapiens
ggaaugggauuugaagucuggc

SEQ ID NO: 75719 - RNA, 22 nt, Homo sapiens
ggaaugugugucaugcuuuugc

SEQ ID NO: 75720 - RNA, 22 nt, Homo sapiens
ggacaagaucuuccaccauuca

SEQ ID NO: 75721 - RNA, 22 nt, Homo sapiens
ggacacaucaugugaccaaggu

SEQ ID NO: 75722 - RNA, 22 nt, Homo sapiens
ggacagaugggcucccgggucu

SEQ ID NO: 75723 - RNA, 22 nt, Homo sapiens
ggacuguacuccuggccagugu

SEQ ID NO: 75724 - RNA, 22 nt, Homo sapiens
ggagaauguaauugguauuuug

SEQ ID NO: 75725 - RNA, 20 nt, Homo sapiens
ggagagugacauaauucugg

SEQ ID NO: 75726 - RNA, 22 nt, Homo sapiens
ggagauccucugcgggcaaaga

SEQ ID NO: 75727 - RNA, 22 nt, Homo sapiens
ggagaugaaaugagcuacuuaa

SEQ ID NO: 75728 - RNA, 22 nt, Homo sapiens
ggaggcuaguaaaaagguagaa

SEQ ID NO: 75729 - RNA, 22 nt, Homo sapiens
ggagggugagaucaauuuggga

SEQ ID NO: 75730 - RNA, 16 nt, Homo sapiens
ggaggucaucugggaa

SEQ ID NO: 75731 - RNA, 22 nt, Homo sapiens
ggaguaaaagaguaggaggaau

SEQ ID NO: 75732 - RNA, 22 nt, Homo sapiens
ggagucugauguucuaaggcag

SEQ ID NO: 75733 - RNA, 22 nt, Homo sapiens
ggagucugauuuuuauguugcu

SEQ ID NO: 75734 - RNA, 22 nt, Homo sapiens
ggagugcuguuguuacacaagg

SEQ ID NO: 75735 - RNA, 23 nt, Homo sapiens
ggaguguaaauuauuucaaccau

SEQ ID NO: 75736 - RNA, 23 nt, Homo sapiens
ggaguguaaugacucgaucucgg

SEQ ID NO: 75737 - RNA, 23 nt, Homo sapiens
ggaguguauuggcacgaucucag

SEQ ID NO: 75738 - RNA, 22 nt, Homo sapiens
ggagugucagaaacaguguccu

SEQ ID NO: 75739 - RNA, 22 nt, Homo sapiens
ggaguuuaagucuugugcaucu

SEQ ID NO: 75740 - RNA, 22 nt, Homo sapiens
ggauacaucuggacagccgaau

SEQ ID NO: 75741 - RNA, 22 nt, Homo sapiens
ggaucacagagcuugggaaagg

SEQ ID NO: 75742 - RNA, 22 nt, Homo sapiens
ggaucgauuccaaauguagauc

SEQ ID NO: 75743 - RNA, 22 nt, Homo sapiens
ggaugcauuuuugguugucaca

SEQ ID NO: 75744 - RNA, 21 nt, Homo sapiens
ggauucaucccucaugaauuu

SEQ ID NO: 75745 - RNA, 22 nt, Homo sapiens
ggcaaaaucgcaauuacuuuug

SEQ ID NO: 75746 - RNA, 22 nt, Homo sapiens
ggcaaaucugcaauuacuuuug

SEQ ID NO: 75747 - RNA, 22 nt, Homo sapiens
ggcaacaugccgaaaccacguc

SEQ ID NO: 75748 - RNA, 22 nt, Homo sapiens
gacuauaucaggaauggggauu

SEQ ID NO: 75749 - RNA, 22 nt, Homo sapiens
gacucagaacuaaggguguuuc

SEQ ID NO: 75750 - RNA, 22 nt, Homo sapiens
gacugcauuugccccaucgaau

SEQ ID NO: 75751 - RNA, 22 nt, Homo sapiens
gacuggagcuguaugugguuac

SEQ ID NO: 75752 - RNA, 16 nt, Homo sapiens
gacugggcugaggaau

SEQ ID NO: 75753 - RNA, 22 nt, Homo sapiens
gacuugaagaaucuaagggagg

SEQ ID NO: 75754 - RNA, 22 nt, Homo sapiens
gacuuugguaaacucgguggca

SEQ ID NO: 75755 - RNA, 22 nt, Homo sapiens
gagaacaguguuguauuuuuuc

SEQ ID NO: 75756 - RNA, 22 nt, Homo sapiens
gagaaccauuuggagaaaaagu

SEQ ID NO: 75757 - RNA, 21 nt, Homo sapiens
gagaaucuuuucagggcaaac

SEQ ID NO: 75758 - RNA, 22 nt, Homo sapiens
gagaaugagaggggaaggccac

SEQ ID NO: 75759 - RNA, 22 nt, Homo sapiens
gagacagugucagccauugaaa

SEQ ID NO: 75760 - RNA, 22 nt, Homo sapiens
gagacauguuugcuuaucugag

SEQ ID NO: 75761 - RNA, 22 nt, Homo sapiens
gagacauugacuuuguuccaga

SEQ ID NO: 75762 - RNA, 22 nt, Homo sapiens
gagaccauuuacugccuacuua

SEQ ID NO: 75763 - RNA, 22 nt, Homo sapiens
gagacggagucacgcccuguca

SEQ ID NO: 75764 - RNA, 22 nt, Homo sapiens
gagacggagucucgcucuguca

SEQ ID NO: 75765 - RNA, 22 nt, Homo sapiens
gagacucuuagauuggaaaucu

SEQ ID NO: 75766 - RNA, 22 nt, Homo sapiens
gagacugagucuugcuuuguca

SEQ ID NO: 75767 - RNA, 22 nt, Homo sapiens
gagagcauuaagccaucaucau

SEQ ID NO: 75768 - RNA, 22 nt, Homo sapiens
gagagcuaggccacuggggcuu

SEQ ID NO: 75769 - RNA, 22 nt, Homo sapiens
gagaggucguauaugauuucug

SEQ ID NO: 75770 - RNA, 22 nt, Homo sapiens
gagagucacagugaauguggca

SEQ ID NO: 75771 - RNA, 22 nt, Homo sapiens
gagauaaauaggucacaguucu

SEQ ID NO: 75772 - RNA, 22 nt, Homo sapiens
gagauaauuugaaucauggggg

SEQ ID NO: 75773 - RNA, 22 nt, Homo sapiens
gagauauuauuucccuuucaca

SEQ ID NO: 75774 - RNA, 22 nt, Homo sapiens
gagauauuuagaaauguguucu

SEQ ID NO: 75775 - RNA, 22 nt, Homo sapiens
gagaucaauucauggcauaguu

SEQ ID NO: 75776 - RNA, 22 nt, Homo sapiens
gagaucacuguuuauauucucu

SEQ ID NO: 75777 - RNA, 22 nt, Homo sapiens
gagaucaguuaaugaagugagc

SEQ ID NO: 75778 - RNA, 22 nt, Homo sapiens
gagaucauuaugucagggguca

SEQ ID NO: 75779 - RNA, 22 nt, Homo sapiens
gagaucauucugauccagaguc

SEQ ID NO: 75780 - RNA, 22 nt, Homo sapiens
gagaugauuugccccauguauu

SEQ ID NO: 75781 - RNA, 22 nt, Homo sapiens
gagaugguacacauacgauucu

SEQ ID NO: 75782 - RNA, 22 nt, Homo sapiens
gagauggugugcuguuggaagu

SEQ ID NO: 75783 - RNA, 22 nt, Homo sapiens
gagaugugugugauuauauaau

SEQ ID NO: 75784 - RNA, 22 nt, Homo sapiens
gagauuauuagauguucugcuu

SEQ ID NO: 75785 - RNA, 22 nt, Homo sapiens
gagauuauugucucccucacca

SEQ ID NO: 75786 - RNA, 22 nt, Homo sapiens
gagauuauuuaaaaggugauuu

SEQ ID NO: 75787 - RNA, 22 nt, Homo sapiens
gagauuuucagcuugacuggga

SEQ ID NO: 75788 - RNA, 22 nt, Homo sapiens
gagcaaaaguauguauugguua

SEQ ID NO: 75789 - RNA, 22 nt, Homo sapiens
gagcaacaguggcagugguggg

SEQ ID NO: 75790 - RNA, 22 nt, Homo sapiens
gagcaaugauugagccacugua

SEQ ID NO: 75791 - RNA, 22 nt, Homo sapiens
gagcacauaugacauuuucuuc

SEQ ID NO: 75792 - RNA, 21 nt, Homo sapiens
gagcacauuguccucuaacgc

SEQ ID NO: 75793 - RNA, 22 nt, Homo sapiens
gagcacccuuuguugauugcaa

SEQ ID NO: 75794 - RNA, 18 nt, Homo sapiens
gagcaccuuuuuugcaga

SEQ ID NO: 75795 - RNA, 22 nt, Homo sapiens
gagcacugauuuauuuuugucu

SEQ ID NO: 75796 - RNA, 22 nt, Homo sapiens
gagcaucauggggccaaagcgc

SEQ ID NO: 75797 - RNA, 22 nt, Homo sapiens
gagcuacacugauucauuuguu

SEQ ID NO: 75798 - RNA, 22 nt, Homo sapiens
gagcuagcauuuagacaucugg

SEQ ID NO: 75799 - RNA, 22 nt, Homo sapiens
gagcucaccuuaccucuggagc

SEQ ID NO: 75800 - RNA, 22 nt, Homo sapiens
gagcucauuaaaguaggaccua

SEQ ID NO: 75801 - RNA, 22 nt, Homo sapiens
gagcucauuguugcuaaagaga

SEQ ID NO: 75802 - RNA, 22 nt, Homo sapiens
gagcucguuuuugcugacucuu

SEQ ID NO: 75803 - RNA, 22 nt, Homo sapiens
gagcugaucuuuucugauucca

SEQ ID NO: 75804 - RNA, 22 nt, Homo sapiens
gagcugguccuuuaaggaugca

SEQ ID NO: 75805 - RNA, 22 nt, Homo sapiens
gagcuguugguuugaaagaauu

SEQ ID NO: 75806 - RNA, 22 nt, Homo sapiens
gaggaguagggcacaaagccuu

SEQ ID NO: 75807 - RNA, 22 nt, Homo sapiens
gaggaguauuuugucgaauguc

SEQ ID NO: 75808 - RNA, 22 nt, Homo sapiens
gaggcagucugacccuuagcag

SEQ ID NO: 75809 - RNA, 22 nt, Homo sapiens
gaggcauugaaauauugcuuau

SEQ ID NO: 75810 - RNA, 22 nt, Homo sapiens
gagggcacugcuuuccuuucaa

SEQ ID NO: 75811 - RNA, 22 nt, Homo sapiens
gagguaagagaauaaacaguuu

SEQ ID NO: 75812 - RNA, 22 nt, Homo sapiens
gagguagugagcagcugaacua

SEQ ID NO: 75813 - RNA, 22 nt, Homo sapiens
gagguaucauuauguugcccag

SEQ ID NO: 75814 - RNA, 22 nt, Homo sapiens
gagguaugauugacauauaaaa

SEQ ID NO: 75815 - RNA, 22 nt, Homo sapiens
gaggucauucugugguacccag

SEQ ID NO: 75816 - RNA, 22 nt, Homo sapiens
gagguguagucaugccaagauc

SEQ ID NO: 75817 - RNA, 22 nt, Homo sapiens
auggcuauuccauaggcagagc

SEQ ID NO: 75818 - RNA, 22 nt, Homo sapiens
auggcucuggauagaaugcagg

SEQ ID NO: 75819 - RNA, 22 nt, Homo sapiens
auggcucuguuuuuuaugcucu

SEQ ID NO: 75820 - RNA, 22 nt, Homo sapiens
auggcugagugauuucaaacag

SEQ ID NO: 75821 - RNA, 22 nt, Homo sapiens
auggcuguuucugcaaugucua

SEQ ID NO: 75822 - RNA, 22 nt, Homo sapiens
auggcuuuguguucagagcuga

SEQ ID NO: 75823 - RNA, 22 nt, Homo sapiens
augggucuccugaauacagcac

SEQ ID NO: 75824 - RNA, 22 nt, Homo sapiens
augguaagcugaaaauaucgaa

SEQ ID NO: 75825 - RNA, 22 nt, Homo sapiens
augguaguagaugugugguuuu

SEQ ID NO: 75826 - RNA, 22 nt, Homo sapiens
augguuugugcuccuauaagaa

SEQ ID NO: 75827 - RNA, 22 nt, Homo sapiens
auguaacacagugcggcugggc

SEQ ID NO: 75828 - RNA, 22 nt, Homo sapiens
auguaacaguauuuggagaugu

SEQ ID NO: 75829 - RNA, 22 nt, Homo sapiens
auguaacugggacacaagccuc

SEQ ID NO: 75830 - RNA, 22 nt, Homo sapiens
auguagauaucaagaggcauau

SEQ ID NO: 75831 - RNA, 22 nt, Homo sapiens
auguaguaugaagaagaugcuu

SEQ ID NO: 75832 - RNA, 22 nt, Homo sapiens
auguaguauuaaugagagauaa

SEQ ID NO: 75833 - RNA, 22 nt, Homo sapiens
auguagugugauuuucacuaga

SEQ ID NO: 75834 - RNA, 22 nt, Homo sapiens
auguaguugcucugccuguuuu

SEQ ID NO: 75835 - RNA, 17 nt, Homo sapiens
auguauacauccaugua

SEQ ID NO: 75836 - RNA, 22 nt, Homo sapiens
augucaaagaggaaaacuggau

SEQ ID NO: 75837 - RNA, 22 nt, Homo sapiens
augucaacauagacaguagagu

SEQ ID NO: 75838 - RNA, 20 nt, Homo sapiens
augucaggaagggagucagg

SEQ ID NO: 75839 - RNA, 22 nt, Homo sapiens
augucauagauaaggaagugga

SEQ ID NO: 75840 - RNA, 21 nt, Homo sapiens
augucauggaugacuaauuca

SEQ ID NO: 75841 - RNA, 22 nt, Homo sapiens
auguccuaaucuccuguucuua

SEQ ID NO: 75842 - RNA, 22 nt, Homo sapiens
auguccuagagagauggugguc

SEQ ID NO: 75843 - RNA, 22 nt, Homo sapiens
augucuagagcaagagaugcug

SEQ ID NO: 75844 - RNA, 22 nt, Homo sapiens
augucuguuugcugagcccggc

SEQ ID NO: 75845 - RNA, 22 nt, Homo sapiens
cuggucguuauuuaucuucuca

SEQ ID NO: 75846 - RNA, 22 nt, Homo sapiens
cuggugugugacuuuucauuau

SEQ ID NO: 75847 - RNA, 21 nt, Homo sapiens
cugguguuagcacuucuuccc

SEQ ID NO: 75848 - RNA, 22 nt, Homo sapiens
cuguaauguaaugagacuacau

SEQ ID NO: 75849 - RNA, 23 nt, Homo sapiens
cuguacacauauacaucuaagua

SEQ ID NO: 75850 - RNA, 22 nt, Homo sapiens
cuguagcuuuuauaugcuuagc

SEQ ID NO: 75851 - RNA, 22 nt, Homo sapiens
cuguauguuucuaugaauguga

SEQ ID NO: 75852 - RNA, 22 nt, Homo sapiens
cugucacaguuuuggaggccag

SEQ ID NO: 75853 - RNA, 22 nt, Homo sapiens
cugucagugggaguucaggcuu

SEQ ID NO: 75854 - RNA, 22 nt, Homo sapiens
cugucuagagggcacaugaugc

SEQ ID NO: 75855 - RNA, 22 nt, Homo sapiens
cugucuaugagccaggaagcca

SEQ ID NO: 75856 - RNA, 22 nt, Homo sapiens
cugucuguuucaaaagugguua

SEQ ID NO: 75857 - RNA, 22 nt, Homo sapiens
cugugaacaugggagaaauggc

SEQ ID NO: 75858 - RNA, 22 nt, Homo sapiens
cugugauagguuagucaugaau

SEQ ID NO: 75859 - RNA, 22 nt, Homo sapiens
cugugaucuuuuuucauguggu

SEQ ID NO: 75860 - RNA, 22 nt, Homo sapiens
cugugcaaacaagugaaccccu

SEQ ID NO: 75861 - RNA, 22 nt, Homo sapiens
cugugcauaugacuuuauugga

SEQ ID NO: 75862 - RNA, 22 nt, Homo sapiens
cugugcaugcgcggagcugaaa

SEQ ID NO: 75863 - RNA, 22 nt, Homo sapiens
cugugccaagcuugcgaugugc

SEQ ID NO: 75864 - RNA, 22 nt, Homo sapiens
cugugcuaggcaaugugguaga

SEQ ID NO: 75865 - RNA, 22 nt, Homo sapiens
cugugcuuggagucccccuagg

SEQ ID NO: 75866 - RNA, 22 nt, Homo sapiens
cugugguugagcuuugccauga

SEQ ID NO: 75867 - RNA, 22 nt, Homo sapiens
cuguuauguucuagagggugca

SEQ ID NO: 75868 - RNA, 22 nt, Homo sapiens
cuguuugaggguuugcuuucag

SEQ ID NO: 75869 - RNA, 22 nt, Homo sapiens
cuguuuguuuaggguacucaga

SEQ ID NO: 75870 - RNA, 22 nt, Homo sapiens
cuuaacagugguauugaugacc

SEQ ID NO: 75871 - RNA, 20 nt, Homo sapiens
cuuaaugcagcauuucucag

SEQ ID NO: 75872 - RNA, 22 nt, Homo sapiens
cuuacagucuaucagccacaac

SEQ ID NO: 75873 - RNA, 18 nt, Homo sapiens
cuuagguagcucauucca

SEQ ID NO: 75874 - RNA, 22 nt, Homo sapiens
cuuagguuaugauaaauuuagu

SEQ ID NO: 75875 - RNA, 20 nt, Homo sapiens
cuuaucaguggcaaguauaa

SEQ ID NO: 75876 - RNA, 22 nt, Homo sapiens
cuucaaguuggaagggaccuaa

SEQ ID NO: 75877 - RNA, 22 nt, Homo sapiens
cuucaccaguuuggcagucuca

SEQ ID NO: 75878 - RNA, 22 nt, Homo sapiens
cuucagcaauauauccccuggg

SEQ ID NO: 75879 - RNA, 22 nt, Homo sapiens
cuucaucugguuugugaacuuu

SEQ ID NO: 75880 - RNA, 22 nt, Homo sapiens
cuuccauaguuacacccaggga

SEQ ID NO: 75881 - RNA, 22 nt, Homo sapiens
cuucccguuauugcccuugggu

SEQ ID NO: 75882 - RNA, 20 nt, Homo sapiens
cuugaagacuaugcugcuga

SEQ ID NO: 75883 - RNA, 22 nt, Homo sapiens
cuugacacugguuuucugaaua

SEQ ID NO: 75884 - RNA, 22 nt, Homo sapiens
cuugagacauuguuuuccaagu

SEQ ID NO: 75885 - RNA, 22 nt, Homo sapiens
cuugagcauauucuauauuaaa

SEQ ID NO: 75886 - RNA, 22 nt, Homo sapiens
cuugauagugguaaucauuuuu

SEQ ID NO: 75887 - RNA, 22 nt, Homo sapiens
cuugcacauuacagaucugcau

SEQ ID NO: 75888 - RNA, 22 nt, Homo sapiens
cuugcacuccacuguucuccug

SEQ ID NO: 75889 - RNA, 22 nt, Homo sapiens
uggacuguaagugccuugagua

SEQ ID NO: 75890 - RNA, 22 nt, Homo sapiens
uggacuguaauagagaacagaa

SEQ ID NO: 75891 - RNA, 22 nt, Homo sapiens
uggacuuuaauaaaagggaaau

SEQ ID NO: 75892 - RNA, 22 nt, Homo sapiens
uggagaacauucauuugcaaga

SEQ ID NO: 75893 - RNA, 23 nt, Homo sapiens
uggaggacaagcauggauaguga

SEQ ID NO: 75894 - RNA, 22 nt, Homo sapiens
uggaggucauuggaucaugggg

SEQ ID NO: 75895 - RNA, 16 nt, Homo sapiens
uggagucauccuugac

SEQ ID NO: 75896 - RNA, 20 nt, Homo sapiens
uggagugaagguucuggacc

SEQ ID NO: 75897 - RNA, 21 nt, Homo sapiens
uggagugcaacacuagguaua

SEQ ID NO: 75898 - RNA, 22 nt, Homo sapiens
uggaguguaauuagccaucagu

SEQ ID NO: 75899 - RNA, 22 nt, Homo sapiens
uggaguguagcggcaccuauua

SEQ ID NO: 75900 - RNA, 22 nt, Homo sapiens
uggaguguguuaacuuuacaag

SEQ ID NO: 75901 - RNA, 22 nt, Homo sapiens
uggauaguucuucuacuagagu

SEQ ID NO: 75902 - RNA, 18 nt, Homo sapiens
uggauaguuguuggcaga

SEQ ID NO: 75903 - RNA, 22 nt, Homo sapiens
uggauauguuuauuacccugaa

SEQ ID NO: 75904 - RNA, 19 nt, Homo sapiens
uggaugacugucugggucu

SEQ ID NO: 75905 - RNA, 22 nt, Homo sapiens
uggauugaaagcuuuaauauug

SEQ ID NO: 75906 - RNA, 22 nt, Homo sapiens
uggauugcaaaaucuuuuugag

SEQ ID NO: 75907 - RNA, 22 nt, Homo sapiens
uggauugugaagaccaugggaa

SEQ ID NO: 75908 - RNA, 22 nt, Homo sapiens
uggcaaaauauuuugguuucug

SEQ ID NO: 75909 - RNA, 22 nt, Homo sapiens
uggcaaaucagaggcauggaca

SEQ ID NO: 75910 - RNA, 22 nt, Homo sapiens
uggcaaaugaaagaaagccagu

SEQ ID NO: 75911 - RNA, 22 nt, Homo sapiens
uggcaaaugugagaugagaacu

SEQ ID NO: 75912 - RNA, 21 nt, Homo sapiens
uggcaacgaggugugcauuau

SEQ ID NO: 75913 - RNA, 22 nt, Homo sapiens
uggcaagaaccacaguuacuuu

SEQ ID NO: 75914 - RNA, 22 nt, Homo sapiens
uggcaagaacugcaauugcuuu

SEQ ID NO: 75915 - RNA, 22 nt, Homo sapiens
uggcaagaagagcaugagacca

SEQ ID NO: 75916 - RNA, 22 nt, Homo sapiens
uggcaagaccccaucucuacaa

SEQ ID NO: 75917 - RNA, 22 nt, Homo sapiens
uggcaagagggaugcaagguuu

SEQ ID NO: 75918 - RNA, 23 nt, Homo sapiens
uggcaagauuuguauugccugga

SEQ ID NO: 75919 - RNA, 18 nt, Homo sapiens
uggcaagugccauacggu

SEQ ID NO: 75920 - RNA, 20 nt, Homo sapiens
uggcaagugggaauuguggg

SEQ ID NO: 75921 - RNA, 22 nt, Homo sapiens
uggcaagugggaccuaguuaaa

SEQ ID NO: 75922 - RNA, 19 nt, Homo sapiens
uggcacauguauacauaug

SEQ ID NO: 75923 - RNA, 22 nt, Homo sapiens
uggcaccugacuccgagaugca

SEQ ID NO: 75924 - RNA, 21 nt, Homo sapiens
uggcacuauucacaauagcaa

SEQ ID NO: 75925 - RNA, 22 nt, Homo sapiens
uggcagacaaauuugagcauau

SEQ ID NO: 75926 - RNA, 22 nt, Homo sapiens
uggcagauaggauacaggacua

SEQ ID NO: 75927 - RNA, 22 nt, Homo sapiens
uggcagaugagccgcgcuccaa

SEQ ID NO: 75928 - RNA, 22 nt, Homo sapiens
uggcagaugcucuuggugccca

SEQ ID NO: 75929 - RNA, 22 nt, Homo sapiens
uggcagaugggugagcuggaga

SEQ ID NO: 75930 - RNA, 22 nt, Homo sapiens
uggcagauggugacaccauuag

SEQ ID NO: 75931 - RNA, 22 nt, Homo sapiens
uggcaggugcacuggcuuugaa

SEQ ID NO: 75932 - RNA, 22 nt, Homo sapiens
uggcagugggagauauuuuauu

SEQ ID NO: 75933 - RNA, 22 nt, Homo sapiens
uggcaguuuuaugugguucaac

SEQ ID NO: 75934 - RNA, 22 nt, Homo sapiens
uggcauauaaagauguguucaa

SEQ ID NO: 75935 - RNA, 22 nt, Homo sapiens
uggcauauaauauagaagacua

SEQ ID NO: 75936 - RNA, 22 nt, Homo sapiens
uggcaucuguucuacacauaaa

SEQ ID NO: 75937 - RNA, 19 nt, Homo sapiens
uggcaugaaugugaacuaa

SEQ ID NO: 75938 - RNA, 22 nt, Homo sapiens
uggcauggaaagcuuuucauac

SEQ ID NO: 75939 - RNA, 22 nt, Homo sapiens
uggcauggaguggauggcccca

SEQ ID NO: 75940 - RNA, 22 nt, Homo sapiens
uggcauguagucugggaccugg

SEQ ID NO: 75941 - RNA, 22 nt, Homo sapiens
uggcauuuucucuguucuuaga

SEQ ID NO: 75942 - RNA, 23 nt, Homo sapiens
uggccaagauaaucucaguuuuc

SEQ ID NO: 75943 - RNA, 22 nt, Homo sapiens
uggccagagggcaauuagcugu

SEQ ID NO: 75944 - RNA, 22 nt, Homo sapiens
uggccaguuuuuaauugggucu

SEQ ID NO: 75945 - RNA, 23 nt, Homo sapiens
uggcgagacagaaaacuuuuaga

SEQ ID NO: 75946 - RNA, 22 nt, Homo sapiens
uggcuaagaugcacacuucacu

SEQ ID NO: 75947 - RNA, 22 nt, Homo sapiens
uugaaggaacgcuguucccuug

SEQ ID NO: 75948 - RNA, 22 nt, Homo sapiens
uugaaggaggugcucacucucg

SEQ ID NO: 75949 - RNA, 22 nt, Homo sapiens
uugaagguagaaguucucaauu

SEQ ID NO: 75950 - RNA, 22 nt, Homo sapiens
uugaaguaugaccgcugagaau

SEQ ID NO: 75951 - RNA, 22 nt, Homo sapiens
uugaauaguggugaaaguuuga

SEQ ID NO: 75952 - RNA, 18 nt, Homo sapiens
uugaauaguguccaaucu

SEQ ID NO: 75953 - RNA, 22 nt, Homo sapiens
uugaaugaaaugaugucauuug

SEQ ID NO: 75954 - RNA, 22 nt, Homo sapiens
uugaaugaaauuggugugggga

SEQ ID NO: 75955 - RNA, 22 nt, Homo sapiens
uugaauguguugggaagcccuu

SEQ ID NO: 75956 - RNA, 22 nt, Homo sapiens
uugacacuaauuauuauaggug

SEQ ID NO: 75957 - RNA, 22 nt, Homo sapiens
uugacauauuugugcuuaagaa

SEQ ID NO: 75958 - RNA, 22 nt, Homo sapiens
uugacuuuuauucacucugcua

SEQ ID NO: 75959 - RNA, 22 nt, Homo sapiens
uugagacggagucucacucugu

SEQ ID NO: 75960 - RNA, 22 nt, Homo sapiens
uugagacugagucucgcccugu

SEQ ID NO: 75961 - RNA, 22 nt, Homo sapiens
uugagaguggaggcuauaucuu

SEQ ID NO: 75962 - RNA, 22 nt, Homo sapiens
uugagauagggucuaccucugu

SEQ ID NO: 75963 - RNA, 22 nt, Homo sapiens
uugagauauccauaaaugggaa

SEQ ID NO: 75964 - RNA, 22 nt, Homo sapiens
uugagauaucuuggccuuugca

SEQ ID NO: 75965 - RNA, 22 nt, Homo sapiens
uugagaugaagucuugcucucu

SEQ ID NO: 75966 - RNA, 22 nt, Homo sapiens
uugagaugaaguuuugcucuuu

SEQ ID NO: 75967 - RNA, 22 nt, Homo sapiens
uugagauggagucucacucuuc

SEQ ID NO: 75968 - RNA, 22 nt, Homo sapiens
uugagauggagucucgcacugu

SEQ ID NO: 75969 - RNA, 22 nt, Homo sapiens
uugagauggagucuugcgcugu

SEQ ID NO: 75970 - RNA, 22 nt, Homo sapiens
uugagauggagucuugcucugu

SEQ ID NO: 75971 - RNA, 22 nt, Homo sapiens
uugagauggagucuugcucuug

SEQ ID NO: 75972 - RNA, 22 nt, Homo sapiens
uugagauggaguucauuuuugu

SEQ ID NO: 75973 - RNA, 22 nt, Homo sapiens
uugagauggaguuucaauauug

SEQ ID NO: 75974 - RNA, 22 nt, Homo sapiens
uugagauggaguuucacucugu

SEQ ID NO: 75975 - RNA, 22 nt, Homo sapiens
uugagauggaguuuugcucuug

SEQ ID NO: 75976 - RNA, 22 nt, Homo sapiens
uugagauuauuguguuccuuua

SEQ ID NO: 75977 - RNA, 22 nt, Homo sapiens
uugagauuuuccucaaauauuu

SEQ ID NO: 75978 - RNA, 22 nt, Homo sapiens
uugagcaacauagugagacugu

SEQ ID NO: 75979 - RNA, 22 nt, Homo sapiens
uugagcaaugaacgauucaggg

SEQ ID NO: 75980 - RNA, 22 nt, Homo sapiens
uugagcacaggaguuuugagac

SEQ ID NO: 75981 - RNA, 22 nt, Homo sapiens
uugagcaccaugccuggccaug

SEQ ID NO: 75982 - RNA, 22 nt, Homo sapiens
uugagcacugucugugugcagu

SEQ ID NO: 75983 - RNA, 22 nt, Homo sapiens
uugagccaaggauugucuuucc

SEQ ID NO: 75984 - RNA, 22 nt, Homo sapiens
uugagcuaguugcaccagcagg

SEQ ID NO: 75985 - RNA, 22 nt, Homo sapiens
uugagcuaugaguuaauaggac

SEQ ID NO: 75986 - RNA, 22 nt, Homo sapiens
uugagcucuuccagccuggagc

SEQ ID NO: 75987 - RNA, 22 nt, Homo sapiens
uugagcucuucuagcaauucua

SEQ ID NO: 75988 - RNA, 22 nt, Homo sapiens
uugaggacugguugaaagcuuu

SEQ ID NO: 75989 - RNA, 22 nt, Homo sapiens
uugaggaggcagucuguccguu

SEQ ID NO: 75990 - RNA, 23 nt, Homo sapiens
uugaggcauguaccaucaauauc

SEQ ID NO: 75991 - RNA, 22 nt, Homo sapiens
uugaggcuuuugaccucaugug

SEQ ID NO: 75992 - RNA, 22 nt, Homo sapiens
uugagggcugaauaccaaucag

SEQ ID NO: 75993 - RNA, 22 nt, Homo sapiens
uugaggguggcauauauugauu

SEQ ID NO: 75994 - RNA, 22 nt, Homo sapiens
uugugcuccagagacgggcucg

SEQ ID NO: 75995 - RNA, 22 nt, Homo sapiens
uugugcuccuaugagaaucuaa

SEQ ID NO: 75996 - RNA, 22 nt, Homo sapiens
uugugcuuuugagcugagauga

SEQ ID NO: 75997 - RNA, 22 nt, Homo sapiens
uugugguuuuagcacuguggau

SEQ ID NO: 75998 - RNA, 22 nt, Homo sapiens
uuguguccccacccaaauuuca

SEQ ID NO: 75999 - RNA, 22 nt, Homo sapiens
uuguguuugaugcugacacgca

SEQ ID NO: 76000 - RNA, 22 nt, Homo sapiens
uuguuauguaucucaagauaaa

SEQ ID NO: 76001 - RNA, 22 nt, Homo sapiens
uuguuauguuggucaguaaugu

SEQ ID NO: 76002 - RNA, 22 nt, Homo sapiens
uuguucaggagguuggggaugc

SEQ ID NO: 76003 - RNA, 22 nt, Homo sapiens
uuguuguggauuaaauuugcau

SEQ ID NO: 76004 - RNA, 22 nt, Homo sapiens
uuguuugguugaguauggaagu

SEQ ID NO: 76005 - RNA, 22 nt, Homo sapiens
uuuaacauuggaugagaucguc

SEQ ID NO: 76006 - RNA, 22 nt, Homo sapiens
uuuaaggcacuucaugguuuca

SEQ ID NO: 76007 - RNA, 22 nt, Homo sapiens
uuuaaggcaugccuguacaugc

SEQ ID NO: 76008 - RNA, 22 nt, Homo sapiens
uuuaauacugcaucuuuacucu

SEQ ID NO: 76009 - RNA, 22 nt, Homo sapiens
uuuaaugcacuaggugguguuc

SEQ ID NO: 76010 - RNA, 22 nt, Homo sapiens
uuuaaugcgucucugaguuuug

SEQ ID NO: 76011 - RNA, 17 nt, Homo sapiens
uuuaaugcuaggacucu

SEQ ID NO: 76012 - RNA, 22 nt, Homo sapiens
uuuaaugcugcccagucauggg

SEQ ID NO: 76013 - RNA, 22 nt, Homo sapiens
uuuaauguuacaguauugguau

SEQ ID NO: 76014 - RNA, 22 nt, Homo sapiens
uuuacagucuuuugugugaguc

SEQ ID NO: 76015 - RNA, 22 nt, Homo sapiens
uuuagcaaagcaauuuacacca

SEQ ID NO: 76016 - RNA, 22 nt, Homo sapiens
uuuagcagcaaagagccaugcu

SEQ ID NO: 76017 - RNA, 22 nt, Homo sapiens
uuuagcgaaugcuugcuccugu

SEQ ID NO: 76018 - RNA, 22 nt, Homo sapiens
uuuaggcaugcaguucuauuua

SEQ ID NO: 76019 - RNA, 22 nt, Homo sapiens
uuuagggcagggacaguucuuc

SEQ ID NO: 76020 - RNA, 22 nt, Homo sapiens
uuuauagucaggaacuugagga

SEQ ID NO: 76021 - RNA, 22 nt, Homo sapiens
uuuaugcuacauguguuggaaa

SEQ ID NO: 76022 - RNA, 22 nt, Homo sapiens
uuuauggagagauauuuauggu

SEQ ID NO: 76023 - RNA, 22 nt, Homo sapiens
uuuaugucuguacaucgggcgg

SEQ ID NO: 76024 - RNA, 22 nt, Homo sapiens
uuuauguggagcacuugacaca

SEQ ID NO: 76025 - RNA, 22 nt, Homo sapiens
uuuauucggcuaggagcuucgg

SEQ ID NO: 76026 - RNA, 22 nt, Homo sapiens
uuucacuagccagcccuuuauu

SEQ ID NO: 76027 - RNA, 22 nt, Homo sapiens
uuucagagucaucugcccaagu

SEQ ID NO: 76028 - RNA, 18 nt, Homo sapiens
uuucaggguggacaugag

SEQ ID NO: 76029 - RNA, 15 nt, Homo sapiens
uuucaguacagauuc

SEQ ID NO: 76030 - RNA, 23 nt, Homo sapiens
uuucaguaguuguauccuguugc

SEQ ID NO: 76031 - RNA, 22 nt, Homo sapiens
uuucauagccuucuaaugaguu

SEQ ID NO: 76032 - RNA, 16 nt, Homo sapiens
uuucaucaguuuuaau

SEQ ID NO: 76033 - RNA, 22 nt, Homo sapiens
uuucauccggcuguguauuaug

SEQ ID NO: 76034 - RNA, 22 nt, Homo sapiens
uuucauggagaaucuucuuacu

SEQ ID NO: 76035 - RNA, 22 nt, Homo sapiens
uuucauggaggauuugcuucuu

SEQ ID NO: 76036 - RNA, 22 nt, Homo sapiens
uuucauggcaguuuggggccug

SEQ ID NO: 76037 - RNA, 22 nt, Homo sapiens
uuucauguuuuucugugaggca

SEQ ID NO: 76038 - RNA, 18 nt, Homo sapiens
uuucauugagugugauau

SEQ ID NO: 76039 - RNA, 22 nt, Homo sapiens
uuuccacauggacuuaccuucg

SEQ ID NO: 76040 - RNA, 22 nt, Homo sapiens
uuuccaguuggaaagccuguuu

SEQ ID NO: 76041 - RNA, 22 nt, Homo sapiens
uuuccaguuguucuagaaagcu

SEQ ID NO: 76042 - RNA, 19 nt, Homo sapiens
uuucccugcagaccuacua

SEQ ID NO: 76043 - RNA, 22 nt, Homo sapiens
uuucccuuugcuuugucagcca

SEQ ID NO: 76044 - RNA, 20 nt, Homo sapiens
uuauugcggcaucauucaug

SEQ ID NO: 76045 - RNA, 22 nt, Homo sapiens
uuauugcuuuugugcaggugag

SEQ ID NO: 76046 - RNA, 22 nt, Homo sapiens
uuauuguccaaguuucccuuug

SEQ ID NO: 76047 - RNA, 22 nt, Homo sapiens
uuauuugguuauuguaauuggg

SEQ ID NO: 76048 - RNA, 22 nt, Homo sapiens
uucaaaguguugguuuugggcu

SEQ ID NO: 76049 - RNA, 22 nt, Homo sapiens
uucaaaguuggaggacaaacug

SEQ ID NO: 76050 - RNA, 22 nt, Homo sapiens
uucaaaucuuuggcucccacua

SEQ ID NO: 76051 - RNA, 22 nt, Homo sapiens
uucaagcugggcaaauaagggg

SEQ ID NO: 76052 - RNA, 22 nt, Homo sapiens
uucaaguaguucucaugccuca

SEQ ID NO: 76053 - RNA, 22 nt, Homo sapiens
uucaauacuguugauccuuaug

SEQ ID NO: 76054 - RNA, 19 nt, Homo sapiens
uucaaugcagcauugccac

SEQ ID NO: 76055 - RNA, 22 nt, Homo sapiens
uucaauuaauauuauacucuca

SEQ ID NO: 76056 - RNA, 22 nt, Homo sapiens
uucacagagagaacucaaacca

SEQ ID NO: 76057 - RNA, 22 nt, Homo sapiens
uucacagucacccuucuccaug

SEQ ID NO: 76058 - RNA, 22 nt, Homo sapiens
uucacaguggugggagacguca

SEQ ID NO: 76059 - RNA, 22 nt, Homo sapiens
uucaccggggaccccuggcugu

SEQ ID NO: 76060 - RNA, 22 nt, Homo sapiens
uucaccuugcccacagcagucu

SEQ ID NO: 76061 - RNA, 22 nt, Homo sapiens
uucacugagccagacuaagaca

SEQ ID NO: 76062 - RNA, 22 nt, Homo sapiens
uucacugcacuccagccugagc

SEQ ID NO: 76063 - RNA, 22 nt, Homo sapiens
uucacugcaugaaaaggacagc

SEQ ID NO: 76064 - RNA, 22 nt, Homo sapiens
uucacuguagccucagccucuu

SEQ ID NO: 76065 - RNA, 22 nt, Homo sapiens
uucagagagggagggauaccua

SEQ ID NO: 76066 - RNA, 22 nt, Homo sapiens
uucagagugaggcucucggaac

SEQ ID NO: 76067 - RNA, 22 nt, Homo sapiens
uucagauugcauaccgaaagua

SEQ ID NO: 76068 - RNA, 22 nt, Homo sapiens
uucagcaggccaggcccugacu

SEQ ID NO: 76069 - RNA, 22 nt, Homo sapiens
uucagguacugggggaguaugg

SEQ ID NO: 76070 - RNA, 22 nt, Homo sapiens
uucaguacuucaaaaucuuuaa

SEQ ID NO: 76071 - RNA, 22 nt, Homo sapiens
uucaguaguaaguuggaacucu

SEQ ID NO: 76072 - RNA, 22 nt, Homo sapiens
uucaguagucuccauagaaccg

SEQ ID NO: 76073 - RNA, 18 nt, Homo sapiens
uucagugaauucuuuuga

SEQ ID NO: 76074 - RNA, 22 nt, Homo sapiens
uucaguucugcacugaucuuag

SEQ ID NO: 76075 - RNA, 22 nt, Homo sapiens
uucauacaguggcugcacucca

SEQ ID NO: 76076 - RNA, 22 nt, Homo sapiens
uucauagucuaauuuuuuccac

SEQ ID NO: 76077 - RNA, 22 nt, Homo sapiens
uucauagucuaugcaaguaaga

SEQ ID NO: 76078 - RNA, 22 nt, Homo sapiens
uucauagugaaaaauucaaagu

SEQ ID NO: 76079 - RNA, 22 nt, Homo sapiens
uucauaguguaccugaaggcac

SEQ ID NO: 76080 - RNA, 22 nt, Homo sapiens
uucauaguucuuuuagucauua

SEQ ID NO: 76081 - RNA, 20 nt, Homo sapiens
uucaucaggauauuggucua

SEQ ID NO: 76082 - RNA, 22 nt, Homo sapiens
uucaucaguugagcugguugcu

SEQ ID NO: 76083 - RNA, 22 nt, Homo sapiens
uucaucuggcaauucagagauu

SEQ ID NO: 76084 - RNA, 22 nt, Homo sapiens
uucauggaauauugaccauuuu

SEQ ID NO: 76085 - RNA, 22 nt, Homo sapiens
uucauggagccauccuuugauc

SEQ ID NO: 76086 - RNA, 22 nt, Homo sapiens
uucauggaguuuaaauuguagu

SEQ ID NO: 76087 - RNA, 22 nt, Homo sapiens
uucauggugguacaaaagcaau

SEQ ID NO: 76088 - RNA, 22 nt, Homo sapiens
uucaugugagucuguauuaacu

SEQ ID NO: 76089 - RNA, 17 nt, Homo sapiens
acuuuuugaggaggcau

SEQ ID NO: 76090 - RNA, 22 nt, Homo sapiens
acuuuuugaugaggucguuugu

SEQ ID NO: 76091 - RNA, 22 nt, Homo sapiens
acuuuuugcaaccauuuggacc

SEQ ID NO: 76092 - RNA, 22 nt, Homo sapiens
agaaagugcuucccuuugguga

SEQ ID NO: 76093 - RNA, 23 nt, Homo sapiens
agaaaugucuauucagggucccu

SEQ ID NO: 76094 - RNA, 22 nt, Homo sapiens
agaaccauuagagggagauauu

SEQ ID NO: 76095 - RNA, 20 nt, Homo sapiens
agaaccuguaguguagaggg

SEQ ID NO: 76096 - RNA, 19 nt, Homo sapiens
agaaucuaaauuauuucug

SEQ ID NO: 76097 - RNA, 22 nt, Homo sapiens
agaaugauccuucucagaggca

SEQ ID NO: 76098 - RNA, 22 nt, Homo sapiens
agaauguaacucuaugaaggca

SEQ ID NO: 76099 - RNA, 22 nt, Homo sapiens
agaaugugaccuuauuuggaga

SEQ ID NO: 76100 - RNA, 21 nt, Homo sapiens
agacacuuggaagguuuuaga

SEQ ID NO: 76101 - RNA, 22 nt, Homo sapiens
agacagcugggaaauggagugu

SEQ ID NO: 76102 - RNA, 20 nt, Homo sapiens
agacaguguggagauuccuu

SEQ ID NO: 76103 - RNA, 22 nt, Homo sapiens
agacccuguauguguuuaguuu

SEQ ID NO: 76104 - RNA, 22 nt, Homo sapiens
agacuagacagaugaacagcac

SEQ ID NO: 76105 - RNA, 22 nt, Homo sapiens
agagaacugauucagggaaaau

SEQ ID NO: 76106 - RNA, 22 nt, Homo sapiens
agagaacugauuggaguugggc

SEQ ID NO: 76107 - RNA, 22 nt, Homo sapiens
agagaacuggcuucaccauucu

SEQ ID NO: 76108 - RNA, 22 nt, Homo sapiens
agagaccuguaaaguucaggca

SEQ ID NO: 76109 - RNA, 19 nt, Homo sapiens
agagacucauuguagcauu

SEQ ID NO: 76110 - RNA, 22 nt, Homo sapiens
agagagcuugggguguuaaauu

SEQ ID NO: 76111 - RNA, 22 nt, Homo sapiens
agagauccucauuuuauagaca

SEQ ID NO: 76112 - RNA, 22 nt, Homo sapiens
agagaugaagauggggcucccg

SEQ ID NO: 76113 - RNA, 22 nt, Homo sapiens
agagcaaugggugaauauuaaa

SEQ ID NO: 76114 - RNA, 22 nt, Homo sapiens
agagcauugaguuaaugguuca

SEQ ID NO: 76115 - RNA, 22 nt, Homo sapiens
agagccacauuaaauaugggaa

SEQ ID NO: 76116 - RNA, 22 nt, Homo sapiens
agaggaguacuacuccaagucu

SEQ ID NO: 76117 - RNA, 22 nt, Homo sapiens
agagguguuaaagucucuuuua

SEQ ID NO: 76118 - RNA, 22 nt, Homo sapiens
agagguuuaacuggcuuauggu

SEQ ID NO: 76119 - RNA, 22 nt, Homo sapiens
agaguacugacguuugcaaauu

SEQ ID NO: 76120 - RNA, 22 nt, Homo sapiens
agauauguuauugauguuaaug

SEQ ID NO: 76121 - RNA, 22 nt, Homo sapiens
agauauguuuaguuucaaaaug

SEQ ID NO: 76122 - RNA, 22 nt, Homo sapiens
agaucacaguaccguaaggcug

SEQ ID NO: 76123 - RNA, 22 nt, Homo sapiens
agaugauguuucuggcacauga

SEQ ID NO: 76124 - RNA, 23 nt, Homo sapiens
agaugcauucuuguaggauauau

SEQ ID NO: 76125 - RNA, 22 nt, Homo sapiens
agaugcuguuaucaacuguagc

SEQ ID NO: 76126 - RNA, 22 nt, Homo sapiens
agauggauuuuguagccccagc

SEQ ID NO: 76127 - RNA, 22 nt, Homo sapiens
agauggucuucauaaguuuuaa

SEQ ID NO: 76128 - RNA, 22 nt, Homo sapiens
agcaacaucagcagcaggaaaa

SEQ ID NO: 76129 - RNA, 22 nt, Homo sapiens
agcaacauuguucauaauagcu

SEQ ID NO: 76130 - RNA, 22 nt, Homo sapiens
agcaagaaugaacucucccaga

SEQ ID NO: 76131 - RNA, 22 nt, Homo sapiens
agcacauauauuucccaaaaca

SEQ ID NO: 76132 - RNA, 22 nt, Homo sapiens
agcaccauuagcguugggccgg

SEQ ID NO: 76133 - RNA, 22 nt, Homo sapiens
agcaccauuuauugaaaagaca

SEQ ID NO: 76134 - RNA, 22 nt, Homo sapiens
agcaccauuucucuaaagcacu

SEQ ID NO: 76135 - RNA, 22 nt, Homo sapiens
agcacuacugcacuccagccug

SEQ ID NO: 76136 - RNA, 19 nt, Homo sapiens
agcagaacaaauguguggg

SEQ ID NO: 76137 - RNA, 22 nt, Homo sapiens
agcagagcaguggauuuuguga

SEQ ID NO: 76138 - RNA, 21 nt, Homo sapiens
agcagaguggcagcucuuuug

SEQ ID NO: 76139 - RNA, 22 nt, Homo sapiens
agcagauguuuagugagcgccu

SEQ ID NO: 76140 - RNA, 22 nt, Homo sapiens
agcagcauggguauaaaucucc

SEQ ID NO: 76141 - RNA, 22 nt, Homo sapiens
agcagcauuccaaaaaucugcu

SEQ ID NO: 76142 - RNA, 17 nt, Homo sapiens
agcagcccauaucccca

SEQ ID NO: 76143 - RNA, 22 nt, Homo sapiens
agcagcuuugaucugaaugauu

SEQ ID NO: 76144 - RNA, 22 nt, Homo sapiens
agcagcuuugcauggccugugg

SEQ ID NO: 76145 - RNA, 22 nt, Homo sapiens
agcagguauucgggucaugggg

SEQ ID NO: 76146 - RNA, 22 nt, Homo sapiens
agcagguguggcuuauccugaa

SEQ ID NO: 76147 - RNA, 22 nt, Homo sapiens
agcagugucauuuucuggugag

SEQ ID NO: 76148 - RNA, 19 nt, Homo sapiens
agcaguguggagauuucuc

SEQ ID NO: 76149 - RNA, 22 nt, Homo sapiens
agcaucagugauuuuguugaag

SEQ ID NO: 76150 - RNA, 22 nt, Homo sapiens
agcaucaugcaguugcuauuca

SEQ ID NO: 76151 - RNA, 22 nt, Homo sapiens
agcaucauguuuucgagguuca

SEQ ID NO: 76152 - RNA, 19 nt, Homo sapiens
agcaucauuauuguuuugg

SEQ ID NO: 76153 - RNA, 20 nt, Homo sapiens
agcaucauugcaauuuguca

SEQ ID NO: 76154 - RNA, 20 nt, Homo sapiens
agcaucguuguguuauagcc

SEQ ID NO: 76155 - RNA, 22 nt, Homo sapiens
agcaugacauauuguagagaaa

SEQ ID NO: 76156 - RNA, 22 nt, Homo sapiens
agcaugauugggguugggcaca

SEQ ID NO: 76157 - RNA, 16 nt, Homo sapiens
agccaccauuuacuug

SEQ ID NO: 76158 - RNA, 22 nt, Homo sapiens
agccaguauuuuauugaggauu

SEQ ID NO: 76159 - RNA, 22 nt, Homo sapiens
agccaguauuuugaguuggucu

SEQ ID NO: 76160 - RNA, 22 nt, Homo sapiens
agccaguuuggcuaauuuuggc

SEQ ID NO: 76161 - RNA, 22 nt, Homo sapiens
agcccauguggcugaggcuucu

SEQ ID NO: 76162 - RNA, 22 nt, Homo sapiens
agcccauuuugcacugagaugc

SEQ ID NO: 76163 - RNA, 20 nt, Homo sapiens
agccccauguaaaccacaug

SEQ ID NO: 76164 - RNA, 22 nt, Homo sapiens
agccccauuuguugaaaagacg

SEQ ID NO: 76165 - RNA, 22 nt, Homo sapiens
agcccuuagauggcuccuucca

SEQ ID NO: 76166 - RNA, 21 nt, Homo sapiens
agccugugggucauaguugcc

SEQ ID NO: 76167 - RNA, 23 nt, Homo sapiens
agccuguugccuaggcagcucau

SEQ ID NO: 76168 - RNA, 22 nt, Homo sapiens
agcgguguuaggaaggugaggg

SEQ ID NO: 76169 - RNA, 20 nt, Homo sapiens
agcuaguauuuccaugguua

SEQ ID NO: 76170 - RNA, 22 nt, Homo sapiens
agcuaguauuuucuuaaggauu

SEQ ID NO: 76171 - RNA, 22 nt, Homo sapiens
agcuaguguucaccagagguca

SEQ ID NO: 76172 - RNA, 18 nt, Homo sapiens
agcucaguguuugcuuac

SEQ ID NO: 76173 - RNA, 22 nt, Homo sapiens
agcucauugcuguccuggagga

SEQ ID NO: 76174 - RNA, 22 nt, Homo sapiens
agcugaguguuccaagagcgag

SEQ ID NO: 76175 - RNA, 22 nt, Homo sapiens
agcugcaaagggagagaugauu

SEQ ID NO: 76176 - RNA, 22 nt, Homo sapiens
agcugcacaaauggaugugagg

SEQ ID NO: 76177 - RNA, 17 nt, Homo sapiens
agcuggaauuacgggag

SEQ ID NO: 76178 - RNA, 22 nt, Homo sapiens
agcuggaauuuaagguagauag

SEQ ID NO: 76179 - RNA, 20 nt, Homo sapiens
agcuggguguguuggugcau

SEQ ID NO: 76180 - RNA, 22 nt, Homo sapiens
agcugguccugugacuugcuuc

SEQ ID NO: 76181 - RNA, 22 nt, Homo sapiens
agcugguuuauuucuauauccu

SEQ ID NO: 76182 - RNA, 22 nt, Homo sapiens
agcugguuuauuucucacaaca

SEQ ID NO: 76183 - RNA, 20 nt, Homo sapiens
agcugguuuuaugaaucuuu

SEQ ID NO: 76184 - RNA, 22 nt, Homo sapiens
agggcuuguuuaacuaucauua

SEQ ID NO: 76185 - RNA, 20 nt, Homo sapiens
agguacacugacaugccuuc

SEQ ID NO: 76186 - RNA, 22 nt, Homo sapiens
agguagaguguuuuguucuucu

SEQ ID NO: 76187 - RNA, 21 nt, Homo sapiens
agguaguuuuccuuuuggagu

SEQ ID NO: 76188 - RNA, 22 nt, Homo sapiens
agguauuuuuuauccuccagca

SEQ ID NO: 76189 - RNA, 21 nt, Homo sapiens
aggucaugaagauguucuaau

SEQ ID NO: 76190 - RNA, 22 nt, Homo sapiens
agguccacuuacuacuccuguu

SEQ ID NO: 76191 - RNA, 22 nt, Homo sapiens
aggucccauguccucccugacc

SEQ ID NO: 76192 - RNA, 22 nt, Homo sapiens
aggugcaauggugguuuugugg

SEQ ID NO: 76193 - RNA, 22 nt, Homo sapiens
aggugcaugcuucacuggauau

SEQ ID NO: 76194 - RNA, 22 nt, Homo sapiens
agguuaacaucuauuuuggaug

SEQ ID NO: 76195 - RNA, 22 nt, Homo sapiens
agguuaugauuguagagcgagg

SEQ ID NO: 76196 - RNA, 22 nt, Homo sapiens
agguuguguuugugauuagaua

SEQ ID NO: 76197 - RNA, 22 nt, Homo sapiens
aguaaagccagaccuguuaauu

SEQ ID NO: 76198 - RNA, 22 nt, Homo sapiens
aguaacauuucuaguagagagu

SEQ ID NO: 76199 - RNA, 22 nt, Homo sapiens
aguaagauggcaacucuccaca

SEQ ID NO: 76200 - RNA, 22 nt, Homo sapiens
aguaagucucaagguaggguag

SEQ ID NO: 76201 - RNA, 22 nt, Homo sapiens
aguacaauguugaguagaagug

SEQ ID NO: 76202 - RNA, 22 nt, Homo sapiens
aguacacuguugaacagaagug

SEQ ID NO: 76203 - RNA, 22 nt, Homo sapiens
aguaccauuccguuggagcugg

SEQ ID NO: 76204 - RNA, 23 nt, Homo sapiens
aguacuguaguaauugaggggaa

SEQ ID NO: 76205 - RNA, 16 nt, Homo sapiens
aguaguuuuacagauu

SEQ ID NO: 76206 - RNA, 22 nt, Homo sapiens
aguaucaucuuguuggccaggc

SEQ ID NO: 76207 - RNA, 22 nt, Homo sapiens
aguauugcuaauaagagauuug

SEQ ID NO: 76208 - RNA, 22 nt, Homo sapiens
agucaaguuuuuucagagaaua

SEQ ID NO: 76209 - RNA, 22 nt, Homo sapiens
agucacagccuuuuacuuuaga

SEQ ID NO: 76210 - RNA, 22 nt, Homo sapiens
agucagucuguccugugcugag

SEQ ID NO: 76211 - RNA, 22 nt, Homo sapiens
agucaugggagagaugugaucg

SEQ ID NO: 76212 - RNA, 22 nt, Homo sapiens
agucugguguucucacacuagu

SEQ ID NO: 76213 - RNA, 22 nt, Homo sapiens
agugaacacagcuucuuugguu

SEQ ID NO: 76214 - RNA, 22 nt, Homo sapiens
agugaauuguucaacaggagga

SEQ ID NO: 76215 - RNA, 22 nt, Homo sapiens
agugacaugggaucaaaucuga

SEQ ID NO: 76216 - RNA, 19 nt, Homo sapiens
agugagccaagauccuacc

SEQ ID NO: 76217 - RNA, 22 nt, Homo sapiens
agugagcuggagaaaagaaacu

SEQ ID NO: 76218 - RNA, 22 nt, Homo sapiens
agugcaaagccgagguuucuug

SEQ ID NO: 76219 - RNA, 22 nt, Homo sapiens
agugcaaggacauuuagguugu

SEQ ID NO: 76220 - RNA, 22 nt, Homo sapiens
agugcaauggcgugaucuuggc

SEQ ID NO: 76221 - RNA, 22 nt, Homo sapiens
agugcacucuuuccucucuuac

SEQ ID NO: 76222 - RNA, 22 nt, Homo sapiens
agugcaguggugccaucauaac

SEQ ID NO: 76223 - RNA, 22 nt, Homo sapiens
agugcaguugucacgugccuuc

SEQ ID NO: 76224 - RNA, 22 nt, Homo sapiens
agugccuacuugaauuguagug

SEQ ID NO: 76225 - RNA, 22 nt, Homo sapiens
aguggauuuuauuugacaacua

SEQ ID NO: 76226 - RNA, 19 nt, Homo sapiens
aguggguguuuucuguuug

SEQ ID NO: 76227 - RNA, 22 nt, Homo sapiens
aguuggcacugagcugugauug

SEQ ID NO: 76228 - RNA, 22 nt, Homo sapiens
aguuuugguugaguuacuagca

SEQ ID NO: 76229 - RNA, 22 nt, Homo sapiens
auaaaagcaggucuaggucagg

SEQ ID NO: 76230 - RNA, 22 nt, Homo sapiens
auaaacugucaguggagaguaa

SEQ ID NO: 76231 - RNA, 22 nt, Homo sapiens
auaaagacacuuggcaugauuu

SEQ ID NO: 76232 - RNA, 22 nt, Homo sapiens
auaaaguagaggugaggugcau

SEQ ID NO: 76233 - RNA, 22 nt, Homo sapiens
auaaaguguuuaguauaggcaa

SEQ ID NO: 76234 - RNA, 19 nt, Homo sapiens
auaaaugccuacaagggug

SEQ ID NO: 76235 - RNA, 22 nt, Homo sapiens
auaagaucauuugcuaagaggg

SEQ ID NO: 76236 - RNA, 22 nt, Homo sapiens
auaaggcagcugcuaaaaggca

SEQ ID NO: 76237 - RNA, 22 nt, Homo sapiens
auaaggcuaguguaggagccag

SEQ ID NO: 76238 - RNA, 22 nt, Homo sapiens
auaagguuagcucugagaaagu

SEQ ID NO: 76239 - RNA, 22 nt, Homo sapiens
auaaguaguaaagcagugacua

SEQ ID NO: 76240 - RNA, 22 nt, Homo sapiens
auaagucaauggaacagauuaa

SEQ ID NO: 76241 - RNA, 19 nt, Homo sapiens
gugguauuaccuuuugauu

SEQ ID NO: 76242 - RNA, 22 nt, Homo sapiens
gugguucuagaauugaguaucc

SEQ ID NO: 76243 - RNA, 22 nt, Homo sapiens
gugguucuagagggacagaaug

SEQ ID NO: 76244 - RNA, 22 nt, Homo sapiens
gugguuuuaauauucagucuag

SEQ ID NO: 76245 - RNA, 22 nt, Homo sapiens
gugguuuuacaaagagaaagau

SEQ ID NO: 76246 - RNA, 22 nt, Homo sapiens
gugguuuuuagauuucuacagu

SEQ ID NO: 76247 - RNA, 22 nt, Homo sapiens
gugguuuuuuucugccuuauag

SEQ ID NO: 76248 - RNA, 22 nt, Homo sapiens
guguaaaucugcugugaacauu

SEQ ID NO: 76249 - RNA, 22 nt, Homo sapiens
guguaaaugagugcugaaggag

SEQ ID NO: 76250 - RNA, 22 nt, Homo sapiens
guguaacaacagcacuccacug

SEQ ID NO: 76251 - RNA, 20 nt, Homo sapiens
guguaagagcaagcuuccua

SEQ ID NO: 76252 - RNA, 22 nt, Homo sapiens
guguaauacauuagcaaaccaa

SEQ ID NO: 76253 - RNA, 22 nt, Homo sapiens
guguagagaaaaguaccauuuu

SEQ ID NO: 76254 - RNA, 22 nt, Homo sapiens
guguauguuguccauggaugcg

SEQ ID NO: 76255 - RNA, 22 nt, Homo sapiens
guguauucaucuggcugaggua

SEQ ID NO: 76256 - RNA, 22 nt, Homo sapiens
gugucaaggaugccugucaggc

SEQ ID NO: 76257 - RNA, 21 nt, Homo sapiens
gugucacagacaugacagaug

SEQ ID NO: 76258 - RNA, 22 nt, Homo sapiens
gugucacuguugagaaguccac

SEQ ID NO: 76259 - RNA, 22 nt, Homo sapiens
gugucaugagggggacaggaag

SEQ ID NO: 76260 - RNA, 22 nt, Homo sapiens
gugucaugggcauguccuuaac

SEQ ID NO: 76261 - RNA, 22 nt, Homo sapiens
gugucuccuguggagcuaugua

SEQ ID NO: 76262 - RNA, 22 nt, Homo sapiens
gugugcaugucuuuuuaguagg

SEQ ID NO: 76263 - RNA, 21 nt, Homo sapiens
gugugcuugaauucagcuguc

SEQ ID NO: 76264 - RNA, 22 nt, Homo sapiens
gugugucuugaccaggaucgga

SEQ ID NO: 76265 - RNA, 22 nt, Homo sapiens
guuaagaaguguaacuuaaguu

SEQ ID NO: 76266 - RNA, 23 nt, Homo sapiens
guuaagugaauguguacucuauu

SEQ ID NO: 76267 - RNA, 22 nt, Homo sapiens
guuacagucuuguguaagguua

SEQ ID NO: 76268 - RNA, 22 nt, Homo sapiens
guuagcuaguagacaauuuucc

SEQ ID NO: 76269 - RNA, 22 nt, Homo sapiens
guuagguagaaguuuacuuuga

SEQ ID NO: 76270 - RNA, 22 nt, Homo sapiens
guuaugcagcaauugauaaucu

SEQ ID NO: 76271 - RNA, 22 nt, Homo sapiens
guuauguuaaauuguuguaugc

SEQ ID NO: 76272 - RNA, 22 nt, Homo sapiens
guuauuaguugauauuaaguuc

SEQ ID NO: 76273 - RNA, 22 nt, Homo sapiens
guuauugcucucgaagacucuc

SEQ ID NO: 76274 - RNA, 22 nt, Homo sapiens
guucaagugauagcugggauua

SEQ ID NO: 76275 - RNA, 22 nt, Homo sapiens
guucaaguuuucucuugugggu

SEQ ID NO: 76276 - RNA, 22 nt, Homo sapiens
guucacagugguugccuuccag

SEQ ID NO: 76277 - RNA, 22 nt, Homo sapiens
guucagcaggggcuucaauggu

SEQ ID NO: 76278 - RNA, 22 nt, Homo sapiens
guucaguuuugaaauguuaauu

SEQ ID NO: 76279 - RNA, 22 nt, Homo sapiens
guucaucagggauauuggccug

SEQ ID NO: 76280 - RNA, 17 nt, Homo sapiens
guucccaguggcauuug

SEQ ID NO: 76281 - RNA, 20 nt, Homo sapiens
guucccuguaggugugcgga

SEQ ID NO: 76282 - RNA, 22 nt, Homo sapiens
guuccuuguagaugcuggauau

SEQ ID NO: 76283 - RNA, 22 nt, Homo sapiens
guucuauguugggaguucacua

SEQ ID NO: 76284 - RNA, 22 nt, Homo sapiens
guucucacuggugcugguaagu

SEQ ID NO: 76285 - RNA, 18 nt, Homo sapiens
guugagcuuuuccuuuag

SEQ ID NO: 76286 - RNA, 22 nt, Homo sapiens
guugcccuuagcacuucagccu

SEQ ID NO: 76287 - RNA, 22 nt, Homo sapiens
guugcucaggccggagugcagu

SEQ ID NO: 76288 - RNA, 22 nt, Homo sapiens
guugcucaggcugaagugcagu

SEQ ID NO: 76289 - RNA, 22 nt, Homo sapiens
guuggcaaguggcugagcuggg

SEQ ID NO: 76290 - RNA, 22 nt, Homo sapiens
guuggguaauggggcgcaccgu

SEQ ID NO: 76291 - RNA, 22 nt, Homo sapiens
guuugcacuccuaugagaaucu

SEQ ID NO: 76292 - RNA, 22 nt, Homo sapiens
guuugcagaucaugaagaaccc

SEQ ID NO: 76293 - RNA, 22 nt, Homo sapiens
guuugcauagugcugggagggg

SEQ ID NO: 76294 - RNA, 22 nt, Homo sapiens
guuugccuuuuagauaggaaug

SEQ ID NO: 76295 - RNA, 22 nt, Homo sapiens
guuugguugcauggaaaauuua

SEQ ID NO: 76296 - RNA, 22 nt, Homo sapiens
guuugugcuccuaugagaaucu

SEQ ID NO: 76297 - RNA, 22 nt, Homo sapiens
guuuugguuauauggaucaguu

SEQ ID NO: 76298 - RNA, 22 nt, Homo sapiens
guuuuuggggucacuauuaccg

SEQ ID NO: 76299 - RNA, 21 nt, Homo sapiens
uaaaacuguaacuuuguccug

SEQ ID NO: 76300 - RNA, 22 nt, Homo sapiens
uaaaagucaucacaacuggagu

SEQ ID NO: 76301 - RNA, 22 nt, Homo sapiens
uaaacugucuuuggagcuuugc

SEQ ID NO: 76302 - RNA, 22 nt, Homo sapiens
uaaagcauguaauuagguuaga

SEQ ID NO: 76303 - RNA, 22 nt, Homo sapiens
uaaagccagugauuaugucucu

SEQ ID NO: 76304 - RNA, 22 nt, Homo sapiens
uaaagcuacaguauaugguauu

SEQ ID NO: 76305 - RNA, 21 nt, Homo sapiens
uaaagcuagaaccuuagcuuu

SEQ ID NO: 76306 - RNA, 22 nt, Homo sapiens
uaaagcuagaauuguuccagca

SEQ ID NO: 76307 - RNA, 22 nt, Homo sapiens
uaaagcugaaaugauuaugaca

SEQ ID NO: 76308 - RNA, 22 nt, Homo sapiens
uaaagcuuagauccaugguggc

SEQ ID NO: 76309 - RNA, 21 nt, Homo sapiens
uaaagcuuagcuauaguggcu

SEQ ID NO: 76310 - RNA, 22 nt, Homo sapiens
uaaagugaggauggcaguaggu

SEQ ID NO: 76311 - RNA, 22 nt, Homo sapiens
uaaaugcucuuuaaaagugcuu

SEQ ID NO: 76312 - RNA, 22 nt, Homo sapiens
uaaauugcauaaguacaaauga

SEQ ID NO: 76313 - RNA, 18 nt, Homo sapiens
uaaauugcuucaccugag

SEQ ID NO: 76314 - RNA, 22 nt, Homo sapiens
uaacaccuuugauagcacuuuu

SEQ ID NO: 76315 - RNA, 22 nt, Homo sapiens
uaacaguauauuuaccaaaccu

SEQ ID NO: 76316 - RNA, 22 nt, Homo sapiens
uaacaguguauuuacuacuucc

SEQ ID NO: 76317 - RNA, 22 nt, Homo sapiens
uaacauuguugauuauacuaag

SEQ ID NO: 76318 - RNA, 22 nt, Homo sapiens
uaacccagugucugugaugggu

SEQ ID NO: 76319 - RNA, 22 nt, Homo sapiens
uaacuaaagagaagucaauguc

SEQ ID NO: 76320 - RNA, 22 nt, Homo sapiens
uaacuagaaaggagacaguugc

SEQ ID NO: 76321 - RNA, 22 nt, Homo sapiens
uaacuaguggaauuugauuuca

SEQ ID NO: 76322 - RNA, 22 nt, Homo sapiens
uaacuauagagaauguugagua

SEQ ID NO: 76323 - RNA, 22 nt, Homo sapiens
uaacugccuacugugcaaauau

SEQ ID NO: 76324 - RNA, 18 nt, Homo sapiens
uaacuggugugagauggu

SEQ ID NO: 76325 - RNA, 22 nt, Homo sapiens
uaacugucucccuugguccuga

SEQ ID NO: 76326 - RNA, 22 nt, Homo sapiens
uaagacucuggacucuaauguu

SEQ ID NO: 76327 - RNA, 22 nt, Homo sapiens
uaagacugccccagacagcaag

SEQ ID NO: 76328 - RNA, 22 nt, Homo sapiens
uaagacuguuggcaauuuuugc

SEQ ID NO: 76329 - RNA, 22 nt, Homo sapiens
uaagagagcuccaucuuuuccu

SEQ ID NO: 76330 - RNA, 20 nt, Homo sapiens
uaagcauaguugucaggguc

SEQ ID NO: 76331 - RNA, 22 nt, Homo sapiens
uaaggauuuuggugauuacacu

SEQ ID NO: 76332 - RNA, 22 nt, Homo sapiens
uaaggcaaguuuuuaguggaca

SEQ ID NO: 76333 - RNA, 22 nt, Homo sapiens
uaaggcacucuucugugugccu

SEQ ID NO: 76334 - RNA, 20 nt, Homo sapiens
uaaggcacugugcuuuuagg

SEQ ID NO: 76335 - RNA, 22 nt, Homo sapiens
uaaggcuuugcuggacucaguc

SEQ ID NO: 76336 - RNA, 22 nt, Homo sapiens
uaagggacgcccccuucucucu

SEQ ID NO: 76337 - RNA, 22 nt, Homo sapiens
uaagggcacuaaucccauuuau

SEQ ID NO: 76338 - RNA, 22 nt, Homo sapiens
uaagggcaugcugcaugagagu

SEQ ID NO: 76339 - RNA, 22 nt, Homo sapiens
uaaguaauuuguauuuuaccca

SEQ ID NO: 76340 - RNA, 19 nt, Homo sapiens
uaaguagaugacugaugcu

SEQ ID NO: 76341 - RNA, 22 nt, Homo sapiens
uaaguaguauaagguuuuuuga

SEQ ID NO: 76342 - RNA, 22 nt, Homo sapiens
uaaguauagguaacagaagcaa

SEQ ID NO: 76343 - RNA, 22 nt, Homo sapiens
uaaguaucaguuuagcuaugau

SEQ ID NO: 76344 - RNA, 22 nt, Homo sapiens
uaaguauuaugugcugcauuuu

SEQ ID NO: 76345 - RNA, 22 nt, Homo sapiens
uaagugacuuugagauuccuca

SEQ ID NO: 76346 - RNA, 22 nt, Homo sapiens
uaagugaugucuuuuugugugc

SEQ ID NO: 76347 - RNA, 22 nt, Homo sapiens
uaagugcaacauaaguguuaaa

SEQ ID NO: 76348 - RNA, 20 nt, Homo sapiens
uaagugcuugagacuucuga

SEQ ID NO: 76349 - RNA, 22 nt, Homo sapiens
auaauaccugccacauuugaau

SEQ ID NO: 76350 - RNA, 18 nt, Homo sapiens
auacaagcagcagagauu

SEQ ID NO: 76351 - RNA, 22 nt, Homo sapiens
auacaaguuauuugaacugcgg

SEQ ID NO: 76352 - RNA, 22 nt, Homo sapiens
auacaguaucuucuggcaagca

SEQ ID NO: 76353 - RNA, 22 nt, Homo sapiens
auacagucuguuagauuuccuc

SEQ ID NO: 76354 - RNA, 22 nt, Homo sapiens
auacaguugccauuucuugugc

SEQ ID NO: 76355 - RNA, 22 nt, Homo sapiens
auacaugugccaugcuggugug

SEQ ID NO: 76356 - RNA, 22 nt, Homo sapiens
auacaugugccauguugguaug

SEQ ID NO: 76357 - RNA, 20 nt, Homo sapiens
auaccacagacuggguaguu

SEQ ID NO: 76358 - RNA, 22 nt, Homo sapiens
auacccugucgugagucagaga

SEQ ID NO: 76359 - RNA, 22 nt, Homo sapiens
auacguacauaugcacauaugg

SEQ ID NO: 76360 - RNA, 22 nt, Homo sapiens
auacugccuuuagcaaaacagu

SEQ ID NO: 76361 - RNA, 22 nt, Homo sapiens
auacugguuuuugucaugugga

SEQ ID NO: 76362 - RNA, 22 nt, Homo sapiens
auacuguuucugaacuuugauu

SEQ ID NO: 76363 - RNA, 20 nt, Homo sapiens
auagaagacuagugcagcag

SEQ ID NO: 76364 - RNA, 22 nt, Homo sapiens
auagaagcugccaacguuucag

SEQ ID NO: 76365 - RNA, 22 nt, Homo sapiens
auagaccuggagaguagauaua

SEQ ID NO: 76366 - RNA, 22 nt, Homo sapiens
auagagcuggcagacacccuua

SEQ ID NO: 76367 - RNA, 22 nt, Homo sapiens
auagaguccugcucgaguugcu

SEQ ID NO: 76368 - RNA, 22 nt, Homo sapiens
auagaguuagaaagaaauguuu

SEQ ID NO: 76369 - RNA, 22 nt, Homo sapiens
auagaucuauuuauguaucccu

SEQ ID NO: 76370 - RNA, 22 nt, Homo sapiens
auagcaaugccccacuccuugg

SEQ ID NO: 76371 - RNA, 22 nt, Homo sapiens
auagcacacuauagcuucaaac

SEQ ID NO: 76372 - RNA, 21 nt, Homo sapiens
auagcacaucagauuuuauua

SEQ ID NO: 76373 - RNA, 22 nt, Homo sapiens
auagcacauggcauccucucuu

SEQ ID NO: 76374 - RNA, 22 nt, Homo sapiens
auagcacaugugcaaauggcug

SEQ ID NO: 76375 - RNA, 22 nt, Homo sapiens
auagcacuuaccacaggcugca

SEQ ID NO: 76376 - RNA, 22 nt, Homo sapiens
auagcacuuauagauuuggucu

SEQ ID NO: 76377 - RNA, 21 nt, Homo sapiens
auagcacuucacuugguuaga

SEQ ID NO: 76378 - RNA, 22 nt, Homo sapiens
auagcagaacagugucucacug

SEQ ID NO: 76379 - RNA, 22 nt, Homo sapiens
auagcagaauuuggucaagucu

SEQ ID NO: 76380 - RNA, 20 nt, Homo sapiens
auagcagcaugauuuauaau

SEQ ID NO: 76381 - RNA, 20 nt, Homo sapiens
auagcagcaugauuuauagu

SEQ ID NO: 76382 - RNA, 22 nt, Homo sapiens
auagcagcucacuuauuuaugg

SEQ ID NO: 76383 - RNA, 22 nt, Homo sapiens
auagcaggagaauggucauggg

SEQ ID NO: 76384 - RNA, 22 nt, Homo sapiens
auagcagugugaaaacagacug

SEQ ID NO: 76385 - RNA, 22 nt, Homo sapiens
auagcagugugaaaauggacua

SEQ ID NO: 76386 - RNA, 22 nt, Homo sapiens
auagcagugugaaaauugacug

SEQ ID NO: 76387 - RNA, 22 nt, Homo sapiens
auagcauaucccacaugucaga

SEQ ID NO: 76388 - RNA, 22 nt, Homo sapiens
auagcucuugcuuacccacugu

SEQ ID NO: 76389 - RNA, 22 nt, Homo sapiens
auagcuguccuuacuagcuagg

SEQ ID NO: 76390 - RNA, 22 nt, Homo sapiens
auagcuguugaauggaauauuc

SEQ ID NO: 76391 - RNA, 22 nt, Homo sapiens
auaggagcacaaacuauuguga

SEQ ID NO: 76392 - RNA, 22 nt, Homo sapiens
auaggcacauuaggaacuuuug

SEQ ID NO: 76393 - RNA, 22 nt, Homo sapiens
auagguaguuuuucaauccuca

SEQ ID NO: 76394 - RNA, 22 nt, Homo sapiens
auagguauuuuuaaaugacugu

SEQ ID NO: 76395 - RNA, 21 nt, Homo sapiens
auagugcuagagaguagcagg

SEQ ID NO: 76396 - RNA, 22 nt, Homo sapiens
auagugcugcaagaaacauacg

SEQ ID NO: 76397 - RNA, 22 nt, Homo sapiens
auagugcugcaauaaacauacg

SEQ ID NO: 76398 - RNA, 22 nt, Homo sapiens
auagugcugcaauaaccauggg

SEQ ID NO: 76399 - RNA, 22 nt, Homo sapiens
auagugcugcaaugaacauaca

SEQ ID NO: 76400 - RNA, 22 nt, Homo sapiens
auagugcugcaauuaacauaca

SEQ ID NO: 76401 - RNA, 22 nt, Homo sapiens
auagugcugcacuaaacauaca

SEQ ID NO: 76402 - RNA, 22 nt, Homo sapiens
auagugcugcagucaauguacg

SEQ ID NO: 76403 - RNA, 22 nt, Homo sapiens
auagugcugcauuaaacauacg

SEQ ID NO: 76404 - RNA, 22 nt, Homo sapiens
auagugcuggaauaaauauacg

SEQ ID NO: 76405 - RNA, 19 nt, Homo sapiens
auauaacauccaggagcag

SEQ ID NO: 76406 - RNA, 22 nt, Homo sapiens
auauagcucuggcuggaugacu

SEQ ID NO: 76407 - RNA, 22 nt, Homo sapiens
auauaugcuaagugcuaauaaa

SEQ ID NO: 76408 - RNA, 22 nt, Homo sapiens
auauauguuuucugggaagaaa

SEQ ID NO: 76409 - RNA, 22 nt, Homo sapiens
auaucacagguguuuaccugau

SEQ ID NO: 76410 - RNA, 22 nt, Homo sapiens
auaucccuguauaagugaaugu

SEQ ID NO: 76411 - RNA, 22 nt, Homo sapiens
auaucugcauugccauuuaugu

SEQ ID NO: 76412 - RNA, 22 nt, Homo sapiens
auauggguuuuauauuaggcuc

SEQ ID NO: 76413 - RNA, 22 nt, Homo sapiens
auaugguacuuaugcucaaacu

SEQ ID NO: 76414 - RNA, 22 nt, Homo sapiens
auauggucccuguuaccucauu

SEQ ID NO: 76415 - RNA, 22 nt, Homo sapiens
auauguaguauggaaacauugu

SEQ ID NO: 76416 - RNA, 22 nt, Homo sapiens
auauugacuuucucuuagauca

SEQ ID NO: 76417 - RNA, 22 nt, Homo sapiens
auauuggacucugugcuaggaa

SEQ ID NO: 76418 - RNA, 22 nt, Homo sapiens
auauuggacugugcuaguuaga

SEQ ID NO: 76419 - RNA, 22 nt, Homo sapiens
auauuggucuucaagaccugug

SEQ ID NO: 76420 - RNA, 22 nt, Homo sapiens
auauuugguuaccugugggucu

SEQ ID NO: 76421 - RNA, 22 nt, Homo sapiens
aucaaaguaucucaauauggua

SEQ ID NO: 76422 - RNA, 22 nt, Homo sapiens
aucaaagugaaauauuaguuau

SEQ ID NO: 76423 - RNA, 22 nt, Homo sapiens
aucaaagugaauuaaugagaau

SEQ ID NO: 76424 - RNA, 22 nt, Homo sapiens
aucacacuguuauuuuaguuaa

SEQ ID NO: 76425 - RNA, 22 nt, Homo sapiens
aucacagagucacgggcaacuu

SEQ ID NO: 76426 - RNA, 22 nt, Homo sapiens
aucacagaguuaaaacuuucuu

SEQ ID NO: 76427 - RNA, 22 nt, Homo sapiens
aucacagcuacuccucugucuu

SEQ ID NO: 76428 - RNA, 22 nt, Homo sapiens
aucacaguggcucacaagagcc

SEQ ID NO: 76429 - RNA, 22 nt, Homo sapiens
aucacaguggucagguauagau

SEQ ID NO: 76430 - RNA, 22 nt, Homo sapiens
aucacaguuuuaccauuuggua

SEQ ID NO: 76431 - RNA, 22 nt, Homo sapiens
aucaccauguguacauuagacc

SEQ ID NO: 76432 - RNA, 22 nt, Homo sapiens
aucaccugagcaguauacacug

SEQ ID NO: 76433 - RNA, 22 nt, Homo sapiens
aucaccuggaggugaucacuug

SEQ ID NO: 76434 - RNA, 22 nt, Homo sapiens
aucaccuuucccuuucugaauc

SEQ ID NO: 76435 - RNA, 22 nt, Homo sapiens
aucacuggccuuuuuaaaugcu

SEQ ID NO: 76436 - RNA, 22 nt, Homo sapiens
aucacugggagcagccauuaau

SEQ ID NO: 76437 - RNA, 22 nt, Homo sapiens
aucacugugauuucuacugugc

SEQ ID NO: 76438 - RNA, 22 nt, Homo sapiens
aucacuuucuauuucugugcca

SEQ ID NO: 76439 - RNA, 21 nt, Homo sapiens
aucagagacccaggcuuccuc

SEQ ID NO: 76440 - RNA, 22 nt, Homo sapiens
aucagagccugugugcccugaa

SEQ ID NO: 76441 - RNA, 22 nt, Homo sapiens
aucagagugaugguuuaaguau

SEQ ID NO: 76442 - RNA, 22 nt, Homo sapiens
aucagaguggguuuuaaaagug

SEQ ID NO: 76443 - RNA, 23 nt, Homo sapiens
aucagauaguuguagguaugugg

SEQ ID NO: 76444 - RNA, 22 nt, Homo sapiens
ggacagugaaugccacuccucc

SEQ ID NO: 76445 - RNA, 22 nt, Homo sapiens
ggacaucauuaccauggaccca

SEQ ID NO: 76446 - RNA, 22 nt, Homo sapiens
ggacauuaacugcaagauagau

SEQ ID NO: 76447 - RNA, 22 nt, Homo sapiens
ggacuagaggugaaaagaagac

SEQ ID NO: 76448 - RNA, 22 nt, Homo sapiens
ggagaguaauuagacugaaaga

SEQ ID NO: 76449 - RNA, 22 nt, Homo sapiens
ggagauaauccagggagggacu

SEQ ID NO: 76450 - RNA, 22 nt, Homo sapiens
ggagaucacucuuuguagcgug

SEQ ID NO: 76451 - RNA, 22 nt, Homo sapiens
ggagaugauuaugaaucacuua

SEQ ID NO: 76452 - RNA, 22 nt, Homo sapiens
ggagauguuuaaccuuuuaucu

SEQ ID NO: 76453 - RNA, 22 nt, Homo sapiens
ggagcucaucuagcauagaggu

SEQ ID NO: 76454 - RNA, 22 nt, Homo sapiens
ggaguguaauggcgccaucuca

SEQ ID NO: 76455 - RNA, 22 nt, Homo sapiens
ggaguguaguggcuccaucucg

SEQ ID NO: 76456 - RNA, 22 nt, Homo sapiens
ggagugucugugcuggucaaag

SEQ ID NO: 76457 - RNA, 22 nt, Homo sapiens
ggauaucauuauuucuagggcu

SEQ ID NO: 76458 - RNA, 22 nt, Homo sapiens
ggaucacagccagcucccagaa

SEQ ID NO: 76459 - RNA, 22 nt, Homo sapiens
ggaucacugugaaccgugucag

SEQ ID NO: 76460 - RNA, 22 nt, Homo sapiens
ggaucacuugagaccaggaguu

SEQ ID NO: 76461 - RNA, 23 nt, Homo sapiens
ggauggaaaguuuugagggccac

SEQ ID NO: 76462 - RNA, 22 nt, Homo sapiens
ggaugugugcacgcgcacaugc

SEQ ID NO: 76463 - RNA, 22 nt, Homo sapiens
ggauuagagauguuauuaagag

SEQ ID NO: 76464 - RNA, 23 nt, Homo sapiens
ggauucaucuguuuguucgcugu

SEQ ID NO: 76465 - RNA, 22 nt, Homo sapiens
ggauugcuuaagaaguuucauu

SEQ ID NO: 76466 - RNA, 22 nt, Homo sapiens
ggauuuguuggcauuagugaug

SEQ ID NO: 76467 - RNA, 22 nt, Homo sapiens
ggcaaaauggccagugggucac

SEQ ID NO: 76468 - RNA, 22 nt, Homo sapiens
ggcaacaugaugaaaugccauc

SEQ ID NO: 76469 - RNA, 22 nt, Homo sapiens
ggcaagaaccacaauuacuuuu

SEQ ID NO: 76470 - RNA, 22 nt, Homo sapiens
ggcaagaagagaguuuaaacau

SEQ ID NO: 76471 - RNA, 21 nt, Homo sapiens
ggcaagagaauacaacauaaa

SEQ ID NO: 76472 - RNA, 23 nt, Homo sapiens
ggcaagaucucagcucacugcaa

SEQ ID NO: 76473 - RNA, 22 nt, Homo sapiens
ggcaagcucaggccucaggugu

SEQ ID NO: 76474 - RNA, 22 nt, Homo sapiens
ggcaaggaggggcacuuucacu

SEQ ID NO: 76475 - RNA, 22 nt, Homo sapiens
ggcaagugucagcagcaacacc

SEQ ID NO: 76476 - RNA, 19 nt, Homo sapiens
ggcaauacuuucuuguugg

SEQ ID NO: 76477 - RNA, 22 nt, Homo sapiens
ggcaauauuauuaacccucugu

SEQ ID NO: 76478 - RNA, 22 nt, Homo sapiens
ggcagagucuugcaucuuuaga

SEQ ID NO: 76479 - RNA, 22 nt, Homo sapiens
ggcagcacaauuuucugaugga

SEQ ID NO: 76480 - RNA, 22 nt, Homo sapiens
ggcagcgugguggauugaaaau

SEQ ID NO: 76481 - RNA, 22 nt, Homo sapiens
ggcaguguauuacuuaggguuc

SEQ ID NO: 76482 - RNA, 22 nt, Homo sapiens
ggcaguguggcugcauauagca

SEQ ID NO: 76483 - RNA, 22 nt, Homo sapiens
ggcaugaggccauaaaaguaag

SEQ ID NO: 76484 - RNA, 22 nt, Homo sapiens
ggcaugauguauuugagguuug

SEQ ID NO: 76485 - RNA, 22 nt, Homo sapiens
ggcaugcauuguacuaguaugc

SEQ ID NO: 76486 - RNA, 22 nt, Homo sapiens
ggcauguguggguuauuaaaga

SEQ ID NO: 76487 - RNA, 22 nt, Homo sapiens
ggccagaugcaguggcucacac

SEQ ID NO: 76488 - RNA, 22 nt, Homo sapiens
ggcccugagacaggaaaaagcu

SEQ ID NO: 76489 - RNA, 22 nt, Homo sapiens
ggccuguaaacuagagacccug

SEQ ID NO: 76490 - RNA, 22 nt, Homo sapiens
ggcuacauuguuacaauuagua

SEQ ID NO: 76491 - RNA, 22 nt, Homo sapiens
ggcuagagaauagugccacuaa

SEQ ID NO: 76492 - RNA, 22 nt, Homo sapiens
ggcuagagagcucagggauaug

SEQ ID NO: 76493 - RNA, 19 nt, Homo sapiens
ggcucagucaacugacugu

SEQ ID NO: 76494 - RNA, 22 nt, Homo sapiens
ggcucagugaucuguuucugua

SEQ ID NO: 76495 - RNA, 22 nt, Homo sapiens
ggcucaguugcaaaucaguuca

SEQ ID NO: 76496 - RNA, 22 nt, Homo sapiens
ggcucaguuuccuccgucugcu

SEQ ID NO: 76497 - RNA, 18 nt, Homo sapiens
ggcugguguuuuaguaua

SEQ ID NO: 76498 - RNA, 22 nt, Homo sapiens
ggcugguuuucaguuacugagu

SEQ ID NO: 76499 - RNA, 22 nt, Homo sapiens
ggcuuuggucacacaggggcaa

SEQ ID NO: 76500 - RNA, 22 nt, Homo sapiens
gggaaaaugucuauugaaugaa

SEQ ID NO: 76501 - RNA, 22 nt, Homo sapiens
gggaacaugagaaugugaauga

SEQ ID NO: 76502 - RNA, 22 nt, Homo sapiens
gggagcaaaaaugaugcccaag

SEQ ID NO: 76503 - RNA, 19 nt, Homo sapiens
gggaggaugcgucuucagg

SEQ ID NO: 76504 - RNA, 22 nt, Homo sapiens
gggagguagguauuagcuuuuc

SEQ ID NO: 76505 - RNA, 22 nt, Homo sapiens
gggaggucauuguaaggucuua

SEQ ID NO: 76506 - RNA, 22 nt, Homo sapiens
gggaugauuaugguucacuaca

SEQ ID NO: 76507 - RNA, 19 nt, Homo sapiens
gggcaaaucuggaaauuua

SEQ ID NO: 76508 - RNA, 21 nt, Homo sapiens
gggcaaaucuuuauccuaagc

SEQ ID NO: 76509 - RNA, 22 nt, Homo sapiens
gggcaagaagucuuguaguuuu

SEQ ID NO: 76510 - RNA, 16 nt, Homo sapiens
gggcaugugaagccua

SEQ ID NO: 76511 - RNA, 22 nt, Homo sapiens
gggcuagaauccgcgucucuug

SEQ ID NO: 76512 - RNA, 22 nt, Homo sapiens
ggggcaaaaugccacgagucuc

SEQ ID NO: 76513 - RNA, 22 nt, Homo sapiens
ggggcauugugacauaucucug

SEQ ID NO: 76514 - RNA, 22 nt, Homo sapiens
ggggucaucagagaaucuaccc

SEQ ID NO: 76515 - RNA, 22 nt, Homo sapiens
ggguaggcaagcggaugucaga

SEQ ID NO: 76516 - RNA, 17 nt, Homo sapiens
gggucaccuugcaggua

SEQ ID NO: 76517 - RNA, 19 nt, Homo sapiens
gggucaguuugaaugauua

SEQ ID NO: 76518 - RNA, 22 nt, Homo sapiens
gggucaguuuugagaaagcgug

SEQ ID NO: 76519 - RNA, 22 nt, Homo sapiens
gggugguuuuaucucuucccuu

SEQ ID NO: 76520 - RNA, 22 nt, Homo sapiens
gguaauguaacugguauucugu

SEQ ID NO: 76521 - RNA, 22 nt, Homo sapiens
gguaucuuggagagagaaguga

SEQ ID NO: 76522 - RNA, 22 nt, Homo sapiens
gguauguagugugaaguaggga

SEQ ID NO: 76523 - RNA, 22 nt, Homo sapiens
ggucaagcuagauuuuaaugau

SEQ ID NO: 76524 - RNA, 19 nt, Homo sapiens
ggucccucucaagucauuc

SEQ ID NO: 76525 - RNA, 22 nt, Homo sapiens
ggucuuggagaauuguccuggg

SEQ ID NO: 76526 - RNA, 22 nt, Homo sapiens
ggugacugguuuaucuggcagu

SEQ ID NO: 76527 - RNA, 22 nt, Homo sapiens
ggugagcacagaaugcccugag

SEQ ID NO: 76528 - RNA, 22 nt, Homo sapiens
ggugccuacugugugucaggca

SEQ ID NO: 76529 - RNA, 22 nt, Homo sapiens
ggugucuuguuuaauacucauu

SEQ ID NO: 76530 - RNA, 22 nt, Homo sapiens
gguuagaaacagguccucagga

SEQ ID NO: 76531 - RNA, 22 nt, Homo sapiens
guaaaguaaagcacaucaaggu

SEQ ID NO: 76532 - RNA, 22 nt, Homo sapiens
guaaaucucuguuuucauggac

SEQ ID NO: 76533 - RNA, 22 nt, Homo sapiens
guaaauguccccugugauauug

SEQ ID NO: 76534 - RNA, 22 nt, Homo sapiens
guaacacaugcugcucucuggu

SEQ ID NO: 76535 - RNA, 22 nt, Homo sapiens
guaacagucucaacaguggucu

SEQ ID NO: 76536 - RNA, 22 nt, Homo sapiens
guaacccuguaggccuaaagua

SEQ ID NO: 76537 - RNA, 22 nt, Homo sapiens
guaaggcuucuggcccuuaacu

SEQ ID NO: 76538 - RNA, 22 nt, Homo sapiens
guaaggcuucuggucaacagca

SEQ ID NO: 76539 - RNA, 22 nt, Homo sapiens
gcagugcaguggcgcgaucucg

SEQ ID NO: 76540 - RNA, 22 nt, Homo sapiens
gcagugugauguuuuaaucuau

SEQ ID NO: 76541 - RNA, 20 nt, Homo sapiens
gcaguguucacuguauuccu

SEQ ID NO: 76542 - RNA, 22 nt, Homo sapiens
gcaucacagggagacaggccuc

SEQ ID NO: 76543 - RNA, 20 nt, Homo sapiens
gcaugagucuuuauaguaga

SEQ ID NO: 76544 - RNA, 22 nt, Homo sapiens
gcaugaugaauaauaucacaag

SEQ ID NO: 76545 - RNA, 22 nt, Homo sapiens
gcaugcacaugugaaaaaauga

SEQ ID NO: 76546 - RNA, 22 nt, Homo sapiens
gcaugcacuguauuuaaguauc

SEQ ID NO: 76547 - RNA, 22 nt, Homo sapiens
gcauggaaggcgcuuugugacu

SEQ ID NO: 76548 - RNA, 22 nt, Homo sapiens
gcauggagcauacauuucuguu

SEQ ID NO: 76549 - RNA, 22 nt, Homo sapiens
gcauggaguggaaauucuuggg

SEQ ID NO: 76550 - RNA, 22 nt, Homo sapiens
gcaugguaguaaccuacauuug

SEQ ID NO: 76551 - RNA, 22 nt, Homo sapiens
gcauguaguagauguugaauaa

SEQ ID NO: 76552 - RNA, 22 nt, Homo sapiens
gcauugcacuuggcauagacug

SEQ ID NO: 76553 - RNA, 22 nt, Homo sapiens
gccaacauggcgcuccauucuu

SEQ ID NO: 76554 - RNA, 22 nt, Homo sapiens
gccaagauugguuuaauauucc

SEQ ID NO: 76555 - RNA, 20 nt, Homo sapiens
gccacaguuaagcuucugcc

SEQ ID NO: 76556 - RNA, 22 nt, Homo sapiens
gccaguguguguuguucuccgc

SEQ ID NO: 76557 - RNA, 22 nt, Homo sapiens
gccaguguuuuauugagaauuu

SEQ ID NO: 76558 - RNA, 22 nt, Homo sapiens
gccauugcacuccagccuaggc

SEQ ID NO: 76559 - RNA, 22 nt, Homo sapiens
gccauugcacuccagccugagc

SEQ ID NO: 76560 - RNA, 22 nt, Homo sapiens
gcccagcguucagggaggggcu

SEQ ID NO: 76561 - RNA, 22 nt, Homo sapiens
gcccauuguuccuaggcuacaa

SEQ ID NO: 76562 - RNA, 22 nt, Homo sapiens
gccccaguacaggcuccuuaga

SEQ ID NO: 76563 - RNA, 22 nt, Homo sapiens
gcccgugagacuggaagcaaga

SEQ ID NO: 76564 - RNA, 22 nt, Homo sapiens
gcccugagauucuuggauucug

SEQ ID NO: 76565 - RNA, 22 nt, Homo sapiens
gcccugauacauucuucugccu

SEQ ID NO: 76566 - RNA, 19 nt, Homo sapiens
gcggcacuggagacacagc

SEQ ID NO: 76567 - RNA, 22 nt, Homo sapiens
gcgguuuuaagugaguuucuua

SEQ ID NO: 76568 - RNA, 20 nt, Homo sapiens
gcuaaggcacgggaauuacu

SEQ ID NO: 76569 - RNA, 22 nt, Homo sapiens
gcuauggccugaauguuugugu

SEQ ID NO: 76570 - RNA, 22 nt, Homo sapiens
gcuaugguuuuuagcuccauca

SEQ ID NO: 76571 - RNA, 22 nt, Homo sapiens
gcucaaguaauggcaguuuugc

SEQ ID NO: 76572 - RNA, 19 nt, Homo sapiens
gcucaccuugcugcuccag

SEQ ID NO: 76573 - RNA, 22 nt, Homo sapiens
gcucaguuuccucagcugcaaa

SEQ ID NO: 76574 - RNA, 22 nt, Homo sapiens
gcuccuuugaguagcuucugug

SEQ ID NO: 76575 - RNA, 22 nt, Homo sapiens
gcucguccccuccugacucugc

SEQ ID NO: 76576 - RNA, 22 nt, Homo sapiens
gcucguuuuugccucugguugc

SEQ ID NO: 76577 - RNA, 22 nt, Homo sapiens
gcugagacauugguuuucuccu

SEQ ID NO: 76578 - RNA, 19 nt, Homo sapiens
gcugauguuacauucuugc

SEQ ID NO: 76579 - RNA, 22 nt, Homo sapiens
gcugauguugaccuugaucacc

SEQ ID NO: 76580 - RNA, 22 nt, Homo sapiens
gcugauguuggccucugggcuu

SEQ ID NO: 76581 - RNA, 17 nt, Homo sapiens
gcugauguuugcauuuu

SEQ ID NO: 76582 - RNA, 22 nt, Homo sapiens
gcugcacuuuaaggcauccccu

SEQ ID NO: 76583 - RNA, 22 nt, Homo sapiens
gcugcguguagaguucucacug

SEQ ID NO: 76584 - RNA, 22 nt, Homo sapiens
gcugcuguaccagaugugguua

SEQ ID NO: 76585 - RNA, 22 nt, Homo sapiens
gcuggcuuucuccugaucucag

SEQ ID NO: 76586 - RNA, 22 nt, Homo sapiens
gcuggguucagagugggcugcg

SEQ ID NO: 76587 - RNA, 21 nt, Homo sapiens
gcugguaaucacuuugccaaa

SEQ ID NO: 76588 - RNA, 22 nt, Homo sapiens
gcuggucugccguaguaggugc

SEQ ID NO: 76589 - RNA, 22 nt, Homo sapiens
gcuguaguugaggauuuuaaga

SEQ ID NO: 76590 - RNA, 22 nt, Homo sapiens
gcugucuggagucuguucaaug

SEQ ID NO: 76591 - RNA, 22 nt, Homo sapiens
gcugugauucuguguagauagu

SEQ ID NO: 76592 - RNA, 22 nt, Homo sapiens
gcugugguuuaguagaaagaag

SEQ ID NO: 76593 - RNA, 22 nt, Homo sapiens
gcuguguucucgaggcggggga

SEQ ID NO: 76594 - RNA, 18 nt, Homo sapiens
gcuguugucagagcacau

SEQ ID NO: 76595 - RNA, 22 nt, Homo sapiens
gcuguugugaacuauacaucua

SEQ ID NO: 76596 - RNA, 22 nt, Homo sapiens
gcuuggugugcaagugguacua

SEQ ID NO: 76597 - RNA, 22 nt, Homo sapiens
gcuuguguucaagucacccuua

SEQ ID NO: 76598 - RNA, 22 nt, Homo sapiens
gcuuuggcauguagauguaugg

SEQ ID NO: 76599 - RNA, 22 nt, Homo sapiens
gcuuuguugauggugagucugu

SEQ ID NO: 76600 - RNA, 23 nt, Homo sapiens
ggaaacauccagucuuucaccau

SEQ ID NO: 76601 - RNA, 22 nt, Homo sapiens
ggaaagauguaauauuaucuaa

SEQ ID NO: 76602 - RNA, 22 nt, Homo sapiens
ggaaaguaacccauucucuuac

SEQ ID NO: 76603 - RNA, 22 nt, Homo sapiens
ggaaaucucugaggcucccuuc

SEQ ID NO: 76604 - RNA, 22 nt, Homo sapiens
ggaaauguuggugucaugaguu

SEQ ID NO: 76605 - RNA, 22 nt, Homo sapiens
ggaagagugaauuaucuugacu

SEQ ID NO: 76606 - RNA, 20 nt, Homo sapiens
ggaagagugacacaagguau

SEQ ID NO: 76607 - RNA, 18 nt, Homo sapiens
ggaagauuggcuaugugc

SEQ ID NO: 76608 - RNA, 22 nt, Homo sapiens
ggaagccuggaaaaaauuguga

SEQ ID NO: 76609 - RNA, 22 nt, Homo sapiens
ggaagguaauuggguaaugaga

SEQ ID NO: 76610 - RNA, 22 nt, Homo sapiens
ggaaguauaaacuuaguggagu

SEQ ID NO: 76611 - RNA, 22 nt, Homo sapiens
ggaaguuaauacagauagagua

SEQ ID NO: 76612 - RNA, 22 nt, Homo sapiens
ggaauauaaaacuuuugacagg

SEQ ID NO: 76613 - RNA, 22 nt, Homo sapiens
ggaaugcuaaaauaggaugcug

SEQ ID NO: 76614 - RNA, 22 nt, Homo sapiens
ggaauguuaaggcgcuguuggu

SEQ ID NO: 76615 - RNA, 22 nt, Homo sapiens
ggaauuaaggcaauugaaagcu

SEQ ID NO: 76616 - RNA, 22 nt, Homo sapiens
ggacaagagacugggacacuga

SEQ ID NO: 76617 - RNA, 22 nt, Homo sapiens
uagagcuaguuuuuaaucuaac

SEQ ID NO: 76618 - RNA, 22 nt, Homo sapiens
uagagcucaucuucuuuaaacu

SEQ ID NO: 76619 - RNA, 22 nt, Homo sapiens
uagagguauguauaguauucuu

SEQ ID NO: 76620 - RNA, 22 nt, Homo sapiens
uagaguguuuuguuaggcagca

SEQ ID NO: 76621 - RNA, 21 nt, Homo sapiens
uagauacuguauuaaaccuag

SEQ ID NO: 76622 - RNA, 22 nt, Homo sapiens
uagauaguuaugauuugaugau

SEQ ID NO: 76623 - RNA, 22 nt, Homo sapiens
uagaucaauuaauuguuacuug

SEQ ID NO: 76624 - RNA, 22 nt, Homo sapiens
uagaucacucaggcaauaaaag

SEQ ID NO: 76625 - RNA, 20 nt, Homo sapiens
uagaugcauuuagauucauu

SEQ ID NO: 76626 - RNA, 22 nt, Homo sapiens
uagauuaucuguaugugcucuu

SEQ ID NO: 76627 - RNA, 22 nt, Homo sapiens
uagauuauuccuuugaauggcc

SEQ ID NO: 76628 - RNA, 22 nt, Homo sapiens
uagauuguaauaugcagaaugg

SEQ ID NO: 76629 - RNA, 23 nt, Homo sapiens
uagcaacaguuggaggugaggua

SEQ ID NO: 76630 - RNA, 22 nt, Homo sapiens
uagcaacauucagcucagguac

SEQ ID NO: 76631 - RNA, 22 nt, Homo sapiens
uagcaagaugaauuugugcaaa

SEQ ID NO: 76632 - RNA, 20 nt, Homo sapiens
uagcacacauguagaauagu

SEQ ID NO: 76633 - RNA, 19 nt, Homo sapiens
uagcacagggucccagacu

SEQ ID NO: 76634 - RNA, 22 nt, Homo sapiens
uagcacaucccuaaaaugcugu

SEQ ID NO: 76635 - RNA, 22 nt, Homo sapiens
uagcaccugugcacaccaggca

SEQ ID NO: 76636 - RNA, 22 nt, Homo sapiens
uagcacuauuuuucacuauccu

SEQ ID NO: 76637 - RNA, 22 nt, Homo sapiens
uagcagaauaacuugccagccu

SEQ ID NO: 76638 - RNA, 22 nt, Homo sapiens
uagcagacuauuuugugauaau

SEQ ID NO: 76639 - RNA, 22 nt, Homo sapiens
uagcagcagugguguauuuaga

SEQ ID NO: 76640 - RNA, 22 nt, Homo sapiens
uagcagcauaaauggacuaaga

SEQ ID NO: 76641 - RNA, 22 nt, Homo sapiens
uagcagccaggaagggcuggcu

SEQ ID NO: 76642 - RNA, 22 nt, Homo sapiens
uagcaggaaaggggucagaucu

SEQ ID NO: 76643 - RNA, 22 nt, Homo sapiens
uagcaguaucccaccaucuggu

SEQ ID NO: 76644 - RNA, 22 nt, Homo sapiens
uagcagucuguuaaaacuuuua

SEQ ID NO: 76645 - RNA, 22 nt, Homo sapiens
uagcagugucuagguaggccau

SEQ ID NO: 76646 - RNA, 22 nt, Homo sapiens
uagcagugugaaaacggacuaa

SEQ ID NO: 76647 - RNA, 22 nt, Homo sapiens
uagcaguucauuguugugugaa

SEQ ID NO: 76648 - RNA, 22 nt, Homo sapiens
uagcaguuguuguuacuuguau

SEQ ID NO: 76649 - RNA, 22 nt, Homo sapiens
uagcauccuucucuaaacagga

SEQ ID NO: 76650 - RNA, 22 nt, Homo sapiens
uagcucagcccagcuaagcuca

SEQ ID NO: 76651 - RNA, 21 nt, Homo sapiens
uagcucagugguguugccaua

SEQ ID NO: 76652 - RNA, 22 nt, Homo sapiens
uagcugauguuugucuaguagc

SEQ ID NO: 76653 - RNA, 22 nt, Homo sapiens
uagcugcaaaauauagacuucu

SEQ ID NO: 76654 - RNA, 22 nt, Homo sapiens
uagcugcccagcacgaaguugg

SEQ ID NO: 76655 - RNA, 22 nt, Homo sapiens
uagcugcugcuaggcuaaggau

SEQ ID NO: 76656 - RNA, 22 nt, Homo sapiens
uagcugcuguauguacacggau

SEQ ID NO: 76657 - RNA, 22 nt, Homo sapiens
uagcuggaauuacuugcaccug

SEQ ID NO: 76658 - RNA, 18 nt, Homo sapiens
uaggaacauugauuggag

SEQ ID NO: 76659 - RNA, 22 nt, Homo sapiens
uaggaaugaacgauuuauuggu

SEQ ID NO: 76660 - RNA, 22 nt, Homo sapiens
uaggacacagauggagaaaagc

SEQ ID NO: 76661 - RNA, 19 nt, Homo sapiens
uaggacccugguggccccc

SEQ ID NO: 76662 - RNA, 22 nt, Homo sapiens
uaggagcacaaacccuacugug

SEQ ID NO: 76663 - RNA, 22 nt, Homo sapiens
uaggauaguccuccugagaccu

SEQ ID NO: 76664 - RNA, 22 nt, Homo sapiens
uaggcaaguugcccaaucucuc

SEQ ID NO: 76665 - RNA, 22 nt, Homo sapiens
uaggcagccagcuguggauuga

SEQ ID NO: 76666 - RNA, 22 nt, Homo sapiens
uaggccuuuuucagauggguag

SEQ ID NO: 76667 - RNA, 22 nt, Homo sapiens
uagggcuugugaucagguguag

SEQ ID NO: 76668 - RNA, 22 nt, Homo sapiens
uagggcuuuccggccugucaga

SEQ ID NO: 76669 - RNA, 22 nt, Homo sapiens
uagggcuuuuccaagcugccac

SEQ ID NO: 76670 - RNA, 22 nt, Homo sapiens
uaggggcacacuucgguuagca

SEQ ID NO: 76671 - RNA, 22 nt, Homo sapiens
uagguacuuaagaucucagcua

SEQ ID NO: 76672 - RNA, 22 nt, Homo sapiens
uagguagguggaaaaguaauug

SEQ ID NO: 76673 - RNA, 22 nt, Homo sapiens
uagguauguauauacacacaca

SEQ ID NO: 76674 - RNA, 22 nt, Homo sapiens
uaggucuccuuuuugccuaaau

SEQ ID NO: 76675 - RNA, 22 nt, Homo sapiens
uaggucuuuuagcauaggagcu

SEQ ID NO: 76676 - RNA, 22 nt, Homo sapiens
uaggugaaugcuggaagaaaug

SEQ ID NO: 76677 - RNA, 22 nt, Homo sapiens
uaggugcacaguaaauauaugu

SEQ ID NO: 76678 - RNA, 19 nt, Homo sapiens
uaggugguuuuccccucac

SEQ ID NO: 76679 - RNA, 22 nt, Homo sapiens
uagguucucaggaaugagcuuc

SEQ ID NO: 76680 - RNA, 22 nt, Homo sapiens
uagguucuccacagguucucca

SEQ ID NO: 76681 - RNA, 22 nt, Homo sapiens
uagguugucuguucacucugau

SEQ ID NO: 76682 - RNA, 22 nt, Homo sapiens
uagguuguucuauuaucuuaca

SEQ ID NO: 76683 - RNA, 20 nt, Homo sapiens
uagguuuucacagaauugcc

SEQ ID NO: 76684 - RNA, 22 nt, Homo sapiens
uaguaacacauugaacgaucgc

SEQ ID NO: 76685 - RNA, 22 nt, Homo sapiens
uaguacuggcauguauuuccca

SEQ ID NO: 76686 - RNA, 22 nt, Homo sapiens
uaguagcauaccuaaguauacu

SEQ ID NO: 76687 - RNA, 22 nt, Homo sapiens
uaguaggacaggauuucaguua

SEQ ID NO: 76688 - RNA, 22 nt, Homo sapiens
uaguaguuuuguguauaauaau

SEQ ID NO: 76689 - RNA, 22 nt, Homo sapiens
uaguaucacaagguguacaccc

SEQ ID NO: 76690 - RNA, 22 nt, Homo sapiens
uaguauguuuauagcauugagu

SEQ ID NO: 76691 - RNA, 22 nt, Homo sapiens
uagucacacacucaacuuuuca

SEQ ID NO: 76692 - RNA, 22 nt, Homo sapiens
uaguccauuuucaugcugcuau

SEQ ID NO: 76693 - RNA, 22 nt, Homo sapiens
uagucccuuucuauuaaugaga

SEQ ID NO: 76694 - RNA, 22 nt, Homo sapiens
uagugcuagaugacuuugccau

SEQ ID NO: 76695 - RNA, 22 nt, Homo sapiens
uagugcugagauugagaagccc

SEQ ID NO: 76696 - RNA, 22 nt, Homo sapiens
uagugcuguaauucuaaugaaa

SEQ ID NO: 76697 - RNA, 22 nt, Homo sapiens
uagugcugugauaaacauauau

SEQ ID NO: 76698 - RNA, 18 nt, Homo sapiens
uagugcuguucucaugau

SEQ ID NO: 76699 - RNA, 22 nt, Homo sapiens
uagugguaguuauggauuugcu

SEQ ID NO: 76700 - RNA, 22 nt, Homo sapiens
uagugguauuagcgauacuacu

SEQ ID NO: 76701 - RNA, 22 nt, Homo sapiens
uaguguuuuucauuggcagagg

SEQ ID NO: 76702 - RNA, 22 nt, Homo sapiens
uaguucauuauguguugcucag

SEQ ID NO: 76703 - RNA, 22 nt, Homo sapiens
uaguucguguuugaacuagauc

SEQ ID NO: 76704 - RNA, 22 nt, Homo sapiens
uaguugcaucuuaggucuguga

SEQ ID NO: 76705 - RNA, 22 nt, Homo sapiens
uaguugcauucaggauaugacg

SEQ ID NO: 76706 - RNA, 22 nt, Homo sapiens
uauaaaguaauuucuaggggcu

SEQ ID NO: 76707 - RNA, 22 nt, Homo sapiens
uauaagguuaggaaaaauuucu

SEQ ID NO: 76708 - RNA, 22 nt, Homo sapiens
uauaccacugauuuuauucuga

SEQ ID NO: 76709 - RNA, 22 nt, Homo sapiens
uauacugucuuuguaugccuag

SEQ ID NO: 76710 - RNA, 20 nt, Homo sapiens
uauagcaauuuuuuucuccu

SEQ ID NO: 76711 - RNA, 22 nt, Homo sapiens
uauagcacugaccuuccaggac

SEQ ID NO: 76712 - RNA, 18 nt, Homo sapiens
uacagaacuggaguagaa

SEQ ID NO: 76713 - RNA, 22 nt, Homo sapiens
uacagaauucugucccuugagu

SEQ ID NO: 76714 - RNA, 22 nt, Homo sapiens
uacagaauugcagguguggcag

SEQ ID NO: 76715 - RNA, 22 nt, Homo sapiens
uacagccacauaauguaugauu

SEQ ID NO: 76716 - RNA, 22 nt, Homo sapiens
uacaggaaugucagguugcugu

SEQ ID NO: 76717 - RNA, 22 nt, Homo sapiens
uacaggacuucucagaguuauu

SEQ ID NO: 76718 - RNA, 22 nt, Homo sapiens
uacaggauagacaauuuauuaa

SEQ ID NO: 76719 - RNA, 22 nt, Homo sapiens
uacagguauagauguguguucu

SEQ ID NO: 76720 - RNA, 22 nt, Homo sapiens
uacaguagaaugucuuucaaaa

SEQ ID NO: 76721 - RNA, 22 nt, Homo sapiens
uacagugcauagaggcaugaua

SEQ ID NO: 76722 - RNA, 22 nt, Homo sapiens
uacagugcuugguaucuaguaa

SEQ ID NO: 76723 - RNA, 22 nt, Homo sapiens
uacagugcuuuuugguggagaa

SEQ ID NO: 76724 - RNA, 22 nt, Homo sapiens
uacaguggcaugucaggugcuu

SEQ ID NO: 76725 - RNA, 22 nt, Homo sapiens
uacaguggugugaucucagcuc

SEQ ID NO: 76726 - RNA, 22 nt, Homo sapiens
uacaguguuuugguauuccaca

SEQ ID NO: 76727 - RNA, 22 nt, Homo sapiens
uacauacuucacagacuuuaaa

SEQ ID NO: 76728 - RNA, 22 nt, Homo sapiens
uacauaguaagcacuaugccaa

SEQ ID NO: 76729 - RNA, 22 nt, Homo sapiens
uacauaguaagcaucuccugug

SEQ ID NO: 76730 - RNA, 22 nt, Homo sapiens
uacauaguuacuuccauuucca

SEQ ID NO: 76731 - RNA, 22 nt, Homo sapiens
uacauccauccugcugggcagu

SEQ ID NO: 76732 - RNA, 22 nt, Homo sapiens
uacauguauccauuguuuuugg

SEQ ID NO: 76733 - RNA, 22 nt, Homo sapiens
uacauugcacuuuauuagauac

SEQ ID NO: 76734 - RNA, 16 nt, Homo sapiens
uacauuuguuacaugg

SEQ ID NO: 76735 - RNA, 22 nt, Homo sapiens
uaccaaaguuucggccucuguu

SEQ ID NO: 76736 - RNA, 22 nt, Homo sapiens
uaccaaguauuuucacaugaac

SEQ ID NO: 76737 - RNA, 22 nt, Homo sapiens
uaccagugucagcuuccugugu

SEQ ID NO: 76738 - RNA, 22 nt, Homo sapiens
uaccaugcagguguauguuugu

SEQ ID NO: 76739 - RNA, 22 nt, Homo sapiens
uaccauguauguuucuccauug

SEQ ID NO: 76740 - RNA, 22 nt, Homo sapiens
uacccuguaaucugaaacauga

SEQ ID NO: 76741 - RNA, 22 nt, Homo sapiens
uaccucaguucaauaacagaua

SEQ ID NO: 76742 - RNA, 22 nt, Homo sapiens
uaccugagaaagaaagcccucg

SEQ ID NO: 76743 - RNA, 23 nt, Homo sapiens
uaccugagacuggguaauuaaua

SEQ ID NO: 76744 - RNA, 22 nt, Homo sapiens
uaccuuugucaguuacucaccu

SEQ ID NO: 76745 - RNA, 22 nt, Homo sapiens
uacuacuuucucuucugggaaa

SEQ ID NO: 76746 - RNA, 22 nt, Homo sapiens
uacuacuuucugacaucuuuaa

SEQ ID NO: 76747 - RNA, 18 nt, Homo sapiens
uacuaguaaggcuucuga

SEQ ID NO: 76748 - RNA, 22 nt, Homo sapiens
uacucaguagucuguugcuguc

SEQ ID NO: 76749 - RNA, 22 nt, Homo sapiens
uacuccccuuguucugugagcu

SEQ ID NO: 76750 - RNA, 22 nt, Homo sapiens
uacucuuuagcuccuuaaggaa

SEQ ID NO: 76751 - RNA, 22 nt, Homo sapiens
uacugcacauaugaagguuccc

SEQ ID NO: 76752 - RNA, 22 nt, Homo sapiens
uacugcacuccagccucgguga

SEQ ID NO: 76753 - RNA, 22 nt, Homo sapiens
uacugcacuccagccugccaac

SEQ ID NO: 76754 - RNA, 22 nt, Homo sapiens
uacugcacuccagccugggaga

SEQ ID NO: 76755 - RNA, 22 nt, Homo sapiens
uacugcacuccaggcucaccug

SEQ ID NO: 76756 - RNA, 22 nt, Homo sapiens
uacugcacuugaccuccugggc

SEQ ID NO: 76757 - RNA, 20 nt, Homo sapiens
uacugcacuuuccucauggu

SEQ ID NO: 76758 - RNA, 22 nt, Homo sapiens
uacugcaucgaaaugcuuuuau

SEQ ID NO: 76759 - RNA, 22 nt, Homo sapiens
uacugcugucagugccaaguag

SEQ ID NO: 76760 - RNA, 22 nt, Homo sapiens
uacuucauucuugaccuugcau

SEQ ID NO: 76761 - RNA, 22 nt, Homo sapiens
uagaaaguagggaagguaggau

SEQ ID NO: 76762 - RNA, 22 nt, Homo sapiens
uagaacaauugcuggauccgaa

SEQ ID NO: 76763 - RNA, 22 nt, Homo sapiens
uagaauggaagguugagaagaa

SEQ ID NO: 76764 - RNA, 22 nt, Homo sapiens
uagaauguaaauuccaagggca

SEQ ID NO: 76765 - RNA, 22 nt, Homo sapiens
uagacacugcauauuuuuuuaa

SEQ ID NO: 76766 - RNA, 22 nt, Homo sapiens
uagacuguaagauccaggagag

SEQ ID NO: 76767 - RNA, 21 nt, Homo sapiens
uagagcaacacacgcccucuc

SEQ ID NO: 76768 - RNA, 22 nt, Homo sapiens
uagagcaaugacucuggaaacc

SEQ ID NO: 76769 - RNA, 18 nt, Homo sapiens
uagagcacaagcuuuggc

SEQ ID NO: 76770 - RNA, 22 nt, Homo sapiens
gaucuguuuuccuauuguuugu

SEQ ID NO: 76771 - RNA, 22 nt, Homo sapiens
gaugacacugggucaaaucuca

SEQ ID NO: 76772 - RNA, 22 nt, Homo sapiens
gaugagaugagcauuugaauug

SEQ ID NO: 76773 - RNA, 22 nt, Homo sapiens
gaugagcuaaguucucacagca

SEQ ID NO: 76774 - RNA, 22 nt, Homo sapiens
gaugagguagaagacucagcaa

SEQ ID NO: 76775 - RNA, 22 nt, Homo sapiens
gaugauguuggaaacuuggugc

SEQ ID NO: 76776 - RNA, 22 nt, Homo sapiens
gauggaguugacuaagacaaca

SEQ ID NO: 76777 - RNA, 22 nt, Homo sapiens
gauggauuuuaagugaaugaaa

SEQ ID NO: 76778 - RNA, 22 nt, Homo sapiens
gauggcuauucuuaccauuucu

SEQ ID NO: 76779 - RNA, 22 nt, Homo sapiens
gaugguuuuuuaagaagagccu

SEQ ID NO: 76780 - RNA, 18 nt, Homo sapiens
gauguaguauggugugga

SEQ ID NO: 76781 - RNA, 22 nt, Homo sapiens
gaugugaaaucauaguuucuag

SEQ ID NO: 76782 - RNA, 22 nt, Homo sapiens
gauguguuuaucacccaguccu

SEQ ID NO: 76783 - RNA, 22 nt, Homo sapiens
gauuggcauugcugcaccugag

SEQ ID NO: 76784 - RNA, 22 nt, Homo sapiens
gauuguguucauaggcauguua

SEQ ID NO: 76785 - RNA, 22 nt, Homo sapiens
gauuucacuuucuggaugugca

SEQ ID NO: 76786 - RNA, 22 nt, Homo sapiens
gauuucaucuuuagaggaagga

SEQ ID NO: 76787 - RNA, 22 nt, Homo sapiens
gauuuuuggggaagccucuuau

SEQ ID NO: 76788 - RNA, 21 nt, Homo sapiens
gcaaacauccuuugaugccag

SEQ ID NO: 76789 - RNA, 22 nt, Homo sapiens
gcaaaguaauuguuguuuuugc

SEQ ID NO: 76790 - RNA, 20 nt, Homo sapiens
gcaacauggccagagugaau

SEQ ID NO: 76791 - RNA, 22 nt, Homo sapiens
gcaacugguuucaguuuuucag

SEQ ID NO: 76792 - RNA, 22 nt, Homo sapiens
gcaagaaucugggaguaaaauu

SEQ ID NO: 76793 - RNA, 22 nt, Homo sapiens
gcaagaaugagaaggauuaauu

SEQ ID NO: 76794 - RNA, 22 nt, Homo sapiens
gcaagaauggaacaggagagcc

SEQ ID NO: 76795 - RNA, 22 nt, Homo sapiens
gcaagaguauuucaaggaagau

SEQ ID NO: 76796 - RNA, 22 nt, Homo sapiens
gcaagauguuaccauuagggaa

SEQ ID NO: 76797 - RNA, 22 nt, Homo sapiens
gcaaggacucccugggucauuc

SEQ ID NO: 76798 - RNA, 22 nt, Homo sapiens
gcaaggaugagugcccaugaga

SEQ ID NO: 76799 - RNA, 21 nt, Homo sapiens
gcaaguacuaucaucauuauc

SEQ ID NO: 76800 - RNA, 22 nt, Homo sapiens
gcaauacugacagcauuaguuu

SEQ ID NO: 76801 - RNA, 22 nt, Homo sapiens
gcaauggaaucccuugaucaau

SEQ ID NO: 76802 - RNA, 22 nt, Homo sapiens
gcacagaugaggagaggucuca

SEQ ID NO: 76803 - RNA, 22 nt, Homo sapiens
gcacauggccacuaggaauaaa

SEQ ID NO: 76804 - RNA, 22 nt, Homo sapiens
gcacgcauuguccuucuaguca

SEQ ID NO: 76805 - RNA, 22 nt, Homo sapiens
gcacgugcucauuugaggucuu

SEQ ID NO: 76806 - RNA, 22 nt, Homo sapiens
gcagaguauagagggcugggcc

SEQ ID NO: 76807 - RNA, 22 nt, Homo sapiens
gcagaucucuucauuucucuua

SEQ ID NO: 76808 - RNA, 22 nt, Homo sapiens
gcagcagugcccuggauggaaa

SEQ ID NO: 76809 - RNA, 22 nt, Homo sapiens
gcagcaguggcaguuaauauuu

SEQ ID NO: 76810 - RNA, 22 nt, Homo sapiens
gcagcauuaccaagacauggca

SEQ ID NO: 76811 - RNA, 22 nt, Homo sapiens
gcagguaguuucugacuuuuac

SEQ ID NO: 76812 - RNA, 22 nt, Homo sapiens
gcaguacacuguugguaggaau

SEQ ID NO: 76813 - RNA, 17 nt, Homo sapiens
gcaguacuuaguaagga

SEQ ID NO: 76814 - RNA, 22 nt, Homo sapiens
gcaguagugugaucuuggcuca

SEQ ID NO: 76815 - RNA, 19 nt, Homo sapiens
gcaguauugaaggccaguc

SEQ ID NO: 76816 - RNA, 22 nt, Homo sapiens
gcaguauuguugaaauguccau

SEQ ID NO: 76817 - RNA, 22 nt, Homo sapiens
gcagucacagggagauggugac

SEQ ID NO: 76818 - RNA, 22 nt, Homo sapiens
gcagugcuggagcccccgugug

SEQ ID NO: 76819 - RNA, 22 nt, Homo sapiens
gcaguguggguagagggcaaga

SEQ ID NO: 76820 - RNA, 20 nt, Homo sapiens
gcaguguucugaccugaauc

SEQ ID NO: 76821 - RNA, 22 nt, Homo sapiens
gcauaaagcuaauaagacgaag

SEQ ID NO: 76822 - RNA, 20 nt, Homo sapiens
gcauaugucuuuauagcaga

SEQ ID NO: 76823 - RNA, 22 nt, Homo sapiens
gcauaugucuuuauagcagcau

SEQ ID NO: 76824 - RNA, 20 nt, Homo sapiens
gcauaugucuuuauggcagc

SEQ ID NO: 76825 - RNA, 22 nt, Homo sapiens
gcaucaaugucuauaguguuug

SEQ ID NO: 76826 - RNA, 22 nt, Homo sapiens
gcaugauuuuauaucuauguaa

SEQ ID NO: 76827 - RNA, 22 nt, Homo sapiens
gcauggagaaggggacugauuc

SEQ ID NO: 76828 - RNA, 22 nt, Homo sapiens
gcaugguacuggaugguaguau

SEQ ID NO: 76829 - RNA, 22 nt, Homo sapiens
gccaagaugcugcccacagaca

SEQ ID NO: 76830 - RNA, 22 nt, Homo sapiens
gccaagauuuaauucaucaguu

SEQ ID NO: 76831 - RNA, 22 nt, Homo sapiens
gccagauuguccaguuuuuuau

SEQ ID NO: 76832 - RNA, 22 nt, Homo sapiens
gccaguauuuuguugagaauuu

SEQ ID NO: 76833 - RNA, 22 nt, Homo sapiens
gccauagucauagauggcaggg

SEQ ID NO: 76834 - RNA, 22 nt, Homo sapiens
gccauugcacuccagccucggg

SEQ ID NO: 76835 - RNA, 22 nt, Homo sapiens
gccauugcacuccagcuugggc

SEQ ID NO: 76836 - RNA, 22 nt, Homo sapiens
gccauugcacuccgcccugggc

SEQ ID NO: 76837 - RNA, 22 nt, Homo sapiens
gcccaguagcaguacaucccuu

SEQ ID NO: 76838 - RNA, 22 nt, Homo sapiens
gccccgggugaugcagccguca

SEQ ID NO: 76839 - RNA, 22 nt, Homo sapiens
gcccuguguuuggguaugguca

SEQ ID NO: 76840 - RNA, 17 nt, Homo sapiens
gcccuuugugccucuuc

SEQ ID NO: 76841 - RNA, 22 nt, Homo sapiens
gccuaaaguagugguuuaggcu

SEQ ID NO: 76842 - RNA, 22 nt, Homo sapiens
gccugagaggauaugauccccu

SEQ ID NO: 76843 - RNA, 22 nt, Homo sapiens
gcgguagcauagacugcaggac

SEQ ID NO: 76844 - RNA, 22 nt, Homo sapiens
gcgugguguuagaaugagaagu

SEQ ID NO: 76845 - RNA, 22 nt, Homo sapiens
gcuacugucuaucugugcuucu

SEQ ID NO: 76846 - RNA, 23 nt, Homo sapiens
gcuaggagagaugaaacacaggu

SEQ ID NO: 76847 - RNA, 22 nt, Homo sapiens
gcuaggagauccacugcucucu

SEQ ID NO: 76848 - RNA, 22 nt, Homo sapiens
gcucaugggcagugugauuguu

SEQ ID NO: 76849 - RNA, 22 nt, Homo sapiens
gcucugguuacaaaggcaaauu

SEQ ID NO: 76850 - RNA, 22 nt, Homo sapiens
gcugagaucucuugccugaacu

SEQ ID NO: 76851 - RNA, 22 nt, Homo sapiens
gcugauguuuucagguaauucu

SEQ ID NO: 76852 - RNA, 22 nt, Homo sapiens
gcuggcaaaugguuauaaggcc

SEQ ID NO: 76853 - RNA, 22 nt, Homo sapiens
gcuggcaagaugcugaugcaac

SEQ ID NO: 76854 - RNA, 22 nt, Homo sapiens
gcuggcaaguggccuacuuugu

SEQ ID NO: 76855 - RNA, 22 nt, Homo sapiens
gcuggguugccagguuacuuaa

SEQ ID NO: 76856 - RNA, 22 nt, Homo sapiens
gcuggugacuuuaaguugaagc

SEQ ID NO: 76857 - RNA, 22 nt, Homo sapiens
gcuguauugacuuuguaucaua

SEQ ID NO: 76858 - RNA, 22 nt, Homo sapiens
gcugucaugagcaacacaugaa

SEQ ID NO: 76859 - RNA, 20 nt, Homo sapiens
gcugugcuuaauacacuuuc

SEQ ID NO: 76860 - RNA, 22 nt, Homo sapiens
gcuguguguuaucagaaauugc

SEQ ID NO: 76861 - RNA, 22 nt, Homo sapiens
gcuguugcuauuauuccgagaa

SEQ ID NO: 76862 - RNA, 19 nt, Homo sapiens
gcuuagagacaaaacauug

SEQ ID NO: 76863 - RNA, 19 nt, Homo sapiens
gcuucuugaggacgaugac

SEQ ID NO: 76864 - RNA, 22 nt, Homo sapiens
gcuuguguuuacuguaguuacu

SEQ ID NO: 76865 - RNA, 22 nt, Homo sapiens
guagaauguauguauaacgcaa

SEQ ID NO: 76866 - RNA, 22 nt, Homo sapiens
guagaggaauggcuccaccaua

SEQ ID NO: 76867 - RNA, 22 nt, Homo sapiens
guagagguagacuuccuugucu

SEQ ID NO: 76868 - RNA, 22 nt, Homo sapiens
guagcaccagugcucuucucaa

SEQ ID NO: 76869 - RNA, 22 nt, Homo sapiens
guagcagcaauuuacuccauac

SEQ ID NO: 76870 - RNA, 22 nt, Homo sapiens
guagcagucacauagcagauug

SEQ ID NO: 76871 - RNA, 22 nt, Homo sapiens
guagguaaguacuucuggugag

SEQ ID NO: 76872 - RNA, 22 nt, Homo sapiens
guaguggcaugaucuuggcuca

SEQ ID NO: 76873 - RNA, 22 nt, Homo sapiens
guauacaguugacccuugaacc

SEQ ID NO: 76874 - RNA, 22 nt, Homo sapiens
guaucaugaaguuucuucauuu

SEQ ID NO: 76875 - RNA, 22 nt, Homo sapiens
guaucauugccuaaugcucuca

SEQ ID NO: 76876 - RNA, 22 nt, Homo sapiens
guaucauuggcauguaaccaga

SEQ ID NO: 76877 - RNA, 22 nt, Homo sapiens
guaugacacaggaagcuuaacc

SEQ ID NO: 76878 - RNA, 22 nt, Homo sapiens
guaugcaagugauaugacauau

SEQ ID NO: 76879 - RNA, 22 nt, Homo sapiens
guauggaauuugugaccuuaua

SEQ ID NO: 76880 - RNA, 22 nt, Homo sapiens
guauggcacuauccucucugau

SEQ ID NO: 76881 - RNA, 21 nt, Homo sapiens
guauggcauugauuaguuacu

SEQ ID NO: 76882 - RNA, 22 nt, Homo sapiens
guaugucuuuauagcagugugg

SEQ ID NO: 76883 - RNA, 22 nt, Homo sapiens
guaugugcauuguaaauuuuga

SEQ ID NO: 76884 - RNA, 22 nt, Homo sapiens
guauuugguuauugcagccuga

SEQ ID NO: 76885 - RNA, 22 nt, Homo sapiens
gucaaggaauuuauccauuucu

SEQ ID NO: 76886 - RNA, 22 nt, Homo sapiens
gucaaguguuuucaaggcuucc

SEQ ID NO: 76887 - RNA, 22 nt, Homo sapiens
gucacaguguuuguucauccca

SEQ ID NO: 76888 - RNA, 22 nt, Homo sapiens
gucaccagcuguguuagccccu

SEQ ID NO: 76889 - RNA, 22 nt, Homo sapiens
gucacugacaagagagaagaac

SEQ ID NO: 76890 - RNA, 22 nt, Homo sapiens
gucacugagaagguuaguuugu

SEQ ID NO: 76891 - RNA, 22 nt, Homo sapiens
gucacugagauugguauuaaug

SEQ ID NO: 76892 - RNA, 22 nt, Homo sapiens
gucacuguggagaagaaagugg

SEQ ID NO: 76893 - RNA, 22 nt, Homo sapiens
gucagaugcagauuccaguucu

SEQ ID NO: 76894 - RNA, 22 nt, Homo sapiens
gucaggcaccgauacaguuuuu

SEQ ID NO: 76895 - RNA, 22 nt, Homo sapiens
gucagugugauaucugcagggg

SEQ ID NO: 76896 - RNA, 22 nt, Homo sapiens
gucaguuucacucagcuggaac

SEQ ID NO: 76897 - RNA, 21 nt, Homo sapiens
gucauaugucucugauuagug

SEQ ID NO: 76898 - RNA, 22 nt, Homo sapiens
gucauccaggcuggagugaagc

SEQ ID NO: 76899 - RNA, 22 nt, Homo sapiens
gucaugaacuguacuacuccua

SEQ ID NO: 76900 - RNA, 22 nt, Homo sapiens
gucauggaacaacuuaaaguca

SEQ ID NO: 76901 - RNA, 22 nt, Homo sapiens
gucauggacaaggugugagcca

SEQ ID NO: 76902 - RNA, 22 nt, Homo sapiens
gucauggaggaugaauggccaa

SEQ ID NO: 76903 - RNA, 22 nt, Homo sapiens
gucauggagggacauaacuaac

SEQ ID NO: 76904 - RNA, 22 nt, Homo sapiens
gucauggugcuagcgggaaugu

SEQ ID NO: 76905 - RNA, 22 nt, Homo sapiens
gucauguuuaacuucuugagga

SEQ ID NO: 76906 - RNA, 22 nt, Homo sapiens
gucauugaaguggaaucaucca

SEQ ID NO: 76907 - RNA, 22 nt, Homo sapiens
guccaaauccaugggauguaca

SEQ ID NO: 76908 - RNA, 22 nt, Homo sapiens
guccaguacucuuuccugaaaa

SEQ ID NO: 76909 - RNA, 22 nt, Homo sapiens
guccaguguuggagguuuuacc

SEQ ID NO: 76910 - RNA, 20 nt, Homo sapiens
guccauuugcugccauugcu

SEQ ID NO: 76911 - RNA, 22 nt, Homo sapiens
guccuggagaagcguggaccgg

SEQ ID NO: 76912 - RNA, 22 nt, Homo sapiens
guccuguuuuuaagguucauag

SEQ ID NO: 76913 - RNA, 22 nt, Homo sapiens
gucgguguuuccugagaacgaa

SEQ ID NO: 76914 - RNA, 22 nt, Homo sapiens
gucuaugagucccugaauuuaa

SEQ ID NO: 76915 - RNA, 22 nt, Homo sapiens
gucucauugcaguuagaccugu

SEQ ID NO: 76916 - RNA, 22 nt, Homo sapiens
gucucccaaccccugugcccag

SEQ ID NO: 76917 - RNA, 22 nt, Homo sapiens
gucucccagccuacauauuucu

SEQ ID NO: 76918 - RNA, 22 nt, Homo sapiens
gucuccgagccguguggagccg

SEQ ID NO: 76919 - RNA, 22 nt, Homo sapiens
gucugcaugucauaugauagua

SEQ ID NO: 76920 - RNA, 22 nt, Homo sapiens
gucuggcuuaucucacuuacca

SEQ ID NO: 76921 - RNA, 22 nt, Homo sapiens
gucugugguuccuaugucaccu

SEQ ID NO: 76922 - RNA, 22 nt, Homo sapiens
gucuuuaguugaaacauguggu

SEQ ID NO: 76923 - RNA, 22 nt, Homo sapiens
gucuuugagauaggguuauuuu

SEQ ID NO: 76924 - RNA, 22 nt, Homo sapiens
gucuuugaugucuaugugcuuc

SEQ ID NO: 76925 - RNA, 17 nt, Homo sapiens
gucuuugguugaguuua

SEQ ID NO: 76926 - RNA, 22 nt, Homo sapiens
gucuuuguuuugauuuaccaga

SEQ ID NO: 76927 - RNA, 22 nt, Homo sapiens
gugaaaagaugagcaccauaca

SEQ ID NO: 76928 - RNA, 22 nt, Homo sapiens
gugaaagauuaaaccagugugu

SEQ ID NO: 76929 - RNA, 22 nt, Homo sapiens
gugaaaugaaucuggaaauauu

SEQ ID NO: 76930 - RNA, 15 nt, Homo sapiens
gugaaauguuucaga

SEQ ID NO: 76931 - RNA, 22 nt, Homo sapiens
gugaacuguuugaggaagagaa

SEQ ID NO: 76932 - RNA, 22 nt, Homo sapiens
gugaaguuuuuugcugagaguc

SEQ ID NO: 76933 - RNA, 22 nt, Homo sapiens
gugaaucauaugccagucaugc

SEQ ID NO: 76934 - RNA, 22 nt, Homo sapiens
gugaaucuguuuucuucuguuc

SEQ ID NO: 76935 - RNA, 22 nt, Homo sapiens
gugacacuggagcuggcacaau

SEQ ID NO: 76936 - RNA, 22 nt, Homo sapiens
gugacauuuuuacugaugagag

SEQ ID NO: 76937 - RNA, 22 nt, Homo sapiens
gugacuacaggccacaguuugg

SEQ ID NO: 76938 - RNA, 20 nt, Homo sapiens
gugagaacaugugguauuug

SEQ ID NO: 76939 - RNA, 22 nt, Homo sapiens
gugagaauugacacccuugucu

SEQ ID NO: 76940 - RNA, 22 nt, Homo sapiens
gugagacugaguuucgcucuug

SEQ ID NO: 76941 - RNA, 22 nt, Homo sapiens
gugagauccucucuuauauggg

SEQ ID NO: 76942 - RNA, 22 nt, Homo sapiens
gugagaugaggucucacucugu

SEQ ID NO: 76943 - RNA, 22 nt, Homo sapiens
gugagaugauggguauguuaau

SEQ ID NO: 76944 - RNA, 22 nt, Homo sapiens
gugagauggaguuggugucuuu

SEQ ID NO: 76945 - RNA, 22 nt, Homo sapiens
gugagauuaguucuggaccugg

SEQ ID NO: 76946 - RNA, 22 nt, Homo sapiens
gugagauuuucuccagguucag

SEQ ID NO: 76947 - RNA, 19 nt, Homo sapiens
gugagcaaugcauugcacu

SEQ ID NO: 76948 - RNA, 22 nt, Homo sapiens
gugagcauaacaacagaguuua

SEQ ID NO: 76949 - RNA, 22 nt, Homo sapiens
gugagcauaggaggcuucuguu

SEQ ID NO: 76950 - RNA, 22 nt, Homo sapiens
gugagcuaagcaaauaugagcc

SEQ ID NO: 76951 - RNA, 22 nt, Homo sapiens
gugagcuauguccugguuuggg

SEQ ID NO: 76952 - RNA, 22 nt, Homo sapiens
gugaggaaggaaaccugcuagc

SEQ ID NO: 76953 - RNA, 22 nt, Homo sapiens
gugagguaauuagcucccuuag

SEQ ID NO: 76954 - RNA, 21 nt, Homo sapiens
gugaggucauugggcuuucug

SEQ ID NO: 76955 - RNA, 22 nt, Homo sapiens
gugagguguuaaccaaccugug

SEQ ID NO: 76956 - RNA, 22 nt, Homo sapiens
gugagguugaaaauaauggaaa

SEQ ID NO: 76957 - RNA, 22 nt, Homo sapiens
gugaguaaagguucauugaauu

SEQ ID NO: 76958 - RNA, 22 nt, Homo sapiens
gugagucaugucccaucugauu

SEQ ID NO: 76959 - RNA, 22 nt, Homo sapiens
gugauaguucuuacuccaaagu

SEQ ID NO: 76960 - RNA, 22 nt, Homo sapiens
uaaguaguguugagacaaguuu

SEQ ID NO: 76961 - RNA, 22 nt, Homo sapiens
uaaguaguuucuggauauucuc

SEQ ID NO: 76962 - RNA, 22 nt, Homo sapiens
uaaguaguuuucuuggaggcga

SEQ ID NO: 76963 - RNA, 22 nt, Homo sapiens
uaagucguggaugauucuucgg

SEQ ID NO: 76964 - RNA, 22 nt, Homo sapiens
uaagugaaggaaguguguuuac

SEQ ID NO: 76965 - RNA, 22 nt, Homo sapiens
uaagugaauauggacaguuagc

SEQ ID NO: 76966 - RNA, 20 nt, Homo sapiens
uaagugcauaggauauuucu

SEQ ID NO: 76967 - RNA, 22 nt, Homo sapiens
uaagugcuugacuuugauguuu

SEQ ID NO: 76968 - RNA, 22 nt, Homo sapiens
uaauacauucaaggugguaguu

SEQ ID NO: 76969 - RNA, 22 nt, Homo sapiens
uaauacuagugaauagcaggau

SEQ ID NO: 76970 - RNA, 22 nt, Homo sapiens
uaauacugcugugcuugaguug

SEQ ID NO: 76971 - RNA, 22 nt, Homo sapiens
uaauauguuuugaaaucaggaa

SEQ ID NO: 76972 - RNA, 22 nt, Homo sapiens
uaaucucagcugagcugagauu

SEQ ID NO: 76973 - RNA, 22 nt, Homo sapiens
uaaugcacauuuauuuuaccuu

SEQ ID NO: 76974 - RNA, 22 nt, Homo sapiens
uaaugcauacagaagguguuuu

SEQ ID NO: 76975 - RNA, 22 nt, Homo sapiens
uaaugcaucagugguaguucuu

SEQ ID NO: 76976 - RNA, 22 nt, Homo sapiens
uaaugcucauuagcaggccaau

SEQ ID NO: 76977 - RNA, 22 nt, Homo sapiens
uaaugcuccauggguuauuaaa

SEQ ID NO: 76978 - RNA, 22 nt, Homo sapiens
uaaugcuugguuguuuggaaaa

SEQ ID NO: 76979 - RNA, 22 nt, Homo sapiens
uaauucugacaacaguggcguu

SEQ ID NO: 76980 - RNA, 22 nt, Homo sapiens
uacaaagcuacucgagggcagg

SEQ ID NO: 76981 - RNA, 22 nt, Homo sapiens
uacaaaucuagguuuguuacug

SEQ ID NO: 76982 - RNA, 22 nt, Homo sapiens
uacaaccucugccucccaaguu

SEQ ID NO: 76983 - RNA, 22 nt, Homo sapiens
uacacacguguguauauauaca

SEQ ID NO: 76984 - RNA, 22 nt, Homo sapiens
uacaccauuugauucuuuaagc

SEQ ID NO: 76985 - RNA, 22 nt, Homo sapiens
uacaccugaguuugugguuuuc

SEQ ID NO: 76986 - RNA, 22 nt, Homo sapiens
uacaccugcacucuagccuggg

SEQ ID NO: 76987 - RNA, 20 nt, Homo sapiens
uacacguaugagcacaugug

SEQ ID NO: 76988 - RNA, 22 nt, Homo sapiens
uacacgugcacaacgugcacgu

SEQ ID NO: 76989 - RNA, 22 nt, Homo sapiens
uacagaguagaagauuugcaga

SEQ ID NO: 76990 - RNA, 22 nt, Homo sapiens
uacagaucaguuauuuuguaga

SEQ ID NO: 76991 - RNA, 22 nt, Homo sapiens
uacagcacaggugcagguguug

SEQ ID NO: 76992 - RNA, 22 nt, Homo sapiens
uacagcuaugugcaugcaugcu

SEQ ID NO: 76993 - RNA, 20 nt, Homo sapiens
uacaggacugagaaucugug

SEQ ID NO: 76994 - RNA, 22 nt, Homo sapiens
uacaggcaccuggcuaauuuuu

SEQ ID NO: 76995 - RNA, 22 nt, Homo sapiens
uacaguacacagguaccaagcu

SEQ ID NO: 76996 - RNA, 22 nt, Homo sapiens
uacaguacagugacaccauuau

SEQ ID NO: 76997 - RNA, 22 nt, Homo sapiens
uacaguaggauuuucagggucu

SEQ ID NO: 76998 - RNA, 22 nt, Homo sapiens
uacaguccaugcauuauccucc

SEQ ID NO: 76999 - RNA, 22 nt, Homo sapiens
uacagucuagaggagaaucagg

SEQ ID NO: 77000 - RNA, 22 nt, Homo sapiens
uacagucuggaggccuguguug

SEQ ID NO: 77001 - RNA, 22 nt, Homo sapiens
uacauguauacaggguuuacuu

SEQ ID NO: 77002 - RNA, 22 nt, Homo sapiens
uacauguauguguuuauggcug

SEQ ID NO: 77003 - RNA, 22 nt, Homo sapiens
uaccacaggcuggguaaucuau

SEQ ID NO: 77004 - RNA, 22 nt, Homo sapiens
uaccacagucauuacacuugua

SEQ ID NO: 77005 - RNA, 22 nt, Homo sapiens
uaccacugccgagaaaacagau

SEQ ID NO: 77006 - RNA, 22 nt, Homo sapiens
uaccaguaaugggucaaaggca

SEQ ID NO: 77007 - RNA, 22 nt, Homo sapiens
uaccagugaauuccaggggcua

SEQ ID NO: 77008 - RNA, 22 nt, Homo sapiens
uacccuuuaguauaaaaucaga

SEQ ID NO: 77009 - RNA, 22 nt, Homo sapiens
uaccuaguguugacuucucuuc

SEQ ID NO: 77010 - RNA, 22 nt, Homo sapiens
uaccugagucuagagucuagaa

SEQ ID NO: 77011 - RNA, 16 nt, Homo sapiens
uacuacugccuauuau

SEQ ID NO: 77012 - RNA, 22 nt, Homo sapiens
uacuagaaccuuauucagagug

SEQ ID NO: 77013 - RNA, 22 nt, Homo sapiens
uacuagaggaaaacuugaagac

SEQ ID NO: 77014 - RNA, 22 nt, Homo sapiens
uacucacauucuguuucuugcu

SEQ ID NO: 77015 - RNA, 22 nt, Homo sapiens
uacucaguaagugcuggcugcu

SEQ ID NO: 77016 - RNA, 22 nt, Homo sapiens
ugagaacugguagcacuuguga

SEQ ID NO: 77017 - RNA, 22 nt, Homo sapiens
ugagaacuuauggugauuuuuu

SEQ ID NO: 77018 - RNA, 22 nt, Homo sapiens
ugagaagacaucagcuuucgga

SEQ ID NO: 77019 - RNA, 22 nt, Homo sapiens
ugagaagugauauagaaguuaa

SEQ ID NO: 77020 - RNA, 22 nt, Homo sapiens
ugagaauauuuuccaugucuca

SEQ ID NO: 77021 - RNA, 22 nt, Homo sapiens
ugagaaugaugauuuccaguuu

SEQ ID NO: 77022 - RNA, 19 nt, Homo sapiens
ugagaauguuaccaggucc

SEQ ID NO: 77023 - RNA, 22 nt, Homo sapiens
ugagacacugaauccggccuga

SEQ ID NO: 77024 - RNA, 22 nt, Homo sapiens
ugagacauacuuacaggggaug

SEQ ID NO: 77025 - RNA, 22 nt, Homo sapiens
ugagaccugaucuugguacugc

SEQ ID NO: 77026 - RNA, 22 nt, Homo sapiens
ugagacggagucucgcucuguu

SEQ ID NO: 77027 - RNA, 22 nt, Homo sapiens
ugagacggagucuugcucuguc

SEQ ID NO: 77028 - RNA, 22 nt, Homo sapiens
ugagacggaguuucacucuugu

SEQ ID NO: 77029 - RNA, 22 nt, Homo sapiens
ugagacugauaggacauuuucu

SEQ ID NO: 77030 - RNA, 22 nt, Homo sapiens
ugagacugguaauguguagggc

SEQ ID NO: 77031 - RNA, 22 nt, Homo sapiens
ugagagacaguuuguuaaaauu

SEQ ID NO: 77032 - RNA, 19 nt, Homo sapiens
ugagagcacaacugaacaa

SEQ ID NO: 77033 - RNA, 22 nt, Homo sapiens
ugagagcuuuuuugccugguga

SEQ ID NO: 77034 - RNA, 22 nt, Homo sapiens
ugagaguauaaauugaugcagc

SEQ ID NO: 77035 - RNA, 22 nt, Homo sapiens
ugagauaaagcauguacugugu

SEQ ID NO: 77036 - RNA, 22 nt, Homo sapiens
ugagauaggaucuugcucuguu

SEQ ID NO: 77037 - RNA, 20 nt, Homo sapiens
ugagauaguaauccccuaca

SEQ ID NO: 77038 - RNA, 22 nt, Homo sapiens
ugagauauauauauuugagaca

SEQ ID NO: 77039 - RNA, 22 nt, Homo sapiens
ugagaucaacugagucagagca

SEQ ID NO: 77040 - RNA, 22 nt, Homo sapiens
ugagaucaagauguuagggacu

SEQ ID NO: 77041 - RNA, 22 nt, Homo sapiens
ugagaucaagguuaauauaauc

SEQ ID NO: 77042 - RNA, 22 nt, Homo sapiens
ugagaucagugaagaaguguuu

SEQ ID NO: 77043 - RNA, 22 nt, Homo sapiens
ugagaucaugucauuugcacuc

SEQ ID NO: 77044 - RNA, 22 nt, Homo sapiens
ugagaucauguguggaccccag

SEQ ID NO: 77045 - RNA, 22 nt, Homo sapiens
ugagaucuucgcucuucacaga

SEQ ID NO: 77046 - RNA, 22 nt, Homo sapiens
ugagaugaagucucacucuguc

SEQ ID NO: 77047 - RNA, 22 nt, Homo sapiens
ugagaugagagaaugcuugccu

SEQ ID NO: 77048 - RNA, 22 nt, Homo sapiens
ugagaugagggcugcacucaaa

SEQ ID NO: 77049 - RNA, 22 nt, Homo sapiens
ugagaugaguucucgcucuguc

SEQ ID NO: 77050 - RNA, 22 nt, Homo sapiens
ugagaugaguugcuggcucuga

SEQ ID NO: 77051 - RNA, 22 nt, Homo sapiens
ugagaugcaaaaugagaauugu

SEQ ID NO: 77052 - RNA, 22 nt, Homo sapiens
ugagauggcugaauucagaaua

SEQ ID NO: 77053 - RNA, 20 nt, Homo sapiens
uagcagcagacagagggagg

SEQ ID NO: 77054 - RNA, 19 nt, Homo sapiens
uagcagcaugauuuauaau

SEQ ID NO: 77055 - RNA, 21 nt, Homo sapiens
uagcagcguuguugcaaaugu

SEQ ID NO: 77056 - RNA, 22 nt, Homo sapiens
uagcaggaaaccuguguugagg

SEQ ID NO: 77057 - RNA, 22 nt, Homo sapiens
uagcagguguuccacaaauauu

SEQ ID NO: 77058 - RNA, 22 nt, Homo sapiens
uagcaguaaagaaugugauguu

SEQ ID NO: 77059 - RNA, 22 nt, Homo sapiens
uagcaguauugaaagaugaggg

SEQ ID NO: 77060 - RNA, 22 nt, Homo sapiens
uagcagucaagauagucauuau

SEQ ID NO: 77061 - RNA, 22 nt, Homo sapiens
uagcagucucagaaugcauggu

SEQ ID NO: 77062 - RNA, 22 nt, Homo sapiens
uagcaucagauuccauauucua

SEQ ID NO: 77063 - RNA, 18 nt, Homo sapiens
uagcaugaugcugagugc

SEQ ID NO: 77064 - RNA, 22 nt, Homo sapiens
uagcuaguauuuugcugaggau

SEQ ID NO: 77065 - RNA, 22 nt, Homo sapiens
uagcuccacagcuauauauaau

SEQ ID NO: 77066 - RNA, 18 nt, Homo sapiens
uagcucuuguugguccau

SEQ ID NO: 77067 - RNA, 22 nt, Homo sapiens
uagcugagacuacaguaggugc

SEQ ID NO: 77068 - RNA, 22 nt, Homo sapiens
uagcugaucuuuuaaagaauga

SEQ ID NO: 77069 - RNA, 22 nt, Homo sapiens
uagcugcacuuacaagugagaa

SEQ ID NO: 77070 - RNA, 22 nt, Homo sapiens
uagcuggaguuuuuguuauagg

SEQ ID NO: 77071 - RNA, 22 nt, Homo sapiens
uaggaaguuucuugauuacuua

SEQ ID NO: 77072 - RNA, 22 nt, Homo sapiens
uaggacacagaccuggauggaa

SEQ ID NO: 77073 - RNA, 22 nt, Homo sapiens
uaggacacaggacauauguaga

SEQ ID NO: 77074 - RNA, 22 nt, Homo sapiens
uaggagcauaggauuguuugag

SEQ ID NO: 77075 - RNA, 22 nt, Homo sapiens
uaggcaauguacauaucggccc

SEQ ID NO: 77076 - RNA, 22 nt, Homo sapiens
uaggcacacaucuacuacaaau

SEQ ID NO: 77077 - RNA, 22 nt, Homo sapiens
uaggcacuguguuuguaggagu

SEQ ID NO: 77078 - RNA, 22 nt, Homo sapiens
uaggcaguggagaaauaaacag

SEQ ID NO: 77079 - RNA, 22 nt, Homo sapiens
uagggagugucuucauuuugua

SEQ ID NO: 77080 - RNA, 22 nt, Homo sapiens
uagggaguuuuggggugcagaa

SEQ ID NO: 77081 - RNA, 22 nt, Homo sapiens
uagguagaacuuuagacccugu

SEQ ID NO: 77082 - RNA, 22 nt, Homo sapiens
uagguaggaaguguuguuuuua

SEQ ID NO: 77083 - RNA, 22 nt, Homo sapiens
uagguaggauagucuuuauuuu

SEQ ID NO: 77084 - RNA, 22 nt, Homo sapiens
uagguaggugucauaauccaug

SEQ ID NO: 77085 - RNA, 22 nt, Homo sapiens
uagguagugugugcaugagagg

SEQ ID NO: 77086 - RNA, 22 nt, Homo sapiens
uagguaucuugguauaucagga

SEQ ID NO: 77087 - RNA, 22 nt, Homo sapiens
uagguaucuuuauagcaguagc

SEQ ID NO: 77088 - RNA, 22 nt, Homo sapiens
uaggucacugcucugugucuaa

SEQ ID NO: 77089 - RNA, 22 nt, Homo sapiens
uaggucaguuuuggcuuggcuu

SEQ ID NO: 77090 - RNA, 22 nt, Homo sapiens
uaggucccguuucagacugaga

SEQ ID NO: 77091 - RNA, 22 nt, Homo sapiens
uaggugaauguaguaagguguu

SEQ ID NO: 77092 - RNA, 22 nt, Homo sapiens
uagguuaugauccaucuuggcu

SEQ ID NO: 77093 - RNA, 22 nt, Homo sapiens
uagguugucucuucacucugau

SEQ ID NO: 77094 - RNA, 22 nt, Homo sapiens
uagguugucuucccagaguuuu

SEQ ID NO: 77095 - RNA, 22 nt, Homo sapiens
uaguaucacauggucuuaauua

SEQ ID NO: 77096 - RNA, 22 nt, Homo sapiens
uagugacauugcugggaaugcu

SEQ ID NO: 77097 - RNA, 21 nt, Homo sapiens
uagugcagugggguaugacuu

SEQ ID NO: 77098 - RNA, 22 nt, Homo sapiens
uagugcccuuauaagagcagga

SEQ ID NO: 77099 - RNA, 21 nt, Homo sapiens
uagugcugaggcaguauggga

SEQ ID NO: 77100 - RNA, 20 nt, Homo sapiens
uaguggaaaucagguccucu

SEQ ID NO: 77101 - RNA, 22 nt, Homo sapiens
uaguucauuuuucuugcuuaga

SEQ ID NO: 77102 - RNA, 22 nt, Homo sapiens
uaguuguugcagguaggaugua

SEQ ID NO: 77103 - RNA, 22 nt, Homo sapiens
uaguuuaucuucuggauggaca

SEQ ID NO: 77104 - RNA, 22 nt, Homo sapiens
uauaacacccacauauagucuu

SEQ ID NO: 77105 - RNA, 20 nt, Homo sapiens
uauaacaguuuggacccagu

SEQ ID NO: 77106 - RNA, 22 nt, Homo sapiens
uauagcaaugccccacuccuga

SEQ ID NO: 77107 - RNA, 22 nt, Homo sapiens
uauagcacugcaauauuucccu

SEQ ID NO: 77108 - RNA, 17 nt, Homo sapiens
uauagcacuucucacau

SEQ ID NO: 77109 - RNA, 22 nt, Homo sapiens
uauagcagccugaacaaaguaa

SEQ ID NO: 77110 - RNA, 22 nt, Homo sapiens
uauagcagugugagaacagacu

SEQ ID NO: 77111 - RNA, 22 nt, Homo sapiens
uauaguuuuuccugggaggaaa

SEQ ID NO: 77112 - RNA, 22 nt, Homo sapiens
ugagaugguaaauuuuuguugu

SEQ ID NO: 77113 - RNA, 21 nt, Homo sapiens
ugagaugugaccagggcauca

SEQ ID NO: 77114 - RNA, 22 nt, Homo sapiens
ugagaugugugcauucaacuca

SEQ ID NO: 77115 - RNA, 22 nt, Homo sapiens
ugagauguugcucugaaacaag

SEQ ID NO: 77116 - RNA, 22 nt, Homo sapiens
ugagauuguaucugcaaugugu

SEQ ID NO: 77117 - RNA, 19 nt, Homo sapiens
ugagauuguaugaggagau

SEQ ID NO: 77118 - RNA, 22 nt, Homo sapiens
ugagauuguucuaugucugguu

SEQ ID NO: 77119 - RNA, 22 nt, Homo sapiens
ugagcaacauuucaaaacucca

SEQ ID NO: 77120 - RNA, 22 nt, Homo sapiens
ugagcaagaaauagaaacagau

SEQ ID NO: 77121 - RNA, 22 nt, Homo sapiens
ugagcaagaucuuuauaauuag

SEQ ID NO: 77122 - RNA, 23 nt, Homo sapiens
ugagcaauauucuacuauugagu

SEQ ID NO: 77123 - RNA, 22 nt, Homo sapiens
ugagcacagcgugugggagagc

SEQ ID NO: 77124 - RNA, 22 nt, Homo sapiens
ugagcccauuguccugguuuau

SEQ ID NO: 77125 - RNA, 22 nt, Homo sapiens
ugagcuacuacacccagcuugg

SEQ ID NO: 77126 - RNA, 22 nt, Homo sapiens
ugagcuaggaucacaccugcau

SEQ ID NO: 77127 - RNA, 22 nt, Homo sapiens
ugagcuaggauccugucacugu

SEQ ID NO: 77128 - RNA, 20 nt, Homo sapiens
ugagcucaauuguugcaagu

SEQ ID NO: 77129 - RNA, 22 nt, Homo sapiens
ugagcucagcuaguugaggugu

SEQ ID NO: 77130 - RNA, 20 nt, Homo sapiens
ugagcucaugacauuuuucu

SEQ ID NO: 77131 - RNA, 22 nt, Homo sapiens
ugagcucaugcauucuugagga

SEQ ID NO: 77132 - RNA, 22 nt, Homo sapiens
ugagcugagauuaagcugcugc

SEQ ID NO: 77133 - RNA, 22 nt, Homo sapiens
ugagcuguuugaagaagcauuu

SEQ ID NO: 77134 - RNA, 20 nt, Homo sapiens
ugagcuuguaaacacuguuu

SEQ ID NO: 77135 - RNA, 22 nt, Homo sapiens
ugaggaguauguucuguagacc

SEQ ID NO: 77136 - RNA, 22 nt, Homo sapiens
ugaggcacucccuagcggggug

SEQ ID NO: 77137 - RNA, 22 nt, Homo sapiens
ugaggcaggagaacggcuugaa

SEQ ID NO: 77138 - RNA, 22 nt, Homo sapiens
ugagggaugccugguuuguuuu

SEQ ID NO: 77139 - RNA, 22 nt, Homo sapiens
ugagggcguauccuucauuaag

SEQ ID NO: 77140 - RNA, 22 nt, Homo sapiens
ugagguaacaaacuaugaguua

SEQ ID NO: 77141 - RNA, 22 nt, Homo sapiens
ugagguaagauguucauuuuuc

SEQ ID NO: 77142 - RNA, 22 nt, Homo sapiens
ugagguagaaugauucuaauau

SEQ ID NO: 77143 - RNA, 22 nt, Homo sapiens
ugagguaugacuuauuauucuu

SEQ ID NO: 77144 - RNA, 19 nt, Homo sapiens
ugagguauuuguugggaga

SEQ ID NO: 77145 - RNA, 22 nt, Homo sapiens
ugaggucuuuauuuagugcuca

SEQ ID NO: 77146 - RNA, 22 nt, Homo sapiens
ugagguguauugggggaaauuc

SEQ ID NO: 77147 - RNA, 22 nt, Homo sapiens
ugagguuauuuguucaagaagu

SEQ ID NO: 77148 - RNA, 22 nt, Homo sapiens
ugaguacugauuuaagauacac

SEQ ID NO: 77149 - RNA, 22 nt, Homo sapiens
ugaguagaacuagucuagagcu

SEQ ID NO: 77150 - RNA, 22 nt, Homo sapiens
ugaguagaagugaagauagugg

SEQ ID NO: 77151 - RNA, 22 nt, Homo sapiens
ugaguagagaauucagcuaagg

SEQ ID NO: 77152 - RNA, 22 nt, Homo sapiens
ugaguagcuaagacgauaggca

SEQ ID NO: 77153 - RNA, 22 nt, Homo sapiens
ugaguaggauugguauuucuuc

SEQ ID NO: 77154 - RNA, 23 nt, Homo sapiens
ugaguaggcaguuuuccccucac

SEQ ID NO: 77155 - RNA, 22 nt, Homo sapiens
ugaguagucagugggcaggaag

SEQ ID NO: 77156 - RNA, 19 nt, Homo sapiens
ugaguauauuguauucauu

SEQ ID NO: 77157 - RNA, 22 nt, Homo sapiens
ugaguaucuugaugaauuugaa

SEQ ID NO: 77158 - RNA, 22 nt, Homo sapiens
ugaguaugaguucaggaaaggc

SEQ ID NO: 77159 - RNA, 22 nt, Homo sapiens
ugaguauguaggaugugucuua

SEQ ID NO: 77160 - RNA, 22 nt, Homo sapiens
ugaguauguuuagaaguaaagg

SEQ ID NO: 77161 - RNA, 22 nt, Homo sapiens
ugagucaugcuggagucauggc

SEQ ID NO: 77162 - RNA, 22 nt, Homo sapiens
ugagucgagauugcgccacugu

SEQ ID NO: 77163 - RNA, 22 nt, Homo sapiens
ugagucuguuccaaagaaauaa

SEQ ID NO: 77164 - RNA, 22 nt, Homo sapiens
ugagugaacgcugagaccaaau

SEQ ID NO: 77165 - RNA, 22 nt, Homo sapiens
ugagugaggcugggcagucccu

SEQ ID NO: 77166 - RNA, 22 nt, Homo sapiens
ugaguguccaaguaaggugaaa

SEQ ID NO: 77167 - RNA, 22 nt, Homo sapiens
ugagugugaggaagaauuagaa

SEQ ID NO: 77168 - RNA, 22 nt, Homo sapiens
ugaguucauggucauuugucac

SEQ ID NO: 77169 - RNA, 22 nt, Homo sapiens
ugaguuccuugugugaccuugc

SEQ ID NO: 77170 - RNA, 22 nt, Homo sapiens
ugaguucuuccaccgggaccag

SEQ ID NO: 77171 - RNA, 22 nt, Homo sapiens
ugauaauguuaggcuuuauuca

SEQ ID NO: 77172 - RNA, 22 nt, Homo sapiens
gacaaguuugauuuauuccaag

SEQ ID NO: 77173 - RNA, 22 nt, Homo sapiens
gacagugagaugucaugugaaa

SEQ ID NO: 77174 - RNA, 22 nt, Homo sapiens
gacaguuucucaggcuuccuua

SEQ ID NO: 77175 - RNA, 22 nt, Homo sapiens
gacaguuuggugaggaagacga

SEQ ID NO: 77176 - RNA, 20 nt, Homo sapiens
gacauagagacucucaaaaa

SEQ ID NO: 77177 - RNA, 20 nt, Homo sapiens
gacauaggcugguaucuggc

SEQ ID NO: 77178 - RNA, 22 nt, Homo sapiens
gacaucauuaugagauuuaaac

SEQ ID NO: 77179 - RNA, 20 nt, Homo sapiens
gacaugacuaggagauagcc

SEQ ID NO: 77180 - RNA, 16 nt, Homo sapiens
gacaugaucuuguuua

SEQ ID NO: 77181 - RNA, 20 nt, Homo sapiens
gacauguugguuugcugcac

SEQ ID NO: 77182 - RNA, 22 nt, Homo sapiens
gacauguuuacaguguugagag

SEQ ID NO: 77183 - RNA, 20 nt, Homo sapiens
gacauguuuuguggccuaac

SEQ ID NO: 77184 - RNA, 22 nt, Homo sapiens
gacauuaucagguuuguuuucu

SEQ ID NO: 77185 - RNA, 22 nt, Homo sapiens
gaccacagacuggaaagagggc

SEQ ID NO: 77186 - RNA, 21 nt, Homo sapiens
gaccacagcagggaaugucag

SEQ ID NO: 77187 - RNA, 22 nt, Homo sapiens
gaccuaggaggauugcuugagc

SEQ ID NO: 77188 - RNA, 21 nt, Homo sapiens
gaccuguaguaagcauucaca

SEQ ID NO: 77189 - RNA, 22 nt, Homo sapiens
gaccuguaguuuaguugccugu

SEQ ID NO: 77190 - RNA, 22 nt, Homo sapiens
gacgauaucaaggaaaugaagu

SEQ ID NO: 77191 - RNA, 17 nt, Homo sapiens
gacgaucaucaggaggc

SEQ ID NO: 77192 - RNA, 22 nt, Homo sapiens
gacguagagaaaugugaaaugg

SEQ ID NO: 77193 - RNA, 16 nt, Homo sapiens
gacuaauacaaaggaa

SEQ ID NO: 77194 - RNA, 22 nt, Homo sapiens
gacuaaugaaagagugugauau

SEQ ID NO: 77195 - RNA, 22 nt, Homo sapiens
gacuagaggcaggcaccgcugc

SEQ ID NO: 77196 - RNA, 22 nt, Homo sapiens
gacuaggagagcagcugcccau

SEQ ID NO: 77197 - RNA, 22 nt, Homo sapiens
gacuagggaaaauuauuuuguu

SEQ ID NO: 77198 - RNA, 22 nt, Homo sapiens
gugauauguuaggaucuaaguc

SEQ ID NO: 77199 - RNA, 22 nt, Homo sapiens
gugaucuguccuucauagccug

SEQ ID NO: 77200 - RNA, 22 nt, Homo sapiens
gugaucuuucaggcuugaccau

SEQ ID NO: 77201 - RNA, 22 nt, Homo sapiens
gugauguguuuguucuaucucu

SEQ ID NO: 77202 - RNA, 22 nt, Homo sapiens
gugauuauccacgucuuuguga

SEQ ID NO: 77203 - RNA, 20 nt, Homo sapiens
gugauuggucacugguuguu

SEQ ID NO: 77204 - RNA, 22 nt, Homo sapiens
gugcaaaucucugaguaucuuu

SEQ ID NO: 77205 - RNA, 22 nt, Homo sapiens
gugcaacaugccuggcuaauuu

SEQ ID NO: 77206 - RNA, 22 nt, Homo sapiens
gugcaaccaucaccacugacuc

SEQ ID NO: 77207 - RNA, 22 nt, Homo sapiens
gugcaaguguaauacagcuagg

SEQ ID NO: 77208 - RNA, 18 nt, Homo sapiens
gugcaaugaauagcagag

SEQ ID NO: 77209 - RNA, 22 nt, Homo sapiens
gugcaaugaguguggcaaagcc

SEQ ID NO: 77210 - RNA, 22 nt, Homo sapiens
gugcaauguuaauuacuugacu

SEQ ID NO: 77211 - RNA, 22 nt, Homo sapiens
gugcacaacaugcagguuuguu

SEQ ID NO: 77212 - RNA, 22 nt, Homo sapiens
gugcacaacgugcagguuuguu

SEQ ID NO: 77213 - RNA, 22 nt, Homo sapiens
gugcacaacguguagguuuguu

SEQ ID NO: 77214 - RNA, 22 nt, Homo sapiens
gugcacaaucgugcauuccuug

SEQ ID NO: 77215 - RNA, 21 nt, Homo sapiens
gugcacaguaguguuuaauag

SEQ ID NO: 77216 - RNA, 22 nt, Homo sapiens
gugcacaucuguguuccagcua

SEQ ID NO: 77217 - RNA, 22 nt, Homo sapiens
gugcacaugguagguauugagu

SEQ ID NO: 77218 - RNA, 22 nt, Homo sapiens
gugcacauuguuuaugucuguu

SEQ ID NO: 77219 - RNA, 22 nt, Homo sapiens
gugcacuguagaacccuuuguu

SEQ ID NO: 77220 - RNA, 22 nt, Homo sapiens
gugcagaugucuuuauaguagc

SEQ ID NO: 77221 - RNA, 22 nt, Homo sapiens
gugcagugugauccuuccguau

SEQ ID NO: 77222 - RNA, 22 nt, Homo sapiens
gugcaguuuuaagugaguuucu

SEQ ID NO: 77223 - RNA, 18 nt, Homo sapiens
gugcauagccauggcagc

SEQ ID NO: 77224 - RNA, 22 nt, Homo sapiens
gugcauauaaguuguuucuagu

SEQ ID NO: 77225 - RNA, 22 nt, Homo sapiens
gugccacaguguuaagggauuc

SEQ ID NO: 77226 - RNA, 22 nt, Homo sapiens
gugccacugcaccuggccuaag

SEQ ID NO: 77227 - RNA, 22 nt, Homo sapiens
gugccuagugcuauugugcccu

SEQ ID NO: 77228 - RNA, 23 nt, Homo sapiens
gugccuucugagccuagucucca

SEQ ID NO: 77229 - RNA, 22 nt, Homo sapiens
gugcuuguauuuaaaucaugug

SEQ ID NO: 77230 - RNA, 22 nt, Homo sapiens
guggaaaucucugugugacuua

SEQ ID NO: 77231 - RNA, 21 nt, Homo sapiens
guggaaauggaauuuacuaau

SEQ ID NO: 77232 - RNA, 20 nt, Homo sapiens
guggaagauaaguagccuga

SEQ ID NO: 77233 - RNA, 22 nt, Homo sapiens
guggaagguaaugcagcuuacu

SEQ ID NO: 77234 - RNA, 20 nt, Homo sapiens
guggaaguagaaacauaugu

SEQ ID NO: 77235 - RNA, 22 nt, Homo sapiens
guggaaguuaagugacuuucug

SEQ ID NO: 77236 - RNA, 22 nt, Homo sapiens
guggaauacuaugaugguggau

SEQ ID NO: 77237 - RNA, 22 nt, Homo sapiens
guggaaucuagagaggcaguag

SEQ ID NO: 77238 - RNA, 22 nt, Homo sapiens
guggaauggaaugauuguguau

SEQ ID NO: 77239 - RNA, 22 nt, Homo sapiens
guggacagagacuaaauguugu

SEQ ID NO: 77240 - RNA, 22 nt, Homo sapiens
guggacugggagagauaguucc

SEQ ID NO: 77241 - RNA, 22 nt, Homo sapiens
guggaguacugagggucacuua

SEQ ID NO: 77242 - RNA, 22 nt, Homo sapiens
guggaucacuugaggucaagag

SEQ ID NO: 77243 - RNA, 22 nt, Homo sapiens
guggaucacuugagguuagaag

SEQ ID NO: 77244 - RNA, 22 nt, Homo sapiens
guggcaaagaugccuucuccaa

SEQ ID NO: 77245 - RNA, 22 nt, Homo sapiens
guggcacaauuaaguagcuauu

SEQ ID NO: 77246 - RNA, 22 nt, Homo sapiens
guggcagugugaggauccugcu

SEQ ID NO: 77247 - RNA, 22 nt, Homo sapiens
guggcgagaucauagcucauug

SEQ ID NO: 77248 - RNA, 22 nt, Homo sapiens
guggcuaaagauuuggaaucug

SEQ ID NO: 77249 - RNA, 22 nt, Homo sapiens
guggcuagaaugaagguagcug

SEQ ID NO: 77250 - RNA, 22 nt, Homo sapiens
guggcuauuguucccugguugc

SEQ ID NO: 77251 - RNA, 22 nt, Homo sapiens
gugggaugcaaguaaaauuguc

SEQ ID NO: 77252 - RNA, 22 nt, Homo sapiens
gugggauggagagaagguauga

SEQ ID NO: 77253 - RNA, 22 nt, Homo sapiens
guggguaaaucucuggggcucu

SEQ ID NO: 77254 - RNA, 22 nt, Homo sapiens
gugguagaaaguaccaaacuag

SEQ ID NO: 77255 - RNA, 22 nt, Homo sapiens
gugguagaaauguagaugcuag

SEQ ID NO: 77256 - RNA, 22 nt, Homo sapiens
gugguaucauuuaaccauuaga

SEQ ID NO: 77257 - RNA, 22 nt, Homo sapiens
gugguucuaaaccuuuuuuggu

SEQ ID NO: 77258 - RNA, 22 nt, Homo sapiens
guguaaaacaauuagaggauuu

SEQ ID NO: 77259 - RNA, 22 nt, Homo sapiens
guguaaaucaaucuguugucuu

SEQ ID NO: 77260 - RNA, 22 nt, Homo sapiens
guguaaguccugaguuuggaua

SEQ ID NO: 77261 - RNA, 22 nt, Homo sapiens
guguaguuugagguaugggggc

SEQ ID NO: 77262 - RNA, 22 nt, Homo sapiens
guguauacauagaauuguguau

SEQ ID NO: 77263 - RNA, 22 nt, Homo sapiens
guguaugugagaaugcucaugu

SEQ ID NO: 77264 - RNA, 22 nt, Homo sapiens
gugucacagcuuccaucucggu

SEQ ID NO: 77265 - RNA, 22 nt, Homo sapiens
gagguuuuagugagucccacug

SEQ ID NO: 77266 - RNA, 22 nt, Homo sapiens
gaguaaaugucaaguacuuagg

SEQ ID NO: 77267 - RNA, 22 nt, Homo sapiens
gaguaaauguccuagcuucuug

SEQ ID NO: 77268 - RNA, 22 nt, Homo sapiens
gaguagaacugguuaucuaaua

SEQ ID NO: 77269 - RNA, 22 nt, Homo sapiens
gaguagugcugcaguaaacaca

SEQ ID NO: 77270 - RNA, 22 nt, Homo sapiens
gaguauauuugcacuguuaugu

SEQ ID NO: 77271 - RNA, 22 nt, Homo sapiens
gaguaucuuuaaggugguuugg

SEQ ID NO: 77272 - RNA, 22 nt, Homo sapiens
gaguauguauaugagugugucu

SEQ ID NO: 77273 - RNA, 22 nt, Homo sapiens
gagucagugucuugcucuguca

SEQ ID NO: 77274 - RNA, 22 nt, Homo sapiens
gagugcaaagguccugaggugg

SEQ ID NO: 77275 - RNA, 21 nt, Homo sapiens
gagugcaaauaaagagagggc

SEQ ID NO: 77276 - RNA, 22 nt, Homo sapiens
gagugcaagguuuuucugagug

SEQ ID NO: 77277 - RNA, 22 nt, Homo sapiens
gagugcaauggcagaucuccgc

SEQ ID NO: 77278 - RNA, 22 nt, Homo sapiens
gagugcaauggcaugaucuggg

SEQ ID NO: 77279 - RNA, 22 nt, Homo sapiens
gagugcauugguggucaggugu

SEQ ID NO: 77280 - RNA, 22 nt, Homo sapiens
gagugcuguuagcccuggguuu

SEQ ID NO: 77281 - RNA, 22 nt, Homo sapiens
gauaacagauaaugucaguuau

SEQ ID NO: 77282 - RNA, 22 nt, Homo sapiens
gauagcauucaauuaucuguug

SEQ ID NO: 77283 - RNA, 22 nt, Homo sapiens
gauauguaaaaauuauaucuga

SEQ ID NO: 77284 - RNA, 22 nt, Homo sapiens
gauaugugauaagaguuaucuu

SEQ ID NO: 77285 - RNA, 22 nt, Homo sapiens
gauauguguuuuagucaggguu

SEQ ID NO: 77286 - RNA, 22 nt, Homo sapiens
gauauguucuuucacguuggug

SEQ ID NO: 77287 - RNA, 22 nt, Homo sapiens
gaucaauuggcugaagacacgu

SEQ ID NO: 77288 - RNA, 22 nt, Homo sapiens
gaucacauguguacucaaugug

SEQ ID NO: 77289 - RNA, 22 nt, Homo sapiens
gaucagauggcuguuggugugu

SEQ ID NO: 77290 - RNA, 22 nt, Homo sapiens
gaucccauuggcugccaugugg

SEQ ID NO: 77291 - RNA, 22 nt, Homo sapiens
gaucuggucuuugauuagacac

SEQ ID NO: 77292 - RNA, 22 nt, Homo sapiens
gaucuguuguuuggaaguauca

SEQ ID NO: 77293 - RNA, 22 nt, Homo sapiens
gaugaaacaucuuuggaaacug

SEQ ID NO: 77294 - RNA, 22 nt, Homo sapiens
gcuguugguaaaaaggacauga

SEQ ID NO: 77295 - RNA, 22 nt, Homo sapiens
gcuucauggaggcugggcgcag

SEQ ID NO: 77296 - RNA, 22 nt, Homo sapiens
gcuugguccccacccaaaucgc

SEQ ID NO: 77297 - RNA, 22 nt, Homo sapiens
gcuuguguuugcuccccagaau

SEQ ID NO: 77298 - RNA, 22 nt, Homo sapiens
gcuuuguuaaaacacagccaca

SEQ ID NO: 77299 - RNA, 22 nt, Homo sapiens
gcuuuguuguugaugggaaauc

SEQ ID NO: 77300 - RNA, 22 nt, Homo sapiens
gcuuuuggaggaacuuaagauu

SEQ ID NO: 77301 - RNA, 22 nt, Homo sapiens
ggaaagacuauuguaaaggaug

SEQ ID NO: 77302 - RNA, 22 nt, Homo sapiens
ggaaagaucagcuaaauguaag

SEQ ID NO: 77303 - RNA, 22 nt, Homo sapiens
ggaaaguccuucuguaggcucc

SEQ ID NO: 77304 - RNA, 22 nt, Homo sapiens
ggaaauguaaacaauggggcua

SEQ ID NO: 77305 - RNA, 19 nt, Homo sapiens
ggaaaugucuauuaagauc

SEQ ID NO: 77306 - RNA, 22 nt, Homo sapiens
ggaaauguuuagcauccacuuu

SEQ ID NO: 77307 - RNA, 22 nt, Homo sapiens
ggaagaauauuaggggauuucg

SEQ ID NO: 77308 - RNA, 22 nt, Homo sapiens
ggaagacaguguggugauuccu

SEQ ID NO: 77309 - RNA, 22 nt, Homo sapiens
ggaagacuuagaguagcaucag

SEQ ID NO: 77310 - RNA, 22 nt, Homo sapiens
ggaagguaauugucagcucaua

SEQ ID NO: 77311 - RNA, 22 nt, Homo sapiens
ggaaggucaaagggaaagcaga

SEQ ID NO: 77312 - RNA, 20 nt, Homo sapiens
ggaauagucuacacucugac

SEQ ID NO: 77313 - RNA, 22 nt, Homo sapiens
ggaauguaguaauuugguuagu

SEQ ID NO: 77314 - RNA, 22 nt, Homo sapiens
ggaauguuaaagacuacacuga

SEQ ID NO: 77315 - RNA, 20 nt, Homo sapiens
ggaauguuaaucuccaugau

SEQ ID NO: 77316 - RNA, 21 nt, Homo sapiens
ggaauguugccagcagccaga

SEQ ID NO: 77317 - RNA, 22 nt, Homo sapiens
ggacaaaguauuuucaaaugua

SEQ ID NO: 77318 - RNA, 22 nt, Homo sapiens
ggacagaaaggguucaccaaac

SEQ ID NO: 77319 - RNA, 22 nt, Homo sapiens
ggacuagaacugagaaucauau

SEQ ID NO: 77320 - RNA, 22 nt, Homo sapiens
ggacuaggagcuaggaagaucu

SEQ ID NO: 77321 - RNA, 22 nt, Homo sapiens
ggacugagaggacuacagugua

SEQ ID NO: 77322 - RNA, 19 nt, Homo sapiens
ggacugucauggaguaguu

SEQ ID NO: 77323 - RNA, 22 nt, Homo sapiens
ggagagcuaggcagagguuugu

SEQ ID NO: 77324 - RNA, 22 nt, Homo sapiens
ggagaucauuuccuauuugaag

SEQ ID NO: 77325 - RNA, 22 nt, Homo sapiens
ggagaucuuugaaguguugugc

SEQ ID NO: 77326 - RNA, 22 nt, Homo sapiens
ggagaugugccugcucugcucu

SEQ ID NO: 77327 - RNA, 22 nt, Homo sapiens
ggagauuauuaguguuucaugc

SEQ ID NO: 77328 - RNA, 22 nt, Homo sapiens
ggagauuauugaaucaugaggg

SEQ ID NO: 77329 - RNA, 22 nt, Homo sapiens
ggagcaaugccucauucucacu

SEQ ID NO: 77330 - RNA, 22 nt, Homo sapiens
ggagcugugauuugaguccaga

SEQ ID NO: 77331 - RNA, 22 nt, Homo sapiens
ggagguagguuugugauuugua

SEQ ID NO: 77332 - RNA, 22 nt, Homo sapiens
ggagguagucuuucccuuauca

SEQ ID NO: 77333 - RNA, 20 nt, Homo sapiens
ggagguguugauuuuucuuu

SEQ ID NO: 77334 - RNA, 20 nt, Homo sapiens
ggagguguuggauuucuagu

SEQ ID NO: 77335 - RNA, 20 nt, Homo sapiens
ggagguuguauaaguacauc

SEQ ID NO: 77336 - RNA, 21 nt, Homo sapiens
ggaguauaaggcaaaggagug

SEQ ID NO: 77337 - RNA, 22 nt, Homo sapiens
ggaguaugaaacccacuccaau

SEQ ID NO: 77338 - RNA, 22 nt, Homo sapiens
ggagucugaacuggacaaugac

SEQ ID NO: 77339 - RNA, 22 nt, Homo sapiens
ggagucugacuuauaggaaccu

SEQ ID NO: 77340 - RNA, 22 nt, Homo sapiens
ggagucuugcuauguugccaag

SEQ ID NO: 77341 - RNA, 22 nt, Homo sapiens
ggagugugauucaguauaauau

SEQ ID NO: 77342 - RNA, 22 nt, Homo sapiens
ggaguguguaggagaaagguaa

SEQ ID NO: 77343 - RNA, 22 nt, Homo sapiens
ggaguguuccauuugucacauu

SEQ ID NO: 77344 - RNA, 22 nt, Homo sapiens
ggauacauuuuuccuccucuuc

SEQ ID NO: 77345 - RNA, 22 nt, Homo sapiens
ggauauguagggcauaucuaca

SEQ ID NO: 77346 - RNA, 22 nt, Homo sapiens
ggauggcauuucuuuagcuuuu

SEQ ID NO: 77347 - RNA, 22 nt, Homo sapiens
ggcaaaauauugucugguauag

SEQ ID NO: 77348 - RNA, 22 nt, Homo sapiens
ggcaaaugaagauggagaggcu

SEQ ID NO: 77349 - RNA, 22 nt, Homo sapiens
ggcaacaaagacauuucaacau

SEQ ID NO: 77350 - RNA, 22 nt, Homo sapiens
ggcaacaauuccuacuucuuuu

SEQ ID NO: 77351 - RNA, 22 nt, Homo sapiens
ggcaagaaaaugcaauuacugu

SEQ ID NO: 77352 - RNA, 22 nt, Homo sapiens
ggcaagaaccucaauuaccuuu

SEQ ID NO: 77353 - RNA, 22 nt, Homo sapiens
ggcaagaacuucacucacuuuu

SEQ ID NO: 77354 - RNA, 20 nt, Homo sapiens
ggcaagacccaaagugugug

SEQ ID NO: 77355 - RNA, 22 nt, Homo sapiens
ggcaagaggagauucugcuccc

SEQ ID NO: 77356 - RNA, 22 nt, Homo sapiens
ggcaaggauguuuuucuggcaa

SEQ ID NO: 77357 - RNA, 22 nt, Homo sapiens
gugucacuguauaauauuuauu

SEQ ID NO: 77358 - RNA, 22 nt, Homo sapiens
gugucacugugaggauauugua

SEQ ID NO: 77359 - RNA, 22 nt, Homo sapiens
gugucaugaagguuuuaugcag

SEQ ID NO: 77360 - RNA, 18 nt, Homo sapiens
gugucugguuaugggagu

SEQ ID NO: 77361 - RNA, 22 nt, Homo sapiens
gugugacugcucuauuagggcg

SEQ ID NO: 77362 - RNA, 22 nt, Homo sapiens
gugugauggcgcacacagggug

SEQ ID NO: 77363 - RNA, 22 nt, Homo sapiens
gugugauuauuucaauugaugc

SEQ ID NO: 77364 - RNA, 22 nt, Homo sapiens
gugugauuguuaauuuuaggug

SEQ ID NO: 77365 - RNA, 22 nt, Homo sapiens
gugugcaaauguguaccuacau

SEQ ID NO: 77366 - RNA, 19 nt, Homo sapiens
gugugcauaucacagagca

SEQ ID NO: 77367 - RNA, 22 nt, Homo sapiens
guguggaacucaauacaacgca

SEQ ID NO: 77368 - RNA, 22 nt, Homo sapiens
guguuauggagccaaacuacua

SEQ ID NO: 77369 - RNA, 22 nt, Homo sapiens
guguuauugagaaauagggugu

SEQ ID NO: 77370 - RNA, 22 nt, Homo sapiens
guguucaaacccaggucugucu

SEQ ID NO: 77371 - RNA, 22 nt, Homo sapiens
guguucaaauucugacagagag

SEQ ID NO: 77372 - RNA, 22 nt, Homo sapiens
guuaaugcuggaauaaguuaag

SEQ ID NO: 77373 - RNA, 22 nt, Homo sapiens
guuacugucuuccugauugcuu

SEQ ID NO: 77374 - RNA, 22 nt, Homo sapiens
guuagaugaagaccaagggcaa

SEQ ID NO: 77375 - RNA, 22 nt, Homo sapiens
guuaggcagugugguauagcag

SEQ ID NO: 77376 - RNA, 18 nt, Homo sapiens
guuagguaguaugaugcu

SEQ ID NO: 77377 - RNA, 22 nt, Homo sapiens
guuauauguuuggaaugaggaa

SEQ ID NO: 77378 - RNA, 22 nt, Homo sapiens
guuaugacacucuuuuuaucau

SEQ ID NO: 77379 - RNA, 22 nt, Homo sapiens
guuauguguuuccuuaauugcu

SEQ ID NO: 77380 - RNA, 22 nt, Homo sapiens
guuauguuaguuacaaggcuag

SEQ ID NO: 77381 - RNA, 22 nt, Homo sapiens
guuauuguccauuuauuuagca

SEQ ID NO: 77382 - RNA, 22 nt, Homo sapiens
guucaaggaauguuggcuucuc

SEQ ID NO: 77383 - RNA, 21 nt, Homo sapiens
guucaagugauccuccugucu

SEQ ID NO: 77384 - RNA, 22 nt, Homo sapiens
guucacacuugcaaccccagca

SEQ ID NO: 77385 - RNA, 20 nt, Homo sapiens
guucacagagguuaugauua

SEQ ID NO: 77386 - RNA, 20 nt, Homo sapiens
guucacaggcuuccuuucag

SEQ ID NO: 77387 - RNA, 22 nt, Homo sapiens
guucacucuggagaauauugac

SEQ ID NO: 77388 - RNA, 22 nt, Homo sapiens
guucagguauucuggaacagag

SEQ ID NO: 77389 - RNA, 22 nt, Homo sapiens
guucaguuugcugaugcguuga

SEQ ID NO: 77390 - RNA, 22 nt, Homo sapiens
uaugcuuauugucucauccacu

SEQ ID NO: 77391 - RNA, 22 nt, Homo sapiens
uauggauuucauuagacuugag

SEQ ID NO: 77392 - RNA, 22 nt, Homo sapiens
uauggcaaugcauaggaaggaa

SEQ ID NO: 77393 - RNA, 22 nt, Homo sapiens
uauggccugaauuagaaaagug

SEQ ID NO: 77394 - RNA, 22 nt, Homo sapiens
uauggccuuuuuaaugauauug

SEQ ID NO: 77395 - RNA, 22 nt, Homo sapiens
uauggcuaugggaacugggagu

SEQ ID NO: 77396 - RNA, 22 nt, Homo sapiens
uauggcuuuguuaacauuuucu

SEQ ID NO: 77397 - RNA, 22 nt, Homo sapiens
uauggguauuuuauacauaacc

SEQ ID NO: 77398 - RNA, 22 nt, Homo sapiens
uauggguguuauugcaugggag

SEQ ID NO: 77399 - RNA, 22 nt, Homo sapiens
uauggucuuugagaggugacug

SEQ ID NO: 77400 - RNA, 22 nt, Homo sapiens
uaugguuuucucuuacguguug

SEQ ID NO: 77401 - RNA, 22 nt, Homo sapiens
uaugucacuggacauaaguucu

SEQ ID NO: 77402 - RNA, 22 nt, Homo sapiens
uaugugcuuuguuaaacagaug

SEQ ID NO: 77403 - RNA, 22 nt, Homo sapiens
uauguguuuuauggucagggag

SEQ ID NO: 77404 - RNA, 22 nt, Homo sapiens
uauuacacuuuagugucuucca

SEQ ID NO: 77405 - RNA, 22 nt, Homo sapiens
uauuagguuggggcaaaaguaa

SEQ ID NO: 77406 - RNA, 22 nt, Homo sapiens
uauuagguuggugcaacaguaa

SEQ ID NO: 77407 - RNA, 22 nt, Homo sapiens
uauuagguugguggaaaaguaa

SEQ ID NO: 77408 - RNA, 22 nt, Homo sapiens
uauuagugccuaagucuuaggg

SEQ ID NO: 77409 - RNA, 22 nt, Homo sapiens
uauuaugcacuuuauaaaaauu

SEQ ID NO: 77410 - RNA, 20 nt, Homo sapiens
uauucacucuccagucuugc

SEQ ID NO: 77411 - RNA, 22 nt, Homo sapiens
uauucacuguaucauugauggg

SEQ ID NO: 77412 - RNA, 22 nt, Homo sapiens
uauuccacacuguuggugggau

SEQ ID NO: 77413 - RNA, 22 nt, Homo sapiens
uauuccacuggcacugcauuug

SEQ ID NO: 77414 - RNA, 22 nt, Homo sapiens
uauuccagcccuggugagccag

SEQ ID NO: 77415 - RNA, 22 nt, Homo sapiens
uauuccucuuuguugagguuau

SEQ ID NO: 77416 - RNA, 22 nt, Homo sapiens
uauuccuuuugcauuuccacau

SEQ ID NO: 77417 - RNA, 22 nt, Homo sapiens
uauugaauuuuuaagcccuuug

SEQ ID NO: 77418 - RNA, 22 nt, Homo sapiens
uauugacuuuuuuguuaggagg

SEQ ID NO: 77419 - RNA, 22 nt, Homo sapiens
uauugcacuccagccuuggcaa

SEQ ID NO: 77420 - RNA, 22 nt, Homo sapiens
uauugcacuuuuccauaggagu

SEQ ID NO: 77421 - RNA, 22 nt, Homo sapiens
uauugcagaaugugaguuggca

SEQ ID NO: 77422 - RNA, 22 nt, Homo sapiens
uauugcccugcuuuguucuaaa

SEQ ID NO: 77423 - RNA, 22 nt, Homo sapiens
uauugccucagugacuuugggg

SEQ ID NO: 77424 - RNA, 22 nt, Homo sapiens
uauugccuugccuacuuuucca

SEQ ID NO: 77425 - RNA, 22 nt, Homo sapiens
uauugcuaaauucuuuuccuag

SEQ ID NO: 77426 - RNA, 22 nt, Homo sapiens
uauugcuccccauaucgcagug

SEQ ID NO: 77427 - RNA, 22 nt, Homo sapiens
uauugcuccuaauaucacggug

SEQ ID NO: 77428 - RNA, 22 nt, Homo sapiens
uauugcuugaggaaaugguaau

SEQ ID NO: 77429 - RNA, 22 nt, Homo sapiens
uauugcuuuugauucaaggcag

SEQ ID NO: 77430 - RNA, 22 nt, Homo sapiens
uauugguugcuaauuggcgcca

SEQ ID NO: 77431 - RNA, 22 nt, Homo sapiens
uauugucaccaucccuguuuua

SEQ ID NO: 77432 - RNA, 22 nt, Homo sapiens
uauugucacuaaaggaagcugg

SEQ ID NO: 77433 - RNA, 22 nt, Homo sapiens
uauuucaguugugcagguaguu

SEQ ID NO: 77434 - RNA, 22 nt, Homo sapiens
uauuugcacucccaucauggug

SEQ ID NO: 77435 - RNA, 22 nt, Homo sapiens
uauuuggugaaugaaugcaugu

SEQ ID NO: 77436 - RNA, 22 nt, Homo sapiens
ucaaaaccucagagaguagagc

SEQ ID NO: 77437 - RNA, 22 nt, Homo sapiens
ucaaaaucucuuagcugugucu

SEQ ID NO: 77438 - RNA, 22 nt, Homo sapiens
ucaaacugcuugaggccauuua

SEQ ID NO: 77439 - RNA, 22 nt, Homo sapiens
ucaaacugucagguugaccaga

SEQ ID NO: 77440 - RNA, 22 nt, Homo sapiens
ucaaaguagaaaaggggcaauu

SEQ ID NO: 77441 - RNA, 20 nt, Homo sapiens
ucaaaguaugcucugcacua

SEQ ID NO: 77442 - RNA, 22 nt, Homo sapiens
gcuuuggauaaaugucaguuua

SEQ ID NO: 77443 - RNA, 19 nt, Homo sapiens
gcuuuguggggaaggagcc

SEQ ID NO: 77444 - RNA, 18 nt, Homo sapiens
ggaaaacuuuucuaagua

SEQ ID NO: 77445 - RNA, 22 nt, Homo sapiens
ggaaagcuagguguggguguac

SEQ ID NO: 77446 - RNA, 21 nt, Homo sapiens
ggaaaguuaaggaaauacccc

SEQ ID NO: 77447 - RNA, 22 nt, Homo sapiens
ggaaaucaucauucucgguaua

SEQ ID NO: 77448 - RNA, 22 nt, Homo sapiens
ggaacaccauuuuuccugccuu

SEQ ID NO: 77449 - RNA, 18 nt, Homo sapiens
ggaagccuauuuaguaac

SEQ ID NO: 77450 - RNA, 22 nt, Homo sapiens
ggaagccugcacucgggcaggg

SEQ ID NO: 77451 - RNA, 22 nt, Homo sapiens
ggaagguaauuggcuaaugaga

SEQ ID NO: 77452 - RNA, 22 nt, Homo sapiens
ggaauauaaaaagccccagaau

SEQ ID NO: 77453 - RNA, 23 nt, Homo sapiens
ggaaugaaaccugguuaugauau

SEQ ID NO: 77454 - RNA, 17 nt, Homo sapiens
ggaaugaauuccagccc

SEQ ID NO: 77455 - RNA, 22 nt, Homo sapiens
ggaaugagaaauauuacacaau

SEQ ID NO: 77456 - RNA, 19 nt, Homo sapiens
ggaaugcaccaguccuugc

SEQ ID NO: 77457 - RNA, 19 nt, Homo sapiens
ggaaugcuauucaaccuuu

SEQ ID NO: 77458 - RNA, 22 nt, Homo sapiens
ggaauggaacaaagucuugaaa

SEQ ID NO: 77459 - RNA, 21 nt, Homo sapiens
ggaauuuagggaaugauuuag

SEQ ID NO: 77460 - RNA, 22 nt, Homo sapiens
ggacaguagugcuuucuaucau

SEQ ID NO: 77461 - RNA, 22 nt, Homo sapiens
ggacauguauauauaugugugu

SEQ ID NO: 77462 - RNA, 22 nt, Homo sapiens
ggacuagagaugagauuuuuca

SEQ ID NO: 77463 - RNA, 22 nt, Homo sapiens
ggacuagggacauggggagcug

SEQ ID NO: 77464 - RNA, 22 nt, Homo sapiens
ggacugucagggcuauuaguca

SEQ ID NO: 77465 - RNA, 22 nt, Homo sapiens
ggagaauugcuuggacccggga

SEQ ID NO: 77466 - RNA, 22 nt, Homo sapiens
ggagagugacauauuucuaggc

SEQ ID NO: 77467 - RNA, 22 nt, Homo sapiens
ggagaucuuguuaaaguacaga

SEQ ID NO: 77468 - RNA, 22 nt, Homo sapiens
ggagaucuuuaggaguuggacu

SEQ ID NO: 77469 - RNA, 22 nt, Homo sapiens
ggagaucuuuguuaucuuuuga

SEQ ID NO: 77470 - RNA, 22 nt, Homo sapiens
ggagcuuugaaaguuuccgguu

SEQ ID NO: 77471 - RNA, 22 nt, Homo sapiens
ggagguaauaaguuccagugua

SEQ ID NO: 77472 - RNA, 22 nt, Homo sapiens
ggaguaggaaggaaauguuaaa

SEQ ID NO: 77473 - RNA, 22 nt, Homo sapiens
ggaguaggcuguccggcaccca

SEQ ID NO: 77474 - RNA, 22 nt, Homo sapiens
ggagugucccaaucucagcuca

SEQ ID NO: 77475 - RNA, 22 nt, Homo sapiens
ggagugugauuguucucuguua

SEQ ID NO: 77476 - RNA, 22 nt, Homo sapiens
ggaguguguuuuccaacuuggu

SEQ ID NO: 77477 - RNA, 22 nt, Homo sapiens
ggaguucaucaggugaggggua

SEQ ID NO: 77478 - RNA, 22 nt, Homo sapiens
ggauaacagccaggucaaacaa

SEQ ID NO: 77479 - RNA, 21 nt, Homo sapiens
ggauagaaaacuuggcuguau

SEQ ID NO: 77480 - RNA, 22 nt, Homo sapiens
ggaucauaugauagcucaauuu

SEQ ID NO: 77481 - RNA, 22 nt, Homo sapiens
ggaugcauucaacuuccaguuc

SEQ ID NO: 77482 - RNA, 22 nt, Homo sapiens
ggauugugauaauuguugcaaa

SEQ ID NO: 77483 - RNA, 22 nt, Homo sapiens
ggcaaagagacaugcaucgggg

SEQ ID NO: 77484 - RNA, 22 nt, Homo sapiens
ggcaaagaugaccauuacuuuu

SEQ ID NO: 77485 - RNA, 22 nt, Homo sapiens
ggcaaauucuuguaugccuacu

SEQ ID NO: 77486 - RNA, 22 nt, Homo sapiens
gugguuuucaacuccaccugca

SEQ ID NO: 77487 - RNA, 22 nt, Homo sapiens
gugguuuuuaaaguaccugugg

SEQ ID NO: 77488 - RNA, 22 nt, Homo sapiens
guguaauaaucguggacuaugu

SEQ ID NO: 77489 - RNA, 22 nt, Homo sapiens
guguagagaaauagccugaagg

SEQ ID NO: 77490 - RNA, 22 nt, Homo sapiens
guguauauccuauuaguucugu

SEQ ID NO: 77491 - RNA, 22 nt, Homo sapiens
guguauguuucucccugucccu

SEQ ID NO: 77492 - RNA, 22 nt, Homo sapiens
gugucaguggggagugaucuuc

SEQ ID NO: 77493 - RNA, 22 nt, Homo sapiens
guguccuaugaaacaggaucca

SEQ ID NO: 77494 - RNA, 22 nt, Homo sapiens
gugugaacaucauagaguguau

SEQ ID NO: 77495 - RNA, 22 nt, Homo sapiens
gugugauguaaagaacugggga

SEQ ID NO: 77496 - RNA, 22 nt, Homo sapiens
gugugcauggagggggcaguga

SEQ ID NO: 77497 - RNA, 22 nt, Homo sapiens
guguggcaggugggggcucaga

SEQ ID NO: 77498 - RNA, 22 nt, Homo sapiens
guguuaaucucaaguacucuca

SEQ ID NO: 77499 - RNA, 22 nt, Homo sapiens
guguuauuuugcugggaaugau

SEQ ID NO: 77500 - RNA, 22 nt, Homo sapiens
guguucaaagcugauugagauu

SEQ ID NO: 77501 - RNA, 22 nt, Homo sapiens
guguucauggaauuugcaauug

SEQ ID NO: 77502 - RNA, 22 nt, Homo sapiens
guguuugguugauagagccacu

SEQ ID NO: 77503 - RNA, 22 nt, Homo sapiens
guuaaagacauccacauaggag

SEQ ID NO: 77504 - RNA, 22 nt, Homo sapiens
guuaugcagcuuagaaaaugaa

SEQ ID NO: 77505 - RNA, 22 nt, Homo sapiens
guuauggaguauaugugaacug

SEQ ID NO: 77506 - RNA, 22 nt, Homo sapiens
guuauguuauguuauguuaugu

SEQ ID NO: 77507 - RNA, 22 nt, Homo sapiens
guucacaguuaggacaacugcu

SEQ ID NO: 77508 - RNA, 22 nt, Homo sapiens
guucacaguuucuaaucccagc

SEQ ID NO: 77509 - RNA, 22 nt, Homo sapiens
guucaguaguucauucauuuau

SEQ ID NO: 77510 - RNA, 22 nt, Homo sapiens
guucaucaggaauauuggccua

SEQ ID NO: 77511 - RNA, 22 nt, Homo sapiens
guucaucaggcuuucucuagag

SEQ ID NO: 77512 - RNA, 22 nt, Homo sapiens
guucaucagggauacuggcuua

SEQ ID NO: 77513 - RNA, 23 nt, Homo sapiens
guucaucagggauauuggccuga

SEQ ID NO: 77514 - RNA, 20 nt, Homo sapiens
guucuugcucguguaucuuc

SEQ ID NO: 77515 - RNA, 22 nt, Homo sapiens
guugcagaguucuuccuccuga

SEQ ID NO: 77516 - RNA, 22 nt, Homo sapiens
guuggcaagaggugcuguacac

SEQ ID NO: 77517 - RNA, 22 nt, Homo sapiens
guuggugaccugaagagaguaa

SEQ ID NO: 77518 - RNA, 22 nt, Homo sapiens
guuguacuaccucucguauuag

SEQ ID NO: 77519 - RNA, 22 nt, Homo sapiens
guuguauaggcauggggagaau

SEQ ID NO: 77520 - RNA, 22 nt, Homo sapiens
guugugcuuaagccuauugauu

SEQ ID NO: 77521 - RNA, 22 nt, Homo sapiens
guuuaacugguacuucaagucu

SEQ ID NO: 77522 - RNA, 22 nt, Homo sapiens
guuuacagucgacuugggaaua

SEQ ID NO: 77523 - RNA, 22 nt, Homo sapiens
guuuaggaaugagaauauuuag

SEQ ID NO: 77524 - RNA, 22 nt, Homo sapiens
guuuggcuuucucucuauccug

SEQ ID NO: 77525 - RNA, 22 nt, Homo sapiens
guuuguaacucuagugacuaga

SEQ ID NO: 77526 - RNA, 22 nt, Homo sapiens
guuugugcuccuaugagaaccu

SEQ ID NO: 77527 - RNA, 22 nt, Homo sapiens
guuugugguuaaagccuuucau

SEQ ID NO: 77528 - RNA, 22 nt, Homo sapiens
uaaacugcuugaaaugguguca

SEQ ID NO: 77529 - RNA, 22 nt, Homo sapiens
uaaacugcuugaggguaaguac

SEQ ID NO: 77530 - RNA, 22 nt, Homo sapiens
uaaagccauugucaaguuugua

SEQ ID NO: 77531 - RNA, 22 nt, Homo sapiens
uaaagcuagagcuggaguggca

SEQ ID NO: 77532 - RNA, 22 nt, Homo sapiens
uaaagcuaucacauuggugauu

SEQ ID NO: 77533 - RNA, 22 nt, Homo sapiens
uaaagcuauuauaguuauguuu

SEQ ID NO: 77534 - RNA, 20 nt, Homo sapiens
uaaagcugcucagggggcuc

SEQ ID NO: 77535 - RNA, 20 nt, Homo sapiens
uaaaugccucaugcuuuauu

SEQ ID NO: 77536 - RNA, 22 nt, Homo sapiens
gguaaacauacugcugucuucu

SEQ ID NO: 77537 - RNA, 22 nt, Homo sapiens
gguacagcuaguuaaacauuug

SEQ ID NO: 77538 - RNA, 22 nt, Homo sapiens
gguauguagcaaaagaggugcu

SEQ ID NO: 77539 - RNA, 22 nt, Homo sapiens
gguauuuaaaguaccugucugc

SEQ ID NO: 77540 - RNA, 22 nt, Homo sapiens
ggucaacaucaucaugguaagu

SEQ ID NO: 77541 - RNA, 22 nt, Homo sapiens
ggucaguguuaucaccgaagga

SEQ ID NO: 77542 - RNA, 22 nt, Homo sapiens
ggucauagagaauucaccagga

SEQ ID NO: 77543 - RNA, 22 nt, Homo sapiens
ggucauagagcaagcaaacagc

SEQ ID NO: 77544 - RNA, 19 nt, Homo sapiens
ggucauggagguuguguga

SEQ ID NO: 77545 - RNA, 22 nt, Homo sapiens
ggucauggauaagauccagaag

SEQ ID NO: 77546 - RNA, 22 nt, Homo sapiens
ggucauggauguuuauaguaca

SEQ ID NO: 77547 - RNA, 22 nt, Homo sapiens
ggucauggauugucuuuucuug

SEQ ID NO: 77548 - RNA, 22 nt, Homo sapiens
ggucccccuccacucucgcaaa

SEQ ID NO: 77549 - RNA, 22 nt, Homo sapiens
gguccgccugccuuggccuccc

SEQ ID NO: 77550 - RNA, 22 nt, Homo sapiens
ggugaauuguaccccauaggau

SEQ ID NO: 77551 - RNA, 22 nt, Homo sapiens
ggugagaaaaacauagucucag

SEQ ID NO: 77552 - RNA, 22 nt, Homo sapiens
ggugagaaagggauuccuguuc

SEQ ID NO: 77553 - RNA, 22 nt, Homo sapiens
ggugagauguucagacgaacug

SEQ ID NO: 77554 - RNA, 22 nt, Homo sapiens
ggugaggaaaguugaguuucua

SEQ ID NO: 77555 - RNA, 23 nt, Homo sapiens
ggugaggaguacagagucuucau

SEQ ID NO: 77556 - RNA, 19 nt, Homo sapiens
ggugcuugaauauuccucc

SEQ ID NO: 77557 - RNA, 22 nt, Homo sapiens
gguggugguauuucagaaaaug

SEQ ID NO: 77558 - RNA, 22 nt, Homo sapiens
gguguuccccuuaccucuuggc

SEQ ID NO: 77559 - RNA, 22 nt, Homo sapiens
guaaacuuccccucaugaauga

SEQ ID NO: 77560 - RNA, 22 nt, Homo sapiens
guaacacucuaaagggaugcac

SEQ ID NO: 77561 - RNA, 22 nt, Homo sapiens
guaacuggccuucaauuucuuc

SEQ ID NO: 77562 - RNA, 22 nt, Homo sapiens
guaagagaauggguuacuuucc

SEQ ID NO: 77563 - RNA, 22 nt, Homo sapiens
guaagagcauguaguggcucua

SEQ ID NO: 77564 - RNA, 22 nt, Homo sapiens
guaagugguagagcugggcuau

SEQ ID NO: 77565 - RNA, 22 nt, Homo sapiens
guaauaccuuccccugcuggag

SEQ ID NO: 77566 - RNA, 22 nt, Homo sapiens
guaauacuuuugggauauuaga

SEQ ID NO: 77567 - RNA, 22 nt, Homo sapiens
guaaucucagcuacuugggagg

SEQ ID NO: 77568 - RNA, 22 nt, Homo sapiens
guaaucucagcuacuugggagu

SEQ ID NO: 77569 - RNA, 22 nt, Homo sapiens
guaaucucagcuucuugggagg

SEQ ID NO: 77570 - RNA, 22 nt, Homo sapiens
guaaucuguaguaaagcaccau

SEQ ID NO: 77571 - RNA, 22 nt, Homo sapiens
guacaguacugaaugaauguau

SEQ ID NO: 77572 - RNA, 22 nt, Homo sapiens
guacaguuuucaguguucacug

SEQ ID NO: 77573 - RNA, 22 nt, Homo sapiens
guacccuauggauauagaugaa

SEQ ID NO: 77574 - RNA, 22 nt, Homo sapiens
guaccugggugacaggauuauu

SEQ ID NO: 77575 - RNA, 22 nt, Homo sapiens
guacucuggaguaggccuaauu

SEQ ID NO: 77576 - RNA, 22 nt, Homo sapiens
guacuguuucauuggagauuaa

SEQ ID NO: 77577 - RNA, 22 nt, Homo sapiens
guacuuagagauagggucuuua

SEQ ID NO: 77578 - RNA, 22 nt, Homo sapiens
guagaagcacaggugaguuggu

SEQ ID NO: 77579 - RNA, 22 nt, Homo sapiens
guagaauguauacaguauacag

SEQ ID NO: 77580 - RNA, 22 nt, Homo sapiens
guagagagaaauacaaagcugu

SEQ ID NO: 77581 - RNA, 22 nt, Homo sapiens
guagaucucaacacuggaagua

SEQ ID NO: 77582 - RNA, 22 nt, Homo sapiens
ucaccuguagcuaagaccuaau

SEQ ID NO: 77583 - RNA, 22 nt, Homo sapiens
ucaccuuacuugcuucugaacu

SEQ ID NO: 77584 - RNA, 22 nt, Homo sapiens
ucacuauugacaacagugugga

SEQ ID NO: 77585 - RNA, 21 nt, Homo sapiens
ucacugagguuaaauaggguu

SEQ ID NO: 77586 - RNA, 22 nt, Homo sapiens
ucacugcgaccucugccucccg

SEQ ID NO: 77587 - RNA, 22 nt, Homo sapiens
ucacugcgcuucagccugggug

SEQ ID NO: 77588 - RNA, 22 nt, Homo sapiens
ucacuggagguuccugaaguuc
